United States Patent 7,250,289 (METHODS OF GENETIC ANALYSIS OF MOUSE) - sequence listing, part 22

SEQ ID NO: 843844 - DNA, 25 bp, Mus musculus
tgaagaagctctgactcttgtctct

SEQ ID NO: 843845 - DNA, 25 bp, Mus musculus
tgaagaagggccagtcagcctttgg

SEQ ID NO: 843846 - DNA, 25 bp, Mus musculus
tgaagaagggcctgtcagcctttgg

SEQ ID NO: 843847 - DNA, 25 bp, Mus musculus
tgaagaaggtgaccctagacccttt

SEQ ID NO: 843848 - DNA, 25 bp, Mus musculus
tgaagaaggtgagcctagacccttt

SEQ ID NO: 843849 - DNA, 25 bp, Mus musculus
tgaagaagtctaaccacaacctggg

SEQ ID NO: 843850 - DNA, 25 bp, Mus musculus
tgaagaagtctatccacaacctggg

SEQ ID NO: 843851 - DNA, 25 bp, Mus musculus
tgaagaagttaccacccaccaggcc

SEQ ID NO: 843852 - DNA, 25 bp, Mus musculus
tgaagaagttacgacccaccaggcc

SEQ ID NO: 843853 - DNA, 25 bp, Mus musculus
tgaagaatatccaaccacacctagc

SEQ ID NO: 843854 - DNA, 25 bp, Mus musculus
tgaagaatatcctaccacacctagc

SEQ ID NO: 843855 - DNA, 25 bp, Mus musculus
tgaagaatcatgacctcatgcccca

SEQ ID NO: 843856 - DNA, 25 bp, Mus musculus
tgaagaatcatgtcctcatgcccca

SEQ ID NO: 843857 - DNA, 25 bp, Mus musculus
tgaagaatccaaagccccagtgtac

SEQ ID NO: 843858 - DNA, 25 bp, Mus musculus
tgaagaatccaatgccccagtgtac

SEQ ID NO: 843859 - DNA, 25 bp, Mus musculus
tgaagaatcccgaaccccgcctagg

SEQ ID NO: 843860 - DNA, 25 bp, Mus musculus
tgaagaatcccgatcacacagggtg

SEQ ID NO: 843861 - DNA, 25 bp, Mus musculus
tgaagaatcccgtaccccgcctagg

SEQ ID NO: 843862 - DNA, 25 bp, Mus musculus
tgaagaatcccgttcacacagggtg

SEQ ID NO: 843863 - DNA, 25 bp, Mus musculus
tgaagaatccttcttactgtgctag

SEQ ID NO: 843864 - DNA, 25 bp, Mus musculus
tgaagaatccttgttactgtgctag

SEQ ID NO: 843865 - DNA, 25 bp, Mus musculus
tgaagaatctctatcccacatgcag

SEQ ID NO: 843866 - DNA, 25 bp, Mus musculus
tgaagaatctctttcccacatgcag

SEQ ID NO: 843867 - DNA, 25 bp, Mus musculus
tgaagaatgatgcagcccagtctac

SEQ ID NO: 843868 - DNA, 25 bp, Mus musculus
tgaagaatgatggagcccagtctac

SEQ ID NO: 843869 - DNA, 25 bp, Mus musculus
tgaagaatgcctacgggcgcattat

SEQ ID NO: 843870 - DNA, 25 bp, Mus musculus
tgaagaatgccttcgggcgcattat

SEQ ID NO: 843871 - DNA, 25 bp, Mus musculus
tgaagaatgctacctgtcttccctc

SEQ ID NO: 843872 - DNA, 25 bp, Mus musculus
tgaagaatgctagctgtcttccctc

SEQ ID NO: 843873 - DNA, 25 bp, Mus musculus
tgaagaatgtgcacccagatgcagg

SEQ ID NO: 843874 - DNA, 25 bp, Mus musculus
tgaagaatgtgctcccagatgcagg

SEQ ID NO: 843875 - DNA, 25 bp, Mus musculus
tgaagaatgttcacccatttgtggt

SEQ ID NO: 843876 - DNA, 25 bp, Mus musculus
tgaagaatgttctcccatttgtggt

SEQ ID NO: 843877 - DNA, 25 bp, Mus musculus
tgaagaattagaccccatggacccc

SEQ ID NO: 843878 - DNA, 25 bp, Mus musculus
tgaagaattagagcccatggacccc

SEQ ID NO: 843879 - DNA, 25 bp, Mus musculus
tgaagaattctcactcagtggcacc

SEQ ID NO: 843880 - DNA, 25 bp, Mus musculus
tgaagaattctctctcagtggcacc

SEQ ID NO: 843881 - DNA, 25 bp, Mus musculus
tgaagaattcttcgactgtcacaca

SEQ ID NO: 843882 - DNA, 25 bp, Mus musculus
tgaagaattcttggactgtcacaca

SEQ ID NO: 843883 - DNA, 25 bp, Mus musculus
tgaagaatttccacagttccccaat

SEQ ID NO: 843884 - DNA, 25 bp, Mus musculus
tgaagaatttccatccaccagtcag

SEQ ID NO: 843885 - DNA, 25 bp, Mus musculus
tgaagaatttccctgcacacgtgta

SEQ ID NO: 843886 - DNA, 25 bp, Mus musculus
tgaagaatttccgtgcacacgtgta

SEQ ID NO: 843887 - DNA, 25 bp, Mus musculus
tgaagaatttcctcagttccccaat

SEQ ID NO: 843888 - DNA, 25 bp, Mus musculus
tgaagaatttccttccaccagtcag

SEQ ID NO: 843889 - DNA, 25 bp, Mus musculus
tgaagacaaaaaccgtgttccctat

SEQ ID NO: 843890 - DNA, 25 bp, Mus musculus
tgaagacaaaaagcgtgttccctat

SEQ ID NO: 843891 - DNA, 25 bp, Mus musculus
tgaagacaacaaagagggcttgaat

SEQ ID NO: 843892 - DNA, 25 bp, Mus musculus
tgaagacaacaatgagggcttgaat

SEQ ID NO: 843893 - DNA, 25 bp, Mus musculus
tgaagacaacttccttgtgcccata

SEQ ID NO: 843894 - DNA, 25 bp, Mus musculus
tgaagacaacttgcttgtgcccata

SEQ ID NO: 843895 - DNA, 25 bp, Mus musculus
tgaagacaaggtcagccatgtgagc

SEQ ID NO: 843896 - DNA, 25 bp, Mus musculus
tgaagacaaggtgagccatgtgagc

SEQ ID NO: 843897 - DNA, 25 bp, Mus musculus
tgaagacaccgtaccacacagagga

SEQ ID NO: 843898 - DNA, 25 bp, Mus musculus
tgaagacaccgtatccttggagttc

SEQ ID NO: 843899 - DNA, 25 bp, Mus musculus
tgaagacaccgttccacacagagga

SEQ ID NO: 843900 - DNA, 25 bp, Mus musculus
tgaagacaccgtttccttggagttc

SEQ ID NO: 843901 - DNA, 25 bp, Mus musculus
tgaagacaccttacagtgcctctaa

SEQ ID NO: 843902 - DNA, 25 bp, Mus musculus
tgaagacacctttcagtgcctctaa

SEQ ID NO: 843903 - DNA, 25 bp, Mus musculus
tgaagacactacagaccctggacag

SEQ ID NO: 843904 - DNA, 25 bp, Mus musculus
tgaagacactactgaccctggacag

SEQ ID NO: 843905 - DNA, 25 bp, Mus musculus
tgaagacactgacaccaagcctggc

SEQ ID NO: 843906 - DNA, 25 bp, Mus musculus
tgaagacactgagaccaagcctggc

SEQ ID NO: 843907 - DNA, 25 bp, Mus musculus
tgaagacagaccaggtgggcagaca

SEQ ID NO: 843908 - DNA, 25 bp, Mus musculus
tgaagacagacctggtgggcagaca

SEQ ID NO: 843909 - DNA, 25 bp, Mus musculus
tgaagacagacgacccaagcactgc

SEQ ID NO: 843910 - DNA, 25 bp, Mus musculus
tgaagacagacgcactgctgtgaca

SEQ ID NO: 843911 - DNA, 25 bp, Mus musculus
tgaagacagacggactgctgtgaca

SEQ ID NO: 843912 - DNA, 25 bp, Mus musculus
tgaagacagacgtcccaagcactgc

SEQ ID NO: 843913 - DNA, 25 bp, Mus musculus
tgaagacagatgcacccctttgctt

SEQ ID NO: 843914 - DNA, 25 bp, Mus musculus
tgaagacagatggacccctttgctt

SEQ ID NO: 843915 - DNA, 25 bp, Mus musculus
tgaagacagccaactgagacctgtg

SEQ ID NO: 843916 - DNA, 25 bp, Mus musculus
tgaagacagccatctgagacctgtg

SEQ ID NO: 843917 - DNA, 25 bp, Mus musculus
tgaagacagctccaacacgtttaca

SEQ ID NO: 843918 - DNA, 25 bp, Mus musculus
tgaagacagctcgaacacgtttaca

SEQ ID NO: 843919 - DNA, 25 bp, Mus musculus
tgaagacaggcacatccccagagct

SEQ ID NO: 843920 - DNA, 25 bp, Mus musculus
tgaagacaggcagatccccagagct

SEQ ID NO: 843921 - DNA, 25 bp, Mus musculus
tgaagacagtctacgatcctgtccc

SEQ ID NO: 843922 - DNA, 25 bp, Mus musculus
tgaagacagtcttcgatcctgtccc

SEQ ID NO: 843923 - DNA, 25 bp, Mus musculus
tgaagacagtggatacatcacaggg

SEQ ID NO: 843924 - DNA, 25 bp, Mus musculus
tgaagacagtggttacatcacaggg

SEQ ID NO: 843925 - DNA, 25 bp, Mus musculus
tgaagacataggcaatctgtccttg

SEQ ID NO: 843926 - DNA, 25 bp, Mus musculus
tgaagacatagggaatctgtccttg

SEQ ID NO: 843927 - DNA, 25 bp, Mus musculus
tgaagacatcacacgggaccaaacc

SEQ ID NO: 843928 - DNA, 25 bp, Mus musculus
tgaagacatcactcgggaccaaacc

SEQ ID NO: 843929 - DNA, 25 bp, Mus musculus
tgaagacatccaatggaccccacaa

SEQ ID NO: 843930 - DNA, 25 bp, Mus musculus
tgaagacatccattggaccccacaa

SEQ ID NO: 843931 - DNA, 25 bp, Mus musculus
tgaagacatcccctagtcctgctga

SEQ ID NO: 843932 - DNA, 25 bp, Mus musculus
tgaagacatcccgtagtcctgctga

SEQ ID NO: 843933 - DNA, 25 bp, Mus musculus
tgaagacatgaaaatccctgtggta

SEQ ID NO: 843934 - DNA, 25 bp, Mus musculus
tgaagacatgaatatccctgtggta

SEQ ID NO: 843935 - DNA, 25 bp, Mus musculus
tgaagacatggtaagttctcaaatt

SEQ ID NO: 843936 - DNA, 25 bp, Mus musculus
tgaagacatggttagttctcaaatt

SEQ ID NO: 843937 - DNA, 25 bp, Mus musculus
tgaagacatgttatcccaaggttga

SEQ ID NO: 843938 - DNA, 25 bp, Mus musculus
tgaagacatgttttcccaaggttga

SEQ ID NO: 843939 - DNA, 25 bp, Mus musculus
tgaagacatttcctgttgggctctt

SEQ ID NO: 843940 - DNA, 25 bp, Mus musculus
tgaagacatttcgtgttgggctctt

SEQ ID NO: 843941 - DNA, 25 bp, Mus musculus
tgaagaccaaaaacccactgggaac

SEQ ID NO: 843942 - DNA, 25 bp, Mus musculus
tgaagaccaaaatcccactgggaac

SEQ ID NO: 843943 - DNA, 25 bp, Mus musculus
tgaagaccaagaagcagcagcggaa

SEQ ID NO: 843944 - DNA, 25 bp, Mus musculus
tgaagaccaagacagccccctctgg

SEQ ID NO: 843945 - DNA, 25 bp, Mus musculus
tgaagaccaagacggtgccacagcc

SEQ ID NO: 843946 - DNA, 25 bp, Mus musculus
tgaagaccaagagagccccctctgg

SEQ ID NO: 843947 - DNA, 25 bp, Mus musculus
tgaagaccaagagggtgccacagcc

SEQ ID NO: 843948 - DNA, 25 bp, Mus musculus
tgaagaccaagatgcagcagcggaa

SEQ ID NO: 843949 - DNA, 25 bp, Mus musculus
tgaagaccacacaatgctccatcaa

SEQ ID NO: 843950 - DNA, 25 bp, Mus musculus
tgaagaccacactatgctccatcaa

SEQ ID NO: 843951 - DNA, 25 bp, Mus musculus
tgaagaccaccacaggcacagggac

SEQ ID NO: 843952 - DNA, 25 bp, Mus musculus
tgaagaccaccagaggcacagggac

SEQ ID NO: 843953 - DNA, 25 bp, Mus musculus
tgaagaccagtgagccagagctccg

SEQ ID NO: 843954 - DNA, 25 bp, Mus musculus
tgaagaccagtgcttgcttgctctc

SEQ ID NO: 843955 - DNA, 25 bp, Mus musculus
tgaagaccagtggttgcttgctctc

SEQ ID NO: 843956 - DNA, 25 bp, Mus musculus
tgaagaccagtgtgccagagctccg

SEQ ID NO: 843957 - DNA, 25 bp, Mus musculus
tgaagaccatgtcgccacacacgga

SEQ ID NO: 843958 - DNA, 25 bp, Mus musculus
tgaagaccatgtggccacacacgga

SEQ ID NO: 843959 - DNA, 25 bp, Mus musculus
tgaagacccaacaagagccagcaac

SEQ ID NO: 843960 - DNA, 25 bp, Mus musculus
tgaagacccaactagagccagcaac

SEQ ID NO: 843961 - DNA, 25 bp, Mus musculus
tgaagacccagtctgtctctctgac

SEQ ID NO: 843962 - DNA, 25 bp, Mus musculus
tgaagacccagtgtgtctctctgac

SEQ ID NO: 843963 - DNA, 25 bp, Mus musculus
tgaagacccggacatgcctcaacct

SEQ ID NO: 843964 - DNA, 25 bp, Mus musculus
tgaagacccggagatgcctcaacct

SEQ ID NO: 843965 - DNA, 25 bp, Mus musculus
tgaagaccctacaagcccaatctat

SEQ ID NO: 843966 - DNA, 25 bp, Mus musculus
tgaagaccctactagcccaatctat

SEQ ID NO: 843967 - DNA, 25 bp, Mus musculus
tgaagaccctgcatcttgagatttt

SEQ ID NO: 843968 - DNA, 25 bp, Mus musculus
tgaagaccctgcttcttgagatttt

SEQ ID NO: 843969 - DNA, 25 bp, Mus musculus
tgaagacccttgaactctctggtgt

SEQ ID NO: 843970 - DNA, 25 bp, Mus musculus
tgaagacccttgtactctctggtgt

SEQ ID NO: 843971 - DNA, 25 bp, Mus musculus
tgaagacctcttccgagaatggctg

SEQ ID NO: 843972 - DNA, 25 bp, Mus musculus
tgaagacctcttgcgagaatggctg

SEQ ID NO: 843973 - DNA, 25 bp, Mus musculus
tgaagacctggacagtagcagccag

SEQ ID NO: 843974 - DNA, 25 bp, Mus musculus
tgaagacctggagagtagcagccag

SEQ ID NO: 843975 - DNA, 25 bp, Mus musculus
tgaagacctggcagattaaactaga

SEQ ID NO: 843976 - DNA, 25 bp, Mus musculus
tgaagacctggctgattaaactaga

SEQ ID NO: 843977 - DNA, 25 bp, Mus musculus
tgaagacctgtccggactccgcgcg

SEQ ID NO: 843978 - DNA, 25 bp, Mus musculus
tgaagacctgtcgggactccgcgcg

SEQ ID NO: 843979 - DNA, 25 bp, Mus musculus
tgaagaccttaaaacccacatggtt

SEQ ID NO: 843980 - DNA, 25 bp, Mus musculus
tgaagaccttaatacccacatggtt

SEQ ID NO: 843981 - DNA, 25 bp, Mus musculus
tgaagacctttcacagactgttgct

SEQ ID NO: 843982 - DNA, 25 bp, Mus musculus
tgaagacctttctcagactgttgct

SEQ ID NO: 843983 - DNA, 25 bp, Mus musculus
tgaagacgacttaccctgtggaatt

SEQ ID NO: 843984 - DNA, 25 bp, Mus musculus
tgaagacgactttccctgtggaatt

SEQ ID NO: 843985 - DNA, 25 bp, Mus musculus
tgaagacgcctcattcgtgtctgat

SEQ ID NO: 843986 - DNA, 25 bp, Mus musculus
tgaagacgcctctttcgtgtctgat

SEQ ID NO: 843987 - DNA, 25 bp, Mus musculus
tgaagacgtcgcatctgcaacacag

SEQ ID NO: 843988 - DNA, 25 bp, Mus musculus
tgaagacgtcgcttctgcaacacag

SEQ ID NO: 843989 - DNA, 25 bp, Mus musculus
tgaagactaattccagccatggaat

SEQ ID NO: 843990 - DNA, 25 bp, Mus musculus
tgaagactaattgcagccatggaat

SEQ ID NO: 843991 - DNA, 25 bp, Mus musculus
tgaagactacaaaggacgaccaatc

SEQ ID NO: 843992 - DNA, 25 bp, Mus musculus
tgaagactacaatggacgaccaatc

SEQ ID NO: 843993 - DNA, 25 bp, Mus musculus
tgaagactaccaacacacctgaagg

SEQ ID NO: 843994 - DNA, 25 bp, Mus musculus
tgaagactaccatcacacctgaagg

SEQ ID NO: 843995 - DNA, 25 bp, Mus musculus
tgaagactactgctgcaccaaatcc

SEQ ID NO: 843996 - DNA, 25 bp, Mus musculus
tgaagactactggtgcaccaaatcc

SEQ ID NO: 843997 - DNA, 25 bp, Mus musculus
tgaagactatccaagctgtgctgac

SEQ ID NO: 843998 - DNA, 25 bp, Mus musculus
tgaagactatcctagctgtgctgac

SEQ ID NO: 843999 - DNA, 25 bp, Mus musculus
tgaagactcactccaggatcctgga

SEQ ID NO: 844000 - DNA, 25 bp, Mus musculus
tgaagactcactgcaggatcctgga

SEQ ID NO: 844001 - DNA, 25 bp, Mus musculus
tgaagactcagacacatctcaccat

SEQ ID NO: 844002 - DNA, 25 bp, Mus musculus
tgaagactcagagacatctcaccat

SEQ ID NO: 844003 - DNA, 25 bp, Mus musculus
tgaagactcattctgtgccatctac

SEQ ID NO: 844004 - DNA, 25 bp, Mus musculus
tgaagactcattgtgtgccatctac

SEQ ID NO: 844005 - DNA, 25 bp, Mus musculus
tgaagactccttatctttaaagaca

SEQ ID NO: 844006 - DNA, 25 bp, Mus musculus
tgaagactccttcagcagtcaaact

SEQ ID NO: 844007 - DNA, 25 bp, Mus musculus
tgaagactccttgagcagtcaaact

SEQ ID NO: 844008 - DNA, 25 bp, Mus musculus
tgaagactccttttctttaaagaca

SEQ ID NO: 844009 - DNA, 25 bp, Mus musculus
tgaagactctcaaacttaaaggaaa

SEQ ID NO: 844010 - DNA, 25 bp, Mus musculus
tgaagactctcatacttaaaggaaa

SEQ ID NO: 844011 - DNA, 25 bp, Mus musculus
tgaagactctcccatcacaatgact

SEQ ID NO: 844012 - DNA, 25 bp, Mus musculus
tgaagactctccgatcacaatgact

SEQ ID NO: 844013 - DNA, 25 bp, Mus musculus
tgaagactctgcactacacatcatg

SEQ ID NO: 844014 - DNA, 25 bp, Mus musculus
tgaagactctgccaaccacgaggat

SEQ ID NO: 844015 - DNA, 25 bp, Mus musculus
tgaagactctgcgaaccacgaggat

SEQ ID NO: 844016 - DNA, 25 bp, Mus musculus
tgaagactctgctctacacatcatg

SEQ ID NO: 844017 - DNA, 25 bp, Mus musculus
tgaagactctgtcccgaagtttggt

SEQ ID NO: 844018 - DNA, 25 bp, Mus musculus
tgaagactctgtgccgaagtttggt

SEQ ID NO: 844019 - DNA, 25 bp, Mus musculus
tgaagactgactccagcgttgggcc

SEQ ID NO: 844020 - DNA, 25 bp, Mus musculus
tgaagactgactgcagcgttgggcc

SEQ ID NO: 844021 - DNA, 25 bp, Mus musculus
tgaagactgaggctatcctgcctgt

SEQ ID NO: 844022 - DNA, 25 bp, Mus musculus
tgaagactgagggtatcctgcctgt

SEQ ID NO: 844023 - DNA, 25 bp, Mus musculus
tgaagactgccgacatgcactcatg

SEQ ID NO: 844024 - DNA, 25 bp, Mus musculus
tgaagactgccgtcatgcactcatg

SEQ ID NO: 844025 - DNA, 25 bp, Mus musculus
tgaagactgttgattccaacaggaa

SEQ ID NO: 844026 - DNA, 25 bp, Mus musculus
tgaagactgttgtttccaacaggaa

SEQ ID NO: 844027 - DNA, 25 bp, Mus musculus
tgaagactgtttccctttgctgcat

SEQ ID NO: 844028 - DNA, 25 bp, Mus musculus
tgaagactgtttgcctttgctgcat

SEQ ID NO: 844029 - DNA, 25 bp, Mus musculus
tgaagacttagcctagatgcctaga

SEQ ID NO: 844030 - DNA, 25 bp, Mus musculus
tgaagacttagcgtagatgcctaga

SEQ ID NO: 844031 - DNA, 25 bp, Mus musculus
tgaagacttcaacctggcctccgtg

SEQ ID NO: 844032 - DNA, 25 bp, Mus musculus
tgaagacttcaagctggcctccgtg

SEQ ID NO: 844033 - DNA, 25 bp, Mus musculus
tgaagacttcatatgggcaccagaa

SEQ ID NO: 844034 - DNA, 25 bp, Mus musculus
tgaagacttcatttgggcaccagaa

SEQ ID NO: 844035 - DNA, 25 bp, Mus musculus
tgaagacttcgtcaaacagcgttac

SEQ ID NO: 844036 - DNA, 25 bp, Mus musculus
tgaagacttcgtgaaacagcgttac

SEQ ID NO: 844037 - DNA, 25 bp, Mus musculus
tgaagacttgaacctctccagacct

SEQ ID NO: 844038 - DNA, 25 bp, Mus musculus
tgaagacttgaagctctccagacct

SEQ ID NO: 844039 - DNA, 25 bp, Mus musculus
tgaagacttggcatcttgtttcagt

SEQ ID NO: 844040 - DNA, 25 bp, Mus musculus
tgaagacttggcttcttgtttcagt

SEQ ID NO: 844041 - DNA, 25 bp, Mus musculus
tgaagactttctacacctggcggaa

SEQ ID NO: 844042 - DNA, 25 bp, Mus musculus
tgaagactttcttcacctggcggaa

SEQ ID NO: 844043 - DNA, 25 bp, Mus musculus
tgaagagaagcgacccttcgtggag

SEQ ID NO: 844044 - DNA, 25 bp, Mus musculus
tgaagagaagcgtcccttcgtggag

SEQ ID NO: 844045 - DNA, 25 bp, Mus musculus
tgaagagaaggcacgcctggctgct

SEQ ID NO: 844046 - DNA, 25 bp, Mus musculus
tgaagagaaggctcgcctggctgct

SEQ ID NO: 844047 - DNA, 25 bp, Mus musculus
tgaagagacacgctgccggcacaca

SEQ ID NO: 844048 - DNA, 25 bp, Mus musculus
tgaagagacacggtgccggcacaca

SEQ ID NO: 844049 - DNA, 25 bp, Mus musculus
tgaagagacactaccacacctgtgc

SEQ ID NO: 844050 - DNA, 25 bp, Mus musculus
tgaagagacacttccacacctgtgc

SEQ ID NO: 844051 - DNA, 25 bp, Mus musculus
tgaagagacctgattcttctgccgc

SEQ ID NO: 844052 - DNA, 25 bp, Mus musculus
tgaagagacctgtttcttctgccgc

SEQ ID NO: 844053 - DNA, 25 bp, Mus musculus
tgaagagaccttcatatgcattttg

SEQ ID NO: 844054 - DNA, 25 bp, Mus musculus
tgaagagaccttgatatgcattttg

SEQ ID NO: 844055 - DNA, 25 bp, Mus musculus
tgaagagactctctccttcaccttg

SEQ ID NO: 844056 - DNA, 25 bp, Mus musculus
tgaagagactctgtccttcaccttg

SEQ ID NO: 844057 - DNA, 25 bp, Mus musculus
tgaagagactgcaaagactacccgt

SEQ ID NO: 844058 - DNA, 25 bp, Mus musculus
tgaagagactgctaagactacccgt

SEQ ID NO: 844059 - DNA, 25 bp, Mus musculus
tgaagagagcccaacagaaattatc

SEQ ID NO: 844060 - DNA, 25 bp, Mus musculus
tgaagagagccctacagaaattatc

SEQ ID NO: 844061 - DNA, 25 bp, Mus musculus
tgaagagagtgtccacgctgccctg

SEQ ID NO: 844062 - DNA, 25 bp, Mus musculus
tgaagagagtgtgcacgctgccctg

SEQ ID NO: 844063 - DNA, 25 bp, Mus musculus
tgaagagataccctcattgctctgt

SEQ ID NO: 844064 - DNA, 25 bp, Mus musculus
tgaagagataccgtcattgctctgt

SEQ ID NO: 844065 - DNA, 25 bp, Mus musculus
tgaagagatagtccctggagacctc

SEQ ID NO: 844066 - DNA, 25 bp, Mus musculus
tgaagagatagtgcctggagacctc

SEQ ID NO: 844067 - DNA, 25 bp, Mus musculus
tgaagagatctacgccttgtggctt

SEQ ID NO: 844068 - DNA, 25 bp, Mus musculus
tgaagagatctaggccttgtggctt

SEQ ID NO: 844069 - DNA, 25 bp, Mus musculus
tgaagagcaagcatgcgcccctgac

SEQ ID NO: 844070 - DNA, 25 bp, Mus musculus
tgaagagcaagcttgcgcccctgac

SEQ ID NO: 844071 - DNA, 25 bp, Mus musculus
tgaagagcaaggactctcccatcct

SEQ ID NO: 844072 - DNA, 25 bp, Mus musculus
tgaagagcaaggtctctcccatcct

SEQ ID NO: 844073 - DNA, 25 bp, Mus musculus
tgaagagcacatctcactcattcct

SEQ ID NO: 844074 - DNA, 25 bp, Mus musculus
tgaagagcacatgtcactcattcct

SEQ ID NO: 844075 - DNA, 25 bp, Mus musculus
tgaagagcacttaagaacacttggg

SEQ ID NO: 844076 - DNA, 25 bp, Mus musculus
tgaagagcactttagaacacttggg

SEQ ID NO: 844077 - DNA, 25 bp, Mus musculus
tgaagagccacaacacagcagtttg

SEQ ID NO: 844078 - DNA, 25 bp, Mus musculus
tgaagagccacatcacagcagtttg

SEQ ID NO: 844079 - DNA, 25 bp, Mus musculus
tgaagagccatcctatgaccccaaa

SEQ ID NO: 844080 - DNA, 25 bp, Mus musculus
tgaagagccatcgtatgaccccaaa

SEQ ID NO: 844081 - DNA, 25 bp, Mus musculus
tgaagagcccaccagttgcgtgaat

SEQ ID NO: 844082 - DNA, 25 bp, Mus musculus
tgaagagcccacgagttgcgtgaat

SEQ ID NO: 844083 - DNA, 25 bp, Mus musculus
tgaagagcccatcgtggacacttgc

SEQ ID NO: 844084 - DNA, 25 bp, Mus musculus
tgaagagcccatggtggacacttgc

SEQ ID NO: 844085 - DNA, 25 bp, Mus musculus
tgaagagccctgagagcttacaaag

SEQ ID NO: 844086 - DNA, 25 bp, Mus musculus
tgaagagccctgtgagcttacaaag

SEQ ID NO: 844087 - DNA, 25 bp, Mus musculus
tgaagagcccttacagtgttcatcc

SEQ ID NO: 844088 - DNA, 25 bp, Mus musculus
tgaagagccctttcagtgttcatcc

SEQ ID NO: 844089 - DNA, 25 bp, Mus musculus
tgaagagccgcactgctcacatgaa

SEQ ID NO: 844090 - DNA, 25 bp, Mus musculus
tgaagagccgcagtgctcacatgaa

SEQ ID NO: 844091 - DNA, 25 bp, Mus musculus
tgaagagcctatacccagctggtga

SEQ ID NO: 844092 - DNA, 25 bp, Mus musculus
tgaagagcctattcccagctggtga

SEQ ID NO: 844093 - DNA, 25 bp, Mus musculus
tgaagagcctttatggggtgccact

SEQ ID NO: 844094 - DNA, 25 bp, Mus musculus
tgaagagcctttttggggtgccact

SEQ ID NO: 844095 - DNA, 25 bp, Mus musculus
tgaagagcgcatcaggatacagaaa

SEQ ID NO: 844096 - DNA, 25 bp, Mus musculus
tgaagagcgcatgaggatacagaaa

SEQ ID NO: 844097 - DNA, 25 bp, Mus musculus
tgaagagcggtgcacctcctctgaa

SEQ ID NO: 844098 - DNA, 25 bp, Mus musculus
tgaagagcggtggacctcctctgaa

SEQ ID NO: 844099 - DNA, 25 bp, Mus musculus
tgaagagctcagagtccttccactc

SEQ ID NO: 844100 - DNA, 25 bp, Mus musculus
tgaagagctcagtgtccttccactc

SEQ ID NO: 844101 - DNA, 25 bp, Mus musculus
tgaagagctccgagttctctgcctt

SEQ ID NO: 844102 - DNA, 25 bp, Mus musculus
tgaagagctccgtgttctctgcctt

SEQ ID NO: 844103 - DNA, 25 bp, Mus musculus
tgaagagctgaacttcccagcaccc

SEQ ID NO: 844104 - DNA, 25 bp, Mus musculus
tgaagagctgaagttcccagcaccc

SEQ ID NO: 844105 - DNA, 25 bp, Mus musculus
tgaagagctgacactgtcctacctt

SEQ ID NO: 844106 - DNA, 25 bp, Mus musculus
tgaagagctgactctgtcctacctt

SEQ ID NO: 844107 - DNA, 25 bp, Mus musculus
tgaagagctgcccttctgattagga

SEQ ID NO: 844108 - DNA, 25 bp, Mus musculus
tgaagagctgcccttgtttctggtg

SEQ ID NO: 844109 - DNA, 25 bp, Mus musculus
tgaagagctgccgttctgattagga

SEQ ID NO: 844110 - DNA, 25 bp, Mus musculus
tgaagagctgccgttgtttctggtg

SEQ ID NO: 844111 - DNA, 25 bp, Mus musculus
tgaagagctgtccttttcccttgct

SEQ ID NO: 844112 - DNA, 25 bp, Mus musculus
tgaagagctgtcgttttcccttgct

SEQ ID NO: 844113 - DNA, 25 bp, Mus musculus
tgaagagctgttccccttaagtcca

SEQ ID NO: 844114 - DNA, 25 bp, Mus musculus
tgaagagctgttgcccttaagtcca

SEQ ID NO: 844115 - DNA, 25 bp, Mus musculus
tgaagagcttgccacatgaattgag

SEQ ID NO: 844116 - DNA, 25 bp, Mus musculus
tgaagagcttgcgacatgaattgag

SEQ ID NO: 844117 - DNA, 25 bp, Mus musculus
tgaagaggacacacccgtgtggtaa

SEQ ID NO: 844118 - DNA, 25 bp, Mus musculus
tgaagaggacaccaggcaatggaaa

SEQ ID NO: 844119 - DNA, 25 bp, Mus musculus
tgaagaggacacgaggcaatggaaa

SEQ ID NO: 844120 - DNA, 25 bp, Mus musculus
tgaagaggacactcccgtgtggtaa

SEQ ID NO: 844121 - DNA, 25 bp, Mus musculus
tgaagaggacgcactgtcgcagctg

SEQ ID NO: 844122 - DNA, 25 bp, Mus musculus
tgaagaggacgctctgtcgcagctg

SEQ ID NO: 844123 - DNA, 25 bp, Mus musculus
tgaagaggagaaatcgctgagacgc

SEQ ID NO: 844124 - DNA, 25 bp, Mus musculus
tgaagaggagaattcgctgagacgc

SEQ ID NO: 844125 - DNA, 25 bp, Mus musculus
tgaagaggcaccacatcacggaggc

SEQ ID NO: 844126 - DNA, 25 bp, Mus musculus
tgaagaggcacctcatcacggaggc

SEQ ID NO: 844127 - DNA, 25 bp, Mus musculus
tgaagaggccaaagttgttcccagc

SEQ ID NO: 844128 - DNA, 25 bp, Mus musculus
tgaagaggccaatgttgttcccagc

SEQ ID NO: 844129 - DNA, 25 bp, Mus musculus
tgaagaggcgagcaccatgccttgc

SEQ ID NO: 844130 - DNA, 25 bp, Mus musculus
tgaagaggcgaggaccatgccttgc

SEQ ID NO: 844131 - DNA, 25 bp, Mus musculus
tgaagaggcttcacctgctactcta

SEQ ID NO: 844132 - DNA, 25 bp, Mus musculus
tgaagaggcttctcctgctactcta

SEQ ID NO: 844133 - DNA, 25 bp, Mus musculus
tgaagaggctttcacgtagcccctc

SEQ ID NO: 844134 - DNA, 25 bp, Mus musculus
tgaagaggctttgacgtagcccctc

SEQ ID NO: 844135 - DNA, 25 bp, Mus musculus
tgaagaggtaatccccattcccgcc

SEQ ID NO: 844136 - DNA, 25 bp, Mus musculus
tgaagaggtaatgcccattcccgcc

SEQ ID NO: 844137 - DNA, 25 bp, Mus musculus
tgaagaggtacaacacccaagctac

SEQ ID NO: 844138 - DNA, 25 bp, Mus musculus
tgaagaggtacatcacccaagctac

SEQ ID NO: 844139 - DNA, 25 bp, Mus musculus
tgaagagtatgtcgcggcttcttcc

SEQ ID NO: 844140 - DNA, 25 bp, Mus musculus
tgaagagtatgtggcggcttcttcc

SEQ ID NO: 844141 - DNA, 25 bp, Mus musculus
tgaagagtcttgcttgccatttctg

SEQ ID NO: 844142 - DNA, 25 bp, Mus musculus
tgaagagtcttggttgccatttctg

SEQ ID NO: 844143 - DNA, 25 bp, Mus musculus
tgaagagtgaaaagcttccatgtgc

SEQ ID NO: 844144 - DNA, 25 bp, Mus musculus
tgaagagtgaaatgcttccatgtgc

SEQ ID NO: 844145 - DNA, 25 bp, Mus musculus
tgaagagtgtggaagtcactacccc

SEQ ID NO: 844146 - DNA, 25 bp, Mus musculus
tgaagagtgtggtagtcactacccc

SEQ ID NO: 844147 - DNA, 25 bp, Mus musculus
tgaagagtgtgtcaggttccctgaa

SEQ ID NO: 844148 - DNA, 25 bp, Mus musculus
tgaagagtgtgtgaggttccctgaa

SEQ ID NO: 844149 - DNA, 25 bp, Mus musculus
tgaagagttagtactcccattccac

SEQ ID NO: 844150 - DNA, 25 bp, Mus musculus
tgaagagttagttctcccattccac

SEQ ID NO: 844151 - DNA, 25 bp, Mus musculus
tgaagagttatcagtcctttgtcag

SEQ ID NO: 844152 - DNA, 25 bp, Mus musculus
tgaagagttatctgtcctttgtcag

SEQ ID NO: 844153 - DNA, 25 bp, Mus musculus
tgaagagttcgtaggcattcccggc

SEQ ID NO: 844154 - DNA, 25 bp, Mus musculus
tgaagagttcgttggcattcccggc

SEQ ID NO: 844155 - DNA, 25 bp, Mus musculus
tgaagagttcttaggtagtgcacag

SEQ ID NO: 844156 - DNA, 25 bp, Mus musculus
tgaagagttctttggtagtgcacag

SEQ ID NO: 844157 - DNA, 25 bp, Mus musculus
tgaagagtttatccctttcccctaa

SEQ ID NO: 844158 - DNA, 25 bp, Mus musculus
tgaagagtttatgcctttcccctaa

SEQ ID NO: 844159 - DNA, 25 bp, Mus musculus
tgaagagtttctcatcacgggccgc

SEQ ID NO: 844160 - DNA, 25 bp, Mus musculus
tgaagagtttctgatcacgggccgc

SEQ ID NO: 844161 - DNA, 25 bp, Mus musculus
tgaagagtttgacaatgggcctgct

SEQ ID NO: 844162 - DNA, 25 bp, Mus musculus
tgaagagtttgagaatgggcctgct

SEQ ID NO: 844163 - DNA, 25 bp, Mus musculus
tgaagataaattagtgtgacccact

SEQ ID NO: 844164 - DNA, 25 bp, Mus musculus
tgaagataaatttgtgtgacccact

SEQ ID NO: 844165 - DNA, 25 bp, Mus musculus
tgaagatacgtacggcatcatgcgg

SEQ ID NO: 844166 - DNA, 25 bp, Mus musculus
tgaagatacgtagggcatcatgcgg

SEQ ID NO: 844167 - DNA, 25 bp, Mus musculus
tgaagatagcgtcctagacaccagc

SEQ ID NO: 844168 - DNA, 25 bp, Mus musculus
tgaagatagcgtgctagacaccagc

SEQ ID NO: 844169 - DNA, 25 bp, Mus musculus
tgaagatagcttactgtcacccatc

SEQ ID NO: 844170 - DNA, 25 bp, Mus musculus
tgaagatagctttctgtcacccatc

SEQ ID NO: 844171 - DNA, 25 bp, Mus musculus
tgaagataggtcaggctgctcagcc

SEQ ID NO: 844172 - DNA, 25 bp, Mus musculus
tgaagataggtctggctgctcagcc

SEQ ID NO: 844173 - DNA, 25 bp, Mus musculus
tgaagatcaaatctccccaacttgc

SEQ ID NO: 844174 - DNA, 25 bp, Mus musculus
tgaagatcaaatgtccccaacttgc

SEQ ID NO: 844175 - DNA, 25 bp, Mus musculus
tgaagatcaactctctattcctgaa

SEQ ID NO: 844176 - DNA, 25 bp, Mus musculus
tgaagatcaactgtctattcctgaa

SEQ ID NO: 844177 - DNA, 25 bp, Mus musculus
tgaagatcagcacttggccgtcatt

SEQ ID NO: 844178 - DNA, 25 bp, Mus musculus
tgaagatcagcagttggccgtcatt

SEQ ID NO: 844179 - DNA, 25 bp, Mus musculus
tgaagatcagttccctcagggaccc

SEQ ID NO: 844180 - DNA, 25 bp, Mus musculus
tgaagatcagttgcctcagggaccc

SEQ ID NO: 844181 - DNA, 25 bp, Mus musculus
tgaagatcatgtccctagtcctata

SEQ ID NO: 844182 - DNA, 25 bp, Mus musculus
tgaagatcatgtgcctagtcctata

SEQ ID NO: 844183 - DNA, 25 bp, Mus musculus
tgaagatcccaacgctcaaagaagt

SEQ ID NO: 844184 - DNA, 25 bp, Mus musculus
tgaagatcccaacttgcactgtcat

SEQ ID NO: 844185 - DNA, 25 bp, Mus musculus
tgaagatcccaaggctcaaagaagt

SEQ ID NO: 844186 - DNA, 25 bp, Mus musculus
tgaagatcccaagttgcactgtcat

SEQ ID NO: 844187 - DNA, 25 bp, Mus musculus
tgaagatcccgaagccagggctttg

SEQ ID NO: 844188 - DNA, 25 bp, Mus musculus
tgaagatcccgatgccagggctttg

SEQ ID NO: 844189 - DNA, 25 bp, Mus musculus
tgaagatcccgcctcctgatttaat

SEQ ID NO: 844190 - DNA, 25 bp, Mus musculus
tgaagatcccgcgtcctgatttaat

SEQ ID NO: 844191 - DNA, 25 bp, Mus musculus
tgaagatccggacgtctgtggacct

SEQ ID NO: 844192 - DNA, 25 bp, Mus musculus
tgaagatccggaggtctgtggacct

SEQ ID NO: 844193 - DNA, 25 bp, Mus musculus
tgaagatctggactgcctgtggcac

SEQ ID NO: 844194 - DNA, 25 bp, Mus musculus
tgaagatctggagtgcctgtggcac

SEQ ID NO: 844195 - DNA, 25 bp, Mus musculus
tgaagatcttatctgctgtttctcc

SEQ ID NO: 844196 - DNA, 25 bp, Mus musculus
tgaagatcttatgtgctgtttctcc

SEQ ID NO: 844197 - DNA, 25 bp, Mus musculus
tgaagatcttctaccctcttcttct

SEQ ID NO: 844198 - DNA, 25 bp, Mus musculus
tgaagatcttcttccctcttcttct

SEQ ID NO: 844199 - DNA, 25 bp, Mus musculus
tgaagatcttgaaccgtcccctgta

SEQ ID NO: 844200 - DNA, 25 bp, Mus musculus
tgaagatcttgatccgtcccctgta

SEQ ID NO: 844201 - DNA, 25 bp, Mus musculus
tgaagatgaatcctgatcctgtgat

SEQ ID NO: 844202 - DNA, 25 bp, Mus musculus
tgaagatgaatcgtgatcctgtgat

SEQ ID NO: 844203 - DNA, 25 bp, Mus musculus
tgaagatgaccaatctcacgcactc

SEQ ID NO: 844204 - DNA, 25 bp, Mus musculus
tgaagatgaccattctcacgcactc

SEQ ID NO: 844205 - DNA, 25 bp, Mus musculus
tgaagatgactcagaacctctgctc

SEQ ID NO: 844206 - DNA, 25 bp, Mus musculus
tgaagatgactctgaacctctgctc

SEQ ID NO: 844207 - DNA, 25 bp, Mus musculus
tgaagatgatgaatccctccgagaa

SEQ ID NO: 844208 - DNA, 25 bp, Mus musculus
tgaagatgatgattccctccgagaa

SEQ ID NO: 844209 - DNA, 25 bp, Mus musculus
tgaagatgcccactgcactggttgg

SEQ ID NO: 844210 - DNA, 25 bp, Mus musculus
tgaagatgcccagtgcactggttgg

SEQ ID NO: 844211 - DNA, 25 bp, Mus musculus
tgaagatgccctcagaaaccagccc

SEQ ID NO: 844212 - DNA, 25 bp, Mus musculus
tgaagatgccctgagaaaccagccc

SEQ ID NO: 844213 - DNA, 25 bp, Mus musculus
tgaagatgctcacatgccttaacat

SEQ ID NO: 844214 - DNA, 25 bp, Mus musculus
tgaagatgctcagatgccttaacat

SEQ ID NO: 844215 - DNA, 25 bp, Mus musculus
tgaagatgcttacacagtttcctcc

SEQ ID NO: 844216 - DNA, 25 bp, Mus musculus
tgaagatgcttagacagtttcctcc

SEQ ID NO: 844217 - DNA, 25 bp, Mus musculus
tgaagatggaggaccctagctctgt

SEQ ID NO: 844218 - DNA, 25 bp, Mus musculus
tgaagatggaggtccctagctctgt

SEQ ID NO: 844219 - DNA, 25 bp, Mus musculus
tgaagatggcgtccgggcacacttt

SEQ ID NO: 844220 - DNA, 25 bp, Mus musculus
tgaagatggcgtgcgggcacacttt

SEQ ID NO: 844221 - DNA, 25 bp, Mus musculus
tgaagatggtgtctggcttcatccc

SEQ ID NO: 844222 - DNA, 25 bp, Mus musculus
tgaagatggtgtgtggcttcatccc

SEQ ID NO: 844223 - DNA, 25 bp, Mus musculus
tgaagatgtaaaactcctgggagaa

SEQ ID NO: 844224 - DNA, 25 bp, Mus musculus
tgaagatgtaaatctcctgggagaa

SEQ ID NO: 844225 - DNA, 25 bp, Mus musculus
tgaagatgtctacatttcccctcat

SEQ ID NO: 844226 - DNA, 25 bp, Mus musculus
tgaagatgtctagatttcccctcat

SEQ ID NO: 844227 - DNA, 25 bp, Mus musculus
tgaagatgtcttactcttggatcct

SEQ ID NO: 844228 - DNA, 25 bp, Mus musculus
tgaagatgtctttctcttggatcct

SEQ ID NO: 844229 - DNA, 25 bp, Mus musculus
tgaagatgtgcaatgtgggagaacc

SEQ ID NO: 844230 - DNA, 25 bp, Mus musculus
tgaagatgtgcattgtgggagaacc

SEQ ID NO: 844231 - DNA, 25 bp, Mus musculus
tgaagatgtgccatttattgggtga

SEQ ID NO: 844232 - DNA, 25 bp, Mus musculus
tgaagatgtgccttttattgggtga

SEQ ID NO: 844233 - DNA, 25 bp, Mus musculus
tgaagattaacaccatctgccactg

SEQ ID NO: 844234 - DNA, 25 bp, Mus musculus
tgaagattaacagcatctgccactg

SEQ ID NO: 844235 - DNA, 25 bp, Mus musculus
tgaagattcccactcagtagctcat

SEQ ID NO: 844236 - DNA, 25 bp, Mus musculus
tgaagattcccagtcagtagctcat

SEQ ID NO: 844237 - DNA, 25 bp, Mus musculus
tgaagattccctccggtgtttgtcc

SEQ ID NO: 844238 - DNA, 25 bp, Mus musculus
tgaagattccctgcggtgtttgtcc

SEQ ID NO: 844239 - DNA, 25 bp, Mus musculus
tgaagattcctaccctgcaactggg

SEQ ID NO: 844240 - DNA, 25 bp, Mus musculus
tgaagattcctagcctgcaactggg

SEQ ID NO: 844241 - DNA, 25 bp, Mus musculus
tgaagattcctgaggccaagcgggt

SEQ ID NO: 844242 - DNA, 25 bp, Mus musculus
tgaagattcctgtggccaagcgggt

SEQ ID NO: 844243 - DNA, 25 bp, Mus musculus
tgaagattcgcgcttccttggccag

SEQ ID NO: 844244 - DNA, 25 bp, Mus musculus
tgaagattcgcggttccttggccag

SEQ ID NO: 844245 - DNA, 25 bp, Mus musculus
tgaagattcggcaccaccatacaga

SEQ ID NO: 844246 - DNA, 25 bp, Mus musculus
tgaagattcggctccaccatacaga

SEQ ID NO: 844247 - DNA, 25 bp, Mus musculus
tgaagattctctagcccagtattgc

SEQ ID NO: 844248 - DNA, 25 bp, Mus musculus
tgaagattctcttgcccagtattgc

SEQ ID NO: 844249 - DNA, 25 bp, Mus musculus
tgaagattctgtccctttgtatgta

SEQ ID NO: 844250 - DNA, 25 bp, Mus musculus
tgaagattctgtgcctttgtatgta

SEQ ID NO: 844251 - DNA, 25 bp, Mus musculus
tgaagattgatcagcttgtgtatgg

SEQ ID NO: 844252 - DNA, 25 bp, Mus musculus
tgaagattgatctgcttgtgtatgg

SEQ ID NO: 844253 - DNA, 25 bp, Mus musculus
tgaagattgtccaggccgcgacctg

SEQ ID NO: 844254 - DNA, 25 bp, Mus musculus
tgaagattgtcctggccgcgacctg

SEQ ID NO: 844255 - DNA, 25 bp, Mus musculus
tgaagattgttaccaaccaaccgac

SEQ ID NO: 844256 - DNA, 25 bp, Mus musculus
tgaagattgttagcaaccaaccgac

SEQ ID NO: 844257 - DNA, 25 bp, Mus musculus
tgaagatttcatcctcacagcttgg

SEQ ID NO: 844258 - DNA, 25 bp, Mus musculus
tgaagatttcatgctcacagcttgg

SEQ ID NO: 844259 - DNA, 25 bp, Mus musculus
tgaagatttgtgagtccgttcctct

SEQ ID NO: 844260 - DNA, 25 bp, Mus musculus
tgaagatttgtgtgtccgttcctct

SEQ ID NO: 844261 - DNA, 25 bp, Mus musculus
tgaagattttgtcatttgggctaaa

SEQ ID NO: 844262 - DNA, 25 bp, Mus musculus
tgaagattttgtccagagggagcca

SEQ ID NO: 844263 - DNA, 25 bp, Mus musculus
tgaagattttgtgatttgggctaaa

SEQ ID NO: 844264 - DNA, 25 bp, Mus musculus
tgaagattttgtgcagagggagcca

SEQ ID NO: 844265 - DNA, 25 bp, Mus musculus
tgaagcaaacctccaagctctgata

SEQ ID NO: 844266 - DNA, 25 bp, Mus musculus
tgaagcaaacctctgagccttccta

SEQ ID NO: 844267 - DNA, 25 bp, Mus musculus
tgaagcaaacctgcaagctctgata

SEQ ID NO: 844268 - DNA, 25 bp, Mus musculus
tgaagcaaacctgtgagccttccta

SEQ ID NO: 844269 - DNA, 25 bp, Mus musculus
tgaagcaaagctatcatttcctgga

SEQ ID NO: 844270 - DNA, 25 bp, Mus musculus
tgaagcaaagctttcatttcctgga

SEQ ID NO: 844271 - DNA, 25 bp, Mus musculus
tgaagcaaatctaccttaggaactt

SEQ ID NO: 844272 - DNA, 25 bp, Mus musculus
tgaagcaaatctcgtgcgggtcacc

SEQ ID NO: 844273 - DNA, 25 bp, Mus musculus
tgaagcaaatctggtgcgggtcacc

SEQ ID NO: 844274 - DNA, 25 bp, Mus musculus
tgaagcaaatcttccttaggaactt

SEQ ID NO: 844275 - DNA, 25 bp, Mus musculus
tgaagcaacccaagatttgtccctc

SEQ ID NO: 844276 - DNA, 25 bp, Mus musculus
tgaagcaacccatgatttgtccctc

SEQ ID NO: 844277 - DNA, 25 bp, Mus musculus
tgaagcaactcaacgccatcacagg

SEQ ID NO: 844278 - DNA, 25 bp, Mus musculus
tgaagcaactcatcgccatcacagg

SEQ ID NO: 844279 - DNA, 25 bp, Mus musculus
tgaagcaacttcacatggaggtaat

SEQ ID NO: 844280 - DNA, 25 bp, Mus musculus
tgaagcaacttctcatggaggtaat

SEQ ID NO: 844281 - DNA, 25 bp, Mus musculus
tgaagcaagcatcaatggcggccaa

SEQ ID NO: 844282 - DNA, 25 bp, Mus musculus
tgaagcaagcatgaatggcggccaa

SEQ ID NO: 844283 - DNA, 25 bp, Mus musculus
tgaagcaagggcaggatccctaccc

SEQ ID NO: 844284 - DNA, 25 bp, Mus musculus
tgaagcaagggctggatccctaccc

SEQ ID NO: 844285 - DNA, 25 bp, Mus musculus
tgaagcacaactcggtttgcactaa

SEQ ID NO: 844286 - DNA, 25 bp, Mus musculus
tgaagcacaactgggtttgcactaa

SEQ ID NO: 844287 - DNA, 25 bp, Mus musculus
tgaagcacatcgagtccatgggcta

SEQ ID NO: 844288 - DNA, 25 bp, Mus musculus
tgaagcacatcgtgtccatgggcta

SEQ ID NO: 844289 - DNA, 25 bp, Mus musculus
tgaagcacatgacaattccacccct

SEQ ID NO: 844290 - DNA, 25 bp, Mus musculus
tgaagcacatgagaattccacccct

SEQ ID NO: 844291 - DNA, 25 bp, Mus musculus
tgaagcacattgactcaccggatga

SEQ ID NO: 844292 - DNA, 25 bp, Mus musculus
tgaagcacattgtctcaccggatga

SEQ ID NO: 844293 - DNA, 25 bp, Mus musculus
tgaagcaccataaccaaaaagtaag

SEQ ID NO: 844294 - DNA, 25 bp, Mus musculus
tgaagcaccatacctgccctaattt

SEQ ID NO: 844295 - DNA, 25 bp, Mus musculus
tgaagcaccatagctgccctaattt

SEQ ID NO: 844296 - DNA, 25 bp, Mus musculus
tgaagcaccatatccaaaaagtaag

SEQ ID NO: 844297 - DNA, 25 bp, Mus musculus
tgaagcaccctgatatctaaagaat

SEQ ID NO: 844298 - DNA, 25 bp, Mus musculus
tgaagcaccctgttatctaaagaat

SEQ ID NO: 844299 - DNA, 25 bp, Mus musculus
tgaagcacctcgaagccctgcaggg

SEQ ID NO: 844300 - DNA, 25 bp, Mus musculus
tgaagcacctcgtagccctgcaggg

SEQ ID NO: 844301 - DNA, 25 bp, Mus musculus
tgaagcactgaacctgcattcccca

SEQ ID NO: 844302 - DNA, 25 bp, Mus musculus
tgaagcactgaagctgcattcccca

SEQ ID NO: 844303 - DNA, 25 bp, Mus musculus
tgaagcactggacgcgacctgccaa

SEQ ID NO: 844304 - DNA, 25 bp, Mus musculus
tgaagcactggacgctgcccgtatt

SEQ ID NO: 844305 - DNA, 25 bp, Mus musculus
tgaagcactggaggcgacctgccaa

SEQ ID NO: 844306 - DNA, 25 bp, Mus musculus
tgaagcactggaggctgcccgtatt

SEQ ID NO: 844307 - DNA, 25 bp, Mus musculus
tgaagcactgggaatttttacatga

SEQ ID NO: 844308 - DNA, 25 bp, Mus musculus
tgaagcactgggtatttttacatga

SEQ ID NO: 844309 - DNA, 25 bp, Mus musculus
tgaagcacttagcagctactgctct

SEQ ID NO: 844310 - DNA, 25 bp, Mus musculus
tgaagcacttaggagctactgctct

SEQ ID NO: 844311 - DNA, 25 bp, Mus musculus
tgaagcactttcactgttcgtgtct

SEQ ID NO: 844312 - DNA, 25 bp, Mus musculus
tgaagcactttctctgttcgtgtct

SEQ ID NO: 844313 - DNA, 25 bp, Mus musculus
tgaagcacttttaccttacacatcc

SEQ ID NO: 844314 - DNA, 25 bp, Mus musculus
tgaagcactttttccttacacatcc

SEQ ID NO: 844315 - DNA, 25 bp, Mus musculus
tgaagcagaagcagattcgtcgcgg

SEQ ID NO: 844316 - DNA, 25 bp, Mus musculus
tgaagcagaagctgattcgtcgcgg

SEQ ID NO: 844317 - DNA, 25 bp, Mus musculus
tgaagcagacccacagagagcctga

SEQ ID NO: 844318 - DNA, 25 bp, Mus musculus
tgaagcagaccctcagagagcctga

SEQ ID NO: 844319 - DNA, 25 bp, Mus musculus
tgaagcagacctagtgctcctcacc

SEQ ID NO: 844320 - DNA, 25 bp, Mus musculus
tgaagcagaccttgtgctcctcacc

SEQ ID NO: 844321 - DNA, 25 bp, Mus musculus
tgaagcagacgcacgctaagcagga

SEQ ID NO: 844322 - DNA, 25 bp, Mus musculus
tgaagcagacgctcgctaagcagga

SEQ ID NO: 844323 - DNA, 25 bp, Mus musculus
tgaagcagacggattttccctgcac

SEQ ID NO: 844324 - DNA, 25 bp, Mus musculus
tgaagcagacggtttttccctgcac

SEQ ID NO: 844325 - DNA, 25 bp, Mus musculus
tgaagcagagcactgtgagacatat

SEQ ID NO: 844326 - DNA, 25 bp, Mus musculus
tgaagcagagcagtgtgagacatat

SEQ ID NO: 844327 - DNA, 25 bp, Mus musculus
tgaagcagagctcgcatcagctgct

SEQ ID NO: 844328 - DNA, 25 bp, Mus musculus
tgaagcagagctggcatcagctgct

SEQ ID NO: 844329 - DNA, 25 bp, Mus musculus
tgaagcagatccacaccatgtgtaa

SEQ ID NO: 844330 - DNA, 25 bp, Mus musculus
tgaagcagatcctcaccatgtgtaa

SEQ ID NO: 844331 - DNA, 25 bp, Mus musculus
tgaagcagatctatcctagccggga

SEQ ID NO: 844332 - DNA, 25 bp, Mus musculus
tgaagcagatctttcctagccggga

SEQ ID NO: 844333 - DNA, 25 bp, Mus musculus
tgaagcagcagcaagtcaaccagca

SEQ ID NO: 844334 - DNA, 25 bp, Mus musculus
tgaagcagcagctagtcaaccagca

SEQ ID NO: 844335 - DNA, 25 bp, Mus musculus
tgaagcagccatacatccttgtcta

SEQ ID NO: 844336 - DNA, 25 bp, Mus musculus
tgaagcagccattcatccttgtcta

SEQ ID NO: 844337 - DNA, 25 bp, Mus musculus
tgaagcagcctacagaccccaggga

SEQ ID NO: 844338 - DNA, 25 bp, Mus musculus
tgaagcagcctagagaccccaggga

SEQ ID NO: 844339 - DNA, 25 bp, Mus musculus
tgaagcagccttaactacagcctac

SEQ ID NO: 844340 - DNA, 25 bp, Mus musculus
tgaagcagcctttactacagcctac

SEQ ID NO: 844341 - DNA, 25 bp, Mus musculus
tgaagcagctctaccgacgtgtggc

SEQ ID NO: 844342 - DNA, 25 bp, Mus musculus
tgaagcagctcttccgacgtgtggc

SEQ ID NO: 844343 - DNA, 25 bp, Mus musculus
tgaagcagctgcagtggtccggaat

SEQ ID NO: 844344 - DNA, 25 bp, Mus musculus
tgaagcagctgctgtggtccggaat

SEQ ID NO: 844345 - DNA, 25 bp, Mus musculus
tgaagcagcttcacgtgttggccag

SEQ ID NO: 844346 - DNA, 25 bp, Mus musculus
tgaagcagcttctcgtgttggccag

SEQ ID NO: 844347 - DNA, 25 bp, Mus musculus
tgaagcaggagcaacgccatctgct

SEQ ID NO: 844348 - DNA, 25 bp, Mus musculus
tgaagcaggagctacgccatctgct

SEQ ID NO: 844349 - DNA, 25 bp, Mus musculus
tgaagcagggccagctacttggaat

SEQ ID NO: 844350 - DNA, 25 bp, Mus musculus
tgaagcagggcctgctacttggaat

SEQ ID NO: 844351 - DNA, 25 bp, Mus musculus
tgaagcaggtcaactgttttatcct

SEQ ID NO: 844352 - DNA, 25 bp, Mus musculus
tgaagcaggtcatctgttttatcct

SEQ ID NO: 844353 - DNA, 25 bp, Mus musculus
tgaagcaggtgcatccggacaccgg

SEQ ID NO: 844354 - DNA, 25 bp, Mus musculus
tgaagcaggtgcttccggacaccgg

SEQ ID NO: 844355 - DNA, 25 bp, Mus musculus
tgaagcagtcccagcaacttgacca

SEQ ID NO: 844356 - DNA, 25 bp, Mus musculus
tgaagcagtccctgcaacttgacca

SEQ ID NO: 844357 - DNA, 25 bp, Mus musculus
tgaagcagtcttcctgaaaccctca

SEQ ID NO: 844358 - DNA, 25 bp, Mus musculus
tgaagcagtcttgctgaaaccctca

SEQ ID NO: 844359 - DNA, 25 bp, Mus musculus
tgaagcagtgtgcagcctcggctcc

SEQ ID NO: 844360 - DNA, 25 bp, Mus musculus
tgaagcagtgtggagcctcggctcc

SEQ ID NO: 844361 - DNA, 25 bp, Mus musculus
tgaagcagttgtacacagctaagtc

SEQ ID NO: 844362 - DNA, 25 bp, Mus musculus
tgaagcagttgttcacagctaagtc

SEQ ID NO: 844363 - DNA, 25 bp, Mus musculus
tgaagcatagctcagagggtctgat

SEQ ID NO: 844364 - DNA, 25 bp, Mus musculus
tgaagcatagctgagagggtctgat

SEQ ID NO: 844365 - DNA, 25 bp, Mus musculus
tgaagcatagttacttgttttctgt

SEQ ID NO: 844366 - DNA, 25 bp, Mus musculus
tgaagcatagtttcttgttttctgt

SEQ ID NO: 844367 - DNA, 25 bp, Mus musculus
tgaagcatatgtattccacgattgt

SEQ ID NO: 844368 - DNA, 25 bp, Mus musculus
tgaagcatatgttttccacgattgt

SEQ ID NO: 844369 - DNA, 25 bp, Mus musculus
tgaagcatcactacctcataggaag

SEQ ID NO: 844370 - DNA, 25 bp, Mus musculus
tgaagcatcacttcctcataggaag

SEQ ID NO: 844371 - DNA, 25 bp, Mus musculus
tgaagcatcagtaccattgcaggaa

SEQ ID NO: 844372 - DNA, 25 bp, Mus musculus
tgaagcatcagttccattgcaggaa

SEQ ID NO: 844373 - DNA, 25 bp, Mus musculus
tgaagcatccagcagcatgtgcaga

SEQ ID NO: 844374 - DNA, 25 bp, Mus musculus
tgaagcatccaggagcatgtgcaga

SEQ ID NO: 844375 - DNA, 25 bp, Mus musculus
tgaagcatccctaagcgtggagcca

SEQ ID NO: 844376 - DNA, 25 bp, Mus musculus
tgaagcatcccttagcgtggagcca

SEQ ID NO: 844377 - DNA, 25 bp, Mus musculus
tgaagcatcctcaatcgctcgaatt

SEQ ID NO: 844378 - DNA, 25 bp, Mus musculus
tgaagcatcctctatcgctcgaatt

SEQ ID NO: 844379 - DNA, 25 bp, Mus musculus
tgaagcatccttactgaagtttctt

SEQ ID NO: 844380 - DNA, 25 bp, Mus musculus
tgaagcatcctttctgaagtttctt

SEQ ID NO: 844381 - DNA, 25 bp, Mus musculus
tgaagcatcggacacttcccttgct

SEQ ID NO: 844382 - DNA, 25 bp, Mus musculus
tgaagcatcggagacttcccttgct

SEQ ID NO: 844383 - DNA, 25 bp, Mus musculus
tgaagcatctctcagaactggtctg

SEQ ID NO: 844384 - DNA, 25 bp, Mus musculus
tgaagcatctctgagaactggtctg

SEQ ID NO: 844385 - DNA, 25 bp, Mus musculus
tgaagcatctttctctctctctacc

SEQ ID NO: 844386 - DNA, 25 bp, Mus musculus
tgaagcatctttgtctctctctacc

SEQ ID NO: 844387 - DNA, 25 bp, Mus musculus
tgaagcatgcttcggtccacacaca

SEQ ID NO: 844388 - DNA, 25 bp, Mus musculus
tgaagcatgcttgggtccacacaca

SEQ ID NO: 844389 - DNA, 25 bp, Mus musculus
tgaagcatggctaagggacctacaa

SEQ ID NO: 844390 - DNA, 25 bp, Mus musculus
tgaagcatggcttagggacctacaa

SEQ ID NO: 844391 - DNA, 25 bp, Mus musculus
tgaagcattaaacccctactctgcc

SEQ ID NO: 844392 - DNA, 25 bp, Mus musculus
tgaagcattaaagccctactctgcc

SEQ ID NO: 844393 - DNA, 25 bp, Mus musculus
tgaagcattaccagtctcagtgttt

SEQ ID NO: 844394 - DNA, 25 bp, Mus musculus
tgaagcattacctgtctcagtgttt

SEQ ID NO: 844395 - DNA, 25 bp, Mus musculus
tgaagcattatccatgctgtcacct

SEQ ID NO: 844396 - DNA, 25 bp, Mus musculus
tgaagcattatcgatgctgtcacct

SEQ ID NO: 844397 - DNA, 25 bp, Mus musculus
tgaagcattcagagccgtccggcta

SEQ ID NO: 844398 - DNA, 25 bp, Mus musculus
tgaagcattcagtgccgtccggcta

SEQ ID NO: 844399 - DNA, 25 bp, Mus musculus
tgaagcattctcacagtctgtatgt

SEQ ID NO: 844400 - DNA, 25 bp, Mus musculus
tgaagcattctctcagtctgtatgt

SEQ ID NO: 844401 - DNA, 25 bp, Mus musculus
tgaagccaaccacgctgcgggaact

SEQ ID NO: 844402 - DNA, 25 bp, Mus musculus
tgaagccaaccaggctgcgggaact

SEQ ID NO: 844403 - DNA, 25 bp, Mus musculus
tgaagccaagtaaccctaccacaga

SEQ ID NO: 844404 - DNA, 25 bp, Mus musculus
tgaagccaagtatccctaccacaga

SEQ ID NO: 844405 - DNA, 25 bp, Mus musculus
tgaagccaagtcatactgcagccct

SEQ ID NO: 844406 - DNA, 25 bp, Mus musculus
tgaagccaagtcttactgcagccct

SEQ ID NO: 844407 - DNA, 25 bp, Mus musculus
tgaagccaagttacctagggctctg

SEQ ID NO: 844408 - DNA, 25 bp, Mus musculus
tgaagccaagtttcctagggctctg

SEQ ID NO: 844409 - DNA, 25 bp, Mus musculus
tgaagccaattcaaatcccaagcct

SEQ ID NO: 844410 - DNA, 25 bp, Mus musculus
tgaagccaattctaatcccaagcct

SEQ ID NO: 844411 - DNA, 25 bp, Mus musculus
tgaagccacagaaccaagcctgaca

SEQ ID NO: 844412 - DNA, 25 bp, Mus musculus
tgaagccacagatccaagcctgaca

SEQ ID NO: 844413 - DNA, 25 bp, Mus musculus
tgaagccacaggagagcaccatgat

SEQ ID NO: 844414 - DNA, 25 bp, Mus musculus
tgaagccacaggtgagcaccatgat

SEQ ID NO: 844415 - DNA, 25 bp, Mus musculus
tgaagccaccacacaaaggacctgg

SEQ ID NO: 844416 - DNA, 25 bp, Mus musculus
tgaagccaccactcaaaggacctgg

SEQ ID NO: 844417 - DNA, 25 bp, Mus musculus
tgaagccaccagacagagctctaac

SEQ ID NO: 844418 - DNA, 25 bp, Mus musculus
tgaagccaccagtcagagctctaac

SEQ ID NO: 844419 - DNA, 25 bp, Mus musculus
tgaagccacctgagcaaggaccctt

SEQ ID NO: 844420 - DNA, 25 bp, Mus musculus
tgaagccacctgtgcaaggaccctt

SEQ ID NO: 844421 - DNA, 25 bp, Mus musculus
tgaagccacggccaaggacaagagt

SEQ ID NO: 844422 - DNA, 25 bp, Mus musculus
tgaagccacggcgaaggacaagagt

SEQ ID NO: 844423 - DNA, 25 bp, Mus musculus
tgaagccacgtaccctctgaggtaa

SEQ ID NO: 844424 - DNA, 25 bp, Mus musculus
tgaagccacgtagcctctgaggtaa

SEQ ID NO: 844425 - DNA, 25 bp, Mus musculus
tgaagccactgcaagggccacactg

SEQ ID NO: 844426 - DNA, 25 bp, Mus musculus
tgaagccactgctagggccacactg

SEQ ID NO: 844427 - DNA, 25 bp, Mus musculus
tgaagccacttcattccgcttgttt

SEQ ID NO: 844428 - DNA, 25 bp, Mus musculus
tgaagccacttctttccgcttgttt

SEQ ID NO: 844429 - DNA, 25 bp, Mus musculus
tgaagccagagtcgctcctggagca

SEQ ID NO: 844430 - DNA, 25 bp, Mus musculus
tgaagccagagtggctcctggagca

SEQ ID NO: 844431 - DNA, 25 bp, Mus musculus
tgaagccagatgctcacacctttaa

SEQ ID NO: 844432 - DNA, 25 bp, Mus musculus
tgaagccagatggtcacacctttaa

SEQ ID NO: 844433 - DNA, 25 bp, Mus musculus
tgaagccagcgcagcctcagcggct

SEQ ID NO: 844434 - DNA, 25 bp, Mus musculus
tgaagccagcgctgcctcagcggct

SEQ ID NO: 844435 - DNA, 25 bp, Mus musculus
tgaagccagctgagcagacccctct

SEQ ID NO: 844436 - DNA, 25 bp, Mus musculus
tgaagccagctgcttcaaggccatt

SEQ ID NO: 844437 - DNA, 25 bp, Mus musculus
tgaagccagctggttcaaggccatt

SEQ ID NO: 844438 - DNA, 25 bp, Mus musculus
tgaagccagctgtgcagacccctct

SEQ ID NO: 844439 - DNA, 25 bp, Mus musculus
tgaagccaggcactgctctgactta

SEQ ID NO: 844440 - DNA, 25 bp, Mus musculus
tgaagccaggcagtgctctgactta

SEQ ID NO: 844441 - DNA, 25 bp, Mus musculus
tgaagccaggcgcatggccttcctc

SEQ ID NO: 844442 - DNA, 25 bp, Mus musculus
tgaagccaggcggatggccttcctc

SEQ ID NO: 844443 - DNA, 25 bp, Mus musculus
tgaagccagttcacgaatgacctcg

SEQ ID NO: 844444 - DNA, 25 bp, Mus musculus
tgaagccagttctcgaatgacctcg

SEQ ID NO: 844445 - DNA, 25 bp, Mus musculus
tgaagccatagtatcttcctcacca

SEQ ID NO: 844446 - DNA, 25 bp, Mus musculus
tgaagccatagtttcttcctcacca

SEQ ID NO: 844447 - DNA, 25 bp, Mus musculus
tgaagccatcaaaacgaagaaccga

SEQ ID NO: 844448 - DNA, 25 bp, Mus musculus
tgaagccatcaatacgaagaaccga

SEQ ID NO: 844449 - DNA, 25 bp, Mus musculus
tgaagccatccgcagaacccataac

SEQ ID NO: 844450 - DNA, 25 bp, Mus musculus
tgaagccatccggagaacccataac

SEQ ID NO: 844451 - DNA, 25 bp, Mus musculus
tgaagccatcctatttgtttctggg

SEQ ID NO: 844452 - DNA, 25 bp, Mus musculus
tgaagccatcctttttgtttctggg

SEQ ID NO: 844453 - DNA, 25 bp, Mus musculus
tgaagccatgataccctccatgttt

SEQ ID NO: 844454 - DNA, 25 bp, Mus musculus
tgaagccatgattccctccatgttt

SEQ ID NO: 844455 - DNA, 25 bp, Mus musculus
tgaagccatgttctaccaccagaag

SEQ ID NO: 844456 - DNA, 25 bp, Mus musculus
tgaagccatgttgtaccaccagaag

SEQ ID NO: 844457 - DNA, 25 bp, Mus musculus
tgaagcccaaaaacaaccttcctgt

SEQ ID NO: 844458 - DNA, 25 bp, Mus musculus
tgaagcccaaaatcaaccttcctgt

SEQ ID NO: 844459 - DNA, 25 bp, Mus musculus
tgaagcccaaacatacttataatat

SEQ ID NO: 844460 - DNA, 25 bp, Mus musculus
tgaagcccaaacttacttataatat

SEQ ID NO: 844461 - DNA, 25 bp, Mus musculus
tgaagcccaagaagccggcaaggct

SEQ ID NO: 844462 - DNA, 25 bp, Mus musculus
tgaagcccaagaatgtgcccctgtg

SEQ ID NO: 844463 - DNA, 25 bp, Mus musculus
tgaagcccaagatgccggcaaggct

SEQ ID NO: 844464 - DNA, 25 bp, Mus musculus
tgaagcccaagattgtgcccctgtg

SEQ ID NO: 844465 - DNA, 25 bp, Mus musculus
tgaagcccacaacgagtgcatgagg

SEQ ID NO: 844466 - DNA, 25 bp, Mus musculus
tgaagcccacaaggagtgcatgagg

SEQ ID NO: 844467 - DNA, 25 bp, Mus musculus
tgaagcccactaaggtctcagcccg

SEQ ID NO: 844468 - DNA, 25 bp, Mus musculus
tgaagcccactatggtctcagcccg

SEQ ID NO: 844469 - DNA, 25 bp, Mus musculus
tgaagcccaggaagacccacagaaa

SEQ ID NO: 844470 - DNA, 25 bp, Mus musculus
tgaagcccaggatgacccacagaaa

SEQ ID NO: 844471 - DNA, 25 bp, Mus musculus
tgaagcccaggcagcttgtctgtaa

SEQ ID NO: 844472 - DNA, 25 bp, Mus musculus
tgaagcccaggctgcttgtctgtaa

SEQ ID NO: 844473 - DNA, 25 bp, Mus musculus
tgaagcccatttccttttccttggc

SEQ ID NO: 844474 - DNA, 25 bp, Mus musculus
tgaagcccatttgcttttccttggc

SEQ ID NO: 844475 - DNA, 25 bp, Mus musculus
tgaagccccactcaggcaattcgag

SEQ ID NO: 844476 - DNA, 25 bp, Mus musculus
tgaagccccactgaggcaattcgag

SEQ ID NO: 844477 - DNA, 25 bp, Mus musculus
tgaagccccagcagagagtgtcctc

SEQ ID NO: 844478 - DNA, 25 bp, Mus musculus
tgaagccccagctgagagtgtcctc

SEQ ID NO: 844479 - DNA, 25 bp, Mus musculus
tgaagccccataaagacccgtgatg

SEQ ID NO: 844480 - DNA, 25 bp, Mus musculus
tgaagccccatatagacccgtgatg

SEQ ID NO: 844481 - DNA, 25 bp, Mus musculus
tgaagcccctttcccaacagaagaa

SEQ ID NO: 844482 - DNA, 25 bp, Mus musculus
tgaagcccctttgccaacagaagaa

SEQ ID NO: 844483 - DNA, 25 bp, Mus musculus
tgaagcccgacccagcataagcagg

SEQ ID NO: 844484 - DNA, 25 bp, Mus musculus
tgaagcccgaccgagcataagcagg

SEQ ID NO: 844485 - DNA, 25 bp, Mus musculus
tgaagcccgcaacccaaaggcgccc

SEQ ID NO: 844486 - DNA, 25 bp, Mus musculus
tgaagcccgcaagccaaaggcgccc

SEQ ID NO: 844487 - DNA, 25 bp, Mus musculus
tgaagcccggagcacagctaagctg

SEQ ID NO: 844488 - DNA, 25 bp, Mus musculus
tgaagcccggaggacagctaagctg

SEQ ID NO: 844489 - DNA, 25 bp, Mus musculus
tgaagcccgtgcagtgagctcaggt

SEQ ID NO: 844490 - DNA, 25 bp, Mus musculus
tgaagcccgtgctgtgagctcaggt

SEQ ID NO: 844491 - DNA, 25 bp, Mus musculus
tgaagcccgtgtacttaatctcgca

SEQ ID NO: 844492 - DNA, 25 bp, Mus musculus
tgaagcccgtgttcttaatctcgca

SEQ ID NO: 844493 - DNA, 25 bp, Mus musculus
tgaagccctatgcacgccgtaacga

SEQ ID NO: 844494 - DNA, 25 bp, Mus musculus
tgaagccctatggacgccgtaacga

SEQ ID NO: 844495 - DNA, 25 bp, Mus musculus
tgaagccctattctagtacctctcc

SEQ ID NO: 844496 - DNA, 25 bp, Mus musculus
tgaagccctattgtagtacctctcc

SEQ ID NO: 844497 - DNA, 25 bp, Mus musculus
tgaagccctcccaatcctagagaag

SEQ ID NO: 844498 - DNA, 25 bp, Mus musculus
tgaagccctccctatcctagagaag

SEQ ID NO: 844499 - DNA, 25 bp, Mus musculus
tgaagccctccgcacgataaatggt

SEQ ID NO: 844500 - DNA, 25 bp, Mus musculus
tgaagccctccggacgataaatggt

SEQ ID NO: 844501 - DNA, 25 bp, Mus musculus
tgaagccctctacagactgagtctg

SEQ ID NO: 844502 - DNA, 25 bp, Mus musculus
tgaagccctctagagactgagtctg

SEQ ID NO: 844503 - DNA, 25 bp, Mus musculus
tgaagccctgaaactcagcacacaa

SEQ ID NO: 844504 - DNA, 25 bp, Mus musculus
tgaagccctgaatctcagcacacaa

SEQ ID NO: 844505 - DNA, 25 bp, Mus musculus
tgaagccctgcaaggatcctgagaa

SEQ ID NO: 844506 - DNA, 25 bp, Mus musculus
tgaagccctgcatggatcctgagaa

SEQ ID NO: 844507 - DNA, 25 bp, Mus musculus
tgaagccctgctacatatggaatct

SEQ ID NO: 844508 - DNA, 25 bp, Mus musculus
tgaagccctgcttcatatggaatct

SEQ ID NO: 844509 - DNA, 25 bp, Mus musculus
tgaagccctggcagatcgaggtcaa

SEQ ID NO: 844510 - DNA, 25 bp, Mus musculus
tgaagccctggcatagacctgaaga

SEQ ID NO: 844511 - DNA, 25 bp, Mus musculus
tgaagccctggctgatcgaggtcaa

SEQ ID NO: 844512 - DNA, 25 bp, Mus musculus
tgaagccctggcttagacctgaaga

SEQ ID NO: 844513 - DNA, 25 bp, Mus musculus
tgaagccctgtaacgggaaggcctg

SEQ ID NO: 844514 - DNA, 25 bp, Mus musculus
tgaagccctgtatcgggaaggcctg

SEQ ID NO: 844515 - DNA, 25 bp, Mus musculus
tgaagccctgttagaccttgtagtc

SEQ ID NO: 844516 - DNA, 25 bp, Mus musculus
tgaagccctgtttgaccttgtagtc

SEQ ID NO: 844517 - DNA, 25 bp, Mus musculus
tgaagcccttctcgagtcaagcctg

SEQ ID NO: 844518 - DNA, 25 bp, Mus musculus
tgaagcccttctggagtcaagcctg

SEQ ID NO: 844519 - DNA, 25 bp, Mus musculus
tgaagcccttgtcaacacaggaaaa

SEQ ID NO: 844520 - DNA, 25 bp, Mus musculus
tgaagcccttgtgaacacaggaaaa

SEQ ID NO: 844521 - DNA, 25 bp, Mus musculus
tgaagccgaaatacagcccctacaa

SEQ ID NO: 844522 - DNA, 25 bp, Mus musculus
tgaagccgaaattcagcccctacaa

SEQ ID NO: 844523 - DNA, 25 bp, Mus musculus
tgaagccgaacgactacatgtcggt

SEQ ID NO: 844524 - DNA, 25 bp, Mus musculus
tgaagccgaacgtctacatgtcggt

SEQ ID NO: 844525 - DNA, 25 bp, Mus musculus
tgaagccgaggtaatcctctgagcc

SEQ ID NO: 844526 - DNA, 25 bp, Mus musculus
tgaagccgaggttatcctctgagcc

SEQ ID NO: 844527 - DNA, 25 bp, Mus musculus
tgaagccgattcacatacctctgaa

SEQ ID NO: 844528 - DNA, 25 bp, Mus musculus
tgaagccgattctcatacctctgaa

SEQ ID NO: 844529 - DNA, 25 bp, Mus musculus
tgaagccgcccaaacagtctagatg

SEQ ID NO: 844530 - DNA, 25 bp, Mus musculus
tgaagccgcccatacagtctagatg

SEQ ID NO: 844531 - DNA, 25 bp, Mus musculus
tgaagccgctgaatcccaacttctg

SEQ ID NO: 844532 - DNA, 25 bp, Mus musculus
tgaagccgctgattcccaacttctg

SEQ ID NO: 844533 - DNA, 25 bp, Mus musculus
tgaagccgggatagccctacctgga

SEQ ID NO: 844534 - DNA, 25 bp, Mus musculus
tgaagccgggattgccctacctgga

SEQ ID NO: 844535 - DNA, 25 bp, Mus musculus
tgaagccgtcctaccgcaatgccat

SEQ ID NO: 844536 - DNA, 25 bp, Mus musculus
tgaagccgtccttccgcaatgccat

SEQ ID NO: 844537 - DNA, 25 bp, Mus musculus
tgaagccgtctcagtagcattttcc

SEQ ID NO: 844538 - DNA, 25 bp, Mus musculus
tgaagccgtctctgtagcattttcc

SEQ ID NO: 844539 - DNA, 25 bp, Mus musculus
tgaagcctaaaaaggctcatttgag

SEQ ID NO: 844540 - DNA, 25 bp, Mus musculus
tgaagcctaaaatggctcatttgag

SEQ ID NO: 844541 - DNA, 25 bp, Mus musculus
tgaagcctaaatacacatggcagca

SEQ ID NO: 844542 - DNA, 25 bp, Mus musculus
tgaagcctaaattcacatggcagca

SEQ ID NO: 844543 - DNA, 25 bp, Mus musculus
tgaagcctatgaagacgcgtgtcgt

SEQ ID NO: 844544 - DNA, 25 bp, Mus musculus
tgaagcctatgatgacgcgtgtcgt

SEQ ID NO: 844545 - DNA, 25 bp, Mus musculus
tgaagcctcaatccggtatgggcaa

SEQ ID NO: 844546 - DNA, 25 bp, Mus musculus
tgaagcctcaatgcggtatgggcaa

SEQ ID NO: 844547 - DNA, 25 bp, Mus musculus
tgaagcctcacacgtgtctggccgc

SEQ ID NO: 844548 - DNA, 25 bp, Mus musculus
tgaagcctcacaggtgtctggccgc

SEQ ID NO: 844549 - DNA, 25 bp, Mus musculus
tgaagcctcctcatgcttatgctca

SEQ ID NO: 844550 - DNA, 25 bp, Mus musculus
tgaagcctcctcttgcttatgctca

SEQ ID NO: 844551 - DNA, 25 bp, Mus musculus
tgaagcctccttagacatcaaacct

SEQ ID NO: 844552 - DNA, 25 bp, Mus musculus
tgaagcctcctttgacatcaaacct

SEQ ID NO: 844553 - DNA, 25 bp, Mus musculus
tgaagcctcgaaagcaacagccatt

SEQ ID NO: 844554 - DNA, 25 bp, Mus musculus
tgaagcctcgaatgcaacagccatt

SEQ ID NO: 844555 - DNA, 25 bp, Mus musculus
tgaagcctctgtacgtgtttatcac

SEQ ID NO: 844556 - DNA, 25 bp, Mus musculus
tgaagcctctgttcgtgtttatcac

SEQ ID NO: 844557 - DNA, 25 bp, Mus musculus
tgaagcctgcaacatggcatgtgtg

SEQ ID NO: 844558 - DNA, 25 bp, Mus musculus
tgaagcctgcaagatggcatgtgtg

SEQ ID NO: 844559 - DNA, 25 bp, Mus musculus
tgaagcctggatcattcgtcttctc

SEQ ID NO: 844560 - DNA, 25 bp, Mus musculus
tgaagcctggatgattcgtcttctc

SEQ ID NO: 844561 - DNA, 25 bp, Mus musculus
tgaagcctgggtaccatgcccagta

SEQ ID NO: 844562 - DNA, 25 bp, Mus musculus
tgaagcctgggttccatgcccagta

SEQ ID NO: 844563 - DNA, 25 bp, Mus musculus
tgaagcctgtgaattctctctcagg

SEQ ID NO: 844564 - DNA, 25 bp, Mus musculus
tgaagcctgtgatttctctctcagg

SEQ ID NO: 844565 - DNA, 25 bp, Mus musculus
tgaagcctgtgtacagcatcggcga

SEQ ID NO: 844566 - DNA, 25 bp, Mus musculus
tgaagcctgtgttcagcatcggcga

SEQ ID NO: 844567 - DNA, 25 bp, Mus musculus
tgaagcctgttcactgtttaaacca

SEQ ID NO: 844568 - DNA, 25 bp, Mus musculus
tgaagcctgttctctgtttaaacca

SEQ ID NO: 844569 - DNA, 25 bp, Mus musculus
tgaagccttaccaatgtcctgagtg

SEQ ID NO: 844570 - DNA, 25 bp, Mus musculus
tgaagccttacctatgtcctgagtg

SEQ ID NO: 844571 - DNA, 25 bp, Mus musculus
tgaagccttcgaaaaagttttccag

SEQ ID NO: 844572 - DNA, 25 bp, Mus musculus
tgaagccttcgataaagttttccag

SEQ ID NO: 844573 - DNA, 25 bp, Mus musculus
tgaagccttcttactagtccctaca

SEQ ID NO: 844574 - DNA, 25 bp, Mus musculus
tgaagccttcttagtctctgacctt

SEQ ID NO: 844575 - DNA, 25 bp, Mus musculus
tgaagccttctttctagtccctaca

SEQ ID NO: 844576 - DNA, 25 bp, Mus musculus
tgaagccttctttgtctctgacctt

SEQ ID NO: 844577 - DNA, 25 bp, Mus musculus
tgaagccttgctcctgacagtgttc

SEQ ID NO: 844578 - DNA, 25 bp, Mus musculus
tgaagccttgctgctgacagtgttc

SEQ ID NO: 844579 - DNA, 25 bp, Mus musculus
tgaagcctttacagcctgctgaata

SEQ ID NO: 844580 - DNA, 25 bp, Mus musculus
tgaagcctttactgcctgctgaata

SEQ ID NO: 844581 - DNA, 25 bp, Mus musculus
tgaagcctttagatcccacagagcc

SEQ ID NO: 844582 - DNA, 25 bp, Mus musculus
tgaagcctttagttcccacagagcc

SEQ ID NO: 844583 - DNA, 25 bp, Mus musculus
tgaagccttttgctctgaccctgac

SEQ ID NO: 844584 - DNA, 25 bp, Mus musculus
tgaagccttttggtctgaccctgac

SEQ ID NO: 844585 - DNA, 25 bp, Mus musculus
tgaagcgaaccaaggatattaagga

SEQ ID NO: 844586 - DNA, 25 bp, Mus musculus
tgaagcgaaccatggatattaagga

SEQ ID NO: 844587 - DNA, 25 bp, Mus musculus
tgaagcgagcgcagtctcagtggct

SEQ ID NO: 844588 - DNA, 25 bp, Mus musculus
tgaagcgagcgctgtctcagtggct

SEQ ID NO: 844589 - DNA, 25 bp, Mus musculus
tgaagcgcagccagatatgtgtctt

SEQ ID NO: 844590 - DNA, 25 bp, Mus musculus
tgaagcgcagcctgatatgtgtctt

SEQ ID NO: 844591 - DNA, 25 bp, Mus musculus
tgaagcgctaggagcacttgctgct

SEQ ID NO: 844592 - DNA, 25 bp, Mus musculus
tgaagcgctaggtgcacttgctgct

SEQ ID NO: 844593 - DNA, 25 bp, Mus musculus
tgaagcgctttgctgagtctctgcc

SEQ ID NO: 844594 - DNA, 25 bp, Mus musculus
tgaagcgctttggtgagtctctgcc

SEQ ID NO: 844595 - DNA, 25 bp, Mus musculus
tgaagcggagatacgctacagggat

SEQ ID NO: 844596 - DNA, 25 bp, Mus musculus
tgaagcggagattcgctacagggat

SEQ ID NO: 844597 - DNA, 25 bp, Mus musculus
tgaagcggcagaatttgctgtatga

SEQ ID NO: 844598 - DNA, 25 bp, Mus musculus
tgaagcggcagattttgctgtatga

SEQ ID NO: 844599 - DNA, 25 bp, Mus musculus
tgaagcggctccaggttcctgtgat

SEQ ID NO: 844600 - DNA, 25 bp, Mus musculus
tgaagcggctcctggttcctgtgat

SEQ ID NO: 844601 - DNA, 25 bp, Mus musculus
tgaagcggcttcactatgacacctt

SEQ ID NO: 844602 - DNA, 25 bp, Mus musculus
tgaagcggcttctctatgacacctt

SEQ ID NO: 844603 - DNA, 25 bp, Mus musculus
tgaagcgggttcagaccacgattcc

SEQ ID NO: 844604 - DNA, 25 bp, Mus musculus
tgaagcgggttctgaccacgattcc

SEQ ID NO: 844605 - DNA, 25 bp, Mus musculus
tgaagcgttggtaggaactctgaaa

SEQ ID NO: 844606 - DNA, 25 bp, Mus musculus
tgaagcgttggttggaactctgaaa

SEQ ID NO: 844607 - DNA, 25 bp, Mus musculus
tgaagcgtttgaatcctctaggaaa

SEQ ID NO: 844608 - DNA, 25 bp, Mus musculus
tgaagcgtttgattcctctaggaaa

SEQ ID NO: 844609 - DNA, 25 bp, Mus musculus
tgaagcgttttgaccagtggctgaa

SEQ ID NO: 844610 - DNA, 25 bp, Mus musculus
tgaagcgttttgtccagtggctgaa

SEQ ID NO: 844611 - DNA, 25 bp, Mus musculus
tgaagctaacacactgaatacagaa

SEQ ID NO: 844612 - DNA, 25 bp, Mus musculus
tgaagctaacactctgaatacagaa

SEQ ID NO: 844613 - DNA, 25 bp, Mus musculus
tgaagctaactaaaatcctctgggt

SEQ ID NO: 844614 - DNA, 25 bp, Mus musculus
tgaagctaactataatcctctgggt

SEQ ID NO: 844615 - DNA, 25 bp, Mus musculus
tgaagctacaataccctgggctcaa

SEQ ID NO: 844616 - DNA, 25 bp, Mus musculus
tgaagctacaattccctgggctcaa

SEQ ID NO: 844617 - DNA, 25 bp, Mus musculus
tgaagctaccttcgcagggtcctcc

SEQ ID NO: 844618 - DNA, 25 bp, Mus musculus
tgaagctaccttggcagggtcctcc

SEQ ID NO: 844619 - DNA, 25 bp, Mus musculus
tgaagctactgaaggtggccacctt

SEQ ID NO: 844620 - DNA, 25 bp, Mus musculus
tgaagctactgatggtggccacctt

SEQ ID NO: 844621 - DNA, 25 bp, Mus musculus
tgaagctactgcacagacgggcaga

SEQ ID NO: 844622 - DNA, 25 bp, Mus musculus
tgaagctactgctcagacgggcaga

SEQ ID NO: 844623 - DNA, 25 bp, Mus musculus
tgaagctagacccacctgccatggc

SEQ ID NO: 844624 - DNA, 25 bp, Mus musculus
tgaagctagaccgacctgccatggc

SEQ ID NO: 844625 - DNA, 25 bp, Mus musculus
tgaagctagtgcaggcctccgaaga

SEQ ID NO: 844626 - DNA, 25 bp, Mus musculus
tgaagctagtgctggcctccgaaga

SEQ ID NO: 844627 - DNA, 25 bp, Mus musculus
tgaagctatagaacccaccgggcaa

SEQ ID NO: 844628 - DNA, 25 bp, Mus musculus
tgaagctatagatcccaccgggcaa

SEQ ID NO: 844629 - DNA, 25 bp, Mus musculus
tgaagctatcttaaccttccttttg

SEQ ID NO: 844630 - DNA, 25 bp, Mus musculus
tgaagctatctttaccttccttttg

SEQ ID NO: 844631 - DNA, 25 bp, Mus musculus
tgaagctatggaccctgtctgctga

SEQ ID NO: 844632 - DNA, 25 bp, Mus musculus
tgaagctatggagcctgtctgctga

SEQ ID NO: 844633 - DNA, 25 bp, Mus musculus
tgaagctattatctgccgactgcag

SEQ ID NO: 844634 - DNA, 25 bp, Mus musculus
tgaagctattatgtgccgactgcag

SEQ ID NO: 844635 - DNA, 25 bp, Mus musculus
tgaagctattgaaacagctggccga

SEQ ID NO: 844636 - DNA, 25 bp, Mus musculus
tgaagctattgatacagctggccga

SEQ ID NO: 844637 - DNA, 25 bp, Mus musculus
tgaagctcaatgacctgtaggccct

SEQ ID NO: 844638 - DNA, 25 bp, Mus musculus
tgaagctcaatgtcctgtaggccct

SEQ ID NO: 844639 - DNA, 25 bp, Mus musculus
tgaagctcacatcagagtgccgtcc

SEQ ID NO: 844640 - DNA, 25 bp, Mus musculus
tgaagctcacatgagagtgccgtcc

SEQ ID NO: 844641 - DNA, 25 bp, Mus musculus
tgaagctcacccagtatgaccagag

SEQ ID NO: 844642 - DNA, 25 bp, Mus musculus
tgaagctcaccctgtatgaccagag

SEQ ID NO: 844643 - DNA, 25 bp, Mus musculus
tgaagctcactcagtacctcaagga

SEQ ID NO: 844644 - DNA, 25 bp, Mus musculus
tgaagctcactctgtacctcaagga

SEQ ID NO: 844645 - DNA, 25 bp, Mus musculus
tgaagctcagtaaccattatttttg

SEQ ID NO: 844646 - DNA, 25 bp, Mus musculus
tgaagctcagtatccattatttttg

SEQ ID NO: 844647 - DNA, 25 bp, Mus musculus
tgaagctcagttccactccatgtac

SEQ ID NO: 844648 - DNA, 25 bp, Mus musculus
tgaagctcagttgcactccatgtac

SEQ ID NO: 844649 - DNA, 25 bp, Mus musculus
tgaagctccagccaaatcccagtta

SEQ ID NO: 844650 - DNA, 25 bp, Mus musculus
tgaagctccagcgaaatcccagtta

SEQ ID NO: 844651 - DNA, 25 bp, Mus musculus
tgaagctccctcctatggcacttgg

SEQ ID NO: 844652 - DNA, 25 bp, Mus musculus
tgaagctccctcgtatggcacttgg

SEQ ID NO: 844653 - DNA, 25 bp, Mus musculus
tgaagctccggcatcctggacaccg

SEQ ID NO: 844654 - DNA, 25 bp, Mus musculus
tgaagctccggcttcctggacaccg

SEQ ID NO: 844655 - DNA, 25 bp, Mus musculus
tgaagctcctagacgggtagcctga

SEQ ID NO: 844656 - DNA, 25 bp, Mus musculus
tgaagctcctagtcgggtagcctga

SEQ ID NO: 844657 - DNA, 25 bp, Mus musculus
tgaagctcgccaacttgggatgcgt

SEQ ID NO: 844658 - DNA, 25 bp, Mus musculus
tgaagctcgccatcttgggatgcgt

SEQ ID NO: 844659 - DNA, 25 bp, Mus musculus
tgaagctctaggagtgcctgcttgc

SEQ ID NO: 844660 - DNA, 25 bp, Mus musculus
tgaagctctaggtgtgcctgcttgc

SEQ ID NO: 844661 - DNA, 25 bp, Mus musculus
tgaagctctcacaacatacaggaag

SEQ ID NO: 844662 - DNA, 25 bp, Mus musculus
tgaagctctcactacatacaggaag

SEQ ID NO: 844663 - DNA, 25 bp, Mus musculus
tgaagctctgcccaaacaatctgtg

SEQ ID NO: 844664 - DNA, 25 bp, Mus musculus
tgaagctctgccgaaacaatctgtg

SEQ ID NO: 844665 - DNA, 25 bp, Mus musculus
tgaagctctgttccccatactgagc

SEQ ID NO: 844666 - DNA, 25 bp, Mus musculus
tgaagctctgttgcccatactgagc

SEQ ID NO: 844667 - DNA, 25 bp, Mus musculus
tgaagctcttttactaccccggcgg

SEQ ID NO: 844668 - DNA, 25 bp, Mus musculus
tgaagctctttttctaccccggcgg

SEQ ID NO: 844669 - DNA, 25 bp, Mus musculus
tgaagctgaattcctgctgctgcat

SEQ ID NO: 844670 - DNA, 25 bp, Mus musculus
tgaagctgaattccttcctccatga

SEQ ID NO: 844671 - DNA, 25 bp, Mus musculus
tgaagctgaattgctgctgctgcat

SEQ ID NO: 844672 - DNA, 25 bp, Mus musculus
tgaagctgaattgcttcctccatga

SEQ ID NO: 844673 - DNA, 25 bp, Mus musculus
tgaagctgacaaaggtgaactgatc

SEQ ID NO: 844674 - DNA, 25 bp, Mus musculus
tgaagctgacaatggtgaactgatc

SEQ ID NO: 844675 - DNA, 25 bp, Mus musculus
tgaagctgacacacagtatcctgct

SEQ ID NO: 844676 - DNA, 25 bp, Mus musculus
tgaagctgacactcagtatcctgct

SEQ ID NO: 844677 - DNA, 25 bp, Mus musculus
tgaagctgacataaccacacctggc

SEQ ID NO: 844678 - DNA, 25 bp, Mus musculus
tgaagctgacattaccacacctggc

SEQ ID NO: 844679 - DNA, 25 bp, Mus musculus
tgaagctgaccgactttggctttgc

SEQ ID NO: 844680 - DNA, 25 bp, Mus musculus
tgaagctgaccgtctttggctttgc

SEQ ID NO: 844681 - DNA, 25 bp, Mus musculus
tgaagctgagggatcaccatcgcca

SEQ ID NO: 844682 - DNA, 25 bp, Mus musculus
tgaagctgagggttcaccatcgcca

SEQ ID NO: 844683 - DNA, 25 bp, Mus musculus
tgaagctgaggtccgcacactatac

SEQ ID NO: 844684 - DNA, 25 bp, Mus musculus
tgaagctgaggtgcgcacactatac

SEQ ID NO: 844685 - DNA, 25 bp, Mus musculus
tgaagctgatagctgcagccctctt

SEQ ID NO: 844686 - DNA, 25 bp, Mus musculus
tgaagctgataggtgcagccctctt

SEQ ID NO: 844687 - DNA, 25 bp, Mus musculus
tgaagctgatgaatatcagaaacca

SEQ ID NO: 844688 - DNA, 25 bp, Mus musculus
tgaagctgatgattatcagaaacca

SEQ ID NO: 844689 - DNA, 25 bp, Mus musculus
tgaagctgatgtcctccttgtgaga

SEQ ID NO: 844690 - DNA, 25 bp, Mus musculus
tgaagctgatgtgctccttgtgaga

SEQ ID NO: 844691 - DNA, 25 bp, Mus musculus
tgaagctgcactcaatggcaacggg

SEQ ID NO: 844692 - DNA, 25 bp, Mus musculus
tgaagctgcactgaatggcaacggg

SEQ ID NO: 844693 - DNA, 25 bp, Mus musculus
tgaagctgccagcatttttgcacac

SEQ ID NO: 844694 - DNA, 25 bp, Mus musculus
tgaagctgccaggatttttgcacac

SEQ ID NO: 844695 - DNA, 25 bp, Mus musculus
tgaagctgccatactggtaaagaag

SEQ ID NO: 844696 - DNA, 25 bp, Mus musculus
tgaagctgccattctggtaaagaag

SEQ ID NO: 844697 - DNA, 25 bp, Mus musculus
tgaagctgccctcagattggccagg

SEQ ID NO: 844698 - DNA, 25 bp, Mus musculus
tgaagctgccctgagattggccagg

SEQ ID NO: 844699 - DNA, 25 bp, Mus musculus
tgaagctgcttcaccagactgaggg

SEQ ID NO: 844700 - DNA, 25 bp, Mus musculus
tgaagctgcttctccagactgaggg

SEQ ID NO: 844701 - DNA, 25 bp, Mus musculus
tgaagctggactccctaacacctga

SEQ ID NO: 844702 - DNA, 25 bp, Mus musculus
tgaagctggactgcctaacacctga

SEQ ID NO: 844703 - DNA, 25 bp, Mus musculus
tgaagctggctccactctagtccca

SEQ ID NO: 844704 - DNA, 25 bp, Mus musculus
tgaagctggctcgactctagtccca

SEQ ID NO: 844705 - DNA, 25 bp, Mus musculus
tgaagctgggatagctctcctctga

SEQ ID NO: 844706 - DNA, 25 bp, Mus musculus
tgaagctgggattgctctcctctga

SEQ ID NO: 844707 - DNA, 25 bp, Mus musculus
tgaagctgggcgacgtccgttgatc

SEQ ID NO: 844708 - DNA, 25 bp, Mus musculus
tgaagctgggcgtcgtccgttgatc

SEQ ID NO: 844709 - DNA, 25 bp, Mus musculus
tgaagctgggctatcgagtctgcgc

SEQ ID NO: 844710 - DNA, 25 bp, Mus musculus
tgaagctgggctttcgagtctgcgc

SEQ ID NO: 844711 - DNA, 25 bp, Mus musculus
tgaagctggtggcagaaaacctgaa

SEQ ID NO: 844712 - DNA, 25 bp, Mus musculus
tgaagctggtgggagaaaacctgaa

SEQ ID NO: 844713 - DNA, 25 bp, Mus musculus
tgaagctgtcagctctcggtccaca

SEQ ID NO: 844714 - DNA, 25 bp, Mus musculus
tgaagctgtcaggtctcggtccaca

SEQ ID NO: 844715 - DNA, 25 bp, Mus musculus
tgaagctgtgcccactactgctttt

SEQ ID NO: 844716 - DNA, 25 bp, Mus musculus
tgaagctgtgccgactactgctttt

SEQ ID NO: 844717 - DNA, 25 bp, Mus musculus
tgaagctgtggtcagcactggcact

SEQ ID NO: 844718 - DNA, 25 bp, Mus musculus
tgaagctgtggtgagcactggcact

SEQ ID NO: 844719 - DNA, 25 bp, Mus musculus
tgaagctgtgtgacgcctcttctgt

SEQ ID NO: 844720 - DNA, 25 bp, Mus musculus
tgaagctgtgtgtcgcctcttctgt

SEQ ID NO: 844721 - DNA, 25 bp, Mus musculus
tgaagctgtgttctgtcagtgctcc

SEQ ID NO: 844722 - DNA, 25 bp, Mus musculus
tgaagctgtgttgtgtcagtgctcc

SEQ ID NO: 844723 - DNA, 25 bp, Mus musculus
tgaagctgttccaagtacccagatg

SEQ ID NO: 844724 - DNA, 25 bp, Mus musculus
tgaagctgttcccagtcatctgtat

SEQ ID NO: 844725 - DNA, 25 bp, Mus musculus
tgaagctgttccgagtcatctgtat

SEQ ID NO: 844726 - DNA, 25 bp, Mus musculus
tgaagctgttcctagtacccagatg

SEQ ID NO: 844727 - DNA, 25 bp, Mus musculus
tgaagctgttctatcccagacacac

SEQ ID NO: 844728 - DNA, 25 bp, Mus musculus
tgaagctgttctttcccagacacac

SEQ ID NO: 844729 - DNA, 25 bp, Mus musculus
tgaagcttacacacatacctgggag

SEQ ID NO: 844730 - DNA, 25 bp, Mus musculus
tgaagcttacactcatacctgggag

SEQ ID NO: 844731 - DNA, 25 bp, Mus musculus
tgaagcttattaccagcagcccggc

SEQ ID NO: 844732 - DNA, 25 bp, Mus musculus
tgaagcttattagcagcagcccggc

SEQ ID NO: 844733 - DNA, 25 bp, Mus musculus
tgaagcttcaaaccctggagtccca

SEQ ID NO: 844734 - DNA, 25 bp, Mus musculus
tgaagcttcaaagcctggagtccca

SEQ ID NO: 844735 - DNA, 25 bp, Mus musculus
tgaagcttcctgatggacggactgt

SEQ ID NO: 844736 - DNA, 25 bp, Mus musculus
tgaagcttcctgttggacggactgt

SEQ ID NO: 844737 - DNA, 25 bp, Mus musculus
tgaagcttcggaacatcctggacct

SEQ ID NO: 844738 - DNA, 25 bp, Mus musculus
tgaagcttcggatcatcctggacct

SEQ ID NO: 844739 - DNA, 25 bp, Mus musculus
tgaagcttcttgaatttgtctaaaa

SEQ ID NO: 844740 - DNA, 25 bp, Mus musculus
tgaagcttcttgtatttgtctaaaa

SEQ ID NO: 844741 - DNA, 25 bp, Mus musculus
tgaagcttgaggattctttagagaa

SEQ ID NO: 844742 - DNA, 25 bp, Mus musculus
tgaagcttgaggtttctttagagaa

SEQ ID NO: 844743 - DNA, 25 bp, Mus musculus
tgaagcttggctaggcatccacgat

SEQ ID NO: 844744 - DNA, 25 bp, Mus musculus
tgaagcttggcttggcatccacgat

SEQ ID NO: 844745 - DNA, 25 bp, Mus musculus
tgaagctttgcaagaggacctgggt

SEQ ID NO: 844746 - DNA, 25 bp, Mus musculus
tgaagctttgcatgaggacctgggt

SEQ ID NO: 844747 - DNA, 25 bp, Mus musculus
tgaagcttttcactttccttcccct

SEQ ID NO: 844748 - DNA, 25 bp, Mus musculus
tgaagcttttcagtttccttcccct

SEQ ID NO: 844749 - DNA, 25 bp, Mus musculus
tgaagcttttgcatttcctcctcgt

SEQ ID NO: 844750 - DNA, 25 bp, Mus musculus
tgaagcttttgcttttcctcctcgt

SEQ ID NO: 844751 - DNA, 25 bp, Mus musculus
tgaagctttttcagagaccctaggg

SEQ ID NO: 844752 - DNA, 25 bp, Mus musculus
tgaagctttttctgagaccctaggg

SEQ ID NO: 844753 - DNA, 25 bp, Mus musculus
tgaaggaaaattagcatcactacct

SEQ ID NO: 844754 - DNA, 25 bp, Mus musculus
tgaaggaaaatttgcatcactacct

SEQ ID NO: 844755 - DNA, 25 bp, Mus musculus
tgaaggaaatgcacctgactccaga

SEQ ID NO: 844756 - DNA, 25 bp, Mus musculus
tgaaggaaatgctcctgactccaga

SEQ ID NO: 844757 - DNA, 25 bp, Mus musculus
tgaaggaacatgaccctgctgcctt

SEQ ID NO: 844758 - DNA, 25 bp, Mus musculus
tgaaggaacatgtccctgctgcctt

SEQ ID NO: 844759 - DNA, 25 bp, Mus musculus
tgaaggaaccttaataatattttct

SEQ ID NO: 844760 - DNA, 25 bp, Mus musculus
tgaaggaaccttccgcatccagaag

SEQ ID NO: 844761 - DNA, 25 bp, Mus musculus
tgaaggaaccttgcgcatccagaag

SEQ ID NO: 844762 - DNA, 25 bp, Mus musculus
tgaaggaacctttataatattttct

SEQ ID NO: 844763 - DNA, 25 bp, Mus musculus
tgaaggaactgcaggccattgccga

SEQ ID NO: 844764 - DNA, 25 bp, Mus musculus
tgaaggaactgctggccattgccga

SEQ ID NO: 844765 - DNA, 25 bp, Mus musculus
tgaaggaagcaccatactgcctgcc

SEQ ID NO: 844766 - DNA, 25 bp, Mus musculus
tgaaggaagcacgatactgcctgcc

SEQ ID NO: 844767 - DNA, 25 bp, Mus musculus
tgaaggaagcatcccgagccaacgt

SEQ ID NO: 844768 - DNA, 25 bp, Mus musculus
tgaaggaagcatgccgagccaacgt

SEQ ID NO: 844769 - DNA, 25 bp, Mus musculus
tgaaggaaggtaccatcggcgatat

SEQ ID NO: 844770 - DNA, 25 bp, Mus musculus
tgaaggaaggtagcatcggcgatat

SEQ ID NO: 844771 - DNA, 25 bp, Mus musculus
tgaaggaagtcacttgccactgtcc

SEQ ID NO: 844772 - DNA, 25 bp, Mus musculus
tgaaggaagtcagttgccactgtcc

SEQ ID NO: 844773 - DNA, 25 bp, Mus musculus
tgaaggaagtctacccagaagccag

SEQ ID NO: 844774 - DNA, 25 bp, Mus musculus
tgaaggaagtcttcccagaagccag

SEQ ID NO: 844775 - DNA, 25 bp, Mus musculus
tgaaggaagtgaaccggctgtgcca

SEQ ID NO: 844776 - DNA, 25 bp, Mus musculus
tgaaggaagtgatccggctgtgcca

SEQ ID NO: 844777 - DNA, 25 bp, Mus musculus
tgaaggaatccgaagaccccgacgt

SEQ ID NO: 844778 - DNA, 25 bp, Mus musculus
tgaaggaatccgtagaccccgacgt

SEQ ID NO: 844779 - DNA, 25 bp, Mus musculus
tgaaggaatcttataggcttctttt

SEQ ID NO: 844780 - DNA, 25 bp, Mus musculus
tgaaggaatcttttaggcttctttt

SEQ ID NO: 844781 - DNA, 25 bp, Mus musculus
tgaaggaattaccaacctgtgtccc

SEQ ID NO: 844782 - DNA, 25 bp, Mus musculus
tgaaggaattacgaacctgtgtccc

SEQ ID NO: 844783 - DNA, 25 bp, Mus musculus
tgaaggacaaccactgcacagatcc

SEQ ID NO: 844784 - DNA, 25 bp, Mus musculus
tgaaggacaacctctgcacagatcc

SEQ ID NO: 844785 - DNA, 25 bp, Mus musculus
tgaaggacacaaccacacattctgg

SEQ ID NO: 844786 - DNA, 25 bp, Mus musculus
tgaaggacacaagcacacattctgg

SEQ ID NO: 844787 - DNA, 25 bp, Mus musculus
tgaaggacacacctcgctgctcgat

SEQ ID NO: 844788 - DNA, 25 bp, Mus musculus
tgaaggacacacgtcgctgctcgat

SEQ ID NO: 844789 - DNA, 25 bp, Mus musculus
tgaaggacaggccttcccgtcagat

SEQ ID NO: 844790 - DNA, 25 bp, Mus musculus
tgaaggacaggcgttcccgtcagat

SEQ ID NO: 844791 - DNA, 25 bp, Mus musculus
tgaaggacatccactactccgtgaa

SEQ ID NO: 844792 - DNA, 25 bp, Mus musculus
tgaaggacatcctctactccgtgaa

SEQ ID NO: 844793 - DNA, 25 bp, Mus musculus
tgaaggaccaaccacgcaacagcaa

SEQ ID NO: 844794 - DNA, 25 bp, Mus musculus
tgaaggaccaacgacgcaacagcaa

SEQ ID NO: 844795 - DNA, 25 bp, Mus musculus
tgaaggaccaatacagggagctgat

SEQ ID NO: 844796 - DNA, 25 bp, Mus musculus
tgaaggaccaattcagggagctgat

SEQ ID NO: 844797 - DNA, 25 bp, Mus musculus
tgaaggaccccaccagcaaacattg

SEQ ID NO: 844798 - DNA, 25 bp, Mus musculus
tgaaggaccccagcagcaaacattg

SEQ ID NO: 844799 - DNA, 25 bp, Mus musculus
tgaaggacccgcaggtgctgtttgc

SEQ ID NO: 844800 - DNA, 25 bp, Mus musculus
tgaaggacccgctggtgctgtttgc

SEQ ID NO: 844801 - DNA, 25 bp, Mus musculus
tgaaggacccttacaggtttggctt

SEQ ID NO: 844802 - DNA, 25 bp, Mus musculus
tgaaggaccctttcaggtttggctt

SEQ ID NO: 844803 - DNA, 25 bp, Mus musculus
tgaaggaccgtccattctttgccgg

SEQ ID NO: 844804 - DNA, 25 bp, Mus musculus
tgaaggaccgtcgattctttgccgg

SEQ ID NO: 844805 - DNA, 25 bp, Mus musculus
tgaaggacctggagcctgtgcctgt

SEQ ID NO: 844806 - DNA, 25 bp, Mus musculus
tgaaggacctggtgcctgtgcctgt

SEQ ID NO: 844807 - DNA, 25 bp, Mus musculus
tgaaggacctgtatcattgctgccc

SEQ ID NO: 844808 - DNA, 25 bp, Mus musculus
tgaaggacctgtttcattgctgccc

SEQ ID NO: 844809 - DNA, 25 bp, Mus musculus
tgaaggacctttacatctctttctc

SEQ ID NO: 844810 - DNA, 25 bp, Mus musculus
tgaaggaccttttcatctctttctc

SEQ ID NO: 844811 - DNA, 25 bp, Mus musculus
tgaaggacgagccaagcccacgtgt

SEQ ID NO: 844812 - DNA, 25 bp, Mus musculus
tgaaggacgagcctcaaagcccagg

SEQ ID NO: 844813 - DNA, 25 bp, Mus musculus
tgaaggacgagcgaagcccacgtgt

SEQ ID NO: 844814 - DNA, 25 bp, Mus musculus
tgaaggacgagcgtcaaagcccagg

SEQ ID NO: 844815 - DNA, 25 bp, Mus musculus
tgaaggacgcggattagctgcctcg

SEQ ID NO: 844816 - DNA, 25 bp, Mus musculus
tgaaggacgcggtttagctgcctcg

SEQ ID NO: 844817 - DNA, 25 bp, Mus musculus
tgaaggacgtggacaaggaactctc

SEQ ID NO: 844818 - DNA, 25 bp, Mus musculus
tgaaggacgtggtcaaggaactctc

SEQ ID NO: 844819 - DNA, 25 bp, Mus musculus
tgaaggactggcagatctcacggca

SEQ ID NO: 844820 - DNA, 25 bp, Mus musculus
tgaaggactggctgatctcacggca

SEQ ID NO: 844821 - DNA, 25 bp, Mus musculus
tgaaggactgttaaaacttatttct

SEQ ID NO: 844822 - DNA, 25 bp, Mus musculus
tgaaggactgtttaaacttatttct

SEQ ID NO: 844823 - DNA, 25 bp, Mus musculus
tgaaggacttcaatgacacccctgc

SEQ ID NO: 844824 - DNA, 25 bp, Mus musculus
tgaaggacttcattgacacccctgc

SEQ ID NO: 844825 - DNA, 25 bp, Mus musculus
tgaaggactttcagccgtcacagta

SEQ ID NO: 844826 - DNA, 25 bp, Mus musculus
tgaaggactttctgccgtcacagta

SEQ ID NO: 844827 - DNA, 25 bp, Mus musculus
tgaaggactttgaaccttaccgcca

SEQ ID NO: 844828 - DNA, 25 bp, Mus musculus
tgaaggactttgtaccttaccgcca

SEQ ID NO: 844829 - DNA, 25 bp, Mus musculus
tgaaggagaccacacccctgagaaa

SEQ ID NO: 844830 - DNA, 25 bp, Mus musculus
tgaaggagaccaccagtaagcgcag

SEQ ID NO: 844831 - DNA, 25 bp, Mus musculus
tgaaggagaccagacccctgagaaa

SEQ ID NO: 844832 - DNA, 25 bp, Mus musculus
tgaaggagaccagcagtaagcgcag

SEQ ID NO: 844833 - DNA, 25 bp, Mus musculus
tgaaggagacgtattagttgttagg

SEQ ID NO: 844834 - DNA, 25 bp, Mus musculus
tgaaggagacgttttagttgttagg

SEQ ID NO: 844835 - DNA, 25 bp, Mus musculus
tgaaggagactcactaactggcttt

SEQ ID NO: 844836 - DNA, 25 bp, Mus musculus
tgaaggagactctctaactggcttt

SEQ ID NO: 844837 - DNA, 25 bp, Mus musculus
tgaaggagagaacccgccccttgga

SEQ ID NO: 844838 - DNA, 25 bp, Mus musculus
tgaaggagagaagccgccccttgga

SEQ ID NO: 844839 - DNA, 25 bp, Mus musculus
tgaaggagagacagtcccgcctcaa

SEQ ID NO: 844840 - DNA, 25 bp, Mus musculus
tgaaggagagactgtcccgcctcaa

SEQ ID NO: 844841 - DNA, 25 bp, Mus musculus
tgaaggagaggacccgcccgtttac

SEQ ID NO: 844842 - DNA, 25 bp, Mus musculus
tgaaggagaggagccgcccgtttac

SEQ ID NO: 844843 - DNA, 25 bp, Mus musculus
tgaaggagagtgctttatgctgaaa

SEQ ID NO: 844844 - DNA, 25 bp, Mus musculus
tgaaggagagtggtttatgctgaaa

SEQ ID NO: 844845 - DNA, 25 bp, Mus musculus
tgaaggagatctctcctgggccagc

SEQ ID NO: 844846 - DNA, 25 bp, Mus musculus
tgaaggagatctgtcctgggccagc

SEQ ID NO: 844847 - DNA, 25 bp, Mus musculus
tgaaggagcagaaggcctcttccca

SEQ ID NO: 844848 - DNA, 25 bp, Mus musculus
tgaaggagcagatggcctcttccca

SEQ ID NO: 844849 - DNA, 25 bp, Mus musculus
tgaaggagccttccatggagcctga

SEQ ID NO: 844850 - DNA, 25 bp, Mus musculus
tgaaggagccttgcatggagcctga

SEQ ID NO: 844851 - DNA, 25 bp, Mus musculus
tgaaggagctcactctgtcacgcag

SEQ ID NO: 844852 - DNA, 25 bp, Mus musculus
tgaaggagctcagtctgtcacgcag

SEQ ID NO: 844853 - DNA, 25 bp, Mus musculus
tgaaggaggcgcagcttcctgtctg

SEQ ID NO: 844854 - DNA, 25 bp, Mus musculus
tgaaggaggcgctgcttcctgtctg

SEQ ID NO: 844855 - DNA, 25 bp, Mus musculus
tgaaggaggtgacatgctgacaaaa

SEQ ID NO: 844856 - DNA, 25 bp, Mus musculus
tgaaggaggtgagatgctgacaaaa

SEQ ID NO: 844857 - DNA, 25 bp, Mus musculus
tgaaggaggtgcaatggcagcccat

SEQ ID NO: 844858 - DNA, 25 bp, Mus musculus
tgaaggaggtgctatggcagcccat

SEQ ID NO: 844859 - DNA, 25 bp, Mus musculus
tgaaggagtattcatggctgctcgc

SEQ ID NO: 844860 - DNA, 25 bp, Mus musculus
tgaaggagtattgatggctgctcgc

SEQ ID NO: 844861 - DNA, 25 bp, Mus musculus
tgaaggagtccaccaccagtgagca

SEQ ID NO: 844862 - DNA, 25 bp, Mus musculus
tgaaggagtccagcaccagtgagca

SEQ ID NO: 844863 - DNA, 25 bp, Mus musculus
tgaaggagtgacctgtgccctgcac

SEQ ID NO: 844864 - DNA, 25 bp, Mus musculus
tgaaggagtgacgtgtgccctgcac

SEQ ID NO: 844865 - DNA, 25 bp, Mus musculus
tgaaggagtgttactgcagtgcaaa

SEQ ID NO: 844866 - DNA, 25 bp, Mus musculus
tgaaggagtgtttctgcagtgcaaa

SEQ ID NO: 844867 - DNA, 25 bp, Mus musculus
tgaaggagtttcaatgtcccctcac

SEQ ID NO: 844868 - DNA, 25 bp, Mus musculus
tgaaggagtttctatgtcccctcac

SEQ ID NO: 844869 - DNA, 25 bp, Mus musculus
tgaaggataaccctgcgttttccat

SEQ ID NO: 844870 - DNA, 25 bp, Mus musculus
tgaaggataaccgtgcgttttccat

SEQ ID NO: 844871 - DNA, 25 bp, Mus musculus
tgaaggatctgcactccactctcag

SEQ ID NO: 844872 - DNA, 25 bp, Mus musculus
tgaaggatctgctctccactctcag

SEQ ID NO: 844873 - DNA, 25 bp, Mus musculus
tgaaggatgacacgaacatttttta

SEQ ID NO: 844874 - DNA, 25 bp, Mus musculus
tgaaggatgacacgtgagacccacc

SEQ ID NO: 844875 - DNA, 25 bp, Mus musculus
tgaaggatgacaggaacatttttta

SEQ ID NO: 844876 - DNA, 25 bp, Mus musculus
tgaaggatgacaggtgagacccacc

SEQ ID NO: 844877 - DNA, 25 bp, Mus musculus
tgaaggatgaccacatcctggttat

SEQ ID NO: 844878 - DNA, 25 bp, Mus musculus
tgaaggatgacctcatcctggttat

SEQ ID NO: 844879 - DNA, 25 bp, Mus musculus
tgaaggatgagcaggccggtttcac

SEQ ID NO: 844880 - DNA, 25 bp, Mus musculus
tgaaggatgagctggccggtttcac

SEQ ID NO: 844881 - DNA, 25 bp, Mus musculus
tgaaggatgctgagccatctccaag

SEQ ID NO: 844882 - DNA, 25 bp, Mus musculus
tgaaggatgctgtgccatctccaag

SEQ ID NO: 844883 - DNA, 25 bp, Mus musculus
tgaaggatggcccaggtccctgtca

SEQ ID NO: 844884 - DNA, 25 bp, Mus musculus
tgaaggatggccgaggtccctgtca

SEQ ID NO: 844885 - DNA, 25 bp, Mus musculus
tgaaggatggcgaggttctcgtgca

SEQ ID NO: 844886 - DNA, 25 bp, Mus musculus
tgaaggatggcgtggttctcgtgca

SEQ ID NO: 844887 - DNA, 25 bp, Mus musculus
tgaaggatgggcctttctctctctg

SEQ ID NO: 844888 - DNA, 25 bp, Mus musculus
tgaaggatgggcgtttctctctctg

SEQ ID NO: 844889 - DNA, 25 bp, Mus musculus
tgaaggcaaatgactgtaatcgtag

SEQ ID NO: 844890 - DNA, 25 bp, Mus musculus
tgaaggcaaatgtctgtaatcgtag

SEQ ID NO: 844891 - DNA, 25 bp, Mus musculus
tgaaggcaacgtagtttcccgagca

SEQ ID NO: 844892 - DNA, 25 bp, Mus musculus
tgaaggcaacgttgtttcccgagca

SEQ ID NO: 844893 - DNA, 25 bp, Mus musculus
tgaaggcaacttagatccccggcct

SEQ ID NO: 844894 - DNA, 25 bp, Mus musculus
tgaaggcaactttgatccccggcct

SEQ ID NO: 844895 - DNA, 25 bp, Mus musculus
tgaaggcaagccaaaggcctctttg

SEQ ID NO: 844896 - DNA, 25 bp, Mus musculus
tgaaggcaagccaacccgaggacga

SEQ ID NO: 844897 - DNA, 25 bp, Mus musculus
tgaaggcaagccctactgcaatcat

SEQ ID NO: 844898 - DNA, 25 bp, Mus musculus
tgaaggcaagccgtactgcaatcat

SEQ ID NO: 844899 - DNA, 25 bp, Mus musculus
tgaaggcaagcctaaggcctctttg

SEQ ID NO: 844900 - DNA, 25 bp, Mus musculus
tgaaggcaagcctacccgaggacga

SEQ ID NO: 844901 - DNA, 25 bp, Mus musculus
tgaaggcaatccctgcagcacaata

SEQ ID NO: 844902 - DNA, 25 bp, Mus musculus
tgaaggcaatccgtgcagcacaata

SEQ ID NO: 844903 - DNA, 25 bp, Mus musculus
tgaaggcaatgcagagtcttgtgaa

SEQ ID NO: 844904 - DNA, 25 bp, Mus musculus
tgaaggcaatgctgagtcttgtgaa

SEQ ID NO: 844905 - DNA, 25 bp, Mus musculus
tgaaggcacccaagcggccgggtcc

SEQ ID NO: 844906 - DNA, 25 bp, Mus musculus
tgaaggcacccatgcggccgggtcc

SEQ ID NO: 844907 - DNA, 25 bp, Mus musculus
tgaaggcaccgtcatctgtgtcact

SEQ ID NO: 844908 - DNA, 25 bp, Mus musculus
tgaaggcaccgtgatctgtgtcact

SEQ ID NO: 844909 - DNA, 25 bp, Mus musculus
tgaaggcacctcctttgagggtctc

SEQ ID NO: 844910 - DNA, 25 bp, Mus musculus
tgaaggcacctcgtttgagggtctc

SEQ ID NO: 844911 - DNA, 25 bp, Mus musculus
tgaaggcactgacgtgcgcttctgc

SEQ ID NO: 844912 - DNA, 25 bp, Mus musculus
tgaaggcactgaggtgcgcttctgc

SEQ ID NO: 844913 - DNA, 25 bp, Mus musculus
tgaaggcactgcaaacacaatgatt

SEQ ID NO: 844914 - DNA, 25 bp, Mus musculus
tgaaggcactgctaacacaatgatt

SEQ ID NO: 844915 - DNA, 25 bp, Mus musculus
tgaaggcacttcataatcccacaag

SEQ ID NO: 844916 - DNA, 25 bp, Mus musculus
tgaaggcacttcttaatcccacaag

SEQ ID NO: 844917 - DNA, 25 bp, Mus musculus
tgaaggcagactccgagtaccccac

SEQ ID NO: 844918 - DNA, 25 bp, Mus musculus
tgaaggcagactgcgagtaccccac

SEQ ID NO: 844919 - DNA, 25 bp, Mus musculus
tgaaggcagagaacgggacctcctc

SEQ ID NO: 844920 - DNA, 25 bp, Mus musculus
tgaaggcagagatcgggacctcctc

SEQ ID NO: 844921 - DNA, 25 bp, Mus musculus
tgaaggcaggatccaggcttccctt

SEQ ID NO: 844922 - DNA, 25 bp, Mus musculus
tgaaggcaggatgcaggcttccctt

SEQ ID NO: 844923 - DNA, 25 bp, Mus musculus
tgaaggcaggccctgttctctccta

SEQ ID NO: 844924 - DNA, 25 bp, Mus musculus
tgaaggcaggccgtgttctctccta

SEQ ID NO: 844925 - DNA, 25 bp, Mus musculus
tgaaggcatataccattctcccctg

SEQ ID NO: 844926 - DNA, 25 bp, Mus musculus
tgaaggcatatagcattctcccctg

SEQ ID NO: 844927 - DNA, 25 bp, Mus musculus
tgaaggcatcccagcccaagaagaa

SEQ ID NO: 844928 - DNA, 25 bp, Mus musculus
tgaaggcatccctgcccaagaagaa

SEQ ID NO: 844929 - DNA, 25 bp, Mus musculus
tgaaggcatgtgctcatggccaaat

SEQ ID NO: 844930 - DNA, 25 bp, Mus musculus
tgaaggcatgtggtcatggccaaat

SEQ ID NO: 844931 - DNA, 25 bp, Mus musculus
tgaaggccaactcgtgaggctgcca

SEQ ID NO: 844932 - DNA, 25 bp, Mus musculus
tgaaggccaactggtgaggctgcca

SEQ ID NO: 844933 - DNA, 25 bp, Mus musculus
tgaaggccaatgactttttcttttc

SEQ ID NO: 844934 - DNA, 25 bp, Mus musculus
tgaaggccaatgtctttttcttttc

SEQ ID NO: 844935 - DNA, 25 bp, Mus musculus
tgaaggccaccaacaggtagcagtg

SEQ ID NO: 844936 - DNA, 25 bp, Mus musculus
tgaaggccaccatcaggtagcagtg

SEQ ID NO: 844937 - DNA, 25 bp, Mus musculus
tgaaggccactgcacatctactcgg

SEQ ID NO: 844938 - DNA, 25 bp, Mus musculus
tgaaggccactggacatctactcgg

SEQ ID NO: 844939 - DNA, 25 bp, Mus musculus
tgaaggccagtacccctgggagcac

SEQ ID NO: 844940 - DNA, 25 bp, Mus musculus
tgaaggccagtagccctgggagcac

SEQ ID NO: 844941 - DNA, 25 bp, Mus musculus
tgaaggccatcacctggctacttgt

SEQ ID NO: 844942 - DNA, 25 bp, Mus musculus
tgaaggccatcagctggctacttgt

SEQ ID NO: 844943 - DNA, 25 bp, Mus musculus
tgaaggccatctccagctactttgt

SEQ ID NO: 844944 - DNA, 25 bp, Mus musculus
tgaaggccatctgcagctactttgt

SEQ ID NO: 844945 - DNA, 25 bp, Mus musculus
tgaaggccatgcacaacattgtccc

SEQ ID NO: 844946 - DNA, 25 bp, Mus musculus
tgaaggccatgctcaacattgtccc

SEQ ID NO: 844947 - DNA, 25 bp, Mus musculus
tgaaggcccagtccacttctggtcc

SEQ ID NO: 844948 - DNA, 25 bp, Mus musculus
tgaaggcccagtgcacttctggtcc

SEQ ID NO: 844949 - DNA, 25 bp, Mus musculus
tgaaggcccggaaggactaacctgt

SEQ ID NO: 844950 - DNA, 25 bp, Mus musculus
tgaaggcccggatggactaacctgt

SEQ ID NO: 844951 - DNA, 25 bp, Mus musculus
tgaaggccgtgcacgaacagctggc

SEQ ID NO: 844952 - DNA, 25 bp, Mus musculus
tgaaggccgtgctcgaacagctggc

SEQ ID NO: 844953 - DNA, 25 bp, Mus musculus
tgaaggcctcatcagcttcgaggaa

SEQ ID NO: 844954 - DNA, 25 bp, Mus musculus
tgaaggcctcatgagcttcgaggaa

SEQ ID NO: 844955 - DNA, 25 bp, Mus musculus
tgaaggcctcctctgtgttcaagat

SEQ ID NO: 844956 - DNA, 25 bp, Mus musculus
tgaaggcctcctgtgtgttcaagat

SEQ ID NO: 844957 - DNA, 25 bp, Mus musculus
tgaaggcctgccaggcacaggatcc

SEQ ID NO: 844958 - DNA, 25 bp, Mus musculus
tgaaggcctgcctggcacaggatcc

SEQ ID NO: 844959 - DNA, 25 bp, Mus musculus
tgaaggccttccctgcaccaactga

SEQ ID NO: 844960 - DNA, 25 bp, Mus musculus
tgaaggccttccgtgcaccaactga

SEQ ID NO: 844961 - DNA, 25 bp, Mus musculus
tgaaggcctttgacaccgaggacat

SEQ ID NO: 844962 - DNA, 25 bp, Mus musculus
tgaaggcctttgtcaccgaggacat

SEQ ID NO: 844963 - DNA, 25 bp, Mus musculus
tgaaggcgcaaactattctaggatt

SEQ ID NO: 844964 - DNA, 25 bp, Mus musculus
tgaaggcgcaaagtattctaggatt

SEQ ID NO: 844965 - DNA, 25 bp, Mus musculus
tgaaggcgcatgactggccatcgat

SEQ ID NO: 844966 - DNA, 25 bp, Mus musculus
tgaaggcgcatgtctggccatcgat

SEQ ID NO: 844967 - DNA, 25 bp, Mus musculus
tgaaggcggcaacctgtactaggta

SEQ ID NO: 844968 - DNA, 25 bp, Mus musculus
tgaaggcggcaagctgtactaggta

SEQ ID NO: 844969 - DNA, 25 bp, Mus musculus
tgaaggcggctcactcctcggaggc

SEQ ID NO: 844970 - DNA, 25 bp, Mus musculus
tgaaggcggctctctcctcggaggc

SEQ ID NO: 844971 - DNA, 25 bp, Mus musculus
tgaaggcgttgaacgtcttctggtc

SEQ ID NO: 844972 - DNA, 25 bp, Mus musculus
tgaaggcgttgatcgtcttctggtc

SEQ ID NO: 844973 - DNA, 25 bp, Mus musculus
tgaaggctaaaacccactccggctc

SEQ ID NO: 844974 - DNA, 25 bp, Mus musculus
tgaaggctaaaagccactccggctc

SEQ ID NO: 844975 - DNA, 25 bp, Mus musculus
tgaaggctaatccactctgagtaaa

SEQ ID NO: 844976 - DNA, 25 bp, Mus musculus
tgaaggctaatcgactctgagtaaa

SEQ ID NO: 844977 - DNA, 25 bp, Mus musculus
tgaaggctagcaccttgtcctgacc

SEQ ID NO: 844978 - DNA, 25 bp, Mus musculus
tgaaggctagcagcttgtcctgacc

SEQ ID NO: 844979 - DNA, 25 bp, Mus musculus
tgaaggctatttaccctccaacata

SEQ ID NO: 844980 - DNA, 25 bp, Mus musculus
tgaaggctattttccctccaacata

SEQ ID NO: 844981 - DNA, 25 bp, Mus musculus
tgaaggctcagtcgctcaaggacaa

SEQ ID NO: 844982 - DNA, 25 bp, Mus musculus
tgaaggctcagtggctcaaggacaa

SEQ ID NO: 844983 - DNA, 25 bp, Mus musculus
tgaaggctccatcagctggacacag

SEQ ID NO: 844984 - DNA, 25 bp, Mus musculus
tgaaggctccatgagctggacacag

SEQ ID NO: 844985 - DNA, 25 bp, Mus musculus
tgaaggctgacactctgctccaaga

SEQ ID NO: 844986 - DNA, 25 bp, Mus musculus
tgaaggctgacagtctgctccaaga

SEQ ID NO: 844987 - DNA, 25 bp, Mus musculus
tgaaggctgcctccctaataaaatg

SEQ ID NO: 844988 - DNA, 25 bp, Mus musculus
tgaaggctgcctgcctaataaaatg

SEQ ID NO: 844989 - DNA, 25 bp, Mus musculus
tgaaggctgcgcacactgtaacaca

SEQ ID NO: 844990 - DNA, 25 bp, Mus musculus
tgaaggctgcgctcactgtaacaca

SEQ ID NO: 844991 - DNA, 25 bp, Mus musculus
tgaaggctgctcagcgccttgaaag

SEQ ID NO: 844992 - DNA, 25 bp, Mus musculus
tgaaggctgctctgcgccttgaaag

SEQ ID NO: 844993 - DNA, 25 bp, Mus musculus
tgaaggctggccagactgtcacagt

SEQ ID NO: 844994 - DNA, 25 bp, Mus musculus
tgaaggctggcctgactgtcacagt

SEQ ID NO: 844995 - DNA, 25 bp, Mus musculus
tgaaggctgggaccgtgtactcaca

SEQ ID NO: 844996 - DNA, 25 bp, Mus musculus
tgaaggctgggagcgtgtactcaca

SEQ ID NO: 844997 - DNA, 25 bp, Mus musculus
tgaaggctgggtacctttggaaaca

SEQ ID NO: 844998 - DNA, 25 bp, Mus musculus
tgaaggctgggttcctttggaaaca

SEQ ID NO: 844999 - DNA, 25 bp, Mus musculus
tgaaggctgtcgaggtgcccgctgc

SEQ ID NO: 845000 - DNA, 25 bp, Mus musculus
tgaaggctgtcgtggtgcccgctgc

SEQ ID NO: 845001 - DNA, 25 bp, Mus musculus
tgaaggctgtctcccgagctctgag

SEQ ID NO: 845002 - DNA, 25 bp, Mus musculus
tgaaggctgtctgccgagctctgag

SEQ ID NO: 845003 - DNA, 25 bp, Mus musculus
tgaaggcttactaaaatcagagctt

SEQ ID NO: 845004 - DNA, 25 bp, Mus musculus
tgaaggcttacttaaatcagagctt

SEQ ID NO: 845005 - DNA, 25 bp, Mus musculus
tgaaggcttagaaggatctgggacc

SEQ ID NO: 845006 - DNA, 25 bp, Mus musculus
tgaaggcttagatggatctgggacc

SEQ ID NO: 845007 - DNA, 25 bp, Mus musculus
tgaaggcttccaaacccttgttaga

SEQ ID NO: 845008 - DNA, 25 bp, Mus musculus
tgaaggcttccatacccttgttaga

SEQ ID NO: 845009 - DNA, 25 bp, Mus musculus
tgaaggcttcgccaattgctctaag

SEQ ID NO: 845010 - DNA, 25 bp, Mus musculus
tgaaggcttcgcgaattgctctaag

SEQ ID NO: 845011 - DNA, 25 bp, Mus musculus
tgaaggcttgacaacctctggaaat

SEQ ID NO: 845012 - DNA, 25 bp, Mus musculus
tgaaggcttgacacactacgccagc

SEQ ID NO: 845013 - DNA, 25 bp, Mus musculus
tgaaggcttgactacctctggaaat

SEQ ID NO: 845014 - DNA, 25 bp, Mus musculus
tgaaggcttgactcactacgccagc

SEQ ID NO: 845015 - DNA, 25 bp, Mus musculus
tgaaggcttgcaagttgaccggctc

SEQ ID NO: 845016 - DNA, 25 bp, Mus musculus
tgaaggcttgcatgttgaccggctc

SEQ ID NO: 845017 - DNA, 25 bp, Mus musculus
tgaaggcttgttaaagtgtctaact

SEQ ID NO: 845018 - DNA, 25 bp, Mus musculus
tgaaggcttgtttaagtgtctaact

SEQ ID NO: 845019 - DNA, 25 bp, Mus musculus
tgaaggcttttgctgcttgtccaca

SEQ ID NO: 845020 - DNA, 25 bp, Mus musculus
tgaaggcttttggtgcttgtccaca

SEQ ID NO: 845021 - DNA, 25 bp, Mus musculus
tgaagggaaatcctctatgtgttaa

SEQ ID NO: 845022 - DNA, 25 bp, Mus musculus
tgaagggaaatcgtctatgtgttaa

SEQ ID NO: 845023 - DNA, 25 bp, Mus musculus
tgaagggaacctagtcatgatgaca

SEQ ID NO: 845024 - DNA, 25 bp, Mus musculus
tgaagggaaccttgtcatgatgaca

SEQ ID NO: 845025 - DNA, 25 bp, Mus musculus
tgaagggaaggcagacttgctctct

SEQ ID NO: 845026 - DNA, 25 bp, Mus musculus
tgaagggaaggctgacttgctctct

SEQ ID NO: 845027 - DNA, 25 bp, Mus musculus
tgaagggaatgcctgtctgacagca

SEQ ID NO: 845028 - DNA, 25 bp, Mus musculus
tgaagggaatgcgtgtctgacagca

SEQ ID NO: 845029 - DNA, 25 bp, Mus musculus
tgaagggacagcaccatacctcact

SEQ ID NO: 845030 - DNA, 25 bp, Mus musculus
tgaagggacagctccatacctcact

SEQ ID NO: 845031 - DNA, 25 bp, Mus musculus
tgaagggagaccacagagcatcgct

SEQ ID NO: 845032 - DNA, 25 bp, Mus musculus
tgaagggagacctcagagcatcgct

SEQ ID NO: 845033 - DNA, 25 bp, Mus musculus
tgaagggagctgctactgccatttc

SEQ ID NO: 845034 - DNA, 25 bp, Mus musculus
tgaagggagctggtactgccatttc

SEQ ID NO: 845035 - DNA, 25 bp, Mus musculus
tgaagggatgctctgtaaccaacca

SEQ ID NO: 845036 - DNA, 25 bp, Mus musculus
tgaagggatgctgtgtaaccaacca

SEQ ID NO: 845037 - DNA, 25 bp, Mus musculus
tgaagggcactgaccaagtggaaat

SEQ ID NO: 845038 - DNA, 25 bp, Mus musculus
tgaagggcactgtccaagtggaaat

SEQ ID NO: 845039 - DNA, 25 bp, Mus musculus
tgaagggcagaaaaccgtccaggtg

SEQ ID NO: 845040 - DNA, 25 bp, Mus musculus
tgaagggcagaataccgtccaggtg

SEQ ID NO: 845041 - DNA, 25 bp, Mus musculus
tgaagggcagacctatccaggcttt

SEQ ID NO: 845042 - DNA, 25 bp, Mus musculus
tgaagggcagacgtatccaggcttt

SEQ ID NO: 845043 - DNA, 25 bp, Mus musculus
tgaagggcagttacacacggcctgg

SEQ ID NO: 845044 - DNA, 25 bp, Mus musculus
tgaagggcagtttcacacggcctgg

SEQ ID NO: 845045 - DNA, 25 bp, Mus musculus
tgaagggccacgagacttactccta

SEQ ID NO: 845046 - DNA, 25 bp, Mus musculus
tgaagggccacgtgacttactccta

SEQ ID NO: 845047 - DNA, 25 bp, Mus musculus
tgaagggccattactcacctagata

SEQ ID NO: 845048 - DNA, 25 bp, Mus musculus
tgaagggccatttctcacctagata

SEQ ID NO: 845049 - DNA, 25 bp, Mus musculus
tgaagggccccgacaaattggaatt

SEQ ID NO: 845050 - DNA, 25 bp, Mus musculus
tgaagggccccgtcaaattggaatt

SEQ ID NO: 845051 - DNA, 25 bp, Mus musculus
tgaagggccctaactggctccttct

SEQ ID NO: 845052 - DNA, 25 bp, Mus musculus
tgaagggccctatctggctccttct

SEQ ID NO: 845053 - DNA, 25 bp, Mus musculus
tgaagggccgcaagtccctgagcca

SEQ ID NO: 845054 - DNA, 25 bp, Mus musculus
tgaagggccgcatgtccctgagcca

SEQ ID NO: 845055 - DNA, 25 bp, Mus musculus
tgaagggctctgagtcattaaacgt

SEQ ID NO: 845056 - DNA, 25 bp, Mus musculus
tgaagggctctgtgtcattaaacgt

SEQ ID NO: 845057 - DNA, 25 bp, Mus musculus
tgaagggctgcccattctgccgctg

SEQ ID NO: 845058 - DNA, 25 bp, Mus musculus
tgaagggctgccgattctgccgctg

SEQ ID NO: 845059 - DNA, 25 bp, Mus musculus
tgaagggtcaacactcttgacattt

SEQ ID NO: 845060 - DNA, 25 bp, Mus musculus
tgaagggtcaactctcttgacattt

SEQ ID NO: 845061 - DNA, 25 bp, Mus musculus
tgaagggtcccaactgtggcctgta

SEQ ID NO: 845062 - DNA, 25 bp, Mus musculus
tgaagggtcccatctgtggcctgta

SEQ ID NO: 845063 - DNA, 25 bp, Mus musculus
tgaagggtgacgaggcccaagcaaa

SEQ ID NO: 845064 - DNA, 25 bp, Mus musculus
tgaagggtgacgtggcccaagcaaa

SEQ ID NO: 845065 - DNA, 25 bp, Mus musculus
tgaagggtgactcctgctggttcta

SEQ ID NO: 845066 - DNA, 25 bp, Mus musculus
tgaagggtgactgctgctggttcta

SEQ ID NO: 845067 - DNA, 25 bp, Mus musculus
tgaagggtggcaattcccagagcct

SEQ ID NO: 845068 - DNA, 25 bp, Mus musculus
tgaagggtggcatttcccagagcct

SEQ ID NO: 845069 - DNA, 25 bp, Mus musculus
tgaagggttacacccgttaaaggat

SEQ ID NO: 845070 - DNA, 25 bp, Mus musculus
tgaagggttacagccgttaaaggat

SEQ ID NO: 845071 - DNA, 25 bp, Mus musculus
tgaagggttgccacatttacctcgg

SEQ ID NO: 845072 - DNA, 25 bp, Mus musculus
tgaagggttgcctcatttacctcgg

SEQ ID NO: 845073 - DNA, 25 bp, Mus musculus
tgaagggtttaccagagtgttttct

SEQ ID NO: 845074 - DNA, 25 bp, Mus musculus
tgaagggtttacgagagtgttttct

SEQ ID NO: 845075 - DNA, 25 bp, Mus musculus
tgaagggtttctctttgattccaca

SEQ ID NO: 845076 - DNA, 25 bp, Mus musculus
tgaagggtttctgtttgattccaca

SEQ ID NO: 845077 - DNA, 25 bp, Mus musculus
tgaaggtaacagcatctcctcgtgt

SEQ ID NO: 845078 - DNA, 25 bp, Mus musculus
tgaaggtaacaggatctcctcgtgt

SEQ ID NO: 845079 - DNA, 25 bp, Mus musculus
tgaaggtaaccacagccactctgag

SEQ ID NO: 845080 - DNA, 25 bp, Mus musculus
tgaaggtaaccagagccactctgag

SEQ ID NO: 845081 - DNA, 25 bp, Mus musculus
tgaaggtagacactttctgctggaa

SEQ ID NO: 845082 - DNA, 25 bp, Mus musculus
tgaaggtagacagtttctgctggaa

SEQ ID NO: 845083 - DNA, 25 bp, Mus musculus
tgaaggtagagcactaacataaact

SEQ ID NO: 845084 - DNA, 25 bp, Mus musculus
tgaaggtagagctctaacataaact

SEQ ID NO: 845085 - DNA, 25 bp, Mus musculus
tgaaggtagtgccacccatgggcta

SEQ ID NO: 845086 - DNA, 25 bp, Mus musculus
tgaaggtagtgcgacccatgggcta

SEQ ID NO: 845087 - DNA, 25 bp, Mus musculus
tgaaggtatgtgacccaggcaagga

SEQ ID NO: 845088 - DNA, 25 bp, Mus musculus
tgaaggtatgtgtcccaggcaagga

SEQ ID NO: 845089 - DNA, 25 bp, Mus musculus
tgaaggtcacaccaatgccctcatt

SEQ ID NO: 845090 - DNA, 25 bp, Mus musculus
tgaaggtcacacgaatgccctcatt

SEQ ID NO: 845091 - DNA, 25 bp, Mus musculus
tgaaggtcaccaacgtactgccttt

SEQ ID NO: 845092 - DNA, 25 bp, Mus musculus
tgaaggtcaccatcgtactgccttt

SEQ ID NO: 845093 - DNA, 25 bp, Mus musculus
tgaaggtcactcatggccacatagt

SEQ ID NO: 845094 - DNA, 25 bp, Mus musculus
tgaaggtcactcttggccacatagt

SEQ ID NO: 845095 - DNA, 25 bp, Mus musculus
tgaaggtccacaagggcacccatat

SEQ ID NO: 845096 - DNA, 25 bp, Mus musculus
tgaaggtccacatgggcacccatat

SEQ ID NO: 845097 - DNA, 25 bp, Mus musculus
tgaaggtcccctcgagagcacaagc

SEQ ID NO: 845098 - DNA, 25 bp, Mus musculus
tgaaggtcccctggagagcacaagc

SEQ ID NO: 845099 - DNA, 25 bp, Mus musculus
tgaaggtcgagacagcgacacaatc

SEQ ID NO: 845100 - DNA, 25 bp, Mus musculus
tgaaggtcgagagagcgacacaatc

SEQ ID NO: 845101 - DNA, 25 bp, Mus musculus
tgaaggtctcaaaacagctgttact

SEQ ID NO: 845102 - DNA, 25 bp, Mus musculus
tgaaggtctcaatacagctgttact

SEQ ID NO: 845103 - DNA, 25 bp, Mus musculus
tgaaggtctcccaggctgcctcaga

SEQ ID NO: 845104 - DNA, 25 bp, Mus musculus
tgaaggtctccctggctgcctcaga

SEQ ID NO: 845105 - DNA, 25 bp, Mus musculus
tgaaggtctcttcccagacgaactt

SEQ ID NO: 845106 - DNA, 25 bp, Mus musculus
tgaaggtctcttgccagacgaactt

SEQ ID NO: 845107 - DNA, 25 bp, Mus musculus
tgaaggtctgacagtagctcttagt

SEQ ID NO: 845108 - DNA, 25 bp, Mus musculus
tgaaggtctgactgtagctcttagt

SEQ ID NO: 845109 - DNA, 25 bp, Mus musculus
tgaaggtgacacattctgttctccc

SEQ ID NO: 845110 - DNA, 25 bp, Mus musculus
tgaaggtgacactttctgttctccc

SEQ ID NO: 845111 - DNA, 25 bp, Mus musculus
tgaaggtgacatagccaccactgac

SEQ ID NO: 845112 - DNA, 25 bp, Mus musculus
tgaaggtgacattgccaccactgac

SEQ ID NO: 845113 - DNA, 25 bp, Mus musculus
tgaaggtgactccagttcccagaac

SEQ ID NO: 845114 - DNA, 25 bp, Mus musculus
tgaaggtgactcgagttcccagaac

SEQ ID NO: 845115 - DNA, 25 bp, Mus musculus
tgaaggtgagtccaagatccctcct

SEQ ID NO: 845116 - DNA, 25 bp, Mus musculus
tgaaggtgagtcgaagatccctcct

SEQ ID NO: 845117 - DNA, 25 bp, Mus musculus
tgaaggtgattgacagctccctggg

SEQ ID NO: 845118 - DNA, 25 bp, Mus musculus
tgaaggtgattgtcagctccctggg

SEQ ID NO: 845119 - DNA, 25 bp, Mus musculus
tgaaggtgccaccatattcgtgcag

SEQ ID NO: 845120 - DNA, 25 bp, Mus musculus
tgaaggtgccacgatattcgtgcag

SEQ ID NO: 845121 - DNA, 25 bp, Mus musculus
tgaaggtgccttcctgtaggacagt

SEQ ID NO: 845122 - DNA, 25 bp, Mus musculus
tgaaggtgccttgctgtaggacagt

SEQ ID NO: 845123 - DNA, 25 bp, Mus musculus
tgaaggtgctctccgttccgtgtag

SEQ ID NO: 845124 - DNA, 25 bp, Mus musculus
tgaaggtgctctgcgttccgtgtag

SEQ ID NO: 845125 - DNA, 25 bp, Mus musculus
tgaaggtggaatagtcccagcttcg

SEQ ID NO: 845126 - DNA, 25 bp, Mus musculus
tgaaggtggaattgtcccagcttcg

SEQ ID NO: 845127 - DNA, 25 bp, Mus musculus
tgaaggtggtttaccagctgcggta

SEQ ID NO: 845128 - DNA, 25 bp, Mus musculus
tgaaggtggttttccagctgcggta

SEQ ID NO: 845129 - DNA, 25 bp, Mus musculus
tgaaggtgtagcagcccttgaggac

SEQ ID NO: 845130 - DNA, 25 bp, Mus musculus
tgaaggtgtagctgcccttgaggac

SEQ ID NO: 845131 - DNA, 25 bp, Mus musculus
tgaaggtgtcttctccaggaggttt

SEQ ID NO: 845132 - DNA, 25 bp, Mus musculus
tgaaggtgtcttgtccaggaggttt

SEQ ID NO: 845133 - DNA, 25 bp, Mus musculus
tgaaggtgttaaccctacacacact

SEQ ID NO: 845134 - DNA, 25 bp, Mus musculus
tgaaggtgttaagcctacacacact

SEQ ID NO: 845135 - DNA, 25 bp, Mus musculus
tgaaggttactaccaggttcttttt

SEQ ID NO: 845136 - DNA, 25 bp, Mus musculus
tgaaggttactagcaggttcttttt

SEQ ID NO: 845137 - DNA, 25 bp, Mus musculus
tgaaggttacttcccggatggtgtt

SEQ ID NO: 845138 - DNA, 25 bp, Mus musculus
tgaaggttacttgccggatggtgtt

SEQ ID NO: 845139 - DNA, 25 bp, Mus musculus
tgaaggttagttattgtcagctttt

SEQ ID NO: 845140 - DNA, 25 bp, Mus musculus
tgaaggttagtttttgtcagctttt

SEQ ID NO: 845141 - DNA, 25 bp, Mus musculus
tgaaggttatgaccaggagtcccca

SEQ ID NO: 845142 - DNA, 25 bp, Mus musculus
tgaaggttatgagcaggagtcccca

SEQ ID NO: 845143 - DNA, 25 bp, Mus musculus
tgaaggttatttaggccacctcctg

SEQ ID NO: 845144 - DNA, 25 bp, Mus musculus
tgaaggttattttggccacctcctg

SEQ ID NO: 845145 - DNA, 25 bp, Mus musculus
tgaaggttcaaaacctccttgcccg

SEQ ID NO: 845146 - DNA, 25 bp, Mus musculus
tgaaggttcaaatcctccttgcccg

SEQ ID NO: 845147 - DNA, 25 bp, Mus musculus
tgaaggttcccaaccatctatacag

SEQ ID NO: 845148 - DNA, 25 bp, Mus musculus
tgaaggttcccatccatctatacag

SEQ ID NO: 845149 - DNA, 25 bp, Mus musculus
tgaaggttccctcgttggttctcgt

SEQ ID NO: 845150 - DNA, 25 bp, Mus musculus
tgaaggttccctggttggttctcgt

SEQ ID NO: 845151 - DNA, 25 bp, Mus musculus
tgaaggttcctccatatcagctcgt

SEQ ID NO: 845152 - DNA, 25 bp, Mus musculus
tgaaggttcctcgatatcagctcgt

SEQ ID NO: 845153 - DNA, 25 bp, Mus musculus
tgaaggttctccactggttggtcct

SEQ ID NO: 845154 - DNA, 25 bp, Mus musculus
tgaaggttctcctctggttggtcct

SEQ ID NO: 845155 - DNA, 25 bp, Mus musculus
tgaaggttgcacagctcctgacgtg

SEQ ID NO: 845156 - DNA, 25 bp, Mus musculus
tgaaggttgcactgctcctgacgtg

SEQ ID NO: 845157 - DNA, 25 bp, Mus musculus
tgaaggtttattacccttgctttca

SEQ ID NO: 845158 - DNA, 25 bp, Mus musculus
tgaaggtttattccgcatcagtctc

SEQ ID NO: 845159 - DNA, 25 bp, Mus musculus
tgaaggtttattgcgcatcagtctc

SEQ ID NO: 845160 - DNA, 25 bp, Mus musculus
tgaaggtttatttcccttgctttca

SEQ ID NO: 845161 - DNA, 25 bp, Mus musculus
tgaaggtttcagacacccgatacct

SEQ ID NO: 845162 - DNA, 25 bp, Mus musculus
tgaaggtttcagtcacccgatacct

SEQ ID NO: 845163 - DNA, 25 bp, Mus musculus
tgaaggtttcctaacagcggtgtgg

SEQ ID NO: 845164 - DNA, 25 bp, Mus musculus
tgaaggtttccttacagcggtgtgg

SEQ ID NO: 845165 - DNA, 25 bp, Mus musculus
tgaaggtttcgtagttcttgttgtt

SEQ ID NO: 845166 - DNA, 25 bp, Mus musculus
tgaaggtttcgttgttcttgttgtt

SEQ ID NO: 845167 - DNA, 25 bp, Mus musculus
tgaaggtttgcacatggtcatgttc

SEQ ID NO: 845168 - DNA, 25 bp, Mus musculus
tgaaggtttgcagatggtcatgttc

SEQ ID NO: 845169 - DNA, 25 bp, Mus musculus
tgaaggtttgctagtacccataaag

SEQ ID NO: 845170 - DNA, 25 bp, Mus musculus
tgaaggtttgctcattctcccaaag

SEQ ID NO: 845171 - DNA, 25 bp, Mus musculus
tgaaggtttgctgattctcccaaag

SEQ ID NO: 845172 - DNA, 25 bp, Mus musculus
tgaaggtttgcttgtacccataaag

SEQ ID NO: 845173 - DNA, 25 bp, Mus musculus
tgaaggtttgtgagctcaattctgc

SEQ ID NO: 845174 - DNA, 25 bp, Mus musculus
tgaaggtttgtgcaactcccgcaaa

SEQ ID NO: 845175 - DNA, 25 bp, Mus musculus
tgaaggtttgtggaactcccgcaaa

SEQ ID NO: 845176 - DNA, 25 bp, Mus musculus
tgaaggtttgtgtgctcaattctgc

SEQ ID NO: 845177 - DNA, 25 bp, Mus musculus
tgaaggttttcaagcttacccgact

SEQ ID NO: 845178 - DNA, 25 bp, Mus musculus
tgaaggttttcatgcttacccgact

SEQ ID NO: 845179 - DNA, 25 bp, Mus musculus
tgaaggttttgcagaaggtaccttt

SEQ ID NO: 845180 - DNA, 25 bp, Mus musculus
tgaaggttttgctgaaggtaccttt

SEQ ID NO: 845181 - DNA, 25 bp, Mus musculus
tgaagtaacctgaccttgccacagt

SEQ ID NO: 845182 - DNA, 25 bp, Mus musculus
tgaagtaacctgtccttgccacagt

SEQ ID NO: 845183 - DNA, 25 bp, Mus musculus
tgaagtaacgccaagaagagcacat

SEQ ID NO: 845184 - DNA, 25 bp, Mus musculus
tgaagtaacgcctagaagagcacat

SEQ ID NO: 845185 - DNA, 25 bp, Mus musculus
tgaagtaagtacctgctgcaaaagc

SEQ ID NO: 845186 - DNA, 25 bp, Mus musculus
tgaagtaagtacgtgctgcaaaagc

SEQ ID NO: 845187 - DNA, 25 bp, Mus musculus
tgaagtaagtgaccgacccacccat

SEQ ID NO: 845188 - DNA, 25 bp, Mus musculus
tgaagtaagtgagcgacccacccat

SEQ ID NO: 845189 - DNA, 25 bp, Mus musculus
tgaagtaattctcgtaacatctaaa

SEQ ID NO: 845190 - DNA, 25 bp, Mus musculus
tgaagtaattctggtaacatctaaa

SEQ ID NO: 845191 - DNA, 25 bp, Mus musculus
tgaagtacaaaaactgccggcgatt

SEQ ID NO: 845192 - DNA, 25 bp, Mus musculus
tgaagtacaaaatctgccggcgatt

SEQ ID NO: 845193 - DNA, 25 bp, Mus musculus
tgaagtacaacacgccgcagagaac

SEQ ID NO: 845194 - DNA, 25 bp, Mus musculus
tgaagtacaacaggccgcagagaac

SEQ ID NO: 845195 - DNA, 25 bp, Mus musculus
tgaagtacactcctttctgatgatc

SEQ ID NO: 845196 - DNA, 25 bp, Mus musculus
tgaagtacactcgtttctgatgatc

SEQ ID NO: 845197 - DNA, 25 bp, Mus musculus
tgaagtacatccaacgatccctgtc

SEQ ID NO: 845198 - DNA, 25 bp, Mus musculus
tgaagtacatcctacgatccctgtc

SEQ ID NO: 845199 - DNA, 25 bp, Mus musculus
tgaagtaccacaaactgctctagtg

SEQ ID NO: 845200 - DNA, 25 bp, Mus musculus
tgaagtaccacatactgctctagtg

SEQ ID NO: 845201 - DNA, 25 bp, Mus musculus
tgaagtacccttctcagtattgagg

SEQ ID NO: 845202 - DNA, 25 bp, Mus musculus
tgaagtacccttgtcagtattgagg

SEQ ID NO: 845203 - DNA, 25 bp, Mus musculus
tgaagtaccggaaccgtgtgcgcag

SEQ ID NO: 845204 - DNA, 25 bp, Mus musculus
tgaagtaccggatccgtgtgcgcag

SEQ ID NO: 845205 - DNA, 25 bp, Mus musculus
tgaagtacgaggacgccatccagtt

SEQ ID NO: 845206 - DNA, 25 bp, Mus musculus
tgaagtacgaggtcgccatccagtt

SEQ ID NO: 845207 - DNA, 25 bp, Mus musculus
tgaagtactcagaccgaagtgctcg

SEQ ID NO: 845208 - DNA, 25 bp, Mus musculus
tgaagtactcagtccgaagtgctcg

SEQ ID NO: 845209 - DNA, 25 bp, Mus musculus
tgaagtactcccctggcatctaaac

SEQ ID NO: 845210 - DNA, 25 bp, Mus musculus
tgaagtactcccgtggcatctaaac

SEQ ID NO: 845211 - DNA, 25 bp, Mus musculus
tgaagtagaacacccgtcactgctg

SEQ ID NO: 845212 - DNA, 25 bp, Mus musculus
tgaagtagaacagccgtcactgctg

SEQ ID NO: 845213 - DNA, 25 bp, Mus musculus
tgaagtagaccgacactccttcagg

SEQ ID NO: 845214 - DNA, 25 bp, Mus musculus
tgaagtagaccgtcactccttcagg

SEQ ID NO: 845215 - DNA, 25 bp, Mus musculus
tgaagtagagtcattgtgctctgag

SEQ ID NO: 845216 - DNA, 25 bp, Mus musculus
tgaagtagagtctttgtgctctgag

SEQ ID NO: 845217 - DNA, 25 bp, Mus musculus
tgaagtagagttctaagaccccact

SEQ ID NO: 845218 - DNA, 25 bp, Mus musculus
tgaagtagagttgtaagaccccact

SEQ ID NO: 845219 - DNA, 25 bp, Mus musculus
tgaagtagccctaaatcctaacttt

SEQ ID NO: 845220 - DNA, 25 bp, Mus musculus
tgaagtagcccttaatcctaacttt

SEQ ID NO: 845221 - DNA, 25 bp, Mus musculus
tgaagtagccgaaaccccacggtga

SEQ ID NO: 845222 - DNA, 25 bp, Mus musculus
tgaagtagccgataccccacggtga

SEQ ID NO: 845223 - DNA, 25 bp, Mus musculus
tgaagtagcgtgatggtcctcacac

SEQ ID NO: 845224 - DNA, 25 bp, Mus musculus
tgaagtagcgtgttggtcctcacac

SEQ ID NO: 845225 - DNA, 25 bp, Mus musculus
tgaagtagggctacctcactgtcca

SEQ ID NO: 845226 - DNA, 25 bp, Mus musculus
tgaagtagggcttcctcactgtcca

SEQ ID NO: 845227 - DNA, 25 bp, Mus musculus
tgaagtagtcctcgccctagttcta

SEQ ID NO: 845228 - DNA, 25 bp, Mus musculus
tgaagtagtcctggccctagttcta

SEQ ID NO: 845229 - DNA, 25 bp, Mus musculus
tgaagtagtctcactcatggtgtgc

SEQ ID NO: 845230 - DNA, 25 bp, Mus musculus
tgaagtagtctctctcatggtgtgc

SEQ ID NO: 845231 - DNA, 25 bp, Mus musculus
tgaagtagtgggatttgattgagtt

SEQ ID NO: 845232 - DNA, 25 bp, Mus musculus
tgaagtagtgggttttgattgagtt

SEQ ID NO: 845233 - DNA, 25 bp, Mus musculus
tgaagtataccactagcccaagact

SEQ ID NO: 845234 - DNA, 25 bp, Mus musculus
tgaagtataccagtagcccaagact

SEQ ID NO: 845235 - DNA, 25 bp, Mus musculus
tgaagtatagcacgccgactcactc

SEQ ID NO: 845236 - DNA, 25 bp, Mus musculus
tgaagtatagcaggccgactcactc

SEQ ID NO: 845237 - DNA, 25 bp, Mus musculus
tgaagtatcagcaccgttcctgggc

SEQ ID NO: 845238 - DNA, 25 bp, Mus musculus
tgaagtatcagctccgttcctgggc

SEQ ID NO: 845239 - DNA, 25 bp, Mus musculus
tgaagtatgacacctacagccgctt

SEQ ID NO: 845240 - DNA, 25 bp, Mus musculus
tgaagtatgacagctacagccgctt

SEQ ID NO: 845241 - DNA, 25 bp, Mus musculus
tgaagtatgtccacaacactgccag

SEQ ID NO: 845242 - DNA, 25 bp, Mus musculus
tgaagtatgtcctcaacactgccag

SEQ ID NO: 845243 - DNA, 25 bp, Mus musculus
tgaagtattaccatgtctgctaaat

SEQ ID NO: 845244 - DNA, 25 bp, Mus musculus
tgaagtattaccttgtctgctaaat

SEQ ID NO: 845245 - DNA, 25 bp, Mus musculus
tgaagtatttctcccacatgtatct

SEQ ID NO: 845246 - DNA, 25 bp, Mus musculus
tgaagtatttctgccacatgtatct

SEQ ID NO: 845247 - DNA, 25 bp, Mus musculus
tgaagtcaacccagtccttaagtcc

SEQ ID NO: 845248 - DNA, 25 bp, Mus musculus
tgaagtcaaccctgtccttaagtcc

SEQ ID NO: 845249 - DNA, 25 bp, Mus musculus
tgaagtcaactgacactcctgtggc

SEQ ID NO: 845250 - DNA, 25 bp, Mus musculus
tgaagtcaactgtcactcctgtggc

SEQ ID NO: 845251 - DNA, 25 bp, Mus musculus
tgaagtcaatccacatttggccact

SEQ ID NO: 845252 - DNA, 25 bp, Mus musculus
tgaagtcaatcctcatttggccact

SEQ ID NO: 845253 - DNA, 25 bp, Mus musculus
tgaagtcacatacctgactcatgac

SEQ ID NO: 845254 - DNA, 25 bp, Mus musculus
tgaagtcacatagctgactcatgac

SEQ ID NO: 845255 - DNA, 25 bp, Mus musculus
tgaagtcactgaacccagcaatagg

SEQ ID NO: 845256 - DNA, 25 bp, Mus musculus
tgaagtcactgatcccagcaatagg

SEQ ID NO: 845257 - DNA, 25 bp, Mus musculus
tgaagtcactttccctctgaatgga

SEQ ID NO: 845258 - DNA, 25 bp, Mus musculus
tgaagtcactttgcctctgaatgga

SEQ ID NO: 845259 - DNA, 25 bp, Mus musculus
tgaagtcagaatccgaaaccaccaa

SEQ ID NO: 845260 - DNA, 25 bp, Mus musculus
tgaagtcagaatgcgaaaccaccaa

SEQ ID NO: 845261 - DNA, 25 bp, Mus musculus
tgaagtcaggctatcaggccttcgt

SEQ ID NO: 845262 - DNA, 25 bp, Mus musculus
tgaagtcaggctttcaggccttcgt

SEQ ID NO: 845263 - DNA, 25 bp, Mus musculus
tgaagtcatcagacctgctcacatt

SEQ ID NO: 845264 - DNA, 25 bp, Mus musculus
tgaagtcatcagtcctgctcacatt

SEQ ID NO: 845265 - DNA, 25 bp, Mus musculus
tgaagtcattcactacagaaaggat

SEQ ID NO: 845266 - DNA, 25 bp, Mus musculus
tgaagtcattcagtacagaaaggat

SEQ ID NO: 845267 - DNA, 25 bp, Mus musculus
tgaagtcattctctagcctaagctg

SEQ ID NO: 845268 - DNA, 25 bp, Mus musculus
tgaagtcattctgtagcctaagctg

SEQ ID NO: 845269 - DNA, 25 bp, Mus musculus
tgaagtcatttccagtgtacacaag

SEQ ID NO: 845270 - DNA, 25 bp, Mus musculus
tgaagtcatttcgagtgtacacaag

SEQ ID NO: 845271 - DNA, 25 bp, Mus musculus
tgaagtccaaagaccaagcctcagc

SEQ ID NO: 845272 - DNA, 25 bp, Mus musculus
tgaagtccaaagtccaagcctcagc

SEQ ID NO: 845273 - DNA, 25 bp, Mus musculus
tgaagtccacatagagcaccccaga

SEQ ID NO: 845274 - DNA, 25 bp, Mus musculus
tgaagtccacattgagcaccccaga

SEQ ID NO: 845275 - DNA, 25 bp, Mus musculus
tgaagtccagaaagatggccacatt

SEQ ID NO: 845276 - DNA, 25 bp, Mus musculus
tgaagtccagaacccatcagtgacc

SEQ ID NO: 845277 - DNA, 25 bp, Mus musculus
tgaagtccagaagccatcagtgacc

SEQ ID NO: 845278 - DNA, 25 bp, Mus musculus
tgaagtccagaatgatggccacatt

SEQ ID NO: 845279 - DNA, 25 bp, Mus musculus
tgaagtccagtacacatctccacgg

SEQ ID NO: 845280 - DNA, 25 bp, Mus musculus
tgaagtccagtagacatctccacgg

SEQ ID NO: 845281 - DNA, 25 bp, Mus musculus
tgaagtccatagatcctgtcgggca

SEQ ID NO: 845282 - DNA, 25 bp, Mus musculus
tgaagtccatagttcctgtcgggca

SEQ ID NO: 845283 - DNA, 25 bp, Mus musculus
tgaagtccatgcaagcacagagaca

SEQ ID NO: 845284 - DNA, 25 bp, Mus musculus
tgaagtccatgctagcacagagaca

SEQ ID NO: 845285 - DNA, 25 bp, Mus musculus
tgaagtcccaatcccttcgattcag

SEQ ID NO: 845286 - DNA, 25 bp, Mus musculus
tgaagtcccaatgccttcgattcag

SEQ ID NO: 845287 - DNA, 25 bp, Mus musculus
tgaagtcccaggaatcccgggtcca

SEQ ID NO: 845288 - DNA, 25 bp, Mus musculus
tgaagtcccaggtatcccgggtcca

SEQ ID NO: 845289 - DNA, 25 bp, Mus musculus
tgaagtcccatgagcaccttggtgt

SEQ ID NO: 845290 - DNA, 25 bp, Mus musculus
tgaagtcccatgtgcaccttggtgt

SEQ ID NO: 845291 - DNA, 25 bp, Mus musculus
tgaagtcccattaggagccacttac

SEQ ID NO: 845292 - DNA, 25 bp, Mus musculus
tgaagtcccatttggagccacttac

SEQ ID NO: 845293 - DNA, 25 bp, Mus musculus
tgaagtcccctgcaatcgcaaagga

SEQ ID NO: 845294 - DNA, 25 bp, Mus musculus
tgaagtcccctggaatcgcaaagga

SEQ ID NO: 845295 - DNA, 25 bp, Mus musculus
tgaagtccctgaactcaagaacacc

SEQ ID NO: 845296 - DNA, 25 bp, Mus musculus
tgaagtccctgatctcaagaacacc

SEQ ID NO: 845297 - DNA, 25 bp, Mus musculus
tgaagtccctttactcaggcaaata

SEQ ID NO: 845298 - DNA, 25 bp, Mus musculus
tgaagtcccttttctcaggcaaata

SEQ ID NO: 845299 - DNA, 25 bp, Mus musculus
tgaagtccgccacaaactccgtgat

SEQ ID NO: 845300 - DNA, 25 bp, Mus musculus
tgaagtccgccagaaactccgtgat

SEQ ID NO: 845301 - DNA, 25 bp, Mus musculus
tgaagtccggtactaatcccagttt

SEQ ID NO: 845302 - DNA, 25 bp, Mus musculus
tgaagtccggtagtaatcccagttt

SEQ ID NO: 845303 - DNA, 25 bp, Mus musculus
tgaagtccggttctggcccagttcg

SEQ ID NO: 845304 - DNA, 25 bp, Mus musculus
tgaagtccggttgtggcccagttcg

SEQ ID NO: 845305 - DNA, 25 bp, Mus musculus
tgaagtcctgaccactcagcctgat

SEQ ID NO: 845306 - DNA, 25 bp, Mus musculus
tgaagtcctgacgactcagcctgat

SEQ ID NO: 845307 - DNA, 25 bp, Mus musculus
tgaagtcctggaaaacctcttggcc

SEQ ID NO: 845308 - DNA, 25 bp, Mus musculus
tgaagtcctggataacctcttggcc

SEQ ID NO: 845309 - DNA, 25 bp, Mus musculus
tgaagtccttaaccccatgatcaat

SEQ ID NO: 845310 - DNA, 25 bp, Mus musculus
tgaagtccttaagcccatgatcaat

SEQ ID NO: 845311 - DNA, 25 bp, Mus musculus
tgaagtccttgtaaagcggtgatac

SEQ ID NO: 845312 - DNA, 25 bp, Mus musculus
tgaagtccttgttaagcggtgatac

SEQ ID NO: 845313 - DNA, 25 bp, Mus musculus
tgaagtcggcagactgtacctgggc

SEQ ID NO: 845314 - DNA, 25 bp, Mus musculus
tgaagtcggcagtctgtacctgggc

SEQ ID NO: 845315 - DNA, 25 bp, Mus musculus
tgaagtcggcgaccttaaaggatat

SEQ ID NO: 845316 - DNA, 25 bp, Mus musculus
tgaagtcggcgagcttaaaggatat

SEQ ID NO: 845317 - DNA, 25 bp, Mus musculus
tgaagtcgtcagaggcagtgtatac

SEQ ID NO: 845318 - DNA, 25 bp, Mus musculus
tgaagtcgtcagtggcagtgtatac

SEQ ID NO: 845319 - DNA, 25 bp, Mus musculus
tgaagtctaaccaccttccttcttg

SEQ ID NO: 845320 - DNA, 25 bp, Mus musculus
tgaagtctaacctccttccttcttg

SEQ ID NO: 845321 - DNA, 25 bp, Mus musculus
tgaagtctaggtctttccttatatc

SEQ ID NO: 845322 - DNA, 25 bp, Mus musculus
tgaagtctaggtgtttccttatatc

SEQ ID NO: 845323 - DNA, 25 bp, Mus musculus
tgaagtctcatgatgaagtttccta

SEQ ID NO: 845324 - DNA, 25 bp, Mus musculus
tgaagtctcatgttgaagtttccta

SEQ ID NO: 845325 - DNA, 25 bp, Mus musculus
tgaagtctctataacccaacactgg

SEQ ID NO: 845326 - DNA, 25 bp, Mus musculus
tgaagtctctattacccaacactgg

SEQ ID NO: 845327 - DNA, 25 bp, Mus musculus
tgaagtctctctcgcccattgtaag

SEQ ID NO: 845328 - DNA, 25 bp, Mus musculus
tgaagtctctctggcccattgtaag

SEQ ID NO: 845329 - DNA, 25 bp, Mus musculus
tgaagtctcttcaatgcctgcctgc

SEQ ID NO: 845330 - DNA, 25 bp, Mus musculus
tgaagtctcttctatgcctgcctgc

SEQ ID NO: 845331 - DNA, 25 bp, Mus musculus
tgaagtctgagcagcaggttccact

SEQ ID NO: 845332 - DNA, 25 bp, Mus musculus
tgaagtctgagctgcaggttccact

SEQ ID NO: 845333 - DNA, 25 bp, Mus musculus
tgaagtctgcatatccatggtggct

SEQ ID NO: 845334 - DNA, 25 bp, Mus musculus
tgaagtctgcatttccatggtggct

SEQ ID NO: 845335 - DNA, 25 bp, Mus musculus
tgaagtctgctaattgctgacggca

SEQ ID NO: 845336 - DNA, 25 bp, Mus musculus
tgaagtctgctatttgctgacggca

SEQ ID NO: 845337 - DNA, 25 bp, Mus musculus
tgaagtctggaccttttcatagccc

SEQ ID NO: 845338 - DNA, 25 bp, Mus musculus
tgaagtctggacgttttcatagccc

SEQ ID NO: 845339 - DNA, 25 bp, Mus musculus
tgaagtctggccagctctttggtac

SEQ ID NO: 845340 - DNA, 25 bp, Mus musculus
tgaagtctggcctgctctttggtac

SEQ ID NO: 845341 - DNA, 25 bp, Mus musculus
tgaagtctgtgtatggaccccaact

SEQ ID NO: 845342 - DNA, 25 bp, Mus musculus
tgaagtctgtgtttggaccccaact

SEQ ID NO: 845343 - DNA, 25 bp, Mus musculus
tgaagtcttgctaatcttcccgagt

SEQ ID NO: 845344 - DNA, 25 bp, Mus musculus
tgaagtcttgcttatcttcccgagt

SEQ ID NO: 845345 - DNA, 25 bp, Mus musculus
tgaagtcttgtcattcacttgtgac

SEQ ID NO: 845346 - DNA, 25 bp, Mus musculus
tgaagtcttgtctttcacttgtgac

SEQ ID NO: 845347 - DNA, 25 bp, Mus musculus
tgaagtgaagctcctcacagacttt

SEQ ID NO: 845348 - DNA, 25 bp, Mus musculus
tgaagtgaagctgctcacagacttt

SEQ ID NO: 845349 - DNA, 25 bp, Mus musculus
tgaagtgacaaaagggctcattctc

SEQ ID NO: 845350 - DNA, 25 bp, Mus musculus
tgaagtgacaaatgggctcattctc

SEQ ID NO: 845351 - DNA, 25 bp, Mus musculus
tgaagtgacctaaatccttttgaac

SEQ ID NO: 845352 - DNA, 25 bp, Mus musculus
tgaagtgacctatatccttttgaac

SEQ ID NO: 845353 - DNA, 25 bp, Mus musculus
tgaagtgacgtgagacccctgcaaa

SEQ ID NO: 845354 - DNA, 25 bp, Mus musculus
tgaagtgacgtgtgacccctgcaaa

SEQ ID NO: 845355 - DNA, 25 bp, Mus musculus
tgaagtgactaaccccagttcctgg

SEQ ID NO: 845356 - DNA, 25 bp, Mus musculus
tgaagtgactaagcccagttcctgg

SEQ ID NO: 845357 - DNA, 25 bp, Mus musculus
tgaagtgactacactgccacacata

SEQ ID NO: 845358 - DNA, 25 bp, Mus musculus
tgaagtgactactctgccacacata

SEQ ID NO: 845359 - DNA, 25 bp, Mus musculus
tgaagtgacttcacatccctggatc

SEQ ID NO: 845360 - DNA, 25 bp, Mus musculus
tgaagtgacttctcatccctggatc

SEQ ID NO: 845361 - DNA, 25 bp, Mus musculus
tgaagtgagaaccacatggagagat

SEQ ID NO: 845362 - DNA, 25 bp, Mus musculus
tgaagtgagaacgacatggagagat

SEQ ID NO: 845363 - DNA, 25 bp, Mus musculus
tgaagtgagagcacggcgaagccca

SEQ ID NO: 845364 - DNA, 25 bp, Mus musculus
tgaagtgagagctcggcgaagccca

SEQ ID NO: 845365 - DNA, 25 bp, Mus musculus
tgaagtgagtgaccctggacctcct

SEQ ID NO: 845366 - DNA, 25 bp, Mus musculus
tgaagtgagtgagcctggacctcct

SEQ ID NO: 845367 - DNA, 25 bp, Mus musculus
tgaagtgatgcaaaacccatgacaa

SEQ ID NO: 845368 - DNA, 25 bp, Mus musculus
tgaagtgatgcataacccatgacaa

SEQ ID NO: 845369 - DNA, 25 bp, Mus musculus
tgaagtgcacaccaagtgacctccg

SEQ ID NO: 845370 - DNA, 25 bp, Mus musculus
tgaagtgcacacgaagtgacctccg

SEQ ID NO: 845371 - DNA, 25 bp, Mus musculus
tgaagtgcacccagagcatcgcaag

SEQ ID NO: 845372 - DNA, 25 bp, Mus musculus
tgaagtgcaccctgagcatcgcaag

SEQ ID NO: 845373 - DNA, 25 bp, Mus musculus
tgaagtgcaggcagatacccgggcc

SEQ ID NO: 845374 - DNA, 25 bp, Mus musculus
tgaagtgcaggctgatacccgggcc

SEQ ID NO: 845375 - DNA, 25 bp, Mus musculus
tgaagtgcagtcaggtttgaaccca

SEQ ID NO: 845376 - DNA, 25 bp, Mus musculus
tgaagtgcagtcatgggaattacct

SEQ ID NO: 845377 - DNA, 25 bp, Mus musculus
tgaagtgcagtctggtttgaaccca

SEQ ID NO: 845378 - DNA, 25 bp, Mus musculus
tgaagtgcagtcttgggaattacct

SEQ ID NO: 845379 - DNA, 25 bp, Mus musculus
tgaagtgcattccagtcctctcaag

SEQ ID NO: 845380 - DNA, 25 bp, Mus musculus
tgaagtgcattcgagtcctctcaag

SEQ ID NO: 845381 - DNA, 25 bp, Mus musculus
tgaagtgcccacaagtatgttcttt

SEQ ID NO: 845382 - DNA, 25 bp, Mus musculus
tgaagtgcccactagtatgttcttt

SEQ ID NO: 845383 - DNA, 25 bp, Mus musculus
tgaagtgcccggatgaagcgccagc

SEQ ID NO: 845384 - DNA, 25 bp, Mus musculus
tgaagtgcccggttgaagcgccagc

SEQ ID NO: 845385 - DNA, 25 bp, Mus musculus
tgaagtgcctatctcctggaatccc

SEQ ID NO: 845386 - DNA, 25 bp, Mus musculus
tgaagtgcctatgtcctggaatccc

SEQ ID NO: 845387 - DNA, 25 bp, Mus musculus
tgaagtgcctccacggtgtggttcc

SEQ ID NO: 845388 - DNA, 25 bp, Mus musculus
tgaagtgcctcctcggtgtggttcc

SEQ ID NO: 845389 - DNA, 25 bp, Mus musculus
tgaagtgcctgccaactgctctttt

SEQ ID NO: 845390 - DNA, 25 bp, Mus musculus
tgaagtgcctgcgaactgctctttt

SEQ ID NO: 845391 - DNA, 25 bp, Mus musculus
tgaagtgcctggaggattcctaagt

SEQ ID NO: 845392 - DNA, 25 bp, Mus musculus
tgaagtgcctggtggattcctaagt

SEQ ID NO: 845393 - DNA, 25 bp, Mus musculus
tgaagtgccttgcatcagggattag

SEQ ID NO: 845394 - DNA, 25 bp, Mus musculus
tgaagtgccttggatcagggattag

SEQ ID NO: 845395 - DNA, 25 bp, Mus musculus
tgaagtgcgggtcagatccagacaa

SEQ ID NO: 845396 - DNA, 25 bp, Mus musculus
tgaagtgcgggtgagatccagacaa

SEQ ID NO: 845397 - DNA, 25 bp, Mus musculus
tgaagtgcgtgacacttctgtccct

SEQ ID NO: 845398 - DNA, 25 bp, Mus musculus
tgaagtgcgtgagacttctgtccct

SEQ ID NO: 845399 - DNA, 25 bp, Mus musculus
tgaagtgctgacaagagacgcgaga

SEQ ID NO: 845400 - DNA, 25 bp, Mus musculus
tgaagtgctgactagagacgcgaga

SEQ ID NO: 845401 - DNA, 25 bp, Mus musculus
tgaagtgctgctctacttggctact

SEQ ID NO: 845402 - DNA, 25 bp, Mus musculus
tgaagtgctgctgtacttggctact

SEQ ID NO: 845403 - DNA, 25 bp, Mus musculus
tgaagtgctttgctgctagtggctt

SEQ ID NO: 845404 - DNA, 25 bp, Mus musculus
tgaagtgctttggtgctagtggctt

SEQ ID NO: 845405 - DNA, 25 bp, Mus musculus
tgaagtggaccgagtaaacctggca

SEQ ID NO: 845406 - DNA, 25 bp, Mus musculus
tgaagtggaccgtgtaaacctggca

SEQ ID NO: 845407 - DNA, 25 bp, Mus musculus
tgaagtggacttactgcagggagac

SEQ ID NO: 845408 - DNA, 25 bp, Mus musculus
tgaagtggactttctgcagggagac

SEQ ID NO: 845409 - DNA, 25 bp, Mus musculus
tgaagtggcggcagttccaaaccct

SEQ ID NO: 845410 - DNA, 25 bp, Mus musculus
tgaagtggcggctgttccaaaccct

SEQ ID NO: 845411 - DNA, 25 bp, Mus musculus
tgaagtggctcgcactgaggctcct

SEQ ID NO: 845412 - DNA, 25 bp, Mus musculus
tgaagtggctcggactgaggctcct

SEQ ID NO: 845413 - DNA, 25 bp, Mus musculus
tgaagtggctttccaccccgacgag

SEQ ID NO: 845414 - DNA, 25 bp, Mus musculus
tgaagtggctttgcaccccgacgag

SEQ ID NO: 845415 - DNA, 25 bp, Mus musculus
tgaagtggtatgctctctgcaagaa

SEQ ID NO: 845416 - DNA, 25 bp, Mus musculus
tgaagtggtatggtctctgcaagaa

SEQ ID NO: 845417 - DNA, 25 bp, Mus musculus
tgaagtggtctcattgcttggactc

SEQ ID NO: 845418 - DNA, 25 bp, Mus musculus
tgaagtggtctctttgcttggactc

SEQ ID NO: 845419 - DNA, 25 bp, Mus musculus
tgaagtggtgcgaccatgctacctc

SEQ ID NO: 845420 - DNA, 25 bp, Mus musculus
tgaagtggtgcgtccatgctacctc

SEQ ID NO: 845421 - DNA, 25 bp, Mus musculus
tgaagtggttggctctgcacatcca

SEQ ID NO: 845422 - DNA, 25 bp, Mus musculus
tgaagtggttgggtctgcacatcca

SEQ ID NO: 845423 - DNA, 25 bp, Mus musculus
tgaagtgtacccagagcccctggta

SEQ ID NO: 845424 - DNA, 25 bp, Mus musculus
tgaagtgtaccctgagcccctggta

SEQ ID NO: 845425 - DNA, 25 bp, Mus musculus
tgaagtgtacgtcccaacctgctgg

SEQ ID NO: 845426 - DNA, 25 bp, Mus musculus
tgaagtgtacgtgccaacctgctgg

SEQ ID NO: 845427 - DNA, 25 bp, Mus musculus
tgaagtgtatgaaacctgctgcccc

SEQ ID NO: 845428 - DNA, 25 bp, Mus musculus
tgaagtgtatgatacctgctgcccc

SEQ ID NO: 845429 - DNA, 25 bp, Mus musculus
tgaagtgtattcatagccaggcatg

SEQ ID NO: 845430 - DNA, 25 bp, Mus musculus
tgaagtgtattcttagccaggcatg

SEQ ID NO: 845431 - DNA, 25 bp, Mus musculus
tgaagtgtcaataactggccagaat

SEQ ID NO: 845432 - DNA, 25 bp, Mus musculus
tgaagtgtcaattactggccagaat

SEQ ID NO: 845433 - DNA, 25 bp, Mus musculus
tgaagtgtccagatcaccttatctc

SEQ ID NO: 845434 - DNA, 25 bp, Mus musculus
tgaagtgtccagttcaccttatctc

SEQ ID NO: 845435 - DNA, 25 bp, Mus musculus
tgaagtgtcccaaaggtgtccctcg

SEQ ID NO: 845436 - DNA, 25 bp, Mus musculus
tgaagtgtcccaccaattgttgatg

SEQ ID NO: 845437 - DNA, 25 bp, Mus musculus
tgaagtgtcccagcaattgttgatg

SEQ ID NO: 845438 - DNA, 25 bp, Mus musculus
tgaagtgtcccataggtgtccctcg

SEQ ID NO: 845439 - DNA, 25 bp, Mus musculus
tgaagtgtccctcagccgaggagat

SEQ ID NO: 845440 - DNA, 25 bp, Mus musculus
tgaagtgtccctgagccgaggagat

SEQ ID NO: 845441 - DNA, 25 bp, Mus musculus
tgaagtgtcctcagcactggctgag

SEQ ID NO: 845442 - DNA, 25 bp, Mus musculus
tgaagtgtcctccagaagggccctg

SEQ ID NO: 845443 - DNA, 25 bp, Mus musculus
tgaagtgtcctcgagaagggccctg

SEQ ID NO: 845444 - DNA, 25 bp, Mus musculus
tgaagtgtcctctgcactggctgag

SEQ ID NO: 845445 - DNA, 25 bp, Mus musculus
tgaagtgtcttcacttgacagtcgt

SEQ ID NO: 845446 - DNA, 25 bp, Mus musculus
tgaagtgtcttctcttgacagtcgt

SEQ ID NO: 845447 - DNA, 25 bp, Mus musculus
tgaagtgtctttccctttgcctgtg

SEQ ID NO: 845448 - DNA, 25 bp, Mus musculus
tgaagtgtctttgcctttgcctgtg

SEQ ID NO: 845449 - DNA, 25 bp, Mus musculus
tgaagtgtgccaccctaagcctgcg

SEQ ID NO: 845450 - DNA, 25 bp, Mus musculus
tgaagtgtgccagcctaagcctgcg

SEQ ID NO: 845451 - DNA, 25 bp, Mus musculus
tgaagtgtgcccatccagccaggtc

SEQ ID NO: 845452 - DNA, 25 bp, Mus musculus
tgaagtgtgcccattgaaataaaac

SEQ ID NO: 845453 - DNA, 25 bp, Mus musculus
tgaagtgtgcccttccagccaggtc

SEQ ID NO: 845454 - DNA, 25 bp, Mus musculus
tgaagtgtgccctttgaaataaaac

SEQ ID NO: 845455 - DNA, 25 bp, Mus musculus
tgaagtgtgctgagtttcctttacc

SEQ ID NO: 845456 - DNA, 25 bp, Mus musculus
tgaagtgtgctgtgtttcctttacc

SEQ ID NO: 845457 - DNA, 25 bp, Mus musculus
tgaagtgtgtccctcatctgcaacc

SEQ ID NO: 845458 - DNA, 25 bp, Mus musculus
tgaagtgtgtccgtcatctgcaacc

SEQ ID NO: 845459 - DNA, 25 bp, Mus musculus
tgaagtgtgtgccacgcatctcaaa

SEQ ID NO: 845460 - DNA, 25 bp, Mus musculus
tgaagtgtgtgcgacgcatctcaaa

SEQ ID NO: 845461 - DNA, 25 bp, Mus musculus
tgaagtgttccacgacatgctaccc

SEQ ID NO: 845462 - DNA, 25 bp, Mus musculus
tgaagtgttccaggacatgctaccc

SEQ ID NO: 845463 - DNA, 25 bp, Mus musculus
tgaagtgttccgaccttgctatcag

SEQ ID NO: 845464 - DNA, 25 bp, Mus musculus
tgaagtgttccgtccttgctatcag

SEQ ID NO: 845465 - DNA, 25 bp, Mus musculus
tgaagtgttcttctaacccttcagg

SEQ ID NO: 845466 - DNA, 25 bp, Mus musculus
tgaagtgttcttgtaacccttcagg

SEQ ID NO: 845467 - DNA, 25 bp, Mus musculus
tgaagtgttgctacttctactgcca

SEQ ID NO: 845468 - DNA, 25 bp, Mus musculus
tgaagtgttgcttcttctactgcca

SEQ ID NO: 845469 - DNA, 25 bp, Mus musculus
tgaagtgtttgcagctatctccaca

SEQ ID NO: 845470 - DNA, 25 bp, Mus musculus
tgaagtgtttgctgctatctccaca

SEQ ID NO: 845471 - DNA, 25 bp, Mus musculus
tgaagtgtttttcgacaggcgagaa

SEQ ID NO: 845472 - DNA, 25 bp, Mus musculus
tgaagtgtttttggacaggcgagaa

SEQ ID NO: 845473 - DNA, 25 bp, Mus musculus
tgaagttaaaacagaagctaagagt

SEQ ID NO: 845474 - DNA, 25 bp, Mus musculus
tgaagttaaaactgaagctaagagt

SEQ ID NO: 845475 - DNA, 25 bp, Mus musculus
tgaagttaattcaagaacccctcgt

SEQ ID NO: 845476 - DNA, 25 bp, Mus musculus
tgaagttaattctagaacccctcgt

SEQ ID NO: 845477 - DNA, 25 bp, Mus musculus
tgaagttacactcctctacaactgt

SEQ ID NO: 845478 - DNA, 25 bp, Mus musculus
tgaagttacactgctctacaactgt

SEQ ID NO: 845479 - DNA, 25 bp, Mus musculus
tgaagttaccagatctagtccaagc

SEQ ID NO: 845480 - DNA, 25 bp, Mus musculus
tgaagttaccagttctagtccaagc

SEQ ID NO: 845481 - DNA, 25 bp, Mus musculus
tgaagttaccttccattttgtcaca

SEQ ID NO: 845482 - DNA, 25 bp, Mus musculus
tgaagttaccttgcattttgtcaca

SEQ ID NO: 845483 - DNA, 25 bp, Mus musculus
tgaagttacggaagctgaaacactg

SEQ ID NO: 845484 - DNA, 25 bp, Mus musculus
tgaagttacggatgctgaaacactg

SEQ ID NO: 845485 - DNA, 25 bp, Mus musculus
tgaagttactggctcctcatgtgtc

SEQ ID NO: 845486 - DNA, 25 bp, Mus musculus
tgaagttactgggtcctcatgtgtc

SEQ ID NO: 845487 - DNA, 25 bp, Mus musculus
tgaagttaggatcattcttgactac

SEQ ID NO: 845488 - DNA, 25 bp, Mus musculus
tgaagttaggatgattcttgactac

SEQ ID NO: 845489 - DNA, 25 bp, Mus musculus
tgaagttaggtccaggctaccctga

SEQ ID NO: 845490 - DNA, 25 bp, Mus musculus
tgaagttaggtcgaggctaccctga

SEQ ID NO: 845491 - DNA, 25 bp, Mus musculus
tgaagttataataacttccttccct

SEQ ID NO: 845492 - DNA, 25 bp, Mus musculus
tgaagttataattacttccttccct

SEQ ID NO: 845493 - DNA, 25 bp, Mus musculus
tgaagttcaaatattactcactagt

SEQ ID NO: 845494 - DNA, 25 bp, Mus musculus
tgaagttcaaattttactcactagt

SEQ ID NO: 845495 - DNA, 25 bp, Mus musculus
tgaagttcaagcctcaggatccctg

SEQ ID NO: 845496 - DNA, 25 bp, Mus musculus
tgaagttcaagcgtcaggatccctg

SEQ ID NO: 845497 - DNA, 25 bp, Mus musculus
tgaagttcaaggatcgctgcagcag

SEQ ID NO: 845498 - DNA, 25 bp, Mus musculus
tgaagttcaaggttcgctgcagcag

SEQ ID NO: 845499 - DNA, 25 bp, Mus musculus
tgaagttcacaaacctgtaccactc

SEQ ID NO: 845500 - DNA, 25 bp, Mus musculus
tgaagttcacaatcctgtaccactc

SEQ ID NO: 845501 - DNA, 25 bp, Mus musculus
tgaagttcacccaggactgcactca

SEQ ID NO: 845502 - DNA, 25 bp, Mus musculus
tgaagttcaccctggactgcactca

SEQ ID NO: 845503 - DNA, 25 bp, Mus musculus
tgaagttcactacgtagccaggctg

SEQ ID NO: 845504 - DNA, 25 bp, Mus musculus
tgaagttcactaggtagccaggctg

SEQ ID NO: 845505 - DNA, 25 bp, Mus musculus
tgaagttcacttactagtggtaggc

SEQ ID NO: 845506 - DNA, 25 bp, Mus musculus
tgaagttcactttctagtggtaggc

SEQ ID NO: 845507 - DNA, 25 bp, Mus musculus
tgaagttcagcaacgaggatctcaa

SEQ ID NO: 845508 - DNA, 25 bp, Mus musculus
tgaagttcagcatcgaggatctcaa

SEQ ID NO: 845509 - DNA, 25 bp, Mus musculus
tgaagttcattgagccttttttctt

SEQ ID NO: 845510 - DNA, 25 bp, Mus musculus
tgaagttcattgtgccttttttctt

SEQ ID NO: 845511 - DNA, 25 bp, Mus musculus
tgaagttccactctccgttttaatt

SEQ ID NO: 845512 - DNA, 25 bp, Mus musculus
tgaagttccactgtccgttttaatt

SEQ ID NO: 845513 - DNA, 25 bp, Mus musculus
tgaagttcccaaattcttaagctaa

SEQ ID NO: 845514 - DNA, 25 bp, Mus musculus
tgaagttcccaatttcttaagctaa

SEQ ID NO: 845515 - DNA, 25 bp, Mus musculus
tgaagttcccgaagcctacaacatg

SEQ ID NO: 845516 - DNA, 25 bp, Mus musculus
tgaagttcccgatgcctacaacatg

SEQ ID NO: 845517 - DNA, 25 bp, Mus musculus
tgaagttcccgtcccaccggagagc

SEQ ID NO: 845518 - DNA, 25 bp, Mus musculus
tgaagttcccgtgccaccggagagc

SEQ ID NO: 845519 - DNA, 25 bp, Mus musculus
tgaagttccggcagactcatctgct

SEQ ID NO: 845520 - DNA, 25 bp, Mus musculus
tgaagttccggctgactcatctgct

SEQ ID NO: 845521 - DNA, 25 bp, Mus musculus
tgaagttccgtgacactcagagcta

SEQ ID NO: 845522 - DNA, 25 bp, Mus musculus
tgaagttccgtgtcactcagagcta

SEQ ID NO: 845523 - DNA, 25 bp, Mus musculus
tgaagttcgatgagctctaccacct

SEQ ID NO: 845524 - DNA, 25 bp, Mus musculus
tgaagttcgatgtgctctaccacct

SEQ ID NO: 845525 - DNA, 25 bp, Mus musculus
tgaagttctaatacagtgaccttag

SEQ ID NO: 845526 - DNA, 25 bp, Mus musculus
tgaagttctaattcagtgaccttag

SEQ ID NO: 845527 - DNA, 25 bp, Mus musculus
tgaagttctcagattttccagtgga

SEQ ID NO: 845528 - DNA, 25 bp, Mus musculus
tgaagttctcagtttttccagtgga

SEQ ID NO: 845529 - DNA, 25 bp, Mus musculus
tgaagttctctgataaagttctgaa

SEQ ID NO: 845530 - DNA, 25 bp, Mus musculus
tgaagttctctgttaaagttctgaa

SEQ ID NO: 845531 - DNA, 25 bp, Mus musculus
tgaagttctgttatctgaggttctt

SEQ ID NO: 845532 - DNA, 25 bp, Mus musculus
tgaagttctgttcaactcctacact

SEQ ID NO: 845533 - DNA, 25 bp, Mus musculus
tgaagttctgttgaactcctacact

SEQ ID NO: 845534 - DNA, 25 bp, Mus musculus
tgaagttctgttttctgaggttctt

SEQ ID NO: 845535 - DNA, 25 bp, Mus musculus
tgaagttgacgtctgacgacgtgaa

SEQ ID NO: 845536 - DNA, 25 bp, Mus musculus
tgaagttgacgtgtgacgacgtgaa

SEQ ID NO: 845537 - DNA, 25 bp, Mus musculus
tgaagttgagcaccagcccagattt

SEQ ID NO: 845538 - DNA, 25 bp, Mus musculus
tgaagttgagcagcagcccagattt

SEQ ID NO: 845539 - DNA, 25 bp, Mus musculus
tgaagttgcactagttcacctacca

SEQ ID NO: 845540 - DNA, 25 bp, Mus musculus
tgaagttgcacttgttcacctacca

SEQ ID NO: 845541 - DNA, 25 bp, Mus musculus
tgaagttgcaggctcatgtgtgcat

SEQ ID NO: 845542 - DNA, 25 bp, Mus musculus
tgaagttgcagggtcatgtgtgcat

SEQ ID NO: 845543 - DNA, 25 bp, Mus musculus
tgaagttgcataaggacccgtgttt

SEQ ID NO: 845544 - DNA, 25 bp, Mus musculus
tgaagttgcatatggacccgtgttt

SEQ ID NO: 845545 - DNA, 25 bp, Mus musculus
tgaagttgcatcaccacgtggatat

SEQ ID NO: 845546 - DNA, 25 bp, Mus musculus
tgaagttgcatctccacgtggatat

SEQ ID NO: 845547 - DNA, 25 bp, Mus musculus
tgaagttgccatcctttggctccaa

SEQ ID NO: 845548 - DNA, 25 bp, Mus musculus
tgaagttgccatgctttggctccaa

SEQ ID NO: 845549 - DNA, 25 bp, Mus musculus
tgaagttgcggcattcttctgcatt

SEQ ID NO: 845550 - DNA, 25 bp, Mus musculus
tgaagttgcggctttcttctgcatt

SEQ ID NO: 845551 - DNA, 25 bp, Mus musculus
tgaagttgctttataccccagcaga

SEQ ID NO: 845552 - DNA, 25 bp, Mus musculus
tgaagttgctttttaccccagcaga

SEQ ID NO: 845553 - DNA, 25 bp, Mus musculus
tgaagttggaaaacggtggcctgct

SEQ ID NO: 845554 - DNA, 25 bp, Mus musculus
tgaagttggaaatcggtggcctgct

SEQ ID NO: 845555 - DNA, 25 bp, Mus musculus
tgaagttggaaccaaatcatgttgt

SEQ ID NO: 845556 - DNA, 25 bp, Mus musculus
tgaagttggaacgaaatcatgttgt

SEQ ID NO: 845557 - DNA, 25 bp, Mus musculus
tgaagttgggcacttccgttcctag

SEQ ID NO: 845558 - DNA, 25 bp, Mus musculus
tgaagttgggcagttccgttcctag

SEQ ID NO: 845559 - DNA, 25 bp, Mus musculus
tgaagttggtgccaggtgcctatct

SEQ ID NO: 845560 - DNA, 25 bp, Mus musculus
tgaagttggtgcgaggtgcctatct

SEQ ID NO: 845561 - DNA, 25 bp, Mus musculus
tgaagttggttaccctggtggcatt

SEQ ID NO: 845562 - DNA, 25 bp, Mus musculus
tgaagttggttagcctggtggcatt

SEQ ID NO: 845563 - DNA, 25 bp, Mus musculus
tgaagttggttcattgctctttctt

SEQ ID NO: 845564 - DNA, 25 bp, Mus musculus
tgaagttggttctttgctctttctt

SEQ ID NO: 845565 - DNA, 25 bp, Mus musculus
tgaagttgtaacctgctgcacgctt

SEQ ID NO: 845566 - DNA, 25 bp, Mus musculus
tgaagttgtaacgtgctgcacgctt

SEQ ID NO: 845567 - DNA, 25 bp, Mus musculus
tgaagttgtatcactcaataatggc

SEQ ID NO: 845568 - DNA, 25 bp, Mus musculus
tgaagttgtatctctcaataatggc

SEQ ID NO: 845569 - DNA, 25 bp, Mus musculus
tgaagttgtcaaaggccgcaaggat

SEQ ID NO: 845570 - DNA, 25 bp, Mus musculus
tgaagttgtcaatggccgcaaggat

SEQ ID NO: 845571 - DNA, 25 bp, Mus musculus
tgaagtttaaccagagtcaggcatg

SEQ ID NO: 845572 - DNA, 25 bp, Mus musculus
tgaagtttaacctgagtcaggcatg

SEQ ID NO: 845573 - DNA, 25 bp, Mus musculus
tgaagtttaagtctctgaggcagaa

SEQ ID NO: 845574 - DNA, 25 bp, Mus musculus
tgaagtttaagtgtctgaggcagaa

SEQ ID NO: 845575 - DNA, 25 bp, Mus musculus
tgaagtttacccatggcctccatgt

SEQ ID NO: 845576 - DNA, 25 bp, Mus musculus
tgaagtttacccttggcctccatgt

SEQ ID NO: 845577 - DNA, 25 bp, Mus musculus
tgaagtttactactgttttgcccga

SEQ ID NO: 845578 - DNA, 25 bp, Mus musculus
tgaagtttactagtgttttgcccga

SEQ ID NO: 845579 - DNA, 25 bp, Mus musculus
tgaagtttacttccccatcaagctt

SEQ ID NO: 845580 - DNA, 25 bp, Mus musculus
tgaagtttacttgcccatcaagctt

SEQ ID NO: 845581 - DNA, 25 bp, Mus musculus
tgaagtttatatcatgtaccccaaa

SEQ ID NO: 845582 - DNA, 25 bp, Mus musculus
tgaagtttatatgatgtaccccaaa

SEQ ID NO: 845583 - DNA, 25 bp, Mus musculus
tgaagtttatccctagtcaccttcc

SEQ ID NO: 845584 - DNA, 25 bp, Mus musculus
tgaagtttatccgtagtcaccttcc

SEQ ID NO: 845585 - DNA, 25 bp, Mus musculus
tgaagtttcaagacagctagctggg

SEQ ID NO: 845586 - DNA, 25 bp, Mus musculus
tgaagtttcaagtcagctagctggg

SEQ ID NO: 845587 - DNA, 25 bp, Mus musculus
tgaagtttcaccacattgctctgac

SEQ ID NO: 845588 - DNA, 25 bp, Mus musculus
tgaagtttcacctcattgctctgac

SEQ ID NO: 845589 - DNA, 25 bp, Mus musculus
tgaagtttctcgctgcctgagctaa

SEQ ID NO: 845590 - DNA, 25 bp, Mus musculus
tgaagtttctcggtgcctgagctaa

SEQ ID NO: 845591 - DNA, 25 bp, Mus musculus
tgaagtttctctatggaatctggcc

SEQ ID NO: 845592 - DNA, 25 bp, Mus musculus
tgaagtttctctcggaagtatgaac

SEQ ID NO: 845593 - DNA, 25 bp, Mus musculus
tgaagtttctctgggaagtatgaac

SEQ ID NO: 845594 - DNA, 25 bp, Mus musculus
tgaagtttctctttggaatctggcc

SEQ ID NO: 845595 - DNA, 25 bp, Mus musculus
tgaagtttctgtattagagcgcgaa

SEQ ID NO: 845596 - DNA, 25 bp, Mus musculus
tgaagtttctgtcggtcattataac

SEQ ID NO: 845597 - DNA, 25 bp, Mus musculus
tgaagtttctgtgggtcattataac

SEQ ID NO: 845598 - DNA, 25 bp, Mus musculus
tgaagtttctgttttagagcgcgaa

SEQ ID NO: 845599 - DNA, 25 bp, Mus musculus
tgaagtttgaaaacggccaggccct

SEQ ID NO: 845600 - DNA, 25 bp, Mus musculus
tgaagtttgaaatcggccaggccct

SEQ ID NO: 845601 - DNA, 25 bp, Mus musculus
tgaagtttgactatccttctctcct

SEQ ID NO: 845602 - DNA, 25 bp, Mus musculus
tgaagtttgactttccttctctcct

SEQ ID NO: 845603 - DNA, 25 bp, Mus musculus
tgaagtttgccaaagaacgacaact

SEQ ID NO: 845604 - DNA, 25 bp, Mus musculus
tgaagtttgccatagaacgacaact

SEQ ID NO: 845605 - DNA, 25 bp, Mus musculus
tgaagttttacactaagccaaagga

SEQ ID NO: 845606 - DNA, 25 bp, Mus musculus
tgaagttttacagtaagccaaagga

SEQ ID NO: 845607 - DNA, 25 bp, Mus musculus
tgaagttttcaacggctctctgcag

SEQ ID NO: 845608 - DNA, 25 bp, Mus musculus
tgaagttttcaagggctctctgcag

SEQ ID NO: 845609 - DNA, 25 bp, Mus musculus
tgaagttttcataacatccacggaa

SEQ ID NO: 845610 - DNA, 25 bp, Mus musculus
tgaagttttcattacatccacggaa

SEQ ID NO: 845611 - DNA, 25 bp, Mus musculus
tgaagttttcggatgctggccagcc

SEQ ID NO: 845612 - DNA, 25 bp, Mus musculus
tgaagttttcggttgctggccagcc

SEQ ID NO: 845613 - DNA, 25 bp, Mus musculus
tgaagttttgacacaccacaggctc

SEQ ID NO: 845614 - DNA, 25 bp, Mus musculus
tgaagttttgactcaccacaggctc

SEQ ID NO: 845615 - DNA, 25 bp, Mus musculus
tgaagtttttaaatggccccagtgt

SEQ ID NO: 845616 - DNA, 25 bp, Mus musculus
tgaagtttttaattggccccagtgt

SEQ ID NO: 845617 - DNA, 25 bp, Mus musculus
tgaagttttttgagtggtcacccct

SEQ ID NO: 845618 - DNA, 25 bp, Mus musculus
tgaagttttttgtgtggtcacccct

SEQ ID NO: 845619 - DNA, 25 bp, Mus musculus
tgaataaactcacgttatttcggta

SEQ ID NO: 845620 - DNA, 25 bp, Mus musculus
tgaataaactcaggttatttcggta

SEQ ID NO: 845621 - DNA, 25 bp, Mus musculus
tgaataaagcctactcttctctcct

SEQ ID NO: 845622 - DNA, 25 bp, Mus musculus
tgaataaagccttctcttctctcct

SEQ ID NO: 845623 - DNA, 25 bp, Mus musculus
tgaataaagctacccgtgatcctca

SEQ ID NO: 845624 - DNA, 25 bp, Mus musculus
tgaataaagctagccgtgatcctca

SEQ ID NO: 845625 - DNA, 25 bp, Mus musculus
tgaataaatacaagcatgctgctaa

SEQ ID NO: 845626 - DNA, 25 bp, Mus musculus
tgaataaatacatgcatgctgctaa

SEQ ID NO: 845627 - DNA, 25 bp, Mus musculus
tgaataaatgtcagagcctctccaa

SEQ ID NO: 845628 - DNA, 25 bp, Mus musculus
tgaataaatgtctgagcctctccaa

SEQ ID NO: 845629 - DNA, 25 bp, Mus musculus
tgaataacccacatcctcataccag

SEQ ID NO: 845630 - DNA, 25 bp, Mus musculus
tgaataacccacttcctcataccag

SEQ ID NO: 845631 - DNA, 25 bp, Mus musculus
tgaataacccagaaaaggagagcct

SEQ ID NO: 845632 - DNA, 25 bp, Mus musculus
tgaataacccagtaaaggagagcct

SEQ ID NO: 845633 - DNA, 25 bp, Mus musculus
tgaataacgcaacctccaggactat

SEQ ID NO: 845634 - DNA, 25 bp, Mus musculus
tgaataacgcaagctccaggactat

SEQ ID NO: 845635 - DNA, 25 bp, Mus musculus
tgaataactattctggaccaaggga

SEQ ID NO: 845636 - DNA, 25 bp, Mus musculus
tgaataactattgtggaccaaggga

SEQ ID NO: 845637 - DNA, 25 bp, Mus musculus
tgaataactgcgagctgctggtgga

SEQ ID NO: 845638 - DNA, 25 bp, Mus musculus
tgaataactgcgtgctgctggtgga

SEQ ID NO: 845639 - DNA, 25 bp, Mus musculus
tgaataacttaaacctcgctttgag

SEQ ID NO: 845640 - DNA, 25 bp, Mus musculus
tgaataacttaatcctcgctttgag

SEQ ID NO: 845641 - DNA, 25 bp, Mus musculus
tgaataacttacagaactcccagaa

SEQ ID NO: 845642 - DNA, 25 bp, Mus musculus
tgaataacttactgaactcccagaa

SEQ ID NO: 845643 - DNA, 25 bp, Mus musculus
tgaataagagcaagtggaagaaact

SEQ ID NO: 845644 - DNA, 25 bp, Mus musculus
tgaataagagcatgtggaagaaact

SEQ ID NO: 845645 - DNA, 25 bp, Mus musculus
tgaataagcagcacggccaggccag

SEQ ID NO: 845646 - DNA, 25 bp, Mus musculus
tgaataagcagctcggccaggccag

SEQ ID NO: 845647 - DNA, 25 bp, Mus musculus
tgaataagccaaccctttctagctc

SEQ ID NO: 845648 - DNA, 25 bp, Mus musculus
tgaataagccaagcctttctagctc

SEQ ID NO: 845649 - DNA, 25 bp, Mus musculus
tgaataagccacagtctgggcttcc

SEQ ID NO: 845650 - DNA, 25 bp, Mus musculus
tgaataagccactgtctgggcttcc

SEQ ID NO: 845651 - DNA, 25 bp, Mus musculus
tgaataagctgaacccgtcactcaa

SEQ ID NO: 845652 - DNA, 25 bp, Mus musculus
tgaataagctgatcccgtcactcaa

SEQ ID NO: 845653 - DNA, 25 bp, Mus musculus
tgaataagggagaaaccgtctcctc

SEQ ID NO: 845654 - DNA, 25 bp, Mus musculus
tgaataagggagtaaccgtctcctc

SEQ ID NO: 845655 - DNA, 25 bp, Mus musculus
tgaataagggtgattcttaccataa

SEQ ID NO: 845656 - DNA, 25 bp, Mus musculus
tgaataagggtgtttcttaccataa

SEQ ID NO: 845657 - DNA, 25 bp, Mus musculus
tgaataagttccaattttggtccaa

SEQ ID NO: 845658 - DNA, 25 bp, Mus musculus
tgaataagttcctattttggtccaa

SEQ ID NO: 845659 - DNA, 25 bp, Mus musculus
tgaataatacatccctctctcaggt

SEQ ID NO: 845660 - DNA, 25 bp, Mus musculus
tgaataatacatgcctctctcaggt

SEQ ID NO: 845661 - DNA, 25 bp, Mus musculus
tgaataatattaacccctgccactt

SEQ ID NO: 845662 - DNA, 25 bp, Mus musculus
tgaataatattatcccctgccactt

SEQ ID NO: 845663 - DNA, 25 bp, Mus musculus
tgaataatccacatgcctcaagcag

SEQ ID NO: 845664 - DNA, 25 bp, Mus musculus
tgaataatccacttgcctcaagcag

SEQ ID NO: 845665 - DNA, 25 bp, Mus musculus
tgaataatgtctaccttttaaaggc

SEQ ID NO: 845666 - DNA, 25 bp, Mus musculus
tgaataatgtctccctgactcaccc

SEQ ID NO: 845667 - DNA, 25 bp, Mus musculus
tgaataatgtctgcctgactcaccc

SEQ ID NO: 845668 - DNA, 25 bp, Mus musculus
tgaataatgtcttccttttaaaggc

SEQ ID NO: 845669 - DNA, 25 bp, Mus musculus
tgaataatttgtactccctggtggg

SEQ ID NO: 845670 - DNA, 25 bp, Mus musculus
tgaataatttgttctccctggtggg

SEQ ID NO: 845671 - DNA, 25 bp, Mus musculus
tgaataattttacctggctccctaa

SEQ ID NO: 845672 - DNA, 25 bp, Mus musculus
tgaataattttagctggctccctaa

SEQ ID NO: 845673 - DNA, 25 bp, Mus musculus
tgaatacaccgtaaacaaccttaag

SEQ ID NO: 845674 - DNA, 25 bp, Mus musculus
tgaatacaccgttaacaaccttaag

SEQ ID NO: 845675 - DNA, 25 bp, Mus musculus
tgaatacacttgatttcggctctgc

SEQ ID NO: 845676 - DNA, 25 bp, Mus musculus
tgaatacacttgttttcggctctgc

SEQ ID NO: 845677 - DNA, 25 bp, Mus musculus
tgaatacagcatcccgcagaggtag

SEQ ID NO: 845678 - DNA, 25 bp, Mus musculus
tgaatacagcatgccgcagaggtag

SEQ ID NO: 845679 - DNA, 25 bp, Mus musculus
tgaatacaggcgctcttgaacctct

SEQ ID NO: 845680 - DNA, 25 bp, Mus musculus
tgaatacaggcggtcttgaacctct

SEQ ID NO: 845681 - DNA, 25 bp, Mus musculus
tgaatacaggtaattctcccatcct

SEQ ID NO: 845682 - DNA, 25 bp, Mus musculus
tgaatacaggtatttctcccatcct

SEQ ID NO: 845683 - DNA, 25 bp, Mus musculus
tgaatacatccacagtaggcacagt

SEQ ID NO: 845684 - DNA, 25 bp, Mus musculus
tgaatacatccagagtaggcacagt

SEQ ID NO: 845685 - DNA, 25 bp, Mus musculus
tgaatacattcaaccaatcccggac

SEQ ID NO: 845686 - DNA, 25 bp, Mus musculus
tgaatacattcatccaatcccggac

SEQ ID NO: 845687 - DNA, 25 bp, Mus musculus
tgaataccaagaagacattgtctga

SEQ ID NO: 845688 - DNA, 25 bp, Mus musculus
tgaataccaagatgacattgtctga

SEQ ID NO: 845689 - DNA, 25 bp, Mus musculus
tgaatacccagaagagctccagtgt

SEQ ID NO: 845690 - DNA, 25 bp, Mus musculus
tgaatacccagatgagctccagtgt

SEQ ID NO: 845691 - DNA, 25 bp, Mus musculus
tgaatacgaggcatgtctatacact

SEQ ID NO: 845692 - DNA, 25 bp, Mus musculus
tgaatacgaggcttgtctatacact

SEQ ID NO: 845693 - DNA, 25 bp, Mus musculus
tgaatacgtcgcacagtcgactggc

SEQ ID NO: 845694 - DNA, 25 bp, Mus musculus
tgaatacgtcgctcagtcgactggc

SEQ ID NO: 845695 - DNA, 25 bp, Mus musculus
tgaatactaacaaggaggtccctgt

SEQ ID NO: 845696 - DNA, 25 bp, Mus musculus
tgaatactaacatggaggtccctgt

SEQ ID NO: 845697 - DNA, 25 bp, Mus musculus
tgaatactagtacctgtgggctctg

SEQ ID NO: 845698 - DNA, 25 bp, Mus musculus
tgaatactagtagctgtgggctctg

SEQ ID NO: 845699 - DNA, 25 bp, Mus musculus
tgaatactccagaactactgcccat

SEQ ID NO: 845700 - DNA, 25 bp, Mus musculus
tgaatactccagtactactgcccat

SEQ ID NO: 845701 - DNA, 25 bp, Mus musculus
tgaatactgccccatataatatgag

SEQ ID NO: 845702 - DNA, 25 bp, Mus musculus
tgaatactgcccgatataatatgag

SEQ ID NO: 845703 - DNA, 25 bp, Mus musculus
tgaatactgttcactgtgctgtcca

SEQ ID NO: 845704 - DNA, 25 bp, Mus musculus
tgaatactgttctctgtgctgtcca

SEQ ID NO: 845705 - DNA, 25 bp, Mus musculus
tgaatacttaaccatttgggacgtt

SEQ ID NO: 845706 - DNA, 25 bp, Mus musculus
tgaatacttaacgatttgggacgtt

SEQ ID NO: 845707 - DNA, 25 bp, Mus musculus
tgaatacttcatagtcagactggac

SEQ ID NO: 845708 - DNA, 25 bp, Mus musculus
tgaatacttcattgtcagactggac

SEQ ID NO: 845709 - DNA, 25 bp, Mus musculus
tgaatacttgccactgtctttgaaa

SEQ ID NO: 845710 - DNA, 25 bp, Mus musculus
tgaatacttgcctctgtctttgaaa

SEQ ID NO: 845711 - DNA, 25 bp, Mus musculus
tgaatacttggtccccacttagtag

SEQ ID NO: 845712 - DNA, 25 bp, Mus musculus
tgaatacttggtgcccacttagtag

SEQ ID NO: 845713 - DNA, 25 bp, Mus musculus
tgaatactttacactgcctgcagaa

SEQ ID NO: 845714 - DNA, 25 bp, Mus musculus
tgaatactttactctgcctgcagaa

SEQ ID NO: 845715 - DNA, 25 bp, Mus musculus
tgaatactttatatctttctaatga

SEQ ID NO: 845716 - DNA, 25 bp, Mus musculus
tgaatactttatttctttctaatga

SEQ ID NO: 845717 - DNA, 25 bp, Mus musculus
tgaatagacacgacactggcccaga

SEQ ID NO: 845718 - DNA, 25 bp, Mus musculus
tgaatagacacgtcactggcccaga

SEQ ID NO: 845719 - DNA, 25 bp, Mus musculus
tgaatagcaaatctctccacacctt

SEQ ID NO: 845720 - DNA, 25 bp, Mus musculus
tgaatagcaaatgtctccacacctt

SEQ ID NO: 845721 - DNA, 25 bp, Mus musculus
tgaatagcacttattttcatctgtg

SEQ ID NO: 845722 - DNA, 25 bp, Mus musculus
tgaatagcactttttttcatctgtg

SEQ ID NO: 845723 - DNA, 25 bp, Mus musculus
tgaatagccaaccacccacagagga

SEQ ID NO: 845724 - DNA, 25 bp, Mus musculus
tgaatagccaacgacccacagagga

SEQ ID NO: 845725 - DNA, 25 bp, Mus musculus
tgaatagccgagagtccctaaaccc

SEQ ID NO: 845726 - DNA, 25 bp, Mus musculus
tgaatagccgagtgtccctaaaccc

SEQ ID NO: 845727 - DNA, 25 bp, Mus musculus
tgaatagcctacacccaagtaagag

SEQ ID NO: 845728 - DNA, 25 bp, Mus musculus
tgaatagcctactcccaagtaagag

SEQ ID NO: 845729 - DNA, 25 bp, Mus musculus
tgaatagctcagcaccagcattttc

SEQ ID NO: 845730 - DNA, 25 bp, Mus musculus
tgaatagctcaggaccagcattttc

SEQ ID NO: 845731 - DNA, 25 bp, Mus musculus
tgaatagcttgcacactttgctggc

SEQ ID NO: 845732 - DNA, 25 bp, Mus musculus
tgaatagcttgctcactttgctggc

SEQ ID NO: 845733 - DNA, 25 bp, Mus musculus
tgaataggaccccagaatcgacctg

SEQ ID NO: 845734 - DNA, 25 bp, Mus musculus
tgaataggacccgagaatcgacctg

SEQ ID NO: 845735 - DNA, 25 bp, Mus musculus
tgaataggattcatctcagttgaaa

SEQ ID NO: 845736 - DNA, 25 bp, Mus musculus
tgaataggattcttctcagttgaaa

SEQ ID NO: 845737 - DNA, 25 bp, Mus musculus
tgaatagtctggctttgtgccacca

SEQ ID NO: 845738 - DNA, 25 bp, Mus musculus
tgaatagtctgggtttgtgccacca

SEQ ID NO: 845739 - DNA, 25 bp, Mus musculus
tgaatagtgatgaaagtatctgatt

SEQ ID NO: 845740 - DNA, 25 bp, Mus musculus
tgaatagtgatgtaagtatctgatt

SEQ ID NO: 845741 - DNA, 25 bp, Mus musculus
tgaatagttcttcgcccatctcatt

SEQ ID NO: 845742 - DNA, 25 bp, Mus musculus
tgaatagttcttggcccatctcatt

SEQ ID NO: 845743 - DNA, 25 bp, Mus musculus
tgaatagttgatccctgccatcccg

SEQ ID NO: 845744 - DNA, 25 bp, Mus musculus
tgaatagttgatgcctgccatcccg

SEQ ID NO: 845745 - DNA, 25 bp, Mus musculus
tgaatagtttagacactgtcaagaa

SEQ ID NO: 845746 - DNA, 25 bp, Mus musculus
tgaatagtttagtcactgtcaagaa

SEQ ID NO: 845747 - DNA, 25 bp, Mus musculus
tgaatagtttttctcagccctacct

SEQ ID NO: 845748 - DNA, 25 bp, Mus musculus
tgaatagtttttgtcagccctacct

SEQ ID NO: 845749 - DNA, 25 bp, Mus musculus
tgaatatacctgacagcatgcccac

SEQ ID NO: 845750 - DNA, 25 bp, Mus musculus
tgaatatacctgtcagcatgcccac

SEQ ID NO: 845751 - DNA, 25 bp, Mus musculus
tgaatatagtagataccctcagtac

SEQ ID NO: 845752 - DNA, 25 bp, Mus musculus
tgaatatagtagttaccctcagtac

SEQ ID NO: 845753 - DNA, 25 bp, Mus musculus
tgaatatcagcacgtgttaccatgt

SEQ ID NO: 845754 - DNA, 25 bp, Mus musculus
tgaatatcagcaggtgttaccatgt

SEQ ID NO: 845755 - DNA, 25 bp, Mus musculus
tgaatatcagctccctgatcttcag

SEQ ID NO: 845756 - DNA, 25 bp, Mus musculus
tgaatatcagctgcctgatcttcag

SEQ ID NO: 845757 - DNA, 25 bp, Mus musculus
tgaatatgaaggatgactccacccc

SEQ ID NO: 845758 - DNA, 25 bp, Mus musculus
tgaatatgaaggttgactccacccc

SEQ ID NO: 845759 - DNA, 25 bp, Mus musculus
tgaatatgatcacacccagtcatga

SEQ ID NO: 845760 - DNA, 25 bp, Mus musculus
tgaatatgatcagacccagtcatga

SEQ ID NO: 845761 - DNA, 25 bp, Mus musculus
tgaatatgatttcaagctccctggg

SEQ ID NO: 845762 - DNA, 25 bp, Mus musculus
tgaatatgatttgaagctccctggg

SEQ ID NO: 845763 - DNA, 25 bp, Mus musculus
tgaatatgcaaaaagtcggccccgc

SEQ ID NO: 845764 - DNA, 25 bp, Mus musculus
tgaatatgcaaatagtcggccccgc

SEQ ID NO: 845765 - DNA, 25 bp, Mus musculus
tgaatatgccaaagccctcactata

SEQ ID NO: 845766 - DNA, 25 bp, Mus musculus
tgaatatgccaatgccctcactata

SEQ ID NO: 845767 - DNA, 25 bp, Mus musculus
tgaatatgcctacatctgtcaaaag

SEQ ID NO: 845768 - DNA, 25 bp, Mus musculus
tgaatatgcctagatctgtcaaaag

SEQ ID NO: 845769 - DNA, 25 bp, Mus musculus
tgaatatgcgccatcaagtgtcagg

SEQ ID NO: 845770 - DNA, 25 bp, Mus musculus
tgaatatgcgccttcaagtgtcagg

SEQ ID NO: 845771 - DNA, 25 bp, Mus musculus
tgaatatgttctctagtgccagaac

SEQ ID NO: 845772 - DNA, 25 bp, Mus musculus
tgaatatgttctgtagtgccagaac

SEQ ID NO: 845773 - DNA, 25 bp, Mus musculus
tgaatattacaacctctgtcattgc

SEQ ID NO: 845774 - DNA, 25 bp, Mus musculus
tgaatattacaagctctgtcattgc

SEQ ID NO: 845775 - DNA, 25 bp, Mus musculus
tgaatattatgaccacctgccgcag

SEQ ID NO: 845776 - DNA, 25 bp, Mus musculus
tgaatattatgagcacctgccgcag

SEQ ID NO: 845777 - DNA, 25 bp, Mus musculus
tgaatattccaactcctaactccgc

SEQ ID NO: 845778 - DNA, 25 bp, Mus musculus
tgaatattccaagtcctaactccgc

SEQ ID NO: 845779 - DNA, 25 bp, Mus musculus
tgaatattcctgctgggatctcttc

SEQ ID NO: 845780 - DNA, 25 bp, Mus musculus
tgaatattcctggtgggatctcttc

SEQ ID NO: 845781 - DNA, 25 bp, Mus musculus
tgaatattctcaccacctcttagat

SEQ ID NO: 845782 - DNA, 25 bp, Mus musculus
tgaatattctcagcacctcttagat

SEQ ID NO: 845783 - DNA, 25 bp, Mus musculus
tgaatattctgaacccacccgatat

SEQ ID NO: 845784 - DNA, 25 bp, Mus musculus
tgaatattctgatcccacccgatat

SEQ ID NO: 845785 - DNA, 25 bp, Mus musculus
tgaatattgaacctgttctggacct

SEQ ID NO: 845786 - DNA, 25 bp, Mus musculus
tgaatattgaacgtgttctggacct

SEQ ID NO: 845787 - DNA, 25 bp, Mus musculus
tgaatattgagccgcccctgttgta

SEQ ID NO: 845788 - DNA, 25 bp, Mus musculus
tgaatattgagcggcccctgttgta

SEQ ID NO: 845789 - DNA, 25 bp, Mus musculus
tgaatattgagtctcccgggaggtc

SEQ ID NO: 845790 - DNA, 25 bp, Mus musculus
tgaatattgagtgtcccgggaggtc

SEQ ID NO: 845791 - DNA, 25 bp, Mus musculus
tgaatattgcctctgctgcaaaggc

SEQ ID NO: 845792 - DNA, 25 bp, Mus musculus
tgaatattgcctgtgctgcaaaggc

SEQ ID NO: 845793 - DNA, 25 bp, Mus musculus
tgaatattgtgccaaccccatctgt

SEQ ID NO: 845794 - DNA, 25 bp, Mus musculus
tgaatattgtgcgaaccccatctgt

SEQ ID NO: 845795 - DNA, 25 bp, Mus musculus
tgaatatttcacaacacacaaaaac

SEQ ID NO: 845796 - DNA, 25 bp, Mus musculus
tgaatatttcactacacacaaaaac

SEQ ID NO: 845797 - DNA, 25 bp, Mus musculus
tgaatatttggacccagaccttcgg

SEQ ID NO: 845798 - DNA, 25 bp, Mus musculus
tgaatatttggagccagaccttcgg

SEQ ID NO: 845799 - DNA, 25 bp, Mus musculus
tgaatattttgaatctcccgttcct

SEQ ID NO: 845800 - DNA, 25 bp, Mus musculus
tgaatattttgattctcccgttcct

SEQ ID NO: 845801 - DNA, 25 bp, Mus musculus
tgaatcaactctcgtctggcactgc

SEQ ID NO: 845802 - DNA, 25 bp, Mus musculus
tgaatcaactctggtctggcactgc

SEQ ID NO: 845803 - DNA, 25 bp, Mus musculus
tgaatcaactgtattgggaccagca

SEQ ID NO: 845804 - DNA, 25 bp, Mus musculus
tgaatcaactgttttgggaccagca

SEQ ID NO: 845805 - DNA, 25 bp, Mus musculus
tgaatcaagccaacatttccatcag

SEQ ID NO: 845806 - DNA, 25 bp, Mus musculus
tgaatcaagccatcatttccatcag

SEQ ID NO: 845807 - DNA, 25 bp, Mus musculus
tgaatcacaattcttggtgccaggc

SEQ ID NO: 845808 - DNA, 25 bp, Mus musculus
tgaatcacaattgttggtgccaggc

SEQ ID NO: 845809 - DNA, 25 bp, Mus musculus
tgaatcacacagaggcttgctggat

SEQ ID NO: 845810 - DNA, 25 bp, Mus musculus
tgaatcacacagtggcttgctggat

SEQ ID NO: 845811 - DNA, 25 bp, Mus musculus
tgaatcacagtgagtccttttgccc

SEQ ID NO: 845812 - DNA, 25 bp, Mus musculus
tgaatcacagtgtgtccttttgccc

SEQ ID NO: 845813 - DNA, 25 bp, Mus musculus
tgaatcacgaagagagggtgtccaa

SEQ ID NO: 845814 - DNA, 25 bp, Mus musculus
tgaatcacgaagtgagggtgtccaa

SEQ ID NO: 845815 - DNA, 25 bp, Mus musculus
tgaatcacgactacacatccttttt

SEQ ID NO: 845816 - DNA, 25 bp, Mus musculus
tgaatcacgacttcacatccttttt

SEQ ID NO: 845817 - DNA, 25 bp, Mus musculus
tgaatcagaaaaaggccgagatggc

SEQ ID NO: 845818 - DNA, 25 bp, Mus musculus
tgaatcagaaaatggccgagatggc

SEQ ID NO: 845819 - DNA, 25 bp, Mus musculus
tgaatcagacaccagacgtaacaat

SEQ ID NO: 845820 - DNA, 25 bp, Mus musculus
tgaatcagacacgagacgtaacaat

SEQ ID NO: 845821 - DNA, 25 bp, Mus musculus
tgaatcagatgtctaggctaatatt

SEQ ID NO: 845822 - DNA, 25 bp, Mus musculus
tgaatcagatgtgtaggctaatatt

SEQ ID NO: 845823 - DNA, 25 bp, Mus musculus
tgaatcagcgtcagcccaatgctaa

SEQ ID NO: 845824 - DNA, 25 bp, Mus musculus
tgaatcagcgtctgcccaatgctaa

SEQ ID NO: 845825 - DNA, 25 bp, Mus musculus
tgaatcaggacccatcatcagatga

SEQ ID NO: 845826 - DNA, 25 bp, Mus musculus
tgaatcaggaccgatcatcagatga

SEQ ID NO: 845827 - DNA, 25 bp, Mus musculus
tgaatcaggatgagtctctctccag

SEQ ID NO: 845828 - DNA, 25 bp, Mus musculus
tgaatcaggatgtgtctctctccag

SEQ ID NO: 845829 - DNA, 25 bp, Mus musculus
tgaatcaggccccttcaagtgaagg

SEQ ID NO: 845830 - DNA, 25 bp, Mus musculus
tgaatcaggcccgttcaagtgaagg

SEQ ID NO: 845831 - DNA, 25 bp, Mus musculus
tgaatcaggcctctcttatccctgc

SEQ ID NO: 845832 - DNA, 25 bp, Mus musculus
tgaatcaggcctgtcttatccctgc

SEQ ID NO: 845833 - DNA, 25 bp, Mus musculus
tgaatcagggtgataatatattgcc

SEQ ID NO: 845834 - DNA, 25 bp, Mus musculus
tgaatcagggtgttaatatattgcc

SEQ ID NO: 845835 - DNA, 25 bp, Mus musculus
tgaatcaggtctcgctccctatact

SEQ ID NO: 845836 - DNA, 25 bp, Mus musculus
tgaatcaggtctggctccctatact

SEQ ID NO: 845837 - DNA, 25 bp, Mus musculus
tgaatcagtccaactacagggaact

SEQ ID NO: 845838 - DNA, 25 bp, Mus musculus
tgaatcagtccatctacagggaact

SEQ ID NO: 845839 - DNA, 25 bp, Mus musculus
tgaatcatctacaacaccctgtgga

SEQ ID NO: 845840 - DNA, 25 bp, Mus musculus
tgaatcatctactacaccctgtgga

SEQ ID NO: 845841 - DNA, 25 bp, Mus musculus
tgaatcatctagctggccctcggga

SEQ ID NO: 845842 - DNA, 25 bp, Mus musculus
tgaatcatctaggtggccctcggga

SEQ ID NO: 845843 - DNA, 25 bp, Mus musculus
tgaatcatgcacacgacttatctgt

SEQ ID NO: 845844 - DNA, 25 bp, Mus musculus
tgaatcatgcactcgacttatctgt

SEQ ID NO: 845845 - DNA, 25 bp, Mus musculus
tgaatcatgctgaattgctaccatc

SEQ ID NO: 845846 - DNA, 25 bp, Mus musculus
tgaatcatgctgtattgctaccatc

SEQ ID NO: 845847 - DNA, 25 bp, Mus musculus
tgaatcatgtctctagcccagtgcc

SEQ ID NO: 845848 - DNA, 25 bp, Mus musculus
tgaatcatgtctgtagcccagtgcc

SEQ ID NO: 845849 - DNA, 25 bp, Mus musculus
tgaatcattcaacagcttgtaggct

SEQ ID NO: 845850 - DNA, 25 bp, Mus musculus
tgaatcattcaagagcttgtaggct

SEQ ID NO: 845851 - DNA, 25 bp, Mus musculus
tgaatccaacccaagtatctttata

SEQ ID NO: 845852 - DNA, 25 bp, Mus musculus
tgaatccaaccctagtatctttata

SEQ ID NO: 845853 - DNA, 25 bp, Mus musculus
tgaatccaagatactatgtacggaa

SEQ ID NO: 845854 - DNA, 25 bp, Mus musculus
tgaatccaagattctatgtacggaa

SEQ ID NO: 845855 - DNA, 25 bp, Mus musculus
tgaatccacgatcggcagcaactct

SEQ ID NO: 845856 - DNA, 25 bp, Mus musculus
tgaatccacgatgggcagcaactct

SEQ ID NO: 845857 - DNA, 25 bp, Mus musculus
tgaatccatctcatgcctcagtgag

SEQ ID NO: 845858 - DNA, 25 bp, Mus musculus
tgaatccatctcttgcctcagtgag

SEQ ID NO: 845859 - DNA, 25 bp, Mus musculus
tgaatccatgttccagtgtgtgtct

SEQ ID NO: 845860 - DNA, 25 bp, Mus musculus
tgaatccatgttcgcttgctatagc

SEQ ID NO: 845861 - DNA, 25 bp, Mus musculus
tgaatccatgttgcagtgtgtgtct

SEQ ID NO: 845862 - DNA, 25 bp, Mus musculus
tgaatccatgttggcttgctatagc

SEQ ID NO: 845863 - DNA, 25 bp, Mus musculus
tgaatcccaagtactctgctttctt

SEQ ID NO: 845864 - DNA, 25 bp, Mus musculus
tgaatcccaagttctctgctttctt

SEQ ID NO: 845865 - DNA, 25 bp, Mus musculus
tgaatcccacctataccaaaacacg

SEQ ID NO: 845866 - DNA, 25 bp, Mus musculus
tgaatcccacctttaccaaaacacg

SEQ ID NO: 845867 - DNA, 25 bp, Mus musculus
tgaatcccagccaaagtgcacagag

SEQ ID NO: 845868 - DNA, 25 bp, Mus musculus
tgaatcccagcctaagtgcacagag

SEQ ID NO: 845869 - DNA, 25 bp, Mus musculus
tgaatcccaggtacagtaacgccca

SEQ ID NO: 845870 - DNA, 25 bp, Mus musculus
tgaatcccaggttcagtaacgccca

SEQ ID NO: 845871 - DNA, 25 bp, Mus musculus
tgaatcccatgaaagcagcttcccc

SEQ ID NO: 845872 - DNA, 25 bp, Mus musculus
tgaatcccatgatagcagcttcccc

SEQ ID NO: 845873 - DNA, 25 bp, Mus musculus
tgaatccccacactgcggtgtttgg

SEQ ID NO: 845874 - DNA, 25 bp, Mus musculus
tgaatccccacagtgcggtgtttgg

SEQ ID NO: 845875 - DNA, 25 bp, Mus musculus
tgaatccctaaacagggtttgccag

SEQ ID NO: 845876 - DNA, 25 bp, Mus musculus
tgaatccctaaagagggtttgccag

SEQ ID NO: 845877 - DNA, 25 bp, Mus musculus
tgaatccctcatacacagttttctc

SEQ ID NO: 845878 - DNA, 25 bp, Mus musculus
tgaatccctcattcacagttttctc

SEQ ID NO: 845879 - DNA, 25 bp, Mus musculus
tgaatccctcgaaagaccacaaatg

SEQ ID NO: 845880 - DNA, 25 bp, Mus musculus
tgaatccctcgatagaccacaaatg

SEQ ID NO: 845881 - DNA, 25 bp, Mus musculus
tgaatcccttaactgtgaacggtta

SEQ ID NO: 845882 - DNA, 25 bp, Mus musculus
tgaatcccttaagtgtgaacggtta

SEQ ID NO: 845883 - DNA, 25 bp, Mus musculus
tgaatcccttcaccatgcaggagga

SEQ ID NO: 845884 - DNA, 25 bp, Mus musculus
tgaatcccttcagcatgcaggagga

SEQ ID NO: 845885 - DNA, 25 bp, Mus musculus
tgaatccctttcctgtaactgggct

SEQ ID NO: 845886 - DNA, 25 bp, Mus musculus
tgaatccctttcgtgtaactgggct

SEQ ID NO: 845887 - DNA, 25 bp, Mus musculus
tgaatccgcagtcccagttattgaa

SEQ ID NO: 845888 - DNA, 25 bp, Mus musculus
tgaatccgcagtgccagttattgaa

SEQ ID NO: 845889 - DNA, 25 bp, Mus musculus
tgaatccgctcaactatactctaag

SEQ ID NO: 845890 - DNA, 25 bp, Mus musculus
tgaatccgctcatctatactctaag

SEQ ID NO: 845891 - DNA, 25 bp, Mus musculus
tgaatccggctccaccaacagggtg

SEQ ID NO: 845892 - DNA, 25 bp, Mus musculus
tgaatccggctcgaccaacagggtg

SEQ ID NO: 845893 - DNA, 25 bp, Mus musculus
tgaatccggttgacagcgcgtgtgc

SEQ ID NO: 845894 - DNA, 25 bp, Mus musculus
tgaatccggttgtcagcgcgtgtgc

SEQ ID NO: 845895 - DNA, 25 bp, Mus musculus
tgaatccgtttcaactactctactc

SEQ ID NO: 845896 - DNA, 25 bp, Mus musculus
tgaatccgtttctactactctactc

SEQ ID NO: 845897 - DNA, 25 bp, Mus musculus
tgaatcctaaatattttcaccctca

SEQ ID NO: 845898 - DNA, 25 bp, Mus musculus
tgaatcctaaattttttcaccctca

SEQ ID NO: 845899 - DNA, 25 bp, Mus musculus
tgaatcctagtgatgccttgatagc

SEQ ID NO: 845900 - DNA, 25 bp, Mus musculus
tgaatcctagtgttgccttgatagc

SEQ ID NO: 845901 - DNA, 25 bp, Mus musculus
tgaatcctatatcacttcatcaaca

SEQ ID NO: 845902 - DNA, 25 bp, Mus musculus
tgaatcctatatgacttcatcaaca

SEQ ID NO: 845903 - DNA, 25 bp, Mus musculus
tgaatcctatgcctccactgttcag

SEQ ID NO: 845904 - DNA, 25 bp, Mus musculus
tgaatcctatgcgtccactgttcag

SEQ ID NO: 845905 - DNA, 25 bp, Mus musculus
tgaatcctcagtactggcctctgat

SEQ ID NO: 845906 - DNA, 25 bp, Mus musculus
tgaatcctcagttctggcctctgat

SEQ ID NO: 845907 - DNA, 25 bp, Mus musculus
tgaatcctccagacacgcctacatg

SEQ ID NO: 845908 - DNA, 25 bp, Mus musculus
tgaatcctccagtcacgcctacatg

SEQ ID NO: 845909 - DNA, 25 bp, Mus musculus
tgaatcctccatatgcctagccttg

SEQ ID NO: 845910 - DNA, 25 bp, Mus musculus
tgaatcctccatttgcctagccttg

SEQ ID NO: 845911 - DNA, 25 bp, Mus musculus
tgaatcctcctgcttaggtaggcac

SEQ ID NO: 845912 - DNA, 25 bp, Mus musculus
tgaatcctcctggttaggtaggcac

SEQ ID NO: 845913 - DNA, 25 bp, Mus musculus
tgaatcctcggaatctcgggtcggc

SEQ ID NO: 845914 - DNA, 25 bp, Mus musculus
tgaatcctcggattctcgggtcggc

SEQ ID NO: 845915 - DNA, 25 bp, Mus musculus
tgaatcctcttacggaagacactgt

SEQ ID NO: 845916 - DNA, 25 bp, Mus musculus
tgaatcctcttagggaagacactgt

SEQ ID NO: 845917 - DNA, 25 bp, Mus musculus
tgaatcctgaatcctgctggcctga

SEQ ID NO: 845918 - DNA, 25 bp, Mus musculus
tgaatcctgaatgctgctggcctga

SEQ ID NO: 845919 - DNA, 25 bp, Mus musculus
tgaatcctgagccatcaaggtgtct

SEQ ID NO: 845920 - DNA, 25 bp, Mus musculus
tgaatcctgagcgatcaaggtgtct

SEQ ID NO: 845921 - DNA, 25 bp, Mus musculus
tgaatcctgatcctgtgatgacaat

SEQ ID NO: 845922 - DNA, 25 bp, Mus musculus
tgaatcctgatcgtgtgatgacaat

SEQ ID NO: 845923 - DNA, 25 bp, Mus musculus
tgaatccttcccataggaacttaat

SEQ ID NO: 845924 - DNA, 25 bp, Mus musculus
tgaatccttcccttaggaacttaat

SEQ ID NO: 845925 - DNA, 25 bp, Mus musculus
tgaatccttctcagctaagctgtag

SEQ ID NO: 845926 - DNA, 25 bp, Mus musculus
tgaatccttctctgctaagctgtag

SEQ ID NO: 845927 - DNA, 25 bp, Mus musculus
tgaatcctttacatgttgggagtgt

SEQ ID NO: 845928 - DNA, 25 bp, Mus musculus
tgaatcctttacttgttgggagtgt

SEQ ID NO: 845929 - DNA, 25 bp, Mus musculus
tgaatcctttccataatctcagcac

SEQ ID NO: 845930 - DNA, 25 bp, Mus musculus
tgaatcctttccttaatctcagcac

SEQ ID NO: 845931 - DNA, 25 bp, Mus musculus
tgaatcgaaataagccttcctcctc

SEQ ID NO: 845932 - DNA, 25 bp, Mus musculus
tgaatcgaaatatgccttcctcctc

SEQ ID NO: 845933 - DNA, 25 bp, Mus musculus
tgaatcgaacccagtctgcaccttt

SEQ ID NO: 845934 - DNA, 25 bp, Mus musculus
tgaatcgaaccctgtctgcaccttt

SEQ ID NO: 845935 - DNA, 25 bp, Mus musculus
tgaatcgagtccctctctgtaaaca

SEQ ID NO: 845936 - DNA, 25 bp, Mus musculus
tgaatcgagtccgtctctgtaaaca

SEQ ID NO: 845937 - DNA, 25 bp, Mus musculus
tgaatcgcatccagctgtggaaccc

SEQ ID NO: 845938 - DNA, 25 bp, Mus musculus
tgaatcgcatcctgctgtggaaccc

SEQ ID NO: 845939 - DNA, 25 bp, Mus musculus
tgaatcgcgaagagtgggccgcatc

SEQ ID NO: 845940 - DNA, 25 bp, Mus musculus
tgaatcgcgaagtgtgggccgcatc

SEQ ID NO: 845941 - DNA, 25 bp, Mus musculus
tgaatcggactgactattcatccgg

SEQ ID NO: 845942 - DNA, 25 bp, Mus musculus
tgaatcggactgtctattcatccgg

SEQ ID NO: 845943 - DNA, 25 bp, Mus musculus
tgaatcggcctcattctacctagtg

SEQ ID NO: 845944 - DNA, 25 bp, Mus musculus
tgaatcggcctctttctacctagtg

SEQ ID NO: 845945 - DNA, 25 bp, Mus musculus
tgaatcgggctacaaacctcaaggc

SEQ ID NO: 845946 - DNA, 25 bp, Mus musculus
tgaatcgggctagaaacctcaaggc

SEQ ID NO: 845947 - DNA, 25 bp, Mus musculus
tgaatcgggctgctaggcttgaatc

SEQ ID NO: 845948 - DNA, 25 bp, Mus musculus
tgaatcgggctggtaggcttgaatc

SEQ ID NO: 845949 - DNA, 25 bp, Mus musculus
tgaatcgggtcaacaacttctatgc

SEQ ID NO: 845950 - DNA, 25 bp, Mus musculus
tgaatcgggtcatcaacttctatgc

SEQ ID NO: 845951 - DNA, 25 bp, Mus musculus
tgaatcggtagacccacttcgactc

SEQ ID NO: 845952 - DNA, 25 bp, Mus musculus
tgaatcggtagagccacttcgactc

SEQ ID NO: 845953 - DNA, 25 bp, Mus musculus
tgaatcggtcagattttaatcccag

SEQ ID NO: 845954 - DNA, 25 bp, Mus musculus
tgaatcggtcagtttttaatcccag

SEQ ID NO: 845955 - DNA, 25 bp, Mus musculus
tgaatcgtccatatatataccttga

SEQ ID NO: 845956 - DNA, 25 bp, Mus musculus
tgaatcgtccatttatataccttga

SEQ ID NO: 845957 - DNA, 25 bp, Mus musculus
tgaatcgtggttactcaaatctgga

SEQ ID NO: 845958 - DNA, 25 bp, Mus musculus
tgaatcgtggtttctcaaatctgga

SEQ ID NO: 845959 - DNA, 25 bp, Mus musculus
tgaatcgtgttcagttacttggacg

SEQ ID NO: 845960 - DNA, 25 bp, Mus musculus
tgaatcgtgttctgttacttggacg

SEQ ID NO: 845961 - DNA, 25 bp, Mus musculus
tgaatcgtttgcagtgttgagtccc

SEQ ID NO: 845962 - DNA, 25 bp, Mus musculus
tgaatcgtttgctgtgttgagtccc

SEQ ID NO: 845963 - DNA, 25 bp, Mus musculus
tgaatctaggttcctgtcacttttt

SEQ ID NO: 845964 - DNA, 25 bp, Mus musculus
tgaatctaggttgctgtcacttttt

SEQ ID NO: 845965 - DNA, 25 bp, Mus musculus
tgaatctcacagatcctcggaagga

SEQ ID NO: 845966 - DNA, 25 bp, Mus musculus
tgaatctcacagttcctcggaagga

SEQ ID NO: 845967 - DNA, 25 bp, Mus musculus
tgaatctcaccgcttacctcgggaa

SEQ ID NO: 845968 - DNA, 25 bp, Mus musculus
tgaatctcaccggttacctcgggaa

SEQ ID NO: 845969 - DNA, 25 bp, Mus musculus
tgaatctcagggacgaactctctag

SEQ ID NO: 845970 - DNA, 25 bp, Mus musculus
tgaatctcagggtcgaactctctag

SEQ ID NO: 845971 - DNA, 25 bp, Mus musculus
tgaatctcatatcgcctgttgctct

SEQ ID NO: 845972 - DNA, 25 bp, Mus musculus
tgaatctcatatggcctgttgctct

SEQ ID NO: 845973 - DNA, 25 bp, Mus musculus
tgaatctcgagccagtctccaggaa

SEQ ID NO: 845974 - DNA, 25 bp, Mus musculus
tgaatctcgagcgagtctccaggaa

SEQ ID NO: 845975 - DNA, 25 bp, Mus musculus
tgaatctcgggacctgtcttacagc

SEQ ID NO: 845976 - DNA, 25 bp, Mus musculus
tgaatctcgggagctgtcttacagc

SEQ ID NO: 845977 - DNA, 25 bp, Mus musculus
tgaatctctgtccaattcagcctgc

SEQ ID NO: 845978 - DNA, 25 bp, Mus musculus
tgaatctctgtcgaattcagcctgc

SEQ ID NO: 845979 - DNA, 25 bp, Mus musculus
tgaatctgaacacgcttcacaaaat

SEQ ID NO: 845980 - DNA, 25 bp, Mus musculus
tgaatctgaacaggcttcacaaaat

SEQ ID NO: 845981 - DNA, 25 bp, Mus musculus
tgaatctgaagacagcttgctcact

SEQ ID NO: 845982 - DNA, 25 bp, Mus musculus
tgaatctgaagagagcttgctcact

SEQ ID NO: 845983 - DNA, 25 bp, Mus musculus
tgaatctgaagccactctgagccat

SEQ ID NO: 845984 - DNA, 25 bp, Mus musculus
tgaatctgaagcgactctgagccat

SEQ ID NO: 845985 - DNA, 25 bp, Mus musculus
tgaatctgattaccagtcaaagcag

SEQ ID NO: 845986 - DNA, 25 bp, Mus musculus
tgaatctgattagcagtcaaagcag

SEQ ID NO: 845987 - DNA, 25 bp, Mus musculus
tgaatctgcactaagtaccacctga

SEQ ID NO: 845988 - DNA, 25 bp, Mus musculus
tgaatctgcacttagtaccacctga

SEQ ID NO: 845989 - DNA, 25 bp, Mus musculus
tgaatctgcatccacccagtcctga

SEQ ID NO: 845990 - DNA, 25 bp, Mus musculus
tgaatctgcatcgacccagtcctga

SEQ ID NO: 845991 - DNA, 25 bp, Mus musculus
tgaatctgcctcacaatcggaactt

SEQ ID NO: 845992 - DNA, 25 bp, Mus musculus
tgaatctgcctctcaatcggaactt

SEQ ID NO: 845993 - DNA, 25 bp, Mus musculus
tgaatctgcgcacggcatctttcca

SEQ ID NO: 845994 - DNA, 25 bp, Mus musculus
tgaatctgcgcagggcatctttcca

SEQ ID NO: 845995 - DNA, 25 bp, Mus musculus
tgaatctgctgcctattgtggctcc

SEQ ID NO: 845996 - DNA, 25 bp, Mus musculus
tgaatctgctgcgtattgtggctcc

SEQ ID NO: 845997 - DNA, 25 bp, Mus musculus
tgaatctgctttctcattcaaacca

SEQ ID NO: 845998 - DNA, 25 bp, Mus musculus
tgaatctgctttgtcattcaaacca

SEQ ID NO: 845999 - DNA, 25 bp, Mus musculus
tgaatctggaggctcagccattcta

SEQ ID NO: 846000 - DNA, 25 bp, Mus musculus
tgaatctggagggtcagccattcta

SEQ ID NO: 846001 - DNA, 25 bp, Mus musculus
tgaatctgggccataaccacctgga

SEQ ID NO: 846002 - DNA, 25 bp, Mus musculus
tgaatctgggccttaaccacctgga

SEQ ID NO: 846003 - DNA, 25 bp, Mus musculus
tgaatctgtacaccattttcccttt

SEQ ID NO: 846004 - DNA, 25 bp, Mus musculus
tgaatctgtacagcattttcccttt

SEQ ID NO: 846005 - DNA, 25 bp, Mus musculus
tgaatctgtataaagcccggcaagt

SEQ ID NO: 846006 - DNA, 25 bp, Mus musculus
tgaatctgtatatagcccggcaagt

SEQ ID NO: 846007 - DNA, 25 bp, Mus musculus
tgaatctgtcacctgcactgtagag

SEQ ID NO: 846008 - DNA, 25 bp, Mus musculus
tgaatctgtcacgtgcactgtagag

SEQ ID NO: 846009 - DNA, 25 bp, Mus musculus
tgaatctgtcatagcttgtgagtac

SEQ ID NO: 846010 - DNA, 25 bp, Mus musculus
tgaatctgtcattgcttgtgagtac

SEQ ID NO: 846011 - DNA, 25 bp, Mus musculus
tgaatctgtctaatttttaaacctt

SEQ ID NO: 846012 - DNA, 25 bp, Mus musculus
tgaatctgtctattttttaaacctt

SEQ ID NO: 846013 - DNA, 25 bp, Mus musculus
tgaatctgtgatcatcctcttgtgg

SEQ ID NO: 846014 - DNA, 25 bp, Mus musculus
tgaatctgtgatgatcctcttgtgg

SEQ ID NO: 846015 - DNA, 25 bp, Mus musculus
tgaatctgtttgcacagatgcccgt

SEQ ID NO: 846016 - DNA, 25 bp, Mus musculus
tgaatctgtttggacagatgcccgt

SEQ ID NO: 846017 - DNA, 25 bp, Mus musculus
tgaatcttagatagagcccttgttt

SEQ ID NO: 846018 - DNA, 25 bp, Mus musculus
tgaatcttagattgagcccttgttt

SEQ ID NO: 846019 - DNA, 25 bp, Mus musculus
tgaatcttcaggacgtctcttgtga

SEQ ID NO: 846020 - DNA, 25 bp, Mus musculus
tgaatcttcaggtcgtctcttgtga

SEQ ID NO: 846021 - DNA, 25 bp, Mus musculus
tgaatcttccggcatgctggctgag

SEQ ID NO: 846022 - DNA, 25 bp, Mus musculus
tgaatcttccgggatgctggctgag

SEQ ID NO: 846023 - DNA, 25 bp, Mus musculus
tgaatcttctgtatgccaacctcat

SEQ ID NO: 846024 - DNA, 25 bp, Mus musculus
tgaatcttctgtttgccaacctcat

SEQ ID NO: 846025 - DNA, 25 bp, Mus musculus
tgaatcttcttcatctcctcggagt

SEQ ID NO: 846026 - DNA, 25 bp, Mus musculus
tgaatcttcttcttctcctcggagt

SEQ ID NO: 846027 - DNA, 25 bp, Mus musculus
tgaatcttgatcatgggcatcccca

SEQ ID NO: 846028 - DNA, 25 bp, Mus musculus
tgaatcttgatcttgggcatcccca

SEQ ID NO: 846029 - DNA, 25 bp, Mus musculus
tgaatcttgctgaggctaggctggc

SEQ ID NO: 846030 - DNA, 25 bp, Mus musculus
tgaatcttgctgtggctaggctggc

SEQ ID NO: 846031 - DNA, 25 bp, Mus musculus
tgaatcttgtgcctgacagctcgtt

SEQ ID NO: 846032 - DNA, 25 bp, Mus musculus
tgaatcttgtgcgtgacagctcgtt

SEQ ID NO: 846033 - DNA, 25 bp, Mus musculus
tgaatcttgttgatctcttgcccaa

SEQ ID NO: 846034 - DNA, 25 bp, Mus musculus
tgaatcttgttgttctcttgcccaa

SEQ ID NO: 846035 - DNA, 25 bp, Mus musculus
tgaatcttttctacccgtccattta

SEQ ID NO: 846036 - DNA, 25 bp, Mus musculus
tgaatcttttcttcccgtccattta

SEQ ID NO: 846037 - DNA, 25 bp, Mus musculus
tgaatgaaactcaaacctggcctcc

SEQ ID NO: 846038 - DNA, 25 bp, Mus musculus
tgaatgaaactctaacctggcctcc

SEQ ID NO: 846039 - DNA, 25 bp, Mus musculus
tgaatgaaatcaagcattgccttaa

SEQ ID NO: 846040 - DNA, 25 bp, Mus musculus
tgaatgaaatcatgcattgccttaa

SEQ ID NO: 846041 - DNA, 25 bp, Mus musculus
tgaatgaacaccagacccggcagtt

SEQ ID NO: 846042 - DNA, 25 bp, Mus musculus
tgaatgaacacctgacccggcagtt

SEQ ID NO: 846043 - DNA, 25 bp, Mus musculus
tgaatgaacctgatgctgctaccat

SEQ ID NO: 846044 - DNA, 25 bp, Mus musculus
tgaatgaacctgttgctgctaccat

SEQ ID NO: 846045 - DNA, 25 bp, Mus musculus
tgaatgaaggatcctaaaactgagg

SEQ ID NO: 846046 - DNA, 25 bp, Mus musculus
tgaatgaaggatgctaaaactgagg

SEQ ID NO: 846047 - DNA, 25 bp, Mus musculus
tgaatgaatgctaaggctacctatt

SEQ ID NO: 846048 - DNA, 25 bp, Mus musculus
tgaatgaatgcttaggctacctatt

SEQ ID NO: 846049 - DNA, 25 bp, Mus musculus
tgaatgaatgtgatgcattccctaa

SEQ ID NO: 846050 - DNA, 25 bp, Mus musculus
tgaatgaatgtgttgcattccctaa

SEQ ID NO: 846051 - DNA, 25 bp, Mus musculus
tgaatgacacagaaaccatccggac

SEQ ID NO: 846052 - DNA, 25 bp, Mus musculus
tgaatgacacagtaaccatccggac

SEQ ID NO: 846053 - DNA, 25 bp, Mus musculus
tgaatgacacgacgctttaccatga

SEQ ID NO: 846054 - DNA, 25 bp, Mus musculus
tgaatgacacgaggctttaccatga

SEQ ID NO: 846055 - DNA, 25 bp, Mus musculus
tgaatgacagccacgcgtggtcctg

SEQ ID NO: 846056 - DNA, 25 bp, Mus musculus
tgaatgacagcctcgcgtggtcctg

SEQ ID NO: 846057 - DNA, 25 bp, Mus musculus
tgaatgaccccgagcggcagaggca

SEQ ID NO: 846058 - DNA, 25 bp, Mus musculus
tgaatgaccccgtgcggcagaggca

SEQ ID NO: 846059 - DNA, 25 bp, Mus musculus
tgaatgacgttgaagacctaccctt

SEQ ID NO: 846060 - DNA, 25 bp, Mus musculus
tgaatgacgttgtagacctaccctt

SEQ ID NO: 846061 - DNA, 25 bp, Mus musculus
tgaatgactgcacccataacgatcc

SEQ ID NO: 846062 - DNA, 25 bp, Mus musculus
tgaatgactgcagccataacgatcc

SEQ ID NO: 846063 - DNA, 25 bp, Mus musculus
tgaatgacttcacaagccctggtct

SEQ ID NO: 846064 - DNA, 25 bp, Mus musculus
tgaatgacttcagaagccctggtct

SEQ ID NO: 846065 - DNA, 25 bp, Mus musculus
tgaatgagacgtacacatgtgaaga

SEQ ID NO: 846066 - DNA, 25 bp, Mus musculus
tgaatgagacgttcacatgtgaaga

SEQ ID NO: 846067 - DNA, 25 bp, Mus musculus
tgaatgagagctcccagcacgtcac

SEQ ID NO: 846068 - DNA, 25 bp, Mus musculus
tgaatgagagctgccagcacgtcac

SEQ ID NO: 846069 - DNA, 25 bp, Mus musculus
tgaatgagcgtcactatggagcctt

SEQ ID NO: 846070 - DNA, 25 bp, Mus musculus
tgaatgagcgtctctatggagcctt

SEQ ID NO: 846071 - DNA, 25 bp, Mus musculus
tgaatgagctcgagtccctgacatg

SEQ ID NO: 846072 - DNA, 25 bp, Mus musculus
tgaatgagctcgtgtccctgacatg

SEQ ID NO: 846073 - DNA, 25 bp, Mus musculus
tgaatgagctgaacgccacgggcca

SEQ ID NO: 846074 - DNA, 25 bp, Mus musculus
tgaatgagctgatcgccacgggcca

SEQ ID NO: 846075 - DNA, 25 bp, Mus musculus
tgaatgaggaacatgatgtcttgat

SEQ ID NO: 846076 - DNA, 25 bp, Mus musculus
tgaatgaggaacttgatgtcttgat

SEQ ID NO: 846077 - DNA, 25 bp, Mus musculus
tgaatgaggattactttccatcagg

SEQ ID NO: 846078 - DNA, 25 bp, Mus musculus
tgaatgaggatttctttccatcagg

SEQ ID NO: 846079 - DNA, 25 bp, Mus musculus
tgaatgagtctcagtggtgttgcct

SEQ ID NO: 846080 - DNA, 25 bp, Mus musculus
tgaatgagtctctgtggtgttgcct

SEQ ID NO: 846081 - DNA, 25 bp, Mus musculus
tgaatgagtggaactagactagact

SEQ ID NO: 846082 - DNA, 25 bp, Mus musculus
tgaatgagtggatctagactagact

SEQ ID NO: 846083 - DNA, 25 bp, Mus musculus
tgaatgagtggcacctgccagcacg

SEQ ID NO: 846084 - DNA, 25 bp, Mus musculus
tgaatgagtggctcctgccagcacg

SEQ ID NO: 846085 - DNA, 25 bp, Mus musculus
tgaatgataagaactggaaccctgg

SEQ ID NO: 846086 - DNA, 25 bp, Mus musculus
tgaatgataagatctggaaccctgg

SEQ ID NO: 846087 - DNA, 25 bp, Mus musculus
tgaatgatcccgatgtttctgagca

SEQ ID NO: 846088 - DNA, 25 bp, Mus musculus
tgaatgatcccgttgtttctgagca

SEQ ID NO: 846089 - DNA, 25 bp, Mus musculus
tgaatgatggaaactgtttccctat

SEQ ID NO: 846090 - DNA, 25 bp, Mus musculus
tgaatgatggaatctgtttccctat

SEQ ID NO: 846091 - DNA, 25 bp, Mus musculus
tgaatgatgtgtacctgcctgtcca

SEQ ID NO: 846092 - DNA, 25 bp, Mus musculus
tgaatgatgtgttcctgcctgtcca

SEQ ID NO: 846093 - DNA, 25 bp, Mus musculus
tgaatgcaaaggaatcctcacccct

SEQ ID NO: 846094 - DNA, 25 bp, Mus musculus
tgaatgcaaaggtatcctcacccct

SEQ ID NO: 846095 - DNA, 25 bp, Mus musculus
tgaatgcaaccaacatcgagctagc

SEQ ID NO: 846096 - DNA, 25 bp, Mus musculus
tgaatgcaaccatcatcgagctagc

SEQ ID NO: 846097 - DNA, 25 bp, Mus musculus
tgaatgcaacttacaatgcttaata

SEQ ID NO: 846098 - DNA, 25 bp, Mus musculus
tgaatgcaactttcaatgcttaata

SEQ ID NO: 846099 - DNA, 25 bp, Mus musculus
tgaatgcacgaacccggacacgctg

SEQ ID NO: 846100 - DNA, 25 bp, Mus musculus
tgaatgcacgaagccggacacgctg

SEQ ID NO: 846101 - DNA, 25 bp, Mus musculus
tgaatgcagaataagcgcgctctcc

SEQ ID NO: 846102 - DNA, 25 bp, Mus musculus
tgaatgcagaattagcgcgctctcc

SEQ ID NO: 846103 - DNA, 25 bp, Mus musculus
tgaatgcagggcatcgtttcaacca

SEQ ID NO: 846104 - DNA, 25 bp, Mus musculus
tgaatgcagggcttcgtttcaacca

SEQ ID NO: 846105 - DNA, 25 bp, Mus musculus
tgaatgcatgcaagttcctctctct

SEQ ID NO: 846106 - DNA, 25 bp, Mus musculus
tgaatgcatgcatgttcctctctct

SEQ ID NO: 846107 - DNA, 25 bp, Mus musculus
tgaatgccagatcggtctacatcgc

SEQ ID NO: 846108 - DNA, 25 bp, Mus musculus
tgaatgccagatgggtctacatcgc

SEQ ID NO: 846109 - DNA, 25 bp, Mus musculus
tgaatgccagtgacaagtccacagt

SEQ ID NO: 846110 - DNA, 25 bp, Mus musculus
tgaatgccagtgtcaagtccacagt

SEQ ID NO: 846111 - DNA, 25 bp, Mus musculus
tgaatgccattcagattgatctctt

SEQ ID NO: 846112 - DNA, 25 bp, Mus musculus
tgaatgccattctgattgatctctt

SEQ ID NO: 846113 - DNA, 25 bp, Mus musculus
tgaatgccatttccaaggtcccaaa

SEQ ID NO: 846114 - DNA, 25 bp, Mus musculus
tgaatgccatttgcaaggtcccaaa

SEQ ID NO: 846115 - DNA, 25 bp, Mus musculus
tgaatgcccaatagatgccccagtg

SEQ ID NO: 846116 - DNA, 25 bp, Mus musculus
tgaatgcccaattgatgccccagtg

SEQ ID NO: 846117 - DNA, 25 bp, Mus musculus
tgaatgcccgaacatcaacgactct

SEQ ID NO: 846118 - DNA, 25 bp, Mus musculus
tgaatgcccgaagatcaacgactct

SEQ ID NO: 846119 - DNA, 25 bp, Mus musculus
tgaatgccctgcctagagtgccctg

SEQ ID NO: 846120 - DNA, 25 bp, Mus musculus
tgaatgccctgcgtagagtgccctg

SEQ ID NO: 846121 - DNA, 25 bp, Mus musculus
tgaatgccctgtcggccctggtgtt

SEQ ID NO: 846122 - DNA, 25 bp, Mus musculus
tgaatgccctgtgggccctggtgtt

SEQ ID NO: 846123 - DNA, 25 bp, Mus musculus
tgaatgcctcatcgtgctaatacct

SEQ ID NO: 846124 - DNA, 25 bp, Mus musculus
tgaatgcctcatggtgctaatacct

SEQ ID NO: 846125 - DNA, 25 bp, Mus musculus
tgaatgccttcaactacagtctgag

SEQ ID NO: 846126 - DNA, 25 bp, Mus musculus
tgaatgccttcatctacagtctgag

SEQ ID NO: 846127 - DNA, 25 bp, Mus musculus
tgaatgccttgaactttggtctccc

SEQ ID NO: 846128 - DNA, 25 bp, Mus musculus
tgaatgccttgatctttggtctccc

SEQ ID NO: 846129 - DNA, 25 bp, Mus musculus
tgaatgcggtccaggctgtgtttca

SEQ ID NO: 846130 - DNA, 25 bp, Mus musculus
tgaatgcggtcctggctgtgtttca

SEQ ID NO: 846131 - DNA, 25 bp, Mus musculus
tgaatgcgtattacttaaaccggaa

SEQ ID NO: 846132 - DNA, 25 bp, Mus musculus
tgaatgcgtatttcttaaaccggaa

SEQ ID NO: 846133 - DNA, 25 bp, Mus musculus
tgaatgctagtacccaagaccttga

SEQ ID NO: 846134 - DNA, 25 bp, Mus musculus
tgaatgctagtagccaagaccttga

SEQ ID NO: 846135 - DNA, 25 bp, Mus musculus
tgaatgctgatacacagactcacag

SEQ ID NO: 846136 - DNA, 25 bp, Mus musculus
tgaatgctgatagacagactcacag

SEQ ID NO: 846137 - DNA, 25 bp, Mus musculus
tgaatgctgccaaggtacccttgat

SEQ ID NO: 846138 - DNA, 25 bp, Mus musculus
tgaatgctgccatggtacccttgat

SEQ ID NO: 846139 - DNA, 25 bp, Mus musculus
tgaatgctgcttcgctcaagcgaga

SEQ ID NO: 846140 - DNA, 25 bp, Mus musculus
tgaatgctgcttggctcaagcgaga

SEQ ID NO: 846141 - DNA, 25 bp, Mus musculus
tgaatgctggcacatgctgccacag

SEQ ID NO: 846142 - DNA, 25 bp, Mus musculus
tgaatgctggcagatgctgccacag

SEQ ID NO: 846143 - DNA, 25 bp, Mus musculus
tgaatgctgtggacagttctacaac

SEQ ID NO: 846144 - DNA, 25 bp, Mus musculus
tgaatgctgtggtcagttctacaac

SEQ ID NO: 846145 - DNA, 25 bp, Mus musculus
tgaatgctgttcatcagccaatcca

SEQ ID NO: 846146 - DNA, 25 bp, Mus musculus
tgaatgctgttcttcagccaatcca

SEQ ID NO: 846147 - DNA, 25 bp, Mus musculus
tgaatgcttcttacgtgtgtgtagg

SEQ ID NO: 846148 - DNA, 25 bp, Mus musculus
tgaatgcttctttcgtgtgtgtagg

SEQ ID NO: 846149 - DNA, 25 bp, Mus musculus
tgaatggacacaacctttttagagc

SEQ ID NO: 846150 - DNA, 25 bp, Mus musculus
tgaatggacacatcctttttagagc

SEQ ID NO: 846151 - DNA, 25 bp, Mus musculus
tgaatggacacgcaagcccctctct

SEQ ID NO: 846152 - DNA, 25 bp, Mus musculus
tgaatggacacggaagcccctctct

SEQ ID NO: 846153 - DNA, 25 bp, Mus musculus
tgaatggacgaacaggagcagacca

SEQ ID NO: 846154 - DNA, 25 bp, Mus musculus
tgaatggacgaagaggagcagacca

SEQ ID NO: 846155 - DNA, 25 bp, Mus musculus
tgaatggagattccgagaaatcctg

SEQ ID NO: 846156 - DNA, 25 bp, Mus musculus
tgaatggagattgcgagaaatcctg

SEQ ID NO: 846157 - DNA, 25 bp, Mus musculus
tgaatggatcctcatttgtaaaaat

SEQ ID NO: 846158 - DNA, 25 bp, Mus musculus
tgaatggatcctgatttgtaaaaat

SEQ ID NO: 846159 - DNA, 25 bp, Mus musculus
tgaatggatcttcccacatgtcttt

SEQ ID NO: 846160 - DNA, 25 bp, Mus musculus
tgaatggatcttgccacatgtcttt

SEQ ID NO: 846161 - DNA, 25 bp, Mus musculus
tgaatggccacaccatcccagaaaa

SEQ ID NO: 846162 - DNA, 25 bp, Mus musculus
tgaatggccacagcatcccagaaaa

SEQ ID NO: 846163 - DNA, 25 bp, Mus musculus
tgaatggcctagagaacctattttt

SEQ ID NO: 846164 - DNA, 25 bp, Mus musculus
tgaatggcctagtgaacctattttt

SEQ ID NO: 846165 - DNA, 25 bp, Mus musculus
tgaatggccttaacatccaaccagc

SEQ ID NO: 846166 - DNA, 25 bp, Mus musculus
tgaatggccttatcatccaaccagc

SEQ ID NO: 846167 - DNA, 25 bp, Mus musculus
tgaatggcgcctaaaccagtgcact

SEQ ID NO: 846168 - DNA, 25 bp, Mus musculus
tgaatggcgccttaaccagtgcact

SEQ ID NO: 846169 - DNA, 25 bp, Mus musculus
tgaatggcgctcactgttgcccttt

SEQ ID NO: 846170 - DNA, 25 bp, Mus musculus
tgaatggcgctctctgttgcccttt

SEQ ID NO: 846171 - DNA, 25 bp, Mus musculus
tgaatggctaatacttggccagaag

SEQ ID NO: 846172 - DNA, 25 bp, Mus musculus
tgaatggctaattcttggccagaag

SEQ ID NO: 846173 - DNA, 25 bp, Mus musculus
tgaatggctgatacgcacgcacctt

SEQ ID NO: 846174 - DNA, 25 bp, Mus musculus
tgaatggctgattcgcacgcacctt

SEQ ID NO: 846175 - DNA, 25 bp, Mus musculus
tgaatgggaactcgtcttgctgacc

SEQ ID NO: 846176 - DNA, 25 bp, Mus musculus
tgaatgggaactggtcttgctgacc

SEQ ID NO: 846177 - DNA, 25 bp, Mus musculus
tgaatgggccatcgtgccttgtttt

SEQ ID NO: 846178 - DNA, 25 bp, Mus musculus
tgaatgggccatggtgccttgtttt

SEQ ID NO: 846179 - DNA, 25 bp, Mus musculus
tgaatgggtaaccacaccactgctg

SEQ ID NO: 846180 - DNA, 25 bp, Mus musculus
tgaatgggtaacgacaccactgctg

SEQ ID NO: 846181 - DNA, 25 bp, Mus musculus
tgaatgggttgcactatctgactga

SEQ ID NO: 846182 - DNA, 25 bp, Mus musculus
tgaatgggttgctctatctgactga

SEQ ID NO: 846183 - DNA, 25 bp, Mus musculus
tgaatggtcactactctcctatgag

SEQ ID NO: 846184 - DNA, 25 bp, Mus musculus
tgaatggtcacttctctcctatgag

SEQ ID NO: 846185 - DNA, 25 bp, Mus musculus
tgaatggttactctctgcctcctaa

SEQ ID NO: 846186 - DNA, 25 bp, Mus musculus
tgaatggttactgtctgcctcctaa

SEQ ID NO: 846187 - DNA, 25 bp, Mus musculus
tgaatggtttagatgaggccccagg

SEQ ID NO: 846188 - DNA, 25 bp, Mus musculus
tgaatggtttagttgaggccccagg

SEQ ID NO: 846189 - DNA, 25 bp, Mus musculus
tgaatggtttcactgtctaggcagg

SEQ ID NO: 846190 - DNA, 25 bp, Mus musculus
tgaatggtttcagtgtctaggcagg

SEQ ID NO: 846191 - DNA, 25 bp, Mus musculus
tgaatgtaacttccgagggtccccg

SEQ ID NO: 846192 - DNA, 25 bp, Mus musculus
tgaatgtaacttcgccatctaaccc

SEQ ID NO: 846193 - DNA, 25 bp, Mus musculus
tgaatgtaacttgcgagggtccccg

SEQ ID NO: 846194 - DNA, 25 bp, Mus musculus
tgaatgtaacttggccatctaaccc

SEQ ID NO: 846195 - DNA, 25 bp, Mus musculus
tgaatgtaagtgagctctcctaggg

SEQ ID NO: 846196 - DNA, 25 bp, Mus musculus
tgaatgtaagtgtgctctcctaggg

SEQ ID NO: 846197 - DNA, 25 bp, Mus musculus
tgaatgtacattcctttgtaatcaa

SEQ ID NO: 846198 - DNA, 25 bp, Mus musculus
tgaatgtacattgctttgtaatcaa

SEQ ID NO: 846199 - DNA, 25 bp, Mus musculus
tgaatgtacctcacagctagtctgg

SEQ ID NO: 846200 - DNA, 25 bp, Mus musculus
tgaatgtacctctcagctagtctgg

SEQ ID NO: 846201 - DNA, 25 bp, Mus musculus
tgaatgtactttctctacattgtct

SEQ ID NO: 846202 - DNA, 25 bp, Mus musculus
tgaatgtactttgtctacattgtct

SEQ ID NO: 846203 - DNA, 25 bp, Mus musculus
tgaatgtagccaataacacaggccc

SEQ ID NO: 846204 - DNA, 25 bp, Mus musculus
tgaatgtagccattaacacaggccc

SEQ ID NO: 846205 - DNA, 25 bp, Mus musculus
tgaatgtagcttacagctctgccca

SEQ ID NO: 846206 - DNA, 25 bp, Mus musculus
tgaatgtagctttcagctctgccca

SEQ ID NO: 846207 - DNA, 25 bp, Mus musculus
tgaatgtatccacataccttcccat

SEQ ID NO: 846208 - DNA, 25 bp, Mus musculus
tgaatgtatccagataccttcccat

SEQ ID NO: 846209 - DNA, 25 bp, Mus musculus
tgaatgtattgtaccctgagagcaa

SEQ ID NO: 846210 - DNA, 25 bp, Mus musculus
tgaatgtattgttccctgagagcaa

SEQ ID NO: 846211 - DNA, 25 bp, Mus musculus
tgaatgtcaaacacacacacccggg

SEQ ID NO: 846212 - DNA, 25 bp, Mus musculus
tgaatgtcaaactcacacacccggg

SEQ ID NO: 846213 - DNA, 25 bp, Mus musculus
tgaatgtcaataagtgtgtacacac

SEQ ID NO: 846214 - DNA, 25 bp, Mus musculus
tgaatgtcaatatgtgtgtacacac

SEQ ID NO: 846215 - DNA, 25 bp, Mus musculus
tgaatgtcacgtctgtgggaagacc

SEQ ID NO: 846216 - DNA, 25 bp, Mus musculus
tgaatgtcacgtgtgtgggaagacc

SEQ ID NO: 846217 - DNA, 25 bp, Mus musculus
tgaatgtcactcagcggcttcatga

SEQ ID NO: 846218 - DNA, 25 bp, Mus musculus
tgaatgtcactctgcggcttcatga

SEQ ID NO: 846219 - DNA, 25 bp, Mus musculus
tgaatgtcatctctatttgaaccag

SEQ ID NO: 846220 - DNA, 25 bp, Mus musculus
tgaatgtcatctgtatttgaaccag

SEQ ID NO: 846221 - DNA, 25 bp, Mus musculus
tgaatgtccagaactgtgtttccct

SEQ ID NO: 846222 - DNA, 25 bp, Mus musculus
tgaatgtccagaagtcaggtgttct

SEQ ID NO: 846223 - DNA, 25 bp, Mus musculus
tgaatgtccagatctgtgtttccct

SEQ ID NO: 846224 - DNA, 25 bp, Mus musculus
tgaatgtccagatgtcaggtgttct

SEQ ID NO: 846225 - DNA, 25 bp, Mus musculus
tgaatgtcccacaggactaaccttt

SEQ ID NO: 846226 - DNA, 25 bp, Mus musculus
tgaatgtcccactggactaaccttt

SEQ ID NO: 846227 - DNA, 25 bp, Mus musculus
tgaatgtcgtcaaccctcatctcca

SEQ ID NO: 846228 - DNA, 25 bp, Mus musculus
tgaatgtcgtcatccctcatctcca

SEQ ID NO: 846229 - DNA, 25 bp, Mus musculus
tgaatgtcttgtcccctctggaaag

SEQ ID NO: 846230 - DNA, 25 bp, Mus musculus
tgaatgtcttgtgccctctggaaag

SEQ ID NO: 846231 - DNA, 25 bp, Mus musculus
tgaatgtgactcattcttctcctta

SEQ ID NO: 846232 - DNA, 25 bp, Mus musculus
tgaatgtgactctttcttctcctta

SEQ ID NO: 846233 - DNA, 25 bp, Mus musculus
tgaatgtgcaccatgggtctcagac

SEQ ID NO: 846234 - DNA, 25 bp, Mus musculus
tgaatgtgcaccttgggtctcagac

SEQ ID NO: 846235 - DNA, 25 bp, Mus musculus
tgaatgtgcacgctttgccctaaag

SEQ ID NO: 846236 - DNA, 25 bp, Mus musculus
tgaatgtgcacggtttgccctaaag

SEQ ID NO: 846237 - DNA, 25 bp, Mus musculus
tgaatgtgcagactgctcaccagcc

SEQ ID NO: 846238 - DNA, 25 bp, Mus musculus
tgaatgtgcagagtgctcaccagcc

SEQ ID NO: 846239 - DNA, 25 bp, Mus musculus
tgaatgtgccgtcaccaagtctatt

SEQ ID NO: 846240 - DNA, 25 bp, Mus musculus
tgaatgtgccgtgaccaagtctatt

SEQ ID NO: 846241 - DNA, 25 bp, Mus musculus
tgaatgtgcctaatgtcttcctgac

SEQ ID NO: 846242 - DNA, 25 bp, Mus musculus
tgaatgtgcctattgtcttcctgac

SEQ ID NO: 846243 - DNA, 25 bp, Mus musculus
tgaatgtggcttacaggcgctgctt

SEQ ID NO: 846244 - DNA, 25 bp, Mus musculus
tgaatgtggctttcaggcgctgctt

SEQ ID NO: 846245 - DNA, 25 bp, Mus musculus
tgaatgtggtgcaggagttttcatg

SEQ ID NO: 846246 - DNA, 25 bp, Mus musculus
tgaatgtggtgctggagttttcatg

SEQ ID NO: 846247 - DNA, 25 bp, Mus musculus
tgaatgtgtcatcttaccatcctga

SEQ ID NO: 846248 - DNA, 25 bp, Mus musculus
tgaatgtgtcatgttaccatcctga

SEQ ID NO: 846249 - DNA, 25 bp, Mus musculus
tgaatgtgtccaaaagctgcccagc

SEQ ID NO: 846250 - DNA, 25 bp, Mus musculus
tgaatgtgtccataagctgcccagc

SEQ ID NO: 846251 - DNA, 25 bp, Mus musculus
tgaatgtgtgaaccttactctctcc

SEQ ID NO: 846252 - DNA, 25 bp, Mus musculus
tgaatgtgtgaagcttactctctcc

SEQ ID NO: 846253 - DNA, 25 bp, Mus musculus
tgaatgtgtgctcaccgtcgttggc

SEQ ID NO: 846254 - DNA, 25 bp, Mus musculus
tgaatgtgtgctgaccgtcgttggc

SEQ ID NO: 846255 - DNA, 25 bp, Mus musculus
tgaatgtgtggcctcgaataatgtg

SEQ ID NO: 846256 - DNA, 25 bp, Mus musculus
tgaatgtgtggcgtcgaataatgtg

SEQ ID NO: 846257 - DNA, 25 bp, Mus musculus
tgaatgttaaatatccaggccggtg

SEQ ID NO: 846258 - DNA, 25 bp, Mus musculus
tgaatgttaaatttccaggccggtg

SEQ ID NO: 846259 - DNA, 25 bp, Mus musculus
tgaatgttaaccaatcaccactccc

SEQ ID NO: 846260 - DNA, 25 bp, Mus musculus
tgaatgttaacctatcaccactccc

SEQ ID NO: 846261 - DNA, 25 bp, Mus musculus
tgaatgttcacgagaggcacccagc

SEQ ID NO: 846262 - DNA, 25 bp, Mus musculus
tgaatgttcacgtgaggcacccagc

SEQ ID NO: 846263 - DNA, 25 bp, Mus musculus
tgaatgttctatactcctatgttct

SEQ ID NO: 846264 - DNA, 25 bp, Mus musculus
tgaatgttctattctcctatgttct

SEQ ID NO: 846265 - DNA, 25 bp, Mus musculus
tgaatgtttagccatgttcccaacc

SEQ ID NO: 846266 - DNA, 25 bp, Mus musculus
tgaatgtttagcgatgttcccaacc

SEQ ID NO: 846267 - DNA, 25 bp, Mus musculus
tgaatgtttctactgcagtctgaga

SEQ ID NO: 846268 - DNA, 25 bp, Mus musculus
tgaatgtttctagtgcagtctgaga

SEQ ID NO: 846269 - DNA, 25 bp, Mus musculus
tgaatgtttgccctatctgcttacg

SEQ ID NO: 846270 - DNA, 25 bp, Mus musculus
tgaatgtttgccgtatctgcttacg

SEQ ID NO: 846271 - DNA, 25 bp, Mus musculus
tgaattaaattgatctcccgcctgc

SEQ ID NO: 846272 - DNA, 25 bp, Mus musculus
tgaattaaattgttctcccgcctgc

SEQ ID NO: 846273 - DNA, 25 bp, Mus musculus
tgaattacaagactcacctgcctcc

SEQ ID NO: 846274 - DNA, 25 bp, Mus musculus
tgaattacaagagtcacctgcctcc

SEQ ID NO: 846275 - DNA, 25 bp, Mus musculus
tgaattacacggaaacgcacgcgct

SEQ ID NO: 846276 - DNA, 25 bp, Mus musculus
tgaattacacggtaacgcacgcgct

SEQ ID NO: 846277 - DNA, 25 bp, Mus musculus
tgaattacactcctatccctaatgt

SEQ ID NO: 846278 - DNA, 25 bp, Mus musculus
tgaattacactcgtatccctaatgt

SEQ ID NO: 846279 - DNA, 25 bp, Mus musculus
tgaattacatcaacccacagtgggc

SEQ ID NO: 846280 - DNA, 25 bp, Mus musculus
tgaattacatcatcccacagtgggc

SEQ ID NO: 846281 - DNA, 25 bp, Mus musculus
tgaattacatccacatctcccaaat

SEQ ID NO: 846282 - DNA, 25 bp, Mus musculus
tgaattacatcctcatctcccaaat

SEQ ID NO: 846283 - DNA, 25 bp, Mus musculus
tgaattagcagcaaaccattatcct

SEQ ID NO: 846284 - DNA, 25 bp, Mus musculus
tgaattagcagctaaccattatcct

SEQ ID NO: 846285 - DNA, 25 bp, Mus musculus
tgaattagcggacaacacaggtgat

SEQ ID NO: 846286 - DNA, 25 bp, Mus musculus
tgaattagcggagaacacaggtgat

SEQ ID NO: 846287 - DNA, 25 bp, Mus musculus
tgaattaggctacgtctctccactc

SEQ ID NO: 846288 - DNA, 25 bp, Mus musculus
tgaattaggctaggtctctccactc

SEQ ID NO: 846289 - DNA, 25 bp, Mus musculus
tgaattagttcaacaccagcccggg

SEQ ID NO: 846290 - DNA, 25 bp, Mus musculus
tgaattagttcatcaccagcccggg

SEQ ID NO: 846291 - DNA, 25 bp, Mus musculus
tgaattataccaatggcttcccctg

SEQ ID NO: 846292 - DNA, 25 bp, Mus musculus
tgaattataccattggcttcccctg

SEQ ID NO: 846293 - DNA, 25 bp, Mus musculus
tgaattatgtgcctgcgtagctgcc

SEQ ID NO: 846294 - DNA, 25 bp, Mus musculus
tgaattatgtgcgtgcgtagctgcc

SEQ ID NO: 846295 - DNA, 25 bp, Mus musculus
tgaattcaaatcacaccaacttctc

SEQ ID NO: 846296 - DNA, 25 bp, Mus musculus
tgaattcaaatctcaccaacttctc

SEQ ID NO: 846297 - DNA, 25 bp, Mus musculus
tgaattcacatccagcagtgcccat

SEQ ID NO: 846298 - DNA, 25 bp, Mus musculus
tgaattcacatcgagcagtgcccat

SEQ ID NO: 846299 - DNA, 25 bp, Mus musculus
tgaattcaccacactctgatgtcct

SEQ ID NO: 846300 - DNA, 25 bp, Mus musculus
tgaattcaccactctctgatgtcct

SEQ ID NO: 846301 - DNA, 25 bp, Mus musculus
tgaattcactgtacctcaggagcat

SEQ ID NO: 846302 - DNA, 25 bp, Mus musculus
tgaattcactgttcctcaggagcat

SEQ ID NO: 846303 - DNA, 25 bp, Mus musculus
tgaattcagaccctgtgggaaacac

SEQ ID NO: 846304 - DNA, 25 bp, Mus musculus
tgaattcagaccgtgtgggaaacac

SEQ ID NO: 846305 - DNA, 25 bp, Mus musculus
tgaattcagagaatcgctttctgaa

SEQ ID NO: 846306 - DNA, 25 bp, Mus musculus
tgaattcagagacggtgcactccct

SEQ ID NO: 846307 - DNA, 25 bp, Mus musculus
tgaattcagagagggtgcactccct

SEQ ID NO: 846308 - DNA, 25 bp, Mus musculus
tgaattcagagattcgctttctgaa

SEQ ID NO: 846309 - DNA, 25 bp, Mus musculus
tgaattcagtcgcaaatcatccctc

SEQ ID NO: 846310 - DNA, 25 bp, Mus musculus
tgaattcagtcggaaatcatccctc

SEQ ID NO: 846311 - DNA, 25 bp, Mus musculus
tgaattcatacccagctcacgctgg

SEQ ID NO: 846312 - DNA, 25 bp, Mus musculus
tgaattcataccgagctcacgctgg

SEQ ID NO: 846313 - DNA, 25 bp, Mus musculus
tgaattcatactatgacatttgtgt

SEQ ID NO: 846314 - DNA, 25 bp, Mus musculus
tgaattcatactttgacatttgtgt

SEQ ID NO: 846315 - DNA, 25 bp, Mus musculus
tgaattcatgcaccgcgcccttcag

SEQ ID NO: 846316 - DNA, 25 bp, Mus musculus
tgaattcatgcagcgcgcccttcag

SEQ ID NO: 846317 - DNA, 25 bp, Mus musculus
tgaattcattgtctggatccagccg

SEQ ID NO: 846318 - DNA, 25 bp, Mus musculus
tgaattcattgtgtggatccagccg

SEQ ID NO: 846319 - DNA, 25 bp, Mus musculus
tgaattccaaacatcttggcggaaa

SEQ ID NO: 846320 - DNA, 25 bp, Mus musculus
tgaattccaaacttcttggcggaaa

SEQ ID NO: 846321 - DNA, 25 bp, Mus musculus
tgaattccaagcaagcccggactgg

SEQ ID NO: 846322 - DNA, 25 bp, Mus musculus
tgaattccaagctagcccggactgg

SEQ ID NO: 846323 - DNA, 25 bp, Mus musculus
tgaattccagccagctaactactga

SEQ ID NO: 846324 - DNA, 25 bp, Mus musculus
tgaattccagccattcccagcttgg

SEQ ID NO: 846325 - DNA, 25 bp, Mus musculus
tgaattccagcctgctaactactga

SEQ ID NO: 846326 - DNA, 25 bp, Mus musculus
tgaattccagcctttcccagcttgg

SEQ ID NO: 846327 - DNA, 25 bp, Mus musculus
tgaattccaggaagtcacactactt

SEQ ID NO: 846328 - DNA, 25 bp, Mus musculus
tgaattccaggatgtcacactactt

SEQ ID NO: 846329 - DNA, 25 bp, Mus musculus
tgaattccaggtcgtggatggccct

SEQ ID NO: 846330 - DNA, 25 bp, Mus musculus
tgaattccaggtggtggatggccct

SEQ ID NO: 846331 - DNA, 25 bp, Mus musculus
tgaattccagtgcacctcagaggtg

SEQ ID NO: 846332 - DNA, 25 bp, Mus musculus
tgaattccagtggacctcagaggtg

SEQ ID NO: 846333 - DNA, 25 bp, Mus musculus
tgaattcccaatagcacctgaaatt

SEQ ID NO: 846334 - DNA, 25 bp, Mus musculus
tgaattcccaattgcacctgaaatt

SEQ ID NO: 846335 - DNA, 25 bp, Mus musculus
tgaattcccactatgtggccatatg

SEQ ID NO: 846336 - DNA, 25 bp, Mus musculus
tgaattcccactttgtggccatatg

SEQ ID NO: 846337 - DNA, 25 bp, Mus musculus
tgaattccctacactctaattatcc

SEQ ID NO: 846338 - DNA, 25 bp, Mus musculus
tgaattccctacagtgcccttggtt

SEQ ID NO: 846339 - DNA, 25 bp, Mus musculus
tgaattccctactctctaattatcc

SEQ ID NO: 846340 - DNA, 25 bp, Mus musculus
tgaattccctactgtgcccttggtt

SEQ ID NO: 846341 - DNA, 25 bp, Mus musculus
tgaattccctcacctcatttgcaac

SEQ ID NO: 846342 - DNA, 25 bp, Mus musculus
tgaattccctcagctcatttgcaac

SEQ ID NO: 846343 - DNA, 25 bp, Mus musculus
tgaattccctgactatttttcctgc

SEQ ID NO: 846344 - DNA, 25 bp, Mus musculus
tgaattccctgagtatttttcctgc

SEQ ID NO: 846345 - DNA, 25 bp, Mus musculus
tgaattcctcacattccagcgcttt

SEQ ID NO: 846346 - DNA, 25 bp, Mus musculus
tgaattcctcactttccagcgcttt

SEQ ID NO: 846347 - DNA, 25 bp, Mus musculus
tgaattcctgacattgcctgcacgc

SEQ ID NO: 846348 - DNA, 25 bp, Mus musculus
tgaattcctgactttgcctgcacgc

SEQ ID NO: 846349 - DNA, 25 bp, Mus musculus
tgaattcctggcaaggagctgcaaa

SEQ ID NO: 846350 - DNA, 25 bp, Mus musculus
tgaattcctggctaggagctgcaaa

SEQ ID NO: 846351 - DNA, 25 bp, Mus musculus
tgaattccttgcctctttctagaac

SEQ ID NO: 846352 - DNA, 25 bp, Mus musculus
tgaattccttgcgtctttctagaac

SEQ ID NO: 846353 - DNA, 25 bp, Mus musculus
tgaattcctttcatgccatattgca

SEQ ID NO: 846354 - DNA, 25 bp, Mus musculus
tgaattcctttcttgccatattgca

SEQ ID NO: 846355 - DNA, 25 bp, Mus musculus
tgaattcgcggaagtggttttcaca

SEQ ID NO: 846356 - DNA, 25 bp, Mus musculus
tgaattcgcggatgtggttttcaca

SEQ ID NO: 846357 - DNA, 25 bp, Mus musculus
tgaattcggctactgcagccttgat

SEQ ID NO: 846358 - DNA, 25 bp, Mus musculus
tgaattcggctagtgcagccttgat

SEQ ID NO: 846359 - DNA, 25 bp, Mus musculus
tgaattcgttccacctggcctctcc

SEQ ID NO: 846360 - DNA, 25 bp, Mus musculus
tgaattcgttcctcctggcctctcc

SEQ ID NO: 846361 - DNA, 25 bp, Mus musculus
tgaattcgttgtcacattcttccct

SEQ ID NO: 846362 - DNA, 25 bp, Mus musculus
tgaattcgttgtgacattcttccct

SEQ ID NO: 846363 - DNA, 25 bp, Mus musculus
tgaattctacttacctattacccac

SEQ ID NO: 846364 - DNA, 25 bp, Mus musculus
tgaattctactttcctattacccac

SEQ ID NO: 846365 - DNA, 25 bp, Mus musculus
tgaattctatgcagtgaccagtttc

SEQ ID NO: 846366 - DNA, 25 bp, Mus musculus
tgaattctatgctgtgaccagtttc

SEQ ID NO: 846367 - DNA, 25 bp, Mus musculus
tgaattctcagaagggacagtctct

SEQ ID NO: 846368 - DNA, 25 bp, Mus musculus
tgaattctcagatgggacagtctct

SEQ ID NO: 846369 - DNA, 25 bp, Mus musculus
tgaattctcgacactcatttcccct

SEQ ID NO: 846370 - DNA, 25 bp, Mus musculus
tgaattctcgactctcatttcccct

SEQ ID NO: 846371 - DNA, 25 bp, Mus musculus
tgaattctgaatccctggtctttct

SEQ ID NO: 846372 - DNA, 25 bp, Mus musculus
tgaattctgaatgcctggtctttct

SEQ ID NO: 846373 - DNA, 25 bp, Mus musculus
tgaattctgccaccctgatgacccg

SEQ ID NO: 846374 - DNA, 25 bp, Mus musculus
tgaattctgccagcctgatgacccg

SEQ ID NO: 846375 - DNA, 25 bp, Mus musculus
tgaattctggccacacacggctcac

SEQ ID NO: 846376 - DNA, 25 bp, Mus musculus
tgaattctggcctcacacggctcac

SEQ ID NO: 846377 - DNA, 25 bp, Mus musculus
tgaattctgggcagcggagcccaag

SEQ ID NO: 846378 - DNA, 25 bp, Mus musculus
tgaattctgggctgcggagcccaag

SEQ ID NO: 846379 - DNA, 25 bp, Mus musculus
tgaattctgttgacccgcactttaa

SEQ ID NO: 846380 - DNA, 25 bp, Mus musculus
tgaattctgttgtcccgcactttaa

SEQ ID NO: 846381 - DNA, 25 bp, Mus musculus
tgaattcttcacctggttgtcagaa

SEQ ID NO: 846382 - DNA, 25 bp, Mus musculus
tgaattcttcacgtggttgtcagaa

SEQ ID NO: 846383 - DNA, 25 bp, Mus musculus
tgaattcttgtaccagtccatattt

SEQ ID NO: 846384 - DNA, 25 bp, Mus musculus
tgaattcttgtagcagtccatattt

SEQ ID NO: 846385 - DNA, 25 bp, Mus musculus
tgaattctttaaacccaggatctaa

SEQ ID NO: 846386 - DNA, 25 bp, Mus musculus
tgaattctttaatcccaggatctaa

SEQ ID NO: 846387 - DNA, 25 bp, Mus musculus
tgaattctttcaacaacccctttga

SEQ ID NO: 846388 - DNA, 25 bp, Mus musculus
tgaattctttcatcaacccctttga

SEQ ID NO: 846389 - DNA, 25 bp, Mus musculus
tgaattgaacccagttgtcccagac

SEQ ID NO: 846390 - DNA, 25 bp, Mus musculus
tgaattgaaccctgttgtcccagac

SEQ ID NO: 846391 - DNA, 25 bp, Mus musculus
tgaattgaacctcgactatgagatg

SEQ ID NO: 846392 - DNA, 25 bp, Mus musculus
tgaattgaacctggactatgagatg

SEQ ID NO: 846393 - DNA, 25 bp, Mus musculus
tgaattgactatctatcgcctcact

SEQ ID NO: 846394 - DNA, 25 bp, Mus musculus
tgaattgactatgtatcgcctcact

SEQ ID NO: 846395 - DNA, 25 bp, Mus musculus
tgaattgagccgaggtttaaacctg

SEQ ID NO: 846396 - DNA, 25 bp, Mus musculus
tgaattgagccgtggtttaaacctg

SEQ ID NO: 846397 - DNA, 25 bp, Mus musculus
tgaattgaggagcaccagcctgccc

SEQ ID NO: 846398 - DNA, 25 bp, Mus musculus
tgaattgaggaggaccagcctgccc

SEQ ID NO: 846399 - DNA, 25 bp, Mus musculus
tgaattgcacacagaccttaactct

SEQ ID NO: 846400 - DNA, 25 bp, Mus musculus
tgaattgcacactgaccttaactct

SEQ ID NO: 846401 - DNA, 25 bp, Mus musculus
tgaattgcacagacgctggtacctg

SEQ ID NO: 846402 - DNA, 25 bp, Mus musculus
tgaattgcacagtcgctggtacctg

SEQ ID NO: 846403 - DNA, 25 bp, Mus musculus
tgaattgccatacagccagtaccag

SEQ ID NO: 846404 - DNA, 25 bp, Mus musculus
tgaattgccatagagccagtaccag

SEQ ID NO: 846405 - DNA, 25 bp, Mus musculus
tgaattgcccggagcagtgtccaca

SEQ ID NO: 846406 - DNA, 25 bp, Mus musculus
tgaattgcccggtgcagtgtccaca

SEQ ID NO: 846407 - DNA, 25 bp, Mus musculus
tgaattgcccgtatccatacagggt

SEQ ID NO: 846408 - DNA, 25 bp, Mus musculus
tgaattgcccgtttccatacagggt

SEQ ID NO: 846409 - DNA, 25 bp, Mus musculus
tgaattgccgccagtttgttacgat

SEQ ID NO: 846410 - DNA, 25 bp, Mus musculus
tgaattgccgcctgtttgttacgat

SEQ ID NO: 846411 - DNA, 25 bp, Mus musculus
tgaattgcctccacaaggcagaact

SEQ ID NO: 846412 - DNA, 25 bp, Mus musculus
tgaattgcctcctcaaggcagaact

SEQ ID NO: 846413 - DNA, 25 bp, Mus musculus
tgaattgctaaaagccccgttagtg

SEQ ID NO: 846414 - DNA, 25 bp, Mus musculus
tgaattgctaaatgccccgttagtg

SEQ ID NO: 846415 - DNA, 25 bp, Mus musculus
tgaattgctaccatcactgcagacc

SEQ ID NO: 846416 - DNA, 25 bp, Mus musculus
tgaattgctaccttcactgcagacc

SEQ ID NO: 846417 - DNA, 25 bp, Mus musculus
tgaattgctgagctctccctgttaa

SEQ ID NO: 846418 - DNA, 25 bp, Mus musculus
tgaattgctgaggtctccctgttaa

SEQ ID NO: 846419 - DNA, 25 bp, Mus musculus
tgaattgcttagctttgcctttccc

SEQ ID NO: 846420 - DNA, 25 bp, Mus musculus
tgaattgcttaggtttgcctttccc

SEQ ID NO: 846421 - DNA, 25 bp, Mus musculus
tgaattgcttcccaaaggctgtcac

SEQ ID NO: 846422 - DNA, 25 bp, Mus musculus
tgaattgcttccgaaaggctgtcac

SEQ ID NO: 846423 - DNA, 25 bp, Mus musculus
tgaattggagtcaccgggcacatat

SEQ ID NO: 846424 - DNA, 25 bp, Mus musculus
tgaattggagtctccgggcacatat

SEQ ID NO: 846425 - DNA, 25 bp, Mus musculus
tgaattggccttaagtaccccttca

SEQ ID NO: 846426 - DNA, 25 bp, Mus musculus
tgaattggcctttagtaccccttca

SEQ ID NO: 846427 - DNA, 25 bp, Mus musculus
tgaattggctcaacccaacatctac

SEQ ID NO: 846428 - DNA, 25 bp, Mus musculus
tgaattggctcatcccaacatctac

SEQ ID NO: 846429 - DNA, 25 bp, Mus musculus
tgaattgggattccctcatgttttt

SEQ ID NO: 846430 - DNA, 25 bp, Mus musculus
tgaattgggattgcctcatgttttt

SEQ ID NO: 846431 - DNA, 25 bp, Mus musculus
tgaattggtaccagcctgtcaaaag

SEQ ID NO: 846432 - DNA, 25 bp, Mus musculus
tgaattggtacctgcctgtcaaaag

SEQ ID NO: 846433 - DNA, 25 bp, Mus musculus
tgaattggtgctaagttcccttgcc

SEQ ID NO: 846434 - DNA, 25 bp, Mus musculus
tgaattggtgcttagttcccttgcc

SEQ ID NO: 846435 - DNA, 25 bp, Mus musculus
tgaattggtgggactgaggattaca

SEQ ID NO: 846436 - DNA, 25 bp, Mus musculus
tgaattggtgggtctgaggattaca

SEQ ID NO: 846437 - DNA, 25 bp, Mus musculus
tgaattgtaagcctcactgagcgta

SEQ ID NO: 846438 - DNA, 25 bp, Mus musculus
tgaattgtaagcgtcactgagcgta

SEQ ID NO: 846439 - DNA, 25 bp, Mus musculus
tgaattgtcgtgcaaaactagggtc

SEQ ID NO: 846440 - DNA, 25 bp, Mus musculus
tgaattgtcgtggaaaactagggtc

SEQ ID NO: 846441 - DNA, 25 bp, Mus musculus
tgaattgtcttacatgctcagcttc

SEQ ID NO: 846442 - DNA, 25 bp, Mus musculus
tgaattgtcttagatgctcagcttc

SEQ ID NO: 846443 - DNA, 25 bp, Mus musculus
tgaattgtgaccatttgttaatatc

SEQ ID NO: 846444 - DNA, 25 bp, Mus musculus
tgaattgtgaccttttgttaatatc

SEQ ID NO: 846445 - DNA, 25 bp, Mus musculus
tgaattgtggcaagctcactccagt

SEQ ID NO: 846446 - DNA, 25 bp, Mus musculus
tgaattgtggcatgctcactccagt

SEQ ID NO: 846447 - DNA, 25 bp, Mus musculus
tgaattgtgtaaccatggatgggaa

SEQ ID NO: 846448 - DNA, 25 bp, Mus musculus
tgaattgtgtaagcatggatgggaa

SEQ ID NO: 846449 - DNA, 25 bp, Mus musculus
tgaattgtgtgcattcaccaacacc

SEQ ID NO: 846450 - DNA, 25 bp, Mus musculus
tgaattgtgtgctttcaccaacacc

SEQ ID NO: 846451 - DNA, 25 bp, Mus musculus
tgaattgttccacctacatctccat

SEQ ID NO: 846452 - DNA, 25 bp, Mus musculus
tgaattgttccagctacatctccat

SEQ ID NO: 846453 - DNA, 25 bp, Mus musculus
tgaattgttttaacttgtcatcatt

SEQ ID NO: 846454 - DNA, 25 bp, Mus musculus
tgaattgttttatcttgtcatcatt

SEQ ID NO: 846455 - DNA, 25 bp, Mus musculus
tgaatttaacatattctgcctgtgg

SEQ ID NO: 846456 - DNA, 25 bp, Mus musculus
tgaatttaacattttctgcctgtgg

SEQ ID NO: 846457 - DNA, 25 bp, Mus musculus
tgaatttaacttcctctcatcagcc

SEQ ID NO: 846458 - DNA, 25 bp, Mus musculus
tgaatttaacttgctctcatcagcc

SEQ ID NO: 846459 - DNA, 25 bp, Mus musculus
tgaatttacagtcttgtcaagaatt

SEQ ID NO: 846460 - DNA, 25 bp, Mus musculus
tgaatttacagtgttgtcaagaatt

SEQ ID NO: 846461 - DNA, 25 bp, Mus musculus
tgaatttacctcagaagcacctatt

SEQ ID NO: 846462 - DNA, 25 bp, Mus musculus
tgaatttacctctgaagcacctatt

SEQ ID NO: 846463 - DNA, 25 bp, Mus musculus
tgaatttatgcaattttctgaccat

SEQ ID NO: 846464 - DNA, 25 bp, Mus musculus
tgaatttatgcatttttctgaccat

SEQ ID NO: 846465 - DNA, 25 bp, Mus musculus
tgaatttcaccgacgctaccgtctg

SEQ ID NO: 846466 - DNA, 25 bp, Mus musculus
tgaatttcaccgtcgctaccgtctg

SEQ ID NO: 846467 - DNA, 25 bp, Mus musculus
tgaatttcagccagctcgaccaaga

SEQ ID NO: 846468 - DNA, 25 bp, Mus musculus
tgaatttcagcctgctcgaccaaga

SEQ ID NO: 846469 - DNA, 25 bp, Mus musculus
tgaatttccacaacatatccacctc

SEQ ID NO: 846470 - DNA, 25 bp, Mus musculus
tgaatttccacatcatatccacctc

SEQ ID NO: 846471 - DNA, 25 bp, Mus musculus
tgaatttccaggctctcctgtgtcc

SEQ ID NO: 846472 - DNA, 25 bp, Mus musculus
tgaatttccagggtctcctgtgtcc

SEQ ID NO: 846473 - DNA, 25 bp, Mus musculus
tgaatttcccttaatattttggcct

SEQ ID NO: 846474 - DNA, 25 bp, Mus musculus
tgaatttccctttatattttggcct

SEQ ID NO: 846475 - DNA, 25 bp, Mus musculus
tgaatttctaagaatgcctaatcat

SEQ ID NO: 846476 - DNA, 25 bp, Mus musculus
tgaatttctaagtatgcctaatcat

SEQ ID NO: 846477 - DNA, 25 bp, Mus musculus
tgaatttctaccctgtccttaggta

SEQ ID NO: 846478 - DNA, 25 bp, Mus musculus
tgaatttctaccgtgtccttaggta

SEQ ID NO: 846479 - DNA, 25 bp, Mus musculus
tgaatttctcagcccactacctagg

SEQ ID NO: 846480 - DNA, 25 bp, Mus musculus
tgaatttctcaggccactacctagg

SEQ ID NO: 846481 - DNA, 25 bp, Mus musculus
tgaatttctcatctccaacccttag

SEQ ID NO: 846482 - DNA, 25 bp, Mus musculus
tgaatttctcatgtccaacccttag

SEQ ID NO: 846483 - DNA, 25 bp, Mus musculus
tgaatttcttatcgcctcagggata

SEQ ID NO: 846484 - DNA, 25 bp, Mus musculus
tgaatttcttatggcctcagggata

SEQ ID NO: 846485 - DNA, 25 bp, Mus musculus
tgaatttgaccaacctgattcccgc

SEQ ID NO: 846486 - DNA, 25 bp, Mus musculus
tgaatttgaccatcctgattcccgc

SEQ ID NO: 846487 - DNA, 25 bp, Mus musculus
tgaatttgagacacctccatgcgct

SEQ ID NO: 846488 - DNA, 25 bp, Mus musculus
tgaatttgagactcctccatgcgct

SEQ ID NO: 846489 - DNA, 25 bp, Mus musculus
tgaatttgattgacccttcctccct

SEQ ID NO: 846490 - DNA, 25 bp, Mus musculus
tgaatttgattgtcccttcctccct

SEQ ID NO: 846491 - DNA, 25 bp, Mus musculus
tgaatttgcagtaacactcacagtt

SEQ ID NO: 846492 - DNA, 25 bp, Mus musculus
tgaatttgcagttacactcacagtt

SEQ ID NO: 846493 - DNA, 25 bp, Mus musculus
tgaatttgccacatgatcacccttc

SEQ ID NO: 846494 - DNA, 25 bp, Mus musculus
tgaatttgccacttgatcacccttc

SEQ ID NO: 846495 - DNA, 25 bp, Mus musculus
tgaatttgctatcttccctaacgga

SEQ ID NO: 846496 - DNA, 25 bp, Mus musculus
tgaatttgctatgttccctaacgga

SEQ ID NO: 846497 - DNA, 25 bp, Mus musculus
tgaatttgctcaaccgcttgaaacc

SEQ ID NO: 846498 - DNA, 25 bp, Mus musculus
tgaatttgctcatccgcttgaaacc

SEQ ID NO: 846499 - DNA, 25 bp, Mus musculus
tgaatttgtgccacagctctccata

SEQ ID NO: 846500 - DNA, 25 bp, Mus musculus
tgaatttgtgcctcagctctccata

SEQ ID NO: 846501 - DNA, 25 bp, Mus musculus
tgaatttgttttcacctatcttttc

SEQ ID NO: 846502 - DNA, 25 bp, Mus musculus
tgaatttgttttgacctatcttttc

SEQ ID NO: 846503 - DNA, 25 bp, Mus musculus
tgaattttaacccaccaggcttcac

SEQ ID NO: 846504 - DNA, 25 bp, Mus musculus
tgaattttaaccgaccaggcttcac

SEQ ID NO: 846505 - DNA, 25 bp, Mus musculus
tgaattttatcacctggtgggcagt

SEQ ID NO: 846506 - DNA, 25 bp, Mus musculus
tgaattttatcagctggtgggcagt

SEQ ID NO: 846507 - DNA, 25 bp, Mus musculus
tgaattttcagtcgctcatcttagc

SEQ ID NO: 846508 - DNA, 25 bp, Mus musculus
tgaattttcagtggctcatcttagc

SEQ ID NO: 846509 - DNA, 25 bp, Mus musculus
tgaattttccaaagcaaagcccact

SEQ ID NO: 846510 - DNA, 25 bp, Mus musculus
tgaattttccaatgcaaagcccact

SEQ ID NO: 846511 - DNA, 25 bp, Mus musculus
tgaattttcccacttgccactcaaa

SEQ ID NO: 846512 - DNA, 25 bp, Mus musculus
tgaattttcccagttgccactcaaa

SEQ ID NO: 846513 - DNA, 25 bp, Mus musculus
tgaattttctacagtgggcaggagg

SEQ ID NO: 846514 - DNA, 25 bp, Mus musculus
tgaattttctactgtgggcaggagg

SEQ ID NO: 846515 - DNA, 25 bp, Mus musculus
tgaattttctgtacctgcgttgcac

SEQ ID NO: 846516 - DNA, 25 bp, Mus musculus
tgaattttctgttcctgcgttgcac

SEQ ID NO: 846517 - DNA, 25 bp, Mus musculus
tgaattttgttgatgagggtgtcca

SEQ ID NO: 846518 - DNA, 25 bp, Mus musculus
tgaattttgttgttgagggtgtcca

SEQ ID NO: 846519 - DNA, 25 bp, Mus musculus
tgaatttttcaactccaggtgctaa

SEQ ID NO: 846520 - DNA, 25 bp, Mus musculus
tgaatttttcaagtccaggtgctaa

SEQ ID NO: 846521 - DNA, 25 bp, Mus musculus
tgaatttttcttcacaccacaccag

SEQ ID NO: 846522 - DNA, 25 bp, Mus musculus
tgaatttttcttgacaccacaccag

SEQ ID NO: 846523 - DNA, 25 bp, Mus musculus
tgaattttttagaagcagaccctga

SEQ ID NO: 846524 - DNA, 25 bp, Mus musculus
tgaattttttagtagcagaccctga

SEQ ID NO: 846525 - DNA, 25 bp, Mus musculus
tgaattttttcactggtattaccaa

SEQ ID NO: 846526 - DNA, 25 bp, Mus musculus
tgaattttttcagtggtattaccaa

SEQ ID NO: 846527 - DNA, 25 bp, Mus musculus
tgacaaaacgggaagcagcattaat

SEQ ID NO: 846528 - DNA, 25 bp, Mus musculus
tgacaaaacgggtagcagcattaat

SEQ ID NO: 846529 - DNA, 25 bp, Mus musculus
tgacaaaaggaacgccaaggccctc

SEQ ID NO: 846530 - DNA, 25 bp, Mus musculus
tgacaaaaggaaggccaaggccctc

SEQ ID NO: 846531 - DNA, 25 bp, Mus musculus
tgacaaaaggacagtattctacagc

SEQ ID NO: 846532 - DNA, 25 bp, Mus musculus
tgacaaaaggactgtattctacagc

SEQ ID NO: 846533 - DNA, 25 bp, Mus musculus
tgacaaaagtctcaccagctcacag

SEQ ID NO: 846534 - DNA, 25 bp, Mus musculus
tgacaaaagtctgaccagctcacag

SEQ ID NO: 846535 - DNA, 25 bp, Mus musculus
tgacaaaattgtaaaccctgactta

SEQ ID NO: 846536 - DNA, 25 bp, Mus musculus
tgacaaaattgttaaccctgactta

SEQ ID NO: 846537 - DNA, 25 bp, Mus musculus
tgacaaaattttaggccttccccat

SEQ ID NO: 846538 - DNA, 25 bp, Mus musculus
tgacaaaatttttggccttccccat

SEQ ID NO: 846539 - DNA, 25 bp, Mus musculus
tgacaaacattcacttcgccatgaa

SEQ ID NO: 846540 - DNA, 25 bp, Mus musculus
tgacaaacattctcttcgccatgaa

SEQ ID NO: 846541 - DNA, 25 bp, Mus musculus
tgacaaacattgataggacatcagt

SEQ ID NO: 846542 - DNA, 25 bp, Mus musculus
tgacaaacattgttaggacatcagt

SEQ ID NO: 846543 - DNA, 25 bp, Mus musculus
tgacaaaccaacatacatacaccct

SEQ ID NO: 846544 - DNA, 25 bp, Mus musculus
tgacaaaccaacttacatacaccct

SEQ ID NO: 846545 - DNA, 25 bp, Mus musculus
tgacaaactcttaaccatcagtttc

SEQ ID NO: 846546 - DNA, 25 bp, Mus musculus
tgacaaactcttactgtgtgatggc

SEQ ID NO: 846547 - DNA, 25 bp, Mus musculus
tgacaaactctttaccatcagtttc

SEQ ID NO: 846548 - DNA, 25 bp, Mus musculus
tgacaaactctttctgtgtgatggc

SEQ ID NO: 846549 - DNA, 25 bp, Mus musculus
tgacaaactgttcctgtgctggtga

SEQ ID NO: 846550 - DNA, 25 bp, Mus musculus
tgacaaactgttgctgtgctggtga

SEQ ID NO: 846551 - DNA, 25 bp, Mus musculus
tgacaaacttctagatacatttaat

SEQ ID NO: 846552 - DNA, 25 bp, Mus musculus
tgacaaacttcttgatacatttaat

SEQ ID NO: 846553 - DNA, 25 bp, Mus musculus
tgacaaacttgaccaccgattccgc

SEQ ID NO: 846554 - DNA, 25 bp, Mus musculus
tgacaaacttgagcaccgattccgc

SEQ ID NO: 846555 - DNA, 25 bp, Mus musculus
tgacaaacttttcctggacacctta

SEQ ID NO: 846556 - DNA, 25 bp, Mus musculus
tgacaaacttttgctggacacctta

SEQ ID NO: 846557 - DNA, 25 bp, Mus musculus
tgacaaagaaatccctgaaatggcc

SEQ ID NO: 846558 - DNA, 25 bp, Mus musculus
tgacaaagaaatgcctgaaatggcc

SEQ ID NO: 846559 - DNA, 25 bp, Mus musculus
tgacaaagcccgagtgcttccttcc

SEQ ID NO: 846560 - DNA, 25 bp, Mus musculus
tgacaaagcccgtgtgcttccttcc

SEQ ID NO: 846561 - DNA, 25 bp, Mus musculus
tgacaaagcgcactctgcactctgt

SEQ ID NO: 846562 - DNA, 25 bp, Mus musculus
tgacaaagcgcagtctgcactctgt

SEQ ID NO: 846563 - DNA, 25 bp, Mus musculus
tgacaaaggaaacacctctggccag

SEQ ID NO: 846564 - DNA, 25 bp, Mus musculus
tgacaaaggaaagacctctggccag

SEQ ID NO: 846565 - DNA, 25 bp, Mus musculus
tgacaaagggcaacagccagcctct

SEQ ID NO: 846566 - DNA, 25 bp, Mus musculus
tgacaaagggcatcagccagcctct

SEQ ID NO: 846567 - DNA, 25 bp, Mus musculus
tgacaaagtcacaaagtctcagact

SEQ ID NO: 846568 - DNA, 25 bp, Mus musculus
tgacaaagtcactaagtctcagact

SEQ ID NO: 846569 - DNA, 25 bp, Mus musculus
tgacaaatactaccactatgacctg

SEQ ID NO: 846570 - DNA, 25 bp, Mus musculus
tgacaaatactagcactatgacctg

SEQ ID NO: 846571 - DNA, 25 bp, Mus musculus
tgacaaatcctcagcagccttggaa

SEQ ID NO: 846572 - DNA, 25 bp, Mus musculus
tgacaaatcctctgcagccttggaa

SEQ ID NO: 846573 - DNA, 25 bp, Mus musculus
tgacaaatgaatacctgcaggcccg

SEQ ID NO: 846574 - DNA, 25 bp, Mus musculus
tgacaaatgaattcctgcaggcccg

SEQ ID NO: 846575 - DNA, 25 bp, Mus musculus
tgacaaatgacccatcagcaccgat

SEQ ID NO: 846576 - DNA, 25 bp, Mus musculus
tgacaaatgaccgatcagcaccgat

SEQ ID NO: 846577 - DNA, 25 bp, Mus musculus
tgacaaatgccaatgctgtgtgtgg

SEQ ID NO: 846578 - DNA, 25 bp, Mus musculus
tgacaaatgccattgctgtgtgtgg

SEQ ID NO: 846579 - DNA, 25 bp, Mus musculus
tgacaaatgtcccttcttcagatgg

SEQ ID NO: 846580 - DNA, 25 bp, Mus musculus
tgacaaatgtccgttcttcagatgg

SEQ ID NO: 846581 - DNA, 25 bp, Mus musculus
tgacaaatttagcaagaccaagggc

SEQ ID NO: 846582 - DNA, 25 bp, Mus musculus
tgacaaatttaggaagaccaagggc

SEQ ID NO: 846583 - DNA, 25 bp, Mus musculus
tgacaacaaacacccctactttatt

SEQ ID NO: 846584 - DNA, 25 bp, Mus musculus
tgacaacaaacagccctactttatt

SEQ ID NO: 846585 - DNA, 25 bp, Mus musculus
tgacaacaaagaccccgtatctgat

SEQ ID NO: 846586 - DNA, 25 bp, Mus musculus
tgacaacaaagagcccgtatctgat

SEQ ID NO: 846587 - DNA, 25 bp, Mus musculus
tgacaacaatcaccctgtggctgga

SEQ ID NO: 846588 - DNA, 25 bp, Mus musculus
tgacaacaatcagcctgtggctgga

SEQ ID NO: 846589 - DNA, 25 bp, Mus musculus
tgacaacactggaccccttaacttt

SEQ ID NO: 846590 - DNA, 25 bp, Mus musculus
tgacaacactggtccccttaacttt

SEQ ID NO: 846591 - DNA, 25 bp, Mus musculus
tgacaacactgtatccatgtgccac

SEQ ID NO: 846592 - DNA, 25 bp, Mus musculus
tgacaacactgtttccatgtgccac

SEQ ID NO: 846593 - DNA, 25 bp, Mus musculus
tgacaacatcccaactgattccaag

SEQ ID NO: 846594 - DNA, 25 bp, Mus musculus
tgacaacatccctactgattccaag

SEQ ID NO: 846595 - DNA, 25 bp, Mus musculus
tgacaacatcggcatcaaagccatg

SEQ ID NO: 846596 - DNA, 25 bp, Mus musculus
tgacaacatcgggatcaaagccatg

SEQ ID NO: 846597 - DNA, 25 bp, Mus musculus
tgacaacatggaagcttacctggaa

SEQ ID NO: 846598 - DNA, 25 bp, Mus musculus
tgacaacatggatgcttacctggaa

SEQ ID NO: 846599 - DNA, 25 bp, Mus musculus
tgacaaccacgtcccaaaatcctaa

SEQ ID NO: 846600 - DNA, 25 bp, Mus musculus
tgacaaccacgtgccaaaatcctaa

SEQ ID NO: 846601 - DNA, 25 bp, Mus musculus
tgacaaccagaactccacatcgatg

SEQ ID NO: 846602 - DNA, 25 bp, Mus musculus
tgacaaccagaagtccacatcgatg

SEQ ID NO: 846603 - DNA, 25 bp, Mus musculus
tgacaaccagacagccaccgtgatc

SEQ ID NO: 846604 - DNA, 25 bp, Mus musculus
tgacaaccagactgccaccgtgatc

SEQ ID NO: 846605 - DNA, 25 bp, Mus musculus
tgacaaccagggagcaggagagcaa

SEQ ID NO: 846606 - DNA, 25 bp, Mus musculus
tgacaaccagggtgcaggagagcaa

SEQ ID NO: 846607 - DNA, 25 bp, Mus musculus
tgacaacccaggacaaaaagcatgt

SEQ ID NO: 846608 - DNA, 25 bp, Mus musculus
tgacaacccaggtcaaaaagcatgt

SEQ ID NO: 846609 - DNA, 25 bp, Mus musculus
tgacaaccgcatcgagtctttcttc

SEQ ID NO: 846610 - DNA, 25 bp, Mus musculus
tgacaaccgcatggagtctttcttc

SEQ ID NO: 846611 - DNA, 25 bp, Mus musculus
tgacaaccggacatttgacaccctt

SEQ ID NO: 846612 - DNA, 25 bp, Mus musculus
tgacaaccggacttttgacaccctt

SEQ ID NO: 846613 - DNA, 25 bp, Mus musculus
tgacaacctcatacctgtctattgc

SEQ ID NO: 846614 - DNA, 25 bp, Mus musculus
tgacaacctcattcctgtctattgc

SEQ ID NO: 846615 - DNA, 25 bp, Mus musculus
tgacaacctcccaaaagcaccgaga

SEQ ID NO: 846616 - DNA, 25 bp, Mus musculus
tgacaacctccctaaagcaccgaga

SEQ ID NO: 846617 - DNA, 25 bp, Mus musculus
tgacaacctcggagacccggagcca

SEQ ID NO: 846618 - DNA, 25 bp, Mus musculus
tgacaacctcggtgacccggagcca

SEQ ID NO: 846619 - DNA, 25 bp, Mus musculus
tgacaacctgttccactctcagtga

SEQ ID NO: 846620 - DNA, 25 bp, Mus musculus
tgacaacctgttgcactctcagtga

SEQ ID NO: 846621 - DNA, 25 bp, Mus musculus
tgacaaccttgtcctgaatctacag

SEQ ID NO: 846622 - DNA, 25 bp, Mus musculus
tgacaaccttgtgctgaatctacag

SEQ ID NO: 846623 - DNA, 25 bp, Mus musculus
tgacaacgcggtcccagagctagtg

SEQ ID NO: 846624 - DNA, 25 bp, Mus musculus
tgacaacgcggtgccagagctagtg

SEQ ID NO: 846625 - DNA, 25 bp, Mus musculus
tgacaacgctcaatggcagggctta

SEQ ID NO: 846626 - DNA, 25 bp, Mus musculus
tgacaacgctcattggcagggctta

SEQ ID NO: 846627 - DNA, 25 bp, Mus musculus
tgacaacggcacacagacagataca

SEQ ID NO: 846628 - DNA, 25 bp, Mus musculus
tgacaacggcactcagacagataca

SEQ ID NO: 846629 - DNA, 25 bp, Mus musculus
tgacaacggtttcttcctccaagat

SEQ ID NO: 846630 - DNA, 25 bp, Mus musculus
tgacaacggtttgttcctccaagat

SEQ ID NO: 846631 - DNA, 25 bp, Mus musculus
tgacaacgtcatcgaggaatcacat

SEQ ID NO: 846632 - DNA, 25 bp, Mus musculus
tgacaacgtcatggaggaatcacat

SEQ ID NO: 846633 - DNA, 25 bp, Mus musculus
tgacaactagagaaccctagtctct

SEQ ID NO: 846634 - DNA, 25 bp, Mus musculus
tgacaactagagtaccctagtctct

SEQ ID NO: 846635 - DNA, 25 bp, Mus musculus
tgacaactcattccagactccaggt

SEQ ID NO: 846636 - DNA, 25 bp, Mus musculus
tgacaactcattgcagactccaggt

SEQ ID NO: 846637 - DNA, 25 bp, Mus musculus
tgacaactccttactgtgcaaactg

SEQ ID NO: 846638 - DNA, 25 bp, Mus musculus
tgacaactcctttctgtgcaaactg

SEQ ID NO: 846639 - DNA, 25 bp, Mus musculus
tgacaactctttccttggtctcgct

SEQ ID NO: 846640 - DNA, 25 bp, Mus musculus
tgacaactctttgcttggtctcgct

SEQ ID NO: 846641 - DNA, 25 bp, Mus musculus
tgacaactgcaacgagtggttccat

SEQ ID NO: 846642 - DNA, 25 bp, Mus musculus
tgacaactgcaaggagtggttccat

SEQ ID NO: 846643 - DNA, 25 bp, Mus musculus
tgacaactggccataactctagttc

SEQ ID NO: 846644 - DNA, 25 bp, Mus musculus
tgacaactggccttaactctagttc

SEQ ID NO: 846645 - DNA, 25 bp, Mus musculus
tgacaactgtacaggcccgttatga

SEQ ID NO: 846646 - DNA, 25 bp, Mus musculus
tgacaactgtactggcccgttatga

SEQ ID NO: 846647 - DNA, 25 bp, Mus musculus
tgacaactgtgacttctcctggaga

SEQ ID NO: 846648 - DNA, 25 bp, Mus musculus
tgacaactgtgagttctcctggaga

SEQ ID NO: 846649 - DNA, 25 bp, Mus musculus
tgacaacttcctacccaataaaaat

SEQ ID NO: 846650 - DNA, 25 bp, Mus musculus
tgacaacttccttcccaataaaaat

SEQ ID NO: 846651 - DNA, 25 bp, Mus musculus
tgacaagaagacaccagctgacatc

SEQ ID NO: 846652 - DNA, 25 bp, Mus musculus
tgacaagaagactccagctgacatc

SEQ ID NO: 846653 - DNA, 25 bp, Mus musculus
tgacaagaatgaaccccacttatgt

SEQ ID NO: 846654 - DNA, 25 bp, Mus musculus
tgacaagaatgatccccacttatgt

SEQ ID NO: 846655 - DNA, 25 bp, Mus musculus
tgacaagaccccacttcctgagatg

SEQ ID NO: 846656 - DNA, 25 bp, Mus musculus
tgacaagacccctcttcctgagatg

SEQ ID NO: 846657 - DNA, 25 bp, Mus musculus
tgacaagaccctccgtgtatgggat

SEQ ID NO: 846658 - DNA, 25 bp, Mus musculus
tgacaagaccctgcgtgtatgggat

SEQ ID NO: 846659 - DNA, 25 bp, Mus musculus
tgacaagagccaagtacagccgccg

SEQ ID NO: 846660 - DNA, 25 bp, Mus musculus
tgacaagagccatgtacagccgccg

SEQ ID NO: 846661 - DNA, 25 bp, Mus musculus
tgacaagagcgacgacagcagtacc

SEQ ID NO: 846662 - DNA, 25 bp, Mus musculus
tgacaagagcgaggacagcagtacc

SEQ ID NO: 846663 - DNA, 25 bp, Mus musculus
tgacaagatgttacccaataaccca

SEQ ID NO: 846664 - DNA, 25 bp, Mus musculus
tgacaagatgtttcccaataaccca

SEQ ID NO: 846665 - DNA, 25 bp, Mus musculus
tgacaagcacttaaccaagactccc

SEQ ID NO: 846666 - DNA, 25 bp, Mus musculus
tgacaagcacttagaccaggccatg

SEQ ID NO: 846667 - DNA, 25 bp, Mus musculus
tgacaagcactttaccaagactccc

SEQ ID NO: 846668 - DNA, 25 bp, Mus musculus
tgacaagcactttgaccaggccatg

SEQ ID NO: 846669 - DNA, 25 bp, Mus musculus
tgacaagcagagaccacacgcctgg

SEQ ID NO: 846670 - DNA, 25 bp, Mus musculus
tgacaagcagagtccacacgcctgg

SEQ ID NO: 846671 - DNA, 25 bp, Mus musculus
tgacaagcagccctatgagaagaaa

SEQ ID NO: 846672 - DNA, 25 bp, Mus musculus
tgacaagcagccgtatgagaagaaa

SEQ ID NO: 846673 - DNA, 25 bp, Mus musculus
tgacaagcagctacttcaagtgaaa

SEQ ID NO: 846674 - DNA, 25 bp, Mus musculus
tgacaagcagcttcttcaagtgaaa

SEQ ID NO: 846675 - DNA, 25 bp, Mus musculus
tgacaagcatttaccgagcacctct

SEQ ID NO: 846676 - DNA, 25 bp, Mus musculus
tgacaagcattttccgagcacctct

SEQ ID NO: 846677 - DNA, 25 bp, Mus musculus
tgacaagccctgagaatgccatctg

SEQ ID NO: 846678 - DNA, 25 bp, Mus musculus
tgacaagccctgtgaatgccatctg

SEQ ID NO: 846679 - DNA, 25 bp, Mus musculus
tgacaagccgatcacaagctcccat

SEQ ID NO: 846680 - DNA, 25 bp, Mus musculus
tgacaagccgatgacaagctcccat

SEQ ID NO: 846681 - DNA, 25 bp, Mus musculus
tgacaagccggccaaaggcagtcaa

SEQ ID NO: 846682 - DNA, 25 bp, Mus musculus
tgacaagccggcgaaaggcagtcaa

SEQ ID NO: 846683 - DNA, 25 bp, Mus musculus
tgacaagcctacctttaagtgccag

SEQ ID NO: 846684 - DNA, 25 bp, Mus musculus
tgacaagcctacgtttaagtgccag

SEQ ID NO: 846685 - DNA, 25 bp, Mus musculus
tgacaagcggctcaaggcagagcct

SEQ ID NO: 846686 - DNA, 25 bp, Mus musculus
tgacaagcggctgaaggcagagcct

SEQ ID NO: 846687 - DNA, 25 bp, Mus musculus
tgacaagcgtgcaggaggcccatat

SEQ ID NO: 846688 - DNA, 25 bp, Mus musculus
tgacaagcgtgctggaggcccatat

SEQ ID NO: 846689 - DNA, 25 bp, Mus musculus
tgacaagcgtgtcgtaggctctctt

SEQ ID NO: 846690 - DNA, 25 bp, Mus musculus
tgacaagcgtgtggtaggctctctt

SEQ ID NO: 846691 - DNA, 25 bp, Mus musculus
tgacaagctattccacatctctggt

SEQ ID NO: 846692 - DNA, 25 bp, Mus musculus
tgacaagctattgcacatctctggt

SEQ ID NO: 846693 - DNA, 25 bp, Mus musculus
tgacaagctgctaccaccctttagt

SEQ ID NO: 846694 - DNA, 25 bp, Mus musculus
tgacaagctgcttccaccctttagt

SEQ ID NO: 846695 - DNA, 25 bp, Mus musculus
tgacaaggacgccattgtgcaagct

SEQ ID NO: 846696 - DNA, 25 bp, Mus musculus
tgacaaggacgcgattgtgcaagct

SEQ ID NO: 846697 - DNA, 25 bp, Mus musculus
tgacaaggatctcgccacagggaca

SEQ ID NO: 846698 - DNA, 25 bp, Mus musculus
tgacaaggatctggccacagggaca

SEQ ID NO: 846699 - DNA, 25 bp, Mus musculus
tgacaaggcactcctacaggcaagg

SEQ ID NO: 846700 - DNA, 25 bp, Mus musculus
tgacaaggcactgctacaggcaagg

SEQ ID NO: 846701 - DNA, 25 bp, Mus musculus
tgacaaggccgcattactaagttat

SEQ ID NO: 846702 - DNA, 25 bp, Mus musculus
tgacaaggccgctttactaagttat

SEQ ID NO: 846703 - DNA, 25 bp, Mus musculus
tgacaaggcgagacactcctgctgg

SEQ ID NO: 846704 - DNA, 25 bp, Mus musculus
tgacaaggcgagtcactcctgctgg

SEQ ID NO: 846705 - DNA, 25 bp, Mus musculus
tgacaagggacacttcgggccatgt

SEQ ID NO: 846706 - DNA, 25 bp, Mus musculus
tgacaagggacagttcgggccatgt

SEQ ID NO: 846707 - DNA, 25 bp, Mus musculus
tgacaagggctgctgaaaccccctt

SEQ ID NO: 846708 - DNA, 25 bp, Mus musculus
tgacaagggctggtgaaaccccctt

SEQ ID NO: 846709 - DNA, 25 bp, Mus musculus
tgacaagggtaaaggcgacgcctcc

SEQ ID NO: 846710 - DNA, 25 bp, Mus musculus
tgacaagggtaatggcgacgcctcc

SEQ ID NO: 846711 - DNA, 25 bp, Mus musculus
tgacaagtacaacttaccgcctatg

SEQ ID NO: 846712 - DNA, 25 bp, Mus musculus
tgacaagtacaagttaccgcctatg

SEQ ID NO: 846713 - DNA, 25 bp, Mus musculus
tgacaagtcaatcacacccctgggt

SEQ ID NO: 846714 - DNA, 25 bp, Mus musculus
tgacaagtcaatgacacccctgggt

SEQ ID NO: 846715 - DNA, 25 bp, Mus musculus
tgacaagtcattcccacttccaaat

SEQ ID NO: 846716 - DNA, 25 bp, Mus musculus
tgacaagtcattgccacttccaaat

SEQ ID NO: 846717 - DNA, 25 bp, Mus musculus
tgacaagtccacagtgtctgttctg

SEQ ID NO: 846718 - DNA, 25 bp, Mus musculus
tgacaagtccactgtgtctgttctg

SEQ ID NO: 846719 - DNA, 25 bp, Mus musculus
tgacaagtccccatcgttgaagtga

SEQ ID NO: 846720 - DNA, 25 bp, Mus musculus
tgacaagtccccttcgttgaagtga

SEQ ID NO: 846721 - DNA, 25 bp, Mus musculus
tgacaagtctttccctcaggagctg

SEQ ID NO: 846722 - DNA, 25 bp, Mus musculus
tgacaagtctttgcctcaggagctg

SEQ ID NO: 846723 - DNA, 25 bp, Mus musculus
tgacaagtgacaaggcatctgcgat

SEQ ID NO: 846724 - DNA, 25 bp, Mus musculus
tgacaagtgacatggcatctgcgat

SEQ ID NO: 846725 - DNA, 25 bp, Mus musculus
tgacaagttagcagctttgacagtc

SEQ ID NO: 846726 - DNA, 25 bp, Mus musculus
tgacaagttagctgctttgacagtc

SEQ ID NO: 846727 - DNA, 25 bp, Mus musculus
tgacaagttcagaccccagtatatt

SEQ ID NO: 846728 - DNA, 25 bp, Mus musculus
tgacaagttcagtccccagtatatt

SEQ ID NO: 846729 - DNA, 25 bp, Mus musculus
tgacaagttttcactgtggaagagt

SEQ ID NO: 846730 - DNA, 25 bp, Mus musculus
tgacaagttttctctgtggaagagt

SEQ ID NO: 846731 - DNA, 25 bp, Mus musculus
tgacaataccagatgccatgcctga

SEQ ID NO: 846732 - DNA, 25 bp, Mus musculus
tgacaataccagttgccatgcctga

SEQ ID NO: 846733 - DNA, 25 bp, Mus musculus
tgacaataccatcggtgaaggccct

SEQ ID NO: 846734 - DNA, 25 bp, Mus musculus
tgacaataccatgggtgaaggccct

SEQ ID NO: 846735 - DNA, 25 bp, Mus musculus
tgacaatagaccaacatcccagctt

SEQ ID NO: 846736 - DNA, 25 bp, Mus musculus
tgacaatagacctacatcccagctt

SEQ ID NO: 846737 - DNA, 25 bp, Mus musculus
tgacaatagagaagaccgggccaat

SEQ ID NO: 846738 - DNA, 25 bp, Mus musculus
tgacaatagagatgaccgggccaat

SEQ ID NO: 846739 - DNA, 25 bp, Mus musculus
tgacaatagccgcaagacctacaac

SEQ ID NO: 846740 - DNA, 25 bp, Mus musculus
tgacaatagccggaagacctacaac

SEQ ID NO: 846741 - DNA, 25 bp, Mus musculus
tgacaataggagcaacacatggaca

SEQ ID NO: 846742 - DNA, 25 bp, Mus musculus
tgacaataggaggaacacatggaca

SEQ ID NO: 846743 - DNA, 25 bp, Mus musculus
tgacaatattgacgctgaggacttt

SEQ ID NO: 846744 - DNA, 25 bp, Mus musculus
tgacaatattgaggctgaggacttt

SEQ ID NO: 846745 - DNA, 25 bp, Mus musculus
tgacaatcaaatacactgcagccat

SEQ ID NO: 846746 - DNA, 25 bp, Mus musculus
tgacaatcaaattcactgcagccat

SEQ ID NO: 846747 - DNA, 25 bp, Mus musculus
tgacaatccacaaggctgaatcaca

SEQ ID NO: 846748 - DNA, 25 bp, Mus musculus
tgacaatccacatggctgaatcaca

SEQ ID NO: 846749 - DNA, 25 bp, Mus musculus
tgacaatccccgagacacaaaacag

SEQ ID NO: 846750 - DNA, 25 bp, Mus musculus
tgacaatccccgtgacacaaaacag

SEQ ID NO: 846751 - DNA, 25 bp, Mus musculus
tgacaatctactctgcaaccaaggc

SEQ ID NO: 846752 - DNA, 25 bp, Mus musculus
tgacaatctactgtgcaaccaaggc

SEQ ID NO: 846753 - DNA, 25 bp, Mus musculus
tgacaatctcgtactctactgcaat

SEQ ID NO: 846754 - DNA, 25 bp, Mus musculus
tgacaatctcgttctctactgcaat

SEQ ID NO: 846755 - DNA, 25 bp, Mus musculus
tgacaatgaatacggctacagcaac

SEQ ID NO: 846756 - DNA, 25 bp, Mus musculus
tgacaatgaatagggctacagcaac

SEQ ID NO: 846757 - DNA, 25 bp, Mus musculus
tgacaatgaccaccaagcaagcaca

SEQ ID NO: 846758 - DNA, 25 bp, Mus musculus
tgacaatgaccagcaagcaagcaca

SEQ ID NO: 846759 - DNA, 25 bp, Mus musculus
tgacaatgacctacctatggacagc

SEQ ID NO: 846760 - DNA, 25 bp, Mus musculus
tgacaatgaccttcctatggacagc

SEQ ID NO: 846761 - DNA, 25 bp, Mus musculus
tgacaatgcactcagcgctctgcga

SEQ ID NO: 846762 - DNA, 25 bp, Mus musculus
tgacaatgcactgagcgctctgcga

SEQ ID NO: 846763 - DNA, 25 bp, Mus musculus
tgacaatgccagagtgtttaccctc

SEQ ID NO: 846764 - DNA, 25 bp, Mus musculus
tgacaatgccagtgtgtttaccctc

SEQ ID NO: 846765 - DNA, 25 bp, Mus musculus
tgacaatggactctgtccctggtta

SEQ ID NO: 846766 - DNA, 25 bp, Mus musculus
tgacaatggactgtgtccctggtta

SEQ ID NO: 846767 - DNA, 25 bp, Mus musculus
tgacaattaggcaaagctcctggaa

SEQ ID NO: 846768 - DNA, 25 bp, Mus musculus
tgacaattaggctaagctcctggaa

SEQ ID NO: 846769 - DNA, 25 bp, Mus musculus
tgacaattccgtacacacaaatccc

SEQ ID NO: 846770 - DNA, 25 bp, Mus musculus
tgacaattccgttcacacaaatccc

SEQ ID NO: 846771 - DNA, 25 bp, Mus musculus
tgacaattgctcatcgcacgaatgg

SEQ ID NO: 846772 - DNA, 25 bp, Mus musculus
tgacaattgctcttcgcacgaatgg

SEQ ID NO: 846773 - DNA, 25 bp, Mus musculus
tgacaattgtatcccggttccccag

SEQ ID NO: 846774 - DNA, 25 bp, Mus musculus
tgacaattgtatgccggttccccag

SEQ ID NO: 846775 - DNA, 25 bp, Mus musculus
tgacaatttgccatagtactgctat

SEQ ID NO: 846776 - DNA, 25 bp, Mus musculus
tgacaatttgccttagtactgctat

SEQ ID NO: 846777 - DNA, 25 bp, Mus musculus
tgacaatttttgagaacacctaaat

SEQ ID NO: 846778 - DNA, 25 bp, Mus musculus
tgacaatttttgtgaacacctaaat

SEQ ID NO: 846779 - DNA, 25 bp, Mus musculus
tgacacaaaaacactccgagtcctc

SEQ ID NO: 846780 - DNA, 25 bp, Mus musculus
tgacacaaaaactctccgagtcctc

SEQ ID NO: 846781 - DNA, 25 bp, Mus musculus
tgacacaaaaccctctgcagcattt

SEQ ID NO: 846782 - DNA, 25 bp, Mus musculus
tgacacaaaaccgtctgcagcattt

SEQ ID NO: 846783 - DNA, 25 bp, Mus musculus
tgacacaacaaactgggattccatg

SEQ ID NO: 846784 - DNA, 25 bp, Mus musculus
tgacacaacaaagtgggattccatg

SEQ ID NO: 846785 - DNA, 25 bp, Mus musculus
tgacacacaccccatatggctagtg

SEQ ID NO: 846786 - DNA, 25 bp, Mus musculus
tgacacacacccgatatggctagtg

SEQ ID NO: 846787 - DNA, 25 bp, Mus musculus
tgacacacactcactttcaaagtta

SEQ ID NO: 846788 - DNA, 25 bp, Mus musculus
tgacacacactctctttcaaagtta

SEQ ID NO: 846789 - DNA, 25 bp, Mus musculus
tgacacacatgtatttgcagtctgt

SEQ ID NO: 846790 - DNA, 25 bp, Mus musculus
tgacacacatgtttttgcagtctgt

SEQ ID NO: 846791 - DNA, 25 bp, Mus musculus
tgacacacgccaccaaagggactgg

SEQ ID NO: 846792 - DNA, 25 bp, Mus musculus
tgacacacgccagcaaagggactgg

SEQ ID NO: 846793 - DNA, 25 bp, Mus musculus
tgacacacgtgtacccagtgggatt

SEQ ID NO: 846794 - DNA, 25 bp, Mus musculus
tgacacacgtgttcccagtgggatt

SEQ ID NO: 846795 - DNA, 25 bp, Mus musculus
tgacacactctcatttctttcacag

SEQ ID NO: 846796 - DNA, 25 bp, Mus musculus
tgacacactctcttttctttcacag

SEQ ID NO: 846797 - DNA, 25 bp, Mus musculus
tgacacactgctccattaatcctgt

SEQ ID NO: 846798 - DNA, 25 bp, Mus musculus
tgacacactgctgcattaatcctgt

SEQ ID NO: 846799 - DNA, 25 bp, Mus musculus
tgacacactggtcacaacagctcaa

SEQ ID NO: 846800 - DNA, 25 bp, Mus musculus
tgacacactggtgacaacagctcaa

SEQ ID NO: 846801 - DNA, 25 bp, Mus musculus
tgacacagagacaagtagcagcgac

SEQ ID NO: 846802 - DNA, 25 bp, Mus musculus
tgacacagagactagtagcagcgac

SEQ ID NO: 846803 - DNA, 25 bp, Mus musculus
tgacacagcaacagatccagtattt

SEQ ID NO: 846804 - DNA, 25 bp, Mus musculus
tgacacagcaactgatccagtattt

SEQ ID NO: 846805 - DNA, 25 bp, Mus musculus
tgacacagcactcgtgaccctacat

SEQ ID NO: 846806 - DNA, 25 bp, Mus musculus
tgacacagcactggtgaccctacat

SEQ ID NO: 846807 - DNA, 25 bp, Mus musculus
tgacacagcagtatctctttgaccg

SEQ ID NO: 846808 - DNA, 25 bp, Mus musculus
tgacacagcagtttctctttgaccg

SEQ ID NO: 846809 - DNA, 25 bp, Mus musculus
tgacacagccatagactgcagcggc

SEQ ID NO: 846810 - DNA, 25 bp, Mus musculus
tgacacagccattgactgcagcggc

SEQ ID NO: 846811 - DNA, 25 bp, Mus musculus
tgacacagccccaggagagcaagac

SEQ ID NO: 846812 - DNA, 25 bp, Mus musculus
tgacacagcccctggagagcaagac

SEQ ID NO: 846813 - DNA, 25 bp, Mus musculus
tgacacagctcaaaggtagggaccc

SEQ ID NO: 846814 - DNA, 25 bp, Mus musculus
tgacacagctcaaattgcccagggt

SEQ ID NO: 846815 - DNA, 25 bp, Mus musculus
tgacacagctcataggtagggaccc

SEQ ID NO: 846816 - DNA, 25 bp, Mus musculus
tgacacagctcatattgcccagggt

SEQ ID NO: 846817 - DNA, 25 bp, Mus musculus
tgacacagctccagcatatctgtga

SEQ ID NO: 846818 - DNA, 25 bp, Mus musculus
tgacacagctcctgcatatctgtga

SEQ ID NO: 846819 - DNA, 25 bp, Mus musculus
tgacacaggacgcagacttcacagg

SEQ ID NO: 846820 - DNA, 25 bp, Mus musculus
tgacacaggacggagacttcacagg

SEQ ID NO: 846821 - DNA, 25 bp, Mus musculus
tgacacaggcctatagcatttctaa

SEQ ID NO: 846822 - DNA, 25 bp, Mus musculus
tgacacaggcctttagcatttctaa

SEQ ID NO: 846823 - DNA, 25 bp, Mus musculus
tgacacaggcggcacctgctattga

SEQ ID NO: 846824 - DNA, 25 bp, Mus musculus
tgacacaggcgggacctgctattga

SEQ ID NO: 846825 - DNA, 25 bp, Mus musculus
tgacacaggctaccctcatttgaga

SEQ ID NO: 846826 - DNA, 25 bp, Mus musculus
tgacacaggctagcctcatttgaga

SEQ ID NO: 846827 - DNA, 25 bp, Mus musculus
tgacacaggctgctcgaacacttac

SEQ ID NO: 846828 - DNA, 25 bp, Mus musculus
tgacacaggctggtcgaacacttac

SEQ ID NO: 846829 - DNA, 25 bp, Mus musculus
tgacacagggctccctagacccgga

SEQ ID NO: 846830 - DNA, 25 bp, Mus musculus
tgacacagggctcttgtggacccct

SEQ ID NO: 846831 - DNA, 25 bp, Mus musculus
tgacacagggctgcctagacccgga

SEQ ID NO: 846832 - DNA, 25 bp, Mus musculus
tgacacagggctgttgtggacccct

SEQ ID NO: 846833 - DNA, 25 bp, Mus musculus
tgacacaggtgccaaggtccccagt

SEQ ID NO: 846834 - DNA, 25 bp, Mus musculus
tgacacaggtgcgaaggtccccagt

SEQ ID NO: 846835 - DNA, 25 bp, Mus musculus
tgacacagtcttcttcttgagtggg

SEQ ID NO: 846836 - DNA, 25 bp, Mus musculus
tgacacagtcttgttcttgagtggg

SEQ ID NO: 846837 - DNA, 25 bp, Mus musculus
tgacacagtgaccacccaagcagca

SEQ ID NO: 846838 - DNA, 25 bp, Mus musculus
tgacacagtgacgacccaagcagca

SEQ ID NO: 846839 - DNA, 25 bp, Mus musculus
tgacacagtggcaccgtacagcgag

SEQ ID NO: 846840 - DNA, 25 bp, Mus musculus
tgacacagtggctccgtacagcgag

SEQ ID NO: 846841 - DNA, 25 bp, Mus musculus
tgacacagtgtgctggactgctaga

SEQ ID NO: 846842 - DNA, 25 bp, Mus musculus
tgacacagtgtggtggactgctaga

SEQ ID NO: 846843 - DNA, 25 bp, Mus musculus
tgacacagttccctcaccaaaagca

SEQ ID NO: 846844 - DNA, 25 bp, Mus musculus
tgacacagttccgtcaccaaaagca

SEQ ID NO: 846845 - DNA, 25 bp, Mus musculus
tgacacatagatctcaccgactcgt

SEQ ID NO: 846846 - DNA, 25 bp, Mus musculus
tgacacatagatgtcaccgactcgt

SEQ ID NO: 846847 - DNA, 25 bp, Mus musculus
tgacacatcccgcaaactgaaaaga

SEQ ID NO: 846848 - DNA, 25 bp, Mus musculus
tgacacatcccggaaactgaaaaga

SEQ ID NO: 846849 - DNA, 25 bp, Mus musculus
tgacacatctttccaacctattatt

SEQ ID NO: 846850 - DNA, 25 bp, Mus musculus
tgacacatctttgcaacctattatt

SEQ ID NO: 846851 - DNA, 25 bp, Mus musculus
tgacacatgaccctttgcatcagga

SEQ ID NO: 846852 - DNA, 25 bp, Mus musculus
tgacacatgaccgtttgcatcagga

SEQ ID NO: 846853 - DNA, 25 bp, Mus musculus
tgacacatgctaactctgtggcctt

SEQ ID NO: 846854 - DNA, 25 bp, Mus musculus
tgacacatgctatctctgtggcctt

SEQ ID NO: 846855 - DNA, 25 bp, Mus musculus
tgacacattcccacgctgcgggtga

SEQ ID NO: 846856 - DNA, 25 bp, Mus musculus
tgacacattccctcgctgcgggtga

SEQ ID NO: 846857 - DNA, 25 bp, Mus musculus
tgacacattcgcatttctcttgaag

SEQ ID NO: 846858 - DNA, 25 bp, Mus musculus
tgacacattcgcttttctcttgaag

SEQ ID NO: 846859 - DNA, 25 bp, Mus musculus
tgacacattgtcatgcgtgagggaa

SEQ ID NO: 846860 - DNA, 25 bp, Mus musculus
tgacacattgtcttgcgtgagggaa

SEQ ID NO: 846861 - DNA, 25 bp, Mus musculus
tgacacatttctactcttccaacag

SEQ ID NO: 846862 - DNA, 25 bp, Mus musculus
tgacacatttcttctcttccaacag

SEQ ID NO: 846863 - DNA, 25 bp, Mus musculus
tgacacatttttaaagtagcacctt

SEQ ID NO: 846864 - DNA, 25 bp, Mus musculus
tgacacattttttaagtagcacctt

SEQ ID NO: 846865 - DNA, 25 bp, Mus musculus
tgacaccaaagcagaagtccccttg

SEQ ID NO: 846866 - DNA, 25 bp, Mus musculus
tgacaccaaagctgaagtccccttg

SEQ ID NO: 846867 - DNA, 25 bp, Mus musculus
tgacaccaaataagccgccgagttc

SEQ ID NO: 846868 - DNA, 25 bp, Mus musculus
tgacaccaaatatgccgccgagttc

SEQ ID NO: 846869 - DNA, 25 bp, Mus musculus
tgacaccaacagaacttcttatagt

SEQ ID NO: 846870 - DNA, 25 bp, Mus musculus
tgacaccaacagtacttcttatagt

SEQ ID NO: 846871 - DNA, 25 bp, Mus musculus
tgacaccaagccaatggttaacctg

SEQ ID NO: 846872 - DNA, 25 bp, Mus musculus
tgacaccaagcccatagccctgagt

SEQ ID NO: 846873 - DNA, 25 bp, Mus musculus
tgacaccaagccgatagccctgagt

SEQ ID NO: 846874 - DNA, 25 bp, Mus musculus
tgacaccaagcctatggttaacctg

SEQ ID NO: 846875 - DNA, 25 bp, Mus musculus
tgacaccaagggatcctactagctc

SEQ ID NO: 846876 - DNA, 25 bp, Mus musculus
tgacaccaagggttcctactagctc

SEQ ID NO: 846877 - DNA, 25 bp, Mus musculus
tgacaccaagttatctgctgtgctg

SEQ ID NO: 846878 - DNA, 25 bp, Mus musculus
tgacaccaagttttctgctgtgctg

SEQ ID NO: 846879 - DNA, 25 bp, Mus musculus
tgacaccaatgacctcagcgagcat

SEQ ID NO: 846880 - DNA, 25 bp, Mus musculus
tgacaccaatgagctcagcgagcat

SEQ ID NO: 846881 - DNA, 25 bp, Mus musculus
tgacaccaccacctacaagaacctg

SEQ ID NO: 846882 - DNA, 25 bp, Mus musculus
tgacaccaccacgtacaagaacctg

SEQ ID NO: 846883 - DNA, 25 bp, Mus musculus
tgacaccactccactgtgagagcat

SEQ ID NO: 846884 - DNA, 25 bp, Mus musculus
tgacaccactcctctgtgagagcat

SEQ ID NO: 846885 - DNA, 25 bp, Mus musculus
tgacaccagcaccatagaccagaaa

SEQ ID NO: 846886 - DNA, 25 bp, Mus musculus
tgacaccagcacgatagaccagaaa

SEQ ID NO: 846887 - DNA, 25 bp, Mus musculus
tgacaccagctaaggctaattgcca

SEQ ID NO: 846888 - DNA, 25 bp, Mus musculus
tgacaccagctactgagagcctaca

SEQ ID NO: 846889 - DNA, 25 bp, Mus musculus
tgacaccagctagtgagagcctaca

SEQ ID NO: 846890 - DNA, 25 bp, Mus musculus
tgacaccagctatggctaattgcca

SEQ ID NO: 846891 - DNA, 25 bp, Mus musculus
tgacaccaggtacggctagccaagt

SEQ ID NO: 846892 - DNA, 25 bp, Mus musculus
tgacaccaggtagggctagccaagt

SEQ ID NO: 846893 - DNA, 25 bp, Mus musculus
tgacaccagtgacttattctgctcc

SEQ ID NO: 846894 - DNA, 25 bp, Mus musculus
tgacaccagtgagttattctgctcc

SEQ ID NO: 846895 - DNA, 25 bp, Mus musculus
tgacaccatcaaccagctgagccag

SEQ ID NO: 846896 - DNA, 25 bp, Mus musculus
tgacaccatcaagcagctgagccag

SEQ ID NO: 846897 - DNA, 25 bp, Mus musculus
tgacaccatccaagacatccagaaa

SEQ ID NO: 846898 - DNA, 25 bp, Mus musculus
tgacaccatccatgacatccagaaa

SEQ ID NO: 846899 - DNA, 25 bp, Mus musculus
tgacacccaaagcttttcttaggag

SEQ ID NO: 846900 - DNA, 25 bp, Mus musculus
tgacacccaaaggttttcttaggag

SEQ ID NO: 846901 - DNA, 25 bp, Mus musculus
tgacacccacctctattctggctgg

SEQ ID NO: 846902 - DNA, 25 bp, Mus musculus
tgacacccacctgtattctggctgg

SEQ ID NO: 846903 - DNA, 25 bp, Mus musculus
tgacacccacggaaggccaccatga

SEQ ID NO: 846904 - DNA, 25 bp, Mus musculus
tgacacccacggtaggccaccatga

SEQ ID NO: 846905 - DNA, 25 bp, Mus musculus
tgacacccagacagctgagggtcct

SEQ ID NO: 846906 - DNA, 25 bp, Mus musculus
tgacacccagactgctgagggtcct

SEQ ID NO: 846907 - DNA, 25 bp, Mus musculus
tgacacccaggtccagaatccttgg

SEQ ID NO: 846908 - DNA, 25 bp, Mus musculus
tgacacccaggtgcagaatccttgg

SEQ ID NO: 846909 - DNA, 25 bp, Mus musculus
tgacacccagtacaccggccgaaag

SEQ ID NO: 846910 - DNA, 25 bp, Mus musculus
tgacacccagtagaccggccgaaag

SEQ ID NO: 846911 - DNA, 25 bp, Mus musculus
tgacacccagtcattgctgtattac

SEQ ID NO: 846912 - DNA, 25 bp, Mus musculus
tgacacccagtctttgctgtattac

SEQ ID NO: 846913 - DNA, 25 bp, Mus musculus
tgacacccatggctgaaatgctatg

SEQ ID NO: 846914 - DNA, 25 bp, Mus musculus
tgacacccatgggtgaaatgctatg

SEQ ID NO: 846915 - DNA, 25 bp, Mus musculus
tgacaccccacaacagaaagaactg

SEQ ID NO: 846916 - DNA, 25 bp, Mus musculus
tgacaccccacatcagaaagaactg

SEQ ID NO: 846917 - DNA, 25 bp, Mus musculus
tgacacccctatacatgtttgtggt

SEQ ID NO: 846918 - DNA, 25 bp, Mus musculus
tgacacccctattcatgtttgtggt

SEQ ID NO: 846919 - DNA, 25 bp, Mus musculus
tgacacccctttcagggtccagtgg

SEQ ID NO: 846920 - DNA, 25 bp, Mus musculus
tgacacccctttgagggtccagtgg

SEQ ID NO: 846921 - DNA, 25 bp, Mus musculus
tgacaccctcttaaaatactgccaa

SEQ ID NO: 846922 - DNA, 25 bp, Mus musculus
tgacaccctcttatagcctctatga

SEQ ID NO: 846923 - DNA, 25 bp, Mus musculus
tgacaccctctttaaatactgccaa

SEQ ID NO: 846924 - DNA, 25 bp, Mus musculus
tgacaccctcttttagcctctatga

SEQ ID NO: 846925 - DNA, 25 bp, Mus musculus
tgacaccctgagatcaacccataga

SEQ ID NO: 846926 - DNA, 25 bp, Mus musculus
tgacaccctgagttcaacccataga

SEQ ID NO: 846927 - DNA, 25 bp, Mus musculus
tgacaccctttgcattgctcagttg

SEQ ID NO: 846928 - DNA, 25 bp, Mus musculus
tgacaccctttggattgctcagttg

SEQ ID NO: 846929 - DNA, 25 bp, Mus musculus
tgacaccgatacatattccctagga

SEQ ID NO: 846930 - DNA, 25 bp, Mus musculus
tgacaccgatacttattccctagga

SEQ ID NO: 846931 - DNA, 25 bp, Mus musculus
tgacaccgattgatttaccccttaa

SEQ ID NO: 846932 - DNA, 25 bp, Mus musculus
tgacaccgattgttttaccccttaa

SEQ ID NO: 846933 - DNA, 25 bp, Mus musculus
tgacaccgtgggagagtccctggcc

SEQ ID NO: 846934 - DNA, 25 bp, Mus musculus
tgacaccgtgggtgagtccctggcc

SEQ ID NO: 846935 - DNA, 25 bp, Mus musculus
tgacacctcaacctagacaccttag

SEQ ID NO: 846936 - DNA, 25 bp, Mus musculus
tgacacctcaacgtagacaccttag

SEQ ID NO: 846937 - DNA, 25 bp, Mus musculus
tgacacctcacaatagtgcctgggc

SEQ ID NO: 846938 - DNA, 25 bp, Mus musculus
tgacacctcacattagtgcctgggc

SEQ ID NO: 846939 - DNA, 25 bp, Mus musculus
tgacacctcatcaccgttatgccat

SEQ ID NO: 846940 - DNA, 25 bp, Mus musculus
tgacacctcatctccgttatgccat

SEQ ID NO: 846941 - DNA, 25 bp, Mus musculus
tgacacctcccgaatagcatgagat

SEQ ID NO: 846942 - DNA, 25 bp, Mus musculus
tgacacctcccgtatagcatgagat

SEQ ID NO: 846943 - DNA, 25 bp, Mus musculus
tgacacctcctaacagacctggaaa

SEQ ID NO: 846944 - DNA, 25 bp, Mus musculus
tgacacctcctatcagacctggaaa

SEQ ID NO: 846945 - DNA, 25 bp, Mus musculus
tgacacctcgtaagaaaactgcatg

SEQ ID NO: 846946 - DNA, 25 bp, Mus musculus
tgacacctcgtatgaaaactgcatg

SEQ ID NO: 846947 - DNA, 25 bp, Mus musculus
tgacacctctgaagtcatgagccaa

SEQ ID NO: 846948 - DNA, 25 bp, Mus musculus
tgacacctctgatgtcatgagccaa

SEQ ID NO: 846949 - DNA, 25 bp, Mus musculus
tgacacctgaggctagagtcctttc

SEQ ID NO: 846950 - DNA, 25 bp, Mus musculus
tgacacctgagggtagagtcctttc

SEQ ID NO: 846951 - DNA, 25 bp, Mus musculus
tgacacctgagtaccattcgcagaa

SEQ ID NO: 846952 - DNA, 25 bp, Mus musculus
tgacacctgagttccattcgcagaa

SEQ ID NO: 846953 - DNA, 25 bp, Mus musculus
tgacacctggcaatagctgggtttt

SEQ ID NO: 846954 - DNA, 25 bp, Mus musculus
tgacacctggcattagctgggtttt

SEQ ID NO: 846955 - DNA, 25 bp, Mus musculus
tgacacctggttactgatggcatat

SEQ ID NO: 846956 - DNA, 25 bp, Mus musculus
tgacacctggtttctgatggcatat

SEQ ID NO: 846957 - DNA, 25 bp, Mus musculus
tgacacctgtaacatgcccatggct

SEQ ID NO: 846958 - DNA, 25 bp, Mus musculus
tgacacctgtaagatgcccatggct

SEQ ID NO: 846959 - DNA, 25 bp, Mus musculus
tgacacctttcacgtctttgatgag

SEQ ID NO: 846960 - DNA, 25 bp, Mus musculus
tgacacctttcaggtctttgatgag

SEQ ID NO: 846961 - DNA, 25 bp, Mus musculus
tgacacgacacacttgaaaccctgg

SEQ ID NO: 846962 - DNA, 25 bp, Mus musculus
tgacacgacacagttgaaaccctgg

SEQ ID NO: 846963 - DNA, 25 bp, Mus musculus
tgacacgatgatacagactcctgga

SEQ ID NO: 846964 - DNA, 25 bp, Mus musculus
tgacacgatgattcagactcctgga

SEQ ID NO: 846965 - DNA, 25 bp, Mus musculus
tgacacgcacgtcacattctctctt

SEQ ID NO: 846966 - DNA, 25 bp, Mus musculus
tgacacgcacgtgacattctctctt

SEQ ID NO: 846967 - DNA, 25 bp, Mus musculus
tgacacgcacttagattgactggca

SEQ ID NO: 846968 - DNA, 25 bp, Mus musculus
tgacacgcactttgattgactggca

SEQ ID NO: 846969 - DNA, 25 bp, Mus musculus
tgacacgcttccaggtccgaggaga

SEQ ID NO: 846970 - DNA, 25 bp, Mus musculus
tgacacgcttcctggtccgaggaga

SEQ ID NO: 846971 - DNA, 25 bp, Mus musculus
tgacacggctcgcagccactcgtgg

SEQ ID NO: 846972 - DNA, 25 bp, Mus musculus
tgacacggctcggagccactcgtgg

SEQ ID NO: 846973 - DNA, 25 bp, Mus musculus
tgacacgggcccaatttatatttaa

SEQ ID NO: 846974 - DNA, 25 bp, Mus musculus
tgacacgggccctatttatatttaa

SEQ ID NO: 846975 - DNA, 25 bp, Mus musculus
tgacacggtcagcttcaacacctgt

SEQ ID NO: 846976 - DNA, 25 bp, Mus musculus
tgacacggtcaggttcaacacctgt

SEQ ID NO: 846977 - DNA, 25 bp, Mus musculus
tgacacggttcaaagctggtctttt

SEQ ID NO: 846978 - DNA, 25 bp, Mus musculus
tgacacggttcatagctggtctttt

SEQ ID NO: 846979 - DNA, 25 bp, Mus musculus
tgacacgtacttctggcctcatcca

SEQ ID NO: 846980 - DNA, 25 bp, Mus musculus
tgacacgtacttgtggcctcatcca

SEQ ID NO: 846981 - DNA, 25 bp, Mus musculus
tgacacgtcagcagggtaaacatct

SEQ ID NO: 846982 - DNA, 25 bp, Mus musculus
tgacacgtcagctgggtaaacatct

SEQ ID NO: 846983 - DNA, 25 bp, Mus musculus
tgacacgtggtcatcctttggcaaa

SEQ ID NO: 846984 - DNA, 25 bp, Mus musculus
tgacacgtggtcttcctttggcaaa

SEQ ID NO: 846985 - DNA, 25 bp, Mus musculus
tgacacgtgtgtagtacccagcgga

SEQ ID NO: 846986 - DNA, 25 bp, Mus musculus
tgacacgtgtgttgtacccagcgga

SEQ ID NO: 846987 - DNA, 25 bp, Mus musculus
tgacacgtttctccaactaacgcag

SEQ ID NO: 846988 - DNA, 25 bp, Mus musculus
tgacacgtttctgcaactaacgcag

SEQ ID NO: 846989 - DNA, 25 bp, Mus musculus
tgacacgtttgtagtggagaacccc

SEQ ID NO: 846990 - DNA, 25 bp, Mus musculus
tgacacgtttgttgtggagaacccc

SEQ ID NO: 846991 - DNA, 25 bp, Mus musculus
tgacactaagccacatcacatatta

SEQ ID NO: 846992 - DNA, 25 bp, Mus musculus
tgacactaagcctcatcacatatta

SEQ ID NO: 846993 - DNA, 25 bp, Mus musculus
tgacactacctcagagctggagaac

SEQ ID NO: 846994 - DNA, 25 bp, Mus musculus
tgacactacctctgagctggagaac

SEQ ID NO: 846995 - DNA, 25 bp, Mus musculus
tgacactactcactccagtattgga

SEQ ID NO: 846996 - DNA, 25 bp, Mus musculus
tgacactactcagtccagtattgga

SEQ ID NO: 846997 - DNA, 25 bp, Mus musculus
tgacactactccagtggccaatact

SEQ ID NO: 846998 - DNA, 25 bp, Mus musculus
tgacactactcctgtggccaatact

SEQ ID NO: 846999 - DNA, 25 bp, Mus musculus
tgacactagaacaggatctttccgg

SEQ ID NO: 847000 - DNA, 25 bp, Mus musculus
tgacactagaactggatctttccgg

SEQ ID NO: 847001 - DNA, 25 bp, Mus musculus
tgacactagtccatggtacattctg

SEQ ID NO: 847002 - DNA, 25 bp, Mus musculus
tgacactagtccttggtacattctg

SEQ ID NO: 847003 - DNA, 25 bp, Mus musculus
tgacactattcaatgcaatgcactt

SEQ ID NO: 847004 - DNA, 25 bp, Mus musculus
tgacactattcattgcaatgcactt

SEQ ID NO: 847005 - DNA, 25 bp, Mus musculus
tgacactcactgagtgcgactcata

SEQ ID NO: 847006 - DNA, 25 bp, Mus musculus
tgacactcactgtgtgcgactcata

SEQ ID NO: 847007 - DNA, 25 bp, Mus musculus
tgacactcagcaccacacgggaagt

SEQ ID NO: 847008 - DNA, 25 bp, Mus musculus
tgacactcagcagcacacgggaagt

SEQ ID NO: 847009 - DNA, 25 bp, Mus musculus
tgacactcattgaggctgaggccct

SEQ ID NO: 847010 - DNA, 25 bp, Mus musculus
tgacactcattgtggctgaggccct

SEQ ID NO: 847011 - DNA, 25 bp, Mus musculus
tgacactccgctagaaaccacgtga

SEQ ID NO: 847012 - DNA, 25 bp, Mus musculus
tgacactccgcttgaaaccacgtga

SEQ ID NO: 847013 - DNA, 25 bp, Mus musculus
tgacactcctttccttggatatcat

SEQ ID NO: 847014 - DNA, 25 bp, Mus musculus
tgacactcctttgcttggatatcat

SEQ ID NO: 847015 - DNA, 25 bp, Mus musculus
tgacactctcccagaacaacagcat

SEQ ID NO: 847016 - DNA, 25 bp, Mus musculus
tgacactctccctgaacaacagcat

SEQ ID NO: 847017 - DNA, 25 bp, Mus musculus
tgacactcttctcaatcctggtggt

SEQ ID NO: 847018 - DNA, 25 bp, Mus musculus
tgacactcttctgaatcctggtggt

SEQ ID NO: 847019 - DNA, 25 bp, Mus musculus
tgacactgacccaaaagaggtcact

SEQ ID NO: 847020 - DNA, 25 bp, Mus musculus
tgacactgaccctaaagaggtcact

SEQ ID NO: 847021 - DNA, 25 bp, Mus musculus
tgacactgacctccagcacctgaaa

SEQ ID NO: 847022 - DNA, 25 bp, Mus musculus
tgacactgacctgcagcacctgaaa

SEQ ID NO: 847023 - DNA, 25 bp, Mus musculus
tgacactgccaaaggtattttaaag

SEQ ID NO: 847024 - DNA, 25 bp, Mus musculus
tgacactgccaatggtattttaaag

SEQ ID NO: 847025 - DNA, 25 bp, Mus musculus
tgacactgctcacagcctctgtgct

SEQ ID NO: 847026 - DNA, 25 bp, Mus musculus
tgacactgctcagagcctctgtgct

SEQ ID NO: 847027 - DNA, 25 bp, Mus musculus
tgacactgctgccagagcggctcat

SEQ ID NO: 847028 - DNA, 25 bp, Mus musculus
tgacactgctgcgagagcggctcat

SEQ ID NO: 847029 - DNA, 25 bp, Mus musculus
tgacactggctcagaagtatgaagt

SEQ ID NO: 847030 - DNA, 25 bp, Mus musculus
tgacactggctctgaagtatgaagt

SEQ ID NO: 847031 - DNA, 25 bp, Mus musculus
tgacactggctgcagcaaaagcatt

SEQ ID NO: 847032 - DNA, 25 bp, Mus musculus
tgacactggctggagcaaaagcatt

SEQ ID NO: 847033 - DNA, 25 bp, Mus musculus
tgacactggcttcccggacccgagt

SEQ ID NO: 847034 - DNA, 25 bp, Mus musculus
tgacactggcttgccggacccgagt

SEQ ID NO: 847035 - DNA, 25 bp, Mus musculus
tgacactgggctcggacacatacct

SEQ ID NO: 847036 - DNA, 25 bp, Mus musculus
tgacactgggctgggacacatacct

SEQ ID NO: 847037 - DNA, 25 bp, Mus musculus
tgacactgtactacctttagcaaca

SEQ ID NO: 847038 - DNA, 25 bp, Mus musculus
tgacactgtacttcctttagcaaca

SEQ ID NO: 847039 - DNA, 25 bp, Mus musculus
tgacactgtagcactgaaaaccaag

SEQ ID NO: 847040 - DNA, 25 bp, Mus musculus
tgacactgtagctctgaaaaccaag

SEQ ID NO: 847041 - DNA, 25 bp, Mus musculus
tgacactgtctaacagtacgtcggc

SEQ ID NO: 847042 - DNA, 25 bp, Mus musculus
tgacactgtctatcagtacgtcggc

SEQ ID NO: 847043 - DNA, 25 bp, Mus musculus
tgacactgtggacctcggtcacctc

SEQ ID NO: 847044 - DNA, 25 bp, Mus musculus
tgacactgtggagctcggtcacctc

SEQ ID NO: 847045 - DNA, 25 bp, Mus musculus
tgacactgttacagtgtgcccgtca

SEQ ID NO: 847046 - DNA, 25 bp, Mus musculus
tgacactgttactgtgtgcccgtca

SEQ ID NO: 847047 - DNA, 25 bp, Mus musculus
tgacactgttcacgatcaccagatg

SEQ ID NO: 847048 - DNA, 25 bp, Mus musculus
tgacactgttcaggatcaccagatg

SEQ ID NO: 847049 - DNA, 25 bp, Mus musculus
tgacacttaggccactgctgtgagc

SEQ ID NO: 847050 - DNA, 25 bp, Mus musculus
tgacacttaggcgactgctgtgagc

SEQ ID NO: 847051 - DNA, 25 bp, Mus musculus
tgacacttatatactttctgctccc

SEQ ID NO: 847052 - DNA, 25 bp, Mus musculus
tgacacttatattctttctgctccc

SEQ ID NO: 847053 - DNA, 25 bp, Mus musculus
tgacacttattgcatgtgattctaa

SEQ ID NO: 847054 - DNA, 25 bp, Mus musculus
tgacacttattggatgtgattctaa

SEQ ID NO: 847055 - DNA, 25 bp, Mus musculus
tgacacttcattctcaacccaaatt

SEQ ID NO: 847056 - DNA, 25 bp, Mus musculus
tgacacttcattgtcaacccaaatt

SEQ ID NO: 847057 - DNA, 25 bp, Mus musculus
tgacacttccatatgatacctcttg

SEQ ID NO: 847058 - DNA, 25 bp, Mus musculus
tgacacttccatttgatacctcttg

SEQ ID NO: 847059 - DNA, 25 bp, Mus musculus
tgacacttcccgacttactgaaatg

SEQ ID NO: 847060 - DNA, 25 bp, Mus musculus
tgacacttcccgtcttactgaaatg

SEQ ID NO: 847061 - DNA, 25 bp, Mus musculus
tgacacttcctaccaaacttctctt

SEQ ID NO: 847062 - DNA, 25 bp, Mus musculus
tgacacttcctagcaaacttctctt

SEQ ID NO: 847063 - DNA, 25 bp, Mus musculus
tgacacttcgctacctcattgctga

SEQ ID NO: 847064 - DNA, 25 bp, Mus musculus
tgacacttcgcttcctcattgctga

SEQ ID NO: 847065 - DNA, 25 bp, Mus musculus
tgacacttgacgaggcctctgagac

SEQ ID NO: 847066 - DNA, 25 bp, Mus musculus
tgacacttgacgtggcctctgagac

SEQ ID NO: 847067 - DNA, 25 bp, Mus musculus
tgacacttgatgaagaccttgggac

SEQ ID NO: 847068 - DNA, 25 bp, Mus musculus
tgacacttgatgtagaccttgggac

SEQ ID NO: 847069 - DNA, 25 bp, Mus musculus
tgacacttgctcactgatgtccctt

SEQ ID NO: 847070 - DNA, 25 bp, Mus musculus
tgacacttgctctctgatgtccctt

SEQ ID NO: 847071 - DNA, 25 bp, Mus musculus
tgacacttgtggatttaccgggaat

SEQ ID NO: 847072 - DNA, 25 bp, Mus musculus
tgacacttgtggttttaccgggaat

SEQ ID NO: 847073 - DNA, 25 bp, Mus musculus
tgacactttcacatttgcagattgg

SEQ ID NO: 847074 - DNA, 25 bp, Mus musculus
tgacactttcacttttgcagattgg

SEQ ID NO: 847075 - DNA, 25 bp, Mus musculus
tgacacttttgtactcagcttctgc

SEQ ID NO: 847076 - DNA, 25 bp, Mus musculus
tgacacttttgtctccagtctgctc

SEQ ID NO: 847077 - DNA, 25 bp, Mus musculus
tgacacttttgtgtccagtctgctc

SEQ ID NO: 847078 - DNA, 25 bp, Mus musculus
tgacacttttgttctcagcttctgc

SEQ ID NO: 847079 - DNA, 25 bp, Mus musculus
tgacagaaaaatctaaggccatgac

SEQ ID NO: 847080 - DNA, 25 bp, Mus musculus
tgacagaaaaatgtaaggccatgac

SEQ ID NO: 847081 - DNA, 25 bp, Mus musculus
tgacagaaactaccaagcacagctt

SEQ ID NO: 847082 - DNA, 25 bp, Mus musculus
tgacagaaactagcaagcacagctt

SEQ ID NO: 847083 - DNA, 25 bp, Mus musculus
tgacagaaactgactgacctattca

SEQ ID NO: 847084 - DNA, 25 bp, Mus musculus
tgacagaaactgtctgacctattca

SEQ ID NO: 847085 - DNA, 25 bp, Mus musculus
tgacagaaatcaccaccacggagag

SEQ ID NO: 847086 - DNA, 25 bp, Mus musculus
tgacagaaatcagcaccacggagag

SEQ ID NO: 847087 - DNA, 25 bp, Mus musculus
tgacagaacggtagcgcagtcgcta

SEQ ID NO: 847088 - DNA, 25 bp, Mus musculus
tgacagaacggttgcgcagtcgcta

SEQ ID NO: 847089 - DNA, 25 bp, Mus musculus
tgacagaactggagcacccgacaca

SEQ ID NO: 847090 - DNA, 25 bp, Mus musculus
tgacagaactggtgcacccgacaca

SEQ ID NO: 847091 - DNA, 25 bp, Mus musculus
tgacagaagacaccgggctagagct

SEQ ID NO: 847092 - DNA, 25 bp, Mus musculus
tgacagaagacacgcctgactgctc

SEQ ID NO: 847093 - DNA, 25 bp, Mus musculus
tgacagaagacagcgggctagagct

SEQ ID NO: 847094 - DNA, 25 bp, Mus musculus
tgacagaagacaggcctgactgctc

SEQ ID NO: 847095 - DNA, 25 bp, Mus musculus
tgacagaagctaacgcatctcctat

SEQ ID NO: 847096 - DNA, 25 bp, Mus musculus
tgacagaagctatcgcatctcctat

SEQ ID NO: 847097 - DNA, 25 bp, Mus musculus
tgacagaagtctatttgccacccag

SEQ ID NO: 847098 - DNA, 25 bp, Mus musculus
tgacagaagtctttttgccacccag

SEQ ID NO: 847099 - DNA, 25 bp, Mus musculus
tgacagaatccacctttacgaacct

SEQ ID NO: 847100 - DNA, 25 bp, Mus musculus
tgacagaatccagctttacgaacct

SEQ ID NO: 847101 - DNA, 25 bp, Mus musculus
tgacagaatgctatccttggcactc

SEQ ID NO: 847102 - DNA, 25 bp, Mus musculus
tgacagaatgctttccttggcactc

SEQ ID NO: 847103 - DNA, 25 bp, Mus musculus
tgacagacaagcatgcacctgagca

SEQ ID NO: 847104 - DNA, 25 bp, Mus musculus
tgacagacaagcttgcacctgagca

SEQ ID NO: 847105 - DNA, 25 bp, Mus musculus
tgacagacactgactgacttatctc

SEQ ID NO: 847106 - DNA, 25 bp, Mus musculus
tgacagacactgtctgacttatctc

SEQ ID NO: 847107 - DNA, 25 bp, Mus musculus
tgacagacagggaggcgctgtttta

SEQ ID NO: 847108 - DNA, 25 bp, Mus musculus
tgacagacagggtggcgctgtttta

SEQ ID NO: 847109 - DNA, 25 bp, Mus musculus
tgacagacaggtcgcgagcaggatt

SEQ ID NO: 847110 - DNA, 25 bp, Mus musculus
tgacagacaggtggcgagcaggatt

SEQ ID NO: 847111 - DNA, 25 bp, Mus musculus
tgacagacataactcatcattcccc

SEQ ID NO: 847112 - DNA, 25 bp, Mus musculus
tgacagacataagtcatcattcccc

SEQ ID NO: 847113 - DNA, 25 bp, Mus musculus
tgacagacatcaccactagatcgcc

SEQ ID NO: 847114 - DNA, 25 bp, Mus musculus
tgacagacatcagcactagatcgcc

SEQ ID NO: 847115 - DNA, 25 bp, Mus musculus
tgacagacattaaccagctccctga

SEQ ID NO: 847116 - DNA, 25 bp, Mus musculus
tgacagacattatccagctccctga

SEQ ID NO: 847117 - DNA, 25 bp, Mus musculus
tgacagaccagccacaccatggagc

SEQ ID NO: 847118 - DNA, 25 bp, Mus musculus
tgacagaccagcgacaccatggagc

SEQ ID NO: 847119 - DNA, 25 bp, Mus musculus
tgacagaccagtccttttgggaaac

SEQ ID NO: 847120 - DNA, 25 bp, Mus musculus
tgacagaccagtgcttttgggaaac

SEQ ID NO: 847121 - DNA, 25 bp, Mus musculus
tgacagaccctgagttggcatccca

SEQ ID NO: 847122 - DNA, 25 bp, Mus musculus
tgacagaccctgtgttggcatccca

SEQ ID NO: 847123 - DNA, 25 bp, Mus musculus
tgacagaccgaacctgccgggtaat

SEQ ID NO: 847124 - DNA, 25 bp, Mus musculus
tgacagaccgaagctgccgggtaat

SEQ ID NO: 847125 - DNA, 25 bp, Mus musculus
tgacagaccgacattctgtcggtgg

SEQ ID NO: 847126 - DNA, 25 bp, Mus musculus
tgacagaccgactttctgtcggtgg

SEQ ID NO: 847127 - DNA, 25 bp, Mus musculus
tgacagaccgcacctctgagcgtgt

SEQ ID NO: 847128 - DNA, 25 bp, Mus musculus
tgacagaccgcagctctgagcgtgt

SEQ ID NO: 847129 - DNA, 25 bp, Mus musculus
tgacagaccgtcatgattgatggtt

SEQ ID NO: 847130 - DNA, 25 bp, Mus musculus
tgacagaccgtcttgattgatggtt

SEQ ID NO: 847131 - DNA, 25 bp, Mus musculus
tgacagacctagagaggcccatcta

SEQ ID NO: 847132 - DNA, 25 bp, Mus musculus
tgacagacctagtgaggcccatcta

SEQ ID NO: 847133 - DNA, 25 bp, Mus musculus
tgacagacgatgagttcaggtctct

SEQ ID NO: 847134 - DNA, 25 bp, Mus musculus
tgacagacgatgtgttcaggtctct

SEQ ID NO: 847135 - DNA, 25 bp, Mus musculus
tgacagacgtcgagaacacctgcca

SEQ ID NO: 847136 - DNA, 25 bp, Mus musculus
tgacagacgtcgtgaacacctgcca

SEQ ID NO: 847137 - DNA, 25 bp, Mus musculus
tgacagacgtgcacagcgctgagga

SEQ ID NO: 847138 - DNA, 25 bp, Mus musculus
tgacagacgtgcagttgtaatcctc

SEQ ID NO: 847139 - DNA, 25 bp, Mus musculus
tgacagacgtgctcagcgctgagga

SEQ ID NO: 847140 - DNA, 25 bp, Mus musculus
tgacagacgtgctgttgtaatcctc

SEQ ID NO: 847141 - DNA, 25 bp, Mus musculus
tgacagactagacagcctttccccg

SEQ ID NO: 847142 - DNA, 25 bp, Mus musculus
tgacagactagagagcctttccccg

SEQ ID NO: 847143 - DNA, 25 bp, Mus musculus
tgacagactaggatgtgcccagctc

SEQ ID NO: 847144 - DNA, 25 bp, Mus musculus
tgacagactaggttgtgcccagctc

SEQ ID NO: 847145 - DNA, 25 bp, Mus musculus
tgacagacttccagcaggcggagac

SEQ ID NO: 847146 - DNA, 25 bp, Mus musculus
tgacagacttcctgcaggcggagac

SEQ ID NO: 847147 - DNA, 25 bp, Mus musculus
tgacagagaaccagctggctagcct

SEQ ID NO: 847148 - DNA, 25 bp, Mus musculus
tgacagagaacctgctggctagcct

SEQ ID NO: 847149 - DNA, 25 bp, Mus musculus
tgacagagaactcaggcgactgcac

SEQ ID NO: 847150 - DNA, 25 bp, Mus musculus
tgacagagaactgaggcgactgcac

SEQ ID NO: 847151 - DNA, 25 bp, Mus musculus
tgacagagacacctacagaaggagc

SEQ ID NO: 847152 - DNA, 25 bp, Mus musculus
tgacagagacacgtacagaaggagc

SEQ ID NO: 847153 - DNA, 25 bp, Mus musculus
tgacagagcaggaagacactccctc

SEQ ID NO: 847154 - DNA, 25 bp, Mus musculus
tgacagagcaggtagacactccctc

SEQ ID NO: 847155 - DNA, 25 bp, Mus musculus
tgacagagcagtactgctgccgccg

SEQ ID NO: 847156 - DNA, 25 bp, Mus musculus
tgacagagcagttctgctgccgccg

SEQ ID NO: 847157 - DNA, 25 bp, Mus musculus
tgacagagcatacagacggagcccc

SEQ ID NO: 847158 - DNA, 25 bp, Mus musculus
tgacagagcatagagacggagcccc

SEQ ID NO: 847159 - DNA, 25 bp, Mus musculus
tgacagagccacagaccgccagctt

SEQ ID NO: 847160 - DNA, 25 bp, Mus musculus
tgacagagccactgaccgccagctt

SEQ ID NO: 847161 - DNA, 25 bp, Mus musculus
tgacagaggatcagcccagggcatt

SEQ ID NO: 847162 - DNA, 25 bp, Mus musculus
tgacagaggatctgcccagggcatt

SEQ ID NO: 847163 - DNA, 25 bp, Mus musculus
tgacagaggtcacagatcggaatat

SEQ ID NO: 847164 - DNA, 25 bp, Mus musculus
tgacagaggtcagagatcggaatat

SEQ ID NO: 847165 - DNA, 25 bp, Mus musculus
tgacagaggtcgcaacccgcaggtt

SEQ ID NO: 847166 - DNA, 25 bp, Mus musculus
tgacagaggtcggaacccgcaggtt

SEQ ID NO: 847167 - DNA, 25 bp, Mus musculus
tgacagagtgctcggcgcagaatcc

SEQ ID NO: 847168 - DNA, 25 bp, Mus musculus
tgacagagtgctgggcgcagaatcc

SEQ ID NO: 847169 - DNA, 25 bp, Mus musculus
tgacagatagttaccagagtacgcc

SEQ ID NO: 847170 - DNA, 25 bp, Mus musculus
tgacagatagtttccagagtacgcc

SEQ ID NO: 847171 - DNA, 25 bp, Mus musculus
tgacagatgcagacatgccccggcc

SEQ ID NO: 847172 - DNA, 25 bp, Mus musculus
tgacagatgcagtcatgccccggcc

SEQ ID NO: 847173 - DNA, 25 bp, Mus musculus
tgacagatgctcacttgggaacaat

SEQ ID NO: 847174 - DNA, 25 bp, Mus musculus
tgacagatgctcagtgtcacacacc

SEQ ID NO: 847175 - DNA, 25 bp, Mus musculus
tgacagatgctctcttgggaacaat

SEQ ID NO: 847176 - DNA, 25 bp, Mus musculus
tgacagatgctctgtgtcacacacc

SEQ ID NO: 847177 - DNA, 25 bp, Mus musculus
tgacagatggctctggtgtgaccat

SEQ ID NO: 847178 - DNA, 25 bp, Mus musculus
tgacagatggctgtggtgtgaccat

SEQ ID NO: 847179 - DNA, 25 bp, Mus musculus
tgacagatgtacacagcagcagagt

SEQ ID NO: 847180 - DNA, 25 bp, Mus musculus
tgacagatgtactcagcagcagagt

SEQ ID NO: 847181 - DNA, 25 bp, Mus musculus
tgacagatgtgtcacctaggtttgg

SEQ ID NO: 847182 - DNA, 25 bp, Mus musculus
tgacagatgtgtgacctaggtttgg

SEQ ID NO: 847183 - DNA, 25 bp, Mus musculus
tgacagatgttcactccagcagagt

SEQ ID NO: 847184 - DNA, 25 bp, Mus musculus
tgacagatgttctctccagcagagt

SEQ ID NO: 847185 - DNA, 25 bp, Mus musculus
tgacagattacaaacccagacaaag

SEQ ID NO: 847186 - DNA, 25 bp, Mus musculus
tgacagattacatacccagacaaag

SEQ ID NO: 847187 - DNA, 25 bp, Mus musculus
tgacagatttcacaacccctccttt

SEQ ID NO: 847188 - DNA, 25 bp, Mus musculus
tgacagatttcagaacccctccttt

SEQ ID NO: 847189 - DNA, 25 bp, Mus musculus
tgacagatttctacccagccaagat

SEQ ID NO: 847190 - DNA, 25 bp, Mus musculus
tgacagatttcttcccagccaagat

SEQ ID NO: 847191 - DNA, 25 bp, Mus musculus
tgacagcaaatgaaagccgttactt

SEQ ID NO: 847192 - DNA, 25 bp, Mus musculus
tgacagcaaatgtaagccgttactt

SEQ ID NO: 847193 - DNA, 25 bp, Mus musculus
tgacagcaaggaatacttctccaaa

SEQ ID NO: 847194 - DNA, 25 bp, Mus musculus
tgacagcaaggattacttctccaaa

SEQ ID NO: 847195 - DNA, 25 bp, Mus musculus
tgacagcactaccaggcgtctctct

SEQ ID NO: 847196 - DNA, 25 bp, Mus musculus
tgacagcactacgaggcgtctctct

SEQ ID NO: 847197 - DNA, 25 bp, Mus musculus
tgacagcagcaaacccatctgaggc

SEQ ID NO: 847198 - DNA, 25 bp, Mus musculus
tgacagcagcaatcccatctgaggc

SEQ ID NO: 847199 - DNA, 25 bp, Mus musculus
tgacagcagcagcacgggtcttcag

SEQ ID NO: 847200 - DNA, 25 bp, Mus musculus
tgacagcagcagcatttcctatggg

SEQ ID NO: 847201 - DNA, 25 bp, Mus musculus
tgacagcagcaggacgggtcttcag

SEQ ID NO: 847202 - DNA, 25 bp, Mus musculus
tgacagcagcaggatttcctatggg

SEQ ID NO: 847203 - DNA, 25 bp, Mus musculus
tgacagcagcctaccacagaaccag

SEQ ID NO: 847204 - DNA, 25 bp, Mus musculus
tgacagcagccttccacagaaccag

SEQ ID NO: 847205 - DNA, 25 bp, Mus musculus
tgacagcagggactagccttgtagc

SEQ ID NO: 847206 - DNA, 25 bp, Mus musculus
tgacagcagggagtagccttgtagc

SEQ ID NO: 847207 - DNA, 25 bp, Mus musculus
tgacagcatcaaccggactcggcat

SEQ ID NO: 847208 - DNA, 25 bp, Mus musculus
tgacagcatcaagcggactcggcat

SEQ ID NO: 847209 - DNA, 25 bp, Mus musculus
tgacagcatgtaactgcctgtgtct

SEQ ID NO: 847210 - DNA, 25 bp, Mus musculus
tgacagcatgtatctgcctgtgtct

SEQ ID NO: 847211 - DNA, 25 bp, Mus musculus
tgacagcattttctggtccctctaa

SEQ ID NO: 847212 - DNA, 25 bp, Mus musculus
tgacagcattttgtggtccctctaa

SEQ ID NO: 847213 - DNA, 25 bp, Mus musculus
tgacagccaaacactgctaacccgg

SEQ ID NO: 847214 - DNA, 25 bp, Mus musculus
tgacagccaaactctgctaacccgg

SEQ ID NO: 847215 - DNA, 25 bp, Mus musculus
tgacagccaagccacatgtcctatc

SEQ ID NO: 847216 - DNA, 25 bp, Mus musculus
tgacagccaagcgacatgtcctatc

SEQ ID NO: 847217 - DNA, 25 bp, Mus musculus
tgacagccacccagagcgagcagaa

SEQ ID NO: 847218 - DNA, 25 bp, Mus musculus
tgacagccaccctgagcgagcagaa

SEQ ID NO: 847219 - DNA, 25 bp, Mus musculus
tgacagccacgcctggtcctggtta

SEQ ID NO: 847220 - DNA, 25 bp, Mus musculus
tgacagccacgcgtggtcctggtta

SEQ ID NO: 847221 - DNA, 25 bp, Mus musculus
tgacagccacggctggacgccactg

SEQ ID NO: 847222 - DNA, 25 bp, Mus musculus
tgacagccacgggtggacgccactg

SEQ ID NO: 847223 - DNA, 25 bp, Mus musculus
tgacagccactcacctgtttgattt

SEQ ID NO: 847224 - DNA, 25 bp, Mus musculus
tgacagccactctcctgtttgattt

SEQ ID NO: 847225 - DNA, 25 bp, Mus musculus
tgacagccagagacccaagtaactt

SEQ ID NO: 847226 - DNA, 25 bp, Mus musculus
tgacagccagagtcccaagtaactt

SEQ ID NO: 847227 - DNA, 25 bp, Mus musculus
tgacagccagccacaggtcctcaga

SEQ ID NO: 847228 - DNA, 25 bp, Mus musculus
tgacagccagcctcaggtcctcaga

SEQ ID NO: 847229 - DNA, 25 bp, Mus musculus
tgacagccagctactaccagacata

SEQ ID NO: 847230 - DNA, 25 bp, Mus musculus
tgacagccagcttctaccagacata

SEQ ID NO: 847231 - DNA, 25 bp, Mus musculus
tgacagccaggcactcatggttggg

SEQ ID NO: 847232 - DNA, 25 bp, Mus musculus
tgacagccaggctctcatggttggg

SEQ ID NO: 847233 - DNA, 25 bp, Mus musculus
tgacagccaggtaagttgcccaaat

SEQ ID NO: 847234 - DNA, 25 bp, Mus musculus
tgacagccaggttagttgcccaaat

SEQ ID NO: 847235 - DNA, 25 bp, Mus musculus
tgacagccatggagttgtaccagct

SEQ ID NO: 847236 - DNA, 25 bp, Mus musculus
tgacagccatggtgttgtaccagct

SEQ ID NO: 847237 - DNA, 25 bp, Mus musculus
tgacagccccgacaagatgccacag

SEQ ID NO: 847238 - DNA, 25 bp, Mus musculus
tgacagccccgagaagatgccacag

SEQ ID NO: 847239 - DNA, 25 bp, Mus musculus
tgacagccctcaagctcttctgagg

SEQ ID NO: 847240 - DNA, 25 bp, Mus musculus
tgacagccctcatgctcttctgagg

SEQ ID NO: 847241 - DNA, 25 bp, Mus musculus
tgacagccgaggactgctttgagct

SEQ ID NO: 847242 - DNA, 25 bp, Mus musculus
tgacagccgaggtctgctttgagct

SEQ ID NO: 847243 - DNA, 25 bp, Mus musculus
tgacagccgagtctgctttgcatcc

SEQ ID NO: 847244 - DNA, 25 bp, Mus musculus
tgacagccgagtgtgctttgcatcc

SEQ ID NO: 847245 - DNA, 25 bp, Mus musculus
tgacagccgttcactgatgacccta

SEQ ID NO: 847246 - DNA, 25 bp, Mus musculus
tgacagccgttctctgatgacccta

SEQ ID NO: 847247 - DNA, 25 bp, Mus musculus
tgacagcctaatacgggtattacaa

SEQ ID NO: 847248 - DNA, 25 bp, Mus musculus
tgacagcctaattcgggtattacaa

SEQ ID NO: 847249 - DNA, 25 bp, Mus musculus
tgacagcctataccactgtgccata

SEQ ID NO: 847250 - DNA, 25 bp, Mus musculus
tgacagcctatagcactgtgccata

SEQ ID NO: 847251 - DNA, 25 bp, Mus musculus
tgacagcctcctatcgtactggaaa

SEQ ID NO: 847252 - DNA, 25 bp, Mus musculus
tgacagcctcctttcgtactggaaa

SEQ ID NO: 847253 - DNA, 25 bp, Mus musculus
tgacagcgaatacccttccagagtg

SEQ ID NO: 847254 - DNA, 25 bp, Mus musculus
tgacagcgaatagccttccagagtg

SEQ ID NO: 847255 - DNA, 25 bp, Mus musculus
tgacagcgacctagtcatctgggat

SEQ ID NO: 847256 - DNA, 25 bp, Mus musculus
tgacagcgaccttgtcatctgggat

SEQ ID NO: 847257 - DNA, 25 bp, Mus musculus
tgacagcgcacaactgagttctgat

SEQ ID NO: 847258 - DNA, 25 bp, Mus musculus
tgacagcgcacatctgagttctgat

SEQ ID NO: 847259 - DNA, 25 bp, Mus musculus
tgacagcggctacgcattttcatct

SEQ ID NO: 847260 - DNA, 25 bp, Mus musculus
tgacagcggctaggcattttcatct

SEQ ID NO: 847261 - DNA, 25 bp, Mus musculus
tgacagcggcttagttcaacttgta

SEQ ID NO: 847262 - DNA, 25 bp, Mus musculus
tgacagcggctttgttcaacttgta

SEQ ID NO: 847263 - DNA, 25 bp, Mus musculus
tgacagcgtctgaggctaccccttt

SEQ ID NO: 847264 - DNA, 25 bp, Mus musculus
tgacagcgtctgtggctaccccttt

SEQ ID NO: 847265 - DNA, 25 bp, Mus musculus
tgacagctacatcaccctgctcttt

SEQ ID NO: 847266 - DNA, 25 bp, Mus musculus
tgacagctacatgaccctgctcttt

SEQ ID NO: 847267 - DNA, 25 bp, Mus musculus
tgacagctacctacccttatcatta

SEQ ID NO: 847268 - DNA, 25 bp, Mus musculus
tgacagctaccttcccttatcatta

SEQ ID NO: 847269 - DNA, 25 bp, Mus musculus
tgacagctacgtcgagcctctgaaa

SEQ ID NO: 847270 - DNA, 25 bp, Mus musculus
tgacagctacgtggagcctctgaaa

SEQ ID NO: 847271 - DNA, 25 bp, Mus musculus
tgacagctagccctcagagcttcca

SEQ ID NO: 847272 - DNA, 25 bp, Mus musculus
tgacagctagccgtcagagcttcca

SEQ ID NO: 847273 - DNA, 25 bp, Mus musculus
tgacagctcagactttcctcactgt

SEQ ID NO: 847274 - DNA, 25 bp, Mus musculus
tgacagctcagagtttcctcactgt

SEQ ID NO: 847275 - DNA, 25 bp, Mus musculus
tgacagctcattctcccaaggtgac

SEQ ID NO: 847276 - DNA, 25 bp, Mus musculus
tgacagctcattgtcccaaggtgac

SEQ ID NO: 847277 - DNA, 25 bp, Mus musculus
tgacagctccggagttgtgtgtatt

SEQ ID NO: 847278 - DNA, 25 bp, Mus musculus
tgacagctccggtgttgtgtgtatt

SEQ ID NO: 847279 - DNA, 25 bp, Mus musculus
tgacagctcgttctcagtacattct

SEQ ID NO: 847280 - DNA, 25 bp, Mus musculus
tgacagctcgttgtcagtacattct

SEQ ID NO: 847281 - DNA, 25 bp, Mus musculus
tgacagctctgaccctgcttgagaa

SEQ ID NO: 847282 - DNA, 25 bp, Mus musculus
tgacagctctgagcctgcttgagaa

SEQ ID NO: 847283 - DNA, 25 bp, Mus musculus
tgacagctcttgatcaccattgctt

SEQ ID NO: 847284 - DNA, 25 bp, Mus musculus
tgacagctcttgttcaccattgctt

SEQ ID NO: 847285 - DNA, 25 bp, Mus musculus
tgacagctgactcactgctcacgct

SEQ ID NO: 847286 - DNA, 25 bp, Mus musculus
tgacagctgactgactgctcacgct

SEQ ID NO: 847287 - DNA, 25 bp, Mus musculus
tgacagctgaggcacacagacgtgt

SEQ ID NO: 847288 - DNA, 25 bp, Mus musculus
tgacagctgagggacacagacgtgt

SEQ ID NO: 847289 - DNA, 25 bp, Mus musculus
tgacagctgcatacccaaaacctat

SEQ ID NO: 847290 - DNA, 25 bp, Mus musculus
tgacagctgcattcccaaaacctat

SEQ ID NO: 847291 - DNA, 25 bp, Mus musculus
tgacagctgcctaattacttgaaaa

SEQ ID NO: 847292 - DNA, 25 bp, Mus musculus
tgacagctgccttattacttgaaaa

SEQ ID NO: 847293 - DNA, 25 bp, Mus musculus
tgacagctgcggacctcgagggttc

SEQ ID NO: 847294 - DNA, 25 bp, Mus musculus
tgacagctgcggtcctcgagggttc

SEQ ID NO: 847295 - DNA, 25 bp, Mus musculus
tgacagctgcttaggaaccttcatc

SEQ ID NO: 847296 - DNA, 25 bp, Mus musculus
tgacagctgctttggaaccttcatc

SEQ ID NO: 847297 - DNA, 25 bp, Mus musculus
tgacagctggctatctagactgccc

SEQ ID NO: 847298 - DNA, 25 bp, Mus musculus
tgacagctggctttctagactgccc

SEQ ID NO: 847299 - DNA, 25 bp, Mus musculus
tgacagctgggcattcttcctagga

SEQ ID NO: 847300 - DNA, 25 bp, Mus musculus
tgacagctgggctttcttcctagga

SEQ ID NO: 847301 - DNA, 25 bp, Mus musculus
tgacagctgtccacatcaccaagat

SEQ ID NO: 847302 - DNA, 25 bp, Mus musculus
tgacagctgtcctcatcaccaagat

SEQ ID NO: 847303 - DNA, 25 bp, Mus musculus
tgacagctgttcatccaagacccgg

SEQ ID NO: 847304 - DNA, 25 bp, Mus musculus
tgacagctgttcttccaagacccgg

SEQ ID NO: 847305 - DNA, 25 bp, Mus musculus
tgacagcttaaaccccaagcgggaa

SEQ ID NO: 847306 - DNA, 25 bp, Mus musculus
tgacagcttaaagcccaagcgggaa

SEQ ID NO: 847307 - DNA, 25 bp, Mus musculus
tgacagcttacaactcaagccccag

SEQ ID NO: 847308 - DNA, 25 bp, Mus musculus
tgacagcttacatctcaagccccag

SEQ ID NO: 847309 - DNA, 25 bp, Mus musculus
tgacagcttattacacccagatctc

SEQ ID NO: 847310 - DNA, 25 bp, Mus musculus
tgacagcttatttcacccagatctc

SEQ ID NO: 847311 - DNA, 25 bp, Mus musculus
tgacagcttcaaatcacgggacacc

SEQ ID NO: 847312 - DNA, 25 bp, Mus musculus
tgacagcttcaattcacgggacacc

SEQ ID NO: 847313 - DNA, 25 bp, Mus musculus
tgacagctttcccatcagtagaagt

SEQ ID NO: 847314 - DNA, 25 bp, Mus musculus
tgacagctttccgatcagtagaagt

SEQ ID NO: 847315 - DNA, 25 bp, Mus musculus
tgacaggaaattagcaccagctggg

SEQ ID NO: 847316 - DNA, 25 bp, Mus musculus
tgacaggaaatttgcaccagctggg

SEQ ID NO: 847317 - DNA, 25 bp, Mus musculus
tgacaggaacctctctcttcagtgg

SEQ ID NO: 847318 - DNA, 25 bp, Mus musculus
tgacaggaacctgtctcttcagtgg

SEQ ID NO: 847319 - DNA, 25 bp, Mus musculus
tgacaggaatcacgatggcaccata

SEQ ID NO: 847320 - DNA, 25 bp, Mus musculus
tgacaggaatcaggatggcaccata

SEQ ID NO: 847321 - DNA, 25 bp, Mus musculus
tgacaggacccaactgaggccacgt

SEQ ID NO: 847322 - DNA, 25 bp, Mus musculus
tgacaggacccatctgaggccacgt

SEQ ID NO: 847323 - DNA, 25 bp, Mus musculus
tgacaggacctgagatgcccatccg

SEQ ID NO: 847324 - DNA, 25 bp, Mus musculus
tgacaggacctgcacagtcacttca

SEQ ID NO: 847325 - DNA, 25 bp, Mus musculus
tgacaggacctggacagtcacttca

SEQ ID NO: 847326 - DNA, 25 bp, Mus musculus
tgacaggacctgtgatgcccatccg

SEQ ID NO: 847327 - DNA, 25 bp, Mus musculus
tgacaggactctacagagcttgggt

SEQ ID NO: 847328 - DNA, 25 bp, Mus musculus
tgacaggactcttcagagcttgggt

SEQ ID NO: 847329 - DNA, 25 bp, Mus musculus
tgacaggagctgctatctaccacaa

SEQ ID NO: 847330 - DNA, 25 bp, Mus musculus
tgacaggagctggtatctaccacaa

SEQ ID NO: 847331 - DNA, 25 bp, Mus musculus
tgacaggatcaaccgggctttcctt

SEQ ID NO: 847332 - DNA, 25 bp, Mus musculus
tgacaggatcaagcgggctttcctt

SEQ ID NO: 847333 - DNA, 25 bp, Mus musculus
tgacaggatggcatcccttcgactc

SEQ ID NO: 847334 - DNA, 25 bp, Mus musculus
tgacaggatggcttcccttcgactc

SEQ ID NO: 847335 - DNA, 25 bp, Mus musculus
tgacaggcagaaatgttcccagatt

SEQ ID NO: 847336 - DNA, 25 bp, Mus musculus
tgacaggcagaattgttcccagatt

SEQ ID NO: 847337 - DNA, 25 bp, Mus musculus
tgacaggcagagcattccacgcctc

SEQ ID NO: 847338 - DNA, 25 bp, Mus musculus
tgacaggcagaggattccacgcctc

SEQ ID NO: 847339 - DNA, 25 bp, Mus musculus
tgacaggcagctaacataagtgagt

SEQ ID NO: 847340 - DNA, 25 bp, Mus musculus
tgacaggcagctacggctggacgaa

SEQ ID NO: 847341 - DNA, 25 bp, Mus musculus
tgacaggcagcttacataagtgagt

SEQ ID NO: 847342 - DNA, 25 bp, Mus musculus
tgacaggcagcttcggctggacgaa

SEQ ID NO: 847343 - DNA, 25 bp, Mus musculus
tgacaggcatcccagcgtgtgctca

SEQ ID NO: 847344 - DNA, 25 bp, Mus musculus
tgacaggcatccgagcgtgtgctca

SEQ ID NO: 847345 - DNA, 25 bp, Mus musculus
tgacaggccaaaagctgcacctctt

SEQ ID NO: 847346 - DNA, 25 bp, Mus musculus
tgacaggccaaatgctgcacctctt

SEQ ID NO: 847347 - DNA, 25 bp, Mus musculus
tgacaggcccagcatgtagctgctc

SEQ ID NO: 847348 - DNA, 25 bp, Mus musculus
tgacaggcccaggatgtagctgctc

SEQ ID NO: 847349 - DNA, 25 bp, Mus musculus
tgacaggcccttagcagagttgctc

SEQ ID NO: 847350 - DNA, 25 bp, Mus musculus
tgacaggccctttgcagagttgctc

SEQ ID NO: 847351 - DNA, 25 bp, Mus musculus
tgacaggctaacagtggctcacaca

SEQ ID NO: 847352 - DNA, 25 bp, Mus musculus
tgacaggctaactgtggctcacaca

SEQ ID NO: 847353 - DNA, 25 bp, Mus musculus
tgacaggctctacataggcctggcc

SEQ ID NO: 847354 - DNA, 25 bp, Mus musculus
tgacaggctctagataggcctggcc

SEQ ID NO: 847355 - DNA, 25 bp, Mus musculus
tgacaggctttacgcctggaccaca

SEQ ID NO: 847356 - DNA, 25 bp, Mus musculus
tgacaggctttaggcctggaccaca

SEQ ID NO: 847357 - DNA, 25 bp, Mus musculus
tgacaggctttgagcaaacacccac

SEQ ID NO: 847358 - DNA, 25 bp, Mus musculus
tgacaggctttgtgcaaacacccac

SEQ ID NO: 847359 - DNA, 25 bp, Mus musculus
tgacagggactgctcctttctcact

SEQ ID NO: 847360 - DNA, 25 bp, Mus musculus
tgacagggactggtcctttctcact

SEQ ID NO: 847361 - DNA, 25 bp, Mus musculus
tgacagggagtccttgttctcttct

SEQ ID NO: 847362 - DNA, 25 bp, Mus musculus
tgacagggagtcgttgttctcttct

SEQ ID NO: 847363 - DNA, 25 bp, Mus musculus
tgacagggccagacctgcttctctg

SEQ ID NO: 847364 - DNA, 25 bp, Mus musculus
tgacagggccagtcctgcttctctg

SEQ ID NO: 847365 - DNA, 25 bp, Mus musculus
tgacagggccctcgaactgagtctg

SEQ ID NO: 847366 - DNA, 25 bp, Mus musculus
tgacagggccctggaactgagtctg

SEQ ID NO: 847367 - DNA, 25 bp, Mus musculus
tgacaggtacttcacaacttgtaag

SEQ ID NO: 847368 - DNA, 25 bp, Mus musculus
tgacaggtacttgacaacttgtaag

SEQ ID NO: 847369 - DNA, 25 bp, Mus musculus
tgacaggtagtgagccccaggaaca

SEQ ID NO: 847370 - DNA, 25 bp, Mus musculus
tgacaggtagtgtgccccaggaaca

SEQ ID NO: 847371 - DNA, 25 bp, Mus musculus
tgacaggtcagccactgcagtgcat

SEQ ID NO: 847372 - DNA, 25 bp, Mus musculus
tgacaggtcagcgactgcagtgcat

SEQ ID NO: 847373 - DNA, 25 bp, Mus musculus
tgacaggtcctaatcctccctttgg

SEQ ID NO: 847374 - DNA, 25 bp, Mus musculus
tgacaggtcctattcctccctttgg

SEQ ID NO: 847375 - DNA, 25 bp, Mus musculus
tgacaggtcctgcagtgctggatat

SEQ ID NO: 847376 - DNA, 25 bp, Mus musculus
tgacaggtcctggagtgctggatat

SEQ ID NO: 847377 - DNA, 25 bp, Mus musculus
tgacaggtgcctatgaactctacat

SEQ ID NO: 847378 - DNA, 25 bp, Mus musculus
tgacaggtgcctttgaactctacat

SEQ ID NO: 847379 - DNA, 25 bp, Mus musculus
tgacaggtgtgtccgccttcattgg

SEQ ID NO: 847380 - DNA, 25 bp, Mus musculus
tgacaggtgtgtgcgccttcattgg

SEQ ID NO: 847381 - DNA, 25 bp, Mus musculus
tgacaggtgtttcccaggaccatat

SEQ ID NO: 847382 - DNA, 25 bp, Mus musculus
tgacaggtgtttgccaggaccatat

SEQ ID NO: 847383 - DNA, 25 bp, Mus musculus
tgacaggttagcatgctcaccaact

SEQ ID NO: 847384 - DNA, 25 bp, Mus musculus
tgacaggttagcttgctcaccaact

SEQ ID NO: 847385 - DNA, 25 bp, Mus musculus
tgacaggttcaaccatggacctttg

SEQ ID NO: 847386 - DNA, 25 bp, Mus musculus
tgacaggttcaagcatggacctttg

SEQ ID NO: 847387 - DNA, 25 bp, Mus musculus
tgacaggttgtcatggcctccgcat

SEQ ID NO: 847388 - DNA, 25 bp, Mus musculus
tgacaggttgtcttggcctccgcat

SEQ ID NO: 847389 - DNA, 25 bp, Mus musculus
tgacaggtttgcagctgttccgggt

SEQ ID NO: 847390 - DNA, 25 bp, Mus musculus
tgacaggtttgctgctgttccgggt

SEQ ID NO: 847391 - DNA, 25 bp, Mus musculus
tgacagtaaaccagccatcattagt

SEQ ID NO: 847392 - DNA, 25 bp, Mus musculus
tgacagtaaacctgccatcattagt

SEQ ID NO: 847393 - DNA, 25 bp, Mus musculus
tgacagtaacagaattcccaatttt

SEQ ID NO: 847394 - DNA, 25 bp, Mus musculus
tgacagtaacagtattcccaatttt

SEQ ID NO: 847395 - DNA, 25 bp, Mus musculus
tgacagtaaccgacttcacttctgt

SEQ ID NO: 847396 - DNA, 25 bp, Mus musculus
tgacagtaaccgtcttcacttctgt

SEQ ID NO: 847397 - DNA, 25 bp, Mus musculus
tgacagtaactcagggcgtgaccct

SEQ ID NO: 847398 - DNA, 25 bp, Mus musculus
tgacagtaactctgggcgtgaccct

SEQ ID NO: 847399 - DNA, 25 bp, Mus musculus
tgacagtagtacaacaacctgtgcc

SEQ ID NO: 847400 - DNA, 25 bp, Mus musculus
tgacagtagtactacaacctgtgcc

SEQ ID NO: 847401 - DNA, 25 bp, Mus musculus
tgacagtatgctcagtatccccagt

SEQ ID NO: 847402 - DNA, 25 bp, Mus musculus
tgacagtatgctgagtatccccagt

SEQ ID NO: 847403 - DNA, 25 bp, Mus musculus
tgacagtcaaaaagccccagtacag

SEQ ID NO: 847404 - DNA, 25 bp, Mus musculus
tgacagtcaaaatgccccagtacag

SEQ ID NO: 847405 - DNA, 25 bp, Mus musculus
tgacagtcaggtaagccaaatccat

SEQ ID NO: 847406 - DNA, 25 bp, Mus musculus
tgacagtcaggttagccaaatccat

SEQ ID NO: 847407 - DNA, 25 bp, Mus musculus
tgacagtcatccattgtgctggctc

SEQ ID NO: 847408 - DNA, 25 bp, Mus musculus
tgacagtcatcctttgtgctggctc

SEQ ID NO: 847409 - DNA, 25 bp, Mus musculus
tgacagtccagacttagcttcccgt

SEQ ID NO: 847410 - DNA, 25 bp, Mus musculus
tgacagtccagagttagcttcccgt

SEQ ID NO: 847411 - DNA, 25 bp, Mus musculus
tgacagtccccactggtaacaggac

SEQ ID NO: 847412 - DNA, 25 bp, Mus musculus
tgacagtccccagtggtaacaggac

SEQ ID NO: 847413 - DNA, 25 bp, Mus musculus
tgacagtccctgctagcttcaacag

SEQ ID NO: 847414 - DNA, 25 bp, Mus musculus
tgacagtccctggtagcttcaacag

SEQ ID NO: 847415 - DNA, 25 bp, Mus musculus
tgacagtccgtccagctctatggca

SEQ ID NO: 847416 - DNA, 25 bp, Mus musculus
tgacagtccgtcgagctctatggca

SEQ ID NO: 847417 - DNA, 25 bp, Mus musculus
tgacagtctcccattgacagcagaa

SEQ ID NO: 847418 - DNA, 25 bp, Mus musculus
tgacagtctccctttgacagcagaa

SEQ ID NO: 847419 - DNA, 25 bp, Mus musculus
tgacagtctccgcagctgctgtgac

SEQ ID NO: 847420 - DNA, 25 bp, Mus musculus
tgacagtctccggagctgctgtgac

SEQ ID NO: 847421 - DNA, 25 bp, Mus musculus
tgacagtcttcgctcttcactaaag

SEQ ID NO: 847422 - DNA, 25 bp, Mus musculus
tgacagtcttcggtcttcactaaag

SEQ ID NO: 847423 - DNA, 25 bp, Mus musculus
tgacagtcttggatcagggtgatcg

SEQ ID NO: 847424 - DNA, 25 bp, Mus musculus
tgacagtcttggttcagggtgatcg

SEQ ID NO: 847425 - DNA, 25 bp, Mus musculus
tgacagtgaaacctgttaaacgggt

SEQ ID NO: 847426 - DNA, 25 bp, Mus musculus
tgacagtgaaacgtgttaaacgggt

SEQ ID NO: 847427 - DNA, 25 bp, Mus musculus
tgacagtgacaacggccttcagcaa

SEQ ID NO: 847428 - DNA, 25 bp, Mus musculus
tgacagtgacaagggccttcagcaa

SEQ ID NO: 847429 - DNA, 25 bp, Mus musculus
tgacagtgacacctaccacagtggg

SEQ ID NO: 847430 - DNA, 25 bp, Mus musculus
tgacagtgacacgtaccacagtggg

SEQ ID NO: 847431 - DNA, 25 bp, Mus musculus
tgacagtgaggtcccataccatttc

SEQ ID NO: 847432 - DNA, 25 bp, Mus musculus
tgacagtgaggtgccataccatttc

SEQ ID NO: 847433 - DNA, 25 bp, Mus musculus
tgacagtgattgctacacctcccga

SEQ ID NO: 847434 - DNA, 25 bp, Mus musculus
tgacagtgattggtacacctcccga

SEQ ID NO: 847435 - DNA, 25 bp, Mus musculus
tgacagtgcaggatccagtgggact

SEQ ID NO: 847436 - DNA, 25 bp, Mus musculus
tgacagtgcaggttccagtgggact

SEQ ID NO: 847437 - DNA, 25 bp, Mus musculus
tgacagtgcatcatcctacagacag

SEQ ID NO: 847438 - DNA, 25 bp, Mus musculus
tgacagtgcatcttcctacagacag

SEQ ID NO: 847439 - DNA, 25 bp, Mus musculus
tgacagtgccccagttcacagtaaa

SEQ ID NO: 847440 - DNA, 25 bp, Mus musculus
tgacagtgcccctgttcacagtaaa

SEQ ID NO: 847441 - DNA, 25 bp, Mus musculus
tgacagtgctgtcgctaccctgtgt

SEQ ID NO: 847442 - DNA, 25 bp, Mus musculus
tgacagtgctgtggctaccctgtgt

SEQ ID NO: 847443 - DNA, 25 bp, Mus musculus
tgacagtggagtccaacggctctga

SEQ ID NO: 847444 - DNA, 25 bp, Mus musculus
tgacagtggagtgcaacggctctga

SEQ ID NO: 847445 - DNA, 25 bp, Mus musculus
tgacagtggatgctttctcagagct

SEQ ID NO: 847446 - DNA, 25 bp, Mus musculus
tgacagtggatggtttctcagagct

SEQ ID NO: 847447 - DNA, 25 bp, Mus musculus
tgacagtggcccaccgaactatact

SEQ ID NO: 847448 - DNA, 25 bp, Mus musculus
tgacagtggccctccgaactatact

SEQ ID NO: 847449 - DNA, 25 bp, Mus musculus
tgacagtgtcctcggttactccgag

SEQ ID NO: 847450 - DNA, 25 bp, Mus musculus
tgacagtgtcctgggttactccgag

SEQ ID NO: 847451 - DNA, 25 bp, Mus musculus
tgacagtgtgtccttcacgggctca

SEQ ID NO: 847452 - DNA, 25 bp, Mus musculus
tgacagtgtgtcgttcacgggctca

SEQ ID NO: 847453 - DNA, 25 bp, Mus musculus
tgacagtgtgtgacttcttcaagta

SEQ ID NO: 847454 - DNA, 25 bp, Mus musculus
tgacagtgtgtgtcttcttcaagta

SEQ ID NO: 847455 - DNA, 25 bp, Mus musculus
tgacagttacctatctttgtacatt

SEQ ID NO: 847456 - DNA, 25 bp, Mus musculus
tgacagttacctttctttgtacatt

SEQ ID NO: 847457 - DNA, 25 bp, Mus musculus
tgacagttccacactagttcttctt

SEQ ID NO: 847458 - DNA, 25 bp, Mus musculus
tgacagttccacattactcccatat

SEQ ID NO: 847459 - DNA, 25 bp, Mus musculus
tgacagttccactctagttcttctt

SEQ ID NO: 847460 - DNA, 25 bp, Mus musculus
tgacagttccactttactcccatat

SEQ ID NO: 847461 - DNA, 25 bp, Mus musculus
tgacagttcccaaggacgacggctt

SEQ ID NO: 847462 - DNA, 25 bp, Mus musculus
tgacagttcccatggacgacggctt

SEQ ID NO: 847463 - DNA, 25 bp, Mus musculus
tgacagttcgctactgccagaactc

SEQ ID NO: 847464 - DNA, 25 bp, Mus musculus
tgacagttcgcttctgccagaactc

SEQ ID NO: 847465 - DNA, 25 bp, Mus musculus
tgacagttcgtcatcttaaggccct

SEQ ID NO: 847466 - DNA, 25 bp, Mus musculus
tgacagttcgtcttcttaaggccct

SEQ ID NO: 847467 - DNA, 25 bp, Mus musculus
tgacagttgcttagaggctcttgaa

SEQ ID NO: 847468 - DNA, 25 bp, Mus musculus
tgacagttgctttgaggctcttgaa

SEQ ID NO: 847469 - DNA, 25 bp, Mus musculus
tgacagttggtcaccctgttctgct

SEQ ID NO: 847470 - DNA, 25 bp, Mus musculus
tgacagttggtctccctgttctgct

SEQ ID NO: 847471 - DNA, 25 bp, Mus musculus
tgacagttttgtcctaccccagtag

SEQ ID NO: 847472 - DNA, 25 bp, Mus musculus
tgacagttttgtgctaccccagtag

SEQ ID NO: 847473 - DNA, 25 bp, Mus musculus
tgacataatcatccagcctcatgcc

SEQ ID NO: 847474 - DNA, 25 bp, Mus musculus
tgacataatcatgcagcctcatgcc

SEQ ID NO: 847475 - DNA, 25 bp, Mus musculus
tgacataatctaagctccaccacat

SEQ ID NO: 847476 - DNA, 25 bp, Mus musculus
tgacataatctatgctccaccacat

SEQ ID NO: 847477 - DNA, 25 bp, Mus musculus
tgacataattaacgagctggaagca

SEQ ID NO: 847478 - DNA, 25 bp, Mus musculus
tgacataattaaggagctggaagca

SEQ ID NO: 847479 - DNA, 25 bp, Mus musculus
tgacatacacacatagacgcataga

SEQ ID NO: 847480 - DNA, 25 bp, Mus musculus
tgacatacacacttagacgcataga

SEQ ID NO: 847481 - DNA, 25 bp, Mus musculus
tgacatacagtgctttgtgctgcta

SEQ ID NO: 847482 - DNA, 25 bp, Mus musculus
tgacatacagtggtttgtgctgcta

SEQ ID NO: 847483 - DNA, 25 bp, Mus musculus
tgacatacatgtcaccagagatttg

SEQ ID NO: 847484 - DNA, 25 bp, Mus musculus
tgacatacatgtgaccagagatttg

SEQ ID NO: 847485 - DNA, 25 bp, Mus musculus
tgacataccatcatccatttccggt

SEQ ID NO: 847486 - DNA, 25 bp, Mus musculus
tgacataccatcttccatttccggt

SEQ ID NO: 847487 - DNA, 25 bp, Mus musculus
tgacatacctggaccacggagatgt

SEQ ID NO: 847488 - DNA, 25 bp, Mus musculus
tgacatacctggtccacggagatgt

SEQ ID NO: 847489 - DNA, 25 bp, Mus musculus
tgacatacgattagagtttactcca

SEQ ID NO: 847490 - DNA, 25 bp, Mus musculus
tgacatacgatttgagtttactcca

SEQ ID NO: 847491 - DNA, 25 bp, Mus musculus
tgacatagagctccttctgtgtaaa

SEQ ID NO: 847492 - DNA, 25 bp, Mus musculus
tgacatagagctgcttctgtgtaaa

SEQ ID NO: 847493 - DNA, 25 bp, Mus musculus
tgacatagggccagactctggctgc

SEQ ID NO: 847494 - DNA, 25 bp, Mus musculus
tgacatagggcctgactctggctgc

SEQ ID NO: 847495 - DNA, 25 bp, Mus musculus
tgacatagggtcatgaactccctct

SEQ ID NO: 847496 - DNA, 25 bp, Mus musculus
tgacatagggtcttgaactccctct

SEQ ID NO: 847497 - DNA, 25 bp, Mus musculus
tgacatagtcttagtatggcaactt

SEQ ID NO: 847498 - DNA, 25 bp, Mus musculus
tgacatagtctttgtatggcaactt

SEQ ID NO: 847499 - DNA, 25 bp, Mus musculus
tgacatagttcacatagccatgggt

SEQ ID NO: 847500 - DNA, 25 bp, Mus musculus
tgacatagttcagatagccatgggt

SEQ ID NO: 847501 - DNA, 25 bp, Mus musculus
tgacatatataacgcctttccaccc

SEQ ID NO: 847502 - DNA, 25 bp, Mus musculus
tgacatatataaggcctttccaccc

SEQ ID NO: 847503 - DNA, 25 bp, Mus musculus
tgacatatctgtaatcacaaagctt

SEQ ID NO: 847504 - DNA, 25 bp, Mus musculus
tgacatatctgttatcacaaagctt

SEQ ID NO: 847505 - DNA, 25 bp, Mus musculus
tgacatatggtcagccgttcacagt

SEQ ID NO: 847506 - DNA, 25 bp, Mus musculus
tgacatatggtctgccgttcacagt

SEQ ID NO: 847507 - DNA, 25 bp, Mus musculus
tgacatattgaccttcattccttcc

SEQ ID NO: 847508 - DNA, 25 bp, Mus musculus
tgacatattgacgttcattccttcc

SEQ ID NO: 847509 - DNA, 25 bp, Mus musculus
tgacatatttctaccaacaaggctg

SEQ ID NO: 847510 - DNA, 25 bp, Mus musculus
tgacatatttcttccaacaaggctg

SEQ ID NO: 847511 - DNA, 25 bp, Mus musculus
tgacatattttgaagcagaattttt

SEQ ID NO: 847512 - DNA, 25 bp, Mus musculus
tgacatattttgtagcagaattttt

SEQ ID NO: 847513 - DNA, 25 bp, Mus musculus
tgacatcaagtcagggtttccatcc

SEQ ID NO: 847514 - DNA, 25 bp, Mus musculus
tgacatcaagtctgggtttccatcc

SEQ ID NO: 847515 - DNA, 25 bp, Mus musculus
tgacatcaatctagccaggacacct

SEQ ID NO: 847516 - DNA, 25 bp, Mus musculus
tgacatcaatcttgccaggacacct

SEQ ID NO: 847517 - DNA, 25 bp, Mus musculus
tgacatcacaaaagaagaatccttc

SEQ ID NO: 847518 - DNA, 25 bp, Mus musculus
tgacatcacaaatgaagaatccttc

SEQ ID NO: 847519 - DNA, 25 bp, Mus musculus
tgacatcacataacgctgacaggaa

SEQ ID NO: 847520 - DNA, 25 bp, Mus musculus
tgacatcacatatcgctgacaggaa

SEQ ID NO: 847521 - DNA, 25 bp, Mus musculus
tgacatcaccagaagaagtacatat

SEQ ID NO: 847522 - DNA, 25 bp, Mus musculus
tgacatcaccagtagaagtacatat

SEQ ID NO: 847523 - DNA, 25 bp, Mus musculus
tgacatcaccatcacctggaagagg

SEQ ID NO: 847524 - DNA, 25 bp, Mus musculus
tgacatcaccatgacctggaagagg

SEQ ID NO: 847525 - DNA, 25 bp, Mus musculus
tgacatcactgactgaccagaccat

SEQ ID NO: 847526 - DNA, 25 bp, Mus musculus
tgacatcactgagtgaccagaccat

SEQ ID NO: 847527 - DNA, 25 bp, Mus musculus
tgacatcacttgaacagataccacc

SEQ ID NO: 847528 - DNA, 25 bp, Mus musculus
tgacatcacttgtacagataccacc

SEQ ID NO: 847529 - DNA, 25 bp, Mus musculus
tgacatcagcccaaacatgctctgt

SEQ ID NO: 847530 - DNA, 25 bp, Mus musculus
tgacatcagccctaacatgctctgt

SEQ ID NO: 847531 - DNA, 25 bp, Mus musculus
tgacatcagggacctttcacactgg

SEQ ID NO: 847532 - DNA, 25 bp, Mus musculus
tgacatcagggagctttcacactgg

SEQ ID NO: 847533 - DNA, 25 bp, Mus musculus
tgacatcatacaccttctaaaagtt

SEQ ID NO: 847534 - DNA, 25 bp, Mus musculus
tgacatcatacagcttctaaaagtt

SEQ ID NO: 847535 - DNA, 25 bp, Mus musculus
tgacatcatatcactcaacttccgc

SEQ ID NO: 847536 - DNA, 25 bp, Mus musculus
tgacatcatatctctcaacttccgc

SEQ ID NO: 847537 - DNA, 25 bp, Mus musculus
tgacatcatcggacagaccaagtag

SEQ ID NO: 847538 - DNA, 25 bp, Mus musculus
tgacatcatcggtcagaccaagtag

SEQ ID NO: 847539 - DNA, 25 bp, Mus musculus
tgacatcatgctcctttcctactgc

SEQ ID NO: 847540 - DNA, 25 bp, Mus musculus
tgacatcatgctgctttcctactgc

SEQ ID NO: 847541 - DNA, 25 bp, Mus musculus
tgacatcatgtcactggcaggcctc

SEQ ID NO: 847542 - DNA, 25 bp, Mus musculus
tgacatcatgtctctggcaggcctc

SEQ ID NO: 847543 - DNA, 25 bp, Mus musculus
tgacatcatgttactagacacctgt

SEQ ID NO: 847544 - DNA, 25 bp, Mus musculus
tgacatcatgtttctagacacctgt

SEQ ID NO: 847545 - DNA, 25 bp, Mus musculus
tgacatcattgtaccctatgcacta

SEQ ID NO: 847546 - DNA, 25 bp, Mus musculus
tgacatcattgtactgtccccggtg

SEQ ID NO: 847547 - DNA, 25 bp, Mus musculus
tgacatcattgttccctatgcacta

SEQ ID NO: 847548 - DNA, 25 bp, Mus musculus
tgacatcattgttctgtccccggtg

SEQ ID NO: 847549 - DNA, 25 bp, Mus musculus
tgacatccagatcaggcccacagag

SEQ ID NO: 847550 - DNA, 25 bp, Mus musculus
tgacatccagatgaggcccacagag

SEQ ID NO: 847551 - DNA, 25 bp, Mus musculus
tgacatccagccactgtatgacagt

SEQ ID NO: 847552 - DNA, 25 bp, Mus musculus
tgacatccagcctctgtatgacagt

SEQ ID NO: 847553 - DNA, 25 bp, Mus musculus
tgacatccattaaaccccaacatgg

SEQ ID NO: 847554 - DNA, 25 bp, Mus musculus
tgacatccattataccccaacatgg

SEQ ID NO: 847555 - DNA, 25 bp, Mus musculus
tgacatccattgacagaaagtcccc

SEQ ID NO: 847556 - DNA, 25 bp, Mus musculus
tgacatccattgtcagaaagtcccc

SEQ ID NO: 847557 - DNA, 25 bp, Mus musculus
tgacatccatttaaggccagtactg

SEQ ID NO: 847558 - DNA, 25 bp, Mus musculus
tgacatccattttaggccagtactg

SEQ ID NO: 847559 - DNA, 25 bp, Mus musculus
tgacatcccagaacagaacgcaatt

SEQ ID NO: 847560 - DNA, 25 bp, Mus musculus
tgacatcccagaccactgaatgtgt

SEQ ID NO: 847561 - DNA, 25 bp, Mus musculus
tgacatcccagagcactgaatgtgt

SEQ ID NO: 847562 - DNA, 25 bp, Mus musculus
tgacatcccagatcagaacgcaatt

SEQ ID NO: 847563 - DNA, 25 bp, Mus musculus
tgacatccctaccagtagtgtccaa

SEQ ID NO: 847564 - DNA, 25 bp, Mus musculus
tgacatccctacgagtagtgtccaa

SEQ ID NO: 847565 - DNA, 25 bp, Mus musculus
tgacatccctggagaggctacgctg

SEQ ID NO: 847566 - DNA, 25 bp, Mus musculus
tgacatccctggtgaggctacgctg

SEQ ID NO: 847567 - DNA, 25 bp, Mus musculus
tgacatccgagcacaaagatttttg

SEQ ID NO: 847568 - DNA, 25 bp, Mus musculus
tgacatccgagctcaaagatttttg

SEQ ID NO: 847569 - DNA, 25 bp, Mus musculus
tgacatccgctgagacctggagaga

SEQ ID NO: 847570 - DNA, 25 bp, Mus musculus
tgacatccgctgtgacctggagaga

SEQ ID NO: 847571 - DNA, 25 bp, Mus musculus
tgacatccgggcactgctgatagat

SEQ ID NO: 847572 - DNA, 25 bp, Mus musculus
tgacatccgggctctgctgatagat

SEQ ID NO: 847573 - DNA, 25 bp, Mus musculus
tgacatccgtaaagacctctatgcc

SEQ ID NO: 847574 - DNA, 25 bp, Mus musculus
tgacatccgtaatgacctctatgcc

SEQ ID NO: 847575 - DNA, 25 bp, Mus musculus
tgacatcctaaacttcttccagaag

SEQ ID NO: 847576 - DNA, 25 bp, Mus musculus
tgacatcctaaagttcttccagaag

SEQ ID NO: 847577 - DNA, 25 bp, Mus musculus
tgacatcctgccacctagtttatgc

SEQ ID NO: 847578 - DNA, 25 bp, Mus musculus
tgacatcctgcctcctagtttatgc

SEQ ID NO: 847579 - DNA, 25 bp, Mus musculus
tgacatcctgcgagactacaaggtt

SEQ ID NO: 847580 - DNA, 25 bp, Mus musculus
tgacatcctgcgtgactacaaggtt

SEQ ID NO: 847581 - DNA, 25 bp, Mus musculus
tgacatccttgcctgcatgcactat

SEQ ID NO: 847582 - DNA, 25 bp, Mus musculus
tgacatccttgcgtgcatgcactat

SEQ ID NO: 847583 - DNA, 25 bp, Mus musculus
tgacatccttgtatataagaccaat

SEQ ID NO: 847584 - DNA, 25 bp, Mus musculus
tgacatccttgtcgcctcggcagag

SEQ ID NO: 847585 - DNA, 25 bp, Mus musculus
tgacatccttgtggcctcggcagag

SEQ ID NO: 847586 - DNA, 25 bp, Mus musculus
tgacatccttgtttataagaccaat

SEQ ID NO: 847587 - DNA, 25 bp, Mus musculus
tgacatcctttgctcatagtaaaat

SEQ ID NO: 847588 - DNA, 25 bp, Mus musculus
tgacatcctttggtcatagtaaaat

SEQ ID NO: 847589 - DNA, 25 bp, Mus musculus
tgacatcggtgtctcggccttctgg

SEQ ID NO: 847590 - DNA, 25 bp, Mus musculus
tgacatcggtgtgtcggccttctgg

SEQ ID NO: 847591 - DNA, 25 bp, Mus musculus
tgacatcgtctacctgtggtctgtt

SEQ ID NO: 847592 - DNA, 25 bp, Mus musculus
tgacatcgtctagctgtggtctgtt

SEQ ID NO: 847593 - DNA, 25 bp, Mus musculus
tgacatctacagcttcggcgtggtt

SEQ ID NO: 847594 - DNA, 25 bp, Mus musculus
tgacatctacaggttcggcgtggtt

SEQ ID NO: 847595 - DNA, 25 bp, Mus musculus
tgacatctcagtcgtagcccatgtt

SEQ ID NO: 847596 - DNA, 25 bp, Mus musculus
tgacatctcagtggtagcccatgtt

SEQ ID NO: 847597 - DNA, 25 bp, Mus musculus
tgacatctccctcctcaagtaagga

SEQ ID NO: 847598 - DNA, 25 bp, Mus musculus
tgacatctccctgctcaagtaagga

SEQ ID NO: 847599 - DNA, 25 bp, Mus musculus
tgacatctcctaatctgtggcctac

SEQ ID NO: 847600 - DNA, 25 bp, Mus musculus
tgacatctcctattctgtggcctac

SEQ ID NO: 847601 - DNA, 25 bp, Mus musculus
tgacatctctacacgggaccaagtt

SEQ ID NO: 847602 - DNA, 25 bp, Mus musculus
tgacatctctactcgggaccaagtt

SEQ ID NO: 847603 - DNA, 25 bp, Mus musculus
tgacatctgatgaccctggagattt

SEQ ID NO: 847604 - DNA, 25 bp, Mus musculus
tgacatctgatgtccctggagattt

SEQ ID NO: 847605 - DNA, 25 bp, Mus musculus
tgacatctgccaagttaagtctcag

SEQ ID NO: 847606 - DNA, 25 bp, Mus musculus
tgacatctgccacaaagctttccgg

SEQ ID NO: 847607 - DNA, 25 bp, Mus musculus
tgacatctgccacgcacagactcaa

SEQ ID NO: 847608 - DNA, 25 bp, Mus musculus
tgacatctgccagaaagctttccgg

SEQ ID NO: 847609 - DNA, 25 bp, Mus musculus
tgacatctgccaggcacagactcaa

SEQ ID NO: 847610 - DNA, 25 bp, Mus musculus
tgacatctgccatgttaagtctcag

SEQ ID NO: 847611 - DNA, 25 bp, Mus musculus
tgacatctgcctacagcaatgacct

SEQ ID NO: 847612 - DNA, 25 bp, Mus musculus
tgacatctgccttcagcaatgacct

SEQ ID NO: 847613 - DNA, 25 bp, Mus musculus
tgacatctggtcatataaacctaaa

SEQ ID NO: 847614 - DNA, 25 bp, Mus musculus
tgacatctggtcttataaacctaaa

SEQ ID NO: 847615 - DNA, 25 bp, Mus musculus
tgacatctgtctaccatggtttaga

SEQ ID NO: 847616 - DNA, 25 bp, Mus musculus
tgacatctgtctccatatcagtctt

SEQ ID NO: 847617 - DNA, 25 bp, Mus musculus
tgacatctgtctgcatatcagtctt

SEQ ID NO: 847618 - DNA, 25 bp, Mus musculus
tgacatctgtcttccatggtttaga

SEQ ID NO: 847619 - DNA, 25 bp, Mus musculus
tgacatctgtgaatgctgcagccat

SEQ ID NO: 847620 - DNA, 25 bp, Mus musculus
tgacatctgtgattgctgcagccat

SEQ ID NO: 847621 - DNA, 25 bp, Mus musculus
tgacatcttcctccacatctctgat

SEQ ID NO: 847622 - DNA, 25 bp, Mus musculus
tgacatcttcctgcacatctctgat

SEQ ID NO: 847623 - DNA, 25 bp, Mus musculus
tgacatcttcttacataggccctta

SEQ ID NO: 847624 - DNA, 25 bp, Mus musculus
tgacatcttctttcataggccctta

SEQ ID NO: 847625 - DNA, 25 bp, Mus musculus
tgacatgacagaactcggcttccca

SEQ ID NO: 847626 - DNA, 25 bp, Mus musculus
tgacatgacagatctcggcttccca

SEQ ID NO: 847627 - DNA, 25 bp, Mus musculus
tgacatgactacaaggaggcctgat

SEQ ID NO: 847628 - DNA, 25 bp, Mus musculus
tgacatgactactaggaggcctgat

SEQ ID NO: 847629 - DNA, 25 bp, Mus musculus
tgacatgactgacggcacacacttg

SEQ ID NO: 847630 - DNA, 25 bp, Mus musculus
tgacatgactgagggcacacacttg

SEQ ID NO: 847631 - DNA, 25 bp, Mus musculus
tgacatgataaaaacaccagcttcc

SEQ ID NO: 847632 - DNA, 25 bp, Mus musculus
tgacatgataaatacaccagcttcc

SEQ ID NO: 847633 - DNA, 25 bp, Mus musculus
tgacatgattccattttccccaata

SEQ ID NO: 847634 - DNA, 25 bp, Mus musculus
tgacatgattcctttttccccaata

SEQ ID NO: 847635 - DNA, 25 bp, Mus musculus
tgacatgattgacccagacctgcag

SEQ ID NO: 847636 - DNA, 25 bp, Mus musculus
tgacatgattgagccagacctgcag

SEQ ID NO: 847637 - DNA, 25 bp, Mus musculus
tgacatgcaaaacccctgtgttcaa

SEQ ID NO: 847638 - DNA, 25 bp, Mus musculus
tgacatgcaaaagccctgtgttcaa

SEQ ID NO: 847639 - DNA, 25 bp, Mus musculus
tgacatgcagatcagcaactaggat

SEQ ID NO: 847640 - DNA, 25 bp, Mus musculus
tgacatgcagatgagcaactaggat

SEQ ID NO: 847641 - DNA, 25 bp, Mus musculus
tgacatgcctaactcctgcaaagga

SEQ ID NO: 847642 - DNA, 25 bp, Mus musculus
tgacatgcctaagtcctgcaaagga

SEQ ID NO: 847643 - DNA, 25 bp, Mus musculus
tgacatgctgtcattttgtccccag

SEQ ID NO: 847644 - DNA, 25 bp, Mus musculus
tgacatgctgtctttttgtccccag

SEQ ID NO: 847645 - DNA, 25 bp, Mus musculus
tgacatggaagaatactcccctcct

SEQ ID NO: 847646 - DNA, 25 bp, Mus musculus
tgacatggaagattactcccctcct

SEQ ID NO: 847647 - DNA, 25 bp, Mus musculus
tgacatggacgcatatacagtttat

SEQ ID NO: 847648 - DNA, 25 bp, Mus musculus
tgacatggacgcttatacagtttat

SEQ ID NO: 847649 - DNA, 25 bp, Mus musculus
tgacatggaggaaaggtgactgaca

SEQ ID NO: 847650 - DNA, 25 bp, Mus musculus
tgacatggaggataggtgactgaca

SEQ ID NO: 847651 - DNA, 25 bp, Mus musculus
tgacatggtcccagtacccagatat

SEQ ID NO: 847652 - DNA, 25 bp, Mus musculus
tgacatggtccctgtacccagatat

SEQ ID NO: 847653 - DNA, 25 bp, Mus musculus
tgacatgtacaactcttaagaaagc

SEQ ID NO: 847654 - DNA, 25 bp, Mus musculus
tgacatgtacaagtcttaagaaagc

SEQ ID NO: 847655 - DNA, 25 bp, Mus musculus
tgacatgtatgcagatggcacccag

SEQ ID NO: 847656 - DNA, 25 bp, Mus musculus
tgacatgtatgctgatggcacccag

SEQ ID NO: 847657 - DNA, 25 bp, Mus musculus
tgacatgtcaccacgttgcctgtgt

SEQ ID NO: 847658 - DNA, 25 bp, Mus musculus
tgacatgtcacctcgttgcctgtgt

SEQ ID NO: 847659 - DNA, 25 bp, Mus musculus
tgacatgtccgtccacagaggccat

SEQ ID NO: 847660 - DNA, 25 bp, Mus musculus
tgacatgtccgtgcacagaggccat

SEQ ID NO: 847661 - DNA, 25 bp, Mus musculus
tgacatgtcctcacacattcaggat

SEQ ID NO: 847662 - DNA, 25 bp, Mus musculus
tgacatgtcctctcacattcaggat

SEQ ID NO: 847663 - DNA, 25 bp, Mus musculus
tgacatgtcggcctaacacgttcag

SEQ ID NO: 847664 - DNA, 25 bp, Mus musculus
tgacatgtcggcgtaacacgttcag

SEQ ID NO: 847665 - DNA, 25 bp, Mus musculus
tgacatgtggagattccttctggat

SEQ ID NO: 847666 - DNA, 25 bp, Mus musculus
tgacatgtggagtttccttctggat

SEQ ID NO: 847667 - DNA, 25 bp, Mus musculus
tgacatgtggccctggttcctactt

SEQ ID NO: 847668 - DNA, 25 bp, Mus musculus
tgacatgtggccgtggttcctactt

SEQ ID NO: 847669 - DNA, 25 bp, Mus musculus
tgacatgtgtgaaccagtctttaca

SEQ ID NO: 847670 - DNA, 25 bp, Mus musculus
tgacatgtgtgatccagtctttaca

SEQ ID NO: 847671 - DNA, 25 bp, Mus musculus
tgacatgttcttctgtctgtgcctc

SEQ ID NO: 847672 - DNA, 25 bp, Mus musculus
tgacatgttcttgtgtctgtgcctc

SEQ ID NO: 847673 - DNA, 25 bp, Mus musculus
tgacatgtttcaatggcaagccaca

SEQ ID NO: 847674 - DNA, 25 bp, Mus musculus
tgacatgtttcattggcaagccaca

SEQ ID NO: 847675 - DNA, 25 bp, Mus musculus
tgacatgtttcgattggtactttga

SEQ ID NO: 847676 - DNA, 25 bp, Mus musculus
tgacatgtttcgtttggtactttga

SEQ ID NO: 847677 - DNA, 25 bp, Mus musculus
tgacattaaactactctggcctcag

SEQ ID NO: 847678 - DNA, 25 bp, Mus musculus
tgacattaaacttctctggcctcag

SEQ ID NO: 847679 - DNA, 25 bp, Mus musculus
tgacattaagcaagggctccctgaa

SEQ ID NO: 847680 - DNA, 25 bp, Mus musculus
tgacattaagcatgggctccctgaa

SEQ ID NO: 847681 - DNA, 25 bp, Mus musculus
tgacattaccttcgaaagttccatc

SEQ ID NO: 847682 - DNA, 25 bp, Mus musculus
tgacattaccttggaaagttccatc

SEQ ID NO: 847683 - DNA, 25 bp, Mus musculus
tgacattatgtcacgtggcagcctt

SEQ ID NO: 847684 - DNA, 25 bp, Mus musculus
tgacattatgtctcgtggcagcctt

SEQ ID NO: 847685 - DNA, 25 bp, Mus musculus
tgacattattccagatttggccagt

SEQ ID NO: 847686 - DNA, 25 bp, Mus musculus
tgacattattcctgatttggccagt

SEQ ID NO: 847687 - DNA, 25 bp, Mus musculus
tgacattattgacactttgccctgc

SEQ ID NO: 847688 - DNA, 25 bp, Mus musculus
tgacattattgagactttgccctgc

SEQ ID NO: 847689 - DNA, 25 bp, Mus musculus
tgacattcaccaccgggatgagaca

SEQ ID NO: 847690 - DNA, 25 bp, Mus musculus
tgacattcaccagcgggatgagaca

SEQ ID NO: 847691 - DNA, 25 bp, Mus musculus
tgacattcagctcgcaaacccagaa

SEQ ID NO: 847692 - DNA, 25 bp, Mus musculus
tgacattcagctggcaaacccagaa

SEQ ID NO: 847693 - DNA, 25 bp, Mus musculus
tgacattccacacgctgaactgtta

SEQ ID NO: 847694 - DNA, 25 bp, Mus musculus
tgacattccacaggctgaactgtta

SEQ ID NO: 847695 - DNA, 25 bp, Mus musculus
tgacattccaggctgatgagatggc

SEQ ID NO: 847696 - DNA, 25 bp, Mus musculus
tgacattccagggtgatgagatggc

SEQ ID NO: 847697 - DNA, 25 bp, Mus musculus
tgacattccatgaagccgtagacat

SEQ ID NO: 847698 - DNA, 25 bp, Mus musculus
tgacattccatgtagccgtagacat

SEQ ID NO: 847699 - DNA, 25 bp, Mus musculus
tgacattcccctagaagtttctact

SEQ ID NO: 847700 - DNA, 25 bp, Mus musculus
tgacattccccttgaagtttctact

SEQ ID NO: 847701 - DNA, 25 bp, Mus musculus
tgacattccgtcagtctttattggt

SEQ ID NO: 847702 - DNA, 25 bp, Mus musculus
tgacattccgtctgtctttattggt

SEQ ID NO: 847703 - DNA, 25 bp, Mus musculus
tgacattcctcacattttttggcat

SEQ ID NO: 847704 - DNA, 25 bp, Mus musculus
tgacattcctcagattttttggcat

SEQ ID NO: 847705 - DNA, 25 bp, Mus musculus
tgacattcgcgcaggccggcatcaa

SEQ ID NO: 847706 - DNA, 25 bp, Mus musculus
tgacattcgcgctggccggcatcaa

SEQ ID NO: 847707 - DNA, 25 bp, Mus musculus
tgacattctgtgcttctcttttcct

SEQ ID NO: 847708 - DNA, 25 bp, Mus musculus
tgacattctgtggttctcttttcct

SEQ ID NO: 847709 - DNA, 25 bp, Mus musculus
tgacattcttaaaagatttcctcca

SEQ ID NO: 847710 - DNA, 25 bp, Mus musculus
tgacattcttaatagatttcctcca

SEQ ID NO: 847711 - DNA, 25 bp, Mus musculus
tgacattcttctctctcagggcaga

SEQ ID NO: 847712 - DNA, 25 bp, Mus musculus
tgacattcttctgtctcagggcaga

SEQ ID NO: 847713 - DNA, 25 bp, Mus musculus
tgacattgagcactcgtacatcaac

SEQ ID NO: 847714 - DNA, 25 bp, Mus musculus
tgacattgagcagtcgtacatcaac

SEQ ID NO: 847715 - DNA, 25 bp, Mus musculus
tgacattgagctacggtggccggct

SEQ ID NO: 847716 - DNA, 25 bp, Mus musculus
tgacattgagcttcggtggccggct

SEQ ID NO: 847717 - DNA, 25 bp, Mus musculus
tgacattgatgcagcctggcaggcc

SEQ ID NO: 847718 - DNA, 25 bp, Mus musculus
tgacattgatgctgcctggcaggcc

SEQ ID NO: 847719 - DNA, 25 bp, Mus musculus
tgacattgatttcatggcccctcag

SEQ ID NO: 847720 - DNA, 25 bp, Mus musculus
tgacattgatttgatggcccctcag

SEQ ID NO: 847721 - DNA, 25 bp, Mus musculus
tgacattgcctcacagctcaaaagt

SEQ ID NO: 847722 - DNA, 25 bp, Mus musculus
tgacattgcctctcagctcaaaagt

SEQ ID NO: 847723 - DNA, 25 bp, Mus musculus
tgacattgcttgctgttttcaacaa

SEQ ID NO: 847724 - DNA, 25 bp, Mus musculus
tgacattgcttggtgttttcaacaa

SEQ ID NO: 847725 - DNA, 25 bp, Mus musculus
tgacattggaagctccacagaggtt

SEQ ID NO: 847726 - DNA, 25 bp, Mus musculus
tgacattggaaggtccacagaggtt

SEQ ID NO: 847727 - DNA, 25 bp, Mus musculus
tgacattggagcagagacctgaata

SEQ ID NO: 847728 - DNA, 25 bp, Mus musculus
tgacattggagctgagacctgaata

SEQ ID NO: 847729 - DNA, 25 bp, Mus musculus
tgacattggctccagcaaactagct

SEQ ID NO: 847730 - DNA, 25 bp, Mus musculus
tgacattggctcgagcaaactagct

SEQ ID NO: 847731 - DNA, 25 bp, Mus musculus
tgacattggtggctggcctctttta

SEQ ID NO: 847732 - DNA, 25 bp, Mus musculus
tgacattggtgggtggcctctttta

SEQ ID NO: 847733 - DNA, 25 bp, Mus musculus
tgacattgtctcctgtagctggtga

SEQ ID NO: 847734 - DNA, 25 bp, Mus musculus
tgacattgtctcgtgtagctggtga

SEQ ID NO: 847735 - DNA, 25 bp, Mus musculus
tgacattgttcacccatacaaagca

SEQ ID NO: 847736 - DNA, 25 bp, Mus musculus
tgacattgttcagccatacaaagca

SEQ ID NO: 847737 - DNA, 25 bp, Mus musculus
tgacatttccatcccagcctgatct

SEQ ID NO: 847738 - DNA, 25 bp, Mus musculus
tgacatttccatgccagcctgatct

SEQ ID NO: 847739 - DNA, 25 bp, Mus musculus
tgacatttccttcactactgcagca

SEQ ID NO: 847740 - DNA, 25 bp, Mus musculus
tgacatttccttcgctggtattgtt

SEQ ID NO: 847741 - DNA, 25 bp, Mus musculus
tgacatttccttctctgccgttgca

SEQ ID NO: 847742 - DNA, 25 bp, Mus musculus
tgacatttccttgactactgcagca

SEQ ID NO: 847743 - DNA, 25 bp, Mus musculus
tgacatttccttggctggtattgtt

SEQ ID NO: 847744 - DNA, 25 bp, Mus musculus
tgacatttccttgtctgccgttgca

SEQ ID NO: 847745 - DNA, 25 bp, Mus musculus
tgacatttgaggactacccttctgg

SEQ ID NO: 847746 - DNA, 25 bp, Mus musculus
tgacatttgaggtctacccttctgg

SEQ ID NO: 847747 - DNA, 25 bp, Mus musculus
tgacatttgcacatggagaacactt

SEQ ID NO: 847748 - DNA, 25 bp, Mus musculus
tgacatttgcacttggagaacactt

SEQ ID NO: 847749 - DNA, 25 bp, Mus musculus
tgacatttggcactgttcctggaac

SEQ ID NO: 847750 - DNA, 25 bp, Mus musculus
tgacatttggcagtgttcctggaac

SEQ ID NO: 847751 - DNA, 25 bp, Mus musculus
tgacatttgtgtcctcctaaccact

SEQ ID NO: 847752 - DNA, 25 bp, Mus musculus
tgacatttgtgtgctcctaaccact

SEQ ID NO: 847753 - DNA, 25 bp, Mus musculus
tgacattttctgagcataggcagga

SEQ ID NO: 847754 - DNA, 25 bp, Mus musculus
tgacattttctgtgcataggcagga

SEQ ID NO: 847755 - DNA, 25 bp, Mus musculus
tgaccaaacactcttaaccgttcca

SEQ ID NO: 847756 - DNA, 25 bp, Mus musculus
tgaccaaacactgttaaccgttcca

SEQ ID NO: 847757 - DNA, 25 bp, Mus musculus
tgaccaaacatcacgctgcaatcaa

SEQ ID NO: 847758 - DNA, 25 bp, Mus musculus
tgaccaaacatctcgctgcaatcaa

SEQ ID NO: 847759 - DNA, 25 bp, Mus musculus
tgaccaaagccactgaaagacgacg

SEQ ID NO: 847760 - DNA, 25 bp, Mus musculus
tgaccaaagccagtgaaagacgacg

SEQ ID NO: 847761 - DNA, 25 bp, Mus musculus
tgaccaaagctgcatcactgggact

SEQ ID NO: 847762 - DNA, 25 bp, Mus musculus
tgaccaaagctggatcactgggact

SEQ ID NO: 847763 - DNA, 25 bp, Mus musculus
tgaccaaaggaacctttactacatc

SEQ ID NO: 847764 - DNA, 25 bp, Mus musculus
tgaccaaaggaagctttactacatc

SEQ ID NO: 847765 - DNA, 25 bp, Mus musculus
tgaccaaagtggatcctgtcactgc

SEQ ID NO: 847766 - DNA, 25 bp, Mus musculus
tgaccaaagtggttcctgtcactgc

SEQ ID NO: 847767 - DNA, 25 bp, Mus musculus
tgaccaaatggcagtatttctctct

SEQ ID NO: 847768 - DNA, 25 bp, Mus musculus
tgaccaaatggctgtatttctctct

SEQ ID NO: 847769 - DNA, 25 bp, Mus musculus
tgaccaaattatctgtgcatttaag

SEQ ID NO: 847770 - DNA, 25 bp, Mus musculus
tgaccaaattatgtgtgcatttaag

SEQ ID NO: 847771 - DNA, 25 bp, Mus musculus
tgaccaacacttaccagggacctgt

SEQ ID NO: 847772 - DNA, 25 bp, Mus musculus
tgaccaacactttccagggacctgt

SEQ ID NO: 847773 - DNA, 25 bp, Mus musculus
tgaccaacagccatgtctgaccttc

SEQ ID NO: 847774 - DNA, 25 bp, Mus musculus
tgaccaacagccttgtctgaccttc

SEQ ID NO: 847775 - DNA, 25 bp, Mus musculus
tgaccaacattcaggtgtccagcca

SEQ ID NO: 847776 - DNA, 25 bp, Mus musculus
tgaccaacattctggtgtccagcca

SEQ ID NO: 847777 - DNA, 25 bp, Mus musculus
tgaccaacatttacaccttcagcaa

SEQ ID NO: 847778 - DNA, 25 bp, Mus musculus
tgaccaacattttcaccttcagcaa

SEQ ID NO: 847779 - DNA, 25 bp, Mus musculus
tgaccaaccatactgtctactgttc

SEQ ID NO: 847780 - DNA, 25 bp, Mus musculus
tgaccaaccatagtgtctactgttc

SEQ ID NO: 847781 - DNA, 25 bp, Mus musculus
tgaccaacctgaatgcctaccgaga

SEQ ID NO: 847782 - DNA, 25 bp, Mus musculus
tgaccaacctgattgcctaccgaga

SEQ ID NO: 847783 - DNA, 25 bp, Mus musculus
tgaccaacgcaaccactgttcctgg

SEQ ID NO: 847784 - DNA, 25 bp, Mus musculus
tgaccaacgcaagcactgttcctgg

SEQ ID NO: 847785 - DNA, 25 bp, Mus musculus
tgaccaagaagccagcaatctcgtg

SEQ ID NO: 847786 - DNA, 25 bp, Mus musculus
tgaccaagaagcgagcaatctcgtg

SEQ ID NO: 847787 - DNA, 25 bp, Mus musculus
tgaccaagacagatttttatttgtt

SEQ ID NO: 847788 - DNA, 25 bp, Mus musculus
tgaccaagacagttttttatttgtt

SEQ ID NO: 847789 - DNA, 25 bp, Mus musculus
tgaccaagacatcgcgctctagtgc

SEQ ID NO: 847790 - DNA, 25 bp, Mus musculus
tgaccaagacatggcgctctagtgc

SEQ ID NO: 847791 - DNA, 25 bp, Mus musculus
tgaccaagaccgactgccaataata

SEQ ID NO: 847792 - DNA, 25 bp, Mus musculus
tgaccaagaccgtctgccaataata

SEQ ID NO: 847793 - DNA, 25 bp, Mus musculus
tgaccaagactgagggagtgtttct

SEQ ID NO: 847794 - DNA, 25 bp, Mus musculus
tgaccaagactgtgggagtgtttct

SEQ ID NO: 847795 - DNA, 25 bp, Mus musculus
tgaccaagaggtcctagcagagctg

SEQ ID NO: 847796 - DNA, 25 bp, Mus musculus
tgaccaagaggtgctagcagagctg

SEQ ID NO: 847797 - DNA, 25 bp, Mus musculus
tgaccaagcaccagacctacgctgt

SEQ ID NO: 847798 - DNA, 25 bp, Mus musculus
tgaccaagcacctgacctacgctgt

SEQ ID NO: 847799 - DNA, 25 bp, Mus musculus
tgaccaagccttccagatagtagag

SEQ ID NO: 847800 - DNA, 25 bp, Mus musculus
tgaccaagccttgcagatagtagag

SEQ ID NO: 847801 - DNA, 25 bp, Mus musculus
tgaccaagcgagagtgtgaagccct

SEQ ID NO: 847802 - DNA, 25 bp, Mus musculus
tgaccaagcgagtgtgtgaagccct

SEQ ID NO: 847803 - DNA, 25 bp, Mus musculus
tgaccaagctttctcttgaggaaga

SEQ ID NO: 847804 - DNA, 25 bp, Mus musculus
tgaccaagctttgtcttgaggaaga

SEQ ID NO: 847805 - DNA, 25 bp, Mus musculus
tgaccaaggaatataccgcagcccc

SEQ ID NO: 847806 - DNA, 25 bp, Mus musculus
tgaccaaggaatttaccgcagcccc

SEQ ID NO: 847807 - DNA, 25 bp, Mus musculus
tgaccaaggcttccagggacacttt

SEQ ID NO: 847808 - DNA, 25 bp, Mus musculus
tgaccaaggcttcctcagggcttca

SEQ ID NO: 847809 - DNA, 25 bp, Mus musculus
tgaccaaggcttgcagggacacttt

SEQ ID NO: 847810 - DNA, 25 bp, Mus musculus
tgaccaaggcttgctcagggcttca

SEQ ID NO: 847811 - DNA, 25 bp, Mus musculus
tgaccaagtgcccatggtggagatt

SEQ ID NO: 847812 - DNA, 25 bp, Mus musculus
tgaccaagtgccgatggtggagatt

SEQ ID NO: 847813 - DNA, 25 bp, Mus musculus
tgaccaagtgctctgtctcctggaa

SEQ ID NO: 847814 - DNA, 25 bp, Mus musculus
tgaccaagtgctgtgtctcctggaa

SEQ ID NO: 847815 - DNA, 25 bp, Mus musculus
tgaccaagtggaatgctgttgcaga

SEQ ID NO: 847816 - DNA, 25 bp, Mus musculus
tgaccaagtggattgctgttgcaga

SEQ ID NO: 847817 - DNA, 25 bp, Mus musculus
tgaccaagttcaaggctccacagta

SEQ ID NO: 847818 - DNA, 25 bp, Mus musculus
tgaccaagttcatggctccacagta

SEQ ID NO: 847819 - DNA, 25 bp, Mus musculus
tgaccaatacccatgacctttagag

SEQ ID NO: 847820 - DNA, 25 bp, Mus musculus
tgaccaatacccttgacctttagag

SEQ ID NO: 847821 - DNA, 25 bp, Mus musculus
tgaccaatatcacccgggaccagaa

SEQ ID NO: 847822 - DNA, 25 bp, Mus musculus
tgaccaatatcagccgggaccagaa

SEQ ID NO: 847823 - DNA, 25 bp, Mus musculus
tgaccaatcatacctgacctaatag

SEQ ID NO: 847824 - DNA, 25 bp, Mus musculus
tgaccaatcatagctgacctaatag

SEQ ID NO: 847825 - DNA, 25 bp, Mus musculus
tgaccaatggtcaagctcttcacca

SEQ ID NO: 847826 - DNA, 25 bp, Mus musculus
tgaccaatggtctagctcttcacca

SEQ ID NO: 847827 - DNA, 25 bp, Mus musculus
tgaccaattttcctttcatttgtaa

SEQ ID NO: 847828 - DNA, 25 bp, Mus musculus
tgaccaattttcgtttcatttgtaa

SEQ ID NO: 847829 - DNA, 25 bp, Mus musculus
tgaccacaaagcatcccgtgtacag

SEQ ID NO: 847830 - DNA, 25 bp, Mus musculus
tgaccacaaagcttcccgtgtacag

SEQ ID NO: 847831 - DNA, 25 bp, Mus musculus
tgaccacaacctccaccaggattgg

SEQ ID NO: 847832 - DNA, 25 bp, Mus musculus
tgaccacaacctgcaccaggattgg

SEQ ID NO: 847833 - DNA, 25 bp, Mus musculus
tgaccacaaggaacaatgatccatt

SEQ ID NO: 847834 - DNA, 25 bp, Mus musculus
tgaccacaaggatcaatgatccatt

SEQ ID NO: 847835 - DNA, 25 bp, Mus musculus
tgaccacaagtgaagcagcccagag

SEQ ID NO: 847836 - DNA, 25 bp, Mus musculus
tgaccacaagtgtagcagcccagag

SEQ ID NO: 847837 - DNA, 25 bp, Mus musculus
tgaccacaattgcacttctctttga

SEQ ID NO: 847838 - DNA, 25 bp, Mus musculus
tgaccacaattggacttctctttga

SEQ ID NO: 847839 - DNA, 25 bp, Mus musculus
tgaccacacacaccagagcaggact

SEQ ID NO: 847840 - DNA, 25 bp, Mus musculus
tgaccacacacagcagagcaggact

SEQ ID NO: 847841 - DNA, 25 bp, Mus musculus
tgaccacacactagatctcacctat

SEQ ID NO: 847842 - DNA, 25 bp, Mus musculus
tgaccacacacttgatctcacctat

SEQ ID NO: 847843 - DNA, 25 bp, Mus musculus
tgaccacacagcatggacctttagc

SEQ ID NO: 847844 - DNA, 25 bp, Mus musculus
tgaccacacagcttggacctttagc

SEQ ID NO: 847845 - DNA, 25 bp, Mus musculus
tgaccacactcacaagtattccagg

SEQ ID NO: 847846 - DNA, 25 bp, Mus musculus
tgaccacactcagaagtattccagg

SEQ ID NO: 847847 - DNA, 25 bp, Mus musculus
tgaccacactgcatttttcgacatt

SEQ ID NO: 847848 - DNA, 25 bp, Mus musculus
tgaccacactgcttttttcgacatt

SEQ ID NO: 847849 - DNA, 25 bp, Mus musculus
tgaccacagactccacagacgggat

SEQ ID NO: 847850 - DNA, 25 bp, Mus musculus
tgaccacagactgcacagacgggat

SEQ ID NO: 847851 - DNA, 25 bp, Mus musculus
tgaccacagcttaggcaacatgaaa

SEQ ID NO: 847852 - DNA, 25 bp, Mus musculus
tgaccacagctttggcaacatgaaa

SEQ ID NO: 847853 - DNA, 25 bp, Mus musculus
tgaccacagggcattgttaccttgc

SEQ ID NO: 847854 - DNA, 25 bp, Mus musculus
tgaccacagggctttgttaccttgc

SEQ ID NO: 847855 - DNA, 25 bp, Mus musculus
tgaccacaggtcagtgatgtcacct

SEQ ID NO: 847856 - DNA, 25 bp, Mus musculus
tgaccacaggtctgtgatgtcacct

SEQ ID NO: 847857 - DNA, 25 bp, Mus musculus
tgaccacagtcacgaggccttactg

SEQ ID NO: 847858 - DNA, 25 bp, Mus musculus
tgaccacagtcaggaggccttactg

SEQ ID NO: 847859 - DNA, 25 bp, Mus musculus
tgaccacatcatccgcaatgggctg

SEQ ID NO: 847860 - DNA, 25 bp, Mus musculus
tgaccacatcatgcgcaatgggctg

SEQ ID NO: 847861 - DNA, 25 bp, Mus musculus
tgaccacatccaaataaggccgctg

SEQ ID NO: 847862 - DNA, 25 bp, Mus musculus
tgaccacatccacttcacaaagatt

SEQ ID NO: 847863 - DNA, 25 bp, Mus musculus
tgaccacatccagttcacaaagatt

SEQ ID NO: 847864 - DNA, 25 bp, Mus musculus
tgaccacatccatataaggccgctg

SEQ ID NO: 847865 - DNA, 25 bp, Mus musculus
tgaccacatggcctctgaaacacag

SEQ ID NO: 847866 - DNA, 25 bp, Mus musculus
tgaccacatggcgtctgaaacacag

SEQ ID NO: 847867 - DNA, 25 bp, Mus musculus
tgaccacattcccatacatctggat

SEQ ID NO: 847868 - DNA, 25 bp, Mus musculus
tgaccacattccgatacatctggat

SEQ ID NO: 847869 - DNA, 25 bp, Mus musculus
tgaccacattgaagggttcttgatg

SEQ ID NO: 847870 - DNA, 25 bp, Mus musculus
tgaccacattgatgggttcttgatg

SEQ ID NO: 847871 - DNA, 25 bp, Mus musculus
tgaccacattggagcactgctggca

SEQ ID NO: 847872 - DNA, 25 bp, Mus musculus
tgaccacattggtgcactgctggca

SEQ ID NO: 847873 - DNA, 25 bp, Mus musculus
tgaccaccaacacacaggaactctg

SEQ ID NO: 847874 - DNA, 25 bp, Mus musculus
tgaccaccaacagacaggaactctg

SEQ ID NO: 847875 - DNA, 25 bp, Mus musculus
tgaccaccaatcacagcacagtaca

SEQ ID NO: 847876 - DNA, 25 bp, Mus musculus
tgaccaccaatctcagcacagtaca

SEQ ID NO: 847877 - DNA, 25 bp, Mus musculus
tgaccaccattccaaggagatagag

SEQ ID NO: 847878 - DNA, 25 bp, Mus musculus
tgaccaccattcgaaggagatagag

SEQ ID NO: 847879 - DNA, 25 bp, Mus musculus
tgaccaccccaccttaaatagttct

SEQ ID NO: 847880 - DNA, 25 bp, Mus musculus
tgaccaccccacgttaaatagttct

SEQ ID NO: 847881 - DNA, 25 bp, Mus musculus
tgaccaccccggcatgggcacatgt

SEQ ID NO: 847882 - DNA, 25 bp, Mus musculus
tgaccaccccgggatgggcacatgt

SEQ ID NO: 847883 - DNA, 25 bp, Mus musculus
tgaccaccctggataatgcaagtgt

SEQ ID NO: 847884 - DNA, 25 bp, Mus musculus
tgaccaccctggttaatgcaagtgt

SEQ ID NO: 847885 - DNA, 25 bp, Mus musculus
tgaccaccgaccagacattgtatat

SEQ ID NO: 847886 - DNA, 25 bp, Mus musculus
tgaccaccgacctgacattgtatat

SEQ ID NO: 847887 - DNA, 25 bp, Mus musculus
tgaccaccgtatcaccagacacatg

SEQ ID NO: 847888 - DNA, 25 bp, Mus musculus
tgaccaccgtatgaccagacacatg

SEQ ID NO: 847889 - DNA, 25 bp, Mus musculus
tgaccacctcccaattctagtgtct

SEQ ID NO: 847890 - DNA, 25 bp, Mus musculus
tgaccacctcccagattgctctaat

SEQ ID NO: 847891 - DNA, 25 bp, Mus musculus
tgaccacctccctattctagtgtct

SEQ ID NO: 847892 - DNA, 25 bp, Mus musculus
tgaccacctccctgattgctctaat

SEQ ID NO: 847893 - DNA, 25 bp, Mus musculus
tgaccacctgctcaccatatgctga

SEQ ID NO: 847894 - DNA, 25 bp, Mus musculus
tgaccacctgctgaccatatgctga

SEQ ID NO: 847895 - DNA, 25 bp, Mus musculus
tgaccacctggaccacatcaagaag

SEQ ID NO: 847896 - DNA, 25 bp, Mus musculus
tgaccacctggagcacatcaagaag

SEQ ID NO: 847897 - DNA, 25 bp, Mus musculus
tgaccacctgtaagaggccttcaaa

SEQ ID NO: 847898 - DNA, 25 bp, Mus musculus
tgaccacctgtatgaggccttcaaa

SEQ ID NO: 847899 - DNA, 25 bp, Mus musculus
tgaccacctgtgaactggccatcat

SEQ ID NO: 847900 - DNA, 25 bp, Mus musculus
tgaccacctgtgtactggccatcat

SEQ ID NO: 847901 - DNA, 25 bp, Mus musculus
tgaccaccttataattacatacaac

SEQ ID NO: 847902 - DNA, 25 bp, Mus musculus
tgaccaccttattattacatacaac

SEQ ID NO: 847903 - DNA, 25 bp, Mus musculus
tgaccaccttcaaatatactccact

SEQ ID NO: 847904 - DNA, 25 bp, Mus musculus
tgaccaccttcatatatactccact

SEQ ID NO: 847905 - DNA, 25 bp, Mus musculus
tgaccacgagttagtgcctcaatcc

SEQ ID NO: 847906 - DNA, 25 bp, Mus musculus
tgaccacgagtttgtgcctcaatcc

SEQ ID NO: 847907 - DNA, 25 bp, Mus musculus
tgaccacgatggagctgccctgatg

SEQ ID NO: 847908 - DNA, 25 bp, Mus musculus
tgaccacgatggtgctgccctgatg

SEQ ID NO: 847909 - DNA, 25 bp, Mus musculus
tgaccacgcaatactaccagtacat

SEQ ID NO: 847910 - DNA, 25 bp, Mus musculus
tgaccacgcaattctaccagtacat

SEQ ID NO: 847911 - DNA, 25 bp, Mus musculus
tgaccacggctcaggatggccatgt

SEQ ID NO: 847912 - DNA, 25 bp, Mus musculus
tgaccacggctctggatggccatgt

SEQ ID NO: 847913 - DNA, 25 bp, Mus musculus
tgaccacgggctactttctggagtc

SEQ ID NO: 847914 - DNA, 25 bp, Mus musculus
tgaccacgggcttctttctggagtc

SEQ ID NO: 847915 - DNA, 25 bp, Mus musculus
tgaccactacaacaggcacaattat

SEQ ID NO: 847916 - DNA, 25 bp, Mus musculus
tgaccactacaagaggcacaattat

SEQ ID NO: 847917 - DNA, 25 bp, Mus musculus
tgaccactacatccgattctgtttt

SEQ ID NO: 847918 - DNA, 25 bp, Mus musculus
tgaccactacatgcgattctgtttt

SEQ ID NO: 847919 - DNA, 25 bp, Mus musculus
tgaccactatggctctcatgtttga

SEQ ID NO: 847920 - DNA, 25 bp, Mus musculus
tgaccactatgggtctcatgtttga

SEQ ID NO: 847921 - DNA, 25 bp, Mus musculus
tgaccactcagacccacatttgttt

SEQ ID NO: 847922 - DNA, 25 bp, Mus musculus
tgaccactcagagccacatttgttt

SEQ ID NO: 847923 - DNA, 25 bp, Mus musculus
tgaccactcatgaatgccaacactg

SEQ ID NO: 847924 - DNA, 25 bp, Mus musculus
tgaccactcatgtatgccaacactg

SEQ ID NO: 847925 - DNA, 25 bp, Mus musculus
tgaccactctaaagcccactattat

SEQ ID NO: 847926 - DNA, 25 bp, Mus musculus
tgaccactctaatgcccactattat

SEQ ID NO: 847927 - DNA, 25 bp, Mus musculus
tgaccactctcccttcaggctatgg

SEQ ID NO: 847928 - DNA, 25 bp, Mus musculus
tgaccactctccgttcaggctatgg

SEQ ID NO: 847929 - DNA, 25 bp, Mus musculus
tgaccactctgaagtggcacatttc

SEQ ID NO: 847930 - DNA, 25 bp, Mus musculus
tgaccactctgatgtggcacatttc

SEQ ID NO: 847931 - DNA, 25 bp, Mus musculus
tgaccactgaacataaccttggcga

SEQ ID NO: 847932 - DNA, 25 bp, Mus musculus
tgaccactgaacttaaccttggcga

SEQ ID NO: 847933 - DNA, 25 bp, Mus musculus
tgaccactgacaaggctgggtggct

SEQ ID NO: 847934 - DNA, 25 bp, Mus musculus
tgaccactgacatggctgggtggct

SEQ ID NO: 847935 - DNA, 25 bp, Mus musculus
tgaccactgcatacatgtgtctaag

SEQ ID NO: 847936 - DNA, 25 bp, Mus musculus
tgaccactgcattcatgtgtctaag

SEQ ID NO: 847937 - DNA, 25 bp, Mus musculus
tgaccactgctcaaactttctgcta

SEQ ID NO: 847938 - DNA, 25 bp, Mus musculus
tgaccactgctctaactttctgcta

SEQ ID NO: 847939 - DNA, 25 bp, Mus musculus
tgaccactggatcatcgacacggac

SEQ ID NO: 847940 - DNA, 25 bp, Mus musculus
tgaccactggatgatcgacacggac

SEQ ID NO: 847941 - DNA, 25 bp, Mus musculus
tgaccactggcaaatcacagctgca

SEQ ID NO: 847942 - DNA, 25 bp, Mus musculus
tgaccactggcatatcacagctgca

SEQ ID NO: 847943 - DNA, 25 bp, Mus musculus
tgaccactggccactgagtgatgtg

SEQ ID NO: 847944 - DNA, 25 bp, Mus musculus
tgaccactggcctctgagtgatgtg

SEQ ID NO: 847945 - DNA, 25 bp, Mus musculus
tgaccactgtggcatacggtgacat

SEQ ID NO: 847946 - DNA, 25 bp, Mus musculus
tgaccactgtgggatacggtgacat

SEQ ID NO: 847947 - DNA, 25 bp, Mus musculus
tgaccactgtgtccttgtcatggac

SEQ ID NO: 847948 - DNA, 25 bp, Mus musculus
tgaccactgtgtgcttgtcatggac

SEQ ID NO: 847949 - DNA, 25 bp, Mus musculus
tgaccacttactcggagtctcttta

SEQ ID NO: 847950 - DNA, 25 bp, Mus musculus
tgaccacttactgggagtctcttta

SEQ ID NO: 847951 - DNA, 25 bp, Mus musculus
tgaccacttagcactgcacatgaag

SEQ ID NO: 847952 - DNA, 25 bp, Mus musculus
tgaccacttagctctgcacatgaag

SEQ ID NO: 847953 - DNA, 25 bp, Mus musculus
tgaccacttcttatgccgtaactac

SEQ ID NO: 847954 - DNA, 25 bp, Mus musculus
tgaccacttcttttgccgtaactac

SEQ ID NO: 847955 - DNA, 25 bp, Mus musculus
tgaccactttgacggaaggttcctt

SEQ ID NO: 847956 - DNA, 25 bp, Mus musculus
tgaccactttgagggaaggttcctt

SEQ ID NO: 847957 - DNA, 25 bp, Mus musculus
tgaccacttttaccctgttctttct

SEQ ID NO: 847958 - DNA, 25 bp, Mus musculus
tgaccacttttagcctgttctttct

SEQ ID NO: 847959 - DNA, 25 bp, Mus musculus
tgaccagaaacaagacgcgcctgct

SEQ ID NO: 847960 - DNA, 25 bp, Mus musculus
tgaccagaaacatgacgcgcctgct

SEQ ID NO: 847961 - DNA, 25 bp, Mus musculus
tgaccagaacggaactggcgtctgt

SEQ ID NO: 847962 - DNA, 25 bp, Mus musculus
tgaccagaacggtactggcgtctgt

SEQ ID NO: 847963 - DNA, 25 bp, Mus musculus
tgaccagaactgcatccactgggct

SEQ ID NO: 847964 - DNA, 25 bp, Mus musculus
tgaccagaactggatccactgggct

SEQ ID NO: 847965 - DNA, 25 bp, Mus musculus
tgaccagaagccagtggaacgcagt

SEQ ID NO: 847966 - DNA, 25 bp, Mus musculus
tgaccagaagcctgtggaacgcagt

SEQ ID NO: 847967 - DNA, 25 bp, Mus musculus
tgaccagaatgcaagcagaagatga

SEQ ID NO: 847968 - DNA, 25 bp, Mus musculus
tgaccagaatgctagcagaagatga

SEQ ID NO: 847969 - DNA, 25 bp, Mus musculus
tgaccagacaccctagaggactcgc

SEQ ID NO: 847970 - DNA, 25 bp, Mus musculus
tgaccagacaccgtagaggactcgc

SEQ ID NO: 847971 - DNA, 25 bp, Mus musculus
tgaccagacagccacctatgaagac

SEQ ID NO: 847972 - DNA, 25 bp, Mus musculus
tgaccagacagcgacctatgaagac

SEQ ID NO: 847973 - DNA, 25 bp, Mus musculus
tgaccagaccaacgctcaggcggca

SEQ ID NO: 847974 - DNA, 25 bp, Mus musculus
tgaccagaccaaggctcaggcggca

SEQ ID NO: 847975 - DNA, 25 bp, Mus musculus
tgaccagaccacagcgattgacatg

SEQ ID NO: 847976 - DNA, 25 bp, Mus musculus
tgaccagaccacaggtgaccttggc

SEQ ID NO: 847977 - DNA, 25 bp, Mus musculus
tgaccagaccactgcgattgacatg

SEQ ID NO: 847978 - DNA, 25 bp, Mus musculus
tgaccagaccactggtgaccttggc

SEQ ID NO: 847979 - DNA, 25 bp, Mus musculus
tgaccagactgcagcggatggacca

SEQ ID NO: 847980 - DNA, 25 bp, Mus musculus
tgaccagactgctgcggatggacca

SEQ ID NO: 847981 - DNA, 25 bp, Mus musculus
tgaccagagcaaaccacacaggtgt

SEQ ID NO: 847982 - DNA, 25 bp, Mus musculus
tgaccagagcaatccacacaggtgt

SEQ ID NO: 847983 - DNA, 25 bp, Mus musculus
tgaccagaggccaccatgttgaatg

SEQ ID NO: 847984 - DNA, 25 bp, Mus musculus
tgaccagaggcctccatgttgaatg

SEQ ID NO: 847985 - DNA, 25 bp, Mus musculus
tgaccagcaatacctcctggcttca

SEQ ID NO: 847986 - DNA, 25 bp, Mus musculus
tgaccagcaatagctcctggcttca

SEQ ID NO: 847987 - DNA, 25 bp, Mus musculus
tgaccagcagacctctttctaagca

SEQ ID NO: 847988 - DNA, 25 bp, Mus musculus
tgaccagcagacgtctttctaagca

SEQ ID NO: 847989 - DNA, 25 bp, Mus musculus
tgaccagcatcacaaactgtccaac

SEQ ID NO: 847990 - DNA, 25 bp, Mus musculus
tgaccagcatcagaaactgtccaac

SEQ ID NO: 847991 - DNA, 25 bp, Mus musculus
tgaccagcatcgaggaggagccgct

SEQ ID NO: 847992 - DNA, 25 bp, Mus musculus
tgaccagcatcgtggaggagccgct

SEQ ID NO: 847993 - DNA, 25 bp, Mus musculus
tgaccagccactcattttcactgtt

SEQ ID NO: 847994 - DNA, 25 bp, Mus musculus
tgaccagccactgattttcactgtt

SEQ ID NO: 847995 - DNA, 25 bp, Mus musculus
tgaccagccagcacatttaacctta

SEQ ID NO: 847996 - DNA, 25 bp, Mus musculus
tgaccagccagctcatttaacctta

SEQ ID NO: 847997 - DNA, 25 bp, Mus musculus
tgaccagccccaactgatgaggaag

SEQ ID NO: 847998 - DNA, 25 bp, Mus musculus
tgaccagccccatctgatgaggaag

SEQ ID NO: 847999 - DNA, 25 bp, Mus musculus
tgaccagcctgcaaatagctcactt

SEQ ID NO: 848000 - DNA, 25 bp, Mus musculus
tgaccagcctgcagatccttttgag

SEQ ID NO: 848001 - DNA, 25 bp, Mus musculus
tgaccagcctgctaatagctcactt

SEQ ID NO: 848002 - DNA, 25 bp, Mus musculus
tgaccagcctgctgatccttttgag

SEQ ID NO: 848003 - DNA, 25 bp, Mus musculus
tgaccagcctgtcctgggaggatta

SEQ ID NO: 848004 - DNA, 25 bp, Mus musculus
tgaccagcctgtgctgggaggatta

SEQ ID NO: 848005 - DNA, 25 bp, Mus musculus
tgaccagcgagaactgtgagcactt

SEQ ID NO: 848006 - DNA, 25 bp, Mus musculus
tgaccagcgagatctgtgagcactt

SEQ ID NO: 848007 - DNA, 25 bp, Mus musculus
tgaccagcgatgctgtactactgat

SEQ ID NO: 848008 - DNA, 25 bp, Mus musculus
tgaccagcgatggtgtactactgat

SEQ ID NO: 848009 - DNA, 25 bp, Mus musculus
tgaccagcgtgactcttacagaaat

SEQ ID NO: 848010 - DNA, 25 bp, Mus musculus
tgaccagcgtgagtcttacagaaat

SEQ ID NO: 848011 - DNA, 25 bp, Mus musculus
tgaccagctcttcaggatcttcaga

SEQ ID NO: 848012 - DNA, 25 bp, Mus musculus
tgaccagctcttgaggatcttcaga

SEQ ID NO: 848013 - DNA, 25 bp, Mus musculus
tgaccagctggcctttgttttgaca

SEQ ID NO: 848014 - DNA, 25 bp, Mus musculus
tgaccagctggcgtttgttttgaca

SEQ ID NO: 848015 - DNA, 25 bp, Mus musculus
tgaccagctggtagctgcatttgac

SEQ ID NO: 848016 - DNA, 25 bp, Mus musculus
tgaccagctggttgctgcatttgac

SEQ ID NO: 848017 - DNA, 25 bp, Mus musculus
tgaccagctgtcaaggatgtccctc

SEQ ID NO: 848018 - DNA, 25 bp, Mus musculus
tgaccagctgtctaggatgtccctc

SEQ ID NO: 848019 - DNA, 25 bp, Mus musculus
tgaccagcttggagccgaccgcgca

SEQ ID NO: 848020 - DNA, 25 bp, Mus musculus
tgaccagcttggtgccgaccgcgca

SEQ ID NO: 848021 - DNA, 25 bp, Mus musculus
tgaccaggaacacggcatctagagc

SEQ ID NO: 848022 - DNA, 25 bp, Mus musculus
tgaccaggaacagggcatctagagc

SEQ ID NO: 848023 - DNA, 25 bp, Mus musculus
tgaccaggacccaaaacctcacaaa

SEQ ID NO: 848024 - DNA, 25 bp, Mus musculus
tgaccaggaccctaaacctcacaaa

SEQ ID NO: 848025 - DNA, 25 bp, Mus musculus
tgaccaggacctcagacgaccttga

SEQ ID NO: 848026 - DNA, 25 bp, Mus musculus
tgaccaggacctgagacgaccttga

SEQ ID NO: 848027 - DNA, 25 bp, Mus musculus
tgaccaggactacggctgacggcaa

SEQ ID NO: 848028 - DNA, 25 bp, Mus musculus
tgaccaggactagggctgacggcaa

SEQ ID NO: 848029 - DNA, 25 bp, Mus musculus
tgaccaggatgtcggcattcagctc

SEQ ID NO: 848030 - DNA, 25 bp, Mus musculus
tgaccaggatgtgggcattcagctc

SEQ ID NO: 848031 - DNA, 25 bp, Mus musculus
tgaccaggattcagcttctgacagt

SEQ ID NO: 848032 - DNA, 25 bp, Mus musculus
tgaccaggattctgcttctgacagt

SEQ ID NO: 848033 - DNA, 25 bp, Mus musculus
tgaccaggccccattgcacatttat

SEQ ID NO: 848034 - DNA, 25 bp, Mus musculus
tgaccaggcccctttgcacatttat

SEQ ID NO: 848035 - DNA, 25 bp, Mus musculus
tgaccagggacaagcatgcagctgt

SEQ ID NO: 848036 - DNA, 25 bp, Mus musculus
tgaccagggacatgcatgcagctgt

SEQ ID NO: 848037 - DNA, 25 bp, Mus musculus
tgaccagggagcaccacagcttggc

SEQ ID NO: 848038 - DNA, 25 bp, Mus musculus
tgaccagggagctccacagcttggc

SEQ ID NO: 848039 - DNA, 25 bp, Mus musculus
tgaccagggtggacgtccacctgct

SEQ ID NO: 848040 - DNA, 25 bp, Mus musculus
tgaccagggtggtcgtccacctgct

SEQ ID NO: 848041 - DNA, 25 bp, Mus musculus
tgaccaggtctgcaagcacaagtct

SEQ ID NO: 848042 - DNA, 25 bp, Mus musculus
tgaccaggtctggaagcacaagtct

SEQ ID NO: 848043 - DNA, 25 bp, Mus musculus
tgaccaggttatcaagacccttgaa

SEQ ID NO: 848044 - DNA, 25 bp, Mus musculus
tgaccaggttatgaagacccttgaa

SEQ ID NO: 848045 - DNA, 25 bp, Mus musculus
tgaccagtcacactgacctcagaca

SEQ ID NO: 848046 - DNA, 25 bp, Mus musculus
tgaccagtcacagtgacctcagaca

SEQ ID NO: 848047 - DNA, 25 bp, Mus musculus
tgaccagtcaggagcaccgcttaag

SEQ ID NO: 848048 - DNA, 25 bp, Mus musculus
tgaccagtcaggtgcaccgcttaag

SEQ ID NO: 848049 - DNA, 25 bp, Mus musculus
tgaccagtcagtctgagctgcatcc

SEQ ID NO: 848050 - DNA, 25 bp, Mus musculus
tgaccagtcagtgtgagctgcatcc

SEQ ID NO: 848051 - DNA, 25 bp, Mus musculus
tgaccagtccctacgtccttggagg

SEQ ID NO: 848052 - DNA, 25 bp, Mus musculus
tgaccagtcccttcgtccttggagg

SEQ ID NO: 848053 - DNA, 25 bp, Mus musculus
tgaccagtctctcagctgtgcgttt

SEQ ID NO: 848054 - DNA, 25 bp, Mus musculus
tgaccagtctctgagctgtgcgttt

SEQ ID NO: 848055 - DNA, 25 bp, Mus musculus
tgaccagtctgaaatgcatggacat

SEQ ID NO: 848056 - DNA, 25 bp, Mus musculus
tgaccagtctgatatgcatggacat

SEQ ID NO: 848057 - DNA, 25 bp, Mus musculus
tgaccagtgacgacaacgacaacga

SEQ ID NO: 848058 - DNA, 25 bp, Mus musculus
tgaccagtgacgtcaacgacaacga

SEQ ID NO: 848059 - DNA, 25 bp, Mus musculus
tgaccagtgactcttgtctctgtat

SEQ ID NO: 848060 - DNA, 25 bp, Mus musculus
tgaccagtgactgttgtctctgtat

SEQ ID NO: 848061 - DNA, 25 bp, Mus musculus
tgaccagtgagcacatgttttcctc

SEQ ID NO: 848062 - DNA, 25 bp, Mus musculus
tgaccagtgagctcatgttttcctc

SEQ ID NO: 848063 - DNA, 25 bp, Mus musculus
tgaccagtgcagcttagtgctccca

SEQ ID NO: 848064 - DNA, 25 bp, Mus musculus
tgaccagtgcaggttagtgctccca

SEQ ID NO: 848065 - DNA, 25 bp, Mus musculus
tgaccagtggatctgaaccggcact

SEQ ID NO: 848066 - DNA, 25 bp, Mus musculus
tgaccagtggatgtgaaccggcact

SEQ ID NO: 848067 - DNA, 25 bp, Mus musculus
tgaccagttttcacttaaagccatt

SEQ ID NO: 848068 - DNA, 25 bp, Mus musculus
tgaccagttttcagtgtccacacac

SEQ ID NO: 848069 - DNA, 25 bp, Mus musculus
tgaccagttttctcttaaagccatt

SEQ ID NO: 848070 - DNA, 25 bp, Mus musculus
tgaccagttttctgtgtccacacac

SEQ ID NO: 848071 - DNA, 25 bp, Mus musculus
tgaccataatcaagatgccctgcca

SEQ ID NO: 848072 - DNA, 25 bp, Mus musculus
tgaccataatcatgatgccctgcca

SEQ ID NO: 848073 - DNA, 25 bp, Mus musculus
tgaccatagctgcagctctcgtgct

SEQ ID NO: 848074 - DNA, 25 bp, Mus musculus
tgaccatagctggagctctcgtgct

SEQ ID NO: 848075 - DNA, 25 bp, Mus musculus
tgaccataggcgagggtgtgcgtct

SEQ ID NO: 848076 - DNA, 25 bp, Mus musculus
tgaccataggcgtgggtgtgcgtct

SEQ ID NO: 848077 - DNA, 25 bp, Mus musculus
tgaccatagtccaagtgtctggctc

SEQ ID NO: 848078 - DNA, 25 bp, Mus musculus
tgaccatagtcctagtgtctggctc

SEQ ID NO: 848079 - DNA, 25 bp, Mus musculus
tgaccatcaagcaagcaggtttaaa

SEQ ID NO: 848080 - DNA, 25 bp, Mus musculus
tgaccatcaagcagccagacggaca

SEQ ID NO: 848081 - DNA, 25 bp, Mus musculus
tgaccatcaagctagcaggtttaaa

SEQ ID NO: 848082 - DNA, 25 bp, Mus musculus
tgaccatcaagctgccagacggaca

SEQ ID NO: 848083 - DNA, 25 bp, Mus musculus
tgaccatcacacagaccagcaggac

SEQ ID NO: 848084 - DNA, 25 bp, Mus musculus
tgaccatcacactgaccagcaggac

SEQ ID NO: 848085 - DNA, 25 bp, Mus musculus
tgaccatcacagaaccagccactgg

SEQ ID NO: 848086 - DNA, 25 bp, Mus musculus
tgaccatcacagtaccagccactgg

SEQ ID NO: 848087 - DNA, 25 bp, Mus musculus
tgaccatcagcaaccttgacgtaaa

SEQ ID NO: 848088 - DNA, 25 bp, Mus musculus
tgaccatcagcatccttgacgtaaa

SEQ ID NO: 848089 - DNA, 25 bp, Mus musculus
tgaccatcaggcaaaaggaaagaat

SEQ ID NO: 848090 - DNA, 25 bp, Mus musculus
tgaccatcaggctaaaggaaagaat

SEQ ID NO: 848091 - DNA, 25 bp, Mus musculus
tgaccatcaggtactgcccctcatt

SEQ ID NO: 848092 - DNA, 25 bp, Mus musculus
tgaccatcaggttctgcccctcatt

SEQ ID NO: 848093 - DNA, 25 bp, Mus musculus
tgaccatccctaacaatatgtctgt

SEQ ID NO: 848094 - DNA, 25 bp, Mus musculus
tgaccatccctatcaatatgtctgt

SEQ ID NO: 848095 - DNA, 25 bp, Mus musculus
tgaccatccgttaggcccagaaagt

SEQ ID NO: 848096 - DNA, 25 bp, Mus musculus
tgaccatccgtttggcccagaaagt

SEQ ID NO: 848097 - DNA, 25 bp, Mus musculus
tgaccatcgcccaggctggtaacca

SEQ ID NO: 848098 - DNA, 25 bp, Mus musculus
tgaccatcgccctggctggtaacca

SEQ ID NO: 848099 - DNA, 25 bp, Mus musculus
tgaccatctatgacaggatcccgtg

SEQ ID NO: 848100 - DNA, 25 bp, Mus musculus
tgaccatctatgtcaggatcccgtg

SEQ ID NO: 848101 - DNA, 25 bp, Mus musculus
tgaccatctcgtctgcacacagagg

SEQ ID NO: 848102 - DNA, 25 bp, Mus musculus
tgaccatctcgtgtgcacacagagg

SEQ ID NO: 848103 - DNA, 25 bp, Mus musculus
tgaccatctgtcaccttgtagaagc

SEQ ID NO: 848104 - DNA, 25 bp, Mus musculus
tgaccatctgtctccttgtagaagc

SEQ ID NO: 848105 - DNA, 25 bp, Mus musculus
tgaccatctgttaccctgagtacac

SEQ ID NO: 848106 - DNA, 25 bp, Mus musculus
tgaccatctgtttccctgagtacac

SEQ ID NO: 848107 - DNA, 25 bp, Mus musculus
tgaccatgacttccgctagttgagc

SEQ ID NO: 848108 - DNA, 25 bp, Mus musculus
tgaccatgacttgcgctagttgagc

SEQ ID NO: 848109 - DNA, 25 bp, Mus musculus
tgaccatgatcaattctcttgctgc

SEQ ID NO: 848110 - DNA, 25 bp, Mus musculus
tgaccatgatcatttctcttgctgc

SEQ ID NO: 848111 - DNA, 25 bp, Mus musculus
tgaccatgcagacgcctttccgatg

SEQ ID NO: 848112 - DNA, 25 bp, Mus musculus
tgaccatgcagaggcctttccgatg

SEQ ID NO: 848113 - DNA, 25 bp, Mus musculus
tgaccatgccacacagtatctcaag

SEQ ID NO: 848114 - DNA, 25 bp, Mus musculus
tgaccatgccactcagtatctcaag

SEQ ID NO: 848115 - DNA, 25 bp, Mus musculus
tgaccatgctctctgtttctagata

SEQ ID NO: 848116 - DNA, 25 bp, Mus musculus
tgaccatgctctgtgtttctagata

SEQ ID NO: 848117 - DNA, 25 bp, Mus musculus
tgaccatggacacccaactttgtga

SEQ ID NO: 848118 - DNA, 25 bp, Mus musculus
tgaccatggacagccaactttgtga

SEQ ID NO: 848119 - DNA, 25 bp, Mus musculus
tgaccatggccacttacctgacgat

SEQ ID NO: 848120 - DNA, 25 bp, Mus musculus
tgaccatggccagttacctgacgat

SEQ ID NO: 848121 - DNA, 25 bp, Mus musculus
tgaccatggcccaggtggatgcaaa

SEQ ID NO: 848122 - DNA, 25 bp, Mus musculus
tgaccatggccctggtggatgcaaa

SEQ ID NO: 848123 - DNA, 25 bp, Mus musculus
tgaccatggcggagtttcacgacga

SEQ ID NO: 848124 - DNA, 25 bp, Mus musculus
tgaccatggcggtgtttcacgacga

SEQ ID NO: 848125 - DNA, 25 bp, Mus musculus
tgaccatgggtgaaaccagctgctt

SEQ ID NO: 848126 - DNA, 25 bp, Mus musculus
tgaccatgggtgtaaccagctgctt

SEQ ID NO: 848127 - DNA, 25 bp, Mus musculus
tgaccatggtgcatagtggccccag

SEQ ID NO: 848128 - DNA, 25 bp, Mus musculus
tgaccatggtgcttagtggccccag

SEQ ID NO: 848129 - DNA, 25 bp, Mus musculus
tgaccatggtttcaatttccctttc

SEQ ID NO: 848130 - DNA, 25 bp, Mus musculus
tgaccatggtttgaatttccctttc

SEQ ID NO: 848131 - DNA, 25 bp, Mus musculus
tgaccatgtaacatctatccttgag

SEQ ID NO: 848132 - DNA, 25 bp, Mus musculus
tgaccatgtaacttctatccttgag

SEQ ID NO: 848133 - DNA, 25 bp, Mus musculus
tgaccatgtactaagcatttgctag

SEQ ID NO: 848134 - DNA, 25 bp, Mus musculus
tgaccatgtacttagcatttgctag

SEQ ID NO: 848135 - DNA, 25 bp, Mus musculus
tgaccatgtgtcatcagaagcaaga

SEQ ID NO: 848136 - DNA, 25 bp, Mus musculus
tgaccatgtgtcttcagaagcaaga

SEQ ID NO: 848137 - DNA, 25 bp, Mus musculus
tgaccatgtgtgacctcgtgtcctt

SEQ ID NO: 848138 - DNA, 25 bp, Mus musculus
tgaccatgtgtgtcctcgtgtcctt

SEQ ID NO: 848139 - DNA, 25 bp, Mus musculus
tgaccattaggccagtttgccgggc

SEQ ID NO: 848140 - DNA, 25 bp, Mus musculus
tgaccattaggcgagtttgccgggc

SEQ ID NO: 848141 - DNA, 25 bp, Mus musculus
tgaccattgcagctgatcgtggcct

SEQ ID NO: 848142 - DNA, 25 bp, Mus musculus
tgaccattgcaggtgatcgtggcct

SEQ ID NO: 848143 - DNA, 25 bp, Mus musculus
tgaccattgttcactggatggcaat

SEQ ID NO: 848144 - DNA, 25 bp, Mus musculus
tgaccattgttctctggatggcaat

SEQ ID NO: 848145 - DNA, 25 bp, Mus musculus
tgaccatttcctctgtcagtagctg

SEQ ID NO: 848146 - DNA, 25 bp, Mus musculus
tgaccatttcctgtgtcagtagctg

SEQ ID NO: 848147 - DNA, 25 bp, Mus musculus
tgaccatttctgagtttcctgtgag

SEQ ID NO: 848148 - DNA, 25 bp, Mus musculus
tgaccatttctgtgtttcctgtgag

SEQ ID NO: 848149 - DNA, 25 bp, Mus musculus
tgaccatttgaaattctttctttgt

SEQ ID NO: 848150 - DNA, 25 bp, Mus musculus
tgaccatttgaatttctttctttgt

SEQ ID NO: 848151 - DNA, 25 bp, Mus musculus
tgaccattttagcaattatgtgaat

SEQ ID NO: 848152 - DNA, 25 bp, Mus musculus
tgaccattttaggaattatgtgaat

SEQ ID NO: 848153 - DNA, 25 bp, Mus musculus
tgaccatttttaacatcccaggctg

SEQ ID NO: 848154 - DNA, 25 bp, Mus musculus
tgaccatttttacttgagagcacag

SEQ ID NO: 848155 - DNA, 25 bp, Mus musculus
tgaccatttttagttgagagcacag

SEQ ID NO: 848156 - DNA, 25 bp, Mus musculus
tgaccatttttatcatcccaggctg

SEQ ID NO: 848157 - DNA, 25 bp, Mus musculus
tgacccaaaactatcttgggccggg

SEQ ID NO: 848158 - DNA, 25 bp, Mus musculus
tgacccaaaactttcttgggccggg

SEQ ID NO: 848159 - DNA, 25 bp, Mus musculus
tgacccaacaaaccctgtatttctc

SEQ ID NO: 848160 - DNA, 25 bp, Mus musculus
tgacccaacaaagcctgtatttctc

SEQ ID NO: 848161 - DNA, 25 bp, Mus musculus
tgacccaacacaaggaggcctctca

SEQ ID NO: 848162 - DNA, 25 bp, Mus musculus
tgacccaacacatggaggcctctca

SEQ ID NO: 848163 - DNA, 25 bp, Mus musculus
tgacccaacagcacaacacggtgtt

SEQ ID NO: 848164 - DNA, 25 bp, Mus musculus
tgacccaacagctcaacacggtgtt

SEQ ID NO: 848165 - DNA, 25 bp, Mus musculus
tgacccaagatcctgcctgagcagg

SEQ ID NO: 848166 - DNA, 25 bp, Mus musculus
tgacccaagatcgtgcctgagcagg

SEQ ID NO: 848167 - DNA, 25 bp, Mus musculus
tgacccaatcatcagcacacatttg

SEQ ID NO: 848168 - DNA, 25 bp, Mus musculus
tgacccaatcatgagcacacatttg

SEQ ID NO: 848169 - DNA, 25 bp, Mus musculus
tgacccaatggcatctggctgggag

SEQ ID NO: 848170 - DNA, 25 bp, Mus musculus
tgacccaatggcttctggctgggag

SEQ ID NO: 848171 - DNA, 25 bp, Mus musculus
tgacccaattctatcaacccaggga

SEQ ID NO: 848172 - DNA, 25 bp, Mus musculus
tgacccaattctttcaacccaggga

SEQ ID NO: 848173 - DNA, 25 bp, Mus musculus
tgacccacaagcaacaagaggacct

SEQ ID NO: 848174 - DNA, 25 bp, Mus musculus
tgacccacaagcagatagttccagt

SEQ ID NO: 848175 - DNA, 25 bp, Mus musculus
tgacccacaagctacaagaggacct

SEQ ID NO: 848176 - DNA, 25 bp, Mus musculus
tgacccacaagctgatagttccagt

SEQ ID NO: 848177 - DNA, 25 bp, Mus musculus
tgacccacaattattaacccagtat

SEQ ID NO: 848178 - DNA, 25 bp, Mus musculus
tgacccacaatttttaacccagtat

SEQ ID NO: 848179 - DNA, 25 bp, Mus musculus
tgacccacacacacattaattctac

SEQ ID NO: 848180 - DNA, 25 bp, Mus musculus
tgacccacacactcattaattctac

SEQ ID NO: 848181 - DNA, 25 bp, Mus musculus
tgacccacagatccgatgctatacc

SEQ ID NO: 848182 - DNA, 25 bp, Mus musculus
tgacccacagatgcgatgctatacc

SEQ ID NO: 848183 - DNA, 25 bp, Mus musculus
tgacccacatgtctcaactctatgc

SEQ ID NO: 848184 - DNA, 25 bp, Mus musculus
tgacccacatgtgtcaactctatgc

SEQ ID NO: 848185 - DNA, 25 bp, Mus musculus
tgacccaccacaaagaaccattgag

SEQ ID NO: 848186 - DNA, 25 bp, Mus musculus
tgacccaccacatagaaccattgag

SEQ ID NO: 848187 - DNA, 25 bp, Mus musculus
tgacccacccagctgccattgtgtg

SEQ ID NO: 848188 - DNA, 25 bp, Mus musculus
tgacccacccaggtgccattgtgtg

SEQ ID NO: 848189 - DNA, 25 bp, Mus musculus
tgacccaccctgattgccagaaaga

SEQ ID NO: 848190 - DNA, 25 bp, Mus musculus
tgacccaccctgctgtgctgtgtga

SEQ ID NO: 848191 - DNA, 25 bp, Mus musculus
tgacccaccctggtgtgctgtgtga

SEQ ID NO: 848192 - DNA, 25 bp, Mus musculus
tgacccaccctgtttgccagaaaga

SEQ ID NO: 848193 - DNA, 25 bp, Mus musculus
tgacccacgatgagctgatccagct

SEQ ID NO: 848194 - DNA, 25 bp, Mus musculus
tgacccacgatgtgctgatccagct

SEQ ID NO: 848195 - DNA, 25 bp, Mus musculus
tgacccacggataggcaaactgctt

SEQ ID NO: 848196 - DNA, 25 bp, Mus musculus
tgacccacggatcaattcaggaatt

SEQ ID NO: 848197 - DNA, 25 bp, Mus musculus
tgacccacggatgaattcaggaatt

SEQ ID NO: 848198 - DNA, 25 bp, Mus musculus
tgacccacggattggcaaactgctt

SEQ ID NO: 848199 - DNA, 25 bp, Mus musculus
tgacccacgggcaacttgaagttag

SEQ ID NO: 848200 - DNA, 25 bp, Mus musculus
tgacccacgggctacttgaagttag

SEQ ID NO: 848201 - DNA, 25 bp, Mus musculus
tgacccacgtccctgaaataaactt

SEQ ID NO: 848202 - DNA, 25 bp, Mus musculus
tgacccacgtccgtgaaataaactt

SEQ ID NO: 848203 - DNA, 25 bp, Mus musculus
tgacccacgtgccagatgtgtgcaa

SEQ ID NO: 848204 - DNA, 25 bp, Mus musculus
tgacccacgtgcgagatgtgtgcaa

SEQ ID NO: 848205 - DNA, 25 bp, Mus musculus
tgacccactcatagctcgtggcaaa

SEQ ID NO: 848206 - DNA, 25 bp, Mus musculus
tgacccactcattgctcgtggcaaa

SEQ ID NO: 848207 - DNA, 25 bp, Mus musculus
tgacccacttgtacctacagaacaa

SEQ ID NO: 848208 - DNA, 25 bp, Mus musculus
tgacccacttgttcctacagaacaa

SEQ ID NO: 848209 - DNA, 25 bp, Mus musculus
tgacccagaaaaccccacaaaatca

SEQ ID NO: 848210 - DNA, 25 bp, Mus musculus
tgacccagaaaagcccacaaaatca

SEQ ID NO: 848211 - DNA, 25 bp, Mus musculus
tgacccagacacaagctaacatgat

SEQ ID NO: 848212 - DNA, 25 bp, Mus musculus
tgacccagacactagctaacatgat

SEQ ID NO: 848213 - DNA, 25 bp, Mus musculus
tgacccagacagagcaattgggaaa

SEQ ID NO: 848214 - DNA, 25 bp, Mus musculus
tgacccagacagtgcaattgggaaa

SEQ ID NO: 848215 - DNA, 25 bp, Mus musculus
tgacccagaccaaccctaatattag

SEQ ID NO: 848216 - DNA, 25 bp, Mus musculus
tgacccagaccatccctaatattag

SEQ ID NO: 848217 - DNA, 25 bp, Mus musculus
tgacccagacttcgctcaagtgctg

SEQ ID NO: 848218 - DNA, 25 bp, Mus musculus
tgacccagacttggctcaagtgctg

SEQ ID NO: 848219 - DNA, 25 bp, Mus musculus
tgacccagagatatacaggttgtct

SEQ ID NO: 848220 - DNA, 25 bp, Mus musculus
tgacccagagatttacaggttgtct

SEQ ID NO: 848221 - DNA, 25 bp, Mus musculus
tgacccagaggtcacttacagtgtt

SEQ ID NO: 848222 - DNA, 25 bp, Mus musculus
tgacccagaggtgacttacagtgtt

SEQ ID NO: 848223 - DNA, 25 bp, Mus musculus
tgacccagatcaagtttgagacctt

SEQ ID NO: 848224 - DNA, 25 bp, Mus musculus
tgacccagatcatgtttgagacctt

SEQ ID NO: 848225 - DNA, 25 bp, Mus musculus
tgacccagcagaagctgaccctctt

SEQ ID NO: 848226 - DNA, 25 bp, Mus musculus
tgacccagcagatgctgaccctctt

SEQ ID NO: 848227 - DNA, 25 bp, Mus musculus
tgacccagcaggattatgtgaaccg

SEQ ID NO: 848228 - DNA, 25 bp, Mus musculus
tgacccagcaggtttatgtgaaccg

SEQ ID NO: 848229 - DNA, 25 bp, Mus musculus
tgacccagccacaagccttttttct

SEQ ID NO: 848230 - DNA, 25 bp, Mus musculus
tgacccagccactagccttttttct

SEQ ID NO: 848231 - DNA, 25 bp, Mus musculus
tgacccagccgcagcctttgtgaac

SEQ ID NO: 848232 - DNA, 25 bp, Mus musculus
tgacccagccgctgcctttgtgaac

SEQ ID NO: 848233 - DNA, 25 bp, Mus musculus
tgacccagcctgacgcgttctcagt

SEQ ID NO: 848234 - DNA, 25 bp, Mus musculus
tgacccagcctgtcgcgttctcagt

SEQ ID NO: 848235 - DNA, 25 bp, Mus musculus
tgacccagcgagaaggatcaccttg

SEQ ID NO: 848236 - DNA, 25 bp, Mus musculus
tgacccagcgagtaggatcaccttg

SEQ ID NO: 848237 - DNA, 25 bp, Mus musculus
tgacccagcgcaaccggatggagat

SEQ ID NO: 848238 - DNA, 25 bp, Mus musculus
tgacccagcgcatccggatggagat

SEQ ID NO: 848239 - DNA, 25 bp, Mus musculus
tgacccagcgtcagtctccaaagct

SEQ ID NO: 848240 - DNA, 25 bp, Mus musculus
tgacccagcgtctgtctccaaagct

SEQ ID NO: 848241 - DNA, 25 bp, Mus musculus
tgacccagcgttagaggactgccta

SEQ ID NO: 848242 - DNA, 25 bp, Mus musculus
tgacccagcgtttgaggactgccta

SEQ ID NO: 848243 - DNA, 25 bp, Mus musculus
tgacccagctccacatttatattct

SEQ ID NO: 848244 - DNA, 25 bp, Mus musculus
tgacccagctcctcatttatattct

SEQ ID NO: 848245 - DNA, 25 bp, Mus musculus
tgacccagctgtcccggctcaagag

SEQ ID NO: 848246 - DNA, 25 bp, Mus musculus
tgacccagctgtgccggctcaagag

SEQ ID NO: 848247 - DNA, 25 bp, Mus musculus
tgacccaggaacagctcatccccaa

SEQ ID NO: 848248 - DNA, 25 bp, Mus musculus
tgacccaggaactgctcatccccaa

SEQ ID NO: 848249 - DNA, 25 bp, Mus musculus
tgacccaggctgaagcatgattgtt

SEQ ID NO: 848250 - DNA, 25 bp, Mus musculus
tgacccaggctgtagcatgattgtt

SEQ ID NO: 848251 - DNA, 25 bp, Mus musculus
tgacccagtgagctgcgacctgctg

SEQ ID NO: 848252 - DNA, 25 bp, Mus musculus
tgacccagtgaggtgcgacctgctg

SEQ ID NO: 848253 - DNA, 25 bp, Mus musculus
tgacccagtgccattgtggcgcaca

SEQ ID NO: 848254 - DNA, 25 bp, Mus musculus
tgacccagtgcctttgtggcgcaca

SEQ ID NO: 848255 - DNA, 25 bp, Mus musculus
tgacccagtgctcggctgttcagaa

SEQ ID NO: 848256 - DNA, 25 bp, Mus musculus
tgacccagtgctgggctgttcagaa

SEQ ID NO: 848257 - DNA, 25 bp, Mus musculus
tgacccagtggacccttcacatggt

SEQ ID NO: 848258 - DNA, 25 bp, Mus musculus
tgacccagtggagccttcacatggt

SEQ ID NO: 848259 - DNA, 25 bp, Mus musculus
tgacccagttgcatccaggcagtag

SEQ ID NO: 848260 - DNA, 25 bp, Mus musculus
tgacccagttgcttccaggcagtag

SEQ ID NO: 848261 - DNA, 25 bp, Mus musculus
tgacccatactgagacctatagttt

SEQ ID NO: 848262 - DNA, 25 bp, Mus musculus
tgacccatactgcttcctcattagc

SEQ ID NO: 848263 - DNA, 25 bp, Mus musculus
tgacccatactggttcctcattagc

SEQ ID NO: 848264 - DNA, 25 bp, Mus musculus
tgacccatactgtgacctatagttt

SEQ ID NO: 848265 - DNA, 25 bp, Mus musculus
tgacccatatttccaagaccctaca

SEQ ID NO: 848266 - DNA, 25 bp, Mus musculus
tgacccatatttgcaagaccctaca

SEQ ID NO: 848267 - DNA, 25 bp, Mus musculus
tgacccatcagaccctgagatgtgg

SEQ ID NO: 848268 - DNA, 25 bp, Mus musculus
tgacccatcagagcctgagatgtgg

SEQ ID NO: 848269 - DNA, 25 bp, Mus musculus
tgacccatcatcaaataggaccagg

SEQ ID NO: 848270 - DNA, 25 bp, Mus musculus
tgacccatcatctaataggaccagg

SEQ ID NO: 848271 - DNA, 25 bp, Mus musculus
tgacccatcccaccagtgcagaatg

SEQ ID NO: 848272 - DNA, 25 bp, Mus musculus
tgacccatcccagcagtgcagaatg

SEQ ID NO: 848273 - DNA, 25 bp, Mus musculus
tgacccatcctcaataaactctgaa

SEQ ID NO: 848274 - DNA, 25 bp, Mus musculus
tgacccatcctctataaactctgaa

SEQ ID NO: 848275 - DNA, 25 bp, Mus musculus
tgacccatccttaggtgtgtgtgtt

SEQ ID NO: 848276 - DNA, 25 bp, Mus musculus
tgacccatcctttggtgtgtgtgtt

SEQ ID NO: 848277 - DNA, 25 bp, Mus musculus
tgacccatcggtacgcaatgtagaa

SEQ ID NO: 848278 - DNA, 25 bp, Mus musculus
tgacccatcggttcgcaatgtagaa

SEQ ID NO: 848279 - DNA, 25 bp, Mus musculus
tgacccatgcggaatacctggtgta

SEQ ID NO: 848280 - DNA, 25 bp, Mus musculus
tgacccatgcggtatacctggtgta

SEQ ID NO: 848281 - DNA, 25 bp, Mus musculus
tgacccatgggtactgtttgagaca

SEQ ID NO: 848282 - DNA, 25 bp, Mus musculus
tgacccatgggttctgtttgagaca

SEQ ID NO: 848283 - DNA, 25 bp, Mus musculus
tgacccatgtctctggctggtaatg

SEQ ID NO: 848284 - DNA, 25 bp, Mus musculus
tgacccatgtctgtggctggtaatg

SEQ ID NO: 848285 - DNA, 25 bp, Mus musculus
tgacccattcttatttcaatttctc

SEQ ID NO: 848286 - DNA, 25 bp, Mus musculus
tgacccattcttttttcaatttctc

SEQ ID NO: 848287 - DNA, 25 bp, Mus musculus
tgacccattggaatgtttgaactgc

SEQ ID NO: 848288 - DNA, 25 bp, Mus musculus
tgacccattggattgtttgaactgc

SEQ ID NO: 848289 - DNA, 25 bp, Mus musculus
tgacccatttacagccaagctgagc

SEQ ID NO: 848290 - DNA, 25 bp, Mus musculus
tgacccatttactgccaagctgagc

SEQ ID NO: 848291 - DNA, 25 bp, Mus musculus
tgacccattttccacgtttatcttt

SEQ ID NO: 848292 - DNA, 25 bp, Mus musculus
tgacccattttcgacgtttatcttt

SEQ ID NO: 848293 - DNA, 25 bp, Mus musculus
tgaccccaaatcctctagggattcc

SEQ ID NO: 848294 - DNA, 25 bp, Mus musculus
tgaccccaaatcgtctagggattcc

SEQ ID NO: 848295 - DNA, 25 bp, Mus musculus
tgaccccaactgagtgccgcgggat

SEQ ID NO: 848296 - DNA, 25 bp, Mus musculus
tgaccccaactgtgtgccgcgggat

SEQ ID NO: 848297 - DNA, 25 bp, Mus musculus
tgaccccaagagaaccagattctgt

SEQ ID NO: 848298 - DNA, 25 bp, Mus musculus
tgaccccaagagtaccagattctgt

SEQ ID NO: 848299 - DNA, 25 bp, Mus musculus
tgaccccaatttcaccaacagtagt

SEQ ID NO: 848300 - DNA, 25 bp, Mus musculus
tgaccccaatttgaccaacagtagt

SEQ ID NO: 848301 - DNA, 25 bp, Mus musculus
tgaccccacctaccaataaaaacag

SEQ ID NO: 848302 - DNA, 25 bp, Mus musculus
tgaccccacctagcaataaaaacag

SEQ ID NO: 848303 - DNA, 25 bp, Mus musculus
tgaccccactcacatttacatcagg

SEQ ID NO: 848304 - DNA, 25 bp, Mus musculus
tgaccccactcagatttacatcagg

SEQ ID NO: 848305 - DNA, 25 bp, Mus musculus
tgaccccagagcattgtgggtgcta

SEQ ID NO: 848306 - DNA, 25 bp, Mus musculus
tgaccccagagctttgtgggtgcta

SEQ ID NO: 848307 - DNA, 25 bp, Mus musculus
tgaccccagcaaagcatcacaaagg

SEQ ID NO: 848308 - DNA, 25 bp, Mus musculus
tgaccccagcaatgcatcacaaagg

SEQ ID NO: 848309 - DNA, 25 bp, Mus musculus
tgaccccagcagaagtatccagaaa

SEQ ID NO: 848310 - DNA, 25 bp, Mus musculus
tgaccccagcagtagtatccagaaa

SEQ ID NO: 848311 - DNA, 25 bp, Mus musculus
tgaccccagccaaagccgagtggaa

SEQ ID NO: 848312 - DNA, 25 bp, Mus musculus
tgaccccagccatagccgagtggaa

SEQ ID NO: 848313 - DNA, 25 bp, Mus musculus
tgaccccaggctctgtcacaagagg

SEQ ID NO: 848314 - DNA, 25 bp, Mus musculus
tgaccccaggctgtgtcacaagagg

SEQ ID NO: 848315 - DNA, 25 bp, Mus musculus
tgaccccagggcaaaggcattaagt

SEQ ID NO: 848316 - DNA, 25 bp, Mus musculus
tgaccccagggctaaggcattaagt

SEQ ID NO: 848317 - DNA, 25 bp, Mus musculus
tgaccccagggtacaaggaattgta

SEQ ID NO: 848318 - DNA, 25 bp, Mus musculus
tgaccccagggtctgagtcgccgct

SEQ ID NO: 848319 - DNA, 25 bp, Mus musculus
tgaccccagggtgtgagtcgccgct

SEQ ID NO: 848320 - DNA, 25 bp, Mus musculus
tgaccccagggttcaaggaattgta

SEQ ID NO: 848321 - DNA, 25 bp, Mus musculus
tgaccccaggttacaggagtggtgt

SEQ ID NO: 848322 - DNA, 25 bp, Mus musculus
tgaccccaggtttcaggagtggtgt

SEQ ID NO: 848323 - DNA, 25 bp, Mus musculus
tgaccccagtacacggaacttggag

SEQ ID NO: 848324 - DNA, 25 bp, Mus musculus
tgaccccagtactcggaacttggag

SEQ ID NO: 848325 - DNA, 25 bp, Mus musculus
tgaccccagtctacctagggaatgt

SEQ ID NO: 848326 - DNA, 25 bp, Mus musculus
tgaccccagtcttcctagggaatgt

SEQ ID NO: 848327 - DNA, 25 bp, Mus musculus
tgaccccatatgcttgatggctttg

SEQ ID NO: 848328 - DNA, 25 bp, Mus musculus
tgaccccatatggttgatggctttg

SEQ ID NO: 848329 - DNA, 25 bp, Mus musculus
tgaccccatattcctgacctgtctg

SEQ ID NO: 848330 - DNA, 25 bp, Mus musculus
tgaccccatattgctgacctgtctg

SEQ ID NO: 848331 - DNA, 25 bp, Mus musculus
tgaccccatcctagagtgactggag

SEQ ID NO: 848332 - DNA, 25 bp, Mus musculus
tgaccccatcctaggtgaacaagat

SEQ ID NO: 848333 - DNA, 25 bp, Mus musculus
tgaccccatccttgagtgactggag

SEQ ID NO: 848334 - DNA, 25 bp, Mus musculus
tgaccccatccttggtgaacaagat

SEQ ID NO: 848335 - DNA, 25 bp, Mus musculus
tgaccccatgagactatgtttattt

SEQ ID NO: 848336 - DNA, 25 bp, Mus musculus
tgaccccatgagtctatgtttattt

SEQ ID NO: 848337 - DNA, 25 bp, Mus musculus
tgaccccattggataacctgctagg

SEQ ID NO: 848338 - DNA, 25 bp, Mus musculus
tgaccccattggttaacctgctagg

SEQ ID NO: 848339 - DNA, 25 bp, Mus musculus
tgaccccatttacctataaagttgt

SEQ ID NO: 848340 - DNA, 25 bp, Mus musculus
tgaccccatttagctataaagttgt

SEQ ID NO: 848341 - DNA, 25 bp, Mus musculus
tgaccccgacgaacctagagacttg

SEQ ID NO: 848342 - DNA, 25 bp, Mus musculus
tgaccccgacgatcctagagacttg

SEQ ID NO: 848343 - DNA, 25 bp, Mus musculus
tgaccccgctaaacaagaacttctt

SEQ ID NO: 848344 - DNA, 25 bp, Mus musculus
tgaccccgctaatcaagaacttctt

SEQ ID NO: 848345 - DNA, 25 bp, Mus musculus
tgaccccgctggaggatgaggtgaa

SEQ ID NO: 848346 - DNA, 25 bp, Mus musculus
tgaccccgctggtggatgaggtgaa

SEQ ID NO: 848347 - DNA, 25 bp, Mus musculus
tgaccccgcttcaggttccctgtat

SEQ ID NO: 848348 - DNA, 25 bp, Mus musculus
tgaccccgcttctggttccctgtat

SEQ ID NO: 848349 - DNA, 25 bp, Mus musculus
tgaccccgggccaaaaagcggtgat

SEQ ID NO: 848350 - DNA, 25 bp, Mus musculus
tgaccccgggcctaaaagcggtgat

SEQ ID NO: 848351 - DNA, 25 bp, Mus musculus
tgaccccggtcccacagttgtgggc

SEQ ID NO: 848352 - DNA, 25 bp, Mus musculus
tgaccccggtccgacagttgtgggc

SEQ ID NO: 848353 - DNA, 25 bp, Mus musculus
tgaccccgtcttccaaagatgcctt

SEQ ID NO: 848354 - DNA, 25 bp, Mus musculus
tgaccccgtcttgcaaagatgcctt

SEQ ID NO: 848355 - DNA, 25 bp, Mus musculus
tgaccccgtgatactaatctgacat

SEQ ID NO: 848356 - DNA, 25 bp, Mus musculus
tgaccccgtgattctaatctgacat

SEQ ID NO: 848357 - DNA, 25 bp, Mus musculus
tgacccctaaggctcggctttccag

SEQ ID NO: 848358 - DNA, 25 bp, Mus musculus
tgacccctaagggtcggctttccag

SEQ ID NO: 848359 - DNA, 25 bp, Mus musculus
tgacccctactgcatcaactgagga

SEQ ID NO: 848360 - DNA, 25 bp, Mus musculus
tgacccctactggatcaactgagga

SEQ ID NO: 848361 - DNA, 25 bp, Mus musculus
tgacccctaggacccaggcggtgga

SEQ ID NO: 848362 - DNA, 25 bp, Mus musculus
tgacccctaggagccaggcggtgga

SEQ ID NO: 848363 - DNA, 25 bp, Mus musculus
tgacccctatggacattccggagcc

SEQ ID NO: 848364 - DNA, 25 bp, Mus musculus
tgacccctatggtcattccggagcc

SEQ ID NO: 848365 - DNA, 25 bp, Mus musculus
tgacccctcatcagggagaggtcta

SEQ ID NO: 848366 - DNA, 25 bp, Mus musculus
tgacccctcatctgggagaggtcta

SEQ ID NO: 848367 - DNA, 25 bp, Mus musculus
tgacccctccctaaaaatgccattt

SEQ ID NO: 848368 - DNA, 25 bp, Mus musculus
tgacccctcccttaaaatgccattt

SEQ ID NO: 848369 - DNA, 25 bp, Mus musculus
tgacccctccgactataacaagatt

SEQ ID NO: 848370 - DNA, 25 bp, Mus musculus
tgacccctccgagtataacaagatt

SEQ ID NO: 848371 - DNA, 25 bp, Mus musculus
tgacccctctcaatagagcacactt

SEQ ID NO: 848372 - DNA, 25 bp, Mus musculus
tgacccctctcattagagcacactt

SEQ ID NO: 848373 - DNA, 25 bp, Mus musculus
tgacccctgcccagaacatgtgtgc

SEQ ID NO: 848374 - DNA, 25 bp, Mus musculus
tgacccctgccctgaacatgtgtgc

SEQ ID NO: 848375 - DNA, 25 bp, Mus musculus
tgacccctgcctctactgcggtggg

SEQ ID NO: 848376 - DNA, 25 bp, Mus musculus
tgacccctgcctgtactgcggtggg

SEQ ID NO: 848377 - DNA, 25 bp, Mus musculus
tgacccctggctaaggagagggtac

SEQ ID NO: 848378 - DNA, 25 bp, Mus musculus
tgacccctggcttaggagagggtac

SEQ ID NO: 848379 - DNA, 25 bp, Mus musculus
tgacccctggtcacgtaacacagaa

SEQ ID NO: 848380 - DNA, 25 bp, Mus musculus
tgacccctggtcatcatgtgatcat

SEQ ID NO: 848381 - DNA, 25 bp, Mus musculus
tgacccctggtctcgtaacacagaa

SEQ ID NO: 848382 - DNA, 25 bp, Mus musculus
tgacccctggtcttcatgtgatcat

SEQ ID NO: 848383 - DNA, 25 bp, Mus musculus
tgacccctgtcaaaaggttattcaa

SEQ ID NO: 848384 - DNA, 25 bp, Mus musculus
tgacccctgtcataaggttattcaa

SEQ ID NO: 848385 - DNA, 25 bp, Mus musculus
tgaccccttaggaggagtctctaaa

SEQ ID NO: 848386 - DNA, 25 bp, Mus musculus
tgaccccttaggtggagtctctaaa

SEQ ID NO: 848387 - DNA, 25 bp, Mus musculus
tgaccccttggaacaacaatggatg

SEQ ID NO: 848388 - DNA, 25 bp, Mus musculus
tgaccccttggaccagaagatcatt

SEQ ID NO: 848389 - DNA, 25 bp, Mus musculus
tgaccccttggagcagaagatcatt

SEQ ID NO: 848390 - DNA, 25 bp, Mus musculus
tgaccccttggatcaacaatggatg

SEQ ID NO: 848391 - DNA, 25 bp, Mus musculus
tgaccccttgtcaccaatggactag

SEQ ID NO: 848392 - DNA, 25 bp, Mus musculus
tgaccccttgtctccaatggactag

SEQ ID NO: 848393 - DNA, 25 bp, Mus musculus
tgaccccttgtgcttctgccagtga

SEQ ID NO: 848394 - DNA, 25 bp, Mus musculus
tgaccccttgtggttctgccagtga

SEQ ID NO: 848395 - DNA, 25 bp, Mus musculus
tgaccccttgttccctgtagctttg

SEQ ID NO: 848396 - DNA, 25 bp, Mus musculus
tgaccccttgttgcctgtagctttg

SEQ ID NO: 848397 - DNA, 25 bp, Mus musculus
tgacccgaacgacagcttttatatg

SEQ ID NO: 848398 - DNA, 25 bp, Mus musculus
tgacccgaacgagagcttttatatg

SEQ ID NO: 848399 - DNA, 25 bp, Mus musculus
tgacccgactcacccttatggaaga

SEQ ID NO: 848400 - DNA, 25 bp, Mus musculus
tgacccgactcagccttatggaaga

SEQ ID NO: 848401 - DNA, 25 bp, Mus musculus
tgacccgagagacacactacgagaa

SEQ ID NO: 848402 - DNA, 25 bp, Mus musculus
tgacccgagagagacactacgagaa

SEQ ID NO: 848403 - DNA, 25 bp, Mus musculus
tgacccgagccgaggtgacaccggt

SEQ ID NO: 848404 - DNA, 25 bp, Mus musculus
tgacccgagccgtggtgacaccggt

SEQ ID NO: 848405 - DNA, 25 bp, Mus musculus
tgacccgatgggactgtgccacctt

SEQ ID NO: 848406 - DNA, 25 bp, Mus musculus
tgacccgatgggtctgtgccacctt

SEQ ID NO: 848407 - DNA, 25 bp, Mus musculus
tgacccgatgtcacttgctggagca

SEQ ID NO: 848408 - DNA, 25 bp, Mus musculus
tgacccgatgtctcttgctggagca

SEQ ID NO: 848409 - DNA, 25 bp, Mus musculus
tgacccgcagctcaaaggtgagctt

SEQ ID NO: 848410 - DNA, 25 bp, Mus musculus
tgacccgcagctccgcgtcatggag

SEQ ID NO: 848411 - DNA, 25 bp, Mus musculus
tgacccgcagctgaaaggtgagctt

SEQ ID NO: 848412 - DNA, 25 bp, Mus musculus
tgacccgcagctgcgcgtcatggag

SEQ ID NO: 848413 - DNA, 25 bp, Mus musculus
tgacccgcatgcctgttcaggaggt

SEQ ID NO: 848414 - DNA, 25 bp, Mus musculus
tgacccgcatgcgtgttcaggaggt

SEQ ID NO: 848415 - DNA, 25 bp, Mus musculus
tgacccgccaggaccatgagggagt

SEQ ID NO: 848416 - DNA, 25 bp, Mus musculus
tgacccgccaggtccatgagggagt

SEQ ID NO: 848417 - DNA, 25 bp, Mus musculus
tgacccgccctccaatagtcaagaa

SEQ ID NO: 848418 - DNA, 25 bp, Mus musculus
tgacccgccctcgaatagtcaagaa

SEQ ID NO: 848419 - DNA, 25 bp, Mus musculus
tgacccggaaatcttcgatgctcca

SEQ ID NO: 848420 - DNA, 25 bp, Mus musculus
tgacccggaaatgttcgatgctcca

SEQ ID NO: 848421 - DNA, 25 bp, Mus musculus
tgacccggaagacctggaaaacctt

SEQ ID NO: 848422 - DNA, 25 bp, Mus musculus
tgacccggaagagctggaaaacctt

SEQ ID NO: 848423 - DNA, 25 bp, Mus musculus
tgacccggacctcggaggaatttga

SEQ ID NO: 848424 - DNA, 25 bp, Mus musculus
tgacccggacctgggaggaatttga

SEQ ID NO: 848425 - DNA, 25 bp, Mus musculus
tgacccggaggcacaataacttctg

SEQ ID NO: 848426 - DNA, 25 bp, Mus musculus
tgacccggaggctcaataacttctg

SEQ ID NO: 848427 - DNA, 25 bp, Mus musculus
tgacccggatctctgatgacctcat

SEQ ID NO: 848428 - DNA, 25 bp, Mus musculus
tgacccggatctgtgatgacctcat

SEQ ID NO: 848429 - DNA, 25 bp, Mus musculus
tgacccggcgctatctgtgggatgc

SEQ ID NO: 848430 - DNA, 25 bp, Mus musculus
tgacccggcgctttctgtgggatgc

SEQ ID NO: 848431 - DNA, 25 bp, Mus musculus
tgacccggcttccaaagccaaagca

SEQ ID NO: 848432 - DNA, 25 bp, Mus musculus
tgacccggcttcgaaagccaaagca

SEQ ID NO: 848433 - DNA, 25 bp, Mus musculus
tgacccgggaatctttcttttcttg

SEQ ID NO: 848434 - DNA, 25 bp, Mus musculus
tgacccgggaatgtttcttttcttg

SEQ ID NO: 848435 - DNA, 25 bp, Mus musculus
tgacccgtaaagaagcacaggaata

SEQ ID NO: 848436 - DNA, 25 bp, Mus musculus
tgacccgtaaagtagcacaggaata

SEQ ID NO: 848437 - DNA, 25 bp, Mus musculus
tgacccgtctgcatttaatgcctat

SEQ ID NO: 848438 - DNA, 25 bp, Mus musculus
tgacccgtctgcttttaatgcctat

SEQ ID NO: 848439 - DNA, 25 bp, Mus musculus
tgacccgtgcggaagacagcgtaac

SEQ ID NO: 848440 - DNA, 25 bp, Mus musculus
tgacccgtgcggtagacagcgtaac

SEQ ID NO: 848441 - DNA, 25 bp, Mus musculus
tgacccgttactccctgtggtatag

SEQ ID NO: 848442 - DNA, 25 bp, Mus musculus
tgacccgttactgcctgtggtatag

SEQ ID NO: 848443 - DNA, 25 bp, Mus musculus
tgacccgtttttagaggtgcgctag

SEQ ID NO: 848444 - DNA, 25 bp, Mus musculus
tgacccgttttttgaggtgcgctag

SEQ ID NO: 848445 - DNA, 25 bp, Mus musculus
tgaccctaagggaatcacatggtag

SEQ ID NO: 848446 - DNA, 25 bp, Mus musculus
tgaccctaagggtatcacatggtag

SEQ ID NO: 848447 - DNA, 25 bp, Mus musculus
tgaccctaatttccccagacttgat

SEQ ID NO: 848448 - DNA, 25 bp, Mus musculus
tgaccctaatttgcccagacttgat

SEQ ID NO: 848449 - DNA, 25 bp, Mus musculus
tgaccctaccaaagtggactgctgg

SEQ ID NO: 848450 - DNA, 25 bp, Mus musculus
tgaccctaccaatgtggactgctgg

SEQ ID NO: 848451 - DNA, 25 bp, Mus musculus
tgaccctactacactaaaaccttca

SEQ ID NO: 848452 - DNA, 25 bp, Mus musculus
tgaccctactactctaaaaccttca

SEQ ID NO: 848453 - DNA, 25 bp, Mus musculus
tgaccctactgtaagtgctggacca

SEQ ID NO: 848454 - DNA, 25 bp, Mus musculus
tgaccctactgttagtgctggacca

SEQ ID NO: 848455 - DNA, 25 bp, Mus musculus
tgaccctactttctcatggagcctg

SEQ ID NO: 848456 - DNA, 25 bp, Mus musculus
tgaccctactttgtcatggagcctg

SEQ ID NO: 848457 - DNA, 25 bp, Mus musculus
tgaccctagcacacacatctagaag

SEQ ID NO: 848458 - DNA, 25 bp, Mus musculus
tgaccctagcactcacatctagaag

SEQ ID NO: 848459 - DNA, 25 bp, Mus musculus
tgaccctatggtcagttcttcttta

SEQ ID NO: 848460 - DNA, 25 bp, Mus musculus
tgaccctatggtgagttcttcttta

SEQ ID NO: 848461 - DNA, 25 bp, Mus musculus
tgaccctatgtgcaatgtccgccat

SEQ ID NO: 848462 - DNA, 25 bp, Mus musculus
tgaccctatgtggaatgtccgccat

SEQ ID NO: 848463 - DNA, 25 bp, Mus musculus
tgaccctattacacagttcttggca

SEQ ID NO: 848464 - DNA, 25 bp, Mus musculus
tgaccctattactcagttcttggca

SEQ ID NO: 848465 - DNA, 25 bp, Mus musculus
tgaccctcaagacatacctgcatac

SEQ ID NO: 848466 - DNA, 25 bp, Mus musculus
tgaccctcaagagatacctgcatac

SEQ ID NO: 848467 - DNA, 25 bp, Mus musculus
tgaccctcacagaccatttaggact

SEQ ID NO: 848468 - DNA, 25 bp, Mus musculus
tgaccctcacagtccatttaggact

SEQ ID NO: 848469 - DNA, 25 bp, Mus musculus
tgaccctcagaaatgagcacttgag

SEQ ID NO: 848470 - DNA, 25 bp, Mus musculus
tgaccctcagaattgagcacttgag

SEQ ID NO: 848471 - DNA, 25 bp, Mus musculus
tgaccctcagagaacactgcacagg

SEQ ID NO: 848472 - DNA, 25 bp, Mus musculus
tgaccctcagagtacactgcacagg

SEQ ID NO: 848473 - DNA, 25 bp, Mus musculus
tgaccctcattcactagcggtgaag

SEQ ID NO: 848474 - DNA, 25 bp, Mus musculus
tgaccctcattcactagcgtgaaga

SEQ ID NO: 848475 - DNA, 25 bp, Mus musculus
tgaccctcattctctagcggtgaag

SEQ ID NO: 848476 - DNA, 25 bp, Mus musculus
tgaccctcattctctagcgtgaaga

SEQ ID NO: 848477 - DNA, 25 bp, Mus musculus
tgaccctccaaaacactcagtattt

SEQ ID NO: 848478 - DNA, 25 bp, Mus musculus
tgaccctccaaatcactcagtattt

SEQ ID NO: 848479 - DNA, 25 bp, Mus musculus
tgaccctccatgattcagctctgat

SEQ ID NO: 848480 - DNA, 25 bp, Mus musculus
tgaccctccatgtttcagctctgat

SEQ ID NO: 848481 - DNA, 25 bp, Mus musculus
tgaccctcccagatgatgcagctag

SEQ ID NO: 848482 - DNA, 25 bp, Mus musculus
tgaccctcccagttgatgcagctag

SEQ ID NO: 848483 - DNA, 25 bp, Mus musculus
tgaccctcctcacaaggcttggttt

SEQ ID NO: 848484 - DNA, 25 bp, Mus musculus
tgaccctcctcagaaggcttggttt

SEQ ID NO: 848485 - DNA, 25 bp, Mus musculus
tgaccctcctgtactgtctgttgag

SEQ ID NO: 848486 - DNA, 25 bp, Mus musculus
tgaccctcctgttctgtctgttgag

SEQ ID NO: 848487 - DNA, 25 bp, Mus musculus
tgaccctcgtgacccgtaaagatat

SEQ ID NO: 848488 - DNA, 25 bp, Mus musculus
tgaccctcgtgagccgtaaagatat

SEQ ID NO: 848489 - DNA, 25 bp, Mus musculus
tgaccctctgctctcttggaacatg

SEQ ID NO: 848490 - DNA, 25 bp, Mus musculus
tgaccctctgctgtcttggaacatg

SEQ ID NO: 848491 - DNA, 25 bp, Mus musculus
tgaccctctgtcaccctagatcggt

SEQ ID NO: 848492 - DNA, 25 bp, Mus musculus
tgaccctctgtctccctagatcggt

SEQ ID NO: 848493 - DNA, 25 bp, Mus musculus
tgaccctctgtgagactaaagccct

SEQ ID NO: 848494 - DNA, 25 bp, Mus musculus
tgaccctctgtgtgactaaagccct

SEQ ID NO: 848495 - DNA, 25 bp, Mus musculus
tgaccctgacaaaacgtttctacct

SEQ ID NO: 848496 - DNA, 25 bp, Mus musculus
tgaccctgacaatacgtttctacct

SEQ ID NO: 848497 - DNA, 25 bp, Mus musculus
tgaccctgaccaagacccgagcagg

SEQ ID NO: 848498 - DNA, 25 bp, Mus musculus
tgaccctgaccacacataatttgat

SEQ ID NO: 848499 - DNA, 25 bp, Mus musculus
tgaccctgaccagacataatttgat

SEQ ID NO: 848500 - DNA, 25 bp, Mus musculus
tgaccctgaccatgacccgagcagg

SEQ ID NO: 848501 - DNA, 25 bp, Mus musculus
tgaccctgacgaagagccagaggca

SEQ ID NO: 848502 - DNA, 25 bp, Mus musculus
tgaccctgacgatgagccagaggca

SEQ ID NO: 848503 - DNA, 25 bp, Mus musculus
tgaccctgaggcatgactctactgt

SEQ ID NO: 848504 - DNA, 25 bp, Mus musculus
tgaccctgaggcttgactctactgt

SEQ ID NO: 848505 - DNA, 25 bp, Mus musculus
tgaccctgatcaatgtgtactgccc

SEQ ID NO: 848506 - DNA, 25 bp, Mus musculus
tgaccctgatcattgtgtactgccc

SEQ ID NO: 848507 - DNA, 25 bp, Mus musculus
tgaccctgatggaggaggtgctcct

SEQ ID NO: 848508 - DNA, 25 bp, Mus musculus
tgaccctgatggtggaggtgctcct

SEQ ID NO: 848509 - DNA, 25 bp, Mus musculus
tgaccctgcagtctgactaattaga

SEQ ID NO: 848510 - DNA, 25 bp, Mus musculus
tgaccctgcagtgtgactaattaga

SEQ ID NO: 848511 - DNA, 25 bp, Mus musculus
tgaccctgccacaaatggacctgta

SEQ ID NO: 848512 - DNA, 25 bp, Mus musculus
tgaccctgccactaatggacctgta

SEQ ID NO: 848513 - DNA, 25 bp, Mus musculus
tgaccctgcccgagtgggtgagaac

SEQ ID NO: 848514 - DNA, 25 bp, Mus musculus
tgaccctgcccgtgtgggtgagaac

SEQ ID NO: 848515 - DNA, 25 bp, Mus musculus
tgaccctgcctaatgtatctgctag

SEQ ID NO: 848516 - DNA, 25 bp, Mus musculus
tgaccctgcctattgtatctgctag

SEQ ID NO: 848517 - DNA, 25 bp, Mus musculus
tgaccctgcgatagtatggaccttt

SEQ ID NO: 848518 - DNA, 25 bp, Mus musculus
tgaccctgcgattgtatggaccttt

SEQ ID NO: 848519 - DNA, 25 bp, Mus musculus
tgaccctgctcaataacatctttct

SEQ ID NO: 848520 - DNA, 25 bp, Mus musculus
tgaccctgctcacttgatatctctg

SEQ ID NO: 848521 - DNA, 25 bp, Mus musculus
tgaccctgctcagttgatatctctg

SEQ ID NO: 848522 - DNA, 25 bp, Mus musculus
tgaccctgctcattaacatctttct

SEQ ID NO: 848523 - DNA, 25 bp, Mus musculus
tgaccctgctgacccgtgaacggaa

SEQ ID NO: 848524 - DNA, 25 bp, Mus musculus
tgaccctgctgagccgtgaacggaa

SEQ ID NO: 848525 - DNA, 25 bp, Mus musculus
tgaccctgctttaatatcccgagtg

SEQ ID NO: 848526 - DNA, 25 bp, Mus musculus
tgaccctgcttttatatcccgagtg

SEQ ID NO: 848527 - DNA, 25 bp, Mus musculus
tgaccctggaccaaaacgtatctgg

SEQ ID NO: 848528 - DNA, 25 bp, Mus musculus
tgaccctggacctaaacgtatctgg

SEQ ID NO: 848529 - DNA, 25 bp, Mus musculus
tgaccctggactcgaattgctctca

SEQ ID NO: 848530 - DNA, 25 bp, Mus musculus
tgaccctggactggaattgctctca

SEQ ID NO: 848531 - DNA, 25 bp, Mus musculus
tgaccctgggaacctacctacttgt

SEQ ID NO: 848532 - DNA, 25 bp, Mus musculus
tgaccctgggaagctacctacttgt

SEQ ID NO: 848533 - DNA, 25 bp, Mus musculus
tgaccctgggctactcagatgacac

SEQ ID NO: 848534 - DNA, 25 bp, Mus musculus
tgaccctgggcttctcagatgacac

SEQ ID NO: 848535 - DNA, 25 bp, Mus musculus
tgaccctggggtacagcactctcac

SEQ ID NO: 848536 - DNA, 25 bp, Mus musculus
tgaccctggggttcagcactctcac

SEQ ID NO: 848537 - DNA, 25 bp, Mus musculus
tgaccctggtgtacagattactgtc

SEQ ID NO: 848538 - DNA, 25 bp, Mus musculus
tgaccctggtgtcactaagcatcag

SEQ ID NO: 848539 - DNA, 25 bp, Mus musculus
tgaccctggtgtgactaagcatcag

SEQ ID NO: 848540 - DNA, 25 bp, Mus musculus
tgaccctggtgttcagattactgtc

SEQ ID NO: 848541 - DNA, 25 bp, Mus musculus
tgaccctgtaccctacgtgtaacag

SEQ ID NO: 848542 - DNA, 25 bp, Mus musculus
tgaccctgtaccgtacgtgtaacag

SEQ ID NO: 848543 - DNA, 25 bp, Mus musculus
tgaccctgtataatagtttgactat

SEQ ID NO: 848544 - DNA, 25 bp, Mus musculus
tgaccctgtatattagtttgactat

SEQ ID NO: 848545 - DNA, 25 bp, Mus musculus
tgaccctgtgaaatcctcctttgtc

SEQ ID NO: 848546 - DNA, 25 bp, Mus musculus
tgaccctgtgaacgtacatatatgg

SEQ ID NO: 848547 - DNA, 25 bp, Mus musculus
tgaccctgtgaaggtacatatatgg

SEQ ID NO: 848548 - DNA, 25 bp, Mus musculus
tgaccctgtgaattcctcctttgtc

SEQ ID NO: 848549 - DNA, 25 bp, Mus musculus
tgaccctgtgatacaactgccagct

SEQ ID NO: 848550 - DNA, 25 bp, Mus musculus
tgaccctgtgattcaactgccagct

SEQ ID NO: 848551 - DNA, 25 bp, Mus musculus
tgaccctgtgctcgagatgtcctgt

SEQ ID NO: 848552 - DNA, 25 bp, Mus musculus
tgaccctgtgctggagatgtcctgt

SEQ ID NO: 848553 - DNA, 25 bp, Mus musculus
tgaccctgtggtcgaagagcacttc

SEQ ID NO: 848554 - DNA, 25 bp, Mus musculus
tgaccctgtggtggaagagcacttc

SEQ ID NO: 848555 - DNA, 25 bp, Mus musculus
tgaccctgtgtgatgtgacccatac

SEQ ID NO: 848556 - DNA, 25 bp, Mus musculus
tgaccctgtgtgttgtgacccatac

SEQ ID NO: 848557 - DNA, 25 bp, Mus musculus
tgaccctgttttctcagcctttgta

SEQ ID NO: 848558 - DNA, 25 bp, Mus musculus
tgaccctgttttgtcagcctttgta

SEQ ID NO: 848559 - DNA, 25 bp, Mus musculus
tgacccttaattaggaaactggcca

SEQ ID NO: 848560 - DNA, 25 bp, Mus musculus
tgacccttaatttggaaactggcca

SEQ ID NO: 848561 - DNA, 25 bp, Mus musculus
tgacccttacttccagttcctgaga

SEQ ID NO: 848562 - DNA, 25 bp, Mus musculus
tgacccttacttgcagttcctgaga

SEQ ID NO: 848563 - DNA, 25 bp, Mus musculus
tgacccttaggaagtgacccgcatg

SEQ ID NO: 848564 - DNA, 25 bp, Mus musculus
tgacccttaggatgtgacccgcatg

SEQ ID NO: 848565 - DNA, 25 bp, Mus musculus
tgacccttaggtctttgcttgtgga

SEQ ID NO: 848566 - DNA, 25 bp, Mus musculus
tgacccttaggtgtttgcttgtgga

SEQ ID NO: 848567 - DNA, 25 bp, Mus musculus
tgacccttatgaccagtcctttgaa

SEQ ID NO: 848568 - DNA, 25 bp, Mus musculus
tgacccttatgagcagtcctttgaa

SEQ ID NO: 848569 - DNA, 25 bp, Mus musculus
tgacccttcttcattgctctatctg

SEQ ID NO: 848570 - DNA, 25 bp, Mus musculus
tgacccttcttctttgctctatctg

SEQ ID NO: 848571 - DNA, 25 bp, Mus musculus
tgacccttgagcatggttctttaag

SEQ ID NO: 848572 - DNA, 25 bp, Mus musculus
tgacccttgagcttggttctttaag

SEQ ID NO: 848573 - DNA, 25 bp, Mus musculus
tgacccttgggaagataacactgaa

SEQ ID NO: 848574 - DNA, 25 bp, Mus musculus
tgacccttgggatgataacactgaa

SEQ ID NO: 848575 - DNA, 25 bp, Mus musculus
tgacccttgggtatataatccactt

SEQ ID NO: 848576 - DNA, 25 bp, Mus musculus
tgacccttgggtttataatccactt

SEQ ID NO: 848577 - DNA, 25 bp, Mus musculus
tgacccttgtgacccatgtgagtag

SEQ ID NO: 848578 - DNA, 25 bp, Mus musculus
tgacccttgtgagccatgtgagtag

SEQ ID NO: 848579 - DNA, 25 bp, Mus musculus
tgacccttgttacaagtcattcaag

SEQ ID NO: 848580 - DNA, 25 bp, Mus musculus
tgacccttgttagaagtcattcaag

SEQ ID NO: 848581 - DNA, 25 bp, Mus musculus
tgaccctttccgcaaatgagcagtg

SEQ ID NO: 848582 - DNA, 25 bp, Mus musculus
tgaccctttccggaaatgagcagtg

SEQ ID NO: 848583 - DNA, 25 bp, Mus musculus
tgaccctttcgtcccatgacgagaa

SEQ ID NO: 848584 - DNA, 25 bp, Mus musculus
tgaccctttcgtgccatgacgagaa

SEQ ID NO: 848585 - DNA, 25 bp, Mus musculus
tgaccctttgatcgtctgtcacttg

SEQ ID NO: 848586 - DNA, 25 bp, Mus musculus
tgaccctttgatggtctgtcacttg

SEQ ID NO: 848587 - DNA, 25 bp, Mus musculus
tgacccttttctaacagccatttgc

SEQ ID NO: 848588 - DNA, 25 bp, Mus musculus
tgacccttttcttacagccatttgc

SEQ ID NO: 848589 - DNA, 25 bp, Mus musculus
tgaccgaaatgacggccggagacat

SEQ ID NO: 848590 - DNA, 25 bp, Mus musculus
tgaccgaaatgagggccggagacat

SEQ ID NO: 848591 - DNA, 25 bp, Mus musculus
tgaccgaacacgaaatgctgagatt

SEQ ID NO: 848592 - DNA, 25 bp, Mus musculus
tgaccgaacacgtaatgctgagatt

SEQ ID NO: 848593 - DNA, 25 bp, Mus musculus
tgaccgaagggcagacaagccatgg

SEQ ID NO: 848594 - DNA, 25 bp, Mus musculus
tgaccgaagggctgacaagccatgg

SEQ ID NO: 848595 - DNA, 25 bp, Mus musculus
tgaccgacttcgaacaatgaccaat

SEQ ID NO: 848596 - DNA, 25 bp, Mus musculus
tgaccgacttcgtacaatgaccaat

SEQ ID NO: 848597 - DNA, 25 bp, Mus musculus
tgaccgagaagaccggcgtccttca

SEQ ID NO: 848598 - DNA, 25 bp, Mus musculus
tgaccgagaagagcggcgtccttca

SEQ ID NO: 848599 - DNA, 25 bp, Mus musculus
tgaccgaggacccagatcttcaggt

SEQ ID NO: 848600 - DNA, 25 bp, Mus musculus
tgaccgaggaccgagatcttcaggt

SEQ ID NO: 848601 - DNA, 25 bp, Mus musculus
tgaccgagtaacagctttccatttc

SEQ ID NO: 848602 - DNA, 25 bp, Mus musculus
tgaccgagtaactgctttccatttc

SEQ ID NO: 848603 - DNA, 25 bp, Mus musculus
tgaccgagtcaaccagtacacctga

SEQ ID NO: 848604 - DNA, 25 bp, Mus musculus
tgaccgagtcaagcagtacacctga

SEQ ID NO: 848605 - DNA, 25 bp, Mus musculus
tgaccgagtcccagcaggcgtgtaa

SEQ ID NO: 848606 - DNA, 25 bp, Mus musculus
tgaccgagtccctgcaggcgtgtaa

SEQ ID NO: 848607 - DNA, 25 bp, Mus musculus
tgaccgagtgttacctcagccccag

SEQ ID NO: 848608 - DNA, 25 bp, Mus musculus
tgaccgagtgtttcctcagccccag

SEQ ID NO: 848609 - DNA, 25 bp, Mus musculus
tgaccgagttgtactctcaggagag

SEQ ID NO: 848610 - DNA, 25 bp, Mus musculus
tgaccgagttgttctctcaggagag

SEQ ID NO: 848611 - DNA, 25 bp, Mus musculus
tgaccgatctgtataaaactttagg

SEQ ID NO: 848612 - DNA, 25 bp, Mus musculus
tgaccgatctgtttaaaactttagg

SEQ ID NO: 848613 - DNA, 25 bp, Mus musculus
tgaccgatgattctagaccttgctt

SEQ ID NO: 848614 - DNA, 25 bp, Mus musculus
tgaccgatgattgtagaccttgctt

SEQ ID NO: 848615 - DNA, 25 bp, Mus musculus
tgaccgattcctcggcttcttcatg

SEQ ID NO: 848616 - DNA, 25 bp, Mus musculus
tgaccgattcctgggcttcttcatg

SEQ ID NO: 848617 - DNA, 25 bp, Mus musculus
tgaccgcaagttcggctttgctgac

SEQ ID NO: 848618 - DNA, 25 bp, Mus musculus
tgaccgcaagttgggctttgctgac

SEQ ID NO: 848619 - DNA, 25 bp, Mus musculus
tgaccgcagacccaggttagtttag

SEQ ID NO: 848620 - DNA, 25 bp, Mus musculus
tgaccgcagaccgaggttagtttag

SEQ ID NO: 848621 - DNA, 25 bp, Mus musculus
tgaccgcagcagaacttattaacca

SEQ ID NO: 848622 - DNA, 25 bp, Mus musculus
tgaccgcagcagtacttattaacca

SEQ ID NO: 848623 - DNA, 25 bp, Mus musculus
tgaccgcagggaaatcaggcgcaat

SEQ ID NO: 848624 - DNA, 25 bp, Mus musculus
tgaccgcagggatatcaggcgcaat

SEQ ID NO: 848625 - DNA, 25 bp, Mus musculus
tgaccgcatagcagaaggcacattt

SEQ ID NO: 848626 - DNA, 25 bp, Mus musculus
tgaccgcatagctgaaggcacattt

SEQ ID NO: 848627 - DNA, 25 bp, Mus musculus
tgaccgccatttaatcaagtgcctc

SEQ ID NO: 848628 - DNA, 25 bp, Mus musculus
tgaccgccattttatcaagtgcctc

SEQ ID NO: 848629 - DNA, 25 bp, Mus musculus
tgaccgcccacaacctgggaaattg

SEQ ID NO: 848630 - DNA, 25 bp, Mus musculus
tgaccgcccacatcctgggaaattg

SEQ ID NO: 848631 - DNA, 25 bp, Mus musculus
tgaccgcccagtatggagccacaga

SEQ ID NO: 848632 - DNA, 25 bp, Mus musculus
tgaccgcccagtttggagccacaga

SEQ ID NO: 848633 - DNA, 25 bp, Mus musculus
tgaccgccctggacagcatttctaa

SEQ ID NO: 848634 - DNA, 25 bp, Mus musculus
tgaccgccctggtcagcatttctaa

SEQ ID NO: 848635 - DNA, 25 bp, Mus musculus
tgaccgccgtccacaggagatctgg

SEQ ID NO: 848636 - DNA, 25 bp, Mus musculus
tgaccgccgtcctcaggagatctgg

SEQ ID NO: 848637 - DNA, 25 bp, Mus musculus
tgaccgcctcatcagtctgcaaagc

SEQ ID NO: 848638 - DNA, 25 bp, Mus musculus
tgaccgcctcatgagtctgcaaagc

SEQ ID NO: 848639 - DNA, 25 bp, Mus musculus
tgaccgcctggtacgtaaacaccat

SEQ ID NO: 848640 - DNA, 25 bp, Mus musculus
tgaccgcctggttcgtaaacaccat

SEQ ID NO: 848641 - DNA, 25 bp, Mus musculus
tgaccgcgaccgccatggtacctgg

SEQ ID NO: 848642 - DNA, 25 bp, Mus musculus
tgaccgcgaccggcatggtacctgg

SEQ ID NO: 848643 - DNA, 25 bp, Mus musculus
tgaccgcggcatccagcaagcaaag

SEQ ID NO: 848644 - DNA, 25 bp, Mus musculus
tgaccgcggcatgcagcaagcaaag

SEQ ID NO: 848645 - DNA, 25 bp, Mus musculus
tgaccgctacatcgcgatctgtgat

SEQ ID NO: 848646 - DNA, 25 bp, Mus musculus
tgaccgctacatggcgatctgtgat

SEQ ID NO: 848647 - DNA, 25 bp, Mus musculus
tgaccgctccatctgtaaacctaac

SEQ ID NO: 848648 - DNA, 25 bp, Mus musculus
tgaccgctccatgtgtaaacctaac

SEQ ID NO: 848649 - DNA, 25 bp, Mus musculus
tgaccgctgaggacgatgcccagat

SEQ ID NO: 848650 - DNA, 25 bp, Mus musculus
tgaccgctgaggtcgatgcccagat

SEQ ID NO: 848651 - DNA, 25 bp, Mus musculus
tgaccgctggaacggcatgaaccga

SEQ ID NO: 848652 - DNA, 25 bp, Mus musculus
tgaccgctggaagggcatgaaccga

SEQ ID NO: 848653 - DNA, 25 bp, Mus musculus
tgaccgctggacattccatagcaca

SEQ ID NO: 848654 - DNA, 25 bp, Mus musculus
tgaccgctggactttccatagcaca

SEQ ID NO: 848655 - DNA, 25 bp, Mus musculus
tgaccgctgtgtcgaagccttcgtg

SEQ ID NO: 848656 - DNA, 25 bp, Mus musculus
tgaccgctgtgtggaagccttcgtg

SEQ ID NO: 848657 - DNA, 25 bp, Mus musculus
tgaccgcttggacttgctagcttac

SEQ ID NO: 848658 - DNA, 25 bp, Mus musculus
tgaccgcttggagttgctagcttac

SEQ ID NO: 848659 - DNA, 25 bp, Mus musculus
tgaccggaacccactgcaaaaacag

SEQ ID NO: 848660 - DNA, 25 bp, Mus musculus
tgaccggaaccctctgcaaaaacag

SEQ ID NO: 848661 - DNA, 25 bp, Mus musculus
tgaccggaagaacgttgtttcctgg

SEQ ID NO: 848662 - DNA, 25 bp, Mus musculus
tgaccggaagaaggttgtttcctgg

SEQ ID NO: 848663 - DNA, 25 bp, Mus musculus
tgaccggcaagcaggcgcgccagaa

SEQ ID NO: 848664 - DNA, 25 bp, Mus musculus
tgaccggcaagctggcgcgccagaa

SEQ ID NO: 848665 - DNA, 25 bp, Mus musculus
tgaccggcaggcaacattttgtgat

SEQ ID NO: 848666 - DNA, 25 bp, Mus musculus
tgaccggcaggctacattttgtgat

SEQ ID NO: 848667 - DNA, 25 bp, Mus musculus
tgaccggccctgaagcgtttgaagg

SEQ ID NO: 848668 - DNA, 25 bp, Mus musculus
tgaccggccctgtagcgtttgaagg

SEQ ID NO: 848669 - DNA, 25 bp, Mus musculus
tgaccggcgtaaccctcatgaagta

SEQ ID NO: 848670 - DNA, 25 bp, Mus musculus
tgaccggcgtaagcctcatgaagta

SEQ ID NO: 848671 - DNA, 25 bp, Mus musculus
tgaccggcgtgtacgcgcaactgca

SEQ ID NO: 848672 - DNA, 25 bp, Mus musculus
tgaccggcgtgttcgcgcaactgca

SEQ ID NO: 848673 - DNA, 25 bp, Mus musculus
tgaccggctaacacggctgtgggcc

SEQ ID NO: 848674 - DNA, 25 bp, Mus musculus
tgaccggctaactcggctgtgggcc

SEQ ID NO: 848675 - DNA, 25 bp, Mus musculus
tgaccggctacacaagtgtccttgt

SEQ ID NO: 848676 - DNA, 25 bp, Mus musculus
tgaccggctacagaagtgtccttgt

SEQ ID NO: 848677 - DNA, 25 bp, Mus musculus
tgaccgggacacatgtaatctgaac

SEQ ID NO: 848678 - DNA, 25 bp, Mus musculus
tgaccgggacacttgtaatctgaac

SEQ ID NO: 848679 - DNA, 25 bp, Mus musculus
tgaccgggtcaaagcacagctcgaa

SEQ ID NO: 848680 - DNA, 25 bp, Mus musculus
tgaccgggtcaatgcacagctcgaa

SEQ ID NO: 848681 - DNA, 25 bp, Mus musculus
tgaccgggtctcaagcgcctattgg

SEQ ID NO: 848682 - DNA, 25 bp, Mus musculus
tgaccgggtctctagcgcctattgg

SEQ ID NO: 848683 - DNA, 25 bp, Mus musculus
tgaccgggttggctttctctttgga

SEQ ID NO: 848684 - DNA, 25 bp, Mus musculus
tgaccgggttgggtttctctttgga

SEQ ID NO: 848685 - DNA, 25 bp, Mus musculus
tgaccggtacggcacactcgaggct

SEQ ID NO: 848686 - DNA, 25 bp, Mus musculus
tgaccggtacgggacactcgaggct

SEQ ID NO: 848687 - DNA, 25 bp, Mus musculus
tgaccggtagagatgtggagaacac

SEQ ID NO: 848688 - DNA, 25 bp, Mus musculus
tgaccggtagagttgtggagaacac

SEQ ID NO: 848689 - DNA, 25 bp, Mus musculus
tgaccggtattacaacaagtacatc

SEQ ID NO: 848690 - DNA, 25 bp, Mus musculus
tgaccggtattagaacaagtacatc

SEQ ID NO: 848691 - DNA, 25 bp, Mus musculus
tgaccggtctggcagtgtacatata

SEQ ID NO: 848692 - DNA, 25 bp, Mus musculus
tgaccggtctgggagtgtacatata

SEQ ID NO: 848693 - DNA, 25 bp, Mus musculus
tgaccgtaactgcaggcctgcggct

SEQ ID NO: 848694 - DNA, 25 bp, Mus musculus
tgaccgtaactggaggcctgcggct

SEQ ID NO: 848695 - DNA, 25 bp, Mus musculus
tgaccgtatgacatatgggacacta

SEQ ID NO: 848696 - DNA, 25 bp, Mus musculus
tgaccgtatgacttatgggacacta

SEQ ID NO: 848697 - DNA, 25 bp, Mus musculus
tgaccgtatgcactgatggatccct

SEQ ID NO: 848698 - DNA, 25 bp, Mus musculus
tgaccgtatgcagtgatggatccct

SEQ ID NO: 848699 - DNA, 25 bp, Mus musculus
tgaccgtatggcagtcgataaaacc

SEQ ID NO: 848700 - DNA, 25 bp, Mus musculus
tgaccgtatggctgtcgataaaacc

SEQ ID NO: 848701 - DNA, 25 bp, Mus musculus
tgaccgtcctccctgcagataggat

SEQ ID NO: 848702 - DNA, 25 bp, Mus musculus
tgaccgtcctccgtgcagataggat

SEQ ID NO: 848703 - DNA, 25 bp, Mus musculus
tgaccgtcctgcatgataacctgca

SEQ ID NO: 848704 - DNA, 25 bp, Mus musculus
tgaccgtcctgcttgataacctgca

SEQ ID NO: 848705 - DNA, 25 bp, Mus musculus
tgaccgtctttgaaagcgacaaatg

SEQ ID NO: 848706 - DNA, 25 bp, Mus musculus
tgaccgtctttgtaagcgacaaatg

SEQ ID NO: 848707 - DNA, 25 bp, Mus musculus
tgaccgtgaaagaagaaccaagatt

SEQ ID NO: 848708 - DNA, 25 bp, Mus musculus
tgaccgtgaaagtagaaccaagatt

SEQ ID NO: 848709 - DNA, 25 bp, Mus musculus
tgaccgtgaccaccttgagcagttt

SEQ ID NO: 848710 - DNA, 25 bp, Mus musculus
tgaccgtgaccagcttgagcagttt

SEQ ID NO: 848711 - DNA, 25 bp, Mus musculus
tgaccgtgcctacaatagctgctac

SEQ ID NO: 848712 - DNA, 25 bp, Mus musculus
tgaccgtgcctagaatagctgctac

SEQ ID NO: 848713 - DNA, 25 bp, Mus musculus
tgaccgtgggctccgtctaggacct

SEQ ID NO: 848714 - DNA, 25 bp, Mus musculus
tgaccgtgggctgcgtctaggacct

SEQ ID NO: 848715 - DNA, 25 bp, Mus musculus
tgaccgtggtgacccttcaggagtc

SEQ ID NO: 848716 - DNA, 25 bp, Mus musculus
tgaccgtggtgagccttcaggagtc

SEQ ID NO: 848717 - DNA, 25 bp, Mus musculus
tgaccgtggtgtactgggcctctga

SEQ ID NO: 848718 - DNA, 25 bp, Mus musculus
tgaccgtggtgttctgggcctctga

SEQ ID NO: 848719 - DNA, 25 bp, Mus musculus
tgaccgtggtttccttggtgccaga

SEQ ID NO: 848720 - DNA, 25 bp, Mus musculus
tgaccgtggtttgcttggtgccaga

SEQ ID NO: 848721 - DNA, 25 bp, Mus musculus
tgaccgtgtctgcaagtcaagcccc

SEQ ID NO: 848722 - DNA, 25 bp, Mus musculus
tgaccgtgtctggaagtcaagcccc

SEQ ID NO: 848723 - DNA, 25 bp, Mus musculus
tgaccgttcagcacacattcagaat

SEQ ID NO: 848724 - DNA, 25 bp, Mus musculus
tgaccgttcagctcacattcagaat

SEQ ID NO: 848725 - DNA, 25 bp, Mus musculus
tgaccgttccggagtagctgctctg

SEQ ID NO: 848726 - DNA, 25 bp, Mus musculus
tgaccgttccggtgtagctgctctg

SEQ ID NO: 848727 - DNA, 25 bp, Mus musculus
tgaccgttctaaagacatcatgcta

SEQ ID NO: 848728 - DNA, 25 bp, Mus musculus
tgaccgttctaatgacatcatgcta

SEQ ID NO: 848729 - DNA, 25 bp, Mus musculus
tgaccgtttccacacttacgttaag

SEQ ID NO: 848730 - DNA, 25 bp, Mus musculus
tgaccgtttccagacttacgttaag

SEQ ID NO: 848731 - DNA, 25 bp, Mus musculus
tgaccgtttcgaagttgataagaag

SEQ ID NO: 848732 - DNA, 25 bp, Mus musculus
tgaccgtttcgatgttgataagaag

SEQ ID NO: 848733 - DNA, 25 bp, Mus musculus
tgaccgttttgtctgaattcccaac

SEQ ID NO: 848734 - DNA, 25 bp, Mus musculus
tgaccgttttgtgtgaattcccaac

SEQ ID NO: 848735 - DNA, 25 bp, Mus musculus
tgaccgtttttcacctaaactctgt

SEQ ID NO: 848736 - DNA, 25 bp, Mus musculus
tgaccgtttttctcctaaactctgt

SEQ ID NO: 848737 - DNA, 25 bp, Mus musculus
tgacctaaacatccatgtaccacac

SEQ ID NO: 848738 - DNA, 25 bp, Mus musculus
tgacctaaacatgcatgtaccacac

SEQ ID NO: 848739 - DNA, 25 bp, Mus musculus
tgacctaaagtgataatgatcctct

SEQ ID NO: 848740 - DNA, 25 bp, Mus musculus
tgacctaaagtgcactggtgctaca

SEQ ID NO: 848741 - DNA, 25 bp, Mus musculus
tgacctaaagtggactggtgctaca

SEQ ID NO: 848742 - DNA, 25 bp, Mus musculus
tgacctaaagtgttaatgatcctct

SEQ ID NO: 848743 - DNA, 25 bp, Mus musculus
tgacctaaatatcagaccctgtatg

SEQ ID NO: 848744 - DNA, 25 bp, Mus musculus
tgacctaaatatgagaccctgtatg

SEQ ID NO: 848745 - DNA, 25 bp, Mus musculus
tgacctaactctagggttcccagat

SEQ ID NO: 848746 - DNA, 25 bp, Mus musculus
tgacctaactcttgggttcccagat

SEQ ID NO: 848747 - DNA, 25 bp, Mus musculus
tgacctaacttcactctaaacctag

SEQ ID NO: 848748 - DNA, 25 bp, Mus musculus
tgacctaacttctctctaaacctag

SEQ ID NO: 848749 - DNA, 25 bp, Mus musculus
tgacctaatcagctcttactggacc

SEQ ID NO: 848750 - DNA, 25 bp, Mus musculus
tgacctaatcaggtcttactggacc

SEQ ID NO: 848751 - DNA, 25 bp, Mus musculus
tgacctaatccactgttgcgtctta

SEQ ID NO: 848752 - DNA, 25 bp, Mus musculus
tgacctaatccagtgttgcgtctta

SEQ ID NO: 848753 - DNA, 25 bp, Mus musculus
tgacctacaagcaaggaacatttct

SEQ ID NO: 848754 - DNA, 25 bp, Mus musculus
tgacctacaagctaggaacatttct

SEQ ID NO: 848755 - DNA, 25 bp, Mus musculus
tgacctacaatgagaaaccctttct

SEQ ID NO: 848756 - DNA, 25 bp, Mus musculus
tgacctacaatgtgaaaccctttct

SEQ ID NO: 848757 - DNA, 25 bp, Mus musculus
tgacctacagataccggaaccagaa

SEQ ID NO: 848758 - DNA, 25 bp, Mus musculus
tgacctacagattccggaaccagaa

SEQ ID NO: 848759 - DNA, 25 bp, Mus musculus
tgacctaccagaagatggcgcgcgc

SEQ ID NO: 848760 - DNA, 25 bp, Mus musculus
tgacctaccagatgatggcgcgcgc

SEQ ID NO: 848761 - DNA, 25 bp, Mus musculus
tgacctaccaggaccagcaaaacct

SEQ ID NO: 848762 - DNA, 25 bp, Mus musculus
tgacctaccaggtccagcaaaacct

SEQ ID NO: 848763 - DNA, 25 bp, Mus musculus
tgacctacccacacattttgatttt

SEQ ID NO: 848764 - DNA, 25 bp, Mus musculus
tgacctacccactcattttgatttt

SEQ ID NO: 848765 - DNA, 25 bp, Mus musculus
tgacctacctctcgcttcttggttt

SEQ ID NO: 848766 - DNA, 25 bp, Mus musculus
tgacctacctctggcttcttggttt

SEQ ID NO: 848767 - DNA, 25 bp, Mus musculus
tgacctacgtagactatgtactgag

SEQ ID NO: 848768 - DNA, 25 bp, Mus musculus
tgacctacgtagtctatgtactgag

SEQ ID NO: 848769 - DNA, 25 bp, Mus musculus
tgacctactggcacatttcaatagt

SEQ ID NO: 848770 - DNA, 25 bp, Mus musculus
tgacctactggcatacggtgccaaa

SEQ ID NO: 848771 - DNA, 25 bp, Mus musculus
tgacctactggctcatttcaatagt

SEQ ID NO: 848772 - DNA, 25 bp, Mus musculus
tgacctactggcttacggtgccaaa

SEQ ID NO: 848773 - DNA, 25 bp, Mus musculus
tgacctactgtccagggcttgatag

SEQ ID NO: 848774 - DNA, 25 bp, Mus musculus
tgacctactgtcgagggcttgatag

SEQ ID NO: 848775 - DNA, 25 bp, Mus musculus
tgacctagaaaactcatcccgcatt

SEQ ID NO: 848776 - DNA, 25 bp, Mus musculus
tgacctagaaaagtcatcccgcatt

SEQ ID NO: 848777 - DNA, 25 bp, Mus musculus
tgacctagagaacccatgttcctgc

SEQ ID NO: 848778 - DNA, 25 bp, Mus musculus
tgacctagagaagccatgttcctgc

SEQ ID NO: 848779 - DNA, 25 bp, Mus musculus
tgacctagagggatcttagccagca

SEQ ID NO: 848780 - DNA, 25 bp, Mus musculus
tgacctagagggttcttagccagca

SEQ ID NO: 848781 - DNA, 25 bp, Mus musculus
tgacctagcgacatcacttggcatt

SEQ ID NO: 848782 - DNA, 25 bp, Mus musculus
tgacctagcgacttcacttggcatt

SEQ ID NO: 848783 - DNA, 25 bp, Mus musculus
tgacctaggagcacttgtgtgccct

SEQ ID NO: 848784 - DNA, 25 bp, Mus musculus
tgacctaggagctcttgtgtgccct

SEQ ID NO: 848785 - DNA, 25 bp, Mus musculus
tgacctagggatatgaacacgaagc

SEQ ID NO: 848786 - DNA, 25 bp, Mus musculus
tgacctagggatttgaacacgaagc

SEQ ID NO: 848787 - DNA, 25 bp, Mus musculus
tgacctaggtcactctgtactctct

SEQ ID NO: 848788 - DNA, 25 bp, Mus musculus
tgacctaggtcagtctgtactctct

SEQ ID NO: 848789 - DNA, 25 bp, Mus musculus
tgacctagtaatatctgagacccgt

SEQ ID NO: 848790 - DNA, 25 bp, Mus musculus
tgacctagtaatttctgagacccgt

SEQ ID NO: 848791 - DNA, 25 bp, Mus musculus
tgacctagtcttatgcaaattttct

SEQ ID NO: 848792 - DNA, 25 bp, Mus musculus
tgacctagtcttttgcaaattttct

SEQ ID NO: 848793 - DNA, 25 bp, Mus musculus
tgacctagtgtaaagatggccagat

SEQ ID NO: 848794 - DNA, 25 bp, Mus musculus
tgacctagtgtatagatggccagat

SEQ ID NO: 848795 - DNA, 25 bp, Mus musculus
tgacctagtgtgagcttttcggctg

SEQ ID NO: 848796 - DNA, 25 bp, Mus musculus
tgacctagtgtgtgcttttcggctg

SEQ ID NO: 848797 - DNA, 25 bp, Mus musculus
tgacctataaccaagccagggcctt

SEQ ID NO: 848798 - DNA, 25 bp, Mus musculus
tgacctataaccattcactatgccc

SEQ ID NO: 848799 - DNA, 25 bp, Mus musculus
tgacctataacctagccagggcctt

SEQ ID NO: 848800 - DNA, 25 bp, Mus musculus
tgacctataacctttcactatgccc

SEQ ID NO: 848801 - DNA, 25 bp, Mus musculus
tgacctatccatacagcagacatct

SEQ ID NO: 848802 - DNA, 25 bp, Mus musculus
tgacctatccattcagcagacatct

SEQ ID NO: 848803 - DNA, 25 bp, Mus musculus
tgacctatcgctacccaccgaagtt

SEQ ID NO: 848804 - DNA, 25 bp, Mus musculus
tgacctatcgcttcccaccgaagtt

SEQ ID NO: 848805 - DNA, 25 bp, Mus musculus
tgacctatctccctgttcgatacag

SEQ ID NO: 848806 - DNA, 25 bp, Mus musculus
tgacctatctccgtgttcgatacag

SEQ ID NO: 848807 - DNA, 25 bp, Mus musculus
tgacctatctgtatctgtttctctg

SEQ ID NO: 848808 - DNA, 25 bp, Mus musculus
tgacctatctgtttctgtttctctg

SEQ ID NO: 848809 - DNA, 25 bp, Mus musculus
tgacctatcttcatttctagcagaa

SEQ ID NO: 848810 - DNA, 25 bp, Mus musculus
tgacctatcttcttttctagcagaa

SEQ ID NO: 848811 - DNA, 25 bp, Mus musculus
tgacctatgaggaataccctgcccc

SEQ ID NO: 848812 - DNA, 25 bp, Mus musculus
tgacctatgaggtataccctgcccc

SEQ ID NO: 848813 - DNA, 25 bp, Mus musculus
tgacctatgatcctgttcccattcc

SEQ ID NO: 848814 - DNA, 25 bp, Mus musculus
tgacctatgatcgtgttcccattcc

SEQ ID NO: 848815 - DNA, 25 bp, Mus musculus
tgacctatgcccaagtgatgcctgg

SEQ ID NO: 848816 - DNA, 25 bp, Mus musculus
tgacctatgccctagtgatgcctgg

SEQ ID NO: 848817 - DNA, 25 bp, Mus musculus
tgacctatggagcagactcacctgg

SEQ ID NO: 848818 - DNA, 25 bp, Mus musculus
tgacctatggaggagactcacctgg

SEQ ID NO: 848819 - DNA, 25 bp, Mus musculus
tgacctatttgcctgggcactgtat

SEQ ID NO: 848820 - DNA, 25 bp, Mus musculus
tgacctatttgcgtgggcactgtat

SEQ ID NO: 848821 - DNA, 25 bp, Mus musculus
tgacctatttttccaagcaccttat

SEQ ID NO: 848822 - DNA, 25 bp, Mus musculus
tgacctatttttgcaagcaccttat

SEQ ID NO: 848823 - DNA, 25 bp, Mus musculus
tgacctcaaaacaggctgtgttggt

SEQ ID NO: 848824 - DNA, 25 bp, Mus musculus
tgacctcaaaactggctgtgttggt

SEQ ID NO: 848825 - DNA, 25 bp, Mus musculus
tgacctcaaacaccagacttgcaca

SEQ ID NO: 848826 - DNA, 25 bp, Mus musculus
tgacctcaaacagcagacttgcaca

SEQ ID NO: 848827 - DNA, 25 bp, Mus musculus
tgacctcaaactacctccaaaagaa

SEQ ID NO: 848828 - DNA, 25 bp, Mus musculus
tgacctcaaactacgtcgaactacc

SEQ ID NO: 848829 - DNA, 25 bp, Mus musculus
tgacctcaaacttcctccaaaagaa

SEQ ID NO: 848830 - DNA, 25 bp, Mus musculus
tgacctcaaacttcgtcgaactacc

SEQ ID NO: 848831 - DNA, 25 bp, Mus musculus
tgacctcaaagcactttcctggctg

SEQ ID NO: 848832 - DNA, 25 bp, Mus musculus
tgacctcaaagcctgtgtgatgcaa

SEQ ID NO: 848833 - DNA, 25 bp, Mus musculus
tgacctcaaagcgtgtgtgatgcaa

SEQ ID NO: 848834 - DNA, 25 bp, Mus musculus
tgacctcaaagctctttcctggctg

SEQ ID NO: 848835 - DNA, 25 bp, Mus musculus
tgacctcaaatgctgggcccaaggg

SEQ ID NO: 848836 - DNA, 25 bp, Mus musculus
tgacctcaaatggtgggcccaaggg

SEQ ID NO: 848837 - DNA, 25 bp, Mus musculus
tgacctcaactacatggtctacatg

SEQ ID NO: 848838 - DNA, 25 bp, Mus musculus
tgacctcaactagatggtctacatg

SEQ ID NO: 848839 - DNA, 25 bp, Mus musculus
tgacctcaagacactggatcagaag

SEQ ID NO: 848840 - DNA, 25 bp, Mus musculus
tgacctcaagacacttcattccaag

SEQ ID NO: 848841 - DNA, 25 bp, Mus musculus
tgacctcaagactctggatcagaag

SEQ ID NO: 848842 - DNA, 25 bp, Mus musculus
tgacctcaagactcttcattccaag

SEQ ID NO: 848843 - DNA, 25 bp, Mus musculus
tgacctcaatcgaggcaggcagatt

SEQ ID NO: 848844 - DNA, 25 bp, Mus musculus
tgacctcaatcgtggcaggcagatt

SEQ ID NO: 848845 - DNA, 25 bp, Mus musculus
tgacctcaatctatccagactctta

SEQ ID NO: 848846 - DNA, 25 bp, Mus musculus
tgacctcaatctttccagactctta

SEQ ID NO: 848847 - DNA, 25 bp, Mus musculus
tgacctcacaagaacccacagtaac

SEQ ID NO: 848848 - DNA, 25 bp, Mus musculus
tgacctcacaagtacccacagtaac

SEQ ID NO: 848849 - DNA, 25 bp, Mus musculus
tgacctcacactagaacatccacaa

SEQ ID NO: 848850 - DNA, 25 bp, Mus musculus
tgacctcacacttgaacatccacaa

SEQ ID NO: 848851 - DNA, 25 bp, Mus musculus
tgacctcacaggcacacagatccat

SEQ ID NO: 848852 - DNA, 25 bp, Mus musculus
tgacctcacagggacacagatccat

SEQ ID NO: 848853 - DNA, 25 bp, Mus musculus
tgacctcacctcataattttacctt

SEQ ID NO: 848854 - DNA, 25 bp, Mus musculus
tgacctcacctcttaattttacctt

SEQ ID NO: 848855 - DNA, 25 bp, Mus musculus
tgacctcacctgagtattgaccgca

SEQ ID NO: 848856 - DNA, 25 bp, Mus musculus
tgacctcacctgtgtattgaccgca

SEQ ID NO: 848857 - DNA, 25 bp, Mus musculus
tgacctcacgttctctgctaagaga

SEQ ID NO: 848858 - DNA, 25 bp, Mus musculus
tgacctcacgttgtctgctaagaga

SEQ ID NO: 848859 - DNA, 25 bp, Mus musculus
tgacctcactagacctcatgtgaag

SEQ ID NO: 848860 - DNA, 25 bp, Mus musculus
tgacctcactagtcctcatgtgaag

SEQ ID NO: 848861 - DNA, 25 bp, Mus musculus
tgacctcagactcaccaatgtgggt

SEQ ID NO: 848862 - DNA, 25 bp, Mus musculus
tgacctcagactgaccaatgtgggt

SEQ ID NO: 848863 - DNA, 25 bp, Mus musculus
tgacctcagcacagacaacctagga

SEQ ID NO: 848864 - DNA, 25 bp, Mus musculus
tgacctcagcactgacaacctagga

SEQ ID NO: 848865 - DNA, 25 bp, Mus musculus
tgacctcagcatagccagctctgaa

SEQ ID NO: 848866 - DNA, 25 bp, Mus musculus
tgacctcagcattgccagctctgaa

SEQ ID NO: 848867 - DNA, 25 bp, Mus musculus
tgacctcagctacccagatgaactt

SEQ ID NO: 848868 - DNA, 25 bp, Mus musculus
tgacctcagctagccagatgaactt

SEQ ID NO: 848869 - DNA, 25 bp, Mus musculus
tgacctcagcttctgtgagcagtga

SEQ ID NO: 848870 - DNA, 25 bp, Mus musculus
tgacctcagcttgtgtgagcagtga

SEQ ID NO: 848871 - DNA, 25 bp, Mus musculus
tgacctcagggacttgccagcatct

SEQ ID NO: 848872 - DNA, 25 bp, Mus musculus
tgacctcagggagttgccagcatct

SEQ ID NO: 848873 - DNA, 25 bp, Mus musculus
tgacctcaggtcagcatttacagac

SEQ ID NO: 848874 - DNA, 25 bp, Mus musculus
tgacctcaggtctgcatttacagac

SEQ ID NO: 848875 - DNA, 25 bp, Mus musculus
tgacctcagtacatggctaatttct

SEQ ID NO: 848876 - DNA, 25 bp, Mus musculus
tgacctcagtacttggctaatttct

SEQ ID NO: 848877 - DNA, 25 bp, Mus musculus
tgacctcagtgcaagaaccaggccc

SEQ ID NO: 848878 - DNA, 25 bp, Mus musculus
tgacctcagtgctagaaccaggccc

SEQ ID NO: 848879 - DNA, 25 bp, Mus musculus
tgacctcagttacagttttctatgg

SEQ ID NO: 848880 - DNA, 25 bp, Mus musculus
tgacctcagttagagttttctatgg

SEQ ID NO: 848881 - DNA, 25 bp, Mus musculus
tgacctcatagtatttaataaagtt

SEQ ID NO: 848882 - DNA, 25 bp, Mus musculus
tgacctcatagtttttaataaagtt

SEQ ID NO: 848883 - DNA, 25 bp, Mus musculus
tgacctcatcatctgcaagacccgt

SEQ ID NO: 848884 - DNA, 25 bp, Mus musculus
tgacctcatcatgtgcaagacccgt

SEQ ID NO: 848885 - DNA, 25 bp, Mus musculus
tgacctcatgaactactcggccttt

SEQ ID NO: 848886 - DNA, 25 bp, Mus musculus
tgacctcatgaagtactcggccttt

SEQ ID NO: 848887 - DNA, 25 bp, Mus musculus
tgacctcatgacatcctgtggacac

SEQ ID NO: 848888 - DNA, 25 bp, Mus musculus
tgacctcatgacttcctgtggacac

SEQ ID NO: 848889 - DNA, 25 bp, Mus musculus
tgacctcatggcatacctaaacttg

SEQ ID NO: 848890 - DNA, 25 bp, Mus musculus
tgacctcatggcttacctaaacttg

SEQ ID NO: 848891 - DNA, 25 bp, Mus musculus
tgacctcatgtcctgcagagtcgta

SEQ ID NO: 848892 - DNA, 25 bp, Mus musculus
tgacctcatgtcgtgcagagtcgta

SEQ ID NO: 848893 - DNA, 25 bp, Mus musculus
tgacctccaaacagacccgaagggt

SEQ ID NO: 848894 - DNA, 25 bp, Mus musculus
tgacctccaaaccagtgtgggctgc

SEQ ID NO: 848895 - DNA, 25 bp, Mus musculus
tgacctccaaacgagtgtgggctgc

SEQ ID NO: 848896 - DNA, 25 bp, Mus musculus
tgacctccaaactgacccgaagggt

SEQ ID NO: 848897 - DNA, 25 bp, Mus musculus
tgacctccacaactgctgtggtact

SEQ ID NO: 848898 - DNA, 25 bp, Mus musculus
tgacctccacaagtgctgtggtact

SEQ ID NO: 848899 - DNA, 25 bp, Mus musculus
tgacctccacatactacatacaatg

SEQ ID NO: 848900 - DNA, 25 bp, Mus musculus
tgacctccacattctacatacaatg

SEQ ID NO: 848901 - DNA, 25 bp, Mus musculus
tgacctccacttagccaaagggctt

SEQ ID NO: 848902 - DNA, 25 bp, Mus musculus
tgacctccacttccgcaccatggca

SEQ ID NO: 848903 - DNA, 25 bp, Mus musculus
tgacctccacttgcgcaccatggca

SEQ ID NO: 848904 - DNA, 25 bp, Mus musculus
tgacctccactttgccaaagggctt

SEQ ID NO: 848905 - DNA, 25 bp, Mus musculus
tgacctccagagcacagctacagac

SEQ ID NO: 848906 - DNA, 25 bp, Mus musculus
tgacctccagaggacagctacagac

SEQ ID NO: 848907 - DNA, 25 bp, Mus musculus
tgacctccaggaacatggcatgcct

SEQ ID NO: 848908 - DNA, 25 bp, Mus musculus
tgacctccaggatcatggcatgcct

SEQ ID NO: 848909 - DNA, 25 bp, Mus musculus
tgacctccatacaaaccttagggtg

SEQ ID NO: 848910 - DNA, 25 bp, Mus musculus
tgacctccatactaaccttagggtg

SEQ ID NO: 848911 - DNA, 25 bp, Mus musculus
tgacctccatatcccgtatatgcca

SEQ ID NO: 848912 - DNA, 25 bp, Mus musculus
tgacctccatatgccgtatatgcca

SEQ ID NO: 848913 - DNA, 25 bp, Mus musculus
tgacctccatgtaagcagccaattc

SEQ ID NO: 848914 - DNA, 25 bp, Mus musculus
tgacctccatgtccttgcacacagt

SEQ ID NO: 848915 - DNA, 25 bp, Mus musculus
tgacctccatgtgcttgcacacagt

SEQ ID NO: 848916 - DNA, 25 bp, Mus musculus
tgacctccatgttagcagccaattc

SEQ ID NO: 848917 - DNA, 25 bp, Mus musculus
tgacctcccaaacagcattgcacgg

SEQ ID NO: 848918 - DNA, 25 bp, Mus musculus
tgacctcccaaagagcattgcacgg

SEQ ID NO: 848919 - DNA, 25 bp, Mus musculus
tgacctcccaacaatttctgggtct

SEQ ID NO: 848920 - DNA, 25 bp, Mus musculus
tgacctcccaactatttctgggtct

SEQ ID NO: 848921 - DNA, 25 bp, Mus musculus
tgacctccccacacgaagacaatgt

SEQ ID NO: 848922 - DNA, 25 bp, Mus musculus
tgacctccccactcgaagacaatgt

SEQ ID NO: 848923 - DNA, 25 bp, Mus musculus
tgacctccctgtaactcaagacaag

SEQ ID NO: 848924 - DNA, 25 bp, Mus musculus
tgacctccctgttactcaagacaag

SEQ ID NO: 848925 - DNA, 25 bp, Mus musculus
tgacctcccttgcatgtaacatgtt

SEQ ID NO: 848926 - DNA, 25 bp, Mus musculus
tgacctcccttggatgtaacatgtt

SEQ ID NO: 848927 - DNA, 25 bp, Mus musculus
tgacctcctacacttccgtgcagta

SEQ ID NO: 848928 - DNA, 25 bp, Mus musculus
tgacctcctacagttccgtgcagta

SEQ ID NO: 848929 - DNA, 25 bp, Mus musculus
tgacctcctgtaatccatcaccaaa

SEQ ID NO: 848930 - DNA, 25 bp, Mus musculus
tgacctcctgtattccatcaccaaa

SEQ ID NO: 848931 - DNA, 25 bp, Mus musculus
tgacctcctttcatgtgttgacgga

SEQ ID NO: 848932 - DNA, 25 bp, Mus musculus
tgacctcctttcttgtgttgacgga

SEQ ID NO: 848933 - DNA, 25 bp, Mus musculus
tgacctcgaaggcaacagcttttta

SEQ ID NO: 848934 - DNA, 25 bp, Mus musculus
tgacctcgaagggaacagcttttta

SEQ ID NO: 848935 - DNA, 25 bp, Mus musculus
tgacctcgagtcagtagtccagcaa

SEQ ID NO: 848936 - DNA, 25 bp, Mus musculus
tgacctcgagtctgtagtccagcaa

SEQ ID NO: 848937 - DNA, 25 bp, Mus musculus
tgacctcgggacattggagtctgaa

SEQ ID NO: 848938 - DNA, 25 bp, Mus musculus
tgacctcgggactttggagtctgaa

SEQ ID NO: 848939 - DNA, 25 bp, Mus musculus
tgacctcgggagagcagagcctgct

SEQ ID NO: 848940 - DNA, 25 bp, Mus musculus
tgacctcgggagtgcagagcctgct

SEQ ID NO: 848941 - DNA, 25 bp, Mus musculus
tgacctcgggatccagaacccgcgt

SEQ ID NO: 848942 - DNA, 25 bp, Mus musculus
tgacctcgggatgcagaacccgcgt

SEQ ID NO: 848943 - DNA, 25 bp, Mus musculus
tgacctcggtcacaaatgcagtttt

SEQ ID NO: 848944 - DNA, 25 bp, Mus musculus
tgacctcggtcagaaatgcagtttt

SEQ ID NO: 848945 - DNA, 25 bp, Mus musculus
tgacctcgtcctatggtgggtacaa

SEQ ID NO: 848946 - DNA, 25 bp, Mus musculus
tgacctcgtcctttggtgggtacaa

SEQ ID NO: 848947 - DNA, 25 bp, Mus musculus
tgacctctacacatcgcggagaacg

SEQ ID NO: 848948 - DNA, 25 bp, Mus musculus
tgacctctacacttcgcggagaacg

SEQ ID NO: 848949 - DNA, 25 bp, Mus musculus
tgacctctacagctttgcttccatg

SEQ ID NO: 848950 - DNA, 25 bp, Mus musculus
tgacctctacaggtttgcttccatg

SEQ ID NO: 848951 - DNA, 25 bp, Mus musculus
tgacctctactgcatcctggaaact

SEQ ID NO: 848952 - DNA, 25 bp, Mus musculus
tgacctctactggatcctggaaact

SEQ ID NO: 848953 - DNA, 25 bp, Mus musculus
tgacctctagttacctgtgtgatat

SEQ ID NO: 848954 - DNA, 25 bp, Mus musculus
tgacctctagtttcctgtgtgatat

SEQ ID NO: 848955 - DNA, 25 bp, Mus musculus
tgacctctatctagagaagctcagt

SEQ ID NO: 848956 - DNA, 25 bp, Mus musculus
tgacctctatcttgagaagctcagt

SEQ ID NO: 848957 - DNA, 25 bp, Mus musculus
tgacctctatggacttcattagctg

SEQ ID NO: 848958 - DNA, 25 bp, Mus musculus
tgacctctatggtcttcattagctg

SEQ ID NO: 848959 - DNA, 25 bp, Mus musculus
tgacctctcaaaagagtaatcttag

SEQ ID NO: 848960 - DNA, 25 bp, Mus musculus
tgacctctcaaatgagtaatcttag

SEQ ID NO: 848961 - DNA, 25 bp, Mus musculus
tgacctctcacacggaggatctagc

SEQ ID NO: 848962 - DNA, 25 bp, Mus musculus
tgacctctcacagggaggatctagc

SEQ ID NO: 848963 - DNA, 25 bp, Mus musculus
tgacctctcacgcagaatctgtatc

SEQ ID NO: 848964 - DNA, 25 bp, Mus musculus
tgacctctcacggagaatctgtatc

SEQ ID NO: 848965 - DNA, 25 bp, Mus musculus
tgacctctccctattaggttgactt

SEQ ID NO: 848966 - DNA, 25 bp, Mus musculus
tgacctctcccttttaggttgactt

SEQ ID NO: 848967 - DNA, 25 bp, Mus musculus
tgacctctcgaacacgactgtggat

SEQ ID NO: 848968 - DNA, 25 bp, Mus musculus
tgacctctcgaagacgactgtggat

SEQ ID NO: 848969 - DNA, 25 bp, Mus musculus
tgacctctcgtaacattaaacttga

SEQ ID NO: 848970 - DNA, 25 bp, Mus musculus
tgacctctcgtatcattaaacttga

SEQ ID NO: 848971 - DNA, 25 bp, Mus musculus
tgacctctctgcctacgatgctgag

SEQ ID NO: 848972 - DNA, 25 bp, Mus musculus
tgacctctctgcgtacgatgctgag

SEQ ID NO: 848973 - DNA, 25 bp, Mus musculus
tgacctctgacaccttagcgaagaa

SEQ ID NO: 848974 - DNA, 25 bp, Mus musculus
tgacctctgacagcttagcgaagaa

SEQ ID NO: 848975 - DNA, 25 bp, Mus musculus
tgacctctgactattactgggaaat

SEQ ID NO: 848976 - DNA, 25 bp, Mus musculus
tgacctctgacttttactgggaaat

SEQ ID NO: 848977 - DNA, 25 bp, Mus musculus
tgacctctgagaatatgcatgcgca

SEQ ID NO: 848978 - DNA, 25 bp, Mus musculus
tgacctctgagattatgcatgcgca

SEQ ID NO: 848979 - DNA, 25 bp, Mus musculus
tgacctctgcacactggcatatctg

SEQ ID NO: 848980 - DNA, 25 bp, Mus musculus
tgacctctgcactctggcatatctg

SEQ ID NO: 848981 - DNA, 25 bp, Mus musculus
tgacctctgcccatcgttgttgatt

SEQ ID NO: 848982 - DNA, 25 bp, Mus musculus
tgacctctgcccttcgttgttgatt

SEQ ID NO: 848983 - DNA, 25 bp, Mus musculus
tgacctctgctaacctgggtaagaa

SEQ ID NO: 848984 - DNA, 25 bp, Mus musculus
tgacctctgctatcctgggtaagaa

SEQ ID NO: 848985 - DNA, 25 bp, Mus musculus
tgacctctgctcaaggcgcacacag

SEQ ID NO: 848986 - DNA, 25 bp, Mus musculus
tgacctctgctctaggcgcacacag

SEQ ID NO: 848987 - DNA, 25 bp, Mus musculus
tgacctctggcacaactctaagcta

SEQ ID NO: 848988 - DNA, 25 bp, Mus musculus
tgacctctggcagaactctaagcta

SEQ ID NO: 848989 - DNA, 25 bp, Mus musculus
tgacctctggccagggttacattgc

SEQ ID NO: 848990 - DNA, 25 bp, Mus musculus
tgacctctggcctgggttacattgc

SEQ ID NO: 848991 - DNA, 25 bp, Mus musculus
tgacctctggtcacaagaacacttg

SEQ ID NO: 848992 - DNA, 25 bp, Mus musculus
tgacctctggtctcaagaacacttg

SEQ ID NO: 848993 - DNA, 25 bp, Mus musculus
tgacctctgtggcatctgtacacat

SEQ ID NO: 848994 - DNA, 25 bp, Mus musculus
tgacctctgtgggatctgtacacat

SEQ ID NO: 848995 - DNA, 25 bp, Mus musculus
tgacctctgtgtaattgcttcaacc

SEQ ID NO: 848996 - DNA, 25 bp, Mus musculus
tgacctctgtgttattgcttcaacc

SEQ ID NO: 848997 - DNA, 25 bp, Mus musculus
tgacctcttactctttaaaagctag

SEQ ID NO: 848998 - DNA, 25 bp, Mus musculus
tgacctcttactgtttaaaagctag

SEQ ID NO: 848999 - DNA, 25 bp, Mus musculus
tgacctcttatcctctgtggctttg

SEQ ID NO: 849000 - DNA, 25 bp, Mus musculus
tgacctcttatcgtctgtggctttg

SEQ ID NO: 849001 - DNA, 25 bp, Mus musculus
tgacctcttttgacttccatgggca

SEQ ID NO: 849002 - DNA, 25 bp, Mus musculus
tgacctcttttgtcttccatgggca

SEQ ID NO: 849003 - DNA, 25 bp, Mus musculus
tgacctgaaaacctgtctgatgcag

SEQ ID NO: 849004 - DNA, 25 bp, Mus musculus
tgacctgaaaacgtgtctgatgcag

SEQ ID NO: 849005 - DNA, 25 bp, Mus musculus
tgacctgaaacaaacatgcaccaaa

SEQ ID NO: 849006 - DNA, 25 bp, Mus musculus
tgacctgaaacatacatgcaccaaa

SEQ ID NO: 849007 - DNA, 25 bp, Mus musculus
tgacctgaacctcactcagtccttg

SEQ ID NO: 849008 - DNA, 25 bp, Mus musculus
tgacctgaacctccaactgctgggt

SEQ ID NO: 849009 - DNA, 25 bp, Mus musculus
tgacctgaacctgactcagtccttg

SEQ ID NO: 849010 - DNA, 25 bp, Mus musculus
tgacctgaacctgcaactgctgggt

SEQ ID NO: 849011 - DNA, 25 bp, Mus musculus
tgacctgaactcagggcgtttcttg

SEQ ID NO: 849012 - DNA, 25 bp, Mus musculus
tgacctgaactctgggcgtttcttg

SEQ ID NO: 849013 - DNA, 25 bp, Mus musculus
tgacctgacacgcaatgacctggac

SEQ ID NO: 849014 - DNA, 25 bp, Mus musculus
tgacctgacacggaatgacctggac

SEQ ID NO: 849015 - DNA, 25 bp, Mus musculus
tgacctgacccacctggaggacatt

SEQ ID NO: 849016 - DNA, 25 bp, Mus musculus
tgacctgacccagctggaggacatt

SEQ ID NO: 849017 - DNA, 25 bp, Mus musculus
tgacctgacggaagccttcgtggag

SEQ ID NO: 849018 - DNA, 25 bp, Mus musculus
tgacctgacggatgccttcgtggag

SEQ ID NO: 849019 - DNA, 25 bp, Mus musculus
tgacctgacgtgaggctccatggga

SEQ ID NO: 849020 - DNA, 25 bp, Mus musculus
tgacctgacgtgtggctccatggga

SEQ ID NO: 849021 - DNA, 25 bp, Mus musculus
tgacctgactccacagctagaatgg

SEQ ID NO: 849022 - DNA, 25 bp, Mus musculus
tgacctgactcctcagctagaatgg

SEQ ID NO: 849023 - DNA, 25 bp, Mus musculus
tgacctgactctctgcctaacagaa

SEQ ID NO: 849024 - DNA, 25 bp, Mus musculus
tgacctgactctgtgcctaacagaa

SEQ ID NO: 849025 - DNA, 25 bp, Mus musculus
tgacctgagacccacagctgtgaag

SEQ ID NO: 849026 - DNA, 25 bp, Mus musculus
tgacctgagaccctttctgtataac

SEQ ID NO: 849027 - DNA, 25 bp, Mus musculus
tgacctgagaccgacagctgtgaag

SEQ ID NO: 849028 - DNA, 25 bp, Mus musculus
tgacctgagaccgtttctgtataac

SEQ ID NO: 849029 - DNA, 25 bp, Mus musculus
tgacctgagcaacttgccctttctt

SEQ ID NO: 849030 - DNA, 25 bp, Mus musculus
tgacctgagcaagttgccctttctt

SEQ ID NO: 849031 - DNA, 25 bp, Mus musculus
tgacctgagcctcgactctcagagc

SEQ ID NO: 849032 - DNA, 25 bp, Mus musculus
tgacctgagcctggactctcagagc

SEQ ID NO: 849033 - DNA, 25 bp, Mus musculus
tgacctgagcgtatgcatacataca

SEQ ID NO: 849034 - DNA, 25 bp, Mus musculus
tgacctgagcgtttgcatacataca

SEQ ID NO: 849035 - DNA, 25 bp, Mus musculus
tgacctgaggcacaacccagattaa

SEQ ID NO: 849036 - DNA, 25 bp, Mus musculus
tgacctgaggcagaacccagattaa

SEQ ID NO: 849037 - DNA, 25 bp, Mus musculus
tgacctgataatcctcccactatat

SEQ ID NO: 849038 - DNA, 25 bp, Mus musculus
tgacctgataatgctcccactatat

SEQ ID NO: 849039 - DNA, 25 bp, Mus musculus
tgacctgatgacagactccctggcg

SEQ ID NO: 849040 - DNA, 25 bp, Mus musculus
tgacctgatgactgactccctggcg

SEQ ID NO: 849041 - DNA, 25 bp, Mus musculus
tgacctgatgccagggcgtgaagct

SEQ ID NO: 849042 - DNA, 25 bp, Mus musculus
tgacctgatgcctgggcgtgaagct

SEQ ID NO: 849043 - DNA, 25 bp, Mus musculus
tgacctgcacatagacctcaataat

SEQ ID NO: 849044 - DNA, 25 bp, Mus musculus
tgacctgcacattgacctcaataat

SEQ ID NO: 849045 - DNA, 25 bp, Mus musculus
tgacctgcaccaacatagcttcttc

SEQ ID NO: 849046 - DNA, 25 bp, Mus musculus
tgacctgcaccacaaaacctgcaag

SEQ ID NO: 849047 - DNA, 25 bp, Mus musculus
tgacctgcaccagaaaacctgcaag

SEQ ID NO: 849048 - DNA, 25 bp, Mus musculus
tgacctgcaccatcatagcttcttc

SEQ ID NO: 849049 - DNA, 25 bp, Mus musculus
tgacctgcacccacgttatgttact

SEQ ID NO: 849050 - DNA, 25 bp, Mus musculus
tgacctgcaccctcgttatgttact

SEQ ID NO: 849051 - DNA, 25 bp, Mus musculus
tgacctgcactgaaaggcaagggta

SEQ ID NO: 849052 - DNA, 25 bp, Mus musculus
tgacctgcactgtaaggcaagggta

SEQ ID NO: 849053 - DNA, 25 bp, Mus musculus
tgacctgcagatcgaagaaatgctt

SEQ ID NO: 849054 - DNA, 25 bp, Mus musculus
tgacctgcagatggaagaaatgctt

SEQ ID NO: 849055 - DNA, 25 bp, Mus musculus
tgacctgcagcaccaggctggtgat

SEQ ID NO: 849056 - DNA, 25 bp, Mus musculus
tgacctgcagcagcaggctggtgat

SEQ ID NO: 849057 - DNA, 25 bp, Mus musculus
tgacctgcagttacggtagtacctg

SEQ ID NO: 849058 - DNA, 25 bp, Mus musculus
tgacctgcagtttcggtagtacctg

SEQ ID NO: 849059 - DNA, 25 bp, Mus musculus
tgacctgcattacaaacattataat

SEQ ID NO: 849060 - DNA, 25 bp, Mus musculus
tgacctgcattagaaacattataat

SEQ ID NO: 849061 - DNA, 25 bp, Mus musculus
tgacctgcccaacaatctcactttt

SEQ ID NO: 849062 - DNA, 25 bp, Mus musculus
tgacctgcccaagaatctcactttt

SEQ ID NO: 849063 - DNA, 25 bp, Mus musculus
tgacctgccgcgcctgctgagagca

SEQ ID NO: 849064 - DNA, 25 bp, Mus musculus
tgacctgccgcggctgctgagagca

SEQ ID NO: 849065 - DNA, 25 bp, Mus musculus
tgacctgccggtcaaacaagacctt

SEQ ID NO: 849066 - DNA, 25 bp, Mus musculus
tgacctgccggtgaaacaagacctt

SEQ ID NO: 849067 - DNA, 25 bp, Mus musculus
tgacctgcctttccctatgtatgag

SEQ ID NO: 849068 - DNA, 25 bp, Mus musculus
tgacctgcctttgcctatgtatgag

SEQ ID NO: 849069 - DNA, 25 bp, Mus musculus
tgacctgctaacaactgctttatgg

SEQ ID NO: 849070 - DNA, 25 bp, Mus musculus
tgacctgctaactactgctttatgg

SEQ ID NO: 849071 - DNA, 25 bp, Mus musculus
tgacctgctacaaataacctactac

SEQ ID NO: 849072 - DNA, 25 bp, Mus musculus
tgacctgctacatataacctactac

SEQ ID NO: 849073 - DNA, 25 bp, Mus musculus
tgacctgctaggcactggaactgca

SEQ ID NO: 849074 - DNA, 25 bp, Mus musculus
tgacctgctagggactggaactgca

SEQ ID NO: 849075 - DNA, 25 bp, Mus musculus
tgacctgctcatccacacagtggca

SEQ ID NO: 849076 - DNA, 25 bp, Mus musculus
tgacctgctcatgcacacagtggca

SEQ ID NO: 849077 - DNA, 25 bp, Mus musculus
tgacctgctctaagggcccacaggt

SEQ ID NO: 849078 - DNA, 25 bp, Mus musculus
tgacctgctctatgggcccacaggt

SEQ ID NO: 849079 - DNA, 25 bp, Mus musculus
tgacctgctcttcgctgaagttgac

SEQ ID NO: 849080 - DNA, 25 bp, Mus musculus
tgacctgctcttggctgaagttgac

SEQ ID NO: 849081 - DNA, 25 bp, Mus musculus
tgacctgctgacatgggatatcctg

SEQ ID NO: 849082 - DNA, 25 bp, Mus musculus
tgacctgctgaccaggctcacatgg

SEQ ID NO: 849083 - DNA, 25 bp, Mus musculus
tgacctgctgacgaggctcacatgg

SEQ ID NO: 849084 - DNA, 25 bp, Mus musculus
tgacctgctgacttgggatatcctg

SEQ ID NO: 849085 - DNA, 25 bp, Mus musculus
tgacctgctggtctgtgtatatatt

SEQ ID NO: 849086 - DNA, 25 bp, Mus musculus
tgacctgctggtgtgtgtatatatt

SEQ ID NO: 849087 - DNA, 25 bp, Mus musculus
tgacctgctgtgaggttgctggcaa

SEQ ID NO: 849088 - DNA, 25 bp, Mus musculus
tgacctgctgtgtggttgctggcaa

SEQ ID NO: 849089 - DNA, 25 bp, Mus musculus
tgacctgcttgactgtgagtgcaca

SEQ ID NO: 849090 - DNA, 25 bp, Mus musculus
tgacctgcttgagtgtgagtgcaca

SEQ ID NO: 849091 - DNA, 25 bp, Mus musculus
tgacctggaaaccaatcttttcctt

SEQ ID NO: 849092 - DNA, 25 bp, Mus musculus
tgacctggaaacgaatcttttcctt

SEQ ID NO: 849093 - DNA, 25 bp, Mus musculus
tgacctggaactcacggtatcacca

SEQ ID NO: 849094 - DNA, 25 bp, Mus musculus
tgacctggaactctgatctacctgc

SEQ ID NO: 849095 - DNA, 25 bp, Mus musculus
tgacctggaactgacggtatcacca

SEQ ID NO: 849096 - DNA, 25 bp, Mus musculus
tgacctggaactgtgatctacctgc

SEQ ID NO: 849097 - DNA, 25 bp, Mus musculus
tgacctggacagatgttcggataac

SEQ ID NO: 849098 - DNA, 25 bp, Mus musculus
tgacctggacagttgttcggataac

SEQ ID NO: 849099 - DNA, 25 bp, Mus musculus
tgacctggaggcactaaggcatgcc

SEQ ID NO: 849100 - DNA, 25 bp, Mus musculus
tgacctggaggctctaaggcatgcc

SEQ ID NO: 849101 - DNA, 25 bp, Mus musculus
tgacctggagttactgtgtgaatat

SEQ ID NO: 849102 - DNA, 25 bp, Mus musculus
tgacctggagtttctgtgtgaatat

SEQ ID NO: 849103 - DNA, 25 bp, Mus musculus
tgacctggatgtcttcacaccgcat

SEQ ID NO: 849104 - DNA, 25 bp, Mus musculus
tgacctggatgtgttcacaccgcat

SEQ ID NO: 849105 - DNA, 25 bp, Mus musculus
tgacctggcaccatacaagcagaaa

SEQ ID NO: 849106 - DNA, 25 bp, Mus musculus
tgacctggcaccttacaagcagaaa

SEQ ID NO: 849107 - DNA, 25 bp, Mus musculus
tgacctggcacgacttctggttaaa

SEQ ID NO: 849108 - DNA, 25 bp, Mus musculus
tgacctggcacgtcttctggttaaa

SEQ ID NO: 849109 - DNA, 25 bp, Mus musculus
tgacctggcagacgatgacatcatg

SEQ ID NO: 849110 - DNA, 25 bp, Mus musculus
tgacctggcagaggatgacatcatg

SEQ ID NO: 849111 - DNA, 25 bp, Mus musculus
tgacctggcagcatattccttattt

SEQ ID NO: 849112 - DNA, 25 bp, Mus musculus
tgacctggcagcttattccttattt

SEQ ID NO: 849113 - DNA, 25 bp, Mus musculus
tgacctggcctacagcaaaggacct

SEQ ID NO: 849114 - DNA, 25 bp, Mus musculus
tgacctggcctagagcaaaggacct

SEQ ID NO: 849115 - DNA, 25 bp, Mus musculus
tgacctggcctgaggcgcagaagta

SEQ ID NO: 849116 - DNA, 25 bp, Mus musculus
tgacctggcctgtggcgcagaagta

SEQ ID NO: 849117 - DNA, 25 bp, Mus musculus
tgacctggctgtaaactttgccctc

SEQ ID NO: 849118 - DNA, 25 bp, Mus musculus
tgacctggctgtagtcttgagtgtt

SEQ ID NO: 849119 - DNA, 25 bp, Mus musculus
tgacctggctgttaactttgccctc

SEQ ID NO: 849120 - DNA, 25 bp, Mus musculus
tgacctggctgttgtcttgagtgtt

SEQ ID NO: 849121 - DNA, 25 bp, Mus musculus
tgacctgggaatagtccttgtgcct

SEQ ID NO: 849122 - DNA, 25 bp, Mus musculus
tgacctgggaattgtccttgtgcct

SEQ ID NO: 849123 - DNA, 25 bp, Mus musculus
tgacctgggacacccaaacacagta

SEQ ID NO: 849124 - DNA, 25 bp, Mus musculus
tgacctgggacagccaaacacagta

SEQ ID NO: 849125 - DNA, 25 bp, Mus musculus
tgacctgggcttagaaacctaccca

SEQ ID NO: 849126 - DNA, 25 bp, Mus musculus
tgacctgggcttcctatgacgataa

SEQ ID NO: 849127 - DNA, 25 bp, Mus musculus
tgacctgggcttgctatgacgataa

SEQ ID NO: 849128 - DNA, 25 bp, Mus musculus
tgacctgggctttgaaacctaccca

SEQ ID NO: 849129 - DNA, 25 bp, Mus musculus
tgacctgggttgatttctgaactcc

SEQ ID NO: 849130 - DNA, 25 bp, Mus musculus
tgacctgggttgttttctgaactcc

SEQ ID NO: 849131 - DNA, 25 bp, Mus musculus
tgacctggtattcccattgctttgg

SEQ ID NO: 849132 - DNA, 25 bp, Mus musculus
tgacctggtattgccattgctttgg

SEQ ID NO: 849133 - DNA, 25 bp, Mus musculus
tgacctggtgacacattcctgtact

SEQ ID NO: 849134 - DNA, 25 bp, Mus musculus
tgacctggtgactcattcctgtact

SEQ ID NO: 849135 - DNA, 25 bp, Mus musculus
tgacctggtgtcacagagtggcttc

SEQ ID NO: 849136 - DNA, 25 bp, Mus musculus
tgacctggtgtctcagagtggcttc

SEQ ID NO: 849137 - DNA, 25 bp, Mus musculus
tgacctggtgtgatccacaggaccc

SEQ ID NO: 849138 - DNA, 25 bp, Mus musculus
tgacctggtgtgttccacaggaccc

SEQ ID NO: 849139 - DNA, 25 bp, Mus musculus
tgacctggttctcgttccacaaaaa

SEQ ID NO: 849140 - DNA, 25 bp, Mus musculus
tgacctggttctggttccacaaaaa

SEQ ID NO: 849141 - DNA, 25 bp, Mus musculus
tgacctgtaacaagctgggccttac

SEQ ID NO: 849142 - DNA, 25 bp, Mus musculus
tgacctgtaacatgctgggccttac

SEQ ID NO: 849143 - DNA, 25 bp, Mus musculus
tgacctgtacagagtgcttttgaag

SEQ ID NO: 849144 - DNA, 25 bp, Mus musculus
tgacctgtacagtgtgcttttgaag

SEQ ID NO: 849145 - DNA, 25 bp, Mus musculus
tgacctgtaggcatgacttctgtag

SEQ ID NO: 849146 - DNA, 25 bp, Mus musculus
tgacctgtaggcttgacttctgtag

SEQ ID NO: 849147 - DNA, 25 bp, Mus musculus
tgacctgtagttaattatcatgcta

SEQ ID NO: 849148 - DNA, 25 bp, Mus musculus
tgacctgtagtttattatcatgcta

SEQ ID NO: 849149 - DNA, 25 bp, Mus musculus
tgacctgtatttcacaccccagcta

SEQ ID NO: 849150 - DNA, 25 bp, Mus musculus
tgacctgtatttgacaccccagcta

SEQ ID NO: 849151 - DNA, 25 bp, Mus musculus
tgacctgtccctactttaggagcag

SEQ ID NO: 849152 - DNA, 25 bp, Mus musculus
tgacctgtcccttctttaggagcag

SEQ ID NO: 849153 - DNA, 25 bp, Mus musculus
tgacctgtgaatagaactgccaacg

SEQ ID NO: 849154 - DNA, 25 bp, Mus musculus
tgacctgtgaattgaactgccaacg

SEQ ID NO: 849155 - DNA, 25 bp, Mus musculus
tgacctgtgacaaagctgcatattt

SEQ ID NO: 849156 - DNA, 25 bp, Mus musculus
tgacctgtgacatagctgcatattt

SEQ ID NO: 849157 - DNA, 25 bp, Mus musculus
tgacctgtgatcctcatcgtcttca

SEQ ID NO: 849158 - DNA, 25 bp, Mus musculus
tgacctgtgatcgtcatcgtcttca

SEQ ID NO: 849159 - DNA, 25 bp, Mus musculus
tgacctgtgcctccaagtgatgttc

SEQ ID NO: 849160 - DNA, 25 bp, Mus musculus
tgacctgtgcctgcaagtgatgttc

SEQ ID NO: 849161 - DNA, 25 bp, Mus musculus
tgacctgtgcggagacactagttct

SEQ ID NO: 849162 - DNA, 25 bp, Mus musculus
tgacctgtgcggattctgcaaatac

SEQ ID NO: 849163 - DNA, 25 bp, Mus musculus
tgacctgtgcggtgacactagttct

SEQ ID NO: 849164 - DNA, 25 bp, Mus musculus
tgacctgtgcggtttctgcaaatac

SEQ ID NO: 849165 - DNA, 25 bp, Mus musculus
tgacctgtgcgtacaatccagagaa

SEQ ID NO: 849166 - DNA, 25 bp, Mus musculus
tgacctgtgcgttcaatccagagaa

SEQ ID NO: 849167 - DNA, 25 bp, Mus musculus
tgacctgtgggaaggtgaaatcact

SEQ ID NO: 849168 - DNA, 25 bp, Mus musculus
tgacctgtgggatggtgaaatcact

SEQ ID NO: 849169 - DNA, 25 bp, Mus musculus
tgacctgtggtaactctcgtggaga

SEQ ID NO: 849170 - DNA, 25 bp, Mus musculus
tgacctgtggtatctctcgtggaga

SEQ ID NO: 849171 - DNA, 25 bp, Mus musculus
tgacctgtgtaacctccctaaaaag

SEQ ID NO: 849172 - DNA, 25 bp, Mus musculus
tgacctgtgtaagctccctaaaaag

SEQ ID NO: 849173 - DNA, 25 bp, Mus musculus
tgacctgttcacaatcaaacctctg

SEQ ID NO: 849174 - DNA, 25 bp, Mus musculus
tgacctgttcacctgcaacaagtgc

SEQ ID NO: 849175 - DNA, 25 bp, Mus musculus
tgacctgttcacgtgcaacaagtgc

SEQ ID NO: 849176 - DNA, 25 bp, Mus musculus
tgacctgttcactatcaaacctctg

SEQ ID NO: 849177 - DNA, 25 bp, Mus musculus
tgacctgttcccagtaggacatctg

SEQ ID NO: 849178 - DNA, 25 bp, Mus musculus
tgacctgttccctgtaggacatctg

SEQ ID NO: 849179 - DNA, 25 bp, Mus musculus
tgacctgttcttcacccagacaaag

SEQ ID NO: 849180 - DNA, 25 bp, Mus musculus
tgacctgttcttgacccagacaaag

SEQ ID NO: 849181 - DNA, 25 bp, Mus musculus
tgacctgttgccaggtgggaacttg

SEQ ID NO: 849182 - DNA, 25 bp, Mus musculus
tgacctgttgcctggtgggaacttg

SEQ ID NO: 849183 - DNA, 25 bp, Mus musculus
tgacctgttttaagtggagtttatt

SEQ ID NO: 849184 - DNA, 25 bp, Mus musculus
tgacctgttttatgtggagtttatt

SEQ ID NO: 849185 - DNA, 25 bp, Mus musculus
tgaccttaaacgagtaaacctcctg

SEQ ID NO: 849186 - DNA, 25 bp, Mus musculus
tgaccttaaacgtgtaaacctcctg

SEQ ID NO: 849187 - DNA, 25 bp, Mus musculus
tgaccttaaactagagagcctcttg

SEQ ID NO: 849188 - DNA, 25 bp, Mus musculus
tgaccttaaactcccaatgttccta

SEQ ID NO: 849189 - DNA, 25 bp, Mus musculus
tgaccttaaactgccaatgttccta

SEQ ID NO: 849190 - DNA, 25 bp, Mus musculus
tgaccttaaacttgagagcctcttg

SEQ ID NO: 849191 - DNA, 25 bp, Mus musculus
tgaccttaactcactgtatgtaccc

SEQ ID NO: 849192 - DNA, 25 bp, Mus musculus
tgaccttaactctctgtatgtaccc

SEQ ID NO: 849193 - DNA, 25 bp, Mus musculus
tgaccttacacccagttcagaattt

SEQ ID NO: 849194 - DNA, 25 bp, Mus musculus
tgaccttacaccgagttcagaattt

SEQ ID NO: 849195 - DNA, 25 bp, Mus musculus
tgaccttacttgcacggccaggtag

SEQ ID NO: 849196 - DNA, 25 bp, Mus musculus
tgaccttacttggacggccaggtag

SEQ ID NO: 849197 - DNA, 25 bp, Mus musculus
tgaccttactttcattccaagctcc

SEQ ID NO: 849198 - DNA, 25 bp, Mus musculus
tgaccttactttgattccaagctcc

SEQ ID NO: 849199 - DNA, 25 bp, Mus musculus
tgaccttagaatctgacccttatgt

SEQ ID NO: 849200 - DNA, 25 bp, Mus musculus
tgaccttagaatgtgacccttatgt

SEQ ID NO: 849201 - DNA, 25 bp, Mus musculus
tgaccttaggaaccaactatcggtt

SEQ ID NO: 849202 - DNA, 25 bp, Mus musculus
tgaccttaggaagcaactatcggtt

SEQ ID NO: 849203 - DNA, 25 bp, Mus musculus
tgaccttatccaaaaatataatgac

SEQ ID NO: 849204 - DNA, 25 bp, Mus musculus
tgaccttatccataaatataatgac

SEQ ID NO: 849205 - DNA, 25 bp, Mus musculus
tgaccttcaagacggcaaacgggct

SEQ ID NO: 849206 - DNA, 25 bp, Mus musculus
tgaccttcaagagggcaaacgggct

SEQ ID NO: 849207 - DNA, 25 bp, Mus musculus
tgaccttcacaaccacatgttcaat

SEQ ID NO: 849208 - DNA, 25 bp, Mus musculus
tgaccttcacaagcacatgttcaat

SEQ ID NO: 849209 - DNA, 25 bp, Mus musculus
tgaccttcacatctgcccaaacata

SEQ ID NO: 849210 - DNA, 25 bp, Mus musculus
tgaccttcacatgtgcccaaacata

SEQ ID NO: 849211 - DNA, 25 bp, Mus musculus
tgaccttcacttaaactgcttggcc

SEQ ID NO: 849212 - DNA, 25 bp, Mus musculus
tgaccttcactttaactgcttggcc

SEQ ID NO: 849213 - DNA, 25 bp, Mus musculus
tgaccttcagagaacccgaccgaaa

SEQ ID NO: 849214 - DNA, 25 bp, Mus musculus
tgaccttcagagtacccgaccgaaa

SEQ ID NO: 849215 - DNA, 25 bp, Mus musculus
tgaccttcaggcattcatgaggtac

SEQ ID NO: 849216 - DNA, 25 bp, Mus musculus
tgaccttcaggctttcatgaggtac

SEQ ID NO: 849217 - DNA, 25 bp, Mus musculus
tgaccttccaccaggtccggtgatc

SEQ ID NO: 849218 - DNA, 25 bp, Mus musculus
tgaccttccacctggtccggtgatc

SEQ ID NO: 849219 - DNA, 25 bp, Mus musculus
tgaccttccagaagcccaagtttga

SEQ ID NO: 849220 - DNA, 25 bp, Mus musculus
tgaccttccagatgcccaagtttga

SEQ ID NO: 849221 - DNA, 25 bp, Mus musculus
tgaccttccagtcgtccttcacaat

SEQ ID NO: 849222 - DNA, 25 bp, Mus musculus
tgaccttccagtggtccttcacaat

SEQ ID NO: 849223 - DNA, 25 bp, Mus musculus
tgaccttccatcaagaagcccagat

SEQ ID NO: 849224 - DNA, 25 bp, Mus musculus
tgaccttccatctagaagcccagat

SEQ ID NO: 849225 - DNA, 25 bp, Mus musculus
tgaccttccatgcactgttcaaaag

SEQ ID NO: 849226 - DNA, 25 bp, Mus musculus
tgaccttccatggactgttcaaaag

SEQ ID NO: 849227 - DNA, 25 bp, Mus musculus
tgaccttcccacagagaaacacatg

SEQ ID NO: 849228 - DNA, 25 bp, Mus musculus
tgaccttcccactgagaaacacatg

SEQ ID NO: 849229 - DNA, 25 bp, Mus musculus
tgaccttcccgcagaggcatttgga

SEQ ID NO: 849230 - DNA, 25 bp, Mus musculus
tgaccttcccgctgaggcatttgga

SEQ ID NO: 849231 - DNA, 25 bp, Mus musculus
tgaccttcctatcgacagccaataa

SEQ ID NO: 849232 - DNA, 25 bp, Mus musculus
tgaccttcctatggacagccaataa

SEQ ID NO: 849233 - DNA, 25 bp, Mus musculus
tgaccttcctctcaagccaatagtt

SEQ ID NO: 849234 - DNA, 25 bp, Mus musculus
tgaccttcctctgaagccaatagtt

SEQ ID NO: 849235 - DNA, 25 bp, Mus musculus
tgaccttcctgcatagatgctagtt

SEQ ID NO: 849236 - DNA, 25 bp, Mus musculus
tgaccttcctgcttagatgctagtt

SEQ ID NO: 849237 - DNA, 25 bp, Mus musculus
tgaccttccttcatgcctgtggatc

SEQ ID NO: 849238 - DNA, 25 bp, Mus musculus
tgaccttccttcttgcctgtggatc

SEQ ID NO: 849239 - DNA, 25 bp, Mus musculus
tgaccttcggaaatatttttacact

SEQ ID NO: 849240 - DNA, 25 bp, Mus musculus
tgaccttcggaattatttttacact

SEQ ID NO: 849241 - DNA, 25 bp, Mus musculus
tgaccttcgttacaagctacaccta

SEQ ID NO: 849242 - DNA, 25 bp, Mus musculus
tgaccttcgttagaagctacaccta

SEQ ID NO: 849243 - DNA, 25 bp, Mus musculus
tgaccttctattaccagttgctgtg

SEQ ID NO: 849244 - DNA, 25 bp, Mus musculus
tgaccttctatttccagttgctgtg

SEQ ID NO: 849245 - DNA, 25 bp, Mus musculus
tgaccttctctcactgtaaggacta

SEQ ID NO: 849246 - DNA, 25 bp, Mus musculus
tgaccttctctctctgtaaggacta

SEQ ID NO: 849247 - DNA, 25 bp, Mus musculus
tgaccttctgatccattgacctgat

SEQ ID NO: 849248 - DNA, 25 bp, Mus musculus
tgaccttctgatgcattgacctgat

SEQ ID NO: 849249 - DNA, 25 bp, Mus musculus
tgaccttctgtccacctttaaacta

SEQ ID NO: 849250 - DNA, 25 bp, Mus musculus
tgaccttctgtcgacctttaaacta

SEQ ID NO: 849251 - DNA, 25 bp, Mus musculus
tgaccttgaactaggcctgcaggct

SEQ ID NO: 849252 - DNA, 25 bp, Mus musculus
tgaccttgaacttggcctgcaggct

SEQ ID NO: 849253 - DNA, 25 bp, Mus musculus
tgaccttgaagacatggccactagc

SEQ ID NO: 849254 - DNA, 25 bp, Mus musculus
tgaccttgaagagatggccactagc

SEQ ID NO: 849255 - DNA, 25 bp, Mus musculus
tgaccttgacaacagagcataccat

SEQ ID NO: 849256 - DNA, 25 bp, Mus musculus
tgaccttgacaagagagcataccat

SEQ ID NO: 849257 - DNA, 25 bp, Mus musculus
tgaccttgacacaagcaggcagctc

SEQ ID NO: 849258 - DNA, 25 bp, Mus musculus
tgaccttgacactagcaggcagctc

SEQ ID NO: 849259 - DNA, 25 bp, Mus musculus
tgaccttgactgcaccaacgagtat

SEQ ID NO: 849260 - DNA, 25 bp, Mus musculus
tgaccttgactggaccaacgagtat

SEQ ID NO: 849261 - DNA, 25 bp, Mus musculus
tgaccttgagcgctgccacgaggaa

SEQ ID NO: 849262 - DNA, 25 bp, Mus musculus
tgaccttgagcggtgccacgaggaa

SEQ ID NO: 849263 - DNA, 25 bp, Mus musculus
tgaccttgagctagcctctgagtgt

SEQ ID NO: 849264 - DNA, 25 bp, Mus musculus
tgaccttgagcttgcctctgagtgt

SEQ ID NO: 849265 - DNA, 25 bp, Mus musculus
tgaccttgagtcaggcgctcaccat

SEQ ID NO: 849266 - DNA, 25 bp, Mus musculus
tgaccttgagtctggcgctcaccat

SEQ ID NO: 849267 - DNA, 25 bp, Mus musculus
tgaccttgattgaagtccatttaat

SEQ ID NO: 849268 - DNA, 25 bp, Mus musculus
tgaccttgattgagcctgacttctg

SEQ ID NO: 849269 - DNA, 25 bp, Mus musculus
tgaccttgattgtagtccatttaat

SEQ ID NO: 849270 - DNA, 25 bp, Mus musculus
tgaccttgattgtgcctgacttctg

SEQ ID NO: 849271 - DNA, 25 bp, Mus musculus
tgaccttgatttcgctttaagtaca

SEQ ID NO: 849272 - DNA, 25 bp, Mus musculus
tgaccttgatttggctttaagtaca

SEQ ID NO: 849273 - DNA, 25 bp, Mus musculus
tgaccttgccaacgcctgccttagg

SEQ ID NO: 849274 - DNA, 25 bp, Mus musculus
tgaccttgccaaggcctgccttagg

SEQ ID NO: 849275 - DNA, 25 bp, Mus musculus
tgaccttgcccacatccagaaagca

SEQ ID NO: 849276 - DNA, 25 bp, Mus musculus
tgaccttgcccagatccagaaagca

SEQ ID NO: 849277 - DNA, 25 bp, Mus musculus
tgaccttgcggtcattacaaaacag

SEQ ID NO: 849278 - DNA, 25 bp, Mus musculus
tgaccttgcggtgattacaaaacag

SEQ ID NO: 849279 - DNA, 25 bp, Mus musculus
tgaccttgctggatctttgctggag

SEQ ID NO: 849280 - DNA, 25 bp, Mus musculus
tgaccttgctggttctttgctggag

SEQ ID NO: 849281 - DNA, 25 bp, Mus musculus
tgaccttgcttgcattcctgaccct

SEQ ID NO: 849282 - DNA, 25 bp, Mus musculus
tgaccttgcttggattcctgaccct

SEQ ID NO: 849283 - DNA, 25 bp, Mus musculus
tgaccttgctttctttacagcttag

SEQ ID NO: 849284 - DNA, 25 bp, Mus musculus
tgaccttgctttgtttacagcttag

SEQ ID NO: 849285 - DNA, 25 bp, Mus musculus
tgaccttggacaaactagtcttcaa

SEQ ID NO: 849286 - DNA, 25 bp, Mus musculus
tgaccttggacacgctggtttacct

SEQ ID NO: 849287 - DNA, 25 bp, Mus musculus
tgaccttggacaggctggtttacct

SEQ ID NO: 849288 - DNA, 25 bp, Mus musculus
tgaccttggacatactagtcttcaa

SEQ ID NO: 849289 - DNA, 25 bp, Mus musculus
tgaccttggactcgtcctcgtccgt

SEQ ID NO: 849290 - DNA, 25 bp, Mus musculus
tgaccttggactggtcctcgtccgt

SEQ ID NO: 849291 - DNA, 25 bp, Mus musculus
tgaccttggatacccctaattgttg

SEQ ID NO: 849292 - DNA, 25 bp, Mus musculus
tgaccttggatagccctaattgttg

SEQ ID NO: 849293 - DNA, 25 bp, Mus musculus
tgaccttggatgctacatcttgccc

SEQ ID NO: 849294 - DNA, 25 bp, Mus musculus
tgaccttggatggtacatcttgccc

SEQ ID NO: 849295 - DNA, 25 bp, Mus musculus
tgaccttgggtaaagttccttcatt

SEQ ID NO: 849296 - DNA, 25 bp, Mus musculus
tgaccttgggtatagttccttcatt

SEQ ID NO: 849297 - DNA, 25 bp, Mus musculus
tgaccttgggtcctcagcacatgct

SEQ ID NO: 849298 - DNA, 25 bp, Mus musculus
tgaccttgggtcgtcagcacatgct

SEQ ID NO: 849299 - DNA, 25 bp, Mus musculus
tgaccttgtgaccagagttgggact

SEQ ID NO: 849300 - DNA, 25 bp, Mus musculus
tgaccttgtgacgagagttgggact

SEQ ID NO: 849301 - DNA, 25 bp, Mus musculus
tgaccttgtggaactgtctcagaga

SEQ ID NO: 849302 - DNA, 25 bp, Mus musculus
tgaccttgtggatctgtctcagaga

SEQ ID NO: 849303 - DNA, 25 bp, Mus musculus
tgaccttgtggcaattacattctag

SEQ ID NO: 849304 - DNA, 25 bp, Mus musculus
tgaccttgtggctattacattctag

SEQ ID NO: 849305 - DNA, 25 bp, Mus musculus
tgaccttgtggtctactttctagag

SEQ ID NO: 849306 - DNA, 25 bp, Mus musculus
tgaccttgtggtgtactttctagag

SEQ ID NO: 849307 - DNA, 25 bp, Mus musculus
tgaccttgttttcctatattttaaa

SEQ ID NO: 849308 - DNA, 25 bp, Mus musculus
tgaccttgttttgctatattttaaa

SEQ ID NO: 849309 - DNA, 25 bp, Mus musculus
tgacctttaaaaatataactgatag

SEQ ID NO: 849310 - DNA, 25 bp, Mus musculus
tgacctttaaaattataactgatag

SEQ ID NO: 849311 - DNA, 25 bp, Mus musculus
tgacctttaaccatcacttatccaa

SEQ ID NO: 849312 - DNA, 25 bp, Mus musculus
tgacctttaacccacataagcgaat

SEQ ID NO: 849313 - DNA, 25 bp, Mus musculus
tgacctttaaccgacataagcgaat

SEQ ID NO: 849314 - DNA, 25 bp, Mus musculus
tgacctttaaccttcacttatccaa

SEQ ID NO: 849315 - DNA, 25 bp, Mus musculus
tgacctttaattcctaacccctctg

SEQ ID NO: 849316 - DNA, 25 bp, Mus musculus
tgacctttaattgctaacccctctg

SEQ ID NO: 849317 - DNA, 25 bp, Mus musculus
tgacctttaccaaacttctgagctc

SEQ ID NO: 849318 - DNA, 25 bp, Mus musculus
tgacctttaccatacttctgagctc

SEQ ID NO: 849319 - DNA, 25 bp, Mus musculus
tgacctttacttatgaccatcatct

SEQ ID NO: 849320 - DNA, 25 bp, Mus musculus
tgacctttacttttgaccatcatct

SEQ ID NO: 849321 - DNA, 25 bp, Mus musculus
tgacctttagctagtgggactgcag

SEQ ID NO: 849322 - DNA, 25 bp, Mus musculus
tgacctttagcttgtgggactgcag

SEQ ID NO: 849323 - DNA, 25 bp, Mus musculus
tgacctttatcccttgaggactcag

SEQ ID NO: 849324 - DNA, 25 bp, Mus musculus
tgacctttatccgttgaggactcag

SEQ ID NO: 849325 - DNA, 25 bp, Mus musculus
tgacctttccatccagagttcgtgt

SEQ ID NO: 849326 - DNA, 25 bp, Mus musculus
tgacctttccatgcagagttcgtgt

SEQ ID NO: 849327 - DNA, 25 bp, Mus musculus
tgacctttcgtaattctcttacatt

SEQ ID NO: 849328 - DNA, 25 bp, Mus musculus
tgacctttcgtatttctcttacatt

SEQ ID NO: 849329 - DNA, 25 bp, Mus musculus
tgacctttctgtacttgagcctgta

SEQ ID NO: 849330 - DNA, 25 bp, Mus musculus
tgacctttctgttcttgagcctgta

SEQ ID NO: 849331 - DNA, 25 bp, Mus musculus
tgacctttgaaaagttacctcctgg

SEQ ID NO: 849332 - DNA, 25 bp, Mus musculus
tgacctttgaaatgttacctcctgg

SEQ ID NO: 849333 - DNA, 25 bp, Mus musculus
tgacctttgaccataatgatctccc

SEQ ID NO: 849334 - DNA, 25 bp, Mus musculus
tgacctttgaccttaatgatctccc

SEQ ID NO: 849335 - DNA, 25 bp, Mus musculus
tgacctttgattcgagaagtacccc

SEQ ID NO: 849336 - DNA, 25 bp, Mus musculus
tgacctttgattggagaagtacccc

SEQ ID NO: 849337 - DNA, 25 bp, Mus musculus
tgacctttgctcaggatagcgccga

SEQ ID NO: 849338 - DNA, 25 bp, Mus musculus
tgacctttgctctggatagcgccga

SEQ ID NO: 849339 - DNA, 25 bp, Mus musculus
tgacctttgggaagctgatttactt

SEQ ID NO: 849340 - DNA, 25 bp, Mus musculus
tgacctttgggatgctgatttactt

SEQ ID NO: 849341 - DNA, 25 bp, Mus musculus
tgacctttgtacctaaccatgtttg

SEQ ID NO: 849342 - DNA, 25 bp, Mus musculus
tgacctttgtacgtaaccatgtttg

SEQ ID NO: 849343 - DNA, 25 bp, Mus musculus
tgacctttgtccagggagttcttta

SEQ ID NO: 849344 - DNA, 25 bp, Mus musculus
tgacctttgtcctgggagttcttta

SEQ ID NO: 849345 - DNA, 25 bp, Mus musculus
tgacctttgtggagtcaaaattgag

SEQ ID NO: 849346 - DNA, 25 bp, Mus musculus
tgacctttgtggcagccatcttcaa

SEQ ID NO: 849347 - DNA, 25 bp, Mus musculus
tgacctttgtgggagccatcttcaa

SEQ ID NO: 849348 - DNA, 25 bp, Mus musculus
tgacctttgtggtgtcaaaattgag

SEQ ID NO: 849349 - DNA, 25 bp, Mus musculus
tgacctttgtgtatcagctctaaaa

SEQ ID NO: 849350 - DNA, 25 bp, Mus musculus
tgacctttgtgtttcagctctaaaa

SEQ ID NO: 849351 - DNA, 25 bp, Mus musculus
tgaccttttaatcttgttccttgtg

SEQ ID NO: 849352 - DNA, 25 bp, Mus musculus
tgaccttttaatgttgttccttgtg

SEQ ID NO: 849353 - DNA, 25 bp, Mus musculus
tgaccttttcatcccactggacaaa

SEQ ID NO: 849354 - DNA, 25 bp, Mus musculus
tgaccttttcatccccatgcagttt

SEQ ID NO: 849355 - DNA, 25 bp, Mus musculus
tgaccttttcatgccactggacaaa

SEQ ID NO: 849356 - DNA, 25 bp, Mus musculus
tgaccttttcatgcccatgcagttt

SEQ ID NO: 849357 - DNA, 25 bp, Mus musculus
tgaccttttccacaagtgcttagta

SEQ ID NO: 849358 - DNA, 25 bp, Mus musculus
tgaccttttccagaagtgcttagta

SEQ ID NO: 849359 - DNA, 25 bp, Mus musculus
tgaccttttgagcagaactccctat

SEQ ID NO: 849360 - DNA, 25 bp, Mus musculus
tgaccttttgaggagaactccctat

SEQ ID NO: 849361 - DNA, 25 bp, Mus musculus
tgaccttttgcaacttctcatcaac

SEQ ID NO: 849362 - DNA, 25 bp, Mus musculus
tgaccttttgcatcttctcatcaac

SEQ ID NO: 849363 - DNA, 25 bp, Mus musculus
tgaccttttggtactggcattcttg

SEQ ID NO: 849364 - DNA, 25 bp, Mus musculus
tgaccttttggttctggcattcttg

SEQ ID NO: 849365 - DNA, 25 bp, Mus musculus
tgaccttttgtcacagcctcccaaa

SEQ ID NO: 849366 - DNA, 25 bp, Mus musculus
tgaccttttgtctcagcctcccaaa

SEQ ID NO: 849367 - DNA, 25 bp, Mus musculus
tgacctttttatacaaattattttg

SEQ ID NO: 849368 - DNA, 25 bp, Mus musculus
tgacctttttattcaaattattttg

SEQ ID NO: 849369 - DNA, 25 bp, Mus musculus
tgaccttttttaatttgttgcaaag

SEQ ID NO: 849370 - DNA, 25 bp, Mus musculus
tgaccttttttattttgttgcaaag

SEQ ID NO: 849371 - DNA, 25 bp, Mus musculus
tgacgaaaactgagactcccagcgg

SEQ ID NO: 849372 - DNA, 25 bp, Mus musculus
tgacgaaaactgtgactcccagcgg

SEQ ID NO: 849373 - DNA, 25 bp, Mus musculus
tgacgaaatcagaatcaggacttag

SEQ ID NO: 849374 - DNA, 25 bp, Mus musculus
tgacgaaatcagtatcaggacttag

SEQ ID NO: 849375 - DNA, 25 bp, Mus musculus
tgacgaaatccacgcccatccatgt

SEQ ID NO: 849376 - DNA, 25 bp, Mus musculus
tgacgaaatccaggcccatccatgt

SEQ ID NO: 849377 - DNA, 25 bp, Mus musculus
tgacgaacacacaaagggcctggac

SEQ ID NO: 849378 - DNA, 25 bp, Mus musculus
tgacgaacacactaagggcctggac

SEQ ID NO: 849379 - DNA, 25 bp, Mus musculus
tgacgaacatctcggtttcctgttt

SEQ ID NO: 849380 - DNA, 25 bp, Mus musculus
tgacgaacatctgggtttcctgttt

SEQ ID NO: 849381 - DNA, 25 bp, Mus musculus
tgacgaactttgaccaccagaactc

SEQ ID NO: 849382 - DNA, 25 bp, Mus musculus
tgacgaactttgtccaccagaactc

SEQ ID NO: 849383 - DNA, 25 bp, Mus musculus
tgacgaagttaccagcatccaccac

SEQ ID NO: 849384 - DNA, 25 bp, Mus musculus
tgacgaagttacgagcatccaccac

SEQ ID NO: 849385 - DNA, 25 bp, Mus musculus
tgacgacacacacatcagggctgta

SEQ ID NO: 849386 - DNA, 25 bp, Mus musculus
tgacgacacacagatcagggctgta

SEQ ID NO: 849387 - DNA, 25 bp, Mus musculus
tgacgacagtttccacgtgcccgga

SEQ ID NO: 849388 - DNA, 25 bp, Mus musculus
tgacgacagtttgcacgtgcccgga

SEQ ID NO: 849389 - DNA, 25 bp, Mus musculus
tgacgaccatcaccaggcttcggaa

SEQ ID NO: 849390 - DNA, 25 bp, Mus musculus
tgacgaccatcagcaggcttcggaa

SEQ ID NO: 849391 - DNA, 25 bp, Mus musculus
tgacgacctcccaacgagaacatgc

SEQ ID NO: 849392 - DNA, 25 bp, Mus musculus
tgacgacctccctacgagaacatgc

SEQ ID NO: 849393 - DNA, 25 bp, Mus musculus
tgacgacgagtgactgtgaagctat

SEQ ID NO: 849394 - DNA, 25 bp, Mus musculus
tgacgacgagtgtctgtgaagctat

SEQ ID NO: 849395 - DNA, 25 bp, Mus musculus
tgacgacgcatgagagccgctttgg

SEQ ID NO: 849396 - DNA, 25 bp, Mus musculus
tgacgacgcatgtgagccgctttgg

SEQ ID NO: 849397 - DNA, 25 bp, Mus musculus
tgacgacgtgaacgaacagatttac

SEQ ID NO: 849398 - DNA, 25 bp, Mus musculus
tgacgacgtgaaggaacagatttac

SEQ ID NO: 849399 - DNA, 25 bp, Mus musculus
tgacgactccagacactccgtgtga

SEQ ID NO: 849400 - DNA, 25 bp, Mus musculus
tgacgactccagtcactccgtgtga

SEQ ID NO: 849401 - DNA, 25 bp, Mus musculus
tgacgactcggcatgatcagctcaa

SEQ ID NO: 849402 - DNA, 25 bp, Mus musculus
tgacgactcggcttgatcagctcaa

SEQ ID NO: 849403 - DNA, 25 bp, Mus musculus
tgacgactgctgagtttgcttctct

SEQ ID NO: 849404 - DNA, 25 bp, Mus musculus
tgacgactgctgtgtttgcttctct

SEQ ID NO: 849405 - DNA, 25 bp, Mus musculus
tgacgagaacggacagtgacagaag

SEQ ID NO: 849406 - DNA, 25 bp, Mus musculus
tgacgagaacggtcagtgacagaag

SEQ ID NO: 849407 - DNA, 25 bp, Mus musculus
tgacgagacccgcaatctgcagagt

SEQ ID NO: 849408 - DNA, 25 bp, Mus musculus
tgacgagacccggaatctgcagagt

SEQ ID NO: 849409 - DNA, 25 bp, Mus musculus
tgacgagagcctccgttcttctgcc

SEQ ID NO: 849410 - DNA, 25 bp, Mus musculus
tgacgagagcctgcgttcttctgcc

SEQ ID NO: 849411 - DNA, 25 bp, Mus musculus
tgacgagattcaacgagaactccgt

SEQ ID NO: 849412 - DNA, 25 bp, Mus musculus
tgacgagattcatcgagaactccgt

SEQ ID NO: 849413 - DNA, 25 bp, Mus musculus
tgacgagcccttagattcagagcag

SEQ ID NO: 849414 - DNA, 25 bp, Mus musculus
tgacgagccctttgattcagagcag

SEQ ID NO: 849415 - DNA, 25 bp, Mus musculus
tgacgagccgttcaagattgaattt

SEQ ID NO: 849416 - DNA, 25 bp, Mus musculus
tgacgagccgttgaagattgaattt

SEQ ID NO: 849417 - DNA, 25 bp, Mus musculus
tgacgaggaccacccaggacacaga

SEQ ID NO: 849418 - DNA, 25 bp, Mus musculus
tgacgaggaccagccaggacacaga

SEQ ID NO: 849419 - DNA, 25 bp, Mus musculus
tgacgaggccacagtcaatcagttt

SEQ ID NO: 849420 - DNA, 25 bp, Mus musculus
tgacgaggccactgtcaatcagttt

SEQ ID NO: 849421 - DNA, 25 bp, Mus musculus
tgacgaggctggctcccgatgacac

SEQ ID NO: 849422 - DNA, 25 bp, Mus musculus
tgacgaggctgggtcccgatgacac

SEQ ID NO: 849423 - DNA, 25 bp, Mus musculus
tgacgagtacgcactgctattcagc

SEQ ID NO: 849424 - DNA, 25 bp, Mus musculus
tgacgagtacgctctgctattcagc

SEQ ID NO: 849425 - DNA, 25 bp, Mus musculus
tgacgagtccaaccttacagccatg

SEQ ID NO: 849426 - DNA, 25 bp, Mus musculus
tgacgagtccaagcttacagccatg

SEQ ID NO: 849427 - DNA, 25 bp, Mus musculus
tgacgagtggttagctacgaggaat

SEQ ID NO: 849428 - DNA, 25 bp, Mus musculus
tgacgagtggtttgctacgaggaat

SEQ ID NO: 849429 - DNA, 25 bp, Mus musculus
tgacgagttcacatgtcgtgtctcc

SEQ ID NO: 849430 - DNA, 25 bp, Mus musculus
tgacgagttcacttgtcgtgtctcc

SEQ ID NO: 849431 - DNA, 25 bp, Mus musculus
tgacgagttcatctgcccaataacc

SEQ ID NO: 849432 - DNA, 25 bp, Mus musculus
tgacgagttcatgtgcccaataacc

SEQ ID NO: 849433 - DNA, 25 bp, Mus musculus
tgacgataaccacaccaccatttac

SEQ ID NO: 849434 - DNA, 25 bp, Mus musculus
tgacgataaccagaccaccatttac

SEQ ID NO: 849435 - DNA, 25 bp, Mus musculus
tgacgatccttaagactgcatccga

SEQ ID NO: 849436 - DNA, 25 bp, Mus musculus
tgacgatccttatgactgcatccga

SEQ ID NO: 849437 - DNA, 25 bp, Mus musculus
tgacgatgcgacatcactttacgac

SEQ ID NO: 849438 - DNA, 25 bp, Mus musculus
tgacgatgcgacttcactttacgac

SEQ ID NO: 849439 - DNA, 25 bp, Mus musculus
tgacgattcctgcatccgctaagtt

SEQ ID NO: 849440 - DNA, 25 bp, Mus musculus
tgacgattcctggatccgctaagtt

SEQ ID NO: 849441 - DNA, 25 bp, Mus musculus
tgacgattccttatgggtgggccaa

SEQ ID NO: 849442 - DNA, 25 bp, Mus musculus
tgacgattccttttgggtgggccaa

SEQ ID NO: 849443 - DNA, 25 bp, Mus musculus
tgacgatttattactcgctgtgaaa

SEQ ID NO: 849444 - DNA, 25 bp, Mus musculus
tgacgatttatttctcgctgtgaaa

SEQ ID NO: 849445 - DNA, 25 bp, Mus musculus
tgacgatttggcatgcctgaagctg

SEQ ID NO: 849446 - DNA, 25 bp, Mus musculus
tgacgatttggcttgcctgaagctg

SEQ ID NO: 849447 - DNA, 25 bp, Mus musculus
tgacgattttcccaggatcattact

SEQ ID NO: 849448 - DNA, 25 bp, Mus musculus
tgacgattttccgaggatcattact

SEQ ID NO: 849449 - DNA, 25 bp, Mus musculus
tgacgcaagcctaacagagtccctt

SEQ ID NO: 849450 - DNA, 25 bp, Mus musculus
tgacgcaagccttacagagtccctt

SEQ ID NO: 849451 - DNA, 25 bp, Mus musculus
tgacgcaccggaaggactccattga

SEQ ID NO: 849452 - DNA, 25 bp, Mus musculus
tgacgcaccggatggactccattga

SEQ ID NO: 849453 - DNA, 25 bp, Mus musculus
tgacgcacgcatctcaaggtttcag

SEQ ID NO: 849454 - DNA, 25 bp, Mus musculus
tgacgcacgcatgtcaaggtttcag

SEQ ID NO: 849455 - DNA, 25 bp, Mus musculus
tgacgcagacggcccaacaacagag

SEQ ID NO: 849456 - DNA, 25 bp, Mus musculus
tgacgcagacgggccaacaacagag

SEQ ID NO: 849457 - DNA, 25 bp, Mus musculus
tgacgcagcaccagctgcagcggcg

SEQ ID NO: 849458 - DNA, 25 bp, Mus musculus
tgacgcagcacctgctgcagcggcg

SEQ ID NO: 849459 - DNA, 25 bp, Mus musculus
tgacgcagtttgaacagcagcccga

SEQ ID NO: 849460 - DNA, 25 bp, Mus musculus
tgacgcagtttgtacagcagcccga

SEQ ID NO: 849461 - DNA, 25 bp, Mus musculus
tgacgcatcgctatctgactctgac

SEQ ID NO: 849462 - DNA, 25 bp, Mus musculus
tgacgcatcgctttctgactctgac

SEQ ID NO: 849463 - DNA, 25 bp, Mus musculus
tgacgccaaaagatcagctgacatt

SEQ ID NO: 849464 - DNA, 25 bp, Mus musculus
tgacgccaaaagttcagctgacatt

SEQ ID NO: 849465 - DNA, 25 bp, Mus musculus
tgacgccaaggcatatttcttcatg

SEQ ID NO: 849466 - DNA, 25 bp, Mus musculus
tgacgccaaggcttatttcttcatg

SEQ ID NO: 849467 - DNA, 25 bp, Mus musculus
tgacgccatgagaccctcgttcgaa

SEQ ID NO: 849468 - DNA, 25 bp, Mus musculus
tgacgccatgagtccctcgttcgaa

SEQ ID NO: 849469 - DNA, 25 bp, Mus musculus
tgacgccatgatcactgccctcaaa

SEQ ID NO: 849470 - DNA, 25 bp, Mus musculus
tgacgccatgatgactgccctcaaa

SEQ ID NO: 849471 - DNA, 25 bp, Mus musculus
tgacgcccaacccagcaaggctgga

SEQ ID NO: 849472 - DNA, 25 bp, Mus musculus
tgacgcccaaccgagcaaggctgga

SEQ ID NO: 849473 - DNA, 25 bp, Mus musculus
tgacgcccaagtctgcagtgcagac

SEQ ID NO: 849474 - DNA, 25 bp, Mus musculus
tgacgcccaagtgtgcagtgcagac

SEQ ID NO: 849475 - DNA, 25 bp, Mus musculus
tgacgccccaaaccctactaggaat

SEQ ID NO: 849476 - DNA, 25 bp, Mus musculus
tgacgccccaaagcctactaggaat

SEQ ID NO: 849477 - DNA, 25 bp, Mus musculus
tgacgccctgacctcgctcggaaag

SEQ ID NO: 849478 - DNA, 25 bp, Mus musculus
tgacgccctgacgtcgctcggaaag

SEQ ID NO: 849479 - DNA, 25 bp, Mus musculus
tgacgccctgggatcatgcctagga

SEQ ID NO: 849480 - DNA, 25 bp, Mus musculus
tgacgccctgggttcatgcctagga

SEQ ID NO: 849481 - DNA, 25 bp, Mus musculus
tgacgcccttcaccagaagcagctg

SEQ ID NO: 849482 - DNA, 25 bp, Mus musculus
tgacgcccttcagcagaagcagctg

SEQ ID NO: 849483 - DNA, 25 bp, Mus musculus
tgacgccgtcacagcttgcaaagaa

SEQ ID NO: 849484 - DNA, 25 bp, Mus musculus
tgacgccgtcactgcttgcaaagaa

SEQ ID NO: 849485 - DNA, 25 bp, Mus musculus
tgacgcctcagcattggcattccag

SEQ ID NO: 849486 - DNA, 25 bp, Mus musculus
tgacgcctcagctttggcattccag

SEQ ID NO: 849487 - DNA, 25 bp, Mus musculus
tgacgcctcaggcacagagagacct

SEQ ID NO: 849488 - DNA, 25 bp, Mus musculus
tgacgcctcagggacagagagacct

SEQ ID NO: 849489 - DNA, 25 bp, Mus musculus
tgacgcctgaggatccccagtgtgg

SEQ ID NO: 849490 - DNA, 25 bp, Mus musculus
tgacgcctgaggttccccagtgtgg

SEQ ID NO: 849491 - DNA, 25 bp, Mus musculus
tgacgcctgtacagggtaggtttgt

SEQ ID NO: 849492 - DNA, 25 bp, Mus musculus
tgacgcctgtactgggtaggtttgt

SEQ ID NO: 849493 - DNA, 25 bp, Mus musculus
tgacgccttcatctcaggactggga

SEQ ID NO: 849494 - DNA, 25 bp, Mus musculus
tgacgccttcatgtcaggactggga

SEQ ID NO: 849495 - DNA, 25 bp, Mus musculus
tgacgccttggcagtgatgcagcag

SEQ ID NO: 849496 - DNA, 25 bp, Mus musculus
tgacgccttggctgtgatgcagcag

SEQ ID NO: 849497 - DNA, 25 bp, Mus musculus
tgacgcctttctcaccagagcaaag

SEQ ID NO: 849498 - DNA, 25 bp, Mus musculus
tgacgcctttctgaccagagcaaag

SEQ ID NO: 849499 - DNA, 25 bp, Mus musculus
tgacgcgacactcgaaaccgctgag

SEQ ID NO: 849500 - DNA, 25 bp, Mus musculus
tgacgcgacactggaaaccgctgag

SEQ ID NO: 849501 - DNA, 25 bp, Mus musculus
tgacgcgcaagcactacaagtgcat

SEQ ID NO: 849502 - DNA, 25 bp, Mus musculus
tgacgcgcaagctctacaagtgcat

SEQ ID NO: 849503 - DNA, 25 bp, Mus musculus
tgacgcggcgctatggcataaggac

SEQ ID NO: 849504 - DNA, 25 bp, Mus musculus
tgacgcggcgctttggcataaggac

SEQ ID NO: 849505 - DNA, 25 bp, Mus musculus
tgacgcggctgtacactgtgtttgg

SEQ ID NO: 849506 - DNA, 25 bp, Mus musculus
tgacgcggctgttcactgtgtttgg

SEQ ID NO: 849507 - DNA, 25 bp, Mus musculus
tgacgctaacagaaggagaggtgac

SEQ ID NO: 849508 - DNA, 25 bp, Mus musculus
tgacgctaacagtaggagaggtgac

SEQ ID NO: 849509 - DNA, 25 bp, Mus musculus
tgacgctactgcagctcagcatcaa

SEQ ID NO: 849510 - DNA, 25 bp, Mus musculus
tgacgctactgctgctcagcatcaa

SEQ ID NO: 849511 - DNA, 25 bp, Mus musculus
tgacgctcagatcaagtgtgctcta

SEQ ID NO: 849512 - DNA, 25 bp, Mus musculus
tgacgctcagatgaagtgtgctcta

SEQ ID NO: 849513 - DNA, 25 bp, Mus musculus
tgacgctccagtacgtgctctgcat

SEQ ID NO: 849514 - DNA, 25 bp, Mus musculus
tgacgctccagttcgtgctctgcat

SEQ ID NO: 849515 - DNA, 25 bp, Mus musculus
tgacgctcccggagtgatggttaac

SEQ ID NO: 849516 - DNA, 25 bp, Mus musculus
tgacgctcccggtgtgatggttaac

SEQ ID NO: 849517 - DNA, 25 bp, Mus musculus
tgacgctcgtcgactatgacatggt

SEQ ID NO: 849518 - DNA, 25 bp, Mus musculus
tgacgctcgtcgtctatgacatggt

SEQ ID NO: 849519 - DNA, 25 bp, Mus musculus
tgacgctgagaacgacagaccctgt

SEQ ID NO: 849520 - DNA, 25 bp, Mus musculus
tgacgctgagaaggacagaccctgt

SEQ ID NO: 849521 - DNA, 25 bp, Mus musculus
tgacgctgcaaactacacatcgctg

SEQ ID NO: 849522 - DNA, 25 bp, Mus musculus
tgacgctgcaaagtacacatcgctg

SEQ ID NO: 849523 - DNA, 25 bp, Mus musculus
tgacgctggacgcaggcaaactcat

SEQ ID NO: 849524 - DNA, 25 bp, Mus musculus
tgacgctggacggaggcaaactcat

SEQ ID NO: 849525 - DNA, 25 bp, Mus musculus
tgacgctggcacctatcagtgtgga

SEQ ID NO: 849526 - DNA, 25 bp, Mus musculus
tgacgctggcacgtatcagtgtgga

SEQ ID NO: 849527 - DNA, 25 bp, Mus musculus
tgacgctgggccacaagctccttag

SEQ ID NO: 849528 - DNA, 25 bp, Mus musculus
tgacgctgggcctcaagctccttag

SEQ ID NO: 849529 - DNA, 25 bp, Mus musculus
tgacgctgtcctatcctcctctctg

SEQ ID NO: 849530 - DNA, 25 bp, Mus musculus
tgacgctgtcctttcctcctctctg

SEQ ID NO: 849531 - DNA, 25 bp, Mus musculus
tgacgctgttgccaagtgggaccac

SEQ ID NO: 849532 - DNA, 25 bp, Mus musculus
tgacgctgttgcgaagtgggaccac

SEQ ID NO: 849533 - DNA, 25 bp, Mus musculus
tgacgcttcactatccaggatcact

SEQ ID NO: 849534 - DNA, 25 bp, Mus musculus
tgacgcttcactttccaggatcact

SEQ ID NO: 849535 - DNA, 25 bp, Mus musculus
tgacgcttggcacccagatacatgg

SEQ ID NO: 849536 - DNA, 25 bp, Mus musculus
tgacgcttggcagccagatacatgg

SEQ ID NO: 849537 - DNA, 25 bp, Mus musculus
tgacgcttgtaaagacgtccctgcg

SEQ ID NO: 849538 - DNA, 25 bp, Mus musculus
tgacgcttgtaatgacgtccctgcg

SEQ ID NO: 849539 - DNA, 25 bp, Mus musculus
tgacgctttcatagcacgctttccc

SEQ ID NO: 849540 - DNA, 25 bp, Mus musculus
tgacgctttcattgcacgctttccc

SEQ ID NO: 849541 - DNA, 25 bp, Mus musculus
tgacgctttcgcagctcttgagaat

SEQ ID NO: 849542 - DNA, 25 bp, Mus musculus
tgacgctttcgctgctcttgagaat

SEQ ID NO: 849543 - DNA, 25 bp, Mus musculus
tgacgctttgaaagtaattggcccc

SEQ ID NO: 849544 - DNA, 25 bp, Mus musculus
tgacgctttgaatgtaattggcccc

SEQ ID NO: 849545 - DNA, 25 bp, Mus musculus
tgacgctttgttcctagctccaaaa

SEQ ID NO: 849546 - DNA, 25 bp, Mus musculus
tgacgctttgttgctagctccaaaa

SEQ ID NO: 849547 - DNA, 25 bp, Mus musculus
tgacggaactatcaaccctggaatt

SEQ ID NO: 849548 - DNA, 25 bp, Mus musculus
tgacggaactatgaaccctggaatt

SEQ ID NO: 849549 - DNA, 25 bp, Mus musculus
tgacggaagggcaccaccaggagtg

SEQ ID NO: 849550 - DNA, 25 bp, Mus musculus
tgacggaagggctccaccaggagtg

SEQ ID NO: 849551 - DNA, 25 bp, Mus musculus
tgacggacccttcagacatttcaaa

SEQ ID NO: 849552 - DNA, 25 bp, Mus musculus
tgacggacccttgagacatttcaaa

SEQ ID NO: 849553 - DNA, 25 bp, Mus musculus
tgacggaccggtacaccatccacag

SEQ ID NO: 849554 - DNA, 25 bp, Mus musculus
tgacggaccggttcaccatccacag

SEQ ID NO: 849555 - DNA, 25 bp, Mus musculus
tgacggacctacagcgagcagagca

SEQ ID NO: 849556 - DNA, 25 bp, Mus musculus
tgacggacctactgcgagcagagca

SEQ ID NO: 849557 - DNA, 25 bp, Mus musculus
tgacggactctacagctcaagcgga

SEQ ID NO: 849558 - DNA, 25 bp, Mus musculus
tgacggactctagagctcaagcgga

SEQ ID NO: 849559 - DNA, 25 bp, Mus musculus
tgacggactggtaggctggccacca

SEQ ID NO: 849560 - DNA, 25 bp, Mus musculus
tgacggactggttggctggccacca

SEQ ID NO: 849561 - DNA, 25 bp, Mus musculus
tgacggagacatatgtgctcacaat

SEQ ID NO: 849562 - DNA, 25 bp, Mus musculus
tgacggagacatttgtgctcacaat

SEQ ID NO: 849563 - DNA, 25 bp, Mus musculus
tgacggaggcacctactgctgcaaa

SEQ ID NO: 849564 - DNA, 25 bp, Mus musculus
tgacggaggcacgtactgctgcaaa

SEQ ID NO: 849565 - DNA, 25 bp, Mus musculus
tgacggatgaccctgagattgccac

SEQ ID NO: 849566 - DNA, 25 bp, Mus musculus
tgacggatgaccgtgagattgccac

SEQ ID NO: 849567 - DNA, 25 bp, Mus musculus
tgacggattaaaccctcaatgactg

SEQ ID NO: 849568 - DNA, 25 bp, Mus musculus
tgacggattaaagcctcaatgactg

SEQ ID NO: 849569 - DNA, 25 bp, Mus musculus
tgacggattagtaattcctgtgggt

SEQ ID NO: 849570 - DNA, 25 bp, Mus musculus
tgacggattagttattcctgtgggt

SEQ ID NO: 849571 - DNA, 25 bp, Mus musculus
tgacggattcgcacttcctgtgggt

SEQ ID NO: 849572 - DNA, 25 bp, Mus musculus
tgacggattcgctcttcctgtgggt

SEQ ID NO: 849573 - DNA, 25 bp, Mus musculus
tgacggcaccagctcctatttcgga

SEQ ID NO: 849574 - DNA, 25 bp, Mus musculus
tgacggcaccaggtcctatttcgga

SEQ ID NO: 849575 - DNA, 25 bp, Mus musculus
tgacggcaccatcgcgtttatgttt

SEQ ID NO: 849576 - DNA, 25 bp, Mus musculus
tgacggcaccatggcgtttatgttt

SEQ ID NO: 849577 - DNA, 25 bp, Mus musculus
tgacggcagacacttcctctaacac

SEQ ID NO: 849578 - DNA, 25 bp, Mus musculus
tgacggcagacagttcctctaacac

SEQ ID NO: 849579 - DNA, 25 bp, Mus musculus
tgacggcattttataacatttactg

SEQ ID NO: 849580 - DNA, 25 bp, Mus musculus
tgacggcattttttaacatttactg

SEQ ID NO: 849581 - DNA, 25 bp, Mus musculus
tgacggccaaatccccatttggagt

SEQ ID NO: 849582 - DNA, 25 bp, Mus musculus
tgacggccaaatgcccatttggagt

SEQ ID NO: 849583 - DNA, 25 bp, Mus musculus
tgacggccaattagcctttctcatc

SEQ ID NO: 849584 - DNA, 25 bp, Mus musculus
tgacggccaatttgcctttctcatc

SEQ ID NO: 849585 - DNA, 25 bp, Mus musculus
tgacggccctctacccagtttaagg

SEQ ID NO: 849586 - DNA, 25 bp, Mus musculus
tgacggccctcttcccagtttaagg

SEQ ID NO: 849587 - DNA, 25 bp, Mus musculus
tgacggcctgtgatatggagctgca

SEQ ID NO: 849588 - DNA, 25 bp, Mus musculus
tgacggcctgtgttatggagctgca

SEQ ID NO: 849589 - DNA, 25 bp, Mus musculus
tgacggcgaactaggagacctggat

SEQ ID NO: 849590 - DNA, 25 bp, Mus musculus
tgacggcgaacttggagacctggat

SEQ ID NO: 849591 - DNA, 25 bp, Mus musculus
tgacggcggaagacgattcctccat

SEQ ID NO: 849592 - DNA, 25 bp, Mus musculus
tgacggcggaagtcgattcctccat

SEQ ID NO: 849593 - DNA, 25 bp, Mus musculus
tgacggcggctcacctcgaacgtgt

SEQ ID NO: 849594 - DNA, 25 bp, Mus musculus
tgacggcggctctcctcgaacgtgt

SEQ ID NO: 849595 - DNA, 25 bp, Mus musculus
tgacggctaataatggctccacttg

SEQ ID NO: 849596 - DNA, 25 bp, Mus musculus
tgacggctaatattggctccacttg

SEQ ID NO: 849597 - DNA, 25 bp, Mus musculus
tgacggctcctcatttagttattta

SEQ ID NO: 849598 - DNA, 25 bp, Mus musculus
tgacggctcctcttttagttattta

SEQ ID NO: 849599 - DNA, 25 bp, Mus musculus
tgacggctctgtccagtacctagtt

SEQ ID NO: 849600 - DNA, 25 bp, Mus musculus
tgacggctctgtccttgcaggagtc

SEQ ID NO: 849601 - DNA, 25 bp, Mus musculus
tgacggctctgtgcagtacctagtt

SEQ ID NO: 849602 - DNA, 25 bp, Mus musculus
tgacggctctgtgcttgcaggagtc

SEQ ID NO: 849603 - DNA, 25 bp, Mus musculus
tgacggctgaggacctgacgcagat

SEQ ID NO: 849604 - DNA, 25 bp, Mus musculus
tgacggctgaggtcctgacgcagat

SEQ ID NO: 849605 - DNA, 25 bp, Mus musculus
tgacggcttctgaacgcaggagact

SEQ ID NO: 849606 - DNA, 25 bp, Mus musculus
tgacggcttctgtacgcaggagact

SEQ ID NO: 849607 - DNA, 25 bp, Mus musculus
tgacgggaatttctgccaccataga

SEQ ID NO: 849608 - DNA, 25 bp, Mus musculus
tgacgggaatttgtgccaccataga

SEQ ID NO: 849609 - DNA, 25 bp, Mus musculus
tgacgggagcatcaaaaccctactg

SEQ ID NO: 849610 - DNA, 25 bp, Mus musculus
tgacgggagcatgaaaaccctactg

SEQ ID NO: 849611 - DNA, 25 bp, Mus musculus
tgacgggatactcggctccggcacc

SEQ ID NO: 849612 - DNA, 25 bp, Mus musculus
tgacgggatactgggctccggcacc

SEQ ID NO: 849613 - DNA, 25 bp, Mus musculus
tgacgggatcccaatttattatttt

SEQ ID NO: 849614 - DNA, 25 bp, Mus musculus
tgacgggatccctatttattatttt

SEQ ID NO: 849615 - DNA, 25 bp, Mus musculus
tgacgggcatctactaaccaggttg

SEQ ID NO: 849616 - DNA, 25 bp, Mus musculus
tgacgggcatcttctaaccaggttg

SEQ ID NO: 849617 - DNA, 25 bp, Mus musculus
tgacgggtccagagcagtaccgaga

SEQ ID NO: 849618 - DNA, 25 bp, Mus musculus
tgacgggtccagtgcagtaccgaga

SEQ ID NO: 849619 - DNA, 25 bp, Mus musculus
tgacgggtgccaacctcgggtccgc

SEQ ID NO: 849620 - DNA, 25 bp, Mus musculus
tgacgggtgccatcctcgggtccgc

SEQ ID NO: 849621 - DNA, 25 bp, Mus musculus
tgacgggtgccgatcatgagcaatc

SEQ ID NO: 849622 - DNA, 25 bp, Mus musculus
tgacgggtgccgttcatgagcaatc

SEQ ID NO: 849623 - DNA, 25 bp, Mus musculus
tgacggtaccaccaatcaccaagtg

SEQ ID NO: 849624 - DNA, 25 bp, Mus musculus
tgacggtaccacgaatcaccaagtg

SEQ ID NO: 849625 - DNA, 25 bp, Mus musculus
tgacggtagcttctccaacaagcag

SEQ ID NO: 849626 - DNA, 25 bp, Mus musculus
tgacggtagcttgtccaacaagcag

SEQ ID NO: 849627 - DNA, 25 bp, Mus musculus
tgacggtcaggacacaactcttttt

SEQ ID NO: 849628 - DNA, 25 bp, Mus musculus
tgacggtcaggagacaactcttttt

SEQ ID NO: 849629 - DNA, 25 bp, Mus musculus
tgacggtcatcaatttaagtcattt

SEQ ID NO: 849630 - DNA, 25 bp, Mus musculus
tgacggtcatcattttaagtcattt

SEQ ID NO: 849631 - DNA, 25 bp, Mus musculus
tgacggtcatcccagaagagcagac

SEQ ID NO: 849632 - DNA, 25 bp, Mus musculus
tgacggtcatccgagaagagcagac

SEQ ID NO: 849633 - DNA, 25 bp, Mus musculus
tgacggtccagaagcggcagcagca

SEQ ID NO: 849634 - DNA, 25 bp, Mus musculus
tgacggtccagatgcggcagcagca

SEQ ID NO: 849635 - DNA, 25 bp, Mus musculus
tgacggtccaggagtcttcacttca

SEQ ID NO: 849636 - DNA, 25 bp, Mus musculus
tgacggtccaggtgtcttcacttca

SEQ ID NO: 849637 - DNA, 25 bp, Mus musculus
tgacggtccccgagaacgattcagt

SEQ ID NO: 849638 - DNA, 25 bp, Mus musculus
tgacggtccccgtgaacgattcagt

SEQ ID NO: 849639 - DNA, 25 bp, Mus musculus
tgacggtcctggacttttgcagtgc

SEQ ID NO: 849640 - DNA, 25 bp, Mus musculus
tgacggtcctggtcttttgcagtgc

SEQ ID NO: 849641 - DNA, 25 bp, Mus musculus
tgacggtccttgatctacttcagag

SEQ ID NO: 849642 - DNA, 25 bp, Mus musculus
tgacggtccttgttctacttcagag

SEQ ID NO: 849643 - DNA, 25 bp, Mus musculus
tgacggttgaccacagggaccccac

SEQ ID NO: 849644 - DNA, 25 bp, Mus musculus
tgacggttgacctcagggaccccac

SEQ ID NO: 849645 - DNA, 25 bp, Mus musculus
tgacggtttcagcagccacttgtcc

SEQ ID NO: 849646 - DNA, 25 bp, Mus musculus
tgacggtttcaggagccacttgtcc

SEQ ID NO: 849647 - DNA, 25 bp, Mus musculus
tgacgtaaccagatgacccttcaca

SEQ ID NO: 849648 - DNA, 25 bp, Mus musculus
tgacgtaaccagttgacccttcaca

SEQ ID NO: 849649 - DNA, 25 bp, Mus musculus
tgacgtacaatcatttccaaagatc

SEQ ID NO: 849650 - DNA, 25 bp, Mus musculus
tgacgtacaatcttttccaaagatc

SEQ ID NO: 849651 - DNA, 25 bp, Mus musculus
tgacgtaccagtagcggcccaggct

SEQ ID NO: 849652 - DNA, 25 bp, Mus musculus
tgacgtaccagttgcggcccaggct

SEQ ID NO: 849653 - DNA, 25 bp, Mus musculus
tgacgtaccctcagatggcctgctc

SEQ ID NO: 849654 - DNA, 25 bp, Mus musculus
tgacgtaccctctgatggcctgctc

SEQ ID NO: 849655 - DNA, 25 bp, Mus musculus
tgacgtagtgtactgagcatgcaac

SEQ ID NO: 849656 - DNA, 25 bp, Mus musculus
tgacgtagtgtagtgagcatgcaac

SEQ ID NO: 849657 - DNA, 25 bp, Mus musculus
tgacgtattcggcttagggattatt

SEQ ID NO: 849658 - DNA, 25 bp, Mus musculus
tgacgtattcgggttagggattatt

SEQ ID NO: 849659 - DNA, 25 bp, Mus musculus
tgacgtcacaagagcgggggtttta

SEQ ID NO: 849660 - DNA, 25 bp, Mus musculus
tgacgtcacaagtgcgggggtttta

SEQ ID NO: 849661 - DNA, 25 bp, Mus musculus
tgacgtcacatcctgtaaacagccc

SEQ ID NO: 849662 - DNA, 25 bp, Mus musculus
tgacgtcacatcgtgtaaacagccc

SEQ ID NO: 849663 - DNA, 25 bp, Mus musculus
tgacgtcaccagatatatctgtgaa

SEQ ID NO: 849664 - DNA, 25 bp, Mus musculus
tgacgtcaccagttatatctgtgaa

SEQ ID NO: 849665 - DNA, 25 bp, Mus musculus
tgacgtcactgcaccatcagggtga

SEQ ID NO: 849666 - DNA, 25 bp, Mus musculus
tgacgtcactgctccatcagggtga

SEQ ID NO: 849667 - DNA, 25 bp, Mus musculus
tgacgtcagacgcagaacctaagat

SEQ ID NO: 849668 - DNA, 25 bp, Mus musculus
tgacgtcagacggagaacctaagat

SEQ ID NO: 849669 - DNA, 25 bp, Mus musculus
tgacgtcagccaagggtgatggaca

SEQ ID NO: 849670 - DNA, 25 bp, Mus musculus
tgacgtcagccatgggtgatggaca

SEQ ID NO: 849671 - DNA, 25 bp, Mus musculus
tgacgtcagcgtatgtgtacctatt

SEQ ID NO: 849672 - DNA, 25 bp, Mus musculus
tgacgtcagcgtttgtgtacctatt

SEQ ID NO: 849673 - DNA, 25 bp, Mus musculus
tgacgtcatacaccaaccatcaggg

SEQ ID NO: 849674 - DNA, 25 bp, Mus musculus
tgacgtcatacagcaaccatcaggg

SEQ ID NO: 849675 - DNA, 25 bp, Mus musculus
tgacgtcatcccagcctaaaacata

SEQ ID NO: 849676 - DNA, 25 bp, Mus musculus
tgacgtcatccctgcctaaaacata

SEQ ID NO: 849677 - DNA, 25 bp, Mus musculus
tgacgtcattggagttcgaccccgc

SEQ ID NO: 849678 - DNA, 25 bp, Mus musculus
tgacgtcattggtgttcgaccccgc

SEQ ID NO: 849679 - DNA, 25 bp, Mus musculus
tgacgtcattgtacacatcactgtg

SEQ ID NO: 849680 - DNA, 25 bp, Mus musculus
tgacgtcattgttcacatcactgtg

SEQ ID NO: 849681 - DNA, 25 bp, Mus musculus
tgacgtccccaacactcatgtgata

SEQ ID NO: 849682 - DNA, 25 bp, Mus musculus
tgacgtccccaagactcatgtgata

SEQ ID NO: 849683 - DNA, 25 bp, Mus musculus
tgacgtccccatcgatggaatgtct

SEQ ID NO: 849684 - DNA, 25 bp, Mus musculus
tgacgtccccatggatggaatgtct

SEQ ID NO: 849685 - DNA, 25 bp, Mus musculus
tgacgtccccgcagcaggagaattc

SEQ ID NO: 849686 - DNA, 25 bp, Mus musculus
tgacgtccccgctgcaggagaattc

SEQ ID NO: 849687 - DNA, 25 bp, Mus musculus
tgacgtccggcgatttctaggccgt

SEQ ID NO: 849688 - DNA, 25 bp, Mus musculus
tgacgtccggcgttttctaggccgt

SEQ ID NO: 849689 - DNA, 25 bp, Mus musculus
tgacgtcctggacagctctgaactc

SEQ ID NO: 849690 - DNA, 25 bp, Mus musculus
tgacgtcctggagagctctgaactc

SEQ ID NO: 849691 - DNA, 25 bp, Mus musculus
tgacgtcgctggaactcgagctcgg

SEQ ID NO: 849692 - DNA, 25 bp, Mus musculus
tgacgtcgctggacacgtttatatg

SEQ ID NO: 849693 - DNA, 25 bp, Mus musculus
tgacgtcgctggtactcgagctcgg

SEQ ID NO: 849694 - DNA, 25 bp, Mus musculus
tgacgtcgctggtcacgtttatatg

SEQ ID NO: 849695 - DNA, 25 bp, Mus musculus
tgacgtctctgcagcttggaaccgc

SEQ ID NO: 849696 - DNA, 25 bp, Mus musculus
tgacgtctctgctgcttggaaccgc

SEQ ID NO: 849697 - DNA, 25 bp, Mus musculus
tgacgtctgtgccatctgtctggat

SEQ ID NO: 849698 - DNA, 25 bp, Mus musculus
tgacgtctgtgcgatctgtctggat

SEQ ID NO: 849699 - DNA, 25 bp, Mus musculus
tgacgtgatatcactgctcctctct

SEQ ID NO: 849700 - DNA, 25 bp, Mus musculus
tgacgtgatatctctgctcctctct

SEQ ID NO: 849701 - DNA, 25 bp, Mus musculus
tgacgtgatccacaatgctgggcct

SEQ ID NO: 849702 - DNA, 25 bp, Mus musculus
tgacgtgatccagaatgctgggcct

SEQ ID NO: 849703 - DNA, 25 bp, Mus musculus
tgacgtgcactgaaagatgtgacaa

SEQ ID NO: 849704 - DNA, 25 bp, Mus musculus
tgacgtgcactgtaagatgtgacaa

SEQ ID NO: 849705 - DNA, 25 bp, Mus musculus
tgacgtgctcaccataaactagcca

SEQ ID NO: 849706 - DNA, 25 bp, Mus musculus
tgacgtgctcacgataaactagcca

SEQ ID NO: 849707 - DNA, 25 bp, Mus musculus
tgacgtgctggtcggttttaaagct

SEQ ID NO: 849708 - DNA, 25 bp, Mus musculus
tgacgtgctggtgggttttaaagct

SEQ ID NO: 849709 - DNA, 25 bp, Mus musculus
tgacgtggtggcctactttgtgaat

SEQ ID NO: 849710 - DNA, 25 bp, Mus musculus
tgacgtggtggcgtactttgtgaat

SEQ ID NO: 849711 - DNA, 25 bp, Mus musculus
tgacgtgtaagtccacagggcttca

SEQ ID NO: 849712 - DNA, 25 bp, Mus musculus
tgacgtgtaagtgcacagggcttca

SEQ ID NO: 849713 - DNA, 25 bp, Mus musculus
tgacgtgtcttcagagcgggagcca

SEQ ID NO: 849714 - DNA, 25 bp, Mus musculus
tgacgtgtcttctgagcgggagcca

SEQ ID NO: 849715 - DNA, 25 bp, Mus musculus
tgacgtgtttaacacatctccaaga

SEQ ID NO: 849716 - DNA, 25 bp, Mus musculus
tgacgtgtttaagacatctccaaga

SEQ ID NO: 849717 - DNA, 25 bp, Mus musculus
tgacgttacaacactgcagttactg

SEQ ID NO: 849718 - DNA, 25 bp, Mus musculus
tgacgttacaactctgcagttactg

SEQ ID NO: 849719 - DNA, 25 bp, Mus musculus
tgacgttacgatatacaaacccact

SEQ ID NO: 849720 - DNA, 25 bp, Mus musculus
tgacgttacgatttacaaacccact

SEQ ID NO: 849721 - DNA, 25 bp, Mus musculus
tgacgttcagaacaaatggccccat

SEQ ID NO: 849722 - DNA, 25 bp, Mus musculus
tgacgttcagaagaaatggccccat

SEQ ID NO: 849723 - DNA, 25 bp, Mus musculus
tgacgttcaggcaaacagaggagct

SEQ ID NO: 849724 - DNA, 25 bp, Mus musculus
tgacgttcaggctaacagaggagct

SEQ ID NO: 849725 - DNA, 25 bp, Mus musculus
tgacgttgatcaattgggcaaattt

SEQ ID NO: 849726 - DNA, 25 bp, Mus musculus
tgacgttgatcatttgggcaaattt

SEQ ID NO: 849727 - DNA, 25 bp, Mus musculus
tgacgttgcctgacggacaccagct

SEQ ID NO: 849728 - DNA, 25 bp, Mus musculus
tgacgttgcctgtcggacaccagct

SEQ ID NO: 849729 - DNA, 25 bp, Mus musculus
tgacgtttagatatccccgggaggt

SEQ ID NO: 849730 - DNA, 25 bp, Mus musculus
tgacgtttagatttccccgggaggt

SEQ ID NO: 849731 - DNA, 25 bp, Mus musculus
tgacgtttctgtctggctggctctt

SEQ ID NO: 849732 - DNA, 25 bp, Mus musculus
tgacgtttctgtgtggctggctctt

SEQ ID NO: 849733 - DNA, 25 bp, Mus musculus
tgacgttttgctaaagtggatactt

SEQ ID NO: 849734 - DNA, 25 bp, Mus musculus
tgacgttttgcttaagtggatactt

SEQ ID NO: 849735 - DNA, 25 bp, Mus musculus
tgacgtttttatcatgactcctccc

SEQ ID NO: 849736 - DNA, 25 bp, Mus musculus
tgacgtttttatgatgactcctccc

SEQ ID NO: 849737 - DNA, 25 bp, Mus musculus
tgactaaaccttatatttgccatct

SEQ ID NO: 849738 - DNA, 25 bp, Mus musculus
tgactaaaccttttatttgccatct

SEQ ID NO: 849739 - DNA, 25 bp, Mus musculus
tgactaaagcctcaattcctcatgg

SEQ ID NO: 849740 - DNA, 25 bp, Mus musculus
tgactaaagcctgaattcctcatgg

SEQ ID NO: 849741 - DNA, 25 bp, Mus musculus
tgactaaagtcaacttccttccagc

SEQ ID NO: 849742 - DNA, 25 bp, Mus musculus
tgactaaagtcatcttccttccagc

SEQ ID NO: 849743 - DNA, 25 bp, Mus musculus
tgactaaatgacataacctttggct

SEQ ID NO: 849744 - DNA, 25 bp, Mus musculus
tgactaaatgacttaacctttggct

SEQ ID NO: 849745 - DNA, 25 bp, Mus musculus
tgactaaatgtgctcctacctggat

SEQ ID NO: 849746 - DNA, 25 bp, Mus musculus
tgactaaatgtggtcctacctggat

SEQ ID NO: 849747 - DNA, 25 bp, Mus musculus
tgactaaattttacgccagcttgac

SEQ ID NO: 849748 - DNA, 25 bp, Mus musculus
tgactaaatttttcgccagcttgac

SEQ ID NO: 849749 - DNA, 25 bp, Mus musculus
tgactaacagcaaggcggaatttta

SEQ ID NO: 849750 - DNA, 25 bp, Mus musculus
tgactaacagcatggcggaatttta

SEQ ID NO: 849751 - DNA, 25 bp, Mus musculus
tgactaacagtgaccggccttatga

SEQ ID NO: 849752 - DNA, 25 bp, Mus musculus
tgactaacagtgtccggccttatga

SEQ ID NO: 849753 - DNA, 25 bp, Mus musculus
tgactaacctctcttaatggcccca

SEQ ID NO: 849754 - DNA, 25 bp, Mus musculus
tgactaacctctgttaatggcccca

SEQ ID NO: 849755 - DNA, 25 bp, Mus musculus
tgactaactaaacacttcccctcat

SEQ ID NO: 849756 - DNA, 25 bp, Mus musculus
tgactaactaaagacttcccctcat

SEQ ID NO: 849757 - DNA, 25 bp, Mus musculus
tgactaactgttagggaaaccctca

SEQ ID NO: 849758 - DNA, 25 bp, Mus musculus
tgactaactgtttgggaaaccctca

SEQ ID NO: 849759 - DNA, 25 bp, Mus musculus
tgactaagacacaaccctgactgag

SEQ ID NO: 849760 - DNA, 25 bp, Mus musculus
tgactaagacactaccctgactgag

SEQ ID NO: 849761 - DNA, 25 bp, Mus musculus
tgactaagacgtctacactgtgaat

SEQ ID NO: 849762 - DNA, 25 bp, Mus musculus
tgactaagacgtgtacactgtgaat

SEQ ID NO: 849763 - DNA, 25 bp, Mus musculus
tgactaaggcttagccttcaccatg

SEQ ID NO: 849764 - DNA, 25 bp, Mus musculus
tgactaaggctttgccttcaccatg

SEQ ID NO: 849765 - DNA, 25 bp, Mus musculus
tgactaagtcagcacccagcattcc

SEQ ID NO: 849766 - DNA, 25 bp, Mus musculus
tgactaagtcaggacccagcattcc

SEQ ID NO: 849767 - DNA, 25 bp, Mus musculus
tgactaagtcctaattttgagctct

SEQ ID NO: 849768 - DNA, 25 bp, Mus musculus
tgactaagtccttattttgagctct

SEQ ID NO: 849769 - DNA, 25 bp, Mus musculus
tgactaataaacagccaattctcag

SEQ ID NO: 849770 - DNA, 25 bp, Mus musculus
tgactaataaactgccaattctcag

SEQ ID NO: 849771 - DNA, 25 bp, Mus musculus
tgactaataccgaactacccccttg

SEQ ID NO: 849772 - DNA, 25 bp, Mus musculus
tgactaataccgtactacccccttg

SEQ ID NO: 849773 - DNA, 25 bp, Mus musculus
tgactaatatcgactgcccctgatc

SEQ ID NO: 849774 - DNA, 25 bp, Mus musculus
tgactaatatcgtctgcccctgatc

SEQ ID NO: 849775 - DNA, 25 bp, Mus musculus
tgactaatcctaacgtagcacccta

SEQ ID NO: 849776 - DNA, 25 bp, Mus musculus
tgactaatcctatcgtagcacccta

SEQ ID NO: 849777 - DNA, 25 bp, Mus musculus
tgactaatctccctcatcaagatgg

SEQ ID NO: 849778 - DNA, 25 bp, Mus musculus
tgactaatctccgtcatcaagatgg

SEQ ID NO: 849779 - DNA, 25 bp, Mus musculus
tgactaattaagagtctattgccct

SEQ ID NO: 849780 - DNA, 25 bp, Mus musculus
tgactaattaagtgtctattgccct

SEQ ID NO: 849781 - DNA, 25 bp, Mus musculus
tgactaattccacattggtgccctg

SEQ ID NO: 849782 - DNA, 25 bp, Mus musculus
tgactaattccagattggtgccctg

SEQ ID NO: 849783 - DNA, 25 bp, Mus musculus
tgactacaactactgctggcactgt

SEQ ID NO: 849784 - DNA, 25 bp, Mus musculus
tgactacaactagtgctggcactgt

SEQ ID NO: 849785 - DNA, 25 bp, Mus musculus
tgactacaccacagtattacttccc

SEQ ID NO: 849786 - DNA, 25 bp, Mus musculus
tgactacaccactgtattacttccc

SEQ ID NO: 849787 - DNA, 25 bp, Mus musculus
tgactacaccccagggacacaggat

SEQ ID NO: 849788 - DNA, 25 bp, Mus musculus
tgactacacccctgggacacaggat

SEQ ID NO: 849789 - DNA, 25 bp, Mus musculus
tgactacacccgatcattctggaaa

SEQ ID NO: 849790 - DNA, 25 bp, Mus musculus
tgactacacccgttcattctggaaa

SEQ ID NO: 849791 - DNA, 25 bp, Mus musculus
tgactacagcacacagtcgctggaa

SEQ ID NO: 849792 - DNA, 25 bp, Mus musculus
tgactacagcactcagtcgctggaa

SEQ ID NO: 849793 - DNA, 25 bp, Mus musculus
tgactacagtacctgacaccctgag

SEQ ID NO: 849794 - DNA, 25 bp, Mus musculus
tgactacagtacgtgacaccctgag

SEQ ID NO: 849795 - DNA, 25 bp, Mus musculus
tgactacatctactggcatcctcct

SEQ ID NO: 849796 - DNA, 25 bp, Mus musculus
tgactacatctagtggcatcctcct

SEQ ID NO: 849797 - DNA, 25 bp, Mus musculus
tgactacatggtcacactcttctgt

SEQ ID NO: 849798 - DNA, 25 bp, Mus musculus
tgactacatggtgacactcttctgt

SEQ ID NO: 849799 - DNA, 25 bp, Mus musculus
tgactacatgtcatcaggccaagtt

SEQ ID NO: 849800 - DNA, 25 bp, Mus musculus
tgactacatgtcttcaggccaagtt

SEQ ID NO: 849801 - DNA, 25 bp, Mus musculus
tgactacattacaacgggccaggaa

SEQ ID NO: 849802 - DNA, 25 bp, Mus musculus
tgactacattactacgggccaggaa

SEQ ID NO: 849803 - DNA, 25 bp, Mus musculus
tgactacattctaagccaggtgctg

SEQ ID NO: 849804 - DNA, 25 bp, Mus musculus
tgactacattcttagccaggtgctg

SEQ ID NO: 849805 - DNA, 25 bp, Mus musculus
tgactaccaaggctcaaccaatagt

SEQ ID NO: 849806 - DNA, 25 bp, Mus musculus
tgactaccaagggtcaaccaatagt

SEQ ID NO: 849807 - DNA, 25 bp, Mus musculus
tgactacccagcagactgcaaatgc

SEQ ID NO: 849808 - DNA, 25 bp, Mus musculus
tgactacccagctgactgcaaatgc

SEQ ID NO: 849809 - DNA, 25 bp, Mus musculus
tgactaccgggaagcacaggagttt

SEQ ID NO: 849810 - DNA, 25 bp, Mus musculus
tgactaccgggatgcacaggagttt

SEQ ID NO: 849811 - DNA, 25 bp, Mus musculus
tgactaccgggcctaggaactgtcc

SEQ ID NO: 849812 - DNA, 25 bp, Mus musculus
tgactaccgggcgtaggaactgtcc

SEQ ID NO: 849813 - DNA, 25 bp, Mus musculus
tgactaccgttccttgtgttcagaa

SEQ ID NO: 849814 - DNA, 25 bp, Mus musculus
tgactaccgttcgttgtgttcagaa

SEQ ID NO: 849815 - DNA, 25 bp, Mus musculus
tgactacctaaccttggcagagcag

SEQ ID NO: 849816 - DNA, 25 bp, Mus musculus
tgactacctaacgttggcagagcag

SEQ ID NO: 849817 - DNA, 25 bp, Mus musculus
tgactacctactccatgtggtgtac

SEQ ID NO: 849818 - DNA, 25 bp, Mus musculus
tgactacctactgcatgtggtgtac

SEQ ID NO: 849819 - DNA, 25 bp, Mus musculus
tgactacctgtaccggtgaccagac

SEQ ID NO: 849820 - DNA, 25 bp, Mus musculus
tgactacctgtagcggtgaccagac

SEQ ID NO: 849821 - DNA, 25 bp, Mus musculus
tgactacctgttctgtgctattgcc

SEQ ID NO: 849822 - DNA, 25 bp, Mus musculus
tgactacctgttgtgtgctattgcc

SEQ ID NO: 849823 - DNA, 25 bp, Mus musculus
tgactacctttgattgggcactcca

SEQ ID NO: 849824 - DNA, 25 bp, Mus musculus
tgactacctttgtttgggcactcca

SEQ ID NO: 849825 - DNA, 25 bp, Mus musculus
tgactacgagaaatacattgacata

SEQ ID NO: 849826 - DNA, 25 bp, Mus musculus
tgactacgagaattacattgacata

SEQ ID NO: 849827 - DNA, 25 bp, Mus musculus
tgactacgtaacagatggaaatact

SEQ ID NO: 849828 - DNA, 25 bp, Mus musculus
tgactacgtaactgatggaaatact

SEQ ID NO: 849829 - DNA, 25 bp, Mus musculus
tgactactaagtcaccagtttcggt

SEQ ID NO: 849830 - DNA, 25 bp, Mus musculus
tgactactaagtgaccagtttcggt

SEQ ID NO: 849831 - DNA, 25 bp, Mus musculus
tgactactacagcaatcaccatagc

SEQ ID NO: 849832 - DNA, 25 bp, Mus musculus
tgactactacaggaatcaccatagc

SEQ ID NO: 849833 - DNA, 25 bp, Mus musculus
tgactactatgcactttggtttctg

SEQ ID NO: 849834 - DNA, 25 bp, Mus musculus
tgactactatgctctttggtttctg

SEQ ID NO: 849835 - DNA, 25 bp, Mus musculus
tgactactccacagagcctgctaga

SEQ ID NO: 849836 - DNA, 25 bp, Mus musculus
tgactactccactgagcctgctaga

SEQ ID NO: 849837 - DNA, 25 bp, Mus musculus
tgactacttacaccacatcctcaag

SEQ ID NO: 849838 - DNA, 25 bp, Mus musculus
tgactacttacagcacatcctcaag

SEQ ID NO: 849839 - DNA, 25 bp, Mus musculus
tgactacttggactacgctcctgtt

SEQ ID NO: 849840 - DNA, 25 bp, Mus musculus
tgactacttggagtacgctcctgtt

SEQ ID NO: 849841 - DNA, 25 bp, Mus musculus
tgactactttgtcgctttctcagca

SEQ ID NO: 849842 - DNA, 25 bp, Mus musculus
tgactactttgtggctttctcagca

SEQ ID NO: 849843 - DNA, 25 bp, Mus musculus
tgactagaacttcctcacctgcgag

SEQ ID NO: 849844 - DNA, 25 bp, Mus musculus
tgactagaacttgctcacctgcgag

SEQ ID NO: 849845 - DNA, 25 bp, Mus musculus
tgactagagctcatacttggcacac

SEQ ID NO: 849846 - DNA, 25 bp, Mus musculus
tgactagagctcttacttggcacac

SEQ ID NO: 849847 - DNA, 25 bp, Mus musculus
tgactagaggacagaaacacaccaa

SEQ ID NO: 849848 - DNA, 25 bp, Mus musculus
tgactagaggactgaaacacaccaa

SEQ ID NO: 849849 - DNA, 25 bp, Mus musculus
tgactaggcgctatgaccggaatga

SEQ ID NO: 849850 - DNA, 25 bp, Mus musculus
tgactaggcgctttgaccggaatga

SEQ ID NO: 849851 - DNA, 25 bp, Mus musculus
tgactagggacaaccgccacttcta

SEQ ID NO: 849852 - DNA, 25 bp, Mus musculus
tgactagggacatccgccacttcta

SEQ ID NO: 849853 - DNA, 25 bp, Mus musculus
tgactagggccacgcaaagctctaa

SEQ ID NO: 849854 - DNA, 25 bp, Mus musculus
tgactagggccaggcaaagctctaa

SEQ ID NO: 849855 - DNA, 25 bp, Mus musculus
tgactagggcctcagatcatattct

SEQ ID NO: 849856 - DNA, 25 bp, Mus musculus
tgactagggcctgagatcatattct

SEQ ID NO: 849857 - DNA, 25 bp, Mus musculus
tgactagggtgtatgcaagcagctc

SEQ ID NO: 849858 - DNA, 25 bp, Mus musculus
tgactagggtgtttgcaagcagctc

SEQ ID NO: 849859 - DNA, 25 bp, Mus musculus
tgactaggtagtatgctttctttct

SEQ ID NO: 849860 - DNA, 25 bp, Mus musculus
tgactaggtagtttgctttctttct

SEQ ID NO: 849861 - DNA, 25 bp, Mus musculus
tgactaggtttcattgcactcgtgc

SEQ ID NO: 849862 - DNA, 25 bp, Mus musculus
tgactaggtttctttgcactcgtgc

SEQ ID NO: 849863 - DNA, 25 bp, Mus musculus
tgactagtcagcacagcacagggcc

SEQ ID NO: 849864 - DNA, 25 bp, Mus musculus
tgactagtcagcctcagtgcgccaa

SEQ ID NO: 849865 - DNA, 25 bp, Mus musculus
tgactagtcagcgtcagtgcgccaa

SEQ ID NO: 849866 - DNA, 25 bp, Mus musculus
tgactagtcagctcagcacagggcc

SEQ ID NO: 849867 - DNA, 25 bp, Mus musculus
tgactagtgatcatccaggtgcatg

SEQ ID NO: 849868 - DNA, 25 bp, Mus musculus
tgactagtgatcttccaggtgcatg

SEQ ID NO: 849869 - DNA, 25 bp, Mus musculus
tgactagttaatatttgtgcatgtt

SEQ ID NO: 849870 - DNA, 25 bp, Mus musculus
tgactagttaatttttgtgcatgtt

SEQ ID NO: 849871 - DNA, 25 bp, Mus musculus
tgactataacatcccattagcctgg

SEQ ID NO: 849872 - DNA, 25 bp, Mus musculus
tgactataacatgccattagcctgg

SEQ ID NO: 849873 - DNA, 25 bp, Mus musculus
tgactataacctcttaatagttgtg

SEQ ID NO: 849874 - DNA, 25 bp, Mus musculus
tgactataacctgttaatagttgtg

SEQ ID NO: 849875 - DNA, 25 bp, Mus musculus
tgactatacacacaacaagacttct

SEQ ID NO: 849876 - DNA, 25 bp, Mus musculus
tgactatacacagaacaagacttct

SEQ ID NO: 849877 - DNA, 25 bp, Mus musculus
tgactatacccaaacttcctacaat

SEQ ID NO: 849878 - DNA, 25 bp, Mus musculus
tgactatacccatacttcctacaat

SEQ ID NO: 849879 - DNA, 25 bp, Mus musculus
tgactatagcacacgccatgagcca

SEQ ID NO: 849880 - DNA, 25 bp, Mus musculus
tgactatagcactcgccatgagcca

SEQ ID NO: 849881 - DNA, 25 bp, Mus musculus
tgactatatctaatcctcctacata

SEQ ID NO: 849882 - DNA, 25 bp, Mus musculus
tgactatatctattcctcctacata

SEQ ID NO: 849883 - DNA, 25 bp, Mus musculus
tgactatcaagccatttccccagtg

SEQ ID NO: 849884 - DNA, 25 bp, Mus musculus
tgactatcaagcgatttccccagtg

SEQ ID NO: 849885 - DNA, 25 bp, Mus musculus
tgactatcaggtccaacatggccct

SEQ ID NO: 849886 - DNA, 25 bp, Mus musculus
tgactatcaggtgcaacatggccct

SEQ ID NO: 849887 - DNA, 25 bp, Mus musculus
tgactatccagaagacagtgtccca

SEQ ID NO: 849888 - DNA, 25 bp, Mus musculus
tgactatccagatgacagtgtccca

SEQ ID NO: 849889 - DNA, 25 bp, Mus musculus
tgactatctgacaggtgactcagaa

SEQ ID NO: 849890 - DNA, 25 bp, Mus musculus
tgactatctgactggtgactcagaa

SEQ ID NO: 849891 - DNA, 25 bp, Mus musculus
tgactatgagatcagcacccctgca

SEQ ID NO: 849892 - DNA, 25 bp, Mus musculus
tgactatgagatgagcacccctgca

SEQ ID NO: 849893 - DNA, 25 bp, Mus musculus
tgactatggactcaagtcggccctc

SEQ ID NO: 849894 - DNA, 25 bp, Mus musculus
tgactatggactgaagtcggccctc

SEQ ID NO: 849895 - DNA, 25 bp, Mus musculus
tgactatggccactgataacctatg

SEQ ID NO: 849896 - DNA, 25 bp, Mus musculus
tgactatggccagtgataacctatg

SEQ ID NO: 849897 - DNA, 25 bp, Mus musculus
tgactatgggcacccggcttccaag

SEQ ID NO: 849898 - DNA, 25 bp, Mus musculus
tgactatgggcagccggcttccaag

SEQ ID NO: 849899 - DNA, 25 bp, Mus musculus
tgactatggtcaccatgccctcctt

SEQ ID NO: 849900 - DNA, 25 bp, Mus musculus
tgactatggtcagcatgccctcctt

SEQ ID NO: 849901 - DNA, 25 bp, Mus musculus
tgactatgtgacagtggctgtgtgt

SEQ ID NO: 849902 - DNA, 25 bp, Mus musculus
tgactatgtgactgtggctgtgtgt

SEQ ID NO: 849903 - DNA, 25 bp, Mus musculus
tgactatgtgagagttggatcccct

SEQ ID NO: 849904 - DNA, 25 bp, Mus musculus
tgactatgtgagtgttggatcccct

SEQ ID NO: 849905 - DNA, 25 bp, Mus musculus
tgactatgtgcacccacagctgcgg

SEQ ID NO: 849906 - DNA, 25 bp, Mus musculus
tgactatgtgcagccacagctgcgg

SEQ ID NO: 849907 - DNA, 25 bp, Mus musculus
tgactatgttctacgcttgatgcaa

SEQ ID NO: 849908 - DNA, 25 bp, Mus musculus
tgactatgttcttcgcttgatgcaa

SEQ ID NO: 849909 - DNA, 25 bp, Mus musculus
tgactattatgtccggaaaattggc

SEQ ID NO: 849910 - DNA, 25 bp, Mus musculus
tgactattatgtgcggaaaattggc

SEQ ID NO: 849911 - DNA, 25 bp, Mus musculus
tgactattgtacatatttaggccaa

SEQ ID NO: 849912 - DNA, 25 bp, Mus musculus
tgactattgtacttatttaggccaa

SEQ ID NO: 849913 - DNA, 25 bp, Mus musculus
tgactattgtttccctcgtgctctg

SEQ ID NO: 849914 - DNA, 25 bp, Mus musculus
tgactattgtttgcctcgtgctctg

SEQ ID NO: 849915 - DNA, 25 bp, Mus musculus
tgactatttacactctcaccctaca

SEQ ID NO: 849916 - DNA, 25 bp, Mus musculus
tgactatttacagtctcaccctaca

SEQ ID NO: 849917 - DNA, 25 bp, Mus musculus
tgactatttgacaaccacacttggg

SEQ ID NO: 849918 - DNA, 25 bp, Mus musculus
tgactatttgactaccacacttggg

SEQ ID NO: 849919 - DNA, 25 bp, Mus musculus
tgactatttggcatcttcctataaa

SEQ ID NO: 849920 - DNA, 25 bp, Mus musculus
tgactatttggcttcttcctataaa

SEQ ID NO: 849921 - DNA, 25 bp, Mus musculus
tgactcaaaaagctagatgtaggtt

SEQ ID NO: 849922 - DNA, 25 bp, Mus musculus
tgactcaaaaaggtagatgtaggtt

SEQ ID NO: 849923 - DNA, 25 bp, Mus musculus
tgactcaaatatacctaccacctta

SEQ ID NO: 849924 - DNA, 25 bp, Mus musculus
tgactcaaatattcctaccacctta

SEQ ID NO: 849925 - DNA, 25 bp, Mus musculus
tgactcaagaggacacaagctgact

SEQ ID NO: 849926 - DNA, 25 bp, Mus musculus
tgactcaagaggtcacaagctgact

SEQ ID NO: 849927 - DNA, 25 bp, Mus musculus
tgactcaagccgaatccctcagaga

SEQ ID NO: 849928 - DNA, 25 bp, Mus musculus
tgactcaagccgtatccctcagaga

SEQ ID NO: 849929 - DNA, 25 bp, Mus musculus
tgactcaagggtcgatgctgtcttt

SEQ ID NO: 849930 - DNA, 25 bp, Mus musculus
tgactcaagggtggatgctgtcttt

SEQ ID NO: 849931 - DNA, 25 bp, Mus musculus
tgactcaaggtcagggccagcacgt

SEQ ID NO: 849932 - DNA, 25 bp, Mus musculus
tgactcaaggtctgggccagcacgt

SEQ ID NO: 849933 - DNA, 25 bp, Mus musculus
tgactcaatggtaacttgctgtatt

SEQ ID NO: 849934 - DNA, 25 bp, Mus musculus
tgactcaatggttacttgctgtatt

SEQ ID NO: 849935 - DNA, 25 bp, Mus musculus
tgactcaattatcccatgtcttcag

SEQ ID NO: 849936 - DNA, 25 bp, Mus musculus
tgactcaattatgccatgtcttcag

SEQ ID NO: 849937 - DNA, 25 bp, Mus musculus
tgactcacaagaacttttccaccat

SEQ ID NO: 849938 - DNA, 25 bp, Mus musculus
tgactcacaagacctcctgacatgg

SEQ ID NO: 849939 - DNA, 25 bp, Mus musculus
tgactcacaagagctcctgacatgg

SEQ ID NO: 849940 - DNA, 25 bp, Mus musculus
tgactcacaagatcttttccaccat

SEQ ID NO: 849941 - DNA, 25 bp, Mus musculus
tgactcacacaaatcacacttggct

SEQ ID NO: 849942 - DNA, 25 bp, Mus musculus
tgactcacacaattcacacttggct

SEQ ID NO: 849943 - DNA, 25 bp, Mus musculus
tgactcacaccaagcaccatacata

SEQ ID NO: 849944 - DNA, 25 bp, Mus musculus
tgactcacaccacataggctagcta

SEQ ID NO: 849945 - DNA, 25 bp, Mus musculus
tgactcacaccagataggctagcta

SEQ ID NO: 849946 - DNA, 25 bp, Mus musculus
tgactcacaccatgcaccatacata

SEQ ID NO: 849947 - DNA, 25 bp, Mus musculus
tgactcaccatcaccagaaaaacca

SEQ ID NO: 849948 - DNA, 25 bp, Mus musculus
tgactcaccatctccagaaaaacca

SEQ ID NO: 849949 - DNA, 25 bp, Mus musculus
tgactcacgcttaacatctccataa

SEQ ID NO: 849950 - DNA, 25 bp, Mus musculus
tgactcacgctttacatctccataa

SEQ ID NO: 849951 - DNA, 25 bp, Mus musculus
tgactcacgtggcttttgttgttgc

SEQ ID NO: 849952 - DNA, 25 bp, Mus musculus
tgactcacgtgggttttgttgttgc

SEQ ID NO: 849953 - DNA, 25 bp, Mus musculus
tgactcactgacacaaacagccaga

SEQ ID NO: 849954 - DNA, 25 bp, Mus musculus
tgactcactgactcaaacagccaga

SEQ ID NO: 849955 - DNA, 25 bp, Mus musculus
tgactcacttgaatcacttgaaggg

SEQ ID NO: 849956 - DNA, 25 bp, Mus musculus
tgactcacttgattcacttgaaggg

SEQ ID NO: 849957 - DNA, 25 bp, Mus musculus
tgactcactttcacaccaggagcct

SEQ ID NO: 849958 - DNA, 25 bp, Mus musculus
tgactcactttctcaccaggagcct

SEQ ID NO: 849959 - DNA, 25 bp, Mus musculus
tgactcagacacatcccagaaagca

SEQ ID NO: 849960 - DNA, 25 bp, Mus musculus
tgactcagacacttcccagaaagca

SEQ ID NO: 849961 - DNA, 25 bp, Mus musculus
tgactcagactgctgttactactct

SEQ ID NO: 849962 - DNA, 25 bp, Mus musculus
tgactcagactggtgttactactct

SEQ ID NO: 849963 - DNA, 25 bp, Mus musculus
tgactcagatttccagatatttggg

SEQ ID NO: 849964 - DNA, 25 bp, Mus musculus
tgactcagatttgcagatatttggg

SEQ ID NO: 849965 - DNA, 25 bp, Mus musculus
tgactcagcgagagtgttccagact

SEQ ID NO: 849966 - DNA, 25 bp, Mus musculus
tgactcagcgagtgtgttccagact

SEQ ID NO: 849967 - DNA, 25 bp, Mus musculus
tgactcaggaagctcacggtctctg

SEQ ID NO: 849968 - DNA, 25 bp, Mus musculus
tgactcaggaaggtcacggtctctg

SEQ ID NO: 849969 - DNA, 25 bp, Mus musculus
tgactcaggaggcttacacgcgtgc

SEQ ID NO: 849970 - DNA, 25 bp, Mus musculus
tgactcaggagggttacacgcgtgc

SEQ ID NO: 849971 - DNA, 25 bp, Mus musculus
tgactcaggataaacaagcagacac

SEQ ID NO: 849972 - DNA, 25 bp, Mus musculus
tgactcaggatatacaagcagacac

SEQ ID NO: 849973 - DNA, 25 bp, Mus musculus
tgactcaggcagcagccagtggcct

SEQ ID NO: 849974 - DNA, 25 bp, Mus musculus
tgactcaggcaggagccagtggcct

SEQ ID NO: 849975 - DNA, 25 bp, Mus musculus
tgactcagggcacgtttctgtctga

SEQ ID NO: 849976 - DNA, 25 bp, Mus musculus
tgactcagggcaggtttctgtctga

SEQ ID NO: 849977 - DNA, 25 bp, Mus musculus
tgactcagggtccacagtctcatgg

SEQ ID NO: 849978 - DNA, 25 bp, Mus musculus
tgactcagggtcgacagtctcatgg

SEQ ID NO: 849979 - DNA, 25 bp, Mus musculus
tgactcagtcatcctatctttccac

SEQ ID NO: 849980 - DNA, 25 bp, Mus musculus
tgactcagtcatgctatctttccac

SEQ ID NO: 849981 - DNA, 25 bp, Mus musculus
tgactcagtctactgtctcacagac

SEQ ID NO: 849982 - DNA, 25 bp, Mus musculus
tgactcagtctagtgtctcacagac

SEQ ID NO: 849983 - DNA, 25 bp, Mus musculus
tgactcagttatacccaacactagc

SEQ ID NO: 849984 - DNA, 25 bp, Mus musculus
tgactcagttattcccaacactagc

SEQ ID NO: 849985 - DNA, 25 bp, Mus musculus
tgactcagtttcctcccatttagag

SEQ ID NO: 849986 - DNA, 25 bp, Mus musculus
tgactcagtttcgtcccatttagag

SEQ ID NO: 849987 - DNA, 25 bp, Mus musculus
tgactcagttttcaggtctcagtag

SEQ ID NO: 849988 - DNA, 25 bp, Mus musculus
tgactcagttttgaggtctcagtag

SEQ ID NO: 849989 - DNA, 25 bp, Mus musculus
tgactcatagcacccacttcagtta

SEQ ID NO: 849990 - DNA, 25 bp, Mus musculus
tgactcatagcagccacttcagtta

SEQ ID NO: 849991 - DNA, 25 bp, Mus musculus
tgactcatctcccaggctcttgatt

SEQ ID NO: 849992 - DNA, 25 bp, Mus musculus
tgactcatctccgaggctcttgatt

SEQ ID NO: 849993 - DNA, 25 bp, Mus musculus
tgactcatgacaacccctcatggaa

SEQ ID NO: 849994 - DNA, 25 bp, Mus musculus
tgactcatgacaccctagcaatacc

SEQ ID NO: 849995 - DNA, 25 bp, Mus musculus
tgactcatgacagcctagcaatacc

SEQ ID NO: 849996 - DNA, 25 bp, Mus musculus
tgactcatgacatcccctcatggaa

SEQ ID NO: 849997 - DNA, 25 bp, Mus musculus
tgactcatggacactgttgggcgat

SEQ ID NO: 849998 - DNA, 25 bp, Mus musculus
tgactcatggactctgttgggcgat

SEQ ID NO: 849999 - DNA, 25 bp, Mus musculus
tgactcattaacactgcgtaattag

SEQ ID NO: 850000 - DNA, 25 bp, Mus musculus
tgactcattaactctgcgtaattag

SEQ ID NO: 850001 - DNA, 25 bp, Mus musculus
tgactcattactcatttgccccttg

SEQ ID NO: 850002 - DNA, 25 bp, Mus musculus
tgactcattactgatttgccccttg

SEQ ID NO: 850003 - DNA, 25 bp, Mus musculus
tgactcattgctcggaatgtcagac

SEQ ID NO: 850004 - DNA, 25 bp, Mus musculus
tgactcattgctgggaatgtcagac

SEQ ID NO: 850005 - DNA, 25 bp, Mus musculus
tgactcattggtaatctgttggatt

SEQ ID NO: 850006 - DNA, 25 bp, Mus musculus
tgactcattggttatctgttggatt

SEQ ID NO: 850007 - DNA, 25 bp, Mus musculus
tgactcattttgagtgttgtcctga

SEQ ID NO: 850008 - DNA, 25 bp, Mus musculus
tgactcattttgtgtgttgtcctga

SEQ ID NO: 850009 - DNA, 25 bp, Mus musculus
tgactccaaaagcaaaattaaccaa

SEQ ID NO: 850010 - DNA, 25 bp, Mus musculus
tgactccaaaaggaaaattaaccaa

SEQ ID NO: 850011 - DNA, 25 bp, Mus musculus
tgactccaaactagaggttccactc

SEQ ID NO: 850012 - DNA, 25 bp, Mus musculus
tgactccaaacttgaggttccactc

SEQ ID NO: 850013 - DNA, 25 bp, Mus musculus
tgactccaacatcgcaattgctgat

SEQ ID NO: 850014 - DNA, 25 bp, Mus musculus
tgactccaacatggcaattgctgat

SEQ ID NO: 850015 - DNA, 25 bp, Mus musculus
tgactccaacttcgcgttgtcagct

SEQ ID NO: 850016 - DNA, 25 bp, Mus musculus
tgactccaacttggcgttgtcagct

SEQ ID NO: 850017 - DNA, 25 bp, Mus musculus
tgactccaaggtccaatattttatt

SEQ ID NO: 850018 - DNA, 25 bp, Mus musculus
tgactccaaggtgcaatattttatt

SEQ ID NO: 850019 - DNA, 25 bp, Mus musculus
tgactccaagtactgggctgcttcc

SEQ ID NO: 850020 - DNA, 25 bp, Mus musculus
tgactccaagtagtgggctgcttcc

SEQ ID NO: 850021 - DNA, 25 bp, Mus musculus
tgactccaatataaactacaagaac

SEQ ID NO: 850022 - DNA, 25 bp, Mus musculus
tgactccaatattaactacaagaac

SEQ ID NO: 850023 - DNA, 25 bp, Mus musculus
tgactccaatggacagccagagggt

SEQ ID NO: 850024 - DNA, 25 bp, Mus musculus
tgactccaatggtcagccagagggt

SEQ ID NO: 850025 - DNA, 25 bp, Mus musculus
tgactccactggctcagcagaacat

SEQ ID NO: 850026 - DNA, 25 bp, Mus musculus
tgactccactgggtcagcagaacat

SEQ ID NO: 850027 - DNA, 25 bp, Mus musculus
tgactccagacaaccacaatgccag

SEQ ID NO: 850028 - DNA, 25 bp, Mus musculus
tgactccagacacacaaataccaaa

SEQ ID NO: 850029 - DNA, 25 bp, Mus musculus
tgactccagacagacaaataccaaa

SEQ ID NO: 850030 - DNA, 25 bp, Mus musculus
tgactccagacatccacaatgccag

SEQ ID NO: 850031 - DNA, 25 bp, Mus musculus
tgactccagagaccatcctgtagtg

SEQ ID NO: 850032 - DNA, 25 bp, Mus musculus
tgactccagagagcatcctgtagtg

SEQ ID NO: 850033 - DNA, 25 bp, Mus musculus
tgactccagagcatgcaaacaaaat

SEQ ID NO: 850034 - DNA, 25 bp, Mus musculus
tgactccagagcttgcaaacaaaat

SEQ ID NO: 850035 - DNA, 25 bp, Mus musculus
tgactccagatgacagtccactagg

SEQ ID NO: 850036 - DNA, 25 bp, Mus musculus
tgactccagatgatagtgacaatga

SEQ ID NO: 850037 - DNA, 25 bp, Mus musculus
tgactccagatgtcagtccactagg

SEQ ID NO: 850038 - DNA, 25 bp, Mus musculus
tgactccagatgttagtgacaatga

SEQ ID NO: 850039 - DNA, 25 bp, Mus musculus
tgactccagccgctctggctttttt

SEQ ID NO: 850040 - DNA, 25 bp, Mus musculus
tgactccagccggtctggctttttt

SEQ ID NO: 850041 - DNA, 25 bp, Mus musculus
tgactccaggccaatttacaaccaa

SEQ ID NO: 850042 - DNA, 25 bp, Mus musculus
tgactccaggcctatttacaaccaa

SEQ ID NO: 850043 - DNA, 25 bp, Mus musculus
tgactccatcccagagggcaggaaa

SEQ ID NO: 850044 - DNA, 25 bp, Mus musculus
tgactccatccctgagggcaggaaa

SEQ ID NO: 850045 - DNA, 25 bp, Mus musculus
tgactccatctactggtgtgcagat

SEQ ID NO: 850046 - DNA, 25 bp, Mus musculus
tgactccatctagtggtgtgcagat

SEQ ID NO: 850047 - DNA, 25 bp, Mus musculus
tgactccatgatccttcagtttttc

SEQ ID NO: 850048 - DNA, 25 bp, Mus musculus
tgactccatgatgcttcagtttttc

SEQ ID NO: 850049 - DNA, 25 bp, Mus musculus
tgactccatgctctttgtacttcca

SEQ ID NO: 850050 - DNA, 25 bp, Mus musculus
tgactccatgctgtttgtacttcca

SEQ ID NO: 850051 - DNA, 25 bp, Mus musculus
tgactccattaaacacagctcgtcc

SEQ ID NO: 850052 - DNA, 25 bp, Mus musculus
tgactccattaatcacagctcgtcc

SEQ ID NO: 850053 - DNA, 25 bp, Mus musculus
tgactcccacataggttgatcacac

SEQ ID NO: 850054 - DNA, 25 bp, Mus musculus
tgactcccacattggttgatcacac

SEQ ID NO: 850055 - DNA, 25 bp, Mus musculus
tgactcccagttctttgtttcttac

SEQ ID NO: 850056 - DNA, 25 bp, Mus musculus
tgactcccagttgtttgtttcttac

SEQ ID NO: 850057 - DNA, 25 bp, Mus musculus
tgactccccaggactacaatctgag

SEQ ID NO: 850058 - DNA, 25 bp, Mus musculus
tgactccccaggactagtgcagtgc

SEQ ID NO: 850059 - DNA, 25 bp, Mus musculus
tgactccccaggtctacaatctgag

SEQ ID NO: 850060 - DNA, 25 bp, Mus musculus
tgactccccaggtctagtgcagtgc

SEQ ID NO: 850061 - DNA, 25 bp, Mus musculus
tgactcccctccatgatggctgtgc

SEQ ID NO: 850062 - DNA, 25 bp, Mus musculus
tgactcccctccttgatggctgtgc

SEQ ID NO: 850063 - DNA, 25 bp, Mus musculus
tgactcccggtccttcctaagtgaa

SEQ ID NO: 850064 - DNA, 25 bp, Mus musculus
tgactcccggtcgttcctaagtgaa

SEQ ID NO: 850065 - DNA, 25 bp, Mus musculus
tgactcccgtgtccgagagcagcaa

SEQ ID NO: 850066 - DNA, 25 bp, Mus musculus
tgactcccgtgtgcgagagcagcaa

SEQ ID NO: 850067 - DNA, 25 bp, Mus musculus
tgactccctcggagcagggattgtc

SEQ ID NO: 850068 - DNA, 25 bp, Mus musculus
tgactccctcggtgcagggattgtc

SEQ ID NO: 850069 - DNA, 25 bp, Mus musculus
tgactccctgcaaatctgccaaaga

SEQ ID NO: 850070 - DNA, 25 bp, Mus musculus
tgactccctgcatatctgccaaaga

SEQ ID NO: 850071 - DNA, 25 bp, Mus musculus
tgactcccttcacaacctgtaattg

SEQ ID NO: 850072 - DNA, 25 bp, Mus musculus
tgactcccttcagaacctgtaattg

SEQ ID NO: 850073 - DNA, 25 bp, Mus musculus
tgactcccttctatgggtatctaca

SEQ ID NO: 850074 - DNA, 25 bp, Mus musculus
tgactcccttctttgggtatctaca

SEQ ID NO: 850075 - DNA, 25 bp, Mus musculus
tgactccctttccaaggtctgagtt

SEQ ID NO: 850076 - DNA, 25 bp, Mus musculus
tgactccctttcgaaggtctgagtt

SEQ ID NO: 850077 - DNA, 25 bp, Mus musculus
tgactccgccctacaaggttttgtt

SEQ ID NO: 850078 - DNA, 25 bp, Mus musculus
tgactccgcccttcaaggttttgtt

SEQ ID NO: 850079 - DNA, 25 bp, Mus musculus
tgactccgcctaacagacaggcttt

SEQ ID NO: 850080 - DNA, 25 bp, Mus musculus
tgactccgcctatcagacaggcttt

SEQ ID NO: 850081 - DNA, 25 bp, Mus musculus
tgactccggtggctggccatatccg

SEQ ID NO: 850082 - DNA, 25 bp, Mus musculus
tgactccggtgggtggccatatccg

SEQ ID NO: 850083 - DNA, 25 bp, Mus musculus
tgactccgtcggagttctgttctaa

SEQ ID NO: 850084 - DNA, 25 bp, Mus musculus
tgactccgtcggtgttctgttctaa

SEQ ID NO: 850085 - DNA, 25 bp, Mus musculus
tgactcctaatcagatgcacgtgat

SEQ ID NO: 850086 - DNA, 25 bp, Mus musculus
tgactcctaatctgatgcacgtgat

SEQ ID NO: 850087 - DNA, 25 bp, Mus musculus
tgactcctaggtcacctgtaggtga

SEQ ID NO: 850088 - DNA, 25 bp, Mus musculus
tgactcctaggtgacctgtaggtga

SEQ ID NO: 850089 - DNA, 25 bp, Mus musculus
tgactcctatgtaggctttattaag

SEQ ID NO: 850090 - DNA, 25 bp, Mus musculus
tgactcctatgttggctttattaag

SEQ ID NO: 850091 - DNA, 25 bp, Mus musculus
tgactcctcaacaacaaggagccta

SEQ ID NO: 850092 - DNA, 25 bp, Mus musculus
tgactcctcaactacaaggagccta

SEQ ID NO: 850093 - DNA, 25 bp, Mus musculus
tgactcctcagtaaatgggaccagc

SEQ ID NO: 850094 - DNA, 25 bp, Mus musculus
tgactcctcagtaacttcaaccagg

SEQ ID NO: 850095 - DNA, 25 bp, Mus musculus
tgactcctcagttaatgggaccagc

SEQ ID NO: 850096 - DNA, 25 bp, Mus musculus
tgactcctcagttacttcaaccagg

SEQ ID NO: 850097 - DNA, 25 bp, Mus musculus
tgactcctgacacttgttctctggg

SEQ ID NO: 850098 - DNA, 25 bp, Mus musculus
tgactcctgacagttgttctctggg

SEQ ID NO: 850099 - DNA, 25 bp, Mus musculus
tgactcctgatgaagcacaactccc

SEQ ID NO: 850100 - DNA, 25 bp, Mus musculus
tgactcctgatgtagcacaactccc

SEQ ID NO: 850101 - DNA, 25 bp, Mus musculus
tgactcctgcaaagactcactagtg

SEQ ID NO: 850102 - DNA, 25 bp, Mus musculus
tgactcctgcaatgactcactagtg

SEQ ID NO: 850103 - DNA, 25 bp, Mus musculus
tgactcctgccaagatgtcctgcca

SEQ ID NO: 850104 - DNA, 25 bp, Mus musculus
tgactcctgccatgatgtcctgcca

SEQ ID NO: 850105 - DNA, 25 bp, Mus musculus
tgactcctgctcagggtatctaata

SEQ ID NO: 850106 - DNA, 25 bp, Mus musculus
tgactcctgctctgggtatctaata

SEQ ID NO: 850107 - DNA, 25 bp, Mus musculus
tgactcctggaacatgcacttgccc

SEQ ID NO: 850108 - DNA, 25 bp, Mus musculus
tgactcctggaagatgcacttgccc

SEQ ID NO: 850109 - DNA, 25 bp, Mus musculus
tgactcctggcaacacctcctggga

SEQ ID NO: 850110 - DNA, 25 bp, Mus musculus
tgactcctggcatcacctcctggga

SEQ ID NO: 850111 - DNA, 25 bp, Mus musculus
tgactcctgtccacttcaataaaga

SEQ ID NO: 850112 - DNA, 25 bp, Mus musculus
tgactcctgtcctcttcaataaaga

SEQ ID NO: 850113 - DNA, 25 bp, Mus musculus
tgactcctgtgtcctcagcggcatt

SEQ ID NO: 850114 - DNA, 25 bp, Mus musculus
tgactcctgtgtgctcagcggcatt

SEQ ID NO: 850115 - DNA, 25 bp, Mus musculus
tgactccttacaagcaagtgttttg

SEQ ID NO: 850116 - DNA, 25 bp, Mus musculus
tgactccttacatgcaagtgttttg

SEQ ID NO: 850117 - DNA, 25 bp, Mus musculus
tgactccttcatactctagtgatgt

SEQ ID NO: 850118 - DNA, 25 bp, Mus musculus
tgactccttcattctctagtgatgt

SEQ ID NO: 850119 - DNA, 25 bp, Mus musculus
tgactccttcgtccatgttaccgat

SEQ ID NO: 850120 - DNA, 25 bp, Mus musculus
tgactccttcgtgcatgttaccgat

SEQ ID NO: 850121 - DNA, 25 bp, Mus musculus
tgactccttcttcatgtttggtgga

SEQ ID NO: 850122 - DNA, 25 bp, Mus musculus
tgactccttcttgatgtttggtgga

SEQ ID NO: 850123 - DNA, 25 bp, Mus musculus
tgactccttggcatcctgggtcgga

SEQ ID NO: 850124 - DNA, 25 bp, Mus musculus
tgactccttggcttcctgggtcgga

SEQ ID NO: 850125 - DNA, 25 bp, Mus musculus
tgactcctttcccatgctttgacaa

SEQ ID NO: 850126 - DNA, 25 bp, Mus musculus
tgactcctttccgatgctttgacaa

SEQ ID NO: 850127 - DNA, 25 bp, Mus musculus
tgactcgagagtatagctgcctggg

SEQ ID NO: 850128 - DNA, 25 bp, Mus musculus
tgactcgagagtttagctgcctggg

SEQ ID NO: 850129 - DNA, 25 bp, Mus musculus
tgactcgaggtgaccccttgttgaa

SEQ ID NO: 850130 - DNA, 25 bp, Mus musculus
tgactcgaggtgatggctggacccc

SEQ ID NO: 850131 - DNA, 25 bp, Mus musculus
tgactcgaggtgtccccttgttgaa

SEQ ID NO: 850132 - DNA, 25 bp, Mus musculus
tgactcgaggtgttggctggacccc

SEQ ID NO: 850133 - DNA, 25 bp, Mus musculus
tgactcgcacccacgagggagccga

SEQ ID NO: 850134 - DNA, 25 bp, Mus musculus
tgactcgcaccctcgagggagccga

SEQ ID NO: 850135 - DNA, 25 bp, Mus musculus
tgactcgctattactgctgcggaaa

SEQ ID NO: 850136 - DNA, 25 bp, Mus musculus
tgactcgctatttctgctgcggaaa

SEQ ID NO: 850137 - DNA, 25 bp, Mus musculus
tgactcgctcagcaagactttataa

SEQ ID NO: 850138 - DNA, 25 bp, Mus musculus
tgactcgctcaggaagactttataa

SEQ ID NO: 850139 - DNA, 25 bp, Mus musculus
tgactcggaaatccgggaaacacct

SEQ ID NO: 850140 - DNA, 25 bp, Mus musculus
tgactcggaaatgcgggaaacacct

SEQ ID NO: 850141 - DNA, 25 bp, Mus musculus
tgactcggaacacagcgattggctc

SEQ ID NO: 850142 - DNA, 25 bp, Mus musculus
tgactcggaacagagcgattggctc

SEQ ID NO: 850143 - DNA, 25 bp, Mus musculus
tgactcggaagacaggctgatcctt

SEQ ID NO: 850144 - DNA, 25 bp, Mus musculus
tgactcggaagagaggctgatcctt

SEQ ID NO: 850145 - DNA, 25 bp, Mus musculus
tgactcggagcaccctggtttatgt

SEQ ID NO: 850146 - DNA, 25 bp, Mus musculus
tgactcggagcagcctggtttatgt

SEQ ID NO: 850147 - DNA, 25 bp, Mus musculus
tgactcggagtcaatttttctacca

SEQ ID NO: 850148 - DNA, 25 bp, Mus musculus
tgactcggagtctatttttctacca

SEQ ID NO: 850149 - DNA, 25 bp, Mus musculus
tgactcggctagacctggagcagct

SEQ ID NO: 850150 - DNA, 25 bp, Mus musculus
tgactcggctagtcctggagcagct

SEQ ID NO: 850151 - DNA, 25 bp, Mus musculus
tgactcggcttcatccaacacaaga

SEQ ID NO: 850152 - DNA, 25 bp, Mus musculus
tgactcggcttcttccaacacaaga

SEQ ID NO: 850153 - DNA, 25 bp, Mus musculus
tgactcggtctcattgcagcaggga

SEQ ID NO: 850154 - DNA, 25 bp, Mus musculus
tgactcggtctctttgcagcaggga

SEQ ID NO: 850155 - DNA, 25 bp, Mus musculus
tgactcgtagggacctttggtattg

SEQ ID NO: 850156 - DNA, 25 bp, Mus musculus
tgactcgtagggtcctttggtattg

SEQ ID NO: 850157 - DNA, 25 bp, Mus musculus
tgactcgttgtgaagaaccgggttc

SEQ ID NO: 850158 - DNA, 25 bp, Mus musculus
tgactcgttgtgtagaaccgggttc

SEQ ID NO: 850159 - DNA, 25 bp, Mus musculus
tgactctacggtaatgcacgatcct

SEQ ID NO: 850160 - DNA, 25 bp, Mus musculus
tgactctacggttatgcacgatcct

SEQ ID NO: 850161 - DNA, 25 bp, Mus musculus
tgactctacttcagtgaacctctgt

SEQ ID NO: 850162 - DNA, 25 bp, Mus musculus
tgactctacttctgtgaacctctgt

SEQ ID NO: 850163 - DNA, 25 bp, Mus musculus
tgactctagaatagtcccagcacct

SEQ ID NO: 850164 - DNA, 25 bp, Mus musculus
tgactctagaattgtcccagcacct

SEQ ID NO: 850165 - DNA, 25 bp, Mus musculus
tgactctagataacctcgggccgat

SEQ ID NO: 850166 - DNA, 25 bp, Mus musculus
tgactctagatatcctcgggccgat

SEQ ID NO: 850167 - DNA, 25 bp, Mus musculus
tgactctagcctactatcacttggg

SEQ ID NO: 850168 - DNA, 25 bp, Mus musculus
tgactctagccttctatcacttggg

SEQ ID NO: 850169 - DNA, 25 bp, Mus musculus
tgactctagcttctcttcctaaaat

SEQ ID NO: 850170 - DNA, 25 bp, Mus musculus
tgactctagcttgtcttcctaaaat

SEQ ID NO: 850171 - DNA, 25 bp, Mus musculus
tgactctagggtctattctccgaaa

SEQ ID NO: 850172 - DNA, 25 bp, Mus musculus
tgactctagggtgtattctccgaaa

SEQ ID NO: 850173 - DNA, 25 bp, Mus musculus
tgactctatcacagcactatcacaa

SEQ ID NO: 850174 - DNA, 25 bp, Mus musculus
tgactctatcactgcactatcacaa

SEQ ID NO: 850175 - DNA, 25 bp, Mus musculus
tgactctatggtacttcaggtgtga

SEQ ID NO: 850176 - DNA, 25 bp, Mus musculus
tgactctatggttcttcaggtgtga

SEQ ID NO: 850177 - DNA, 25 bp, Mus musculus
tgactctcaacaccgcttctggaaa

SEQ ID NO: 850178 - DNA, 25 bp, Mus musculus
tgactctcaacagcgcttctggaaa

SEQ ID NO: 850179 - DNA, 25 bp, Mus musculus
tgactctcaagccagctcaaagctt

SEQ ID NO: 850180 - DNA, 25 bp, Mus musculus
tgactctcaagcgagctcaaagctt

SEQ ID NO: 850181 - DNA, 25 bp, Mus musculus
tgactctcacctagcattctgtata

SEQ ID NO: 850182 - DNA, 25 bp, Mus musculus
tgactctcaccttgcattctgtata

SEQ ID NO: 850183 - DNA, 25 bp, Mus musculus
tgactctcactcatggcagtgtggt

SEQ ID NO: 850184 - DNA, 25 bp, Mus musculus
tgactctcactcttggcagtgtggt

SEQ ID NO: 850185 - DNA, 25 bp, Mus musculus
tgactctcagaacaacaccgtgtac

SEQ ID NO: 850186 - DNA, 25 bp, Mus musculus
tgactctcagaaccgtgggttttgt

SEQ ID NO: 850187 - DNA, 25 bp, Mus musculus
tgactctcagaagaacaccgtgtac

SEQ ID NO: 850188 - DNA, 25 bp, Mus musculus
tgactctcagaagcgtgggttttgt

SEQ ID NO: 850189 - DNA, 25 bp, Mus musculus
tgactctcagcaaccttgaccgata

SEQ ID NO: 850190 - DNA, 25 bp, Mus musculus
tgactctcagcatccttgaccgata

SEQ ID NO: 850191 - DNA, 25 bp, Mus musculus
tgactctcatgacccacgtggtagg

SEQ ID NO: 850192 - DNA, 25 bp, Mus musculus
tgactctcatgagccacgtggtagg

SEQ ID NO: 850193 - DNA, 25 bp, Mus musculus
tgactctcatttacacgagcggcac

SEQ ID NO: 850194 - DNA, 25 bp, Mus musculus
tgactctcattttcacgagcggcac

SEQ ID NO: 850195 - DNA, 25 bp, Mus musculus
tgactctccataaccttgctagatt

SEQ ID NO: 850196 - DNA, 25 bp, Mus musculus
tgactctccatatccttgctagatt

SEQ ID NO: 850197 - DNA, 25 bp, Mus musculus
tgactctccttcagtctgacagcag

SEQ ID NO: 850198 - DNA, 25 bp, Mus musculus
tgactctccttctgtctgacagcag

SEQ ID NO: 850199 - DNA, 25 bp, Mus musculus
tgactctctactacagcatgggctt

SEQ ID NO: 850200 - DNA, 25 bp, Mus musculus
tgactctctacttcagcatgggctt

SEQ ID NO: 850201 - DNA, 25 bp, Mus musculus
tgactctctgacaagtgttaaaggt

SEQ ID NO: 850202 - DNA, 25 bp, Mus musculus
tgactctctgactagtgttaaaggt

SEQ ID NO: 850203 - DNA, 25 bp, Mus musculus
tgactctctgcacgccttattgttt

SEQ ID NO: 850204 - DNA, 25 bp, Mus musculus
tgactctctgcaggccttattgttt

SEQ ID NO: 850205 - DNA, 25 bp, Mus musculus
tgactctctggcaccgttttctctt

SEQ ID NO: 850206 - DNA, 25 bp, Mus musculus
tgactctctggctccgttttctctt

SEQ ID NO: 850207 - DNA, 25 bp, Mus musculus
tgactctctggtcgcccacgtaggg

SEQ ID NO: 850208 - DNA, 25 bp, Mus musculus
tgactctctggtggcccacgtaggg

SEQ ID NO: 850209 - DNA, 25 bp, Mus musculus
tgactctgaccccatcacagtggtg

SEQ ID NO: 850210 - DNA, 25 bp, Mus musculus
tgactctgacccgatcacagtggtg

SEQ ID NO: 850211 - DNA, 25 bp, Mus musculus
tgactctgacgacaacactgatccc

SEQ ID NO: 850212 - DNA, 25 bp, Mus musculus
tgactctgacgagaacactgatccc

SEQ ID NO: 850213 - DNA, 25 bp, Mus musculus
tgactctgactcatggcctcattta

SEQ ID NO: 850214 - DNA, 25 bp, Mus musculus
tgactctgactcttggcctcattta

SEQ ID NO: 850215 - DNA, 25 bp, Mus musculus
tgactctgagaacctttggaaccca

SEQ ID NO: 850216 - DNA, 25 bp, Mus musculus
tgactctgagaagctttggaaccca

SEQ ID NO: 850217 - DNA, 25 bp, Mus musculus
tgactctgagtcaaatcccggctct

SEQ ID NO: 850218 - DNA, 25 bp, Mus musculus
tgactctgagtctaatcccggctct

SEQ ID NO: 850219 - DNA, 25 bp, Mus musculus
tgactctgatgaacccccaaatgaa

SEQ ID NO: 850220 - DNA, 25 bp, Mus musculus
tgactctgatgatcccccaaatgaa

SEQ ID NO: 850221 - DNA, 25 bp, Mus musculus
tgactctgatgcagcacagttggga

SEQ ID NO: 850222 - DNA, 25 bp, Mus musculus
tgactctgatgctgcacagttggga

SEQ ID NO: 850223 - DNA, 25 bp, Mus musculus
tgactctgcagtacatgtacgacga

SEQ ID NO: 850224 - DNA, 25 bp, Mus musculus
tgactctgcagtcctaccatggtag

SEQ ID NO: 850225 - DNA, 25 bp, Mus musculus
tgactctgcagtgctaccatggtag

SEQ ID NO: 850226 - DNA, 25 bp, Mus musculus
tgactctgcagttcatgtacgacga

SEQ ID NO: 850227 - DNA, 25 bp, Mus musculus
tgactctgccagctttctttgctaa

SEQ ID NO: 850228 - DNA, 25 bp, Mus musculus
tgactctgccaggtttctttgctaa

SEQ ID NO: 850229 - DNA, 25 bp, Mus musculus
tgactctgccatagttccattggca

SEQ ID NO: 850230 - DNA, 25 bp, Mus musculus
tgactctgccattgttccattggca

SEQ ID NO: 850231 - DNA, 25 bp, Mus musculus
tgactctgccccataccagtgggag

SEQ ID NO: 850232 - DNA, 25 bp, Mus musculus
tgactctgccccttaccagtgggag

SEQ ID NO: 850233 - DNA, 25 bp, Mus musculus
tgactctgcccgcataatcgtctct

SEQ ID NO: 850234 - DNA, 25 bp, Mus musculus
tgactctgcccggataatcgtctct

SEQ ID NO: 850235 - DNA, 25 bp, Mus musculus
tgactctgccttaagctactcaaac

SEQ ID NO: 850236 - DNA, 25 bp, Mus musculus
tgactctgcctttagctactcaaac

SEQ ID NO: 850237 - DNA, 25 bp, Mus musculus
tgactctgctccagcgggcagggct

SEQ ID NO: 850238 - DNA, 25 bp, Mus musculus
tgactctgctcctgcgggcagggct

SEQ ID NO: 850239 - DNA, 25 bp, Mus musculus
tgactctgctctcagataccgaaat

SEQ ID NO: 850240 - DNA, 25 bp, Mus musculus
tgactctgctctgagataccgaaat

SEQ ID NO: 850241 - DNA, 25 bp, Mus musculus
tgactctgcttaacacattctcagc

SEQ ID NO: 850242 - DNA, 25 bp, Mus musculus
tgactctgcttatcacattctcagc

SEQ ID NO: 850243 - DNA, 25 bp, Mus musculus
tgactctggaagccgacgacctcat

SEQ ID NO: 850244 - DNA, 25 bp, Mus musculus
tgactctggaaggcgacgacctcat

SEQ ID NO: 850245 - DNA, 25 bp, Mus musculus
tgactctggagcaccgtgggcacag

SEQ ID NO: 850246 - DNA, 25 bp, Mus musculus
tgactctggagctccgtgggcacag

SEQ ID NO: 850247 - DNA, 25 bp, Mus musculus
tgactctggcttccacctcggatga

SEQ ID NO: 850248 - DNA, 25 bp, Mus musculus
tgactctggcttgcacctcggatga

SEQ ID NO: 850249 - DNA, 25 bp, Mus musculus
tgactctggtaaagtcagttcctgc

SEQ ID NO: 850250 - DNA, 25 bp, Mus musculus
tgactctggtaatgtcagttcctgc

SEQ ID NO: 850251 - DNA, 25 bp, Mus musculus
tgactctgtcacatatgcttttggt

SEQ ID NO: 850252 - DNA, 25 bp, Mus musculus
tgactctgtcacttatgcttttggt

SEQ ID NO: 850253 - DNA, 25 bp, Mus musculus
tgactctgttctacgtgtctctgta

SEQ ID NO: 850254 - DNA, 25 bp, Mus musculus
tgactctgttcttcgtgtctctgta

SEQ ID NO: 850255 - DNA, 25 bp, Mus musculus
tgactcttaaacctgctcctttctc

SEQ ID NO: 850256 - DNA, 25 bp, Mus musculus
tgactcttaaacgtgctcctttctc

SEQ ID NO: 850257 - DNA, 25 bp, Mus musculus
tgactcttaacacaggatcatccaa

SEQ ID NO: 850258 - DNA, 25 bp, Mus musculus
tgactcttaacagaggatcatccaa

SEQ ID NO: 850259 - DNA, 25 bp, Mus musculus
tgactcttagctcacttggtctgtt

SEQ ID NO: 850260 - DNA, 25 bp, Mus musculus
tgactcttagctgacttggtctgtt

SEQ ID NO: 850261 - DNA, 25 bp, Mus musculus
tgactcttaggtcttcctatttcag

SEQ ID NO: 850262 - DNA, 25 bp, Mus musculus
tgactcttaggtgttcctatttcag

SEQ ID NO: 850263 - DNA, 25 bp, Mus musculus
tgactcttcaaacccttccatttat

SEQ ID NO: 850264 - DNA, 25 bp, Mus musculus
tgactcttcaaagccttccatttat

SEQ ID NO: 850265 - DNA, 25 bp, Mus musculus
tgactcttcccaccaacttttaagc

SEQ ID NO: 850266 - DNA, 25 bp, Mus musculus
tgactcttcccagcaacttttaagc

SEQ ID NO: 850267 - DNA, 25 bp, Mus musculus
tgactcttctgtcacagcccattct

SEQ ID NO: 850268 - DNA, 25 bp, Mus musculus
tgactcttctgtgacagcccattct

SEQ ID NO: 850269 - DNA, 25 bp, Mus musculus
tgactcttcttcaatcaaccatttg

SEQ ID NO: 850270 - DNA, 25 bp, Mus musculus
tgactcttcttctatcaaccatttg

SEQ ID NO: 850271 - DNA, 25 bp, Mus musculus
tgactcttttaaatcagcccaaatt

SEQ ID NO: 850272 - DNA, 25 bp, Mus musculus
tgactcttttaattcagcccaaatt

SEQ ID NO: 850273 - DNA, 25 bp, Mus musculus
tgactcttttagaacctgttattag

SEQ ID NO: 850274 - DNA, 25 bp, Mus musculus
tgactcttttagtacctgttattag

SEQ ID NO: 850275 - DNA, 25 bp, Mus musculus
tgactcttttctagtgccagatgca

SEQ ID NO: 850276 - DNA, 25 bp, Mus musculus
tgactcttttcttgtgccagatgca

SEQ ID NO: 850277 - DNA, 25 bp, Mus musculus
tgactcttttgcattattccactct

SEQ ID NO: 850278 - DNA, 25 bp, Mus musculus
tgactcttttgccagcactcttttc

SEQ ID NO: 850279 - DNA, 25 bp, Mus musculus
tgactcttttgcgagcactcttttc

SEQ ID NO: 850280 - DNA, 25 bp, Mus musculus
tgactcttttgctttattccactct

SEQ ID NO: 850281 - DNA, 25 bp, Mus musculus
tgactcttttggcacaacagaaggg

SEQ ID NO: 850282 - DNA, 25 bp, Mus musculus
tgactcttttgggacaacagaaggg

SEQ ID NO: 850283 - DNA, 25 bp, Mus musculus
tgactgaaactccacatccgtgttc

SEQ ID NO: 850284 - DNA, 25 bp, Mus musculus
tgactgaaactcgacatccgtgttc

SEQ ID NO: 850285 - DNA, 25 bp, Mus musculus
tgactgaaactgaagcatccatctg

SEQ ID NO: 850286 - DNA, 25 bp, Mus musculus
tgactgaaactgtagcatccatctg

SEQ ID NO: 850287 - DNA, 25 bp, Mus musculus
tgactgaaacttaccatactgtgaa

SEQ ID NO: 850288 - DNA, 25 bp, Mus musculus
tgactgaaactttccatactgtgaa

SEQ ID NO: 850289 - DNA, 25 bp, Mus musculus
tgactgaacacacactctcatgtcc

SEQ ID NO: 850290 - DNA, 25 bp, Mus musculus
tgactgaacacagactctcatgtcc

SEQ ID NO: 850291 - DNA, 25 bp, Mus musculus
tgactgaacactatccttccaggta

SEQ ID NO: 850292 - DNA, 25 bp, Mus musculus
tgactgaacactttccttccaggta

SEQ ID NO: 850293 - DNA, 25 bp, Mus musculus
tgactgaagcaaaaaaccttttcac

SEQ ID NO: 850294 - DNA, 25 bp, Mus musculus
tgactgaagcaataaaccttttcac

SEQ ID NO: 850295 - DNA, 25 bp, Mus musculus
tgactgaagcccacgtacacgggta

SEQ ID NO: 850296 - DNA, 25 bp, Mus musculus
tgactgaagccctcgtacacgggta

SEQ ID NO: 850297 - DNA, 25 bp, Mus musculus
tgactgaaggaaagtgagatcacag

SEQ ID NO: 850298 - DNA, 25 bp, Mus musculus
tgactgaaggaatgtgagatcacag

SEQ ID NO: 850299 - DNA, 25 bp, Mus musculus
tgactgaatagtctggatgccctgt

SEQ ID NO: 850300 - DNA, 25 bp, Mus musculus
tgactgaatagtgtggatgccctgt

SEQ ID NO: 850301 - DNA, 25 bp, Mus musculus
tgactgacatctcccacagactgta

SEQ ID NO: 850302 - DNA, 25 bp, Mus musculus
tgactgacatctgccacagactgta

SEQ ID NO: 850303 - DNA, 25 bp, Mus musculus
tgactgaccaccagttcacggagaa

SEQ ID NO: 850304 - DNA, 25 bp, Mus musculus
tgactgaccacctgttcacggagaa

SEQ ID NO: 850305 - DNA, 25 bp, Mus musculus
tgactgaccagaccatggcttacca

SEQ ID NO: 850306 - DNA, 25 bp, Mus musculus
tgactgaccagagcatggcttacca

SEQ ID NO: 850307 - DNA, 25 bp, Mus musculus
tgactgaccaggcacaggctcttat

SEQ ID NO: 850308 - DNA, 25 bp, Mus musculus
tgactgaccagggacaggctcttat

SEQ ID NO: 850309 - DNA, 25 bp, Mus musculus
tgactgacctttctcactattgtct

SEQ ID NO: 850310 - DNA, 25 bp, Mus musculus
tgactgacctttgtcactattgtct

SEQ ID NO: 850311 - DNA, 25 bp, Mus musculus
tgactgacgactctttttaagttat

SEQ ID NO: 850312 - DNA, 25 bp, Mus musculus
tgactgacgactgtttttaagttat

SEQ ID NO: 850313 - DNA, 25 bp, Mus musculus
tgactgacgatgcttcagtacctct

SEQ ID NO: 850314 - DNA, 25 bp, Mus musculus
tgactgacgatggttcagtacctct

SEQ ID NO: 850315 - DNA, 25 bp, Mus musculus
tgactgacgctcaaattctccatga

SEQ ID NO: 850316 - DNA, 25 bp, Mus musculus
tgactgacgctctaattctccatga

SEQ ID NO: 850317 - DNA, 25 bp, Mus musculus
tgactgactacgactcaagtgaacg

SEQ ID NO: 850318 - DNA, 25 bp, Mus musculus
tgactgactacgtctcaagtgaacg

SEQ ID NO: 850319 - DNA, 25 bp, Mus musculus
tgactgactatgcttgtggttctcc

SEQ ID NO: 850320 - DNA, 25 bp, Mus musculus
tgactgactatggttgtggttctcc

SEQ ID NO: 850321 - DNA, 25 bp, Mus musculus
tgactgactgccacaagttccagcg

SEQ ID NO: 850322 - DNA, 25 bp, Mus musculus
tgactgactgcctcaagttccagcg

SEQ ID NO: 850323 - DNA, 25 bp, Mus musculus
tgactgactgctctggcaatttctg

SEQ ID NO: 850324 - DNA, 25 bp, Mus musculus
tgactgactgctgtggcaatttctg

SEQ ID NO: 850325 - DNA, 25 bp, Mus musculus
tgactgactgtcactgggctttggt

SEQ ID NO: 850326 - DNA, 25 bp, Mus musculus
tgactgactgtctctgggctttggt

SEQ ID NO: 850327 - DNA, 25 bp, Mus musculus
tgactgagacctaggcgttcagaga

SEQ ID NO: 850328 - DNA, 25 bp, Mus musculus
tgactgagaccttggcgttcagaga

SEQ ID NO: 850329 - DNA, 25 bp, Mus musculus
tgactgaggcacacaacttccctgg

SEQ ID NO: 850330 - DNA, 25 bp, Mus musculus
tgactgaggcactcaacttccctgg

SEQ ID NO: 850331 - DNA, 25 bp, Mus musculus
tgactgaggtatacctgtagcccct

SEQ ID NO: 850332 - DNA, 25 bp, Mus musculus
tgactgaggtattcctgtagcccct

SEQ ID NO: 850333 - DNA, 25 bp, Mus musculus
tgactgagtcttatacaacaccgaa

SEQ ID NO: 850334 - DNA, 25 bp, Mus musculus
tgactgagtcttttacaacaccgaa

SEQ ID NO: 850335 - DNA, 25 bp, Mus musculus
tgactgagttttccctagaaaggag

SEQ ID NO: 850336 - DNA, 25 bp, Mus musculus
tgactgagttttgcctagaaaggag

SEQ ID NO: 850337 - DNA, 25 bp, Mus musculus
tgactgatactcaagtgctcatggg

SEQ ID NO: 850338 - DNA, 25 bp, Mus musculus
tgactgatactctagtgctcatggg

SEQ ID NO: 850339 - DNA, 25 bp, Mus musculus
tgactgatcgtcatgggccaagtgt

SEQ ID NO: 850340 - DNA, 25 bp, Mus musculus
tgactgatcgtcttgggccaagtgt

SEQ ID NO: 850341 - DNA, 25 bp, Mus musculus
tgactgatgaacagcgctgaccctg

SEQ ID NO: 850342 - DNA, 25 bp, Mus musculus
tgactgatgaactgcgctgaccctg

SEQ ID NO: 850343 - DNA, 25 bp, Mus musculus
tgactgatgacactccttgttggga

SEQ ID NO: 850344 - DNA, 25 bp, Mus musculus
tgactgatgacagtccttgttggga

SEQ ID NO: 850345 - DNA, 25 bp, Mus musculus
tgactgattcacatggtttgtcccc

SEQ ID NO: 850346 - DNA, 25 bp, Mus musculus
tgactgattcacttggtttgtcccc

SEQ ID NO: 850347 - DNA, 25 bp, Mus musculus
tgactgcaaaatccccttttaccac

SEQ ID NO: 850348 - DNA, 25 bp, Mus musculus
tgactgcaaaatgcccttttaccac

SEQ ID NO: 850349 - DNA, 25 bp, Mus musculus
tgactgcacagcaatggcccctgaa

SEQ ID NO: 850350 - DNA, 25 bp, Mus musculus
tgactgcacagctatggcccctgaa

SEQ ID NO: 850351 - DNA, 25 bp, Mus musculus
tgactgcaccagctttgtggctgat

SEQ ID NO: 850352 - DNA, 25 bp, Mus musculus
tgactgcaccaggtttgtggctgat

SEQ ID NO: 850353 - DNA, 25 bp, Mus musculus
tgactgcaccgcctggaacgtttca

SEQ ID NO: 850354 - DNA, 25 bp, Mus musculus
tgactgcaccgcgtggaacgtttca

SEQ ID NO: 850355 - DNA, 25 bp, Mus musculus
tgactgcagcacaggcttcttggct

SEQ ID NO: 850356 - DNA, 25 bp, Mus musculus
tgactgcagcactggcttcttggct

SEQ ID NO: 850357 - DNA, 25 bp, Mus musculus
tgactgcagcagacaagaaccttgg

SEQ ID NO: 850358 - DNA, 25 bp, Mus musculus
tgactgcagcagtcaagaaccttgg

SEQ ID NO: 850359 - DNA, 25 bp, Mus musculus
tgactgcaggcacggactctgcact

SEQ ID NO: 850360 - DNA, 25 bp, Mus musculus
tgactgcaggcagggactctgcact

SEQ ID NO: 850361 - DNA, 25 bp, Mus musculus
tgactgcaggtcagggtgttgaaca

SEQ ID NO: 850362 - DNA, 25 bp, Mus musculus
tgactgcaggtctgggtgttgaaca

SEQ ID NO: 850363 - DNA, 25 bp, Mus musculus
tgactgcagtggcaacgcacccttt

SEQ ID NO: 850364 - DNA, 25 bp, Mus musculus
tgactgcagtggccctctgccaggt

SEQ ID NO: 850365 - DNA, 25 bp, Mus musculus
tgactgcagtgggaacgcacccttt

SEQ ID NO: 850366 - DNA, 25 bp, Mus musculus
tgactgcagtgggcctctgccaggt

SEQ ID NO: 850367 - DNA, 25 bp, Mus musculus
tgactgcagttcagacatctggatc

SEQ ID NO: 850368 - DNA, 25 bp, Mus musculus
tgactgcagttctgacatctggatc

SEQ ID NO: 850369 - DNA, 25 bp, Mus musculus
tgactgcatcataatggacagaagt

SEQ ID NO: 850370 - DNA, 25 bp, Mus musculus
tgactgcatcattatggacagaagt

SEQ ID NO: 850371 - DNA, 25 bp, Mus musculus
tgactgcatctgcttaatggccctt

SEQ ID NO: 850372 - DNA, 25 bp, Mus musculus
tgactgcatctggttaatggccctt

SEQ ID NO: 850373 - DNA, 25 bp, Mus musculus
tgactgcatgtgaccaccttcagag

SEQ ID NO: 850374 - DNA, 25 bp, Mus musculus
tgactgcatgtgtccaccttcagag

SEQ ID NO: 850375 - DNA, 25 bp, Mus musculus
tgactgccacacatggagcccaata

SEQ ID NO: 850376 - DNA, 25 bp, Mus musculus
tgactgccacacttggagcccaata

SEQ ID NO: 850377 - DNA, 25 bp, Mus musculus
tgactgccatgtctcccgatgactg

SEQ ID NO: 850378 - DNA, 25 bp, Mus musculus
tgactgccatgtgtcccgatgactg

SEQ ID NO: 850379 - DNA, 25 bp, Mus musculus
tgactgccccatcataaaaacttac

SEQ ID NO: 850380 - DNA, 25 bp, Mus musculus
tgactgccccatgataaaaacttac

SEQ ID NO: 850381 - DNA, 25 bp, Mus musculus
tgactgccccttatatttccttact

SEQ ID NO: 850382 - DNA, 25 bp, Mus musculus
tgactgccccttccaggtccgggtt

SEQ ID NO: 850383 - DNA, 25 bp, Mus musculus
tgactgccccttgcaggtccgggtt

SEQ ID NO: 850384 - DNA, 25 bp, Mus musculus
tgactgccccttttatttccttact

SEQ ID NO: 850385 - DNA, 25 bp, Mus musculus
tgactgccgatgaggaaatttgttt

SEQ ID NO: 850386 - DNA, 25 bp, Mus musculus
tgactgccgatgtggaaatttgttt

SEQ ID NO: 850387 - DNA, 25 bp, Mus musculus
tgactgccgggtaaagctgtggaat

SEQ ID NO: 850388 - DNA, 25 bp, Mus musculus
tgactgccgggttaagctgtggaat

SEQ ID NO: 850389 - DNA, 25 bp, Mus musculus
tgactgccggttctgtctcactgag

SEQ ID NO: 850390 - DNA, 25 bp, Mus musculus
tgactgccggttgtgtctcactgag

SEQ ID NO: 850391 - DNA, 25 bp, Mus musculus
tgactgcctctgcaaagtgctctta

SEQ ID NO: 850392 - DNA, 25 bp, Mus musculus
tgactgcctctggaaagtgctctta

SEQ ID NO: 850393 - DNA, 25 bp, Mus musculus
tgactgcctcttcagagacagccca

SEQ ID NO: 850394 - DNA, 25 bp, Mus musculus
tgactgcctcttgagagacagccca

SEQ ID NO: 850395 - DNA, 25 bp, Mus musculus
tgactgcctgaaacccagaccagag

SEQ ID NO: 850396 - DNA, 25 bp, Mus musculus
tgactgcctgaatcccagaccagag

SEQ ID NO: 850397 - DNA, 25 bp, Mus musculus
tgactgcctggtcccagcctgggaa

SEQ ID NO: 850398 - DNA, 25 bp, Mus musculus
tgactgcctggtgccagcctgggaa

SEQ ID NO: 850399 - DNA, 25 bp, Mus musculus
tgactgcctgtgaggaggtctccaa

SEQ ID NO: 850400 - DNA, 25 bp, Mus musculus
tgactgcctgtgtggaggtctccaa

SEQ ID NO: 850401 - DNA, 25 bp, Mus musculus
tgactgccttggagaagccttctgc

SEQ ID NO: 850402 - DNA, 25 bp, Mus musculus
tgactgccttggtgaagccttctgc

SEQ ID NO: 850403 - DNA, 25 bp, Mus musculus
tgactgcgccggcaacgacgagacc

SEQ ID NO: 850404 - DNA, 25 bp, Mus musculus
tgactgcgccgggaacgacgagacc

SEQ ID NO: 850405 - DNA, 25 bp, Mus musculus
tgactgcgtcggatcagaggctcag

SEQ ID NO: 850406 - DNA, 25 bp, Mus musculus
tgactgcgtcggttcagaggctcag

SEQ ID NO: 850407 - DNA, 25 bp, Mus musculus
tgactgcgtttcagagtgggctctt

SEQ ID NO: 850408 - DNA, 25 bp, Mus musculus
tgactgcgtttctgagtgggctctt

SEQ ID NO: 850409 - DNA, 25 bp, Mus musculus
tgactgctatgcacaatttcctttg

SEQ ID NO: 850410 - DNA, 25 bp, Mus musculus
tgactgctatgctcaatttcctttg

SEQ ID NO: 850411 - DNA, 25 bp, Mus musculus
tgactgctcacgcttaaaacctgga

SEQ ID NO: 850412 - DNA, 25 bp, Mus musculus
tgactgctcacggttaaaacctgga

SEQ ID NO: 850413 - DNA, 25 bp, Mus musculus
tgactgctccctcggtggagatgac

SEQ ID NO: 850414 - DNA, 25 bp, Mus musculus
tgactgctccctgggtggagatgac

SEQ ID NO: 850415 - DNA, 25 bp, Mus musculus
tgactgctctaaccctttcaactca

SEQ ID NO: 850416 - DNA, 25 bp, Mus musculus
tgactgctctaagcctttcaactca

SEQ ID NO: 850417 - DNA, 25 bp, Mus musculus
tgactgctctgcacctggtgctgag

SEQ ID NO: 850418 - DNA, 25 bp, Mus musculus
tgactgctctgctcctggtgctgag

SEQ ID NO: 850419 - DNA, 25 bp, Mus musculus
tgactgctctggaatgtgcttctgc

SEQ ID NO: 850420 - DNA, 25 bp, Mus musculus
tgactgctctggtatgtgcttctgc

SEQ ID NO: 850421 - DNA, 25 bp, Mus musculus
tgactgctctttagtgaacccaatg

SEQ ID NO: 850422 - DNA, 25 bp, Mus musculus
tgactgctcttttgtgaacccaatg

SEQ ID NO: 850423 - DNA, 25 bp, Mus musculus
tgactgctgagacctttaccccgat

SEQ ID NO: 850424 - DNA, 25 bp, Mus musculus
tgactgctgagactttccctagaat

SEQ ID NO: 850425 - DNA, 25 bp, Mus musculus
tgactgctgagagctttaccccgat

SEQ ID NO: 850426 - DNA, 25 bp, Mus musculus
tgactgctgagagtttccctagaat

SEQ ID NO: 850427 - DNA, 25 bp, Mus musculus
tgactgctgcaaatcaaaagtgaac

SEQ ID NO: 850428 - DNA, 25 bp, Mus musculus
tgactgctgcaattcaaaagtgaac

SEQ ID NO: 850429 - DNA, 25 bp, Mus musculus
tgactgctgcccactcttaggaggt

SEQ ID NO: 850430 - DNA, 25 bp, Mus musculus
tgactgctgccctctcttaggaggt

SEQ ID NO: 850431 - DNA, 25 bp, Mus musculus
tgactgctgcctcaccgggagaaga

SEQ ID NO: 850432 - DNA, 25 bp, Mus musculus
tgactgctgcctgaccgggagaaga

SEQ ID NO: 850433 - DNA, 25 bp, Mus musculus
tgactgctgctactgtgagttcttt

SEQ ID NO: 850434 - DNA, 25 bp, Mus musculus
tgactgctgctagtgtgagttcttt

SEQ ID NO: 850435 - DNA, 25 bp, Mus musculus
tgactgctgcttatgtctagtgggc

SEQ ID NO: 850436 - DNA, 25 bp, Mus musculus
tgactgctgcttttgtctagtgggc

SEQ ID NO: 850437 - DNA, 25 bp, Mus musculus
tgactgctgggtcacgaccactaag

SEQ ID NO: 850438 - DNA, 25 bp, Mus musculus
tgactgctgggtgacgaccactaag

SEQ ID NO: 850439 - DNA, 25 bp, Mus musculus
tgactgcttcctacagggacctagg

SEQ ID NO: 850440 - DNA, 25 bp, Mus musculus
tgactgcttccttcagggacctagg

SEQ ID NO: 850441 - DNA, 25 bp, Mus musculus
tgactgcttctccttttcctgtaat

SEQ ID NO: 850442 - DNA, 25 bp, Mus musculus
tgactgcttctcgttttcctgtaat

SEQ ID NO: 850443 - DNA, 25 bp, Mus musculus
tgactgctttgcattttgggctctt

SEQ ID NO: 850444 - DNA, 25 bp, Mus musculus
tgactgctttgctttttgggctctt

SEQ ID NO: 850445 - DNA, 25 bp, Mus musculus
tgactgctttgtccctggtgtctgc

SEQ ID NO: 850446 - DNA, 25 bp, Mus musculus
tgactgctttgtgcctggtgtctgc

SEQ ID NO: 850447 - DNA, 25 bp, Mus musculus
tgactggaacatactaaagatatta

SEQ ID NO: 850448 - DNA, 25 bp, Mus musculus
tgactggaacattctaaagatatta

SEQ ID NO: 850449 - DNA, 25 bp, Mus musculus
tgactggaaggcctctttctgtcat

SEQ ID NO: 850450 - DNA, 25 bp, Mus musculus
tgactggaaggcgtctttctgtcat

SEQ ID NO: 850451 - DNA, 25 bp, Mus musculus
tgactggacactcctgaaaagttat

SEQ ID NO: 850452 - DNA, 25 bp, Mus musculus
tgactggacactgctgaaaagttat

SEQ ID NO: 850453 - DNA, 25 bp, Mus musculus
tgactggacggccaggctcttcctt

SEQ ID NO: 850454 - DNA, 25 bp, Mus musculus
tgactggacggcgaggctcttcctt

SEQ ID NO: 850455 - DNA, 25 bp, Mus musculus
tgactggagggaccgcttctgcacc

SEQ ID NO: 850456 - DNA, 25 bp, Mus musculus
tgactggagggagcgcttctgcacc

SEQ ID NO: 850457 - DNA, 25 bp, Mus musculus
tgactggaggtacctcccaggacat

SEQ ID NO: 850458 - DNA, 25 bp, Mus musculus
tgactggaggtagctcccaggacat

SEQ ID NO: 850459 - DNA, 25 bp, Mus musculus
tgactggattccacgaaacctccaa

SEQ ID NO: 850460 - DNA, 25 bp, Mus musculus
tgactggattcctcgaaacctccaa

SEQ ID NO: 850461 - DNA, 25 bp, Mus musculus
tgactggcaaccagcaccttggtta

SEQ ID NO: 850462 - DNA, 25 bp, Mus musculus
tgactggcaacctgcaccttggtta

SEQ ID NO: 850463 - DNA, 25 bp, Mus musculus
tgactggcaatgcttatgccctcag

SEQ ID NO: 850464 - DNA, 25 bp, Mus musculus
tgactggcaatggttatgccctcag

SEQ ID NO: 850465 - DNA, 25 bp, Mus musculus
tgactggcagcgcaaagctcacatg

SEQ ID NO: 850466 - DNA, 25 bp, Mus musculus
tgactggcagcggaaagctcacatg

SEQ ID NO: 850467 - DNA, 25 bp, Mus musculus
tgactggcaggcaggacaccctgat

SEQ ID NO: 850468 - DNA, 25 bp, Mus musculus
tgactggcaggctggacaccctgat

SEQ ID NO: 850469 - DNA, 25 bp, Mus musculus
tgactggcagtcaactctatatgta

SEQ ID NO: 850470 - DNA, 25 bp, Mus musculus
tgactggcagtctactctatatgta

SEQ ID NO: 850471 - DNA, 25 bp, Mus musculus
tgactggcctgcatctcactctgac

SEQ ID NO: 850472 - DNA, 25 bp, Mus musculus
tgactggcctgcttctcactctgac

SEQ ID NO: 850473 - DNA, 25 bp, Mus musculus
tgactggccttgaggacggccgccc

SEQ ID NO: 850474 - DNA, 25 bp, Mus musculus
tgactggccttgtggacggccgccc

SEQ ID NO: 850475 - DNA, 25 bp, Mus musculus
tgactggcctttcccttgtaccgaa

SEQ ID NO: 850476 - DNA, 25 bp, Mus musculus
tgactggcctttgccttgtaccgaa

SEQ ID NO: 850477 - DNA, 25 bp, Mus musculus
tgactggctcccaatcgttcttagc

SEQ ID NO: 850478 - DNA, 25 bp, Mus musculus
tgactggctccctatcgttcttagc

SEQ ID NO: 850479 - DNA, 25 bp, Mus musculus
tgactggctcgtcaccatggagaat

SEQ ID NO: 850480 - DNA, 25 bp, Mus musculus
tgactggctcgtgaccatggagaat

SEQ ID NO: 850481 - DNA, 25 bp, Mus musculus
tgactggctgacctgactctgggaa

SEQ ID NO: 850482 - DNA, 25 bp, Mus musculus
tgactggctgacgtgactctgggaa

SEQ ID NO: 850483 - DNA, 25 bp, Mus musculus
tgactggctggacacatcacctcac

SEQ ID NO: 850484 - DNA, 25 bp, Mus musculus
tgactggctggagacatcacctcac

SEQ ID NO: 850485 - DNA, 25 bp, Mus musculus
tgactggctgtacacgcatgaccta

SEQ ID NO: 850486 - DNA, 25 bp, Mus musculus
tgactggctgtagacgcatgaccta

SEQ ID NO: 850487 - DNA, 25 bp, Mus musculus
tgactggcttatcgtgactcctcaa

SEQ ID NO: 850488 - DNA, 25 bp, Mus musculus
tgactggcttatggtgactcctcaa

SEQ ID NO: 850489 - DNA, 25 bp, Mus musculus
tgactggcttctagagcaggctgtc

SEQ ID NO: 850490 - DNA, 25 bp, Mus musculus
tgactggcttcttgagcaggctgtc

SEQ ID NO: 850491 - DNA, 25 bp, Mus musculus
tgactgggacccatagaagttcttt

SEQ ID NO: 850492 - DNA, 25 bp, Mus musculus
tgactgggacccttagaagttcttt

SEQ ID NO: 850493 - DNA, 25 bp, Mus musculus
tgactgggacctcttcacacagaat

SEQ ID NO: 850494 - DNA, 25 bp, Mus musculus
tgactgggacctgttcacacagaat

SEQ ID NO: 850495 - DNA, 25 bp, Mus musculus
tgactgggagccaggtgcagaacac

SEQ ID NO: 850496 - DNA, 25 bp, Mus musculus
tgactgggagcctggtgcagaacac

SEQ ID NO: 850497 - DNA, 25 bp, Mus musculus
tgactgggatacaccagctgactca

SEQ ID NO: 850498 - DNA, 25 bp, Mus musculus
tgactgggatactccagctgactca

SEQ ID NO: 850499 - DNA, 25 bp, Mus musculus
tgactgggcagcaagctctcaatac

SEQ ID NO: 850500 - DNA, 25 bp, Mus musculus
tgactgggcagctagctctcaatac

SEQ ID NO: 850501 - DNA, 25 bp, Mus musculus
tgactgggccatcgaacacctgggt

SEQ ID NO: 850502 - DNA, 25 bp, Mus musculus
tgactgggccatggaacacctgggt

SEQ ID NO: 850503 - DNA, 25 bp, Mus musculus
tgactgggccttcgatcacctagaa

SEQ ID NO: 850504 - DNA, 25 bp, Mus musculus
tgactgggccttggatcacctagaa

SEQ ID NO: 850505 - DNA, 25 bp, Mus musculus
tgactggggtcacactaaaaacaaa

SEQ ID NO: 850506 - DNA, 25 bp, Mus musculus
tgactggggtcagactaaaaacaaa

SEQ ID NO: 850507 - DNA, 25 bp, Mus musculus
tgactgggtttgactctagttgtgt

SEQ ID NO: 850508 - DNA, 25 bp, Mus musculus
tgactgggtttgctcactgctagcc

SEQ ID NO: 850509 - DNA, 25 bp, Mus musculus
tgactgggtttggtcactgctagcc

SEQ ID NO: 850510 - DNA, 25 bp, Mus musculus
tgactgggtttgtctctagttgtgt

SEQ ID NO: 850511 - DNA, 25 bp, Mus musculus
tgactggtacctcgcctggtcctat

SEQ ID NO: 850512 - DNA, 25 bp, Mus musculus
tgactggtacctggcctggtcctat

SEQ ID NO: 850513 - DNA, 25 bp, Mus musculus
tgactggtactgagagcaatagctc

SEQ ID NO: 850514 - DNA, 25 bp, Mus musculus
tgactggtactgtgagcaatagctc

SEQ ID NO: 850515 - DNA, 25 bp, Mus musculus
tgactggtagtcaggctactcagaa

SEQ ID NO: 850516 - DNA, 25 bp, Mus musculus
tgactggtagtctggctactcagaa

SEQ ID NO: 850517 - DNA, 25 bp, Mus musculus
tgactggtatcccttggtgctggcc

SEQ ID NO: 850518 - DNA, 25 bp, Mus musculus
tgactggtatccgttggtgctggcc

SEQ ID NO: 850519 - DNA, 25 bp, Mus musculus
tgactggtcagcctctcaaatcgtg

SEQ ID NO: 850520 - DNA, 25 bp, Mus musculus
tgactggtcagccttttttacctct

SEQ ID NO: 850521 - DNA, 25 bp, Mus musculus
tgactggtcagcgtctcaaatcgtg

SEQ ID NO: 850522 - DNA, 25 bp, Mus musculus
tgactggtcagcgttttttacctct

SEQ ID NO: 850523 - DNA, 25 bp, Mus musculus
tgactggtgcagatctctattctct

SEQ ID NO: 850524 - DNA, 25 bp, Mus musculus
tgactggtgcagttctctattctct

SEQ ID NO: 850525 - DNA, 25 bp, Mus musculus
tgactggtgccacctgtacttctct

SEQ ID NO: 850526 - DNA, 25 bp, Mus musculus
tgactggtgccagctgtacttctct

SEQ ID NO: 850527 - DNA, 25 bp, Mus musculus
tgactggttaggactctgtataaat

SEQ ID NO: 850528 - DNA, 25 bp, Mus musculus
tgactggttaggtctctgtataaat

SEQ ID NO: 850529 - DNA, 25 bp, Mus musculus
tgactggttctacagctcctttgac

SEQ ID NO: 850530 - DNA, 25 bp, Mus musculus
tgactggttctagagctcctttgac

SEQ ID NO: 850531 - DNA, 25 bp, Mus musculus
tgactggtttcacgaaatcaagaag

SEQ ID NO: 850532 - DNA, 25 bp, Mus musculus
tgactggtttcaggaaatcaagaag

SEQ ID NO: 850533 - DNA, 25 bp, Mus musculus
tgactgtaaaaccacctaaccatct

SEQ ID NO: 850534 - DNA, 25 bp, Mus musculus
tgactgtaaaacgacctaaccatct

SEQ ID NO: 850535 - DNA, 25 bp, Mus musculus
tgactgtaacccaaagtcactgagc

SEQ ID NO: 850536 - DNA, 25 bp, Mus musculus
tgactgtaaccctaagtcactgagc

SEQ ID NO: 850537 - DNA, 25 bp, Mus musculus
tgactgtaagctctgcccaacaggg

SEQ ID NO: 850538 - DNA, 25 bp, Mus musculus
tgactgtaagctgtgcccaacaggg

SEQ ID NO: 850539 - DNA, 25 bp, Mus musculus
tgactgtaagtgaaacgatgctaat

SEQ ID NO: 850540 - DNA, 25 bp, Mus musculus
tgactgtaagtgtaacgatgctaat

SEQ ID NO: 850541 - DNA, 25 bp, Mus musculus
tgactgtagaatcgcactgggttat

SEQ ID NO: 850542 - DNA, 25 bp, Mus musculus
tgactgtagaatggcactgggttat

SEQ ID NO: 850543 - DNA, 25 bp, Mus musculus
tgactgtaggtgactttcttgtgca

SEQ ID NO: 850544 - DNA, 25 bp, Mus musculus
tgactgtaggtgtctttcttgtgca

SEQ ID NO: 850545 - DNA, 25 bp, Mus musculus
tgactgtagttgagccaccaatgga

SEQ ID NO: 850546 - DNA, 25 bp, Mus musculus
tgactgtagttgtgccaccaatgga

SEQ ID NO: 850547 - DNA, 25 bp, Mus musculus
tgactgtatctccttagctctctgt

SEQ ID NO: 850548 - DNA, 25 bp, Mus musculus
tgactgtatctcgttagctctctgt

SEQ ID NO: 850549 - DNA, 25 bp, Mus musculus
tgactgtattcacctattgccctgt

SEQ ID NO: 850550 - DNA, 25 bp, Mus musculus
tgactgtattcagctattgccctgt

SEQ ID NO: 850551 - DNA, 25 bp, Mus musculus
tgactgtcaaaactgctgccccaga

SEQ ID NO: 850552 - DNA, 25 bp, Mus musculus
tgactgtcaaaagtgctgccccaga

SEQ ID NO: 850553 - DNA, 25 bp, Mus musculus
tgactgtcaagcacatgcaggatga

SEQ ID NO: 850554 - DNA, 25 bp, Mus musculus
tgactgtcaagctcatgcaggatga

SEQ ID NO: 850555 - DNA, 25 bp, Mus musculus
tgactgtcaccacatggccaagggc

SEQ ID NO: 850556 - DNA, 25 bp, Mus musculus
tgactgtcaccagatggccaagggc

SEQ ID NO: 850557 - DNA, 25 bp, Mus musculus
tgactgtcacccagtctggacagaa

SEQ ID NO: 850558 - DNA, 25 bp, Mus musculus
tgactgtcaccctgtctggacagaa

SEQ ID NO: 850559 - DNA, 25 bp, Mus musculus
tgactgtcagagagccttccaagat

SEQ ID NO: 850560 - DNA, 25 bp, Mus musculus
tgactgtcagagtgccttccaagat

SEQ ID NO: 850561 - DNA, 25 bp, Mus musculus
tgactgtcatccctgctgtataaaa

SEQ ID NO: 850562 - DNA, 25 bp, Mus musculus
tgactgtcatccgtgctgtataaaa

SEQ ID NO: 850563 - DNA, 25 bp, Mus musculus
tgactgtcattcaggccattggctt

SEQ ID NO: 850564 - DNA, 25 bp, Mus musculus
tgactgtcattctggccattggctt

SEQ ID NO: 850565 - DNA, 25 bp, Mus musculus
tgactgtccagcacagaagggtagc

SEQ ID NO: 850566 - DNA, 25 bp, Mus musculus
tgactgtccagctcagaagggtagc

SEQ ID NO: 850567 - DNA, 25 bp, Mus musculus
tgactgtccctgagtgcctgggttc

SEQ ID NO: 850568 - DNA, 25 bp, Mus musculus
tgactgtccctgtgtgcctgggttc

SEQ ID NO: 850569 - DNA, 25 bp, Mus musculus
tgactgtccgctcaagggcttttca

SEQ ID NO: 850570 - DNA, 25 bp, Mus musculus
tgactgtccgctgaagggcttttca

SEQ ID NO: 850571 - DNA, 25 bp, Mus musculus
tgactgtcctgaaaccattatgtag

SEQ ID NO: 850572 - DNA, 25 bp, Mus musculus
tgactgtcctgataccattatgtag

SEQ ID NO: 850573 - DNA, 25 bp, Mus musculus
tgactgtctgacactagctcggtga

SEQ ID NO: 850574 - DNA, 25 bp, Mus musculus
tgactgtctgactctagctcggtga

SEQ ID NO: 850575 - DNA, 25 bp, Mus musculus
tgactgtctgctattcccaggcgaa

SEQ ID NO: 850576 - DNA, 25 bp, Mus musculus
tgactgtctgcttttcccaggcgaa

SEQ ID NO: 850577 - DNA, 25 bp, Mus musculus
tgactgtgaagtaggcctgctcgag

SEQ ID NO: 850578 - DNA, 25 bp, Mus musculus
tgactgtgaagttggcctgctcgag

SEQ ID NO: 850579 - DNA, 25 bp, Mus musculus
tgactgtgagagcttcgttcttggc

SEQ ID NO: 850580 - DNA, 25 bp, Mus musculus
tgactgtgagaggttcgttcttggc

SEQ ID NO: 850581 - DNA, 25 bp, Mus musculus
tgactgtgcatgacacttctgacct

SEQ ID NO: 850582 - DNA, 25 bp, Mus musculus
tgactgtgcatgtcacttctgacct

SEQ ID NO: 850583 - DNA, 25 bp, Mus musculus
tgactgtgcattcggtccagcttcc

SEQ ID NO: 850584 - DNA, 25 bp, Mus musculus
tgactgtgcattgggtccagcttcc

SEQ ID NO: 850585 - DNA, 25 bp, Mus musculus
tgactgtgccacctgggtttccgct

SEQ ID NO: 850586 - DNA, 25 bp, Mus musculus
tgactgtgccacgtgggtttccgct

SEQ ID NO: 850587 - DNA, 25 bp, Mus musculus
tgactgtgccggagtctcctaagtt

SEQ ID NO: 850588 - DNA, 25 bp, Mus musculus
tgactgtgccggtgtctcctaagtt

SEQ ID NO: 850589 - DNA, 25 bp, Mus musculus
tgactgtgcctcatgacataatttc

SEQ ID NO: 850590 - DNA, 25 bp, Mus musculus
tgactgtgcctcttgacataatttc

SEQ ID NO: 850591 - DNA, 25 bp, Mus musculus
tgactgtggaacatgtggagtgcca

SEQ ID NO: 850592 - DNA, 25 bp, Mus musculus
tgactgtggaacttgtggagtgcca

SEQ ID NO: 850593 - DNA, 25 bp, Mus musculus
tgactgtggagcatccttgttcgaa

SEQ ID NO: 850594 - DNA, 25 bp, Mus musculus
tgactgtggagcttccttgttcgaa

SEQ ID NO: 850595 - DNA, 25 bp, Mus musculus
tgactgtggagtacatcacccgcta

SEQ ID NO: 850596 - DNA, 25 bp, Mus musculus
tgactgtggagttcatcacccgcta

SEQ ID NO: 850597 - DNA, 25 bp, Mus musculus
tgactgtggcttaccccctgtcaga

SEQ ID NO: 850598 - DNA, 25 bp, Mus musculus
tgactgtggctttccccctgtcaga

SEQ ID NO: 850599 - DNA, 25 bp, Mus musculus
tgactgtggtaactgatgacgagcc

SEQ ID NO: 850600 - DNA, 25 bp, Mus musculus
tgactgtggtaagtgatgacgagcc

SEQ ID NO: 850601 - DNA, 25 bp, Mus musculus
tgactgtgtacacctgtgcacctgt

SEQ ID NO: 850602 - DNA, 25 bp, Mus musculus
tgactgtgtacagctgtgcacctgt

SEQ ID NO: 850603 - DNA, 25 bp, Mus musculus
tgactgtgtagcactgcgcatgaca

SEQ ID NO: 850604 - DNA, 25 bp, Mus musculus
tgactgtgtagctctgcgcatgaca

SEQ ID NO: 850605 - DNA, 25 bp, Mus musculus
tgactgtgttcccactgaggacaca

SEQ ID NO: 850606 - DNA, 25 bp, Mus musculus
tgactgtgttccgactgaggacaca

SEQ ID NO: 850607 - DNA, 25 bp, Mus musculus
tgactgttacccactagttccggac

SEQ ID NO: 850608 - DNA, 25 bp, Mus musculus
tgactgttaccctctagttccggac

SEQ ID NO: 850609 - DNA, 25 bp, Mus musculus
tgactgttcctaacagtgggcagcc

SEQ ID NO: 850610 - DNA, 25 bp, Mus musculus
tgactgttcctatcagtgggcagcc

SEQ ID NO: 850611 - DNA, 25 bp, Mus musculus
tgactgttctggacactgtgctgag

SEQ ID NO: 850612 - DNA, 25 bp, Mus musculus
tgactgttctggtcactgtgctgag

SEQ ID NO: 850613 - DNA, 25 bp, Mus musculus
tgactgttgaacactgaccccaagt

SEQ ID NO: 850614 - DNA, 25 bp, Mus musculus
tgactgttgaactctgaccccaagt

SEQ ID NO: 850615 - DNA, 25 bp, Mus musculus
tgactgttgaagatacctcaggctc

SEQ ID NO: 850616 - DNA, 25 bp, Mus musculus
tgactgttgaagttacctcaggctc

SEQ ID NO: 850617 - DNA, 25 bp, Mus musculus
tgactgttgtccaagatgggctcct

SEQ ID NO: 850618 - DNA, 25 bp, Mus musculus
tgactgttgtcctagatgggctcct

SEQ ID NO: 850619 - DNA, 25 bp, Mus musculus
tgactgttgtggcagcagtggttgc

SEQ ID NO: 850620 - DNA, 25 bp, Mus musculus
tgactgttgtgggagcagtggttgc

SEQ ID NO: 850621 - DNA, 25 bp, Mus musculus
tgactgtttgtgctgagcatcgccc

SEQ ID NO: 850622 - DNA, 25 bp, Mus musculus
tgactgtttgtggtgagcatcgccc

SEQ ID NO: 850623 - DNA, 25 bp, Mus musculus
tgacttaagcaacattagtctagcc

SEQ ID NO: 850624 - DNA, 25 bp, Mus musculus
tgacttaagcaagattagtctagcc

SEQ ID NO: 850625 - DNA, 25 bp, Mus musculus
tgacttaagtttacttgccagaagg

SEQ ID NO: 850626 - DNA, 25 bp, Mus musculus
tgacttaagttttcttgccagaagg

SEQ ID NO: 850627 - DNA, 25 bp, Mus musculus
tgacttaataacctttctgcctctt

SEQ ID NO: 850628 - DNA, 25 bp, Mus musculus
tgacttaataacgtttctgcctctt

SEQ ID NO: 850629 - DNA, 25 bp, Mus musculus
tgacttaatagacagcgagcgacat

SEQ ID NO: 850630 - DNA, 25 bp, Mus musculus
tgacttaatagagagcgagcgacat

SEQ ID NO: 850631 - DNA, 25 bp, Mus musculus
tgacttacacacatagcctagagct

SEQ ID NO: 850632 - DNA, 25 bp, Mus musculus
tgacttacacacttagcctagagct

SEQ ID NO: 850633 - DNA, 25 bp, Mus musculus
tgacttacaccacgattccccaggt

SEQ ID NO: 850634 - DNA, 25 bp, Mus musculus
tgacttacaccaggattccccaggt

SEQ ID NO: 850635 - DNA, 25 bp, Mus musculus
tgacttacactcaccacagaagcag

SEQ ID NO: 850636 - DNA, 25 bp, Mus musculus
tgacttacactcctctatctagaat

SEQ ID NO: 850637 - DNA, 25 bp, Mus musculus
tgacttacactcgtctatctagaat

SEQ ID NO: 850638 - DNA, 25 bp, Mus musculus
tgacttacactctccacagaagcag

SEQ ID NO: 850639 - DNA, 25 bp, Mus musculus
tgacttacagaacgtgggcctggct

SEQ ID NO: 850640 - DNA, 25 bp, Mus musculus
tgacttacagaaggtgggcctggct

SEQ ID NO: 850641 - DNA, 25 bp, Mus musculus
tgacttacagtacccactcagtttc

SEQ ID NO: 850642 - DNA, 25 bp, Mus musculus
tgacttacagtagccactcagtttc

SEQ ID NO: 850643 - DNA, 25 bp, Mus musculus
tgacttacccaacatgagcaccaac

SEQ ID NO: 850644 - DNA, 25 bp, Mus musculus
tgacttacccaagatgagcaccaac

SEQ ID NO: 850645 - DNA, 25 bp, Mus musculus
tgacttacctcacgcttccaggaag

SEQ ID NO: 850646 - DNA, 25 bp, Mus musculus
tgacttacctcaggcttccaggaag

SEQ ID NO: 850647 - DNA, 25 bp, Mus musculus
tgacttacgaacatcctgggatttc

SEQ ID NO: 850648 - DNA, 25 bp, Mus musculus
tgacttacgaacttcctgggatttc

SEQ ID NO: 850649 - DNA, 25 bp, Mus musculus
tgacttactcagagtgccaccatgg

SEQ ID NO: 850650 - DNA, 25 bp, Mus musculus
tgacttactcagtgtgccaccatgg

SEQ ID NO: 850651 - DNA, 25 bp, Mus musculus
tgacttactctaacggatcaaaaga

SEQ ID NO: 850652 - DNA, 25 bp, Mus musculus
tgacttactctatcggatcaaaaga

SEQ ID NO: 850653 - DNA, 25 bp, Mus musculus
tgacttagaagccatcccgttgatg

SEQ ID NO: 850654 - DNA, 25 bp, Mus musculus
tgacttagaagcgatcccgttgatg

SEQ ID NO: 850655 - DNA, 25 bp, Mus musculus
tgacttagactcaagccaggcagcc

SEQ ID NO: 850656 - DNA, 25 bp, Mus musculus
tgacttagactctagccaggcagcc

SEQ ID NO: 850657 - DNA, 25 bp, Mus musculus
tgacttagccgaccgtggtgttgca

SEQ ID NO: 850658 - DNA, 25 bp, Mus musculus
tgacttagccgagcgtggtgttgca

SEQ ID NO: 850659 - DNA, 25 bp, Mus musculus
tgacttatccagacagggtgcccaa

SEQ ID NO: 850660 - DNA, 25 bp, Mus musculus
tgacttatccagtcagggtgcccaa

SEQ ID NO: 850661 - DNA, 25 bp, Mus musculus
tgacttatcctgaatcttacactag

SEQ ID NO: 850662 - DNA, 25 bp, Mus musculus
tgacttatcctgtatcttacactag

SEQ ID NO: 850663 - DNA, 25 bp, Mus musculus
tgacttatcttactgctgaccctga

SEQ ID NO: 850664 - DNA, 25 bp, Mus musculus
tgacttatcttagtgctgaccctga

SEQ ID NO: 850665 - DNA, 25 bp, Mus musculus
tgacttatgctgagaacatcccagc

SEQ ID NO: 850666 - DNA, 25 bp, Mus musculus
tgacttatgctgtgaacatcccagc

SEQ ID NO: 850667 - DNA, 25 bp, Mus musculus
tgacttattctgctccttgctctat

SEQ ID NO: 850668 - DNA, 25 bp, Mus musculus
tgacttattctggtccttgctctat

SEQ ID NO: 850669 - DNA, 25 bp, Mus musculus
tgacttcacaacacatatccagagg

SEQ ID NO: 850670 - DNA, 25 bp, Mus musculus
tgacttcacaactcatatccagagg

SEQ ID NO: 850671 - DNA, 25 bp, Mus musculus
tgacttcacctacatcttctaccaa

SEQ ID NO: 850672 - DNA, 25 bp, Mus musculus
tgacttcacctagatcttctaccaa

SEQ ID NO: 850673 - DNA, 25 bp, Mus musculus
tgacttcactacactcctaagcatg

SEQ ID NO: 850674 - DNA, 25 bp, Mus musculus
tgacttcactactctcctaagcatg

SEQ ID NO: 850675 - DNA, 25 bp, Mus musculus
tgacttcactccacttcagaacgaa

SEQ ID NO: 850676 - DNA, 25 bp, Mus musculus
tgacttcactccagcgagtgacaca

SEQ ID NO: 850677 - DNA, 25 bp, Mus musculus
tgacttcactcctcttcagaacgaa

SEQ ID NO: 850678 - DNA, 25 bp, Mus musculus
tgacttcactcctgcgagtgacaca

SEQ ID NO: 850679 - DNA, 25 bp, Mus musculus
tgacttcactgcctccgttaaggga

SEQ ID NO: 850680 - DNA, 25 bp, Mus musculus
tgacttcactgcgtccgttaaggga

SEQ ID NO: 850681 - DNA, 25 bp, Mus musculus
tgacttcagattatcaggacccctc

SEQ ID NO: 850682 - DNA, 25 bp, Mus musculus
tgacttcagattttcaggacccctc

SEQ ID NO: 850683 - DNA, 25 bp, Mus musculus
tgacttcagccaaatcaacggcact

SEQ ID NO: 850684 - DNA, 25 bp, Mus musculus
tgacttcagccacattagcagccac

SEQ ID NO: 850685 - DNA, 25 bp, Mus musculus
tgacttcagccagattagcagccac

SEQ ID NO: 850686 - DNA, 25 bp, Mus musculus
tgacttcagccatatcaacggcact

SEQ ID NO: 850687 - DNA, 25 bp, Mus musculus
tgacttcaggtcagtctgtcatcct

SEQ ID NO: 850688 - DNA, 25 bp, Mus musculus
tgacttcaggtctgtctgtcatcct

SEQ ID NO: 850689 - DNA, 25 bp, Mus musculus
tgacttcagtacacacacatttgat

SEQ ID NO: 850690 - DNA, 25 bp, Mus musculus
tgacttcagtactcacacatttgat

SEQ ID NO: 850691 - DNA, 25 bp, Mus musculus
tgacttcagtagacccagctccagc

SEQ ID NO: 850692 - DNA, 25 bp, Mus musculus
tgacttcagtagtcccagctccagc

SEQ ID NO: 850693 - DNA, 25 bp, Mus musculus
tgacttcagtgaacagcgctggtat

SEQ ID NO: 850694 - DNA, 25 bp, Mus musculus
tgacttcagtgatcagcgctggtat

SEQ ID NO: 850695 - DNA, 25 bp, Mus musculus
tgacttcagttcagagcagctcttc

SEQ ID NO: 850696 - DNA, 25 bp, Mus musculus
tgacttcagttctgagcagctcttc

SEQ ID NO: 850697 - DNA, 25 bp, Mus musculus
tgacttcatattacttcctaacctg

SEQ ID NO: 850698 - DNA, 25 bp, Mus musculus
tgacttcatatttcttcctaacctg

SEQ ID NO: 850699 - DNA, 25 bp, Mus musculus
tgacttcatcaacagcctctacaat

SEQ ID NO: 850700 - DNA, 25 bp, Mus musculus
tgacttcatcaagagcctctacaat

SEQ ID NO: 850701 - DNA, 25 bp, Mus musculus
tgacttcatcatcccacttctgtag

SEQ ID NO: 850702 - DNA, 25 bp, Mus musculus
tgacttcatcatgccacttctgtag

SEQ ID NO: 850703 - DNA, 25 bp, Mus musculus
tgacttcatccgaagctgcttgtaa

SEQ ID NO: 850704 - DNA, 25 bp, Mus musculus
tgacttcatccgtagctgcttgtaa

SEQ ID NO: 850705 - DNA, 25 bp, Mus musculus
tgacttcatctcaggaactcgcatg

SEQ ID NO: 850706 - DNA, 25 bp, Mus musculus
tgacttcatctccttgggtttttct

SEQ ID NO: 850707 - DNA, 25 bp, Mus musculus
tgacttcatctcgttgggtttttct

SEQ ID NO: 850708 - DNA, 25 bp, Mus musculus
tgacttcatctctggaactcgcatg

SEQ ID NO: 850709 - DNA, 25 bp, Mus musculus
tgacttcatgctatattattttctt

SEQ ID NO: 850710 - DNA, 25 bp, Mus musculus
tgacttcatgctcgactgtatttta

SEQ ID NO: 850711 - DNA, 25 bp, Mus musculus
tgacttcatgctggactgtatttta

SEQ ID NO: 850712 - DNA, 25 bp, Mus musculus
tgacttcatgctttattattttctt

SEQ ID NO: 850713 - DNA, 25 bp, Mus musculus
tgacttcattatacccatggtattg

SEQ ID NO: 850714 - DNA, 25 bp, Mus musculus
tgacttcattattcccatggtattg

SEQ ID NO: 850715 - DNA, 25 bp, Mus musculus
tgacttcattgtccagtccttaggg

SEQ ID NO: 850716 - DNA, 25 bp, Mus musculus
tgacttcattgtgcagtccttaggg

SEQ ID NO: 850717 - DNA, 25 bp, Mus musculus
tgacttccacagagtcactttaggt

SEQ ID NO: 850718 - DNA, 25 bp, Mus musculus
tgacttccacagtgtcactttaggt

SEQ ID NO: 850719 - DNA, 25 bp, Mus musculus
tgacttccactgcactgaacaaagg

SEQ ID NO: 850720 - DNA, 25 bp, Mus musculus
tgacttccactggactgaacaaagg

SEQ ID NO: 850721 - DNA, 25 bp, Mus musculus
tgacttccagatcacctactgcgtg

SEQ ID NO: 850722 - DNA, 25 bp, Mus musculus
tgacttccagatgacctactgcgtg

SEQ ID NO: 850723 - DNA, 25 bp, Mus musculus
tgacttccagctcaaaaccatcaag

SEQ ID NO: 850724 - DNA, 25 bp, Mus musculus
tgacttccagctgaaaaccatcaag

SEQ ID NO: 850725 - DNA, 25 bp, Mus musculus
tgacttccaggacagcgctgagcac

SEQ ID NO: 850726 - DNA, 25 bp, Mus musculus
tgacttccaggagagcgctgagcac

SEQ ID NO: 850727 - DNA, 25 bp, Mus musculus
tgacttccagtccaggctacagtga

SEQ ID NO: 850728 - DNA, 25 bp, Mus musculus
tgacttccagtcgaggctacagtga

SEQ ID NO: 850729 - DNA, 25 bp, Mus musculus
tgacttccatacatactgcatgaga

SEQ ID NO: 850730 - DNA, 25 bp, Mus musculus
tgacttccatacttactgcatgaga

SEQ ID NO: 850731 - DNA, 25 bp, Mus musculus
tgacttccatgcaggaccattcccg

SEQ ID NO: 850732 - DNA, 25 bp, Mus musculus
tgacttccatgctggaccattcccg

SEQ ID NO: 850733 - DNA, 25 bp, Mus musculus
tgacttcccagcacacaaagggtga

SEQ ID NO: 850734 - DNA, 25 bp, Mus musculus
tgacttcccagctcacaaagggtga

SEQ ID NO: 850735 - DNA, 25 bp, Mus musculus
tgacttcccaggagtcctgcaaagg

SEQ ID NO: 850736 - DNA, 25 bp, Mus musculus
tgacttcccaggtgtcctgcaaagg

SEQ ID NO: 850737 - DNA, 25 bp, Mus musculus
tgacttccccacaggaaactattcc

SEQ ID NO: 850738 - DNA, 25 bp, Mus musculus
tgacttccccactggaaactattcc

SEQ ID NO: 850739 - DNA, 25 bp, Mus musculus
tgacttccccatacattaacatcat

SEQ ID NO: 850740 - DNA, 25 bp, Mus musculus
tgacttccccattcattaacatcat

SEQ ID NO: 850741 - DNA, 25 bp, Mus musculus
tgacttcccctgcaggtctaattcc

SEQ ID NO: 850742 - DNA, 25 bp, Mus musculus
tgacttcccctggaggtctaattcc

SEQ ID NO: 850743 - DNA, 25 bp, Mus musculus
tgacttcccggactactagggtgag

SEQ ID NO: 850744 - DNA, 25 bp, Mus musculus
tgacttcccggagtactagggtgag

SEQ ID NO: 850745 - DNA, 25 bp, Mus musculus
tgacttccctccatgatggactcag

SEQ ID NO: 850746 - DNA, 25 bp, Mus musculus
tgacttccctccttgatggactcag

SEQ ID NO: 850747 - DNA, 25 bp, Mus musculus
tgacttccctgaaatggccaggcat

SEQ ID NO: 850748 - DNA, 25 bp, Mus musculus
tgacttccctgatatggccaggcat

SEQ ID NO: 850749 - DNA, 25 bp, Mus musculus
tgacttccggatccaaaagcagcag

SEQ ID NO: 850750 - DNA, 25 bp, Mus musculus
tgacttccggatgcaaaagcagcag

SEQ ID NO: 850751 - DNA, 25 bp, Mus musculus
tgacttcctatccttttgacacggt

SEQ ID NO: 850752 - DNA, 25 bp, Mus musculus
tgacttcctatcgttttgacacggt

SEQ ID NO: 850753 - DNA, 25 bp, Mus musculus
tgacttcctcaactggcgtggcaca

SEQ ID NO: 850754 - DNA, 25 bp, Mus musculus
tgacttcctcaagtggcgtggcaca

SEQ ID NO: 850755 - DNA, 25 bp, Mus musculus
tgacttcctgctatccaaaactaac

SEQ ID NO: 850756 - DNA, 25 bp, Mus musculus
tgacttcctgctttccaaaactaac

SEQ ID NO: 850757 - DNA, 25 bp, Mus musculus
tgacttcctgtgcatgtcctctggt

SEQ ID NO: 850758 - DNA, 25 bp, Mus musculus
tgacttcctgtggatgtcctctggt

SEQ ID NO: 850759 - DNA, 25 bp, Mus musculus
tgacttcctgttcctgctttagaac

SEQ ID NO: 850760 - DNA, 25 bp, Mus musculus
tgacttcctgttgctgctttagaac

SEQ ID NO: 850761 - DNA, 25 bp, Mus musculus
tgacttccttgtcggttggtactga

SEQ ID NO: 850762 - DNA, 25 bp, Mus musculus
tgacttccttgtgggttggtactga

SEQ ID NO: 850763 - DNA, 25 bp, Mus musculus
tgacttcctttaccatccaaaacag

SEQ ID NO: 850764 - DNA, 25 bp, Mus musculus
tgacttcctttagcatccaaaacag

SEQ ID NO: 850765 - DNA, 25 bp, Mus musculus
tgacttctaggcatgtccgggcttc

SEQ ID NO: 850766 - DNA, 25 bp, Mus musculus
tgacttctaggcttgtccgggcttc

SEQ ID NO: 850767 - DNA, 25 bp, Mus musculus
tgacttctatatactcaagacccct

SEQ ID NO: 850768 - DNA, 25 bp, Mus musculus
tgacttctatattctcaagacccct

SEQ ID NO: 850769 - DNA, 25 bp, Mus musculus
tgacttctatcacttggactatttg

SEQ ID NO: 850770 - DNA, 25 bp, Mus musculus
tgacttctatcagttggactatttg

SEQ ID NO: 850771 - DNA, 25 bp, Mus musculus
tgacttctatccctccgtggaaaat

SEQ ID NO: 850772 - DNA, 25 bp, Mus musculus
tgacttctatccgtccgtggaaaat

SEQ ID NO: 850773 - DNA, 25 bp, Mus musculus
tgacttctatgtatgccccgggcat

SEQ ID NO: 850774 - DNA, 25 bp, Mus musculus
tgacttctatgtttgccccgggcat

SEQ ID NO: 850775 - DNA, 25 bp, Mus musculus
tgacttctccaaagagaggttgggt

SEQ ID NO: 850776 - DNA, 25 bp, Mus musculus
tgacttctccaatgagaggttgggt

SEQ ID NO: 850777 - DNA, 25 bp, Mus musculus
tgacttctccttcatgcctctgaac

SEQ ID NO: 850778 - DNA, 25 bp, Mus musculus
tgacttctccttgatgcctctgaac

SEQ ID NO: 850779 - DNA, 25 bp, Mus musculus
tgacttctcgagagataccaccaga

SEQ ID NO: 850780 - DNA, 25 bp, Mus musculus
tgacttctcgagtgataccaccaga

SEQ ID NO: 850781 - DNA, 25 bp, Mus musculus
tgacttctctccagagatcatcgtc

SEQ ID NO: 850782 - DNA, 25 bp, Mus musculus
tgacttctctcctgagatcatcgtc

SEQ ID NO: 850783 - DNA, 25 bp, Mus musculus
tgacttctctggatgttaacattgt

SEQ ID NO: 850784 - DNA, 25 bp, Mus musculus
tgacttctctggcttatggcttaag

SEQ ID NO: 850785 - DNA, 25 bp, Mus musculus
tgacttctctgggttatggcttaag

SEQ ID NO: 850786 - DNA, 25 bp, Mus musculus
tgacttctctggttgttaacattgt

SEQ ID NO: 850787 - DNA, 25 bp, Mus musculus
tgacttctcttcaggccactgaaga

SEQ ID NO: 850788 - DNA, 25 bp, Mus musculus
tgacttctcttctggccactgaaga

SEQ ID NO: 850789 - DNA, 25 bp, Mus musculus
tgacttctcttgaccagaagcctga

SEQ ID NO: 850790 - DNA, 25 bp, Mus musculus
tgacttctcttgtccagaagcctga

SEQ ID NO: 850791 - DNA, 25 bp, Mus musculus
tgacttctgagaaccattgtttcct

SEQ ID NO: 850792 - DNA, 25 bp, Mus musculus
tgacttctgagatccattgtttcct

SEQ ID NO: 850793 - DNA, 25 bp, Mus musculus
tgacttctgaggatgccatggcagt

SEQ ID NO: 850794 - DNA, 25 bp, Mus musculus
tgacttctgaggttgccatggcagt

SEQ ID NO: 850795 - DNA, 25 bp, Mus musculus
tgacttctgataacaagcaccttta

SEQ ID NO: 850796 - DNA, 25 bp, Mus musculus
tgacttctgatatcaagcaccttta

SEQ ID NO: 850797 - DNA, 25 bp, Mus musculus
tgacttctgcaactgtctgttgctt

SEQ ID NO: 850798 - DNA, 25 bp, Mus musculus
tgacttctgcaagtgtctgttgctt

SEQ ID NO: 850799 - DNA, 25 bp, Mus musculus
tgacttctgctgagctgagctgacc

SEQ ID NO: 850800 - DNA, 25 bp, Mus musculus
tgacttctgctgtgctgagctgacc

SEQ ID NO: 850801 - DNA, 25 bp, Mus musculus
tgacttcttaatccattcttgctgc

SEQ ID NO: 850802 - DNA, 25 bp, Mus musculus
tgacttcttaatgcattcttgctgc

SEQ ID NO: 850803 - DNA, 25 bp, Mus musculus
tgacttcttagcatgtacttctgcc

SEQ ID NO: 850804 - DNA, 25 bp, Mus musculus
tgacttcttagcttgtacttctgcc

SEQ ID NO: 850805 - DNA, 25 bp, Mus musculus
tgacttcttcaactatgcgggactg

SEQ ID NO: 850806 - DNA, 25 bp, Mus musculus
tgacttcttcaagtatgcgggactg

SEQ ID NO: 850807 - DNA, 25 bp, Mus musculus
tgacttcttcagcaactctcggctt

SEQ ID NO: 850808 - DNA, 25 bp, Mus musculus
tgacttcttcaggaactctcggctt

SEQ ID NO: 850809 - DNA, 25 bp, Mus musculus
tgacttcttcatatccttaccaata

SEQ ID NO: 850810 - DNA, 25 bp, Mus musculus
tgacttcttcatttccttaccaata

SEQ ID NO: 850811 - DNA, 25 bp, Mus musculus
tgacttcttcctataacatcttaaa

SEQ ID NO: 850812 - DNA, 25 bp, Mus musculus
tgacttcttcctttaacatcttaaa

SEQ ID NO: 850813 - DNA, 25 bp, Mus musculus
tgacttcttcgtctccacttatgga

SEQ ID NO: 850814 - DNA, 25 bp, Mus musculus
tgacttcttcgtgtccacttatgga

SEQ ID NO: 850815 - DNA, 25 bp, Mus musculus
tgacttcttgacctaagacaaccaa

SEQ ID NO: 850816 - DNA, 25 bp, Mus musculus
tgacttcttgacgtaagacaaccaa

SEQ ID NO: 850817 - DNA, 25 bp, Mus musculus
tgacttcttggccactaaaccatac

SEQ ID NO: 850818 - DNA, 25 bp, Mus musculus
tgacttcttggcgactaaaccatac

SEQ ID NO: 850819 - DNA, 25 bp, Mus musculus
tgacttgaacatattgggtgtctct

SEQ ID NO: 850820 - DNA, 25 bp, Mus musculus
tgacttgaacattttgggtgtctct

SEQ ID NO: 850821 - DNA, 25 bp, Mus musculus
tgacttgaagctaagctttgccagc

SEQ ID NO: 850822 - DNA, 25 bp, Mus musculus
tgacttgaagcttagctttgccagc

SEQ ID NO: 850823 - DNA, 25 bp, Mus musculus
tgacttgacagcatgcaaactttaa

SEQ ID NO: 850824 - DNA, 25 bp, Mus musculus
tgacttgacagcttgcaaactttaa

SEQ ID NO: 850825 - DNA, 25 bp, Mus musculus
tgacttgaccatcggtggccatttt

SEQ ID NO: 850826 - DNA, 25 bp, Mus musculus
tgacttgaccatgggtggccatttt

SEQ ID NO: 850827 - DNA, 25 bp, Mus musculus
tgacttgactatagagcttcctcac

SEQ ID NO: 850828 - DNA, 25 bp, Mus musculus
tgacttgactattgagcttcctcac

SEQ ID NO: 850829 - DNA, 25 bp, Mus musculus
tgacttgacttccaaccagtactac

SEQ ID NO: 850830 - DNA, 25 bp, Mus musculus
tgacttgacttcgaaccagtactac

SEQ ID NO: 850831 - DNA, 25 bp, Mus musculus
tgacttgagcatcttatgtccccac

SEQ ID NO: 850832 - DNA, 25 bp, Mus musculus
tgacttgagcatgttatgtccccac

SEQ ID NO: 850833 - DNA, 25 bp, Mus musculus
tgacttgagctgcatgctgcgccaa

SEQ ID NO: 850834 - DNA, 25 bp, Mus musculus
tgacttgagctggatgctgcgccaa

SEQ ID NO: 850835 - DNA, 25 bp, Mus musculus
tgacttgagtgtaattcagactaaa

SEQ ID NO: 850836 - DNA, 25 bp, Mus musculus
tgacttgagtgttattcagactaaa

SEQ ID NO: 850837 - DNA, 25 bp, Mus musculus
tgacttgatggcctgacttagcggc

SEQ ID NO: 850838 - DNA, 25 bp, Mus musculus
tgacttgatggcgtgacttagcggc

SEQ ID NO: 850839 - DNA, 25 bp, Mus musculus
tgacttgattggctgccagcgactt

SEQ ID NO: 850840 - DNA, 25 bp, Mus musculus
tgacttgattgggtgccagcgactt

SEQ ID NO: 850841 - DNA, 25 bp, Mus musculus
tgacttgcaggtattgctggcagct

SEQ ID NO: 850842 - DNA, 25 bp, Mus musculus
tgacttgcaggttttgctggcagct

SEQ ID NO: 850843 - DNA, 25 bp, Mus musculus
tgacttgcccaaaacacagaatgtg

SEQ ID NO: 850844 - DNA, 25 bp, Mus musculus
tgacttgcccaatacacagaatgtg

SEQ ID NO: 850845 - DNA, 25 bp, Mus musculus
tgacttgcccgaagctggtttttct

SEQ ID NO: 850846 - DNA, 25 bp, Mus musculus
tgacttgcccgatgctggtttttct

SEQ ID NO: 850847 - DNA, 25 bp, Mus musculus
tgacttgccctcaaagttcaccaat

SEQ ID NO: 850848 - DNA, 25 bp, Mus musculus
tgacttgccctctaagttcaccaat

SEQ ID NO: 850849 - DNA, 25 bp, Mus musculus
tgacttgccctgcatcactgaggag

SEQ ID NO: 850850 - DNA, 25 bp, Mus musculus
tgacttgccctggatcactgaggag

SEQ ID NO: 850851 - DNA, 25 bp, Mus musculus
tgacttgcgttgatctttttacata

SEQ ID NO: 850852 - DNA, 25 bp, Mus musculus
tgacttgcgttgttctttttacata

SEQ ID NO: 850853 - DNA, 25 bp, Mus musculus
tgacttgctgccatccaaacgtgtg

SEQ ID NO: 850854 - DNA, 25 bp, Mus musculus
tgacttgctgccctcacatggaaac

SEQ ID NO: 850855 - DNA, 25 bp, Mus musculus
tgacttgctgccgtcacatggaaac

SEQ ID NO: 850856 - DNA, 25 bp, Mus musculus
tgacttgctgccttccaaacgtgtg

SEQ ID NO: 850857 - DNA, 25 bp, Mus musculus
tgacttgctggacatactgtttttc

SEQ ID NO: 850858 - DNA, 25 bp, Mus musculus
tgacttgctggagatactgtttttc

SEQ ID NO: 850859 - DNA, 25 bp, Mus musculus
tgacttgctgtcaccaccaaaggca

SEQ ID NO: 850860 - DNA, 25 bp, Mus musculus
tgacttgctgtctccaccaaaggca

SEQ ID NO: 850861 - DNA, 25 bp, Mus musculus
tgacttgcttcaaatcgcctactca

SEQ ID NO: 850862 - DNA, 25 bp, Mus musculus
tgacttgcttcatatcgcctactca

SEQ ID NO: 850863 - DNA, 25 bp, Mus musculus
tgacttgcttgtagactgctagccc

SEQ ID NO: 850864 - DNA, 25 bp, Mus musculus
tgacttgcttgttgactgctagccc

SEQ ID NO: 850865 - DNA, 25 bp, Mus musculus
tgacttgctttacctctaagcctgt

SEQ ID NO: 850866 - DNA, 25 bp, Mus musculus
tgacttgctttagctctaagcctgt

SEQ ID NO: 850867 - DNA, 25 bp, Mus musculus
tgacttggcacgaaggtttttccta

SEQ ID NO: 850868 - DNA, 25 bp, Mus musculus
tgacttggcacgtaggtttttccta

SEQ ID NO: 850869 - DNA, 25 bp, Mus musculus
tgacttgggaggctactgtctctaa

SEQ ID NO: 850870 - DNA, 25 bp, Mus musculus
tgacttgggagggtactgtctctaa

SEQ ID NO: 850871 - DNA, 25 bp, Mus musculus
tgacttgggcatcagccattccaca

SEQ ID NO: 850872 - DNA, 25 bp, Mus musculus
tgacttgggcatgagccattccaca

SEQ ID NO: 850873 - DNA, 25 bp, Mus musculus
tgacttgggtttagaaccggctctt

SEQ ID NO: 850874 - DNA, 25 bp, Mus musculus
tgacttgggttttgaaccggctctt

SEQ ID NO: 850875 - DNA, 25 bp, Mus musculus
tgacttggtaccacgctaacagatg

SEQ ID NO: 850876 - DNA, 25 bp, Mus musculus
tgacttggtacctcgctaacagatg

SEQ ID NO: 850877 - DNA, 25 bp, Mus musculus
tgacttggtgccagcattcttgagg

SEQ ID NO: 850878 - DNA, 25 bp, Mus musculus
tgacttggtgcctgcattcttgagg

SEQ ID NO: 850879 - DNA, 25 bp, Mus musculus
tgacttggttccctgtagaatcctc

SEQ ID NO: 850880 - DNA, 25 bp, Mus musculus
tgacttggttccgtgtagaatcctc

SEQ ID NO: 850881 - DNA, 25 bp, Mus musculus
tgacttggttctacaccatggcttc

SEQ ID NO: 850882 - DNA, 25 bp, Mus musculus
tgacttggttcttcaccatggcttc

SEQ ID NO: 850883 - DNA, 25 bp, Mus musculus
tgacttgtaccacaggctgtttgag

SEQ ID NO: 850884 - DNA, 25 bp, Mus musculus
tgacttgtaccagaggctgtttgag

SEQ ID NO: 850885 - DNA, 25 bp, Mus musculus
tgacttgtcaataacctacatgaag

SEQ ID NO: 850886 - DNA, 25 bp, Mus musculus
tgacttgtcaattacctacatgaag

SEQ ID NO: 850887 - DNA, 25 bp, Mus musculus
tgacttgtcactcctgccaaaaata

SEQ ID NO: 850888 - DNA, 25 bp, Mus musculus
tgacttgtcactgctgccaaaaata

SEQ ID NO: 850889 - DNA, 25 bp, Mus musculus
tgacttgtcagtatctccatctcta

SEQ ID NO: 850890 - DNA, 25 bp, Mus musculus
tgacttgtcagtttctccatctcta

SEQ ID NO: 850891 - DNA, 25 bp, Mus musculus
tgacttgtctgacccacctagatca

SEQ ID NO: 850892 - DNA, 25 bp, Mus musculus
tgacttgtctgagccacctagatca

SEQ ID NO: 850893 - DNA, 25 bp, Mus musculus
tgacttgtgcccactcttttacaaa

SEQ ID NO: 850894 - DNA, 25 bp, Mus musculus
tgacttgtgccctctcttttacaaa

SEQ ID NO: 850895 - DNA, 25 bp, Mus musculus
tgacttgtgcttacctgttttacct

SEQ ID NO: 850896 - DNA, 25 bp, Mus musculus
tgacttgtgctttcctgttttacct

SEQ ID NO: 850897 - DNA, 25 bp, Mus musculus
tgacttgtgggccattcatctacaa

SEQ ID NO: 850898 - DNA, 25 bp, Mus musculus
tgacttgtgggcgattcatctacaa

SEQ ID NO: 850899 - DNA, 25 bp, Mus musculus
tgacttgttcacatgtggcaaatgt

SEQ ID NO: 850900 - DNA, 25 bp, Mus musculus
tgacttgttcacttgtggcaaatgt

SEQ ID NO: 850901 - DNA, 25 bp, Mus musculus
tgacttgttggtcgctcttatttct

SEQ ID NO: 850902 - DNA, 25 bp, Mus musculus
tgacttgttggtggctcttatttct

SEQ ID NO: 850903 - DNA, 25 bp, Mus musculus
tgacttgtttacagctgggtgtgac

SEQ ID NO: 850904 - DNA, 25 bp, Mus musculus
tgacttgtttactgctgggtgtgac

SEQ ID NO: 850905 - DNA, 25 bp, Mus musculus
tgactttactctacctctggtaact

SEQ ID NO: 850906 - DNA, 25 bp, Mus musculus
tgactttactcttcctctggtaact

SEQ ID NO: 850907 - DNA, 25 bp, Mus musculus
tgactttagaatcctcaccaagatt

SEQ ID NO: 850908 - DNA, 25 bp, Mus musculus
tgactttagaatgctcaccaagatt

SEQ ID NO: 850909 - DNA, 25 bp, Mus musculus
tgactttagtgacttgccatggccg

SEQ ID NO: 850910 - DNA, 25 bp, Mus musculus
tgactttagtgagttgccatggccg

SEQ ID NO: 850911 - DNA, 25 bp, Mus musculus
tgactttataagcttgaccccaaat

SEQ ID NO: 850912 - DNA, 25 bp, Mus musculus
tgactttataaggttgaccccaaat

SEQ ID NO: 850913 - DNA, 25 bp, Mus musculus
tgactttatattaacccatttacct

SEQ ID NO: 850914 - DNA, 25 bp, Mus musculus
tgactttatatttacccatttacct

SEQ ID NO: 850915 - DNA, 25 bp, Mus musculus
tgactttattgtaaacccctgggct

SEQ ID NO: 850916 - DNA, 25 bp, Mus musculus
tgactttattgttaacccctgggct

SEQ ID NO: 850917 - DNA, 25 bp, Mus musculus
tgactttcaaacacagatctgcagg

SEQ ID NO: 850918 - DNA, 25 bp, Mus musculus
tgactttcaaactcagatctgcagg

SEQ ID NO: 850919 - DNA, 25 bp, Mus musculus
tgactttcaaatctctggcttctac

SEQ ID NO: 850920 - DNA, 25 bp, Mus musculus
tgactttcaaatgtctggcttctac

SEQ ID NO: 850921 - DNA, 25 bp, Mus musculus
tgactttcagacatgtttaggagtc

SEQ ID NO: 850922 - DNA, 25 bp, Mus musculus
tgactttcagaccagacccacagga

SEQ ID NO: 850923 - DNA, 25 bp, Mus musculus
tgactttcagacgagacccacagga

SEQ ID NO: 850924 - DNA, 25 bp, Mus musculus
tgactttcagacttgtttaggagtc

SEQ ID NO: 850925 - DNA, 25 bp, Mus musculus
tgactttcatcccttgactttttca

SEQ ID NO: 850926 - DNA, 25 bp, Mus musculus
tgactttcatccgttgactttttca

SEQ ID NO: 850927 - DNA, 25 bp, Mus musculus
tgactttcatgtcttccaaatcctg

SEQ ID NO: 850928 - DNA, 25 bp, Mus musculus
tgactttcatgtgttccaaatcctg

SEQ ID NO: 850929 - DNA, 25 bp, Mus musculus
tgactttccaacagaccgagcctgg

SEQ ID NO: 850930 - DNA, 25 bp, Mus musculus
tgactttccaactgaccgagcctgg

SEQ ID NO: 850931 - DNA, 25 bp, Mus musculus
tgactttccacaactgtccattttc

SEQ ID NO: 850932 - DNA, 25 bp, Mus musculus
tgactttccacatctgtccattttc

SEQ ID NO: 850933 - DNA, 25 bp, Mus musculus
tgactttcccagctccctttttaat

SEQ ID NO: 850934 - DNA, 25 bp, Mus musculus
tgactttcccaggtccctttttaat

SEQ ID NO: 850935 - DNA, 25 bp, Mus musculus
tgactttcccctaaaatgacaaaat

SEQ ID NO: 850936 - DNA, 25 bp, Mus musculus
tgactttccccttaaatgacaaaat

SEQ ID NO: 850937 - DNA, 25 bp, Mus musculus
tgactttcgcaccaactgtattctg

SEQ ID NO: 850938 - DNA, 25 bp, Mus musculus
tgactttcgcacgaactgtattctg

SEQ ID NO: 850939 - DNA, 25 bp, Mus musculus
tgactttcggcacctggacaacctt

SEQ ID NO: 850940 - DNA, 25 bp, Mus musculus
tgactttcggcagctggacaacctt

SEQ ID NO: 850941 - DNA, 25 bp, Mus musculus
tgactttcggttacaaatgttggca

SEQ ID NO: 850942 - DNA, 25 bp, Mus musculus
tgactttcggtttcaaatgttggca

SEQ ID NO: 850943 - DNA, 25 bp, Mus musculus
tgactttctaatcgaggcagccgtg

SEQ ID NO: 850944 - DNA, 25 bp, Mus musculus
tgactttctaatggaggcagccgtg

SEQ ID NO: 850945 - DNA, 25 bp, Mus musculus
tgactttctgttcgagcctcctggg

SEQ ID NO: 850946 - DNA, 25 bp, Mus musculus
tgactttctgttggagcctcctggg

SEQ ID NO: 850947 - DNA, 25 bp, Mus musculus
tgactttcttatacagcccaggcct

SEQ ID NO: 850948 - DNA, 25 bp, Mus musculus
tgactttcttattcagcccaggcct

SEQ ID NO: 850949 - DNA, 25 bp, Mus musculus
tgactttcttccacgatgcgctcat

SEQ ID NO: 850950 - DNA, 25 bp, Mus musculus
tgactttcttcctcgatgcgctcat

SEQ ID NO: 850951 - DNA, 25 bp, Mus musculus
tgactttgactaccacggccgtcat

SEQ ID NO: 850952 - DNA, 25 bp, Mus musculus
tgactttgactagcacggccgtcat

SEQ ID NO: 850953 - DNA, 25 bp, Mus musculus
tgactttgagatctatgcggacccc

SEQ ID NO: 850954 - DNA, 25 bp, Mus musculus
tgactttgagatgtatgcggacccc

SEQ ID NO: 850955 - DNA, 25 bp, Mus musculus
tgactttgagctcctaacccttctg

SEQ ID NO: 850956 - DNA, 25 bp, Mus musculus
tgactttgagctgctaacccttctg

SEQ ID NO: 850957 - DNA, 25 bp, Mus musculus
tgactttgagttaggagtagatccc

SEQ ID NO: 850958 - DNA, 25 bp, Mus musculus
tgactttgagtttggagtagatccc

SEQ ID NO: 850959 - DNA, 25 bp, Mus musculus
tgactttgcaccacgacaggtcaaa

SEQ ID NO: 850960 - DNA, 25 bp, Mus musculus
tgactttgcacctcgacaggtcaaa

SEQ ID NO: 850961 - DNA, 25 bp, Mus musculus
tgactttgcagtatcaccaaacctc

SEQ ID NO: 850962 - DNA, 25 bp, Mus musculus
tgactttgcagtttcaccaaacctc

SEQ ID NO: 850963 - DNA, 25 bp, Mus musculus
tgactttgccaaccctgggacgatg

SEQ ID NO: 850964 - DNA, 25 bp, Mus musculus
tgactttgccaagcctgggacgatg

SEQ ID NO: 850965 - DNA, 25 bp, Mus musculus
tgactttgcccacgacagctaagcg

SEQ ID NO: 850966 - DNA, 25 bp, Mus musculus
tgactttgcccaggacagctaagcg

SEQ ID NO: 850967 - DNA, 25 bp, Mus musculus
tgactttgccctacccttgtgaagg

SEQ ID NO: 850968 - DNA, 25 bp, Mus musculus
tgactttgcccttcccttgtgaagg

SEQ ID NO: 850969 - DNA, 25 bp, Mus musculus
tgactttgctttaatcccaggcatg

SEQ ID NO: 850970 - DNA, 25 bp, Mus musculus
tgactttgcttttatcccaggcatg

SEQ ID NO: 850971 - DNA, 25 bp, Mus musculus
tgactttgggctagcacgggcttcg

SEQ ID NO: 850972 - DNA, 25 bp, Mus musculus
tgactttgggcttgcacgggcttcg

SEQ ID NO: 850973 - DNA, 25 bp, Mus musculus
tgactttgtcctccaaaacttgcag

SEQ ID NO: 850974 - DNA, 25 bp, Mus musculus
tgactttgtcctgcaaaacttgcag

SEQ ID NO: 850975 - DNA, 25 bp, Mus musculus
tgactttgttgtccgaggcttcatt

SEQ ID NO: 850976 - DNA, 25 bp, Mus musculus
tgactttgttgtgcgaggcttcatt

SEQ ID NO: 850977 - DNA, 25 bp, Mus musculus
tgacttttacatcttctcagaactt

SEQ ID NO: 850978 - DNA, 25 bp, Mus musculus
tgacttttacatgttctcagaactt

SEQ ID NO: 850979 - DNA, 25 bp, Mus musculus
tgacttttacctcatcatcctagat

SEQ ID NO: 850980 - DNA, 25 bp, Mus musculus
tgacttttacctgatcatcctagat

SEQ ID NO: 850981 - DNA, 25 bp, Mus musculus
tgacttttcaacaccccaaaagctc

SEQ ID NO: 850982 - DNA, 25 bp, Mus musculus
tgacttttcaactccccaaaagctc

SEQ ID NO: 850983 - DNA, 25 bp, Mus musculus
tgacttttcaggagacttcgtgtac

SEQ ID NO: 850984 - DNA, 25 bp, Mus musculus
tgacttttcaggtgacttcgtgtac

SEQ ID NO: 850985 - DNA, 25 bp, Mus musculus
tgacttttcatcatagcctggacct

SEQ ID NO: 850986 - DNA, 25 bp, Mus musculus
tgacttttcatcttagcctggacct

SEQ ID NO: 850987 - DNA, 25 bp, Mus musculus
tgacttttcattcgcccatgtttca

SEQ ID NO: 850988 - DNA, 25 bp, Mus musculus
tgacttttcattggcccatgtttca

SEQ ID NO: 850989 - DNA, 25 bp, Mus musculus
tgacttttccaacaccacactaggt

SEQ ID NO: 850990 - DNA, 25 bp, Mus musculus
tgacttttccaagaccacactaggt

SEQ ID NO: 850991 - DNA, 25 bp, Mus musculus
tgacttttccttacctattggtgaa

SEQ ID NO: 850992 - DNA, 25 bp, Mus musculus
tgacttttcctttcctattggtgaa

SEQ ID NO: 850993 - DNA, 25 bp, Mus musculus
tgacttttctaactgaattttttgg

SEQ ID NO: 850994 - DNA, 25 bp, Mus musculus
tgacttttctaagtgaattttttgg

SEQ ID NO: 850995 - DNA, 25 bp, Mus musculus
tgacttttctcacggatcacaccaa

SEQ ID NO: 850996 - DNA, 25 bp, Mus musculus
tgacttttctcagggatcacaccaa

SEQ ID NO: 850997 - DNA, 25 bp, Mus musculus
tgacttttctgaaggaccatcacaa

SEQ ID NO: 850998 - DNA, 25 bp, Mus musculus
tgacttttctgatggaccatcacaa

SEQ ID NO: 850999 - DNA, 25 bp, Mus musculus
tgacttttcttaccctttgagactc

SEQ ID NO: 851000 - DNA, 25 bp, Mus musculus
tgacttttcttagcctttgagactc

SEQ ID NO: 851001 - DNA, 25 bp, Mus musculus
tgacttttcttcatccattaggaaa

SEQ ID NO: 851002 - DNA, 25 bp, Mus musculus
tgacttttcttcttccattaggaaa

SEQ ID NO: 851003 - DNA, 25 bp, Mus musculus
tgacttttgaccaaacgagtcccct

SEQ ID NO: 851004 - DNA, 25 bp, Mus musculus
tgacttttgacctaacgagtcccct

SEQ ID NO: 851005 - DNA, 25 bp, Mus musculus
tgacttttgattaccagcagcccat

SEQ ID NO: 851006 - DNA, 25 bp, Mus musculus
tgacttttgatttccagcagcccat

SEQ ID NO: 851007 - DNA, 25 bp, Mus musculus
tgacttttgggcaggaaaccttcaa

SEQ ID NO: 851008 - DNA, 25 bp, Mus musculus
tgacttttgggctggaaaccttcaa

SEQ ID NO: 851009 - DNA, 25 bp, Mus musculus
tgacttttgtaaccccatcagtggc

SEQ ID NO: 851010 - DNA, 25 bp, Mus musculus
tgacttttgtaagcccatcagtggc

SEQ ID NO: 851011 - DNA, 25 bp, Mus musculus
tgacttttgtcaaccagtgagctgg

SEQ ID NO: 851012 - DNA, 25 bp, Mus musculus
tgacttttgtcatccagtgagctgg

SEQ ID NO: 851013 - DNA, 25 bp, Mus musculus
tgactttttataacgtggatttcct

SEQ ID NO: 851014 - DNA, 25 bp, Mus musculus
tgactttttatatcgtggatttcct

SEQ ID NO: 851015 - DNA, 25 bp, Mus musculus
tgactttttcgaccccatagctgat

SEQ ID NO: 851016 - DNA, 25 bp, Mus musculus
tgactttttcgagcccatagctgat

SEQ ID NO: 851017 - DNA, 25 bp, Mus musculus
tgactttttgacaattccttttgca

SEQ ID NO: 851018 - DNA, 25 bp, Mus musculus
tgactttttgactattccttttgca

SEQ ID NO: 851019 - DNA, 25 bp, Mus musculus
tgactttttgagacctattattttt

SEQ ID NO: 851020 - DNA, 25 bp, Mus musculus
tgactttttgagtcctattattttt

SEQ ID NO: 851021 - DNA, 25 bp, Mus musculus
tgacttttttgcagtgtatcccctt

SEQ ID NO: 851022 - DNA, 25 bp, Mus musculus
tgacttttttgctgtgtatcccctt

SEQ ID NO: 851023 - DNA, 25 bp, Mus musculus
tgagaaaaagcaatggaaacccact

SEQ ID NO: 851024 - DNA, 25 bp, Mus musculus
tgagaaaaagcattggaaacccact

SEQ ID NO: 851025 - DNA, 25 bp, Mus musculus
tgagaaaacaccagagaccaactct

SEQ ID NO: 851026 - DNA, 25 bp, Mus musculus
tgagaaaacacctgagaccaactct

SEQ ID NO: 851027 - DNA, 25 bp, Mus musculus
tgagaaaacccgagaacagcagatg

SEQ ID NO: 851028 - DNA, 25 bp, Mus musculus
tgagaaaacccgtgaacagcagatg

SEQ ID NO: 851029 - DNA, 25 bp, Mus musculus
tgagaaaacttcaactccatccttc

SEQ ID NO: 851030 - DNA, 25 bp, Mus musculus
tgagaaaacttctactccatccttc

SEQ ID NO: 851031 - DNA, 25 bp, Mus musculus
tgagaaaagcttccccaaccaaatg

SEQ ID NO: 851032 - DNA, 25 bp, Mus musculus
tgagaaaagcttgcccaaccaaatg

SEQ ID NO: 851033 - DNA, 25 bp, Mus musculus
tgagaaaatgccctcccgagtgcag

SEQ ID NO: 851034 - DNA, 25 bp, Mus musculus
tgagaaaatgccgtcccgagtgcag

SEQ ID NO: 851035 - DNA, 25 bp, Mus musculus
tgagaaaatgctaccccaaaaaccg

SEQ ID NO: 851036 - DNA, 25 bp, Mus musculus
tgagaaaatgcttccccaaaaaccg

SEQ ID NO: 851037 - DNA, 25 bp, Mus musculus
tgagaaaatggacacactcccacag

SEQ ID NO: 851038 - DNA, 25 bp, Mus musculus
tgagaaaatggagacactcccacag

SEQ ID NO: 851039 - DNA, 25 bp, Mus musculus
tgagaaacacaaaccctaggccccg

SEQ ID NO: 851040 - DNA, 25 bp, Mus musculus
tgagaaacacaatccctaggccccg

SEQ ID NO: 851041 - DNA, 25 bp, Mus musculus
tgagaaacacccaattgaagccacc

SEQ ID NO: 851042 - DNA, 25 bp, Mus musculus
tgagaaacaccctattgaagccacc

SEQ ID NO: 851043 - DNA, 25 bp, Mus musculus
tgagaaacacgtaccgtgagcgcag

SEQ ID NO: 851044 - DNA, 25 bp, Mus musculus
tgagaaacacgttccgtgagcgcag

SEQ ID NO: 851045 - DNA, 25 bp, Mus musculus
tgagaaacactgcaggctgctagaa

SEQ ID NO: 851046 - DNA, 25 bp, Mus musculus
tgagaaacactgcatttaactcata

SEQ ID NO: 851047 - DNA, 25 bp, Mus musculus
tgagaaacactggaggctgctagaa

SEQ ID NO: 851048 - DNA, 25 bp, Mus musculus
tgagaaacactggatttaactcata

SEQ ID NO: 851049 - DNA, 25 bp, Mus musculus
tgagaaaccttaatccatcccttga

SEQ ID NO: 851050 - DNA, 25 bp, Mus musculus
tgagaaaccttattccatcccttga

SEQ ID NO: 851051 - DNA, 25 bp, Mus musculus
tgagaaacctttccttggctttgcc

SEQ ID NO: 851052 - DNA, 25 bp, Mus musculus
tgagaaacctttgcttggctttgcc

SEQ ID NO: 851053 - DNA, 25 bp, Mus musculus
tgagaaacgatcaggctactgtagc

SEQ ID NO: 851054 - DNA, 25 bp, Mus musculus
tgagaaacgatctggctactgtagc

SEQ ID NO: 851055 - DNA, 25 bp, Mus musculus
tgagaaacggcgcaaccctgcggca

SEQ ID NO: 851056 - DNA, 25 bp, Mus musculus
tgagaaacggcggaaccctgcggca

SEQ ID NO: 851057 - DNA, 25 bp, Mus musculus
tgagaaacggttcccctcagtaaag

SEQ ID NO: 851058 - DNA, 25 bp, Mus musculus
tgagaaacggttgccctcagtaaag

SEQ ID NO: 851059 - DNA, 25 bp, Mus musculus
tgagaaactaaacccctgcacatgt

SEQ ID NO: 851060 - DNA, 25 bp, Mus musculus
tgagaaactaaagccctgcacatgt

SEQ ID NO: 851061 - DNA, 25 bp, Mus musculus
tgagaaactcaccagccacagatag

SEQ ID NO: 851062 - DNA, 25 bp, Mus musculus
tgagaaactcacgagccacagatag

SEQ ID NO: 851063 - DNA, 25 bp, Mus musculus
tgagaaactcgtcacagaggtctgg

SEQ ID NO: 851064 - DNA, 25 bp, Mus musculus
tgagaaactcgtgacagaggtctgg

SEQ ID NO: 851065 - DNA, 25 bp, Mus musculus
tgagaaactgaactaccccgtgcca

SEQ ID NO: 851066 - DNA, 25 bp, Mus musculus
tgagaaactgaagtaccccgtgcca

SEQ ID NO: 851067 - DNA, 25 bp, Mus musculus
tgagaaactgagacactccctcggg

SEQ ID NO: 851068 - DNA, 25 bp, Mus musculus
tgagaaactgagtcactccctcggg

SEQ ID NO: 851069 - DNA, 25 bp, Mus musculus
tgagaaacttgcagctcttcaccat

SEQ ID NO: 851070 - DNA, 25 bp, Mus musculus
tgagaaacttgctgctcttcaccat

SEQ ID NO: 851071 - DNA, 25 bp, Mus musculus
tgagaaactttgagtcctccagcga

SEQ ID NO: 851072 - DNA, 25 bp, Mus musculus
tgagaaactttgtgtcctccagcga

SEQ ID NO: 851073 - DNA, 25 bp, Mus musculus
tgagaaagaactaccgcctctagcc

SEQ ID NO: 851074 - DNA, 25 bp, Mus musculus
tgagaaagaacttccgcctctagcc

SEQ ID NO: 851075 - DNA, 25 bp, Mus musculus
tgagaaagactactgatggcaagct

SEQ ID NO: 851076 - DNA, 25 bp, Mus musculus
tgagaaagactagtgatggcaagct

SEQ ID NO: 851077 - DNA, 25 bp, Mus musculus
tgagaaagagtgcaaccctcctcct

SEQ ID NO: 851078 - DNA, 25 bp, Mus musculus
tgagaaagagtggaaccctcctcct

SEQ ID NO: 851079 - DNA, 25 bp, Mus musculus
tgagaaagctccatctgcccttgag

SEQ ID NO: 851080 - DNA, 25 bp, Mus musculus
tgagaaagctccttctgcccttgag

SEQ ID NO: 851081 - DNA, 25 bp, Mus musculus
tgagaaaggacaccgaggttgccct

SEQ ID NO: 851082 - DNA, 25 bp, Mus musculus
tgagaaaggacagcgaggttgccct

SEQ ID NO: 851083 - DNA, 25 bp, Mus musculus
tgagaaagtcagaaggtgccatatc

SEQ ID NO: 851084 - DNA, 25 bp, Mus musculus
tgagaaagtcagtaggtgccatatc

SEQ ID NO: 851085 - DNA, 25 bp, Mus musculus
tgagaaagtcgtaccggacccgctg

SEQ ID NO: 851086 - DNA, 25 bp, Mus musculus
tgagaaagtcgttccggacccgctg

SEQ ID NO: 851087 - DNA, 25 bp, Mus musculus
tgagaaagtctactgcctggcatct

SEQ ID NO: 851088 - DNA, 25 bp, Mus musculus
tgagaaagtctagtgcctggcatct

SEQ ID NO: 851089 - DNA, 25 bp, Mus musculus
tgagaaagtgccaccatagaactgg

SEQ ID NO: 851090 - DNA, 25 bp, Mus musculus
tgagaaagtgcctccatagaactgg

SEQ ID NO: 851091 - DNA, 25 bp, Mus musculus
tgagaaagttctagtaccccaagga

SEQ ID NO: 851092 - DNA, 25 bp, Mus musculus
tgagaaagttcttgtaccccaagga

SEQ ID NO: 851093 - DNA, 25 bp, Mus musculus
tgagaaatatccctcttacgcacag

SEQ ID NO: 851094 - DNA, 25 bp, Mus musculus
tgagaaatatccgtcttacgcacag

SEQ ID NO: 851095 - DNA, 25 bp, Mus musculus
tgagaaatcactaagaagccaactt

SEQ ID NO: 851096 - DNA, 25 bp, Mus musculus
tgagaaatcacttagaagccaactt

SEQ ID NO: 851097 - DNA, 25 bp, Mus musculus
tgagaaatcaggctggttcactcct

SEQ ID NO: 851098 - DNA, 25 bp, Mus musculus
tgagaaatcagggtggttcactcct

SEQ ID NO: 851099 - DNA, 25 bp, Mus musculus
tgagaaatctctacaatgccaaatt

SEQ ID NO: 851100 - DNA, 25 bp, Mus musculus
tgagaaatctcttcaatgccaaatt

SEQ ID NO: 851101 - DNA, 25 bp, Mus musculus
tgagaaatgagcactcacctggtgc

SEQ ID NO: 851102 - DNA, 25 bp, Mus musculus
tgagaaatgagctctcacctggtgc

SEQ ID NO: 851103 - DNA, 25 bp, Mus musculus
tgagaaatgtccattgcttcccgga

SEQ ID NO: 851104 - DNA, 25 bp, Mus musculus
tgagaaatgtcctttgcttcccgga

SEQ ID NO: 851105 - DNA, 25 bp, Mus musculus
tgagaaattccacctgtcctcagtt

SEQ ID NO: 851106 - DNA, 25 bp, Mus musculus
tgagaaattccagctgtcctcagtt

SEQ ID NO: 851107 - DNA, 25 bp, Mus musculus
tgagaaattgccattctccaccggt

SEQ ID NO: 851108 - DNA, 25 bp, Mus musculus
tgagaaattgcctttctccaccggt

SEQ ID NO: 851109 - DNA, 25 bp, Mus musculus
tgagaacacacaacggtgcctcgcc

SEQ ID NO: 851110 - DNA, 25 bp, Mus musculus
tgagaacacacatcggtgcctcgcc

SEQ ID NO: 851111 - DNA, 25 bp, Mus musculus
tgagaacaccagcaaacagtccaag

SEQ ID NO: 851112 - DNA, 25 bp, Mus musculus
tgagaacaccaggaaacagtccaag

SEQ ID NO: 851113 - DNA, 25 bp, Mus musculus
tgagaacacccaacattttcacatg

SEQ ID NO: 851114 - DNA, 25 bp, Mus musculus
tgagaacacccacggaagctgggac

SEQ ID NO: 851115 - DNA, 25 bp, Mus musculus
tgagaacacccagggaagctgggac

SEQ ID NO: 851116 - DNA, 25 bp, Mus musculus
tgagaacacccatcattttcacatg

SEQ ID NO: 851117 - DNA, 25 bp, Mus musculus
tgagaacacgtgagtccatctctgc

SEQ ID NO: 851118 - DNA, 25 bp, Mus musculus
tgagaacacgtgtgtccatctctgc

SEQ ID NO: 851119 - DNA, 25 bp, Mus musculus
tgagaacactgccagctacagtcgg

SEQ ID NO: 851120 - DNA, 25 bp, Mus musculus
tgagaacactgcgagctacagtcgg

SEQ ID NO: 851121 - DNA, 25 bp, Mus musculus
tgagaacagacccaggtacccgtgg

SEQ ID NO: 851122 - DNA, 25 bp, Mus musculus
tgagaacagaccgaggtacccgtgg

SEQ ID NO: 851123 - DNA, 25 bp, Mus musculus
tgagaacagctgctctaagcactag

SEQ ID NO: 851124 - DNA, 25 bp, Mus musculus
tgagaacagctggtctaagcactag

SEQ ID NO: 851125 - DNA, 25 bp, Mus musculus
tgagaacaggcaacacccaaggaca

SEQ ID NO: 851126 - DNA, 25 bp, Mus musculus
tgagaacaggcatcacccaaggaca

SEQ ID NO: 851127 - DNA, 25 bp, Mus musculus
tgagaacagttcattcagagcagtt

SEQ ID NO: 851128 - DNA, 25 bp, Mus musculus
tgagaacagttctttcagagcagtt

SEQ ID NO: 851129 - DNA, 25 bp, Mus musculus
tgagaacataagctgtgccaccatt

SEQ ID NO: 851130 - DNA, 25 bp, Mus musculus
tgagaacataaggtgtgccaccatt

SEQ ID NO: 851131 - DNA, 25 bp, Mus musculus
tgagaacatagccaatgcccactgg

SEQ ID NO: 851132 - DNA, 25 bp, Mus musculus
tgagaacatagcgaatgcccactgg

SEQ ID NO: 851133 - DNA, 25 bp, Mus musculus
tgagaacatgtccaggcgaccatca

SEQ ID NO: 851134 - DNA, 25 bp, Mus musculus
tgagaacatgtcgaggcgaccatca

SEQ ID NO: 851135 - DNA, 25 bp, Mus musculus
tgagaacattttactgtgacactct

SEQ ID NO: 851136 - DNA, 25 bp, Mus musculus
tgagaacatttttctgtgacactct

SEQ ID NO: 851137 - DNA, 25 bp, Mus musculus
tgagaaccaaacatcccttggaggg

SEQ ID NO: 851138 - DNA, 25 bp, Mus musculus
tgagaaccaaacttcccttggaggg

SEQ ID NO: 851139 - DNA, 25 bp, Mus musculus
tgagaaccaaatccctcttagggat

SEQ ID NO: 851140 - DNA, 25 bp, Mus musculus
tgagaaccaaatgcctcttagggat

SEQ ID NO: 851141 - DNA, 25 bp, Mus musculus
tgagaaccaaccctgtcatcagcac

SEQ ID NO: 851142 - DNA, 25 bp, Mus musculus
tgagaaccaaccgtgtcatcagcac

SEQ ID NO: 851143 - DNA, 25 bp, Mus musculus
tgagaaccaacgccttaacccatct

SEQ ID NO: 851144 - DNA, 25 bp, Mus musculus
tgagaaccaacggcttaacccatct

SEQ ID NO: 851145 - DNA, 25 bp, Mus musculus
tgagaaccaccaccagagagaacta

SEQ ID NO: 851146 - DNA, 25 bp, Mus musculus
tgagaaccaccaccctaggttgacc

SEQ ID NO: 851147 - DNA, 25 bp, Mus musculus
tgagaaccaccagcagagagaacta

SEQ ID NO: 851148 - DNA, 25 bp, Mus musculus
tgagaaccaccagcctaggttgacc

SEQ ID NO: 851149 - DNA, 25 bp, Mus musculus
tgagaaccacccacttcataacagt

SEQ ID NO: 851150 - DNA, 25 bp, Mus musculus
tgagaaccaccctcttcataacagt

SEQ ID NO: 851151 - DNA, 25 bp, Mus musculus
tgagaaccactcagagttcactctg

SEQ ID NO: 851152 - DNA, 25 bp, Mus musculus
tgagaaccactctgagttcactctg

SEQ ID NO: 851153 - DNA, 25 bp, Mus musculus
tgagaaccacttctcccagtatgac

SEQ ID NO: 851154 - DNA, 25 bp, Mus musculus
tgagaaccacttgtcccagtatgac

SEQ ID NO: 851155 - DNA, 25 bp, Mus musculus
tgagaaccagaacccaccaggagca

SEQ ID NO: 851156 - DNA, 25 bp, Mus musculus
tgagaaccagaacctctcagtgtga

SEQ ID NO: 851157 - DNA, 25 bp, Mus musculus
tgagaaccagaagccaccaggagca

SEQ ID NO: 851158 - DNA, 25 bp, Mus musculus
tgagaaccagaagctctcagtgtga

SEQ ID NO: 851159 - DNA, 25 bp, Mus musculus
tgagaaccagatcatgagaatgaca

SEQ ID NO: 851160 - DNA, 25 bp, Mus musculus
tgagaaccagatctaggacctcaga

SEQ ID NO: 851161 - DNA, 25 bp, Mus musculus
tgagaaccagatgatgagaatgaca

SEQ ID NO: 851162 - DNA, 25 bp, Mus musculus
tgagaaccagatgtaggacctcaga

SEQ ID NO: 851163 - DNA, 25 bp, Mus musculus
tgagaaccagggaacgcaatgcatt

SEQ ID NO: 851164 - DNA, 25 bp, Mus musculus
tgagaaccagggtacgcaatgcatt

SEQ ID NO: 851165 - DNA, 25 bp, Mus musculus
tgagaaccagtcactgctgcgcatg

SEQ ID NO: 851166 - DNA, 25 bp, Mus musculus
tgagaaccagtctctgctgcgcatg

SEQ ID NO: 851167 - DNA, 25 bp, Mus musculus
tgagaacccaacagcctgtggtgga

SEQ ID NO: 851168 - DNA, 25 bp, Mus musculus
tgagaacccaactgcctgtggtgga

SEQ ID NO: 851169 - DNA, 25 bp, Mus musculus
tgagaacccagacctgccttgggca

SEQ ID NO: 851170 - DNA, 25 bp, Mus musculus
tgagaacccagagctgccttgggca

SEQ ID NO: 851171 - DNA, 25 bp, Mus musculus
tgagaacccatcacaggacagtggt

SEQ ID NO: 851172 - DNA, 25 bp, Mus musculus
tgagaacccatctcaggacagtggt

SEQ ID NO: 851173 - DNA, 25 bp, Mus musculus
tgagaaccccgaaaaggccgactgg

SEQ ID NO: 851174 - DNA, 25 bp, Mus musculus
tgagaaccccgataaggccgactgg

SEQ ID NO: 851175 - DNA, 25 bp, Mus musculus
tgagaacccctacttggccagatat

SEQ ID NO: 851176 - DNA, 25 bp, Mus musculus
tgagaacccctagttggccagatat

SEQ ID NO: 851177 - DNA, 25 bp, Mus musculus
tgagaacccctcaatggatccttca

SEQ ID NO: 851178 - DNA, 25 bp, Mus musculus
tgagaacccctcagtgcagttgctc

SEQ ID NO: 851179 - DNA, 25 bp, Mus musculus
tgagaacccctctatggatccttca

SEQ ID NO: 851180 - DNA, 25 bp, Mus musculus
tgagaacccctctgtgcagttgctc

SEQ ID NO: 851181 - DNA, 25 bp, Mus musculus
tgagaacccgaacgaccagaggccc

SEQ ID NO: 851182 - DNA, 25 bp, Mus musculus
tgagaacccgaaggaccagaggccc

SEQ ID NO: 851183 - DNA, 25 bp, Mus musculus
tgagaaccgtcacactcttctgatc

SEQ ID NO: 851184 - DNA, 25 bp, Mus musculus
tgagaaccgtcagactcttctgatc

SEQ ID NO: 851185 - DNA, 25 bp, Mus musculus
tgagaacctagtcagcccacagagg

SEQ ID NO: 851186 - DNA, 25 bp, Mus musculus
tgagaacctagtgagcccacagagg

SEQ ID NO: 851187 - DNA, 25 bp, Mus musculus
tgagaacctattccctgtcacttga

SEQ ID NO: 851188 - DNA, 25 bp, Mus musculus
tgagaacctattgcctgtcacttga

SEQ ID NO: 851189 - DNA, 25 bp, Mus musculus
tgagaacctgatcagcgaggccctc

SEQ ID NO: 851190 - DNA, 25 bp, Mus musculus
tgagaacctgatcgcggtactacat

SEQ ID NO: 851191 - DNA, 25 bp, Mus musculus
tgagaacctgatgagcgaggccctc

SEQ ID NO: 851192 - DNA, 25 bp, Mus musculus
tgagaacctgatggcggtactacat

SEQ ID NO: 851193 - DNA, 25 bp, Mus musculus
tgagaacctggaccaattggaggat

SEQ ID NO: 851194 - DNA, 25 bp, Mus musculus
tgagaacctggagcaattggaggat

SEQ ID NO: 851195 - DNA, 25 bp, Mus musculus
tgagaacgaatgagactccagtgaa

SEQ ID NO: 851196 - DNA, 25 bp, Mus musculus
tgagaacgaatgtgactccagtgaa

SEQ ID NO: 851197 - DNA, 25 bp, Mus musculus
tgagaacgacaacgcattccagtgt

SEQ ID NO: 851198 - DNA, 25 bp, Mus musculus
tgagaacgacaaggcattccagtgt

SEQ ID NO: 851199 - DNA, 25 bp, Mus musculus
tgagaacgatgaccaagcagccagt

SEQ ID NO: 851200 - DNA, 25 bp, Mus musculus
tgagaacgatgagcaagcagccagt

SEQ ID NO: 851201 - DNA, 25 bp, Mus musculus
tgagaacgatggcttacatgcctac

SEQ ID NO: 851202 - DNA, 25 bp, Mus musculus
tgagaacgatgggttacatgcctac

SEQ ID NO: 851203 - DNA, 25 bp, Mus musculus
tgagaacggttcattcagacccaaa

SEQ ID NO: 851204 - DNA, 25 bp, Mus musculus
tgagaacggttctttcagacccaaa

SEQ ID NO: 851205 - DNA, 25 bp, Mus musculus
tgagaacgtcagctttccctgaggc

SEQ ID NO: 851206 - DNA, 25 bp, Mus musculus
tgagaacgtcaggtttccctgaggc

SEQ ID NO: 851207 - DNA, 25 bp, Mus musculus
tgagaacgtgcactccatggtgatg

SEQ ID NO: 851208 - DNA, 25 bp, Mus musculus
tgagaacgtgcagtccatggtgatg

SEQ ID NO: 851209 - DNA, 25 bp, Mus musculus
tgagaacgtgcgactggcctccacc

SEQ ID NO: 851210 - DNA, 25 bp, Mus musculus
tgagaacgtgcgtctggcctccacc

SEQ ID NO: 851211 - DNA, 25 bp, Mus musculus
tgagaacgtgggatttgcctccttc

SEQ ID NO: 851212 - DNA, 25 bp, Mus musculus
tgagaacgtgggttttgcctccttc

SEQ ID NO: 851213 - DNA, 25 bp, Mus musculus
tgagaactaaatatcctcttttggt

SEQ ID NO: 851214 - DNA, 25 bp, Mus musculus
tgagaactaaatttcctcttttggt

SEQ ID NO: 851215 - DNA, 25 bp, Mus musculus
tgagaactagacctgtgtgcctgtg

SEQ ID NO: 851216 - DNA, 25 bp, Mus musculus
tgagaactagacgtgtgtgcctgtg

SEQ ID NO: 851217 - DNA, 25 bp, Mus musculus
tgagaactcaagacccctgttttta

SEQ ID NO: 851218 - DNA, 25 bp, Mus musculus
tgagaactcaagtcccctgttttta

SEQ ID NO: 851219 - DNA, 25 bp, Mus musculus
tgagaactcaccaaccatctgaaag

SEQ ID NO: 851220 - DNA, 25 bp, Mus musculus
tgagaactcacctaccatctgaaag

SEQ ID NO: 851221 - DNA, 25 bp, Mus musculus
tgagaactcctaagagcctagggat

SEQ ID NO: 851222 - DNA, 25 bp, Mus musculus
tgagaactcctaatcgaaccgtacc

SEQ ID NO: 851223 - DNA, 25 bp, Mus musculus
tgagaactcctatgagcctagggat

SEQ ID NO: 851224 - DNA, 25 bp, Mus musculus
tgagaactcctattcgaaccgtacc

SEQ ID NO: 851225 - DNA, 25 bp, Mus musculus
tgagaactcggacatcctgacccgc

SEQ ID NO: 851226 - DNA, 25 bp, Mus musculus
tgagaactcggagatcctgacccgc

SEQ ID NO: 851227 - DNA, 25 bp, Mus musculus
tgagaactctccattttgctgtgaa

SEQ ID NO: 851228 - DNA, 25 bp, Mus musculus
tgagaactctcctttttgctgtgaa

SEQ ID NO: 851229 - DNA, 25 bp, Mus musculus
tgagaactcttcaactttctctgtg

SEQ ID NO: 851230 - DNA, 25 bp, Mus musculus
tgagaactcttctactttctctgtg

SEQ ID NO: 851231 - DNA, 25 bp, Mus musculus
tgagaactgctcaaatgccgggcac

SEQ ID NO: 851232 - DNA, 25 bp, Mus musculus
tgagaactgctctaatgccgggcac

SEQ ID NO: 851233 - DNA, 25 bp, Mus musculus
tgagaactgggtcctgttccccaag

SEQ ID NO: 851234 - DNA, 25 bp, Mus musculus
tgagaactgggtgctgttccccaag

SEQ ID NO: 851235 - DNA, 25 bp, Mus musculus
tgagaactggttctacacacgagct

SEQ ID NO: 851236 - DNA, 25 bp, Mus musculus
tgagaactggttgtacacacgagct

SEQ ID NO: 851237 - DNA, 25 bp, Mus musculus
tgagaacttgtcagctgttacgccc

SEQ ID NO: 851238 - DNA, 25 bp, Mus musculus
tgagaacttgtctgctgttacgccc

SEQ ID NO: 851239 - DNA, 25 bp, Mus musculus
tgagaactttccaaaggccttttgc

SEQ ID NO: 851240 - DNA, 25 bp, Mus musculus
tgagaactttcctaaggccttttgc

SEQ ID NO: 851241 - DNA, 25 bp, Mus musculus
tgagaagaacgaagaccccactgtc

SEQ ID NO: 851242 - DNA, 25 bp, Mus musculus
tgagaagaacgatgaccccactgtc

SEQ ID NO: 851243 - DNA, 25 bp, Mus musculus
tgagaagaatccctagtcagtccta

SEQ ID NO: 851244 - DNA, 25 bp, Mus musculus
tgagaagaatccgtagtcagtccta

SEQ ID NO: 851245 - DNA, 25 bp, Mus musculus
tgagaagaccatcctctccttggta

SEQ ID NO: 851246 - DNA, 25 bp, Mus musculus
tgagaagaccatgctctccttggta

SEQ ID NO: 851247 - DNA, 25 bp, Mus musculus
tgagaagaccgaccttcctgtactt

SEQ ID NO: 851248 - DNA, 25 bp, Mus musculus
tgagaagaccgagcttcctgtactt

SEQ ID NO: 851249 - DNA, 25 bp, Mus musculus
tgagaagacgagactcactcctgcc

SEQ ID NO: 851250 - DNA, 25 bp, Mus musculus
tgagaagacgagtctcactcctgcc

SEQ ID NO: 851251 - DNA, 25 bp, Mus musculus
tgagaagactgtactgtcgcaccca

SEQ ID NO: 851252 - DNA, 25 bp, Mus musculus
tgagaagactgttctgtcgcaccca

SEQ ID NO: 851253 - DNA, 25 bp, Mus musculus
tgagaagactttcctaacagaacgt

SEQ ID NO: 851254 - DNA, 25 bp, Mus musculus
tgagaagactttgctaacagaacgt

SEQ ID NO: 851255 - DNA, 25 bp, Mus musculus
tgagaagagcccactctggcagaat

SEQ ID NO: 851256 - DNA, 25 bp, Mus musculus
tgagaagagcccattcgaccagcta

SEQ ID NO: 851257 - DNA, 25 bp, Mus musculus
tgagaagagccctctctggcagaat

SEQ ID NO: 851258 - DNA, 25 bp, Mus musculus
tgagaagagccctttcgaccagcta

SEQ ID NO: 851259 - DNA, 25 bp, Mus musculus
tgagaagatcaaacggccccggagc

SEQ ID NO: 851260 - DNA, 25 bp, Mus musculus
tgagaagatcaatcggccccggagc

SEQ ID NO: 851261 - DNA, 25 bp, Mus musculus
tgagaagatcttcctcctgcagact

SEQ ID NO: 851262 - DNA, 25 bp, Mus musculus
tgagaagatcttgctcctgcagact

SEQ ID NO: 851263 - DNA, 25 bp, Mus musculus
tgagaagattataccatctcctgac

SEQ ID NO: 851264 - DNA, 25 bp, Mus musculus
tgagaagattattccatctcctgac

SEQ ID NO: 851265 - DNA, 25 bp, Mus musculus
tgagaagattccacacaccagcgaa

SEQ ID NO: 851266 - DNA, 25 bp, Mus musculus
tgagaagattcctcacaccagcgaa

SEQ ID NO: 851267 - DNA, 25 bp, Mus musculus
tgagaagcaaccacctgggaacagt

SEQ ID NO: 851268 - DNA, 25 bp, Mus musculus
tgagaagcaacctcctgggaacagt

SEQ ID NO: 851269 - DNA, 25 bp, Mus musculus
tgagaagcacagatgccgcagggaa

SEQ ID NO: 851270 - DNA, 25 bp, Mus musculus
tgagaagcacagttgccgcagggaa

SEQ ID NO: 851271 - DNA, 25 bp, Mus musculus
tgagaagcagggattctccacgtcc

SEQ ID NO: 851272 - DNA, 25 bp, Mus musculus
tgagaagcagggtttctccacgtcc

SEQ ID NO: 851273 - DNA, 25 bp, Mus musculus
tgagaagccacgatcagctgagaat

SEQ ID NO: 851274 - DNA, 25 bp, Mus musculus
tgagaagccacgttcagctgagaat

SEQ ID NO: 851275 - DNA, 25 bp, Mus musculus
tgagaagccataacctctcgggacc

SEQ ID NO: 851276 - DNA, 25 bp, Mus musculus
tgagaagccatatcctctcgggacc

SEQ ID NO: 851277 - DNA, 25 bp, Mus musculus
tgagaagccatcactggtctctgta

SEQ ID NO: 851278 - DNA, 25 bp, Mus musculus
tgagaagccatctctggtctctgta

SEQ ID NO: 851279 - DNA, 25 bp, Mus musculus
tgagaagcccaaaagtataaaccag

SEQ ID NO: 851280 - DNA, 25 bp, Mus musculus
tgagaagcccaatagtataaaccag

SEQ ID NO: 851281 - DNA, 25 bp, Mus musculus
tgagaagcccacatccgaatcaata

SEQ ID NO: 851282 - DNA, 25 bp, Mus musculus
tgagaagcccacttccgaatcaata

SEQ ID NO: 851283 - DNA, 25 bp, Mus musculus
tgagaagccccacggtaacaagccc

SEQ ID NO: 851284 - DNA, 25 bp, Mus musculus
tgagaagccccagggtaacaagccc

SEQ ID NO: 851285 - DNA, 25 bp, Mus musculus
tgagaagcccccagtcctcagaggc

SEQ ID NO: 851286 - DNA, 25 bp, Mus musculus
tgagaagccccctgtcctcagaggc

SEQ ID NO: 851287 - DNA, 25 bp, Mus musculus
tgagaagcccttcgcccaattccaa

SEQ ID NO: 851288 - DNA, 25 bp, Mus musculus
tgagaagcccttcgcgtgccccgag

SEQ ID NO: 851289 - DNA, 25 bp, Mus musculus
tgagaagcccttggcccaattccaa

SEQ ID NO: 851290 - DNA, 25 bp, Mus musculus
tgagaagcccttggcgtgccccgag

SEQ ID NO: 851291 - DNA, 25 bp, Mus musculus
tgagaagccgcaagtcatcgcagac

SEQ ID NO: 851292 - DNA, 25 bp, Mus musculus
tgagaagccgcatgtcatcgcagac

SEQ ID NO: 851293 - DNA, 25 bp, Mus musculus
tgagaagccgccagagctcatgttt

SEQ ID NO: 851294 - DNA, 25 bp, Mus musculus
tgagaagccgcctgagctcatgttt

SEQ ID NO: 851295 - DNA, 25 bp, Mus musculus
tgagaagccggcagtccctgagact

SEQ ID NO: 851296 - DNA, 25 bp, Mus musculus
tgagaagccggctgtccctgagact

SEQ ID NO: 851297 - DNA, 25 bp, Mus musculus
tgagaagccgttacaaagcccctaa

SEQ ID NO: 851298 - DNA, 25 bp, Mus musculus
tgagaagccgtttcaaagcccctaa

SEQ ID NO: 851299 - DNA, 25 bp, Mus musculus
tgagaagcctgccttgcgcttgcct

SEQ ID NO: 851300 - DNA, 25 bp, Mus musculus
tgagaagcctgcgttgcgcttgcct

SEQ ID NO: 851301 - DNA, 25 bp, Mus musculus
tgagaagcctttacctagcatccgt

SEQ ID NO: 851302 - DNA, 25 bp, Mus musculus
tgagaagccttttcctagcatccgt

SEQ ID NO: 851303 - DNA, 25 bp, Mus musculus
tgagaagcggctacacccagcaggg

SEQ ID NO: 851304 - DNA, 25 bp, Mus musculus
tgagaagcggcttcacccagcaggg

SEQ ID NO: 851305 - DNA, 25 bp, Mus musculus
tgagaagcgtccacctacattgcga

SEQ ID NO: 851306 - DNA, 25 bp, Mus musculus
tgagaagcgtcctcctacattgcga

SEQ ID NO: 851307 - DNA, 25 bp, Mus musculus
tgagaagcgtcgagccagtctctga

SEQ ID NO: 851308 - DNA, 25 bp, Mus musculus
tgagaagcgtcgtgccagtctctga

SEQ ID NO: 851309 - DNA, 25 bp, Mus musculus
tgagaagctcaaccctgacttctta

SEQ ID NO: 851310 - DNA, 25 bp, Mus musculus
tgagaagctcaagcctgacttctta

SEQ ID NO: 851311 - DNA, 25 bp, Mus musculus
tgagaagctccacattcgctcaggc

SEQ ID NO: 851312 - DNA, 25 bp, Mus musculus
tgagaagctccactaggcatgaacc

SEQ ID NO: 851313 - DNA, 25 bp, Mus musculus
tgagaagctccagattcgctcaggc

SEQ ID NO: 851314 - DNA, 25 bp, Mus musculus
tgagaagctccagtaggcatgaacc

SEQ ID NO: 851315 - DNA, 25 bp, Mus musculus
tgagaagctgacagcgtaggcagca

SEQ ID NO: 851316 - DNA, 25 bp, Mus musculus
tgagaagctgactgcgtaggcagca

SEQ ID NO: 851317 - DNA, 25 bp, Mus musculus
tgagaagctgccacgcaaagtgctg

SEQ ID NO: 851318 - DNA, 25 bp, Mus musculus
tgagaagctgcctcgcaaagtgctg

SEQ ID NO: 851319 - DNA, 25 bp, Mus musculus
tgagaagctggcatccgtggaacaa

SEQ ID NO: 851320 - DNA, 25 bp, Mus musculus
tgagaagctggcttccgtggaacaa

SEQ ID NO: 851321 - DNA, 25 bp, Mus musculus
tgagaagctttgcaataaaaccctt

SEQ ID NO: 851322 - DNA, 25 bp, Mus musculus
tgagaagctttggaataaaaccctt

SEQ ID NO: 851323 - DNA, 25 bp, Mus musculus
tgagaaggaaaaactggctgcagct

SEQ ID NO: 851324 - DNA, 25 bp, Mus musculus
tgagaaggaaaatctggctgcagct

SEQ ID NO: 851325 - DNA, 25 bp, Mus musculus
tgagaaggaccacttgttgttgttg

SEQ ID NO: 851326 - DNA, 25 bp, Mus musculus
tgagaaggaccagttgttgttgttg

SEQ ID NO: 851327 - DNA, 25 bp, Mus musculus
tgagaaggatatccgccacagggct

SEQ ID NO: 851328 - DNA, 25 bp, Mus musculus
tgagaaggatatgcgccacagggct

SEQ ID NO: 851329 - DNA, 25 bp, Mus musculus
tgagaaggcatgactcctcccaata

SEQ ID NO: 851330 - DNA, 25 bp, Mus musculus
tgagaaggcatgtctcctcccaata

SEQ ID NO: 851331 - DNA, 25 bp, Mus musculus
tgagaaggcctccaaacgcatgacc

SEQ ID NO: 851332 - DNA, 25 bp, Mus musculus
tgagaaggcctcgaaacgcatgacc

SEQ ID NO: 851333 - DNA, 25 bp, Mus musculus
tgagaaggctacagcggaggaaccc

SEQ ID NO: 851334 - DNA, 25 bp, Mus musculus
tgagaaggctactgcggaggaaccc

SEQ ID NO: 851335 - DNA, 25 bp, Mus musculus
tgagaaggcttcatgtttcctgctg

SEQ ID NO: 851336 - DNA, 25 bp, Mus musculus
tgagaaggcttcttgtttcctgctg

SEQ ID NO: 851337 - DNA, 25 bp, Mus musculus
tgagaaggctttatcagccacgata

SEQ ID NO: 851338 - DNA, 25 bp, Mus musculus
tgagaaggctttcagggaccagtca

SEQ ID NO: 851339 - DNA, 25 bp, Mus musculus
tgagaaggctttgagggaccagtca

SEQ ID NO: 851340 - DNA, 25 bp, Mus musculus
tgagaaggctttttcagccacgata

SEQ ID NO: 851341 - DNA, 25 bp, Mus musculus
tgagaagggataccgttcacgtttt

SEQ ID NO: 851342 - DNA, 25 bp, Mus musculus
tgagaagggatagcgttcacgtttt

SEQ ID NO: 851343 - DNA, 25 bp, Mus musculus
tgagaagggcccactgagtccgcgc

SEQ ID NO: 851344 - DNA, 25 bp, Mus musculus
tgagaagggccctctgagtccgcgc

SEQ ID NO: 851345 - DNA, 25 bp, Mus musculus
tgagaagggtttaccaggcaggcct

SEQ ID NO: 851346 - DNA, 25 bp, Mus musculus
tgagaagggttttccaggcaggcct

SEQ ID NO: 851347 - DNA, 25 bp, Mus musculus
tgagaaggtagtccctgccagcaaa

SEQ ID NO: 851348 - DNA, 25 bp, Mus musculus
tgagaaggtagtgcctgccagcaaa

SEQ ID NO: 851349 - DNA, 25 bp, Mus musculus
tgagaaggtcccactggagaccaat

SEQ ID NO: 851350 - DNA, 25 bp, Mus musculus
tgagaaggtccctctggagaccaat

SEQ ID NO: 851351 - DNA, 25 bp, Mus musculus
tgagaagtacacatcccgcttctac

SEQ ID NO: 851352 - DNA, 25 bp, Mus musculus
tgagaagtacacttcccgcttctac

SEQ ID NO: 851353 - DNA, 25 bp, Mus musculus
tgagaagtcaataacgtcccagagt

SEQ ID NO: 851354 - DNA, 25 bp, Mus musculus
tgagaagtcaattacgtcccagagt

SEQ ID NO: 851355 - DNA, 25 bp, Mus musculus
tgagaagtcacacctgaccatcagc

SEQ ID NO: 851356 - DNA, 25 bp, Mus musculus
tgagaagtcacagctgaccatcagc

SEQ ID NO: 851357 - DNA, 25 bp, Mus musculus
tgagaagtcactacaagcagcattg

SEQ ID NO: 851358 - DNA, 25 bp, Mus musculus
tgagaagtcacttcaagcagcattg

SEQ ID NO: 851359 - DNA, 25 bp, Mus musculus
tgagaagtcattccactgggcctgt

SEQ ID NO: 851360 - DNA, 25 bp, Mus musculus
tgagaagtcattgcactgggcctgt

SEQ ID NO: 851361 - DNA, 25 bp, Mus musculus
tgagaagtccaccttgtgttcactc

SEQ ID NO: 851362 - DNA, 25 bp, Mus musculus
tgagaagtccacgttgtgttcactc

SEQ ID NO: 851363 - DNA, 25 bp, Mus musculus
tgagaagtcgagatgcaccaagtcc

SEQ ID NO: 851364 - DNA, 25 bp, Mus musculus
tgagaagtcgagttgcaccaagtcc

SEQ ID NO: 851365 - DNA, 25 bp, Mus musculus
tgagaagtctagaggtgcggcgatt

SEQ ID NO: 851366 - DNA, 25 bp, Mus musculus
tgagaagtctagtggtgcggcgatt

SEQ ID NO: 851367 - DNA, 25 bp, Mus musculus
tgagaagtgctccttggaccagctg

SEQ ID NO: 851368 - DNA, 25 bp, Mus musculus
tgagaagtgctcgttggaccagctg

SEQ ID NO: 851369 - DNA, 25 bp, Mus musculus
tgagaagtggacaaacagtagagat

SEQ ID NO: 851370 - DNA, 25 bp, Mus musculus
tgagaagtggactaacagtagagat

SEQ ID NO: 851371 - DNA, 25 bp, Mus musculus
tgagaagtgtcccttctgctgtaac

SEQ ID NO: 851372 - DNA, 25 bp, Mus musculus
tgagaagtgtccgttctgctgtaac

SEQ ID NO: 851373 - DNA, 25 bp, Mus musculus
tgagaagtgtgactccctggttcca

SEQ ID NO: 851374 - DNA, 25 bp, Mus musculus
tgagaagtgtgagtccctggttcca

SEQ ID NO: 851375 - DNA, 25 bp, Mus musculus
tgagaagttccactgcctaaagcct

SEQ ID NO: 851376 - DNA, 25 bp, Mus musculus
tgagaagttccagtgcctaaagcct

SEQ ID NO: 851377 - DNA, 25 bp, Mus musculus
tgagaataaggaccgctcttgcaga

SEQ ID NO: 851378 - DNA, 25 bp, Mus musculus
tgagaataaggagcgctcttgcaga

SEQ ID NO: 851379 - DNA, 25 bp, Mus musculus
tgagaataatggctggcgttcctcc

SEQ ID NO: 851380 - DNA, 25 bp, Mus musculus
tgagaataatgggtggcgttcctcc

SEQ ID NO: 851381 - DNA, 25 bp, Mus musculus
tgagaataccccaggtctaggccta

SEQ ID NO: 851382 - DNA, 25 bp, Mus musculus
tgagaatacccctggtctaggccta

SEQ ID NO: 851383 - DNA, 25 bp, Mus musculus
tgagaatagtttccttccagcctcc

SEQ ID NO: 851384 - DNA, 25 bp, Mus musculus
tgagaatagtttgcttccagcctcc

SEQ ID NO: 851385 - DNA, 25 bp, Mus musculus
tgagaatcaagcactgtcccagaat

SEQ ID NO: 851386 - DNA, 25 bp, Mus musculus
tgagaatcaagctctgtcccagaat

SEQ ID NO: 851387 - DNA, 25 bp, Mus musculus
tgagaatcactcatgacctagtggg

SEQ ID NO: 851388 - DNA, 25 bp, Mus musculus
tgagaatcactcttgacctagtggg

SEQ ID NO: 851389 - DNA, 25 bp, Mus musculus
tgagaatcacttaaccttttgcccc

SEQ ID NO: 851390 - DNA, 25 bp, Mus musculus
tgagaatcactttaccttttgcccc

SEQ ID NO: 851391 - DNA, 25 bp, Mus musculus
tgagaatcatatatcgcctgtagat

SEQ ID NO: 851392 - DNA, 25 bp, Mus musculus
tgagaatcatatttcgcctgtagat

SEQ ID NO: 851393 - DNA, 25 bp, Mus musculus
tgagaatcatcaactccaaataatt

SEQ ID NO: 851394 - DNA, 25 bp, Mus musculus
tgagaatcatcatctccaaataatt

SEQ ID NO: 851395 - DNA, 25 bp, Mus musculus
tgagaatccccaagtactgggccta

SEQ ID NO: 851396 - DNA, 25 bp, Mus musculus
tgagaatccccatgtactgggccta

SEQ ID NO: 851397 - DNA, 25 bp, Mus musculus
tgagaatcccgtcgagccacagtgc

SEQ ID NO: 851398 - DNA, 25 bp, Mus musculus
tgagaatcccgtggagccacagtgc

SEQ ID NO: 851399 - DNA, 25 bp, Mus musculus
tgagaatccctgcaacattttaccc

SEQ ID NO: 851400 - DNA, 25 bp, Mus musculus
tgagaatccctggaacattttaccc

SEQ ID NO: 851401 - DNA, 25 bp, Mus musculus
tgagaatccggaaatgctttggcat

SEQ ID NO: 851402 - DNA, 25 bp, Mus musculus
tgagaatccggatatgctttggcat

SEQ ID NO: 851403 - DNA, 25 bp, Mus musculus
tgagaatcctttattctggaagtga

SEQ ID NO: 851404 - DNA, 25 bp, Mus musculus
tgagaatccttttttctggaagtga

SEQ ID NO: 851405 - DNA, 25 bp, Mus musculus
tgagaatcggtaacccatagccctt

SEQ ID NO: 851406 - DNA, 25 bp, Mus musculus
tgagaatcggtatcccatagccctt

SEQ ID NO: 851407 - DNA, 25 bp, Mus musculus
tgagaatctactctagcacgatccc

SEQ ID NO: 851408 - DNA, 25 bp, Mus musculus
tgagaatctactgtagcacgatccc

SEQ ID NO: 851409 - DNA, 25 bp, Mus musculus
tgagaatctggccttcatcgacgag

SEQ ID NO: 851410 - DNA, 25 bp, Mus musculus
tgagaatctggcgttcatcgacgag

SEQ ID NO: 851411 - DNA, 25 bp, Mus musculus
tgagaatgaagtaccaccgtccccg

SEQ ID NO: 851412 - DNA, 25 bp, Mus musculus
tgagaatgaagttccaccgtccccg

SEQ ID NO: 851413 - DNA, 25 bp, Mus musculus
tgagaatgaccccaggagatcccca

SEQ ID NO: 851414 - DNA, 25 bp, Mus musculus
tgagaatgacccgaggagatcccca

SEQ ID NO: 851415 - DNA, 25 bp, Mus musculus
tgagaatgagccagtccatcctcat

SEQ ID NO: 851416 - DNA, 25 bp, Mus musculus
tgagaatgagcctgtccatcctcat

SEQ ID NO: 851417 - DNA, 25 bp, Mus musculus
tgagaatgccccagctgtgactctg

SEQ ID NO: 851418 - DNA, 25 bp, Mus musculus
tgagaatgcccctgctgtgactctg

SEQ ID NO: 851419 - DNA, 25 bp, Mus musculus
tgagaatgccgcagggccctgcaac

SEQ ID NO: 851420 - DNA, 25 bp, Mus musculus
tgagaatgccgctgggccctgcaac

SEQ ID NO: 851421 - DNA, 25 bp, Mus musculus
tgagaatgccttactctggccaggg

SEQ ID NO: 851422 - DNA, 25 bp, Mus musculus
tgagaatgcctttctctggccaggg

SEQ ID NO: 851423 - DNA, 25 bp, Mus musculus
tgagaatgcgtgaccggttgcctct

SEQ ID NO: 851424 - DNA, 25 bp, Mus musculus
tgagaatgcgtgtccggttgcctct

SEQ ID NO: 851425 - DNA, 25 bp, Mus musculus
tgagaatggagcaacatcacccgcc

SEQ ID NO: 851426 - DNA, 25 bp, Mus musculus
tgagaatggagctacatcacccgcc

SEQ ID NO: 851427 - DNA, 25 bp, Mus musculus
tgagaatggcatcagaattgtctac

SEQ ID NO: 851428 - DNA, 25 bp, Mus musculus
tgagaatggcatccatcacaccctg

SEQ ID NO: 851429 - DNA, 25 bp, Mus musculus
tgagaatggcatgagaattgtctac

SEQ ID NO: 851430 - DNA, 25 bp, Mus musculus
tgagaatggcatgcatcacaccctg

SEQ ID NO: 851431 - DNA, 25 bp, Mus musculus
tgagaatgtaccactgctggcagag

SEQ ID NO: 851432 - DNA, 25 bp, Mus musculus
tgagaatgtacctctgctggcagag

SEQ ID NO: 851433 - DNA, 25 bp, Mus musculus
tgagaatgtgaaaccgagctgcccg

SEQ ID NO: 851434 - DNA, 25 bp, Mus musculus
tgagaatgtgaatccgagctgcccg

SEQ ID NO: 851435 - DNA, 25 bp, Mus musculus
tgagaatgtgcaccctcaccttgct

SEQ ID NO: 851436 - DNA, 25 bp, Mus musculus
tgagaatgtgcagcctcaccttgct

SEQ ID NO: 851437 - DNA, 25 bp, Mus musculus
tgagaattataacgccctcgtgaga

SEQ ID NO: 851438 - DNA, 25 bp, Mus musculus
tgagaattataaggccctcgtgaga

SEQ ID NO: 851439 - DNA, 25 bp, Mus musculus
tgagaattccacctgtcccatttgt

SEQ ID NO: 851440 - DNA, 25 bp, Mus musculus
tgagaattccacgtgtcccatttgt

SEQ ID NO: 851441 - DNA, 25 bp, Mus musculus
tgagaattcctaccacctatgacgt

SEQ ID NO: 851442 - DNA, 25 bp, Mus musculus
tgagaattcctagcacctatgacgt

SEQ ID NO: 851443 - DNA, 25 bp, Mus musculus
tgagaattctgtcgcactgtttccc

SEQ ID NO: 851444 - DNA, 25 bp, Mus musculus
tgagaattctgtggcactgtttccc

SEQ ID NO: 851445 - DNA, 25 bp, Mus musculus
tgagaattctttactagcgccttcc

SEQ ID NO: 851446 - DNA, 25 bp, Mus musculus
tgagaattcttttctagcgccttcc

SEQ ID NO: 851447 - DNA, 25 bp, Mus musculus
tgagaattgaagctctctggctgtc

SEQ ID NO: 851448 - DNA, 25 bp, Mus musculus
tgagaattgaaggtctctggctgtc

SEQ ID NO: 851449 - DNA, 25 bp, Mus musculus
tgagaattggccagcaccgtggaac

SEQ ID NO: 851450 - DNA, 25 bp, Mus musculus
tgagaattggcctgcaccgtggaac

SEQ ID NO: 851451 - DNA, 25 bp, Mus musculus
tgagaattgtccagtgttacctggg

SEQ ID NO: 851452 - DNA, 25 bp, Mus musculus
tgagaattgtcctgtgttacctggg

SEQ ID NO: 851453 - DNA, 25 bp, Mus musculus
tgagaatttctgctttcccagtcat

SEQ ID NO: 851454 - DNA, 25 bp, Mus musculus
tgagaatttctggtttcccagtcat

SEQ ID NO: 851455 - DNA, 25 bp, Mus musculus
tgagacaaacaccagcaacttagca

SEQ ID NO: 851456 - DNA, 25 bp, Mus musculus
tgagacaaacacgagcaacttagca

SEQ ID NO: 851457 - DNA, 25 bp, Mus musculus
tgagacaaacttatatgcatcctga

SEQ ID NO: 851458 - DNA, 25 bp, Mus musculus
tgagacaaacttttatgcatcctga

SEQ ID NO: 851459 - DNA, 25 bp, Mus musculus
tgagacaacaacaagaaacaattcg

SEQ ID NO: 851460 - DNA, 25 bp, Mus musculus
tgagacaacaactagaaacaattcg

SEQ ID NO: 851461 - DNA, 25 bp, Mus musculus
tgagacaacaatatttattcctact

SEQ ID NO: 851462 - DNA, 25 bp, Mus musculus
tgagacaacaatttttattcctact

SEQ ID NO: 851463 - DNA, 25 bp, Mus musculus
tgagacaactcaagactcccatctt

SEQ ID NO: 851464 - DNA, 25 bp, Mus musculus
tgagacaactcactatgtatgaaat

SEQ ID NO: 851465 - DNA, 25 bp, Mus musculus
tgagacaactcagtatgtatgaaat

SEQ ID NO: 851466 - DNA, 25 bp, Mus musculus
tgagacaactcatgactcccatctt

SEQ ID NO: 851467 - DNA, 25 bp, Mus musculus
tgagacaactttcactcttgggctc

SEQ ID NO: 851468 - DNA, 25 bp, Mus musculus
tgagacaactttgactcttgggctc

SEQ ID NO: 851469 - DNA, 25 bp, Mus musculus
tgagacaagcatactttccaccaat

SEQ ID NO: 851470 - DNA, 25 bp, Mus musculus
tgagacaagcattctttccaccaat

SEQ ID NO: 851471 - DNA, 25 bp, Mus musculus
tgagacaatgaaactcttcccctcc

SEQ ID NO: 851472 - DNA, 25 bp, Mus musculus
tgagacaatgaatctcttcccctcc

SEQ ID NO: 851473 - DNA, 25 bp, Mus musculus
tgagacaatgttccaagcctcacag

SEQ ID NO: 851474 - DNA, 25 bp, Mus musculus
tgagacaatgttgcaagcctcacag

SEQ ID NO: 851475 - DNA, 25 bp, Mus musculus
tgagacaattccatttccatggctg

SEQ ID NO: 851476 - DNA, 25 bp, Mus musculus
tgagacaattccttttccatggctg

SEQ ID NO: 851477 - DNA, 25 bp, Mus musculus
tgagacacaaagactaccgccagtc

SEQ ID NO: 851478 - DNA, 25 bp, Mus musculus
tgagacacaaagtctaccgccagtc

SEQ ID NO: 851479 - DNA, 25 bp, Mus musculus
tgagacacaagcacttggtgctgtc

SEQ ID NO: 851480 - DNA, 25 bp, Mus musculus
tgagacacaagctcttggtgctgtc

SEQ ID NO: 851481 - DNA, 25 bp, Mus musculus
tgagacacagatcacagagatgcct

SEQ ID NO: 851482 - DNA, 25 bp, Mus musculus
tgagacacagatgacagagatgcct

SEQ ID NO: 851483 - DNA, 25 bp, Mus musculus
tgagacacaggcaaacagactagtt

SEQ ID NO: 851484 - DNA, 25 bp, Mus musculus
tgagacacaggctaacagactagtt

SEQ ID NO: 851485 - DNA, 25 bp, Mus musculus
tgagacaccgctcgatttcgccaag

SEQ ID NO: 851486 - DNA, 25 bp, Mus musculus
tgagacaccgctggatttcgccaag

SEQ ID NO: 851487 - DNA, 25 bp, Mus musculus
tgagacacctttacagttcataccc

SEQ ID NO: 851488 - DNA, 25 bp, Mus musculus
tgagacaccttttcagttcataccc

SEQ ID NO: 851489 - DNA, 25 bp, Mus musculus
tgagacacgttccttctgaaggcga

SEQ ID NO: 851490 - DNA, 25 bp, Mus musculus
tgagacacgttcgttctgaaggcga

SEQ ID NO: 851491 - DNA, 25 bp, Mus musculus
tgagacactacgagttcccgtccta

SEQ ID NO: 851492 - DNA, 25 bp, Mus musculus
tgagacactacgtgttcccgtccta

SEQ ID NO: 851493 - DNA, 25 bp, Mus musculus
tgagacactaggacctgaagatatt

SEQ ID NO: 851494 - DNA, 25 bp, Mus musculus
tgagacactaggtcctgaagatatt

SEQ ID NO: 851495 - DNA, 25 bp, Mus musculus
tgagacactgatataccttgtaaaa

SEQ ID NO: 851496 - DNA, 25 bp, Mus musculus
tgagacactgatttaccttgtaaaa

SEQ ID NO: 851497 - DNA, 25 bp, Mus musculus
tgagacactgctcaccattcatggc

SEQ ID NO: 851498 - DNA, 25 bp, Mus musculus
tgagacactgctgaccattcatggc

SEQ ID NO: 851499 - DNA, 25 bp, Mus musculus
tgagacactgtcacagcagcttcag

SEQ ID NO: 851500 - DNA, 25 bp, Mus musculus
tgagacactgtctcagcagcttcag

SEQ ID NO: 851501 - DNA, 25 bp, Mus musculus
tgagacagaaacaccggccaggcgc

SEQ ID NO: 851502 - DNA, 25 bp, Mus musculus
tgagacagaaactccggccaggcgc

SEQ ID NO: 851503 - DNA, 25 bp, Mus musculus
tgagacagaactcagaggagcctct

SEQ ID NO: 851504 - DNA, 25 bp, Mus musculus
tgagacagaactgagaggagcctct

SEQ ID NO: 851505 - DNA, 25 bp, Mus musculus
tgagacagaagaccttgtaccagcc

SEQ ID NO: 851506 - DNA, 25 bp, Mus musculus
tgagacagaagagcttgtaccagcc

SEQ ID NO: 851507 - DNA, 25 bp, Mus musculus
tgagacagactaagtgccgctgccc

SEQ ID NO: 851508 - DNA, 25 bp, Mus musculus
tgagacagactatgtgccgctgccc

SEQ ID NO: 851509 - DNA, 25 bp, Mus musculus
tgagacagagctccgaggcccagaa

SEQ ID NO: 851510 - DNA, 25 bp, Mus musculus
tgagacagagctgcgaggcccagaa

SEQ ID NO: 851511 - DNA, 25 bp, Mus musculus
tgagacagagtcagggtcaagcctc

SEQ ID NO: 851512 - DNA, 25 bp, Mus musculus
tgagacagagtctgggtcaagcctc

SEQ ID NO: 851513 - DNA, 25 bp, Mus musculus
tgagacagatcacctgcctcttatg

SEQ ID NO: 851514 - DNA, 25 bp, Mus musculus
tgagacagatcagctgcctcttatg

SEQ ID NO: 851515 - DNA, 25 bp, Mus musculus
tgagacagatgcaccttggtgtgga

SEQ ID NO: 851516 - DNA, 25 bp, Mus musculus
tgagacagatgctccttggtgtgga

SEQ ID NO: 851517 - DNA, 25 bp, Mus musculus
tgagacagcactccagccagtgcca

SEQ ID NO: 851518 - DNA, 25 bp, Mus musculus
tgagacagcactgcagccagtgcca

SEQ ID NO: 851519 - DNA, 25 bp, Mus musculus
tgagacagcaggagtaggcttgccc

SEQ ID NO: 851520 - DNA, 25 bp, Mus musculus
tgagacagcaggtgtaggcttgccc

SEQ ID NO: 851521 - DNA, 25 bp, Mus musculus
tgagacagcctacagtgtcccagcg

SEQ ID NO: 851522 - DNA, 25 bp, Mus musculus
tgagacagcctagagtgtcccagcg

SEQ ID NO: 851523 - DNA, 25 bp, Mus musculus
tgagacagcttgacgtcctatagcc

SEQ ID NO: 851524 - DNA, 25 bp, Mus musculus
tgagacagcttgtcgtcctatagcc

SEQ ID NO: 851525 - DNA, 25 bp, Mus musculus
tgagacaggagcatcgagagttcga

SEQ ID NO: 851526 - DNA, 25 bp, Mus musculus
tgagacaggagcttcgagagttcga

SEQ ID NO: 851527 - DNA, 25 bp, Mus musculus
tgagacaggattatcagcccgggct

SEQ ID NO: 851528 - DNA, 25 bp, Mus musculus
tgagacaggattattcagtggaacc

SEQ ID NO: 851529 - DNA, 25 bp, Mus musculus
tgagacaggattttcagcccgggct

SEQ ID NO: 851530 - DNA, 25 bp, Mus musculus
tgagacaggatttttcagtggaacc

SEQ ID NO: 851531 - DNA, 25 bp, Mus musculus
tgagacaggcttctatttctaccac

SEQ ID NO: 851532 - DNA, 25 bp, Mus musculus
tgagacaggcttgtatttctaccac

SEQ ID NO: 851533 - DNA, 25 bp, Mus musculus
tgagacaggtacagtcaggctcctc

SEQ ID NO: 851534 - DNA, 25 bp, Mus musculus
tgagacaggtactgtcaggctcctc

SEQ ID NO: 851535 - DNA, 25 bp, Mus musculus
tgagacagtgctcgatcctgccgag

SEQ ID NO: 851536 - DNA, 25 bp, Mus musculus
tgagacagtgctggatcctgccgag

SEQ ID NO: 851537 - DNA, 25 bp, Mus musculus
tgagacagtgtgatcaaccttttct

SEQ ID NO: 851538 - DNA, 25 bp, Mus musculus
tgagacagtgtgttcaaccttttct

SEQ ID NO: 851539 - DNA, 25 bp, Mus musculus
tgagacatagcactgggctgtcctt

SEQ ID NO: 851540 - DNA, 25 bp, Mus musculus
tgagacatagcagtgggctgtcctt

SEQ ID NO: 851541 - DNA, 25 bp, Mus musculus
tgagacatatgcacccatgtgactg

SEQ ID NO: 851542 - DNA, 25 bp, Mus musculus
tgagacatatgctcccatgtgactg

SEQ ID NO: 851543 - DNA, 25 bp, Mus musculus
tgagacatcacaatattcatcctgt

SEQ ID NO: 851544 - DNA, 25 bp, Mus musculus
tgagacatcacattattcatcctgt

SEQ ID NO: 851545 - DNA, 25 bp, Mus musculus
tgagacatcccacaggtcggtgtat

SEQ ID NO: 851546 - DNA, 25 bp, Mus musculus
tgagacatcccagaggtcggtgtat

SEQ ID NO: 851547 - DNA, 25 bp, Mus musculus
tgagacatcgggagcatccaaccct

SEQ ID NO: 851548 - DNA, 25 bp, Mus musculus
tgagacatcgggtgcatccaaccct

SEQ ID NO: 851549 - DNA, 25 bp, Mus musculus
tgagacatctctagaacccctgaag

SEQ ID NO: 851550 - DNA, 25 bp, Mus musculus
tgagacatctcttgaacccctgaag

SEQ ID NO: 851551 - DNA, 25 bp, Mus musculus
tgagacatgagaacttcagcctccc

SEQ ID NO: 851552 - DNA, 25 bp, Mus musculus
tgagacatgagatcttcagcctccc

SEQ ID NO: 851553 - DNA, 25 bp, Mus musculus
tgagacatgctcatcagctcacaca

SEQ ID NO: 851554 - DNA, 25 bp, Mus musculus
tgagacatgctcttcagctcacaca

SEQ ID NO: 851555 - DNA, 25 bp, Mus musculus
tgagacatgtggaatcagagcccca

SEQ ID NO: 851556 - DNA, 25 bp, Mus musculus
tgagacatgtggtatcagagcccca

SEQ ID NO: 851557 - DNA, 25 bp, Mus musculus
tgagacatgttaatttgttcttcat

SEQ ID NO: 851558 - DNA, 25 bp, Mus musculus
tgagacatgttattttgttcttcat

SEQ ID NO: 851559 - DNA, 25 bp, Mus musculus
tgagacattcacagacgaccctaat

SEQ ID NO: 851560 - DNA, 25 bp, Mus musculus
tgagacattcactgacgaccctaat

SEQ ID NO: 851561 - DNA, 25 bp, Mus musculus
tgagacattttgaaggacgcctgac

SEQ ID NO: 851562 - DNA, 25 bp, Mus musculus
tgagacattttgtaggacgcctgac

SEQ ID NO: 851563 - DNA, 25 bp, Mus musculus
tgagaccaaaaacggctgtgggtca

SEQ ID NO: 851564 - DNA, 25 bp, Mus musculus
tgagaccaaaaagggctgtgggtca

SEQ ID NO: 851565 - DNA, 25 bp, Mus musculus
tgagaccaagaacttaccactgcct

SEQ ID NO: 851566 - DNA, 25 bp, Mus musculus
tgagaccaagaagttaccactgcct

SEQ ID NO: 851567 - DNA, 25 bp, Mus musculus
tgagaccaaggtagcccagagggcc

SEQ ID NO: 851568 - DNA, 25 bp, Mus musculus
tgagaccaaggttgcccagagggcc

SEQ ID NO: 851569 - DNA, 25 bp, Mus musculus
tgagaccacagcatcgtgttccagt

SEQ ID NO: 851570 - DNA, 25 bp, Mus musculus
tgagaccacagcttcgtgttccagt

SEQ ID NO: 851571 - DNA, 25 bp, Mus musculus
tgagaccacaggaatcctagacatg

SEQ ID NO: 851572 - DNA, 25 bp, Mus musculus
tgagaccacaggtatcctagacatg

SEQ ID NO: 851573 - DNA, 25 bp, Mus musculus
tgagaccaccagagacaacaggaat

SEQ ID NO: 851574 - DNA, 25 bp, Mus musculus
tgagaccaccagtgacaacaggaat

SEQ ID NO: 851575 - DNA, 25 bp, Mus musculus
tgagaccactgaaaccgtctgtcat

SEQ ID NO: 851576 - DNA, 25 bp, Mus musculus
tgagaccactgataccgtctgtcat

SEQ ID NO: 851577 - DNA, 25 bp, Mus musculus
tgagaccactggaccactctggaaa

SEQ ID NO: 851578 - DNA, 25 bp, Mus musculus
tgagaccactggtccactctggaaa

SEQ ID NO: 851579 - DNA, 25 bp, Mus musculus
tgagaccacttgcatacaacctcac

SEQ ID NO: 851580 - DNA, 25 bp, Mus musculus
tgagaccacttggatacaacctcac

SEQ ID NO: 851581 - DNA, 25 bp, Mus musculus
tgagaccagcccattcagaggcttt

SEQ ID NO: 851582 - DNA, 25 bp, Mus musculus
tgagaccagccctttcagaggcttt

SEQ ID NO: 851583 - DNA, 25 bp, Mus musculus
tgagaccagcgcagttttctctctt

SEQ ID NO: 851584 - DNA, 25 bp, Mus musculus
tgagaccagcgccttgcagcaaggt

SEQ ID NO: 851585 - DNA, 25 bp, Mus musculus
tgagaccagcgcgttgcagcaaggt

SEQ ID NO: 851586 - DNA, 25 bp, Mus musculus
tgagaccagcgctgttttctctctt

SEQ ID NO: 851587 - DNA, 25 bp, Mus musculus
tgagaccagcggctgaggcctcata

SEQ ID NO: 851588 - DNA, 25 bp, Mus musculus
tgagaccagcgggtgaggcctcata

SEQ ID NO: 851589 - DNA, 25 bp, Mus musculus
tgagaccatcccactggagcggttc

SEQ ID NO: 851590 - DNA, 25 bp, Mus musculus
tgagaccatccctctggagcggttc

SEQ ID NO: 851591 - DNA, 25 bp, Mus musculus
tgagaccatcgtcgccatatacgca

SEQ ID NO: 851592 - DNA, 25 bp, Mus musculus
tgagaccatcgtggccatatacgca

SEQ ID NO: 851593 - DNA, 25 bp, Mus musculus
tgagaccatgtccttaacttcccag

SEQ ID NO: 851594 - DNA, 25 bp, Mus musculus
tgagaccatgtcgttaacttcccag

SEQ ID NO: 851595 - DNA, 25 bp, Mus musculus
tgagaccattttcccagcatgggca

SEQ ID NO: 851596 - DNA, 25 bp, Mus musculus
tgagaccattttgccagcatgggca

SEQ ID NO: 851597 - DNA, 25 bp, Mus musculus
tgagacccaaaacctgagctccatt

SEQ ID NO: 851598 - DNA, 25 bp, Mus musculus
tgagacccaaaagctgagctccatt

SEQ ID NO: 851599 - DNA, 25 bp, Mus musculus
tgagacccaataattccatgcctta

SEQ ID NO: 851600 - DNA, 25 bp, Mus musculus
tgagacccaatatttccatgcctta

SEQ ID NO: 851601 - DNA, 25 bp, Mus musculus
tgagacccacaacttgagcaccact

SEQ ID NO: 851602 - DNA, 25 bp, Mus musculus
tgagacccacaagttgagcaccact

SEQ ID NO: 851603 - DNA, 25 bp, Mus musculus
tgagacccactcagtcaggaatcag

SEQ ID NO: 851604 - DNA, 25 bp, Mus musculus
tgagacccactccaaacatctaaag

SEQ ID NO: 851605 - DNA, 25 bp, Mus musculus
tgagacccactcgaaacatctaaag

SEQ ID NO: 851606 - DNA, 25 bp, Mus musculus
tgagacccactctgtcaggaatcag

SEQ ID NO: 851607 - DNA, 25 bp, Mus musculus
tgagacccatgtcccaggagaactt

SEQ ID NO: 851608 - DNA, 25 bp, Mus musculus
tgagacccatgtgccaggagaactt

SEQ ID NO: 851609 - DNA, 25 bp, Mus musculus
tgagaccccaaacactcttttctaa

SEQ ID NO: 851610 - DNA, 25 bp, Mus musculus
tgagaccccaaacagacacaacctg

SEQ ID NO: 851611 - DNA, 25 bp, Mus musculus
tgagaccccaaagactcttttctaa

SEQ ID NO: 851612 - DNA, 25 bp, Mus musculus
tgagaccccaaagagacacaacctg

SEQ ID NO: 851613 - DNA, 25 bp, Mus musculus
tgagaccccagacgcttacatcagc

SEQ ID NO: 851614 - DNA, 25 bp, Mus musculus
tgagaccccagaggcttacatcagc

SEQ ID NO: 851615 - DNA, 25 bp, Mus musculus
tgagaccccggccttgagctgccat

SEQ ID NO: 851616 - DNA, 25 bp, Mus musculus
tgagaccccggcgttgagctgccat

SEQ ID NO: 851617 - DNA, 25 bp, Mus musculus
tgagacccctcaaatgtactgccat

SEQ ID NO: 851618 - DNA, 25 bp, Mus musculus
tgagacccctcatatgtactgccat

SEQ ID NO: 851619 - DNA, 25 bp, Mus musculus
tgagacccctgcaaatgggacagcc

SEQ ID NO: 851620 - DNA, 25 bp, Mus musculus
tgagacccctgctaatgggacagcc

SEQ ID NO: 851621 - DNA, 25 bp, Mus musculus
tgagaccctaaaagcaaaggcatct

SEQ ID NO: 851622 - DNA, 25 bp, Mus musculus
tgagaccctaaatgcaaaggcatct

SEQ ID NO: 851623 - DNA, 25 bp, Mus musculus
tgagaccctcagagtccctaaaagg

SEQ ID NO: 851624 - DNA, 25 bp, Mus musculus
tgagaccctcagcacttaccattgt

SEQ ID NO: 851625 - DNA, 25 bp, Mus musculus
tgagaccctcaggacttaccattgt

SEQ ID NO: 851626 - DNA, 25 bp, Mus musculus
tgagaccctcagtgtccctaaaagg

SEQ ID NO: 851627 - DNA, 25 bp, Mus musculus
tgagaccctcgactgaatgcacgaa

SEQ ID NO: 851628 - DNA, 25 bp, Mus musculus
tgagaccctcgagtgaatgcacgaa

SEQ ID NO: 851629 - DNA, 25 bp, Mus musculus
tgagaccctgggagagaacacagaa

SEQ ID NO: 851630 - DNA, 25 bp, Mus musculus
tgagaccctgggtgagaacacagaa

SEQ ID NO: 851631 - DNA, 25 bp, Mus musculus
tgagaccctgtaactaaaacacaac

SEQ ID NO: 851632 - DNA, 25 bp, Mus musculus
tgagaccctgtatctaaaacacaac

SEQ ID NO: 851633 - DNA, 25 bp, Mus musculus
tgagaccctgtgatcaacaagacaa

SEQ ID NO: 851634 - DNA, 25 bp, Mus musculus
tgagaccctgtgttcaacaagacaa

SEQ ID NO: 851635 - DNA, 25 bp, Mus musculus
tgagaccctgttacaggcgtgatgg

SEQ ID NO: 851636 - DNA, 25 bp, Mus musculus
tgagaccctgttactccgttttgga

SEQ ID NO: 851637 - DNA, 25 bp, Mus musculus
tgagaccctgtttcaggcgtgatgg

SEQ ID NO: 851638 - DNA, 25 bp, Mus musculus
tgagaccctgtttctccgttttgga

SEQ ID NO: 851639 - DNA, 25 bp, Mus musculus
tgagacccttgtagtataagcacag

SEQ ID NO: 851640 - DNA, 25 bp, Mus musculus
tgagacccttgttgtataagcacag

SEQ ID NO: 851641 - DNA, 25 bp, Mus musculus
tgagaccgcaccagagtactggatt

SEQ ID NO: 851642 - DNA, 25 bp, Mus musculus
tgagaccgcacctgagtactggatt

SEQ ID NO: 851643 - DNA, 25 bp, Mus musculus
tgagaccggtaaaacattccctctt

SEQ ID NO: 851644 - DNA, 25 bp, Mus musculus
tgagaccggtaatacattccctctt

SEQ ID NO: 851645 - DNA, 25 bp, Mus musculus
tgagaccggtacatacccctataca

SEQ ID NO: 851646 - DNA, 25 bp, Mus musculus
tgagaccggtacttacccctataca

SEQ ID NO: 851647 - DNA, 25 bp, Mus musculus
tgagacctacctccaccgtataggg

SEQ ID NO: 851648 - DNA, 25 bp, Mus musculus
tgagacctacctgcaccgtataggg

SEQ ID NO: 851649 - DNA, 25 bp, Mus musculus
tgagacctacttctgccgcagtaga

SEQ ID NO: 851650 - DNA, 25 bp, Mus musculus
tgagacctacttgtgccgcagtaga

SEQ ID NO: 851651 - DNA, 25 bp, Mus musculus
tgagacctagttacagacccaccgg

SEQ ID NO: 851652 - DNA, 25 bp, Mus musculus
tgagacctagtttcagacccaccgg

SEQ ID NO: 851653 - DNA, 25 bp, Mus musculus
tgagacctcaaaaaaccatggacca

SEQ ID NO: 851654 - DNA, 25 bp, Mus musculus
tgagacctcaaacccaaggctggaa

SEQ ID NO: 851655 - DNA, 25 bp, Mus musculus
tgagacctcaaagccaaggctggaa

SEQ ID NO: 851656 - DNA, 25 bp, Mus musculus
tgagacctcaaataaccatggacca

SEQ ID NO: 851657 - DNA, 25 bp, Mus musculus
tgagacctccctcgtatccatgcag

SEQ ID NO: 851658 - DNA, 25 bp, Mus musculus
tgagacctccctggtatccatgcag

SEQ ID NO: 851659 - DNA, 25 bp, Mus musculus
tgagacctcttcacttagccccttg

SEQ ID NO: 851660 - DNA, 25 bp, Mus musculus
tgagacctcttctcttagccccttg

SEQ ID NO: 851661 - DNA, 25 bp, Mus musculus
tgagacctgagaacctagggcaggc

SEQ ID NO: 851662 - DNA, 25 bp, Mus musculus
tgagacctgagatcctagggcaggc

SEQ ID NO: 851663 - DNA, 25 bp, Mus musculus
tgagacctgaggacagcaaagcctg

SEQ ID NO: 851664 - DNA, 25 bp, Mus musculus
tgagacctgaggtcagcaaagcctg

SEQ ID NO: 851665 - DNA, 25 bp, Mus musculus
tgagacctgcacctgactgagaaag

SEQ ID NO: 851666 - DNA, 25 bp, Mus musculus
tgagacctgcacgtgactgagaaag

SEQ ID NO: 851667 - DNA, 25 bp, Mus musculus
tgagacctgcccctgtcctactggt

SEQ ID NO: 851668 - DNA, 25 bp, Mus musculus
tgagacctgcccgtgtcctactggt

SEQ ID NO: 851669 - DNA, 25 bp, Mus musculus
tgagacctgctcatccgcggaacgg

SEQ ID NO: 851670 - DNA, 25 bp, Mus musculus
tgagacctgctcttccgcggaacgg

SEQ ID NO: 851671 - DNA, 25 bp, Mus musculus
tgagacctggtcacgtcgtgggtta

SEQ ID NO: 851672 - DNA, 25 bp, Mus musculus
tgagacctggtctcgtcgtgggtta

SEQ ID NO: 851673 - DNA, 25 bp, Mus musculus
tgagacctgtctacaaatggaggca

SEQ ID NO: 851674 - DNA, 25 bp, Mus musculus
tgagacctgtcttcaaatggaggca

SEQ ID NO: 851675 - DNA, 25 bp, Mus musculus
tgagaccttaccatcctagtcatta

SEQ ID NO: 851676 - DNA, 25 bp, Mus musculus
tgagaccttaccttcctagtcatta

SEQ ID NO: 851677 - DNA, 25 bp, Mus musculus
tgagaccttatgcacctctgatatc

SEQ ID NO: 851678 - DNA, 25 bp, Mus musculus
tgagaccttatggacctctgatatc

SEQ ID NO: 851679 - DNA, 25 bp, Mus musculus
tgagaccttccaacagcatttacca

SEQ ID NO: 851680 - DNA, 25 bp, Mus musculus
tgagaccttccatcagcatttacca

SEQ ID NO: 851681 - DNA, 25 bp, Mus musculus
tgagaccttcctcctatttttccac

SEQ ID NO: 851682 - DNA, 25 bp, Mus musculus
tgagaccttcctgctatttttccac

SEQ ID NO: 851683 - DNA, 25 bp, Mus musculus
tgagaccttggaatgggctatggct

SEQ ID NO: 851684 - DNA, 25 bp, Mus musculus
tgagaccttggattgggctatggct

SEQ ID NO: 851685 - DNA, 25 bp, Mus musculus
tgagaccttgtaccaaaaacaacaa

SEQ ID NO: 851686 - DNA, 25 bp, Mus musculus
tgagaccttgtagcaaaaacaacaa

SEQ ID NO: 851687 - DNA, 25 bp, Mus musculus
tgagaccttgtcagcaaagtaaaaa

SEQ ID NO: 851688 - DNA, 25 bp, Mus musculus
tgagaccttgtctgcaaagtaaaaa

SEQ ID NO: 851689 - DNA, 25 bp, Mus musculus
tgagaccttttaccgccattggcct

SEQ ID NO: 851690 - DNA, 25 bp, Mus musculus
tgagaccttttagcgccattggcct

SEQ ID NO: 851691 - DNA, 25 bp, Mus musculus
tgagacgagcttagaacctgccatt

SEQ ID NO: 851692 - DNA, 25 bp, Mus musculus
tgagacgagctttgaacctgccatt

SEQ ID NO: 851693 - DNA, 25 bp, Mus musculus
tgagacgccaaccagaagaaagtta

SEQ ID NO: 851694 - DNA, 25 bp, Mus musculus
tgagacgccaacgagaagaaagtta

SEQ ID NO: 851695 - DNA, 25 bp, Mus musculus
tgagacgccacacgatgctatatgt

SEQ ID NO: 851696 - DNA, 25 bp, Mus musculus
tgagacgccacaggatgctatatgt

SEQ ID NO: 851697 - DNA, 25 bp, Mus musculus
tgagacgccaggacaggttcctgtg

SEQ ID NO: 851698 - DNA, 25 bp, Mus musculus
tgagacgccaggtcaggttcctgtg

SEQ ID NO: 851699 - DNA, 25 bp, Mus musculus
tgagacgcccagacaatcgagtcac

SEQ ID NO: 851700 - DNA, 25 bp, Mus musculus
tgagacgcccagtcaatcgagtcac

SEQ ID NO: 851701 - DNA, 25 bp, Mus musculus
tgagacgctcacagctgagggccgc

SEQ ID NO: 851702 - DNA, 25 bp, Mus musculus
tgagacgctcactgctgagggccgc

SEQ ID NO: 851703 - DNA, 25 bp, Mus musculus
tgagacgctctccagttggtcctgt

SEQ ID NO: 851704 - DNA, 25 bp, Mus musculus
tgagacgctctcgagttggtcctgt

SEQ ID NO: 851705 - DNA, 25 bp, Mus musculus
tgagacgctgagaggcttctccgac

SEQ ID NO: 851706 - DNA, 25 bp, Mus musculus
tgagacgctgagtggcttctccgac

SEQ ID NO: 851707 - DNA, 25 bp, Mus musculus
tgagacgctttaccgcctgcgcgcg

SEQ ID NO: 851708 - DNA, 25 bp, Mus musculus
tgagacgctttagcgcctgcgcgcg

SEQ ID NO: 851709 - DNA, 25 bp, Mus musculus
tgagacggacatcacaaaactagag

SEQ ID NO: 851710 - DNA, 25 bp, Mus musculus
tgagacggacatcgtacggcagatc

SEQ ID NO: 851711 - DNA, 25 bp, Mus musculus
tgagacggacatgacaaaactagag

SEQ ID NO: 851712 - DNA, 25 bp, Mus musculus
tgagacggacatggtacggcagatc

SEQ ID NO: 851713 - DNA, 25 bp, Mus musculus
tgagacggcttccttctccgtagat

SEQ ID NO: 851714 - DNA, 25 bp, Mus musculus
tgagacggcttcgttctccgtagat

SEQ ID NO: 851715 - DNA, 25 bp, Mus musculus
tgagacggtcacagcttagttccct

SEQ ID NO: 851716 - DNA, 25 bp, Mus musculus
tgagacggtcactgcttagttccct

SEQ ID NO: 851717 - DNA, 25 bp, Mus musculus
tgagacgtccaaccattcacctaat

SEQ ID NO: 851718 - DNA, 25 bp, Mus musculus
tgagacgtccaagcattcacctaat

SEQ ID NO: 851719 - DNA, 25 bp, Mus musculus
tgagacgtctgaaggcaggcaacca

SEQ ID NO: 851720 - DNA, 25 bp, Mus musculus
tgagacgtctgatggcaggcaacca

SEQ ID NO: 851721 - DNA, 25 bp, Mus musculus
tgagacgtggctattggagcatttt

SEQ ID NO: 851722 - DNA, 25 bp, Mus musculus
tgagacgtggcttttggagcatttt

SEQ ID NO: 851723 - DNA, 25 bp, Mus musculus
tgagacgtttctccagttcctactt

SEQ ID NO: 851724 - DNA, 25 bp, Mus musculus
tgagacgtttctgcagttcctactt

SEQ ID NO: 851725 - DNA, 25 bp, Mus musculus
tgagacgttttgacgtatccaccag

SEQ ID NO: 851726 - DNA, 25 bp, Mus musculus
tgagacgttttgtcgtatccaccag

SEQ ID NO: 851727 - DNA, 25 bp, Mus musculus
tgagactaaacacacccacctattt

SEQ ID NO: 851728 - DNA, 25 bp, Mus musculus
tgagactaaacagacccacctattt

SEQ ID NO: 851729 - DNA, 25 bp, Mus musculus
tgagactaaactcagactctgtcct

SEQ ID NO: 851730 - DNA, 25 bp, Mus musculus
tgagactaaactgagactctgtcct

SEQ ID NO: 851731 - DNA, 25 bp, Mus musculus
tgagactaacgtcatgcaccatggc

SEQ ID NO: 851732 - DNA, 25 bp, Mus musculus
tgagactaacgtgatgcaccatggc

SEQ ID NO: 851733 - DNA, 25 bp, Mus musculus
tgagactacaaaagcgggccactct

SEQ ID NO: 851734 - DNA, 25 bp, Mus musculus
tgagactacaaatgcgggccactct

SEQ ID NO: 851735 - DNA, 25 bp, Mus musculus
tgagactacaacagcaccccagaag

SEQ ID NO: 851736 - DNA, 25 bp, Mus musculus
tgagactacaactgcaccccagaag

SEQ ID NO: 851737 - DNA, 25 bp, Mus musculus
tgagactacctgaccgtgatcttta

SEQ ID NO: 851738 - DNA, 25 bp, Mus musculus
tgagactacctgtccgtgatcttta

SEQ ID NO: 851739 - DNA, 25 bp, Mus musculus
tgagactactgcagtcgcagatcct

SEQ ID NO: 851740 - DNA, 25 bp, Mus musculus
tgagactactgctgtcgcagatcct

SEQ ID NO: 851741 - DNA, 25 bp, Mus musculus
tgagactacttgcatactacagagc

SEQ ID NO: 851742 - DNA, 25 bp, Mus musculus
tgagactacttggatactacagagc

SEQ ID NO: 851743 - DNA, 25 bp, Mus musculus
tgagactagattaccctgtgtagac

SEQ ID NO: 851744 - DNA, 25 bp, Mus musculus
tgagactagatttccctgtgtagac

SEQ ID NO: 851745 - DNA, 25 bp, Mus musculus
tgagactaggacacaccagctgttg

SEQ ID NO: 851746 - DNA, 25 bp, Mus musculus
tgagactaggactcaccagctgttg

SEQ ID NO: 851747 - DNA, 25 bp, Mus musculus
tgagactcatgaaacagaccgggat

SEQ ID NO: 851748 - DNA, 25 bp, Mus musculus
tgagactcatgatacagaccgggat

SEQ ID NO: 851749 - DNA, 25 bp, Mus musculus
tgagactccacaccagactcaagga

SEQ ID NO: 851750 - DNA, 25 bp, Mus musculus
tgagactccacagcagactcaagga

SEQ ID NO: 851751 - DNA, 25 bp, Mus musculus
tgagactccaccacagtgcactgtg

SEQ ID NO: 851752 - DNA, 25 bp, Mus musculus
tgagactccacctcagtgcactgtg

SEQ ID NO: 851753 - DNA, 25 bp, Mus musculus
tgagactccgcacgtgttggcacaa

SEQ ID NO: 851754 - DNA, 25 bp, Mus musculus
tgagactccgcaggtgttggcacaa

SEQ ID NO: 851755 - DNA, 25 bp, Mus musculus
tgagactccgttcttgtatccagac

SEQ ID NO: 851756 - DNA, 25 bp, Mus musculus
tgagactccgttgttgtatccagac

SEQ ID NO: 851757 - DNA, 25 bp, Mus musculus
tgagactcctctacacctatacagg

SEQ ID NO: 851758 - DNA, 25 bp, Mus musculus
tgagactcctcttcacctatacagg

SEQ ID NO: 851759 - DNA, 25 bp, Mus musculus
tgagactcgattcggccagggccca

SEQ ID NO: 851760 - DNA, 25 bp, Mus musculus
tgagactcgattgggccagggccca

SEQ ID NO: 851761 - DNA, 25 bp, Mus musculus
tgagactcgcggcttttgtcacctt

SEQ ID NO: 851762 - DNA, 25 bp, Mus musculus
tgagactcgcgggttttgtcacctt

SEQ ID NO: 851763 - DNA, 25 bp, Mus musculus
tgagactcggaacatcatcctgccc

SEQ ID NO: 851764 - DNA, 25 bp, Mus musculus
tgagactcggaagatcatcctgccc

SEQ ID NO: 851765 - DNA, 25 bp, Mus musculus
tgagactctccaacccctgagtatc

SEQ ID NO: 851766 - DNA, 25 bp, Mus musculus
tgagactctccaagagtgaacaaac

SEQ ID NO: 851767 - DNA, 25 bp, Mus musculus
tgagactctccatcccctgagtatc

SEQ ID NO: 851768 - DNA, 25 bp, Mus musculus
tgagactctccatgagtgaacaaac

SEQ ID NO: 851769 - DNA, 25 bp, Mus musculus
tgagactctcctatcaagagcaaca

SEQ ID NO: 851770 - DNA, 25 bp, Mus musculus
tgagactctcctttcaagagcaaca

SEQ ID NO: 851771 - DNA, 25 bp, Mus musculus
tgagactctctactcttgccagggc

SEQ ID NO: 851772 - DNA, 25 bp, Mus musculus
tgagactctctagtcttgccagggc

SEQ ID NO: 851773 - DNA, 25 bp, Mus musculus
tgagactctgctcctctagttagac

SEQ ID NO: 851774 - DNA, 25 bp, Mus musculus
tgagactctgctgctctagttagac

SEQ ID NO: 851775 - DNA, 25 bp, Mus musculus
tgagactctggcagggtccctaggt

SEQ ID NO: 851776 - DNA, 25 bp, Mus musculus
tgagactctggctgggtccctaggt

SEQ ID NO: 851777 - DNA, 25 bp, Mus musculus
tgagactctgtgaggaccctgttca

SEQ ID NO: 851778 - DNA, 25 bp, Mus musculus
tgagactctgtgtggaccctgttca

SEQ ID NO: 851779 - DNA, 25 bp, Mus musculus
tgagactgaattcctgagccttctg

SEQ ID NO: 851780 - DNA, 25 bp, Mus musculus
tgagactgaattgctgagccttctg

SEQ ID NO: 851781 - DNA, 25 bp, Mus musculus
tgagactgagctcggtaggaacaca

SEQ ID NO: 851782 - DNA, 25 bp, Mus musculus
tgagactgagctgggtaggaacaca

SEQ ID NO: 851783 - DNA, 25 bp, Mus musculus
tgagactgatgcacagactgtcact

SEQ ID NO: 851784 - DNA, 25 bp, Mus musculus
tgagactgatgcacccttcgctgta

SEQ ID NO: 851785 - DNA, 25 bp, Mus musculus
tgagactgatgctcagactgtcact

SEQ ID NO: 851786 - DNA, 25 bp, Mus musculus
tgagactgatgctcccttcgctgta

SEQ ID NO: 851787 - DNA, 25 bp, Mus musculus
tgagactgctctcgttcaggcggaa

SEQ ID NO: 851788 - DNA, 25 bp, Mus musculus
tgagactgctctggttcaggcggaa

SEQ ID NO: 851789 - DNA, 25 bp, Mus musculus
tgagactgctggacacaagctccaa

SEQ ID NO: 851790 - DNA, 25 bp, Mus musculus
tgagactgctggtcacaagctccaa

SEQ ID NO: 851791 - DNA, 25 bp, Mus musculus
tgagactggagtacagaatttcctc

SEQ ID NO: 851792 - DNA, 25 bp, Mus musculus
tgagactggagttcagaatttcctc

SEQ ID NO: 851793 - DNA, 25 bp, Mus musculus
tgagactggcaacttgtctagtccc

SEQ ID NO: 851794 - DNA, 25 bp, Mus musculus
tgagactggcaagttgtctagtccc

SEQ ID NO: 851795 - DNA, 25 bp, Mus musculus
tgagactggcccacttgtgcactga

SEQ ID NO: 851796 - DNA, 25 bp, Mus musculus
tgagactggccctcttgtgcactga

SEQ ID NO: 851797 - DNA, 25 bp, Mus musculus
tgagactggtccctgacctgcctat

SEQ ID NO: 851798 - DNA, 25 bp, Mus musculus
tgagactggtccgtgacctgcctat

SEQ ID NO: 851799 - DNA, 25 bp, Mus musculus
tgagactgtaggaggactccatccc

SEQ ID NO: 851800 - DNA, 25 bp, Mus musculus
tgagactgtaggtggactccatccc

SEQ ID NO: 851801 - DNA, 25 bp, Mus musculus
tgagactgtctcataacaatcaaac

SEQ ID NO: 851802 - DNA, 25 bp, Mus musculus
tgagactgtctcttaacaatcaaac

SEQ ID NO: 851803 - DNA, 25 bp, Mus musculus
tgagactgtgtgaaccatggtttcc

SEQ ID NO: 851804 - DNA, 25 bp, Mus musculus
tgagactgtgtgtaccatggtttcc

SEQ ID NO: 851805 - DNA, 25 bp, Mus musculus
tgagactgtgttcacctgctccaat

SEQ ID NO: 851806 - DNA, 25 bp, Mus musculus
tgagactgtgttgacctgctccaat

SEQ ID NO: 851807 - DNA, 25 bp, Mus musculus
tgagactgtttcagactcatgtctg

SEQ ID NO: 851808 - DNA, 25 bp, Mus musculus
tgagactgtttctgactcatgtctg

SEQ ID NO: 851809 - DNA, 25 bp, Mus musculus
tgagacttaccactggaccaaggtg

SEQ ID NO: 851810 - DNA, 25 bp, Mus musculus
tgagacttaccagtggaccaaggtg

SEQ ID NO: 851811 - DNA, 25 bp, Mus musculus
tgagacttatcacagcattacattt

SEQ ID NO: 851812 - DNA, 25 bp, Mus musculus
tgagacttatcagagcattacattt

SEQ ID NO: 851813 - DNA, 25 bp, Mus musculus
tgagacttcaagagcctaggcagct

SEQ ID NO: 851814 - DNA, 25 bp, Mus musculus
tgagacttcaagtgcctaggcagct

SEQ ID NO: 851815 - DNA, 25 bp, Mus musculus
tgagacttcagtcgtgtcactcctg

SEQ ID NO: 851816 - DNA, 25 bp, Mus musculus
tgagacttcagtggtgtcactcctg

SEQ ID NO: 851817 - DNA, 25 bp, Mus musculus
tgagacttcctcatggtggacttgt

SEQ ID NO: 851818 - DNA, 25 bp, Mus musculus
tgagacttcctcttggtggacttgt

SEQ ID NO: 851819 - DNA, 25 bp, Mus musculus
tgagacttctcaccatcacgatgac

SEQ ID NO: 851820 - DNA, 25 bp, Mus musculus
tgagacttctcagcatcacgatgac

SEQ ID NO: 851821 - DNA, 25 bp, Mus musculus
tgagacttggctcggacaacccaga

SEQ ID NO: 851822 - DNA, 25 bp, Mus musculus
tgagacttggctgggacaacccaga

SEQ ID NO: 851823 - DNA, 25 bp, Mus musculus
tgagacttggtcattctgtatagca

SEQ ID NO: 851824 - DNA, 25 bp, Mus musculus
tgagacttggtctttctgtatagca

SEQ ID NO: 851825 - DNA, 25 bp, Mus musculus
tgagactttcatcaaggcttggttc

SEQ ID NO: 851826 - DNA, 25 bp, Mus musculus
tgagactttcatgaaggcttggttc

SEQ ID NO: 851827 - DNA, 25 bp, Mus musculus
tgagactttgggatattttcctaca

SEQ ID NO: 851828 - DNA, 25 bp, Mus musculus
tgagactttgggttattttcctaca

SEQ ID NO: 851829 - DNA, 25 bp, Mus musculus
tgagactttgtgaaccaggacttga

SEQ ID NO: 851830 - DNA, 25 bp, Mus musculus
tgagactttgtgcaccgattcctga

SEQ ID NO: 851831 - DNA, 25 bp, Mus musculus
tgagactttgtggaccgattcctga

SEQ ID NO: 851832 - DNA, 25 bp, Mus musculus
tgagactttgtgtaccaggacttga

SEQ ID NO: 851833 - DNA, 25 bp, Mus musculus
tgagagaaactgaacatgtgacaat

SEQ ID NO: 851834 - DNA, 25 bp, Mus musculus
tgagagaaactgtacatgtgacaat

SEQ ID NO: 851835 - DNA, 25 bp, Mus musculus
tgagagaaatctacatgtttatatt

SEQ ID NO: 851836 - DNA, 25 bp, Mus musculus
tgagagaaatcttcatgtttatatt

SEQ ID NO: 851837 - DNA, 25 bp, Mus musculus
tgagagaaccagcttctggcaccaa

SEQ ID NO: 851838 - DNA, 25 bp, Mus musculus
tgagagaaccaggttctggcaccaa

SEQ ID NO: 851839 - DNA, 25 bp, Mus musculus
tgagagaaccggactttgccttctg

SEQ ID NO: 851840 - DNA, 25 bp, Mus musculus
tgagagaaccggtctttgccttctg

SEQ ID NO: 851841 - DNA, 25 bp, Mus musculus
tgagagaagcggctgcgtcacatct

SEQ ID NO: 851842 - DNA, 25 bp, Mus musculus
tgagagaagcgggtgcgtcacatct

SEQ ID NO: 851843 - DNA, 25 bp, Mus musculus
tgagagaagctcagaagaccattca

SEQ ID NO: 851844 - DNA, 25 bp, Mus musculus
tgagagaagctctgaagaccattca

SEQ ID NO: 851845 - DNA, 25 bp, Mus musculus
tgagagaatactccctttcctggac

SEQ ID NO: 851846 - DNA, 25 bp, Mus musculus
tgagagaatactgcctttcctggac

SEQ ID NO: 851847 - DNA, 25 bp, Mus musculus
tgagagaatgtaatttccttggccg

SEQ ID NO: 851848 - DNA, 25 bp, Mus musculus
tgagagaatgtattttccttggccg

SEQ ID NO: 851849 - DNA, 25 bp, Mus musculus
tgagagacagctaggccccatcatt

SEQ ID NO: 851850 - DNA, 25 bp, Mus musculus
tgagagacagcttggccccatcatt

SEQ ID NO: 851851 - DNA, 25 bp, Mus musculus
tgagagacatgactgccctgacctg

SEQ ID NO: 851852 - DNA, 25 bp, Mus musculus
tgagagacatgagtgccctgacctg

SEQ ID NO: 851853 - DNA, 25 bp, Mus musculus
tgagagaccaaaccttaaggctttt

SEQ ID NO: 851854 - DNA, 25 bp, Mus musculus
tgagagaccaaagcttaaggctttt

SEQ ID NO: 851855 - DNA, 25 bp, Mus musculus
tgagagacctgcaggaaatcagtac

SEQ ID NO: 851856 - DNA, 25 bp, Mus musculus
tgagagacctgctggaaatcagtac

SEQ ID NO: 851857 - DNA, 25 bp, Mus musculus
tgagagacctttaggctccgtttac

SEQ ID NO: 851858 - DNA, 25 bp, Mus musculus
tgagagaccttttggctccgtttac

SEQ ID NO: 851859 - DNA, 25 bp, Mus musculus
tgagagacgacaactttaaaggtaa

SEQ ID NO: 851860 - DNA, 25 bp, Mus musculus
tgagagacgacatctttaaaggtaa

SEQ ID NO: 851861 - DNA, 25 bp, Mus musculus
tgagagacgcatccttggaaggctt

SEQ ID NO: 851862 - DNA, 25 bp, Mus musculus
tgagagacgcatgcttggaaggctt

SEQ ID NO: 851863 - DNA, 25 bp, Mus musculus
tgagagacgctcagaactgtagcag

SEQ ID NO: 851864 - DNA, 25 bp, Mus musculus
tgagagacgctctgaactgtagcag

SEQ ID NO: 851865 - DNA, 25 bp, Mus musculus
tgagagactcaaagcacccgtgact

SEQ ID NO: 851866 - DNA, 25 bp, Mus musculus
tgagagactcaatgcacccgtgact

SEQ ID NO: 851867 - DNA, 25 bp, Mus musculus
tgagagactgcgcatcaaggtcatc

SEQ ID NO: 851868 - DNA, 25 bp, Mus musculus
tgagagactgcggatcaaggtcatc

SEQ ID NO: 851869 - DNA, 25 bp, Mus musculus
tgagagagcactctgaacagctgga

SEQ ID NO: 851870 - DNA, 25 bp, Mus musculus
tgagagagcactgtgaacagctgga

SEQ ID NO: 851871 - DNA, 25 bp, Mus musculus
tgagagagccaacttctgggttaag

SEQ ID NO: 851872 - DNA, 25 bp, Mus musculus
tgagagagccaagttctgggttaag

SEQ ID NO: 851873 - DNA, 25 bp, Mus musculus
tgagagaggcttacccatgcccttt

SEQ ID NO: 851874 - DNA, 25 bp, Mus musculus
tgagagaggctttcccatgcccttt

SEQ ID NO: 851875 - DNA, 25 bp, Mus musculus
tgagagagggcacctggcacatcca

SEQ ID NO: 851876 - DNA, 25 bp, Mus musculus
tgagagagggcagctggcacatcca

SEQ ID NO: 851877 - DNA, 25 bp, Mus musculus
tgagagagggttcacagctacctgt

SEQ ID NO: 851878 - DNA, 25 bp, Mus musculus
tgagagagggttgacagctacctgt

SEQ ID NO: 851879 - DNA, 25 bp, Mus musculus
tgagagaggtcacattccctcgatt

SEQ ID NO: 851880 - DNA, 25 bp, Mus musculus
tgagagaggtcagattccctcgatt

SEQ ID NO: 851881 - DNA, 25 bp, Mus musculus
tgagagagtctaccccaggaagcac

SEQ ID NO: 851882 - DNA, 25 bp, Mus musculus
tgagagagtctagcccaggaagcac

SEQ ID NO: 851883 - DNA, 25 bp, Mus musculus
tgagagagtgctctgaatctctgct

SEQ ID NO: 851884 - DNA, 25 bp, Mus musculus
tgagagagtgctgtgaatctctgct

SEQ ID NO: 851885 - DNA, 25 bp, Mus musculus
tgagagatcccgagagagtaaagtc

SEQ ID NO: 851886 - DNA, 25 bp, Mus musculus
tgagagatcccgtgagagtaaagtc

SEQ ID NO: 851887 - DNA, 25 bp, Mus musculus
tgagagatctttatctcaccctctc

SEQ ID NO: 851888 - DNA, 25 bp, Mus musculus
tgagagatctttttctcaccctctc

SEQ ID NO: 851889 - DNA, 25 bp, Mus musculus
tgagagatgcctctgctctgccggc

SEQ ID NO: 851890 - DNA, 25 bp, Mus musculus
tgagagatgcctgtgctctgccggc

SEQ ID NO: 851891 - DNA, 25 bp, Mus musculus
tgagagatggctcacgtactctttg

SEQ ID NO: 851892 - DNA, 25 bp, Mus musculus
tgagagatggctgacgtactctttg

SEQ ID NO: 851893 - DNA, 25 bp, Mus musculus
tgagagatttaaccttctttaccca

SEQ ID NO: 851894 - DNA, 25 bp, Mus musculus
tgagagatttaagcttctttaccca

SEQ ID NO: 851895 - DNA, 25 bp, Mus musculus
tgagagcaagcccacttgccctggc

SEQ ID NO: 851896 - DNA, 25 bp, Mus musculus
tgagagcaagccgacttgccctggc

SEQ ID NO: 851897 - DNA, 25 bp, Mus musculus
tgagagcaagtaatgttctgttctt

SEQ ID NO: 851898 - DNA, 25 bp, Mus musculus
tgagagcaagtactggcaagaccgt

SEQ ID NO: 851899 - DNA, 25 bp, Mus musculus
tgagagcaagtagtggcaagaccgt

SEQ ID NO: 851900 - DNA, 25 bp, Mus musculus
tgagagcaagtattgttctgttctt

SEQ ID NO: 851901 - DNA, 25 bp, Mus musculus
tgagagcaagtccattccccaggaa

SEQ ID NO: 851902 - DNA, 25 bp, Mus musculus
tgagagcaagtcgattccccaggaa

SEQ ID NO: 851903 - DNA, 25 bp, Mus musculus
tgagagcacagaattacagggcatg

SEQ ID NO: 851904 - DNA, 25 bp, Mus musculus
tgagagcacagatttacagggcatg

SEQ ID NO: 851905 - DNA, 25 bp, Mus musculus
tgagagcaccttacacaccatgtaa

SEQ ID NO: 851906 - DNA, 25 bp, Mus musculus
tgagagcacctttcacaccatgtaa

SEQ ID NO: 851907 - DNA, 25 bp, Mus musculus
tgagagcagccaatatttgtcccca

SEQ ID NO: 851908 - DNA, 25 bp, Mus musculus
tgagagcagccattatttgtcccca

SEQ ID NO: 851909 - DNA, 25 bp, Mus musculus
tgagagcatcatcgaactgcacctc

SEQ ID NO: 851910 - DNA, 25 bp, Mus musculus
tgagagcatcatggaactgcacctc

SEQ ID NO: 851911 - DNA, 25 bp, Mus musculus
tgagagcatccccaactacccagtg

SEQ ID NO: 851912 - DNA, 25 bp, Mus musculus
tgagagcatcccgaactacccagtg

SEQ ID NO: 851913 - DNA, 25 bp, Mus musculus
tgagagcatttcatgcctcctattc

SEQ ID NO: 851914 - DNA, 25 bp, Mus musculus
tgagagcatttcttgcctcctattc

SEQ ID NO: 851915 - DNA, 25 bp, Mus musculus
tgagagccacataatggtgaacagt

SEQ ID NO: 851916 - DNA, 25 bp, Mus musculus
tgagagccacattatggtgaacagt

SEQ ID NO: 851917 - DNA, 25 bp, Mus musculus
tgagagccagacagtggatcttagg

SEQ ID NO: 851918 - DNA, 25 bp, Mus musculus
tgagagccagactgtggatcttagg

SEQ ID NO: 851919 - DNA, 25 bp, Mus musculus
tgagagccagccactgcatgaggta

SEQ ID NO: 851920 - DNA, 25 bp, Mus musculus
tgagagccagcctctgcatgaggta

SEQ ID NO: 851921 - DNA, 25 bp, Mus musculus
tgagagccagcgagcttcagtcaac

SEQ ID NO: 851922 - DNA, 25 bp, Mus musculus
tgagagccagcgtgcttcagtcaac

SEQ ID NO: 851923 - DNA, 25 bp, Mus musculus
tgagagccccatatcacatgcccaa

SEQ ID NO: 851924 - DNA, 25 bp, Mus musculus
tgagagccccatttcacatgcccaa

SEQ ID NO: 851925 - DNA, 25 bp, Mus musculus
tgagagccgcataggtgttggaaac

SEQ ID NO: 851926 - DNA, 25 bp, Mus musculus
tgagagccgcattggtgttggaaac

SEQ ID NO: 851927 - DNA, 25 bp, Mus musculus
tgagagccgccaccatataacctgc

SEQ ID NO: 851928 - DNA, 25 bp, Mus musculus
tgagagccgccagcatataacctgc

SEQ ID NO: 851929 - DNA, 25 bp, Mus musculus
tgagagccgctgaaccagtatcttt

SEQ ID NO: 851930 - DNA, 25 bp, Mus musculus
tgagagccgctgtaccagtatcttt

SEQ ID NO: 851931 - DNA, 25 bp, Mus musculus
tgagagccgttcagactggcagatc

SEQ ID NO: 851932 - DNA, 25 bp, Mus musculus
tgagagccgttctgactggcagatc

SEQ ID NO: 851933 - DNA, 25 bp, Mus musculus
tgagagcctaggaccgatcaatccc

SEQ ID NO: 851934 - DNA, 25 bp, Mus musculus
tgagagcctaggtccgatcaatccc

SEQ ID NO: 851935 - DNA, 25 bp, Mus musculus
tgagagcctcatcgagtcctctgtg

SEQ ID NO: 851936 - DNA, 25 bp, Mus musculus
tgagagcctcatggagtcctctgtg

SEQ ID NO: 851937 - DNA, 25 bp, Mus musculus
tgagagcctccaacggcaagtttgt

SEQ ID NO: 851938 - DNA, 25 bp, Mus musculus
tgagagcctccatcggcaagtttgt

SEQ ID NO: 851939 - DNA, 25 bp, Mus musculus
tgagagcctggccaatcctgtgctt

SEQ ID NO: 851940 - DNA, 25 bp, Mus musculus
tgagagcctggcgaatcctgtgctt

SEQ ID NO: 851941 - DNA, 25 bp, Mus musculus
tgagagccttcacggccgcagcaag

SEQ ID NO: 851942 - DNA, 25 bp, Mus musculus
tgagagccttcagggccgcagcaag

SEQ ID NO: 851943 - DNA, 25 bp, Mus musculus
tgagagccttcgatgctcttccaga

SEQ ID NO: 851944 - DNA, 25 bp, Mus musculus
tgagagccttcgttgctcttccaga

SEQ ID NO: 851945 - DNA, 25 bp, Mus musculus
tgagagccttgcagaagccctgtgg

SEQ ID NO: 851946 - DNA, 25 bp, Mus musculus
tgagagccttgctgaagccctgtgg

SEQ ID NO: 851947 - DNA, 25 bp, Mus musculus
tgagagcgatgcctggcccacctag

SEQ ID NO: 851948 - DNA, 25 bp, Mus musculus
tgagagcgatgcgtggcccacctag

SEQ ID NO: 851949 - DNA, 25 bp, Mus musculus
tgagagcgctgtcaagctcagcctt

SEQ ID NO: 851950 - DNA, 25 bp, Mus musculus
tgagagcgctgtgaagctcagcctt

SEQ ID NO: 851951 - DNA, 25 bp, Mus musculus
tgagagctaatgacaggtccctgga

SEQ ID NO: 851952 - DNA, 25 bp, Mus musculus
tgagagctaatgtcaggtccctgga

SEQ ID NO: 851953 - DNA, 25 bp, Mus musculus
tgagagctactcataccaataaaca

SEQ ID NO: 851954 - DNA, 25 bp, Mus musculus
tgagagctactcttaccaataaaca

SEQ ID NO: 851955 - DNA, 25 bp, Mus musculus
tgagagctctctccaggacttgtag

SEQ ID NO: 851956 - DNA, 25 bp, Mus musculus
tgagagctctctgcaggacttgtag

SEQ ID NO: 851957 - DNA, 25 bp, Mus musculus
tgagagctctgaagcagccagtgat

SEQ ID NO: 851958 - DNA, 25 bp, Mus musculus
tgagagctctgatgcagccagtgat

SEQ ID NO: 851959 - DNA, 25 bp, Mus musculus
tgagagctctggcagcatccctgag

SEQ ID NO: 851960 - DNA, 25 bp, Mus musculus
tgagagctctggcttccacctaaat

SEQ ID NO: 851961 - DNA, 25 bp, Mus musculus
tgagagctctgggagcatccctgag

SEQ ID NO: 851962 - DNA, 25 bp, Mus musculus
tgagagctctgggttccacctaaat

SEQ ID NO: 851963 - DNA, 25 bp, Mus musculus
tgagagctgaatcgccctgcctgtg

SEQ ID NO: 851964 - DNA, 25 bp, Mus musculus
tgagagctgaatggccctgcctgtg

SEQ ID NO: 851965 - DNA, 25 bp, Mus musculus
tgagagctgatcattccaatgccca

SEQ ID NO: 851966 - DNA, 25 bp, Mus musculus
tgagagctgatctttccaatgccca

SEQ ID NO: 851967 - DNA, 25 bp, Mus musculus
tgagagctgctcctttggataccat

SEQ ID NO: 851968 - DNA, 25 bp, Mus musculus
tgagagctgctcgtttggataccat

SEQ ID NO: 851969 - DNA, 25 bp, Mus musculus
tgagagctggccagacttagtgtca

SEQ ID NO: 851970 - DNA, 25 bp, Mus musculus
tgagagctggccaggcccttacctc

SEQ ID NO: 851971 - DNA, 25 bp, Mus musculus
tgagagctggcctgacttagtgtca

SEQ ID NO: 851972 - DNA, 25 bp, Mus musculus
tgagagctggcctggcccttacctc

SEQ ID NO: 851973 - DNA, 25 bp, Mus musculus
tgagagctgggtacagcggttcctc

SEQ ID NO: 851974 - DNA, 25 bp, Mus musculus
tgagagctgggttcagcggttcctc

SEQ ID NO: 851975 - DNA, 25 bp, Mus musculus
tgagagctggttctcaccccccttt

SEQ ID NO: 851976 - DNA, 25 bp, Mus musculus
tgagagctggttgtcaccccccttt

SEQ ID NO: 851977 - DNA, 25 bp, Mus musculus
tgagagctgtcactggcatcaaccc

SEQ ID NO: 851978 - DNA, 25 bp, Mus musculus
tgagagctgtcagtggcatcaaccc

SEQ ID NO: 851979 - DNA, 25 bp, Mus musculus
tgagagctgtcccaagtggtgtgcc

SEQ ID NO: 851980 - DNA, 25 bp, Mus musculus
tgagagctgtccgaagtggtgtgcc

SEQ ID NO: 851981 - DNA, 25 bp, Mus musculus
tgagagcttaaccaaggctgacaga

SEQ ID NO: 851982 - DNA, 25 bp, Mus musculus
tgagagcttaacgaaggctgacaga

SEQ ID NO: 851983 - DNA, 25 bp, Mus musculus
tgagagcttctcagaaaccccgtgc

SEQ ID NO: 851984 - DNA, 25 bp, Mus musculus
tgagagcttctctgaaaccccgtgc

SEQ ID NO: 851985 - DNA, 25 bp, Mus musculus
tgagagctttgcaaaggccactacc

SEQ ID NO: 851986 - DNA, 25 bp, Mus musculus
tgagagctttgctaaggccactacc

SEQ ID NO: 851987 - DNA, 25 bp, Mus musculus
tgagaggaaattacacccatcccct

SEQ ID NO: 851988 - DNA, 25 bp, Mus musculus
tgagaggaaatttcacccatcccct

SEQ ID NO: 851989 - DNA, 25 bp, Mus musculus
tgagaggaaccgcaagtttctccct

SEQ ID NO: 851990 - DNA, 25 bp, Mus musculus
tgagaggaaccggaagtttctccct

SEQ ID NO: 851991 - DNA, 25 bp, Mus musculus
tgagaggaactaacctctttgtggt

SEQ ID NO: 851992 - DNA, 25 bp, Mus musculus
tgagaggaactatcctctttgtggt

SEQ ID NO: 851993 - DNA, 25 bp, Mus musculus
tgagaggaaggcctcccaagttgaa

SEQ ID NO: 851994 - DNA, 25 bp, Mus musculus
tgagaggaaggcgtcccaagttgaa

SEQ ID NO: 851995 - DNA, 25 bp, Mus musculus
tgagaggaccctatgaccactctgg

SEQ ID NO: 851996 - DNA, 25 bp, Mus musculus
tgagaggaccctttgaccactctgg

SEQ ID NO: 851997 - DNA, 25 bp, Mus musculus
tgagaggacctcacgtgtggctgct

SEQ ID NO: 851998 - DNA, 25 bp, Mus musculus
tgagaggacctctcgtgtggctgct

SEQ ID NO: 851999 - DNA, 25 bp, Mus musculus
tgagaggacgtgagcatcccacctg

SEQ ID NO: 852000 - DNA, 25 bp, Mus musculus
tgagaggacgtgtgcatcccacctg

SEQ ID NO: 852001 - DNA, 25 bp, Mus musculus
tgagaggaggaacctggctccattt

SEQ ID NO: 852002 - DNA, 25 bp, Mus musculus
tgagaggaggaagctggctccattt

SEQ ID NO: 852003 - DNA, 25 bp, Mus musculus
tgagaggagtccacggtgagtcacc

SEQ ID NO: 852004 - DNA, 25 bp, Mus musculus
tgagaggagtcctcggtgagtcacc

SEQ ID NO: 852005 - DNA, 25 bp, Mus musculus
tgagaggatcaaatactatttatct

SEQ ID NO: 852006 - DNA, 25 bp, Mus musculus
tgagaggatcaattactatttatct

SEQ ID NO: 852007 - DNA, 25 bp, Mus musculus
tgagaggatcccacttctgtgaact

SEQ ID NO: 852008 - DNA, 25 bp, Mus musculus
tgagaggatccctcttctgtgaact

SEQ ID NO: 852009 - DNA, 25 bp, Mus musculus
tgagaggatctacccagcaactgac

SEQ ID NO: 852010 - DNA, 25 bp, Mus musculus
tgagaggatctagccagcaactgac

SEQ ID NO: 852011 - DNA, 25 bp, Mus musculus
tgagaggcaacacccatacttcatg

SEQ ID NO: 852012 - DNA, 25 bp, Mus musculus
tgagaggcaacagccatacttcatg

SEQ ID NO: 852013 - DNA, 25 bp, Mus musculus
tgagaggcaaccacttgttcttctt

SEQ ID NO: 852014 - DNA, 25 bp, Mus musculus
tgagaggcaacctcttgttcttctt

SEQ ID NO: 852015 - DNA, 25 bp, Mus musculus
tgagaggcacaaaggagttccacat

SEQ ID NO: 852016 - DNA, 25 bp, Mus musculus
tgagaggcacaatggagttccacat

SEQ ID NO: 852017 - DNA, 25 bp, Mus musculus
tgagaggcacagcatcttttcacca

SEQ ID NO: 852018 - DNA, 25 bp, Mus musculus
tgagaggcacaggatcttttcacca

SEQ ID NO: 852019 - DNA, 25 bp, Mus musculus
tgagaggcacccaagctgtttttat

SEQ ID NO: 852020 - DNA, 25 bp, Mus musculus
tgagaggcaccctagctgtttttat

SEQ ID NO: 852021 - DNA, 25 bp, Mus musculus
tgagaggccaggcatagctctctcc

SEQ ID NO: 852022 - DNA, 25 bp, Mus musculus
tgagaggccagggatagctctctcc

SEQ ID NO: 852023 - DNA, 25 bp, Mus musculus
tgagaggcctagactctgctactcc

SEQ ID NO: 852024 - DNA, 25 bp, Mus musculus
tgagaggcctagtctctgctactcc

SEQ ID NO: 852025 - DNA, 25 bp, Mus musculus
tgagaggcctgcactttgctttgct

SEQ ID NO: 852026 - DNA, 25 bp, Mus musculus
tgagaggcctgctctttgctttgct

SEQ ID NO: 852027 - DNA, 25 bp, Mus musculus
tgagaggcctgtacacaaatcacat

SEQ ID NO: 852028 - DNA, 25 bp, Mus musculus
tgagaggcctgttcacaaatcacat

SEQ ID NO: 852029 - DNA, 25 bp, Mus musculus
tgagaggctcttcctgcacctggga

SEQ ID NO: 852030 - DNA, 25 bp, Mus musculus
tgagaggctcttgctgcacctggga

SEQ ID NO: 852031 - DNA, 25 bp, Mus musculus
tgagaggctgccacactttccggag

SEQ ID NO: 852032 - DNA, 25 bp, Mus musculus
tgagaggctgcctcactttccggag

SEQ ID NO: 852033 - DNA, 25 bp, Mus musculus
tgagaggctggcaatggtctgtcct

SEQ ID NO: 852034 - DNA, 25 bp, Mus musculus
tgagaggctggctatggtctgtcct

SEQ ID NO: 852035 - DNA, 25 bp, Mus musculus
tgagagggaacgacgtcgggaccga

SEQ ID NO: 852036 - DNA, 25 bp, Mus musculus
tgagagggaacgtcgtcgggaccga

SEQ ID NO: 852037 - DNA, 25 bp, Mus musculus
tgagagggagtcactcctaggccag

SEQ ID NO: 852038 - DNA, 25 bp, Mus musculus
tgagagggagtctctcctaggccag

SEQ ID NO: 852039 - DNA, 25 bp, Mus musculus
tgagagggcctccaaagccaaagcc

SEQ ID NO: 852040 - DNA, 25 bp, Mus musculus
tgagagggcctcgaaagccaaagcc

SEQ ID NO: 852041 - DNA, 25 bp, Mus musculus
tgagagggcttcatgtgacctcgat

SEQ ID NO: 852042 - DNA, 25 bp, Mus musculus
tgagagggcttcttgtgacctcgat

SEQ ID NO: 852043 - DNA, 25 bp, Mus musculus
tgagagggtccaagcagtcacaggc

SEQ ID NO: 852044 - DNA, 25 bp, Mus musculus
tgagagggtccatgcagtcacaggc

SEQ ID NO: 852045 - DNA, 25 bp, Mus musculus
tgagaggtaaccagcaagaccaatg

SEQ ID NO: 852046 - DNA, 25 bp, Mus musculus
tgagaggtaacctgcaagaccaatg

SEQ ID NO: 852047 - DNA, 25 bp, Mus musculus
tgagaggtcataaagcagcagcagt

SEQ ID NO: 852048 - DNA, 25 bp, Mus musculus
tgagaggtcatatagcagcagcagt

SEQ ID NO: 852049 - DNA, 25 bp, Mus musculus
tgagaggtcctcaaggctctactta

SEQ ID NO: 852050 - DNA, 25 bp, Mus musculus
tgagaggtcctcacagatctgctct

SEQ ID NO: 852051 - DNA, 25 bp, Mus musculus
tgagaggtcctctaggctctactta

SEQ ID NO: 852052 - DNA, 25 bp, Mus musculus
tgagaggtcctctcagatctgctct

SEQ ID NO: 852053 - DNA, 25 bp, Mus musculus
tgagaggtctaacggaattaaccgt

SEQ ID NO: 852054 - DNA, 25 bp, Mus musculus
tgagaggtctaagggaattaaccgt

SEQ ID NO: 852055 - DNA, 25 bp, Mus musculus
tgagaggtctgcatattccgtccga

SEQ ID NO: 852056 - DNA, 25 bp, Mus musculus
tgagaggtctgcttattccgtccga

SEQ ID NO: 852057 - DNA, 25 bp, Mus musculus
tgagaggtgacacacagcctcgtgt

SEQ ID NO: 852058 - DNA, 25 bp, Mus musculus
tgagaggtgacagacagcctcgtgt

SEQ ID NO: 852059 - DNA, 25 bp, Mus musculus
tgagaggtggttcccatttccttac

SEQ ID NO: 852060 - DNA, 25 bp, Mus musculus
tgagaggtggttgccatttccttac

SEQ ID NO: 852061 - DNA, 25 bp, Mus musculus
tgagaggtgtcccagatcttgtact

SEQ ID NO: 852062 - DNA, 25 bp, Mus musculus
tgagaggtgtccgagatcttgtact

SEQ ID NO: 852063 - DNA, 25 bp, Mus musculus
tgagaggttctacgcttgtcccttg

SEQ ID NO: 852064 - DNA, 25 bp, Mus musculus
tgagaggttctaggcttgtcccttg

SEQ ID NO: 852065 - DNA, 25 bp, Mus musculus
tgagaggttctcaagacattcccac

SEQ ID NO: 852066 - DNA, 25 bp, Mus musculus
tgagaggttctctagacattcccac

SEQ ID NO: 852067 - DNA, 25 bp, Mus musculus
tgagaggtttgcaaagtccagggta

SEQ ID NO: 852068 - DNA, 25 bp, Mus musculus
tgagaggtttgctaagtccagggta

SEQ ID NO: 852069 - DNA, 25 bp, Mus musculus
tgagagtaaattattcttgtcctga

SEQ ID NO: 852070 - DNA, 25 bp, Mus musculus
tgagagtaaatttttcttgtcctga

SEQ ID NO: 852071 - DNA, 25 bp, Mus musculus
tgagagtaccacctctgatgcttca

SEQ ID NO: 852072 - DNA, 25 bp, Mus musculus
tgagagtaccacgtctgatgcttca

SEQ ID NO: 852073 - DNA, 25 bp, Mus musculus
tgagagtactcgagtgcatgtgtgt

SEQ ID NO: 852074 - DNA, 25 bp, Mus musculus
tgagagtactcgtgtgcatgtgtgt

SEQ ID NO: 852075 - DNA, 25 bp, Mus musculus
tgagagtactggctgtctcctttac

SEQ ID NO: 852076 - DNA, 25 bp, Mus musculus
tgagagtactgggtgtctcctttac

SEQ ID NO: 852077 - DNA, 25 bp, Mus musculus
tgagagtaggtgacccgcctcagaa

SEQ ID NO: 852078 - DNA, 25 bp, Mus musculus
tgagagtaggtgtcccgcctcagaa

SEQ ID NO: 852079 - DNA, 25 bp, Mus musculus
tgagagtagtggcaactcccgacct

SEQ ID NO: 852080 - DNA, 25 bp, Mus musculus
tgagagtagtgggaactcccgacct

SEQ ID NO: 852081 - DNA, 25 bp, Mus musculus
tgagagtatctactgcctttattac

SEQ ID NO: 852082 - DNA, 25 bp, Mus musculus
tgagagtatctagtgcctttattac

SEQ ID NO: 852083 - DNA, 25 bp, Mus musculus
tgagagtattcaccagcgagtcccc

SEQ ID NO: 852084 - DNA, 25 bp, Mus musculus
tgagagtattcagcagcgagtcccc

SEQ ID NO: 852085 - DNA, 25 bp, Mus musculus
tgagagtcaccacttcagcccagtg

SEQ ID NO: 852086 - DNA, 25 bp, Mus musculus
tgagagtcaccagttcagcccagtg

SEQ ID NO: 852087 - DNA, 25 bp, Mus musculus
tgagagtcacctatccaggcgggcc

SEQ ID NO: 852088 - DNA, 25 bp, Mus musculus
tgagagtcacctttccaggcgggcc

SEQ ID NO: 852089 - DNA, 25 bp, Mus musculus
tgagagtcattgactttgtgttctc

SEQ ID NO: 852090 - DNA, 25 bp, Mus musculus
tgagagtcattgtctttgtgttctc

SEQ ID NO: 852091 - DNA, 25 bp, Mus musculus
tgagagtccctgacatagggtcctg

SEQ ID NO: 852092 - DNA, 25 bp, Mus musculus
tgagagtccctgtcatagggtcctg

SEQ ID NO: 852093 - DNA, 25 bp, Mus musculus
tgagagtccggacaagtcttcgtca

SEQ ID NO: 852094 - DNA, 25 bp, Mus musculus
tgagagtccggagaagtcttcgtca

SEQ ID NO: 852095 - DNA, 25 bp, Mus musculus
tgagagtcctggagccctgtctaga

SEQ ID NO: 852096 - DNA, 25 bp, Mus musculus
tgagagtcctggtgccctgtctaga

SEQ ID NO: 852097 - DNA, 25 bp, Mus musculus
tgagagtcgccaagaggtcctgcct

SEQ ID NO: 852098 - DNA, 25 bp, Mus musculus
tgagagtcgccatgaggtcctgcct

SEQ ID NO: 852099 - DNA, 25 bp, Mus musculus
tgagagtcgccgagcagatatactt

SEQ ID NO: 852100 - DNA, 25 bp, Mus musculus
tgagagtcgccgtgcagatatactt

SEQ ID NO: 852101 - DNA, 25 bp, Mus musculus
tgagagtcgcttaaatcatctgcgt

SEQ ID NO: 852102 - DNA, 25 bp, Mus musculus
tgagagtcgctttaatcatctgcgt

SEQ ID NO: 852103 - DNA, 25 bp, Mus musculus
tgagagtctcccagggagtcactcc

SEQ ID NO: 852104 - DNA, 25 bp, Mus musculus
tgagagtctccctgggagtcactcc

SEQ ID NO: 852105 - DNA, 25 bp, Mus musculus
tgagagtctctcctgtcttcaagtg

SEQ ID NO: 852106 - DNA, 25 bp, Mus musculus
tgagagtctctcgtgtcttcaagtg

SEQ ID NO: 852107 - DNA, 25 bp, Mus musculus
tgagagtcttaacgtctcttccttc

SEQ ID NO: 852108 - DNA, 25 bp, Mus musculus
tgagagtcttaaggtctcttccttc

SEQ ID NO: 852109 - DNA, 25 bp, Mus musculus
tgagagtcttcaccgggccctgaca

SEQ ID NO: 852110 - DNA, 25 bp, Mus musculus
tgagagtcttcagcgggccctgaca

SEQ ID NO: 852111 - DNA, 25 bp, Mus musculus
tgagagtgaccactaccgtctgcgg

SEQ ID NO: 852112 - DNA, 25 bp, Mus musculus
tgagagtgaccagtaccgtctgcgg

SEQ ID NO: 852113 - DNA, 25 bp, Mus musculus
tgagagtgatttctcttcctcctta

SEQ ID NO: 852114 - DNA, 25 bp, Mus musculus
tgagagtgatttgtcttcctcctta

SEQ ID NO: 852115 - DNA, 25 bp, Mus musculus
tgagagtgcacacgacactgatcca

SEQ ID NO: 852116 - DNA, 25 bp, Mus musculus
tgagagtgcacaggacactgatcca

SEQ ID NO: 852117 - DNA, 25 bp, Mus musculus
tgagagtgccagaatgcctgtcctc

SEQ ID NO: 852118 - DNA, 25 bp, Mus musculus
tgagagtgccagtatgcctgtcctc

SEQ ID NO: 852119 - DNA, 25 bp, Mus musculus
tgagagtgcctcagaactctgctga

SEQ ID NO: 852120 - DNA, 25 bp, Mus musculus
tgagagtgcctcattctgatattcc

SEQ ID NO: 852121 - DNA, 25 bp, Mus musculus
tgagagtgcctctgaactctgctga

SEQ ID NO: 852122 - DNA, 25 bp, Mus musculus
tgagagtgcctctttctgatattcc

SEQ ID NO: 852123 - DNA, 25 bp, Mus musculus
tgagagtgctcgaagcccctagctt

SEQ ID NO: 852124 - DNA, 25 bp, Mus musculus
tgagagtgctcgagtttccccgagt

SEQ ID NO: 852125 - DNA, 25 bp, Mus musculus
tgagagtgctcgtagcccctagctt

SEQ ID NO: 852126 - DNA, 25 bp, Mus musculus
tgagagtgctcgtgtttccccgagt

SEQ ID NO: 852127 - DNA, 25 bp, Mus musculus
tgagagtggccaaagcagtccaggc

SEQ ID NO: 852128 - DNA, 25 bp, Mus musculus
tgagagtggccatagcagtccaggc

SEQ ID NO: 852129 - DNA, 25 bp, Mus musculus
tgagagtggtggacccagtgttcat

SEQ ID NO: 852130 - DNA, 25 bp, Mus musculus
tgagagtggtggtcccagtgttcat

SEQ ID NO: 852131 - DNA, 25 bp, Mus musculus
tgagagtgttgtcatctatccagat

SEQ ID NO: 852132 - DNA, 25 bp, Mus musculus
tgagagtgttgtgatctatccagat

SEQ ID NO: 852133 - DNA, 25 bp, Mus musculus
tgagagtttctcattcctcaaccgg

SEQ ID NO: 852134 - DNA, 25 bp, Mus musculus
tgagagtttctctttcctcaaccgg

SEQ ID NO: 852135 - DNA, 25 bp, Mus musculus
tgagagttttacaccctgatccgaa

SEQ ID NO: 852136 - DNA, 25 bp, Mus musculus
tgagagttttactccctgatccgaa

SEQ ID NO: 852137 - DNA, 25 bp, Mus musculus
tgagagttttcaacgaccacggcaa

SEQ ID NO: 852138 - DNA, 25 bp, Mus musculus
tgagagttttcaagagacccagcag

SEQ ID NO: 852139 - DNA, 25 bp, Mus musculus
tgagagttttcatcgaccacggcaa

SEQ ID NO: 852140 - DNA, 25 bp, Mus musculus
tgagagttttcatgagacccagcag

SEQ ID NO: 852141 - DNA, 25 bp, Mus musculus
tgagagttttttcacaacctgtttt

SEQ ID NO: 852142 - DNA, 25 bp, Mus musculus
tgagagttttttgacaacctgtttt

SEQ ID NO: 852143 - DNA, 25 bp, Mus musculus
tgagataaacttaactccttttggg

SEQ ID NO: 852144 - DNA, 25 bp, Mus musculus
tgagataaactttactccttttggg

SEQ ID NO: 852145 - DNA, 25 bp, Mus musculus
tgagataacccgaccttgatttttc

SEQ ID NO: 852146 - DNA, 25 bp, Mus musculus
tgagataacccgtccttgatttttc

SEQ ID NO: 852147 - DNA, 25 bp, Mus musculus
tgagataactcaccactgtccaaag

SEQ ID NO: 852148 - DNA, 25 bp, Mus musculus
tgagataactcagcactgtccaaag

SEQ ID NO: 852149 - DNA, 25 bp, Mus musculus
tgagataacttgcacctgagtgaca

SEQ ID NO: 852150 - DNA, 25 bp, Mus musculus
tgagataacttggacctgagtgaca

SEQ ID NO: 852151 - DNA, 25 bp, Mus musculus
tgagataagaacacccctttcggga

SEQ ID NO: 852152 - DNA, 25 bp, Mus musculus
tgagataagaactcccctttcggga

SEQ ID NO: 852153 - DNA, 25 bp, Mus musculus
tgagataataatcccttcctaccct

SEQ ID NO: 852154 - DNA, 25 bp, Mus musculus
tgagataataatgccttcctaccct

SEQ ID NO: 852155 - DNA, 25 bp, Mus musculus
tgagatacactcacgtgttcctgtc

SEQ ID NO: 852156 - DNA, 25 bp, Mus musculus
tgagatacactctcgtgttcctgtc

SEQ ID NO: 852157 - DNA, 25 bp, Mus musculus
tgagatactcacacctgtcgagtgt

SEQ ID NO: 852158 - DNA, 25 bp, Mus musculus
tgagatactcactcctgtcgagtgt

SEQ ID NO: 852159 - DNA, 25 bp, Mus musculus
tgagatacttacagctcgtgacggg

SEQ ID NO: 852160 - DNA, 25 bp, Mus musculus
tgagatacttactgctcgtgacggg

SEQ ID NO: 852161 - DNA, 25 bp, Mus musculus
tgagatactttcaagcagagtgttt

SEQ ID NO: 852162 - DNA, 25 bp, Mus musculus
tgagatactttctagcagagtgttt

SEQ ID NO: 852163 - DNA, 25 bp, Mus musculus
tgagatagcacacatggcccatcct

SEQ ID NO: 852164 - DNA, 25 bp, Mus musculus
tgagatagcacagatggcccatcct

SEQ ID NO: 852165 - DNA, 25 bp, Mus musculus
tgagatagccccactgacagcaacc

SEQ ID NO: 852166 - DNA, 25 bp, Mus musculus
tgagatagcccctctgacagcaacc

SEQ ID NO: 852167 - DNA, 25 bp, Mus musculus
tgagatagcgcccactcaggagact

SEQ ID NO: 852168 - DNA, 25 bp, Mus musculus
tgagatagcgccgactcaggagact

SEQ ID NO: 852169 - DNA, 25 bp, Mus musculus
tgagataggagaccatccgccctcc

SEQ ID NO: 852170 - DNA, 25 bp, Mus musculus
tgagataggagagcatccgccctcc

SEQ ID NO: 852171 - DNA, 25 bp, Mus musculus
tgagatatatccctagaccaacata

SEQ ID NO: 852172 - DNA, 25 bp, Mus musculus
tgagatatatccgtagaccaacata

SEQ ID NO: 852173 - DNA, 25 bp, Mus musculus
tgagatatcccgagtctcatcctaa

SEQ ID NO: 852174 - DNA, 25 bp, Mus musculus
tgagatatcccgtgtctcatcctaa

SEQ ID NO: 852175 - DNA, 25 bp, Mus musculus
tgagatattccccagacacgtcctg

SEQ ID NO: 852176 - DNA, 25 bp, Mus musculus
tgagatattcccgagacacgtcctg

SEQ ID NO: 852177 - DNA, 25 bp, Mus musculus
tgagatcaacaactctcccagggag

SEQ ID NO: 852178 - DNA, 25 bp, Mus musculus
tgagatcaacaagtctcccagggag

SEQ ID NO: 852179 - DNA, 25 bp, Mus musculus
tgagatcaagggaaccgctgactct

SEQ ID NO: 852180 - DNA, 25 bp, Mus musculus
tgagatcaagggtaccgctgactct

SEQ ID NO: 852181 - DNA, 25 bp, Mus musculus
tgagatcaatgacgcctttgcaagt

SEQ ID NO: 852182 - DNA, 25 bp, Mus musculus
tgagatcaatgaggcctttgcaagt

SEQ ID NO: 852183 - DNA, 25 bp, Mus musculus
tgagatcaatgtcggattccctttg

SEQ ID NO: 852184 - DNA, 25 bp, Mus musculus
tgagatcaatgtgggattccctttg

SEQ ID NO: 852185 - DNA, 25 bp, Mus musculus
tgagatcacaatcaagtcctgggaa

SEQ ID NO: 852186 - DNA, 25 bp, Mus musculus
tgagatcacaatgaagtcctgggaa

SEQ ID NO: 852187 - DNA, 25 bp, Mus musculus
tgagatcacaggcatgtttcagcat

SEQ ID NO: 852188 - DNA, 25 bp, Mus musculus
tgagatcacagggatgtttcagcat

SEQ ID NO: 852189 - DNA, 25 bp, Mus musculus
tgagatcagatgaacctagtgcttt

SEQ ID NO: 852190 - DNA, 25 bp, Mus musculus
tgagatcagatgtacctagtgcttt

SEQ ID NO: 852191 - DNA, 25 bp, Mus musculus
tgagatcagcttagggttacacagt

SEQ ID NO: 852192 - DNA, 25 bp, Mus musculus
tgagatcagctttgggttacacagt

SEQ ID NO: 852193 - DNA, 25 bp, Mus musculus
tgagatcagggcatggaccttagcc

SEQ ID NO: 852194 - DNA, 25 bp, Mus musculus
tgagatcagggcttggaccttagcc

SEQ ID NO: 852195 - DNA, 25 bp, Mus musculus
tgagatcagtggagtacaatgtgct

SEQ ID NO: 852196 - DNA, 25 bp, Mus musculus
tgagatcagtggtgtacaatgtgct

SEQ ID NO: 852197 - DNA, 25 bp, Mus musculus
tgagatcatgagaggccggacagac

SEQ ID NO: 852198 - DNA, 25 bp, Mus musculus
tgagatcatgagtggccggacagac

SEQ ID NO: 852199 - DNA, 25 bp, Mus musculus
tgagatcatggtaccttacaggcaa

SEQ ID NO: 852200 - DNA, 25 bp, Mus musculus
tgagatcatggttccttacaggcaa

SEQ ID NO: 852201 - DNA, 25 bp, Mus musculus
tgagatccaaagacagagctgtagg

SEQ ID NO: 852202 - DNA, 25 bp, Mus musculus
tgagatccaaagtcagagctgtagg

SEQ ID NO: 852203 - DNA, 25 bp, Mus musculus
tgagatccaacaccgtatgcagcgc

SEQ ID NO: 852204 - DNA, 25 bp, Mus musculus
tgagatccaacagcgtatgcagcgc

SEQ ID NO: 852205 - DNA, 25 bp, Mus musculus
tgagatccaattataacaaccaaac

SEQ ID NO: 852206 - DNA, 25 bp, Mus musculus
tgagatccaattttaacaaccaaac

SEQ ID NO: 852207 - DNA, 25 bp, Mus musculus
tgagatccatccactatcaagaagt

SEQ ID NO: 852208 - DNA, 25 bp, Mus musculus
tgagatccatcctctatcaagaagt

SEQ ID NO: 852209 - DNA, 25 bp, Mus musculus
tgagatccatgcacaggacccacat

SEQ ID NO: 852210 - DNA, 25 bp, Mus musculus
tgagatccatgctcaggacccacat

SEQ ID NO: 852211 - DNA, 25 bp, Mus musculus
tgagatcccatactccatctcaaga

SEQ ID NO: 852212 - DNA, 25 bp, Mus musculus
tgagatcccatagtccatctcaaga

SEQ ID NO: 852213 - DNA, 25 bp, Mus musculus
tgagatccctatagcttgtgcttca

SEQ ID NO: 852214 - DNA, 25 bp, Mus musculus
tgagatccctattgcttgtgcttca

SEQ ID NO: 852215 - DNA, 25 bp, Mus musculus
tgagatccctcccatcaggataaag

SEQ ID NO: 852216 - DNA, 25 bp, Mus musculus
tgagatccctccgatcaggataaag

SEQ ID NO: 852217 - DNA, 25 bp, Mus musculus
tgagatccgcgcagacaagcacaac

SEQ ID NO: 852218 - DNA, 25 bp, Mus musculus
tgagatccgcgctgacaagcacaac

SEQ ID NO: 852219 - DNA, 25 bp, Mus musculus
tgagatcctattccagccaaatgca

SEQ ID NO: 852220 - DNA, 25 bp, Mus musculus
tgagatcctattgcagccaaatgca

SEQ ID NO: 852221 - DNA, 25 bp, Mus musculus
tgagatcctcaaagaattaacaagt

SEQ ID NO: 852222 - DNA, 25 bp, Mus musculus
tgagatcctcaatgaattaacaagt

SEQ ID NO: 852223 - DNA, 25 bp, Mus musculus
tgagatcctcacagctctgatgcta

SEQ ID NO: 852224 - DNA, 25 bp, Mus musculus
tgagatcctcactgctctgatgcta

SEQ ID NO: 852225 - DNA, 25 bp, Mus musculus
tgagatcctggactttgccctcagc

SEQ ID NO: 852226 - DNA, 25 bp, Mus musculus
tgagatcctggagtttgccctcagc

SEQ ID NO: 852227 - DNA, 25 bp, Mus musculus
tgagatcctggtcaccgaagatcat

SEQ ID NO: 852228 - DNA, 25 bp, Mus musculus
tgagatcctggtgaccgaagatcat

SEQ ID NO: 852229 - DNA, 25 bp, Mus musculus
tgagatcgagtaagccatggcctac

SEQ ID NO: 852230 - DNA, 25 bp, Mus musculus
tgagatcgagtatgccatggcctac

SEQ ID NO: 852231 - DNA, 25 bp, Mus musculus
tgagatcggcgaaggagcagagctg

SEQ ID NO: 852232 - DNA, 25 bp, Mus musculus
tgagatcggcgatggagcagagctg

SEQ ID NO: 852233 - DNA, 25 bp, Mus musculus
tgagatcgtcagcaggcctgtccca

SEQ ID NO: 852234 - DNA, 25 bp, Mus musculus
tgagatcgtcaggaggcctgtccca

SEQ ID NO: 852235 - DNA, 25 bp, Mus musculus
tgagatcgtctcaggtcaacttaca

SEQ ID NO: 852236 - DNA, 25 bp, Mus musculus
tgagatcgtctctggtcaacttaca

SEQ ID NO: 852237 - DNA, 25 bp, Mus musculus
tgagatctaccgcatcatctttgac

SEQ ID NO: 852238 - DNA, 25 bp, Mus musculus
tgagatctaccggatcatctttgac

SEQ ID NO: 852239 - DNA, 25 bp, Mus musculus
tgagatctcacactgctaggcacgc

SEQ ID NO: 852240 - DNA, 25 bp, Mus musculus
tgagatctcacagtgctaggcacgc

SEQ ID NO: 852241 - DNA, 25 bp, Mus musculus
tgagatctcagcaatcacctttcta

SEQ ID NO: 852242 - DNA, 25 bp, Mus musculus
tgagatctcagctatcacctttcta

SEQ ID NO: 852243 - DNA, 25 bp, Mus musculus
tgagatctctttagtgctctgcaag

SEQ ID NO: 852244 - DNA, 25 bp, Mus musculus
tgagatctcttttgtgctctgcaag

SEQ ID NO: 852245 - DNA, 25 bp, Mus musculus
tgagatctgaacatgcaccatttgc

SEQ ID NO: 852246 - DNA, 25 bp, Mus musculus
tgagatctgaacttgcaccatttgc

SEQ ID NO: 852247 - DNA, 25 bp, Mus musculus
tgagatctgccacttcttatacctc

SEQ ID NO: 852248 - DNA, 25 bp, Mus musculus
tgagatctgccagttcttatacctc

SEQ ID NO: 852249 - DNA, 25 bp, Mus musculus
tgagatctgggcagatttcacttcc

SEQ ID NO: 852250 - DNA, 25 bp, Mus musculus
tgagatctgggctgatttcacttcc

SEQ ID NO: 852251 - DNA, 25 bp, Mus musculus
tgagatcttatcagtttcaccacca

SEQ ID NO: 852252 - DNA, 25 bp, Mus musculus
tgagatcttatctgtttcaccacca

SEQ ID NO: 852253 - DNA, 25 bp, Mus musculus
tgagatcttatgcaccttctccatc

SEQ ID NO: 852254 - DNA, 25 bp, Mus musculus
tgagatcttatggaccttctccatc

SEQ ID NO: 852255 - DNA, 25 bp, Mus musculus
tgagatcttctacacactgtctcct

SEQ ID NO: 852256 - DNA, 25 bp, Mus musculus
tgagatcttctagacactgtctcct

SEQ ID NO: 852257 - DNA, 25 bp, Mus musculus
tgagatcttgcaccctcaagttgct

SEQ ID NO: 852258 - DNA, 25 bp, Mus musculus
tgagatcttgcagcctcaagttgct

SEQ ID NO: 852259 - DNA, 25 bp, Mus musculus
tgagatgaaatgcttcgcagatcgg

SEQ ID NO: 852260 - DNA, 25 bp, Mus musculus
tgagatgaaatggttcgcagatcgg

SEQ ID NO: 852261 - DNA, 25 bp, Mus musculus
tgagatgaagacctgccgctgtgaa

SEQ ID NO: 852262 - DNA, 25 bp, Mus musculus
tgagatgaagacgtgccgctgtgaa

SEQ ID NO: 852263 - DNA, 25 bp, Mus musculus
tgagatgaagatacccgggcagcaa

SEQ ID NO: 852264 - DNA, 25 bp, Mus musculus
tgagatgaagattcccgggcagcaa

SEQ ID NO: 852265 - DNA, 25 bp, Mus musculus
tgagatgacagcattttgcggcccc

SEQ ID NO: 852266 - DNA, 25 bp, Mus musculus
tgagatgacagctttttgcggcccc

SEQ ID NO: 852267 - DNA, 25 bp, Mus musculus
tgagatgacatcactagtggcctgt

SEQ ID NO: 852268 - DNA, 25 bp, Mus musculus
tgagatgacatctctagtggcctgt

SEQ ID NO: 852269 - DNA, 25 bp, Mus musculus
tgagatgacccacacactgacaagt

SEQ ID NO: 852270 - DNA, 25 bp, Mus musculus
tgagatgacccagacactgacaagt

SEQ ID NO: 852271 - DNA, 25 bp, Mus musculus
tgagatgagacacagttagcccaga

SEQ ID NO: 852272 - DNA, 25 bp, Mus musculus
tgagatgagacagagttagcccaga

SEQ ID NO: 852273 - DNA, 25 bp, Mus musculus
tgagatgagaccaatgtccccattg

SEQ ID NO: 852274 - DNA, 25 bp, Mus musculus
tgagatgagacctatgtccccattg

SEQ ID NO: 852275 - DNA, 25 bp, Mus musculus
tgagatgagatgcttgtggcacaca

SEQ ID NO: 852276 - DNA, 25 bp, Mus musculus
tgagatgagatggttgtggcacaca

SEQ ID NO: 852277 - DNA, 25 bp, Mus musculus
tgagatgagcaccaaccagtccaga

SEQ ID NO: 852278 - DNA, 25 bp, Mus musculus
tgagatgagcacgaaccagtccaga

SEQ ID NO: 852279 - DNA, 25 bp, Mus musculus
tgagatgagggcatcctggactgca

SEQ ID NO: 852280 - DNA, 25 bp, Mus musculus
tgagatgagggcttcctggactgca

SEQ ID NO: 852281 - DNA, 25 bp, Mus musculus
tgagatgagtctccccactctggcg

SEQ ID NO: 852282 - DNA, 25 bp, Mus musculus
tgagatgagtctgcccactctggcg

SEQ ID NO: 852283 - DNA, 25 bp, Mus musculus
tgagatgagtgaatggaaaacctgg

SEQ ID NO: 852284 - DNA, 25 bp, Mus musculus
tgagatgagtgattggaaaacctgg

SEQ ID NO: 852285 - DNA, 25 bp, Mus musculus
tgagatgatccgagaggccgacatt

SEQ ID NO: 852286 - DNA, 25 bp, Mus musculus
tgagatgatccgtgaggccgacatt

SEQ ID NO: 852287 - DNA, 25 bp, Mus musculus
tgagatgattcccactcatcactga

SEQ ID NO: 852288 - DNA, 25 bp, Mus musculus
tgagatgattccgactcatcactga

SEQ ID NO: 852289 - DNA, 25 bp, Mus musculus
tgagatgcagacaaaggccccactt

SEQ ID NO: 852290 - DNA, 25 bp, Mus musculus
tgagatgcagactaaggccccactt

SEQ ID NO: 852291 - DNA, 25 bp, Mus musculus
tgagatgcataactgattaaccttt

SEQ ID NO: 852292 - DNA, 25 bp, Mus musculus
tgagatgcataagtgattaaccttt

SEQ ID NO: 852293 - DNA, 25 bp, Mus musculus
tgagatgcccctatataagacatta

SEQ ID NO: 852294 - DNA, 25 bp, Mus musculus
tgagatgcccctttataagacatta

SEQ ID NO: 852295 - DNA, 25 bp, Mus musculus
tgagatgcgagtacgctgtgcgccc

SEQ ID NO: 852296 - DNA, 25 bp, Mus musculus
tgagatgcgagttcgctgtgcgccc

SEQ ID NO: 852297 - DNA, 25 bp, Mus musculus
tgagatgctcatcgtccctgtgtca

SEQ ID NO: 852298 - DNA, 25 bp, Mus musculus
tgagatgctcatggtccctgtgtca

SEQ ID NO: 852299 - DNA, 25 bp, Mus musculus
tgagatgctgacaaccttgggaaca

SEQ ID NO: 852300 - DNA, 25 bp, Mus musculus
tgagatgctgactaccttgggaaca

SEQ ID NO: 852301 - DNA, 25 bp, Mus musculus
tgagatgcttgaagaccttcatatt

SEQ ID NO: 852302 - DNA, 25 bp, Mus musculus
tgagatgcttgatgaccttcatatt

SEQ ID NO: 852303 - DNA, 25 bp, Mus musculus
tgagatgcttgtaagttctgtgcca

SEQ ID NO: 852304 - DNA, 25 bp, Mus musculus
tgagatgcttgttagttctgtgcca

SEQ ID NO: 852305 - DNA, 25 bp, Mus musculus
tgagatggactcagctcagggcgcc

SEQ ID NO: 852306 - DNA, 25 bp, Mus musculus
tgagatggactctgctcagggcgcc

SEQ ID NO: 852307 - DNA, 25 bp, Mus musculus
tgagatggactgaagcttacacaca

SEQ ID NO: 852308 - DNA, 25 bp, Mus musculus
tgagatggactgtagcttacacaca

SEQ ID NO: 852309 - DNA, 25 bp, Mus musculus
tgagatggcacccacacgttcctgt

SEQ ID NO: 852310 - DNA, 25 bp, Mus musculus
tgagatggcaccgacacgttcctgt

SEQ ID NO: 852311 - DNA, 25 bp, Mus musculus
tgagatggcaggctcctcccttgca

SEQ ID NO: 852312 - DNA, 25 bp, Mus musculus
tgagatggcagggtcctcccttgca

SEQ ID NO: 852313 - DNA, 25 bp, Mus musculus
tgagatggccacacgggcgggccta

SEQ ID NO: 852314 - DNA, 25 bp, Mus musculus
tgagatggccactcgggcgggccta

SEQ ID NO: 852315 - DNA, 25 bp, Mus musculus
tgagatggccccagtatgtgctgtg

SEQ ID NO: 852316 - DNA, 25 bp, Mus musculus
tgagatggcccctgtatgtgctgtg

SEQ ID NO: 852317 - DNA, 25 bp, Mus musculus
tgagatggcgtcacactgttgccca

SEQ ID NO: 852318 - DNA, 25 bp, Mus musculus
tgagatggcgtctcactgttgccca

SEQ ID NO: 852319 - DNA, 25 bp, Mus musculus
tgagatgggaagattccttcgcaaa

SEQ ID NO: 852320 - DNA, 25 bp, Mus musculus
tgagatgggaagtttccttcgcaaa

SEQ ID NO: 852321 - DNA, 25 bp, Mus musculus
tgagatggtgttacatggtgctgtc

SEQ ID NO: 852322 - DNA, 25 bp, Mus musculus
tgagatggtgtttcatggtgctgtc

SEQ ID NO: 852323 - DNA, 25 bp, Mus musculus
tgagatggttccacaaccgtgccct

SEQ ID NO: 852324 - DNA, 25 bp, Mus musculus
tgagatggttcctcaaccgtgccct

SEQ ID NO: 852325 - DNA, 25 bp, Mus musculus
tgagatgtacacactgtttcatatt

SEQ ID NO: 852326 - DNA, 25 bp, Mus musculus
tgagatgtacactctgtttcatatt

SEQ ID NO: 852327 - DNA, 25 bp, Mus musculus
tgagatgtactcacatgtctctgag

SEQ ID NO: 852328 - DNA, 25 bp, Mus musculus
tgagatgtactctcatgtctctgag

SEQ ID NO: 852329 - DNA, 25 bp, Mus musculus
tgagatgtattcacctgtgccctag

SEQ ID NO: 852330 - DNA, 25 bp, Mus musculus
tgagatgtattctcctgtgccctag

SEQ ID NO: 852331 - DNA, 25 bp, Mus musculus
tgagatgtctgtacttaggtaggaa

SEQ ID NO: 852332 - DNA, 25 bp, Mus musculus
tgagatgtctgttcttaggtaggaa

SEQ ID NO: 852333 - DNA, 25 bp, Mus musculus
tgagatgtgcaacgtggtattccca

SEQ ID NO: 852334 - DNA, 25 bp, Mus musculus
tgagatgtgcaaggtggtattccca

SEQ ID NO: 852335 - DNA, 25 bp, Mus musculus
tgagatgtgcctatcctttgctcac

SEQ ID NO: 852336 - DNA, 25 bp, Mus musculus
tgagatgtgcctttcctttgctcac

SEQ ID NO: 852337 - DNA, 25 bp, Mus musculus
tgagatgtgcgccacggaagacctt

SEQ ID NO: 852338 - DNA, 25 bp, Mus musculus
tgagatgtgcgcgacggaagacctt

SEQ ID NO: 852339 - DNA, 25 bp, Mus musculus
tgagatgttccacatcctaagagct

SEQ ID NO: 852340 - DNA, 25 bp, Mus musculus
tgagatgttccagatcctaagagct

SEQ ID NO: 852341 - DNA, 25 bp, Mus musculus
tgagatgttctcctgttccctggac

SEQ ID NO: 852342 - DNA, 25 bp, Mus musculus
tgagatgttctcgtgttccctggac

SEQ ID NO: 852343 - DNA, 25 bp, Mus musculus
tgagattaaagacccgcaccactac

SEQ ID NO: 852344 - DNA, 25 bp, Mus musculus
tgagattaaagacttgcagcaggtt

SEQ ID NO: 852345 - DNA, 25 bp, Mus musculus
tgagattaaagagccgcaccactac

SEQ ID NO: 852346 - DNA, 25 bp, Mus musculus
tgagattaaagagttgcagcaggtt

SEQ ID NO: 852347 - DNA, 25 bp, Mus musculus
tgagattacaagctttctctaccag

SEQ ID NO: 852348 - DNA, 25 bp, Mus musculus
tgagattacaaggtttctctaccag

SEQ ID NO: 852349 - DNA, 25 bp, Mus musculus
tgagattacagcacccctggtttta

SEQ ID NO: 852350 - DNA, 25 bp, Mus musculus
tgagattacagctcccctggtttta

SEQ ID NO: 852351 - DNA, 25 bp, Mus musculus
tgagattactggagtgctgacagag

SEQ ID NO: 852352 - DNA, 25 bp, Mus musculus
tgagattactggtgtgctgacagag

SEQ ID NO: 852353 - DNA, 25 bp, Mus musculus
tgagattagaaaacctgccactagg

SEQ ID NO: 852354 - DNA, 25 bp, Mus musculus
tgagattagaaatcctgccactagg

SEQ ID NO: 852355 - DNA, 25 bp, Mus musculus
tgagattagttacccttggttcact

SEQ ID NO: 852356 - DNA, 25 bp, Mus musculus
tgagattagttagccttggttcact

SEQ ID NO: 852357 - DNA, 25 bp, Mus musculus
tgagattcaaaccaactaagtgtgg

SEQ ID NO: 852358 - DNA, 25 bp, Mus musculus
tgagattcaaacgaactaagtgtgg

SEQ ID NO: 852359 - DNA, 25 bp, Mus musculus
tgagattcaaccaagatgcacaaag

SEQ ID NO: 852360 - DNA, 25 bp, Mus musculus
tgagattcaacctagatgcacaaag

SEQ ID NO: 852361 - DNA, 25 bp, Mus musculus
tgagattcagtcatcctgtcacatg

SEQ ID NO: 852362 - DNA, 25 bp, Mus musculus
tgagattcagtcttcctgtcacatg

SEQ ID NO: 852363 - DNA, 25 bp, Mus musculus
tgagattcatcgagagattctgtct

SEQ ID NO: 852364 - DNA, 25 bp, Mus musculus
tgagattcatcgtgagattctgtct

SEQ ID NO: 852365 - DNA, 25 bp, Mus musculus
tgagattcccttctcaccatgcctg

SEQ ID NO: 852366 - DNA, 25 bp, Mus musculus
tgagattcccttgtcaccatgcctg

SEQ ID NO: 852367 - DNA, 25 bp, Mus musculus
tgagattcgcgcagaggaccgcttc

SEQ ID NO: 852368 - DNA, 25 bp, Mus musculus
tgagattcgcgctgaggaccgcttc

SEQ ID NO: 852369 - DNA, 25 bp, Mus musculus
tgagattcgtctccttctctaagaa

SEQ ID NO: 852370 - DNA, 25 bp, Mus musculus
tgagattcgtctgcttctctaagaa

SEQ ID NO: 852371 - DNA, 25 bp, Mus musculus
tgagattctatgacctgtggcccga

SEQ ID NO: 852372 - DNA, 25 bp, Mus musculus
tgagattctatgtcctgtggcccga

SEQ ID NO: 852373 - DNA, 25 bp, Mus musculus
tgagattctcctctgcttgctgttg

SEQ ID NO: 852374 - DNA, 25 bp, Mus musculus
tgagattctcctgtgcttgctgttg

SEQ ID NO: 852375 - DNA, 25 bp, Mus musculus
tgagattctgcgaaccatggtgact

SEQ ID NO: 852376 - DNA, 25 bp, Mus musculus
tgagattctgcgtaccatggtgact

SEQ ID NO: 852377 - DNA, 25 bp, Mus musculus
tgagattctgctattccccagcaaa

SEQ ID NO: 852378 - DNA, 25 bp, Mus musculus
tgagattctgcttttccccagcaaa

SEQ ID NO: 852379 - DNA, 25 bp, Mus musculus
tgagattctgtcactgcagtgcaca

SEQ ID NO: 852380 - DNA, 25 bp, Mus musculus
tgagattctgtctctgcagtgcaca

SEQ ID NO: 852381 - DNA, 25 bp, Mus musculus
tgagattctgttcttgttctaaaaa

SEQ ID NO: 852382 - DNA, 25 bp, Mus musculus
tgagattctgttgttgttctaaaaa

SEQ ID NO: 852383 - DNA, 25 bp, Mus musculus
tgagattgacagagtgcacagccct

SEQ ID NO: 852384 - DNA, 25 bp, Mus musculus
tgagattgacagtgtgcacagccct

SEQ ID NO: 852385 - DNA, 25 bp, Mus musculus
tgagattgaccaagttgttcctgct

SEQ ID NO: 852386 - DNA, 25 bp, Mus musculus
tgagattgaccatgttgttcctgct

SEQ ID NO: 852387 - DNA, 25 bp, Mus musculus
tgagattgagatcgcttgaacagtt

SEQ ID NO: 852388 - DNA, 25 bp, Mus musculus
tgagattgagatggcttgaacagtt

SEQ ID NO: 852389 - DNA, 25 bp, Mus musculus
tgagattgattaccacagaggccaa

SEQ ID NO: 852390 - DNA, 25 bp, Mus musculus
tgagattgattagcacagaggccaa

SEQ ID NO: 852391 - DNA, 25 bp, Mus musculus
tgagattgcaggcagtaccaccatg

SEQ ID NO: 852392 - DNA, 25 bp, Mus musculus
tgagattgcagggagtaccaccatg

SEQ ID NO: 852393 - DNA, 25 bp, Mus musculus
tgagattgcctgaattttcctgtgt

SEQ ID NO: 852394 - DNA, 25 bp, Mus musculus
tgagattgcctgactggtccttggc

SEQ ID NO: 852395 - DNA, 25 bp, Mus musculus
tgagattgcctgtattttcctgtgt

SEQ ID NO: 852396 - DNA, 25 bp, Mus musculus
tgagattgcctgtctggtccttggc

SEQ ID NO: 852397 - DNA, 25 bp, Mus musculus
tgagattggcttattccggaaccgc

SEQ ID NO: 852398 - DNA, 25 bp, Mus musculus
tgagattggctttttccggaaccgc

SEQ ID NO: 852399 - DNA, 25 bp, Mus musculus
tgagattggttcaatgtagccctaa

SEQ ID NO: 852400 - DNA, 25 bp, Mus musculus
tgagattggttctatgtagccctaa

SEQ ID NO: 852401 - DNA, 25 bp, Mus musculus
tgagattgtaccagtgtaccggcgg

SEQ ID NO: 852402 - DNA, 25 bp, Mus musculus
tgagattgtacctgtgtaccggcgg

SEQ ID NO: 852403 - DNA, 25 bp, Mus musculus
tgagatttaaaaacttagttcccag

SEQ ID NO: 852404 - DNA, 25 bp, Mus musculus
tgagatttaaaatcttagttcccag

SEQ ID NO: 852405 - DNA, 25 bp, Mus musculus
tgagatttaagtacccagcccttcc

SEQ ID NO: 852406 - DNA, 25 bp, Mus musculus
tgagatttaagttcccagcccttcc

SEQ ID NO: 852407 - DNA, 25 bp, Mus musculus
tgagatttatcaacagcctgaagga

SEQ ID NO: 852408 - DNA, 25 bp, Mus musculus
tgagatttatcatcagcctgaagga

SEQ ID NO: 852409 - DNA, 25 bp, Mus musculus
tgagatttcaaaagccctagccagg

SEQ ID NO: 852410 - DNA, 25 bp, Mus musculus
tgagatttcaaatgccctagccagg

SEQ ID NO: 852411 - DNA, 25 bp, Mus musculus
tgagatttcctgatacctcatcttc

SEQ ID NO: 852412 - DNA, 25 bp, Mus musculus
tgagatttcctgttacctcatcttc

SEQ ID NO: 852413 - DNA, 25 bp, Mus musculus
tgagatttgagtaagggagccctga

SEQ ID NO: 852414 - DNA, 25 bp, Mus musculus
tgagatttgagttagggagccctga

SEQ ID NO: 852415 - DNA, 25 bp, Mus musculus
tgagatttggccattctctgctggg

SEQ ID NO: 852416 - DNA, 25 bp, Mus musculus
tgagatttggcctttctctgctggg

SEQ ID NO: 852417 - DNA, 25 bp, Mus musculus
tgagatttttacaacaccagacaaa

SEQ ID NO: 852418 - DNA, 25 bp, Mus musculus
tgagatttttactacaccagacaaa

SEQ ID NO: 852419 - DNA, 25 bp, Mus musculus
tgagatttttataattcccaaggaa

SEQ ID NO: 852420 - DNA, 25 bp, Mus musculus
tgagatttttattattcccaaggaa

SEQ ID NO: 852421 - DNA, 25 bp, Mus musculus
tgagatttttcacccatcaagcctc

SEQ ID NO: 852422 - DNA, 25 bp, Mus musculus
tgagatttttcagccatcaagcctc

SEQ ID NO: 852423 - DNA, 25 bp, Mus musculus
tgagcaaaaaggacctcctgtccta

SEQ ID NO: 852424 - DNA, 25 bp, Mus musculus
tgagcaaaaaggtcctcctgtccta

SEQ ID NO: 852425 - DNA, 25 bp, Mus musculus
tgagcaaaatgacatccggaacctg

SEQ ID NO: 852426 - DNA, 25 bp, Mus musculus
tgagcaaaatgagatccggaacctg

SEQ ID NO: 852427 - DNA, 25 bp, Mus musculus
tgagcaaacgtccttcccaattatc

SEQ ID NO: 852428 - DNA, 25 bp, Mus musculus
tgagcaaacgtcgttcccaattatc

SEQ ID NO: 852429 - DNA, 25 bp, Mus musculus
tgagcaaactccctgctaggttcct

SEQ ID NO: 852430 - DNA, 25 bp, Mus musculus
tgagcaaactccgtgctaggttcct

SEQ ID NO: 852431 - DNA, 25 bp, Mus musculus
tgagcaaagataattccccggtttt

SEQ ID NO: 852432 - DNA, 25 bp, Mus musculus
tgagcaaagatatttccccggtttt

SEQ ID NO: 852433 - DNA, 25 bp, Mus musculus
tgagcaacacagctgggccttgcaa

SEQ ID NO: 852434 - DNA, 25 bp, Mus musculus
tgagcaacacaggtgggccttgcaa

SEQ ID NO: 852435 - DNA, 25 bp, Mus musculus
tgagcaacacctactctctgactga

SEQ ID NO: 852436 - DNA, 25 bp, Mus musculus
tgagcaacaccttctctctgactga

SEQ ID NO: 852437 - DNA, 25 bp, Mus musculus
tgagcaacagccactcaaatgcctt

SEQ ID NO: 852438 - DNA, 25 bp, Mus musculus
tgagcaacagcctctcaaatgcctt

SEQ ID NO: 852439 - DNA, 25 bp, Mus musculus
tgagcaaccgcaaggctgagcagag

SEQ ID NO: 852440 - DNA, 25 bp, Mus musculus
tgagcaaccgcatggctgagcagag

SEQ ID NO: 852441 - DNA, 25 bp, Mus musculus
tgagcaacctaaccccttcttggag

SEQ ID NO: 852442 - DNA, 25 bp, Mus musculus
tgagcaacctaagcccttcttggag

SEQ ID NO: 852443 - DNA, 25 bp, Mus musculus
tgagcaacctttatacaacaccatc

SEQ ID NO: 852444 - DNA, 25 bp, Mus musculus
tgagcaacctttttacaacaccatc

SEQ ID NO: 852445 - DNA, 25 bp, Mus musculus
tgagcaacgactatttaatgaccat

SEQ ID NO: 852446 - DNA, 25 bp, Mus musculus
tgagcaacgactttttaatgaccat

SEQ ID NO: 852447 - DNA, 25 bp, Mus musculus
tgagcaacgtagcaggcgtcttcta

SEQ ID NO: 852448 - DNA, 25 bp, Mus musculus
tgagcaacgtaggaggcgtcttcta

SEQ ID NO: 852449 - DNA, 25 bp, Mus musculus
tgagcaacgtgcaggcagccatgag

SEQ ID NO: 852450 - DNA, 25 bp, Mus musculus
tgagcaacgtgctggcagccatgag

SEQ ID NO: 852451 - DNA, 25 bp, Mus musculus
tgagcaactcaaactggtcactacc

SEQ ID NO: 852452 - DNA, 25 bp, Mus musculus
tgagcaactcaatctggtcactacc

SEQ ID NO: 852453 - DNA, 25 bp, Mus musculus
tgagcaactgctccgattactctgg

SEQ ID NO: 852454 - DNA, 25 bp, Mus musculus
tgagcaactgctgcgattactctgg

SEQ ID NO: 852455 - DNA, 25 bp, Mus musculus
tgagcaacttgtacccgttttcagt

SEQ ID NO: 852456 - DNA, 25 bp, Mus musculus
tgagcaacttgttcccgttttcagt

SEQ ID NO: 852457 - DNA, 25 bp, Mus musculus
tgagcaagaagacggtcctagacaa

SEQ ID NO: 852458 - DNA, 25 bp, Mus musculus
tgagcaagaagagggtcctagacaa

SEQ ID NO: 852459 - DNA, 25 bp, Mus musculus
tgagcaagagaaagttcaagccctt

SEQ ID NO: 852460 - DNA, 25 bp, Mus musculus
tgagcaagagaatgttcaagccctt

SEQ ID NO: 852461 - DNA, 25 bp, Mus musculus
tgagcaagatgacaccctgagcttc

SEQ ID NO: 852462 - DNA, 25 bp, Mus musculus
tgagcaagatgagaccctgagcttc

SEQ ID NO: 852463 - DNA, 25 bp, Mus musculus
tgagcaagatggcaagccgtactat

SEQ ID NO: 852464 - DNA, 25 bp, Mus musculus
tgagcaagatgggaagccgtactat

SEQ ID NO: 852465 - DNA, 25 bp, Mus musculus
tgagcaagctgacggttatgttcct

SEQ ID NO: 852466 - DNA, 25 bp, Mus musculus
tgagcaagctgactaaatctggatc

SEQ ID NO: 852467 - DNA, 25 bp, Mus musculus
tgagcaagctgagggttatgttcct

SEQ ID NO: 852468 - DNA, 25 bp, Mus musculus
tgagcaagctgagtaaatctggatc

SEQ ID NO: 852469 - DNA, 25 bp, Mus musculus
tgagcaagctgcctccattctaaag

SEQ ID NO: 852470 - DNA, 25 bp, Mus musculus
tgagcaagctgcgtccattctaaag

SEQ ID NO: 852471 - DNA, 25 bp, Mus musculus
tgagcaagcttacccctttgttcat

SEQ ID NO: 852472 - DNA, 25 bp, Mus musculus
tgagcaagcttagccctttgttcat

SEQ ID NO: 852473 - DNA, 25 bp, Mus musculus
tgagcaaggctaccgtgggaccaaa

SEQ ID NO: 852474 - DNA, 25 bp, Mus musculus
tgagcaaggctagcgtgggaccaaa

SEQ ID NO: 852475 - DNA, 25 bp, Mus musculus
tgagcaaggctgattgtccggaacc

SEQ ID NO: 852476 - DNA, 25 bp, Mus musculus
tgagcaaggctgtttgtccggaacc

SEQ ID NO: 852477 - DNA, 25 bp, Mus musculus
tgagcaaggtacaccattcctgcag

SEQ ID NO: 852478 - DNA, 25 bp, Mus musculus
tgagcaaggtactccattcctgcag

SEQ ID NO: 852479 - DNA, 25 bp, Mus musculus
tgagcaaggtgcacagggccagcct

SEQ ID NO: 852480 - DNA, 25 bp, Mus musculus
tgagcaaggtgctcagggccagcct

SEQ ID NO: 852481 - DNA, 25 bp, Mus musculus
tgagcaagtacaaatcacctttgag

SEQ ID NO: 852482 - DNA, 25 bp, Mus musculus
tgagcaagtacatatcacctttgag

SEQ ID NO: 852483 - DNA, 25 bp, Mus musculus
tgagcaatagcaaacatgttcgaac

SEQ ID NO: 852484 - DNA, 25 bp, Mus musculus
tgagcaatagcatacatgttcgaac

SEQ ID NO: 852485 - DNA, 25 bp, Mus musculus
tgagcaatcattcaagccccgtttc

SEQ ID NO: 852486 - DNA, 25 bp, Mus musculus
tgagcaatcattgaagccccgtttc

SEQ ID NO: 852487 - DNA, 25 bp, Mus musculus
tgagcaatcctaccagtccctggat

SEQ ID NO: 852488 - DNA, 25 bp, Mus musculus
tgagcaatcctagcagtccctggat

SEQ ID NO: 852489 - DNA, 25 bp, Mus musculus
tgagcaatctatctattgaccctgg

SEQ ID NO: 852490 - DNA, 25 bp, Mus musculus
tgagcaatctatgtattgaccctgg

SEQ ID NO: 852491 - DNA, 25 bp, Mus musculus
tgagcaatctctctagcccatcatt

SEQ ID NO: 852492 - DNA, 25 bp, Mus musculus
tgagcaatctctgtagcccatcatt

SEQ ID NO: 852493 - DNA, 25 bp, Mus musculus
tgagcaatgaccactgtaccactga

SEQ ID NO: 852494 - DNA, 25 bp, Mus musculus
tgagcaatgacctctgtaccactga

SEQ ID NO: 852495 - DNA, 25 bp, Mus musculus
tgagcaatggccaactgtgtagata

SEQ ID NO: 852496 - DNA, 25 bp, Mus musculus
tgagcaatggcctactgtgtagata

SEQ ID NO: 852497 - DNA, 25 bp, Mus musculus
tgagcaattcccatgaggatagtat

SEQ ID NO: 852498 - DNA, 25 bp, Mus musculus
tgagcaattcccttgaggatagtat

SEQ ID NO: 852499 - DNA, 25 bp, Mus musculus
tgagcaattgctccctgtatctcct

SEQ ID NO: 852500 - DNA, 25 bp, Mus musculus
tgagcaattgctgcctgtatctcct

SEQ ID NO: 852501 - DNA, 25 bp, Mus musculus
tgagcaatttctcttccagctttga

SEQ ID NO: 852502 - DNA, 25 bp, Mus musculus
tgagcaatttctgttccagctttga

SEQ ID NO: 852503 - DNA, 25 bp, Mus musculus
tgagcacacacacaagtcagccttc

SEQ ID NO: 852504 - DNA, 25 bp, Mus musculus
tgagcacacacagaagtcagccttc

SEQ ID NO: 852505 - DNA, 25 bp, Mus musculus
tgagcacagacgacacattcctgtc

SEQ ID NO: 852506 - DNA, 25 bp, Mus musculus
tgagcacagacgtcacattcctgtc

SEQ ID NO: 852507 - DNA, 25 bp, Mus musculus
tgagcacagccaactaacctgagac

SEQ ID NO: 852508 - DNA, 25 bp, Mus musculus
tgagcacagccatctaacctgagac

SEQ ID NO: 852509 - DNA, 25 bp, Mus musculus
tgagcacagccgagccagggatctt

SEQ ID NO: 852510 - DNA, 25 bp, Mus musculus
tgagcacagccgtgccagggatctt

SEQ ID NO: 852511 - DNA, 25 bp, Mus musculus
tgagcacaggacatggagctccgat

SEQ ID NO: 852512 - DNA, 25 bp, Mus musculus
tgagcacaggacttggagctccgat

SEQ ID NO: 852513 - DNA, 25 bp, Mus musculus
tgagcacaggcgattcagcagttga

SEQ ID NO: 852514 - DNA, 25 bp, Mus musculus
tgagcacaggcgtttcagcagttga

SEQ ID NO: 852515 - DNA, 25 bp, Mus musculus
tgagcacagggcaagaagcctcttt

SEQ ID NO: 852516 - DNA, 25 bp, Mus musculus
tgagcacagggctagaagcctcttt

SEQ ID NO: 852517 - DNA, 25 bp, Mus musculus
tgagcacatagccactgccaacatg

SEQ ID NO: 852518 - DNA, 25 bp, Mus musculus
tgagcacatagcgactgccaacatg

SEQ ID NO: 852519 - DNA, 25 bp, Mus musculus
tgagcacatctcactagaccagtag

SEQ ID NO: 852520 - DNA, 25 bp, Mus musculus
tgagcacatctctctagaccagtag

SEQ ID NO: 852521 - DNA, 25 bp, Mus musculus
tgagcacatctgcttttcatttatt

SEQ ID NO: 852522 - DNA, 25 bp, Mus musculus
tgagcacatctggttttcatttatt

SEQ ID NO: 852523 - DNA, 25 bp, Mus musculus
tgagcacatgcactacatccttacc

SEQ ID NO: 852524 - DNA, 25 bp, Mus musculus
tgagcacatgcagtacatccttacc

SEQ ID NO: 852525 - DNA, 25 bp, Mus musculus
tgagcacatggacctgtaactggcc

SEQ ID NO: 852526 - DNA, 25 bp, Mus musculus
tgagcacatggagctgtaactggcc

SEQ ID NO: 852527 - DNA, 25 bp, Mus musculus
tgagcaccaaacaccagcctttttt

SEQ ID NO: 852528 - DNA, 25 bp, Mus musculus
tgagcaccaaactccagcctttttt

SEQ ID NO: 852529 - DNA, 25 bp, Mus musculus
tgagcaccaaagcacctgccaggat

SEQ ID NO: 852530 - DNA, 25 bp, Mus musculus
tgagcaccaaaggacctgccaggat

SEQ ID NO: 852531 - DNA, 25 bp, Mus musculus
tgagcaccaagaccttgaacttttt

SEQ ID NO: 852532 - DNA, 25 bp, Mus musculus
tgagcaccaagagcttgaacttttt

SEQ ID NO: 852533 - DNA, 25 bp, Mus musculus
tgagcaccactcatgaatggcaaca

SEQ ID NO: 852534 - DNA, 25 bp, Mus musculus
tgagcaccactcttgaatggcaaca

SEQ ID NO: 852535 - DNA, 25 bp, Mus musculus
tgagcaccatcaagtgtgggcgtct

SEQ ID NO: 852536 - DNA, 25 bp, Mus musculus
tgagcaccatcatgtgtgggcgtct

SEQ ID NO: 852537 - DNA, 25 bp, Mus musculus
tgagcaccatgacagcccggctgga

SEQ ID NO: 852538 - DNA, 25 bp, Mus musculus
tgagcaccatgagagcccggctgga

SEQ ID NO: 852539 - DNA, 25 bp, Mus musculus
tgagcacccagcaaggtcctgtggg

SEQ ID NO: 852540 - DNA, 25 bp, Mus musculus
tgagcacccagctaggtcctgtggg

SEQ ID NO: 852541 - DNA, 25 bp, Mus musculus
tgagcacccatgcagccctaagtgg

SEQ ID NO: 852542 - DNA, 25 bp, Mus musculus
tgagcacccatggagccctaagtgg

SEQ ID NO: 852543 - DNA, 25 bp, Mus musculus
tgagcacccttgagaggctctacca

SEQ ID NO: 852544 - DNA, 25 bp, Mus musculus
tgagcacccttgtgaggctctacca

SEQ ID NO: 852545 - DNA, 25 bp, Mus musculus
tgagcaccgaacaggcccttttagg

SEQ ID NO: 852546 - DNA, 25 bp, Mus musculus
tgagcaccgaactggcccttttagg

SEQ ID NO: 852547 - DNA, 25 bp, Mus musculus
tgagcaccgtgtacttctggagaga

SEQ ID NO: 852548 - DNA, 25 bp, Mus musculus
tgagcaccgtgttcttctggagaga

SEQ ID NO: 852549 - DNA, 25 bp, Mus musculus
tgagcaccgtttcagacctgctgca

SEQ ID NO: 852550 - DNA, 25 bp, Mus musculus
tgagcaccgtttgagacctgctgca

SEQ ID NO: 852551 - DNA, 25 bp, Mus musculus
tgagcacctccccagatgtgtgtgc

SEQ ID NO: 852552 - DNA, 25 bp, Mus musculus
tgagcacctcccgagatgtgtgtgc

SEQ ID NO: 852553 - DNA, 25 bp, Mus musculus
tgagcacctgggacttcctttggtc

SEQ ID NO: 852554 - DNA, 25 bp, Mus musculus
tgagcacctgggatgattcactgtc

SEQ ID NO: 852555 - DNA, 25 bp, Mus musculus
tgagcacctgggtcttcctttggtc

SEQ ID NO: 852556 - DNA, 25 bp, Mus musculus
tgagcacctgggttgattcactgtc

SEQ ID NO: 852557 - DNA, 25 bp, Mus musculus
tgagcacctgtaacgcagcactcgg

SEQ ID NO: 852558 - DNA, 25 bp, Mus musculus
tgagcacctgtatcgcagcactcgg

SEQ ID NO: 852559 - DNA, 25 bp, Mus musculus
tgagcacctgtgattgtagtttaaa

SEQ ID NO: 852560 - DNA, 25 bp, Mus musculus
tgagcacctgtgtttgtagtttaaa

SEQ ID NO: 852561 - DNA, 25 bp, Mus musculus
tgagcacctgttatgattcacaagt

SEQ ID NO: 852562 - DNA, 25 bp, Mus musculus
tgagcacctgttttgattcacaagt

SEQ ID NO: 852563 - DNA, 25 bp, Mus musculus
tgagcaccttcccagaggagcccat

SEQ ID NO: 852564 - DNA, 25 bp, Mus musculus
tgagcaccttccgagaggagcccat

SEQ ID NO: 852565 - DNA, 25 bp, Mus musculus
tgagcacgactcaggtgaccacatg

SEQ ID NO: 852566 - DNA, 25 bp, Mus musculus
tgagcacgactctggtgaccacatg

SEQ ID NO: 852567 - DNA, 25 bp, Mus musculus
tgagcacgccgactggatcattttc

SEQ ID NO: 852568 - DNA, 25 bp, Mus musculus
tgagcacgccgagtggatcattttc

SEQ ID NO: 852569 - DNA, 25 bp, Mus musculus
tgagcacgcgctccaggtctcagag

SEQ ID NO: 852570 - DNA, 25 bp, Mus musculus
tgagcacgcgctgcaggtctcagag

SEQ ID NO: 852571 - DNA, 25 bp, Mus musculus
tgagcacgggtgactgcatgtctgc

SEQ ID NO: 852572 - DNA, 25 bp, Mus musculus
tgagcacgggtgctggcacccattt

SEQ ID NO: 852573 - DNA, 25 bp, Mus musculus
tgagcacgggtggtggcacccattt

SEQ ID NO: 852574 - DNA, 25 bp, Mus musculus
tgagcacgggtgtctgcatgtctgc

SEQ ID NO: 852575 - DNA, 25 bp, Mus musculus
tgagcacggtttcgtgatttgcacc

SEQ ID NO: 852576 - DNA, 25 bp, Mus musculus
tgagcacggtttggtgatttgcacc

SEQ ID NO: 852577 - DNA, 25 bp, Mus musculus
tgagcacgtagtccttgcacaggta

SEQ ID NO: 852578 - DNA, 25 bp, Mus musculus
tgagcacgtagtgcttgcacaggta

SEQ ID NO: 852579 - DNA, 25 bp, Mus musculus
tgagcacgttgtagacgatcagtct

SEQ ID NO: 852580 - DNA, 25 bp, Mus musculus
tgagcacgttgttgacgatcagtct

SEQ ID NO: 852581 - DNA, 25 bp, Mus musculus
tgagcactaactacagtctgtctga

SEQ ID NO: 852582 - DNA, 25 bp, Mus musculus
tgagcactaacttcagtctgtctga

SEQ ID NO: 852583 - DNA, 25 bp, Mus musculus
tgagcactacttaactctttctcct

SEQ ID NO: 852584 - DNA, 25 bp, Mus musculus
tgagcactactttactctttctcct

SEQ ID NO: 852585 - DNA, 25 bp, Mus musculus
tgagcactattacccatcagctgag

SEQ ID NO: 852586 - DNA, 25 bp, Mus musculus
tgagcactattagccatcagctgag

SEQ ID NO: 852587 - DNA, 25 bp, Mus musculus
tgagcactcaaaatcagatttcccc

SEQ ID NO: 852588 - DNA, 25 bp, Mus musculus
tgagcactcaaattcagatttcccc

SEQ ID NO: 852589 - DNA, 25 bp, Mus musculus
tgagcactcagccaactatccaact

SEQ ID NO: 852590 - DNA, 25 bp, Mus musculus
tgagcactcagcgaactatccaact

SEQ ID NO: 852591 - DNA, 25 bp, Mus musculus
tgagcactcattagccctgtatggg

SEQ ID NO: 852592 - DNA, 25 bp, Mus musculus
tgagcactcatttgccctgtatggg

SEQ ID NO: 852593 - DNA, 25 bp, Mus musculus
tgagcactccagaagcgcagcagtt

SEQ ID NO: 852594 - DNA, 25 bp, Mus musculus
tgagcactccagtagcgcagcagtt

SEQ ID NO: 852595 - DNA, 25 bp, Mus musculus
tgagcactcccaagcctggctactt

SEQ ID NO: 852596 - DNA, 25 bp, Mus musculus
tgagcactcccatgcctggctactt

SEQ ID NO: 852597 - DNA, 25 bp, Mus musculus
tgagcactcctaagggacagacctt

SEQ ID NO: 852598 - DNA, 25 bp, Mus musculus
tgagcactcctatgggacagacctt

SEQ ID NO: 852599 - DNA, 25 bp, Mus musculus
tgagcactcggtcttcgttctgcag

SEQ ID NO: 852600 - DNA, 25 bp, Mus musculus
tgagcactcggtgttcgttctgcag

SEQ ID NO: 852601 - DNA, 25 bp, Mus musculus
tgagcactctaaatagcaagctggg

SEQ ID NO: 852602 - DNA, 25 bp, Mus musculus
tgagcactctaattagcaagctggg

SEQ ID NO: 852603 - DNA, 25 bp, Mus musculus
tgagcactgaagagttccctggccc

SEQ ID NO: 852604 - DNA, 25 bp, Mus musculus
tgagcactgaagtgttccctggccc

SEQ ID NO: 852605 - DNA, 25 bp, Mus musculus
tgagcactgacaccaaccgccaaga

SEQ ID NO: 852606 - DNA, 25 bp, Mus musculus
tgagcactgacagcaaccgccaaga

SEQ ID NO: 852607 - DNA, 25 bp, Mus musculus
tgagcactgcaacaccaatggctgg

SEQ ID NO: 852608 - DNA, 25 bp, Mus musculus
tgagcactgcaagaccaatggctgg

SEQ ID NO: 852609 - DNA, 25 bp, Mus musculus
tgagcactgccaactggtctgtgga

SEQ ID NO: 852610 - DNA, 25 bp, Mus musculus
tgagcactgccatctggtctgtgga

SEQ ID NO: 852611 - DNA, 25 bp, Mus musculus
tgagcactgccgacagccaatagga

SEQ ID NO: 852612 - DNA, 25 bp, Mus musculus
tgagcactgccgtcagccaatagga

SEQ ID NO: 852613 - DNA, 25 bp, Mus musculus
tgagcactggaccatttttctgcca

SEQ ID NO: 852614 - DNA, 25 bp, Mus musculus
tgagcactggacgatttttctgcca

SEQ ID NO: 852615 - DNA, 25 bp, Mus musculus
tgagcactggagatcacggacttct

SEQ ID NO: 852616 - DNA, 25 bp, Mus musculus
tgagcactggagttcacggacttct

SEQ ID NO: 852617 - DNA, 25 bp, Mus musculus
tgagcactggatagttctggtcccc

SEQ ID NO: 852618 - DNA, 25 bp, Mus musculus
tgagcactggattgttctggtcccc

SEQ ID NO: 852619 - DNA, 25 bp, Mus musculus
tgagcactggcactgtttccatcga

SEQ ID NO: 852620 - DNA, 25 bp, Mus musculus
tgagcactggcagtgtttccatcga

SEQ ID NO: 852621 - DNA, 25 bp, Mus musculus
tgagcactggctctctggataactc

SEQ ID NO: 852622 - DNA, 25 bp, Mus musculus
tgagcactggctgtctggataactc

SEQ ID NO: 852623 - DNA, 25 bp, Mus musculus
tgagcactggtaacactgtcctgtc

SEQ ID NO: 852624 - DNA, 25 bp, Mus musculus
tgagcactggtatcactgtcctgtc

SEQ ID NO: 852625 - DNA, 25 bp, Mus musculus
tgagcactggtgacatgggactgat

SEQ ID NO: 852626 - DNA, 25 bp, Mus musculus
tgagcactggtgtcatgggactgat

SEQ ID NO: 852627 - DNA, 25 bp, Mus musculus
tgagcactgtacaggtatcattgat

SEQ ID NO: 852628 - DNA, 25 bp, Mus musculus
tgagcactgtactggtatcattgat

SEQ ID NO: 852629 - DNA, 25 bp, Mus musculus
tgagcactgtcaatcatgcctccat

SEQ ID NO: 852630 - DNA, 25 bp, Mus musculus
tgagcactgtcattcatgcctccat

SEQ ID NO: 852631 - DNA, 25 bp, Mus musculus
tgagcactgtgtcccctagaaaata

SEQ ID NO: 852632 - DNA, 25 bp, Mus musculus
tgagcactgtgtgccctagaaaata

SEQ ID NO: 852633 - DNA, 25 bp, Mus musculus
tgagcactgttcattgcttccactc

SEQ ID NO: 852634 - DNA, 25 bp, Mus musculus
tgagcactgttctttgcttccactc

SEQ ID NO: 852635 - DNA, 25 bp, Mus musculus
tgagcacttccacctgcagggtgtg

SEQ ID NO: 852636 - DNA, 25 bp, Mus musculus
tgagcacttccagctgcagggtgtg

SEQ ID NO: 852637 - DNA, 25 bp, Mus musculus
tgagcagaagaaagcattcgaattg

SEQ ID NO: 852638 - DNA, 25 bp, Mus musculus
tgagcagaagaatgcattcgaattg

SEQ ID NO: 852639 - DNA, 25 bp, Mus musculus
tgagcagaaggcatcacccctgcaa

SEQ ID NO: 852640 - DNA, 25 bp, Mus musculus
tgagcagaaggcttcacccctgcaa

SEQ ID NO: 852641 - DNA, 25 bp, Mus musculus
tgagcagaaggtatttgccctctgg

SEQ ID NO: 852642 - DNA, 25 bp, Mus musculus
tgagcagaaggtttttgccctctgg

SEQ ID NO: 852643 - DNA, 25 bp, Mus musculus
tgagcagaatgccagtgaatttaga

SEQ ID NO: 852644 - DNA, 25 bp, Mus musculus
tgagcagaatgcgagtgaatttaga

SEQ ID NO: 852645 - DNA, 25 bp, Mus musculus
tgagcagaatggcagcatcgtctcc

SEQ ID NO: 852646 - DNA, 25 bp, Mus musculus
tgagcagaatgggagcatcgtctcc

SEQ ID NO: 852647 - DNA, 25 bp, Mus musculus
tgagcagacagaccctgccagagta

SEQ ID NO: 852648 - DNA, 25 bp, Mus musculus
tgagcagacagagcctgccagagta

SEQ ID NO: 852649 - DNA, 25 bp, Mus musculus
tgagcagaccctagctgccaatgaa

SEQ ID NO: 852650 - DNA, 25 bp, Mus musculus
tgagcagacccttgctgccaatgaa

SEQ ID NO: 852651 - DNA, 25 bp, Mus musculus
tgagcagacctcaagggcagccaat

SEQ ID NO: 852652 - DNA, 25 bp, Mus musculus
tgagcagacctctagggcagccaat

SEQ ID NO: 852653 - DNA, 25 bp, Mus musculus
tgagcagactttacattcctctggt

SEQ ID NO: 852654 - DNA, 25 bp, Mus musculus
tgagcagacttttcattcctctggt

SEQ ID NO: 852655 - DNA, 25 bp, Mus musculus
tgagcagagcatccctttgttacat

SEQ ID NO: 852656 - DNA, 25 bp, Mus musculus
tgagcagagcatgcctttgttacat

SEQ ID NO: 852657 - DNA, 25 bp, Mus musculus
tgagcagagccgcttacttggtaac

SEQ ID NO: 852658 - DNA, 25 bp, Mus musculus
tgagcagagccggttacttggtaac

SEQ ID NO: 852659 - DNA, 25 bp, Mus musculus
tgagcagagctgctcagtacacact

SEQ ID NO: 852660 - DNA, 25 bp, Mus musculus
tgagcagagctggtcagtacacact

SEQ ID NO: 852661 - DNA, 25 bp, Mus musculus
tgagcagaggacacctttcttctcc

SEQ ID NO: 852662 - DNA, 25 bp, Mus musculus
tgagcagaggactcctttcttctcc

SEQ ID NO: 852663 - DNA, 25 bp, Mus musculus
tgagcagaggcgcacaactcttgca

SEQ ID NO: 852664 - DNA, 25 bp, Mus musculus
tgagcagaggcggacaactcttgca

SEQ ID NO: 852665 - DNA, 25 bp, Mus musculus
tgagcagagggtacccttctagctg

SEQ ID NO: 852666 - DNA, 25 bp, Mus musculus
tgagcagagggttcccttctagctg

SEQ ID NO: 852667 - DNA, 25 bp, Mus musculus
tgagcagagtaaacactccccacac

SEQ ID NO: 852668 - DNA, 25 bp, Mus musculus
tgagcagagtaatcactccccacac

SEQ ID NO: 852669 - DNA, 25 bp, Mus musculus
tgagcagagttcacctcttcacagc

SEQ ID NO: 852670 - DNA, 25 bp, Mus musculus
tgagcagagttctcctcttcacagc

SEQ ID NO: 852671 - DNA, 25 bp, Mus musculus
tgagcagatcacacatcttcgagct

SEQ ID NO: 852672 - DNA, 25 bp, Mus musculus
tgagcagatcactcatcttcgagct

SEQ ID NO: 852673 - DNA, 25 bp, Mus musculus
tgagcagatttcaccctgagcaggc

SEQ ID NO: 852674 - DNA, 25 bp, Mus musculus
tgagcagatttctccctgagcaggc

SEQ ID NO: 852675 - DNA, 25 bp, Mus musculus
tgagcagcacggctgaattcccttc

SEQ ID NO: 852676 - DNA, 25 bp, Mus musculus
tgagcagcacgggtgaattcccttc

SEQ ID NO: 852677 - DNA, 25 bp, Mus musculus
tgagcagcactcagaagtcacaaga

SEQ ID NO: 852678 - DNA, 25 bp, Mus musculus
tgagcagcactctgaagtcacaaga

SEQ ID NO: 852679 - DNA, 25 bp, Mus musculus
tgagcagcactgcactaagttccgg

SEQ ID NO: 852680 - DNA, 25 bp, Mus musculus
tgagcagcactggactaagttccgg

SEQ ID NO: 852681 - DNA, 25 bp, Mus musculus
tgagcagcagccactgtagcttctc

SEQ ID NO: 852682 - DNA, 25 bp, Mus musculus
tgagcagcagcctctgtagcttctc

SEQ ID NO: 852683 - DNA, 25 bp, Mus musculus
tgagcagcagcgagaacccggtgct

SEQ ID NO: 852684 - DNA, 25 bp, Mus musculus
tgagcagcagcgtgaacccggtgct

SEQ ID NO: 852685 - DNA, 25 bp, Mus musculus
tgagcagcaggaccctctgttccct

SEQ ID NO: 852686 - DNA, 25 bp, Mus musculus
tgagcagcaggagcctctgttccct

SEQ ID NO: 852687 - DNA, 25 bp, Mus musculus
tgagcagcatagactcctgcctttc

SEQ ID NO: 852688 - DNA, 25 bp, Mus musculus
tgagcagcatagtctcctgcctttc

SEQ ID NO: 852689 - DNA, 25 bp, Mus musculus
tgagcagcatatctgtcagccgctt

SEQ ID NO: 852690 - DNA, 25 bp, Mus musculus
tgagcagcatatgtgtcagccgctt

SEQ ID NO: 852691 - DNA, 25 bp, Mus musculus
tgagcagccactcgcaggaagagca

SEQ ID NO: 852692 - DNA, 25 bp, Mus musculus
tgagcagccactggcaggaagagca

SEQ ID NO: 852693 - DNA, 25 bp, Mus musculus
tgagcagccagaatccctgctgagc

SEQ ID NO: 852694 - DNA, 25 bp, Mus musculus
tgagcagccagattccctgctgagc

SEQ ID NO: 852695 - DNA, 25 bp, Mus musculus
tgagcagccagccaagggcaagtct

SEQ ID NO: 852696 - DNA, 25 bp, Mus musculus
tgagcagccagcgaagggcaagtct

SEQ ID NO: 852697 - DNA, 25 bp, Mus musculus
tgagcagccattaactgggttactt

SEQ ID NO: 852698 - DNA, 25 bp, Mus musculus
tgagcagccatttactgggttactt

SEQ ID NO: 852699 - DNA, 25 bp, Mus musculus
tgagcagcccctagtccagcttggt

SEQ ID NO: 852700 - DNA, 25 bp, Mus musculus
tgagcagccccttgtccagcttggt

SEQ ID NO: 852701 - DNA, 25 bp, Mus musculus
tgagcagcctgcattggaccaaaga

SEQ ID NO: 852702 - DNA, 25 bp, Mus musculus
tgagcagcctgctttggaccaaaga

SEQ ID NO: 852703 - DNA, 25 bp, Mus musculus
tgagcagccttcactattcagtttt

SEQ ID NO: 852704 - DNA, 25 bp, Mus musculus
tgagcagccttctctattcagtttt

SEQ ID NO: 852705 - DNA, 25 bp, Mus musculus
tgagcagccttgactgcctggagtc

SEQ ID NO: 852706 - DNA, 25 bp, Mus musculus
tgagcagccttgtctgcctggagtc

SEQ ID NO: 852707 - DNA, 25 bp, Mus musculus
tgagcagcgagaatacggcgtccct

SEQ ID NO: 852708 - DNA, 25 bp, Mus musculus
tgagcagcgagattacggcgtccct

SEQ ID NO: 852709 - DNA, 25 bp, Mus musculus
tgagcagcgatacgatcagcagttc

SEQ ID NO: 852710 - DNA, 25 bp, Mus musculus
tgagcagcgataggatcagcagttc

SEQ ID NO: 852711 - DNA, 25 bp, Mus musculus
tgagcagcgatgcttttccttcttg

SEQ ID NO: 852712 - DNA, 25 bp, Mus musculus
tgagcagcgatggttttccttcttg

SEQ ID NO: 852713 - DNA, 25 bp, Mus musculus
tgagcagcgtgtcgatgatgacact

SEQ ID NO: 852714 - DNA, 25 bp, Mus musculus
tgagcagcgtgtggatgatgacact

SEQ ID NO: 852715 - DNA, 25 bp, Mus musculus
tgagcagctcaaaagagccctaatg

SEQ ID NO: 852716 - DNA, 25 bp, Mus musculus
tgagcagctcaatagagccctaatg

SEQ ID NO: 852717 - DNA, 25 bp, Mus musculus
tgagcagctcacaccagggcatggg

SEQ ID NO: 852718 - DNA, 25 bp, Mus musculus
tgagcagctcacacttagcacagtc

SEQ ID NO: 852719 - DNA, 25 bp, Mus musculus
tgagcagctcactccagggcatggg

SEQ ID NO: 852720 - DNA, 25 bp, Mus musculus
tgagcagctcactcttagcacagtc

SEQ ID NO: 852721 - DNA, 25 bp, Mus musculus
tgagcagctctacttacgttttgaa

SEQ ID NO: 852722 - DNA, 25 bp, Mus musculus
tgagcagctctagttacgttttgaa

SEQ ID NO: 852723 - DNA, 25 bp, Mus musculus
tgagcagctgccagggtcactcacc

SEQ ID NO: 852724 - DNA, 25 bp, Mus musculus
tgagcagctgcctgggtcactcacc

SEQ ID NO: 852725 - DNA, 25 bp, Mus musculus
tgagcagctgctattcttttgttta

SEQ ID NO: 852726 - DNA, 25 bp, Mus musculus
tgagcagctgcttttcttttgttta

SEQ ID NO: 852727 - DNA, 25 bp, Mus musculus
tgagcagctggtagtcttcgagaca

SEQ ID NO: 852728 - DNA, 25 bp, Mus musculus
tgagcagctggttgtcttcgagaca

SEQ ID NO: 852729 - DNA, 25 bp, Mus musculus
tgagcagctgttcttcctatgtcaa

SEQ ID NO: 852730 - DNA, 25 bp, Mus musculus
tgagcagctgttgttcctatgtcaa

SEQ ID NO: 852731 - DNA, 25 bp, Mus musculus
tgagcagcttcacaaagggtggcaa

SEQ ID NO: 852732 - DNA, 25 bp, Mus musculus
tgagcagcttcagaaagggtggcaa

SEQ ID NO: 852733 - DNA, 25 bp, Mus musculus
tgagcagcttgcatttgccacgacc

SEQ ID NO: 852734 - DNA, 25 bp, Mus musculus
tgagcagcttgcttttgccacgacc

SEQ ID NO: 852735 - DNA, 25 bp, Mus musculus
tgagcaggaagcatttgctgtcaca

SEQ ID NO: 852736 - DNA, 25 bp, Mus musculus
tgagcaggaagcttttgctgtcaca

SEQ ID NO: 852737 - DNA, 25 bp, Mus musculus
tgagcaggaaggaccttgtccaacc

SEQ ID NO: 852738 - DNA, 25 bp, Mus musculus
tgagcaggaaggtccttgtccaacc

SEQ ID NO: 852739 - DNA, 25 bp, Mus musculus
tgagcaggaataatggcagaagatt

SEQ ID NO: 852740 - DNA, 25 bp, Mus musculus
tgagcaggaatattggcagaagatt

SEQ ID NO: 852741 - DNA, 25 bp, Mus musculus
tgagcaggacataagcgggcctcca

SEQ ID NO: 852742 - DNA, 25 bp, Mus musculus
tgagcaggacattagcgggcctcca

SEQ ID NO: 852743 - DNA, 25 bp, Mus musculus
tgagcaggactcagagctatgtaca

SEQ ID NO: 852744 - DNA, 25 bp, Mus musculus
tgagcaggactctgagctatgtaca

SEQ ID NO: 852745 - DNA, 25 bp, Mus musculus
tgagcaggcaccaattatcccggga

SEQ ID NO: 852746 - DNA, 25 bp, Mus musculus
tgagcaggcacctattatcccggga

SEQ ID NO: 852747 - DNA, 25 bp, Mus musculus
tgagcaggcactatccaacactatt

SEQ ID NO: 852748 - DNA, 25 bp, Mus musculus
tgagcaggcactttccaacactatt

SEQ ID NO: 852749 - DNA, 25 bp, Mus musculus
tgagcaggcagaaagcccctgtcct

SEQ ID NO: 852750 - DNA, 25 bp, Mus musculus
tgagcaggcagatagcccctgtcct

SEQ ID NO: 852751 - DNA, 25 bp, Mus musculus
tgagcaggcctgaactaggtatttg

SEQ ID NO: 852752 - DNA, 25 bp, Mus musculus
tgagcaggcctgtactaggtatttg

SEQ ID NO: 852753 - DNA, 25 bp, Mus musculus
tgagcaggcgcaattggaaatccaa

SEQ ID NO: 852754 - DNA, 25 bp, Mus musculus
tgagcaggcgcatttggaaatccaa

SEQ ID NO: 852755 - DNA, 25 bp, Mus musculus
tgagcaggctcaatcctacctacat

SEQ ID NO: 852756 - DNA, 25 bp, Mus musculus
tgagcaggctcattcctacctacat

SEQ ID NO: 852757 - DNA, 25 bp, Mus musculus
tgagcaggctgtacagagtcatgca

SEQ ID NO: 852758 - DNA, 25 bp, Mus musculus
tgagcaggctgttcagagtcatgca

SEQ ID NO: 852759 - DNA, 25 bp, Mus musculus
tgagcagggacgatcacactcccag

SEQ ID NO: 852760 - DNA, 25 bp, Mus musculus
tgagcagggacgttcacactcccag

SEQ ID NO: 852761 - DNA, 25 bp, Mus musculus
tgagcagggagcactgccagcattc

SEQ ID NO: 852762 - DNA, 25 bp, Mus musculus
tgagcagggagctctgccagcattc

SEQ ID NO: 852763 - DNA, 25 bp, Mus musculus
tgagcagggctcatctctgagaaag

SEQ ID NO: 852764 - DNA, 25 bp, Mus musculus
tgagcagggctcttctctgagaaag

SEQ ID NO: 852765 - DNA, 25 bp, Mus musculus
tgagcaggtaataagatttctaaag

SEQ ID NO: 852766 - DNA, 25 bp, Mus musculus
tgagcaggtaattagatttctaaag

SEQ ID NO: 852767 - DNA, 25 bp, Mus musculus
tgagcaggtcataagttttgtcact

SEQ ID NO: 852768 - DNA, 25 bp, Mus musculus
tgagcaggtcattagttttgtcact

SEQ ID NO: 852769 - DNA, 25 bp, Mus musculus
tgagcaggtttgacagagccggaat

SEQ ID NO: 852770 - DNA, 25 bp, Mus musculus
tgagcaggtttgtcagagccggaat

SEQ ID NO: 852771 - DNA, 25 bp, Mus musculus
tgagcagtaaccacgtctctggagt

SEQ ID NO: 852772 - DNA, 25 bp, Mus musculus
tgagcagtaacctcgtctctggagt

SEQ ID NO: 852773 - DNA, 25 bp, Mus musculus
tgagcagtacatcaccaagaccctg

SEQ ID NO: 852774 - DNA, 25 bp, Mus musculus
tgagcagtacatgaccaagaccctg

SEQ ID NO: 852775 - DNA, 25 bp, Mus musculus
tgagcagtcattattactgcctccc

SEQ ID NO: 852776 - DNA, 25 bp, Mus musculus
tgagcagtcatttttactgcctccc

SEQ ID NO: 852777 - DNA, 25 bp, Mus musculus
tgagcagtccttagactcagggctt

SEQ ID NO: 852778 - DNA, 25 bp, Mus musculus
tgagcagtccttaggctttcaaacg

SEQ ID NO: 852779 - DNA, 25 bp, Mus musculus
tgagcagtcctttgactcagggctt

SEQ ID NO: 852780 - DNA, 25 bp, Mus musculus
tgagcagtcctttggctttcaaacg

SEQ ID NO: 852781 - DNA, 25 bp, Mus musculus
tgagcagtcggactctgtggccata

SEQ ID NO: 852782 - DNA, 25 bp, Mus musculus
tgagcagtcggagtctgtggccata

SEQ ID NO: 852783 - DNA, 25 bp, Mus musculus
tgagcagtctccattgtgcctggaa

SEQ ID NO: 852784 - DNA, 25 bp, Mus musculus
tgagcagtctcctttgtgcctggaa

SEQ ID NO: 852785 - DNA, 25 bp, Mus musculus
tgagcagtgactccccttgaggacg

SEQ ID NO: 852786 - DNA, 25 bp, Mus musculus
tgagcagtgactgcccttgaggacg

SEQ ID NO: 852787 - DNA, 25 bp, Mus musculus
tgagcagtgatcaccatctctctta

SEQ ID NO: 852788 - DNA, 25 bp, Mus musculus
tgagcagtgatctccatctctctta

SEQ ID NO: 852789 - DNA, 25 bp, Mus musculus
tgagcagtgtacctgaccaattcct

SEQ ID NO: 852790 - DNA, 25 bp, Mus musculus
tgagcagtgtacgtgaccaattcct

SEQ ID NO: 852791 - DNA, 25 bp, Mus musculus
tgagcagttacgattaccctttgtt

SEQ ID NO: 852792 - DNA, 25 bp, Mus musculus
tgagcagttacgtttaccctttgtt

SEQ ID NO: 852793 - DNA, 25 bp, Mus musculus
tgagcataattccaacagtccatag

SEQ ID NO: 852794 - DNA, 25 bp, Mus musculus
tgagcataattcgaacagtccatag

SEQ ID NO: 852795 - DNA, 25 bp, Mus musculus
tgagcataatttagaattccaggca

SEQ ID NO: 852796 - DNA, 25 bp, Mus musculus
tgagcataattttgaattccaggca

SEQ ID NO: 852797 - DNA, 25 bp, Mus musculus
tgagcatacaccataccaggagcac

SEQ ID NO: 852798 - DNA, 25 bp, Mus musculus
tgagcatacaccttaccaggagcac

SEQ ID NO: 852799 - DNA, 25 bp, Mus musculus
tgagcatagccacttatagccagtt

SEQ ID NO: 852800 - DNA, 25 bp, Mus musculus
tgagcatagccagttatagccagtt

SEQ ID NO: 852801 - DNA, 25 bp, Mus musculus
tgagcatatacccacctgtgtgcca

SEQ ID NO: 852802 - DNA, 25 bp, Mus musculus
tgagcatataccgacctgtgtgcca

SEQ ID NO: 852803 - DNA, 25 bp, Mus musculus
tgagcatatatactgtctgcacaga

SEQ ID NO: 852804 - DNA, 25 bp, Mus musculus
tgagcatatatagtgtctgcacaga

SEQ ID NO: 852805 - DNA, 25 bp, Mus musculus
tgagcatattcacgcagtcagtctg

SEQ ID NO: 852806 - DNA, 25 bp, Mus musculus
tgagcatattcaggcagtcagtctg

SEQ ID NO: 852807 - DNA, 25 bp, Mus musculus
tgagcatcaaaacagcccgagaaga

SEQ ID NO: 852808 - DNA, 25 bp, Mus musculus
tgagcatcaaaagagcccgagaaga

SEQ ID NO: 852809 - DNA, 25 bp, Mus musculus
tgagcatcaccgaagtgcctgattc

SEQ ID NO: 852810 - DNA, 25 bp, Mus musculus
tgagcatcaccgtagtgcctgattc

SEQ ID NO: 852811 - DNA, 25 bp, Mus musculus
tgagcatcacctagttccatttgta

SEQ ID NO: 852812 - DNA, 25 bp, Mus musculus
tgagcatcaccttgttccatttgta

SEQ ID NO: 852813 - DNA, 25 bp, Mus musculus
tgagcatcacgcaggagggatgaat

SEQ ID NO: 852814 - DNA, 25 bp, Mus musculus
tgagcatcacgctggagggatgaat

SEQ ID NO: 852815 - DNA, 25 bp, Mus musculus
tgagcatcagatctaacaaatcaaa

SEQ ID NO: 852816 - DNA, 25 bp, Mus musculus
tgagcatcagatgtaacaaatcaaa

SEQ ID NO: 852817 - DNA, 25 bp, Mus musculus
tgagcatcagccatttcctgccctg

SEQ ID NO: 852818 - DNA, 25 bp, Mus musculus
tgagcatcagccttttcctgccctg

SEQ ID NO: 852819 - DNA, 25 bp, Mus musculus
tgagcatccatcctgattggccttg

SEQ ID NO: 852820 - DNA, 25 bp, Mus musculus
tgagcatccatcgtgattggccttg

SEQ ID NO: 852821 - DNA, 25 bp, Mus musculus
tgagcatcccccaatccatcatgga

SEQ ID NO: 852822 - DNA, 25 bp, Mus musculus
tgagcatccccctatccatcatgga

SEQ ID NO: 852823 - DNA, 25 bp, Mus musculus
tgagcatccctccagacaggcagac

SEQ ID NO: 852824 - DNA, 25 bp, Mus musculus
tgagcatccctcgagacaggcagac

SEQ ID NO: 852825 - DNA, 25 bp, Mus musculus
tgagcatccctgatcgatgggtcac

SEQ ID NO: 852826 - DNA, 25 bp, Mus musculus
tgagcatccctgttcgatgggtcac

SEQ ID NO: 852827 - DNA, 25 bp, Mus musculus
tgagcatcccttcatcccaaaatat

SEQ ID NO: 852828 - DNA, 25 bp, Mus musculus
tgagcatcccttgatcccaaaatat

SEQ ID NO: 852829 - DNA, 25 bp, Mus musculus
tgagcatccttcacaaaacttgcct

SEQ ID NO: 852830 - DNA, 25 bp, Mus musculus
tgagcatccttcagtaattcccttt

SEQ ID NO: 852831 - DNA, 25 bp, Mus musculus
tgagcatccttctcaaaacttgcct

SEQ ID NO: 852832 - DNA, 25 bp, Mus musculus
tgagcatccttctgtaattcccttt

SEQ ID NO: 852833 - DNA, 25 bp, Mus musculus
tgagcatctagactttcctaccaag

SEQ ID NO: 852834 - DNA, 25 bp, Mus musculus
tgagcatctagagtttcctaccaag

SEQ ID NO: 852835 - DNA, 25 bp, Mus musculus
tgagcatctcccacatgatttccac

SEQ ID NO: 852836 - DNA, 25 bp, Mus musculus
tgagcatctccctcatgatttccac

SEQ ID NO: 852837 - DNA, 25 bp, Mus musculus
tgagcatctcctcccgaagacaatg

SEQ ID NO: 852838 - DNA, 25 bp, Mus musculus
tgagcatctcctgccgaagacaatg

SEQ ID NO: 852839 - DNA, 25 bp, Mus musculus
tgagcatctctcaagggtcccagga

SEQ ID NO: 852840 - DNA, 25 bp, Mus musculus
tgagcatctctctagggtcccagga

SEQ ID NO: 852841 - DNA, 25 bp, Mus musculus
tgagcatctctgaccaagtttcttt

SEQ ID NO: 852842 - DNA, 25 bp, Mus musculus
tgagcatctctgtccaagtttcttt

SEQ ID NO: 852843 - DNA, 25 bp, Mus musculus
tgagcatctgtaaagacccagattt

SEQ ID NO: 852844 - DNA, 25 bp, Mus musculus
tgagcatctgtatagacccagattt

SEQ ID NO: 852845 - DNA, 25 bp, Mus musculus
tgagcatctgtcaaggaggccctga

SEQ ID NO: 852846 - DNA, 25 bp, Mus musculus
tgagcatctgtctaggaggccctga

SEQ ID NO: 852847 - DNA, 25 bp, Mus musculus
tgagcatcttcccagctgcaatggg

SEQ ID NO: 852848 - DNA, 25 bp, Mus musculus
tgagcatcttccgagctgcaatggg

SEQ ID NO: 852849 - DNA, 25 bp, Mus musculus
tgagcatgacctcttgggacaagct

SEQ ID NO: 852850 - DNA, 25 bp, Mus musculus
tgagcatgacctgttgggacaagct

SEQ ID NO: 852851 - DNA, 25 bp, Mus musculus
tgagcatgcacccagcgaagacagt

SEQ ID NO: 852852 - DNA, 25 bp, Mus musculus
tgagcatgcaccgagcgaagacagt

SEQ ID NO: 852853 - DNA, 25 bp, Mus musculus
tgagcatgccacacgtggccaagct

SEQ ID NO: 852854 - DNA, 25 bp, Mus musculus
tgagcatgccactcgtggccaagct

SEQ ID NO: 852855 - DNA, 25 bp, Mus musculus
tgagcatgcccacttcaactagtat

SEQ ID NO: 852856 - DNA, 25 bp, Mus musculus
tgagcatgcccagttcaactagtat

SEQ ID NO: 852857 - DNA, 25 bp, Mus musculus
tgagcatgccggaaggtttcctcat

SEQ ID NO: 852858 - DNA, 25 bp, Mus musculus
tgagcatgccggtaggtttcctcat

SEQ ID NO: 852859 - DNA, 25 bp, Mus musculus
tgagcatgcgctacctatggagtgc

SEQ ID NO: 852860 - DNA, 25 bp, Mus musculus
tgagcatgcgcttcctatggagtgc

SEQ ID NO: 852861 - DNA, 25 bp, Mus musculus
tgagcatgctttctgcacaggttgg

SEQ ID NO: 852862 - DNA, 25 bp, Mus musculus
tgagcatgctttgtgcacaggttgg

SEQ ID NO: 852863 - DNA, 25 bp, Mus musculus
tgagcatggacccttgtgttggccc

SEQ ID NO: 852864 - DNA, 25 bp, Mus musculus
tgagcatggaccgttgtgttggccc

SEQ ID NO: 852865 - DNA, 25 bp, Mus musculus
tgagcatggctcatacaggtacacg

SEQ ID NO: 852866 - DNA, 25 bp, Mus musculus
tgagcatggctcttacaggtacacg

SEQ ID NO: 852867 - DNA, 25 bp, Mus musculus
tgagcatggctgatcattgctgcct

SEQ ID NO: 852868 - DNA, 25 bp, Mus musculus
tgagcatggctgttcattgctgcct

SEQ ID NO: 852869 - DNA, 25 bp, Mus musculus
tgagcatggtacctgcttacctttt

SEQ ID NO: 852870 - DNA, 25 bp, Mus musculus
tgagcatggtacgtgcttacctttt

SEQ ID NO: 852871 - DNA, 25 bp, Mus musculus
tgagcatgtacaaccccgagcaagc

SEQ ID NO: 852872 - DNA, 25 bp, Mus musculus
tgagcatgtacatccccgagcaagc

SEQ ID NO: 852873 - DNA, 25 bp, Mus musculus
tgagcatgtcgaagtcacacacact

SEQ ID NO: 852874 - DNA, 25 bp, Mus musculus
tgagcatgtcgatgtcacacacact

SEQ ID NO: 852875 - DNA, 25 bp, Mus musculus
tgagcatgttgcagcatctgcaaat

SEQ ID NO: 852876 - DNA, 25 bp, Mus musculus
tgagcatgttgctgcatctgcaaat

SEQ ID NO: 852877 - DNA, 25 bp, Mus musculus
tgagcatgttggatacccagctccg

SEQ ID NO: 852878 - DNA, 25 bp, Mus musculus
tgagcatgttggttacccagctccg

SEQ ID NO: 852879 - DNA, 25 bp, Mus musculus
tgagcatgttgtagtcatcacagac

SEQ ID NO: 852880 - DNA, 25 bp, Mus musculus
tgagcatgttgttgtcatcacagac

SEQ ID NO: 852881 - DNA, 25 bp, Mus musculus
tgagcattaggtcctgtcagcacgt

SEQ ID NO: 852882 - DNA, 25 bp, Mus musculus
tgagcattaggtgctgtcagcacgt

SEQ ID NO: 852883 - DNA, 25 bp, Mus musculus
tgagcattatgcatcgcactgagcg

SEQ ID NO: 852884 - DNA, 25 bp, Mus musculus
tgagcattatgcttcgcactgagcg

SEQ ID NO: 852885 - DNA, 25 bp, Mus musculus
tgagcattcagtcattcctgcctgt

SEQ ID NO: 852886 - DNA, 25 bp, Mus musculus
tgagcattcagtgattcctgcctgt

SEQ ID NO: 852887 - DNA, 25 bp, Mus musculus
tgagcattcatgacagacctgacac

SEQ ID NO: 852888 - DNA, 25 bp, Mus musculus
tgagcattcatgtcagacctgacac

SEQ ID NO: 852889 - DNA, 25 bp, Mus musculus
tgagcattccaaagaccagcgctaa

SEQ ID NO: 852890 - DNA, 25 bp, Mus musculus
tgagcattccaatgaccagcgctaa

SEQ ID NO: 852891 - DNA, 25 bp, Mus musculus
tgagcattcctaatctaaccttctt

SEQ ID NO: 852892 - DNA, 25 bp, Mus musculus
tgagcattcctattctaaccttctt

SEQ ID NO: 852893 - DNA, 25 bp, Mus musculus
tgagcattcttcacaaagtcccgac

SEQ ID NO: 852894 - DNA, 25 bp, Mus musculus
tgagcattcttctcaaagtcccgac

SEQ ID NO: 852895 - DNA, 25 bp, Mus musculus
tgagcattgacgcttgagtgagcac

SEQ ID NO: 852896 - DNA, 25 bp, Mus musculus
tgagcattgacggttgagtgagcac

SEQ ID NO: 852897 - DNA, 25 bp, Mus musculus
tgagcattgcttacgcctgtttcat

SEQ ID NO: 852898 - DNA, 25 bp, Mus musculus
tgagcattgctttcgcctgtttcat

SEQ ID NO: 852899 - DNA, 25 bp, Mus musculus
tgagcatttactctgatgtcactac

SEQ ID NO: 852900 - DNA, 25 bp, Mus musculus
tgagcatttactgtgatgtcactac

SEQ ID NO: 852901 - DNA, 25 bp, Mus musculus
tgagcatttgctcatccttaggtct

SEQ ID NO: 852902 - DNA, 25 bp, Mus musculus
tgagcatttgctgatccttaggtct

SEQ ID NO: 852903 - DNA, 25 bp, Mus musculus
tgagccaaacagagcatcacctaag

SEQ ID NO: 852904 - DNA, 25 bp, Mus musculus
tgagccaaacagtgcatcacctaag

SEQ ID NO: 852905 - DNA, 25 bp, Mus musculus
tgagccaaagcccagctagcttgcc

SEQ ID NO: 852906 - DNA, 25 bp, Mus musculus
tgagccaaagccgagctagcttgcc

SEQ ID NO: 852907 - DNA, 25 bp, Mus musculus
tgagccaaagctcgagccaaagccc

SEQ ID NO: 852908 - DNA, 25 bp, Mus musculus
tgagccaaagctggagccaaagccc

SEQ ID NO: 852909 - DNA, 25 bp, Mus musculus
tgagccaaattaaccctgcttttcc

SEQ ID NO: 852910 - DNA, 25 bp, Mus musculus
tgagccaaattatccctgcttttcc

SEQ ID NO: 852911 - DNA, 25 bp, Mus musculus
tgagccaacagaccctttgtaaagg

SEQ ID NO: 852912 - DNA, 25 bp, Mus musculus
tgagccaacagagcctttgtaaagg

SEQ ID NO: 852913 - DNA, 25 bp, Mus musculus
tgagccaacctactgagtctcagtt

SEQ ID NO: 852914 - DNA, 25 bp, Mus musculus
tgagccaacctagtgagtctcagtt

SEQ ID NO: 852915 - DNA, 25 bp, Mus musculus
tgagccaacgacagcccttgagcag

SEQ ID NO: 852916 - DNA, 25 bp, Mus musculus
tgagccaacgactgcccttgagcag

SEQ ID NO: 852917 - DNA, 25 bp, Mus musculus
tgagccaacgcaacagggactggga

SEQ ID NO: 852918 - DNA, 25 bp, Mus musculus
tgagccaacgcacataataaagagt

SEQ ID NO: 852919 - DNA, 25 bp, Mus musculus
tgagccaacgcagataataaagagt

SEQ ID NO: 852920 - DNA, 25 bp, Mus musculus
tgagccaacgcatcagggactggga

SEQ ID NO: 852921 - DNA, 25 bp, Mus musculus
tgagccaagattctcatgcacccat

SEQ ID NO: 852922 - DNA, 25 bp, Mus musculus
tgagccaagattgtcatgcacccat

SEQ ID NO: 852923 - DNA, 25 bp, Mus musculus
tgagccaaggccacagtgccagggt

SEQ ID NO: 852924 - DNA, 25 bp, Mus musculus
tgagccaaggcctcagtgccagggt

SEQ ID NO: 852925 - DNA, 25 bp, Mus musculus
tgagccaagggaacttgcaccccat

SEQ ID NO: 852926 - DNA, 25 bp, Mus musculus
tgagccaagggatcttgcaccccat

SEQ ID NO: 852927 - DNA, 25 bp, Mus musculus
tgagccaatatgattgttttcctgg

SEQ ID NO: 852928 - DNA, 25 bp, Mus musculus
tgagccaatatgtttgttttcctgg

SEQ ID NO: 852929 - DNA, 25 bp, Mus musculus
tgagccaatcagagtcgcatcctag

SEQ ID NO: 852930 - DNA, 25 bp, Mus musculus
tgagccaatcagtgtcgcatcctag

SEQ ID NO: 852931 - DNA, 25 bp, Mus musculus
tgagccaatctgagatgctactgct

SEQ ID NO: 852932 - DNA, 25 bp, Mus musculus
tgagccaatctgtgatgctactgct

SEQ ID NO: 852933 - DNA, 25 bp, Mus musculus
tgagccaatgtgctcccatgtcagt

SEQ ID NO: 852934 - DNA, 25 bp, Mus musculus
tgagccaatgtggtcccatgtcagt

SEQ ID NO: 852935 - DNA, 25 bp, Mus musculus
tgagccaattatcactgcacacagt

SEQ ID NO: 852936 - DNA, 25 bp, Mus musculus
tgagccaattatgactgcacacagt

SEQ ID NO: 852937 - DNA, 25 bp, Mus musculus
tgagccacaataactgacagcctta

SEQ ID NO: 852938 - DNA, 25 bp, Mus musculus
tgagccacaatatctgacagcctta

SEQ ID NO: 852939 - DNA, 25 bp, Mus musculus
tgagccacacctcatccttttctgg

SEQ ID NO: 852940 - DNA, 25 bp, Mus musculus
tgagccacacctgatccttttctgg

SEQ ID NO: 852941 - DNA, 25 bp, Mus musculus
tgagccacactccagggccatgggc

SEQ ID NO: 852942 - DNA, 25 bp, Mus musculus
tgagccacactcgagggccatgggc

SEQ ID NO: 852943 - DNA, 25 bp, Mus musculus
tgagccacagcgaaggtcattgctt

SEQ ID NO: 852944 - DNA, 25 bp, Mus musculus
tgagccacagcgtaggtcattgctt

SEQ ID NO: 852945 - DNA, 25 bp, Mus musculus
tgagccaccaaccaagcagtaccat

SEQ ID NO: 852946 - DNA, 25 bp, Mus musculus
tgagccaccaacgaagcagtaccat

SEQ ID NO: 852947 - DNA, 25 bp, Mus musculus
tgagccaccaagactgcatgttctt

SEQ ID NO: 852948 - DNA, 25 bp, Mus musculus
tgagccaccaagtctgcatgttctt

SEQ ID NO: 852949 - DNA, 25 bp, Mus musculus
tgagccaccacacgcgcaggtccca

SEQ ID NO: 852950 - DNA, 25 bp, Mus musculus
tgagccaccacaggcgcaggtccca

SEQ ID NO: 852951 - DNA, 25 bp, Mus musculus
tgagccaccagaccccaaacggagg

SEQ ID NO: 852952 - DNA, 25 bp, Mus musculus
tgagccaccagagcccaaacggagg

SEQ ID NO: 852953 - DNA, 25 bp, Mus musculus
tgagccaccatgacgagtttgaaac

SEQ ID NO: 852954 - DNA, 25 bp, Mus musculus
tgagccaccatgagtcttctggaac

SEQ ID NO: 852955 - DNA, 25 bp, Mus musculus
tgagccaccatgtcgagtttgaaac

SEQ ID NO: 852956 - DNA, 25 bp, Mus musculus
tgagccaccatgtgtcttctggaac

SEQ ID NO: 852957 - DNA, 25 bp, Mus musculus
tgagccaccattcagcatggttttt

SEQ ID NO: 852958 - DNA, 25 bp, Mus musculus
tgagccaccattgagcatggttttt

SEQ ID NO: 852959 - DNA, 25 bp, Mus musculus
tgagccacccacaagcaaggctatg

SEQ ID NO: 852960 - DNA, 25 bp, Mus musculus
tgagccacccactagcaaggctatg

SEQ ID NO: 852961 - DNA, 25 bp, Mus musculus
tgagccacccagcagggacttccaa

SEQ ID NO: 852962 - DNA, 25 bp, Mus musculus
tgagccacccaggagggacttccaa

SEQ ID NO: 852963 - DNA, 25 bp, Mus musculus
tgagccacccatccgttagggaaga

SEQ ID NO: 852964 - DNA, 25 bp, Mus musculus
tgagccacccatgcgttagggaaga

SEQ ID NO: 852965 - DNA, 25 bp, Mus musculus
tgagccacctccacataagggacag

SEQ ID NO: 852966 - DNA, 25 bp, Mus musculus
tgagccacctcctcataagggacag

SEQ ID NO: 852967 - DNA, 25 bp, Mus musculus
tgagccacctgaccttccagtggtc

SEQ ID NO: 852968 - DNA, 25 bp, Mus musculus
tgagccacctgagcttccagtggtc

SEQ ID NO: 852969 - DNA, 25 bp, Mus musculus
tgagccaccttgaagatcccaagga

SEQ ID NO: 852970 - DNA, 25 bp, Mus musculus
tgagccaccttgtagatcccaagga

SEQ ID NO: 852971 - DNA, 25 bp, Mus musculus
tgagccacgactcgaactctctcaa

SEQ ID NO: 852972 - DNA, 25 bp, Mus musculus
tgagccacgactggaactctctcaa

SEQ ID NO: 852973 - DNA, 25 bp, Mus musculus
tgagccacgcaacccagatgtattt

SEQ ID NO: 852974 - DNA, 25 bp, Mus musculus
tgagccacgcaagccagatgtattt

SEQ ID NO: 852975 - DNA, 25 bp, Mus musculus
tgagccacggcaagaagcccttcag

SEQ ID NO: 852976 - DNA, 25 bp, Mus musculus
tgagccacggcatgaagcccttcag

SEQ ID NO: 852977 - DNA, 25 bp, Mus musculus
tgagccacgggcaaagagctgcaca

SEQ ID NO: 852978 - DNA, 25 bp, Mus musculus
tgagccacgggctaagagctgcaca

SEQ ID NO: 852979 - DNA, 25 bp, Mus musculus
tgagccacgtacatcttcatgtgat

SEQ ID NO: 852980 - DNA, 25 bp, Mus musculus
tgagccacgtacttcttcatgtgat

SEQ ID NO: 852981 - DNA, 25 bp, Mus musculus
tgagccacgttgacagtccgcatag

SEQ ID NO: 852982 - DNA, 25 bp, Mus musculus
tgagccacgttgtcagtccgcatag

SEQ ID NO: 852983 - DNA, 25 bp, Mus musculus
tgagccactacgattatttaccaag

SEQ ID NO: 852984 - DNA, 25 bp, Mus musculus
tgagccactacgtttatttaccaag

SEQ ID NO: 852985 - DNA, 25 bp, Mus musculus
tgagccactgagctggtagcaccag

SEQ ID NO: 852986 - DNA, 25 bp, Mus musculus
tgagccactgaggtggtagcaccag

SEQ ID NO: 852987 - DNA, 25 bp, Mus musculus
tgagccacttaaagagatcttgtct

SEQ ID NO: 852988 - DNA, 25 bp, Mus musculus
tgagccacttaatgagatcttgtct

SEQ ID NO: 852989 - DNA, 25 bp, Mus musculus
tgagccacttacatagagcaccatg

SEQ ID NO: 852990 - DNA, 25 bp, Mus musculus
tgagccacttacttagagcaccatg

SEQ ID NO: 852991 - DNA, 25 bp, Mus musculus
tgagccacttccaaaaattcccaat

SEQ ID NO: 852992 - DNA, 25 bp, Mus musculus
tgagccacttcctaaaattcccaat

SEQ ID NO: 852993 - DNA, 25 bp, Mus musculus
tgagccacttctcccacaatgtaac

SEQ ID NO: 852994 - DNA, 25 bp, Mus musculus
tgagccacttctgccacaatgtaac

SEQ ID NO: 852995 - DNA, 25 bp, Mus musculus
tgagccagaaggcaaacccttactt

SEQ ID NO: 852996 - DNA, 25 bp, Mus musculus
tgagccagaagggaaacccttactt

SEQ ID NO: 852997 - DNA, 25 bp, Mus musculus
tgagccagagcaccgagctcccgga

SEQ ID NO: 852998 - DNA, 25 bp, Mus musculus
tgagccagagcagcgagctcccgga

SEQ ID NO: 852999 - DNA, 25 bp, Mus musculus
tgagccagaggcagccatttgctga

SEQ ID NO: 853000 - DNA, 25 bp, Mus musculus
tgagccagaggcagttgatacataa

SEQ ID NO: 853001 - DNA, 25 bp, Mus musculus
tgagccagaggctgccatttgctga

SEQ ID NO: 853002 - DNA, 25 bp, Mus musculus
tgagccagaggctgttgatacataa

SEQ ID NO: 853003 - DNA, 25 bp, Mus musculus
tgagccagagggaactgccctgcaa

SEQ ID NO: 853004 - DNA, 25 bp, Mus musculus
tgagccagagggtactgccctgcaa

SEQ ID NO: 853005 - DNA, 25 bp, Mus musculus
tgagccagcaccatttaaccacttt

SEQ ID NO: 853006 - DNA, 25 bp, Mus musculus
tgagccagcaccttttaaccacttt

SEQ ID NO: 853007 - DNA, 25 bp, Mus musculus
tgagccagccaaacccggaaagaat

SEQ ID NO: 853008 - DNA, 25 bp, Mus musculus
tgagccagccaatcccggaaagaat

SEQ ID NO: 853009 - DNA, 25 bp, Mus musculus
tgagccagccacagttgttgggaat

SEQ ID NO: 853010 - DNA, 25 bp, Mus musculus
tgagccagccactgttgttgggaat

SEQ ID NO: 853011 - DNA, 25 bp, Mus musculus
tgagccagccagaggccgtgagcca

SEQ ID NO: 853012 - DNA, 25 bp, Mus musculus
tgagccagccagctgttggcaatta

SEQ ID NO: 853013 - DNA, 25 bp, Mus musculus
tgagccagccaggtgttggcaatta

SEQ ID NO: 853014 - DNA, 25 bp, Mus musculus
tgagccagccagtggccgtgagcca

SEQ ID NO: 853015 - DNA, 25 bp, Mus musculus
tgagccagcgttcctttctgaggag

SEQ ID NO: 853016 - DNA, 25 bp, Mus musculus
tgagccagcgttgctttctgaggag

SEQ ID NO: 853017 - DNA, 25 bp, Mus musculus
tgagccagctccctagcctaagtac

SEQ ID NO: 853018 - DNA, 25 bp, Mus musculus
tgagccagctccgtagcctaagtac

SEQ ID NO: 853019 - DNA, 25 bp, Mus musculus
tgagccagctgtatgcccggaaagt

SEQ ID NO: 853020 - DNA, 25 bp, Mus musculus
tgagccagctgtttgcccggaaagt

SEQ ID NO: 853021 - DNA, 25 bp, Mus musculus
tgagccaggagacttgcccacccga

SEQ ID NO: 853022 - DNA, 25 bp, Mus musculus
tgagccaggagagttgcccacccga

SEQ ID NO: 853023 - DNA, 25 bp, Mus musculus
tgagccaggcaaacagaggacagtc

SEQ ID NO: 853024 - DNA, 25 bp, Mus musculus
tgagccaggcaatcagaggacagtc

SEQ ID NO: 853025 - DNA, 25 bp, Mus musculus
tgagccaggcagaatcgcagtgact

SEQ ID NO: 853026 - DNA, 25 bp, Mus musculus
tgagccaggcagtatcgcagtgact

SEQ ID NO: 853027 - DNA, 25 bp, Mus musculus
tgagccaggcccagaatctaagagg

SEQ ID NO: 853028 - DNA, 25 bp, Mus musculus
tgagccaggcccatgtgctgcctgc

SEQ ID NO: 853029 - DNA, 25 bp, Mus musculus
tgagccaggccctgaatctaagagg

SEQ ID NO: 853030 - DNA, 25 bp, Mus musculus
tgagccaggcccttgtgctgcctgc

SEQ ID NO: 853031 - DNA, 25 bp, Mus musculus
tgagccaggctcagttgcagatggt

SEQ ID NO: 853032 - DNA, 25 bp, Mus musculus
tgagccaggctctgttgcagatggt

SEQ ID NO: 853033 - DNA, 25 bp, Mus musculus
tgagccagggacatgtgacttactt

SEQ ID NO: 853034 - DNA, 25 bp, Mus musculus
tgagccagggacttgtgacttactt

SEQ ID NO: 853035 - DNA, 25 bp, Mus musculus
tgagccagggccatcgtctctgatg

SEQ ID NO: 853036 - DNA, 25 bp, Mus musculus
tgagccagggccttcgtctctgatg

SEQ ID NO: 853037 - DNA, 25 bp, Mus musculus
tgagccagggctattgcttgttcgc

SEQ ID NO: 853038 - DNA, 25 bp, Mus musculus
tgagccagggcttttgcttgttcgc

SEQ ID NO: 853039 - DNA, 25 bp, Mus musculus
tgagccaggtccaaaatttcgcttc

SEQ ID NO: 853040 - DNA, 25 bp, Mus musculus
tgagccaggtcctaaatttcgcttc

SEQ ID NO: 853041 - DNA, 25 bp, Mus musculus
tgagccagtccaatgtaggtcacct

SEQ ID NO: 853042 - DNA, 25 bp, Mus musculus
tgagccagtccattgtaggtcacct

SEQ ID NO: 853043 - DNA, 25 bp, Mus musculus
tgagccagtgagcagggaccctaaa

SEQ ID NO: 853044 - DNA, 25 bp, Mus musculus
tgagccagtgaggagggaccctaaa

SEQ ID NO: 853045 - DNA, 25 bp, Mus musculus
tgagccagtgcgactgcaagcaggc

SEQ ID NO: 853046 - DNA, 25 bp, Mus musculus
tgagccagtgcgtctgcaagcaggc

SEQ ID NO: 853047 - DNA, 25 bp, Mus musculus
tgagccagttccagatgatgacgat

SEQ ID NO: 853048 - DNA, 25 bp, Mus musculus
tgagccagttcctgatgatgacgat

SEQ ID NO: 853049 - DNA, 25 bp, Mus musculus
tgagccatagccctcgagtaccagc

SEQ ID NO: 853050 - DNA, 25 bp, Mus musculus
tgagccatagccgtcgagtaccagc

SEQ ID NO: 853051 - DNA, 25 bp, Mus musculus
tgagccatcaaaaactagccccgaa

SEQ ID NO: 853052 - DNA, 25 bp, Mus musculus
tgagccatcaaatactagccccgaa

SEQ ID NO: 853053 - DNA, 25 bp, Mus musculus
tgagccatcactacagagagcacag

SEQ ID NO: 853054 - DNA, 25 bp, Mus musculus
tgagccatcacttcagagagcacag

SEQ ID NO: 853055 - DNA, 25 bp, Mus musculus
tgagccatccagaggtgccatcagc

SEQ ID NO: 853056 - DNA, 25 bp, Mus musculus
tgagccatccagtggtgccatcagc

SEQ ID NO: 853057 - DNA, 25 bp, Mus musculus
tgagccatcccaatttattccctac

SEQ ID NO: 853058 - DNA, 25 bp, Mus musculus
tgagccatcccattttattccctac

SEQ ID NO: 853059 - DNA, 25 bp, Mus musculus
tgagccatcccgctgaaggagtctt

SEQ ID NO: 853060 - DNA, 25 bp, Mus musculus
tgagccatcccggtgaaggagtctt

SEQ ID NO: 853061 - DNA, 25 bp, Mus musculus
tgagccatctagaggatagtagtaa

SEQ ID NO: 853062 - DNA, 25 bp, Mus musculus
tgagccatctagtggatagtagtaa

SEQ ID NO: 853063 - DNA, 25 bp, Mus musculus
tgagccatctgacagccagtgtaca

SEQ ID NO: 853064 - DNA, 25 bp, Mus musculus
tgagccatctgacctcagaccagat

SEQ ID NO: 853065 - DNA, 25 bp, Mus musculus
tgagccatctgagagccagtgtaca

SEQ ID NO: 853066 - DNA, 25 bp, Mus musculus
tgagccatctgagctcagaccagat

SEQ ID NO: 853067 - DNA, 25 bp, Mus musculus
tgagccatcttccaaccatacatgg

SEQ ID NO: 853068 - DNA, 25 bp, Mus musculus
tgagccatcttcgaaccatacatgg

SEQ ID NO: 853069 - DNA, 25 bp, Mus musculus
tgagccatctttagctcttttaccc

SEQ ID NO: 853070 - DNA, 25 bp, Mus musculus
tgagccatcttttgctcttttaccc

SEQ ID NO: 853071 - DNA, 25 bp, Mus musculus
tgagccatgagtcacaagcgaggtt

SEQ ID NO: 853072 - DNA, 25 bp, Mus musculus
tgagccatgagtcccgtggccagca

SEQ ID NO: 853073 - DNA, 25 bp, Mus musculus
tgagccatgagtgacaagcgaggtt

SEQ ID NO: 853074 - DNA, 25 bp, Mus musculus
tgagccatgagtgccgtggccagca

SEQ ID NO: 853075 - DNA, 25 bp, Mus musculus
tgagccatgattacttccttgtctc

SEQ ID NO: 853076 - DNA, 25 bp, Mus musculus
tgagccatgatttcttccttgtctc

SEQ ID NO: 853077 - DNA, 25 bp, Mus musculus
tgagccatgccacacagatgttcca

SEQ ID NO: 853078 - DNA, 25 bp, Mus musculus
tgagccatgccagacagatgttcca

SEQ ID NO: 853079 - DNA, 25 bp, Mus musculus
tgagccatgcggactcttttacagt

SEQ ID NO: 853080 - DNA, 25 bp, Mus musculus
tgagccatgcggagtgccataacag

SEQ ID NO: 853081 - DNA, 25 bp, Mus musculus
tgagccatgcggtctcttttacagt

SEQ ID NO: 853082 - DNA, 25 bp, Mus musculus
tgagccatgcggtgtgccataacag

SEQ ID NO: 853083 - DNA, 25 bp, Mus musculus
tgagccatgctaatttccagccatt

SEQ ID NO: 853084 - DNA, 25 bp, Mus musculus
tgagccatgctattttccagccatt

SEQ ID NO: 853085 - DNA, 25 bp, Mus musculus
tgagccatgggaagtgctaagctgt

SEQ ID NO: 853086 - DNA, 25 bp, Mus musculus
tgagccatgggatgtgctaagctgt

SEQ ID NO: 853087 - DNA, 25 bp, Mus musculus
tgagccatgtctcccaacagatgaa

SEQ ID NO: 853088 - DNA, 25 bp, Mus musculus
tgagccatgtctctagcatttgaag

SEQ ID NO: 853089 - DNA, 25 bp, Mus musculus
tgagccatgtctgccaacagatgaa

SEQ ID NO: 853090 - DNA, 25 bp, Mus musculus
tgagccatgtctgtagcatttgaag

SEQ ID NO: 853091 - DNA, 25 bp, Mus musculus
tgagccattcaaactaaacctatgt

SEQ ID NO: 853092 - DNA, 25 bp, Mus musculus
tgagccattcaatctaaacctatgt

SEQ ID NO: 853093 - DNA, 25 bp, Mus musculus
tgagccatttaccttgtcccttaaa

SEQ ID NO: 853094 - DNA, 25 bp, Mus musculus
tgagccatttacgttgtcccttaaa

SEQ ID NO: 853095 - DNA, 25 bp, Mus musculus
tgagccatttatatagcatcacaat

SEQ ID NO: 853096 - DNA, 25 bp, Mus musculus
tgagccatttatttagcatcacaat

SEQ ID NO: 853097 - DNA, 25 bp, Mus musculus
tgagccatttgcagaggcgaattaa

SEQ ID NO: 853098 - DNA, 25 bp, Mus musculus
tgagccatttgctgaggcgaattaa

SEQ ID NO: 853099 - DNA, 25 bp, Mus musculus
tgagccattttgatggtcctggaat

SEQ ID NO: 853100 - DNA, 25 bp, Mus musculus
tgagccattttgttggtcctggaat

SEQ ID NO: 853101 - DNA, 25 bp, Mus musculus
tgagcccaaaggagcgcaaggtgct

SEQ ID NO: 853102 - DNA, 25 bp, Mus musculus
tgagcccaaaggtgcgcaaggtgct

SEQ ID NO: 853103 - DNA, 25 bp, Mus musculus
tgagcccaacagcatccatgaagat

SEQ ID NO: 853104 - DNA, 25 bp, Mus musculus
tgagcccaacaggatccatgaagat

SEQ ID NO: 853105 - DNA, 25 bp, Mus musculus
tgagcccaatgaacccagcaggtat

SEQ ID NO: 853106 - DNA, 25 bp, Mus musculus
tgagcccaatgatcccagcaggtat

SEQ ID NO: 853107 - DNA, 25 bp, Mus musculus
tgagcccacaatcccacggaaattc

SEQ ID NO: 853108 - DNA, 25 bp, Mus musculus
tgagcccacaatgccacggaaattc

SEQ ID NO: 853109 - DNA, 25 bp, Mus musculus
tgagcccacaccacgggtaagctaa

SEQ ID NO: 853110 - DNA, 25 bp, Mus musculus
tgagcccacacctcgggtaagctaa

SEQ ID NO: 853111 - DNA, 25 bp, Mus musculus
tgagcccactaccaaggctgttttt

SEQ ID NO: 853112 - DNA, 25 bp, Mus musculus
tgagcccactacgaaggctgttttt

SEQ ID NO: 853113 - DNA, 25 bp, Mus musculus
tgagcccagagaagcgacagtagtg

SEQ ID NO: 853114 - DNA, 25 bp, Mus musculus
tgagcccagagatgcgacagtagtg

SEQ ID NO: 853115 - DNA, 25 bp, Mus musculus
tgagcccagatcatactagcttcca

SEQ ID NO: 853116 - DNA, 25 bp, Mus musculus
tgagcccagatcttactagcttcca

SEQ ID NO: 853117 - DNA, 25 bp, Mus musculus
tgagcccagcaacctgtaccttgag

SEQ ID NO: 853118 - DNA, 25 bp, Mus musculus
tgagcccagcaagctgtaccttgag

SEQ ID NO: 853119 - DNA, 25 bp, Mus musculus
tgagcccagcagataactcccctgg

SEQ ID NO: 853120 - DNA, 25 bp, Mus musculus
tgagcccagcagttaactcccctgg

SEQ ID NO: 853121 - DNA, 25 bp, Mus musculus
tgagcccagtctagctctgacttca

SEQ ID NO: 853122 - DNA, 25 bp, Mus musculus
tgagcccagtcttgctctgacttca

SEQ ID NO: 853123 - DNA, 25 bp, Mus musculus
tgagcccagtttcccctatatagtg

SEQ ID NO: 853124 - DNA, 25 bp, Mus musculus
tgagcccagtttgccctatatagtg

SEQ ID NO: 853125 - DNA, 25 bp, Mus musculus
tgagcccatagaacatcgcacttca

SEQ ID NO: 853126 - DNA, 25 bp, Mus musculus
tgagcccatagatcatcgcacttca

SEQ ID NO: 853127 - DNA, 25 bp, Mus musculus
tgagcccattagatccttcaggata

SEQ ID NO: 853128 - DNA, 25 bp, Mus musculus
tgagcccattagttccttcaggata

SEQ ID NO: 853129 - DNA, 25 bp, Mus musculus
tgagcccattcaacctcactggcta

SEQ ID NO: 853130 - DNA, 25 bp, Mus musculus
tgagcccattcatcctcactggcta

SEQ ID NO: 853131 - DNA, 25 bp, Mus musculus
tgagccccacaactcacaagctggg

SEQ ID NO: 853132 - DNA, 25 bp, Mus musculus
tgagccccacaagtcacaagctggg

SEQ ID NO: 853133 - DNA, 25 bp, Mus musculus
tgagccccacagctactgacgtcaa

SEQ ID NO: 853134 - DNA, 25 bp, Mus musculus
tgagccccacaggtactgacgtcaa

SEQ ID NO: 853135 - DNA, 25 bp, Mus musculus
tgagccccacataggagggagtctt

SEQ ID NO: 853136 - DNA, 25 bp, Mus musculus
tgagccccacattggagggagtctt

SEQ ID NO: 853137 - DNA, 25 bp, Mus musculus
tgagccccacctatgaatgtacagt

SEQ ID NO: 853138 - DNA, 25 bp, Mus musculus
tgagccccacctttgaatgtacagt

SEQ ID NO: 853139 - DNA, 25 bp, Mus musculus
tgagccccactgaggatgacgatga

SEQ ID NO: 853140 - DNA, 25 bp, Mus musculus
tgagccccactgtggatgacgatga

SEQ ID NO: 853141 - DNA, 25 bp, Mus musculus
tgagccccagtaagtccagtttaac

SEQ ID NO: 853142 - DNA, 25 bp, Mus musculus
tgagccccagtatgtccagtttaac

SEQ ID NO: 853143 - DNA, 25 bp, Mus musculus
tgagccccagtcctagaagtgcaac

SEQ ID NO: 853144 - DNA, 25 bp, Mus musculus
tgagccccagtcctgtggatcctgc

SEQ ID NO: 853145 - DNA, 25 bp, Mus musculus
tgagccccagtcgtagaagtgcaac

SEQ ID NO: 853146 - DNA, 25 bp, Mus musculus
tgagccccagtcgtgtggatcctgc

SEQ ID NO: 853147 - DNA, 25 bp, Mus musculus
tgagccccatcaattgaagtcttgt

SEQ ID NO: 853148 - DNA, 25 bp, Mus musculus
tgagccccatcatttgaagtcttgt

SEQ ID NO: 853149 - DNA, 25 bp, Mus musculus
tgagccccatgcacctgcagcacat

SEQ ID NO: 853150 - DNA, 25 bp, Mus musculus
tgagccccatgctcctgcagcacat

SEQ ID NO: 853151 - DNA, 25 bp, Mus musculus
tgagccccatgtctccgcaggacgg

SEQ ID NO: 853152 - DNA, 25 bp, Mus musculus
tgagccccatgtgtccgcaggacgg

SEQ ID NO: 853153 - DNA, 25 bp, Mus musculus
tgagcccccgggacttatggaagag

SEQ ID NO: 853154 - DNA, 25 bp, Mus musculus
tgagcccccgggtcttatggaagag

SEQ ID NO: 853155 - DNA, 25 bp, Mus musculus
tgagccccgggtcaagttgttcaat

SEQ ID NO: 853156 - DNA, 25 bp, Mus musculus
tgagccccgggtgaagttgttcaat

SEQ ID NO: 853157 - DNA, 25 bp, Mus musculus
tgagcccctaaacgagccaggcgag

SEQ ID NO: 853158 - DNA, 25 bp, Mus musculus
tgagcccctaaaggagccaggcgag

SEQ ID NO: 853159 - DNA, 25 bp, Mus musculus
tgagcccctgccatgcagtgagcag

SEQ ID NO: 853160 - DNA, 25 bp, Mus musculus
tgagcccctgccttgcagtgagcag

SEQ ID NO: 853161 - DNA, 25 bp, Mus musculus
tgagccccttctcactggttgctga

SEQ ID NO: 853162 - DNA, 25 bp, Mus musculus
tgagccccttctgactggttgctga

SEQ ID NO: 853163 - DNA, 25 bp, Mus musculus
tgagccccttgcaaacactgatcta

SEQ ID NO: 853164 - DNA, 25 bp, Mus musculus
tgagccccttgctaacactgatcta

SEQ ID NO: 853165 - DNA, 25 bp, Mus musculus
tgagcccggtaacacccgctaagga

SEQ ID NO: 853166 - DNA, 25 bp, Mus musculus
tgagcccggtaagacccgctaagga

SEQ ID NO: 853167 - DNA, 25 bp, Mus musculus
tgagcccgtacgaggattctgaaac

SEQ ID NO: 853168 - DNA, 25 bp, Mus musculus
tgagcccgtacgtggattctgaaac

SEQ ID NO: 853169 - DNA, 25 bp, Mus musculus
tgagcccgtcctcggcagaggacaa

SEQ ID NO: 853170 - DNA, 25 bp, Mus musculus
tgagcccgtcctgggcagaggacaa

SEQ ID NO: 853171 - DNA, 25 bp, Mus musculus
tgagcccgtcttcggacattcggct

SEQ ID NO: 853172 - DNA, 25 bp, Mus musculus
tgagcccgtcttgggacattcggct

SEQ ID NO: 853173 - DNA, 25 bp, Mus musculus
tgagccctaaggcacctggtagcca

SEQ ID NO: 853174 - DNA, 25 bp, Mus musculus
tgagccctaagggacctggtagcca

SEQ ID NO: 853175 - DNA, 25 bp, Mus musculus
tgagccctaatccagaacatgttta

SEQ ID NO: 853176 - DNA, 25 bp, Mus musculus
tgagccctaatcgagaacatgttta

SEQ ID NO: 853177 - DNA, 25 bp, Mus musculus
tgagccctcaatagaccgctgaaga

SEQ ID NO: 853178 - DNA, 25 bp, Mus musculus
tgagccctcaattgaccgctgaaga

SEQ ID NO: 853179 - DNA, 25 bp, Mus musculus
tgagccctcaggattcccagaggaa

SEQ ID NO: 853180 - DNA, 25 bp, Mus musculus
tgagccctcaggtttcccagaggaa

SEQ ID NO: 853181 - DNA, 25 bp, Mus musculus
tgagccctccctccttgtgagaaga

SEQ ID NO: 853182 - DNA, 25 bp, Mus musculus
tgagccctccctgcttgtgagaaga

SEQ ID NO: 853183 - DNA, 25 bp, Mus musculus
tgagccctctctagtcttcattgcc

SEQ ID NO: 853184 - DNA, 25 bp, Mus musculus
tgagccctctcttgtcttcattgcc

SEQ ID NO: 853185 - DNA, 25 bp, Mus musculus
tgagccctctggatactggatactg

SEQ ID NO: 853186 - DNA, 25 bp, Mus musculus
tgagccctctggttactggatactg

SEQ ID NO: 853187 - DNA, 25 bp, Mus musculus
tgagccctcttaacatgtcatgtgt

SEQ ID NO: 853188 - DNA, 25 bp, Mus musculus
tgagccctcttatcatgtcatgtgt

SEQ ID NO: 853189 - DNA, 25 bp, Mus musculus
tgagccctcttgagtcttggagcca

SEQ ID NO: 853190 - DNA, 25 bp, Mus musculus
tgagccctcttgtgtcttggagcca

SEQ ID NO: 853191 - DNA, 25 bp, Mus musculus
tgagccctgccaacccattgttcct

SEQ ID NO: 853192 - DNA, 25 bp, Mus musculus
tgagccctgccatcccattgttcct

SEQ ID NO: 853193 - DNA, 25 bp, Mus musculus
tgagccctgcctactggtgtagact

SEQ ID NO: 853194 - DNA, 25 bp, Mus musculus
tgagccctgccttctggtgtagact

SEQ ID NO: 853195 - DNA, 25 bp, Mus musculus
tgagccctgcgtcgacgtgttgttc

SEQ ID NO: 853196 - DNA, 25 bp, Mus musculus
tgagccctgcgtggacgtgttgttc

SEQ ID NO: 853197 - DNA, 25 bp, Mus musculus
tgagccctgcttcagtgccgagaga

SEQ ID NO: 853198 - DNA, 25 bp, Mus musculus
tgagccctgcttgagtgccgagaga

SEQ ID NO: 853199 - DNA, 25 bp, Mus musculus
tgagccctgggccagattgtttgat

SEQ ID NO: 853200 - DNA, 25 bp, Mus musculus
tgagccctgggcgagattgtttgat

SEQ ID NO: 853201 - DNA, 25 bp, Mus musculus
tgagccctgggtaaggtcagactcc

SEQ ID NO: 853202 - DNA, 25 bp, Mus musculus
tgagccctgggttaggtcagactcc

SEQ ID NO: 853203 - DNA, 25 bp, Mus musculus
tgagccctggtaccactgtgcgaga

SEQ ID NO: 853204 - DNA, 25 bp, Mus musculus
tgagccctggtagcactgtgcgaga

SEQ ID NO: 853205 - DNA, 25 bp, Mus musculus
tgagccctggtcctttctgagaaca

SEQ ID NO: 853206 - DNA, 25 bp, Mus musculus
tgagccctggtcgtttctgagaaca

SEQ ID NO: 853207 - DNA, 25 bp, Mus musculus
tgagccctgtaaccagatgccccag

SEQ ID NO: 853208 - DNA, 25 bp, Mus musculus
tgagccctgtaagcagatgccccag

SEQ ID NO: 853209 - DNA, 25 bp, Mus musculus
tgagccctgtctatacctggtataa

SEQ ID NO: 853210 - DNA, 25 bp, Mus musculus
tgagccctgtctttacctggtataa

SEQ ID NO: 853211 - DNA, 25 bp, Mus musculus
tgagccctgtgtagtgaacagaccc

SEQ ID NO: 853212 - DNA, 25 bp, Mus musculus
tgagccctgtgttgtgaacagaccc

SEQ ID NO: 853213 - DNA, 25 bp, Mus musculus
tgagcccttgagaaatgcccacaaa

SEQ ID NO: 853214 - DNA, 25 bp, Mus musculus
tgagcccttgagtaatgcccacaaa

SEQ ID NO: 853215 - DNA, 25 bp, Mus musculus
tgagcccttgcacccaagttggagt

SEQ ID NO: 853216 - DNA, 25 bp, Mus musculus
tgagcccttgcagccaagttggagt

SEQ ID NO: 853217 - DNA, 25 bp, Mus musculus
tgagcccttgctattggagatcctc

SEQ ID NO: 853218 - DNA, 25 bp, Mus musculus
tgagcccttgcttttggagatcctc

SEQ ID NO: 853219 - DNA, 25 bp, Mus musculus
tgagcccttggacccgagactgagt

SEQ ID NO: 853220 - DNA, 25 bp, Mus musculus
tgagcccttggagccgagactgagt

SEQ ID NO: 853221 - DNA, 25 bp, Mus musculus
tgagccctttcacggtcacagatca

SEQ ID NO: 853222 - DNA, 25 bp, Mus musculus
tgagccctttcagggtcacagatca

SEQ ID NO: 853223 - DNA, 25 bp, Mus musculus
tgagccgaaaccatcaccaacatag

SEQ ID NO: 853224 - DNA, 25 bp, Mus musculus
tgagccgaaaccttcaccaacatag

SEQ ID NO: 853225 - DNA, 25 bp, Mus musculus
tgagccgaccctatgttcctatgta

SEQ ID NO: 853226 - DNA, 25 bp, Mus musculus
tgagccgaccctttgttcctatgta

SEQ ID NO: 853227 - DNA, 25 bp, Mus musculus
tgagccgaccgcaccggcagcggga

SEQ ID NO: 853228 - DNA, 25 bp, Mus musculus
tgagccgaccgctccggcagcggga

SEQ ID NO: 853229 - DNA, 25 bp, Mus musculus
tgagccgacttcatgacggtcagat

SEQ ID NO: 853230 - DNA, 25 bp, Mus musculus
tgagccgacttcttgacggtcagat

SEQ ID NO: 853231 - DNA, 25 bp, Mus musculus
tgagccgagagaagaggttcacctt

SEQ ID NO: 853232 - DNA, 25 bp, Mus musculus
tgagccgagagatgaggttcacctt

SEQ ID NO: 853233 - DNA, 25 bp, Mus musculus
tgagccgattgtcctatctccagcg

SEQ ID NO: 853234 - DNA, 25 bp, Mus musculus
tgagccgattgtgctatctccagcg

SEQ ID NO: 853235 - DNA, 25 bp, Mus musculus
tgagccgcaaacacggcactgagat

SEQ ID NO: 853236 - DNA, 25 bp, Mus musculus
tgagccgcaaactcggcactgagat

SEQ ID NO: 853237 - DNA, 25 bp, Mus musculus
tgagccgcacacagctgagttacag

SEQ ID NO: 853238 - DNA, 25 bp, Mus musculus
tgagccgcacactgctgagttacag

SEQ ID NO: 853239 - DNA, 25 bp, Mus musculus
tgagccgcactaccgctggagagac

SEQ ID NO: 853240 - DNA, 25 bp, Mus musculus
tgagccgcactagcgctggagagac

SEQ ID NO: 853241 - DNA, 25 bp, Mus musculus
tgagccgcagcaccttcggtgccag

SEQ ID NO: 853242 - DNA, 25 bp, Mus musculus
tgagccgcagcagcttcggtgccag

SEQ ID NO: 853243 - DNA, 25 bp, Mus musculus
tgagccgcatcacttaagtccagct

SEQ ID NO: 853244 - DNA, 25 bp, Mus musculus
tgagccgcatcagttaagtccagct

SEQ ID NO: 853245 - DNA, 25 bp, Mus musculus
tgagccgccactcgcgggaacgtca

SEQ ID NO: 853246 - DNA, 25 bp, Mus musculus
tgagccgccactggcgggaacgtca

SEQ ID NO: 853247 - DNA, 25 bp, Mus musculus
tgagccgcccctctgaagcaaagca

SEQ ID NO: 853248 - DNA, 25 bp, Mus musculus
tgagccgcccctgtgaagcaaagca

SEQ ID NO: 853249 - DNA, 25 bp, Mus musculus
tgagccgccgccacgatgagttaga

SEQ ID NO: 853250 - DNA, 25 bp, Mus musculus
tgagccgccgcctcgatgagttaga

SEQ ID NO: 853251 - DNA, 25 bp, Mus musculus
tgagccgcctaacactggatgacat

SEQ ID NO: 853252 - DNA, 25 bp, Mus musculus
tgagccgcctaagactggatgacat

SEQ ID NO: 853253 - DNA, 25 bp, Mus musculus
tgagccgccttgctggatttccagt

SEQ ID NO: 853254 - DNA, 25 bp, Mus musculus
tgagccgccttggtggatttccagt

SEQ ID NO: 853255 - DNA, 25 bp, Mus musculus
tgagccgcggcgagctcagcaacgc

SEQ ID NO: 853256 - DNA, 25 bp, Mus musculus
tgagccgcggcgtgctcagcaacgc

SEQ ID NO: 853257 - DNA, 25 bp, Mus musculus
tgagccgctgtaccgcaaggactat

SEQ ID NO: 853258 - DNA, 25 bp, Mus musculus
tgagccgctgtagcgcaaggactat

SEQ ID NO: 853259 - DNA, 25 bp, Mus musculus
tgagccgctgttccgatttgaggcc

SEQ ID NO: 853260 - DNA, 25 bp, Mus musculus
tgagccgctgttgcgatttgaggcc

SEQ ID NO: 853261 - DNA, 25 bp, Mus musculus
tgagccggcatgagtacctgcccaa

SEQ ID NO: 853262 - DNA, 25 bp, Mus musculus
tgagccggcatgtgtacctgcccaa

SEQ ID NO: 853263 - DNA, 25 bp, Mus musculus
tgagccggccacctgcaactgagtg

SEQ ID NO: 853264 - DNA, 25 bp, Mus musculus
tgagccggccacgtgcaactgagtg

SEQ ID NO: 853265 - DNA, 25 bp, Mus musculus
tgagccggccccagacgtgctcaga

SEQ ID NO: 853266 - DNA, 25 bp, Mus musculus
tgagccggcccctgacgtgctcaga

SEQ ID NO: 853267 - DNA, 25 bp, Mus musculus
tgagccgggccaaaccttcgaatcc

SEQ ID NO: 853268 - DNA, 25 bp, Mus musculus
tgagccgggccataccttcgaatcc

SEQ ID NO: 853269 - DNA, 25 bp, Mus musculus
tgagccggtccaccagttttttatg

SEQ ID NO: 853270 - DNA, 25 bp, Mus musculus
tgagccggtccagcagttttttatg

SEQ ID NO: 853271 - DNA, 25 bp, Mus musculus
tgagccggttccaaaatcccggatt

SEQ ID NO: 853272 - DNA, 25 bp, Mus musculus
tgagccggttcctaaatcccggatt

SEQ ID NO: 853273 - DNA, 25 bp, Mus musculus
tgagccgtaactctgcactgaaggt

SEQ ID NO: 853274 - DNA, 25 bp, Mus musculus
tgagccgtaactgtgcactgaaggt

SEQ ID NO: 853275 - DNA, 25 bp, Mus musculus
tgagccgtctttacagctttccctg

SEQ ID NO: 853276 - DNA, 25 bp, Mus musculus
tgagccgtcttttcagctttccctg

SEQ ID NO: 853277 - DNA, 25 bp, Mus musculus
tgagccgtgatacaagcttgagcct

SEQ ID NO: 853278 - DNA, 25 bp, Mus musculus
tgagccgtgatagaagcttgagcct

SEQ ID NO: 853279 - DNA, 25 bp, Mus musculus
tgagccgtgtcaccagagagcctga

SEQ ID NO: 853280 - DNA, 25 bp, Mus musculus
tgagccgtgtcagcagagagcctga

SEQ ID NO: 853281 - DNA, 25 bp, Mus musculus
tgagcctaagcaaccctgtaatgac

SEQ ID NO: 853282 - DNA, 25 bp, Mus musculus
tgagcctaagcatccctgtaatgac

SEQ ID NO: 853283 - DNA, 25 bp, Mus musculus
tgagcctaagccaagtcagcattat

SEQ ID NO: 853284 - DNA, 25 bp, Mus musculus
tgagcctaagcctagtcagcattat

SEQ ID NO: 853285 - DNA, 25 bp, Mus musculus
tgagcctaatccatcttctttggaa

SEQ ID NO: 853286 - DNA, 25 bp, Mus musculus
tgagcctaatccttcttctttggaa

SEQ ID NO: 853287 - DNA, 25 bp, Mus musculus
tgagcctacacacatgagccagttt

SEQ ID NO: 853288 - DNA, 25 bp, Mus musculus
tgagcctacacagatgagccagttt

SEQ ID NO: 853289 - DNA, 25 bp, Mus musculus
tgagcctacttcagtcggagatccc

SEQ ID NO: 853290 - DNA, 25 bp, Mus musculus
tgagcctacttctgtcggagatccc

SEQ ID NO: 853291 - DNA, 25 bp, Mus musculus
tgagcctaggctctgtctacagtca

SEQ ID NO: 853292 - DNA, 25 bp, Mus musculus
tgagcctaggctgtgtctacagtca

SEQ ID NO: 853293 - DNA, 25 bp, Mus musculus
tgagcctagtgaccctttactaaga

SEQ ID NO: 853294 - DNA, 25 bp, Mus musculus
tgagcctagtgagcctttactaaga

SEQ ID NO: 853295 - DNA, 25 bp, Mus musculus
tgagcctattatagacagtcctaga

SEQ ID NO: 853296 - DNA, 25 bp, Mus musculus
tgagcctattattgacagtcctaga

SEQ ID NO: 853297 - DNA, 25 bp, Mus musculus
tgagcctattccatagagacagtaa

SEQ ID NO: 853298 - DNA, 25 bp, Mus musculus
tgagcctattccttagagacagtaa

SEQ ID NO: 853299 - DNA, 25 bp, Mus musculus
tgagcctcaggtcactctacaagcc

SEQ ID NO: 853300 - DNA, 25 bp, Mus musculus
tgagcctcaggtgactctacaagcc

SEQ ID NO: 853301 - DNA, 25 bp, Mus musculus
tgagcctcattcagggtctggtact

SEQ ID NO: 853302 - DNA, 25 bp, Mus musculus
tgagcctcattctgggtctggtact

SEQ ID NO: 853303 - DNA, 25 bp, Mus musculus
tgagcctccacacaatgctgggaat

SEQ ID NO: 853304 - DNA, 25 bp, Mus musculus
tgagcctccacagaatgctgggaat

SEQ ID NO: 853305 - DNA, 25 bp, Mus musculus
tgagcctccaggagggcaatatcca

SEQ ID NO: 853306 - DNA, 25 bp, Mus musculus
tgagcctccaggtgggcaatatcca

SEQ ID NO: 853307 - DNA, 25 bp, Mus musculus
tgagcctcccagaggaaaactgttt

SEQ ID NO: 853308 - DNA, 25 bp, Mus musculus
tgagcctcccagtggaaaactgttt

SEQ ID NO: 853309 - DNA, 25 bp, Mus musculus
tgagcctcctgaagcttcaaacaac

SEQ ID NO: 853310 - DNA, 25 bp, Mus musculus
tgagcctcctgaagcttcaaacaat

SEQ ID NO: 853311 - DNA, 25 bp, Mus musculus
tgagcctcctgacactcaaagagat

SEQ ID NO: 853312 - DNA, 25 bp, Mus musculus
tgagcctcctgagactcaaagagat

SEQ ID NO: 853313 - DNA, 25 bp, Mus musculus
tgagcctcctgatgcttcaaacaac

SEQ ID NO: 853314 - DNA, 25 bp, Mus musculus
tgagcctcctgatgcttcaaacaat

SEQ ID NO: 853315 - DNA, 25 bp, Mus musculus
tgagcctcgcggaaaaggaccctaa

SEQ ID NO: 853316 - DNA, 25 bp, Mus musculus
tgagcctcgcggtaaaggaccctaa

SEQ ID NO: 853317 - DNA, 25 bp, Mus musculus
tgagcctcgttccagggtcacatcc

SEQ ID NO: 853318 - DNA, 25 bp, Mus musculus
tgagcctcgttcgagggtcacatcc

SEQ ID NO: 853319 - DNA, 25 bp, Mus musculus
tgagcctctaaccagagatcataca

SEQ ID NO: 853320 - DNA, 25 bp, Mus musculus
tgagcctctaacgagagatcataca

SEQ ID NO: 853321 - DNA, 25 bp, Mus musculus
tgagcctctcaaaatgggttccacc

SEQ ID NO: 853322 - DNA, 25 bp, Mus musculus
tgagcctctcaatatgggttccacc

SEQ ID NO: 853323 - DNA, 25 bp, Mus musculus
tgagcctctcacactaaaatgggag

SEQ ID NO: 853324 - DNA, 25 bp, Mus musculus
tgagcctctcactctaaaatgggag

SEQ ID NO: 853325 - DNA, 25 bp, Mus musculus
tgagcctctccaagctgacctggac

SEQ ID NO: 853326 - DNA, 25 bp, Mus musculus
tgagcctctccatgctgacctggac

SEQ ID NO: 853327 - DNA, 25 bp, Mus musculus
tgagcctctctgagtcagtggaagc

SEQ ID NO: 853328 - DNA, 25 bp, Mus musculus
tgagcctctctgtgtcagtggaagc

SEQ ID NO: 853329 - DNA, 25 bp, Mus musculus
tgagcctctgggagcatcattcttg

SEQ ID NO: 853330 - DNA, 25 bp, Mus musculus
tgagcctctgggtgcatcattcttg

SEQ ID NO: 853331 - DNA, 25 bp, Mus musculus
tgagcctctggtactggtgcactgt

SEQ ID NO: 853332 - DNA, 25 bp, Mus musculus
tgagcctctggttctggtgcactgt

SEQ ID NO: 853333 - DNA, 25 bp, Mus musculus
tgagcctgaaaaatgtggacccctg

SEQ ID NO: 853334 - DNA, 25 bp, Mus musculus
tgagcctgaaaattgtggacccctg

SEQ ID NO: 853335 - DNA, 25 bp, Mus musculus
tgagcctgaaccagatgtgaagaaa

SEQ ID NO: 853336 - DNA, 25 bp, Mus musculus
tgagcctgaacctgatgtgaagaaa

SEQ ID NO: 853337 - DNA, 25 bp, Mus musculus
tgagcctgaagacttggagcacttt

SEQ ID NO: 853338 - DNA, 25 bp, Mus musculus
tgagcctgaagagttggagcacttt

SEQ ID NO: 853339 - DNA, 25 bp, Mus musculus
tgagcctgaccaaggtttgtgctgg

SEQ ID NO: 853340 - DNA, 25 bp, Mus musculus
tgagcctgaccatggtttgtgctgg

SEQ ID NO: 853341 - DNA, 25 bp, Mus musculus
tgagcctgactgcatggtgtacttc

SEQ ID NO: 853342 - DNA, 25 bp, Mus musculus
tgagcctgactggatggtgtacttc

SEQ ID NO: 853343 - DNA, 25 bp, Mus musculus
tgagcctgagagatcatcatccttg

SEQ ID NO: 853344 - DNA, 25 bp, Mus musculus
tgagcctgagagttcatcatccttg

SEQ ID NO: 853345 - DNA, 25 bp, Mus musculus
tgagcctgagcaagctctgggatgt

SEQ ID NO: 853346 - DNA, 25 bp, Mus musculus
tgagcctgagcactagccggagtct

SEQ ID NO: 853347 - DNA, 25 bp, Mus musculus
tgagcctgagcagtagccggagtct

SEQ ID NO: 853348 - DNA, 25 bp, Mus musculus
tgagcctgagcatgctctgggatgt

SEQ ID NO: 853349 - DNA, 25 bp, Mus musculus
tgagcctgagggaaacagcgaacac

SEQ ID NO: 853350 - DNA, 25 bp, Mus musculus
tgagcctgagggtaacagcgaacac

SEQ ID NO: 853351 - DNA, 25 bp, Mus musculus
tgagcctgcaggctgccagttgcct

SEQ ID NO: 853352 - DNA, 25 bp, Mus musculus
tgagcctgcagggtgccagttgcct

SEQ ID NO: 853353 - DNA, 25 bp, Mus musculus
tgagcctgccctcgaagctgatgag

SEQ ID NO: 853354 - DNA, 25 bp, Mus musculus
tgagcctgccctggaagctgatgag

SEQ ID NO: 853355 - DNA, 25 bp, Mus musculus
tgagcctgcctaccagcatggctgg

SEQ ID NO: 853356 - DNA, 25 bp, Mus musculus
tgagcctgcctagcagcatggctgg

SEQ ID NO: 853357 - DNA, 25 bp, Mus musculus
tgagcctgcggaagcaaacccctag

SEQ ID NO: 853358 - DNA, 25 bp, Mus musculus
tgagcctgcggatgcaaacccctag

SEQ ID NO: 853359 - DNA, 25 bp, Mus musculus
tgagcctgctatctatgccagtttc

SEQ ID NO: 853360 - DNA, 25 bp, Mus musculus
tgagcctgctatgtatgccagtttc

SEQ ID NO: 853361 - DNA, 25 bp, Mus musculus
tgagcctgcttcactgcataggcca

SEQ ID NO: 853362 - DNA, 25 bp, Mus musculus
tgagcctgcttcagacaactgccta

SEQ ID NO: 853363 - DNA, 25 bp, Mus musculus
tgagcctgcttcataagccctggta

SEQ ID NO: 853364 - DNA, 25 bp, Mus musculus
tgagcctgcttctctgcataggcca

SEQ ID NO: 853365 - DNA, 25 bp, Mus musculus
tgagcctgcttctgacaactgccta

SEQ ID NO: 853366 - DNA, 25 bp, Mus musculus
tgagcctgcttcttaagccctggta

SEQ ID NO: 853367 - DNA, 25 bp, Mus musculus
tgagcctggactctcagagcagtgt

SEQ ID NO: 853368 - DNA, 25 bp, Mus musculus
tgagcctggactgtcagagcagtgt

SEQ ID NO: 853369 - DNA, 25 bp, Mus musculus
tgagcctggagtagctgagctgacc

SEQ ID NO: 853370 - DNA, 25 bp, Mus musculus
tgagcctggagttgctgagctgacc

SEQ ID NO: 853371 - DNA, 25 bp, Mus musculus
tgagcctggcctacgggcgcacgct

SEQ ID NO: 853372 - DNA, 25 bp, Mus musculus
tgagcctggcctctgtaccgtgcac

SEQ ID NO: 853373 - DNA, 25 bp, Mus musculus
tgagcctggcctgtgtaccgtgcac

SEQ ID NO: 853374 - DNA, 25 bp, Mus musculus
tgagcctggccttcgggcgcacgct

SEQ ID NO: 853375 - DNA, 25 bp, Mus musculus
tgagcctgggatcacgtactcacag

SEQ ID NO: 853376 - DNA, 25 bp, Mus musculus
tgagcctgggatgacgtactcacag

SEQ ID NO: 853377 - DNA, 25 bp, Mus musculus
tgagcctgggcaagatcagcaataa

SEQ ID NO: 853378 - DNA, 25 bp, Mus musculus
tgagcctgggcacacctggagacac

SEQ ID NO: 853379 - DNA, 25 bp, Mus musculus
tgagcctgggcagacctggagacac

SEQ ID NO: 853380 - DNA, 25 bp, Mus musculus
tgagcctgggcatgatcagcaataa

SEQ ID NO: 853381 - DNA, 25 bp, Mus musculus
tgagcctgggccaagacgagctgca

SEQ ID NO: 853382 - DNA, 25 bp, Mus musculus
tgagcctgggcctagacgagctgca

SEQ ID NO: 853383 - DNA, 25 bp, Mus musculus
tgagcctggtggactttgactagat

SEQ ID NO: 853384 - DNA, 25 bp, Mus musculus
tgagcctggtggtctttgactagat

SEQ ID NO: 853385 - DNA, 25 bp, Mus musculus
tgagcctggtttcggtcctgaccgt

SEQ ID NO: 853386 - DNA, 25 bp, Mus musculus
tgagcctggtttgggtcctgaccgt

SEQ ID NO: 853387 - DNA, 25 bp, Mus musculus
tgagcctgtaggcttttcatagtgg

SEQ ID NO: 853388 - DNA, 25 bp, Mus musculus
tgagcctgtagggttttcatagtgg

SEQ ID NO: 853389 - DNA, 25 bp, Mus musculus
tgagcctgtcctcggtggagtcctc

SEQ ID NO: 853390 - DNA, 25 bp, Mus musculus
tgagcctgtcctgggtggagtcctc

SEQ ID NO: 853391 - DNA, 25 bp, Mus musculus
tgagcctgtcgacaaggaagccaga

SEQ ID NO: 853392 - DNA, 25 bp, Mus musculus
tgagcctgtcgagaaggaagccaga

SEQ ID NO: 853393 - DNA, 25 bp, Mus musculus
tgagcctgtgacaaagagcctgtga

SEQ ID NO: 853394 - DNA, 25 bp, Mus musculus
tgagcctgtgactaagagcctgtga

SEQ ID NO: 853395 - DNA, 25 bp, Mus musculus
tgagcctgtgctattagaaagtcca

SEQ ID NO: 853396 - DNA, 25 bp, Mus musculus
tgagcctgtgcttttagaaagtcca

SEQ ID NO: 853397 - DNA, 25 bp, Mus musculus
tgagcctgtggaccaggactacctg

SEQ ID NO: 853398 - DNA, 25 bp, Mus musculus
tgagcctgtggagcaggactacctg

SEQ ID NO: 853399 - DNA, 25 bp, Mus musculus
tgagcctgtgttctgtcagcttcag

SEQ ID NO: 853400 - DNA, 25 bp, Mus musculus
tgagcctgtgttgtgtcagcttcag

SEQ ID NO: 853401 - DNA, 25 bp, Mus musculus
tgagcctgttgcagagaccttgcca

SEQ ID NO: 853402 - DNA, 25 bp, Mus musculus
tgagcctgttgctgagaccttgcca

SEQ ID NO: 853403 - DNA, 25 bp, Mus musculus
tgagccttatttcatctacttccta

SEQ ID NO: 853404 - DNA, 25 bp, Mus musculus
tgagccttatttgatctacttccta

SEQ ID NO: 853405 - DNA, 25 bp, Mus musculus
tgagccttcacaatagcccgaggaa

SEQ ID NO: 853406 - DNA, 25 bp, Mus musculus
tgagccttcacattagcccgaggaa

SEQ ID NO: 853407 - DNA, 25 bp, Mus musculus
tgagccttcctgatgttccagcaaa

SEQ ID NO: 853408 - DNA, 25 bp, Mus musculus
tgagccttcctgttgttccagcaaa

SEQ ID NO: 853409 - DNA, 25 bp, Mus musculus
tgagccttcttgcttgtagacacca

SEQ ID NO: 853410 - DNA, 25 bp, Mus musculus
tgagccttcttggttgtagacacca

SEQ ID NO: 853411 - DNA, 25 bp, Mus musculus
tgagccttgcatatcccatctgaag

SEQ ID NO: 853412 - DNA, 25 bp, Mus musculus
tgagccttgcatttcccatctgaag

SEQ ID NO: 853413 - DNA, 25 bp, Mus musculus
tgagccttgccacttagagaacaag

SEQ ID NO: 853414 - DNA, 25 bp, Mus musculus
tgagccttgccagttagagaacaag

SEQ ID NO: 853415 - DNA, 25 bp, Mus musculus
tgagccttggatactaattcctatt

SEQ ID NO: 853416 - DNA, 25 bp, Mus musculus
tgagccttggattctaattcctatt

SEQ ID NO: 853417 - DNA, 25 bp, Mus musculus
tgagccttggcacccagctagcaaa

SEQ ID NO: 853418 - DNA, 25 bp, Mus musculus
tgagccttggcagccagctagcaaa

SEQ ID NO: 853419 - DNA, 25 bp, Mus musculus
tgagccttgggtcatttgttctgta

SEQ ID NO: 853420 - DNA, 25 bp, Mus musculus
tgagccttgggtgatttgttctgta

SEQ ID NO: 853421 - DNA, 25 bp, Mus musculus
tgagccttggtgaacccttaacaac

SEQ ID NO: 853422 - DNA, 25 bp, Mus musculus
tgagccttggtgtacccttaacaac

SEQ ID NO: 853423 - DNA, 25 bp, Mus musculus
tgagccttgtatctgtcatgtgaca

SEQ ID NO: 853424 - DNA, 25 bp, Mus musculus
tgagccttgtatgtgtcatgtgaca

SEQ ID NO: 853425 - DNA, 25 bp, Mus musculus
tgagccttgtctaccttcagtgtgg

SEQ ID NO: 853426 - DNA, 25 bp, Mus musculus
tgagccttgtcttccttcagtgtgg

SEQ ID NO: 853427 - DNA, 25 bp, Mus musculus
tgagcctttaccacaccagtctcaa

SEQ ID NO: 853428 - DNA, 25 bp, Mus musculus
tgagcctttaccacaggtcttgaac

SEQ ID NO: 853429 - DNA, 25 bp, Mus musculus
tgagcctttacctcaccagtctcaa

SEQ ID NO: 853430 - DNA, 25 bp, Mus musculus
tgagcctttacctcaggtcttgaac

SEQ ID NO: 853431 - DNA, 25 bp, Mus musculus
tgagcctttcagaaggcagtctgtt

SEQ ID NO: 853432 - DNA, 25 bp, Mus musculus
tgagcctttcagtaggcagtctgtt

SEQ ID NO: 853433 - DNA, 25 bp, Mus musculus
tgagcctttcccacctgccaggacc

SEQ ID NO: 853434 - DNA, 25 bp, Mus musculus
tgagcctttccctcctgccaggacc

SEQ ID NO: 853435 - DNA, 25 bp, Mus musculus
tgagcctttcctagaaggtcctgtg

SEQ ID NO: 853436 - DNA, 25 bp, Mus musculus
tgagcctttccttgaaggtcctgtg

SEQ ID NO: 853437 - DNA, 25 bp, Mus musculus
tgagcctttgccagggtgaccgtgc

SEQ ID NO: 853438 - DNA, 25 bp, Mus musculus
tgagcctttgcctgggtgaccgtgc

SEQ ID NO: 853439 - DNA, 25 bp, Mus musculus
tgagcctttgctctcaatgggcgga

SEQ ID NO: 853440 - DNA, 25 bp, Mus musculus
tgagcctttgctgtcaatgggcgga

SEQ ID NO: 853441 - DNA, 25 bp, Mus musculus
tgagcctttgtaaggctttccccaa

SEQ ID NO: 853442 - DNA, 25 bp, Mus musculus
tgagcctttgtatggctttccccaa

SEQ ID NO: 853443 - DNA, 25 bp, Mus musculus
tgagccttttcacctgcattatatc

SEQ ID NO: 853444 - DNA, 25 bp, Mus musculus
tgagccttttcagctgcattatatc

SEQ ID NO: 853445 - DNA, 25 bp, Mus musculus
tgagcgaaagagagaaagcctattt

SEQ ID NO: 853446 - DNA, 25 bp, Mus musculus
tgagcgaaagagtgaaagcctattt

SEQ ID NO: 853447 - DNA, 25 bp, Mus musculus
tgagcgaacaacaagcatatctgca

SEQ ID NO: 853448 - DNA, 25 bp, Mus musculus
tgagcgaacaactagcatatctgca

SEQ ID NO: 853449 - DNA, 25 bp, Mus musculus
tgagcgaaccagaccagagcattaa

SEQ ID NO: 853450 - DNA, 25 bp, Mus musculus
tgagcgaaccagtccagagcattaa

SEQ ID NO: 853451 - DNA, 25 bp, Mus musculus
tgagcgaaccctcacgcgcgaagct

SEQ ID NO: 853452 - DNA, 25 bp, Mus musculus
tgagcgaaccctgacgcgcgaagct

SEQ ID NO: 853453 - DNA, 25 bp, Mus musculus
tgagcgaagagtacccacaagagat

SEQ ID NO: 853454 - DNA, 25 bp, Mus musculus
tgagcgaagagttcccacaagagat

SEQ ID NO: 853455 - DNA, 25 bp, Mus musculus
tgagcgaagggcatgacctcaggct

SEQ ID NO: 853456 - DNA, 25 bp, Mus musculus
tgagcgaagggcttgacctcaggct

SEQ ID NO: 853457 - DNA, 25 bp, Mus musculus
tgagcgaagtatagtctgacctggt

SEQ ID NO: 853458 - DNA, 25 bp, Mus musculus
tgagcgaagtattgtctgacctggt

SEQ ID NO: 853459 - DNA, 25 bp, Mus musculus
tgagcgaatcatcaagccggaccct

SEQ ID NO: 853460 - DNA, 25 bp, Mus musculus
tgagcgaatcatgaagccggaccct

SEQ ID NO: 853461 - DNA, 25 bp, Mus musculus
tgagcgacctcaaatccagtgccag

SEQ ID NO: 853462 - DNA, 25 bp, Mus musculus
tgagcgacctcatatccagtgccag

SEQ ID NO: 853463 - DNA, 25 bp, Mus musculus
tgagcgacctgcaagattcacaaga

SEQ ID NO: 853464 - DNA, 25 bp, Mus musculus
tgagcgacctgctagattcacaaga

SEQ ID NO: 853465 - DNA, 25 bp, Mus musculus
tgagcgactaggagcttcccttgaa

SEQ ID NO: 853466 - DNA, 25 bp, Mus musculus
tgagcgactaggtgcttcccttgaa

SEQ ID NO: 853467 - DNA, 25 bp, Mus musculus
tgagcgacttcgaatccctgagggc

SEQ ID NO: 853468 - DNA, 25 bp, Mus musculus
tgagcgacttcgtatccctgagggc

SEQ ID NO: 853469 - DNA, 25 bp, Mus musculus
tgagcgagacctaggaattccttgc

SEQ ID NO: 853470 - DNA, 25 bp, Mus musculus
tgagcgagaccttggaattccttgc

SEQ ID NO: 853471 - DNA, 25 bp, Mus musculus
tgagcgagatccagagtttgcccca

SEQ ID NO: 853472 - DNA, 25 bp, Mus musculus
tgagcgagatcctgagtttgcccca

SEQ ID NO: 853473 - DNA, 25 bp, Mus musculus
tgagcgagctaaacctctccaggag

SEQ ID NO: 853474 - DNA, 25 bp, Mus musculus
tgagcgagctaatcctctccaggag

SEQ ID NO: 853475 - DNA, 25 bp, Mus musculus
tgagcgaggctaacacccacttggg

SEQ ID NO: 853476 - DNA, 25 bp, Mus musculus
tgagcgaggctatcacccacttggg

SEQ ID NO: 853477 - DNA, 25 bp, Mus musculus
tgagcgaggtgaagccgtcctaccg

SEQ ID NO: 853478 - DNA, 25 bp, Mus musculus
tgagcgaggtgatgccgtcctaccg

SEQ ID NO: 853479 - DNA, 25 bp, Mus musculus
tgagcgaggtggagggccacgccaa

SEQ ID NO: 853480 - DNA, 25 bp, Mus musculus
tgagcgaggtggtgggccacgccaa

SEQ ID NO: 853481 - DNA, 25 bp, Mus musculus
tgagcgagtctcatgcaacccaaaa

SEQ ID NO: 853482 - DNA, 25 bp, Mus musculus
tgagcgagtctcttgcaacccaaaa

SEQ ID NO: 853483 - DNA, 25 bp, Mus musculus
tgagcgagtgctatcctcccacaaa

SEQ ID NO: 853484 - DNA, 25 bp, Mus musculus
tgagcgagtgctttcctcccacaaa

SEQ ID NO: 853485 - DNA, 25 bp, Mus musculus
tgagcgatgttcatgcaggcaagac

SEQ ID NO: 853486 - DNA, 25 bp, Mus musculus
tgagcgatgttcttgcaggcaagac

SEQ ID NO: 853487 - DNA, 25 bp, Mus musculus
tgagcgcaatccctgcgcggtgaaa

SEQ ID NO: 853488 - DNA, 25 bp, Mus musculus
tgagcgcaatccgtgcgcggtgaaa

SEQ ID NO: 853489 - DNA, 25 bp, Mus musculus
tgagcgcaccggcacactttcgagg

SEQ ID NO: 853490 - DNA, 25 bp, Mus musculus
tgagcgcaccgggacactttcgagg

SEQ ID NO: 853491 - DNA, 25 bp, Mus musculus
tgagcgcacgctccggctcttggct

SEQ ID NO: 853492 - DNA, 25 bp, Mus musculus
tgagcgcacgctgcggctcttggct

SEQ ID NO: 853493 - DNA, 25 bp, Mus musculus
tgagcgcagcctatatctaaccaca

SEQ ID NO: 853494 - DNA, 25 bp, Mus musculus
tgagcgcagcctttatctaaccaca

SEQ ID NO: 853495 - DNA, 25 bp, Mus musculus
tgagcgcagcgtagccacaggaaca

SEQ ID NO: 853496 - DNA, 25 bp, Mus musculus
tgagcgcagcgttgccacaggaaca

SEQ ID NO: 853497 - DNA, 25 bp, Mus musculus
tgagcgcatcagcatcctctgaggc

SEQ ID NO: 853498 - DNA, 25 bp, Mus musculus
tgagcgcatcaggatcctctgaggc

SEQ ID NO: 853499 - DNA, 25 bp, Mus musculus
tgagcgcatgaccaggtgaaccctc

SEQ ID NO: 853500 - DNA, 25 bp, Mus musculus
tgagcgcatgacgaggtgaaccctc

SEQ ID NO: 853501 - DNA, 25 bp, Mus musculus
tgagcgccaccacagggacacagag

SEQ ID NO: 853502 - DNA, 25 bp, Mus musculus
tgagcgccaccagagggacacagag

SEQ ID NO: 853503 - DNA, 25 bp, Mus musculus
tgagcgccagcacctgattgcccag

SEQ ID NO: 853504 - DNA, 25 bp, Mus musculus
tgagcgccagcagctgattgcccag

SEQ ID NO: 853505 - DNA, 25 bp, Mus musculus
tgagcgccatcacacggaagttcaa

SEQ ID NO: 853506 - DNA, 25 bp, Mus musculus
tgagcgccatcagacggaagttcaa

SEQ ID NO: 853507 - DNA, 25 bp, Mus musculus
tgagcgccatgaacccagtgggcat

SEQ ID NO: 853508 - DNA, 25 bp, Mus musculus
tgagcgccatgatcccagtgggcat

SEQ ID NO: 853509 - DNA, 25 bp, Mus musculus
tgagcgcccactcgccttgaagagt

SEQ ID NO: 853510 - DNA, 25 bp, Mus musculus
tgagcgcccactggccttgaagagt

SEQ ID NO: 853511 - DNA, 25 bp, Mus musculus
tgagcgcccaggatgcagaatcgga

SEQ ID NO: 853512 - DNA, 25 bp, Mus musculus
tgagcgcccaggttgcagaatcgga

SEQ ID NO: 853513 - DNA, 25 bp, Mus musculus
tgagcgccggcgcacagtgacctca

SEQ ID NO: 853514 - DNA, 25 bp, Mus musculus
tgagcgccggcggacagtgacctca

SEQ ID NO: 853515 - DNA, 25 bp, Mus musculus
tgagcgcctgccctggtatctatca

SEQ ID NO: 853516 - DNA, 25 bp, Mus musculus
tgagcgcctgccgtggtatctatca

SEQ ID NO: 853517 - DNA, 25 bp, Mus musculus
tgagcgcgccaaccgtgtaccagaa

SEQ ID NO: 853518 - DNA, 25 bp, Mus musculus
tgagcgcgccaagcgtgtaccagaa

SEQ ID NO: 853519 - DNA, 25 bp, Mus musculus
tgagcgcgtctcaaagcactttact

SEQ ID NO: 853520 - DNA, 25 bp, Mus musculus
tgagcgcgtctctaagcactttact

SEQ ID NO: 853521 - DNA, 25 bp, Mus musculus
tgagcgctacgtcctgtacatggtg

SEQ ID NO: 853522 - DNA, 25 bp, Mus musculus
tgagcgctacgtgctgtacatggtg

SEQ ID NO: 853523 - DNA, 25 bp, Mus musculus
tgagcgctagaacgccagatatccc

SEQ ID NO: 853524 - DNA, 25 bp, Mus musculus
tgagcgctagaaggccagatatccc

SEQ ID NO: 853525 - DNA, 25 bp, Mus musculus
tgagcgctctgcactttgagctcga

SEQ ID NO: 853526 - DNA, 25 bp, Mus musculus
tgagcgctctgccaccagaggaaat

SEQ ID NO: 853527 - DNA, 25 bp, Mus musculus
tgagcgctctgcgaccagaggaaat

SEQ ID NO: 853528 - DNA, 25 bp, Mus musculus
tgagcgctctgctctttgagctcga

SEQ ID NO: 853529 - DNA, 25 bp, Mus musculus
tgagcgctgggacttatgccccact

SEQ ID NO: 853530 - DNA, 25 bp, Mus musculus
tgagcgctgggagttatgccccact

SEQ ID NO: 853531 - DNA, 25 bp, Mus musculus
tgagcgcttcttaatctgatccagt

SEQ ID NO: 853532 - DNA, 25 bp, Mus musculus
tgagcgcttctttatctgatccagt

SEQ ID NO: 853533 - DNA, 25 bp, Mus musculus
tgagcggaagtgattccctgctttc

SEQ ID NO: 853534 - DNA, 25 bp, Mus musculus
tgagcggaagtgtttccctgctttc

SEQ ID NO: 853535 - DNA, 25 bp, Mus musculus
tgagcggactgaagtctggtcccta

SEQ ID NO: 853536 - DNA, 25 bp, Mus musculus
tgagcggactgatgtctggtcccta

SEQ ID NO: 853537 - DNA, 25 bp, Mus musculus
tgagcggagccaacccagttcagga

SEQ ID NO: 853538 - DNA, 25 bp, Mus musculus
tgagcggagccatcccagttcagga

SEQ ID NO: 853539 - DNA, 25 bp, Mus musculus
tgagcggcctgaagattccccgggt

SEQ ID NO: 853540 - DNA, 25 bp, Mus musculus
tgagcggcctgatgattccccgggt

SEQ ID NO: 853541 - DNA, 25 bp, Mus musculus
tgagcggcgcagaagtctactactt

SEQ ID NO: 853542 - DNA, 25 bp, Mus musculus
tgagcggcgcagtagtctactactt

SEQ ID NO: 853543 - DNA, 25 bp, Mus musculus
tgagcggctgagaaaccatccttga

SEQ ID NO: 853544 - DNA, 25 bp, Mus musculus
tgagcggctgagtaaccatccttga

SEQ ID NO: 853545 - DNA, 25 bp, Mus musculus
tgagcggctgctagtctggatccaa

SEQ ID NO: 853546 - DNA, 25 bp, Mus musculus
tgagcggctgcttgtctggatccaa

SEQ ID NO: 853547 - DNA, 25 bp, Mus musculus
tgagcgggcatcaaagattcgcaga

SEQ ID NO: 853548 - DNA, 25 bp, Mus musculus
tgagcgggcatctaagattcgcaga

SEQ ID NO: 853549 - DNA, 25 bp, Mus musculus
tgagcgggttctacaccatcatcaa

SEQ ID NO: 853550 - DNA, 25 bp, Mus musculus
tgagcgggttcttcaccatcatcaa

SEQ ID NO: 853551 - DNA, 25 bp, Mus musculus
tgagcggtaccgacaccattaatgt

SEQ ID NO: 853552 - DNA, 25 bp, Mus musculus
tgagcggtaccgtcaccattaatgt

SEQ ID NO: 853553 - DNA, 25 bp, Mus musculus
tgagcggttatcaccatggtattac

SEQ ID NO: 853554 - DNA, 25 bp, Mus musculus
tgagcggttatctccatggtattac

SEQ ID NO: 853555 - DNA, 25 bp, Mus musculus
tgagcggttcagacactccaggagg

SEQ ID NO: 853556 - DNA, 25 bp, Mus musculus
tgagcggttcagtcactccaggagg

SEQ ID NO: 853557 - DNA, 25 bp, Mus musculus
tgagcgtatggactgtaaggcactt

SEQ ID NO: 853558 - DNA, 25 bp, Mus musculus
tgagcgtatggagtgtaaggcactt

SEQ ID NO: 853559 - DNA, 25 bp, Mus musculus
tgagcgtccgctaatggaaggtccc

SEQ ID NO: 853560 - DNA, 25 bp, Mus musculus
tgagcgtccgcttatggaaggtccc

SEQ ID NO: 853561 - DNA, 25 bp, Mus musculus
tgagcgtcctccaattagctcagta

SEQ ID NO: 853562 - DNA, 25 bp, Mus musculus
tgagcgtcctcctattagctcagta

SEQ ID NO: 853563 - DNA, 25 bp, Mus musculus
tgagcgtctgaacgttgttcacaag

SEQ ID NO: 853564 - DNA, 25 bp, Mus musculus
tgagcgtctgaaggttgttcacaag

SEQ ID NO: 853565 - DNA, 25 bp, Mus musculus
tgagcgtgaacaagggcctcctgac

SEQ ID NO: 853566 - DNA, 25 bp, Mus musculus
tgagcgtgaacatgggcctcctgac

SEQ ID NO: 853567 - DNA, 25 bp, Mus musculus
tgagcgtgaaccatagttccccgcg

SEQ ID NO: 853568 - DNA, 25 bp, Mus musculus
tgagcgtgaaccttagttccccgcg

SEQ ID NO: 853569 - DNA, 25 bp, Mus musculus
tgagcgtgaatactgccgctttccc

SEQ ID NO: 853570 - DNA, 25 bp, Mus musculus
tgagcgtgaatagtgccgctttccc

SEQ ID NO: 853571 - DNA, 25 bp, Mus musculus
tgagcgtgcaagctagactctccac

SEQ ID NO: 853572 - DNA, 25 bp, Mus musculus
tgagcgtgcaaggtagactctccac

SEQ ID NO: 853573 - DNA, 25 bp, Mus musculus
tgagcgtgcccaacattatcatcac

SEQ ID NO: 853574 - DNA, 25 bp, Mus musculus
tgagcgtgcccatcattatcatcac

SEQ ID NO: 853575 - DNA, 25 bp, Mus musculus
tgagcgtgcctaccctggcaagatc

SEQ ID NO: 853576 - DNA, 25 bp, Mus musculus
tgagcgtgcctagcctggcaagatc

SEQ ID NO: 853577 - DNA, 25 bp, Mus musculus
tgagcgtgcctcagttcagtaaggg

SEQ ID NO: 853578 - DNA, 25 bp, Mus musculus
tgagcgtgcctctgttcagtaaggg

SEQ ID NO: 853579 - DNA, 25 bp, Mus musculus
tgagcgtgtccgacgtgtgccagca

SEQ ID NO: 853580 - DNA, 25 bp, Mus musculus
tgagcgtgtccgtcgtgtgccagca

SEQ ID NO: 853581 - DNA, 25 bp, Mus musculus
tgagcgttgtgtcccctagggctcc

SEQ ID NO: 853582 - DNA, 25 bp, Mus musculus
tgagcgttgtgtgccctagggctcc

SEQ ID NO: 853583 - DNA, 25 bp, Mus musculus
tgagcgtttgcaaacatacactttt

SEQ ID NO: 853584 - DNA, 25 bp, Mus musculus
tgagcgtttgcatacatacactttt

SEQ ID NO: 853585 - DNA, 25 bp, Mus musculus
tgagcgtttgccatcctgtgctggg

SEQ ID NO: 853586 - DNA, 25 bp, Mus musculus
tgagcgtttgccttcctgtgctggg

SEQ ID NO: 853587 - DNA, 25 bp, Mus musculus
tgagctaaagcgatcctgcacagga

SEQ ID NO: 853588 - DNA, 25 bp, Mus musculus
tgagctaaagcgctctgccatgagg

SEQ ID NO: 853589 - DNA, 25 bp, Mus musculus
tgagctaaagcggtctgccatgagg

SEQ ID NO: 853590 - DNA, 25 bp, Mus musculus
tgagctaaagcgttcctgcacagga

SEQ ID NO: 853591 - DNA, 25 bp, Mus musculus
tgagctaaccctacctgcagtttgg

SEQ ID NO: 853592 - DNA, 25 bp, Mus musculus
tgagctaacccttcctgcagtttgg

SEQ ID NO: 853593 - DNA, 25 bp, Mus musculus
tgagctaaggctcgccctattccat

SEQ ID NO: 853594 - DNA, 25 bp, Mus musculus
tgagctaaggctggccctattccat

SEQ ID NO: 853595 - DNA, 25 bp, Mus musculus
tgagctaaggttctgactgggttac

SEQ ID NO: 853596 - DNA, 25 bp, Mus musculus
tgagctaaggttgtgactgggttac

SEQ ID NO: 853597 - DNA, 25 bp, Mus musculus
tgagctaagtcacagggagccccaa

SEQ ID NO: 853598 - DNA, 25 bp, Mus musculus
tgagctaagtcagagggagccccaa

SEQ ID NO: 853599 - DNA, 25 bp, Mus musculus
tgagctaatcctcacatttggcgcc

SEQ ID NO: 853600 - DNA, 25 bp, Mus musculus
tgagctaatcctgacatttggcgcc

SEQ ID NO: 853601 - DNA, 25 bp, Mus musculus
tgagctaattatccagacctttgta

SEQ ID NO: 853602 - DNA, 25 bp, Mus musculus
tgagctaattatgcagacctttgta

SEQ ID NO: 853603 - DNA, 25 bp, Mus musculus
tgagctaattccagttctttggttt

SEQ ID NO: 853604 - DNA, 25 bp, Mus musculus
tgagctaattcctgttctttggttt

SEQ ID NO: 853605 - DNA, 25 bp, Mus musculus
tgagctacacccattcacaaacaag

SEQ ID NO: 853606 - DNA, 25 bp, Mus musculus
tgagctacaccctttcacaaacaag

SEQ ID NO: 853607 - DNA, 25 bp, Mus musculus
tgagctacacctctgcttgtgccaa

SEQ ID NO: 853608 - DNA, 25 bp, Mus musculus
tgagctacacctgtgcttgtgccaa

SEQ ID NO: 853609 - DNA, 25 bp, Mus musculus
tgagctacacggagctggcggccaa

SEQ ID NO: 853610 - DNA, 25 bp, Mus musculus
tgagctacacggtgctggcggccaa

SEQ ID NO: 853611 - DNA, 25 bp, Mus musculus
tgagctacccagagaccgctttata

SEQ ID NO: 853612 - DNA, 25 bp, Mus musculus
tgagctacccagcaagttctagacc

SEQ ID NO: 853613 - DNA, 25 bp, Mus musculus
tgagctacccaggaagttctagacc

SEQ ID NO: 853614 - DNA, 25 bp, Mus musculus
tgagctacccagtgaccgctttata

SEQ ID NO: 853615 - DNA, 25 bp, Mus musculus
tgagctacccgcatactgagattac

SEQ ID NO: 853616 - DNA, 25 bp, Mus musculus
tgagctacccgcttactgagattac

SEQ ID NO: 853617 - DNA, 25 bp, Mus musculus
tgagctacctgacctggctacgctt

SEQ ID NO: 853618 - DNA, 25 bp, Mus musculus
tgagctacctgagctggctacgctt

SEQ ID NO: 853619 - DNA, 25 bp, Mus musculus
tgagctacctggagtgaagacctaa

SEQ ID NO: 853620 - DNA, 25 bp, Mus musculus
tgagctacctggtgtgaagacctaa

SEQ ID NO: 853621 - DNA, 25 bp, Mus musculus
tgagctacctttacacgcctacttt

SEQ ID NO: 853622 - DNA, 25 bp, Mus musculus
tgagctaccttttcacgcctacttt

SEQ ID NO: 853623 - DNA, 25 bp, Mus musculus
tgagctacgctgcagataactttgt

SEQ ID NO: 853624 - DNA, 25 bp, Mus musculus
tgagctacgctggagataactttgt

SEQ ID NO: 853625 - DNA, 25 bp, Mus musculus
tgagctactactacggcaactacta

SEQ ID NO: 853626 - DNA, 25 bp, Mus musculus
tgagctactacttcggcaactacta

SEQ ID NO: 853627 - DNA, 25 bp, Mus musculus
tgagctactaggacagggcccaata

SEQ ID NO: 853628 - DNA, 25 bp, Mus musculus
tgagctactaggtcagggcccaata

SEQ ID NO: 853629 - DNA, 25 bp, Mus musculus
tgagctactcagactaccctagtaa

SEQ ID NO: 853630 - DNA, 25 bp, Mus musculus
tgagctactcagtctaccctagtaa

SEQ ID NO: 853631 - DNA, 25 bp, Mus musculus
tgagctactgatatcttgacaatga

SEQ ID NO: 853632 - DNA, 25 bp, Mus musculus
tgagctactgatttcttgacaatga

SEQ ID NO: 853633 - DNA, 25 bp, Mus musculus
tgagctactgcaaacaagaccccac

SEQ ID NO: 853634 - DNA, 25 bp, Mus musculus
tgagctactgcatacaagaccccac

SEQ ID NO: 853635 - DNA, 25 bp, Mus musculus
tgagctacttttaactttctcttcc

SEQ ID NO: 853636 - DNA, 25 bp, Mus musculus
tgagctactttttactttctcttcc

SEQ ID NO: 853637 - DNA, 25 bp, Mus musculus
tgagctagaatgaaatgtccacgtt

SEQ ID NO: 853638 - DNA, 25 bp, Mus musculus
tgagctagaatgtaatgtccacgtt

SEQ ID NO: 853639 - DNA, 25 bp, Mus musculus
tgagctagatctcatgccagcccca

SEQ ID NO: 853640 - DNA, 25 bp, Mus musculus
tgagctagatctgatgccagcccca

SEQ ID NO: 853641 - DNA, 25 bp, Mus musculus
tgagctagattgaccagttctggta

SEQ ID NO: 853642 - DNA, 25 bp, Mus musculus
tgagctagattgtccagttctggta

SEQ ID NO: 853643 - DNA, 25 bp, Mus musculus
tgagctagccaacaggacacctgtt

SEQ ID NO: 853644 - DNA, 25 bp, Mus musculus
tgagctagccaagaggacacctgtt

SEQ ID NO: 853645 - DNA, 25 bp, Mus musculus
tgagctagctatcctgacctaccca

SEQ ID NO: 853646 - DNA, 25 bp, Mus musculus
tgagctagctatgctgacctaccca

SEQ ID NO: 853647 - DNA, 25 bp, Mus musculus
tgagctagctcacctgcttactcaa

SEQ ID NO: 853648 - DNA, 25 bp, Mus musculus
tgagctagctcagctgcttactcaa

SEQ ID NO: 853649 - DNA, 25 bp, Mus musculus
tgagctaggaagagatgaggaatct

SEQ ID NO: 853650 - DNA, 25 bp, Mus musculus
tgagctaggaagtgatgaggaatct

SEQ ID NO: 853651 - DNA, 25 bp, Mus musculus
tgagctaggacaccacctggacctg

SEQ ID NO: 853652 - DNA, 25 bp, Mus musculus
tgagctaggacagcacctggacctg

SEQ ID NO: 853653 - DNA, 25 bp, Mus musculus
tgagctaggcaacgccatccagtta

SEQ ID NO: 853654 - DNA, 25 bp, Mus musculus
tgagctaggcaaggccatccagtta

SEQ ID NO: 853655 - DNA, 25 bp, Mus musculus
tgagctagggcgagttctttctctc

SEQ ID NO: 853656 - DNA, 25 bp, Mus musculus
tgagctagggcgtgttctttctctc

SEQ ID NO: 853657 - DNA, 25 bp, Mus musculus
tgagctaggtaccaaacctgagtcc

SEQ ID NO: 853658 - DNA, 25 bp, Mus musculus
tgagctaggtacgaaacctgagtcc

SEQ ID NO: 853659 - DNA, 25 bp, Mus musculus
tgagctagtgggatttcgctggttt

SEQ ID NO: 853660 - DNA, 25 bp, Mus musculus
tgagctagtgggttttcgctggttt

SEQ ID NO: 853661 - DNA, 25 bp, Mus musculus
tgagctatactccttctttggtgac

SEQ ID NO: 853662 - DNA, 25 bp, Mus musculus
tgagctatactcgttctttggtgac

SEQ ID NO: 853663 - DNA, 25 bp, Mus musculus
tgagctatagtcacaatcacccctg

SEQ ID NO: 853664 - DNA, 25 bp, Mus musculus
tgagctatagtctcaatcacccctg

SEQ ID NO: 853665 - DNA, 25 bp, Mus musculus
tgagctatcagcaccatcctacaga

SEQ ID NO: 853666 - DNA, 25 bp, Mus musculus
tgagctatcagctccatcctacaga

SEQ ID NO: 853667 - DNA, 25 bp, Mus musculus
tgagctatcagtacaagttggcatg

SEQ ID NO: 853668 - DNA, 25 bp, Mus musculus
tgagctatcagttcaagttggcatg

SEQ ID NO: 853669 - DNA, 25 bp, Mus musculus
tgagctatcctcatagttcgtaaaa

SEQ ID NO: 853670 - DNA, 25 bp, Mus musculus
tgagctatcctcttagttcgtaaaa

SEQ ID NO: 853671 - DNA, 25 bp, Mus musculus
tgagctatctctacagtcctgttgc

SEQ ID NO: 853672 - DNA, 25 bp, Mus musculus
tgagctatctcttcagtcctgttgc

SEQ ID NO: 853673 - DNA, 25 bp, Mus musculus
tgagctatcttgacagtaccctctg

SEQ ID NO: 853674 - DNA, 25 bp, Mus musculus
tgagctatcttgtcagtaccctctg

SEQ ID NO: 853675 - DNA, 25 bp, Mus musculus
tgagctatgcagacaccaaggccca

SEQ ID NO: 853676 - DNA, 25 bp, Mus musculus
tgagctatgcagtcaccaaggccca

SEQ ID NO: 853677 - DNA, 25 bp, Mus musculus
tgagctatggagacttcctttgcat

SEQ ID NO: 853678 - DNA, 25 bp, Mus musculus
tgagctatggagtcttcctttgcat

SEQ ID NO: 853679 - DNA, 25 bp, Mus musculus
tgagctatgggtacagtgtgaagaa

SEQ ID NO: 853680 - DNA, 25 bp, Mus musculus
tgagctatgggttcagtgtgaagaa

SEQ ID NO: 853681 - DNA, 25 bp, Mus musculus
tgagctatgtgcaaaccctgaggaa

SEQ ID NO: 853682 - DNA, 25 bp, Mus musculus
tgagctatgtgctaaccctgaggaa

SEQ ID NO: 853683 - DNA, 25 bp, Mus musculus
tgagctatgttcctagccataggat

SEQ ID NO: 853684 - DNA, 25 bp, Mus musculus
tgagctatgttcgtagccataggat

SEQ ID NO: 853685 - DNA, 25 bp, Mus musculus
tgagctatttctctcttgctttaga

SEQ ID NO: 853686 - DNA, 25 bp, Mus musculus
tgagctatttctgtcttgctttaga

SEQ ID NO: 853687 - DNA, 25 bp, Mus musculus
tgagctcaaggtacaaaagcctgac

SEQ ID NO: 853688 - DNA, 25 bp, Mus musculus
tgagctcaaggttcaaaagcctgac

SEQ ID NO: 853689 - DNA, 25 bp, Mus musculus
tgagctcaatcaacagggcccacat

SEQ ID NO: 853690 - DNA, 25 bp, Mus musculus
tgagctcaatcatcagggcccacat

SEQ ID NO: 853691 - DNA, 25 bp, Mus musculus
tgagctcaatccatggaacccaaac

SEQ ID NO: 853692 - DNA, 25 bp, Mus musculus
tgagctcaatcccaaatccacatat

SEQ ID NO: 853693 - DNA, 25 bp, Mus musculus
tgagctcaatccgaaatccacatat

SEQ ID NO: 853694 - DNA, 25 bp, Mus musculus
tgagctcaatccttggaacccaaac

SEQ ID NO: 853695 - DNA, 25 bp, Mus musculus
tgagctcacaccctctttaagaaaa

SEQ ID NO: 853696 - DNA, 25 bp, Mus musculus
tgagctcacaccgtctttaagaaaa

SEQ ID NO: 853697 - DNA, 25 bp, Mus musculus
tgagctcacagaacaaagcccaggc

SEQ ID NO: 853698 - DNA, 25 bp, Mus musculus
tgagctcacagatcaaagcccaggc

SEQ ID NO: 853699 - DNA, 25 bp, Mus musculus
tgagctcacagcattcccagggtga

SEQ ID NO: 853700 - DNA, 25 bp, Mus musculus
tgagctcacagctttcccagggtga

SEQ ID NO: 853701 - DNA, 25 bp, Mus musculus
tgagctcacataacccttttctttt

SEQ ID NO: 853702 - DNA, 25 bp, Mus musculus
tgagctcacatatcccttttctttt

SEQ ID NO: 853703 - DNA, 25 bp, Mus musculus
tgagctcacattcgttcaattccac

SEQ ID NO: 853704 - DNA, 25 bp, Mus musculus
tgagctcacattggttcaattccac

SEQ ID NO: 853705 - DNA, 25 bp, Mus musculus
tgagctcacgtacctgcgctgcaga

SEQ ID NO: 853706 - DNA, 25 bp, Mus musculus
tgagctcacgtagctgcgctgcaga

SEQ ID NO: 853707 - DNA, 25 bp, Mus musculus
tgagctcacgtcacagcatctatca

SEQ ID NO: 853708 - DNA, 25 bp, Mus musculus
tgagctcacgtctcagcatctatca

SEQ ID NO: 853709 - DNA, 25 bp, Mus musculus
tgagctcactcacgaccaaagccat

SEQ ID NO: 853710 - DNA, 25 bp, Mus musculus
tgagctcactcaggaccaaagccat

SEQ ID NO: 853711 - DNA, 25 bp, Mus musculus
tgagctcagaaaacttccagtctct

SEQ ID NO: 853712 - DNA, 25 bp, Mus musculus
tgagctcagaaatcttccagtctct

SEQ ID NO: 853713 - DNA, 25 bp, Mus musculus
tgagctcagattacttgatcacccc

SEQ ID NO: 853714 - DNA, 25 bp, Mus musculus
tgagctcagatttcttgatcacccc

SEQ ID NO: 853715 - DNA, 25 bp, Mus musculus
tgagctcagcacaagccagtattct

SEQ ID NO: 853716 - DNA, 25 bp, Mus musculus
tgagctcagcactagccagtattct

SEQ ID NO: 853717 - DNA, 25 bp, Mus musculus
tgagctcagcctagtgtatgtgccc

SEQ ID NO: 853718 - DNA, 25 bp, Mus musculus
tgagctcagccttgtgtatgtgccc

SEQ ID NO: 853719 - DNA, 25 bp, Mus musculus
tgagctcaggacacaacgggcaagg

SEQ ID NO: 853720 - DNA, 25 bp, Mus musculus
tgagctcaggactcaacgggcaagg

SEQ ID NO: 853721 - DNA, 25 bp, Mus musculus
tgagctcagggaatgtattgtgcac

SEQ ID NO: 853722 - DNA, 25 bp, Mus musculus
tgagctcagggattgtattgtgcac

SEQ ID NO: 853723 - DNA, 25 bp, Mus musculus
tgagctcatgatctactgcctggaa

SEQ ID NO: 853724 - DNA, 25 bp, Mus musculus
tgagctcatgatgtactgcctggaa

SEQ ID NO: 853725 - DNA, 25 bp, Mus musculus
tgagctcatgctccatcatgcccag

SEQ ID NO: 853726 - DNA, 25 bp, Mus musculus
tgagctcatgctgcatcatgcccag

SEQ ID NO: 853727 - DNA, 25 bp, Mus musculus
tgagctcattcaacatgctactttt

SEQ ID NO: 853728 - DNA, 25 bp, Mus musculus
tgagctcattcatcatgctactttt

SEQ ID NO: 853729 - DNA, 25 bp, Mus musculus
tgagctccacagagtacatgctctc

SEQ ID NO: 853730 - DNA, 25 bp, Mus musculus
tgagctccacagtgtacatgctctc

SEQ ID NO: 853731 - DNA, 25 bp, Mus musculus
tgagctccagacagcacgacgagag

SEQ ID NO: 853732 - DNA, 25 bp, Mus musculus
tgagctccagactgcacgacgagag

SEQ ID NO: 853733 - DNA, 25 bp, Mus musculus
tgagctccaggcaccatgaactttc

SEQ ID NO: 853734 - DNA, 25 bp, Mus musculus
tgagctccaggctccatgaactttc

SEQ ID NO: 853735 - DNA, 25 bp, Mus musculus
tgagctccagtcagtgcgtgacttg

SEQ ID NO: 853736 - DNA, 25 bp, Mus musculus
tgagctccagtcatggttcattctt

SEQ ID NO: 853737 - DNA, 25 bp, Mus musculus
tgagctccagtctgtgcgtgacttg

SEQ ID NO: 853738 - DNA, 25 bp, Mus musculus
tgagctccagtcttggttcattctt

SEQ ID NO: 853739 - DNA, 25 bp, Mus musculus
tgagctccatacactacagcatctg

SEQ ID NO: 853740 - DNA, 25 bp, Mus musculus
tgagctccatactctacagcatctg

SEQ ID NO: 853741 - DNA, 25 bp, Mus musculus
tgagctccattgaagactccagcag

SEQ ID NO: 853742 - DNA, 25 bp, Mus musculus
tgagctccattgtagactccagcag

SEQ ID NO: 853743 - DNA, 25 bp, Mus musculus
tgagctccatttagggtgtgggcca

SEQ ID NO: 853744 - DNA, 25 bp, Mus musculus
tgagctccattttgggtgtgggcca

SEQ ID NO: 853745 - DNA, 25 bp, Mus musculus
tgagctccccgtaggctgtgttttc

SEQ ID NO: 853746 - DNA, 25 bp, Mus musculus
tgagctccccgttggctgtgttttc

SEQ ID NO: 853747 - DNA, 25 bp, Mus musculus
tgagctcccctgaaaccttgaacgt

SEQ ID NO: 853748 - DNA, 25 bp, Mus musculus
tgagctcccctgtaaccttgaacgt

SEQ ID NO: 853749 - DNA, 25 bp, Mus musculus
tgagctcccgtcagcttgtgtgtgc

SEQ ID NO: 853750 - DNA, 25 bp, Mus musculus
tgagctcccgtctgcttgtgtgtgc

SEQ ID NO: 853751 - DNA, 25 bp, Mus musculus
tgagctccctggctaagtgcagcgt

SEQ ID NO: 853752 - DNA, 25 bp, Mus musculus
tgagctccctgggtaagtgcagcgt

SEQ ID NO: 853753 - DNA, 25 bp, Mus musculus
tgagctccgagactttcgaggaaat

SEQ ID NO: 853754 - DNA, 25 bp, Mus musculus
tgagctccgagagtttcgaggaaat

SEQ ID NO: 853755 - DNA, 25 bp, Mus musculus
tgagctccggacacctgtgcagaca

SEQ ID NO: 853756 - DNA, 25 bp, Mus musculus
tgagctccggactcctgtgcagaca

SEQ ID NO: 853757 - DNA, 25 bp, Mus musculus
tgagctccggcgcaccatgcagaac

SEQ ID NO: 853758 - DNA, 25 bp, Mus musculus
tgagctccggcggaccatgcagaac

SEQ ID NO: 853759 - DNA, 25 bp, Mus musculus
tgagctccgtgaattggtgcactcc

SEQ ID NO: 853760 - DNA, 25 bp, Mus musculus
tgagctccgtgatttggtgcactcc

SEQ ID NO: 853761 - DNA, 25 bp, Mus musculus
tgagctccgttaccagaggtctccg

SEQ ID NO: 853762 - DNA, 25 bp, Mus musculus
tgagctccgttagcagaggtctccg

SEQ ID NO: 853763 - DNA, 25 bp, Mus musculus
tgagctcctaagattcatataacag

SEQ ID NO: 853764 - DNA, 25 bp, Mus musculus
tgagctcctaagtttcatataacag

SEQ ID NO: 853765 - DNA, 25 bp, Mus musculus
tgagctcctagtagtgagaacactg

SEQ ID NO: 853766 - DNA, 25 bp, Mus musculus
tgagctcctagttgtgagaacactg

SEQ ID NO: 853767 - DNA, 25 bp, Mus musculus
tgagctcctcacaggcaggaacatg

SEQ ID NO: 853768 - DNA, 25 bp, Mus musculus
tgagctcctcactggcaggaacatg

SEQ ID NO: 853769 - DNA, 25 bp, Mus musculus
tgagctcctcatactgcggtgctga

SEQ ID NO: 853770 - DNA, 25 bp, Mus musculus
tgagctcctcattctgcggtgctga

SEQ ID NO: 853771 - DNA, 25 bp, Mus musculus
tgagctcctcccagggcctttggtt

SEQ ID NO: 853772 - DNA, 25 bp, Mus musculus
tgagctcctccctgggcctttggtt

SEQ ID NO: 853773 - DNA, 25 bp, Mus musculus
tgagctcctcctaggttgggcccca

SEQ ID NO: 853774 - DNA, 25 bp, Mus musculus
tgagctcctccttggttgggcccca

SEQ ID NO: 853775 - DNA, 25 bp, Mus musculus
tgagctcctctacaaacagtgcaca

SEQ ID NO: 853776 - DNA, 25 bp, Mus musculus
tgagctcctctagaaacagtgcaca

SEQ ID NO: 853777 - DNA, 25 bp, Mus musculus
tgagctcctggcagttgctgtaaac

SEQ ID NO: 853778 - DNA, 25 bp, Mus musculus
tgagctcctggctgttgctgtaaac

SEQ ID NO: 853779 - DNA, 25 bp, Mus musculus
tgagctccttccagtgaccaacttg

SEQ ID NO: 853780 - DNA, 25 bp, Mus musculus
tgagctccttcctgtgaccaacttg

SEQ ID NO: 853781 - DNA, 25 bp, Mus musculus
tgagctccttgaagcccttatggaa

SEQ ID NO: 853782 - DNA, 25 bp, Mus musculus
tgagctccttgatgcccttatggaa

SEQ ID NO: 853783 - DNA, 25 bp, Mus musculus
tgagctcctttgctttcaactatag

SEQ ID NO: 853784 - DNA, 25 bp, Mus musculus
tgagctcctttggtttcaactatag

SEQ ID NO: 853785 - DNA, 25 bp, Mus musculus
tgagctcggcacagtctctgagatt

SEQ ID NO: 853786 - DNA, 25 bp, Mus musculus
tgagctcggcactgtctctgagatt

SEQ ID NO: 853787 - DNA, 25 bp, Mus musculus
tgagctcgtcccatgcacagggtct

SEQ ID NO: 853788 - DNA, 25 bp, Mus musculus
tgagctcgtcccttgcacagggtct

SEQ ID NO: 853789 - DNA, 25 bp, Mus musculus
tgagctctaacaacagctggtgcat

SEQ ID NO: 853790 - DNA, 25 bp, Mus musculus
tgagctctaacatcagctggtgcat

SEQ ID NO: 853791 - DNA, 25 bp, Mus musculus
tgagctctactaaggctttacaaga

SEQ ID NO: 853792 - DNA, 25 bp, Mus musculus
tgagctctactatggctttacaaga

SEQ ID NO: 853793 - DNA, 25 bp, Mus musculus
tgagctctataccccgggagttccc

SEQ ID NO: 853794 - DNA, 25 bp, Mus musculus
tgagctctatacgccgggagttccc

SEQ ID NO: 853795 - DNA, 25 bp, Mus musculus
tgagctctatggctgctggatgacc

SEQ ID NO: 853796 - DNA, 25 bp, Mus musculus
tgagctctatgggtgctggatgacc

SEQ ID NO: 853797 - DNA, 25 bp, Mus musculus
tgagctctcactcctattggaggaa

SEQ ID NO: 853798 - DNA, 25 bp, Mus musculus
tgagctctcactgctattggaggaa

SEQ ID NO: 853799 - DNA, 25 bp, Mus musculus
tgagctctcagaaggtctatgcaga

SEQ ID NO: 853800 - DNA, 25 bp, Mus musculus
tgagctctcagatggtctatgcaga

SEQ ID NO: 853801 - DNA, 25 bp, Mus musculus
tgagctctcaggagtttggcctgga

SEQ ID NO: 853802 - DNA, 25 bp, Mus musculus
tgagctctcaggtgtttggcctgga

SEQ ID NO: 853803 - DNA, 25 bp, Mus musculus
tgagctctccatcttgaggccggca

SEQ ID NO: 853804 - DNA, 25 bp, Mus musculus
tgagctctccatgttgaggccggca

SEQ ID NO: 853805 - DNA, 25 bp, Mus musculus
tgagctctcctccaaacctcgggtg

SEQ ID NO: 853806 - DNA, 25 bp, Mus musculus
tgagctctcctcgaaacctcgggtg

SEQ ID NO: 853807 - DNA, 25 bp, Mus musculus
tgagctctcgatcgccttggtgatg

SEQ ID NO: 853808 - DNA, 25 bp, Mus musculus
tgagctctcgatggccttggtgatg

SEQ ID NO: 853809 - DNA, 25 bp, Mus musculus
tgagctctctctctgacgtatgtag

SEQ ID NO: 853810 - DNA, 25 bp, Mus musculus
tgagctctctctgtgacgtatgtag

SEQ ID NO: 853811 - DNA, 25 bp, Mus musculus
tgagctctgaaactgccgctctttc

SEQ ID NO: 853812 - DNA, 25 bp, Mus musculus
tgagctctgaaagtgccgctctttc

SEQ ID NO: 853813 - DNA, 25 bp, Mus musculus
tgagctctgagcaaatcacctcttc

SEQ ID NO: 853814 - DNA, 25 bp, Mus musculus
tgagctctgagctaatcacctcttc

SEQ ID NO: 853815 - DNA, 25 bp, Mus musculus
tgagctctgaggcactatcttgaga

SEQ ID NO: 853816 - DNA, 25 bp, Mus musculus
tgagctctgagggactatcttgaga

SEQ ID NO: 853817 - DNA, 25 bp, Mus musculus
tgagctctgctgagaagccatcgca

SEQ ID NO: 853818 - DNA, 25 bp, Mus musculus
tgagctctgctgtgaagccatcgca

SEQ ID NO: 853819 - DNA, 25 bp, Mus musculus
tgagctctggaactgacacaccttt

SEQ ID NO: 853820 - DNA, 25 bp, Mus musculus
tgagctctggaagtgacacaccttt

SEQ ID NO: 853821 - DNA, 25 bp, Mus musculus
tgagctctgggtatagactgccctc

SEQ ID NO: 853822 - DNA, 25 bp, Mus musculus
tgagctctgggtttagactgccctc

SEQ ID NO: 853823 - DNA, 25 bp, Mus musculus
tgagctctggttccttacataccca

SEQ ID NO: 853824 - DNA, 25 bp, Mus musculus
tgagctctggttgcttacataccca

SEQ ID NO: 853825 - DNA, 25 bp, Mus musculus
tgagctctgtacagccttgtctgca

SEQ ID NO: 853826 - DNA, 25 bp, Mus musculus
tgagctctgtactgccttgtctgca

SEQ ID NO: 853827 - DNA, 25 bp, Mus musculus
tgagctctgtctaaacagtggcttg

SEQ ID NO: 853828 - DNA, 25 bp, Mus musculus
tgagctctgtcttaacagtggcttg

SEQ ID NO: 853829 - DNA, 25 bp, Mus musculus
tgagctctgtgcattcattcctaga

SEQ ID NO: 853830 - DNA, 25 bp, Mus musculus
tgagctctgtgctttcattcctaga

SEQ ID NO: 853831 - DNA, 25 bp, Mus musculus
tgagctctgtggcatagcctgctga

SEQ ID NO: 853832 - DNA, 25 bp, Mus musculus
tgagctctgtgggatagcctgctga

SEQ ID NO: 853833 - DNA, 25 bp, Mus musculus
tgagctctgttacacgagccggcct

SEQ ID NO: 853834 - DNA, 25 bp, Mus musculus
tgagctctgttagacgagccggcct

SEQ ID NO: 853835 - DNA, 25 bp, Mus musculus
tgagctctgttcatcaaccagcacc

SEQ ID NO: 853836 - DNA, 25 bp, Mus musculus
tgagctctgttcttcaaccagcacc

SEQ ID NO: 853837 - DNA, 25 bp, Mus musculus
tgagctcttactctatgccagggct

SEQ ID NO: 853838 - DNA, 25 bp, Mus musculus
tgagctcttactgtatgccagggct

SEQ ID NO: 853839 - DNA, 25 bp, Mus musculus
tgagctcttccccactgtgatcagg

SEQ ID NO: 853840 - DNA, 25 bp, Mus musculus
tgagctcttcccgactgtgatcagg

SEQ ID NO: 853841 - DNA, 25 bp, Mus musculus
tgagctcttggtccttcactggctg

SEQ ID NO: 853842 - DNA, 25 bp, Mus musculus
tgagctcttggtgcttcactggctg

SEQ ID NO: 853843 - DNA, 25 bp, Mus musculus
tgagctcttgtcctgactttctgca

SEQ ID NO: 853844 - DNA, 25 bp, Mus musculus
tgagctcttgtcgtgactttctgca

SEQ ID NO: 853845 - DNA, 25 bp, Mus musculus
tgagctgaaacaaaccaggttcttg

SEQ ID NO: 853846 - DNA, 25 bp, Mus musculus
tgagctgaaacataccaggttcttg

SEQ ID NO: 853847 - DNA, 25 bp, Mus musculus
tgagctgaacgcatttgtaaatttt

SEQ ID NO: 853848 - DNA, 25 bp, Mus musculus
tgagctgaacgcttttgtaaatttt

SEQ ID NO: 853849 - DNA, 25 bp, Mus musculus
tgagctgaatgtccctggcaccaga

SEQ ID NO: 853850 - DNA, 25 bp, Mus musculus
tgagctgaatgtgcctggcaccaga

SEQ ID NO: 853851 - DNA, 25 bp, Mus musculus
tgagctgacaccatcacgagtttgt

SEQ ID NO: 853852 - DNA, 25 bp, Mus musculus
tgagctgacaccttcacgagtttgt

SEQ ID NO: 853853 - DNA, 25 bp, Mus musculus
tgagctgacccgactttagctttgc

SEQ ID NO: 853854 - DNA, 25 bp, Mus musculus
tgagctgacccgtctttagctttgc

SEQ ID NO: 853855 - DNA, 25 bp, Mus musculus
tgagctgactggagaattccactct

SEQ ID NO: 853856 - DNA, 25 bp, Mus musculus
tgagctgactggtgaattccactct

SEQ ID NO: 853857 - DNA, 25 bp, Mus musculus
tgagctgagctaacggtctgttata

SEQ ID NO: 853858 - DNA, 25 bp, Mus musculus
tgagctgagctatcggtctgttata

SEQ ID NO: 853859 - DNA, 25 bp, Mus musculus
tgagctgagcttaaacgtgaacgaa

SEQ ID NO: 853860 - DNA, 25 bp, Mus musculus
tgagctgagctttaacgtgaacgaa

SEQ ID NO: 853861 - DNA, 25 bp, Mus musculus
tgagctgataagctgtctccattac

SEQ ID NO: 853862 - DNA, 25 bp, Mus musculus
tgagctgataaggtgtctccattac

SEQ ID NO: 853863 - DNA, 25 bp, Mus musculus
tgagctgatcttcaagccaccatct

SEQ ID NO: 853864 - DNA, 25 bp, Mus musculus
tgagctgatcttgaagccaccatct

SEQ ID NO: 853865 - DNA, 25 bp, Mus musculus
tgagctgatgctcatgtctgtgctt

SEQ ID NO: 853866 - DNA, 25 bp, Mus musculus
tgagctgatgctgatgtctgtgctt

SEQ ID NO: 853867 - DNA, 25 bp, Mus musculus
tgagctgattgaagtcagctggtac

SEQ ID NO: 853868 - DNA, 25 bp, Mus musculus
tgagctgattgatgtcagctggtac

SEQ ID NO: 853869 - DNA, 25 bp, Mus musculus
tgagctgattggacacaacgcggtt

SEQ ID NO: 853870 - DNA, 25 bp, Mus musculus
tgagctgattggtcacaacgcggtt

SEQ ID NO: 853871 - DNA, 25 bp, Mus musculus
tgagctgcaactcaaagctggcgat

SEQ ID NO: 853872 - DNA, 25 bp, Mus musculus
tgagctgcaactgaaagctggcgat

SEQ ID NO: 853873 - DNA, 25 bp, Mus musculus
tgagctgcagaaaaacatggtgcta

SEQ ID NO: 853874 - DNA, 25 bp, Mus musculus
tgagctgcagaataacatggtgcta

SEQ ID NO: 853875 - DNA, 25 bp, Mus musculus
tgagctgcagacaaatttactcgtt

SEQ ID NO: 853876 - DNA, 25 bp, Mus musculus
tgagctgcagactaatttactcgtt

SEQ ID NO: 853877 - DNA, 25 bp, Mus musculus
tgagctgcagcccttaggactgaga

SEQ ID NO: 853878 - DNA, 25 bp, Mus musculus
tgagctgcagccgttaggactgaga

SEQ ID NO: 853879 - DNA, 25 bp, Mus musculus
tgagctgcatccctacctttaagta

SEQ ID NO: 853880 - DNA, 25 bp, Mus musculus
tgagctgcatccgtacctttaagta

SEQ ID NO: 853881 - DNA, 25 bp, Mus musculus
tgagctgccacgagactgctgtgaa

SEQ ID NO: 853882 - DNA, 25 bp, Mus musculus
tgagctgccacgtgactgctgtgaa

SEQ ID NO: 853883 - DNA, 25 bp, Mus musculus
tgagctgccaggacttcaggaggac

SEQ ID NO: 853884 - DNA, 25 bp, Mus musculus
tgagctgccaggtcttcaggaggac

SEQ ID NO: 853885 - DNA, 25 bp, Mus musculus
tgagctgccatccaggtactgggaa

SEQ ID NO: 853886 - DNA, 25 bp, Mus musculus
tgagctgccatcgaggtactgggaa

SEQ ID NO: 853887 - DNA, 25 bp, Mus musculus
tgagctgccattcaataaagggact

SEQ ID NO: 853888 - DNA, 25 bp, Mus musculus
tgagctgccattcgtcatcatagag

SEQ ID NO: 853889 - DNA, 25 bp, Mus musculus
tgagctgccattgaataaagggact

SEQ ID NO: 853890 - DNA, 25 bp, Mus musculus
tgagctgccattggtcatcatagag

SEQ ID NO: 853891 - DNA, 25 bp, Mus musculus
tgagctgcccggaaccgtggagtca

SEQ ID NO: 853892 - DNA, 25 bp, Mus musculus
tgagctgcccggtaccgtggagtca

SEQ ID NO: 853893 - DNA, 25 bp, Mus musculus
tgagctgcccttctgaaccgtaaat

SEQ ID NO: 853894 - DNA, 25 bp, Mus musculus
tgagctgcccttgtgaaccgtaaat

SEQ ID NO: 853895 - DNA, 25 bp, Mus musculus
tgagctgccgacatgttgtgtgaaa

SEQ ID NO: 853896 - DNA, 25 bp, Mus musculus
tgagctgccgacttgttgtgtgaaa

SEQ ID NO: 853897 - DNA, 25 bp, Mus musculus
tgagctgccgagagtgttgatcctc

SEQ ID NO: 853898 - DNA, 25 bp, Mus musculus
tgagctgccgagtgtgttgatcctc

SEQ ID NO: 853899 - DNA, 25 bp, Mus musculus
tgagctgccgatcgtcatttttcta

SEQ ID NO: 853900 - DNA, 25 bp, Mus musculus
tgagctgccgatggtcatttttcta

SEQ ID NO: 853901 - DNA, 25 bp, Mus musculus
tgagctgcctcaatgtgtgggacct

SEQ ID NO: 853902 - DNA, 25 bp, Mus musculus
tgagctgcctcattgtgtgggacct

SEQ ID NO: 853903 - DNA, 25 bp, Mus musculus
tgagctgcctccctgattgatcagt

SEQ ID NO: 853904 - DNA, 25 bp, Mus musculus
tgagctgcctccgtgattgatcagt

SEQ ID NO: 853905 - DNA, 25 bp, Mus musculus
tgagctgcctctcgaagcttggcca

SEQ ID NO: 853906 - DNA, 25 bp, Mus musculus
tgagctgcctctggaagcttggcca

SEQ ID NO: 853907 - DNA, 25 bp, Mus musculus
tgagctgcgaagcatcaacgcccag

SEQ ID NO: 853908 - DNA, 25 bp, Mus musculus
tgagctgcgaaggatcaacgcccag

SEQ ID NO: 853909 - DNA, 25 bp, Mus musculus
tgagctgcgggcacctgagcatgtc

SEQ ID NO: 853910 - DNA, 25 bp, Mus musculus
tgagctgcgggctcctgagcatgtc

SEQ ID NO: 853911 - DNA, 25 bp, Mus musculus
tgagctgcgggtcctgatcatgaca

SEQ ID NO: 853912 - DNA, 25 bp, Mus musculus
tgagctgcgggtgctgatcatgaca

SEQ ID NO: 853913 - DNA, 25 bp, Mus musculus
tgagctgcgtttaacaccctttctt

SEQ ID NO: 853914 - DNA, 25 bp, Mus musculus
tgagctgcgttttacaccctttctt

SEQ ID NO: 853915 - DNA, 25 bp, Mus musculus
tgagctgctccaatttgccgaggta

SEQ ID NO: 853916 - DNA, 25 bp, Mus musculus
tgagctgctccactctcagggctct

SEQ ID NO: 853917 - DNA, 25 bp, Mus musculus
tgagctgctccagtctcagggctct

SEQ ID NO: 853918 - DNA, 25 bp, Mus musculus
tgagctgctccattttgccgaggta

SEQ ID NO: 853919 - DNA, 25 bp, Mus musculus
tgagctgctcccatctgtttctaat

SEQ ID NO: 853920 - DNA, 25 bp, Mus musculus
tgagctgctcccttctgtttctaat

SEQ ID NO: 853921 - DNA, 25 bp, Mus musculus
tgagctgctctacaccaggaaggtt

SEQ ID NO: 853922 - DNA, 25 bp, Mus musculus
tgagctgctctagaccaggaaggtt

SEQ ID NO: 853923 - DNA, 25 bp, Mus musculus
tgagctgctctcaggcggtgtttct

SEQ ID NO: 853924 - DNA, 25 bp, Mus musculus
tgagctgctctctggcggtgtttct

SEQ ID NO: 853925 - DNA, 25 bp, Mus musculus
tgagctgctctgagagtcatctttc

SEQ ID NO: 853926 - DNA, 25 bp, Mus musculus
tgagctgctctgtgagtcatctttc

SEQ ID NO: 853927 - DNA, 25 bp, Mus musculus
tgagctgctgaacgtcctgcattct

SEQ ID NO: 853928 - DNA, 25 bp, Mus musculus
tgagctgctgaaggtcctgcattct

SEQ ID NO: 853929 - DNA, 25 bp, Mus musculus
tgagctgctgccagatatagaatgg

SEQ ID NO: 853930 - DNA, 25 bp, Mus musculus
tgagctgctgcctgatatagaatgg

SEQ ID NO: 853931 - DNA, 25 bp, Mus musculus
tgagctgcttgtcgatgacctgttc

SEQ ID NO: 853932 - DNA, 25 bp, Mus musculus
tgagctgcttgtggatgacctgttc

SEQ ID NO: 853933 - DNA, 25 bp, Mus musculus
tgagctgctttacagttttcactgc

SEQ ID NO: 853934 - DNA, 25 bp, Mus musculus
tgagctgctttagagttttcactgc

SEQ ID NO: 853935 - DNA, 25 bp, Mus musculus
tgagctgctttccaggtgttcctag

SEQ ID NO: 853936 - DNA, 25 bp, Mus musculus
tgagctgctttcgaggtgttcctag

SEQ ID NO: 853937 - DNA, 25 bp, Mus musculus
tgagctggatatattgccaagcctc

SEQ ID NO: 853938 - DNA, 25 bp, Mus musculus
tgagctggatattttgccaagcctc

SEQ ID NO: 853939 - DNA, 25 bp, Mus musculus
tgagctggatctacggccccatggt

SEQ ID NO: 853940 - DNA, 25 bp, Mus musculus
tgagctggatcttcggccccatggt

SEQ ID NO: 853941 - DNA, 25 bp, Mus musculus
tgagctggcagactctaagtgttct

SEQ ID NO: 853942 - DNA, 25 bp, Mus musculus
tgagctggcagagtctaagtgttct

SEQ ID NO: 853943 - DNA, 25 bp, Mus musculus
tgagctggcagtacctgagcaccct

SEQ ID NO: 853944 - DNA, 25 bp, Mus musculus
tgagctggcagttcctgagcaccct

SEQ ID NO: 853945 - DNA, 25 bp, Mus musculus
tgagctggcataaattctgtaagtc

SEQ ID NO: 853946 - DNA, 25 bp, Mus musculus
tgagctggcatatattctgtaagtc

SEQ ID NO: 853947 - DNA, 25 bp, Mus musculus
tgagctggccacacatttaacccac

SEQ ID NO: 853948 - DNA, 25 bp, Mus musculus
tgagctggccacaggtgactaccta

SEQ ID NO: 853949 - DNA, 25 bp, Mus musculus
tgagctggccactcatttaacccac

SEQ ID NO: 853950 - DNA, 25 bp, Mus musculus
tgagctggccactggtgactaccta

SEQ ID NO: 853951 - DNA, 25 bp, Mus musculus
tgagctggccatcctgtcaaatgag

SEQ ID NO: 853952 - DNA, 25 bp, Mus musculus
tgagctggccatgctgtcaaatgag

SEQ ID NO: 853953 - DNA, 25 bp, Mus musculus
tgagctggcccaacacagtgaacat

SEQ ID NO: 853954 - DNA, 25 bp, Mus musculus
tgagctggcccatcacagtgaacat

SEQ ID NO: 853955 - DNA, 25 bp, Mus musculus
tgagctggcctcacgtgttgactga

SEQ ID NO: 853956 - DNA, 25 bp, Mus musculus
tgagctggcctctcgtgttgactga

SEQ ID NO: 853957 - DNA, 25 bp, Mus musculus
tgagctggctagaggaaaatgtcca

SEQ ID NO: 853958 - DNA, 25 bp, Mus musculus
tgagctggctagtggaaaatgtcca

SEQ ID NO: 853959 - DNA, 25 bp, Mus musculus
tgagctggctcgaagttctttcagg

SEQ ID NO: 853960 - DNA, 25 bp, Mus musculus
tgagctggctcgtagttctttcagg

SEQ ID NO: 853961 - DNA, 25 bp, Mus musculus
tgagctgggacacaccatataccat

SEQ ID NO: 853962 - DNA, 25 bp, Mus musculus
tgagctgggacagaccatataccat

SEQ ID NO: 853963 - DNA, 25 bp, Mus musculus
tgagctgggactcagcctcacagat

SEQ ID NO: 853964 - DNA, 25 bp, Mus musculus
tgagctgggactgagcctcacagat

SEQ ID NO: 853965 - DNA, 25 bp, Mus musculus
tgagctgggcctagtagattctacc

SEQ ID NO: 853966 - DNA, 25 bp, Mus musculus
tgagctgggccttgtagattctacc

SEQ ID NO: 853967 - DNA, 25 bp, Mus musculus
tgagctggggaccatcagtcctctg

SEQ ID NO: 853968 - DNA, 25 bp, Mus musculus
tgagctggggacgatcagtcctctg

SEQ ID NO: 853969 - DNA, 25 bp, Mus musculus
tgagctgggtacatccagaaacacg

SEQ ID NO: 853970 - DNA, 25 bp, Mus musculus
tgagctgggtacttccagaaacacg

SEQ ID NO: 853971 - DNA, 25 bp, Mus musculus
tgagctggtattatctctccactga

SEQ ID NO: 853972 - DNA, 25 bp, Mus musculus
tgagctggtattttctctccactga

SEQ ID NO: 853973 - DNA, 25 bp, Mus musculus
tgagctggtcctcctaaacagcctc

SEQ ID NO: 853974 - DNA, 25 bp, Mus musculus
tgagctggtcctgctaaacagcctc

SEQ ID NO: 853975 - DNA, 25 bp, Mus musculus
tgagctgtaagaaccaatggcccct

SEQ ID NO: 853976 - DNA, 25 bp, Mus musculus
tgagctgtaagatccaatggcccct

SEQ ID NO: 853977 - DNA, 25 bp, Mus musculus
tgagctgtacacctgagcccgctaa

SEQ ID NO: 853978 - DNA, 25 bp, Mus musculus
tgagctgtacacgtgagcccgctaa

SEQ ID NO: 853979 - DNA, 25 bp, Mus musculus
tgagctgtacagctgacgactttag

SEQ ID NO: 853980 - DNA, 25 bp, Mus musculus
tgagctgtacaggtgacgactttag

SEQ ID NO: 853981 - DNA, 25 bp, Mus musculus
tgagctgtacatagtgccctgagta

SEQ ID NO: 853982 - DNA, 25 bp, Mus musculus
tgagctgtacattgtgccctgagta

SEQ ID NO: 853983 - DNA, 25 bp, Mus musculus
tgagctgtacctaaaggctgctgtg

SEQ ID NO: 853984 - DNA, 25 bp, Mus musculus
tgagctgtaccttaaggctgctgtg

SEQ ID NO: 853985 - DNA, 25 bp, Mus musculus
tgagctgtagccagcaggcctatac

SEQ ID NO: 853986 - DNA, 25 bp, Mus musculus
tgagctgtagccctattcccaagtt

SEQ ID NO: 853987 - DNA, 25 bp, Mus musculus
tgagctgtagccgtattcccaagtt

SEQ ID NO: 853988 - DNA, 25 bp, Mus musculus
tgagctgtagcctgcaggcctatac

SEQ ID NO: 853989 - DNA, 25 bp, Mus musculus
tgagctgtagctctcctgttcactt

SEQ ID NO: 853990 - DNA, 25 bp, Mus musculus
tgagctgtagctgtcctgttcactt

SEQ ID NO: 853991 - DNA, 25 bp, Mus musculus
tgagctgtaggaatccacctgtttc

SEQ ID NO: 853992 - DNA, 25 bp, Mus musculus
tgagctgtaggattccacctgtttc

SEQ ID NO: 853993 - DNA, 25 bp, Mus musculus
tgagctgtatatacactggtgtggc

SEQ ID NO: 853994 - DNA, 25 bp, Mus musculus
tgagctgtatattcactggtgtggc

SEQ ID NO: 853995 - DNA, 25 bp, Mus musculus
tgagctgtatcaccgtccatattgt

SEQ ID NO: 853996 - DNA, 25 bp, Mus musculus
tgagctgtatcagcgtccatattgt

SEQ ID NO: 853997 - DNA, 25 bp, Mus musculus
tgagctgtatctcaggttaaagata

SEQ ID NO: 853998 - DNA, 25 bp, Mus musculus
tgagctgtatctgaggttaaagata

SEQ ID NO: 853999 - DNA, 25 bp, Mus musculus
tgagctgtcacaaatcaggcacacc

SEQ ID NO: 854000 - DNA, 25 bp, Mus musculus
tgagctgtcacatatcaggcacacc

SEQ ID NO: 854001 - DNA, 25 bp, Mus musculus
tgagctgtcagtaccatgtctaccc

SEQ ID NO: 854002 - DNA, 25 bp, Mus musculus
tgagctgtcagtcaagggagccagt

SEQ ID NO: 854003 - DNA, 25 bp, Mus musculus
tgagctgtcagtgaagggagccagt

SEQ ID NO: 854004 - DNA, 25 bp, Mus musculus
tgagctgtcagttccatgtctaccc

SEQ ID NO: 854005 - DNA, 25 bp, Mus musculus
tgagctgtcattcatgtgttgggaa

SEQ ID NO: 854006 - DNA, 25 bp, Mus musculus
tgagctgtcattgatgtgttgggaa

SEQ ID NO: 854007 - DNA, 25 bp, Mus musculus
tgagctgtccctctggtagacactg

SEQ ID NO: 854008 - DNA, 25 bp, Mus musculus
tgagctgtccctgtggtagacactg

SEQ ID NO: 854009 - DNA, 25 bp, Mus musculus
tgagctgtcgttaatttttagtatt

SEQ ID NO: 854010 - DNA, 25 bp, Mus musculus
tgagctgtcgtttatttttagtatt

SEQ ID NO: 854011 - DNA, 25 bp, Mus musculus
tgagctgtctctacgggtgatatta

SEQ ID NO: 854012 - DNA, 25 bp, Mus musculus
tgagctgtctctcctgatcactgtc

SEQ ID NO: 854013 - DNA, 25 bp, Mus musculus
tgagctgtctctcgtctttaagtac

SEQ ID NO: 854014 - DNA, 25 bp, Mus musculus
tgagctgtctctgctgatcactgtc

SEQ ID NO: 854015 - DNA, 25 bp, Mus musculus
tgagctgtctctggtctttaagtac

SEQ ID NO: 854016 - DNA, 25 bp, Mus musculus
tgagctgtctcttcgggtgatatta

SEQ ID NO: 854017 - DNA, 25 bp, Mus musculus
tgagctgtctgtagactgtggctct

SEQ ID NO: 854018 - DNA, 25 bp, Mus musculus
tgagctgtctgttgactgtggctct

SEQ ID NO: 854019 - DNA, 25 bp, Mus musculus
tgagctgtgactctggttgccacac

SEQ ID NO: 854020 - DNA, 25 bp, Mus musculus
tgagctgtgactgtggttgccacac

SEQ ID NO: 854021 - DNA, 25 bp, Mus musculus
tgagctgtgcccagagactttattc

SEQ ID NO: 854022 - DNA, 25 bp, Mus musculus
tgagctgtgccctgagactttattc

SEQ ID NO: 854023 - DNA, 25 bp, Mus musculus
tgagctgtgcctcacctccagaaca

SEQ ID NO: 854024 - DNA, 25 bp, Mus musculus
tgagctgtgcctgacctccagaaca

SEQ ID NO: 854025 - DNA, 25 bp, Mus musculus
tgagctgtggtaatctcccttcagt

SEQ ID NO: 854026 - DNA, 25 bp, Mus musculus
tgagctgtggtattctcccttcagt

SEQ ID NO: 854027 - DNA, 25 bp, Mus musculus
tgagctgtgtatagagactcaactt

SEQ ID NO: 854028 - DNA, 25 bp, Mus musculus
tgagctgtgtattgagactcaactt

SEQ ID NO: 854029 - DNA, 25 bp, Mus musculus
tgagctgtgtttagggcagaccaat

SEQ ID NO: 854030 - DNA, 25 bp, Mus musculus
tgagctgtgttttgggcagaccaat

SEQ ID NO: 854031 - DNA, 25 bp, Mus musculus
tgagctgttagacagttccctagaa

SEQ ID NO: 854032 - DNA, 25 bp, Mus musculus
tgagctgttagagagttccctagaa

SEQ ID NO: 854033 - DNA, 25 bp, Mus musculus
tgagctgttcatacacaatataagt

SEQ ID NO: 854034 - DNA, 25 bp, Mus musculus
tgagctgttcattcacaatataagt

SEQ ID NO: 854035 - DNA, 25 bp, Mus musculus
tgagctgttccaaccctcttaggaa

SEQ ID NO: 854036 - DNA, 25 bp, Mus musculus
tgagctgttccatccctcttaggaa

SEQ ID NO: 854037 - DNA, 25 bp, Mus musculus
tgagctgttcccaaggtagaaggca

SEQ ID NO: 854038 - DNA, 25 bp, Mus musculus
tgagctgttcccacgcctgaattca

SEQ ID NO: 854039 - DNA, 25 bp, Mus musculus
tgagctgttccctaggtagaaggca

SEQ ID NO: 854040 - DNA, 25 bp, Mus musculus
tgagctgttccctcgcctgaattca

SEQ ID NO: 854041 - DNA, 25 bp, Mus musculus
tgagctgttctaatgcgatcaaccc

SEQ ID NO: 854042 - DNA, 25 bp, Mus musculus
tgagctgttctattgcgatcaaccc

SEQ ID NO: 854043 - DNA, 25 bp, Mus musculus
tgagctgttgctctacccctgaagc

SEQ ID NO: 854044 - DNA, 25 bp, Mus musculus
tgagctgttgctgtacccctgaagc

SEQ ID NO: 854045 - DNA, 25 bp, Mus musculus
tgagctgtttacagctgaccactgt

SEQ ID NO: 854046 - DNA, 25 bp, Mus musculus
tgagctgtttactgctgaccactgt

SEQ ID NO: 854047 - DNA, 25 bp, Mus musculus
tgagctgttttcaactgagacaata

SEQ ID NO: 854048 - DNA, 25 bp, Mus musculus
tgagctgttttctactgagacaata

SEQ ID NO: 854049 - DNA, 25 bp, Mus musculus
tgagcttaaggcattgacccctgag

SEQ ID NO: 854050 - DNA, 25 bp, Mus musculus
tgagcttaaggctttgacccctgag

SEQ ID NO: 854051 - DNA, 25 bp, Mus musculus
tgagcttacctgacatgtgggcata

SEQ ID NO: 854052 - DNA, 25 bp, Mus musculus
tgagcttacctgtcatgtgggcata

SEQ ID NO: 854053 - DNA, 25 bp, Mus musculus
tgagcttactgaattggttttacaa

SEQ ID NO: 854054 - DNA, 25 bp, Mus musculus
tgagcttactgatttggttttacaa

SEQ ID NO: 854055 - DNA, 25 bp, Mus musculus
tgagcttagctcactttatcacaca

SEQ ID NO: 854056 - DNA, 25 bp, Mus musculus
tgagcttagctctctttatcacaca

SEQ ID NO: 854057 - DNA, 25 bp, Mus musculus
tgagcttatgccagtctgtcattca

SEQ ID NO: 854058 - DNA, 25 bp, Mus musculus
tgagcttatgcctgtctgtcattca

SEQ ID NO: 854059 - DNA, 25 bp, Mus musculus
tgagcttatggaactagcaatagta

SEQ ID NO: 854060 - DNA, 25 bp, Mus musculus
tgagcttatggatctagcaatagta

SEQ ID NO: 854061 - DNA, 25 bp, Mus musculus
tgagcttcaattacctcctgagaca

SEQ ID NO: 854062 - DNA, 25 bp, Mus musculus
tgagcttcaatttcctcctgagaca

SEQ ID NO: 854063 - DNA, 25 bp, Mus musculus
tgagcttcacagaacacacgacagt

SEQ ID NO: 854064 - DNA, 25 bp, Mus musculus
tgagcttcacagtacacacgacagt

SEQ ID NO: 854065 - DNA, 25 bp, Mus musculus
tgagcttcactcaaacccctgattg

SEQ ID NO: 854066 - DNA, 25 bp, Mus musculus
tgagcttcactctaacccctgattg

SEQ ID NO: 854067 - DNA, 25 bp, Mus musculus
tgagcttcaggtatgtcagccatct

SEQ ID NO: 854068 - DNA, 25 bp, Mus musculus
tgagcttcaggtttgtcagccatct

SEQ ID NO: 854069 - DNA, 25 bp, Mus musculus
tgagcttccattcttaccactgtat

SEQ ID NO: 854070 - DNA, 25 bp, Mus musculus
tgagcttccattgttaccactgtat

SEQ ID NO: 854071 - DNA, 25 bp, Mus musculus
tgagcttcccagaactggtcagtac

SEQ ID NO: 854072 - DNA, 25 bp, Mus musculus
tgagcttcccagtactggtcagtac

SEQ ID NO: 854073 - DNA, 25 bp, Mus musculus
tgagcttcccgccaactccggagat

SEQ ID NO: 854074 - DNA, 25 bp, Mus musculus
tgagcttcccgcgaactccggagat

SEQ ID NO: 854075 - DNA, 25 bp, Mus musculus
tgagcttcctagagatagcccacca

SEQ ID NO: 854076 - DNA, 25 bp, Mus musculus
tgagcttcctagtgatagcccacca

SEQ ID NO: 854077 - DNA, 25 bp, Mus musculus
tgagcttcctctacattgacaagtt

SEQ ID NO: 854078 - DNA, 25 bp, Mus musculus
tgagcttcctctacttcagtgattt

SEQ ID NO: 854079 - DNA, 25 bp, Mus musculus
tgagcttcctcttcattgacaagtt

SEQ ID NO: 854080 - DNA, 25 bp, Mus musculus
tgagcttcctcttcttcagtgattt

SEQ ID NO: 854081 - DNA, 25 bp, Mus musculus
tgagcttcgccaagcctcccaaaga

SEQ ID NO: 854082 - DNA, 25 bp, Mus musculus
tgagcttcgccatgcctcccaaaga

SEQ ID NO: 854083 - DNA, 25 bp, Mus musculus
tgagcttcgctcaggttgtctgtct

SEQ ID NO: 854084 - DNA, 25 bp, Mus musculus
tgagcttcgctctggttgtctgtct

SEQ ID NO: 854085 - DNA, 25 bp, Mus musculus
tgagcttcgggccaaaggtcagaat

SEQ ID NO: 854086 - DNA, 25 bp, Mus musculus
tgagcttcgggccaaagttcagaat

SEQ ID NO: 854087 - DNA, 25 bp, Mus musculus
tgagcttcgggcgaaaggtcagaat

SEQ ID NO: 854088 - DNA, 25 bp, Mus musculus
tgagcttcgggcgaaagttcagaat

SEQ ID NO: 854089 - DNA, 25 bp, Mus musculus
tgagcttctcaaacattgcaagtac

SEQ ID NO: 854090 - DNA, 25 bp, Mus musculus
tgagcttctcaactcagtccttatc

SEQ ID NO: 854091 - DNA, 25 bp, Mus musculus
tgagcttctcaagtcagtccttatc

SEQ ID NO: 854092 - DNA, 25 bp, Mus musculus
tgagcttctcaatcattgcaagtac

SEQ ID NO: 854093 - DNA, 25 bp, Mus musculus
tgagcttctcacacatccgtatgtt

SEQ ID NO: 854094 - DNA, 25 bp, Mus musculus
tgagcttctcactcatccgtatgtt

SEQ ID NO: 854095 - DNA, 25 bp, Mus musculus
tgagcttctttcagcattttacaga

SEQ ID NO: 854096 - DNA, 25 bp, Mus musculus
tgagcttctttctgcattttacaga

SEQ ID NO: 854097 - DNA, 25 bp, Mus musculus
tgagcttgaagccacctggactgta

SEQ ID NO: 854098 - DNA, 25 bp, Mus musculus
tgagcttgaagcgacctggactgta

SEQ ID NO: 854099 - DNA, 25 bp, Mus musculus
tgagcttgatgactaccactgacct

SEQ ID NO: 854100 - DNA, 25 bp, Mus musculus
tgagcttgatgagtaccactgacct

SEQ ID NO: 854101 - DNA, 25 bp, Mus musculus
tgagcttgcaaaacagtgctgtgga

SEQ ID NO: 854102 - DNA, 25 bp, Mus musculus
tgagcttgcaaatcagtgctgtgga

SEQ ID NO: 854103 - DNA, 25 bp, Mus musculus
tgagcttgcagtccatcggacagat

SEQ ID NO: 854104 - DNA, 25 bp, Mus musculus
tgagcttgcagtgcatcggacagat

SEQ ID NO: 854105 - DNA, 25 bp, Mus musculus
tgagcttgccaacgacacctctaaa

SEQ ID NO: 854106 - DNA, 25 bp, Mus musculus
tgagcttgccaaggacacctctaaa

SEQ ID NO: 854107 - DNA, 25 bp, Mus musculus
tgagcttgcccaactctgttttaat

SEQ ID NO: 854108 - DNA, 25 bp, Mus musculus
tgagcttgcccatctctgttttaat

SEQ ID NO: 854109 - DNA, 25 bp, Mus musculus
tgagcttgcctgctgaacctttgga

SEQ ID NO: 854110 - DNA, 25 bp, Mus musculus
tgagcttgcctggtgaacctttgga

SEQ ID NO: 854111 - DNA, 25 bp, Mus musculus
tgagcttgctctcctcagtgtttgg

SEQ ID NO: 854112 - DNA, 25 bp, Mus musculus
tgagcttgctctgctcagtgtttgg

SEQ ID NO: 854113 - DNA, 25 bp, Mus musculus
tgagcttgctgaccacgtgtgagaa

SEQ ID NO: 854114 - DNA, 25 bp, Mus musculus
tgagcttgctgagcacgtgtgagaa

SEQ ID NO: 854115 - DNA, 25 bp, Mus musculus
tgagcttggagcattggttcttgtt

SEQ ID NO: 854116 - DNA, 25 bp, Mus musculus
tgagcttggagctttggttcttgtt

SEQ ID NO: 854117 - DNA, 25 bp, Mus musculus
tgagcttggcctacacctttgcagc

SEQ ID NO: 854118 - DNA, 25 bp, Mus musculus
tgagcttggccttcacctttgcagc

SEQ ID NO: 854119 - DNA, 25 bp, Mus musculus
tgagcttggcttctatattataatc

SEQ ID NO: 854120 - DNA, 25 bp, Mus musculus
tgagcttggcttgtatattataatc

SEQ ID NO: 854121 - DNA, 25 bp, Mus musculus
tgagcttgtgaaacatgtgaccctg

SEQ ID NO: 854122 - DNA, 25 bp, Mus musculus
tgagcttgtgaatcatgtgaccctg

SEQ ID NO: 854123 - DNA, 25 bp, Mus musculus
tgagcttgtgctaacaaccagtgac

SEQ ID NO: 854124 - DNA, 25 bp, Mus musculus
tgagcttgtgcttacaaccagtgac

SEQ ID NO: 854125 - DNA, 25 bp, Mus musculus
tgagcttgttgcctcctttgctgtc

SEQ ID NO: 854126 - DNA, 25 bp, Mus musculus
tgagcttgttgcgtcctttgctgtc

SEQ ID NO: 854127 - DNA, 25 bp, Mus musculus
tgagctttaaagattcaggactcga

SEQ ID NO: 854128 - DNA, 25 bp, Mus musculus
tgagctttaaagtttcaggactcga

SEQ ID NO: 854129 - DNA, 25 bp, Mus musculus
tgagctttagcacactggaatccac

SEQ ID NO: 854130 - DNA, 25 bp, Mus musculus
tgagctttagcagactggaatccac

SEQ ID NO: 854131 - DNA, 25 bp, Mus musculus
tgagctttagccagtgcctggcaaa

SEQ ID NO: 854132 - DNA, 25 bp, Mus musculus
tgagctttagcctgtgcctggcaaa

SEQ ID NO: 854133 - DNA, 25 bp, Mus musculus
tgagctttagcgaacgggtttgtgc

SEQ ID NO: 854134 - DNA, 25 bp, Mus musculus
tgagctttagcgtacgggtttgtgc

SEQ ID NO: 854135 - DNA, 25 bp, Mus musculus
tgagctttaggactttcagtcataa

SEQ ID NO: 854136 - DNA, 25 bp, Mus musculus
tgagctttaggagtttcagtcataa

SEQ ID NO: 854137 - DNA, 25 bp, Mus musculus
tgagctttcaagagctggctggcat

SEQ ID NO: 854138 - DNA, 25 bp, Mus musculus
tgagctttcaagcatggccactttg

SEQ ID NO: 854139 - DNA, 25 bp, Mus musculus
tgagctttcaaggatggccactttg

SEQ ID NO: 854140 - DNA, 25 bp, Mus musculus
tgagctttcaagtgctggctggcat

SEQ ID NO: 854141 - DNA, 25 bp, Mus musculus
tgagctttcaggaggagccatttcc

SEQ ID NO: 854142 - DNA, 25 bp, Mus musculus
tgagctttcaggtggagccatttcc

SEQ ID NO: 854143 - DNA, 25 bp, Mus musculus
tgagctttcagtcagctccagggac

SEQ ID NO: 854144 - DNA, 25 bp, Mus musculus
tgagctttcagtccctggagatgtt

SEQ ID NO: 854145 - DNA, 25 bp, Mus musculus
tgagctttcagtgagctccagggac

SEQ ID NO: 854146 - DNA, 25 bp, Mus musculus
tgagctttcagtgcctggagatgtt

SEQ ID NO: 854147 - DNA, 25 bp, Mus musculus
tgagctttcctcaagttagttatgt

SEQ ID NO: 854148 - DNA, 25 bp, Mus musculus
tgagctttcctctagttagttatgt

SEQ ID NO: 854149 - DNA, 25 bp, Mus musculus
tgagctttcggtctccagaatgtaa

SEQ ID NO: 854150 - DNA, 25 bp, Mus musculus
tgagctttcggtgtccagaatgtaa

SEQ ID NO: 854151 - DNA, 25 bp, Mus musculus
tgagctttctaacggtttccacctg

SEQ ID NO: 854152 - DNA, 25 bp, Mus musculus
tgagctttctaagggtttccacctg

SEQ ID NO: 854153 - DNA, 25 bp, Mus musculus
tgagctttcttaattctgtacccaa

SEQ ID NO: 854154 - DNA, 25 bp, Mus musculus
tgagctttcttatttctgtacccaa

SEQ ID NO: 854155 - DNA, 25 bp, Mus musculus
tgagctttgaataatgccaccatgc

SEQ ID NO: 854156 - DNA, 25 bp, Mus musculus
tgagctttgaattatgccaccatgc

SEQ ID NO: 854157 - DNA, 25 bp, Mus musculus
tgagctttgagaccacagcgcccca

SEQ ID NO: 854158 - DNA, 25 bp, Mus musculus
tgagctttgagagcacagcgcccca

SEQ ID NO: 854159 - DNA, 25 bp, Mus musculus
tgagctttggagagacttctgttct

SEQ ID NO: 854160 - DNA, 25 bp, Mus musculus
tgagctttggagtgacttctgttct

SEQ ID NO: 854161 - DNA, 25 bp, Mus musculus
tgagctttggctaaggagaacctac

SEQ ID NO: 854162 - DNA, 25 bp, Mus musculus
tgagctttggcttaggagaacctac

SEQ ID NO: 854163 - DNA, 25 bp, Mus musculus
tgagctttgggcatctgagttcctg

SEQ ID NO: 854164 - DNA, 25 bp, Mus musculus
tgagctttgggcttctgagttcctg

SEQ ID NO: 854165 - DNA, 25 bp, Mus musculus
tgagctttgggtagacctgccctaa

SEQ ID NO: 854166 - DNA, 25 bp, Mus musculus
tgagctttgggttgacctgccctaa

SEQ ID NO: 854167 - DNA, 25 bp, Mus musculus
tgagctttggtgatgctaaggaagc

SEQ ID NO: 854168 - DNA, 25 bp, Mus musculus
tgagctttggtgttgctaaggaagc

SEQ ID NO: 854169 - DNA, 25 bp, Mus musculus
tgagcttttcctagggacccacttg

SEQ ID NO: 854170 - DNA, 25 bp, Mus musculus
tgagcttttccttgggacccacttg

SEQ ID NO: 854171 - DNA, 25 bp, Mus musculus
tgagcttttttaagtctgtacccaa

SEQ ID NO: 854172 - DNA, 25 bp, Mus musculus
tgagcttttttatgtctgtacccaa

SEQ ID NO: 854173 - DNA, 25 bp, Mus musculus
tgaggaaaacgtattcaggacattt

SEQ ID NO: 854174 - DNA, 25 bp, Mus musculus
tgaggaaaacgttttcaggacattt

SEQ ID NO: 854175 - DNA, 25 bp, Mus musculus
tgaggaaaagacctctccctgagtc

SEQ ID NO: 854176 - DNA, 25 bp, Mus musculus
tgaggaaaagacgtctccctgagtc

SEQ ID NO: 854177 - DNA, 25 bp, Mus musculus
tgaggaaaatccaaacaggatgcaa

SEQ ID NO: 854178 - DNA, 25 bp, Mus musculus
tgaggaaaatcctaacaggatgcaa

SEQ ID NO: 854179 - DNA, 25 bp, Mus musculus
tgaggaaacacacccctacctggaa

SEQ ID NO: 854180 - DNA, 25 bp, Mus musculus
tgaggaaacacagccctacctggaa

SEQ ID NO: 854181 - DNA, 25 bp, Mus musculus
tgaggaaacactatgccccgggatt

SEQ ID NO: 854182 - DNA, 25 bp, Mus musculus
tgaggaaacactttgccccgggatt

SEQ ID NO: 854183 - DNA, 25 bp, Mus musculus
tgaggaaacagaatacccagctact

SEQ ID NO: 854184 - DNA, 25 bp, Mus musculus
tgaggaaacagattacccagctact

SEQ ID NO: 854185 - DNA, 25 bp, Mus musculus
tgaggaaacatacagtgactagact

SEQ ID NO: 854186 - DNA, 25 bp, Mus musculus
tgaggaaacatagagtgactagact

SEQ ID NO: 854187 - DNA, 25 bp, Mus musculus
tgaggaaacctcaccgaagatgaaa

SEQ ID NO: 854188 - DNA, 25 bp, Mus musculus
tgaggaaacctctccgaagatgaaa

SEQ ID NO: 854189 - DNA, 25 bp, Mus musculus
tgaggaaacggaaaaggagctgact

SEQ ID NO: 854190 - DNA, 25 bp, Mus musculus
tgaggaaacggataaggagctgact

SEQ ID NO: 854191 - DNA, 25 bp, Mus musculus
tgaggaaactacctcctacttgttt

SEQ ID NO: 854192 - DNA, 25 bp, Mus musculus
tgaggaaactacgtcctacttgttt

SEQ ID NO: 854193 - DNA, 25 bp, Mus musculus
tgaggaaactccatcttttccacag

SEQ ID NO: 854194 - DNA, 25 bp, Mus musculus
tgaggaaactccttcttttccacag

SEQ ID NO: 854195 - DNA, 25 bp, Mus musculus
tgaggaaactgtcatctcactgttg

SEQ ID NO: 854196 - DNA, 25 bp, Mus musculus
tgaggaaactgtgatctcactgttg

SEQ ID NO: 854197 - DNA, 25 bp, Mus musculus
tgaggaaacttaaccctactcaccc

SEQ ID NO: 854198 - DNA, 25 bp, Mus musculus
tgaggaaacttatccctactcaccc

SEQ ID NO: 854199 - DNA, 25 bp, Mus musculus
tgaggaaagctcagccagagaagaa

SEQ ID NO: 854200 - DNA, 25 bp, Mus musculus
tgaggaaagctctgccagagaagaa

SEQ ID NO: 854201 - DNA, 25 bp, Mus musculus
tgaggaaaggccctatccgagctcc

SEQ ID NO: 854202 - DNA, 25 bp, Mus musculus
tgaggaaaggccgtatccgagctcc

SEQ ID NO: 854203 - DNA, 25 bp, Mus musculus
tgaggaaataccctactttgtctta

SEQ ID NO: 854204 - DNA, 25 bp, Mus musculus
tgaggaaataccgtactttgtctta

SEQ ID NO: 854205 - DNA, 25 bp, Mus musculus
tgaggaaatcctccctagttgtcct

SEQ ID NO: 854206 - DNA, 25 bp, Mus musculus
tgaggaaatcctgcctagttgtcct

SEQ ID NO: 854207 - DNA, 25 bp, Mus musculus
tgaggaaatgacaactctgtgtcct

SEQ ID NO: 854208 - DNA, 25 bp, Mus musculus
tgaggaaatgactactctgtgtcct

SEQ ID NO: 854209 - DNA, 25 bp, Mus musculus
tgaggaaatggtccccatcactcca

SEQ ID NO: 854210 - DNA, 25 bp, Mus musculus
tgaggaaatggtgcccatcactcca

SEQ ID NO: 854211 - DNA, 25 bp, Mus musculus
tgaggaacaagtcacagcctttgtc

SEQ ID NO: 854212 - DNA, 25 bp, Mus musculus
tgaggaacaagtgacagcctttgtc

SEQ ID NO: 854213 - DNA, 25 bp, Mus musculus
tgaggaacaggcagctcttgacttt

SEQ ID NO: 854214 - DNA, 25 bp, Mus musculus
tgaggaacaggctgctcttgacttt

SEQ ID NO: 854215 - DNA, 25 bp, Mus musculus
tgaggaacaggtatccagacagtga

SEQ ID NO: 854216 - DNA, 25 bp, Mus musculus
tgaggaacaggtttccagacagtga

SEQ ID NO: 854217 - DNA, 25 bp, Mus musculus
tgaggaacatgccagtcccttcgga

SEQ ID NO: 854218 - DNA, 25 bp, Mus musculus
tgaggaacatgcgagtcccttcgga

SEQ ID NO: 854219 - DNA, 25 bp, Mus musculus
tgaggaaccacacggccgcctggat

SEQ ID NO: 854220 - DNA, 25 bp, Mus musculus
tgaggaaccacagggccgcctggat

SEQ ID NO: 854221 - DNA, 25 bp, Mus musculus
tgaggaaccctcacaaaacctttga

SEQ ID NO: 854222 - DNA, 25 bp, Mus musculus
tgaggaaccctctcaaaacctttga

SEQ ID NO: 854223 - DNA, 25 bp, Mus musculus
tgaggaacctaactggaacctacca

SEQ ID NO: 854224 - DNA, 25 bp, Mus musculus
tgaggaacctaagtggaacctacca

SEQ ID NO: 854225 - DNA, 25 bp, Mus musculus
tgaggaacgggcactcttcacagat

SEQ ID NO: 854226 - DNA, 25 bp, Mus musculus
tgaggaacgggctctcttcacagat

SEQ ID NO: 854227 - DNA, 25 bp, Mus musculus
tgaggaactcaaactacggaaagac

SEQ ID NO: 854228 - DNA, 25 bp, Mus musculus
tgaggaactcaatctacggaaagac

SEQ ID NO: 854229 - DNA, 25 bp, Mus musculus
tgaggaactcggagccgccgaagct

SEQ ID NO: 854230 - DNA, 25 bp, Mus musculus
tgaggaactcggtgccgccgaagct

SEQ ID NO: 854231 - DNA, 25 bp, Mus musculus
tgaggaagaccacgttgtccgccag

SEQ ID NO: 854232 - DNA, 25 bp, Mus musculus
tgaggaagaccaggttgtccgccag

SEQ ID NO: 854233 - DNA, 25 bp, Mus musculus
tgaggaagagtaccaccaaccccgg

SEQ ID NO: 854234 - DNA, 25 bp, Mus musculus
tgaggaagagtagcaccaaccccgg

SEQ ID NO: 854235 - DNA, 25 bp, Mus musculus
tgaggaagcacaccctagcactagc

SEQ ID NO: 854236 - DNA, 25 bp, Mus musculus
tgaggaagcacagcctagcactagc

SEQ ID NO: 854237 - DNA, 25 bp, Mus musculus
tgaggaagcagtaaagtctcttaga

SEQ ID NO: 854238 - DNA, 25 bp, Mus musculus
tgaggaagcagttaagtctcttaga

SEQ ID NO: 854239 - DNA, 25 bp, Mus musculus
tgaggaagccatacgggcggcaaga

SEQ ID NO: 854240 - DNA, 25 bp, Mus musculus
tgaggaagccatccgttttgcccga

SEQ ID NO: 854241 - DNA, 25 bp, Mus musculus
tgaggaagccatgcgttttgcccga

SEQ ID NO: 854242 - DNA, 25 bp, Mus musculus
tgaggaagccattcgggcggcaaga

SEQ ID NO: 854243 - DNA, 25 bp, Mus musculus
tgaggaagcccacagtgttcacccg

SEQ ID NO: 854244 - DNA, 25 bp, Mus musculus
tgaggaagcccaccgtggaagactc

SEQ ID NO: 854245 - DNA, 25 bp, Mus musculus
tgaggaagcccagagtgttcacccg

SEQ ID NO: 854246 - DNA, 25 bp, Mus musculus
tgaggaagcccagcgtggaagactc

SEQ ID NO: 854247 - DNA, 25 bp, Mus musculus
tgaggaagccttacctgtgcagctg

SEQ ID NO: 854248 - DNA, 25 bp, Mus musculus
tgaggaagcctttcctgtgcagctg

SEQ ID NO: 854249 - DNA, 25 bp, Mus musculus
tgaggaaggcatactacccagctgg

SEQ ID NO: 854250 - DNA, 25 bp, Mus musculus
tgaggaaggcataggcaccaccctg

SEQ ID NO: 854251 - DNA, 25 bp, Mus musculus
tgaggaaggcattctacccagctgg

SEQ ID NO: 854252 - DNA, 25 bp, Mus musculus
tgaggaaggcattggcaccaccctg

SEQ ID NO: 854253 - DNA, 25 bp, Mus musculus
tgaggaaggccccacactgacccag

SEQ ID NO: 854254 - DNA, 25 bp, Mus musculus
tgaggaaggcccgacactgacccag

SEQ ID NO: 854255 - DNA, 25 bp, Mus musculus
tgaggaagggtcacaccatgatctc

SEQ ID NO: 854256 - DNA, 25 bp, Mus musculus
tgaggaagggtctcaccatgatctc

SEQ ID NO: 854257 - DNA, 25 bp, Mus musculus
tgaggaaggttcacattctcacttt

SEQ ID NO: 854258 - DNA, 25 bp, Mus musculus
tgaggaaggttctcattctcacttt

SEQ ID NO: 854259 - DNA, 25 bp, Mus musculus
tgaggaagtataatcaaagcccttt

SEQ ID NO: 854260 - DNA, 25 bp, Mus musculus
tgaggaagtatattcaaagcccttt

SEQ ID NO: 854261 - DNA, 25 bp, Mus musculus
tgaggaagtcccaatcaccctgaaa

SEQ ID NO: 854262 - DNA, 25 bp, Mus musculus
tgaggaagtccctatcaccctgaaa

SEQ ID NO: 854263 - DNA, 25 bp, Mus musculus
tgaggaatacaccttctggctgcac

SEQ ID NO: 854264 - DNA, 25 bp, Mus musculus
tgaggaatacacgttctggctgcac

SEQ ID NO: 854265 - DNA, 25 bp, Mus musculus
tgaggaatattcatcatcattgtgg

SEQ ID NO: 854266 - DNA, 25 bp, Mus musculus
tgaggaatattcttcatcattgtgg

SEQ ID NO: 854267 - DNA, 25 bp, Mus musculus
tgaggaatccgaacaccatggtgaa

SEQ ID NO: 854268 - DNA, 25 bp, Mus musculus
tgaggaatccgatcaccatggtgaa

SEQ ID NO: 854269 - DNA, 25 bp, Mus musculus
tgaggaatccggagtgcatgagaac

SEQ ID NO: 854270 - DNA, 25 bp, Mus musculus
tgaggaatccggtgtgcatgagaac

SEQ ID NO: 854271 - DNA, 25 bp, Mus musculus
tgaggaatctgaacgccatagtgca

SEQ ID NO: 854272 - DNA, 25 bp, Mus musculus
tgaggaatctgatcgccatagtgca

SEQ ID NO: 854273 - DNA, 25 bp, Mus musculus
tgaggaatgtcaaccggcacacaga

SEQ ID NO: 854274 - DNA, 25 bp, Mus musculus
tgaggaatgtcatccggcacacaga

SEQ ID NO: 854275 - DNA, 25 bp, Mus musculus
tgaggaatgtgaaggccacctgcgc

SEQ ID NO: 854276 - DNA, 25 bp, Mus musculus
tgaggaatgtgaaggttctccagga

SEQ ID NO: 854277 - DNA, 25 bp, Mus musculus
tgaggaatgtgatggccacctgcgc

SEQ ID NO: 854278 - DNA, 25 bp, Mus musculus
tgaggaatgtgatggttctccagga

SEQ ID NO: 854279 - DNA, 25 bp, Mus musculus
tgaggaattctcagagtgcctgcct

SEQ ID NO: 854280 - DNA, 25 bp, Mus musculus
tgaggaattctctgagtgcctgcct

SEQ ID NO: 854281 - DNA, 25 bp, Mus musculus
tgaggaattctgctgcttcagcact

SEQ ID NO: 854282 - DNA, 25 bp, Mus musculus
tgaggaattctggtgcttcagcact

SEQ ID NO: 854283 - DNA, 25 bp, Mus musculus
tgaggaattggacttggaccccatg

SEQ ID NO: 854284 - DNA, 25 bp, Mus musculus
tgaggaattggagttggaccccatg

SEQ ID NO: 854285 - DNA, 25 bp, Mus musculus
tgaggacaaaggacgctcttccaaa

SEQ ID NO: 854286 - DNA, 25 bp, Mus musculus
tgaggacaaaggtcgctcttccaaa

SEQ ID NO: 854287 - DNA, 25 bp, Mus musculus
tgaggacaacaaactaggcgaggtt

SEQ ID NO: 854288 - DNA, 25 bp, Mus musculus
tgaggacaacaatctaggcgaggtt

SEQ ID NO: 854289 - DNA, 25 bp, Mus musculus
tgaggacaagaaccccatctggtat

SEQ ID NO: 854290 - DNA, 25 bp, Mus musculus
tgaggacaagaagcccatctggtat

SEQ ID NO: 854291 - DNA, 25 bp, Mus musculus
tgaggacacattccggctgctgata

SEQ ID NO: 854292 - DNA, 25 bp, Mus musculus
tgaggacacattgcggctgctgata

SEQ ID NO: 854293 - DNA, 25 bp, Mus musculus
tgaggacaccaacacccttggcaaa

SEQ ID NO: 854294 - DNA, 25 bp, Mus musculus
tgaggacaccaagacccttggcaaa

SEQ ID NO: 854295 - DNA, 25 bp, Mus musculus
tgaggacacccaaggctgacctctg

SEQ ID NO: 854296 - DNA, 25 bp, Mus musculus
tgaggacacccactggatgagagaa

SEQ ID NO: 854297 - DNA, 25 bp, Mus musculus
tgaggacacccagtggatgagagaa

SEQ ID NO: 854298 - DNA, 25 bp, Mus musculus
tgaggacacccatggctgacctctg

SEQ ID NO: 854299 - DNA, 25 bp, Mus musculus
tgaggacaccccaaacagacagtac

SEQ ID NO: 854300 - DNA, 25 bp, Mus musculus
tgaggacacccctaacagacagtac

SEQ ID NO: 854301 - DNA, 25 bp, Mus musculus
tgaggacaccgaaagtaacctcgaa

SEQ ID NO: 854302 - DNA, 25 bp, Mus musculus
tgaggacaccgatagtaacctcgaa

SEQ ID NO: 854303 - DNA, 25 bp, Mus musculus
tgaggacacctacttgtaaccccgg

SEQ ID NO: 854304 - DNA, 25 bp, Mus musculus
tgaggacacctagttgtaaccccgg

SEQ ID NO: 854305 - DNA, 25 bp, Mus musculus
tgaggacacttacctgacacacaaa

SEQ ID NO: 854306 - DNA, 25 bp, Mus musculus
tgaggacacttagctgacacacaaa

SEQ ID NO: 854307 - DNA, 25 bp, Mus musculus
tgaggacagacgacccatgcaggac

SEQ ID NO: 854308 - DNA, 25 bp, Mus musculus
tgaggacagacgtcccatgcaggac

SEQ ID NO: 854309 - DNA, 25 bp, Mus musculus
tgaggacagcaacccactgctttgc

SEQ ID NO: 854310 - DNA, 25 bp, Mus musculus
tgaggacagcaagccactgctttgc

SEQ ID NO: 854311 - DNA, 25 bp, Mus musculus
tgaggacagctcacaggaccctgag

SEQ ID NO: 854312 - DNA, 25 bp, Mus musculus
tgaggacagctctcaggaccctgag

SEQ ID NO: 854313 - DNA, 25 bp, Mus musculus
tgaggacagtatccagccacctgag

SEQ ID NO: 854314 - DNA, 25 bp, Mus musculus
tgaggacagtatgcagccacctgag

SEQ ID NO: 854315 - DNA, 25 bp, Mus musculus
tgaggacagtgaagaggattccgaa

SEQ ID NO: 854316 - DNA, 25 bp, Mus musculus
tgaggacagtgatgaggattccgaa

SEQ ID NO: 854317 - DNA, 25 bp, Mus musculus
tgaggacataggaccctgcacagct

SEQ ID NO: 854318 - DNA, 25 bp, Mus musculus
tgaggacataggtccctgcacagct

SEQ ID NO: 854319 - DNA, 25 bp, Mus musculus
tgaggacatcacctttagccccatg

SEQ ID NO: 854320 - DNA, 25 bp, Mus musculus
tgaggacatcacgtttagccccatg

SEQ ID NO: 854321 - DNA, 25 bp, Mus musculus
tgaggacatcttaccagctttgccc

SEQ ID NO: 854322 - DNA, 25 bp, Mus musculus
tgaggacatctttccagctttgccc

SEQ ID NO: 854323 - DNA, 25 bp, Mus musculus
tgaggacatgacatgcccgaaccac

SEQ ID NO: 854324 - DNA, 25 bp, Mus musculus
tgaggacatgacttgcccgaaccac

SEQ ID NO: 854325 - DNA, 25 bp, Mus musculus
tgaggacatggaacctacttccttc

SEQ ID NO: 854326 - DNA, 25 bp, Mus musculus
tgaggacatggatcctacttccttc

SEQ ID NO: 854327 - DNA, 25 bp, Mus musculus
tgaggacatggcaaccttacggaag

SEQ ID NO: 854328 - DNA, 25 bp, Mus musculus
tgaggacatggctaccttacggaag

SEQ ID NO: 854329 - DNA, 25 bp, Mus musculus
tgaggacatgtcaactcatccctga

SEQ ID NO: 854330 - DNA, 25 bp, Mus musculus
tgaggacatgtctactcatccctga

SEQ ID NO: 854331 - DNA, 25 bp, Mus musculus
tgaggacattctcatgaatttcctg

SEQ ID NO: 854332 - DNA, 25 bp, Mus musculus
tgaggacattctgatgaatttcctg

SEQ ID NO: 854333 - DNA, 25 bp, Mus musculus
tgaggacattgacgcttgcacatcc

SEQ ID NO: 854334 - DNA, 25 bp, Mus musculus
tgaggacattgaggcttgcacatcc

SEQ ID NO: 854335 - DNA, 25 bp, Mus musculus
tgaggaccaacaatcagacgctcct

SEQ ID NO: 854336 - DNA, 25 bp, Mus musculus
tgaggaccaacattcagacgctcct

SEQ ID NO: 854337 - DNA, 25 bp, Mus musculus
tgaggaccaagcctctgactcagaa

SEQ ID NO: 854338 - DNA, 25 bp, Mus musculus
tgaggaccaagcgtctgactcagaa

SEQ ID NO: 854339 - DNA, 25 bp, Mus musculus
tgaggaccagacagagccagcaagg

SEQ ID NO: 854340 - DNA, 25 bp, Mus musculus
tgaggaccagactgagccagcaagg

SEQ ID NO: 854341 - DNA, 25 bp, Mus musculus
tgaggaccagagagaagcatccatg

SEQ ID NO: 854342 - DNA, 25 bp, Mus musculus
tgaggaccagagtgaagcatccatg

SEQ ID NO: 854343 - DNA, 25 bp, Mus musculus
tgaggaccaggaccgttccaaagga

SEQ ID NO: 854344 - DNA, 25 bp, Mus musculus
tgaggaccaggagcgttccaaagga

SEQ ID NO: 854345 - DNA, 25 bp, Mus musculus
tgaggaccaggccaagcttttccct

SEQ ID NO: 854346 - DNA, 25 bp, Mus musculus
tgaggaccaggcgaagcttttccct

SEQ ID NO: 854347 - DNA, 25 bp, Mus musculus
tgaggaccatcaacagccccttgcg

SEQ ID NO: 854348 - DNA, 25 bp, Mus musculus
tgaggaccatcatcagccccttgcg

SEQ ID NO: 854349 - DNA, 25 bp, Mus musculus
tgaggacccaacaactttgcctcca

SEQ ID NO: 854350 - DNA, 25 bp, Mus musculus
tgaggacccaactactttgcctcca

SEQ ID NO: 854351 - DNA, 25 bp, Mus musculus
tgaggacccaagcagctccgtaaca

SEQ ID NO: 854352 - DNA, 25 bp, Mus musculus
tgaggacccaaggagctccgtaaca

SEQ ID NO: 854353 - DNA, 25 bp, Mus musculus
tgaggacccaccacaggagctgtgc

SEQ ID NO: 854354 - DNA, 25 bp, Mus musculus
tgaggacccaccagaagacagccta

SEQ ID NO: 854355 - DNA, 25 bp, Mus musculus
tgaggacccacctcaggagctgtgc

SEQ ID NO: 854356 - DNA, 25 bp, Mus musculus
tgaggacccacctgaagacagccta

SEQ ID NO: 854357 - DNA, 25 bp, Mus musculus
tgaggacccagaaacagcctaccag

SEQ ID NO: 854358 - DNA, 25 bp, Mus musculus
tgaggacccagatacagcctaccag

SEQ ID NO: 854359 - DNA, 25 bp, Mus musculus
tgaggacccctgcaagatgacgttt

SEQ ID NO: 854360 - DNA, 25 bp, Mus musculus
tgaggacccctgctattgtccaaat

SEQ ID NO: 854361 - DNA, 25 bp, Mus musculus
tgaggacccctggaagatgacgttt

SEQ ID NO: 854362 - DNA, 25 bp, Mus musculus
tgaggacccctggtattgtccaaat

SEQ ID NO: 854363 - DNA, 25 bp, Mus musculus
tgaggacccgagcagctacccaatc

SEQ ID NO: 854364 - DNA, 25 bp, Mus musculus
tgaggacccgaggagctacccaatc

SEQ ID NO: 854365 - DNA, 25 bp, Mus musculus
tgaggaccctgaaccctgatttcac

SEQ ID NO: 854366 - DNA, 25 bp, Mus musculus
tgaggaccctgatccctgatttcac

SEQ ID NO: 854367 - DNA, 25 bp, Mus musculus
tgaggacccttcatcacatgcagta

SEQ ID NO: 854368 - DNA, 25 bp, Mus musculus
tgaggacccttcatgtgctggcaag

SEQ ID NO: 854369 - DNA, 25 bp, Mus musculus
tgaggacccttcttcacatgcagta

SEQ ID NO: 854370 - DNA, 25 bp, Mus musculus
tgaggacccttcttgtgctggcaag

SEQ ID NO: 854371 - DNA, 25 bp, Mus musculus
tgaggaccgcaacacagccttggaa

SEQ ID NO: 854372 - DNA, 25 bp, Mus musculus
tgaggaccgcaagacagccttggaa

SEQ ID NO: 854373 - DNA, 25 bp, Mus musculus
tgaggaccggatcctgctggctaac

SEQ ID NO: 854374 - DNA, 25 bp, Mus musculus
tgaggaccggatgctgctggctaac

SEQ ID NO: 854375 - DNA, 25 bp, Mus musculus
tgaggaccggcaattggtggaccaa

SEQ ID NO: 854376 - DNA, 25 bp, Mus musculus
tgaggaccggcatttggtggaccaa

SEQ ID NO: 854377 - DNA, 25 bp, Mus musculus
tgaggacctataattccatgttaaa

SEQ ID NO: 854378 - DNA, 25 bp, Mus musculus
tgaggacctatatttccatgttaaa

SEQ ID NO: 854379 - DNA, 25 bp, Mus musculus
tgaggacctccgcatgtttgccagg

SEQ ID NO: 854380 - DNA, 25 bp, Mus musculus
tgaggacctccggatgtttgccagg

SEQ ID NO: 854381 - DNA, 25 bp, Mus musculus
tgaggacctcttcgtattgtgcctt

SEQ ID NO: 854382 - DNA, 25 bp, Mus musculus
tgaggacctcttggtattgtgcctt

SEQ ID NO: 854383 - DNA, 25 bp, Mus musculus
tgaggacctggccaaacgcagcaaa

SEQ ID NO: 854384 - DNA, 25 bp, Mus musculus
tgaggacctggcgaaacgcagcaaa

SEQ ID NO: 854385 - DNA, 25 bp, Mus musculus
tgaggacctgtcaagtcctgagtcg

SEQ ID NO: 854386 - DNA, 25 bp, Mus musculus
tgaggacctgtctagtcctgagtcg

SEQ ID NO: 854387 - DNA, 25 bp, Mus musculus
tgaggaccttaaacctaccatctgc

SEQ ID NO: 854388 - DNA, 25 bp, Mus musculus
tgaggaccttaatcctaccatctgc

SEQ ID NO: 854389 - DNA, 25 bp, Mus musculus
tgaggaccttagacttggtccctgg

SEQ ID NO: 854390 - DNA, 25 bp, Mus musculus
tgaggaccttagtcttggtccctgg

SEQ ID NO: 854391 - DNA, 25 bp, Mus musculus
tgaggaccttgtctaaccatacgct

SEQ ID NO: 854392 - DNA, 25 bp, Mus musculus
tgaggaccttgtgtaaccatacgct

SEQ ID NO: 854393 - DNA, 25 bp, Mus musculus
tgaggacgacctagctgagatccgc

SEQ ID NO: 854394 - DNA, 25 bp, Mus musculus
tgaggacgaccttgctgagatccgc

SEQ ID NO: 854395 - DNA, 25 bp, Mus musculus
tgaggacgagtgagtcctgagacca

SEQ ID NO: 854396 - DNA, 25 bp, Mus musculus
tgaggacgagtgtgtcctgagacca

SEQ ID NO: 854397 - DNA, 25 bp, Mus musculus
tgaggacgatgcaggtgcgtaccca

SEQ ID NO: 854398 - DNA, 25 bp, Mus musculus
tgaggacgatgctggtgcgtaccca

SEQ ID NO: 854399 - DNA, 25 bp, Mus musculus
tgaggacgccatccgaaacgctgca

SEQ ID NO: 854400 - DNA, 25 bp, Mus musculus
tgaggacgccatgcgaaacgctgca

SEQ ID NO: 854401 - DNA, 25 bp, Mus musculus
tgaggacgccttcaccctagactac

SEQ ID NO: 854402 - DNA, 25 bp, Mus musculus
tgaggacgccttgaccctagactac

SEQ ID NO: 854403 - DNA, 25 bp, Mus musculus
tgaggacggcttcttccctttgcag

SEQ ID NO: 854404 - DNA, 25 bp, Mus musculus
tgaggacggcttgttccctttgcag

SEQ ID NO: 854405 - DNA, 25 bp, Mus musculus
tgaggacgggctcgtttaccagcta

SEQ ID NO: 854406 - DNA, 25 bp, Mus musculus
tgaggacgggctggtttaccagcta

SEQ ID NO: 854407 - DNA, 25 bp, Mus musculus
tgaggactaccacagccgtcacttt

SEQ ID NO: 854408 - DNA, 25 bp, Mus musculus
tgaggactaccagagccgtcacttt

SEQ ID NO: 854409 - DNA, 25 bp, Mus musculus
tgaggactacttcattcccagtctc

SEQ ID NO: 854410 - DNA, 25 bp, Mus musculus
tgaggactacttgattcccagtctc

SEQ ID NO: 854411 - DNA, 25 bp, Mus musculus
tgaggactatatatctattctctct

SEQ ID NO: 854412 - DNA, 25 bp, Mus musculus
tgaggactatatttctattctctct

SEQ ID NO: 854413 - DNA, 25 bp, Mus musculus
tgaggactatgaaccttctggcaca

SEQ ID NO: 854414 - DNA, 25 bp, Mus musculus
tgaggactatgatccttctggcaca

SEQ ID NO: 854415 - DNA, 25 bp, Mus musculus
tgaggactcaacactggaggccatt

SEQ ID NO: 854416 - DNA, 25 bp, Mus musculus
tgaggactcaactctggaggccatt

SEQ ID NO: 854417 - DNA, 25 bp, Mus musculus
tgaggactcaataagccattctgct

SEQ ID NO: 854418 - DNA, 25 bp, Mus musculus
tgaggactcaattagccattctgct

SEQ ID NO: 854419 - DNA, 25 bp, Mus musculus
tgaggactcagaccctggtctgcca

SEQ ID NO: 854420 - DNA, 25 bp, Mus musculus
tgaggactcagagcctggtctgcca

SEQ ID NO: 854421 - DNA, 25 bp, Mus musculus
tgaggactccaacgccttcgcggga

SEQ ID NO: 854422 - DNA, 25 bp, Mus musculus
tgaggactccaaggccttcgcggga

SEQ ID NO: 854423 - DNA, 25 bp, Mus musculus
tgaggactcgagaacacctcctgtg

SEQ ID NO: 854424 - DNA, 25 bp, Mus musculus
tgaggactcgagtacacctcctgtg

SEQ ID NO: 854425 - DNA, 25 bp, Mus musculus
tgaggactcgctctacctgtttgca

SEQ ID NO: 854426 - DNA, 25 bp, Mus musculus
tgaggactcgctgtacctgtttgca

SEQ ID NO: 854427 - DNA, 25 bp, Mus musculus
tgaggactcgggactcttcgtgtca

SEQ ID NO: 854428 - DNA, 25 bp, Mus musculus
tgaggactcgggtctcttcgtgtca

SEQ ID NO: 854429 - DNA, 25 bp, Mus musculus
tgaggactcggtattgaagccccat

SEQ ID NO: 854430 - DNA, 25 bp, Mus musculus
tgaggactcggttttgaagccccat

SEQ ID NO: 854431 - DNA, 25 bp, Mus musculus
tgaggactctaaacacagctggttt

SEQ ID NO: 854432 - DNA, 25 bp, Mus musculus
tgaggactctaatcacagctggttt

SEQ ID NO: 854433 - DNA, 25 bp, Mus musculus
tgaggactcttgctaatgtcaggat

SEQ ID NO: 854434 - DNA, 25 bp, Mus musculus
tgaggactcttggtaatgtcaggat

SEQ ID NO: 854435 - DNA, 25 bp, Mus musculus
tgaggactgacacaggtgaaccaat

SEQ ID NO: 854436 - DNA, 25 bp, Mus musculus
tgaggactgacagaggtgaaccaat

SEQ ID NO: 854437 - DNA, 25 bp, Mus musculus
tgaggactgcccagccatcgaccag

SEQ ID NO: 854438 - DNA, 25 bp, Mus musculus
tgaggactgccctgccatcgaccag

SEQ ID NO: 854439 - DNA, 25 bp, Mus musculus
tgaggactgctcacccaatgttggc

SEQ ID NO: 854440 - DNA, 25 bp, Mus musculus
tgaggactgctctcccaatgttggc

SEQ ID NO: 854441 - DNA, 25 bp, Mus musculus
tgaggactggaacccgctctcctgc

SEQ ID NO: 854442 - DNA, 25 bp, Mus musculus
tgaggactggaagccgctctcctgc

SEQ ID NO: 854443 - DNA, 25 bp, Mus musculus
tgaggactgggcacgccctgaatac

SEQ ID NO: 854444 - DNA, 25 bp, Mus musculus
tgaggactgggctcgccctgaatac

SEQ ID NO: 854445 - DNA, 25 bp, Mus musculus
tgaggactgtggagcccactttgaa

SEQ ID NO: 854446 - DNA, 25 bp, Mus musculus
tgaggactgtggtgcccactttgaa

SEQ ID NO: 854447 - DNA, 25 bp, Mus musculus
tgaggactgttaccatcgtatatga

SEQ ID NO: 854448 - DNA, 25 bp, Mus musculus
tgaggactgttagcatcgtatatga

SEQ ID NO: 854449 - DNA, 25 bp, Mus musculus
tgaggacttactcgctcgtggctgt

SEQ ID NO: 854450 - DNA, 25 bp, Mus musculus
tgaggacttactggctcgtggctgt

SEQ ID NO: 854451 - DNA, 25 bp, Mus musculus
tgaggacttagcacccaaaccatgc

SEQ ID NO: 854452 - DNA, 25 bp, Mus musculus
tgaggacttagctcccaaaccatgc

SEQ ID NO: 854453 - DNA, 25 bp, Mus musculus
tgaggacttcacctgtcactctgat

SEQ ID NO: 854454 - DNA, 25 bp, Mus musculus
tgaggacttcacgtgtcactctgat

SEQ ID NO: 854455 - DNA, 25 bp, Mus musculus
tgaggacttcccagtgagcaccttt

SEQ ID NO: 854456 - DNA, 25 bp, Mus musculus
tgaggacttccctgtgagcaccttt

SEQ ID NO: 854457 - DNA, 25 bp, Mus musculus
tgaggacttcgcagtcactgtgcag

SEQ ID NO: 854458 - DNA, 25 bp, Mus musculus
tgaggacttcgctgtcactgtgcag

SEQ ID NO: 854459 - DNA, 25 bp, Mus musculus
tgaggacttctcagaaaccgaaaaa

SEQ ID NO: 854460 - DNA, 25 bp, Mus musculus
tgaggacttctctgaaaccgaaaaa

SEQ ID NO: 854461 - DNA, 25 bp, Mus musculus
tgaggacttggcatggacctgctgt

SEQ ID NO: 854462 - DNA, 25 bp, Mus musculus
tgaggacttggcttggacctgctgt

SEQ ID NO: 854463 - DNA, 25 bp, Mus musculus
tgaggagaacgtatgccttcttctt

SEQ ID NO: 854464 - DNA, 25 bp, Mus musculus
tgaggagaacgtttgccttcttctt

SEQ ID NO: 854465 - DNA, 25 bp, Mus musculus
tgaggagaaggacactgacacccct

SEQ ID NO: 854466 - DNA, 25 bp, Mus musculus
tgaggagaaggagactgacacccct

SEQ ID NO: 854467 - DNA, 25 bp, Mus musculus
tgaggagaatcccaactgccagatc

SEQ ID NO: 854468 - DNA, 25 bp, Mus musculus
tgaggagaatccgaactgccagatc

SEQ ID NO: 854469 - DNA, 25 bp, Mus musculus
tgaggagacacacttgcccacagag

SEQ ID NO: 854470 - DNA, 25 bp, Mus musculus
tgaggagacacagttgcccacagag

SEQ ID NO: 854471 - DNA, 25 bp, Mus musculus
tgaggagacacgcactcaggctttc

SEQ ID NO: 854472 - DNA, 25 bp, Mus musculus
tgaggagacacggactcaggctttc

SEQ ID NO: 854473 - DNA, 25 bp, Mus musculus
tgaggagaccctacaggactgacct

SEQ ID NO: 854474 - DNA, 25 bp, Mus musculus
tgaggagaccctctactatgtgaag

SEQ ID NO: 854475 - DNA, 25 bp, Mus musculus
tgaggagaccctgtactatgtgaag

SEQ ID NO: 854476 - DNA, 25 bp, Mus musculus
tgaggagacccttcaggactgacct

SEQ ID NO: 854477 - DNA, 25 bp, Mus musculus
tgaggagacctaagctctacaccgc

SEQ ID NO: 854478 - DNA, 25 bp, Mus musculus
tgaggagacctacccatggaccaaa

SEQ ID NO: 854479 - DNA, 25 bp, Mus musculus
tgaggagacctagccatggaccaaa

SEQ ID NO: 854480 - DNA, 25 bp, Mus musculus
tgaggagacctatgctctacaccgc

SEQ ID NO: 854481 - DNA, 25 bp, Mus musculus
tgaggagagtaccacagttgtcacc

SEQ ID NO: 854482 - DNA, 25 bp, Mus musculus
tgaggagagtacgacagttgtcacc

SEQ ID NO: 854483 - DNA, 25 bp, Mus musculus
tgaggagagtccctatctgttcacc

SEQ ID NO: 854484 - DNA, 25 bp, Mus musculus
tgaggagagtccgtatctgttcacc

SEQ ID NO: 854485 - DNA, 25 bp, Mus musculus
tgaggagatacacagctatgctact

SEQ ID NO: 854486 - DNA, 25 bp, Mus musculus
tgaggagatacagagctatgctact

SEQ ID NO: 854487 - DNA, 25 bp, Mus musculus
tgaggagatctgacagggcctgtct

SEQ ID NO: 854488 - DNA, 25 bp, Mus musculus
tgaggagatctgtcagggcctgtct

SEQ ID NO: 854489 - DNA, 25 bp, Mus musculus
tgaggagattttccctgtttctgct

SEQ ID NO: 854490 - DNA, 25 bp, Mus musculus
tgaggagattttgcctgtttctgct

SEQ ID NO: 854491 - DNA, 25 bp, Mus musculus
tgaggagcaagccttcttctgaagg

SEQ ID NO: 854492 - DNA, 25 bp, Mus musculus
tgaggagcaagcgttcttctgaagg

SEQ ID NO: 854493 - DNA, 25 bp, Mus musculus
tgaggagcaaggaagccccgcagaa

SEQ ID NO: 854494 - DNA, 25 bp, Mus musculus
tgaggagcaaggtagccccgcagaa

SEQ ID NO: 854495 - DNA, 25 bp, Mus musculus
tgaggagcaatgcacccacactgac

SEQ ID NO: 854496 - DNA, 25 bp, Mus musculus
tgaggagcaatggacccacactgac

SEQ ID NO: 854497 - DNA, 25 bp, Mus musculus
tgaggagcagctacgcctggccctg

SEQ ID NO: 854498 - DNA, 25 bp, Mus musculus
tgaggagcagcttcgcctggccctg

SEQ ID NO: 854499 - DNA, 25 bp, Mus musculus
tgaggagcaggcaactgggctggag

SEQ ID NO: 854500 - DNA, 25 bp, Mus musculus
tgaggagcaggctactgggctggag

SEQ ID NO: 854501 - DNA, 25 bp, Mus musculus
tgaggagcatttacctgattgatgc

SEQ ID NO: 854502 - DNA, 25 bp, Mus musculus
tgaggagcattttcctgattgatgc

SEQ ID NO: 854503 - DNA, 25 bp, Mus musculus
tgaggagccagaatcaagcgtttct

SEQ ID NO: 854504 - DNA, 25 bp, Mus musculus
tgaggagccagattcaagcgtttct

SEQ ID NO: 854505 - DNA, 25 bp, Mus musculus
tgaggagcccgtccgccagaagatt

SEQ ID NO: 854506 - DNA, 25 bp, Mus musculus
tgaggagcccgtgcgccagaagatt

SEQ ID NO: 854507 - DNA, 25 bp, Mus musculus
tgaggagccctgctccacctgaatg

SEQ ID NO: 854508 - DNA, 25 bp, Mus musculus
tgaggagccctggtccacctgaatg

SEQ ID NO: 854509 - DNA, 25 bp, Mus musculus
tgaggagccggtccttacccggcca

SEQ ID NO: 854510 - DNA, 25 bp, Mus musculus
tgaggagccggtgcttacccggcca

SEQ ID NO: 854511 - DNA, 25 bp, Mus musculus
tgaggagcctgaatgcaaagacatc

SEQ ID NO: 854512 - DNA, 25 bp, Mus musculus
tgaggagcctgaccggctcggcccg

SEQ ID NO: 854513 - DNA, 25 bp, Mus musculus
tgaggagcctgagcggctcggcccg

SEQ ID NO: 854514 - DNA, 25 bp, Mus musculus
tgaggagcctgattgcaaagacatc

SEQ ID NO: 854515 - DNA, 25 bp, Mus musculus
tgaggagcctgcatcccctatcggc

SEQ ID NO: 854516 - DNA, 25 bp, Mus musculus
tgaggagcctgcttcccctatcggc

SEQ ID NO: 854517 - DNA, 25 bp, Mus musculus
tgaggagcctttcctgccaagagag

SEQ ID NO: 854518 - DNA, 25 bp, Mus musculus
tgaggagcctttgctgccaagagag

SEQ ID NO: 854519 - DNA, 25 bp, Mus musculus
tgaggagcgccaccctagtaagcat

SEQ ID NO: 854520 - DNA, 25 bp, Mus musculus
tgaggagcgccagcctagtaagcat

SEQ ID NO: 854521 - DNA, 25 bp, Mus musculus
tgaggagcgctcagccgcagaccac

SEQ ID NO: 854522 - DNA, 25 bp, Mus musculus
tgaggagcgctctgccgcagaccac

SEQ ID NO: 854523 - DNA, 25 bp, Mus musculus
tgaggagcgtgtcgcttccacttct

SEQ ID NO: 854524 - DNA, 25 bp, Mus musculus
tgaggagcgtgtggcttccacttct

SEQ ID NO: 854525 - DNA, 25 bp, Mus musculus
tgaggagctctgctaagtccactct

SEQ ID NO: 854526 - DNA, 25 bp, Mus musculus
tgaggagctctggtaagtccactct

SEQ ID NO: 854527 - DNA, 25 bp, Mus musculus
tgaggagctgccactgtgctgcaca

SEQ ID NO: 854528 - DNA, 25 bp, Mus musculus
tgaggagctgccatgtgacccagtg

SEQ ID NO: 854529 - DNA, 25 bp, Mus musculus
tgaggagctgcctctgtgctgcaca

SEQ ID NO: 854530 - DNA, 25 bp, Mus musculus
tgaggagctgccttgtgacccagtg

SEQ ID NO: 854531 - DNA, 25 bp, Mus musculus
tgaggagctgcgagcaaacacttga

SEQ ID NO: 854532 - DNA, 25 bp, Mus musculus
tgaggagctgcgtgcaaacacttga

SEQ ID NO: 854533 - DNA, 25 bp, Mus musculus
tgaggagctgtaattagggatcaca

SEQ ID NO: 854534 - DNA, 25 bp, Mus musculus
tgaggagctgtatttagggatcaca

SEQ ID NO: 854535 - DNA, 25 bp, Mus musculus
tgaggagctgttcgcatccagccca

SEQ ID NO: 854536 - DNA, 25 bp, Mus musculus
tgaggagctgttggcatccagccca

SEQ ID NO: 854537 - DNA, 25 bp, Mus musculus
tgaggaggacagaccatgtgcttca

SEQ ID NO: 854538 - DNA, 25 bp, Mus musculus
tgaggaggacagtccatgtgcttca

SEQ ID NO: 854539 - DNA, 25 bp, Mus musculus
tgaggaggattgaccacatggaact

SEQ ID NO: 854540 - DNA, 25 bp, Mus musculus
tgaggaggattgtccacatggaact

SEQ ID NO: 854541 - DNA, 25 bp, Mus musculus
tgaggagggcacctcggcaacctct

SEQ ID NO: 854542 - DNA, 25 bp, Mus musculus
tgaggagggcacgtcggcaacctct

SEQ ID NO: 854543 - DNA, 25 bp, Mus musculus
tgaggagggcagagcagacttttct

SEQ ID NO: 854544 - DNA, 25 bp, Mus musculus
tgaggagggcagtgcagacttttct

SEQ ID NO: 854545 - DNA, 25 bp, Mus musculus
tgaggaggtgacacttgcctggcaa

SEQ ID NO: 854546 - DNA, 25 bp, Mus musculus
tgaggaggtgactcttgcctggcaa

SEQ ID NO: 854547 - DNA, 25 bp, Mus musculus
tgaggaggttaacgtgccctagccc

SEQ ID NO: 854548 - DNA, 25 bp, Mus musculus
tgaggaggttaaggtgccctagccc

SEQ ID NO: 854549 - DNA, 25 bp, Mus musculus
tgaggaggttcaccttcacattgct

SEQ ID NO: 854550 - DNA, 25 bp, Mus musculus
tgaggaggttcagcttcacattgct

SEQ ID NO: 854551 - DNA, 25 bp, Mus musculus
tgaggaggttccactgtgctccaaa

SEQ ID NO: 854552 - DNA, 25 bp, Mus musculus
tgaggaggttcccactgagagatta

SEQ ID NO: 854553 - DNA, 25 bp, Mus musculus
tgaggaggttccgactgagagatta

SEQ ID NO: 854554 - DNA, 25 bp, Mus musculus
tgaggaggttcctctgtgctccaaa

SEQ ID NO: 854555 - DNA, 25 bp, Mus musculus
tgaggagtcactccacttaccgtag

SEQ ID NO: 854556 - DNA, 25 bp, Mus musculus
tgaggagtcactgcacttaccgtag

SEQ ID NO: 854557 - DNA, 25 bp, Mus musculus
tgaggagtcatgatctttcttcccc

SEQ ID NO: 854558 - DNA, 25 bp, Mus musculus
tgaggagtcatgttctttcttcccc

SEQ ID NO: 854559 - DNA, 25 bp, Mus musculus
tgaggagtccctataccaactcggc

SEQ ID NO: 854560 - DNA, 25 bp, Mus musculus
tgaggagtccctcagatcttatcca

SEQ ID NO: 854561 - DNA, 25 bp, Mus musculus
tgaggagtccctgagatcttatcca

SEQ ID NO: 854562 - DNA, 25 bp, Mus musculus
tgaggagtccctttaccaactcggc

SEQ ID NO: 854563 - DNA, 25 bp, Mus musculus
tgaggagtcctccattttccaatac

SEQ ID NO: 854564 - DNA, 25 bp, Mus musculus
tgaggagtcctcgattttccaatac

SEQ ID NO: 854565 - DNA, 25 bp, Mus musculus
tgaggagtctatccccggttaccct

SEQ ID NO: 854566 - DNA, 25 bp, Mus musculus
tgaggagtctatgcccggttaccct

SEQ ID NO: 854567 - DNA, 25 bp, Mus musculus
tgaggagtctccacgggttccttgc

SEQ ID NO: 854568 - DNA, 25 bp, Mus musculus
tgaggagtctcctcgggttccttgc

SEQ ID NO: 854569 - DNA, 25 bp, Mus musculus
tgaggagtgctccaggccccataat

SEQ ID NO: 854570 - DNA, 25 bp, Mus musculus
tgaggagtgctcgaggccccataat

SEQ ID NO: 854571 - DNA, 25 bp, Mus musculus
tgaggagttctaaacccccttctaa

SEQ ID NO: 854572 - DNA, 25 bp, Mus musculus
tgaggagttctatacccccttctaa

SEQ ID NO: 854573 - DNA, 25 bp, Mus musculus
tgaggagttgccaccccagtaggcc

SEQ ID NO: 854574 - DNA, 25 bp, Mus musculus
tgaggagttgcctccccagtaggcc

SEQ ID NO: 854575 - DNA, 25 bp, Mus musculus
tgaggagttgtcaccccaggaggcc

SEQ ID NO: 854576 - DNA, 25 bp, Mus musculus
tgaggagttgtctccccaggaggcc

SEQ ID NO: 854577 - DNA, 25 bp, Mus musculus
tgaggataactgaagctatgtgctc

SEQ ID NO: 854578 - DNA, 25 bp, Mus musculus
tgaggataactgtagctatgtgctc

SEQ ID NO: 854579 - DNA, 25 bp, Mus musculus
tgaggataatccatcgccaccatga

SEQ ID NO: 854580 - DNA, 25 bp, Mus musculus
tgaggataatccttcgccaccatga

SEQ ID NO: 854581 - DNA, 25 bp, Mus musculus
tgaggatactctacatttcaaatgt

SEQ ID NO: 854582 - DNA, 25 bp, Mus musculus
tgaggatactcttcatttcaaatgt

SEQ ID NO: 854583 - DNA, 25 bp, Mus musculus
tgaggatactgaaaggtgactgttt

SEQ ID NO: 854584 - DNA, 25 bp, Mus musculus
tgaggatactgataggtgactgttt

SEQ ID NO: 854585 - DNA, 25 bp, Mus musculus
tgaggatatcctacacaaactggtg

SEQ ID NO: 854586 - DNA, 25 bp, Mus musculus
tgaggatatcctcagccatcttcgc

SEQ ID NO: 854587 - DNA, 25 bp, Mus musculus
tgaggatatcctgagccatcttcgc

SEQ ID NO: 854588 - DNA, 25 bp, Mus musculus
tgaggatatccttcacaaactggtg

SEQ ID NO: 854589 - DNA, 25 bp, Mus musculus
tgaggatcacagactacctgagaga

SEQ ID NO: 854590 - DNA, 25 bp, Mus musculus
tgaggatcacagtctacctgagaga

SEQ ID NO: 854591 - DNA, 25 bp, Mus musculus
tgaggatcacccatccagagtcatt

SEQ ID NO: 854592 - DNA, 25 bp, Mus musculus
tgaggatcacccttccagagtcatt

SEQ ID NO: 854593 - DNA, 25 bp, Mus musculus
tgaggatcacgtcggctgcgtttct

SEQ ID NO: 854594 - DNA, 25 bp, Mus musculus
tgaggatcacgtgggctgcgtttct

SEQ ID NO: 854595 - DNA, 25 bp, Mus musculus
tgaggatcaggcacgacaggccatt

SEQ ID NO: 854596 - DNA, 25 bp, Mus musculus
tgaggatcaggctcgacaggccatt

SEQ ID NO: 854597 - DNA, 25 bp, Mus musculus
tgaggatcctcgacaaggtcactgt

SEQ ID NO: 854598 - DNA, 25 bp, Mus musculus
tgaggatcctcgtcaaggtcactgt

SEQ ID NO: 854599 - DNA, 25 bp, Mus musculus
tgaggatcctctactaagccatgca

SEQ ID NO: 854600 - DNA, 25 bp, Mus musculus
tgaggatcctcttctaagccatgca

SEQ ID NO: 854601 - DNA, 25 bp, Mus musculus
tgaggatccttgaattggcagcaca

SEQ ID NO: 854602 - DNA, 25 bp, Mus musculus
tgaggatccttgtattggcagcaca

SEQ ID NO: 854603 - DNA, 25 bp, Mus musculus
tgaggatctgagataacgcctgctt

SEQ ID NO: 854604 - DNA, 25 bp, Mus musculus
tgaggatctgagttaacgcctgctt

SEQ ID NO: 854605 - DNA, 25 bp, Mus musculus
tgaggatcttcccacactggaggtt

SEQ ID NO: 854606 - DNA, 25 bp, Mus musculus
tgaggatcttccgacactggaggtt

SEQ ID NO: 854607 - DNA, 25 bp, Mus musculus
tgaggatgaactagtctatgcagac

SEQ ID NO: 854608 - DNA, 25 bp, Mus musculus
tgaggatgaacttgtctatgcagac

SEQ ID NO: 854609 - DNA, 25 bp, Mus musculus
tgaggatgaagcaactggaggacca

SEQ ID NO: 854610 - DNA, 25 bp, Mus musculus
tgaggatgaagctactggaggacca

SEQ ID NO: 854611 - DNA, 25 bp, Mus musculus
tgaggatgaatcacttcagcgcctg

SEQ ID NO: 854612 - DNA, 25 bp, Mus musculus
tgaggatgaatctcttcagcgcctg

SEQ ID NO: 854613 - DNA, 25 bp, Mus musculus
tgaggatgacgacctgctgcagttt

SEQ ID NO: 854614 - DNA, 25 bp, Mus musculus
tgaggatgacgagctgctgcagttt

SEQ ID NO: 854615 - DNA, 25 bp, Mus musculus
tgaggatgaggaatccccaaacaag

SEQ ID NO: 854616 - DNA, 25 bp, Mus musculus
tgaggatgaggattccccaaacaag

SEQ ID NO: 854617 - DNA, 25 bp, Mus musculus
tgaggatgctccagcacagtctgca

SEQ ID NO: 854618 - DNA, 25 bp, Mus musculus
tgaggatgctcctgcacagtctgca

SEQ ID NO: 854619 - DNA, 25 bp, Mus musculus
tgaggatgcttgcagcttccagttc

SEQ ID NO: 854620 - DNA, 25 bp, Mus musculus
tgaggatgcttggagcttccagttc

SEQ ID NO: 854621 - DNA, 25 bp, Mus musculus
tgaggatggaatccccaaggacccc

SEQ ID NO: 854622 - DNA, 25 bp, Mus musculus
tgaggatggaatgcccaaggacccc

SEQ ID NO: 854623 - DNA, 25 bp, Mus musculus
tgaggatgggtgaactctgccacgc

SEQ ID NO: 854624 - DNA, 25 bp, Mus musculus
tgaggatgggtgtactctgccacgc

SEQ ID NO: 854625 - DNA, 25 bp, Mus musculus
tgaggatggttcactgcccagaaat

SEQ ID NO: 854626 - DNA, 25 bp, Mus musculus
tgaggatggttctctgcccagaaat

SEQ ID NO: 854627 - DNA, 25 bp, Mus musculus
tgaggatggtttagttcctaccttt

SEQ ID NO: 854628 - DNA, 25 bp, Mus musculus
tgaggatggttttgttcctaccttt

SEQ ID NO: 854629 - DNA, 25 bp, Mus musculus
tgaggatgtatgatgcctattttat

SEQ ID NO: 854630 - DNA, 25 bp, Mus musculus
tgaggatgtatgttgcctattttat

SEQ ID NO: 854631 - DNA, 25 bp, Mus musculus
tgaggatgtggaccccgccaaaaag

SEQ ID NO: 854632 - DNA, 25 bp, Mus musculus
tgaggatgtggagcccgccaaaaag

SEQ ID NO: 854633 - DNA, 25 bp, Mus musculus
tgaggattcagccaacccgtttgca

SEQ ID NO: 854634 - DNA, 25 bp, Mus musculus
tgaggattcagcgaacccgtttgca

SEQ ID NO: 854635 - DNA, 25 bp, Mus musculus
tgaggattccttcatgaaatttgta

SEQ ID NO: 854636 - DNA, 25 bp, Mus musculus
tgaggattccttgatgaaatttgta

SEQ ID NO: 854637 - DNA, 25 bp, Mus musculus
tgaggattctagagacttgcacccc

SEQ ID NO: 854638 - DNA, 25 bp, Mus musculus
tgaggattctagtgacttgcacccc

SEQ ID NO: 854639 - DNA, 25 bp, Mus musculus
tgaggattctctcgtgctggcctta

SEQ ID NO: 854640 - DNA, 25 bp, Mus musculus
tgaggattctctggtgctggcctta

SEQ ID NO: 854641 - DNA, 25 bp, Mus musculus
tgaggattggtcagcagctcccaca

SEQ ID NO: 854642 - DNA, 25 bp, Mus musculus
tgaggattggtctgcagctcccaca

SEQ ID NO: 854643 - DNA, 25 bp, Mus musculus
tgaggatttggactttcagtgagaa

SEQ ID NO: 854644 - DNA, 25 bp, Mus musculus
tgaggatttggagtttcagtgagaa

SEQ ID NO: 854645 - DNA, 25 bp, Mus musculus
tgaggcaaaggtatccatggaagtt

SEQ ID NO: 854646 - DNA, 25 bp, Mus musculus
tgaggcaaaggtttccatggaagtt

SEQ ID NO: 854647 - DNA, 25 bp, Mus musculus
tgaggcaaagttatgatcgatctcc

SEQ ID NO: 854648 - DNA, 25 bp, Mus musculus
tgaggcaaagttttgatcgatctcc

SEQ ID NO: 854649 - DNA, 25 bp, Mus musculus
tgaggcaaatcacaccaggctgtcc

SEQ ID NO: 854650 - DNA, 25 bp, Mus musculus
tgaggcaaatcagaccaggctgtcc

SEQ ID NO: 854651 - DNA, 25 bp, Mus musculus
tgaggcaacttgattgtaaacttcg

SEQ ID NO: 854652 - DNA, 25 bp, Mus musculus
tgaggcaacttgtttgtaaacttcg

SEQ ID NO: 854653 - DNA, 25 bp, Mus musculus
tgaggcaagaatacttacctgtttc

SEQ ID NO: 854654 - DNA, 25 bp, Mus musculus
tgaggcaagaattcttacctgtttc

SEQ ID NO: 854655 - DNA, 25 bp, Mus musculus
tgaggcaagacccaaagttcccatt

SEQ ID NO: 854656 - DNA, 25 bp, Mus musculus
tgaggcaagaccgaaagttcccatt

SEQ ID NO: 854657 - DNA, 25 bp, Mus musculus
tgaggcaagccacatgtgaccccaa

SEQ ID NO: 854658 - DNA, 25 bp, Mus musculus
tgaggcaagccagatgtgaccccaa

SEQ ID NO: 854659 - DNA, 25 bp, Mus musculus
tgaggcacaagtacccaccaatggc

SEQ ID NO: 854660 - DNA, 25 bp, Mus musculus
tgaggcacaagttcccaccaatggc

SEQ ID NO: 854661 - DNA, 25 bp, Mus musculus
tgaggcacacatcgcccctaagaat

SEQ ID NO: 854662 - DNA, 25 bp, Mus musculus
tgaggcacacatggcccctaagaat

SEQ ID NO: 854663 - DNA, 25 bp, Mus musculus
tgaggcacagaaaacaggagagttt

SEQ ID NO: 854664 - DNA, 25 bp, Mus musculus
tgaggcacagaatacaggagagttt

SEQ ID NO: 854665 - DNA, 25 bp, Mus musculus
tgaggcacatcacgagctaggaact

SEQ ID NO: 854666 - DNA, 25 bp, Mus musculus
tgaggcacatcaggagctaggaact

SEQ ID NO: 854667 - DNA, 25 bp, Mus musculus
tgaggcacatccacctttagtgaat

SEQ ID NO: 854668 - DNA, 25 bp, Mus musculus
tgaggcacatcctcctttagtgaat

SEQ ID NO: 854669 - DNA, 25 bp, Mus musculus
tgaggcaccaagcacaagcaccagt

SEQ ID NO: 854670 - DNA, 25 bp, Mus musculus
tgaggcaccaaggacaagcaccagt

SEQ ID NO: 854671 - DNA, 25 bp, Mus musculus
tgaggcaccactaagttacacagat

SEQ ID NO: 854672 - DNA, 25 bp, Mus musculus
tgaggcaccacttagttacacagat

SEQ ID NO: 854673 - DNA, 25 bp, Mus musculus
tgaggcaccctcacaggcagtgagg

SEQ ID NO: 854674 - DNA, 25 bp, Mus musculus
tgaggcaccctctcaggcagtgagg

SEQ ID NO: 854675 - DNA, 25 bp, Mus musculus
tgaggcaccgggaggccggccaagt

SEQ ID NO: 854676 - DNA, 25 bp, Mus musculus
tgaggcaccgggtggccggccaagt

SEQ ID NO: 854677 - DNA, 25 bp, Mus musculus
tgaggcaccttcagggacaacctac

SEQ ID NO: 854678 - DNA, 25 bp, Mus musculus
tgaggcaccttctgggacaacctac

SEQ ID NO: 854679 - DNA, 25 bp, Mus musculus
tgaggcacgcctaggctgggcccac

SEQ ID NO: 854680 - DNA, 25 bp, Mus musculus
tgaggcacgccttggctgggcccac

SEQ ID NO: 854681 - DNA, 25 bp, Mus musculus
tgaggcactgatctaggcccctctg

SEQ ID NO: 854682 - DNA, 25 bp, Mus musculus
tgaggcactgatgtaggcccctctg

SEQ ID NO: 854683 - DNA, 25 bp, Mus musculus
tgaggcacttctccaaatctctctt

SEQ ID NO: 854684 - DNA, 25 bp, Mus musculus
tgaggcacttctgcaaatctctctt

SEQ ID NO: 854685 - DNA, 25 bp, Mus musculus
tgaggcagaacaccgtcccagtaaa

SEQ ID NO: 854686 - DNA, 25 bp, Mus musculus
tgaggcagaacagcgtcccagtaaa

SEQ ID NO: 854687 - DNA, 25 bp, Mus musculus
tgaggcagaaccatctcttctccct

SEQ ID NO: 854688 - DNA, 25 bp, Mus musculus
tgaggcagaaccctacaagagcttg

SEQ ID NO: 854689 - DNA, 25 bp, Mus musculus
tgaggcagaaccgtacaagagcttg

SEQ ID NO: 854690 - DNA, 25 bp, Mus musculus
tgaggcagaaccttctcttctccct

SEQ ID NO: 854691 - DNA, 25 bp, Mus musculus
tgaggcagacagctgttatcccaat

SEQ ID NO: 854692 - DNA, 25 bp, Mus musculus
tgaggcagacaggtgttatcccaat

SEQ ID NO: 854693 - DNA, 25 bp, Mus musculus
tgaggcagacctagcactctttgga

SEQ ID NO: 854694 - DNA, 25 bp, Mus musculus
tgaggcagacctccaccaaggcagt

SEQ ID NO: 854695 - DNA, 25 bp, Mus musculus
tgaggcagacctgcaccaaggcagt

SEQ ID NO: 854696 - DNA, 25 bp, Mus musculus
tgaggcagaccttgcactctttgga

SEQ ID NO: 854697 - DNA, 25 bp, Mus musculus
tgaggcagatgcacatgataggaga

SEQ ID NO: 854698 - DNA, 25 bp, Mus musculus
tgaggcagatgctcatgataggaga

SEQ ID NO: 854699 - DNA, 25 bp, Mus musculus
tgaggcagcatcacacagagcagaa

SEQ ID NO: 854700 - DNA, 25 bp, Mus musculus
tgaggcagcatctcacagagcagaa

SEQ ID NO: 854701 - DNA, 25 bp, Mus musculus
tgaggcagccctcagcgactggctt

SEQ ID NO: 854702 - DNA, 25 bp, Mus musculus
tgaggcagccctgagcgactggctt

SEQ ID NO: 854703 - DNA, 25 bp, Mus musculus
tgaggcagctgccatgttccagtct

SEQ ID NO: 854704 - DNA, 25 bp, Mus musculus
tgaggcagctgcgatgttccagtct

SEQ ID NO: 854705 - DNA, 25 bp, Mus musculus
tgaggcagcttcagccacggtcaat

SEQ ID NO: 854706 - DNA, 25 bp, Mus musculus
tgaggcagcttctgccacggtcaat

SEQ ID NO: 854707 - DNA, 25 bp, Mus musculus
tgaggcaggcagaacaatcgctcct

SEQ ID NO: 854708 - DNA, 25 bp, Mus musculus
tgaggcaggcagtacaatcgctcct

SEQ ID NO: 854709 - DNA, 25 bp, Mus musculus
tgaggcagggaccagcgagacgtct

SEQ ID NO: 854710 - DNA, 25 bp, Mus musculus
tgaggcagggacgagcgagacgtct

SEQ ID NO: 854711 - DNA, 25 bp, Mus musculus
tgaggcaggtcccttactcattgtg

SEQ ID NO: 854712 - DNA, 25 bp, Mus musculus
tgaggcaggtccgttactcattgtg

SEQ ID NO: 854713 - DNA, 25 bp, Mus musculus
tgaggcaggtggaccatgcatgata

SEQ ID NO: 854714 - DNA, 25 bp, Mus musculus
tgaggcaggtggtccatgcatgata

SEQ ID NO: 854715 - DNA, 25 bp, Mus musculus
tgaggcagtaacaccacatacccag

SEQ ID NO: 854716 - DNA, 25 bp, Mus musculus
tgaggcagtaactccacatacccag

SEQ ID NO: 854717 - DNA, 25 bp, Mus musculus
tgaggcagtgcccactgtgcagaca

SEQ ID NO: 854718 - DNA, 25 bp, Mus musculus
tgaggcagtgccgactgtgcagaca

SEQ ID NO: 854719 - DNA, 25 bp, Mus musculus
tgaggcatacttctctacccaccct

SEQ ID NO: 854720 - DNA, 25 bp, Mus musculus
tgaggcatacttgtctacccaccct

SEQ ID NO: 854721 - DNA, 25 bp, Mus musculus
tgaggcatatttagccccagtcttg

SEQ ID NO: 854722 - DNA, 25 bp, Mus musculus
tgaggcatattttgccccagtcttg

SEQ ID NO: 854723 - DNA, 25 bp, Mus musculus
tgaggcatcatcacaattctgtcaa

SEQ ID NO: 854724 - DNA, 25 bp, Mus musculus
tgaggcatcatctcaattctgtcaa

SEQ ID NO: 854725 - DNA, 25 bp, Mus musculus
tgaggcatcctaaaagacaatctga

SEQ ID NO: 854726 - DNA, 25 bp, Mus musculus
tgaggcatcctaacagtactgagtc

SEQ ID NO: 854727 - DNA, 25 bp, Mus musculus
tgaggcatcctataagacaatctga

SEQ ID NO: 854728 - DNA, 25 bp, Mus musculus
tgaggcatcctatcagtactgagtc

SEQ ID NO: 854729 - DNA, 25 bp, Mus musculus
tgaggcatcttgatggcccctgtat

SEQ ID NO: 854730 - DNA, 25 bp, Mus musculus
tgaggcatcttgttggcccctgtat

SEQ ID NO: 854731 - DNA, 25 bp, Mus musculus
tgaggcatgcagctcaattgtctat

SEQ ID NO: 854732 - DNA, 25 bp, Mus musculus
tgaggcatgcaggtcaattgtctat

SEQ ID NO: 854733 - DNA, 25 bp, Mus musculus
tgaggcatgtctaagcggtgctgtt

SEQ ID NO: 854734 - DNA, 25 bp, Mus musculus
tgaggcatgtcttagcggtgctgtt

SEQ ID NO: 854735 - DNA, 25 bp, Mus musculus
tgaggcatgtgtcccctgggcaaca

SEQ ID NO: 854736 - DNA, 25 bp, Mus musculus
tgaggcatgtgtgccctgggcaaca

SEQ ID NO: 854737 - DNA, 25 bp, Mus musculus
tgaggcatttgtcactccgcttact

SEQ ID NO: 854738 - DNA, 25 bp, Mus musculus
tgaggcatttgtgactccgcttact

SEQ ID NO: 854739 - DNA, 25 bp, Mus musculus
tgaggccaagaccaccattgccata

SEQ ID NO: 854740 - DNA, 25 bp, Mus musculus
tgaggccaagacgaccattgccata

SEQ ID NO: 854741 - DNA, 25 bp, Mus musculus
tgaggccacagcaacatcagggact

SEQ ID NO: 854742 - DNA, 25 bp, Mus musculus
tgaggccacagctacatcagggact

SEQ ID NO: 854743 - DNA, 25 bp, Mus musculus
tgaggccaccatacttactgtagga

SEQ ID NO: 854744 - DNA, 25 bp, Mus musculus
tgaggccaccattcttactgtagga

SEQ ID NO: 854745 - DNA, 25 bp, Mus musculus
tgaggccaccgaccctttggtttga

SEQ ID NO: 854746 - DNA, 25 bp, Mus musculus
tgaggccaccgagcctttggtttga

SEQ ID NO: 854747 - DNA, 25 bp, Mus musculus
tgaggccacctcactagaatgtata

SEQ ID NO: 854748 - DNA, 25 bp, Mus musculus
tgaggccacctctctagaatgtata

SEQ ID NO: 854749 - DNA, 25 bp, Mus musculus
tgaggccacgtcatacctcacaggg

SEQ ID NO: 854750 - DNA, 25 bp, Mus musculus
tgaggccacgtcttacctcacaggg

SEQ ID NO: 854751 - DNA, 25 bp, Mus musculus
tgaggccactagcaaaccagcaata

SEQ ID NO: 854752 - DNA, 25 bp, Mus musculus
tgaggccactaggaaaccagcaata

SEQ ID NO: 854753 - DNA, 25 bp, Mus musculus
tgaggccactcacaagacatcaact

SEQ ID NO: 854754 - DNA, 25 bp, Mus musculus
tgaggccactcagaagacatcaact

SEQ ID NO: 854755 - DNA, 25 bp, Mus musculus
tgaggccacttgcagacccaactga

SEQ ID NO: 854756 - DNA, 25 bp, Mus musculus
tgaggccacttggagacccaactga

SEQ ID NO: 854757 - DNA, 25 bp, Mus musculus
tgaggccagattacctgggcacaga

SEQ ID NO: 854758 - DNA, 25 bp, Mus musculus
tgaggccagatttcctgggcacaga

SEQ ID NO: 854759 - DNA, 25 bp, Mus musculus
tgaggccagcttattccttaagcat

SEQ ID NO: 854760 - DNA, 25 bp, Mus musculus
tgaggccagcttctgtgtgagcact

SEQ ID NO: 854761 - DNA, 25 bp, Mus musculus
tgaggccagcttgtgtgtgagcact

SEQ ID NO: 854762 - DNA, 25 bp, Mus musculus
tgaggccagctttttccttaagcat

SEQ ID NO: 854763 - DNA, 25 bp, Mus musculus
tgaggccaggatagacttttagtct

SEQ ID NO: 854764 - DNA, 25 bp, Mus musculus
tgaggccaggattgacttttagtct

SEQ ID NO: 854765 - DNA, 25 bp, Mus musculus
tgaggccaggcacggataggacaga

SEQ ID NO: 854766 - DNA, 25 bp, Mus musculus
tgaggccaggcagggataggacaga

SEQ ID NO: 854767 - DNA, 25 bp, Mus musculus
tgaggccaggccctgagctgcatcc

SEQ ID NO: 854768 - DNA, 25 bp, Mus musculus
tgaggccaggccgtgagctgcatcc

SEQ ID NO: 854769 - DNA, 25 bp, Mus musculus
tgaggccaggttaccacgtaagctg

SEQ ID NO: 854770 - DNA, 25 bp, Mus musculus
tgaggccaggtttccacgtaagctg

SEQ ID NO: 854771 - DNA, 25 bp, Mus musculus
tgaggccagtccacagggagagtcc

SEQ ID NO: 854772 - DNA, 25 bp, Mus musculus
tgaggccagtccctggacacactgc

SEQ ID NO: 854773 - DNA, 25 bp, Mus musculus
tgaggccagtccgtggacacactgc

SEQ ID NO: 854774 - DNA, 25 bp, Mus musculus
tgaggccagtcctcagggagagtcc

SEQ ID NO: 854775 - DNA, 25 bp, Mus musculus
tgaggccagtctcaggtctctgaga

SEQ ID NO: 854776 - DNA, 25 bp, Mus musculus
tgaggccagtctgaggtctctgaga

SEQ ID NO: 854777 - DNA, 25 bp, Mus musculus
tgaggccatggcaggactgtctcaa

SEQ ID NO: 854778 - DNA, 25 bp, Mus musculus
tgaggccatggctggactgtctcaa

SEQ ID NO: 854779 - DNA, 25 bp, Mus musculus
tgaggccattccaatgctggtagct

SEQ ID NO: 854780 - DNA, 25 bp, Mus musculus
tgaggccattcctatgctggtagct

SEQ ID NO: 854781 - DNA, 25 bp, Mus musculus
tgaggccattctcctgtgaactgac

SEQ ID NO: 854782 - DNA, 25 bp, Mus musculus
tgaggccattctgctgtgaactgac

SEQ ID NO: 854783 - DNA, 25 bp, Mus musculus
tgaggccattgtcctgtatattgac

SEQ ID NO: 854784 - DNA, 25 bp, Mus musculus
tgaggccattgtgctgtatattgac

SEQ ID NO: 854785 - DNA, 25 bp, Mus musculus
tgaggcccaaacacgagttcgaggt

SEQ ID NO: 854786 - DNA, 25 bp, Mus musculus
tgaggcccaaactcgagttcgaggt

SEQ ID NO: 854787 - DNA, 25 bp, Mus musculus
tgaggcccaagcagtttatttattg

SEQ ID NO: 854788 - DNA, 25 bp, Mus musculus
tgaggcccaagctgtttatttattg

SEQ ID NO: 854789 - DNA, 25 bp, Mus musculus
tgaggcccacgaataaggatcactg

SEQ ID NO: 854790 - DNA, 25 bp, Mus musculus
tgaggcccacgactggagacctaag

SEQ ID NO: 854791 - DNA, 25 bp, Mus musculus
tgaggcccacgagtggagacctaag

SEQ ID NO: 854792 - DNA, 25 bp, Mus musculus
tgaggcccacgattaaggatcactg

SEQ ID NO: 854793 - DNA, 25 bp, Mus musculus
tgaggcccagggatcagtgcttgct

SEQ ID NO: 854794 - DNA, 25 bp, Mus musculus
tgaggcccagggttcagtgcttgct

SEQ ID NO: 854795 - DNA, 25 bp, Mus musculus
tgaggcccagtgaacagctttgaaa

SEQ ID NO: 854796 - DNA, 25 bp, Mus musculus
tgaggcccagtgtacagctttgaaa

SEQ ID NO: 854797 - DNA, 25 bp, Mus musculus
tgaggcccatttaccagcaaaggtt

SEQ ID NO: 854798 - DNA, 25 bp, Mus musculus
tgaggcccatttatcccaggagcaa

SEQ ID NO: 854799 - DNA, 25 bp, Mus musculus
tgaggcccattttccagcaaaggtt

SEQ ID NO: 854800 - DNA, 25 bp, Mus musculus
tgaggcccatttttcccaggagcaa

SEQ ID NO: 854801 - DNA, 25 bp, Mus musculus
tgaggccccaacactttgagaaaat

SEQ ID NO: 854802 - DNA, 25 bp, Mus musculus
tgaggccccaactctttgagaaaat

SEQ ID NO: 854803 - DNA, 25 bp, Mus musculus
tgaggccccactagccaggattgtt

SEQ ID NO: 854804 - DNA, 25 bp, Mus musculus
tgaggccccacttgccaggattgtt

SEQ ID NO: 854805 - DNA, 25 bp, Mus musculus
tgaggcccctttcaggttgcatatc

SEQ ID NO: 854806 - DNA, 25 bp, Mus musculus
tgaggcccctttgaggttgcatatc

SEQ ID NO: 854807 - DNA, 25 bp, Mus musculus
tgaggcccgaggagcttgagttcaa

SEQ ID NO: 854808 - DNA, 25 bp, Mus musculus
tgaggcccgaggtgcttgagttcaa

SEQ ID NO: 854809 - DNA, 25 bp, Mus musculus
tgaggcccgcccacaggacagtgtg

SEQ ID NO: 854810 - DNA, 25 bp, Mus musculus
tgaggcccgccctcaggacagtgtg

SEQ ID NO: 854811 - DNA, 25 bp, Mus musculus
tgaggcccgggaagaattgaccaga

SEQ ID NO: 854812 - DNA, 25 bp, Mus musculus
tgaggcccgggatgaattgaccaga

SEQ ID NO: 854813 - DNA, 25 bp, Mus musculus
tgaggcccggtcagagtcaaaaccc

SEQ ID NO: 854814 - DNA, 25 bp, Mus musculus
tgaggcccggtctgagtcaaaaccc

SEQ ID NO: 854815 - DNA, 25 bp, Mus musculus
tgaggccctaccacaaattttgtat

SEQ ID NO: 854816 - DNA, 25 bp, Mus musculus
tgaggccctacctcaaattttgtat

SEQ ID NO: 854817 - DNA, 25 bp, Mus musculus
tgaggccctcatctggtctccattg

SEQ ID NO: 854818 - DNA, 25 bp, Mus musculus
tgaggccctcatgtggtctccattg

SEQ ID NO: 854819 - DNA, 25 bp, Mus musculus
tgaggccctcgtagtactacatgca

SEQ ID NO: 854820 - DNA, 25 bp, Mus musculus
tgaggccctcgttgtactacatgca

SEQ ID NO: 854821 - DNA, 25 bp, Mus musculus
tgaggccctggtccaatccctatat

SEQ ID NO: 854822 - DNA, 25 bp, Mus musculus
tgaggccctggtgcaatccctatat

SEQ ID NO: 854823 - DNA, 25 bp, Mus musculus
tgaggcccttaactacggacgctac

SEQ ID NO: 854824 - DNA, 25 bp, Mus musculus
tgaggcccttaagtacggacgctac

SEQ ID NO: 854825 - DNA, 25 bp, Mus musculus
tgaggcccttccaaaggactagaga

SEQ ID NO: 854826 - DNA, 25 bp, Mus musculus
tgaggcccttcctaaggactagaga

SEQ ID NO: 854827 - DNA, 25 bp, Mus musculus
tgaggcccttgtataccctgaggtg

SEQ ID NO: 854828 - DNA, 25 bp, Mus musculus
tgaggcccttgtttaccctgaggtg

SEQ ID NO: 854829 - DNA, 25 bp, Mus musculus
tgaggccgacctcctgatccacgag

SEQ ID NO: 854830 - DNA, 25 bp, Mus musculus
tgaggccgacctgctgatccacgag

SEQ ID NO: 854831 - DNA, 25 bp, Mus musculus
tgaggccgagttagcactggttccc

SEQ ID NO: 854832 - DNA, 25 bp, Mus musculus
tgaggccgagtttgcactggttccc

SEQ ID NO: 854833 - DNA, 25 bp, Mus musculus
tgaggccgcatgcaagagagttcct

SEQ ID NO: 854834 - DNA, 25 bp, Mus musculus
tgaggccgcatggaagagagttcct

SEQ ID NO: 854835 - DNA, 25 bp, Mus musculus
tgaggccgccttctgggccaggcgg

SEQ ID NO: 854836 - DNA, 25 bp, Mus musculus
tgaggccgccttgtgggccaggcgg

SEQ ID NO: 854837 - DNA, 25 bp, Mus musculus
tgaggccggacgaccagcaacacat

SEQ ID NO: 854838 - DNA, 25 bp, Mus musculus
tgaggccggacgtccagcaacacat

SEQ ID NO: 854839 - DNA, 25 bp, Mus musculus
tgaggccggatgacatcacagagac

SEQ ID NO: 854840 - DNA, 25 bp, Mus musculus
tgaggccggatgtcatcacagagac

SEQ ID NO: 854841 - DNA, 25 bp, Mus musculus
tgaggccggtctccgagaaacccaa

SEQ ID NO: 854842 - DNA, 25 bp, Mus musculus
tgaggccggtctgcgagaaacccaa

SEQ ID NO: 854843 - DNA, 25 bp, Mus musculus
tgaggccgtaagacttctctgaaaa

SEQ ID NO: 854844 - DNA, 25 bp, Mus musculus
tgaggccgtaagtcttctctgaaaa

SEQ ID NO: 854845 - DNA, 25 bp, Mus musculus
tgaggccgtcctcgagatagcttta

SEQ ID NO: 854846 - DNA, 25 bp, Mus musculus
tgaggccgtcctggagatagcttta

SEQ ID NO: 854847 - DNA, 25 bp, Mus musculus
tgaggccgtgagcagttcatttctc

SEQ ID NO: 854848 - DNA, 25 bp, Mus musculus
tgaggccgtgaggagttcatttctc

SEQ ID NO: 854849 - DNA, 25 bp, Mus musculus
tgaggcctacgtcaaaggctcccca

SEQ ID NO: 854850 - DNA, 25 bp, Mus musculus
tgaggcctacgtgaaaggctcccca

SEQ ID NO: 854851 - DNA, 25 bp, Mus musculus
tgaggcctactcactggaagacaat

SEQ ID NO: 854852 - DNA, 25 bp, Mus musculus
tgaggcctactctctggaagacaat

SEQ ID NO: 854853 - DNA, 25 bp, Mus musculus
tgaggcctataaaacaatctgctat

SEQ ID NO: 854854 - DNA, 25 bp, Mus musculus
tgaggcctataatacaatctgctat

SEQ ID NO: 854855 - DNA, 25 bp, Mus musculus
tgaggcctcaacaaagaaccctgct

SEQ ID NO: 854856 - DNA, 25 bp, Mus musculus
tgaggcctcaactaagaaccctgct

SEQ ID NO: 854857 - DNA, 25 bp, Mus musculus
tgaggcctcactctgcagcaggatg

SEQ ID NO: 854858 - DNA, 25 bp, Mus musculus
tgaggcctcactgtgcagcaggatg

SEQ ID NO: 854859 - DNA, 25 bp, Mus musculus
tgaggcctctcaacctgacgagtct

SEQ ID NO: 854860 - DNA, 25 bp, Mus musculus
tgaggcctctcatcctgacgagtct

SEQ ID NO: 854861 - DNA, 25 bp, Mus musculus
tgaggcctctgaaaccagctctgct

SEQ ID NO: 854862 - DNA, 25 bp, Mus musculus
tgaggcctctgataccagctctgct

SEQ ID NO: 854863 - DNA, 25 bp, Mus musculus
tgaggcctgaacaccagctacaagc

SEQ ID NO: 854864 - DNA, 25 bp, Mus musculus
tgaggcctgaactccagctacaagc

SEQ ID NO: 854865 - DNA, 25 bp, Mus musculus
tgaggcctgcaccactcaggagctc

SEQ ID NO: 854866 - DNA, 25 bp, Mus musculus
tgaggcctgcacgactcaggagctc

SEQ ID NO: 854867 - DNA, 25 bp, Mus musculus
tgaggcctgctcaatctctaaccat

SEQ ID NO: 854868 - DNA, 25 bp, Mus musculus
tgaggcctgctctatctctaaccat

SEQ ID NO: 854869 - DNA, 25 bp, Mus musculus
tgaggcctggcaccttgaccaagaa

SEQ ID NO: 854870 - DNA, 25 bp, Mus musculus
tgaggcctggcagcttgaccaagaa

SEQ ID NO: 854871 - DNA, 25 bp, Mus musculus
tgaggcctggccaattctgcatgac

SEQ ID NO: 854872 - DNA, 25 bp, Mus musculus
tgaggcctggccattgacttagatt

SEQ ID NO: 854873 - DNA, 25 bp, Mus musculus
tgaggcctggccatttgcgaatgct

SEQ ID NO: 854874 - DNA, 25 bp, Mus musculus
tgaggcctggcctattctgcatgac

SEQ ID NO: 854875 - DNA, 25 bp, Mus musculus
tgaggcctggcctttgacttagatt

SEQ ID NO: 854876 - DNA, 25 bp, Mus musculus
tgaggcctggccttttgcgaatgct

SEQ ID NO: 854877 - DNA, 25 bp, Mus musculus
tgaggcctgggactgctcagccttc

SEQ ID NO: 854878 - DNA, 25 bp, Mus musculus
tgaggcctgggagtgctcagccttc

SEQ ID NO: 854879 - DNA, 25 bp, Mus musculus
tgaggcctggtgacctgacacggga

SEQ ID NO: 854880 - DNA, 25 bp, Mus musculus
tgaggcctggtgtcctgacacggga

SEQ ID NO: 854881 - DNA, 25 bp, Mus musculus
tgaggcctgtccagtggttacacac

SEQ ID NO: 854882 - DNA, 25 bp, Mus musculus
tgaggcctgtcctgtggttacacac

SEQ ID NO: 854883 - DNA, 25 bp, Mus musculus
tgaggcctgttccagcctaaccatg

SEQ ID NO: 854884 - DNA, 25 bp, Mus musculus
tgaggcctgttcgagcctaaccatg

SEQ ID NO: 854885 - DNA, 25 bp, Mus musculus
tgaggccttccacatagtgctgtcc

SEQ ID NO: 854886 - DNA, 25 bp, Mus musculus
tgaggccttccagatagtgctgtcc

SEQ ID NO: 854887 - DNA, 25 bp, Mus musculus
tgaggccttctactgccgtttgaaa

SEQ ID NO: 854888 - DNA, 25 bp, Mus musculus
tgaggccttctagtgccgtttgaaa

SEQ ID NO: 854889 - DNA, 25 bp, Mus musculus
tgaggccttcttccgaaaggcagat

SEQ ID NO: 854890 - DNA, 25 bp, Mus musculus
tgaggccttcttgcgaaaggcagat

SEQ ID NO: 854891 - DNA, 25 bp, Mus musculus
tgaggccttgtacaagtgccagcat

SEQ ID NO: 854892 - DNA, 25 bp, Mus musculus
tgaggccttgtagaagtgccagcat

SEQ ID NO: 854893 - DNA, 25 bp, Mus musculus
tgaggcctttgaatgtggacatgat

SEQ ID NO: 854894 - DNA, 25 bp, Mus musculus
tgaggcctttgattgtggacatgat

SEQ ID NO: 854895 - DNA, 25 bp, Mus musculus
tgaggcctttgcaataggtgcccgc

SEQ ID NO: 854896 - DNA, 25 bp, Mus musculus
tgaggcctttgctataggtgcccgc

SEQ ID NO: 854897 - DNA, 25 bp, Mus musculus
tgaggcctttggatgcctacagtct

SEQ ID NO: 854898 - DNA, 25 bp, Mus musculus
tgaggcctttggttgcctacagtct

SEQ ID NO: 854899 - DNA, 25 bp, Mus musculus
tgaggcctttgtctagccctagagg

SEQ ID NO: 854900 - DNA, 25 bp, Mus musculus
tgaggcctttgtgtagccctagagg

SEQ ID NO: 854901 - DNA, 25 bp, Mus musculus
tgaggccttttcagaaacggaccca

SEQ ID NO: 854902 - DNA, 25 bp, Mus musculus
tgaggccttttctgaaacggaccca

SEQ ID NO: 854903 - DNA, 25 bp, Mus musculus
tgaggcgacactcggcacctaatgg

SEQ ID NO: 854904 - DNA, 25 bp, Mus musculus
tgaggcgacactgggcacctaatgg

SEQ ID NO: 854905 - DNA, 25 bp, Mus musculus
tgaggcgaccatatttacaccatgc

SEQ ID NO: 854906 - DNA, 25 bp, Mus musculus
tgaggcgaccatttttacaccatgc

SEQ ID NO: 854907 - DNA, 25 bp, Mus musculus
tgaggcgacctcactccagcaagct

SEQ ID NO: 854908 - DNA, 25 bp, Mus musculus
tgaggcgacctctctccagcaagct

SEQ ID NO: 854909 - DNA, 25 bp, Mus musculus
tgaggcgagcctcggctatctaaga

SEQ ID NO: 854910 - DNA, 25 bp, Mus musculus
tgaggcgagcctgggctatctaaga

SEQ ID NO: 854911 - DNA, 25 bp, Mus musculus
tgaggcgagctaagacatgtctgat

SEQ ID NO: 854912 - DNA, 25 bp, Mus musculus
tgaggcgagctatgacatgtctgat

SEQ ID NO: 854913 - DNA, 25 bp, Mus musculus
tgaggcgcatctcgaatctcctgaa

SEQ ID NO: 854914 - DNA, 25 bp, Mus musculus
tgaggcgcatctggaatctcctgaa

SEQ ID NO: 854915 - DNA, 25 bp, Mus musculus
tgaggcgccctaatctctgatgact

SEQ ID NO: 854916 - DNA, 25 bp, Mus musculus
tgaggcgccctattctctgatgact

SEQ ID NO: 854917 - DNA, 25 bp, Mus musculus
tgaggcggagttagaactgctaact

SEQ ID NO: 854918 - DNA, 25 bp, Mus musculus
tgaggcggagtttgaactgctaact

SEQ ID NO: 854919 - DNA, 25 bp, Mus musculus
tgaggcggccctatcaacgatgaca

SEQ ID NO: 854920 - DNA, 25 bp, Mus musculus
tgaggcggccctttcaacgatgaca

SEQ ID NO: 854921 - DNA, 25 bp, Mus musculus
tgaggcgggtgcctttccaccttaa

SEQ ID NO: 854922 - DNA, 25 bp, Mus musculus
tgaggcgggtgcgtttccaccttaa

SEQ ID NO: 854923 - DNA, 25 bp, Mus musculus
tgaggcggtgagactggctattact

SEQ ID NO: 854924 - DNA, 25 bp, Mus musculus
tgaggcggtgagtctggctattact

SEQ ID NO: 854925 - DNA, 25 bp, Mus musculus
tgaggcggttctatttcttaactga

SEQ ID NO: 854926 - DNA, 25 bp, Mus musculus
tgaggcggttctttttcttaactga

SEQ ID NO: 854927 - DNA, 25 bp, Mus musculus
tgaggcgtacagacacagagtgagt

SEQ ID NO: 854928 - DNA, 25 bp, Mus musculus
tgaggcgtacagtcacagagtgagt

SEQ ID NO: 854929 - DNA, 25 bp, Mus musculus
tgaggcgtctctacttagttgatga

SEQ ID NO: 854930 - DNA, 25 bp, Mus musculus
tgaggcgtctcttcttagttgatga

SEQ ID NO: 854931 - DNA, 25 bp, Mus musculus
tgaggcgtgttgaatcccagaagct

SEQ ID NO: 854932 - DNA, 25 bp, Mus musculus
tgaggcgtgttgtatcccagaagct

SEQ ID NO: 854933 - DNA, 25 bp, Mus musculus
tgaggctaaagtcccctatccgagg

SEQ ID NO: 854934 - DNA, 25 bp, Mus musculus
tgaggctaaagtgccctatccgagg

SEQ ID NO: 854935 - DNA, 25 bp, Mus musculus
tgaggctaacttcatcccaggatca

SEQ ID NO: 854936 - DNA, 25 bp, Mus musculus
tgaggctaacttgatcccaggatca

SEQ ID NO: 854937 - DNA, 25 bp, Mus musculus
tgaggctaaggactgttccccgtgc

SEQ ID NO: 854938 - DNA, 25 bp, Mus musculus
tgaggctaaggagtgttccccgtgc

SEQ ID NO: 854939 - DNA, 25 bp, Mus musculus
tgaggctacaccagtaccctgcgga

SEQ ID NO: 854940 - DNA, 25 bp, Mus musculus
tgaggctacacctgtaccctgcgga

SEQ ID NO: 854941 - DNA, 25 bp, Mus musculus
tgaggctacactcgtacggagctag

SEQ ID NO: 854942 - DNA, 25 bp, Mus musculus
tgaggctacactggtacggagctag

SEQ ID NO: 854943 - DNA, 25 bp, Mus musculus
tgaggctacagcatttcttacgatg

SEQ ID NO: 854944 - DNA, 25 bp, Mus musculus
tgaggctacagcttttcttacgatg

SEQ ID NO: 854945 - DNA, 25 bp, Mus musculus
tgaggctacagtcgccttctctggc

SEQ ID NO: 854946 - DNA, 25 bp, Mus musculus
tgaggctacagtggccttctctggc

SEQ ID NO: 854947 - DNA, 25 bp, Mus musculus
tgaggctaccggagcttagctttgt

SEQ ID NO: 854948 - DNA, 25 bp, Mus musculus
tgaggctaccggtgcttagctttgt

SEQ ID NO: 854949 - DNA, 25 bp, Mus musculus
tgaggctacctaatgttgtctttga

SEQ ID NO: 854950 - DNA, 25 bp, Mus musculus
tgaggctacctattgttgtctttga

SEQ ID NO: 854951 - DNA, 25 bp, Mus musculus
tgaggctacggtaacctacctccaa

SEQ ID NO: 854952 - DNA, 25 bp, Mus musculus
tgaggctacggtattctctctctca

SEQ ID NO: 854953 - DNA, 25 bp, Mus musculus
tgaggctacggttacctacctccaa

SEQ ID NO: 854954 - DNA, 25 bp, Mus musculus
tgaggctacggttttctctctctca

SEQ ID NO: 854955 - DNA, 25 bp, Mus musculus
tgaggctactacacaacaacttgaa

SEQ ID NO: 854956 - DNA, 25 bp, Mus musculus
tgaggctactactcaacaacttgaa

SEQ ID NO: 854957 - DNA, 25 bp, Mus musculus
tgaggctactctcaagcgacccagc

SEQ ID NO: 854958 - DNA, 25 bp, Mus musculus
tgaggctactctgaagcgacccagc

SEQ ID NO: 854959 - DNA, 25 bp, Mus musculus
tgaggctagagcacagggttccact

SEQ ID NO: 854960 - DNA, 25 bp, Mus musculus
tgaggctagagctcagggttccact

SEQ ID NO: 854961 - DNA, 25 bp, Mus musculus
tgaggctagccacgttacttgccca

SEQ ID NO: 854962 - DNA, 25 bp, Mus musculus
tgaggctagccaggttacttgccca

SEQ ID NO: 854963 - DNA, 25 bp, Mus musculus
tgaggctaggccaaacccagaaatc

SEQ ID NO: 854964 - DNA, 25 bp, Mus musculus
tgaggctaggccaggattcatcgcc

SEQ ID NO: 854965 - DNA, 25 bp, Mus musculus
tgaggctaggcctaacccagaaatc

SEQ ID NO: 854966 - DNA, 25 bp, Mus musculus
tgaggctaggcctggattcatcgcc

SEQ ID NO: 854967 - DNA, 25 bp, Mus musculus
tgaggctagtcaccaagcccctttt

SEQ ID NO: 854968 - DNA, 25 bp, Mus musculus
tgaggctagtcagcaagcccctttt

SEQ ID NO: 854969 - DNA, 25 bp, Mus musculus
tgaggctcacacaccattctagcta

SEQ ID NO: 854970 - DNA, 25 bp, Mus musculus
tgaggctcacactccattctagcta

SEQ ID NO: 854971 - DNA, 25 bp, Mus musculus
tgaggctcaccacactagatagatg

SEQ ID NO: 854972 - DNA, 25 bp, Mus musculus
tgaggctcaccagactagatagatg

SEQ ID NO: 854973 - DNA, 25 bp, Mus musculus
tgaggctcacccagggagacctgta

SEQ ID NO: 854974 - DNA, 25 bp, Mus musculus
tgaggctcaccctgggagacctgta

SEQ ID NO: 854975 - DNA, 25 bp, Mus musculus
tgaggctcagacagcaatggttgct

SEQ ID NO: 854976 - DNA, 25 bp, Mus musculus
tgaggctcagactgcaatggttgct

SEQ ID NO: 854977 - DNA, 25 bp, Mus musculus
tgaggctcaggcactattccattta

SEQ ID NO: 854978 - DNA, 25 bp, Mus musculus
tgaggctcaggctctattccattta

SEQ ID NO: 854979 - DNA, 25 bp, Mus musculus
tgaggctcagtgagctccgtccaga

SEQ ID NO: 854980 - DNA, 25 bp, Mus musculus
tgaggctcagtgtgctccgtccaga

SEQ ID NO: 854981 - DNA, 25 bp, Mus musculus
tgaggctcatgacagcatcccatat

SEQ ID NO: 854982 - DNA, 25 bp, Mus musculus
tgaggctcatgagagcatcccatat

SEQ ID NO: 854983 - DNA, 25 bp, Mus musculus
tgaggctcattgctcagtcactctg

SEQ ID NO: 854984 - DNA, 25 bp, Mus musculus
tgaggctcattggtcagtcactctg

SEQ ID NO: 854985 - DNA, 25 bp, Mus musculus
tgaggctccaagactcacttctttt

SEQ ID NO: 854986 - DNA, 25 bp, Mus musculus
tgaggctccaagtctcacttctttt

SEQ ID NO: 854987 - DNA, 25 bp, Mus musculus
tgaggctccagcacgggccagaagt

SEQ ID NO: 854988 - DNA, 25 bp, Mus musculus
tgaggctccagcaggttgactgtgt

SEQ ID NO: 854989 - DNA, 25 bp, Mus musculus
tgaggctccagctcgggccagaagt

SEQ ID NO: 854990 - DNA, 25 bp, Mus musculus
tgaggctccagctggttgactgtgt

SEQ ID NO: 854991 - DNA, 25 bp, Mus musculus
tgaggctcccagagctgtgaactgg

SEQ ID NO: 854992 - DNA, 25 bp, Mus musculus
tgaggctcccagctagtgatacacc

SEQ ID NO: 854993 - DNA, 25 bp, Mus musculus
tgaggctcccaggtagtgatacacc

SEQ ID NO: 854994 - DNA, 25 bp, Mus musculus
tgaggctcccagtgctgtgaactgg

SEQ ID NO: 854995 - DNA, 25 bp, Mus musculus
tgaggctccctgacatctcagccta

SEQ ID NO: 854996 - DNA, 25 bp, Mus musculus
tgaggctccctgctgaaatgcaatt

SEQ ID NO: 854997 - DNA, 25 bp, Mus musculus
tgaggctccctggtgaaatgcaatt

SEQ ID NO: 854998 - DNA, 25 bp, Mus musculus
tgaggctccctgtcatctcagccta

SEQ ID NO: 854999 - DNA, 25 bp, Mus musculus
tgaggctcccttagtcagggactga

SEQ ID NO: 855000 - DNA, 25 bp, Mus musculus
tgaggctccctttgtcagggactga

SEQ ID NO: 855001 - DNA, 25 bp, Mus musculus
tgaggctccgcactgattcagtggt

SEQ ID NO: 855002 - DNA, 25 bp, Mus musculus
tgaggctccgcagtgattcagtggt

SEQ ID NO: 855003 - DNA, 25 bp, Mus musculus
tgaggctcctacagctgaatcacgg

SEQ ID NO: 855004 - DNA, 25 bp, Mus musculus
tgaggctcctactgctgaatcacgg

SEQ ID NO: 855005 - DNA, 25 bp, Mus musculus
tgaggctcctcaagcgactgtgttc

SEQ ID NO: 855006 - DNA, 25 bp, Mus musculus
tgaggctcctcatgcgactgtgttc

SEQ ID NO: 855007 - DNA, 25 bp, Mus musculus
tgaggctcgcaccacggctgtcatg

SEQ ID NO: 855008 - DNA, 25 bp, Mus musculus
tgaggctcgcacgacggctgtcatg

SEQ ID NO: 855009 - DNA, 25 bp, Mus musculus
tgaggctcgcctctgcaataacatg

SEQ ID NO: 855010 - DNA, 25 bp, Mus musculus
tgaggctcgcctgtgcaataacatg

SEQ ID NO: 855011 - DNA, 25 bp, Mus musculus
tgaggctctccgataaataagttaa

SEQ ID NO: 855012 - DNA, 25 bp, Mus musculus
tgaggctctccgttaaataagttaa

SEQ ID NO: 855013 - DNA, 25 bp, Mus musculus
tgaggctctctcagcttgcacttgt

SEQ ID NO: 855014 - DNA, 25 bp, Mus musculus
tgaggctctctctgcttgcacttgt

SEQ ID NO: 855015 - DNA, 25 bp, Mus musculus
tgaggctctgaaccacaaaaagtgt

SEQ ID NO: 855016 - DNA, 25 bp, Mus musculus
tgaggctctgaagcacaaaaagtgt

SEQ ID NO: 855017 - DNA, 25 bp, Mus musculus
tgaggctcttacactgatactccac

SEQ ID NO: 855018 - DNA, 25 bp, Mus musculus
tgaggctcttactctgatactccac

SEQ ID NO: 855019 - DNA, 25 bp, Mus musculus
tgaggctctttcaaactttgcaagt

SEQ ID NO: 855020 - DNA, 25 bp, Mus musculus
tgaggctctttctaactttgcaagt

SEQ ID NO: 855021 - DNA, 25 bp, Mus musculus
tgaggctgaagactcccatcacgtt

SEQ ID NO: 855022 - DNA, 25 bp, Mus musculus
tgaggctgaagagtcccatcacgtt

SEQ ID NO: 855023 - DNA, 25 bp, Mus musculus
tgaggctgaagtcccagatcactgt

SEQ ID NO: 855024 - DNA, 25 bp, Mus musculus
tgaggctgaagtgccagatcactgt

SEQ ID NO: 855025 - DNA, 25 bp, Mus musculus
tgaggctgagacatcgtgtgccctt

SEQ ID NO: 855026 - DNA, 25 bp, Mus musculus
tgaggctgagacttcgtgtgccctt

SEQ ID NO: 855027 - DNA, 25 bp, Mus musculus
tgaggctgatcacgaggtgaacaga

SEQ ID NO: 855028 - DNA, 25 bp, Mus musculus
tgaggctgatcaggaggtgaacaga

SEQ ID NO: 855029 - DNA, 25 bp, Mus musculus
tgaggctgcatcagtctcactgcgg

SEQ ID NO: 855030 - DNA, 25 bp, Mus musculus
tgaggctgcatctgtctcactgcgg

SEQ ID NO: 855031 - DNA, 25 bp, Mus musculus
tgaggctgccggattgatcctttgc

SEQ ID NO: 855032 - DNA, 25 bp, Mus musculus
tgaggctgccggtttgatcctttgc

SEQ ID NO: 855033 - DNA, 25 bp, Mus musculus
tgaggctgcctaatatgagaagcac

SEQ ID NO: 855034 - DNA, 25 bp, Mus musculus
tgaggctgcctattatgagaagcac

SEQ ID NO: 855035 - DNA, 25 bp, Mus musculus
tgaggctgctcaagggacagtcacc

SEQ ID NO: 855036 - DNA, 25 bp, Mus musculus
tgaggctgctcatgggacagtcacc

SEQ ID NO: 855037 - DNA, 25 bp, Mus musculus
tgaggctgctggcagcctccagata

SEQ ID NO: 855038 - DNA, 25 bp, Mus musculus
tgaggctgctgggagcctccagata

SEQ ID NO: 855039 - DNA, 25 bp, Mus musculus
tgaggctggagtccactcagtgctt

SEQ ID NO: 855040 - DNA, 25 bp, Mus musculus
tgaggctggagtgcactcagtgctt

SEQ ID NO: 855041 - DNA, 25 bp, Mus musculus
tgaggctggatcagcgggacctatc

SEQ ID NO: 855042 - DNA, 25 bp, Mus musculus
tgaggctggatctgcgggacctatc

SEQ ID NO: 855043 - DNA, 25 bp, Mus musculus
tgaggctggcaacggttcctgaacc

SEQ ID NO: 855044 - DNA, 25 bp, Mus musculus
tgaggctggcaagggttcctgaacc

SEQ ID NO: 855045 - DNA, 25 bp, Mus musculus
tgaggctggctacagtttttatctt

SEQ ID NO: 855046 - DNA, 25 bp, Mus musculus
tgaggctggctagagtttttatctt

SEQ ID NO: 855047 - DNA, 25 bp, Mus musculus
tgaggctggctcagtacccttggtc

SEQ ID NO: 855048 - DNA, 25 bp, Mus musculus
tgaggctggctctgtacccttggtc

SEQ ID NO: 855049 - DNA, 25 bp, Mus musculus
tgaggctgggatcggaccaactcct

SEQ ID NO: 855050 - DNA, 25 bp, Mus musculus
tgaggctgggatgggaccaactcct

SEQ ID NO: 855051 - DNA, 25 bp, Mus musculus
tgaggctgtaacaactcctggcaca

SEQ ID NO: 855052 - DNA, 25 bp, Mus musculus
tgaggctgtaactactcctggcaca

SEQ ID NO: 855053 - DNA, 25 bp, Mus musculus
tgaggctgtattacaccgtgtttga

SEQ ID NO: 855054 - DNA, 25 bp, Mus musculus
tgaggctgtatttcaccgtgtttga

SEQ ID NO: 855055 - DNA, 25 bp, Mus musculus
tgaggctgtcacaccagaagaccat

SEQ ID NO: 855056 - DNA, 25 bp, Mus musculus
tgaggctgtcactccagaagaccat

SEQ ID NO: 855057 - DNA, 25 bp, Mus musculus
tgaggctgtctacgtccctaaggct

SEQ ID NO: 855058 - DNA, 25 bp, Mus musculus
tgaggctgtctaggtccctaaggct

SEQ ID NO: 855059 - DNA, 25 bp, Mus musculus
tgaggctgtgaacaacatcttgcca

SEQ ID NO: 855060 - DNA, 25 bp, Mus musculus
tgaggctgtgaagaacatcttgcca

SEQ ID NO: 855061 - DNA, 25 bp, Mus musculus
tgaggctgtgacacaaacaccctgt

SEQ ID NO: 855062 - DNA, 25 bp, Mus musculus
tgaggctgtgacaccacgtgctaaa

SEQ ID NO: 855063 - DNA, 25 bp, Mus musculus
tgaggctgtgactcaaacaccctgt

SEQ ID NO: 855064 - DNA, 25 bp, Mus musculus
tgaggctgtgactccacgtgctaaa

SEQ ID NO: 855065 - DNA, 25 bp, Mus musculus
tgaggctgtgccacctccgacagtg

SEQ ID NO: 855066 - DNA, 25 bp, Mus musculus
tgaggctgtgcctcctccgacagtg

SEQ ID NO: 855067 - DNA, 25 bp, Mus musculus
tgaggctgtggcactgaaccaggaa

SEQ ID NO: 855068 - DNA, 25 bp, Mus musculus
tgaggctgtggctctgaaccaggaa

SEQ ID NO: 855069 - DNA, 25 bp, Mus musculus
tgaggctgttaacggccctctagtt

SEQ ID NO: 855070 - DNA, 25 bp, Mus musculus
tgaggctgttaagggccctctagtt

SEQ ID NO: 855071 - DNA, 25 bp, Mus musculus
tgaggcttaagtatttccctgccca

SEQ ID NO: 855072 - DNA, 25 bp, Mus musculus
tgaggcttaagtttttccctgccca

SEQ ID NO: 855073 - DNA, 25 bp, Mus musculus
tgaggcttacggacctgacaccaag

SEQ ID NO: 855074 - DNA, 25 bp, Mus musculus
tgaggcttacggtcctgacaccaag

SEQ ID NO: 855075 - DNA, 25 bp, Mus musculus
tgaggcttacttcaaacatcctaaa

SEQ ID NO: 855076 - DNA, 25 bp, Mus musculus
tgaggcttacttgaaacatcctaaa

SEQ ID NO: 855077 - DNA, 25 bp, Mus musculus
tgaggcttagcaaagtgtttgcttt

SEQ ID NO: 855078 - DNA, 25 bp, Mus musculus
tgaggcttagcacgcttccatacct

SEQ ID NO: 855079 - DNA, 25 bp, Mus musculus
tgaggcttagcaggcttccatacct

SEQ ID NO: 855080 - DNA, 25 bp, Mus musculus
tgaggcttagcatagtgtttgcttt

SEQ ID NO: 855081 - DNA, 25 bp, Mus musculus
tgaggcttcactcaccaacacaagt

SEQ ID NO: 855082 - DNA, 25 bp, Mus musculus
tgaggcttcactgaccaacacaagt

SEQ ID NO: 855083 - DNA, 25 bp, Mus musculus
tgaggcttcaggaccaggatctggc

SEQ ID NO: 855084 - DNA, 25 bp, Mus musculus
tgaggcttcaggtccaggatctggc

SEQ ID NO: 855085 - DNA, 25 bp, Mus musculus
tgaggcttccttacgtcagcacctt

SEQ ID NO: 855086 - DNA, 25 bp, Mus musculus
tgaggcttcctttcgtcagcacctt

SEQ ID NO: 855087 - DNA, 25 bp, Mus musculus
tgaggcttcgaaaaattgggcaatt

SEQ ID NO: 855088 - DNA, 25 bp, Mus musculus
tgaggcttcgaataattgggcaatt

SEQ ID NO: 855089 - DNA, 25 bp, Mus musculus
tgaggcttgagacacacagtttctc

SEQ ID NO: 855090 - DNA, 25 bp, Mus musculus
tgaggcttgagagacacagtttctc

SEQ ID NO: 855091 - DNA, 25 bp, Mus musculus
tgaggcttgagcacacagcaggcca

SEQ ID NO: 855092 - DNA, 25 bp, Mus musculus
tgaggcttgagctcacagcaggcca

SEQ ID NO: 855093 - DNA, 25 bp, Mus musculus
tgaggcttgctacacaccatggaat

SEQ ID NO: 855094 - DNA, 25 bp, Mus musculus
tgaggcttgctagacaccatggaat

SEQ ID NO: 855095 - DNA, 25 bp, Mus musculus
tgaggcttggaccaaccaaaaacca

SEQ ID NO: 855096 - DNA, 25 bp, Mus musculus
tgaggcttggacgaaccaaaaacca

SEQ ID NO: 855097 - DNA, 25 bp, Mus musculus
tgaggcttggctacctcatcttctg

SEQ ID NO: 855098 - DNA, 25 bp, Mus musculus
tgaggcttggcttcctcatcttctg

SEQ ID NO: 855099 - DNA, 25 bp, Mus musculus
tgaggcttgggcagcgattcctgat

SEQ ID NO: 855100 - DNA, 25 bp, Mus musculus
tgaggcttgggctgcgattcctgat

SEQ ID NO: 855101 - DNA, 25 bp, Mus musculus
tgaggcttgtctctcttcgttcaga

SEQ ID NO: 855102 - DNA, 25 bp, Mus musculus
tgaggcttgtctgtcttcgttcaga

SEQ ID NO: 855103 - DNA, 25 bp, Mus musculus
tgaggctttatactacctggaagac

SEQ ID NO: 855104 - DNA, 25 bp, Mus musculus
tgaggctttatagtacctggaagac

SEQ ID NO: 855105 - DNA, 25 bp, Mus musculus
tgaggctttgtgaccagacaagctg

SEQ ID NO: 855106 - DNA, 25 bp, Mus musculus
tgaggctttgtgtccagacaagctg

SEQ ID NO: 855107 - DNA, 25 bp, Mus musculus
tgaggcttttcacacattactacgt

SEQ ID NO: 855108 - DNA, 25 bp, Mus musculus
tgaggcttttcagacattactacgt

SEQ ID NO: 855109 - DNA, 25 bp, Mus musculus
tgaggctttttcaggaactgtaata

SEQ ID NO: 855110 - DNA, 25 bp, Mus musculus
tgaggctttttcatgttacatccat

SEQ ID NO: 855111 - DNA, 25 bp, Mus musculus
tgaggctttttctggaactgtaata

SEQ ID NO: 855112 - DNA, 25 bp, Mus musculus
tgaggctttttcttgttacatccat

SEQ ID NO: 855113 - DNA, 25 bp, Mus musculus
tgagggaaaatgcttgtgacttaac

SEQ ID NO: 855114 - DNA, 25 bp, Mus musculus
tgagggaaaatggttgtgacttaac

SEQ ID NO: 855115 - DNA, 25 bp, Mus musculus
tgagggaacgttcgcttgctctact

SEQ ID NO: 855116 - DNA, 25 bp, Mus musculus
tgagggaacgttggcttgctctact

SEQ ID NO: 855117 - DNA, 25 bp, Mus musculus
tgagggaagactaaagcctgggctt

SEQ ID NO: 855118 - DNA, 25 bp, Mus musculus
tgagggaagacttaagcctgggctt

SEQ ID NO: 855119 - DNA, 25 bp, Mus musculus
tgagggaagcacagggcctcaccat

SEQ ID NO: 855120 - DNA, 25 bp, Mus musculus
tgagggaagcacctaacctctgctg

SEQ ID NO: 855121 - DNA, 25 bp, Mus musculus
tgagggaagcacgtaacctctgctg

SEQ ID NO: 855122 - DNA, 25 bp, Mus musculus
tgagggaagcactgggcctcaccat

SEQ ID NO: 855123 - DNA, 25 bp, Mus musculus
tgagggaagcggatcactatctccc

SEQ ID NO: 855124 - DNA, 25 bp, Mus musculus
tgagggaagcggttcactatctccc

SEQ ID NO: 855125 - DNA, 25 bp, Mus musculus
tgagggaatactctgtgcctgatcc

SEQ ID NO: 855126 - DNA, 25 bp, Mus musculus
tgagggaatactgtgtgcctgatcc

SEQ ID NO: 855127 - DNA, 25 bp, Mus musculus
tgagggaatatcagcaccagtcgcc

SEQ ID NO: 855128 - DNA, 25 bp, Mus musculus
tgagggaatatctgcaccagtcgcc

SEQ ID NO: 855129 - DNA, 25 bp, Mus musculus
tgagggaatcccaacaacgtctagg

SEQ ID NO: 855130 - DNA, 25 bp, Mus musculus
tgagggaatccctacaacgtctagg

SEQ ID NO: 855131 - DNA, 25 bp, Mus musculus
tgagggaatgtgagtcaactggccc

SEQ ID NO: 855132 - DNA, 25 bp, Mus musculus
tgagggaatgtgtgtcaactggccc

SEQ ID NO: 855133 - DNA, 25 bp, Mus musculus
tgagggaattcacccaaggccacta

SEQ ID NO: 855134 - DNA, 25 bp, Mus musculus
tgagggaattcagccaaggccacta

SEQ ID NO: 855135 - DNA, 25 bp, Mus musculus
tgagggacaagcctgcacctgcctt

SEQ ID NO: 855136 - DNA, 25 bp, Mus musculus
tgagggacaagcgtgcacctgcctt

SEQ ID NO: 855137 - DNA, 25 bp, Mus musculus
tgagggacacacagtcctcagacag

SEQ ID NO: 855138 - DNA, 25 bp, Mus musculus
tgagggacacactgtcctcagacag

SEQ ID NO: 855139 - DNA, 25 bp, Mus musculus
tgagggacacagaccagttgcggct

SEQ ID NO: 855140 - DNA, 25 bp, Mus musculus
tgagggacacagtccagttgcggct

SEQ ID NO: 855141 - DNA, 25 bp, Mus musculus
tgagggacccatagctacagctgca

SEQ ID NO: 855142 - DNA, 25 bp, Mus musculus
tgagggacccattgctacagctgca

SEQ ID NO: 855143 - DNA, 25 bp, Mus musculus
tgagggaccgcccactttatagatg

SEQ ID NO: 855144 - DNA, 25 bp, Mus musculus
tgagggaccgccgactttatagatg

SEQ ID NO: 855145 - DNA, 25 bp, Mus musculus
tgagggacgtgtctattcttccaga

SEQ ID NO: 855146 - DNA, 25 bp, Mus musculus
tgagggacgtgtgtattcttccaga

SEQ ID NO: 855147 - DNA, 25 bp, Mus musculus
tgagggactccaagataattttaaa

SEQ ID NO: 855148 - DNA, 25 bp, Mus musculus
tgagggactccaattgttaaccatc

SEQ ID NO: 855149 - DNA, 25 bp, Mus musculus
tgagggactccatgataattttaaa

SEQ ID NO: 855150 - DNA, 25 bp, Mus musculus
tgagggactccatttgttaaccatc

SEQ ID NO: 855151 - DNA, 25 bp, Mus musculus
tgagggactctacgcacaatggtat

SEQ ID NO: 855152 - DNA, 25 bp, Mus musculus
tgagggactctaggcacaatggtat

SEQ ID NO: 855153 - DNA, 25 bp, Mus musculus
tgagggactgtgatcctattagctt

SEQ ID NO: 855154 - DNA, 25 bp, Mus musculus
tgagggactgtgttcctattagctt

SEQ ID NO: 855155 - DNA, 25 bp, Mus musculus
tgagggacttcactcactacggttt

SEQ ID NO: 855156 - DNA, 25 bp, Mus musculus
tgagggacttcagtcactacggttt

SEQ ID NO: 855157 - DNA, 25 bp, Mus musculus
tgagggacttgacactgaggaccac

SEQ ID NO: 855158 - DNA, 25 bp, Mus musculus
tgagggacttgagactgaggaccac

SEQ ID NO: 855159 - DNA, 25 bp, Mus musculus
tgagggagacccactcttgttcgcg

SEQ ID NO: 855160 - DNA, 25 bp, Mus musculus
tgagggagaccctctcttgttcgcg

SEQ ID NO: 855161 - DNA, 25 bp, Mus musculus
tgagggagacctctgcatctgaacc

SEQ ID NO: 855162 - DNA, 25 bp, Mus musculus
tgagggagacctgtgcatctgaacc

SEQ ID NO: 855163 - DNA, 25 bp, Mus musculus
tgagggagcaagacccagttccctg

SEQ ID NO: 855164 - DNA, 25 bp, Mus musculus
tgagggagcaagtcccagttccctg

SEQ ID NO: 855165 - DNA, 25 bp, Mus musculus
tgagggagcactatttacctgcacc

SEQ ID NO: 855166 - DNA, 25 bp, Mus musculus
tgagggagcactttttacctgcacc

SEQ ID NO: 855167 - DNA, 25 bp, Mus musculus
tgagggagcagccacattgtctctg

SEQ ID NO: 855168 - DNA, 25 bp, Mus musculus
tgagggagcagcgacattgtctctg

SEQ ID NO: 855169 - DNA, 25 bp, Mus musculus
tgagggagccagctgtcaccactta

SEQ ID NO: 855170 - DNA, 25 bp, Mus musculus
tgagggagccaggtgtcaccactta

SEQ ID NO: 855171 - DNA, 25 bp, Mus musculus
tgagggagccatctatagaaaggac

SEQ ID NO: 855172 - DNA, 25 bp, Mus musculus
tgagggagccatgtatagaaaggac

SEQ ID NO: 855173 - DNA, 25 bp, Mus musculus
tgagggagcgccagctaaggaatct

SEQ ID NO: 855174 - DNA, 25 bp, Mus musculus
tgagggagcgcctgctaaggaatct

SEQ ID NO: 855175 - DNA, 25 bp, Mus musculus
tgagggagcgctaccacatccaggg

SEQ ID NO: 855176 - DNA, 25 bp, Mus musculus
tgagggagcgcttccacatccaggg

SEQ ID NO: 855177 - DNA, 25 bp, Mus musculus
tgagggaggaataccatttagggca

SEQ ID NO: 855178 - DNA, 25 bp, Mus musculus
tgagggaggaattccatttagggca

SEQ ID NO: 855179 - DNA, 25 bp, Mus musculus
tgagggagggccacagacactagct

SEQ ID NO: 855180 - DNA, 25 bp, Mus musculus
tgagggagggcctcagacactagct

SEQ ID NO: 855181 - DNA, 25 bp, Mus musculus
tgagggagtcagattccccggcaca

SEQ ID NO: 855182 - DNA, 25 bp, Mus musculus
tgagggagtcagtttccccggcaca

SEQ ID NO: 855183 - DNA, 25 bp, Mus musculus
tgagggagtgctcgtaactgaccct

SEQ ID NO: 855184 - DNA, 25 bp, Mus musculus
tgagggagtgctggtaactgaccct

SEQ ID NO: 855185 - DNA, 25 bp, Mus musculus
tgagggatacccaccccaagaggga

SEQ ID NO: 855186 - DNA, 25 bp, Mus musculus
tgagggataccctccccaagaggga

SEQ ID NO: 855187 - DNA, 25 bp, Mus musculus
tgagggatctctaagccacttgatt

SEQ ID NO: 855188 - DNA, 25 bp, Mus musculus
tgagggatctcttagccacttgatt

SEQ ID NO: 855189 - DNA, 25 bp, Mus musculus
tgagggatgcccacctcgccagagc

SEQ ID NO: 855190 - DNA, 25 bp, Mus musculus
tgagggatgccctcctcgccagagc

SEQ ID NO: 855191 - DNA, 25 bp, Mus musculus
tgagggatgtctatgcccggagcat

SEQ ID NO: 855192 - DNA, 25 bp, Mus musculus
tgagggatgtctttgcccggagcat

SEQ ID NO: 855193 - DNA, 25 bp, Mus musculus
tgagggatgtgaattccctttctgg

SEQ ID NO: 855194 - DNA, 25 bp, Mus musculus
tgagggatgtgatttccctttctgg

SEQ ID NO: 855195 - DNA, 25 bp, Mus musculus
tgagggattttcatgctggatttat

SEQ ID NO: 855196 - DNA, 25 bp, Mus musculus
tgagggattttcttgctggatttat

SEQ ID NO: 855197 - DNA, 25 bp, Mus musculus
tgagggcaaagcaaaccgacacgtg

SEQ ID NO: 855198 - DNA, 25 bp, Mus musculus
tgagggcaaagctaaccgacacgtg

SEQ ID NO: 855199 - DNA, 25 bp, Mus musculus
tgagggcaagatccctggctgcacc

SEQ ID NO: 855200 - DNA, 25 bp, Mus musculus
tgagggcaagatgcctggctgcacc

SEQ ID NO: 855201 - DNA, 25 bp, Mus musculus
tgagggcaagccatatgtgaccaag

SEQ ID NO: 855202 - DNA, 25 bp, Mus musculus
tgagggcaagccttatgtgaccaag

SEQ ID NO: 855203 - DNA, 25 bp, Mus musculus
tgagggcaattgcactttggctctc

SEQ ID NO: 855204 - DNA, 25 bp, Mus musculus
tgagggcaattggactttggctctc

SEQ ID NO: 855205 - DNA, 25 bp, Mus musculus
tgagggcacactaaccgtggaggct

SEQ ID NO: 855206 - DNA, 25 bp, Mus musculus
tgagggcacacttaccgtggaggct

SEQ ID NO: 855207 - DNA, 25 bp, Mus musculus
tgagggcacagactgtatcatctgc

SEQ ID NO: 855208 - DNA, 25 bp, Mus musculus
tgagggcacagagtgtatcatctgc

SEQ ID NO: 855209 - DNA, 25 bp, Mus musculus
tgagggcaccaaccgcatgtttgat

SEQ ID NO: 855210 - DNA, 25 bp, Mus musculus
tgagggcaccaagcgcatgtttgat

SEQ ID NO: 855211 - DNA, 25 bp, Mus musculus
tgagggcaccagaagaccagtatgt

SEQ ID NO: 855212 - DNA, 25 bp, Mus musculus
tgagggcaccagtagaccagtatgt

SEQ ID NO: 855213 - DNA, 25 bp, Mus musculus
tgagggcacggtactcggtagtcac

SEQ ID NO: 855214 - DNA, 25 bp, Mus musculus
tgagggcacggttctcggtagtcac

SEQ ID NO: 855215 - DNA, 25 bp, Mus musculus
tgagggcactgaaatcactgtgaac

SEQ ID NO: 855216 - DNA, 25 bp, Mus musculus
tgagggcactgatatcactgtgaac

SEQ ID NO: 855217 - DNA, 25 bp, Mus musculus
tgagggcagaagctgtgaaatcaca

SEQ ID NO: 855218 - DNA, 25 bp, Mus musculus
tgagggcagaaggtgtgaaatcaca

SEQ ID NO: 855219 - DNA, 25 bp, Mus musculus
tgagggcagagaccctttccacttc

SEQ ID NO: 855220 - DNA, 25 bp, Mus musculus
tgagggcagagagcctttccacttc

SEQ ID NO: 855221 - DNA, 25 bp, Mus musculus
tgagggcagagtatccactgcttgc

SEQ ID NO: 855222 - DNA, 25 bp, Mus musculus
tgagggcagagtttccactgcttgc

SEQ ID NO: 855223 - DNA, 25 bp, Mus musculus
tgagggcagcaaaccgccgttgttc

SEQ ID NO: 855224 - DNA, 25 bp, Mus musculus
tgagggcagcaatccgccgttgttc

SEQ ID NO: 855225 - DNA, 25 bp, Mus musculus
tgagggcagctaacaccgacagtga

SEQ ID NO: 855226 - DNA, 25 bp, Mus musculus
tgagggcagctatcaccgacagtga

SEQ ID NO: 855227 - DNA, 25 bp, Mus musculus
tgagggcagctgataccgctccaaa

SEQ ID NO: 855228 - DNA, 25 bp, Mus musculus
tgagggcagctgttaccgctccaaa

SEQ ID NO: 855229 - DNA, 25 bp, Mus musculus
tgagggcagggcctaagcaccatac

SEQ ID NO: 855230 - DNA, 25 bp, Mus musculus
tgagggcagggcgtaagcaccatac

SEQ ID NO: 855231 - DNA, 25 bp, Mus musculus
tgagggcagtcaacacatgtggtca

SEQ ID NO: 855232 - DNA, 25 bp, Mus musculus
tgagggcagtcatcacatgtggtca

SEQ ID NO: 855233 - DNA, 25 bp, Mus musculus
tgagggcagttccatcccgacagaa

SEQ ID NO: 855234 - DNA, 25 bp, Mus musculus
tgagggcagttcgatcccgacagaa

SEQ ID NO: 855235 - DNA, 25 bp, Mus musculus
tgagggcatcatcttggtctctgtt

SEQ ID NO: 855236 - DNA, 25 bp, Mus musculus
tgagggcatcatgttggtctctgtt

SEQ ID NO: 855237 - DNA, 25 bp, Mus musculus
tgagggcatctgagtgatgaccaca

SEQ ID NO: 855238 - DNA, 25 bp, Mus musculus
tgagggcatctgtgtgatgaccaca

SEQ ID NO: 855239 - DNA, 25 bp, Mus musculus
tgagggcatgtcacctgtgctgtaa

SEQ ID NO: 855240 - DNA, 25 bp, Mus musculus
tgagggcatgtctcctgtgctgtaa

SEQ ID NO: 855241 - DNA, 25 bp, Mus musculus
tgagggcatttaagacttctcccgt

SEQ ID NO: 855242 - DNA, 25 bp, Mus musculus
tgagggcatttatgacttctcccgt

SEQ ID NO: 855243 - DNA, 25 bp, Mus musculus
tgagggccaagaacacttcgtatgc

SEQ ID NO: 855244 - DNA, 25 bp, Mus musculus
tgagggccaagatcacttcgtatgc

SEQ ID NO: 855245 - DNA, 25 bp, Mus musculus
tgagggccacaacgattcccagtca

SEQ ID NO: 855246 - DNA, 25 bp, Mus musculus
tgagggccacaaggattcccagtca

SEQ ID NO: 855247 - DNA, 25 bp, Mus musculus
tgagggccacacactcgaaagggtt

SEQ ID NO: 855248 - DNA, 25 bp, Mus musculus
tgagggccacactctcgaaagggtt

SEQ ID NO: 855249 - DNA, 25 bp, Mus musculus
tgagggccatgtcagtttccttgaa

SEQ ID NO: 855250 - DNA, 25 bp, Mus musculus
tgagggccatgtcctgttcaggcaa

SEQ ID NO: 855251 - DNA, 25 bp, Mus musculus
tgagggccatgtgagtttccttgaa

SEQ ID NO: 855252 - DNA, 25 bp, Mus musculus
tgagggccatgtgctgttcaggcaa

SEQ ID NO: 855253 - DNA, 25 bp, Mus musculus
tgagggcccagacactgaccttgaa

SEQ ID NO: 855254 - DNA, 25 bp, Mus musculus
tgagggcccagagactgaccttgaa

SEQ ID NO: 855255 - DNA, 25 bp, Mus musculus
tgagggcccatgctcctctcatggg

SEQ ID NO: 855256 - DNA, 25 bp, Mus musculus
tgagggcccatggtcctctcatggg

SEQ ID NO: 855257 - DNA, 25 bp, Mus musculus
tgagggccccaaaaatgccaggttt

SEQ ID NO: 855258 - DNA, 25 bp, Mus musculus
tgagggccccaataatgccaggttt

SEQ ID NO: 855259 - DNA, 25 bp, Mus musculus
tgagggcccgacactgtatgtcttc

SEQ ID NO: 855260 - DNA, 25 bp, Mus musculus
tgagggcccgacattatatccacat

SEQ ID NO: 855261 - DNA, 25 bp, Mus musculus
tgagggcccgactctgtatgtcttc

SEQ ID NO: 855262 - DNA, 25 bp, Mus musculus
tgagggcccgactttatatccacat

SEQ ID NO: 855263 - DNA, 25 bp, Mus musculus
tgagggccctagacaccagaaacta

SEQ ID NO: 855264 - DNA, 25 bp, Mus musculus
tgagggccctagtcaccagaaacta

SEQ ID NO: 855265 - DNA, 25 bp, Mus musculus
tgagggccctgccctggaagactgg

SEQ ID NO: 855266 - DNA, 25 bp, Mus musculus
tgagggccctgcgctggaagactgg

SEQ ID NO: 855267 - DNA, 25 bp, Mus musculus
tgagggcccttccaaaatagtccca

SEQ ID NO: 855268 - DNA, 25 bp, Mus musculus
tgagggcccttcgaaaatagtccca

SEQ ID NO: 855269 - DNA, 25 bp, Mus musculus
tgagggccgccaacgaagtgaatgc

SEQ ID NO: 855270 - DNA, 25 bp, Mus musculus
tgagggccgccatcgaagtgaatgc

SEQ ID NO: 855271 - DNA, 25 bp, Mus musculus
tgagggcctcagaaaccatctaagc

SEQ ID NO: 855272 - DNA, 25 bp, Mus musculus
tgagggcctcagtaaccatctaagc

SEQ ID NO: 855273 - DNA, 25 bp, Mus musculus
tgagggcctggtacctgagttttaa

SEQ ID NO: 855274 - DNA, 25 bp, Mus musculus
tgagggcctggttcctgagttttaa

SEQ ID NO: 855275 - DNA, 25 bp, Mus musculus
tgagggcctgttactgtttgtacaa

SEQ ID NO: 855276 - DNA, 25 bp, Mus musculus
tgagggcctgtttctgtttgtacaa

SEQ ID NO: 855277 - DNA, 25 bp, Mus musculus
tgagggccttgaagtgtccccaaga

SEQ ID NO: 855278 - DNA, 25 bp, Mus musculus
tgagggccttgacaaagttttcacg

SEQ ID NO: 855279 - DNA, 25 bp, Mus musculus
tgagggccttgagaaagttttcacg

SEQ ID NO: 855280 - DNA, 25 bp, Mus musculus
tgagggccttgatgtgtccccaaga

SEQ ID NO: 855281 - DNA, 25 bp, Mus musculus
tgagggcgaggcctttccctctgtt

SEQ ID NO: 855282 - DNA, 25 bp, Mus musculus
tgagggcgaggcgtttccctctgtt

SEQ ID NO: 855283 - DNA, 25 bp, Mus musculus
tgagggcgagtgacctaaccctgtg

SEQ ID NO: 855284 - DNA, 25 bp, Mus musculus
tgagggcgagtgtcctaaccctgtg

SEQ ID NO: 855285 - DNA, 25 bp, Mus musculus
tgagggcgatccctgcgtccggaag

SEQ ID NO: 855286 - DNA, 25 bp, Mus musculus
tgagggcgatccgtgcgtccggaag

SEQ ID NO: 855287 - DNA, 25 bp, Mus musculus
tgagggcgcaacatctgcataacct

SEQ ID NO: 855288 - DNA, 25 bp, Mus musculus
tgagggcgcaacttctgcataacct

SEQ ID NO: 855289 - DNA, 25 bp, Mus musculus
tgagggcggcagcattcacacacag

SEQ ID NO: 855290 - DNA, 25 bp, Mus musculus
tgagggcggcaggattcacacacag

SEQ ID NO: 855291 - DNA, 25 bp, Mus musculus
tgagggctaacacggctacggattc

SEQ ID NO: 855292 - DNA, 25 bp, Mus musculus
tgagggctaacagggctacggattc

SEQ ID NO: 855293 - DNA, 25 bp, Mus musculus
tgagggctaagaaccaggttcaacc

SEQ ID NO: 855294 - DNA, 25 bp, Mus musculus
tgagggctaagatccaggttcaacc

SEQ ID NO: 855295 - DNA, 25 bp, Mus musculus
tgagggctaggcatacaatctttgt

SEQ ID NO: 855296 - DNA, 25 bp, Mus musculus
tgagggctaggcttacaatctttgt

SEQ ID NO: 855297 - DNA, 25 bp, Mus musculus
tgagggctcaaacttctcagcttca

SEQ ID NO: 855298 - DNA, 25 bp, Mus musculus
tgagggctcaaagttctcagcttca

SEQ ID NO: 855299 - DNA, 25 bp, Mus musculus
tgagggctcacaacagtcccctgga

SEQ ID NO: 855300 - DNA, 25 bp, Mus musculus
tgagggctcacatcagtcccctgga

SEQ ID NO: 855301 - DNA, 25 bp, Mus musculus
tgagggctcaccagcaccctcttgt

SEQ ID NO: 855302 - DNA, 25 bp, Mus musculus
tgagggctcacctgcaccctcttgt

SEQ ID NO: 855303 - DNA, 25 bp, Mus musculus
tgagggctcagcaccatagaccatg

SEQ ID NO: 855304 - DNA, 25 bp, Mus musculus
tgagggctcagctccatagaccatg

SEQ ID NO: 855305 - DNA, 25 bp, Mus musculus
tgagggctcatgatagaactaccat

SEQ ID NO: 855306 - DNA, 25 bp, Mus musculus
tgagggctcatgttagaactaccat

SEQ ID NO: 855307 - DNA, 25 bp, Mus musculus
tgagggctcattcagtcagcatctt

SEQ ID NO: 855308 - DNA, 25 bp, Mus musculus
tgagggctcattgagtcagcatctt

SEQ ID NO: 855309 - DNA, 25 bp, Mus musculus
tgagggctgacaaacaccccaaact

SEQ ID NO: 855310 - DNA, 25 bp, Mus musculus
tgagggctgacatacaccccaaact

SEQ ID NO: 855311 - DNA, 25 bp, Mus musculus
tgagggctgcccataaagagacctt

SEQ ID NO: 855312 - DNA, 25 bp, Mus musculus
tgagggctgcccttaaagagacctt

SEQ ID NO: 855313 - DNA, 25 bp, Mus musculus
tgagggctgtttaggaacgacccca

SEQ ID NO: 855314 - DNA, 25 bp, Mus musculus
tgagggctgttttggaacgacccca

SEQ ID NO: 855315 - DNA, 25 bp, Mus musculus
tgagggcttactaacacagtcctgt

SEQ ID NO: 855316 - DNA, 25 bp, Mus musculus
tgagggcttacttacacagtcctgt

SEQ ID NO: 855317 - DNA, 25 bp, Mus musculus
tgagggcttcacaactgcagcaact

SEQ ID NO: 855318 - DNA, 25 bp, Mus musculus
tgagggcttcactactgcagcaact

SEQ ID NO: 855319 - DNA, 25 bp, Mus musculus
tgagggcttcctactctaagtaatt

SEQ ID NO: 855320 - DNA, 25 bp, Mus musculus
tgagggcttcctagttggcccctag

SEQ ID NO: 855321 - DNA, 25 bp, Mus musculus
tgagggcttccttctctaagtaatt

SEQ ID NO: 855322 - DNA, 25 bp, Mus musculus
tgagggcttccttgttggcccctag

SEQ ID NO: 855323 - DNA, 25 bp, Mus musculus
tgagggcttcttcctaccaaagtgt

SEQ ID NO: 855324 - DNA, 25 bp, Mus musculus
tgagggcttcttgctaccaaagtgt

SEQ ID NO: 855325 - DNA, 25 bp, Mus musculus
tgagggctttcccacctgcacgggc

SEQ ID NO: 855326 - DNA, 25 bp, Mus musculus
tgagggctttccgacctgcacgggc

SEQ ID NO: 855327 - DNA, 25 bp, Mus musculus
tgagggtatgtaccactaccaccgc

SEQ ID NO: 855328 - DNA, 25 bp, Mus musculus
tgagggtatgtagcactaccaccgc

SEQ ID NO: 855329 - DNA, 25 bp, Mus musculus
tgagggtcagcccaggcaacacagc

SEQ ID NO: 855330 - DNA, 25 bp, Mus musculus
tgagggtcagccgaggcaacacagc

SEQ ID NO: 855331 - DNA, 25 bp, Mus musculus
tgagggtcatgtattccaccccatg

SEQ ID NO: 855332 - DNA, 25 bp, Mus musculus
tgagggtcatgttttccaccccatg

SEQ ID NO: 855333 - DNA, 25 bp, Mus musculus
tgagggtcccaaagtttcttccaga

SEQ ID NO: 855334 - DNA, 25 bp, Mus musculus
tgagggtcccaatgtttcttccaga

SEQ ID NO: 855335 - DNA, 25 bp, Mus musculus
tgagggtcgaataactctttcattc

SEQ ID NO: 855336 - DNA, 25 bp, Mus musculus
tgagggtcgaattactctttcattc

SEQ ID NO: 855337 - DNA, 25 bp, Mus musculus
tgagggtctaatatctgcacaaaga

SEQ ID NO: 855338 - DNA, 25 bp, Mus musculus
tgagggtctaatttctgcacaaaga

SEQ ID NO: 855339 - DNA, 25 bp, Mus musculus
tgagggtctcacataacccaggcta

SEQ ID NO: 855340 - DNA, 25 bp, Mus musculus
tgagggtctcacttaacccaggcta

SEQ ID NO: 855341 - DNA, 25 bp, Mus musculus
tgagggtctctgctaccttctggca

SEQ ID NO: 855342 - DNA, 25 bp, Mus musculus
tgagggtctctggtaccttctggca

SEQ ID NO: 855343 - DNA, 25 bp, Mus musculus
tgagggtcttctacagcgccattga

SEQ ID NO: 855344 - DNA, 25 bp, Mus musculus
tgagggtcttctctagcaccacggc

SEQ ID NO: 855345 - DNA, 25 bp, Mus musculus
tgagggtcttctgtagcaccacggc

SEQ ID NO: 855346 - DNA, 25 bp, Mus musculus
tgagggtcttcttcagcgccattga

SEQ ID NO: 855347 - DNA, 25 bp, Mus musculus
tgagggtgaagcagcctccttgtac

SEQ ID NO: 855348 - DNA, 25 bp, Mus musculus
tgagggtgaagctgcctccttgtac

SEQ ID NO: 855349 - DNA, 25 bp, Mus musculus
tgagggtgacacctctggagacttc

SEQ ID NO: 855350 - DNA, 25 bp, Mus musculus
tgagggtgacacgtctggagacttc

SEQ ID NO: 855351 - DNA, 25 bp, Mus musculus
tgagggtgacatcccactctgtgga

SEQ ID NO: 855352 - DNA, 25 bp, Mus musculus
tgagggtgacatgccactctgtgga

SEQ ID NO: 855353 - DNA, 25 bp, Mus musculus
tgagggtgacctctgtctcttagct

SEQ ID NO: 855354 - DNA, 25 bp, Mus musculus
tgagggtgacctgtgtctcttagct

SEQ ID NO: 855355 - DNA, 25 bp, Mus musculus
tgagggtgagcgactcctgtactgt

SEQ ID NO: 855356 - DNA, 25 bp, Mus musculus
tgagggtgagcgtctcctgtactgt

SEQ ID NO: 855357 - DNA, 25 bp, Mus musculus
tgagggtgcattaaaaccagaggat

SEQ ID NO: 855358 - DNA, 25 bp, Mus musculus
tgagggtgcatttaaaccagaggat

SEQ ID NO: 855359 - DNA, 25 bp, Mus musculus
tgagggtgggacaggctcatactca

SEQ ID NO: 855360 - DNA, 25 bp, Mus musculus
tgagggtgggactggctcatactca

SEQ ID NO: 855361 - DNA, 25 bp, Mus musculus
tgagggtgtaaaaatgctgctcatc

SEQ ID NO: 855362 - DNA, 25 bp, Mus musculus
tgagggtgtaaatatgctgctcatc

SEQ ID NO: 855363 - DNA, 25 bp, Mus musculus
tgagggtgttagcagagcctcccct

SEQ ID NO: 855364 - DNA, 25 bp, Mus musculus
tgagggtgttaggagagcctcccct

SEQ ID NO: 855365 - DNA, 25 bp, Mus musculus
tgagggttatcacttttctcccctg

SEQ ID NO: 855366 - DNA, 25 bp, Mus musculus
tgagggttatcagttttctcccctg

SEQ ID NO: 855367 - DNA, 25 bp, Mus musculus
tgagggttcatccaagcttgagctt

SEQ ID NO: 855368 - DNA, 25 bp, Mus musculus
tgagggttcatcgaagcttgagctt

SEQ ID NO: 855369 - DNA, 25 bp, Mus musculus
tgagggttctggatccttcttttaa

SEQ ID NO: 855370 - DNA, 25 bp, Mus musculus
tgagggttctggttccttcttttaa

SEQ ID NO: 855371 - DNA, 25 bp, Mus musculus
tgagggttctgtattgcttgttttc

SEQ ID NO: 855372 - DNA, 25 bp, Mus musculus
tgagggttctgttttgcttgttttc

SEQ ID NO: 855373 - DNA, 25 bp, Mus musculus
tgagggttgggaaccagtgcccctt

SEQ ID NO: 855374 - DNA, 25 bp, Mus musculus
tgagggttgggatccagtgcccctt

SEQ ID NO: 855375 - DNA, 25 bp, Mus musculus
tgagggttgtagataagtactcccc

SEQ ID NO: 855376 - DNA, 25 bp, Mus musculus
tgagggttgtagttaagtactcccc

SEQ ID NO: 855377 - DNA, 25 bp, Mus musculus
tgagggttgtttcccaatcaaaggt

SEQ ID NO: 855378 - DNA, 25 bp, Mus musculus
tgagggttgtttgccaatcaaaggt

SEQ ID NO: 855379 - DNA, 25 bp, Mus musculus
tgagggtttagactggtccagcttt

SEQ ID NO: 855380 - DNA, 25 bp, Mus musculus
tgagggtttagagtggtccagcttt

SEQ ID NO: 855381 - DNA, 25 bp, Mus musculus
tgaggtaaaaatccccaagcccttg

SEQ ID NO: 855382 - DNA, 25 bp, Mus musculus
tgaggtaaaaatgcccaagcccttg

SEQ ID NO: 855383 - DNA, 25 bp, Mus musculus
tgaggtaaattcacatgtggtactt

SEQ ID NO: 855384 - DNA, 25 bp, Mus musculus
tgaggtaaattctcatgtggtactt

SEQ ID NO: 855385 - DNA, 25 bp, Mus musculus
tgaggtaacaaacatttgcctggct

SEQ ID NO: 855386 - DNA, 25 bp, Mus musculus
tgaggtaacaaagatttgcctggct

SEQ ID NO: 855387 - DNA, 25 bp, Mus musculus
tgaggtaaccatctgctgcaacagc

SEQ ID NO: 855388 - DNA, 25 bp, Mus musculus
tgaggtaaccatgtgctgcaacagc

SEQ ID NO: 855389 - DNA, 25 bp, Mus musculus
tgaggtaagaccatgattcctacat

SEQ ID NO: 855390 - DNA, 25 bp, Mus musculus
tgaggtaagaccttgattcctacat

SEQ ID NO: 855391 - DNA, 25 bp, Mus musculus
tgaggtaaggacagacacccaaggt

SEQ ID NO: 855392 - DNA, 25 bp, Mus musculus
tgaggtaaggactgacacccaaggt

SEQ ID NO: 855393 - DNA, 25 bp, Mus musculus
tgaggtaagtatcctatccttgagc

SEQ ID NO: 855394 - DNA, 25 bp, Mus musculus
tgaggtaagtatgctatccttgagc

SEQ ID NO: 855395 - DNA, 25 bp, Mus musculus
tgaggtacaacccataaaggacttt

SEQ ID NO: 855396 - DNA, 25 bp, Mus musculus
tgaggtacaaccgataaaggacttt

SEQ ID NO: 855397 - DNA, 25 bp, Mus musculus
tgaggtacacatctgacacttctgt

SEQ ID NO: 855398 - DNA, 25 bp, Mus musculus
tgaggtacacatgtgacacttctgt

SEQ ID NO: 855399 - DNA, 25 bp, Mus musculus
tgaggtacagctcacttcctctcca

SEQ ID NO: 855400 - DNA, 25 bp, Mus musculus
tgaggtacagctgacttcctctcca

SEQ ID NO: 855401 - DNA, 25 bp, Mus musculus
tgaggtacatgcatttgtgccaccc

SEQ ID NO: 855402 - DNA, 25 bp, Mus musculus
tgaggtacatgcttttgtgccaccc

SEQ ID NO: 855403 - DNA, 25 bp, Mus musculus
tgaggtaccaccaggcaatccaaag

SEQ ID NO: 855404 - DNA, 25 bp, Mus musculus
tgaggtaccacctggcaatccaaag

SEQ ID NO: 855405 - DNA, 25 bp, Mus musculus
tgaggtacccgccatgattaaattg

SEQ ID NO: 855406 - DNA, 25 bp, Mus musculus
tgaggtacccgcgatgattaaattg

SEQ ID NO: 855407 - DNA, 25 bp, Mus musculus
tgaggtacggttaatagccacgcct

SEQ ID NO: 855408 - DNA, 25 bp, Mus musculus
tgaggtacggtttatagccacgcct

SEQ ID NO: 855409 - DNA, 25 bp, Mus musculus
tgaggtagagtcaggtggctcttct

SEQ ID NO: 855410 - DNA, 25 bp, Mus musculus
tgaggtagagtctggtggctcttct

SEQ ID NO: 855411 - DNA, 25 bp, Mus musculus
tgaggtagcccacatgccagccaag

SEQ ID NO: 855412 - DNA, 25 bp, Mus musculus
tgaggtagcccagatgccagccaag

SEQ ID NO: 855413 - DNA, 25 bp, Mus musculus
tgaggtagcctacagatgggcccca

SEQ ID NO: 855414 - DNA, 25 bp, Mus musculus
tgaggtagcctagagatgggcccca

SEQ ID NO: 855415 - DNA, 25 bp, Mus musculus
tgaggtagctcgctgcacttggcaa

SEQ ID NO: 855416 - DNA, 25 bp, Mus musculus
tgaggtagctcggtgcacttggcaa

SEQ ID NO: 855417 - DNA, 25 bp, Mus musculus
tgaggtaggcttctaatcccaactt

SEQ ID NO: 855418 - DNA, 25 bp, Mus musculus
tgaggtaggcttgtaatcccaactt

SEQ ID NO: 855419 - DNA, 25 bp, Mus musculus
tgaggtaggtgcagtctataccctc

SEQ ID NO: 855420 - DNA, 25 bp, Mus musculus
tgaggtaggtgctgtctataccctc

SEQ ID NO: 855421 - DNA, 25 bp, Mus musculus
tgaggtagtaccactatgctttttt

SEQ ID NO: 855422 - DNA, 25 bp, Mus musculus
tgaggtagtacctctatgctttttt

SEQ ID NO: 855423 - DNA, 25 bp, Mus musculus
tgaggtatcaagaacacacctgatt

SEQ ID NO: 855424 - DNA, 25 bp, Mus musculus
tgaggtatcaagtacacacctgatt

SEQ ID NO: 855425 - DNA, 25 bp, Mus musculus
tgaggtatgcatcgctcctatagaa

SEQ ID NO: 855426 - DNA, 25 bp, Mus musculus
tgaggtatgcatggctcctatagaa

SEQ ID NO: 855427 - DNA, 25 bp, Mus musculus
tgaggtatgtagacccttttctccc

SEQ ID NO: 855428 - DNA, 25 bp, Mus musculus
tgaggtatgtagtcccttttctccc

SEQ ID NO: 855429 - DNA, 25 bp, Mus musculus
tgaggtatgtcccacgaatccctaa

SEQ ID NO: 855430 - DNA, 25 bp, Mus musculus
tgaggtatgtccgacgaatccctaa

SEQ ID NO: 855431 - DNA, 25 bp, Mus musculus
tgaggtattacaaagttggcacatg

SEQ ID NO: 855432 - DNA, 25 bp, Mus musculus
tgaggtattacatagttggcacatg

SEQ ID NO: 855433 - DNA, 25 bp, Mus musculus
tgaggtattcggagcagctgctgac

SEQ ID NO: 855434 - DNA, 25 bp, Mus musculus
tgaggtattcggtgcagctgctgac

SEQ ID NO: 855435 - DNA, 25 bp, Mus musculus
tgaggtattctacacagtgtgctga

SEQ ID NO: 855436 - DNA, 25 bp, Mus musculus
tgaggtattctagacagtgtgctga

SEQ ID NO: 855437 - DNA, 25 bp, Mus musculus
tgaggtcaaaatcgcagcacttaag

SEQ ID NO: 855438 - DNA, 25 bp, Mus musculus
tgaggtcaaaatggcagcacttaag

SEQ ID NO: 855439 - DNA, 25 bp, Mus musculus
tgaggtcaaggccaccacagatgga

SEQ ID NO: 855440 - DNA, 25 bp, Mus musculus
tgaggtcaaggcgaccacagatgga

SEQ ID NO: 855441 - DNA, 25 bp, Mus musculus
tgaggtcacatgctggtccactttg

SEQ ID NO: 855442 - DNA, 25 bp, Mus musculus
tgaggtcacatggtggtccactttg

SEQ ID NO: 855443 - DNA, 25 bp, Mus musculus
tgaggtcaccgacaggttcctggca

SEQ ID NO: 855444 - DNA, 25 bp, Mus musculus
tgaggtcaccgagaggttcctggca

SEQ ID NO: 855445 - DNA, 25 bp, Mus musculus
tgaggtcacctaacagtcttttgag

SEQ ID NO: 855446 - DNA, 25 bp, Mus musculus
tgaggtcacctatcagtcttttgag

SEQ ID NO: 855447 - DNA, 25 bp, Mus musculus
tgaggtcacgccacacaaaacatac

SEQ ID NO: 855448 - DNA, 25 bp, Mus musculus
tgaggtcacgcctcacaaaacatac

SEQ ID NO: 855449 - DNA, 25 bp, Mus musculus
tgaggtcacgttctgatgtgcccag

SEQ ID NO: 855450 - DNA, 25 bp, Mus musculus
tgaggtcacgttgtgatgtgcccag

SEQ ID NO: 855451 - DNA, 25 bp, Mus musculus
tgaggtcactgcagggtcgctagtt

SEQ ID NO: 855452 - DNA, 25 bp, Mus musculus
tgaggtcactgctgggtcgctagtt

SEQ ID NO: 855453 - DNA, 25 bp, Mus musculus
tgaggtcacttcctgtctttaaata

SEQ ID NO: 855454 - DNA, 25 bp, Mus musculus
tgaggtcacttcgtgtctttaaata

SEQ ID NO: 855455 - DNA, 25 bp, Mus musculus
tgaggtcacttgcttatgtcactgc

SEQ ID NO: 855456 - DNA, 25 bp, Mus musculus
tgaggtcacttggttatgtcactgc

SEQ ID NO: 855457 - DNA, 25 bp, Mus musculus
tgaggtcactttcctgtttcttagt

SEQ ID NO: 855458 - DNA, 25 bp, Mus musculus
tgaggtcactttgctgtttcttagt

SEQ ID NO: 855459 - DNA, 25 bp, Mus musculus
tgaggtcagcatcgcgccactcctg

SEQ ID NO: 855460 - DNA, 25 bp, Mus musculus
tgaggtcagcatggcgccactcctg

SEQ ID NO: 855461 - DNA, 25 bp, Mus musculus
tgaggtcagccacaatcatgccaat

SEQ ID NO: 855462 - DNA, 25 bp, Mus musculus
tgaggtcagccagaatcatgccaat

SEQ ID NO: 855463 - DNA, 25 bp, Mus musculus
tgaggtcagcccaggatagtgagac

SEQ ID NO: 855464 - DNA, 25 bp, Mus musculus
tgaggtcagccctggatagtgagac

SEQ ID NO: 855465 - DNA, 25 bp, Mus musculus
tgaggtcataagatcctgtctccac

SEQ ID NO: 855466 - DNA, 25 bp, Mus musculus
tgaggtcataagttcctgtctccac

SEQ ID NO: 855467 - DNA, 25 bp, Mus musculus
tgaggtcatgacaggatacccacgg

SEQ ID NO: 855468 - DNA, 25 bp, Mus musculus
tgaggtcatgactggatacccacgg

SEQ ID NO: 855469 - DNA, 25 bp, Mus musculus
tgaggtcatgttatcatctttggac

SEQ ID NO: 855470 - DNA, 25 bp, Mus musculus
tgaggtcatgttttcatctttggac

SEQ ID NO: 855471 - DNA, 25 bp, Mus musculus
tgaggtccaaacactgccttgtgct

SEQ ID NO: 855472 - DNA, 25 bp, Mus musculus
tgaggtccaaactctgccttgtgct

SEQ ID NO: 855473 - DNA, 25 bp, Mus musculus
tgaggtccaaccagaaaaccatact

SEQ ID NO: 855474 - DNA, 25 bp, Mus musculus
tgaggtccaacctgaaaaccatact

SEQ ID NO: 855475 - DNA, 25 bp, Mus musculus
tgaggtccaagaaactatttgcagt

SEQ ID NO: 855476 - DNA, 25 bp, Mus musculus
tgaggtccaagatactatttgcagt

SEQ ID NO: 855477 - DNA, 25 bp, Mus musculus
tgaggtccacctaacagacagggct

SEQ ID NO: 855478 - DNA, 25 bp, Mus musculus
tgaggtccaccttacagacagggct

SEQ ID NO: 855479 - DNA, 25 bp, Mus musculus
tgaggtccacttaagcgaacatttt

SEQ ID NO: 855480 - DNA, 25 bp, Mus musculus
tgaggtccactttagcgaacatttt

SEQ ID NO: 855481 - DNA, 25 bp, Mus musculus
tgaggtccagacagatcccaacctt

SEQ ID NO: 855482 - DNA, 25 bp, Mus musculus
tgaggtccagactgatcccaacctt

SEQ ID NO: 855483 - DNA, 25 bp, Mus musculus
tgaggtccagagactacgttgttgg

SEQ ID NO: 855484 - DNA, 25 bp, Mus musculus
tgaggtccagagtctacgttgttgg

SEQ ID NO: 855485 - DNA, 25 bp, Mus musculus
tgaggtccaggccagactggtcttt

SEQ ID NO: 855486 - DNA, 25 bp, Mus musculus
tgaggtccaggcgagactggtcttt

SEQ ID NO: 855487 - DNA, 25 bp, Mus musculus
tgaggtcccagcactaatggcttaa

SEQ ID NO: 855488 - DNA, 25 bp, Mus musculus
tgaggtcccagctctaatggcttaa

SEQ ID NO: 855489 - DNA, 25 bp, Mus musculus
tgaggtcccatcataaaggcaggta

SEQ ID NO: 855490 - DNA, 25 bp, Mus musculus
tgaggtcccatcttaaaggcaggta

SEQ ID NO: 855491 - DNA, 25 bp, Mus musculus
tgaggtcccatgcttgaactccagg

SEQ ID NO: 855492 - DNA, 25 bp, Mus musculus
tgaggtcccatggttgaactccagg

SEQ ID NO: 855493 - DNA, 25 bp, Mus musculus
tgaggtccccaacgccaaggaggat

SEQ ID NO: 855494 - DNA, 25 bp, Mus musculus
tgaggtccccaaggccaaggaggat

SEQ ID NO: 855495 - DNA, 25 bp, Mus musculus
tgaggtcccccaaggcccagggcaa

SEQ ID NO: 855496 - DNA, 25 bp, Mus musculus
tgaggtcccccatggcccagggcaa

SEQ ID NO: 855497 - DNA, 25 bp, Mus musculus
tgaggtcccgagattgatccttacc

SEQ ID NO: 855498 - DNA, 25 bp, Mus musculus
tgaggtcccgagtttgatccttacc

SEQ ID NO: 855499 - DNA, 25 bp, Mus musculus
tgaggtcctgagagaagagcccatt

SEQ ID NO: 855500 - DNA, 25 bp, Mus musculus
tgaggtcctgagtgaagagcccatt

SEQ ID NO: 855501 - DNA, 25 bp, Mus musculus
tgaggtcctgcaattctcagtcggt

SEQ ID NO: 855502 - DNA, 25 bp, Mus musculus
tgaggtcctgcatttctcagtcggt

SEQ ID NO: 855503 - DNA, 25 bp, Mus musculus
tgaggtcctgccataccaattatgt

SEQ ID NO: 855504 - DNA, 25 bp, Mus musculus
tgaggtcctgccttaccaattatgt

SEQ ID NO: 855505 - DNA, 25 bp, Mus musculus
tgaggtcctgttctcaccagaccag

SEQ ID NO: 855506 - DNA, 25 bp, Mus musculus
tgaggtcctgttgtcaccagaccag

SEQ ID NO: 855507 - DNA, 25 bp, Mus musculus
tgaggtcgcttaccaactagcccta

SEQ ID NO: 855508 - DNA, 25 bp, Mus musculus
tgaggtcgcttagcaactagcccta

SEQ ID NO: 855509 - DNA, 25 bp, Mus musculus
tgaggtctagggatccacgtgctga

SEQ ID NO: 855510 - DNA, 25 bp, Mus musculus
tgaggtctagggttccacgtgctga

SEQ ID NO: 855511 - DNA, 25 bp, Mus musculus
tgaggtctcaatatccactaggtat

SEQ ID NO: 855512 - DNA, 25 bp, Mus musculus
tgaggtctcaatttccactaggtat

SEQ ID NO: 855513 - DNA, 25 bp, Mus musculus
tgaggtctcaccaaattttctaatt

SEQ ID NO: 855514 - DNA, 25 bp, Mus musculus
tgaggtctcaccaactcttcaggaa

SEQ ID NO: 855515 - DNA, 25 bp, Mus musculus
tgaggtctcacctaattttctaatt

SEQ ID NO: 855516 - DNA, 25 bp, Mus musculus
tgaggtctcacctactcttcaggaa

SEQ ID NO: 855517 - DNA, 25 bp, Mus musculus
tgaggtctcataagcacccattgtg

SEQ ID NO: 855518 - DNA, 25 bp, Mus musculus
tgaggtctcatatgcacccattgtg

SEQ ID NO: 855519 - DNA, 25 bp, Mus musculus
tgaggtctccctccagagacatctt

SEQ ID NO: 855520 - DNA, 25 bp, Mus musculus
tgaggtctccctgcagagacatctt

SEQ ID NO: 855521 - DNA, 25 bp, Mus musculus
tgaggtctcgtcctgtagttttaga

SEQ ID NO: 855522 - DNA, 25 bp, Mus musculus
tgaggtctcgtcgtgtagttttaga

SEQ ID NO: 855523 - DNA, 25 bp, Mus musculus
tgaggtctctcaataccacatttcc

SEQ ID NO: 855524 - DNA, 25 bp, Mus musculus
tgaggtctctcattaccacatttcc

SEQ ID NO: 855525 - DNA, 25 bp, Mus musculus
tgaggtctcttcacagctctagtag

SEQ ID NO: 855526 - DNA, 25 bp, Mus musculus
tgaggtctcttctcagctctagtag

SEQ ID NO: 855527 - DNA, 25 bp, Mus musculus
tgaggtctcttgatatttaacttcc

SEQ ID NO: 855528 - DNA, 25 bp, Mus musculus
tgaggtctcttgttatttaacttcc

SEQ ID NO: 855529 - DNA, 25 bp, Mus musculus
tgaggtctgaacactggataagaga

SEQ ID NO: 855530 - DNA, 25 bp, Mus musculus
tgaggtctgaactctggataagaga

SEQ ID NO: 855531 - DNA, 25 bp, Mus musculus
tgaggtctgaccaaaacgtgtagca

SEQ ID NO: 855532 - DNA, 25 bp, Mus musculus
tgaggtctgacctaaacgtgtagca

SEQ ID NO: 855533 - DNA, 25 bp, Mus musculus
tgaggtctgcctagtctattaatga

SEQ ID NO: 855534 - DNA, 25 bp, Mus musculus
tgaggtctgccttgtctattaatga

SEQ ID NO: 855535 - DNA, 25 bp, Mus musculus
tgaggtctggacatccccgctaaga

SEQ ID NO: 855536 - DNA, 25 bp, Mus musculus
tgaggtctggacttccccgctaaga

SEQ ID NO: 855537 - DNA, 25 bp, Mus musculus
tgaggtctgttcactgtgaggtcag

SEQ ID NO: 855538 - DNA, 25 bp, Mus musculus
tgaggtctgttctctgtgaggtcag

SEQ ID NO: 855539 - DNA, 25 bp, Mus musculus
tgaggtcttaggattgaagcataga

SEQ ID NO: 855540 - DNA, 25 bp, Mus musculus
tgaggtcttaggtttgaagcataga

SEQ ID NO: 855541 - DNA, 25 bp, Mus musculus
tgaggtctttggaggcatggtaaaa

SEQ ID NO: 855542 - DNA, 25 bp, Mus musculus
tgaggtctttggtggcatggtaaaa

SEQ ID NO: 855543 - DNA, 25 bp, Mus musculus
tgaggtgaaacaacccacgggcctg

SEQ ID NO: 855544 - DNA, 25 bp, Mus musculus
tgaggtgaaacatcccacgggcctg

SEQ ID NO: 855545 - DNA, 25 bp, Mus musculus
tgaggtgaacgccacgctgatgcac

SEQ ID NO: 855546 - DNA, 25 bp, Mus musculus
tgaggtgaacgcgacgctgatgcac

SEQ ID NO: 855547 - DNA, 25 bp, Mus musculus
tgaggtgaagacagccttccccaga

SEQ ID NO: 855548 - DNA, 25 bp, Mus musculus
tgaggtgaagactgccttccccaga

SEQ ID NO: 855549 - DNA, 25 bp, Mus musculus
tgaggtgagggcaggtctccaccca

SEQ ID NO: 855550 - DNA, 25 bp, Mus musculus
tgaggtgagggctggtctccaccca

SEQ ID NO: 855551 - DNA, 25 bp, Mus musculus
tgaggtgatcaaccttccaagagaa

SEQ ID NO: 855552 - DNA, 25 bp, Mus musculus
tgaggtgatcaacgcgccagtccta

SEQ ID NO: 855553 - DNA, 25 bp, Mus musculus
tgaggtgatcaagcttccaagagaa

SEQ ID NO: 855554 - DNA, 25 bp, Mus musculus
tgaggtgatcaaggcgccagtccta

SEQ ID NO: 855555 - DNA, 25 bp, Mus musculus
tgaggtgatctcatgtggtttctga

SEQ ID NO: 855556 - DNA, 25 bp, Mus musculus
tgaggtgatctcttgtggtttctga

SEQ ID NO: 855557 - DNA, 25 bp, Mus musculus
tgaggtgcagctcgaagttcagaaa

SEQ ID NO: 855558 - DNA, 25 bp, Mus musculus
tgaggtgcagctggaagttcagaaa

SEQ ID NO: 855559 - DNA, 25 bp, Mus musculus
tgaggtgcataaagcagtgctgtct

SEQ ID NO: 855560 - DNA, 25 bp, Mus musculus
tgaggtgcataatgcagtgctgtct

SEQ ID NO: 855561 - DNA, 25 bp, Mus musculus
tgaggtgcatacacatgcacagttt

SEQ ID NO: 855562 - DNA, 25 bp, Mus musculus
tgaggtgcatactcatgcacagttt

SEQ ID NO: 855563 - DNA, 25 bp, Mus musculus
tgaggtgcatgacaaccggccagcc

SEQ ID NO: 855564 - DNA, 25 bp, Mus musculus
tgaggtgcatgacattcactccccg

SEQ ID NO: 855565 - DNA, 25 bp, Mus musculus
tgaggtgcatgagaaccggccagcc

SEQ ID NO: 855566 - DNA, 25 bp, Mus musculus
tgaggtgcatgagattcactccccg

SEQ ID NO: 855567 - DNA, 25 bp, Mus musculus
tgaggtgcatggagtcacaagcaga

SEQ ID NO: 855568 - DNA, 25 bp, Mus musculus
tgaggtgcatggtgtcacaagcaga

SEQ ID NO: 855569 - DNA, 25 bp, Mus musculus
tgaggtgccaagatttgccaaggac

SEQ ID NO: 855570 - DNA, 25 bp, Mus musculus
tgaggtgccaagttttgccaaggac

SEQ ID NO: 855571 - DNA, 25 bp, Mus musculus
tgaggtgcccggagtccagaatgcc

SEQ ID NO: 855572 - DNA, 25 bp, Mus musculus
tgaggtgcccggtgtccagaatgcc

SEQ ID NO: 855573 - DNA, 25 bp, Mus musculus
tgaggtgcctagacgtactacaact

SEQ ID NO: 855574 - DNA, 25 bp, Mus musculus
tgaggtgcctagtcgtactacaact

SEQ ID NO: 855575 - DNA, 25 bp, Mus musculus
tgaggtgcgattaccttaaaaataa

SEQ ID NO: 855576 - DNA, 25 bp, Mus musculus
tgaggtgcgatttccttaaaaataa

SEQ ID NO: 855577 - DNA, 25 bp, Mus musculus
tgaggtgcgccacacactaggccaa

SEQ ID NO: 855578 - DNA, 25 bp, Mus musculus
tgaggtgcgccagacactaggccaa

SEQ ID NO: 855579 - DNA, 25 bp, Mus musculus
tgaggtgcgcgaacccacgttcaga

SEQ ID NO: 855580 - DNA, 25 bp, Mus musculus
tgaggtgcgcgatcccacgttcaga

SEQ ID NO: 855581 - DNA, 25 bp, Mus musculus
tgaggtgcgtgtcctcatgctcctg

SEQ ID NO: 855582 - DNA, 25 bp, Mus musculus
tgaggtgcgtgtgctcatgctcctg

SEQ ID NO: 855583 - DNA, 25 bp, Mus musculus
tgaggtgctattcattctctccctg

SEQ ID NO: 855584 - DNA, 25 bp, Mus musculus
tgaggtgctattgattctctccctg

SEQ ID NO: 855585 - DNA, 25 bp, Mus musculus
tgaggtgctccaatcagtgctcatt

SEQ ID NO: 855586 - DNA, 25 bp, Mus musculus
tgaggtgctccattcagtgctcatt

SEQ ID NO: 855587 - DNA, 25 bp, Mus musculus
tgaggtgctgttacactgggccttt

SEQ ID NO: 855588 - DNA, 25 bp, Mus musculus
tgaggtgctgtttcactgggccttt

SEQ ID NO: 855589 - DNA, 25 bp, Mus musculus
tgaggtggaaccattgttttcctgg

SEQ ID NO: 855590 - DNA, 25 bp, Mus musculus
tgaggtggaacctttgttttcctgg

SEQ ID NO: 855591 - DNA, 25 bp, Mus musculus
tgaggtggactgcagtcgtccctca

SEQ ID NO: 855592 - DNA, 25 bp, Mus musculus
tgaggtggactggagtcgtccctca

SEQ ID NO: 855593 - DNA, 25 bp, Mus musculus
tgaggtggagccagcttacctgctg

SEQ ID NO: 855594 - DNA, 25 bp, Mus musculus
tgaggtggagcctgcttacctgctg

SEQ ID NO: 855595 - DNA, 25 bp, Mus musculus
tgaggtggcacacgaccccattcag

SEQ ID NO: 855596 - DNA, 25 bp, Mus musculus
tgaggtggcacaggaccccattcag

SEQ ID NO: 855597 - DNA, 25 bp, Mus musculus
tgaggtggcacgaccagagaactcc

SEQ ID NO: 855598 - DNA, 25 bp, Mus musculus
tgaggtggcacgtccagagaactcc

SEQ ID NO: 855599 - DNA, 25 bp, Mus musculus
tgaggtggccaacacttggcctcaa

SEQ ID NO: 855600 - DNA, 25 bp, Mus musculus
tgaggtggccaagacttggcctcaa

SEQ ID NO: 855601 - DNA, 25 bp, Mus musculus
tgaggtggcccacatttgtaatccc

SEQ ID NO: 855602 - DNA, 25 bp, Mus musculus
tgaggtggcccagatttgtaatccc

SEQ ID NO: 855603 - DNA, 25 bp, Mus musculus
tgaggtggccctctagggattaccc

SEQ ID NO: 855604 - DNA, 25 bp, Mus musculus
tgaggtggccctgtagggattaccc

SEQ ID NO: 855605 - DNA, 25 bp, Mus musculus
tgaggtggctgcagacgcacgttcc

SEQ ID NO: 855606 - DNA, 25 bp, Mus musculus
tgaggtggctgctgacgcacgttcc

SEQ ID NO: 855607 - DNA, 25 bp, Mus musculus
tgaggtgggcctacttgccattgct

SEQ ID NO: 855608 - DNA, 25 bp, Mus musculus
tgaggtgggccttcttgccattgct

SEQ ID NO: 855609 - DNA, 25 bp, Mus musculus
tgaggtgggcggctcgcctctgctc

SEQ ID NO: 855610 - DNA, 25 bp, Mus musculus
tgaggtgggcgggtcgcctctgctc

SEQ ID NO: 855611 - DNA, 25 bp, Mus musculus
tgaggtggtcaacgcccaagagcat

SEQ ID NO: 855612 - DNA, 25 bp, Mus musculus
tgaggtggtcaaggcccaagagcat

SEQ ID NO: 855613 - DNA, 25 bp, Mus musculus
tgaggtggtgcccacatctgcacag

SEQ ID NO: 855614 - DNA, 25 bp, Mus musculus
tgaggtggtgccgacatctgcacag

SEQ ID NO: 855615 - DNA, 25 bp, Mus musculus
tgaggtggttcaaggcactcaccaa

SEQ ID NO: 855616 - DNA, 25 bp, Mus musculus
tgaggtggttcatggcactcaccaa

SEQ ID NO: 855617 - DNA, 25 bp, Mus musculus
tgaggtgtaaacctgcccagatgca

SEQ ID NO: 855618 - DNA, 25 bp, Mus musculus
tgaggtgtaaacgtgcccagatgca

SEQ ID NO: 855619 - DNA, 25 bp, Mus musculus
tgaggtgtagccactggacacagct

SEQ ID NO: 855620 - DNA, 25 bp, Mus musculus
tgaggtgtagcctctggacacagct

SEQ ID NO: 855621 - DNA, 25 bp, Mus musculus
tgaggtgtagtgaaatctttgctgt

SEQ ID NO: 855622 - DNA, 25 bp, Mus musculus
tgaggtgtagtgtaatctttgctgt

SEQ ID NO: 855623 - DNA, 25 bp, Mus musculus
tgaggtgtcactcctaagtcagctt

SEQ ID NO: 855624 - DNA, 25 bp, Mus musculus
tgaggtgtcactgctaagtcagctt

SEQ ID NO: 855625 - DNA, 25 bp, Mus musculus
tgaggtgtccagctatgtcacttca

SEQ ID NO: 855626 - DNA, 25 bp, Mus musculus
tgaggtgtccaggtatgtcacttca

SEQ ID NO: 855627 - DNA, 25 bp, Mus musculus
tgaggtgtctgtctgcaaactgcat

SEQ ID NO: 855628 - DNA, 25 bp, Mus musculus
tgaggtgtctgtgtgcaaactgcat

SEQ ID NO: 855629 - DNA, 25 bp, Mus musculus
tgaggtgtgatcacagagccagcga

SEQ ID NO: 855630 - DNA, 25 bp, Mus musculus
tgaggtgtgatctcagagccagcga

SEQ ID NO: 855631 - DNA, 25 bp, Mus musculus
tgaggtgtggccacccatccaaggt

SEQ ID NO: 855632 - DNA, 25 bp, Mus musculus
tgaggtgtggcctcccatccaaggt

SEQ ID NO: 855633 - DNA, 25 bp, Mus musculus
tgaggtgtggctcactttatagatc

SEQ ID NO: 855634 - DNA, 25 bp, Mus musculus
tgaggtgtggctgactttatagatc

SEQ ID NO: 855635 - DNA, 25 bp, Mus musculus
tgaggtgtggtaaccactcagcact

SEQ ID NO: 855636 - DNA, 25 bp, Mus musculus
tgaggtgtggtatccactcagcact

SEQ ID NO: 855637 - DNA, 25 bp, Mus musculus
tgaggtgttacgactgctctataca

SEQ ID NO: 855638 - DNA, 25 bp, Mus musculus
tgaggtgttacgtctgctctataca

SEQ ID NO: 855639 - DNA, 25 bp, Mus musculus
tgaggtgttcggaagccacctggac

SEQ ID NO: 855640 - DNA, 25 bp, Mus musculus
tgaggtgttcggtagccacctggac

SEQ ID NO: 855641 - DNA, 25 bp, Mus musculus
tgaggtgttgcccttaccgtgacta

SEQ ID NO: 855642 - DNA, 25 bp, Mus musculus
tgaggtgttgccgttaccgtgacta

SEQ ID NO: 855643 - DNA, 25 bp, Mus musculus
tgaggtgttgctaattgggtttgtt

SEQ ID NO: 855644 - DNA, 25 bp, Mus musculus
tgaggtgttgctctcggtgacttcc

SEQ ID NO: 855645 - DNA, 25 bp, Mus musculus
tgaggtgttgctgtcggtgacttcc

SEQ ID NO: 855646 - DNA, 25 bp, Mus musculus
tgaggtgttgcttattgggtttgtt

SEQ ID NO: 855647 - DNA, 25 bp, Mus musculus
tgaggtgtttgcagtagcacccacc

SEQ ID NO: 855648 - DNA, 25 bp, Mus musculus
tgaggtgtttgctgtagcacccacc

SEQ ID NO: 855649 - DNA, 25 bp, Mus musculus
tgaggtgtttggacctcttttcaca

SEQ ID NO: 855650 - DNA, 25 bp, Mus musculus
tgaggtgtttggtcctcttttcaca

SEQ ID NO: 855651 - DNA, 25 bp, Mus musculus
tgaggtgttttgacttctgtcaacc

SEQ ID NO: 855652 - DNA, 25 bp, Mus musculus
tgaggtgttttgtcttctgtcaacc

SEQ ID NO: 855653 - DNA, 25 bp, Mus musculus
tgaggttaaggcaaccctggaccgt

SEQ ID NO: 855654 - DNA, 25 bp, Mus musculus
tgaggttaaggctaccctggaccgt

SEQ ID NO: 855655 - DNA, 25 bp, Mus musculus
tgaggttacaatacccaagcccaga

SEQ ID NO: 855656 - DNA, 25 bp, Mus musculus
tgaggttacaattcccaagcccaga

SEQ ID NO: 855657 - DNA, 25 bp, Mus musculus
tgaggttacctgctccctgtcctta

SEQ ID NO: 855658 - DNA, 25 bp, Mus musculus
tgaggttacctggtccctgtcctta

SEQ ID NO: 855659 - DNA, 25 bp, Mus musculus
tgaggttactgtaggttcaggtttt

SEQ ID NO: 855660 - DNA, 25 bp, Mus musculus
tgaggttactgttggttcaggtttt

SEQ ID NO: 855661 - DNA, 25 bp, Mus musculus
tgaggttacttccattgttgctact

SEQ ID NO: 855662 - DNA, 25 bp, Mus musculus
tgaggttacttcgattgttgctact

SEQ ID NO: 855663 - DNA, 25 bp, Mus musculus
tgaggttagcacctagaggccgaat

SEQ ID NO: 855664 - DNA, 25 bp, Mus musculus
tgaggttagcacgtagaggccgaat

SEQ ID NO: 855665 - DNA, 25 bp, Mus musculus
tgaggttagcggcagaatcctgttt

SEQ ID NO: 855666 - DNA, 25 bp, Mus musculus
tgaggttagcgggagaatcctgttt

SEQ ID NO: 855667 - DNA, 25 bp, Mus musculus
tgaggttatttaccacaaagtgtaa

SEQ ID NO: 855668 - DNA, 25 bp, Mus musculus
tgaggttatttagcacaaagtgtaa

SEQ ID NO: 855669 - DNA, 25 bp, Mus musculus
tgaggttcaaagacccacacacgca

SEQ ID NO: 855670 - DNA, 25 bp, Mus musculus
tgaggttcaaagtcccacacacgca

SEQ ID NO: 855671 - DNA, 25 bp, Mus musculus
tgaggttcaccaatgagttccagga

SEQ ID NO: 855672 - DNA, 25 bp, Mus musculus
tgaggttcaccattgagttccagga

SEQ ID NO: 855673 - DNA, 25 bp, Mus musculus
tgaggttcaggccaacatgggatac

SEQ ID NO: 855674 - DNA, 25 bp, Mus musculus
tgaggttcaggcgaacatgggatac

SEQ ID NO: 855675 - DNA, 25 bp, Mus musculus
tgaggttcagttcttaggttaatac

SEQ ID NO: 855676 - DNA, 25 bp, Mus musculus
tgaggttcagttgttaggttaatac

SEQ ID NO: 855677 - DNA, 25 bp, Mus musculus
tgaggttccacacaccaggttataa

SEQ ID NO: 855678 - DNA, 25 bp, Mus musculus
tgaggttccacagaccaggttataa

SEQ ID NO: 855679 - DNA, 25 bp, Mus musculus
tgaggttccagacaggcatggctat

SEQ ID NO: 855680 - DNA, 25 bp, Mus musculus
tgaggttccagagaggcatggctat

SEQ ID NO: 855681 - DNA, 25 bp, Mus musculus
tgaggttccaggattccgaccacag

SEQ ID NO: 855682 - DNA, 25 bp, Mus musculus
tgaggttccaggtttccgaccacag

SEQ ID NO: 855683 - DNA, 25 bp, Mus musculus
tgaggttccctccttacagacgagt

SEQ ID NO: 855684 - DNA, 25 bp, Mus musculus
tgaggttccctcgttacagacgagt

SEQ ID NO: 855685 - DNA, 25 bp, Mus musculus
tgaggttcctacagttcttcagggc

SEQ ID NO: 855686 - DNA, 25 bp, Mus musculus
tgaggttcctactgttcttcagggc

SEQ ID NO: 855687 - DNA, 25 bp, Mus musculus
tgaggttcctcaaaactcactggcc

SEQ ID NO: 855688 - DNA, 25 bp, Mus musculus
tgaggttcctcacgtactgtctgga

SEQ ID NO: 855689 - DNA, 25 bp, Mus musculus
tgaggttcctcaggtactgtctgga

SEQ ID NO: 855690 - DNA, 25 bp, Mus musculus
tgaggttcctcataactcactggcc

SEQ ID NO: 855691 - DNA, 25 bp, Mus musculus
tgaggttcctctaccagctaaagct

SEQ ID NO: 855692 - DNA, 25 bp, Mus musculus
tgaggttcctcttccagctaaagct

SEQ ID NO: 855693 - DNA, 25 bp, Mus musculus
tgaggttcctggagaacgtcctctt

SEQ ID NO: 855694 - DNA, 25 bp, Mus musculus
tgaggttcctggtgaacgtcctctt

SEQ ID NO: 855695 - DNA, 25 bp, Mus musculus
tgaggttctcatatagcgtggctgt

SEQ ID NO: 855696 - DNA, 25 bp, Mus musculus
tgaggttctcatttagcgtggctgt

SEQ ID NO: 855697 - DNA, 25 bp, Mus musculus
tgaggttctccaatgcagcacacat

SEQ ID NO: 855698 - DNA, 25 bp, Mus musculus
tgaggttctccattgcagcacacat

SEQ ID NO: 855699 - DNA, 25 bp, Mus musculus
tgaggttctctgagttccctggctg

SEQ ID NO: 855700 - DNA, 25 bp, Mus musculus
tgaggttctctgtgttccctggctg

SEQ ID NO: 855701 - DNA, 25 bp, Mus musculus
tgaggttctgagatgcccacggtag

SEQ ID NO: 855702 - DNA, 25 bp, Mus musculus
tgaggttctgagttgcccacggtag

SEQ ID NO: 855703 - DNA, 25 bp, Mus musculus
tgaggttcttcaaatgctgttggga

SEQ ID NO: 855704 - DNA, 25 bp, Mus musculus
tgaggttcttcatatgctgttggga

SEQ ID NO: 855705 - DNA, 25 bp, Mus musculus
tgaggttgaatactctcactcccag

SEQ ID NO: 855706 - DNA, 25 bp, Mus musculus
tgaggttgaatagtctcactcccag

SEQ ID NO: 855707 - DNA, 25 bp, Mus musculus
tgaggttgacagatcctggcctgac

SEQ ID NO: 855708 - DNA, 25 bp, Mus musculus
tgaggttgacagttcctggcctgac

SEQ ID NO: 855709 - DNA, 25 bp, Mus musculus
tgaggttgataaatgcacaggcttc

SEQ ID NO: 855710 - DNA, 25 bp, Mus musculus
tgaggttgataattgcacaggcttc

SEQ ID NO: 855711 - DNA, 25 bp, Mus musculus
tgaggttgatctcttccagctgcag

SEQ ID NO: 855712 - DNA, 25 bp, Mus musculus
tgaggttgatctgttccagctgcag

SEQ ID NO: 855713 - DNA, 25 bp, Mus musculus
tgaggttgatgacccaagcctacca

SEQ ID NO: 855714 - DNA, 25 bp, Mus musculus
tgaggttgatgagccaagcctacca

SEQ ID NO: 855715 - DNA, 25 bp, Mus musculus
tgaggttgcctacttacccagttta

SEQ ID NO: 855716 - DNA, 25 bp, Mus musculus
tgaggttgcctagttacccagttta

SEQ ID NO: 855717 - DNA, 25 bp, Mus musculus
tgaggttggaataaacagactttta

SEQ ID NO: 855718 - DNA, 25 bp, Mus musculus
tgaggttggaattaacagactttta

SEQ ID NO: 855719 - DNA, 25 bp, Mus musculus
tgaggttggcccaggtcttctcgag

SEQ ID NO: 855720 - DNA, 25 bp, Mus musculus
tgaggttggccctggtcttctcgag

SEQ ID NO: 855721 - DNA, 25 bp, Mus musculus
tgaggttgtccaaaaccctcacgga

SEQ ID NO: 855722 - DNA, 25 bp, Mus musculus
tgaggttgtccataaccctcacgga

SEQ ID NO: 855723 - DNA, 25 bp, Mus musculus
tgaggttgtttgatgctttaaatat

SEQ ID NO: 855724 - DNA, 25 bp, Mus musculus
tgaggttgtttgttgctttaaatat

SEQ ID NO: 855725 - DNA, 25 bp, Mus musculus
tgaggtttacagaggctgccatata

SEQ ID NO: 855726 - DNA, 25 bp, Mus musculus
tgaggtttacagtggctgccatata

SEQ ID NO: 855727 - DNA, 25 bp, Mus musculus
tgaggtttaggcagttgtgaccact

SEQ ID NO: 855728 - DNA, 25 bp, Mus musculus
tgaggtttaggctgttgtgaccact

SEQ ID NO: 855729 - DNA, 25 bp, Mus musculus
tgaggtttatatagacactactggt

SEQ ID NO: 855730 - DNA, 25 bp, Mus musculus
tgaggtttatattgacactactggt

SEQ ID NO: 855731 - DNA, 25 bp, Mus musculus
tgaggtttcatcactgtgccttaag

SEQ ID NO: 855732 - DNA, 25 bp, Mus musculus
tgaggtttcatctctgtgccttaag

SEQ ID NO: 855733 - DNA, 25 bp, Mus musculus
tgaggtttcccgagttgagtcaaat

SEQ ID NO: 855734 - DNA, 25 bp, Mus musculus
tgaggtttcccgtgttgagtcaaat

SEQ ID NO: 855735 - DNA, 25 bp, Mus musculus
tgaggtttccctaaacatgcctttc

SEQ ID NO: 855736 - DNA, 25 bp, Mus musculus
tgaggtttcccttaacatgcctttc

SEQ ID NO: 855737 - DNA, 25 bp, Mus musculus
tgaggtttcctacgctcaagtgcca

SEQ ID NO: 855738 - DNA, 25 bp, Mus musculus
tgaggtttcctaggctcaagtgcca

SEQ ID NO: 855739 - DNA, 25 bp, Mus musculus
tgaggtttcctcatcgcactcggta

SEQ ID NO: 855740 - DNA, 25 bp, Mus musculus
tgaggtttcctcttcgcactcggta

SEQ ID NO: 855741 - DNA, 25 bp, Mus musculus
tgaggtttgcgcagttagttcccac

SEQ ID NO: 855742 - DNA, 25 bp, Mus musculus
tgaggtttgcgctgttagttcccac

SEQ ID NO: 855743 - DNA, 25 bp, Mus musculus
tgaggtttgcttatttgcacttacc

SEQ ID NO: 855744 - DNA, 25 bp, Mus musculus
tgaggtttgcttttttgcacttacc

SEQ ID NO: 855745 - DNA, 25 bp, Mus musculus
tgaggtttggaacaccctcttccca

SEQ ID NO: 855746 - DNA, 25 bp, Mus musculus
tgaggtttggaagaccctcttccca

SEQ ID NO: 855747 - DNA, 25 bp, Mus musculus
tgaggtttgtttagtccctaaatca

SEQ ID NO: 855748 - DNA, 25 bp, Mus musculus
tgaggtttgttttgtccctaaatca

SEQ ID NO: 855749 - DNA, 25 bp, Mus musculus
tgagtaaacaacagtgtccctaagt

SEQ ID NO: 855750 - DNA, 25 bp, Mus musculus
tgagtaaacaactgtgtccctaagt

SEQ ID NO: 855751 - DNA, 25 bp, Mus musculus
tgagtaaacagcctgccctcctttc

SEQ ID NO: 855752 - DNA, 25 bp, Mus musculus
tgagtaaacagcgtgccctcctttc

SEQ ID NO: 855753 - DNA, 25 bp, Mus musculus
tgagtaaaccagctctctaatcctg

SEQ ID NO: 855754 - DNA, 25 bp, Mus musculus
tgagtaaaccaggtctctaatcctg

SEQ ID NO: 855755 - DNA, 25 bp, Mus musculus
tgagtaaacccgctcctttcgatgt

SEQ ID NO: 855756 - DNA, 25 bp, Mus musculus
tgagtaaacccggtcctttcgatgt

SEQ ID NO: 855757 - DNA, 25 bp, Mus musculus
tgagtaaacctgactcctgttgagg

SEQ ID NO: 855758 - DNA, 25 bp, Mus musculus
tgagtaaacctgtctcctgttgagg

SEQ ID NO: 855759 - DNA, 25 bp, Mus musculus
tgagtaacacacagcttgtcaccgt

SEQ ID NO: 855760 - DNA, 25 bp, Mus musculus
tgagtaacacactgcttgtcaccgt

SEQ ID NO: 855761 - DNA, 25 bp, Mus musculus
tgagtaacacttcatcgctttattg

SEQ ID NO: 855762 - DNA, 25 bp, Mus musculus
tgagtaacacttcggctgtcggcag

SEQ ID NO: 855763 - DNA, 25 bp, Mus musculus
tgagtaacacttgatcgctttattg

SEQ ID NO: 855764 - DNA, 25 bp, Mus musculus
tgagtaacacttgggctgtcggcag

SEQ ID NO: 855765 - DNA, 25 bp, Mus musculus
tgagtaacccctagaggtaaccctg

SEQ ID NO: 855766 - DNA, 25 bp, Mus musculus
tgagtaaccccttgaggtaaccctg

SEQ ID NO: 855767 - DNA, 25 bp, Mus musculus
tgagtaacctgcatctctgatgttt

SEQ ID NO: 855768 - DNA, 25 bp, Mus musculus
tgagtaacctgcttctctgatgttt

SEQ ID NO: 855769 - DNA, 25 bp, Mus musculus
tgagtaactcttcgtataactgaag

SEQ ID NO: 855770 - DNA, 25 bp, Mus musculus
tgagtaactcttggtataactgaag

SEQ ID NO: 855771 - DNA, 25 bp, Mus musculus
tgagtaagaggaatctgcccaccct

SEQ ID NO: 855772 - DNA, 25 bp, Mus musculus
tgagtaagaggattctgcccaccct

SEQ ID NO: 855773 - DNA, 25 bp, Mus musculus
tgagtaagcagcacgttctaatcgc

SEQ ID NO: 855774 - DNA, 25 bp, Mus musculus
tgagtaagcagctcgttctaatcgc

SEQ ID NO: 855775 - DNA, 25 bp, Mus musculus
tgagtaagggttattctatattcaa

SEQ ID NO: 855776 - DNA, 25 bp, Mus musculus
tgagtaagggtttttctatattcaa

SEQ ID NO: 855777 - DNA, 25 bp, Mus musculus
tgagtaagtgggagcctcgccgatc

SEQ ID NO: 855778 - DNA, 25 bp, Mus musculus
tgagtaagtgggtgcctcgccgatc

SEQ ID NO: 855779 - DNA, 25 bp, Mus musculus
tgagtaattcgtaacccaaggatta

SEQ ID NO: 855780 - DNA, 25 bp, Mus musculus
tgagtaattcgttacccaaggatta

SEQ ID NO: 855781 - DNA, 25 bp, Mus musculus
tgagtaattctgattcccctcacaa

SEQ ID NO: 855782 - DNA, 25 bp, Mus musculus
tgagtaattctgtttcccctcacaa

SEQ ID NO: 855783 - DNA, 25 bp, Mus musculus
tgagtaattgatactgtccaggcag

SEQ ID NO: 855784 - DNA, 25 bp, Mus musculus
tgagtaattgattctgtccaggcag

SEQ ID NO: 855785 - DNA, 25 bp, Mus musculus
tgagtacaaaacagagtgacaaaga

SEQ ID NO: 855786 - DNA, 25 bp, Mus musculus
tgagtacaaaactgagtgacaaaga

SEQ ID NO: 855787 - DNA, 25 bp, Mus musculus
tgagtacaacctctggtctctgtga

SEQ ID NO: 855788 - DNA, 25 bp, Mus musculus
tgagtacaacctgtggtctctgtga

SEQ ID NO: 855789 - DNA, 25 bp, Mus musculus
tgagtacaacgacatgcccatgcct

SEQ ID NO: 855790 - DNA, 25 bp, Mus musculus
tgagtacaacgagatgcccatgcct

SEQ ID NO: 855791 - DNA, 25 bp, Mus musculus
tgagtacacaggaccccggctatac

SEQ ID NO: 855792 - DNA, 25 bp, Mus musculus
tgagtacacaggtccccggctatac

SEQ ID NO: 855793 - DNA, 25 bp, Mus musculus
tgagtacacattagctatctccaga

SEQ ID NO: 855794 - DNA, 25 bp, Mus musculus
tgagtacacatttgctatctccaga

SEQ ID NO: 855795 - DNA, 25 bp, Mus musculus
tgagtacaccacagccaatgtcatt

SEQ ID NO: 855796 - DNA, 25 bp, Mus musculus
tgagtacaccactgccaatgtcatt

SEQ ID NO: 855797 - DNA, 25 bp, Mus musculus
tgagtacagccaacttgaaccacaa

SEQ ID NO: 855798 - DNA, 25 bp, Mus musculus
tgagtacagccatcttgaaccacaa

SEQ ID NO: 855799 - DNA, 25 bp, Mus musculus
tgagtacaggccagggtcacccgag

SEQ ID NO: 855800 - DNA, 25 bp, Mus musculus
tgagtacaggcctgggtcacccgag

SEQ ID NO: 855801 - DNA, 25 bp, Mus musculus
tgagtacataacctatccttccttg

SEQ ID NO: 855802 - DNA, 25 bp, Mus musculus
tgagtacataacgtatccttccttg

SEQ ID NO: 855803 - DNA, 25 bp, Mus musculus
tgagtacatcagacattgctgtcac

SEQ ID NO: 855804 - DNA, 25 bp, Mus musculus
tgagtacatcagtcattgctgtcac

SEQ ID NO: 855805 - DNA, 25 bp, Mus musculus
tgagtacatggacaggcctatactt

SEQ ID NO: 855806 - DNA, 25 bp, Mus musculus
tgagtacatggagaggcctatactt

SEQ ID NO: 855807 - DNA, 25 bp, Mus musculus
tgagtaccactgctctgggaccagg

SEQ ID NO: 855808 - DNA, 25 bp, Mus musculus
tgagtaccactggtctgggaccagg

SEQ ID NO: 855809 - DNA, 25 bp, Mus musculus
tgagtaccagacaatcccacttaat

SEQ ID NO: 855810 - DNA, 25 bp, Mus musculus
tgagtaccagactatcccacttaat

SEQ ID NO: 855811 - DNA, 25 bp, Mus musculus
tgagtaccagagaaggcagtgagct

SEQ ID NO: 855812 - DNA, 25 bp, Mus musculus
tgagtaccagagtaggcagtgagct

SEQ ID NO: 855813 - DNA, 25 bp, Mus musculus
tgagtaccagatcgcctggcctttt

SEQ ID NO: 855814 - DNA, 25 bp, Mus musculus
tgagtaccagatggcctggcctttt

SEQ ID NO: 855815 - DNA, 25 bp, Mus musculus
tgagtacccacgatgctcctatgaa

SEQ ID NO: 855816 - DNA, 25 bp, Mus musculus
tgagtacccacgttgctcctatgaa

SEQ ID NO: 855817 - DNA, 25 bp, Mus musculus
tgagtaccgcatagttacagcccac

SEQ ID NO: 855818 - DNA, 25 bp, Mus musculus
tgagtaccgcattgttacagcccac

SEQ ID NO: 855819 - DNA, 25 bp, Mus musculus
tgagtaccggctccaaggtcttgtc

SEQ ID NO: 855820 - DNA, 25 bp, Mus musculus
tgagtaccggctgcaaggtcttgtc

SEQ ID NO: 855821 - DNA, 25 bp, Mus musculus
tgagtaccgtccattctgcagaagt

SEQ ID NO: 855822 - DNA, 25 bp, Mus musculus
tgagtaccgtcctttctgcagaagt

SEQ ID NO: 855823 - DNA, 25 bp, Mus musculus
tgagtacctgcaccggagcttcaat

SEQ ID NO: 855824 - DNA, 25 bp, Mus musculus
tgagtacctgcactctttcctggaa

SEQ ID NO: 855825 - DNA, 25 bp, Mus musculus
tgagtacctgcagcggagcttcaat

SEQ ID NO: 855826 - DNA, 25 bp, Mus musculus
tgagtacctgcagtctttcctggaa

SEQ ID NO: 855827 - DNA, 25 bp, Mus musculus
tgagtaccttcaccttgtacctcaa

SEQ ID NO: 855828 - DNA, 25 bp, Mus musculus
tgagtaccttcagcttgtacctcaa

SEQ ID NO: 855829 - DNA, 25 bp, Mus musculus
tgagtactcacactccatcaccagg

SEQ ID NO: 855830 - DNA, 25 bp, Mus musculus
tgagtactcacagtccatcaccagg

SEQ ID NO: 855831 - DNA, 25 bp, Mus musculus
tgagtactcagcaccacttactggt

SEQ ID NO: 855832 - DNA, 25 bp, Mus musculus
tgagtactcagctccacttactggt

SEQ ID NO: 855833 - DNA, 25 bp, Mus musculus
tgagtactgaggcactgacattctt

SEQ ID NO: 855834 - DNA, 25 bp, Mus musculus
tgagtactgagggactgacattctt

SEQ ID NO: 855835 - DNA, 25 bp, Mus musculus
tgagtactgctgaagcctggtatca

SEQ ID NO: 855836 - DNA, 25 bp, Mus musculus
tgagtactgctgtagcctggtatca

SEQ ID NO: 855837 - DNA, 25 bp, Mus musculus
tgagtagaatgtatcgaggcgttta

SEQ ID NO: 855838 - DNA, 25 bp, Mus musculus
tgagtagaatgtttcgaggcgttta

SEQ ID NO: 855839 - DNA, 25 bp, Mus musculus
tgagtagacctcatgctgactgttc

SEQ ID NO: 855840 - DNA, 25 bp, Mus musculus
tgagtagacctcttgctgactgttc

SEQ ID NO: 855841 - DNA, 25 bp, Mus musculus
tgagtagactccagcataccttcag

SEQ ID NO: 855842 - DNA, 25 bp, Mus musculus
tgagtagactcctgcataccttcag

SEQ ID NO: 855843 - DNA, 25 bp, Mus musculus
tgagtagagttcattgtcaatgcac

SEQ ID NO: 855844 - DNA, 25 bp, Mus musculus
tgagtagagttctttgtcaatgcac

SEQ ID NO: 855845 - DNA, 25 bp, Mus musculus
tgagtagatcagaaaagcacctttt

SEQ ID NO: 855846 - DNA, 25 bp, Mus musculus
tgagtagatcagtaaagcacctttt

SEQ ID NO: 855847 - DNA, 25 bp, Mus musculus
tgagtagcaggcatgtctgtggact

SEQ ID NO: 855848 - DNA, 25 bp, Mus musculus
tgagtagcaggcttgtctgtggact

SEQ ID NO: 855849 - DNA, 25 bp, Mus musculus
tgagtagccagcagcatccatctct

SEQ ID NO: 855850 - DNA, 25 bp, Mus musculus
tgagtagccagctgcatccatctct

SEQ ID NO: 855851 - DNA, 25 bp, Mus musculus
tgagtagctactcggctctttctat

SEQ ID NO: 855852 - DNA, 25 bp, Mus musculus
tgagtagctactgggctctttctat

SEQ ID NO: 855853 - DNA, 25 bp, Mus musculus
tgagtagctggccacatctcatccc

SEQ ID NO: 855854 - DNA, 25 bp, Mus musculus
tgagtagctggcgacatctcatccc

SEQ ID NO: 855855 - DNA, 25 bp, Mus musculus
tgagtagctgttctgttatcgccct

SEQ ID NO: 855856 - DNA, 25 bp, Mus musculus
tgagtagctgttgtgttatcgccct

SEQ ID NO: 855857 - DNA, 25 bp, Mus musculus
tgagtaggacagaattccctcaccc

SEQ ID NO: 855858 - DNA, 25 bp, Mus musculus
tgagtaggacagtattccctcaccc

SEQ ID NO: 855859 - DNA, 25 bp, Mus musculus
tgagtagggtaccacccagatcgca

SEQ ID NO: 855860 - DNA, 25 bp, Mus musculus
tgagtagggtacgacccagatcgca

SEQ ID NO: 855861 - DNA, 25 bp, Mus musculus
tgagtagtactaaggttgacctgtg

SEQ ID NO: 855862 - DNA, 25 bp, Mus musculus
tgagtagtactatggttgacctgtg

SEQ ID NO: 855863 - DNA, 25 bp, Mus musculus
tgagtagtactgagcttgcccagca

SEQ ID NO: 855864 - DNA, 25 bp, Mus musculus
tgagtagtactgtgcttgcccagca

SEQ ID NO: 855865 - DNA, 25 bp, Mus musculus
tgagtagtcccaccagccttcgaag

SEQ ID NO: 855866 - DNA, 25 bp, Mus musculus
tgagtagtcccagcagccttcgaag

SEQ ID NO: 855867 - DNA, 25 bp, Mus musculus
tgagtagtgggtcgtccagcccatc

SEQ ID NO: 855868 - DNA, 25 bp, Mus musculus
tgagtagtgggtggtccagcccatc

SEQ ID NO: 855869 - DNA, 25 bp, Mus musculus
tgagtagtgtctaggccccagagca

SEQ ID NO: 855870 - DNA, 25 bp, Mus musculus
tgagtagtgtcttggccccagagca

SEQ ID NO: 855871 - DNA, 25 bp, Mus musculus
tgagtataccaactcgaccaccact

SEQ ID NO: 855872 - DNA, 25 bp, Mus musculus
tgagtataccaagtcgaccaccact

SEQ ID NO: 855873 - DNA, 25 bp, Mus musculus
tgagtataccctaccttttcattgt

SEQ ID NO: 855874 - DNA, 25 bp, Mus musculus
tgagtatacccttccttttcattgt

SEQ ID NO: 855875 - DNA, 25 bp, Mus musculus
tgagtatagtggaaagcctttaatc

SEQ ID NO: 855876 - DNA, 25 bp, Mus musculus
tgagtatagtggtaagcctttaatc

SEQ ID NO: 855877 - DNA, 25 bp, Mus musculus
tgagtatatgctatggtgccatcca

SEQ ID NO: 855878 - DNA, 25 bp, Mus musculus
tgagtatatgctttggtgccatcca

SEQ ID NO: 855879 - DNA, 25 bp, Mus musculus
tgagtatcagaacttccagctcctt

SEQ ID NO: 855880 - DNA, 25 bp, Mus musculus
tgagtatcagaagttccagctcctt

SEQ ID NO: 855881 - DNA, 25 bp, Mus musculus
tgagtatcaggtcttactggatgtc

SEQ ID NO: 855882 - DNA, 25 bp, Mus musculus
tgagtatcaggtgttactggatgtc

SEQ ID NO: 855883 - DNA, 25 bp, Mus musculus
tgagtatccccaaactactgacttg

SEQ ID NO: 855884 - DNA, 25 bp, Mus musculus
tgagtatccccatactactgacttg

SEQ ID NO: 855885 - DNA, 25 bp, Mus musculus
tgagtatcccgtctcccaaggaagc

SEQ ID NO: 855886 - DNA, 25 bp, Mus musculus
tgagtatcccgtgtcccaaggaagc

SEQ ID NO: 855887 - DNA, 25 bp, Mus musculus
tgagtatctgccattgccctaggct

SEQ ID NO: 855888 - DNA, 25 bp, Mus musculus
tgagtatctgcccttgagtcacatt

SEQ ID NO: 855889 - DNA, 25 bp, Mus musculus
tgagtatctgccgttgagtcacatt

SEQ ID NO: 855890 - DNA, 25 bp, Mus musculus
tgagtatctgcctttgccctaggct

SEQ ID NO: 855891 - DNA, 25 bp, Mus musculus
tgagtatcttctctcaggtccagat

SEQ ID NO: 855892 - DNA, 25 bp, Mus musculus
tgagtatcttctgtcaggtccagat

SEQ ID NO: 855893 - DNA, 25 bp, Mus musculus
tgagtatcttggcaaatccctcctg

SEQ ID NO: 855894 - DNA, 25 bp, Mus musculus
tgagtatcttgggaaatccctcctg

SEQ ID NO: 855895 - DNA, 25 bp, Mus musculus
tgagtatgacatcggaatcttacat

SEQ ID NO: 855896 - DNA, 25 bp, Mus musculus
tgagtatgacatgggaatcttacat

SEQ ID NO: 855897 - DNA, 25 bp, Mus musculus
tgagtatgagctagggccaggtcat

SEQ ID NO: 855898 - DNA, 25 bp, Mus musculus
tgagtatgagcttgggccaggtcat

SEQ ID NO: 855899 - DNA, 25 bp, Mus musculus
tgagtatgccaacaagtaccacccc

SEQ ID NO: 855900 - DNA, 25 bp, Mus musculus
tgagtatgccaagaagtaccacccc

SEQ ID NO: 855901 - DNA, 25 bp, Mus musculus
tgagtatgctcaatgtgctccccaa

SEQ ID NO: 855902 - DNA, 25 bp, Mus musculus
tgagtatgctcattgtgctccccaa

SEQ ID NO: 855903 - DNA, 25 bp, Mus musculus
tgagtatggtggcaagtctgcccct

SEQ ID NO: 855904 - DNA, 25 bp, Mus musculus
tgagtatggtgggaagtctgcccct

SEQ ID NO: 855905 - DNA, 25 bp, Mus musculus
tgagtatgtgccctttagcttggtt

SEQ ID NO: 855906 - DNA, 25 bp, Mus musculus
tgagtatgtgccgtttagcttggtt

SEQ ID NO: 855907 - DNA, 25 bp, Mus musculus
tgagtattaaataccaagttcctgt

SEQ ID NO: 855908 - DNA, 25 bp, Mus musculus
tgagtattaaattccaagttcctgt

SEQ ID NO: 855909 - DNA, 25 bp, Mus musculus
tgagtattagctcacccgatgggac

SEQ ID NO: 855910 - DNA, 25 bp, Mus musculus
tgagtattagctgacccgatgggac

SEQ ID NO: 855911 - DNA, 25 bp, Mus musculus
tgagtattcacaccgctttagtctg

SEQ ID NO: 855912 - DNA, 25 bp, Mus musculus
tgagtattcacagcgctttagtctg

SEQ ID NO: 855913 - DNA, 25 bp, Mus musculus
tgagtattgcccaaaaatttaaaga

SEQ ID NO: 855914 - DNA, 25 bp, Mus musculus
tgagtattgccctaaaatttaaaga

SEQ ID NO: 855915 - DNA, 25 bp, Mus musculus
tgagtattgggtatccagcacggct

SEQ ID NO: 855916 - DNA, 25 bp, Mus musculus
tgagtattgggtttccagcacggct

SEQ ID NO: 855917 - DNA, 25 bp, Mus musculus
tgagtatttcctaggtttagttact

SEQ ID NO: 855918 - DNA, 25 bp, Mus musculus
tgagtatttccttggtttagttact

SEQ ID NO: 855919 - DNA, 25 bp, Mus musculus
tgagtatttggtacctcgtttggtg

SEQ ID NO: 855920 - DNA, 25 bp, Mus musculus
tgagtatttggttcctcgtttggtg

SEQ ID NO: 855921 - DNA, 25 bp, Mus musculus
tgagtcaaactccagcaagctaccc

SEQ ID NO: 855922 - DNA, 25 bp, Mus musculus
tgagtcaaactcgagcaagctaccc

SEQ ID NO: 855923 - DNA, 25 bp, Mus musculus
tgagtcaaagcaacgcaggcatccc

SEQ ID NO: 855924 - DNA, 25 bp, Mus musculus
tgagtcaaagcatcgcaggcatccc

SEQ ID NO: 855925 - DNA, 25 bp, Mus musculus
tgagtcaacttactgacccttgggt

SEQ ID NO: 855926 - DNA, 25 bp, Mus musculus
tgagtcaacttagtgacccttgggt

SEQ ID NO: 855927 - DNA, 25 bp, Mus musculus
tgagtcaatttcctatcaccatgcc

SEQ ID NO: 855928 - DNA, 25 bp, Mus musculus
tgagtcaatttcgtatcaccatgcc

SEQ ID NO: 855929 - DNA, 25 bp, Mus musculus
tgagtcacaatcagaggatgccaag

SEQ ID NO: 855930 - DNA, 25 bp, Mus musculus
tgagtcacaatctgaggatgccaag

SEQ ID NO: 855931 - DNA, 25 bp, Mus musculus
tgagtcacactcactttgctgaaag

SEQ ID NO: 855932 - DNA, 25 bp, Mus musculus
tgagtcacactcatcagggaagtgt

SEQ ID NO: 855933 - DNA, 25 bp, Mus musculus
tgagtcacactctctttgctgaaag

SEQ ID NO: 855934 - DNA, 25 bp, Mus musculus
tgagtcacactcttcagggaagtgt

SEQ ID NO: 855935 - DNA, 25 bp, Mus musculus
tgagtcacagatagcttcacacaca

SEQ ID NO: 855936 - DNA, 25 bp, Mus musculus
tgagtcacagattgcttcacacaca

SEQ ID NO: 855937 - DNA, 25 bp, Mus musculus
tgagtcacatttctgggtctttcct

SEQ ID NO: 855938 - DNA, 25 bp, Mus musculus
tgagtcacatttgtgggtctttcct

SEQ ID NO: 855939 - DNA, 25 bp, Mus musculus
tgagtcaccacacactggctcagag

SEQ ID NO: 855940 - DNA, 25 bp, Mus musculus
tgagtcaccacagactggctcagag

SEQ ID NO: 855941 - DNA, 25 bp, Mus musculus
tgagtcaccacgagcgccagcagta

SEQ ID NO: 855942 - DNA, 25 bp, Mus musculus
tgagtcaccacgtgcgccagcagta

SEQ ID NO: 855943 - DNA, 25 bp, Mus musculus
tgagtcaccctaacaccatgggagg

SEQ ID NO: 855944 - DNA, 25 bp, Mus musculus
tgagtcaccctacggctctgtgagg

SEQ ID NO: 855945 - DNA, 25 bp, Mus musculus
tgagtcaccctagggctctgtgagg

SEQ ID NO: 855946 - DNA, 25 bp, Mus musculus
tgagtcaccctatcaccatgggagg

SEQ ID NO: 855947 - DNA, 25 bp, Mus musculus
tgagtcacctttacccgtgcagatt

SEQ ID NO: 855948 - DNA, 25 bp, Mus musculus
tgagtcaccttttcccgtgcagatt

SEQ ID NO: 855949 - DNA, 25 bp, Mus musculus
tgagtcactgaccatgaatcctgga

SEQ ID NO: 855950 - DNA, 25 bp, Mus musculus
tgagtcactgacgatgaatcctgga

SEQ ID NO: 855951 - DNA, 25 bp, Mus musculus
tgagtcactgatcaggaagtaccca

SEQ ID NO: 855952 - DNA, 25 bp, Mus musculus
tgagtcactgatgaggaagtaccca

SEQ ID NO: 855953 - DNA, 25 bp, Mus musculus
tgagtcagagaactccgccgaggtt

SEQ ID NO: 855954 - DNA, 25 bp, Mus musculus
tgagtcagagaagtccgccgaggtt

SEQ ID NO: 855955 - DNA, 25 bp, Mus musculus
tgagtcagatctctgcactccatga

SEQ ID NO: 855956 - DNA, 25 bp, Mus musculus
tgagtcagatctgtgcactccatga

SEQ ID NO: 855957 - DNA, 25 bp, Mus musculus
tgagtcagcaccacagtttgttagg

SEQ ID NO: 855958 - DNA, 25 bp, Mus musculus
tgagtcagcacctcagtttgttagg

SEQ ID NO: 855959 - DNA, 25 bp, Mus musculus
tgagtcagctgacgccgcaaacggt

SEQ ID NO: 855960 - DNA, 25 bp, Mus musculus
tgagtcagctgaggccgcaaacggt

SEQ ID NO: 855961 - DNA, 25 bp, Mus musculus
tgagtcaggtaccagttacccaggc

SEQ ID NO: 855962 - DNA, 25 bp, Mus musculus
tgagtcaggtacgagttacccaggc

SEQ ID NO: 855963 - DNA, 25 bp, Mus musculus
tgagtcagtcacagatggcaaaatt

SEQ ID NO: 855964 - DNA, 25 bp, Mus musculus
tgagtcagtcactgatggcaaaatt

SEQ ID NO: 855965 - DNA, 25 bp, Mus musculus
tgagtcatatttaccttcgccagct

SEQ ID NO: 855966 - DNA, 25 bp, Mus musculus
tgagtcatattttccttcgccagct

SEQ ID NO: 855967 - DNA, 25 bp, Mus musculus
tgagtcatcaacatcgggtccttta

SEQ ID NO: 855968 - DNA, 25 bp, Mus musculus
tgagtcatcaacttcgggtccttta

SEQ ID NO: 855969 - DNA, 25 bp, Mus musculus
tgagtcatcaggagtggattcacca

SEQ ID NO: 855970 - DNA, 25 bp, Mus musculus
tgagtcatcaggtgtggattcacca

SEQ ID NO: 855971 - DNA, 25 bp, Mus musculus
tgagtcatcccaacgacctattagt

SEQ ID NO: 855972 - DNA, 25 bp, Mus musculus
tgagtcatcccatcgacctattagt

SEQ ID NO: 855973 - DNA, 25 bp, Mus musculus
tgagtcatctaaagacctcctctgg

SEQ ID NO: 855974 - DNA, 25 bp, Mus musculus
tgagtcatctaatgacctcctctgg

SEQ ID NO: 855975 - DNA, 25 bp, Mus musculus
tgagtcatcttcctaaccccaatat

SEQ ID NO: 855976 - DNA, 25 bp, Mus musculus
tgagtcatcttcgtaaccccaatat

SEQ ID NO: 855977 - DNA, 25 bp, Mus musculus
tgagtcatttcaccaggccgcaggt

SEQ ID NO: 855978 - DNA, 25 bp, Mus musculus
tgagtcatttcagcaggccgcaggt

SEQ ID NO: 855979 - DNA, 25 bp, Mus musculus
tgagtcatttctctgacccgcattt

SEQ ID NO: 855980 - DNA, 25 bp, Mus musculus
tgagtcatttctgtgacccgcattt

SEQ ID NO: 855981 - DNA, 25 bp, Mus musculus
tgagtccaaaccatcttcactgaaa

SEQ ID NO: 855982 - DNA, 25 bp, Mus musculus
tgagtccaaaccttcttcactgaaa

SEQ ID NO: 855983 - DNA, 25 bp, Mus musculus
tgagtccaagacacagccagttccg

SEQ ID NO: 855984 - DNA, 25 bp, Mus musculus
tgagtccaagactcagccagttccg

SEQ ID NO: 855985 - DNA, 25 bp, Mus musculus
tgagtccaaggaagttccagctctt

SEQ ID NO: 855986 - DNA, 25 bp, Mus musculus
tgagtccaaggatgttccagctctt

SEQ ID NO: 855987 - DNA, 25 bp, Mus musculus
tgagtccacaaacagctgttagaac

SEQ ID NO: 855988 - DNA, 25 bp, Mus musculus
tgagtccacaaacagggaggatttt

SEQ ID NO: 855989 - DNA, 25 bp, Mus musculus
tgagtccacaaagagctgttagaac

SEQ ID NO: 855990 - DNA, 25 bp, Mus musculus
tgagtccacaaagagggaggatttt

SEQ ID NO: 855991 - DNA, 25 bp, Mus musculus
tgagtccacaccctagcctgacaat

SEQ ID NO: 855992 - DNA, 25 bp, Mus musculus
tgagtccacaccgtagcctgacaat

SEQ ID NO: 855993 - DNA, 25 bp, Mus musculus
tgagtccaccagaggcctaatatgt

SEQ ID NO: 855994 - DNA, 25 bp, Mus musculus
tgagtccaccagtggcctaatatgt

SEQ ID NO: 855995 - DNA, 25 bp, Mus musculus
tgagtccacctgagtgcgacctgtg

SEQ ID NO: 855996 - DNA, 25 bp, Mus musculus
tgagtccacctgtgtgcgacctgtg

SEQ ID NO: 855997 - DNA, 25 bp, Mus musculus
tgagtccaggatctcgctaaagcgc

SEQ ID NO: 855998 - DNA, 25 bp, Mus musculus
tgagtccaggatgtcgctaaagcgc

SEQ ID NO: 855999 - DNA, 25 bp, Mus musculus
tgagtccaggctcctatgacacata

SEQ ID NO: 856000 - DNA, 25 bp, Mus musculus
tgagtccaggctgctatgacacata

SEQ ID NO: 856001 - DNA, 25 bp, Mus musculus
tgagtccaggttacagagcctgccc

SEQ ID NO: 856002 - DNA, 25 bp, Mus musculus
tgagtccaggtttcagagcctgccc

SEQ ID NO: 856003 - DNA, 25 bp, Mus musculus
tgagtccagtgacgacccccgtgat

SEQ ID NO: 856004 - DNA, 25 bp, Mus musculus
tgagtccagtgaggacccccgtgat

SEQ ID NO: 856005 - DNA, 25 bp, Mus musculus
tgagtccatcgacgtgccagggtcc

SEQ ID NO: 856006 - DNA, 25 bp, Mus musculus
tgagtccatcgaggtgccagggtcc

SEQ ID NO: 856007 - DNA, 25 bp, Mus musculus
tgagtccatcgccttcattgaagag

SEQ ID NO: 856008 - DNA, 25 bp, Mus musculus
tgagtccatcgcgttcattgaagag

SEQ ID NO: 856009 - DNA, 25 bp, Mus musculus
tgagtccatctcataccttagaaag

SEQ ID NO: 856010 - DNA, 25 bp, Mus musculus
tgagtccatctcttaccttagaaag

SEQ ID NO: 856011 - DNA, 25 bp, Mus musculus
tgagtccatctgacttctggatacc

SEQ ID NO: 856012 - DNA, 25 bp, Mus musculus
tgagtccatctgtcttctggatacc

SEQ ID NO: 856013 - DNA, 25 bp, Mus musculus
tgagtccattgtaagtagtttagct

SEQ ID NO: 856014 - DNA, 25 bp, Mus musculus
tgagtccattgttagtagtttagct

SEQ ID NO: 856015 - DNA, 25 bp, Mus musculus
tgagtcccaaatacagtgccttctt

SEQ ID NO: 856016 - DNA, 25 bp, Mus musculus
tgagtcccaaattcagtgccttctt

SEQ ID NO: 856017 - DNA, 25 bp, Mus musculus
tgagtcccacgaacagttacttacg

SEQ ID NO: 856018 - DNA, 25 bp, Mus musculus
tgagtcccacgatcagttacttacg

SEQ ID NO: 856019 - DNA, 25 bp, Mus musculus
tgagtcccagcaaggaatgagtcct

SEQ ID NO: 856020 - DNA, 25 bp, Mus musculus
tgagtcccagcatggaatgagtcct

SEQ ID NO: 856021 - DNA, 25 bp, Mus musculus
tgagtcccaggaaacacttccagac

SEQ ID NO: 856022 - DNA, 25 bp, Mus musculus
tgagtcccaggaataggtgtacagg

SEQ ID NO: 856023 - DNA, 25 bp, Mus musculus
tgagtcccaggaccatgagtgttta

SEQ ID NO: 856024 - DNA, 25 bp, Mus musculus
tgagtcccaggagcatgagtgttta

SEQ ID NO: 856025 - DNA, 25 bp, Mus musculus
tgagtcccaggatacacttccagac

SEQ ID NO: 856026 - DNA, 25 bp, Mus musculus
tgagtcccaggattaggtgtacagg

SEQ ID NO: 856027 - DNA, 25 bp, Mus musculus
tgagtcccagttatccagcctttga

SEQ ID NO: 856028 - DNA, 25 bp, Mus musculus
tgagtcccagttttccagcctttga

SEQ ID NO: 856029 - DNA, 25 bp, Mus musculus
tgagtcccatgtacagaccccagaa

SEQ ID NO: 856030 - DNA, 25 bp, Mus musculus
tgagtcccatgttcagaccccagaa

SEQ ID NO: 856031 - DNA, 25 bp, Mus musculus
tgagtcccatttccattctgtcaca

SEQ ID NO: 856032 - DNA, 25 bp, Mus musculus
tgagtcccatttgcattctgtcaca

SEQ ID NO: 856033 - DNA, 25 bp, Mus musculus
tgagtccccaacaagactgtgagct

SEQ ID NO: 856034 - DNA, 25 bp, Mus musculus
tgagtccccaactagactgtgagct

SEQ ID NO: 856035 - DNA, 25 bp, Mus musculus
tgagtccccgtacacacactggaag

SEQ ID NO: 856036 - DNA, 25 bp, Mus musculus
tgagtccccgtagacacactggaag

SEQ ID NO: 856037 - DNA, 25 bp, Mus musculus
tgagtcccctaaaacttacaatctt

SEQ ID NO: 856038 - DNA, 25 bp, Mus musculus
tgagtcccctaatacttacaatctt

SEQ ID NO: 856039 - DNA, 25 bp, Mus musculus
tgagtcccctagatacatctgcaga

SEQ ID NO: 856040 - DNA, 25 bp, Mus musculus
tgagtcccctagttacatctgcaga

SEQ ID NO: 856041 - DNA, 25 bp, Mus musculus
tgagtcccctgaagattttgatgag

SEQ ID NO: 856042 - DNA, 25 bp, Mus musculus
tgagtcccctgatgattttgatgag

SEQ ID NO: 856043 - DNA, 25 bp, Mus musculus
tgagtccccttgctgatttattttt

SEQ ID NO: 856044 - DNA, 25 bp, Mus musculus
tgagtccccttggtgatttattttt

SEQ ID NO: 856045 - DNA, 25 bp, Mus musculus
tgagtcccgcagacgcattcgagtg

SEQ ID NO: 856046 - DNA, 25 bp, Mus musculus
tgagtcccgcagtcgcattcgagtg

SEQ ID NO: 856047 - DNA, 25 bp, Mus musculus
tgagtcccgtctaaaggaaaagcgt

SEQ ID NO: 856048 - DNA, 25 bp, Mus musculus
tgagtcccgtcttaaggaaaagcgt

SEQ ID NO: 856049 - DNA, 25 bp, Mus musculus
tgagtcccgtgccattgcctgtgtg

SEQ ID NO: 856050 - DNA, 25 bp, Mus musculus
tgagtcccgtgcgattgcctgtgtg

SEQ ID NO: 856051 - DNA, 25 bp, Mus musculus
tgagtccctacacagtaaacacttg

SEQ ID NO: 856052 - DNA, 25 bp, Mus musculus
tgagtccctacagagtaaacacttg

SEQ ID NO: 856053 - DNA, 25 bp, Mus musculus
tgagtccctcttagcctgtccaggg

SEQ ID NO: 856054 - DNA, 25 bp, Mus musculus
tgagtccctctttgcctgtccaggg

SEQ ID NO: 856055 - DNA, 25 bp, Mus musculus
tgagtccctggcagaagtccctggt

SEQ ID NO: 856056 - DNA, 25 bp, Mus musculus
tgagtccctggctgaagtccctggt

SEQ ID NO: 856057 - DNA, 25 bp, Mus musculus
tgagtcccttcaacttggtacctga

SEQ ID NO: 856058 - DNA, 25 bp, Mus musculus
tgagtcccttcatcttggtacctga

SEQ ID NO: 856059 - DNA, 25 bp, Mus musculus
tgagtcccttgtctctggacaggca

SEQ ID NO: 856060 - DNA, 25 bp, Mus musculus
tgagtcccttgtgtctggacaggca

SEQ ID NO: 856061 - DNA, 25 bp, Mus musculus
tgagtccgcagcataaactctgtgt

SEQ ID NO: 856062 - DNA, 25 bp, Mus musculus
tgagtccgcagcttaaactctgtgt

SEQ ID NO: 856063 - DNA, 25 bp, Mus musculus
tgagtcctaccaactatcacaagaa

SEQ ID NO: 856064 - DNA, 25 bp, Mus musculus
tgagtcctaccatctatcacaagaa

SEQ ID NO: 856065 - DNA, 25 bp, Mus musculus
tgagtcctcaataaggacctggccc

SEQ ID NO: 856066 - DNA, 25 bp, Mus musculus
tgagtcctcaattaggacctggccc

SEQ ID NO: 856067 - DNA, 25 bp, Mus musculus
tgagtcctcagaagcgggttcactt

SEQ ID NO: 856068 - DNA, 25 bp, Mus musculus
tgagtcctcagatgcgggttcactt

SEQ ID NO: 856069 - DNA, 25 bp, Mus musculus
tgagtcctccagagtttcaagttcc

SEQ ID NO: 856070 - DNA, 25 bp, Mus musculus
tgagtcctccagtgtttcaagttcc

SEQ ID NO: 856071 - DNA, 25 bp, Mus musculus
tgagtcctcccaccaacactgtgtg

SEQ ID NO: 856072 - DNA, 25 bp, Mus musculus
tgagtcctcccagcaacactgtgtg

SEQ ID NO: 856073 - DNA, 25 bp, Mus musculus
tgagtcctccccagatgttagttgt

SEQ ID NO: 856074 - DNA, 25 bp, Mus musculus
tgagtcctcccctgatgttagttgt

SEQ ID NO: 856075 - DNA, 25 bp, Mus musculus
tgagtcctcggaactaactaaaaca

SEQ ID NO: 856076 - DNA, 25 bp, Mus musculus
tgagtcctcggatctaactaaaaca

SEQ ID NO: 856077 - DNA, 25 bp, Mus musculus
tgagtcctctatactgggcaagccg

SEQ ID NO: 856078 - DNA, 25 bp, Mus musculus
tgagtcctctattctgggcaagccg

SEQ ID NO: 856079 - DNA, 25 bp, Mus musculus
tgagtcctctcgctagatataccta

SEQ ID NO: 856080 - DNA, 25 bp, Mus musculus
tgagtcctctcggtagatataccta

SEQ ID NO: 856081 - DNA, 25 bp, Mus musculus
tgagtcctctgaatctgagtctgat

SEQ ID NO: 856082 - DNA, 25 bp, Mus musculus
tgagtcctctgattctgagtctgat

SEQ ID NO: 856083 - DNA, 25 bp, Mus musculus
tgagtcctgaggagcggtgacccaa

SEQ ID NO: 856084 - DNA, 25 bp, Mus musculus
tgagtcctgaggctccagcttgcag

SEQ ID NO: 856085 - DNA, 25 bp, Mus musculus
tgagtcctgagggtccagcttgcag

SEQ ID NO: 856086 - DNA, 25 bp, Mus musculus
tgagtcctgaggtgcggtgacccaa

SEQ ID NO: 856087 - DNA, 25 bp, Mus musculus
tgagtcctggatacataatatgccc

SEQ ID NO: 856088 - DNA, 25 bp, Mus musculus
tgagtcctggattcataatatgccc

SEQ ID NO: 856089 - DNA, 25 bp, Mus musculus
tgagtcctgtttcagtccagagagt

SEQ ID NO: 856090 - DNA, 25 bp, Mus musculus
tgagtcctgtttgagtccagagagt

SEQ ID NO: 856091 - DNA, 25 bp, Mus musculus
tgagtccttaccagtttcgggcgac

SEQ ID NO: 856092 - DNA, 25 bp, Mus musculus
tgagtccttacctgtttcgggcgac

SEQ ID NO: 856093 - DNA, 25 bp, Mus musculus
tgagtccttgtacatatttctgtgt

SEQ ID NO: 856094 - DNA, 25 bp, Mus musculus
tgagtccttgtagatatttctgtgt

SEQ ID NO: 856095 - DNA, 25 bp, Mus musculus
tgagtccttttacaacaccttttcg

SEQ ID NO: 856096 - DNA, 25 bp, Mus musculus
tgagtccttttagaacaccttttcg

SEQ ID NO: 856097 - DNA, 25 bp, Mus musculus
tgagtcgagcagagtggccaaacct

SEQ ID NO: 856098 - DNA, 25 bp, Mus musculus
tgagtcgagcagtgtggccaaacct

SEQ ID NO: 856099 - DNA, 25 bp, Mus musculus
tgagtcgcagctaaccaaggccata

SEQ ID NO: 856100 - DNA, 25 bp, Mus musculus
tgagtcgcagcttaccaaggccata

SEQ ID NO: 856101 - DNA, 25 bp, Mus musculus
tgagtcgctcttagctcagagctga

SEQ ID NO: 856102 - DNA, 25 bp, Mus musculus
tgagtcgctctttgctcagagctga

SEQ ID NO: 856103 - DNA, 25 bp, Mus musculus
tgagtcgtcagcatgatcccttcaa

SEQ ID NO: 856104 - DNA, 25 bp, Mus musculus
tgagtcgtcagcttgatcccttcaa

SEQ ID NO: 856105 - DNA, 25 bp, Mus musculus
tgagtcgttacacagtgagcatgct

SEQ ID NO: 856106 - DNA, 25 bp, Mus musculus
tgagtcgttacagagtgagcatgct

SEQ ID NO: 856107 - DNA, 25 bp, Mus musculus
tgagtcgtttcaccacagccatctt

SEQ ID NO: 856108 - DNA, 25 bp, Mus musculus
tgagtcgtttcagcacagccatctt

SEQ ID NO: 856109 - DNA, 25 bp, Mus musculus
tgagtctaacaaatgcttcccctgc

SEQ ID NO: 856110 - DNA, 25 bp, Mus musculus
tgagtctaacaattgcttcccctgc

SEQ ID NO: 856111 - DNA, 25 bp, Mus musculus
tgagtctaagacagttggcaaccga

SEQ ID NO: 856112 - DNA, 25 bp, Mus musculus
tgagtctaagactgttggcaaccga

SEQ ID NO: 856113 - DNA, 25 bp, Mus musculus
tgagtctactacacaggtccaatgc

SEQ ID NO: 856114 - DNA, 25 bp, Mus musculus
tgagtctactactcaggtccaatgc

SEQ ID NO: 856115 - DNA, 25 bp, Mus musculus
tgagtctagtttaattaaccagtac

SEQ ID NO: 856116 - DNA, 25 bp, Mus musculus
tgagtctagttttattaaccagtac

SEQ ID NO: 856117 - DNA, 25 bp, Mus musculus
tgagtctatattaccgtcagcgaga

SEQ ID NO: 856118 - DNA, 25 bp, Mus musculus
tgagtctatatttccgtcagcgaga

SEQ ID NO: 856119 - DNA, 25 bp, Mus musculus
tgagtctattccctgcgacgttgcg

SEQ ID NO: 856120 - DNA, 25 bp, Mus musculus
tgagtctattccgtgcgacgttgcg

SEQ ID NO: 856121 - DNA, 25 bp, Mus musculus
tgagtctcacatacagctcttactg

SEQ ID NO: 856122 - DNA, 25 bp, Mus musculus
tgagtctcacattcagctcttactg

SEQ ID NO: 856123 - DNA, 25 bp, Mus musculus
tgagtctcagccactaggcgaggtg

SEQ ID NO: 856124 - DNA, 25 bp, Mus musculus
tgagtctcagcctctaggcgaggtg

SEQ ID NO: 856125 - DNA, 25 bp, Mus musculus
tgagtctcatgaatctggatacccc

SEQ ID NO: 856126 - DNA, 25 bp, Mus musculus
tgagtctcatgattctggatacccc

SEQ ID NO: 856127 - DNA, 25 bp, Mus musculus
tgagtctcattgctccttaggagga

SEQ ID NO: 856128 - DNA, 25 bp, Mus musculus
tgagtctcattggtccttaggagga

SEQ ID NO: 856129 - DNA, 25 bp, Mus musculus
tgagtctcccgcaaagcatgcaggg

SEQ ID NO: 856130 - DNA, 25 bp, Mus musculus
tgagtctcccgctaagcatgcaggg

SEQ ID NO: 856131 - DNA, 25 bp, Mus musculus
tgagtctcctaaccgaagaaaaggg

SEQ ID NO: 856132 - DNA, 25 bp, Mus musculus
tgagtctcctaagcgaagaaaaggg

SEQ ID NO: 856133 - DNA, 25 bp, Mus musculus
tgagtctctaggaggtttctccatt

SEQ ID NO: 856134 - DNA, 25 bp, Mus musculus
tgagtctctaggtggtttctccatt

SEQ ID NO: 856135 - DNA, 25 bp, Mus musculus
tgagtctctggacgcgatagcacct

SEQ ID NO: 856136 - DNA, 25 bp, Mus musculus
tgagtctctggaggcgatagcacct

SEQ ID NO: 856137 - DNA, 25 bp, Mus musculus
tgagtctgaaatcccttccgagccg

SEQ ID NO: 856138 - DNA, 25 bp, Mus musculus
tgagtctgaaatgccttccgagccg

SEQ ID NO: 856139 - DNA, 25 bp, Mus musculus
tgagtctgagggactctatgttccc

SEQ ID NO: 856140 - DNA, 25 bp, Mus musculus
tgagtctgagggtctctatgttccc

SEQ ID NO: 856141 - DNA, 25 bp, Mus musculus
tgagtctgcgagcagtagctccagt

SEQ ID NO: 856142 - DNA, 25 bp, Mus musculus
tgagtctgcgaggagtagctccagt

SEQ ID NO: 856143 - DNA, 25 bp, Mus musculus
tgagtctgggaacaaaactttttct

SEQ ID NO: 856144 - DNA, 25 bp, Mus musculus
tgagtctgggaagaaaactttttct

SEQ ID NO: 856145 - DNA, 25 bp, Mus musculus
tgagtctgtagactgtgatcccctc

SEQ ID NO: 856146 - DNA, 25 bp, Mus musculus
tgagtctgtagagtgtgatcccctc

SEQ ID NO: 856147 - DNA, 25 bp, Mus musculus
tgagtctgtatgaccccatccctga

SEQ ID NO: 856148 - DNA, 25 bp, Mus musculus
tgagtctgtatgtccccatccctga

SEQ ID NO: 856149 - DNA, 25 bp, Mus musculus
tgagtctgtcttccaattcaagcct

SEQ ID NO: 856150 - DNA, 25 bp, Mus musculus
tgagtctgtcttgcaattcaagcct

SEQ ID NO: 856151 - DNA, 25 bp, Mus musculus
tgagtctgtgacagatgaggccatc

SEQ ID NO: 856152 - DNA, 25 bp, Mus musculus
tgagtctgtgactgatgaggccatc

SEQ ID NO: 856153 - DNA, 25 bp, Mus musculus
tgagtctgtggcactcgtcttctga

SEQ ID NO: 856154 - DNA, 25 bp, Mus musculus
tgagtctgtggctctcgtcttctga

SEQ ID NO: 856155 - DNA, 25 bp, Mus musculus
tgagtctgtgtgatatcatgagaac

SEQ ID NO: 856156 - DNA, 25 bp, Mus musculus
tgagtctgtgtgttatcatgagaac

SEQ ID NO: 856157 - DNA, 25 bp, Mus musculus
tgagtctgttgtcacaccagggtgt

SEQ ID NO: 856158 - DNA, 25 bp, Mus musculus
tgagtctgttgtgacaccagggtgt

SEQ ID NO: 856159 - DNA, 25 bp, Mus musculus
tgagtctgttttcccgtatagaact

SEQ ID NO: 856160 - DNA, 25 bp, Mus musculus
tgagtctgttttgccgtatagaact

SEQ ID NO: 856161 - DNA, 25 bp, Mus musculus
tgagtcttaccgaacaaactttcca

SEQ ID NO: 856162 - DNA, 25 bp, Mus musculus
tgagtcttaccgtacaaactttcca

SEQ ID NO: 856163 - DNA, 25 bp, Mus musculus
tgagtcttccctcctggttctgtat

SEQ ID NO: 856164 - DNA, 25 bp, Mus musculus
tgagtcttccctgctggttctgtat

SEQ ID NO: 856165 - DNA, 25 bp, Mus musculus
tgagtcttcctccatggtagtacat

SEQ ID NO: 856166 - DNA, 25 bp, Mus musculus
tgagtcttcctcgatggtagtacat

SEQ ID NO: 856167 - DNA, 25 bp, Mus musculus
tgagtcttcgacagtatggcgcctg

SEQ ID NO: 856168 - DNA, 25 bp, Mus musculus
tgagtcttcgactgtatggcgcctg

SEQ ID NO: 856169 - DNA, 25 bp, Mus musculus
tgagtcttctgcctgggtccactaa

SEQ ID NO: 856170 - DNA, 25 bp, Mus musculus
tgagtcttctgcgtgggtccactaa

SEQ ID NO: 856171 - DNA, 25 bp, Mus musculus
tgagtcttctttattgctttccacc

SEQ ID NO: 856172 - DNA, 25 bp, Mus musculus
tgagtcttcttttttgctttccacc

SEQ ID NO: 856173 - DNA, 25 bp, Mus musculus
tgagtcttgaaacccagtatttgga

SEQ ID NO: 856174 - DNA, 25 bp, Mus musculus
tgagtcttgaaagccagtatttgga

SEQ ID NO: 856175 - DNA, 25 bp, Mus musculus
tgagtcttgaagacggcagatgcaa

SEQ ID NO: 856176 - DNA, 25 bp, Mus musculus
tgagtcttgaagtcggcagatgcaa

SEQ ID NO: 856177 - DNA, 25 bp, Mus musculus
tgagtctttcatcgcctccaggtgc

SEQ ID NO: 856178 - DNA, 25 bp, Mus musculus
tgagtctttcatggcctccaggtgc

SEQ ID NO: 856179 - DNA, 25 bp, Mus musculus
tgagtctttgaaaccatcttcccca

SEQ ID NO: 856180 - DNA, 25 bp, Mus musculus
tgagtctttgaatccatcttcccca

SEQ ID NO: 856181 - DNA, 25 bp, Mus musculus
tgagtctttgatcgcagctcatgtc

SEQ ID NO: 856182 - DNA, 25 bp, Mus musculus
tgagtctttgatggcagctcatgtc

SEQ ID NO: 856183 - DNA, 25 bp, Mus musculus
tgagtgaaatttccctgctcctggc

SEQ ID NO: 856184 - DNA, 25 bp, Mus musculus
tgagtgaaatttgcctgctcctggc

SEQ ID NO: 856185 - DNA, 25 bp, Mus musculus
tgagtgaaccatctcacatctggct

SEQ ID NO: 856186 - DNA, 25 bp, Mus musculus
tgagtgaaccatgtcacatctggct

SEQ ID NO: 856187 - DNA, 25 bp, Mus musculus
tgagtgaagaccactgactgcccag

SEQ ID NO: 856188 - DNA, 25 bp, Mus musculus
tgagtgaagacctctgactgcccag

SEQ ID NO: 856189 - DNA, 25 bp, Mus musculus
tgagtgaatttgcaccccaaaggct

SEQ ID NO: 856190 - DNA, 25 bp, Mus musculus
tgagtgaatttggaccccaaaggct

SEQ ID NO: 856191 - DNA, 25 bp, Mus musculus
tgagtgacagaccatgtgttcaggt

SEQ ID NO: 856192 - DNA, 25 bp, Mus musculus
tgagtgacagacgatgtgttcaggt

SEQ ID NO: 856193 - DNA, 25 bp, Mus musculus
tgagtgacagctccctacaatgtac

SEQ ID NO: 856194 - DNA, 25 bp, Mus musculus
tgagtgacagctgcctacaatgtac

SEQ ID NO: 856195 - DNA, 25 bp, Mus musculus
tgagtgacaggacggtgctggtttt

SEQ ID NO: 856196 - DNA, 25 bp, Mus musculus
tgagtgacaggagggtgctggtttt

SEQ ID NO: 856197 - DNA, 25 bp, Mus musculus
tgagtgaccaggacagtggccctgc

SEQ ID NO: 856198 - DNA, 25 bp, Mus musculus
tgagtgaccaggtcagtggccctgc

SEQ ID NO: 856199 - DNA, 25 bp, Mus musculus
tgagtgacccggcaatgtttctttt

SEQ ID NO: 856200 - DNA, 25 bp, Mus musculus
tgagtgacccgggaatgtttctttt

SEQ ID NO: 856201 - DNA, 25 bp, Mus musculus
tgagtgaccctgagcacacgtggta

SEQ ID NO: 856202 - DNA, 25 bp, Mus musculus
tgagtgaccctgtgcacacgtggta

SEQ ID NO: 856203 - DNA, 25 bp, Mus musculus
tgagtgacccttacctagaaacaag

SEQ ID NO: 856204 - DNA, 25 bp, Mus musculus
tgagtgaccctttcctagaaacaag

SEQ ID NO: 856205 - DNA, 25 bp, Mus musculus
tgagtgaccggcactctgcaaggac

SEQ ID NO: 856206 - DNA, 25 bp, Mus musculus
tgagtgaccggctctctgcaaggac

SEQ ID NO: 856207 - DNA, 25 bp, Mus musculus
tgagtgacctccaatttccttaatt

SEQ ID NO: 856208 - DNA, 25 bp, Mus musculus
tgagtgacctcctatttccttaatt

SEQ ID NO: 856209 - DNA, 25 bp, Mus musculus
tgagtgacgagaccctgcgttcttc

SEQ ID NO: 856210 - DNA, 25 bp, Mus musculus
tgagtgacgagagcctgcgttcttc

SEQ ID NO: 856211 - DNA, 25 bp, Mus musculus
tgagtgacgccaagcatctgtgtgt

SEQ ID NO: 856212 - DNA, 25 bp, Mus musculus
tgagtgacgccatgcatctgtgtgt

SEQ ID NO: 856213 - DNA, 25 bp, Mus musculus
tgagtgacggaaatccagagctcct

SEQ ID NO: 856214 - DNA, 25 bp, Mus musculus
tgagtgacggaattccagagctcct

SEQ ID NO: 856215 - DNA, 25 bp, Mus musculus
tgagtgacgtacaggacatacgttg

SEQ ID NO: 856216 - DNA, 25 bp, Mus musculus
tgagtgacgtactggacatacgttg

SEQ ID NO: 856217 - DNA, 25 bp, Mus musculus
tgagtgactggtacaagcctgctgt

SEQ ID NO: 856218 - DNA, 25 bp, Mus musculus
tgagtgactggttcaagcctgctgt

SEQ ID NO: 856219 - DNA, 25 bp, Mus musculus
tgagtgactgttagttcctctgctt

SEQ ID NO: 856220 - DNA, 25 bp, Mus musculus
tgagtgactgtttgttcctctgctt

SEQ ID NO: 856221 - DNA, 25 bp, Mus musculus
tgagtgacttaccttctgcttgtcc

SEQ ID NO: 856222 - DNA, 25 bp, Mus musculus
tgagtgacttacgttctgcttgtcc

SEQ ID NO: 856223 - DNA, 25 bp, Mus musculus
tgagtgagaatcagctcagtaagta

SEQ ID NO: 856224 - DNA, 25 bp, Mus musculus
tgagtgagaatctgctcagtaagta

SEQ ID NO: 856225 - DNA, 25 bp, Mus musculus
tgagtgagaccaaccagatgcaggt

SEQ ID NO: 856226 - DNA, 25 bp, Mus musculus
tgagtgagaccatccagatgcaggt

SEQ ID NO: 856227 - DNA, 25 bp, Mus musculus
tgagtgagatcaatggccgagacct

SEQ ID NO: 856228 - DNA, 25 bp, Mus musculus
tgagtgagatcattggccgagacct

SEQ ID NO: 856229 - DNA, 25 bp, Mus musculus
tgagtgagcagcagaagccacgagt

SEQ ID NO: 856230 - DNA, 25 bp, Mus musculus
tgagtgagcagctgaagccacgagt

SEQ ID NO: 856231 - DNA, 25 bp, Mus musculus
tgagtgagcgctatctctttcctct

SEQ ID NO: 856232 - DNA, 25 bp, Mus musculus
tgagtgagcgctttctctttcctct

SEQ ID NO: 856233 - DNA, 25 bp, Mus musculus
tgagtgagcggccaacttgccccga

SEQ ID NO: 856234 - DNA, 25 bp, Mus musculus
tgagtgagcggcgaacttgccccga

SEQ ID NO: 856235 - DNA, 25 bp, Mus musculus
tgagtgagctccctgaggacttctt

SEQ ID NO: 856236 - DNA, 25 bp, Mus musculus
tgagtgagctccgtgaggacttctt

SEQ ID NO: 856237 - DNA, 25 bp, Mus musculus
tgagtgaggcagacagtccacatca

SEQ ID NO: 856238 - DNA, 25 bp, Mus musculus
tgagtgaggcagtcagtccacatca

SEQ ID NO: 856239 - DNA, 25 bp, Mus musculus
tgagtgaggcctcactttgtttctt

SEQ ID NO: 856240 - DNA, 25 bp, Mus musculus
tgagtgaggcctgactttgtttctt

SEQ ID NO: 856241 - DNA, 25 bp, Mus musculus
tgagtgagtagtctcagcctgctgt

SEQ ID NO: 856242 - DNA, 25 bp, Mus musculus
tgagtgagtagtgtcagcctgctgt

SEQ ID NO: 856243 - DNA, 25 bp, Mus musculus
tgagtgagtcacagatgtactatga

SEQ ID NO: 856244 - DNA, 25 bp, Mus musculus
tgagtgagtcactgatgtactatga

SEQ ID NO: 856245 - DNA, 25 bp, Mus musculus
tgagtgagtggcattccgatgttct

SEQ ID NO: 856246 - DNA, 25 bp, Mus musculus
tgagtgagtggctttccgatgttct

SEQ ID NO: 856247 - DNA, 25 bp, Mus musculus
tgagtgatcactcctaaacaactgc

SEQ ID NO: 856248 - DNA, 25 bp, Mus musculus
tgagtgatcactgctaaacaactgc

SEQ ID NO: 856249 - DNA, 25 bp, Mus musculus
tgagtgatcattatctgccgtacca

SEQ ID NO: 856250 - DNA, 25 bp, Mus musculus
tgagtgatcattttctgccgtacca

SEQ ID NO: 856251 - DNA, 25 bp, Mus musculus
tgagtgatccccagtgaatccgtgt

SEQ ID NO: 856252 - DNA, 25 bp, Mus musculus
tgagtgatcccctgtgaatccgtgt

SEQ ID NO: 856253 - DNA, 25 bp, Mus musculus
tgagtgatctacagccatggcctga

SEQ ID NO: 856254 - DNA, 25 bp, Mus musculus
tgagtgatctactgccatggcctga

SEQ ID NO: 856255 - DNA, 25 bp, Mus musculus
tgagtgatggacatccgacttgcct

SEQ ID NO: 856256 - DNA, 25 bp, Mus musculus
tgagtgatggacttccgacttgcct

SEQ ID NO: 856257 - DNA, 25 bp, Mus musculus
tgagtgatgttcaccgtctaatcgg

SEQ ID NO: 856258 - DNA, 25 bp, Mus musculus
tgagtgatgttctccgtctaatcgg

SEQ ID NO: 856259 - DNA, 25 bp, Mus musculus
tgagtgatttctccctctaatcgca

SEQ ID NO: 856260 - DNA, 25 bp, Mus musculus
tgagtgatttctgcctctaatcgca

SEQ ID NO: 856261 - DNA, 25 bp, Mus musculus
tgagtgatttttctccggcatctag

SEQ ID NO: 856262 - DNA, 25 bp, Mus musculus
tgagtgatttttgtccggcatctag

SEQ ID NO: 856263 - DNA, 25 bp, Mus musculus
tgagtgcaacacagagcccttactg

SEQ ID NO: 856264 - DNA, 25 bp, Mus musculus
tgagtgcaacactgagcccttactg

SEQ ID NO: 856265 - DNA, 25 bp, Mus musculus
tgagtgcaaccccatagcttatgtc

SEQ ID NO: 856266 - DNA, 25 bp, Mus musculus
tgagtgcaacccgatagcttatgtc

SEQ ID NO: 856267 - DNA, 25 bp, Mus musculus
tgagtgcaagtcacttttctccttc

SEQ ID NO: 856268 - DNA, 25 bp, Mus musculus
tgagtgcaagtctcttttctccttc

SEQ ID NO: 856269 - DNA, 25 bp, Mus musculus
tgagtgcacacacttcgatgggaaa

SEQ ID NO: 856270 - DNA, 25 bp, Mus musculus
tgagtgcacacagttcgatgggaaa

SEQ ID NO: 856271 - DNA, 25 bp, Mus musculus
tgagtgcacattctctctgtgggca

SEQ ID NO: 856272 - DNA, 25 bp, Mus musculus
tgagtgcacattgtctctgtgggca

SEQ ID NO: 856273 - DNA, 25 bp, Mus musculus
tgagtgcactcaactaaaggaaaaa

SEQ ID NO: 856274 - DNA, 25 bp, Mus musculus
tgagtgcactcatctaaaggaaaaa

SEQ ID NO: 856275 - DNA, 25 bp, Mus musculus
tgagtgcagctcagttttcttccat

SEQ ID NO: 856276 - DNA, 25 bp, Mus musculus
tgagtgcagctctgttttcttccat

SEQ ID NO: 856277 - DNA, 25 bp, Mus musculus
tgagtgcaggccaccagctggagag

SEQ ID NO: 856278 - DNA, 25 bp, Mus musculus
tgagtgcaggcctccagctggagag

SEQ ID NO: 856279 - DNA, 25 bp, Mus musculus
tgagtgcagggcaaggcgctctccc

SEQ ID NO: 856280 - DNA, 25 bp, Mus musculus
tgagtgcagggctaggcgctctccc

SEQ ID NO: 856281 - DNA, 25 bp, Mus musculus
tgagtgcaggttatcctggtgacaa

SEQ ID NO: 856282 - DNA, 25 bp, Mus musculus
tgagtgcaggttttcctggtgacaa

SEQ ID NO: 856283 - DNA, 25 bp, Mus musculus
tgagtgcatcagcactcacaccaca

SEQ ID NO: 856284 - DNA, 25 bp, Mus musculus
tgagtgcatcaggactcacaccaca

SEQ ID NO: 856285 - DNA, 25 bp, Mus musculus
tgagtgcatctcaggagtgccttac

SEQ ID NO: 856286 - DNA, 25 bp, Mus musculus
tgagtgcatctctggagtgccttac

SEQ ID NO: 856287 - DNA, 25 bp, Mus musculus
tgagtgcatcttcagaacctttcct

SEQ ID NO: 856288 - DNA, 25 bp, Mus musculus
tgagtgcatcttgagaacctttcct

SEQ ID NO: 856289 - DNA, 25 bp, Mus musculus
tgagtgcattctccatggatttgcc

SEQ ID NO: 856290 - DNA, 25 bp, Mus musculus
tgagtgcattctgcatggatttgcc

SEQ ID NO: 856291 - DNA, 25 bp, Mus musculus
tgagtgccaagaatatacatgctac

SEQ ID NO: 856292 - DNA, 25 bp, Mus musculus
tgagtgccaagattatacatgctac

SEQ ID NO: 856293 - DNA, 25 bp, Mus musculus
tgagtgccaaggacctgaaagaaaa

SEQ ID NO: 856294 - DNA, 25 bp, Mus musculus
tgagtgccaaggtcctgaaagaaaa

SEQ ID NO: 856295 - DNA, 25 bp, Mus musculus
tgagtgccagaacctgtctccatgg

SEQ ID NO: 856296 - DNA, 25 bp, Mus musculus
tgagtgccagaagctgtctccatgg

SEQ ID NO: 856297 - DNA, 25 bp, Mus musculus
tgagtgccaggccttgcatccagac

SEQ ID NO: 856298 - DNA, 25 bp, Mus musculus
tgagtgccaggcgttgcatccagac

SEQ ID NO: 856299 - DNA, 25 bp, Mus musculus
tgagtgccatgtctgggcaactcct

SEQ ID NO: 856300 - DNA, 25 bp, Mus musculus
tgagtgccatgtgtgggcaactcct

SEQ ID NO: 856301 - DNA, 25 bp, Mus musculus
tgagtgcccacacactttcagccag

SEQ ID NO: 856302 - DNA, 25 bp, Mus musculus
tgagtgcccacaccagagcaagtgt

SEQ ID NO: 856303 - DNA, 25 bp, Mus musculus
tgagtgcccacagactttcagccag

SEQ ID NO: 856304 - DNA, 25 bp, Mus musculus
tgagtgcccacagcagagcaagtgt

SEQ ID NO: 856305 - DNA, 25 bp, Mus musculus
tgagtgcccagccacccttgttcat

SEQ ID NO: 856306 - DNA, 25 bp, Mus musculus
tgagtgcccagcgacccttgttcat

SEQ ID NO: 856307 - DNA, 25 bp, Mus musculus
tgagtgcccgggatgctcggcttaa

SEQ ID NO: 856308 - DNA, 25 bp, Mus musculus
tgagtgcccgggttgctcggcttaa

SEQ ID NO: 856309 - DNA, 25 bp, Mus musculus
tgagtgccctaacttgtcagcccaa

SEQ ID NO: 856310 - DNA, 25 bp, Mus musculus
tgagtgccctaagttgtcagcccaa

SEQ ID NO: 856311 - DNA, 25 bp, Mus musculus
tgagtgccgaccagaggtacctctg

SEQ ID NO: 856312 - DNA, 25 bp, Mus musculus
tgagtgccgacctgaggtacctctg

SEQ ID NO: 856313 - DNA, 25 bp, Mus musculus
tgagtgcctaccaccgtggaccaca

SEQ ID NO: 856314 - DNA, 25 bp, Mus musculus
tgagtgcctaccagagccaggccta

SEQ ID NO: 856315 - DNA, 25 bp, Mus musculus
tgagtgcctacctccgtggaccaca

SEQ ID NO: 856316 - DNA, 25 bp, Mus musculus
tgagtgcctacctgagccaggccta

SEQ ID NO: 856317 - DNA, 25 bp, Mus musculus
tgagtgcctcacaagtgggctgctg

SEQ ID NO: 856318 - DNA, 25 bp, Mus musculus
tgagtgcctcactagtgggctgctg

SEQ ID NO: 856319 - DNA, 25 bp, Mus musculus
tgagtgcctcccagtgagctcagac

SEQ ID NO: 856320 - DNA, 25 bp, Mus musculus
tgagtgcctccctgtgagctcagac

SEQ ID NO: 856321 - DNA, 25 bp, Mus musculus
tgagtgcctctgaggtcccatacag

SEQ ID NO: 856322 - DNA, 25 bp, Mus musculus
tgagtgcctctgtggtcccatacag

SEQ ID NO: 856323 - DNA, 25 bp, Mus musculus
tgagtgcgagtgaccctggccgact

SEQ ID NO: 856324 - DNA, 25 bp, Mus musculus
tgagtgcgagtgtccctggccgact

SEQ ID NO: 856325 - DNA, 25 bp, Mus musculus
tgagtgcgtcatcgccatctctcat

SEQ ID NO: 856326 - DNA, 25 bp, Mus musculus
tgagtgcgtcatggccatctctcat

SEQ ID NO: 856327 - DNA, 25 bp, Mus musculus
tgagtgcgtgtgagatctgtgccat

SEQ ID NO: 856328 - DNA, 25 bp, Mus musculus
tgagtgcgtgtgtgatctgtgccat

SEQ ID NO: 856329 - DNA, 25 bp, Mus musculus
tgagtgctcaccacatagctgagaa

SEQ ID NO: 856330 - DNA, 25 bp, Mus musculus
tgagtgctcacccaattccaaagaa

SEQ ID NO: 856331 - DNA, 25 bp, Mus musculus
tgagtgctcaccgaattccaaagaa

SEQ ID NO: 856332 - DNA, 25 bp, Mus musculus
tgagtgctcacctcatagctgagaa

SEQ ID NO: 856333 - DNA, 25 bp, Mus musculus
tgagtgctcaggcagctagctgtaa

SEQ ID NO: 856334 - DNA, 25 bp, Mus musculus
tgagtgctcagggagctagctgtaa

SEQ ID NO: 856335 - DNA, 25 bp, Mus musculus
tgagtgctcgctatcccagggatct

SEQ ID NO: 856336 - DNA, 25 bp, Mus musculus
tgagtgctcgctttcccagggatct

SEQ ID NO: 856337 - DNA, 25 bp, Mus musculus
tgagtgctcggcaacttcacgactt

SEQ ID NO: 856338 - DNA, 25 bp, Mus musculus
tgagtgctcggctacttcacgactt

SEQ ID NO: 856339 - DNA, 25 bp, Mus musculus
tgagtgctctcacgaacttctcaga

SEQ ID NO: 856340 - DNA, 25 bp, Mus musculus
tgagtgctctcaggaacttctcaga

SEQ ID NO: 856341 - DNA, 25 bp, Mus musculus
tgagtgctctggctcgtcttcagat

SEQ ID NO: 856342 - DNA, 25 bp, Mus musculus
tgagtgctctgggtcgtcttcagat

SEQ ID NO: 856343 - DNA, 25 bp, Mus musculus
tgagtgctctgtcctatgcgaaaat

SEQ ID NO: 856344 - DNA, 25 bp, Mus musculus
tgagtgctctgtcctggttggaacc

SEQ ID NO: 856345 - DNA, 25 bp, Mus musculus
tgagtgctctgtgctatgcgaaaat

SEQ ID NO: 856346 - DNA, 25 bp, Mus musculus
tgagtgctctgtgctggttggaacc

SEQ ID NO: 856347 - DNA, 25 bp, Mus musculus
tgagtgctgactcgtttgtttctat

SEQ ID NO: 856348 - DNA, 25 bp, Mus musculus
tgagtgctgactggtttgtttctat

SEQ ID NO: 856349 - DNA, 25 bp, Mus musculus
tgagtgctgagcagcaccctctgtg

SEQ ID NO: 856350 - DNA, 25 bp, Mus musculus
tgagtgctgagctgcaccctctgtg

SEQ ID NO: 856351 - DNA, 25 bp, Mus musculus
tgagtgctgatgaggtaaccagagc

SEQ ID NO: 856352 - DNA, 25 bp, Mus musculus
tgagtgctgatgtggtaaccagagc

SEQ ID NO: 856353 - DNA, 25 bp, Mus musculus
tgagtgctgcacacgaagtcctcgg

SEQ ID NO: 856354 - DNA, 25 bp, Mus musculus
tgagtgctgcactcgaagtcctcgg

SEQ ID NO: 856355 - DNA, 25 bp, Mus musculus
tgagtgctgggaaaattttgattct

SEQ ID NO: 856356 - DNA, 25 bp, Mus musculus
tgagtgctgggataattttgattct

SEQ ID NO: 856357 - DNA, 25 bp, Mus musculus
tgagtgctggtgatctcgctgtctc

SEQ ID NO: 856358 - DNA, 25 bp, Mus musculus
tgagtgctggtgttctcgctgtctc

SEQ ID NO: 856359 - DNA, 25 bp, Mus musculus
tgagtgctgtggcagatcataggtt

SEQ ID NO: 856360 - DNA, 25 bp, Mus musculus
tgagtgctgtgggagatcataggtt

SEQ ID NO: 856361 - DNA, 25 bp, Mus musculus
tgagtgctgtttactgcatctttat

SEQ ID NO: 856362 - DNA, 25 bp, Mus musculus
tgagtgctgttttctgcatctttat

SEQ ID NO: 856363 - DNA, 25 bp, Mus musculus
tgagtggacagtcacccgattcctc

SEQ ID NO: 856364 - DNA, 25 bp, Mus musculus
tgagtggacagtgacccgattcctc

SEQ ID NO: 856365 - DNA, 25 bp, Mus musculus
tgagtggaccagctccatcttgcag

SEQ ID NO: 856366 - DNA, 25 bp, Mus musculus
tgagtggaccaggtccatcttgcag

SEQ ID NO: 856367 - DNA, 25 bp, Mus musculus
tgagtggacttcagtgcagctcttc

SEQ ID NO: 856368 - DNA, 25 bp, Mus musculus
tgagtggacttctgtgcagctcttc

SEQ ID NO: 856369 - DNA, 25 bp, Mus musculus
tgagtggatccaaaagcttcacaca

SEQ ID NO: 856370 - DNA, 25 bp, Mus musculus
tgagtggatccataagcttcacaca

SEQ ID NO: 856371 - DNA, 25 bp, Mus musculus
tgagtggatcttcattgacccggag

SEQ ID NO: 856372 - DNA, 25 bp, Mus musculus
tgagtggatcttgattgacccggag

SEQ ID NO: 856373 - DNA, 25 bp, Mus musculus
tgagtggattttcaggttttcttcc

SEQ ID NO: 856374 - DNA, 25 bp, Mus musculus
tgagtggattttgaggttttcttcc

SEQ ID NO: 856375 - DNA, 25 bp, Mus musculus
tgagtggcaaccacccctttccaga

SEQ ID NO: 856376 - DNA, 25 bp, Mus musculus
tgagtggcaaccaggaaggccctcc

SEQ ID NO: 856377 - DNA, 25 bp, Mus musculus
tgagtggcaacctcccctttccaga

SEQ ID NO: 856378 - DNA, 25 bp, Mus musculus
tgagtggcaacctggaaggccctcc

SEQ ID NO: 856379 - DNA, 25 bp, Mus musculus
tgagtggcatcaacctgaccaccta

SEQ ID NO: 856380 - DNA, 25 bp, Mus musculus
tgagtggcatcatcctgaccaccta

SEQ ID NO: 856381 - DNA, 25 bp, Mus musculus
tgagtggcattcattaaagcctgca

SEQ ID NO: 856382 - DNA, 25 bp, Mus musculus
tgagtggcattctttaaagcctgca

SEQ ID NO: 856383 - DNA, 25 bp, Mus musculus
tgagtggccacaacagtcccttgat

SEQ ID NO: 856384 - DNA, 25 bp, Mus musculus
tgagtggccacatcagtcccttgat

SEQ ID NO: 856385 - DNA, 25 bp, Mus musculus
tgagtggccacgactacagagtctt

SEQ ID NO: 856386 - DNA, 25 bp, Mus musculus
tgagtggccacgtctacagagtctt

SEQ ID NO: 856387 - DNA, 25 bp, Mus musculus
tgagtggccagtccatccatatagt

SEQ ID NO: 856388 - DNA, 25 bp, Mus musculus
tgagtggccagtgcatccatatagt

SEQ ID NO: 856389 - DNA, 25 bp, Mus musculus
tgagtggccatgctagccttcagga

SEQ ID NO: 856390 - DNA, 25 bp, Mus musculus
tgagtggccatggtagccttcagga

SEQ ID NO: 856391 - DNA, 25 bp, Mus musculus
tgagtggcccaacgccatggaacag

SEQ ID NO: 856392 - DNA, 25 bp, Mus musculus
tgagtggcccaaggccatggaacag

SEQ ID NO: 856393 - DNA, 25 bp, Mus musculus
tgagtggcctgtcttagtcttgtga

SEQ ID NO: 856394 - DNA, 25 bp, Mus musculus
tgagtggcctgtgttagtcttgtga

SEQ ID NO: 856395 - DNA, 25 bp, Mus musculus
tgagtggcggctacagcggctattt

SEQ ID NO: 856396 - DNA, 25 bp, Mus musculus
tgagtggcggcttcagcggctattt

SEQ ID NO: 856397 - DNA, 25 bp, Mus musculus
tgagtggcggtgatccttgctgttc

SEQ ID NO: 856398 - DNA, 25 bp, Mus musculus
tgagtggcggtgttccttgctgttc

SEQ ID NO: 856399 - DNA, 25 bp, Mus musculus
tgagtggctagcactggctttgtaa

SEQ ID NO: 856400 - DNA, 25 bp, Mus musculus
tgagtggctagctctggctttgtaa

SEQ ID NO: 856401 - DNA, 25 bp, Mus musculus
tgagtggctcctcccagcacgattc

SEQ ID NO: 856402 - DNA, 25 bp, Mus musculus
tgagtggctcctgccagcacgattc

SEQ ID NO: 856403 - DNA, 25 bp, Mus musculus
tgagtggctgcaccttaccatgtat

SEQ ID NO: 856404 - DNA, 25 bp, Mus musculus
tgagtggctgcagcttaccatgtat

SEQ ID NO: 856405 - DNA, 25 bp, Mus musculus
tgagtggctgccctaactgtgtatg

SEQ ID NO: 856406 - DNA, 25 bp, Mus musculus
tgagtggctgccgtaactgtgtatg

SEQ ID NO: 856407 - DNA, 25 bp, Mus musculus
tgagtggcttttcttggtctattcc

SEQ ID NO: 856408 - DNA, 25 bp, Mus musculus
tgagtggcttttgttggtctattcc

SEQ ID NO: 856409 - DNA, 25 bp, Mus musculus
tgagtgggagtaatcgcaccgccat

SEQ ID NO: 856410 - DNA, 25 bp, Mus musculus
tgagtgggagtattcgcaccgccat

SEQ ID NO: 856411 - DNA, 25 bp, Mus musculus
tgagtgggatctatttggccgcttc

SEQ ID NO: 856412 - DNA, 25 bp, Mus musculus
tgagtgggatctttttggccgcttc

SEQ ID NO: 856413 - DNA, 25 bp, Mus musculus
tgagtgggcccacgactatgagctc

SEQ ID NO: 856414 - DNA, 25 bp, Mus musculus
tgagtgggcccaggactatgagctc

SEQ ID NO: 856415 - DNA, 25 bp, Mus musculus
tgagtgggtggtacaaccgcgtaac

SEQ ID NO: 856416 - DNA, 25 bp, Mus musculus
tgagtgggtggttcaaccgcgtaac

SEQ ID NO: 856417 - DNA, 25 bp, Mus musculus
tgagtgggttcacagtgacagccct

SEQ ID NO: 856418 - DNA, 25 bp, Mus musculus
tgagtgggttcagagtgacagccct

SEQ ID NO: 856419 - DNA, 25 bp, Mus musculus
tgagtggtaagcaggcactgccgcc

SEQ ID NO: 856420 - DNA, 25 bp, Mus musculus
tgagtggtaagctggcactgccgcc

SEQ ID NO: 856421 - DNA, 25 bp, Mus musculus
tgagtggtacgacatgacaatggat

SEQ ID NO: 856422 - DNA, 25 bp, Mus musculus
tgagtggtacgagatgacaatggat

SEQ ID NO: 856423 - DNA, 25 bp, Mus musculus
tgagtggtagaaaccccaggcccag

SEQ ID NO: 856424 - DNA, 25 bp, Mus musculus
tgagtggtagaatccccaggcccag

SEQ ID NO: 856425 - DNA, 25 bp, Mus musculus
tgagtggtaggaccccacacctggt

SEQ ID NO: 856426 - DNA, 25 bp, Mus musculus
tgagtggtaggagcccacacctggt

SEQ ID NO: 856427 - DNA, 25 bp, Mus musculus
tgagtggtcatcagcgtggtcttga

SEQ ID NO: 856428 - DNA, 25 bp, Mus musculus
tgagtggtcatctgcgtggtcttga

SEQ ID NO: 856429 - DNA, 25 bp, Mus musculus
tgagtggtccagaaaaccccttggc

SEQ ID NO: 856430 - DNA, 25 bp, Mus musculus
tgagtggtccagtaaaccccttggc

SEQ ID NO: 856431 - DNA, 25 bp, Mus musculus
tgagtggtccatctgcttctagagc

SEQ ID NO: 856432 - DNA, 25 bp, Mus musculus
tgagtggtccatgtgcttctagagc

SEQ ID NO: 856433 - DNA, 25 bp, Mus musculus
tgagtggtcccaaccttttgcaggc

SEQ ID NO: 856434 - DNA, 25 bp, Mus musculus
tgagtggtcccatccttttgcaggc

SEQ ID NO: 856435 - DNA, 25 bp, Mus musculus
tgagtggtggctcccactttgctgt

SEQ ID NO: 856436 - DNA, 25 bp, Mus musculus
tgagtggtggctgccactttgctgt

SEQ ID NO: 856437 - DNA, 25 bp, Mus musculus
tgagtggtgtctatgcctgactacc

SEQ ID NO: 856438 - DNA, 25 bp, Mus musculus
tgagtggtgtctttgcctgactacc

SEQ ID NO: 856439 - DNA, 25 bp, Mus musculus
tgagtggttcagcttcacaaaccct

SEQ ID NO: 856440 - DNA, 25 bp, Mus musculus
tgagtggttcaggttcacaaaccct

SEQ ID NO: 856441 - DNA, 25 bp, Mus musculus
tgagtggtttccatcatgctacccc

SEQ ID NO: 856442 - DNA, 25 bp, Mus musculus
tgagtggtttccttcatgctacccc

SEQ ID NO: 856443 - DNA, 25 bp, Mus musculus
tgagtgtaccccaaacggccaagat

SEQ ID NO: 856444 - DNA, 25 bp, Mus musculus
tgagtgtacccctaacggccaagat

SEQ ID NO: 856445 - DNA, 25 bp, Mus musculus
tgagtgtactagatcgagtcccgat

SEQ ID NO: 856446 - DNA, 25 bp, Mus musculus
tgagtgtactagttcgagtcccgat

SEQ ID NO: 856447 - DNA, 25 bp, Mus musculus
tgagtgtagtccacccagctgtttg

SEQ ID NO: 856448 - DNA, 25 bp, Mus musculus
tgagtgtagtcctcccagctgtttg

SEQ ID NO: 856449 - DNA, 25 bp, Mus musculus
tgagtgtatcgtccttcttcgttcc

SEQ ID NO: 856450 - DNA, 25 bp, Mus musculus
tgagtgtatcgtgcttcttcgttcc

SEQ ID NO: 856451 - DNA, 25 bp, Mus musculus
tgagtgtatggacttgccaactaac

SEQ ID NO: 856452 - DNA, 25 bp, Mus musculus
tgagtgtatggagttgccaactaac

SEQ ID NO: 856453 - DNA, 25 bp, Mus musculus
tgagtgtcacgtagagcctgcctgc

SEQ ID NO: 856454 - DNA, 25 bp, Mus musculus
tgagtgtcacgttgagcctgcctgc

SEQ ID NO: 856455 - DNA, 25 bp, Mus musculus
tgagtgtcagtccatggttcccaga

SEQ ID NO: 856456 - DNA, 25 bp, Mus musculus
tgagtgtcagtcgatggttcccaga

SEQ ID NO: 856457 - DNA, 25 bp, Mus musculus
tgagtgtccaacatggagggcccca

SEQ ID NO: 856458 - DNA, 25 bp, Mus musculus
tgagtgtccaacttggagggcccca

SEQ ID NO: 856459 - DNA, 25 bp, Mus musculus
tgagtgtcctccattggcagctgca

SEQ ID NO: 856460 - DNA, 25 bp, Mus musculus
tgagtgtcctcctttggcagctgca

SEQ ID NO: 856461 - DNA, 25 bp, Mus musculus
tgagtgtctcctccagtttctcttc

SEQ ID NO: 856462 - DNA, 25 bp, Mus musculus
tgagtgtctcctgcagtttctcttc

SEQ ID NO: 856463 - DNA, 25 bp, Mus musculus
tgagtgtcttggctgcctgcaaaaa

SEQ ID NO: 856464 - DNA, 25 bp, Mus musculus
tgagtgtcttgggtgcctgcaaaaa

SEQ ID NO: 856465 - DNA, 25 bp, Mus musculus
tgagtgtgactaagcctcccagaaa

SEQ ID NO: 856466 - DNA, 25 bp, Mus musculus
tgagtgtgactatgcctcccagaaa

SEQ ID NO: 856467 - DNA, 25 bp, Mus musculus
tgagtgtgacttacaccagggtgca

SEQ ID NO: 856468 - DNA, 25 bp, Mus musculus
tgagtgtgactttcaccagggtgca

SEQ ID NO: 856469 - DNA, 25 bp, Mus musculus
tgagtgtgcccaaccagtgtgttat

SEQ ID NO: 856470 - DNA, 25 bp, Mus musculus
tgagtgtgcccatccagtgtgttat

SEQ ID NO: 856471 - DNA, 25 bp, Mus musculus
tgagtgtgcctgagttacttgcaga

SEQ ID NO: 856472 - DNA, 25 bp, Mus musculus
tgagtgtgcctgtgttacttgcaga

SEQ ID NO: 856473 - DNA, 25 bp, Mus musculus
tgagtgtgctcaagttctatcttaa

SEQ ID NO: 856474 - DNA, 25 bp, Mus musculus
tgagtgtgctcatgttctatcttaa

SEQ ID NO: 856475 - DNA, 25 bp, Mus musculus
tgagtgtggcatcacatgcctttaa

SEQ ID NO: 856476 - DNA, 25 bp, Mus musculus
tgagtgtggcatgacatgcctttaa

SEQ ID NO: 856477 - DNA, 25 bp, Mus musculus
tgagtgtggtttacgaatcctggcc

SEQ ID NO: 856478 - DNA, 25 bp, Mus musculus
tgagtgtggttttcgaatcctggcc

SEQ ID NO: 856479 - DNA, 25 bp, Mus musculus
tgagtgtgtccaagctgttgagtct

SEQ ID NO: 856480 - DNA, 25 bp, Mus musculus
tgagtgtgtccatgctgttgagtct

SEQ ID NO: 856481 - DNA, 25 bp, Mus musculus
tgagtgtgttaaagccctcactttc

SEQ ID NO: 856482 - DNA, 25 bp, Mus musculus
tgagtgtgttaatgccctcactttc

SEQ ID NO: 856483 - DNA, 25 bp, Mus musculus
tgagtgtgttggctcagcctttgat

SEQ ID NO: 856484 - DNA, 25 bp, Mus musculus
tgagtgtgttgggtcagcctttgat

SEQ ID NO: 856485 - DNA, 25 bp, Mus musculus
tgagtgttagatatccagcggagtc

SEQ ID NO: 856486 - DNA, 25 bp, Mus musculus
tgagtgttagatttccagcggagtc

SEQ ID NO: 856487 - DNA, 25 bp, Mus musculus
tgagtgttccaacgccaagcctttc

SEQ ID NO: 856488 - DNA, 25 bp, Mus musculus
tgagtgttccaaggccaagcctttc

SEQ ID NO: 856489 - DNA, 25 bp, Mus musculus
tgagtgttctatcacccacaattcc

SEQ ID NO: 856490 - DNA, 25 bp, Mus musculus
tgagtgttctatgacccacaattcc

SEQ ID NO: 856491 - DNA, 25 bp, Mus musculus
tgagtgttgcctaatgccttccaga

SEQ ID NO: 856492 - DNA, 25 bp, Mus musculus
tgagtgttgccttatgccttccaga

SEQ ID NO: 856493 - DNA, 25 bp, Mus musculus
tgagtgttgctcatgtgcagccctt

SEQ ID NO: 856494 - DNA, 25 bp, Mus musculus
tgagtgttgctcttgtgcagccctt

SEQ ID NO: 856495 - DNA, 25 bp, Mus musculus
tgagtgttggtcaacttcctggttc

SEQ ID NO: 856496 - DNA, 25 bp, Mus musculus
tgagtgttggtctacttcctggttc

SEQ ID NO: 856497 - DNA, 25 bp, Mus musculus
tgagtgttggttacccggttctttg

SEQ ID NO: 856498 - DNA, 25 bp, Mus musculus
tgagtgttggtttcccggttctttg

SEQ ID NO: 856499 - DNA, 25 bp, Mus musculus
tgagtgttgtccagtcttcatttac

SEQ ID NO: 856500 - DNA, 25 bp, Mus musculus
tgagtgttgtcctgtcttcatttac

SEQ ID NO: 856501 - DNA, 25 bp, Mus musculus
tgagtgtttatccactcacaccctt

SEQ ID NO: 856502 - DNA, 25 bp, Mus musculus
tgagtgtttatcgactcacaccctt

SEQ ID NO: 856503 - DNA, 25 bp, Mus musculus
tgagtgtttgccagcttcaaccacg

SEQ ID NO: 856504 - DNA, 25 bp, Mus musculus
tgagtgtttgcctgcttcaaccacg

SEQ ID NO: 856505 - DNA, 25 bp, Mus musculus
tgagtgtttgtccaccaagaccgtg

SEQ ID NO: 856506 - DNA, 25 bp, Mus musculus
tgagtgtttgtcgaccaagaccgtg

SEQ ID NO: 856507 - DNA, 25 bp, Mus musculus
tgagttaacttcctcttcctttaga

SEQ ID NO: 856508 - DNA, 25 bp, Mus musculus
tgagttaacttcgtcttcctttaga

SEQ ID NO: 856509 - DNA, 25 bp, Mus musculus
tgagttaagcctaccaccagtctgt

SEQ ID NO: 856510 - DNA, 25 bp, Mus musculus
tgagttaagccttccaccagtctgt

SEQ ID NO: 856511 - DNA, 25 bp, Mus musculus
tgagttaagtcacggcccttccttc

SEQ ID NO: 856512 - DNA, 25 bp, Mus musculus
tgagttaagtcagggcccttccttc

SEQ ID NO: 856513 - DNA, 25 bp, Mus musculus
tgagttacaagtaatctttcctggg

SEQ ID NO: 856514 - DNA, 25 bp, Mus musculus
tgagttacaagttatctttcctggg

SEQ ID NO: 856515 - DNA, 25 bp, Mus musculus
tgagttacacccacagcaatgcttt

SEQ ID NO: 856516 - DNA, 25 bp, Mus musculus
tgagttacaccctcagcaatgcttt

SEQ ID NO: 856517 - DNA, 25 bp, Mus musculus
tgagttacacttcccacttgtcata

SEQ ID NO: 856518 - DNA, 25 bp, Mus musculus
tgagttacacttcccagaccataca

SEQ ID NO: 856519 - DNA, 25 bp, Mus musculus
tgagttacacttgccacttgtcata

SEQ ID NO: 856520 - DNA, 25 bp, Mus musculus
tgagttacacttgccagaccataca

SEQ ID NO: 856521 - DNA, 25 bp, Mus musculus
tgagttacagggactgggagccacc

SEQ ID NO: 856522 - DNA, 25 bp, Mus musculus
tgagttacagggtctgggagccacc

SEQ ID NO: 856523 - DNA, 25 bp, Mus musculus
tgagttaccaccatcaagcttgtac

SEQ ID NO: 856524 - DNA, 25 bp, Mus musculus
tgagttaccaccttcaagcttgtac

SEQ ID NO: 856525 - DNA, 25 bp, Mus musculus
tgagttacccaccacagagcatggc

SEQ ID NO: 856526 - DNA, 25 bp, Mus musculus
tgagttacccacgacagagcatggc

SEQ ID NO: 856527 - DNA, 25 bp, Mus musculus
tgagttacctcgaggaaagcataaa

SEQ ID NO: 856528 - DNA, 25 bp, Mus musculus
tgagttacctcgtggaaagcataaa

SEQ ID NO: 856529 - DNA, 25 bp, Mus musculus
tgagttacttgtattcttaactact

SEQ ID NO: 856530 - DNA, 25 bp, Mus musculus
tgagttacttgttttcttaactact

SEQ ID NO: 856531 - DNA, 25 bp, Mus musculus
tgagttagaaggaccagcccctgct

SEQ ID NO: 856532 - DNA, 25 bp, Mus musculus
tgagttagaaggtccagcccctgct

SEQ ID NO: 856533 - DNA, 25 bp, Mus musculus
tgagttagagaaactgtccccttcc

SEQ ID NO: 856534 - DNA, 25 bp, Mus musculus
tgagttagagaatctgtccccttcc

SEQ ID NO: 856535 - DNA, 25 bp, Mus musculus
tgagttagccagcagccacatcttt

SEQ ID NO: 856536 - DNA, 25 bp, Mus musculus
tgagttagccaggagccacatcttt

SEQ ID NO: 856537 - DNA, 25 bp, Mus musculus
tgagttaggtccagacttgtcccct

SEQ ID NO: 856538 - DNA, 25 bp, Mus musculus
tgagttaggtcctgacttgtcccct

SEQ ID NO: 856539 - DNA, 25 bp, Mus musculus
tgagttagtgcaaccagctggttac

SEQ ID NO: 856540 - DNA, 25 bp, Mus musculus
tgagttagtgcatccagctggttac

SEQ ID NO: 856541 - DNA, 25 bp, Mus musculus
tgagttagtttcagcgttgacctcc

SEQ ID NO: 856542 - DNA, 25 bp, Mus musculus
tgagttagtttcctgaggctctctc

SEQ ID NO: 856543 - DNA, 25 bp, Mus musculus
tgagttagtttcgtgaggctctctc

SEQ ID NO: 856544 - DNA, 25 bp, Mus musculus
tgagttagtttctgcgttgacctcc

SEQ ID NO: 856545 - DNA, 25 bp, Mus musculus
tgagttataccaccggactcgcatc

SEQ ID NO: 856546 - DNA, 25 bp, Mus musculus
tgagttataccagcggactcgcatc

SEQ ID NO: 856547 - DNA, 25 bp, Mus musculus
tgagttatacttcccatggcttttg

SEQ ID NO: 856548 - DNA, 25 bp, Mus musculus
tgagttatacttgccatggcttttg

SEQ ID NO: 856549 - DNA, 25 bp, Mus musculus
tgagttatcagtcgcctgtgacacg

SEQ ID NO: 856550 - DNA, 25 bp, Mus musculus
tgagttatcagtggcctgtgacacg

SEQ ID NO: 856551 - DNA, 25 bp, Mus musculus
tgagttatccctaaggccctttaat

SEQ ID NO: 856552 - DNA, 25 bp, Mus musculus
tgagttatcccttaggccctttaat

SEQ ID NO: 856553 - DNA, 25 bp, Mus musculus
tgagttattagacatgaccccacat

SEQ ID NO: 856554 - DNA, 25 bp, Mus musculus
tgagttattagagatgaccccacat

SEQ ID NO: 856555 - DNA, 25 bp, Mus musculus
tgagttattctcagtcttgaccttt

SEQ ID NO: 856556 - DNA, 25 bp, Mus musculus
tgagttattctctgtcttgaccttt

SEQ ID NO: 856557 - DNA, 25 bp, Mus musculus
tgagttattgctcactctgagttct

SEQ ID NO: 856558 - DNA, 25 bp, Mus musculus
tgagttattgctgactctgagttct

SEQ ID NO: 856559 - DNA, 25 bp, Mus musculus
tgagttcaaaacctgactggacaag

SEQ ID NO: 856560 - DNA, 25 bp, Mus musculus
tgagttcaaaacgtgactggacaag

SEQ ID NO: 856561 - DNA, 25 bp, Mus musculus
tgagttcaaatacccgcaatcacct

SEQ ID NO: 856562 - DNA, 25 bp, Mus musculus
tgagttcaaatagccgcaatcacct

SEQ ID NO: 856563 - DNA, 25 bp, Mus musculus
tgagttcaacttaaggtagaaggct

SEQ ID NO: 856564 - DNA, 25 bp, Mus musculus
tgagttcaactttaggtagaaggct

SEQ ID NO: 856565 - DNA, 25 bp, Mus musculus
tgagttcaagacaggcggtgcattt

SEQ ID NO: 856566 - DNA, 25 bp, Mus musculus
tgagttcaagactggcggtgcattt

SEQ ID NO: 856567 - DNA, 25 bp, Mus musculus
tgagttcaagtccttccgacggata

SEQ ID NO: 856568 - DNA, 25 bp, Mus musculus
tgagttcaagtcgttccgacggata

SEQ ID NO: 856569 - DNA, 25 bp, Mus musculus
tgagttcaatccaggaggccatgtt

SEQ ID NO: 856570 - DNA, 25 bp, Mus musculus
tgagttcaatcctggaggccatgtt

SEQ ID NO: 856571 - DNA, 25 bp, Mus musculus
tgagttcaccgaagttgccatcttg

SEQ ID NO: 856572 - DNA, 25 bp, Mus musculus
tgagttcaccgatgttgccatcttg

SEQ ID NO: 856573 - DNA, 25 bp, Mus musculus
tgagttcacctccattttcaaattt

SEQ ID NO: 856574 - DNA, 25 bp, Mus musculus
tgagttcacctcgattttcaaattt

SEQ ID NO: 856575 - DNA, 25 bp, Mus musculus
tgagttcaccttactgacccgaata

SEQ ID NO: 856576 - DNA, 25 bp, Mus musculus
tgagttcacctttctgacccgaata

SEQ ID NO: 856577 - DNA, 25 bp, Mus musculus
tgagttcactgtcctcccttaaaag

SEQ ID NO: 856578 - DNA, 25 bp, Mus musculus
tgagttcactgtgctcccttaaaag

SEQ ID NO: 856579 - DNA, 25 bp, Mus musculus
tgagttcagaatatggatccagatc

SEQ ID NO: 856580 - DNA, 25 bp, Mus musculus
tgagttcagaatttggatccagatc

SEQ ID NO: 856581 - DNA, 25 bp, Mus musculus
tgagttcagattccccacactgtaa

SEQ ID NO: 856582 - DNA, 25 bp, Mus musculus
tgagttcagattgcccacactgtaa

SEQ ID NO: 856583 - DNA, 25 bp, Mus musculus
tgagttcaggcccattaccaaaatg

SEQ ID NO: 856584 - DNA, 25 bp, Mus musculus
tgagttcaggccgattaccaaaatg

SEQ ID NO: 856585 - DNA, 25 bp, Mus musculus
tgagttcagtccctgcgagccacgt

SEQ ID NO: 856586 - DNA, 25 bp, Mus musculus
tgagttcagtccgtgcgagccacgt

SEQ ID NO: 856587 - DNA, 25 bp, Mus musculus
tgagttccacacatgtcacagcaca

SEQ ID NO: 856588 - DNA, 25 bp, Mus musculus
tgagttccacacttgtcacagcaca

SEQ ID NO: 856589 - DNA, 25 bp, Mus musculus
tgagttccaccaacactgctatttg

SEQ ID NO: 856590 - DNA, 25 bp, Mus musculus
tgagttccaccatcactgctatttg

SEQ ID NO: 856591 - DNA, 25 bp, Mus musculus
tgagttccagcaactgtccagcttc

SEQ ID NO: 856592 - DNA, 25 bp, Mus musculus
tgagttccagcatctgtccagcttc

SEQ ID NO: 856593 - DNA, 25 bp, Mus musculus
tgagttccagccatgtagccagcaa

SEQ ID NO: 856594 - DNA, 25 bp, Mus musculus
tgagttccagccttgtagccagcaa

SEQ ID NO: 856595 - DNA, 25 bp, Mus musculus
tgagttccaggacacgcagagtcta

SEQ ID NO: 856596 - DNA, 25 bp, Mus musculus
tgagttccaggagacgcagagtcta

SEQ ID NO: 856597 - DNA, 25 bp, Mus musculus
tgagttccaggcctgtccctcttgc

SEQ ID NO: 856598 - DNA, 25 bp, Mus musculus
tgagttccaggcgtgtccctcttgc

SEQ ID NO: 856599 - DNA, 25 bp, Mus musculus
tgagttccaggtcgcgcgcactacc

SEQ ID NO: 856600 - DNA, 25 bp, Mus musculus
tgagttccaggtggcgcgcactacc

SEQ ID NO: 856601 - DNA, 25 bp, Mus musculus
tgagttccagtgcaggcttggcttt

SEQ ID NO: 856602 - DNA, 25 bp, Mus musculus
tgagttccagtggaggcttggcttt

SEQ ID NO: 856603 - DNA, 25 bp, Mus musculus
tgagttccataccagtgatccataa

SEQ ID NO: 856604 - DNA, 25 bp, Mus musculus
tgagttccatacgagtgatccataa

SEQ ID NO: 856605 - DNA, 25 bp, Mus musculus
tgagttccatccacagcattggcat

SEQ ID NO: 856606 - DNA, 25 bp, Mus musculus
tgagttccatcctcagcattggcat

SEQ ID NO: 856607 - DNA, 25 bp, Mus musculus
tgagttccattcctacgacatttgt

SEQ ID NO: 856608 - DNA, 25 bp, Mus musculus
tgagttccattcctatggtagaagg

SEQ ID NO: 856609 - DNA, 25 bp, Mus musculus
tgagttccattcgtacgacatttgt

SEQ ID NO: 856610 - DNA, 25 bp, Mus musculus
tgagttccattcgtatggtagaagg

SEQ ID NO: 856611 - DNA, 25 bp, Mus musculus
tgagttccatttactgttcggtgca

SEQ ID NO: 856612 - DNA, 25 bp, Mus musculus
tgagttccattttctgttcggtgca

SEQ ID NO: 856613 - DNA, 25 bp, Mus musculus
tgagttcccagtaatcagaaacact

SEQ ID NO: 856614 - DNA, 25 bp, Mus musculus
tgagttcccagttatcagaaacact

SEQ ID NO: 856615 - DNA, 25 bp, Mus musculus
tgagttcccatgacaggctgcgagt

SEQ ID NO: 856616 - DNA, 25 bp, Mus musculus
tgagttcccatgataacctcctaac

SEQ ID NO: 856617 - DNA, 25 bp, Mus musculus
tgagttcccatgtcaggctgcgagt

SEQ ID NO: 856618 - DNA, 25 bp, Mus musculus
tgagttcccatgttaacctcctaac

SEQ ID NO: 856619 - DNA, 25 bp, Mus musculus
tgagttccccacaaaaccctaagct

SEQ ID NO: 856620 - DNA, 25 bp, Mus musculus
tgagttccccactaaaccctaagct

SEQ ID NO: 856621 - DNA, 25 bp, Mus musculus
tgagttccccatcactcccttcaat

SEQ ID NO: 856622 - DNA, 25 bp, Mus musculus
tgagttccccatgactcccttcaat

SEQ ID NO: 856623 - DNA, 25 bp, Mus musculus
tgagttcccctcatctgtagccagt

SEQ ID NO: 856624 - DNA, 25 bp, Mus musculus
tgagttcccctcttctgtagccagt

SEQ ID NO: 856625 - DNA, 25 bp, Mus musculus
tgagttcccggtattttggagagca

SEQ ID NO: 856626 - DNA, 25 bp, Mus musculus
tgagttcccggttttttggagagca

SEQ ID NO: 856627 - DNA, 25 bp, Mus musculus
tgagttcccgtcaagtcatcgcgga

SEQ ID NO: 856628 - DNA, 25 bp, Mus musculus
tgagttcccgtctagtcatcgcgga

SEQ ID NO: 856629 - DNA, 25 bp, Mus musculus
tgagttccctatcagtactttctct

SEQ ID NO: 856630 - DNA, 25 bp, Mus musculus
tgagttccctatgagtactttctct

SEQ ID NO: 856631 - DNA, 25 bp, Mus musculus
tgagttccggtgacagaggttcaga

SEQ ID NO: 856632 - DNA, 25 bp, Mus musculus
tgagttccggtgtcagaggttcaga

SEQ ID NO: 856633 - DNA, 25 bp, Mus musculus
tgagttccgtgtcacttcatggcaa

SEQ ID NO: 856634 - DNA, 25 bp, Mus musculus
tgagttccgtgtgacttcatggcaa

SEQ ID NO: 856635 - DNA, 25 bp, Mus musculus
tgagttcctaatcaccatagatggg

SEQ ID NO: 856636 - DNA, 25 bp, Mus musculus
tgagttcctaatgaccatagatggg

SEQ ID NO: 856637 - DNA, 25 bp, Mus musculus
tgagttcctatcaaactgcccagta

SEQ ID NO: 856638 - DNA, 25 bp, Mus musculus
tgagttcctatctaactgcccagta

SEQ ID NO: 856639 - DNA, 25 bp, Mus musculus
tgagttcctcttctaagttcctctt

SEQ ID NO: 856640 - DNA, 25 bp, Mus musculus
tgagttcctcttgtaagttcctctt

SEQ ID NO: 856641 - DNA, 25 bp, Mus musculus
tgagttcctggaatagttgtatgct

SEQ ID NO: 856642 - DNA, 25 bp, Mus musculus
tgagttcctggattagttgtatgct

SEQ ID NO: 856643 - DNA, 25 bp, Mus musculus
tgagttcctgtcaagcatattcgcg

SEQ ID NO: 856644 - DNA, 25 bp, Mus musculus
tgagttcctgtctagcatattcgcg

SEQ ID NO: 856645 - DNA, 25 bp, Mus musculus
tgagttccttatcccttactaagca

SEQ ID NO: 856646 - DNA, 25 bp, Mus musculus
tgagttccttatgccttactaagca

SEQ ID NO: 856647 - DNA, 25 bp, Mus musculus
tgagttccttccactcagccagctt

SEQ ID NO: 856648 - DNA, 25 bp, Mus musculus
tgagttccttcctctcagccagctt

SEQ ID NO: 856649 - DNA, 25 bp, Mus musculus
tgagttccttcgctgtatgatttag

SEQ ID NO: 856650 - DNA, 25 bp, Mus musculus
tgagttccttcggtgtatgatttag

SEQ ID NO: 856651 - DNA, 25 bp, Mus musculus
tgagttcctttcatagactgtttgg

SEQ ID NO: 856652 - DNA, 25 bp, Mus musculus
tgagttcctttcttagactgtttgg

SEQ ID NO: 856653 - DNA, 25 bp, Mus musculus
tgagttcgagtcccagtacccatat

SEQ ID NO: 856654 - DNA, 25 bp, Mus musculus
tgagttcgagtcgcagtacccatat

SEQ ID NO: 856655 - DNA, 25 bp, Mus musculus
tgagttcgagttagaggcctaagtt

SEQ ID NO: 856656 - DNA, 25 bp, Mus musculus
tgagttcgagtttgaggcctaagtt

SEQ ID NO: 856657 - DNA, 25 bp, Mus musculus
tgagttcggcggacttcctgtatac

SEQ ID NO: 856658 - DNA, 25 bp, Mus musculus
tgagttcggcggtcttcctgtatac

SEQ ID NO: 856659 - DNA, 25 bp, Mus musculus
tgagttcggtatacctgaagacccc

SEQ ID NO: 856660 - DNA, 25 bp, Mus musculus
tgagttcggtattcctgaagacccc

SEQ ID NO: 856661 - DNA, 25 bp, Mus musculus
tgagttcggtttccaagtctgtctt

SEQ ID NO: 856662 - DNA, 25 bp, Mus musculus
tgagttcggtttgcaagtctgtctt

SEQ ID NO: 856663 - DNA, 25 bp, Mus musculus
tgagttcgtcaaagcatccacagat

SEQ ID NO: 856664 - DNA, 25 bp, Mus musculus
tgagttcgtcaatgcatccacagat

SEQ ID NO: 856665 - DNA, 25 bp, Mus musculus
tgagttctaacaacctggtggtggt

SEQ ID NO: 856666 - DNA, 25 bp, Mus musculus
tgagttctaacatcctggtggtggt

SEQ ID NO: 856667 - DNA, 25 bp, Mus musculus
tgagttctacatctatagagtgtag

SEQ ID NO: 856668 - DNA, 25 bp, Mus musculus
tgagttctacatgtatagagtgtag

SEQ ID NO: 856669 - DNA, 25 bp, Mus musculus
tgagttctacggcttcggaagaaaa

SEQ ID NO: 856670 - DNA, 25 bp, Mus musculus
tgagttctacgggttcggaagaaaa

SEQ ID NO: 856671 - DNA, 25 bp, Mus musculus
tgagttctagctcactcccatccaa

SEQ ID NO: 856672 - DNA, 25 bp, Mus musculus
tgagttctagctgactcccatccaa

SEQ ID NO: 856673 - DNA, 25 bp, Mus musculus
tgagttctagggaccaggcttctaa

SEQ ID NO: 856674 - DNA, 25 bp, Mus musculus
tgagttctagggtccaggcttctaa

SEQ ID NO: 856675 - DNA, 25 bp, Mus musculus
tgagttctatccacagcaccataga

SEQ ID NO: 856676 - DNA, 25 bp, Mus musculus
tgagttctatcctcagcaccataga

SEQ ID NO: 856677 - DNA, 25 bp, Mus musculus
tgagttctcacactctctactgtgt

SEQ ID NO: 856678 - DNA, 25 bp, Mus musculus
tgagttctcacagtctctactgtgt

SEQ ID NO: 856679 - DNA, 25 bp, Mus musculus
tgagttctcagaataacctaaggaa

SEQ ID NO: 856680 - DNA, 25 bp, Mus musculus
tgagttctcagattaacctaaggaa

SEQ ID NO: 856681 - DNA, 25 bp, Mus musculus
tgagttctcccactgttaatcttga

SEQ ID NO: 856682 - DNA, 25 bp, Mus musculus
tgagttctcccagtgttaatcttga

SEQ ID NO: 856683 - DNA, 25 bp, Mus musculus
tgagttctcgagaaacaggactgga

SEQ ID NO: 856684 - DNA, 25 bp, Mus musculus
tgagttctcgagtaacaggactgga

SEQ ID NO: 856685 - DNA, 25 bp, Mus musculus
tgagttctctcaaataccataaaag

SEQ ID NO: 856686 - DNA, 25 bp, Mus musculus
tgagttctctcaccagttcctggat

SEQ ID NO: 856687 - DNA, 25 bp, Mus musculus
tgagttctctcagcagttcctggat

SEQ ID NO: 856688 - DNA, 25 bp, Mus musculus
tgagttctctcatataccataaaag

SEQ ID NO: 856689 - DNA, 25 bp, Mus musculus
tgagttctctgcctaaaaccctggc

SEQ ID NO: 856690 - DNA, 25 bp, Mus musculus
tgagttctctgcgtaaaaccctggc

SEQ ID NO: 856691 - DNA, 25 bp, Mus musculus
tgagttctcttgactctactggaga

SEQ ID NO: 856692 - DNA, 25 bp, Mus musculus
tgagttctcttgtctctactggaga

SEQ ID NO: 856693 - DNA, 25 bp, Mus musculus
tgagttctgcatcctttaaaagtaa

SEQ ID NO: 856694 - DNA, 25 bp, Mus musculus
tgagttctgcatgctttaaaagtaa

SEQ ID NO: 856695 - DNA, 25 bp, Mus musculus
tgagttctgcccaggctagctgaat

SEQ ID NO: 856696 - DNA, 25 bp, Mus musculus
tgagttctgccctggctagctgaat

SEQ ID NO: 856697 - DNA, 25 bp, Mus musculus
tgagttctgctaccaattaacacaa

SEQ ID NO: 856698 - DNA, 25 bp, Mus musculus
tgagttctgctaccagcatactacc

SEQ ID NO: 856699 - DNA, 25 bp, Mus musculus
tgagttctgctagcaattaacacaa

SEQ ID NO: 856700 - DNA, 25 bp, Mus musculus
tgagttctgctagcagcatactacc

SEQ ID NO: 856701 - DNA, 25 bp, Mus musculus
tgagttctgctcaatgttaaattaa

SEQ ID NO: 856702 - DNA, 25 bp, Mus musculus
tgagttctgctctatgttaaattaa

SEQ ID NO: 856703 - DNA, 25 bp, Mus musculus
tgagttctgcttagactcccttaat

SEQ ID NO: 856704 - DNA, 25 bp, Mus musculus
tgagttctgcttcatacccgagtga

SEQ ID NO: 856705 - DNA, 25 bp, Mus musculus
tgagttctgcttgatacccgagtga

SEQ ID NO: 856706 - DNA, 25 bp, Mus musculus
tgagttctgctttgactcccttaat

SEQ ID NO: 856707 - DNA, 25 bp, Mus musculus
tgagttctggaaccacccccacttg

SEQ ID NO: 856708 - DNA, 25 bp, Mus musculus
tgagttctggaacctacttctctaa

SEQ ID NO: 856709 - DNA, 25 bp, Mus musculus
tgagttctggaagcacccccacttg

SEQ ID NO: 856710 - DNA, 25 bp, Mus musculus
tgagttctggaagctacttctctaa

SEQ ID NO: 856711 - DNA, 25 bp, Mus musculus
tgagttctggtccaaccttctagac

SEQ ID NO: 856712 - DNA, 25 bp, Mus musculus
tgagttctggtcgaaccttctagac

SEQ ID NO: 856713 - DNA, 25 bp, Mus musculus
tgagttcttcaacggcaggctcatc

SEQ ID NO: 856714 - DNA, 25 bp, Mus musculus
tgagttcttcaagggcaggctcatc

SEQ ID NO: 856715 - DNA, 25 bp, Mus musculus
tgagttcttctcaggtaaaattcca

SEQ ID NO: 856716 - DNA, 25 bp, Mus musculus
tgagttcttctctggtaaaattcca

SEQ ID NO: 856717 - DNA, 25 bp, Mus musculus
tgagttctttgccaagagacagttg

SEQ ID NO: 856718 - DNA, 25 bp, Mus musculus
tgagttctttgcgaagagacagttg

SEQ ID NO: 856719 - DNA, 25 bp, Mus musculus
tgagttctttggacatggcgggcct

SEQ ID NO: 856720 - DNA, 25 bp, Mus musculus
tgagttctttggtcatggcgggcct

SEQ ID NO: 856721 - DNA, 25 bp, Mus musculus
tgagttgaaacgcatgacccacatt

SEQ ID NO: 856722 - DNA, 25 bp, Mus musculus
tgagttgaaacggatgacccacatt

SEQ ID NO: 856723 - DNA, 25 bp, Mus musculus
tgagttgaacccacagactcacatg

SEQ ID NO: 856724 - DNA, 25 bp, Mus musculus
tgagttgaaccctcagactcacatg

SEQ ID NO: 856725 - DNA, 25 bp, Mus musculus
tgagttgaactcacttctgtacctc

SEQ ID NO: 856726 - DNA, 25 bp, Mus musculus
tgagttgaactctcttctgtacctc

SEQ ID NO: 856727 - DNA, 25 bp, Mus musculus
tgagttgaagtcagttactgccaca

SEQ ID NO: 856728 - DNA, 25 bp, Mus musculus
tgagttgaagtctgttactgccaca

SEQ ID NO: 856729 - DNA, 25 bp, Mus musculus
tgagttgactccctgcttatgattg

SEQ ID NO: 856730 - DNA, 25 bp, Mus musculus
tgagttgactccgtgcttatgattg

SEQ ID NO: 856731 - DNA, 25 bp, Mus musculus
tgagttgagcctcgtggtgacacca

SEQ ID NO: 856732 - DNA, 25 bp, Mus musculus
tgagttgagcctggtggtgacacca

SEQ ID NO: 856733 - DNA, 25 bp, Mus musculus
tgagttgagtatcaggtctcctgcc

SEQ ID NO: 856734 - DNA, 25 bp, Mus musculus
tgagttgagtatgaggtctcctgcc

SEQ ID NO: 856735 - DNA, 25 bp, Mus musculus
tgagttgagtttatcctgggcgtct

SEQ ID NO: 856736 - DNA, 25 bp, Mus musculus
tgagttgagtttttcctgggcgtct

SEQ ID NO: 856737 - DNA, 25 bp, Mus musculus
tgagttgatagacttagcccctaag

SEQ ID NO: 856738 - DNA, 25 bp, Mus musculus
tgagttgatagagttagcccctaag

SEQ ID NO: 856739 - DNA, 25 bp, Mus musculus
tgagttgattcaagctttgtattta

SEQ ID NO: 856740 - DNA, 25 bp, Mus musculus
tgagttgattcatgctttgtattta

SEQ ID NO: 856741 - DNA, 25 bp, Mus musculus
tgagttgcactgcactttagaagta

SEQ ID NO: 856742 - DNA, 25 bp, Mus musculus
tgagttgcactggactttagaagta

SEQ ID NO: 856743 - DNA, 25 bp, Mus musculus
tgagttgcagcacggaattcccagt

SEQ ID NO: 856744 - DNA, 25 bp, Mus musculus
tgagttgcagcagggaattcccagt

SEQ ID NO: 856745 - DNA, 25 bp, Mus musculus
tgagttgcatgtccaggcttcccca

SEQ ID NO: 856746 - DNA, 25 bp, Mus musculus
tgagttgcatgtgcaggcttcccca

SEQ ID NO: 856747 - DNA, 25 bp, Mus musculus
tgagttgccaaaaggaagtccatgt

SEQ ID NO: 856748 - DNA, 25 bp, Mus musculus
tgagttgccaaatggaagtccatgt

SEQ ID NO: 856749 - DNA, 25 bp, Mus musculus
tgagttgccaatctccacaatcatg

SEQ ID NO: 856750 - DNA, 25 bp, Mus musculus
tgagttgccaatgtccacaatcatg

SEQ ID NO: 856751 - DNA, 25 bp, Mus musculus
tgagttgccatcatgttcgtttaga

SEQ ID NO: 856752 - DNA, 25 bp, Mus musculus
tgagttgccatcttgttcgtttaga

SEQ ID NO: 856753 - DNA, 25 bp, Mus musculus
tgagttgcccgtagtgccagaaggc

SEQ ID NO: 856754 - DNA, 25 bp, Mus musculus
tgagttgcccgttgtgccagaaggc

SEQ ID NO: 856755 - DNA, 25 bp, Mus musculus
tgagttgctgtgatccacttgtcat

SEQ ID NO: 856756 - DNA, 25 bp, Mus musculus
tgagttgctgtgttccacttgtcat

SEQ ID NO: 856757 - DNA, 25 bp, Mus musculus
tgagttggattacgccgttctaaac

SEQ ID NO: 856758 - DNA, 25 bp, Mus musculus
tgagttggattaggccgttctaaac

SEQ ID NO: 856759 - DNA, 25 bp, Mus musculus
tgagttggcatgatcatttctgtag

SEQ ID NO: 856760 - DNA, 25 bp, Mus musculus
tgagttggcatgttcatttctgtag

SEQ ID NO: 856761 - DNA, 25 bp, Mus musculus
tgagttgggaccactatcttctgtc

SEQ ID NO: 856762 - DNA, 25 bp, Mus musculus
tgagttgggacctctatcttctgtc

SEQ ID NO: 856763 - DNA, 25 bp, Mus musculus
tgagttgggcatctatccagctgtg

SEQ ID NO: 856764 - DNA, 25 bp, Mus musculus
tgagttgggcatgtatccagctgtg

SEQ ID NO: 856765 - DNA, 25 bp, Mus musculus
tgagttgggctgacactgccagaaa

SEQ ID NO: 856766 - DNA, 25 bp, Mus musculus
tgagttgggctgtcactgccagaaa

SEQ ID NO: 856767 - DNA, 25 bp, Mus musculus
tgagttggtcatcgtgatccacctt

SEQ ID NO: 856768 - DNA, 25 bp, Mus musculus
tgagttggtcatggtgatccacctt

SEQ ID NO: 856769 - DNA, 25 bp, Mus musculus
tgagttggtggaaaccttctgggct

SEQ ID NO: 856770 - DNA, 25 bp, Mus musculus
tgagttggtggataccttctgggct

SEQ ID NO: 856771 - DNA, 25 bp, Mus musculus
tgagttgtaaataccttaaaggcca

SEQ ID NO: 856772 - DNA, 25 bp, Mus musculus
tgagttgtaaattccttaaaggcca

SEQ ID NO: 856773 - DNA, 25 bp, Mus musculus
tgagttgtagctctggttaccccat

SEQ ID NO: 856774 - DNA, 25 bp, Mus musculus
tgagttgtagctgtggttaccccat

SEQ ID NO: 856775 - DNA, 25 bp, Mus musculus
tgagttgtcagcctccttcatgttc

SEQ ID NO: 856776 - DNA, 25 bp, Mus musculus
tgagttgtcagcgtccttcatgttc

SEQ ID NO: 856777 - DNA, 25 bp, Mus musculus
tgagttgtcccacctacagtgtata

SEQ ID NO: 856778 - DNA, 25 bp, Mus musculus
tgagttgtcccagctacagtgtata

SEQ ID NO: 856779 - DNA, 25 bp, Mus musculus
tgagttgtgctcagcctggcagtaa

SEQ ID NO: 856780 - DNA, 25 bp, Mus musculus
tgagttgtgctctgcctggcagtaa

SEQ ID NO: 856781 - DNA, 25 bp, Mus musculus
tgagttgtgtcacggtatctgtttc

SEQ ID NO: 856782 - DNA, 25 bp, Mus musculus
tgagttgtgtcagggtatctgtttc

SEQ ID NO: 856783 - DNA, 25 bp, Mus musculus
tgagttgtgtgtaccaactttggac

SEQ ID NO: 856784 - DNA, 25 bp, Mus musculus
tgagttgtgtgttccaactttggac

SEQ ID NO: 856785 - DNA, 25 bp, Mus musculus
tgagttgttcttagcgtatgagaaa

SEQ ID NO: 856786 - DNA, 25 bp, Mus musculus
tgagttgttctttgcgtatgagaaa

SEQ ID NO: 856787 - DNA, 25 bp, Mus musculus
tgagttgtttgcatggtcacatacc

SEQ ID NO: 856788 - DNA, 25 bp, Mus musculus
tgagttgtttgcttggtcacatacc

SEQ ID NO: 856789 - DNA, 25 bp, Mus musculus
tgagtttaaccacagccccgtgttt

SEQ ID NO: 856790 - DNA, 25 bp, Mus musculus
tgagtttaaccagagccccgtgttt

SEQ ID NO: 856791 - DNA, 25 bp, Mus musculus
tgagtttaacccctgagacccacat

SEQ ID NO: 856792 - DNA, 25 bp, Mus musculus
tgagtttaacccgtgagacccacat

SEQ ID NO: 856793 - DNA, 25 bp, Mus musculus
tgagtttacaagctggattccgtga

SEQ ID NO: 856794 - DNA, 25 bp, Mus musculus
tgagtttacaaggtggattccgtga

SEQ ID NO: 856795 - DNA, 25 bp, Mus musculus
tgagtttacagaatggtgttgggcc

SEQ ID NO: 856796 - DNA, 25 bp, Mus musculus
tgagtttacagattggtgttgggcc

SEQ ID NO: 856797 - DNA, 25 bp, Mus musculus
tgagtttacatcatacaccccaatc

SEQ ID NO: 856798 - DNA, 25 bp, Mus musculus
tgagtttacatcttacaccccaatc

SEQ ID NO: 856799 - DNA, 25 bp, Mus musculus
tgagtttacggcagctgggccacat

SEQ ID NO: 856800 - DNA, 25 bp, Mus musculus
tgagtttacggctgctgggccacat

SEQ ID NO: 856801 - DNA, 25 bp, Mus musculus
tgagtttagattcccatcacccaca

SEQ ID NO: 856802 - DNA, 25 bp, Mus musculus
tgagtttagattgccatcacccaca

SEQ ID NO: 856803 - DNA, 25 bp, Mus musculus
tgagtttaggaacctgcaccgctcc

SEQ ID NO: 856804 - DNA, 25 bp, Mus musculus
tgagtttaggaagctgcaccgctcc

SEQ ID NO: 856805 - DNA, 25 bp, Mus musculus
tgagtttagggccattgtctcttct

SEQ ID NO: 856806 - DNA, 25 bp, Mus musculus
tgagtttagggcgattgtctcttct

SEQ ID NO: 856807 - DNA, 25 bp, Mus musculus
tgagtttagtcccaatcctctgacc

SEQ ID NO: 856808 - DNA, 25 bp, Mus musculus
tgagtttagtccgaatcctctgacc

SEQ ID NO: 856809 - DNA, 25 bp, Mus musculus
tgagtttataatcagcactgctgca

SEQ ID NO: 856810 - DNA, 25 bp, Mus musculus
tgagtttataatgagcactgctgca

SEQ ID NO: 856811 - DNA, 25 bp, Mus musculus
tgagtttatactctgtttccccatg

SEQ ID NO: 856812 - DNA, 25 bp, Mus musculus
tgagtttatactgtgtttccccatg

SEQ ID NO: 856813 - DNA, 25 bp, Mus musculus
tgagtttatttgcatggtgtcaggc

SEQ ID NO: 856814 - DNA, 25 bp, Mus musculus
tgagtttatttggatggtgtcaggc

SEQ ID NO: 856815 - DNA, 25 bp, Mus musculus
tgagtttcacctaattcgttggttt

SEQ ID NO: 856816 - DNA, 25 bp, Mus musculus
tgagtttcaccttattcgttggttt

SEQ ID NO: 856817 - DNA, 25 bp, Mus musculus
tgagtttcacgcagcacgaaggtgt

SEQ ID NO: 856818 - DNA, 25 bp, Mus musculus
tgagtttcacgccacagagacagac

SEQ ID NO: 856819 - DNA, 25 bp, Mus musculus
tgagtttcacgcgacagagacagac

SEQ ID NO: 856820 - DNA, 25 bp, Mus musculus
tgagtttcacgctgcacgaaggtgt

SEQ ID NO: 856821 - DNA, 25 bp, Mus musculus
tgagtttcagacaggtgccatggaa

SEQ ID NO: 856822 - DNA, 25 bp, Mus musculus
tgagtttcagactggtgccatggaa

SEQ ID NO: 856823 - DNA, 25 bp, Mus musculus
tgagtttcagcacagaccccattgc

SEQ ID NO: 856824 - DNA, 25 bp, Mus musculus
tgagtttcagcagagaccccattgc

SEQ ID NO: 856825 - DNA, 25 bp, Mus musculus
tgagtttcatccagtccagtgcagc

SEQ ID NO: 856826 - DNA, 25 bp, Mus musculus
tgagtttcatcctgtccagtgcagc

SEQ ID NO: 856827 - DNA, 25 bp, Mus musculus
tgagtttccaaaactttcctttcaa

SEQ ID NO: 856828 - DNA, 25 bp, Mus musculus
tgagtttccaaatctttcctttcaa

SEQ ID NO: 856829 - DNA, 25 bp, Mus musculus
tgagtttccataaccctgctgttaa

SEQ ID NO: 856830 - DNA, 25 bp, Mus musculus
tgagtttccatatccctgctgttaa

SEQ ID NO: 856831 - DNA, 25 bp, Mus musculus
tgagtttcccatattacatttccaa

SEQ ID NO: 856832 - DNA, 25 bp, Mus musculus
tgagtttcccattttacatttccaa

SEQ ID NO: 856833 - DNA, 25 bp, Mus musculus
tgagtttccccaccataaaacagaa

SEQ ID NO: 856834 - DNA, 25 bp, Mus musculus
tgagtttccccagcataaaacagaa

SEQ ID NO: 856835 - DNA, 25 bp, Mus musculus
tgagtttccggtcaaaatcctattt

SEQ ID NO: 856836 - DNA, 25 bp, Mus musculus
tgagtttccggtgaaaatcctattt

SEQ ID NO: 856837 - DNA, 25 bp, Mus musculus
tgagtttcctaccttgtgactgcaa

SEQ ID NO: 856838 - DNA, 25 bp, Mus musculus
tgagtttcctacgttgtgactgcaa

SEQ ID NO: 856839 - DNA, 25 bp, Mus musculus
tgagtttcctgtattcgagtcttcc

SEQ ID NO: 856840 - DNA, 25 bp, Mus musculus
tgagtttcctgttttcgagtcttcc

SEQ ID NO: 856841 - DNA, 25 bp, Mus musculus
tgagtttcgatcacaggccctcatt

SEQ ID NO: 856842 - DNA, 25 bp, Mus musculus
tgagtttcgatctcaggccctcatt

SEQ ID NO: 856843 - DNA, 25 bp, Mus musculus
tgagtttctgatacgtttcccaccc

SEQ ID NO: 856844 - DNA, 25 bp, Mus musculus
tgagtttctgattcgtttcccaccc

SEQ ID NO: 856845 - DNA, 25 bp, Mus musculus
tgagtttgaaataaaccgttacaat

SEQ ID NO: 856846 - DNA, 25 bp, Mus musculus
tgagtttgaaattaaccgttacaat

SEQ ID NO: 856847 - DNA, 25 bp, Mus musculus
tgagtttgaactccggtaccggaga

SEQ ID NO: 856848 - DNA, 25 bp, Mus musculus
tgagtttgaactgcggtaccggaga

SEQ ID NO: 856849 - DNA, 25 bp, Mus musculus
tgagtttgacacagcccaggctggg

SEQ ID NO: 856850 - DNA, 25 bp, Mus musculus
tgagtttgacactgcccaggctggg

SEQ ID NO: 856851 - DNA, 25 bp, Mus musculus
tgagtttgaggtcccagatcagcca

SEQ ID NO: 856852 - DNA, 25 bp, Mus musculus
tgagtttgaggtgccagatcagcca

SEQ ID NO: 856853 - DNA, 25 bp, Mus musculus
tgagtttgagtaacgcccaagcttt

SEQ ID NO: 856854 - DNA, 25 bp, Mus musculus
tgagtttgagtatcgcccaagcttt

SEQ ID NO: 856855 - DNA, 25 bp, Mus musculus
tgagtttgatcccactttgggcgcg

SEQ ID NO: 856856 - DNA, 25 bp, Mus musculus
tgagtttgatccgactttgggcgcg

SEQ ID NO: 856857 - DNA, 25 bp, Mus musculus
tgagtttgcagaacccaaccctcat

SEQ ID NO: 856858 - DNA, 25 bp, Mus musculus
tgagtttgcagatcccaaccctcat

SEQ ID NO: 856859 - DNA, 25 bp, Mus musculus
tgagtttgccagcttttatacccat

SEQ ID NO: 856860 - DNA, 25 bp, Mus musculus
tgagtttgccaggttttatacccat

SEQ ID NO: 856861 - DNA, 25 bp, Mus musculus
tgagtttgcccacgccttgggtgct

SEQ ID NO: 856862 - DNA, 25 bp, Mus musculus
tgagtttgcccaggccttgggtgct

SEQ ID NO: 856863 - DNA, 25 bp, Mus musculus
tgagtttgctccctaaggcctggaa

SEQ ID NO: 856864 - DNA, 25 bp, Mus musculus
tgagtttgctccgtaaggcctggaa

SEQ ID NO: 856865 - DNA, 25 bp, Mus musculus
tgagtttggccaacccaggaggcgc

SEQ ID NO: 856866 - DNA, 25 bp, Mus musculus
tgagtttggccatcccaggaggcgc

SEQ ID NO: 856867 - DNA, 25 bp, Mus musculus
tgagtttggcttcaccctgttcaag

SEQ ID NO: 856868 - DNA, 25 bp, Mus musculus
tgagtttggcttcttgggagtttac

SEQ ID NO: 856869 - DNA, 25 bp, Mus musculus
tgagtttggcttgaccctgttcaag

SEQ ID NO: 856870 - DNA, 25 bp, Mus musculus
tgagtttggcttgttgggagtttac

SEQ ID NO: 856871 - DNA, 25 bp, Mus musculus
tgagtttgggccacttcagatccag

SEQ ID NO: 856872 - DNA, 25 bp, Mus musculus
tgagtttgggcctcttcagatccag

SEQ ID NO: 856873 - DNA, 25 bp, Mus musculus
tgagtttgtattactagcaccctgg

SEQ ID NO: 856874 - DNA, 25 bp, Mus musculus
tgagtttgtatttctagcaccctgg

SEQ ID NO: 856875 - DNA, 25 bp, Mus musculus
tgagtttgtgtgaaggaatcaacct

SEQ ID NO: 856876 - DNA, 25 bp, Mus musculus
tgagtttgtgtgtaggaatcaacct

SEQ ID NO: 856877 - DNA, 25 bp, Mus musculus
tgagttttagagcttttcctaggga

SEQ ID NO: 856878 - DNA, 25 bp, Mus musculus
tgagttttagaggttttcctaggga

SEQ ID NO: 856879 - DNA, 25 bp, Mus musculus
tgagttttagtcatacttagtcctt

SEQ ID NO: 856880 - DNA, 25 bp, Mus musculus
tgagttttagtcttacttagtcctt

SEQ ID NO: 856881 - DNA, 25 bp, Mus musculus
tgagttttcagccttgtaggccacc

SEQ ID NO: 856882 - DNA, 25 bp, Mus musculus
tgagttttcagcgttgtaggccacc

SEQ ID NO: 856883 - DNA, 25 bp, Mus musculus
tgagttttccacataccagtacttt

SEQ ID NO: 856884 - DNA, 25 bp, Mus musculus
tgagttttccacttaccagtacttt

SEQ ID NO: 856885 - DNA, 25 bp, Mus musculus
tgagttttccccatattctgagctg

SEQ ID NO: 856886 - DNA, 25 bp, Mus musculus
tgagttttccccttattctgagctg

SEQ ID NO: 856887 - DNA, 25 bp, Mus musculus
tgagttttccctactctttattaga

SEQ ID NO: 856888 - DNA, 25 bp, Mus musculus
tgagttttcccttctctttattaga

SEQ ID NO: 856889 - DNA, 25 bp, Mus musculus
tgagttttcttcatgcttccacgtc

SEQ ID NO: 856890 - DNA, 25 bp, Mus musculus
tgagttttcttcttgcttccacgtc

SEQ ID NO: 856891 - DNA, 25 bp, Mus musculus
tgagttttgggtatggctgaaagcc

SEQ ID NO: 856892 - DNA, 25 bp, Mus musculus
tgagttttgggtttggctgaaagcc

SEQ ID NO: 856893 - DNA, 25 bp, Mus musculus
tgagttttggtccagttgggctgat

SEQ ID NO: 856894 - DNA, 25 bp, Mus musculus
tgagttttggtcgagttgggctgat

SEQ ID NO: 856895 - DNA, 25 bp, Mus musculus
tgagttttgtgcctctgtcctacca

SEQ ID NO: 856896 - DNA, 25 bp, Mus musculus
tgagttttgtgcgtctgtcctacca

SEQ ID NO: 856897 - DNA, 25 bp, Mus musculus
tgagtttttctaaattggatctggg

SEQ ID NO: 856898 - DNA, 25 bp, Mus musculus
tgagtttttctatattggatctggg

SEQ ID NO: 856899 - DNA, 25 bp, Mus musculus
tgataaaactttagcccaagcccct

SEQ ID NO: 856900 - DNA, 25 bp, Mus musculus
tgataaaacttttgcccaagcccct

SEQ ID NO: 856901 - DNA, 25 bp, Mus musculus
tgataaaaggttcactggttttggt

SEQ ID NO: 856902 - DNA, 25 bp, Mus musculus
tgataaaaggttgactggttttggt

SEQ ID NO: 856903 - DNA, 25 bp, Mus musculus
tgataaacactaatcccgggagcag

SEQ ID NO: 856904 - DNA, 25 bp, Mus musculus
tgataaacactattcccgggagcag

SEQ ID NO: 856905 - DNA, 25 bp, Mus musculus
tgataaacagggatcccaggactcc

SEQ ID NO: 856906 - DNA, 25 bp, Mus musculus
tgataaacagggttcccaggactcc

SEQ ID NO: 856907 - DNA, 25 bp, Mus musculus
tgataaacatctcggctgattccat

SEQ ID NO: 856908 - DNA, 25 bp, Mus musculus
tgataaacatctgggctgattccat

SEQ ID NO: 856909 - DNA, 25 bp, Mus musculus
tgataaacatgtatctttacctttt

SEQ ID NO: 856910 - DNA, 25 bp, Mus musculus
tgataaacatgtttctttacctttt

SEQ ID NO: 856911 - DNA, 25 bp, Mus musculus
tgataaaccatcagtacatacgtaa

SEQ ID NO: 856912 - DNA, 25 bp, Mus musculus
tgataaaccatctgtacatacgtaa

SEQ ID NO: 856913 - DNA, 25 bp, Mus musculus
tgataaacccctaacaacggaagag

SEQ ID NO: 856914 - DNA, 25 bp, Mus musculus
tgataaaccccttacaacggaagag

SEQ ID NO: 856915 - DNA, 25 bp, Mus musculus
tgataaacctaacgccttccaggcg

SEQ ID NO: 856916 - DNA, 25 bp, Mus musculus
tgataaacctaaggccttccaggcg

SEQ ID NO: 856917 - DNA, 25 bp, Mus musculus
tgataaactgcacttccaacttgag

SEQ ID NO: 856918 - DNA, 25 bp, Mus musculus
tgataaactgcagttccaacttgag

SEQ ID NO: 856919 - DNA, 25 bp, Mus musculus
tgataaagacttccctctgagagaa

SEQ ID NO: 856920 - DNA, 25 bp, Mus musculus
tgataaagacttgcctctgagagaa

SEQ ID NO: 856921 - DNA, 25 bp, Mus musculus
tgataaagtctcaaggcctcctatt

SEQ ID NO: 856922 - DNA, 25 bp, Mus musculus
tgataaagtctctaggcctcctatt

SEQ ID NO: 856923 - DNA, 25 bp, Mus musculus
tgataaatatatcaccccaccccaa

SEQ ID NO: 856924 - DNA, 25 bp, Mus musculus
tgataaatatatgaccccaccccaa

SEQ ID NO: 856925 - DNA, 25 bp, Mus musculus
tgataaatatgaattggcttttctt

SEQ ID NO: 856926 - DNA, 25 bp, Mus musculus
tgataaatatgatttggcttttctt

SEQ ID NO: 856927 - DNA, 25 bp, Mus musculus
tgataaatcttaccccttctcttcc

SEQ ID NO: 856928 - DNA, 25 bp, Mus musculus
tgataaatcttagcccttctcttcc

SEQ ID NO: 856929 - DNA, 25 bp, Mus musculus
tgataaatgcttctccactctgtgt

SEQ ID NO: 856930 - DNA, 25 bp, Mus musculus
tgataaatgcttgtccactctgtgt

SEQ ID NO: 856931 - DNA, 25 bp, Mus musculus
tgataacaactcacgagtctgcctc

SEQ ID NO: 856932 - DNA, 25 bp, Mus musculus
tgataacaactctcgagtctgcctc

SEQ ID NO: 856933 - DNA, 25 bp, Mus musculus
tgataacaatctccattcctcacat

SEQ ID NO: 856934 - DNA, 25 bp, Mus musculus
tgataacaatctgcattcctcacat

SEQ ID NO: 856935 - DNA, 25 bp, Mus musculus
tgataacaccacaagtctgactgat

SEQ ID NO: 856936 - DNA, 25 bp, Mus musculus
tgataacaccactagtctgactgat

SEQ ID NO: 856937 - DNA, 25 bp, Mus musculus
tgataacacttgacaggcctcttcc

SEQ ID NO: 856938 - DNA, 25 bp, Mus musculus
tgataacacttgtcaggcctcttcc

SEQ ID NO: 856939 - DNA, 25 bp, Mus musculus
tgataacagagcagactgcccctta

SEQ ID NO: 856940 - DNA, 25 bp, Mus musculus
tgataacagagctgactgcccctta

SEQ ID NO: 856941 - DNA, 25 bp, Mus musculus
tgataacagtggctgatgtcagctc

SEQ ID NO: 856942 - DNA, 25 bp, Mus musculus
tgataacagtgggtgatgtcagctc

SEQ ID NO: 856943 - DNA, 25 bp, Mus musculus
tgataaccctaaacctcacaaggta

SEQ ID NO: 856944 - DNA, 25 bp, Mus musculus
tgataaccctaatcctcacaaggta

SEQ ID NO: 856945 - DNA, 25 bp, Mus musculus
tgataaccctcgagggaagaactcc

SEQ ID NO: 856946 - DNA, 25 bp, Mus musculus
tgataaccctcgtgggaagaactcc

SEQ ID NO: 856947 - DNA, 25 bp, Mus musculus
tgataaccctttatcacttactgta

SEQ ID NO: 856948 - DNA, 25 bp, Mus musculus
tgataaccctttttcacttactgta

SEQ ID NO: 856949 - DNA, 25 bp, Mus musculus
tgataaccgtgtcagctgccttggg

SEQ ID NO: 856950 - DNA, 25 bp, Mus musculus
tgataaccgtgtgagctgccttggg

SEQ ID NO: 856951 - DNA, 25 bp, Mus musculus
tgataaccttcaactagcaccctag

SEQ ID NO: 856952 - DNA, 25 bp, Mus musculus
tgataaccttcatctagcaccctag

SEQ ID NO: 856953 - DNA, 25 bp, Mus musculus
tgataacgagtgataattcccctca

SEQ ID NO: 856954 - DNA, 25 bp, Mus musculus
tgataacgagtgttaattcccctca

SEQ ID NO: 856955 - DNA, 25 bp, Mus musculus
tgataacgctacagtgacgctctca

SEQ ID NO: 856956 - DNA, 25 bp, Mus musculus
tgataacgctactgtgacgctctca

SEQ ID NO: 856957 - DNA, 25 bp, Mus musculus
tgataacgggtcagtgttgtcctct

SEQ ID NO: 856958 - DNA, 25 bp, Mus musculus
tgataacgggtctgtgttgtcctct

SEQ ID NO: 856959 - DNA, 25 bp, Mus musculus
tgataactaaatacttgtcttctgg

SEQ ID NO: 856960 - DNA, 25 bp, Mus musculus
tgataactaaattcttgtcttctgg

SEQ ID NO: 856961 - DNA, 25 bp, Mus musculus
tgataactatgtcccgttggcaccg

SEQ ID NO: 856962 - DNA, 25 bp, Mus musculus
tgataactatgtgccgttggcaccg

SEQ ID NO: 856963 - DNA, 25 bp, Mus musculus
tgataactattcactggcctctgtc

SEQ ID NO: 856964 - DNA, 25 bp, Mus musculus
tgataactattctctggcctctgtc

SEQ ID NO: 856965 - DNA, 25 bp, Mus musculus
tgataactccatcctacgtacttat

SEQ ID NO: 856966 - DNA, 25 bp, Mus musculus
tgataactccatgctacgtacttat

SEQ ID NO: 856967 - DNA, 25 bp, Mus musculus
tgataactcgggatccgggcttagg

SEQ ID NO: 856968 - DNA, 25 bp, Mus musculus
tgataactcgggttccgggcttagg

SEQ ID NO: 856969 - DNA, 25 bp, Mus musculus
tgataactctctaggtctcttggat

SEQ ID NO: 856970 - DNA, 25 bp, Mus musculus
tgataactctcttggtctcttggat

SEQ ID NO: 856971 - DNA, 25 bp, Mus musculus
tgataactgactacccgaggagcca

SEQ ID NO: 856972 - DNA, 25 bp, Mus musculus
tgataactgacttcccgaggagcca

SEQ ID NO: 856973 - DNA, 25 bp, Mus musculus
tgataactgatcagtttttagtgcc

SEQ ID NO: 856974 - DNA, 25 bp, Mus musculus
tgataactgatctgtttttagtgcc

SEQ ID NO: 856975 - DNA, 25 bp, Mus musculus
tgataactgatgctgctgagaagct

SEQ ID NO: 856976 - DNA, 25 bp, Mus musculus
tgataactgatggtgctgagaagct

SEQ ID NO: 856977 - DNA, 25 bp, Mus musculus
tgataactgtgaaaaatcattcatc

SEQ ID NO: 856978 - DNA, 25 bp, Mus musculus
tgataactgtgataaatcattcatc

SEQ ID NO: 856979 - DNA, 25 bp, Mus musculus
tgataacttgacacgttcccttctg

SEQ ID NO: 856980 - DNA, 25 bp, Mus musculus
tgataacttgactcgttcccttctg

SEQ ID NO: 856981 - DNA, 25 bp, Mus musculus
tgataactttttcccacaggttcga

SEQ ID NO: 856982 - DNA, 25 bp, Mus musculus
tgataactttttgccacaggttcga

SEQ ID NO: 856983 - DNA, 25 bp, Mus musculus
tgataagaactacggtctgctcagg

SEQ ID NO: 856984 - DNA, 25 bp, Mus musculus
tgataagaactagggtctgctcagg

SEQ ID NO: 856985 - DNA, 25 bp, Mus musculus
tgataagaatgcctacccagtgccc

SEQ ID NO: 856986 - DNA, 25 bp, Mus musculus
tgataagaatgcgtacccagtgccc

SEQ ID NO: 856987 - DNA, 25 bp, Mus musculus
tgataagacatcatactttacttca

SEQ ID NO: 856988 - DNA, 25 bp, Mus musculus
tgataagacatcttactttacttca

SEQ ID NO: 856989 - DNA, 25 bp, Mus musculus
tgataagagcagatgcctaccctgt

SEQ ID NO: 856990 - DNA, 25 bp, Mus musculus
tgataagagcagttgcctaccctgt

SEQ ID NO: 856991 - DNA, 25 bp, Mus musculus
tgataagagccaatccccataacag

SEQ ID NO: 856992 - DNA, 25 bp, Mus musculus
tgataagagccattccccataacag

SEQ ID NO: 856993 - DNA, 25 bp, Mus musculus
tgataagagtgaccgcatcacgcag

SEQ ID NO: 856994 - DNA, 25 bp, Mus musculus
tgataagagtgagcgcatcacgcag

SEQ ID NO: 856995 - DNA, 25 bp, Mus musculus
tgataagatccacctactttttcag

SEQ ID NO: 856996 - DNA, 25 bp, Mus musculus
tgataagatccagctactttttcag

SEQ ID NO: 856997 - DNA, 25 bp, Mus musculus
tgataagattcccattctcagcctt

SEQ ID NO: 856998 - DNA, 25 bp, Mus musculus
tgataagattccgattctcagcctt

SEQ ID NO: 856999 - DNA, 25 bp, Mus musculus
tgataagcacgaatgcctacctggc

SEQ ID NO: 857000 - DNA, 25 bp, Mus musculus
tgataagcacgattgcctacctggc

SEQ ID NO: 857001 - DNA, 25 bp, Mus musculus
tgataagcccagaccttaaaggtga

SEQ ID NO: 857002 - DNA, 25 bp, Mus musculus
tgataagcccagtccttaaaggtga

SEQ ID NO: 857003 - DNA, 25 bp, Mus musculus
tgataagctgcgcacattgacctcc

SEQ ID NO: 857004 - DNA, 25 bp, Mus musculus
tgataagctgcggacattgacctcc

SEQ ID NO: 857005 - DNA, 25 bp, Mus musculus
tgataagcttctctgccctgacgag

SEQ ID NO: 857006 - DNA, 25 bp, Mus musculus
tgataagcttctgtgccctgacgag

SEQ ID NO: 857007 - DNA, 25 bp, Mus musculus
tgataaggcatgattctttctgcac

SEQ ID NO: 857008 - DNA, 25 bp, Mus musculus
tgataaggcatgtttctttctgcac

SEQ ID NO: 857009 - DNA, 25 bp, Mus musculus
tgataaggccaactactcactcaac

SEQ ID NO: 857010 - DNA, 25 bp, Mus musculus
tgataaggccaagtactcactcaac

SEQ ID NO: 857011 - DNA, 25 bp, Mus musculus
tgataaggccatcctgcacagcgta

SEQ ID NO: 857012 - DNA, 25 bp, Mus musculus
tgataaggccatgctgcacagcgta

SEQ ID NO: 857013 - DNA, 25 bp, Mus musculus
tgataagggccaacagactgtggtg

SEQ ID NO: 857014 - DNA, 25 bp, Mus musculus
tgataagggccatcagactgtggtg

SEQ ID NO: 857015 - DNA, 25 bp, Mus musculus
tgataagtatatccctacagtgcca

SEQ ID NO: 857016 - DNA, 25 bp, Mus musculus
tgataagtatatgcctacagtgcca

SEQ ID NO: 857017 - DNA, 25 bp, Mus musculus
tgataagtctccaccactggcttca

SEQ ID NO: 857018 - DNA, 25 bp, Mus musculus
tgataagtctcctccactggcttca

SEQ ID NO: 857019 - DNA, 25 bp, Mus musculus
tgataagtgttgattctctctgctc

SEQ ID NO: 857020 - DNA, 25 bp, Mus musculus
tgataagtgttgtttctctctgctc

SEQ ID NO: 857021 - DNA, 25 bp, Mus musculus
tgataagttttaaggcaagcagttg

SEQ ID NO: 857022 - DNA, 25 bp, Mus musculus
tgataagttttatggcaagcagttg

SEQ ID NO: 857023 - DNA, 25 bp, Mus musculus
tgataataaggccttcgttccactc

SEQ ID NO: 857024 - DNA, 25 bp, Mus musculus
tgataataaggcgttcgttccactc

SEQ ID NO: 857025 - DNA, 25 bp, Mus musculus
tgataataccccacatacaatagaa

SEQ ID NO: 857026 - DNA, 25 bp, Mus musculus
tgataatacccctcatacaatagaa

SEQ ID NO: 857027 - DNA, 25 bp, Mus musculus
tgataatactctcaacccgtggctc

SEQ ID NO: 857028 - DNA, 25 bp, Mus musculus
tgataatactctgaacccgtggctc

SEQ ID NO: 857029 - DNA, 25 bp, Mus musculus
tgataatagctacgtgaccccaaca

SEQ ID NO: 857030 - DNA, 25 bp, Mus musculus
tgataatagctaggtgaccccaaca

SEQ ID NO: 857031 - DNA, 25 bp, Mus musculus
tgataataggccacctacagctcat

SEQ ID NO: 857032 - DNA, 25 bp, Mus musculus
tgataataggcctcctacagctcat

SEQ ID NO: 857033 - DNA, 25 bp, Mus musculus
tgataatatattcaaacaccacttg

SEQ ID NO: 857034 - DNA, 25 bp, Mus musculus
tgataatatattgaaacaccacttg

SEQ ID NO: 857035 - DNA, 25 bp, Mus musculus
tgataatcgagacgccccgcttcca

SEQ ID NO: 857036 - DNA, 25 bp, Mus musculus
tgataatcgagaggccccgcttcca

SEQ ID NO: 857037 - DNA, 25 bp, Mus musculus
tgataatcgcataagtcaagtcact

SEQ ID NO: 857038 - DNA, 25 bp, Mus musculus
tgataatcgcattagtcaagtcact

SEQ ID NO: 857039 - DNA, 25 bp, Mus musculus
tgataatctcggcaggagcatccct

SEQ ID NO: 857040 - DNA, 25 bp, Mus musculus
tgataatctcgggaggagcatccct

SEQ ID NO: 857041 - DNA, 25 bp, Mus musculus
tgataatctgaacccaaatttgtat

SEQ ID NO: 857042 - DNA, 25 bp, Mus musculus
tgataatctgaagccaaatttgtat

SEQ ID NO: 857043 - DNA, 25 bp, Mus musculus
tgataatcttcacggtcattcataa

SEQ ID NO: 857044 - DNA, 25 bp, Mus musculus
tgataatcttcagggtcattcataa

SEQ ID NO: 857045 - DNA, 25 bp, Mus musculus
tgataatcttccaaacattcatgtg

SEQ ID NO: 857046 - DNA, 25 bp, Mus musculus
tgataatcttcctaacattcatgtg

SEQ ID NO: 857047 - DNA, 25 bp, Mus musculus
tgataatgaactaacctgtcactgt

SEQ ID NO: 857048 - DNA, 25 bp, Mus musculus
tgataatgaacttacctgtcactgt

SEQ ID NO: 857049 - DNA, 25 bp, Mus musculus
tgataatgacagaaaagcaggctct

SEQ ID NO: 857050 - DNA, 25 bp, Mus musculus
tgataatgacagtaaagcaggctct

SEQ ID NO: 857051 - DNA, 25 bp, Mus musculus
tgataatgacatcggcgccgtgatt

SEQ ID NO: 857052 - DNA, 25 bp, Mus musculus
tgataatgacatgggcgccgtgatt

SEQ ID NO: 857053 - DNA, 25 bp, Mus musculus
tgataatgacgcaagctgcccatct

SEQ ID NO: 857054 - DNA, 25 bp, Mus musculus
tgataatgacgctagctgcccatct

SEQ ID NO: 857055 - DNA, 25 bp, Mus musculus
tgataatgatgtctctccctctaac

SEQ ID NO: 857056 - DNA, 25 bp, Mus musculus
tgataatgatgtgtctccctctaac

SEQ ID NO: 857057 - DNA, 25 bp, Mus musculus
tgataatgtaacacctctggctgtg

SEQ ID NO: 857058 - DNA, 25 bp, Mus musculus
tgataatgtaactcctctggctgtg

SEQ ID NO: 857059 - DNA, 25 bp, Mus musculus
tgataatgtgataggcaggctggcc

SEQ ID NO: 857060 - DNA, 25 bp, Mus musculus
tgataatgtgattggcaggctggcc

SEQ ID NO: 857061 - DNA, 25 bp, Mus musculus
tgataatgtgtcatttctctcaggg

SEQ ID NO: 857062 - DNA, 25 bp, Mus musculus
tgataatgtgtcttttctctcaggg

SEQ ID NO: 857063 - DNA, 25 bp, Mus musculus
tgataattgccccttcctatcttcc

SEQ ID NO: 857064 - DNA, 25 bp, Mus musculus
tgataattgcccgttcctatcttcc

SEQ ID NO: 857065 - DNA, 25 bp, Mus musculus
tgataatttacgaccattccaagtt

SEQ ID NO: 857066 - DNA, 25 bp, Mus musculus
tgataatttacgtccattccaagtt

SEQ ID NO: 857067 - DNA, 25 bp, Mus musculus
tgataatttcccatctccaaatgaa

SEQ ID NO: 857068 - DNA, 25 bp, Mus musculus
tgataatttcccttctccaaatgaa

SEQ ID NO: 857069 - DNA, 25 bp, Mus musculus
tgataatttgcacgacagcttcccc

SEQ ID NO: 857070 - DNA, 25 bp, Mus musculus
tgataatttgcaggacagcttcccc

SEQ ID NO: 857071 - DNA, 25 bp, Mus musculus
tgataatttggtaatgcttgctcca

SEQ ID NO: 857072 - DNA, 25 bp, Mus musculus
tgataatttggttatgcttgctcca

SEQ ID NO: 857073 - DNA, 25 bp, Mus musculus
tgatacaagcctagtgatcactggg

SEQ ID NO: 857074 - DNA, 25 bp, Mus musculus
tgatacaagccttgtgatcactggg

SEQ ID NO: 857075 - DNA, 25 bp, Mus musculus
tgatacaatattaccctcacttctg

SEQ ID NO: 857076 - DNA, 25 bp, Mus musculus
tgatacaatatttccctcacttctg

SEQ ID NO: 857077 - DNA, 25 bp, Mus musculus
tgatacaatctcattgggtgaaaat

SEQ ID NO: 857078 - DNA, 25 bp, Mus musculus
tgatacaatctctttgggtgaaaat

SEQ ID NO: 857079 - DNA, 25 bp, Mus musculus
tgatacaattttactggcagttata

SEQ ID NO: 857080 - DNA, 25 bp, Mus musculus
tgatacaatttttctggcagttata

SEQ ID NO: 857081 - DNA, 25 bp, Mus musculus
tgatacacacatatacttctagcag

SEQ ID NO: 857082 - DNA, 25 bp, Mus musculus
tgatacacacatttacttctagcag

SEQ ID NO: 857083 - DNA, 25 bp, Mus musculus
tgatacacccgccttttgtatacgt

SEQ ID NO: 857084 - DNA, 25 bp, Mus musculus
tgatacacccgcgttttgtatacgt

SEQ ID NO: 857085 - DNA, 25 bp, Mus musculus
tgatacagacacaggactccatctc

SEQ ID NO: 857086 - DNA, 25 bp, Mus musculus
tgatacagacactggactccatctc

SEQ ID NO: 857087 - DNA, 25 bp, Mus musculus
tgatacagtggcctacagggtttac

SEQ ID NO: 857088 - DNA, 25 bp, Mus musculus
tgatacagtggcgtacagggtttac

SEQ ID NO: 857089 - DNA, 25 bp, Mus musculus
tgatacagttatattccccagcacc

SEQ ID NO: 857090 - DNA, 25 bp, Mus musculus
tgatacagttattttccccagcacc

SEQ ID NO: 857091 - DNA, 25 bp, Mus musculus
tgatacatagcacaggacaaccttg

SEQ ID NO: 857092 - DNA, 25 bp, Mus musculus
tgatacatagcagaggacaaccttg

SEQ ID NO: 857093 - DNA, 25 bp, Mus musculus
tgatacatctctcatgcagtttggg

SEQ ID NO: 857094 - DNA, 25 bp, Mus musculus
tgatacatctctgatgcagtttggg

SEQ ID NO: 857095 - DNA, 25 bp, Mus musculus
tgatacatgcagcttcgacactaaa

SEQ ID NO: 857096 - DNA, 25 bp, Mus musculus
tgatacatgcaggttcgacactaaa

SEQ ID NO: 857097 - DNA, 25 bp, Mus musculus
tgataccaccttcctcacaggatta

SEQ ID NO: 857098 - DNA, 25 bp, Mus musculus
tgataccaccttgctcacaggatta

SEQ ID NO: 857099 - DNA, 25 bp, Mus musculus
tgataccagatcctttcccgtggtt

SEQ ID NO: 857100 - DNA, 25 bp, Mus musculus
tgataccagatcgtttcccgtggtt

SEQ ID NO: 857101 - DNA, 25 bp, Mus musculus
tgataccatcgaactgcttggcgct

SEQ ID NO: 857102 - DNA, 25 bp, Mus musculus
tgataccatcgatctgcttggcgct

SEQ ID NO: 857103 - DNA, 25 bp, Mus musculus
tgataccatcttccagaatcctatg

SEQ ID NO: 857104 - DNA, 25 bp, Mus musculus
tgataccatcttgcagaatcctatg

SEQ ID NO: 857105 - DNA, 25 bp, Mus musculus
tgataccattcacctgattctccaa

SEQ ID NO: 857106 - DNA, 25 bp, Mus musculus
tgataccattcagctgattctccaa

SEQ ID NO: 857107 - DNA, 25 bp, Mus musculus
tgatacccacagagcttaggaagag

SEQ ID NO: 857108 - DNA, 25 bp, Mus musculus
tgatacccacagtgcttaggaagag

SEQ ID NO: 857109 - DNA, 25 bp, Mus musculus
tgatacccagcgatctctggttgct

SEQ ID NO: 857110 - DNA, 25 bp, Mus musculus
tgatacccagcgttctctggttgct

SEQ ID NO: 857111 - DNA, 25 bp, Mus musculus
tgatacccagtacttcgtctacagc

SEQ ID NO: 857112 - DNA, 25 bp, Mus musculus
tgatacccagtagttcgtctacagc

SEQ ID NO: 857113 - DNA, 25 bp, Mus musculus
tgatacccatgtcatcccgatttgc

SEQ ID NO: 857114 - DNA, 25 bp, Mus musculus
tgatacccatgtgatcccgatttgc

SEQ ID NO: 857115 - DNA, 25 bp, Mus musculus
tgataccccgagaccgagaacttgc

SEQ ID NO: 857116 - DNA, 25 bp, Mus musculus
tgataccccgagtccgagaacttgc

SEQ ID NO: 857117 - DNA, 25 bp, Mus musculus
tgatacccgggcagctagggtcaag

SEQ ID NO: 857118 - DNA, 25 bp, Mus musculus
tgatacccgggctgctagggtcaag

SEQ ID NO: 857119 - DNA, 25 bp, Mus musculus
tgataccctataaatggcccacata

SEQ ID NO: 857120 - DNA, 25 bp, Mus musculus
tgataccctatatatggcccacata

SEQ ID NO: 857121 - DNA, 25 bp, Mus musculus
tgataccctctgatatccatggttt

SEQ ID NO: 857122 - DNA, 25 bp, Mus musculus
tgataccctctgttatccatggttt

SEQ ID NO: 857123 - DNA, 25 bp, Mus musculus
tgataccctcttacggctgaggagt

SEQ ID NO: 857124 - DNA, 25 bp, Mus musculus
tgataccctcttatgacccttgaag

SEQ ID NO: 857125 - DNA, 25 bp, Mus musculus
tgataccctctttcggctgaggagt

SEQ ID NO: 857126 - DNA, 25 bp, Mus musculus
tgataccctcttttgacccttgaag

SEQ ID NO: 857127 - DNA, 25 bp, Mus musculus
tgataccctgtcacatcacaacaca

SEQ ID NO: 857128 - DNA, 25 bp, Mus musculus
tgataccctgtctcatcacaacaca

SEQ ID NO: 857129 - DNA, 25 bp, Mus musculus
tgatacccttgcacctggcggaata

SEQ ID NO: 857130 - DNA, 25 bp, Mus musculus
tgatacccttgctcctggcggaata

SEQ ID NO: 857131 - DNA, 25 bp, Mus musculus
tgatacctcaccacctaggtgatga

SEQ ID NO: 857132 - DNA, 25 bp, Mus musculus
tgatacctcacctcctaggtgatga

SEQ ID NO: 857133 - DNA, 25 bp, Mus musculus
tgatacctcataatggcctcaaatt

SEQ ID NO: 857134 - DNA, 25 bp, Mus musculus
tgatacctcatattggcctcaaatt

SEQ ID NO: 857135 - DNA, 25 bp, Mus musculus
tgatacctctccaatagccatggtt

SEQ ID NO: 857136 - DNA, 25 bp, Mus musculus
tgatacctctcctatagccatggtt

SEQ ID NO: 857137 - DNA, 25 bp, Mus musculus
tgatacctgcccatccttggaaaaa

SEQ ID NO: 857138 - DNA, 25 bp, Mus musculus
tgatacctgcccttccttggaaaaa

SEQ ID NO: 857139 - DNA, 25 bp, Mus musculus
tgatacctggaaaagggtcccagcc

SEQ ID NO: 857140 - DNA, 25 bp, Mus musculus
tgatacctggaaccgataactgcaa

SEQ ID NO: 857141 - DNA, 25 bp, Mus musculus
tgatacctggaagcgataactgcaa

SEQ ID NO: 857142 - DNA, 25 bp, Mus musculus
tgatacctggaatagggtcccagcc

SEQ ID NO: 857143 - DNA, 25 bp, Mus musculus
tgatacctgtaacctcagtactcag

SEQ ID NO: 857144 - DNA, 25 bp, Mus musculus
tgatacctgtaagctcagtactcag

SEQ ID NO: 857145 - DNA, 25 bp, Mus musculus
tgatacctgtcaacactgggaagca

SEQ ID NO: 857146 - DNA, 25 bp, Mus musculus
tgatacctgtcatcactgggaagca

SEQ ID NO: 857147 - DNA, 25 bp, Mus musculus
tgataccttcagatgggcatttttg

SEQ ID NO: 857148 - DNA, 25 bp, Mus musculus
tgataccttcagttgggcatttttg

SEQ ID NO: 857149 - DNA, 25 bp, Mus musculus
tgataccttgagaacacatctggag

SEQ ID NO: 857150 - DNA, 25 bp, Mus musculus
tgataccttgagtacacatctggag

SEQ ID NO: 857151 - DNA, 25 bp, Mus musculus
tgatacgaggacaggccatgctatg

SEQ ID NO: 857152 - DNA, 25 bp, Mus musculus
tgatacgaggactggccatgctatg

SEQ ID NO: 857153 - DNA, 25 bp, Mus musculus
tgatacgagtttaaatgggtcctct

SEQ ID NO: 857154 - DNA, 25 bp, Mus musculus
tgatacgagttttaatgggtcctct

SEQ ID NO: 857155 - DNA, 25 bp, Mus musculus
tgatacgcatccagcctctgaagct

SEQ ID NO: 857156 - DNA, 25 bp, Mus musculus
tgatacgcatcctgcctctgaagct

SEQ ID NO: 857157 - DNA, 25 bp, Mus musculus
tgatacgctctgctgaccatcaaga

SEQ ID NO: 857158 - DNA, 25 bp, Mus musculus
tgatacgctctggtgaccatcaaga

SEQ ID NO: 857159 - DNA, 25 bp, Mus musculus
tgatacggacctagtggctatattt

SEQ ID NO: 857160 - DNA, 25 bp, Mus musculus
tgatacggaccttgtggctatattt

SEQ ID NO: 857161 - DNA, 25 bp, Mus musculus
tgatacgggcgaaataatgctcgat

SEQ ID NO: 857162 - DNA, 25 bp, Mus musculus
tgatacgggcgatataatgctcgat

SEQ ID NO: 857163 - DNA, 25 bp, Mus musculus
tgatacggttgccaattctgtgccc

SEQ ID NO: 857164 - DNA, 25 bp, Mus musculus
tgatacggttgcgaattctgtgccc

SEQ ID NO: 857165 - DNA, 25 bp, Mus musculus
tgatacgtgattccctactaattag

SEQ ID NO: 857166 - DNA, 25 bp, Mus musculus
tgatacgtgattgcctactaattag

SEQ ID NO: 857167 - DNA, 25 bp, Mus musculus
tgatactaacttagagccacttggg

SEQ ID NO: 857168 - DNA, 25 bp, Mus musculus
tgatactaactttgagccacttggg

SEQ ID NO: 857169 - DNA, 25 bp, Mus musculus
tgatactagcagattaaccaccata

SEQ ID NO: 857170 - DNA, 25 bp, Mus musculus
tgatactagcagtttaaccaccata

SEQ ID NO: 857171 - DNA, 25 bp, Mus musculus
tgatactatttgctcataatttatt

SEQ ID NO: 857172 - DNA, 25 bp, Mus musculus
tgatactatttggtcataatttatt

SEQ ID NO: 857173 - DNA, 25 bp, Mus musculus
tgatactcacagaaccctcttgcta

SEQ ID NO: 857174 - DNA, 25 bp, Mus musculus
tgatactcacagtaccctcttgcta

SEQ ID NO: 857175 - DNA, 25 bp, Mus musculus
tgatactcacttctgtcataatggc

SEQ ID NO: 857176 - DNA, 25 bp, Mus musculus
tgatactcacttgtgtcataatggc

SEQ ID NO: 857177 - DNA, 25 bp, Mus musculus
tgatactccactactgagtctttct

SEQ ID NO: 857178 - DNA, 25 bp, Mus musculus
tgatactccacttctgagtctttct

SEQ ID NO: 857179 - DNA, 25 bp, Mus musculus
tgatactcccacacaggagggtgct

SEQ ID NO: 857180 - DNA, 25 bp, Mus musculus
tgatactcccactcaggagggtgct

SEQ ID NO: 857181 - DNA, 25 bp, Mus musculus
tgatactcttctccacacagcctga

SEQ ID NO: 857182 - DNA, 25 bp, Mus musculus
tgatactcttctgcacacagcctga

SEQ ID NO: 857183 - DNA, 25 bp, Mus musculus
tgatactgacacaattgtttggctg

SEQ ID NO: 857184 - DNA, 25 bp, Mus musculus
tgatactgacactattgtttggctg

SEQ ID NO: 857185 - DNA, 25 bp, Mus musculus
tgatactgcacaagccaagaaaggt

SEQ ID NO: 857186 - DNA, 25 bp, Mus musculus
tgatactgcacatgccaagaaaggt

SEQ ID NO: 857187 - DNA, 25 bp, Mus musculus
tgatactgcctgactggtgtagctc

SEQ ID NO: 857188 - DNA, 25 bp, Mus musculus
tgatactgcctgtctggtgtagctc

SEQ ID NO: 857189 - DNA, 25 bp, Mus musculus
tgatactgcgctcgtgacaggtcca

SEQ ID NO: 857190 - DNA, 25 bp, Mus musculus
tgatactgcgctggtgacaggtcca

SEQ ID NO: 857191 - DNA, 25 bp, Mus musculus
tgatactggcatccaacagacacat

SEQ ID NO: 857192 - DNA, 25 bp, Mus musculus
tgatactggcatgcaacagacacat

SEQ ID NO: 857193 - DNA, 25 bp, Mus musculus
tgatactgggccagtggacacacaa

SEQ ID NO: 857194 - DNA, 25 bp, Mus musculus
tgatactgggcctgtggacacacaa

SEQ ID NO: 857195 - DNA, 25 bp, Mus musculus
tgatacttacacagttctccacttg

SEQ ID NO: 857196 - DNA, 25 bp, Mus musculus
tgatacttacactgttctccacttg

SEQ ID NO: 857197 - DNA, 25 bp, Mus musculus
tgatacttccctcccaagctgttta

SEQ ID NO: 857198 - DNA, 25 bp, Mus musculus
tgatacttccctgccaagctgttta

SEQ ID NO: 857199 - DNA, 25 bp, Mus musculus
tgatacttctgacccctgagcaatc

SEQ ID NO: 857200 - DNA, 25 bp, Mus musculus
tgatacttctgagccctgagcaatc

SEQ ID NO: 857201 - DNA, 25 bp, Mus musculus
tgatacttcttacgcaccgctgcag

SEQ ID NO: 857202 - DNA, 25 bp, Mus musculus
tgatacttcttaggcaccgctgcag

SEQ ID NO: 857203 - DNA, 25 bp, Mus musculus
tgatacttgagacactggctgccac

SEQ ID NO: 857204 - DNA, 25 bp, Mus musculus
tgatacttgagagactggctgccac

SEQ ID NO: 857205 - DNA, 25 bp, Mus musculus
tgatacttgcttagtgtgctctgtg

SEQ ID NO: 857206 - DNA, 25 bp, Mus musculus
tgatacttgctttgtgtgctctgtg

SEQ ID NO: 857207 - DNA, 25 bp, Mus musculus
tgatactttttcattcactttcaag

SEQ ID NO: 857208 - DNA, 25 bp, Mus musculus
tgatactttttctttcactttcaag

SEQ ID NO: 857209 - DNA, 25 bp, Mus musculus
tgatagaaactcatgttcacccaca

SEQ ID NO: 857210 - DNA, 25 bp, Mus musculus
tgatagaaactcttgttcacccaca

SEQ ID NO: 857211 - DNA, 25 bp, Mus musculus
tgatagaaaggacaacgctcctgaa

SEQ ID NO: 857212 - DNA, 25 bp, Mus musculus
tgatagaaaggagaacgctcctgaa

SEQ ID NO: 857213 - DNA, 25 bp, Mus musculus
tgatagaacattacagcaagagact

SEQ ID NO: 857214 - DNA, 25 bp, Mus musculus
tgatagaacatttcagcaagagact

SEQ ID NO: 857215 - DNA, 25 bp, Mus musculus
tgatagacctctccatacagccact

SEQ ID NO: 857216 - DNA, 25 bp, Mus musculus
tgatagacctctgcatacagccact

SEQ ID NO: 857217 - DNA, 25 bp, Mus musculus
tgatagactcagagggacccatgac

SEQ ID NO: 857218 - DNA, 25 bp, Mus musculus
tgatagactcagtgggacccatgac

SEQ ID NO: 857219 - DNA, 25 bp, Mus musculus
tgatagagctttacaacgccccgga

SEQ ID NO: 857220 - DNA, 25 bp, Mus musculus
tgatagagcttttcaacgccccgga

SEQ ID NO: 857221 - DNA, 25 bp, Mus musculus
tgatagagggagctctggccactca

SEQ ID NO: 857222 - DNA, 25 bp, Mus musculus
tgatagagggaggtctggccactca

SEQ ID NO: 857223 - DNA, 25 bp, Mus musculus
tgatagagggctagcccagcacact

SEQ ID NO: 857224 - DNA, 25 bp, Mus musculus
tgatagagggcttgcccagcacact

SEQ ID NO: 857225 - DNA, 25 bp, Mus musculus
tgatagagtattatgctgcacatgc

SEQ ID NO: 857226 - DNA, 25 bp, Mus musculus
tgatagagtattttgctgcacatgc

SEQ ID NO: 857227 - DNA, 25 bp, Mus musculus
tgatagagtcatccacgggtcctgt

SEQ ID NO: 857228 - DNA, 25 bp, Mus musculus
tgatagagtcatgcacgggtcctgt

SEQ ID NO: 857229 - DNA, 25 bp, Mus musculus
tgatagattccgaagacagctcatt

SEQ ID NO: 857230 - DNA, 25 bp, Mus musculus
tgatagattccgtagacagctcatt

SEQ ID NO: 857231 - DNA, 25 bp, Mus musculus
tgatagcaacctatgaccccaagcc

SEQ ID NO: 857232 - DNA, 25 bp, Mus musculus
tgatagcaacctttgaccccaagcc

SEQ ID NO: 857233 - DNA, 25 bp, Mus musculus
tgatagcacccaagtttactttaaa

SEQ ID NO: 857234 - DNA, 25 bp, Mus musculus
tgatagcacccatgtttactttaaa

SEQ ID NO: 857235 - DNA, 25 bp, Mus musculus
tgatagcactcgaggctctggcggt

SEQ ID NO: 857236 - DNA, 25 bp, Mus musculus
tgatagcactcgtggctctggcggt

SEQ ID NO: 857237 - DNA, 25 bp, Mus musculus
tgatagcagtgaagccaagcaggca

SEQ ID NO: 857238 - DNA, 25 bp, Mus musculus
tgatagcagtgatgccaagcaggca

SEQ ID NO: 857239 - DNA, 25 bp, Mus musculus
tgatagcagttcatcttggtagccc

SEQ ID NO: 857240 - DNA, 25 bp, Mus musculus
tgatagcagttcttcttggtagccc

SEQ ID NO: 857241 - DNA, 25 bp, Mus musculus
tgatagcataaacgcacttctaggg

SEQ ID NO: 857242 - DNA, 25 bp, Mus musculus
tgatagcataaaggcacttctaggg

SEQ ID NO: 857243 - DNA, 25 bp, Mus musculus
tgatagcatcaccaggcaacctcct

SEQ ID NO: 857244 - DNA, 25 bp, Mus musculus
tgatagcatcacgaggcaacctcct

SEQ ID NO: 857245 - DNA, 25 bp, Mus musculus
tgatagcatctcattccatgaaccg

SEQ ID NO: 857246 - DNA, 25 bp, Mus musculus
tgatagcatctctttccatgaaccg

SEQ ID NO: 857247 - DNA, 25 bp, Mus musculus
tgatagccagttattacaccctcct

SEQ ID NO: 857248 - DNA, 25 bp, Mus musculus
tgatagccagtttttacaccctcct

SEQ ID NO: 857249 - DNA, 25 bp, Mus musculus
tgatagcccaggcccaggaccttag

SEQ ID NO: 857250 - DNA, 25 bp, Mus musculus
tgatagcccagggccaggaccttag

SEQ ID NO: 857251 - DNA, 25 bp, Mus musculus
tgatagccccaaaatgcacaagttt

SEQ ID NO: 857252 - DNA, 25 bp, Mus musculus
tgatagccccaatatgcacaagttt

SEQ ID NO: 857253 - DNA, 25 bp, Mus musculus
tgatagccgaaacaatttgcacgta

SEQ ID NO: 857254 - DNA, 25 bp, Mus musculus
tgatagccgaaagaatttgcacgta

SEQ ID NO: 857255 - DNA, 25 bp, Mus musculus
tgatagcctaataatagtcaaaact

SEQ ID NO: 857256 - DNA, 25 bp, Mus musculus
tgatagcctaattatagtcaaaact

SEQ ID NO: 857257 - DNA, 25 bp, Mus musculus
tgatagcctacacccttaacactgt

SEQ ID NO: 857258 - DNA, 25 bp, Mus musculus
tgatagcctacagccttaacactgt

SEQ ID NO: 857259 - DNA, 25 bp, Mus musculus
tgatagcctctgaagcaagcgttgg

SEQ ID NO: 857260 - DNA, 25 bp, Mus musculus
tgatagcctctgtagcaagcgttgg

SEQ ID NO: 857261 - DNA, 25 bp, Mus musculus
tgatagcctgagaggtctttttcat

SEQ ID NO: 857262 - DNA, 25 bp, Mus musculus
tgatagcctgagtggtctttttcat

SEQ ID NO: 857263 - DNA, 25 bp, Mus musculus
tgatagctacttcggctaaccctgc

SEQ ID NO: 857264 - DNA, 25 bp, Mus musculus
tgatagctacttgggctaaccctgc

SEQ ID NO: 857265 - DNA, 25 bp, Mus musculus
tgatagctctgtctccatgtgtctc

SEQ ID NO: 857266 - DNA, 25 bp, Mus musculus
tgatagctctgtgtccatgtgtctc

SEQ ID NO: 857267 - DNA, 25 bp, Mus musculus
tgatagctgatcctttaacattttt

SEQ ID NO: 857268 - DNA, 25 bp, Mus musculus
tgatagctgatcgtttaacattttt

SEQ ID NO: 857269 - DNA, 25 bp, Mus musculus
tgatagctgattagagacctttttt

SEQ ID NO: 857270 - DNA, 25 bp, Mus musculus
tgatagctgatttgagacctttttt

SEQ ID NO: 857271 - DNA, 25 bp, Mus musculus
tgataggaaaccctcttttcccaag

SEQ ID NO: 857272 - DNA, 25 bp, Mus musculus
tgataggaaaccgtcttttcccaag

SEQ ID NO: 857273 - DNA, 25 bp, Mus musculus
tgataggaaccaatgggtcctctgc

SEQ ID NO: 857274 - DNA, 25 bp, Mus musculus
tgataggaaccattgggtcctctgc

SEQ ID NO: 857275 - DNA, 25 bp, Mus musculus
tgataggaagacagacatcatcaca

SEQ ID NO: 857276 - DNA, 25 bp, Mus musculus
tgataggaagactgacatcatcaca

SEQ ID NO: 857277 - DNA, 25 bp, Mus musculus
tgataggacacaccgactcaacaga

SEQ ID NO: 857278 - DNA, 25 bp, Mus musculus
tgataggacacagcgactcaacaga

SEQ ID NO: 857279 - DNA, 25 bp, Mus musculus
tgataggatctacggttcaaggcaa

SEQ ID NO: 857280 - DNA, 25 bp, Mus musculus
tgataggatctagggttcaaggcaa

SEQ ID NO: 857281 - DNA, 25 bp, Mus musculus
tgataggctacacaatccccactag

SEQ ID NO: 857282 - DNA, 25 bp, Mus musculus
tgataggctacagaatccccactag

SEQ ID NO: 857283 - DNA, 25 bp, Mus musculus
tgataggctgtgaccagtggttgtg

SEQ ID NO: 857284 - DNA, 25 bp, Mus musculus
tgataggctgtgtccagtggttgtg

SEQ ID NO: 857285 - DNA, 25 bp, Mus musculus
tgatagggacaacagacctcctccc

SEQ ID NO: 857286 - DNA, 25 bp, Mus musculus
tgatagggacaagagacctcctccc

SEQ ID NO: 857287 - DNA, 25 bp, Mus musculus
tgatagggaggcatcctcatgtctc

SEQ ID NO: 857288 - DNA, 25 bp, Mus musculus
tgatagggaggcttcctcatgtctc

SEQ ID NO: 857289 - DNA, 25 bp, Mus musculus
tgatagggtcatagcagccctgtct

SEQ ID NO: 857290 - DNA, 25 bp, Mus musculus
tgatagggtcattgcagccctgtct

SEQ ID NO: 857291 - DNA, 25 bp, Mus musculus
tgataggtcatcagccattttggaa

SEQ ID NO: 857292 - DNA, 25 bp, Mus musculus
tgataggtcatctgccattttggaa

SEQ ID NO: 857293 - DNA, 25 bp, Mus musculus
tgataggttctgcttctcatctgca

SEQ ID NO: 857294 - DNA, 25 bp, Mus musculus
tgataggttctggttctcatctgca

SEQ ID NO: 857295 - DNA, 25 bp, Mus musculus
tgataggttgtgaggaggtgctgac

SEQ ID NO: 857296 - DNA, 25 bp, Mus musculus
tgataggttgtgtggaggtgctgac

SEQ ID NO: 857297 - DNA, 25 bp, Mus musculus
tgataggtttccacagcacgacgca

SEQ ID NO: 857298 - DNA, 25 bp, Mus musculus
tgataggtttcctcagcacgacgca

SEQ ID NO: 857299 - DNA, 25 bp, Mus musculus
tgataggtttgcacacagggtcccc

SEQ ID NO: 857300 - DNA, 25 bp, Mus musculus
tgataggtttgctcacagggtcccc

SEQ ID NO: 857301 - DNA, 25 bp, Mus musculus
tgatagtaacacctctgccacgcat

SEQ ID NO: 857302 - DNA, 25 bp, Mus musculus
tgatagtaacacgtctgccacgcat

SEQ ID NO: 857303 - DNA, 25 bp, Mus musculus
tgatagtagccaccagctcactgcc

SEQ ID NO: 857304 - DNA, 25 bp, Mus musculus
tgatagtagccagcagctcactgcc

SEQ ID NO: 857305 - DNA, 25 bp, Mus musculus
tgatagtattacagttatgtgtcaa

SEQ ID NO: 857306 - DNA, 25 bp, Mus musculus
tgatagtattactgttatgtgtcaa

SEQ ID NO: 857307 - DNA, 25 bp, Mus musculus
tgatagtattcaaaaacgttttact

SEQ ID NO: 857308 - DNA, 25 bp, Mus musculus
tgatagtattcataaacgttttact

SEQ ID NO: 857309 - DNA, 25 bp, Mus musculus
tgatagtcacttatggcaacccagg

SEQ ID NO: 857310 - DNA, 25 bp, Mus musculus
tgatagtcacttttggcaacccagg

SEQ ID NO: 857311 - DNA, 25 bp, Mus musculus
tgatagtcagcaccacagattccca

SEQ ID NO: 857312 - DNA, 25 bp, Mus musculus
tgatagtcagcagcacagattccca

SEQ ID NO: 857313 - DNA, 25 bp, Mus musculus
tgatagtcatcgatgctgcttcaca

SEQ ID NO: 857314 - DNA, 25 bp, Mus musculus
tgatagtcatcgttgctgcttcaca

SEQ ID NO: 857315 - DNA, 25 bp, Mus musculus
tgatagtccctaaggtgtgtgtttt

SEQ ID NO: 857316 - DNA, 25 bp, Mus musculus
tgatagtccctatggtgtgtgtttt

SEQ ID NO: 857317 - DNA, 25 bp, Mus musculus
tgatagtctgatctctgctctggaa

SEQ ID NO: 857318 - DNA, 25 bp, Mus musculus
tgatagtctgatgtctgctctggaa

SEQ ID NO: 857319 - DNA, 25 bp, Mus musculus
tgatagtgccccaccttctgcatgg

SEQ ID NO: 857320 - DNA, 25 bp, Mus musculus
tgatagtgcccctccttctgcatgg

SEQ ID NO: 857321 - DNA, 25 bp, Mus musculus
tgatagtgtccgactgcctggaatc

SEQ ID NO: 857322 - DNA, 25 bp, Mus musculus
tgatagtgtccgtctgcctggaatc

SEQ ID NO: 857323 - DNA, 25 bp, Mus musculus
tgatagtgtgggaacatacagggaa

SEQ ID NO: 857324 - DNA, 25 bp, Mus musculus
tgatagtgtgggtacatacagggaa

SEQ ID NO: 857325 - DNA, 25 bp, Mus musculus
tgatagttgtcacccagagcctgga

SEQ ID NO: 857326 - DNA, 25 bp, Mus musculus
tgatagttgtcagccagagcctgga

SEQ ID NO: 857327 - DNA, 25 bp, Mus musculus
tgatagtttacaaaagaccctaggt

SEQ ID NO: 857328 - DNA, 25 bp, Mus musculus
tgatagtttacataagaccctaggt

SEQ ID NO: 857329 - DNA, 25 bp, Mus musculus
tgatataaacctatgcagcacgctg

SEQ ID NO: 857330 - DNA, 25 bp, Mus musculus
tgatataaacctttgcagcacgctg

SEQ ID NO: 857331 - DNA, 25 bp, Mus musculus
tgatataagcatatttccctaggga

SEQ ID NO: 857332 - DNA, 25 bp, Mus musculus
tgatataagcatttttccctaggga

SEQ ID NO: 857333 - DNA, 25 bp, Mus musculus
tgatataatccccttagccaactcc

SEQ ID NO: 857334 - DNA, 25 bp, Mus musculus
tgatataatcccgttagccaactcc

SEQ ID NO: 857335 - DNA, 25 bp, Mus musculus
tgatataatggtagccactggctga

SEQ ID NO: 857336 - DNA, 25 bp, Mus musculus
tgatataatggttgccactggctga

SEQ ID NO: 857337 - DNA, 25 bp, Mus musculus
tgatataattacaacttgctgtttc

SEQ ID NO: 857338 - DNA, 25 bp, Mus musculus
tgatataattactacttgctgtttc

SEQ ID NO: 857339 - DNA, 25 bp, Mus musculus
tgatatacatggcactctctaccac

SEQ ID NO: 857340 - DNA, 25 bp, Mus musculus
tgatatacatgggactctctaccac

SEQ ID NO: 857341 - DNA, 25 bp, Mus musculus
tgatatacccctccacaaaaagtgt

SEQ ID NO: 857342 - DNA, 25 bp, Mus musculus
tgatatacccctgcacaaaaagtgt

SEQ ID NO: 857343 - DNA, 25 bp, Mus musculus
tgatatagaatgcatcaggtccagg

SEQ ID NO: 857344 - DNA, 25 bp, Mus musculus
tgatatagaatggatcaggtccagg

SEQ ID NO: 857345 - DNA, 25 bp, Mus musculus
tgatatagacctagacacagaaacg

SEQ ID NO: 857346 - DNA, 25 bp, Mus musculus
tgatatagaccttgacacagaaacg

SEQ ID NO: 857347 - DNA, 25 bp, Mus musculus
tgatataggcttatgcggcagtgga

SEQ ID NO: 857348 - DNA, 25 bp, Mus musculus
tgatataggcttttgcggcagtgga

SEQ ID NO: 857349 - DNA, 25 bp, Mus musculus
tgatatagggttactcttggtagcc

SEQ ID NO: 857350 - DNA, 25 bp, Mus musculus
tgatatagggtttctcttggtagcc

SEQ ID NO: 857351 - DNA, 25 bp, Mus musculus
tgatatatcaaacaccacacggtcg

SEQ ID NO: 857352 - DNA, 25 bp, Mus musculus
tgatatatcaaagaccacacggtcg

SEQ ID NO: 857353 - DNA, 25 bp, Mus musculus
tgatatcaagccagttactactggg

SEQ ID NO: 857354 - DNA, 25 bp, Mus musculus
tgatatcaagcctgttactactggg

SEQ ID NO: 857355 - DNA, 25 bp, Mus musculus
tgatatcacaccatccacagatgac

SEQ ID NO: 857356 - DNA, 25 bp, Mus musculus
tgatatcacaccttccacagatgac

SEQ ID NO: 857357 - DNA, 25 bp, Mus musculus
tgatatcaccctagcactgaagacc

SEQ ID NO: 857358 - DNA, 25 bp, Mus musculus
tgatatcacccttgcactgaagacc

SEQ ID NO: 857359 - DNA, 25 bp, Mus musculus
tgatatcagcctcccacacaagtat

SEQ ID NO: 857360 - DNA, 25 bp, Mus musculus
tgatatcagcctgccacacaagtat

SEQ ID NO: 857361 - DNA, 25 bp, Mus musculus
tgatatcatagtattgagctatcca

SEQ ID NO: 857362 - DNA, 25 bp, Mus musculus
tgatatcatagttttgagctatcca

SEQ ID NO: 857363 - DNA, 25 bp, Mus musculus
tgatatcatgtacacaggcacgctt

SEQ ID NO: 857364 - DNA, 25 bp, Mus musculus
tgatatcatgtagacaggcacgctt

SEQ ID NO: 857365 - DNA, 25 bp, Mus musculus
tgatatccaagtctctgtgattgtg

SEQ ID NO: 857366 - DNA, 25 bp, Mus musculus
tgatatccaagtgtctgtgattgtg

SEQ ID NO: 857367 - DNA, 25 bp, Mus musculus
tgatatccatccaggtacccagtct

SEQ ID NO: 857368 - DNA, 25 bp, Mus musculus
tgatatccatcctggtacccagtct

SEQ ID NO: 857369 - DNA, 25 bp, Mus musculus
tgatatcccatacctgcaggcctct

SEQ ID NO: 857370 - DNA, 25 bp, Mus musculus
tgatatcccatagctgcaggcctct

SEQ ID NO: 857371 - DNA, 25 bp, Mus musculus
tgatatccccgtcgacagcccaaaa

SEQ ID NO: 857372 - DNA, 25 bp, Mus musculus
tgatatccccgtggacagcccaaaa

SEQ ID NO: 857373 - DNA, 25 bp, Mus musculus
tgatatccctatacactgccaatta

SEQ ID NO: 857374 - DNA, 25 bp, Mus musculus
tgatatccctattcactgccaatta

SEQ ID NO: 857375 - DNA, 25 bp, Mus musculus
tgatatcgaatcacttgccttcaac

SEQ ID NO: 857376 - DNA, 25 bp, Mus musculus
tgatatcgaatctcttgccttcaac

SEQ ID NO: 857377 - DNA, 25 bp, Mus musculus
tgatatcgttctcaagcagctccat

SEQ ID NO: 857378 - DNA, 25 bp, Mus musculus
tgatatcgttctgaagcagctccat

SEQ ID NO: 857379 - DNA, 25 bp, Mus musculus
tgatatctcagaagtggctctccag

SEQ ID NO: 857380 - DNA, 25 bp, Mus musculus
tgatatctcagatgtggctctccag

SEQ ID NO: 857381 - DNA, 25 bp, Mus musculus
tgatatctccggacactgaaccact

SEQ ID NO: 857382 - DNA, 25 bp, Mus musculus
tgatatctccggtcactgaaccact

SEQ ID NO: 857383 - DNA, 25 bp, Mus musculus
tgatatctcctgagcgatcttcact

SEQ ID NO: 857384 - DNA, 25 bp, Mus musculus
tgatatctcctgtgcgatcttcact

SEQ ID NO: 857385 - DNA, 25 bp, Mus musculus
tgatatctccttcgcagtctgtatg

SEQ ID NO: 857386 - DNA, 25 bp, Mus musculus
tgatatctccttggcagtctgtatg

SEQ ID NO: 857387 - DNA, 25 bp, Mus musculus
tgatatctctctcacatgatcttcc

SEQ ID NO: 857388 - DNA, 25 bp, Mus musculus
tgatatctctctgacatgatcttcc

SEQ ID NO: 857389 - DNA, 25 bp, Mus musculus
tgatatctgggcctccaagttccag

SEQ ID NO: 857390 - DNA, 25 bp, Mus musculus
tgatatctgggcgtccaagttccag

SEQ ID NO: 857391 - DNA, 25 bp, Mus musculus
tgatatctgggtatgcactgctcct

SEQ ID NO: 857392 - DNA, 25 bp, Mus musculus
tgatatctgggtttgcactgctcct

SEQ ID NO: 857393 - DNA, 25 bp, Mus musculus
tgatatctgtacatcgtggagcaca

SEQ ID NO: 857394 - DNA, 25 bp, Mus musculus
tgatatctgtacttcgtggagcaca

SEQ ID NO: 857395 - DNA, 25 bp, Mus musculus
tgatatctgtccagttgaccactca

SEQ ID NO: 857396 - DNA, 25 bp, Mus musculus
tgatatctgtcctgttgaccactca

SEQ ID NO: 857397 - DNA, 25 bp, Mus musculus
tgatatcttagtccactcttcgctg

SEQ ID NO: 857398 - DNA, 25 bp, Mus musculus
tgatatcttagtgcactcttcgctg

SEQ ID NO: 857399 - DNA, 25 bp, Mus musculus
tgatatcttatgagcctggacctgc

SEQ ID NO: 857400 - DNA, 25 bp, Mus musculus
tgatatcttatgtgcctggacctgc

SEQ ID NO: 857401 - DNA, 25 bp, Mus musculus
tgatatcttgctcgccttattttta

SEQ ID NO: 857402 - DNA, 25 bp, Mus musculus
tgatatcttgctggccttattttta

SEQ ID NO: 857403 - DNA, 25 bp, Mus musculus
tgatatgacagcaggcactgcactg

SEQ ID NO: 857404 - DNA, 25 bp, Mus musculus
tgatatgacagctggcactgcactg

SEQ ID NO: 857405 - DNA, 25 bp, Mus musculus
tgatatgacgcaatgtctgggtttt

SEQ ID NO: 857406 - DNA, 25 bp, Mus musculus
tgatatgacgcattgtctgggtttt

SEQ ID NO: 857407 - DNA, 25 bp, Mus musculus
tgatatgagcctccatgattttctg

SEQ ID NO: 857408 - DNA, 25 bp, Mus musculus
tgatatgagcctgcatgattttctg

SEQ ID NO: 857409 - DNA, 25 bp, Mus musculus
tgatatgcatgaaaatgtggacaca

SEQ ID NO: 857410 - DNA, 25 bp, Mus musculus
tgatatgcatgataatgtggacaca

SEQ ID NO: 857411 - DNA, 25 bp, Mus musculus
tgatatgccaccaacatcacaaccc

SEQ ID NO: 857412 - DNA, 25 bp, Mus musculus
tgatatgccacctacatcacaaccc

SEQ ID NO: 857413 - DNA, 25 bp, Mus musculus
tgatatgccagcctaggtgacacag

SEQ ID NO: 857414 - DNA, 25 bp, Mus musculus
tgatatgccagcgtaggtgacacag

SEQ ID NO: 857415 - DNA, 25 bp, Mus musculus
tgatatgcccatatctaccagacaa

SEQ ID NO: 857416 - DNA, 25 bp, Mus musculus
tgatatgcccatttctaccagacaa

SEQ ID NO: 857417 - DNA, 25 bp, Mus musculus
tgatatgctaggagttcctgaagat

SEQ ID NO: 857418 - DNA, 25 bp, Mus musculus
tgatatgctaggtgttcctgaagat

SEQ ID NO: 857419 - DNA, 25 bp, Mus musculus
tgatatgggacacttgggaaaccct

SEQ ID NO: 857420 - DNA, 25 bp, Mus musculus
tgatatgggacagttgggaaaccct

SEQ ID NO: 857421 - DNA, 25 bp, Mus musculus
tgatatgtccctatgagtacgctag

SEQ ID NO: 857422 - DNA, 25 bp, Mus musculus
tgatatgtccctttgagtacgctag

SEQ ID NO: 857423 - DNA, 25 bp, Mus musculus
tgatatgtctgtcccttttgctcat

SEQ ID NO: 857424 - DNA, 25 bp, Mus musculus
tgatatgtctgtgccttttgctcat

SEQ ID NO: 857425 - DNA, 25 bp, Mus musculus
tgatatgtgattattgtaagcaacg

SEQ ID NO: 857426 - DNA, 25 bp, Mus musculus
tgatatgtgatttttgtaagcaacg

SEQ ID NO: 857427 - DNA, 25 bp, Mus musculus
tgatatgtgctcagctcctgtgctc

SEQ ID NO: 857428 - DNA, 25 bp, Mus musculus
tgatatgtgctctgctcctgtgctc

SEQ ID NO: 857429 - DNA, 25 bp, Mus musculus
tgatatgttaacagacccgagtcaa

SEQ ID NO: 857430 - DNA, 25 bp, Mus musculus
tgatatgttaactgacccgagtcaa

SEQ ID NO: 857431 - DNA, 25 bp, Mus musculus
tgatatgttgttcggaacagaccat

SEQ ID NO: 857432 - DNA, 25 bp, Mus musculus
tgatatgttgttgggaacagaccat

SEQ ID NO: 857433 - DNA, 25 bp, Mus musculus
tgatatgtttcaatggcaggctaca

SEQ ID NO: 857434 - DNA, 25 bp, Mus musculus
tgatatgtttcattggcaggctaca

SEQ ID NO: 857435 - DNA, 25 bp, Mus musculus
tgatattaacccatttgactttttg

SEQ ID NO: 857436 - DNA, 25 bp, Mus musculus
tgatattaacccttttgactttttg

SEQ ID NO: 857437 - DNA, 25 bp, Mus musculus
tgatattaccaaagaggaccccaag

SEQ ID NO: 857438 - DNA, 25 bp, Mus musculus
tgatattaccaatgaggaccccaag

SEQ ID NO: 857439 - DNA, 25 bp, Mus musculus
tgatattaccttagatgatgagccc

SEQ ID NO: 857440 - DNA, 25 bp, Mus musculus
tgatattacctttgatgatgagccc

SEQ ID NO: 857441 - DNA, 25 bp, Mus musculus
tgatattagtacctctggtcctggt

SEQ ID NO: 857442 - DNA, 25 bp, Mus musculus
tgatattagtacgtctggtcctggt

SEQ ID NO: 857443 - DNA, 25 bp, Mus musculus
tgatattattgaccgcttgaagctg

SEQ ID NO: 857444 - DNA, 25 bp, Mus musculus
tgatattattgagcgcttgaagctg

SEQ ID NO: 857445 - DNA, 25 bp, Mus musculus
tgatattcaaaacggtacttctgga

SEQ ID NO: 857446 - DNA, 25 bp, Mus musculus
tgatattcaaaagggtacttctgga

SEQ ID NO: 857447 - DNA, 25 bp, Mus musculus
tgatattcaccgcactctggtatat

SEQ ID NO: 857448 - DNA, 25 bp, Mus musculus
tgatattcaccggactctggtatat

SEQ ID NO: 857449 - DNA, 25 bp, Mus musculus
tgatattcaggtctggccagttaat

SEQ ID NO: 857450 - DNA, 25 bp, Mus musculus
tgatattcaggtgtggccagttaat

SEQ ID NO: 857451 - DNA, 25 bp, Mus musculus
tgatattcataactacctgtggcta

SEQ ID NO: 857452 - DNA, 25 bp, Mus musculus
tgatattcataagtacctgtggcta

SEQ ID NO: 857453 - DNA, 25 bp, Mus musculus
tgatattcatcacagggcgagtcca

SEQ ID NO: 857454 - DNA, 25 bp, Mus musculus
tgatattcatcagagggcgagtcca

SEQ ID NO: 857455 - DNA, 25 bp, Mus musculus
tgatattcctcaactcttgagcact

SEQ ID NO: 857456 - DNA, 25 bp, Mus musculus
tgatattcctcatctcttgagcact

SEQ ID NO: 857457 - DNA, 25 bp, Mus musculus
tgatattcctgtctccttgccaata

SEQ ID NO: 857458 - DNA, 25 bp, Mus musculus
tgatattcctgtgtccttgccaata

SEQ ID NO: 857459 - DNA, 25 bp, Mus musculus
tgatattctatgacagttccttgga

SEQ ID NO: 857460 - DNA, 25 bp, Mus musculus
tgatattctatgtcagttccttgga

SEQ ID NO: 857461 - DNA, 25 bp, Mus musculus
tgatattctcctagccgggcatggt

SEQ ID NO: 857462 - DNA, 25 bp, Mus musculus
tgatattctccttgccgggcatggt

SEQ ID NO: 857463 - DNA, 25 bp, Mus musculus
tgatattctgctaatctcccaatgg

SEQ ID NO: 857464 - DNA, 25 bp, Mus musculus
tgatattctgcttatctcccaatgg

SEQ ID NO: 857465 - DNA, 25 bp, Mus musculus
tgatattcttccagagagctggcca

SEQ ID NO: 857466 - DNA, 25 bp, Mus musculus
tgatattcttcctgagagctggcca

SEQ ID NO: 857467 - DNA, 25 bp, Mus musculus
tgatattcttttctcctcggactca

SEQ ID NO: 857468 - DNA, 25 bp, Mus musculus
tgatattcttttgtcctcggactca

SEQ ID NO: 857469 - DNA, 25 bp, Mus musculus
tgatattgatttacgccttcctcat

SEQ ID NO: 857470 - DNA, 25 bp, Mus musculus
tgatattgattttcgccttcctcat

SEQ ID NO: 857471 - DNA, 25 bp, Mus musculus
tgatattggcttcctcttcagtaac

SEQ ID NO: 857472 - DNA, 25 bp, Mus musculus
tgatattggcttgctcttcagtaac

SEQ ID NO: 857473 - DNA, 25 bp, Mus musculus
tgatattggttccacccatcaccag

SEQ ID NO: 857474 - DNA, 25 bp, Mus musculus
tgatattggttcgacccatcaccag

SEQ ID NO: 857475 - DNA, 25 bp, Mus musculus
tgatattgtaccctgactgagtcca

SEQ ID NO: 857476 - DNA, 25 bp, Mus musculus
tgatattgtaccgtgactgagtcca

SEQ ID NO: 857477 - DNA, 25 bp, Mus musculus
tgatattgtctcaggaactcgatac

SEQ ID NO: 857478 - DNA, 25 bp, Mus musculus
tgatattgtctctggaactcgatac

SEQ ID NO: 857479 - DNA, 25 bp, Mus musculus
tgatatttacatctgggcacccttg

SEQ ID NO: 857480 - DNA, 25 bp, Mus musculus
tgatatttacatgtgggcacccttg

SEQ ID NO: 857481 - DNA, 25 bp, Mus musculus
tgatatttaccaaggtgtgcctaaa

SEQ ID NO: 857482 - DNA, 25 bp, Mus musculus
tgatatttaccatggtgtgcctaaa

SEQ ID NO: 857483 - DNA, 25 bp, Mus musculus
tgatatttatctaccctgagcactg

SEQ ID NO: 857484 - DNA, 25 bp, Mus musculus
tgatatttatctagcctcaggtaag

SEQ ID NO: 857485 - DNA, 25 bp, Mus musculus
tgatatttatcttccctgagcactg

SEQ ID NO: 857486 - DNA, 25 bp, Mus musculus
tgatatttatcttgcctcaggtaag

SEQ ID NO: 857487 - DNA, 25 bp, Mus musculus
tgatatttctcaagtctacacacag

SEQ ID NO: 857488 - DNA, 25 bp, Mus musculus
tgatatttctcatgtctacacacag

SEQ ID NO: 857489 - DNA, 25 bp, Mus musculus
tgatatttctcgctcatacatcagt

SEQ ID NO: 857490 - DNA, 25 bp, Mus musculus
tgatatttctcggtcatacatcagt

SEQ ID NO: 857491 - DNA, 25 bp, Mus musculus
tgatatttctgcaatctctatgaca

SEQ ID NO: 857492 - DNA, 25 bp, Mus musculus
tgatatttctgctatctctatgaca

SEQ ID NO: 857493 - DNA, 25 bp, Mus musculus
tgatatttgagaatcctggtgcccc

SEQ ID NO: 857494 - DNA, 25 bp, Mus musculus
tgatatttgagattcctggtgcccc

SEQ ID NO: 857495 - DNA, 25 bp, Mus musculus
tgatatttgcttacacacgggtgta

SEQ ID NO: 857496 - DNA, 25 bp, Mus musculus
tgatatttgctttcacacgggtgta

SEQ ID NO: 857497 - DNA, 25 bp, Mus musculus
tgatatttgtccaggaacagcatgg

SEQ ID NO: 857498 - DNA, 25 bp, Mus musculus
tgatatttgtcctggaacagcatgg

SEQ ID NO: 857499 - DNA, 25 bp, Mus musculus
tgatatttttcaatggtgtccacgt

SEQ ID NO: 857500 - DNA, 25 bp, Mus musculus
tgatatttttcattggtgtccacgt

SEQ ID NO: 857501 - DNA, 25 bp, Mus musculus
tgatcaaaacccctcgtaggaaggg

SEQ ID NO: 857502 - DNA, 25 bp, Mus musculus
tgatcaaaacccgtcgtaggaaggg

SEQ ID NO: 857503 - DNA, 25 bp, Mus musculus
tgatcaaaaggtagtccccgttgct

SEQ ID NO: 857504 - DNA, 25 bp, Mus musculus
tgatcaaaaggttgtccccgttgct

SEQ ID NO: 857505 - DNA, 25 bp, Mus musculus
tgatcaaactgcatattcttacccc

SEQ ID NO: 857506 - DNA, 25 bp, Mus musculus
tgatcaaactgcttattcttacccc

SEQ ID NO: 857507 - DNA, 25 bp, Mus musculus
tgatcaaacttcatgcttgcttggc

SEQ ID NO: 857508 - DNA, 25 bp, Mus musculus
tgatcaaacttcttgcttgcttggc

SEQ ID NO: 857509 - DNA, 25 bp, Mus musculus
tgatcaaagctgattgtccctgcag

SEQ ID NO: 857510 - DNA, 25 bp, Mus musculus
tgatcaaagctgtttgtccctgcag

SEQ ID NO: 857511 - DNA, 25 bp, Mus musculus
tgatcaaatacacgccactgaccta

SEQ ID NO: 857512 - DNA, 25 bp, Mus musculus
tgatcaaatacaggccactgaccta

SEQ ID NO: 857513 - DNA, 25 bp, Mus musculus
tgatcaaatatcactggtcctgagt

SEQ ID NO: 857514 - DNA, 25 bp, Mus musculus
tgatcaaatatctctggtcctgagt

SEQ ID NO: 857515 - DNA, 25 bp, Mus musculus
tgatcaacatcaatgcagcagtgca

SEQ ID NO: 857516 - DNA, 25 bp, Mus musculus
tgatcaacatcattgcagcagtgca

SEQ ID NO: 857517 - DNA, 25 bp, Mus musculus
tgatcaaccacactcaccaaacatt

SEQ ID NO: 857518 - DNA, 25 bp, Mus musculus
tgatcaaccacagtcaccaaacatt

SEQ ID NO: 857519 - DNA, 25 bp, Mus musculus
tgatcaaccggtccatggacaccta

SEQ ID NO: 857520 - DNA, 25 bp, Mus musculus
tgatcaaccggtgcatggacaccta

SEQ ID NO: 857521 - DNA, 25 bp, Mus musculus
tgatcaacctcgacgactgggcaga

SEQ ID NO: 857522 - DNA, 25 bp, Mus musculus
tgatcaacctcgtcgactgggcaga

SEQ ID NO: 857523 - DNA, 25 bp, Mus musculus
tgatcaactagactcacggccagaa

SEQ ID NO: 857524 - DNA, 25 bp, Mus musculus
tgatcaactagagtcacggccagaa

SEQ ID NO: 857525 - DNA, 25 bp, Mus musculus
tgatcaactgctctgtcctatccta

SEQ ID NO: 857526 - DNA, 25 bp, Mus musculus
tgatcaactgctgtgtcctatccta

SEQ ID NO: 857527 - DNA, 25 bp, Mus musculus
tgatcaagagttctgtttctcacac

SEQ ID NO: 857528 - DNA, 25 bp, Mus musculus
tgatcaagagttgtgtttctcacac

SEQ ID NO: 857529 - DNA, 25 bp, Mus musculus
tgatcaagctctcacagtgtctgga

SEQ ID NO: 857530 - DNA, 25 bp, Mus musculus
tgatcaagctctgacagtgtctgga

SEQ ID NO: 857531 - DNA, 25 bp, Mus musculus
tgatcaagtactatcacgcccagtg

SEQ ID NO: 857532 - DNA, 25 bp, Mus musculus
tgatcaagtactttcacgcccagtg

SEQ ID NO: 857533 - DNA, 25 bp, Mus musculus
tgatcaagtctcagcagtccgcaga

SEQ ID NO: 857534 - DNA, 25 bp, Mus musculus
tgatcaagtctctgcagtccgcaga

SEQ ID NO: 857535 - DNA, 25 bp, Mus musculus
tgatcaagtgccatcctttgtcggg

SEQ ID NO: 857536 - DNA, 25 bp, Mus musculus
tgatcaagtgccttcctttgtcggg

SEQ ID NO: 857537 - DNA, 25 bp, Mus musculus
tgatcaatatcacccaaaccttttc

SEQ ID NO: 857538 - DNA, 25 bp, Mus musculus
tgatcaatatcagccaaaccttttc

SEQ ID NO: 857539 - DNA, 25 bp, Mus musculus
tgatcaatcgctacatctatgacag

SEQ ID NO: 857540 - DNA, 25 bp, Mus musculus
tgatcaatcgcttcatctatgacag

SEQ ID NO: 857541 - DNA, 25 bp, Mus musculus
tgatcaatgaatcctgtttgtttcc

SEQ ID NO: 857542 - DNA, 25 bp, Mus musculus
tgatcaatgaatgctgtttgtttcc

SEQ ID NO: 857543 - DNA, 25 bp, Mus musculus
tgatcaatgtgtactgccctcacgc

SEQ ID NO: 857544 - DNA, 25 bp, Mus musculus
tgatcaatgtgttctgccctcacgc

SEQ ID NO: 857545 - DNA, 25 bp, Mus musculus
tgatcaatgttgagtgggtaggact

SEQ ID NO: 857546 - DNA, 25 bp, Mus musculus
tgatcaatgttgtgtgggtaggact

SEQ ID NO: 857547 - DNA, 25 bp, Mus musculus
tgatcaattcatctcacagctccac

SEQ ID NO: 857548 - DNA, 25 bp, Mus musculus
tgatcaattcatgtcacagctccac

SEQ ID NO: 857549 - DNA, 25 bp, Mus musculus
tgatcaattccaccatcagctcaag

SEQ ID NO: 857550 - DNA, 25 bp, Mus musculus
tgatcaattccagcatcagctcaag

SEQ ID NO: 857551 - DNA, 25 bp, Mus musculus
tgatcacaatgtccatacctatgat

SEQ ID NO: 857552 - DNA, 25 bp, Mus musculus
tgatcacaatgtgcatacctatgat

SEQ ID NO: 857553 - DNA, 25 bp, Mus musculus
tgatcacacactactgagggccttg

SEQ ID NO: 857554 - DNA, 25 bp, Mus musculus
tgatcacacacttctgagggccttg

SEQ ID NO: 857555 - DNA, 25 bp, Mus musculus
tgatcacacctccttccgtagtaaa

SEQ ID NO: 857556 - DNA, 25 bp, Mus musculus
tgatcacacctcgttccgtagtaaa

SEQ ID NO: 857557 - DNA, 25 bp, Mus musculus
tgatcacacgttaagtttttgggtt

SEQ ID NO: 857558 - DNA, 25 bp, Mus musculus
tgatcacacgtttagtttttgggtt

SEQ ID NO: 857559 - DNA, 25 bp, Mus musculus
tgatcacacttcaaaccctgcaggg

SEQ ID NO: 857560 - DNA, 25 bp, Mus musculus
tgatcacacttctaaccctgcaggg

SEQ ID NO: 857561 - DNA, 25 bp, Mus musculus
tgatcacagcatccattcgggtacc

SEQ ID NO: 857562 - DNA, 25 bp, Mus musculus
tgatcacagcatgcattcgggtacc

SEQ ID NO: 857563 - DNA, 25 bp, Mus musculus
tgatcacaggaacggatcctagccc

SEQ ID NO: 857564 - DNA, 25 bp, Mus musculus
tgatcacaggaagggatcctagccc

SEQ ID NO: 857565 - DNA, 25 bp, Mus musculus
tgatcacaggctcttcctccaagtc

SEQ ID NO: 857566 - DNA, 25 bp, Mus musculus
tgatcacaggctgttcctccaagtc

SEQ ID NO: 857567 - DNA, 25 bp, Mus musculus
tgatcacatacacaagcagccccat

SEQ ID NO: 857568 - DNA, 25 bp, Mus musculus
tgatcacatacagaagcagccccat

SEQ ID NO: 857569 - DNA, 25 bp, Mus musculus
tgatcacatccaaagtctttctctc

SEQ ID NO: 857570 - DNA, 25 bp, Mus musculus
tgatcacatccatagtctttctctc

SEQ ID NO: 857571 - DNA, 25 bp, Mus musculus
tgatcacatggactggccctacggg

SEQ ID NO: 857572 - DNA, 25 bp, Mus musculus
tgatcacatggagtggccctacggg

SEQ ID NO: 857573 - DNA, 25 bp, Mus musculus
tgatcacatgttcttcaccagccaa

SEQ ID NO: 857574 - DNA, 25 bp, Mus musculus
tgatcacatgttgttcaccagccaa

SEQ ID NO: 857575 - DNA, 25 bp, Mus musculus
tgatcacattgtagtggtgtggctc

SEQ ID NO: 857576 - DNA, 25 bp, Mus musculus
tgatcacattgttgtggtgtggctc

SEQ ID NO: 857577 - DNA, 25 bp, Mus musculus
tgatcaccaactctatctctgtctg

SEQ ID NO: 857578 - DNA, 25 bp, Mus musculus
tgatcaccaactgtatctctgtctg

SEQ ID NO: 857579 - DNA, 25 bp, Mus musculus
tgatcaccagcaacaggcgcagcat

SEQ ID NO: 857580 - DNA, 25 bp, Mus musculus
tgatcaccagcatcaggcgcagcat

SEQ ID NO: 857581 - DNA, 25 bp, Mus musculus
tgatcaccagtgattagtccattaa

SEQ ID NO: 857582 - DNA, 25 bp, Mus musculus
tgatcaccagtgcacttacatgtct

SEQ ID NO: 857583 - DNA, 25 bp, Mus musculus
tgatcaccagtggacttacatgtct

SEQ ID NO: 857584 - DNA, 25 bp, Mus musculus
tgatcaccagtgtttagtccattaa

SEQ ID NO: 857585 - DNA, 25 bp, Mus musculus
tgatcaccatctctgctgatctttg

SEQ ID NO: 857586 - DNA, 25 bp, Mus musculus
tgatcaccatctgtgctgatctttg

SEQ ID NO: 857587 - DNA, 25 bp, Mus musculus
tgatcacccctgagttatggatata

SEQ ID NO: 857588 - DNA, 25 bp, Mus musculus
tgatcacccctgtgttatggatata

SEQ ID NO: 857589 - DNA, 25 bp, Mus musculus
tgatcaccctgacgaccattggcta

SEQ ID NO: 857590 - DNA, 25 bp, Mus musculus
tgatcaccctgaggaccattggcta

SEQ ID NO: 857591 - DNA, 25 bp, Mus musculus
tgatcaccgtccagttcagtggaat

SEQ ID NO: 857592 - DNA, 25 bp, Mus musculus
tgatcaccgtcctgttcagtggaat

SEQ ID NO: 857593 - DNA, 25 bp, Mus musculus
tgatcacctattatctcgccaagat

SEQ ID NO: 857594 - DNA, 25 bp, Mus musculus
tgatcacctattttctcgccaagat

SEQ ID NO: 857595 - DNA, 25 bp, Mus musculus
tgatcacctcaccttcaatatgtgc

SEQ ID NO: 857596 - DNA, 25 bp, Mus musculus
tgatcacctcacgttcaatatgtgc

SEQ ID NO: 857597 - DNA, 25 bp, Mus musculus
tgatcacctgtacaggaccttgcgc

SEQ ID NO: 857598 - DNA, 25 bp, Mus musculus
tgatcacctgtagaggaccttgcgc

SEQ ID NO: 857599 - DNA, 25 bp, Mus musculus
tgatcaccttgtagtcttttaaacc

SEQ ID NO: 857600 - DNA, 25 bp, Mus musculus
tgatcaccttgttgtcttttaaacc

SEQ ID NO: 857601 - DNA, 25 bp, Mus musculus
tgatcacgaagaaaccacacgagtt

SEQ ID NO: 857602 - DNA, 25 bp, Mus musculus
tgatcacgaagataccacacgagtt

SEQ ID NO: 857603 - DNA, 25 bp, Mus musculus
tgatcacgatgacaacctcccaaaa

SEQ ID NO: 857604 - DNA, 25 bp, Mus musculus
tgatcacgatgagaacctcccaaaa

SEQ ID NO: 857605 - DNA, 25 bp, Mus musculus
tgatcacgcctgctcattgtgtgac

SEQ ID NO: 857606 - DNA, 25 bp, Mus musculus
tgatcacgcctggtcattgtgtgac

SEQ ID NO: 857607 - DNA, 25 bp, Mus musculus
tgatcacggccaacgtgtagacact

SEQ ID NO: 857608 - DNA, 25 bp, Mus musculus
tgatcacggccatcgtgtagacact

SEQ ID NO: 857609 - DNA, 25 bp, Mus musculus
tgatcacgtcacatctctgcgtcag

SEQ ID NO: 857610 - DNA, 25 bp, Mus musculus
tgatcacgtcacttctctgcgtcag

SEQ ID NO: 857611 - DNA, 25 bp, Mus musculus
tgatcactacctcaacccctactat

SEQ ID NO: 857612 - DNA, 25 bp, Mus musculus
tgatcactacctgaacccctactat

SEQ ID NO: 857613 - DNA, 25 bp, Mus musculus
tgatcactctggcaactggtaggac

SEQ ID NO: 857614 - DNA, 25 bp, Mus musculus
tgatcactctgggaactggtaggac

SEQ ID NO: 857615 - DNA, 25 bp, Mus musculus
tgatcactggacactgaaaaacggt

SEQ ID NO: 857616 - DNA, 25 bp, Mus musculus
tgatcactggactctgaaaaacggt

SEQ ID NO: 857617 - DNA, 25 bp, Mus musculus
tgatcactggctaccatcaaatcca

SEQ ID NO: 857618 - DNA, 25 bp, Mus musculus
tgatcactggcttccatcaaatcca

SEQ ID NO: 857619 - DNA, 25 bp, Mus musculus
tgatcactgtctactgtggtctgac

SEQ ID NO: 857620 - DNA, 25 bp, Mus musculus
tgatcactgtctctggtttgtcatc

SEQ ID NO: 857621 - DNA, 25 bp, Mus musculus
tgatcactgtctgtggtttgtcatc

SEQ ID NO: 857622 - DNA, 25 bp, Mus musculus
tgatcactgtcttctgtggtctgac

SEQ ID NO: 857623 - DNA, 25 bp, Mus musculus
tgatcacttatgaccatgtctcttc

SEQ ID NO: 857624 - DNA, 25 bp, Mus musculus
tgatcacttatgtccatgtctcttc

SEQ ID NO: 857625 - DNA, 25 bp, Mus musculus
tgatcacttattccggcaccaattc

SEQ ID NO: 857626 - DNA, 25 bp, Mus musculus
tgatcacttattgcggcaccaattc

SEQ ID NO: 857627 - DNA, 25 bp, Mus musculus
tgatcacttgcacaggtcgaccaga

SEQ ID NO: 857628 - DNA, 25 bp, Mus musculus
tgatcacttgcagaggtcgaccaga

SEQ ID NO: 857629 - DNA, 25 bp, Mus musculus
tgatcactttaaacatgcatgcctg

SEQ ID NO: 857630 - DNA, 25 bp, Mus musculus
tgatcactttaatcatgcatgcctg

SEQ ID NO: 857631 - DNA, 25 bp, Mus musculus
tgatcactttgtcgtactaccctca

SEQ ID NO: 857632 - DNA, 25 bp, Mus musculus
tgatcactttgtggtactaccctca

SEQ ID NO: 857633 - DNA, 25 bp, Mus musculus
tgatcagaattacgactatgccagt

SEQ ID NO: 857634 - DNA, 25 bp, Mus musculus
tgatcagaattaggactatgccagt

SEQ ID NO: 857635 - DNA, 25 bp, Mus musculus
tgatcagacccgaggcacctcagat

SEQ ID NO: 857636 - DNA, 25 bp, Mus musculus
tgatcagacccgtggcacctcagat

SEQ ID NO: 857637 - DNA, 25 bp, Mus musculus
tgatcagagcatccgtgagccaggc

SEQ ID NO: 857638 - DNA, 25 bp, Mus musculus
tgatcagagcatgcgtgagccaggc

SEQ ID NO: 857639 - DNA, 25 bp, Mus musculus
tgatcagaggcccttaatgccaggc

SEQ ID NO: 857640 - DNA, 25 bp, Mus musculus
tgatcagaggccgttaatgccaggc

SEQ ID NO: 857641 - DNA, 25 bp, Mus musculus
tgatcagatcagatactgctaccgt

SEQ ID NO: 857642 - DNA, 25 bp, Mus musculus
tgatcagatcagttactgctaccgt

SEQ ID NO: 857643 - DNA, 25 bp, Mus musculus
tgatcagcaagtcaggagtcaaact

SEQ ID NO: 857644 - DNA, 25 bp, Mus musculus
tgatcagcaagtgaggagtcaaact

SEQ ID NO: 857645 - DNA, 25 bp, Mus musculus
tgatcagcaggaccactgtgtgttc

SEQ ID NO: 857646 - DNA, 25 bp, Mus musculus
tgatcagcaggagcactgtgtgttc

SEQ ID NO: 857647 - DNA, 25 bp, Mus musculus
tgatcagcagttccgtttacagctc

SEQ ID NO: 857648 - DNA, 25 bp, Mus musculus
tgatcagcagttgcgtttacagctc

SEQ ID NO: 857649 - DNA, 25 bp, Mus musculus
tgatcagcatccctctggtcatcta

SEQ ID NO: 857650 - DNA, 25 bp, Mus musculus
tgatcagcatccgtctggtcatcta

SEQ ID NO: 857651 - DNA, 25 bp, Mus musculus
tgatcagcggcgcatgtctgaaatt

SEQ ID NO: 857652 - DNA, 25 bp, Mus musculus
tgatcagcggcggatgtctgaaatt

SEQ ID NO: 857653 - DNA, 25 bp, Mus musculus
tgatcagctggaaacccggataaac

SEQ ID NO: 857654 - DNA, 25 bp, Mus musculus
tgatcagctggatacccggataaac

SEQ ID NO: 857655 - DNA, 25 bp, Mus musculus
tgatcaggaccaagtggaccgcctc

SEQ ID NO: 857656 - DNA, 25 bp, Mus musculus
tgatcaggaccatgtggaccgcctc

SEQ ID NO: 857657 - DNA, 25 bp, Mus musculus
tgatcaggagcacctctctcaggag

SEQ ID NO: 857658 - DNA, 25 bp, Mus musculus
tgatcaggagcagctctctcaggag

SEQ ID NO: 857659 - DNA, 25 bp, Mus musculus
tgatcaggatcaagatggttctcac

SEQ ID NO: 857660 - DNA, 25 bp, Mus musculus
tgatcaggatcatgatggttctcac

SEQ ID NO: 857661 - DNA, 25 bp, Mus musculus
tgatcaggattaaggtctcccgttc

SEQ ID NO: 857662 - DNA, 25 bp, Mus musculus
tgatcaggattatggtctcccgttc

SEQ ID NO: 857663 - DNA, 25 bp, Mus musculus
tgatcaggcaatacggtcaattgtc

SEQ ID NO: 857664 - DNA, 25 bp, Mus musculus
tgatcaggcaattcggtcaattgtc

SEQ ID NO: 857665 - DNA, 25 bp, Mus musculus
tgatcaggctctccaaaccagatcc

SEQ ID NO: 857666 - DNA, 25 bp, Mus musculus
tgatcaggctctgcaaaccagatcc

SEQ ID NO: 857667 - DNA, 25 bp, Mus musculus
tgatcagggaaacctaacccagccc

SEQ ID NO: 857668 - DNA, 25 bp, Mus musculus
tgatcagggaaagctaacccagccc

SEQ ID NO: 857669 - DNA, 25 bp, Mus musculus
tgatcagggcccatgcacttcagac

SEQ ID NO: 857670 - DNA, 25 bp, Mus musculus
tgatcagggcccttgcacttcagac

SEQ ID NO: 857671 - DNA, 25 bp, Mus musculus
tgatcaggtacccatcattgatgta

SEQ ID NO: 857672 - DNA, 25 bp, Mus musculus
tgatcaggtaccgatcattgatgta

SEQ ID NO: 857673 - DNA, 25 bp, Mus musculus
tgatcaggtacgactgctgtggact

SEQ ID NO: 857674 - DNA, 25 bp, Mus musculus
tgatcaggtacgtctgctgtggact

SEQ ID NO: 857675 - DNA, 25 bp, Mus musculus
tgatcaggtctgaaaatgtgtactg

SEQ ID NO: 857676 - DNA, 25 bp, Mus musculus
tgatcaggtctgtaaatgtgtactg

SEQ ID NO: 857677 - DNA, 25 bp, Mus musculus
tgatcagtcagtccgcctgtagtaa

SEQ ID NO: 857678 - DNA, 25 bp, Mus musculus
tgatcagtcagtgcgcctgtagtaa

SEQ ID NO: 857679 - DNA, 25 bp, Mus musculus
tgatcagtcatccactgtttcctgt

SEQ ID NO: 857680 - DNA, 25 bp, Mus musculus
tgatcagtcatcgactgtttcctgt

SEQ ID NO: 857681 - DNA, 25 bp, Mus musculus
tgatcagtcccgcaagagagctgga

SEQ ID NO: 857682 - DNA, 25 bp, Mus musculus
tgatcagtcccggaagagagctgga

SEQ ID NO: 857683 - DNA, 25 bp, Mus musculus
tgatcagtcgacacgtcaactcctg

SEQ ID NO: 857684 - DNA, 25 bp, Mus musculus
tgatcagtcgactcgtcaactcctg

SEQ ID NO: 857685 - DNA, 25 bp, Mus musculus
tgatcagtcgcccttctcctaaatt

SEQ ID NO: 857686 - DNA, 25 bp, Mus musculus
tgatcagtcgccgttctcctaaatt

SEQ ID NO: 857687 - DNA, 25 bp, Mus musculus
tgatcagtgcttctcgggatgcgat

SEQ ID NO: 857688 - DNA, 25 bp, Mus musculus
tgatcagtgcttgtcgggatgcgat

SEQ ID NO: 857689 - DNA, 25 bp, Mus musculus
tgatcataactccaccaagacactg

SEQ ID NO: 857690 - DNA, 25 bp, Mus musculus
tgatcataactcgaccaagacactg

SEQ ID NO: 857691 - DNA, 25 bp, Mus musculus
tgatcatagatacgcccacacttgg

SEQ ID NO: 857692 - DNA, 25 bp, Mus musculus
tgatcatagataggcccacacttgg

SEQ ID NO: 857693 - DNA, 25 bp, Mus musculus
tgatcataggagacctcgaagccca

SEQ ID NO: 857694 - DNA, 25 bp, Mus musculus
tgatcataggagtcctcgaagccca

SEQ ID NO: 857695 - DNA, 25 bp, Mus musculus
tgatcatatccccactacaagaaga

SEQ ID NO: 857696 - DNA, 25 bp, Mus musculus
tgatcatatcccgactacaagaaga

SEQ ID NO: 857697 - DNA, 25 bp, Mus musculus
tgatcatattctataccgtccccta

SEQ ID NO: 857698 - DNA, 25 bp, Mus musculus
tgatcatattctttaccgtccccta

SEQ ID NO: 857699 - DNA, 25 bp, Mus musculus
tgatcatcacaccaaactctgcatg

SEQ ID NO: 857700 - DNA, 25 bp, Mus musculus
tgatcatcacacgaaactctgcatg

SEQ ID NO: 857701 - DNA, 25 bp, Mus musculus
tgatcatcagctctctacaccacaa

SEQ ID NO: 857702 - DNA, 25 bp, Mus musculus
tgatcatcagctgtctacaccacaa

SEQ ID NO: 857703 - DNA, 25 bp, Mus musculus
tgatcatcaggccatcttcagccaa

SEQ ID NO: 857704 - DNA, 25 bp, Mus musculus
tgatcatcaggcgatcttcagccaa

SEQ ID NO: 857705 - DNA, 25 bp, Mus musculus
tgatcatcatcacctcagcttagag

SEQ ID NO: 857706 - DNA, 25 bp, Mus musculus
tgatcatcatcagctcagcttagag

SEQ ID NO: 857707 - DNA, 25 bp, Mus musculus
tgatcatcatgcaggcagtctgtct

SEQ ID NO: 857708 - DNA, 25 bp, Mus musculus
tgatcatcatgccagaccacactta

SEQ ID NO: 857709 - DNA, 25 bp, Mus musculus
tgatcatcatgcgagaccacactta

SEQ ID NO: 857710 - DNA, 25 bp, Mus musculus
tgatcatcatgctggcagtctgtct

SEQ ID NO: 857711 - DNA, 25 bp, Mus musculus
tgatcatccaccaagaaagccgagc

SEQ ID NO: 857712 - DNA, 25 bp, Mus musculus
tgatcatccacctagaaagccgagc

SEQ ID NO: 857713 - DNA, 25 bp, Mus musculus
tgatcatccattcaggcgtccgcga

SEQ ID NO: 857714 - DNA, 25 bp, Mus musculus
tgatcatccattgaggcgtccgcga

SEQ ID NO: 857715 - DNA, 25 bp, Mus musculus
tgatcatctcaacaggcttcctcag

SEQ ID NO: 857716 - DNA, 25 bp, Mus musculus
tgatcatctcaagaggcttcctcag

SEQ ID NO: 857717 - DNA, 25 bp, Mus musculus
tgatcatctctgctaactcatctca

SEQ ID NO: 857718 - DNA, 25 bp, Mus musculus
tgatcatctctggtaactcatctca

SEQ ID NO: 857719 - DNA, 25 bp, Mus musculus
tgatcatgatctcctacattccact

SEQ ID NO: 857720 - DNA, 25 bp, Mus musculus
tgatcatgatctgctacattccact

SEQ ID NO: 857721 - DNA, 25 bp, Mus musculus
tgatcatgcacacggaggattccat

SEQ ID NO: 857722 - DNA, 25 bp, Mus musculus
tgatcatgcacagggaggattccat

SEQ ID NO: 857723 - DNA, 25 bp, Mus musculus
tgatcatgccacagtaccactaagc

SEQ ID NO: 857724 - DNA, 25 bp, Mus musculus
tgatcatgccactgtaccactaagc

SEQ ID NO: 857725 - DNA, 25 bp, Mus musculus
tgatcatgcctcaaatgccttcata

SEQ ID NO: 857726 - DNA, 25 bp, Mus musculus
tgatcatgcctctaatgccttcata

SEQ ID NO: 857727 - DNA, 25 bp, Mus musculus
tgatcatgcttgcagcatccacgtc

SEQ ID NO: 857728 - DNA, 25 bp, Mus musculus
tgatcatgcttggagcatccacgtc

SEQ ID NO: 857729 - DNA, 25 bp, Mus musculus
tgatcatgggccacatttcttttca

SEQ ID NO: 857730 - DNA, 25 bp, Mus musculus
tgatcatgggcctcatttcttttca

SEQ ID NO: 857731 - DNA, 25 bp, Mus musculus
tgatcatgtatgaggcaattcgaac

SEQ ID NO: 857732 - DNA, 25 bp, Mus musculus
tgatcatgtatgtggcaattcgaac

SEQ ID NO: 857733 - DNA, 25 bp, Mus musculus
tgatcatgttgaaaatgctcgggat

SEQ ID NO: 857734 - DNA, 25 bp, Mus musculus
tgatcatgttgataatgctcgggat

SEQ ID NO: 857735 - DNA, 25 bp, Mus musculus
tgatcattagcccacataccctgta

SEQ ID NO: 857736 - DNA, 25 bp, Mus musculus
tgatcattagccgacataccctgta

SEQ ID NO: 857737 - DNA, 25 bp, Mus musculus
tgatcattattcaggcatgccgtgg

SEQ ID NO: 857738 - DNA, 25 bp, Mus musculus
tgatcattattctggcatgccgtgg

SEQ ID NO: 857739 - DNA, 25 bp, Mus musculus
tgatcattctaaccgcaatgcttgt

SEQ ID NO: 857740 - DNA, 25 bp, Mus musculus
tgatcattctaagcgcaatgcttgt

SEQ ID NO: 857741 - DNA, 25 bp, Mus musculus
tgatcattcttcaccgcctgtccaa

SEQ ID NO: 857742 - DNA, 25 bp, Mus musculus
tgatcattcttctccgcctgtccaa

SEQ ID NO: 857743 - DNA, 25 bp, Mus musculus
tgatcattgcaacattcaagccacc

SEQ ID NO: 857744 - DNA, 25 bp, Mus musculus
tgatcattgcaagattcaagccacc

SEQ ID NO: 857745 - DNA, 25 bp, Mus musculus
tgatcattgtcacatggtaagccat

SEQ ID NO: 857746 - DNA, 25 bp, Mus musculus
tgatcattgtcactctccagttctt

SEQ ID NO: 857747 - DNA, 25 bp, Mus musculus
tgatcattgtcagatggtaagccat

SEQ ID NO: 857748 - DNA, 25 bp, Mus musculus
tgatcattgtcagtctccagttctt

SEQ ID NO: 857749 - DNA, 25 bp, Mus musculus
tgatcatttaccaccagtcttgtta

SEQ ID NO: 857750 - DNA, 25 bp, Mus musculus
tgatcatttacctccagtcttgtta

SEQ ID NO: 857751 - DNA, 25 bp, Mus musculus
tgatcatttactctctgaaaccttt

SEQ ID NO: 857752 - DNA, 25 bp, Mus musculus
tgatcatttactgtctgaaaccttt

SEQ ID NO: 857753 - DNA, 25 bp, Mus musculus
tgatcatttatcagggaccctataa

SEQ ID NO: 857754 - DNA, 25 bp, Mus musculus
tgatcatttatctgggaccctataa

SEQ ID NO: 857755 - DNA, 25 bp, Mus musculus
tgatcatttcagagcctctacctct

SEQ ID NO: 857756 - DNA, 25 bp, Mus musculus
tgatcatttcagtgcctctacctct

SEQ ID NO: 857757 - DNA, 25 bp, Mus musculus
tgatcatttcccacagtcatccaat

SEQ ID NO: 857758 - DNA, 25 bp, Mus musculus
tgatcatttccctcagtcatccaat

SEQ ID NO: 857759 - DNA, 25 bp, Mus musculus
tgatcatttgtcatccactttggag

SEQ ID NO: 857760 - DNA, 25 bp, Mus musculus
tgatcatttgtcttccactttggag

SEQ ID NO: 857761 - DNA, 25 bp, Mus musculus
tgatcatttttaaaaccacgggttt

SEQ ID NO: 857762 - DNA, 25 bp, Mus musculus
tgatcatttttataaccacgggttt

SEQ ID NO: 857763 - DNA, 25 bp, Mus musculus
tgatccaaatgcaaacgggctcctg

SEQ ID NO: 857764 - DNA, 25 bp, Mus musculus
tgatccaaatgctaacgggctcctg

SEQ ID NO: 857765 - DNA, 25 bp, Mus musculus
tgatccaacaaaacacgcaggccca

SEQ ID NO: 857766 - DNA, 25 bp, Mus musculus
tgatccaacaaatcacgcaggccca

SEQ ID NO: 857767 - DNA, 25 bp, Mus musculus
tgatccaacccgaagaaaagtctgt

SEQ ID NO: 857768 - DNA, 25 bp, Mus musculus
tgatccaacccgtagaaaagtctgt

SEQ ID NO: 857769 - DNA, 25 bp, Mus musculus
tgatccaatcagagcctgcatccca

SEQ ID NO: 857770 - DNA, 25 bp, Mus musculus
tgatccaatcagtgcctgcatccca

SEQ ID NO: 857771 - DNA, 25 bp, Mus musculus
tgatccaccatcaactgttcttagg

SEQ ID NO: 857772 - DNA, 25 bp, Mus musculus
tgatccaccatctactgttcttagg

SEQ ID NO: 857773 - DNA, 25 bp, Mus musculus
tgatccactgtgaacagagtacctt

SEQ ID NO: 857774 - DNA, 25 bp, Mus musculus
tgatccactgtgtacagagtacctt

SEQ ID NO: 857775 - DNA, 25 bp, Mus musculus
tgatccagaacaagactacccaggt

SEQ ID NO: 857776 - DNA, 25 bp, Mus musculus
tgatccagaacatgactacccaggt

SEQ ID NO: 857777 - DNA, 25 bp, Mus musculus
tgatccagaaggagctcaccattgg

SEQ ID NO: 857778 - DNA, 25 bp, Mus musculus
tgatccagaaggtgctcaccattgg

SEQ ID NO: 857779 - DNA, 25 bp, Mus musculus
tgatccagagcgcacacccgaagcg

SEQ ID NO: 857780 - DNA, 25 bp, Mus musculus
tgatccagagcggacacccgaagcg

SEQ ID NO: 857781 - DNA, 25 bp, Mus musculus
tgatccagagtccttgtttccttga

SEQ ID NO: 857782 - DNA, 25 bp, Mus musculus
tgatccagagtcgttgtttccttga

SEQ ID NO: 857783 - DNA, 25 bp, Mus musculus
tgatccagcaaactcctcaaggtga

SEQ ID NO: 857784 - DNA, 25 bp, Mus musculus
tgatccagcaaagtcctcaaggtga

SEQ ID NO: 857785 - DNA, 25 bp, Mus musculus
tgatccagcctgatgtcattaggct

SEQ ID NO: 857786 - DNA, 25 bp, Mus musculus
tgatccagcctgttgtcattaggct

SEQ ID NO: 857787 - DNA, 25 bp, Mus musculus
tgatccagcgccaaagtgccagaag

SEQ ID NO: 857788 - DNA, 25 bp, Mus musculus
tgatccagcgcctaagtgccagaag

SEQ ID NO: 857789 - DNA, 25 bp, Mus musculus
tgatccagctgacccctgaggctga

SEQ ID NO: 857790 - DNA, 25 bp, Mus musculus
tgatccagctgagccctgaggctga

SEQ ID NO: 857791 - DNA, 25 bp, Mus musculus
tgatccaggccgaggaccgtgtgca

SEQ ID NO: 857792 - DNA, 25 bp, Mus musculus
tgatccaggccgtggaccgtgtgca

SEQ ID NO: 857793 - DNA, 25 bp, Mus musculus
tgatccaggcctagttgagccgggc

SEQ ID NO: 857794 - DNA, 25 bp, Mus musculus
tgatccaggccttgttgagccgggc

SEQ ID NO: 857795 - DNA, 25 bp, Mus musculus
tgatccaggcgaatccaacagccct

SEQ ID NO: 857796 - DNA, 25 bp, Mus musculus
tgatccaggcgattccaacagccct

SEQ ID NO: 857797 - DNA, 25 bp, Mus musculus
tgatccaggcgtctctgccagagaa

SEQ ID NO: 857798 - DNA, 25 bp, Mus musculus
tgatccaggcgtgtctgccagagaa

SEQ ID NO: 857799 - DNA, 25 bp, Mus musculus
tgatccaggctcacactagattaat

SEQ ID NO: 857800 - DNA, 25 bp, Mus musculus
tgatccaggctctcactagattaat

SEQ ID NO: 857801 - DNA, 25 bp, Mus musculus
tgatccaggtaccaagaccctgtct

SEQ ID NO: 857802 - DNA, 25 bp, Mus musculus
tgatccaggtacgaagaccctgtct

SEQ ID NO: 857803 - DNA, 25 bp, Mus musculus
tgatccaggtttagggtgttcccac

SEQ ID NO: 857804 - DNA, 25 bp, Mus musculus
tgatccaggttttgggtgttcccac

SEQ ID NO: 857805 - DNA, 25 bp, Mus musculus
tgatccagtacaccatcaccattta

SEQ ID NO: 857806 - DNA, 25 bp, Mus musculus
tgatccagtacagcatcaccattta

SEQ ID NO: 857807 - DNA, 25 bp, Mus musculus
tgatccatataacccagcaagctga

SEQ ID NO: 857808 - DNA, 25 bp, Mus musculus
tgatccatataagccagcaagctga

SEQ ID NO: 857809 - DNA, 25 bp, Mus musculus
tgatccatatccacaacacctggaa

SEQ ID NO: 857810 - DNA, 25 bp, Mus musculus
tgatccatatcctcaacacctggaa

SEQ ID NO: 857811 - DNA, 25 bp, Mus musculus
tgatccatattcaccccaaacattt

SEQ ID NO: 857812 - DNA, 25 bp, Mus musculus
tgatccatattctccccaaacattt

SEQ ID NO: 857813 - DNA, 25 bp, Mus musculus
tgatccatcattacactagccttga

SEQ ID NO: 857814 - DNA, 25 bp, Mus musculus
tgatccatcatttcactagccttga

SEQ ID NO: 857815 - DNA, 25 bp, Mus musculus
tgatccatccaaaacgttcaatgta

SEQ ID NO: 857816 - DNA, 25 bp, Mus musculus
tgatccatccaatacgttcaatgta

SEQ ID NO: 857817 - DNA, 25 bp, Mus musculus
tgatccatctgtctagtttctgaac

SEQ ID NO: 857818 - DNA, 25 bp, Mus musculus
tgatccatctgtgtagtttctgaac

SEQ ID NO: 857819 - DNA, 25 bp, Mus musculus
tgatccatgatcctgttaaccgcga

SEQ ID NO: 857820 - DNA, 25 bp, Mus musculus
tgatccatgatcgtgttaaccgcga

SEQ ID NO: 857821 - DNA, 25 bp, Mus musculus
tgatccatgtaaattatgtttgaaa

SEQ ID NO: 857822 - DNA, 25 bp, Mus musculus
tgatccatgtaatttatgtttgaaa

SEQ ID NO: 857823 - DNA, 25 bp, Mus musculus
tgatccattactctgtctccacatt

SEQ ID NO: 857824 - DNA, 25 bp, Mus musculus
tgatccattactgtgtctccacatt

SEQ ID NO: 857825 - DNA, 25 bp, Mus musculus
tgatccattataatgctagagactt

SEQ ID NO: 857826 - DNA, 25 bp, Mus musculus
tgatccattatattgctagagactt

SEQ ID NO: 857827 - DNA, 25 bp, Mus musculus
tgatcccaaatcacaatgaatgtat

SEQ ID NO: 857828 - DNA, 25 bp, Mus musculus
tgatcccaaatctcaatgaatgtat

SEQ ID NO: 857829 - DNA, 25 bp, Mus musculus
tgatcccaactcagcaagagctttt

SEQ ID NO: 857830 - DNA, 25 bp, Mus musculus
tgatcccaactctgcaagagctttt

SEQ ID NO: 857831 - DNA, 25 bp, Mus musculus
tgatcccaatgcacccgaaacagaa

SEQ ID NO: 857832 - DNA, 25 bp, Mus musculus
tgatcccaatgctcccgaaacagaa

SEQ ID NO: 857833 - DNA, 25 bp, Mus musculus
tgatcccacccgatatgccatgttc

SEQ ID NO: 857834 - DNA, 25 bp, Mus musculus
tgatcccacccgttatgccatgttc

SEQ ID NO: 857835 - DNA, 25 bp, Mus musculus
tgatcccaccttcacccagaggaag

SEQ ID NO: 857836 - DNA, 25 bp, Mus musculus
tgatcccaccttcgaaactgtgtgg

SEQ ID NO: 857837 - DNA, 25 bp, Mus musculus
tgatcccaccttgacccagaggaag

SEQ ID NO: 857838 - DNA, 25 bp, Mus musculus
tgatcccaccttggaaactgtgtgg

SEQ ID NO: 857839 - DNA, 25 bp, Mus musculus
tgatcccactgacacaattactgtg

SEQ ID NO: 857840 - DNA, 25 bp, Mus musculus
tgatcccactgagacaattactgtg

SEQ ID NO: 857841 - DNA, 25 bp, Mus musculus
tgatcccagatcattacagctactt

SEQ ID NO: 857842 - DNA, 25 bp, Mus musculus
tgatcccagatctttacagctactt

SEQ ID NO: 857843 - DNA, 25 bp, Mus musculus
tgatcccagcacacattcctatttg

SEQ ID NO: 857844 - DNA, 25 bp, Mus musculus
tgatcccagcactcattcctatttg

SEQ ID NO: 857845 - DNA, 25 bp, Mus musculus
tgatcccagcagctatacagctctg

SEQ ID NO: 857846 - DNA, 25 bp, Mus musculus
tgatcccagcaggtatacagctctg

SEQ ID NO: 857847 - DNA, 25 bp, Mus musculus
tgatcccaggcccatttatgattaa

SEQ ID NO: 857848 - DNA, 25 bp, Mus musculus
tgatcccaggccgatttatgattaa

SEQ ID NO: 857849 - DNA, 25 bp, Mus musculus
tgatcccagtatacgctcagcgaag

SEQ ID NO: 857850 - DNA, 25 bp, Mus musculus
tgatcccagtattcgctcagcgaag

SEQ ID NO: 857851 - DNA, 25 bp, Mus musculus
tgatcccagttaattaccaaccaag

SEQ ID NO: 857852 - DNA, 25 bp, Mus musculus
tgatcccagttaccctttctaggaa

SEQ ID NO: 857853 - DNA, 25 bp, Mus musculus
tgatcccagttagcctttctaggaa

SEQ ID NO: 857854 - DNA, 25 bp, Mus musculus
tgatcccagttatttaccaaccaag

SEQ ID NO: 857855 - DNA, 25 bp, Mus musculus
tgatccccaacgagtatgtctgcaa

SEQ ID NO: 857856 - DNA, 25 bp, Mus musculus
tgatccccaacgtgtatgtctgcaa

SEQ ID NO: 857857 - DNA, 25 bp, Mus musculus
tgatccccaagccatacctgagggc

SEQ ID NO: 857858 - DNA, 25 bp, Mus musculus
tgatccccaagcgatacctgagggc

SEQ ID NO: 857859 - DNA, 25 bp, Mus musculus
tgatccccagctcaactgttggtgg

SEQ ID NO: 857860 - DNA, 25 bp, Mus musculus
tgatccccagctgaactgttggtgg

SEQ ID NO: 857861 - DNA, 25 bp, Mus musculus
tgatccccagttctcagaatgaagt

SEQ ID NO: 857862 - DNA, 25 bp, Mus musculus
tgatccccagttgtcagaatgaagt

SEQ ID NO: 857863 - DNA, 25 bp, Mus musculus
tgatccccatgtagagctctgcaag

SEQ ID NO: 857864 - DNA, 25 bp, Mus musculus
tgatccccatgttgagctctgcaag

SEQ ID NO: 857865 - DNA, 25 bp, Mus musculus
tgatccccgactacttgtaattctt

SEQ ID NO: 857866 - DNA, 25 bp, Mus musculus
tgatccccgacttcttgtaattctt

SEQ ID NO: 857867 - DNA, 25 bp, Mus musculus
tgatccccgcagatggcctgaatgt

SEQ ID NO: 857868 - DNA, 25 bp, Mus musculus
tgatccccgcagttggcctgaatgt

SEQ ID NO: 857869 - DNA, 25 bp, Mus musculus
tgatccccggccatgaactccggag

SEQ ID NO: 857870 - DNA, 25 bp, Mus musculus
tgatccccggccttgaactccggag

SEQ ID NO: 857871 - DNA, 25 bp, Mus musculus
tgatccccggctacagaactttgta

SEQ ID NO: 857872 - DNA, 25 bp, Mus musculus
tgatccccggcttcagaactttgta

SEQ ID NO: 857873 - DNA, 25 bp, Mus musculus
tgatccccgtgtatcctggtgggac

SEQ ID NO: 857874 - DNA, 25 bp, Mus musculus
tgatccccgtgtttcctggtgggac

SEQ ID NO: 857875 - DNA, 25 bp, Mus musculus
tgatccccgtttagggtgcacacgc

SEQ ID NO: 857876 - DNA, 25 bp, Mus musculus
tgatccccgttttgggtgcacacgc

SEQ ID NO: 857877 - DNA, 25 bp, Mus musculus
tgatcccctgggagttagagctgag

SEQ ID NO: 857878 - DNA, 25 bp, Mus musculus
tgatcccctgggtgttagagctgag

SEQ ID NO: 857879 - DNA, 25 bp, Mus musculus
tgatccccttccaaattggaataag

SEQ ID NO: 857880 - DNA, 25 bp, Mus musculus
tgatccccttcctaattggaataag

SEQ ID NO: 857881 - DNA, 25 bp, Mus musculus
tgatccctactcctttcaacaacaa

SEQ ID NO: 857882 - DNA, 25 bp, Mus musculus
tgatccctactcgtttcaacaacaa

SEQ ID NO: 857883 - DNA, 25 bp, Mus musculus
tgatccctcatcacagtgactgcac

SEQ ID NO: 857884 - DNA, 25 bp, Mus musculus
tgatccctcatctcagtgactgcac

SEQ ID NO: 857885 - DNA, 25 bp, Mus musculus
tgatccctcatgatgttttcaaaga

SEQ ID NO: 857886 - DNA, 25 bp, Mus musculus
tgatccctcatgcagacctgggcca

SEQ ID NO: 857887 - DNA, 25 bp, Mus musculus
tgatccctcatggagacctgggcca

SEQ ID NO: 857888 - DNA, 25 bp, Mus musculus
tgatccctcatgttgttttcaaaga

SEQ ID NO: 857889 - DNA, 25 bp, Mus musculus
tgatccctgacaagttcacgacact

SEQ ID NO: 857890 - DNA, 25 bp, Mus musculus
tgatccctgacatgttcacgacact

SEQ ID NO: 857891 - DNA, 25 bp, Mus musculus
tgatccctgatcctatttccctctg

SEQ ID NO: 857892 - DNA, 25 bp, Mus musculus
tgatccctgatcgtatttccctctg

SEQ ID NO: 857893 - DNA, 25 bp, Mus musculus
tgatccctgcacagcttgtgcaagc

SEQ ID NO: 857894 - DNA, 25 bp, Mus musculus
tgatccctgcactgcttgtgcaagc

SEQ ID NO: 857895 - DNA, 25 bp, Mus musculus
tgatccctggatagagtacaccttg

SEQ ID NO: 857896 - DNA, 25 bp, Mus musculus
tgatccctggattgagtacaccttg

SEQ ID NO: 857897 - DNA, 25 bp, Mus musculus
tgatccctggcaactcaggagttct

SEQ ID NO: 857898 - DNA, 25 bp, Mus musculus
tgatccctggcatctcaggagttct

SEQ ID NO: 857899 - DNA, 25 bp, Mus musculus
tgatccctgtacagtgttcctgaca

SEQ ID NO: 857900 - DNA, 25 bp, Mus musculus
tgatccctgtactgtgttcctgaca

SEQ ID NO: 857901 - DNA, 25 bp, Mus musculus
tgatccgacaacatctgtgccagta

SEQ ID NO: 857902 - DNA, 25 bp, Mus musculus
tgatccgacaacttctgtgccagta

SEQ ID NO: 857903 - DNA, 25 bp, Mus musculus
tgatccgacccaacttgaaagctca

SEQ ID NO: 857904 - DNA, 25 bp, Mus musculus
tgatccgacccatcttgaaagctca

SEQ ID NO: 857905 - DNA, 25 bp, Mus musculus
tgatccgaggcccaagttgttaagg

SEQ ID NO: 857906 - DNA, 25 bp, Mus musculus
tgatccgaggccgaagttgttaagg

SEQ ID NO: 857907 - DNA, 25 bp, Mus musculus
tgatccgcaagcagccgttccagcg

SEQ ID NO: 857908 - DNA, 25 bp, Mus musculus
tgatccgcaagctgccgttccagcg

SEQ ID NO: 857909 - DNA, 25 bp, Mus musculus
tgatccgcaagtccctggagatgct

SEQ ID NO: 857910 - DNA, 25 bp, Mus musculus
tgatccgcaagtgcctggagatgct

SEQ ID NO: 857911 - DNA, 25 bp, Mus musculus
tgatccgcatcgaggactcagacca

SEQ ID NO: 857912 - DNA, 25 bp, Mus musculus
tgatccgcatcgtggactcagacca

SEQ ID NO: 857913 - DNA, 25 bp, Mus musculus
tgatccgccttcagaaatgctttgc

SEQ ID NO: 857914 - DNA, 25 bp, Mus musculus
tgatccgccttctgaaatgctttgc

SEQ ID NO: 857915 - DNA, 25 bp, Mus musculus
tgatccggaagaccacagcgagcca

SEQ ID NO: 857916 - DNA, 25 bp, Mus musculus
tgatccggaagagcacagcgagcca

SEQ ID NO: 857917 - DNA, 25 bp, Mus musculus
tgatccggacctctcggcatggaaa

SEQ ID NO: 857918 - DNA, 25 bp, Mus musculus
tgatccggacctgtcggcatggaaa

SEQ ID NO: 857919 - DNA, 25 bp, Mus musculus
tgatccggaggcattgcaggcaaaa

SEQ ID NO: 857920 - DNA, 25 bp, Mus musculus
tgatccggaggctttgcaggcaaaa

SEQ ID NO: 857921 - DNA, 25 bp, Mus musculus
tgatccggatggattcccagacaga

SEQ ID NO: 857922 - DNA, 25 bp, Mus musculus
tgatccggatggtttcccagacaga

SEQ ID NO: 857923 - DNA, 25 bp, Mus musculus
tgatccgggctgaccggaacaccaa

SEQ ID NO: 857924 - DNA, 25 bp, Mus musculus
tgatccgggctgtccggaacaccaa

SEQ ID NO: 857925 - DNA, 25 bp, Mus musculus
tgatccgtaaagctccctgtgactg

SEQ ID NO: 857926 - DNA, 25 bp, Mus musculus
tgatccgtaaaggtccctgtgactg

SEQ ID NO: 857927 - DNA, 25 bp, Mus musculus
tgatccgtaggtaacaacacccctc

SEQ ID NO: 857928 - DNA, 25 bp, Mus musculus
tgatccgtaggttacaacacccctc

SEQ ID NO: 857929 - DNA, 25 bp, Mus musculus
tgatccgttccaccttgttaaactt

SEQ ID NO: 857930 - DNA, 25 bp, Mus musculus
tgatccgttccagcttgttaaactt

SEQ ID NO: 857931 - DNA, 25 bp, Mus musculus
tgatcctaagaacacctccatgaga

SEQ ID NO: 857932 - DNA, 25 bp, Mus musculus
tgatcctaagaagacctccatgaga

SEQ ID NO: 857933 - DNA, 25 bp, Mus musculus
tgatcctaagcaactgtctaaactt

SEQ ID NO: 857934 - DNA, 25 bp, Mus musculus
tgatcctaagcatctgtctaaactt

SEQ ID NO: 857935 - DNA, 25 bp, Mus musculus
tgatcctacagcagttctgagacca

SEQ ID NO: 857936 - DNA, 25 bp, Mus musculus
tgatcctacagctgttctgagacca

SEQ ID NO: 857937 - DNA, 25 bp, Mus musculus
tgatcctaccccagggccagataag

SEQ ID NO: 857938 - DNA, 25 bp, Mus musculus
tgatcctacccctgggccagataag

SEQ ID NO: 857939 - DNA, 25 bp, Mus musculus
tgatcctaccgcctttaacaactct

SEQ ID NO: 857940 - DNA, 25 bp, Mus musculus
tgatcctaccgcgtttaacaactct

SEQ ID NO: 857941 - DNA, 25 bp, Mus musculus
tgatcctactttctgctgttctcac

SEQ ID NO: 857942 - DNA, 25 bp, Mus musculus
tgatcctactttgtgctgttctcac

SEQ ID NO: 857943 - DNA, 25 bp, Mus musculus
tgatcctatgttactgggccgccag

SEQ ID NO: 857944 - DNA, 25 bp, Mus musculus
tgatcctatgtttctgggccgccag

SEQ ID NO: 857945 - DNA, 25 bp, Mus musculus
tgatcctattagcttgtgatgtata

SEQ ID NO: 857946 - DNA, 25 bp, Mus musculus
tgatcctattaggttgtgatgtata

SEQ ID NO: 857947 - DNA, 25 bp, Mus musculus
tgatcctcaaacacattggcacagt

SEQ ID NO: 857948 - DNA, 25 bp, Mus musculus
tgatcctcaaactcattggcacagt

SEQ ID NO: 857949 - DNA, 25 bp, Mus musculus
tgatcctcacgcacatggaaccaga

SEQ ID NO: 857950 - DNA, 25 bp, Mus musculus
tgatcctcacgctcatggaaccaga

SEQ ID NO: 857951 - DNA, 25 bp, Mus musculus
tgatcctcactgagaaggaacagat

SEQ ID NO: 857952 - DNA, 25 bp, Mus musculus
tgatcctcactgtgaaggaacagat

SEQ ID NO: 857953 - DNA, 25 bp, Mus musculus
tgatcctcagacaccgtttcctgcg

SEQ ID NO: 857954 - DNA, 25 bp, Mus musculus
tgatcctcagactccgtttcctgcg

SEQ ID NO: 857955 - DNA, 25 bp, Mus musculus
tgatcctcagccagtcagaaagatt

SEQ ID NO: 857956 - DNA, 25 bp, Mus musculus
tgatcctcagcctgtcagaaagatt

SEQ ID NO: 857957 - DNA, 25 bp, Mus musculus
tgatcctcataaaggcctcggtgtc

SEQ ID NO: 857958 - DNA, 25 bp, Mus musculus
tgatcctcataatggcctcggtgtc

SEQ ID NO: 857959 - DNA, 25 bp, Mus musculus
tgatcctcatccaaagcctggtgca

SEQ ID NO: 857960 - DNA, 25 bp, Mus musculus
tgatcctcatcctaagcctggtgca

SEQ ID NO: 857961 - DNA, 25 bp, Mus musculus
tgatcctcatggagggttagctctg

SEQ ID NO: 857962 - DNA, 25 bp, Mus musculus
tgatcctcatggtgggttagctctg

SEQ ID NO: 857963 - DNA, 25 bp, Mus musculus
tgatcctccactcttctggaagagt

SEQ ID NO: 857964 - DNA, 25 bp, Mus musculus
tgatcctccactgttctggaagagt

SEQ ID NO: 857965 - DNA, 25 bp, Mus musculus
tgatcctccagtcgcaccaaatgtg

SEQ ID NO: 857966 - DNA, 25 bp, Mus musculus
tgatcctccagtggcaccaaatgtg

SEQ ID NO: 857967 - DNA, 25 bp, Mus musculus
tgatcctcctacctgtttctagagt

SEQ ID NO: 857968 - DNA, 25 bp, Mus musculus
tgatcctcctacgtgtttctagagt

SEQ ID NO: 857969 - DNA, 25 bp, Mus musculus
tgatcctcctccagggaacctctat

SEQ ID NO: 857970 - DNA, 25 bp, Mus musculus
tgatcctcctcctgggaacctctat

SEQ ID NO: 857971 - DNA, 25 bp, Mus musculus
tgatcctcgcggcaacatcaaggtg

SEQ ID NO: 857972 - DNA, 25 bp, Mus musculus
tgatcctcgcgggaacatcaaggtg

SEQ ID NO: 857973 - DNA, 25 bp, Mus musculus
tgatcctcggaacccagtgaacaaa

SEQ ID NO: 857974 - DNA, 25 bp, Mus musculus
tgatcctcggaagccagtgaacaaa

SEQ ID NO: 857975 - DNA, 25 bp, Mus musculus
tgatcctctattcgagtggcccaga

SEQ ID NO: 857976 - DNA, 25 bp, Mus musculus
tgatcctctattggagtggcccaga

SEQ ID NO: 857977 - DNA, 25 bp, Mus musculus
tgatcctctctaccatcctgatgat

SEQ ID NO: 857978 - DNA, 25 bp, Mus musculus
tgatcctctctagcatcctgatgat

SEQ ID NO: 857979 - DNA, 25 bp, Mus musculus
tgatcctctgcaccccaggttctgg

SEQ ID NO: 857980 - DNA, 25 bp, Mus musculus
tgatcctctgcagcccaggttctgg

SEQ ID NO: 857981 - DNA, 25 bp, Mus musculus
tgatcctcttaaaccttgtctgtgg

SEQ ID NO: 857982 - DNA, 25 bp, Mus musculus
tgatcctcttaatccttgtctgtgg

SEQ ID NO: 857983 - DNA, 25 bp, Mus musculus
tgatcctcttctcataccctgtgac

SEQ ID NO: 857984 - DNA, 25 bp, Mus musculus
tgatcctcttctgataccctgtgac

SEQ ID NO: 857985 - DNA, 25 bp, Mus musculus
tgatcctgaaatcgcccggcattta

SEQ ID NO: 857986 - DNA, 25 bp, Mus musculus
tgatcctgaaatggcccggcattta

SEQ ID NO: 857987 - DNA, 25 bp, Mus musculus
tgatcctgaagtccaattgacgtga

SEQ ID NO: 857988 - DNA, 25 bp, Mus musculus
tgatcctgaagtgcaattgacgtga

SEQ ID NO: 857989 - DNA, 25 bp, Mus musculus
tgatcctgagcaatgccatgtgccc

SEQ ID NO: 857990 - DNA, 25 bp, Mus musculus
tgatcctgagcattgccatgtgccc

SEQ ID NO: 857991 - DNA, 25 bp, Mus musculus
tgatcctgagccagatgtcatccca

SEQ ID NO: 857992 - DNA, 25 bp, Mus musculus
tgatcctgagcctgatgtcatccca

SEQ ID NO: 857993 - DNA, 25 bp, Mus musculus
tgatcctgattactctgtggttgaa

SEQ ID NO: 857994 - DNA, 25 bp, Mus musculus
tgatcctgattagtctgtggttgaa

SEQ ID NO: 857995 - DNA, 25 bp, Mus musculus
tgatcctgatttagatgagagtaaa

SEQ ID NO: 857996 - DNA, 25 bp, Mus musculus
tgatcctgattttgatgagagtaaa

SEQ ID NO: 857997 - DNA, 25 bp, Mus musculus
tgatcctgcatcaataacctgcttt

SEQ ID NO: 857998 - DNA, 25 bp, Mus musculus
tgatcctgcatctataacctgcttt

SEQ ID NO: 857999 - DNA, 25 bp, Mus musculus
tgatcctgcctgaggatctacaaat

SEQ ID NO: 858000 - DNA, 25 bp, Mus musculus
tgatcctgcctgtggatctacaaat

SEQ ID NO: 858001 - DNA, 25 bp, Mus musculus
tgatcctgctcccatttttgtttgt

SEQ ID NO: 858002 - DNA, 25 bp, Mus musculus
tgatcctgctccgatttttgtttgt

SEQ ID NO: 858003 - DNA, 25 bp, Mus musculus
tgatcctggactcggtgccttacat

SEQ ID NO: 858004 - DNA, 25 bp, Mus musculus
tgatcctggactgggtgccttacat

SEQ ID NO: 858005 - DNA, 25 bp, Mus musculus
tgatcctggcgtcgttcacaactga

SEQ ID NO: 858006 - DNA, 25 bp, Mus musculus
tgatcctggcgtggttcacaactga

SEQ ID NO: 858007 - DNA, 25 bp, Mus musculus
tgatcctggctccaatcatcagtga

SEQ ID NO: 858008 - DNA, 25 bp, Mus musculus
tgatcctggctcgaatcatcagtga

SEQ ID NO: 858009 - DNA, 25 bp, Mus musculus
tgatcctggcttaattgtcccaagt

SEQ ID NO: 858010 - DNA, 25 bp, Mus musculus
tgatcctggctttattgtcccaagt

SEQ ID NO: 858011 - DNA, 25 bp, Mus musculus
tgatcctgggcaaaactaaccccga

SEQ ID NO: 858012 - DNA, 25 bp, Mus musculus
tgatcctgggcataactaaccccga

SEQ ID NO: 858013 - DNA, 25 bp, Mus musculus
tgatcctggtccatctgtcctggtc

SEQ ID NO: 858014 - DNA, 25 bp, Mus musculus
tgatcctggtccttctgtcctggtc

SEQ ID NO: 858015 - DNA, 25 bp, Mus musculus
tgatcctggtttaatgcttgtttgt

SEQ ID NO: 858016 - DNA, 25 bp, Mus musculus
tgatcctggttttatgcttgtttgt

SEQ ID NO: 858017 - DNA, 25 bp, Mus musculus
tgatcctgtcaaaatcccctgagaa

SEQ ID NO: 858018 - DNA, 25 bp, Mus musculus
tgatcctgtcaatatcccctgagaa

SEQ ID NO: 858019 - DNA, 25 bp, Mus musculus
tgatcctgtccaagggtgggcagct

SEQ ID NO: 858020 - DNA, 25 bp, Mus musculus
tgatcctgtccatgggtgggcagct

SEQ ID NO: 858021 - DNA, 25 bp, Mus musculus
tgatcctgtctgcttccaaagcgct

SEQ ID NO: 858022 - DNA, 25 bp, Mus musculus
tgatcctgtctggttccaaagcgct

SEQ ID NO: 858023 - DNA, 25 bp, Mus musculus
tgatcctgtgcgacctgcagctggg

SEQ ID NO: 858024 - DNA, 25 bp, Mus musculus
tgatcctgtgcgtcctgcagctggg

SEQ ID NO: 858025 - DNA, 25 bp, Mus musculus
tgatcctgttccaaactattccatc

SEQ ID NO: 858026 - DNA, 25 bp, Mus musculus
tgatcctgttcctaactattccatc

SEQ ID NO: 858027 - DNA, 25 bp, Mus musculus
tgatccttacaaaggtgatactacc

SEQ ID NO: 858028 - DNA, 25 bp, Mus musculus
tgatccttacaatggtgatactacc

SEQ ID NO: 858029 - DNA, 25 bp, Mus musculus
tgatccttaccacatactgcagagt

SEQ ID NO: 858030 - DNA, 25 bp, Mus musculus
tgatccttaccagatactgcagagt

SEQ ID NO: 858031 - DNA, 25 bp, Mus musculus
tgatccttaggtaactgccaccctg

SEQ ID NO: 858032 - DNA, 25 bp, Mus musculus
tgatccttaggttactgccaccctg

SEQ ID NO: 858033 - DNA, 25 bp, Mus musculus
tgatccttagtacctcacactccta

SEQ ID NO: 858034 - DNA, 25 bp, Mus musculus
tgatccttagtactgcacaaactgg

SEQ ID NO: 858035 - DNA, 25 bp, Mus musculus
tgatccttagtagctcacactccta

SEQ ID NO: 858036 - DNA, 25 bp, Mus musculus
tgatccttagtagtgcacaaactgg

SEQ ID NO: 858037 - DNA, 25 bp, Mus musculus
tgatccttcatactccagcagactc

SEQ ID NO: 858038 - DNA, 25 bp, Mus musculus
tgatccttcatagtccagcagactc

SEQ ID NO: 858039 - DNA, 25 bp, Mus musculus
tgatccttcgaaaccacatatgtac

SEQ ID NO: 858040 - DNA, 25 bp, Mus musculus
tgatccttcgaatccacatatgtac

SEQ ID NO: 858041 - DNA, 25 bp, Mus musculus
tgatccttctagatgctcctgaatg

SEQ ID NO: 858042 - DNA, 25 bp, Mus musculus
tgatccttctagttgctcctgaatg

SEQ ID NO: 858043 - DNA, 25 bp, Mus musculus
tgatccttcttgagaccctactctg

SEQ ID NO: 858044 - DNA, 25 bp, Mus musculus
tgatccttcttgtgaccctactctg

SEQ ID NO: 858045 - DNA, 25 bp, Mus musculus
tgatccttgagtcgccaggcgctct

SEQ ID NO: 858046 - DNA, 25 bp, Mus musculus
tgatccttgagtggccaggcgctct

SEQ ID NO: 858047 - DNA, 25 bp, Mus musculus
tgatccttgcccagcggtgggagct

SEQ ID NO: 858048 - DNA, 25 bp, Mus musculus
tgatccttgccctgcggtgggagct

SEQ ID NO: 858049 - DNA, 25 bp, Mus musculus
tgatcctttcttagcttcctggact

SEQ ID NO: 858050 - DNA, 25 bp, Mus musculus
tgatcctttctttgcttcctggact

SEQ ID NO: 858051 - DNA, 25 bp, Mus musculus
tgatcctttgagcaaccacagacct

SEQ ID NO: 858052 - DNA, 25 bp, Mus musculus
tgatcctttgaggaaccacagacct

SEQ ID NO: 858053 - DNA, 25 bp, Mus musculus
tgatcctttgatatagcccaatatt

SEQ ID NO: 858054 - DNA, 25 bp, Mus musculus
tgatcctttgatttagcccaatatt

SEQ ID NO: 858055 - DNA, 25 bp, Mus musculus
tgatccttttaactgggtttctgct

SEQ ID NO: 858056 - DNA, 25 bp, Mus musculus
tgatccttttaagtgggtttctgct

SEQ ID NO: 858057 - DNA, 25 bp, Mus musculus
tgatcgacattccagagtagccacc

SEQ ID NO: 858058 - DNA, 25 bp, Mus musculus
tgatcgacattcgagagtagccacc

SEQ ID NO: 858059 - DNA, 25 bp, Mus musculus
tgatcgacattgcttctcagttggg

SEQ ID NO: 858060 - DNA, 25 bp, Mus musculus
tgatcgacattggttctcagttggg

SEQ ID NO: 858061 - DNA, 25 bp, Mus musculus
tgatcgaggcttatgatcttaaatt

SEQ ID NO: 858062 - DNA, 25 bp, Mus musculus
tgatcgaggcttttgatcttaaatt

SEQ ID NO: 858063 - DNA, 25 bp, Mus musculus
tgatcgatttccatgagcctcagag

SEQ ID NO: 858064 - DNA, 25 bp, Mus musculus
tgatcgatttccttgagcctcagag

SEQ ID NO: 858065 - DNA, 25 bp, Mus musculus
tgatcgcagaccatccttcaaaacc

SEQ ID NO: 858066 - DNA, 25 bp, Mus musculus
tgatcgcagaccttccttcaaaacc

SEQ ID NO: 858067 - DNA, 25 bp, Mus musculus
tgatcgcagagcaccaggcccgacg

SEQ ID NO: 858068 - DNA, 25 bp, Mus musculus
tgatcgcagagctccaggcccgacg

SEQ ID NO: 858069 - DNA, 25 bp, Mus musculus
tgatcgcagcacaagctgttgcagt

SEQ ID NO: 858070 - DNA, 25 bp, Mus musculus
tgatcgcagcactagctgttgcagt

SEQ ID NO: 858071 - DNA, 25 bp, Mus musculus
tgatcgccaaccagttctacgagtt

SEQ ID NO: 858072 - DNA, 25 bp, Mus musculus
tgatcgccaacctgttctacgagtt

SEQ ID NO: 858073 - DNA, 25 bp, Mus musculus
tgatcgccaactacagtgaacctga

SEQ ID NO: 858074 - DNA, 25 bp, Mus musculus
tgatcgccaacttcagtgaacctga

SEQ ID NO: 858075 - DNA, 25 bp, Mus musculus
tgatcgccaccaacattctcctggt

SEQ ID NO: 858076 - DNA, 25 bp, Mus musculus
tgatcgccaccatcattctcctggt

SEQ ID NO: 858077 - DNA, 25 bp, Mus musculus
tgatcgccatggaggcctcaagagg

SEQ ID NO: 858078 - DNA, 25 bp, Mus musculus
tgatcgccatggtggcctcaagagg

SEQ ID NO: 858079 - DNA, 25 bp, Mus musculus
tgatcgcccaccattggttttaagt

SEQ ID NO: 858080 - DNA, 25 bp, Mus musculus
tgatcgcccacctttggttttaagt

SEQ ID NO: 858081 - DNA, 25 bp, Mus musculus
tgatcgcccagtacagctatacctg

SEQ ID NO: 858082 - DNA, 25 bp, Mus musculus
tgatcgcccagttcagctatacctg

SEQ ID NO: 858083 - DNA, 25 bp, Mus musculus
tgatcgccgagcagctacagttcag

SEQ ID NO: 858084 - DNA, 25 bp, Mus musculus
tgatcgccgagctgctacagttcag

SEQ ID NO: 858085 - DNA, 25 bp, Mus musculus
tgatcgccgtttccttagccagagt

SEQ ID NO: 858086 - DNA, 25 bp, Mus musculus
tgatcgccgtttgcttagccagagt

SEQ ID NO: 858087 - DNA, 25 bp, Mus musculus
tgatcgcctaggagtcagaccttca

SEQ ID NO: 858088 - DNA, 25 bp, Mus musculus
tgatcgcctaggtgtcagaccttca

SEQ ID NO: 858089 - DNA, 25 bp, Mus musculus
tgatcgcctcgtaagtctgtgggac

SEQ ID NO: 858090 - DNA, 25 bp, Mus musculus
tgatcgcctcgttagtctgtgggac

SEQ ID NO: 858091 - DNA, 25 bp, Mus musculus
tgatcgcggagaaggacgattaagt

SEQ ID NO: 858092 - DNA, 25 bp, Mus musculus
tgatcgcggagatggacgattaagt

SEQ ID NO: 858093 - DNA, 25 bp, Mus musculus
tgatcgctcaatattttctggcatt

SEQ ID NO: 858094 - DNA, 25 bp, Mus musculus
tgatcgctcaattttttctggcatt

SEQ ID NO: 858095 - DNA, 25 bp, Mus musculus
tgatcgctgggcacgctccatcaga

SEQ ID NO: 858096 - DNA, 25 bp, Mus musculus
tgatcgctgggcatctgctccggag

SEQ ID NO: 858097 - DNA, 25 bp, Mus musculus
tgatcgctgggctcgctccatcaga

SEQ ID NO: 858098 - DNA, 25 bp, Mus musculus
tgatcgctgggcttctgctccggag

SEQ ID NO: 858099 - DNA, 25 bp, Mus musculus
tgatcggatctgacctcagaaccca

SEQ ID NO: 858100 - DNA, 25 bp, Mus musculus
tgatcggatctgtcctcagaaccca

SEQ ID NO: 858101 - DNA, 25 bp, Mus musculus
tgatcggcgttcatacttctgattt

SEQ ID NO: 858102 - DNA, 25 bp, Mus musculus
tgatcggcgttcttacttctgattt

SEQ ID NO: 858103 - DNA, 25 bp, Mus musculus
tgatcggctcaacaaggtcatcagt

SEQ ID NO: 858104 - DNA, 25 bp, Mus musculus
tgatcggctcaagaaggtcatcagt

SEQ ID NO: 858105 - DNA, 25 bp, Mus musculus
tgatcggcttcacaagtgttgctca

SEQ ID NO: 858106 - DNA, 25 bp, Mus musculus
tgatcggcttcagaagtgttgctca

SEQ ID NO: 858107 - DNA, 25 bp, Mus musculus
tgatcgggaaataccatctcctcct

SEQ ID NO: 858108 - DNA, 25 bp, Mus musculus
tgatcgggaaattccatctcctcct

SEQ ID NO: 858109 - DNA, 25 bp, Mus musculus
tgatcgggaactcggctgccatact

SEQ ID NO: 858110 - DNA, 25 bp, Mus musculus
tgatcgggaactcggtgccttttcg

SEQ ID NO: 858111 - DNA, 25 bp, Mus musculus
tgatcgggaactgggctgccatact

SEQ ID NO: 858112 - DNA, 25 bp, Mus musculus
tgatcgggaactgggtgccttttcg

SEQ ID NO: 858113 - DNA, 25 bp, Mus musculus
tgatcgggatcgagagcacaagcgt

SEQ ID NO: 858114 - DNA, 25 bp, Mus musculus
tgatcgggatcgtgagcacaagcgt

SEQ ID NO: 858115 - DNA, 25 bp, Mus musculus
tgatcgggtcttagaggcttgttac

SEQ ID NO: 858116 - DNA, 25 bp, Mus musculus
tgatcgggtctttgaggcttgttac

SEQ ID NO: 858117 - DNA, 25 bp, Mus musculus
tgatcggtaccgactagtcaaacag

SEQ ID NO: 858118 - DNA, 25 bp, Mus musculus
tgatcggtaccgtctagtcaaacag

SEQ ID NO: 858119 - DNA, 25 bp, Mus musculus
tgatcggtagaaaaatatgcagcca

SEQ ID NO: 858120 - DNA, 25 bp, Mus musculus
tgatcggtagaataatatgcagcca

SEQ ID NO: 858121 - DNA, 25 bp, Mus musculus
tgatcggttgttaatcagaaaggcc

SEQ ID NO: 858122 - DNA, 25 bp, Mus musculus
tgatcggttgtttatcagaaaggcc

SEQ ID NO: 858123 - DNA, 25 bp, Mus musculus
tgatcggtttctcaatctatgctgc

SEQ ID NO: 858124 - DNA, 25 bp, Mus musculus
tgatcggtttctgaatctatgctgc

SEQ ID NO: 858125 - DNA, 25 bp, Mus musculus
tgatcgtcacggcagcaggcagcaa

SEQ ID NO: 858126 - DNA, 25 bp, Mus musculus
tgatcgtcacgggagcaggcagcaa

SEQ ID NO: 858127 - DNA, 25 bp, Mus musculus
tgatcgtgaagcacatcaccacaca

SEQ ID NO: 858128 - DNA, 25 bp, Mus musculus
tgatcgtgaagctcatcaccacaca

SEQ ID NO: 858129 - DNA, 25 bp, Mus musculus
tgatcgtgggaaagggaccctcaca

SEQ ID NO: 858130 - DNA, 25 bp, Mus musculus
tgatcgtgggaatgggaccctcaca

SEQ ID NO: 858131 - DNA, 25 bp, Mus musculus
tgatcgtggtacacagctatacatg

SEQ ID NO: 858132 - DNA, 25 bp, Mus musculus
tgatcgtggtactcagctatacatg

SEQ ID NO: 858133 - DNA, 25 bp, Mus musculus
tgatcgtggtagacctcttccagca

SEQ ID NO: 858134 - DNA, 25 bp, Mus musculus
tgatcgtggtagtcctcttccagca

SEQ ID NO: 858135 - DNA, 25 bp, Mus musculus
tgatcgttataaatttggttcccaa

SEQ ID NO: 858136 - DNA, 25 bp, Mus musculus
tgatcgttataattttggttcccaa

SEQ ID NO: 858137 - DNA, 25 bp, Mus musculus
tgatcgttgccactctaactctgaa

SEQ ID NO: 858138 - DNA, 25 bp, Mus musculus
tgatcgttgccagtctaactctgaa

SEQ ID NO: 858139 - DNA, 25 bp, Mus musculus
tgatcgttggtcctgaaccctacaa

SEQ ID NO: 858140 - DNA, 25 bp, Mus musculus
tgatcgttggtcgtgaaccctacaa

SEQ ID NO: 858141 - DNA, 25 bp, Mus musculus
tgatcgtttgtcattgttgctgttg

SEQ ID NO: 858142 - DNA, 25 bp, Mus musculus
tgatcgtttgtctttgttgctgttg

SEQ ID NO: 858143 - DNA, 25 bp, Mus musculus
tgatctaaggtcaatttttgttttt

SEQ ID NO: 858144 - DNA, 25 bp, Mus musculus
tgatctaaggtctatttttgttttt

SEQ ID NO: 858145 - DNA, 25 bp, Mus musculus
tgatctaatatgctttctccttctc

SEQ ID NO: 858146 - DNA, 25 bp, Mus musculus
tgatctaatatggtttctccttctc

SEQ ID NO: 858147 - DNA, 25 bp, Mus musculus
tgatctacaacaccagagtacctga

SEQ ID NO: 858148 - DNA, 25 bp, Mus musculus
tgatctacaacagcagagtacctga

SEQ ID NO: 858149 - DNA, 25 bp, Mus musculus
tgatctacaaccctcctttatacat

SEQ ID NO: 858150 - DNA, 25 bp, Mus musculus
tgatctacaaccgtcctttatacat

SEQ ID NO: 858151 - DNA, 25 bp, Mus musculus
tgatctacaatacaggtttttcctt

SEQ ID NO: 858152 - DNA, 25 bp, Mus musculus
tgatctacaatagaggtttttcctt

SEQ ID NO: 858153 - DNA, 25 bp, Mus musculus
tgatctacaccgacctcagcagtca

SEQ ID NO: 858154 - DNA, 25 bp, Mus musculus
tgatctacaccgtcctcagcagtca

SEQ ID NO: 858155 - DNA, 25 bp, Mus musculus
tgatctacagaaccacgagtgattt

SEQ ID NO: 858156 - DNA, 25 bp, Mus musculus
tgatctacagaagcacgagtgattt

SEQ ID NO: 858157 - DNA, 25 bp, Mus musculus
tgatctacatcacactctacatttc

SEQ ID NO: 858158 - DNA, 25 bp, Mus musculus
tgatctacatcagactctacatttc

SEQ ID NO: 858159 - DNA, 25 bp, Mus musculus
tgatctaccactatcaatacccaag

SEQ ID NO: 858160 - DNA, 25 bp, Mus musculus
tgatctaccactttcaatacccaag

SEQ ID NO: 858161 - DNA, 25 bp, Mus musculus
tgatctacccttccttaaaactatg

SEQ ID NO: 858162 - DNA, 25 bp, Mus musculus
tgatctacccttgcttaaaactatg

SEQ ID NO: 858163 - DNA, 25 bp, Mus musculus
tgatctacctgtcagcagctccttg

SEQ ID NO: 858164 - DNA, 25 bp, Mus musculus
tgatctacctgtgagcagctccttg

SEQ ID NO: 858165 - DNA, 25 bp, Mus musculus
tgatctactcaaacagtccacctgt

SEQ ID NO: 858166 - DNA, 25 bp, Mus musculus
tgatctactcaacgcctgtaatggg

SEQ ID NO: 858167 - DNA, 25 bp, Mus musculus
tgatctactcaaggcctgtaatggg

SEQ ID NO: 858168 - DNA, 25 bp, Mus musculus
tgatctactcaatcagtccacctgt

SEQ ID NO: 858169 - DNA, 25 bp, Mus musculus
tgatctactctcctataggtctgat

SEQ ID NO: 858170 - DNA, 25 bp, Mus musculus
tgatctactctcgtataggtctgat

SEQ ID NO: 858171 - DNA, 25 bp, Mus musculus
tgatctactgagaagcctctgcttg

SEQ ID NO: 858172 - DNA, 25 bp, Mus musculus
tgatctactgagtagcctctgcttg

SEQ ID NO: 858173 - DNA, 25 bp, Mus musculus
tgatctactgtacccatagcacaaa

SEQ ID NO: 858174 - DNA, 25 bp, Mus musculus
tgatctactgtagccatagcacaaa

SEQ ID NO: 858175 - DNA, 25 bp, Mus musculus
tgatctacttggaggctgcacaaag

SEQ ID NO: 858176 - DNA, 25 bp, Mus musculus
tgatctacttggtggctgcacaaag

SEQ ID NO: 858177 - DNA, 25 bp, Mus musculus
tgatctacttgtcggattctaacag

SEQ ID NO: 858178 - DNA, 25 bp, Mus musculus
tgatctacttgtgggattctaacag

SEQ ID NO: 858179 - DNA, 25 bp, Mus musculus
tgatctagacatcccttaggtaact

SEQ ID NO: 858180 - DNA, 25 bp, Mus musculus
tgatctagacatgccttaggtaact

SEQ ID NO: 858181 - DNA, 25 bp, Mus musculus
tgatctagactcactacctctgagt

SEQ ID NO: 858182 - DNA, 25 bp, Mus musculus
tgatctagactctctacctctgagt

SEQ ID NO: 858183 - DNA, 25 bp, Mus musculus
tgatctagcccaaaggtgtcactct

SEQ ID NO: 858184 - DNA, 25 bp, Mus musculus
tgatctagcccataggtgtcactct

SEQ ID NO: 858185 - DNA, 25 bp, Mus musculus
tgatctagccttaatgtccgtggat

SEQ ID NO: 858186 - DNA, 25 bp, Mus musculus
tgatctagcctttatgtccgtggat

SEQ ID NO: 858187 - DNA, 25 bp, Mus musculus
tgatctagctgacgctcacgctctt

SEQ ID NO: 858188 - DNA, 25 bp, Mus musculus
tgatctagctgaggctcacgctctt

SEQ ID NO: 858189 - DNA, 25 bp, Mus musculus
tgatctagggatacacatgagctct

SEQ ID NO: 858190 - DNA, 25 bp, Mus musculus
tgatctagggattcacatgagctct

SEQ ID NO: 858191 - DNA, 25 bp, Mus musculus
tgatctagtgctcccaagactttga

SEQ ID NO: 858192 - DNA, 25 bp, Mus musculus
tgatctagtgctgccaagactttga

SEQ ID NO: 858193 - DNA, 25 bp, Mus musculus
tgatctatacagcacattcttcagt

SEQ ID NO: 858194 - DNA, 25 bp, Mus musculus
tgatctatacaggacattcttcagt

SEQ ID NO: 858195 - DNA, 25 bp, Mus musculus
tgatctatcaccaatcagcctcaga

SEQ ID NO: 858196 - DNA, 25 bp, Mus musculus
tgatctatcacctatcagcctcaga

SEQ ID NO: 858197 - DNA, 25 bp, Mus musculus
tgatctatcctaccttgtcctgtgt

SEQ ID NO: 858198 - DNA, 25 bp, Mus musculus
tgatctatcctagcttgtcctgtgt

SEQ ID NO: 858199 - DNA, 25 bp, Mus musculus
tgatctatctctccagtaactgttc

SEQ ID NO: 858200 - DNA, 25 bp, Mus musculus
tgatctatctctgcagtaactgttc

SEQ ID NO: 858201 - DNA, 25 bp, Mus musculus
tgatctatcttactcaagtgccctc

SEQ ID NO: 858202 - DNA, 25 bp, Mus musculus
tgatctatcttagtcaagtgccctc

SEQ ID NO: 858203 - DNA, 25 bp, Mus musculus
tgatctatggagctggaaccccgca

SEQ ID NO: 858204 - DNA, 25 bp, Mus musculus
tgatctatggaggtggaaccccgca

SEQ ID NO: 858205 - DNA, 25 bp, Mus musculus
tgatctatttaactggctccagctg

SEQ ID NO: 858206 - DNA, 25 bp, Mus musculus
tgatctatttaagtggctccagctg

SEQ ID NO: 858207 - DNA, 25 bp, Mus musculus
tgatctcaagctcgcacctagcatg

SEQ ID NO: 858208 - DNA, 25 bp, Mus musculus
tgatctcaagctggcacctagcatg

SEQ ID NO: 858209 - DNA, 25 bp, Mus musculus
tgatctcaattactgactccctgtc

SEQ ID NO: 858210 - DNA, 25 bp, Mus musculus
tgatctcaattagtgactccctgtc

SEQ ID NO: 858211 - DNA, 25 bp, Mus musculus
tgatctcacctaatattcatactga

SEQ ID NO: 858212 - DNA, 25 bp, Mus musculus
tgatctcacctattattcatactga

SEQ ID NO: 858213 - DNA, 25 bp, Mus musculus
tgatctcactgcctgtaggttgaag

SEQ ID NO: 858214 - DNA, 25 bp, Mus musculus
tgatctcactgcgtgtaggttgaag

SEQ ID NO: 858215 - DNA, 25 bp, Mus musculus
tgatctcagcataacctctttggaa

SEQ ID NO: 858216 - DNA, 25 bp, Mus musculus
tgatctcagcattacctctttggaa

SEQ ID NO: 858217 - DNA, 25 bp, Mus musculus
tgatctcagcctattcctaagcttg

SEQ ID NO: 858218 - DNA, 25 bp, Mus musculus
tgatctcagccttttcctaagcttg

SEQ ID NO: 858219 - DNA, 25 bp, Mus musculus
tgatctcattccaatcctctttaga

SEQ ID NO: 858220 - DNA, 25 bp, Mus musculus
tgatctcattcctatcctctttaga

SEQ ID NO: 858221 - DNA, 25 bp, Mus musculus
tgatctccaactcttcactctaaga

SEQ ID NO: 858222 - DNA, 25 bp, Mus musculus
tgatctccaactgttcactctaaga

SEQ ID NO: 858223 - DNA, 25 bp, Mus musculus
tgatctccaccacgccttccttggt

SEQ ID NO: 858224 - DNA, 25 bp, Mus musculus
tgatctccaccaggccttccttggt

SEQ ID NO: 858225 - DNA, 25 bp, Mus musculus
tgatctccacctatgcatgctgtag

SEQ ID NO: 858226 - DNA, 25 bp, Mus musculus
tgatctccacctttgcatgctgtag

SEQ ID NO: 858227 - DNA, 25 bp, Mus musculus
tgatctccagagactgcctttgtca

SEQ ID NO: 858228 - DNA, 25 bp, Mus musculus
tgatctccagagtctgcctttgtca

SEQ ID NO: 858229 - DNA, 25 bp, Mus musculus
tgatctccagcaattcgtgtgctaa

SEQ ID NO: 858230 - DNA, 25 bp, Mus musculus
tgatctccagcatttcgtgtgctaa

SEQ ID NO: 858231 - DNA, 25 bp, Mus musculus
tgatctccagggacgtagtgaagcc

SEQ ID NO: 858232 - DNA, 25 bp, Mus musculus
tgatctccagggtcgtagtgaagcc

SEQ ID NO: 858233 - DNA, 25 bp, Mus musculus
tgatctccatacaatgccacagcat

SEQ ID NO: 858234 - DNA, 25 bp, Mus musculus
tgatctccatactatgccacagcat

SEQ ID NO: 858235 - DNA, 25 bp, Mus musculus
tgatctccatatctggctcgaactt

SEQ ID NO: 858236 - DNA, 25 bp, Mus musculus
tgatctccatatgtggctcgaactt

SEQ ID NO: 858237 - DNA, 25 bp, Mus musculus
tgatctccatttctctaagggtcga

SEQ ID NO: 858238 - DNA, 25 bp, Mus musculus
tgatctccatttgtctaagggtcga

SEQ ID NO: 858239 - DNA, 25 bp, Mus musculus
tgatctcccaaaccactttgaagct

SEQ ID NO: 858240 - DNA, 25 bp, Mus musculus
tgatctcccaaagcactttgaagct

SEQ ID NO: 858241 - DNA, 25 bp, Mus musculus
tgatctcccctcagactgtggcatg

SEQ ID NO: 858242 - DNA, 25 bp, Mus musculus
tgatctcccctctgactgtggcatg

SEQ ID NO: 858243 - DNA, 25 bp, Mus musculus
tgatctccctgtcaaggcccacaaa

SEQ ID NO: 858244 - DNA, 25 bp, Mus musculus
tgatctccctgtgaaggcccacaaa

SEQ ID NO: 858245 - DNA, 25 bp, Mus musculus
tgatctcccttgcaagccttcagag

SEQ ID NO: 858246 - DNA, 25 bp, Mus musculus
tgatctcccttggaagccttcagag

SEQ ID NO: 858247 - DNA, 25 bp, Mus musculus
tgatctccgagtaactctttccaaa

SEQ ID NO: 858248 - DNA, 25 bp, Mus musculus
tgatctccgagttactctttccaaa

SEQ ID NO: 858249 - DNA, 25 bp, Mus musculus
tgatctccgcaaccaaagccaaaga

SEQ ID NO: 858250 - DNA, 25 bp, Mus musculus
tgatctccgcaagcaaagccaaaga

SEQ ID NO: 858251 - DNA, 25 bp, Mus musculus
tgatctccttgaagctctttcttaa

SEQ ID NO: 858252 - DNA, 25 bp, Mus musculus
tgatctccttgatgctctttcttaa

SEQ ID NO: 858253 - DNA, 25 bp, Mus musculus
tgatctcgagtaagggctcccctca

SEQ ID NO: 858254 - DNA, 25 bp, Mus musculus
tgatctcgagtatgggctcccctca

SEQ ID NO: 858255 - DNA, 25 bp, Mus musculus
tgatctcgctggcaactgagtccag

SEQ ID NO: 858256 - DNA, 25 bp, Mus musculus
tgatctcgctgggaactgagtccag

SEQ ID NO: 858257 - DNA, 25 bp, Mus musculus
tgatctcgggagaaggatcctttcc

SEQ ID NO: 858258 - DNA, 25 bp, Mus musculus
tgatctcgggagtaggatcctttcc

SEQ ID NO: 858259 - DNA, 25 bp, Mus musculus
tgatctctacagaattgtgctgagt

SEQ ID NO: 858260 - DNA, 25 bp, Mus musculus
tgatctctacagtattgtgctgagt

SEQ ID NO: 858261 - DNA, 25 bp, Mus musculus
tgatctctacttaggagtcctctag

SEQ ID NO: 858262 - DNA, 25 bp, Mus musculus
tgatctctactttggagtcctctag

SEQ ID NO: 858263 - DNA, 25 bp, Mus musculus
tgatctctagggatggtaggtgaac

SEQ ID NO: 858264 - DNA, 25 bp, Mus musculus
tgatctctagggttggtaggtgaac

SEQ ID NO: 858265 - DNA, 25 bp, Mus musculus
tgatctctatacctacttcaccatg

SEQ ID NO: 858266 - DNA, 25 bp, Mus musculus
tgatctctatacgtacttcaccatg

SEQ ID NO: 858267 - DNA, 25 bp, Mus musculus
tgatctctcaaaccatttcacctac

SEQ ID NO: 858268 - DNA, 25 bp, Mus musculus
tgatctctcaaagcatttcacctac

SEQ ID NO: 858269 - DNA, 25 bp, Mus musculus
tgatctctcaatactgtttgcaaag

SEQ ID NO: 858270 - DNA, 25 bp, Mus musculus
tgatctctcaattctgtttgcaaag

SEQ ID NO: 858271 - DNA, 25 bp, Mus musculus
tgatctctccgcagtggtcatgcat

SEQ ID NO: 858272 - DNA, 25 bp, Mus musculus
tgatctctccgctgtggtcatgcat

SEQ ID NO: 858273 - DNA, 25 bp, Mus musculus
tgatctctcgagcatcagcaagtct

SEQ ID NO: 858274 - DNA, 25 bp, Mus musculus
tgatctctcgaggatcagcaagtct

SEQ ID NO: 858275 - DNA, 25 bp, Mus musculus
tgatctctctaacgcttttaacatg

SEQ ID NO: 858276 - DNA, 25 bp, Mus musculus
tgatctctctaaggcttttaacatg

SEQ ID NO: 858277 - DNA, 25 bp, Mus musculus
tgatctctctcaactgaggctctta

SEQ ID NO: 858278 - DNA, 25 bp, Mus musculus
tgatctctctcaatcaacttttctt

SEQ ID NO: 858279 - DNA, 25 bp, Mus musculus
tgatctctctcatctgaggctctta

SEQ ID NO: 858280 - DNA, 25 bp, Mus musculus
tgatctctctcattcaacttttctt

SEQ ID NO: 858281 - DNA, 25 bp, Mus musculus
tgatctctgaaccaatccctttctt

SEQ ID NO: 858282 - DNA, 25 bp, Mus musculus
tgatctctgaacgaatccctttctt

SEQ ID NO: 858283 - DNA, 25 bp, Mus musculus
tgatctctgcaccaagggctttcca

SEQ ID NO: 858284 - DNA, 25 bp, Mus musculus
tgatctctgcacgaagggctttcca

SEQ ID NO: 858285 - DNA, 25 bp, Mus musculus
tgatctctgcggattgcttttgtac

SEQ ID NO: 858286 - DNA, 25 bp, Mus musculus
tgatctctgcggtttgcttttgtac

SEQ ID NO: 858287 - DNA, 25 bp, Mus musculus
tgatctctgcttatgatactccact

SEQ ID NO: 858288 - DNA, 25 bp, Mus musculus
tgatctctgcttttgatactccact

SEQ ID NO: 858289 - DNA, 25 bp, Mus musculus
tgatctctggatctactcaagtgca

SEQ ID NO: 858290 - DNA, 25 bp, Mus musculus
tgatctctggatgtactcaagtgca

SEQ ID NO: 858291 - DNA, 25 bp, Mus musculus
tgatctctgggaagaccttgcctgc

SEQ ID NO: 858292 - DNA, 25 bp, Mus musculus
tgatctctgggatgaccttgcctgc

SEQ ID NO: 858293 - DNA, 25 bp, Mus musculus
tgatctctggttcctttcaagcctt

SEQ ID NO: 858294 - DNA, 25 bp, Mus musculus
tgatctctggttgctttcaagcctt

SEQ ID NO: 858295 - DNA, 25 bp, Mus musculus
tgatctctgtggctgagaggcccct

SEQ ID NO: 858296 - DNA, 25 bp, Mus musculus
tgatctctgtgggtgagaggcccct

SEQ ID NO: 858297 - DNA, 25 bp, Mus musculus
tgatctctgttccacgcatgacatt

SEQ ID NO: 858298 - DNA, 25 bp, Mus musculus
tgatctctgttccttacccatgaca

SEQ ID NO: 858299 - DNA, 25 bp, Mus musculus
tgatctctgttcgacgcatgacatt

SEQ ID NO: 858300 - DNA, 25 bp, Mus musculus
tgatctctgttcgttacccatgaca

SEQ ID NO: 858301 - DNA, 25 bp, Mus musculus
tgatctcttactcactccgttcttt

SEQ ID NO: 858302 - DNA, 25 bp, Mus musculus
tgatctcttactgactccgttcttt

SEQ ID NO: 858303 - DNA, 25 bp, Mus musculus
tgatctcttatcaggcaaggaagga

SEQ ID NO: 858304 - DNA, 25 bp, Mus musculus
tgatctcttatctggcaaggaagga

SEQ ID NO: 858305 - DNA, 25 bp, Mus musculus
tgatctcttcagcacttgcactggg

SEQ ID NO: 858306 - DNA, 25 bp, Mus musculus
tgatctcttcaggacttgcactggg

SEQ ID NO: 858307 - DNA, 25 bp, Mus musculus
tgatctcttccactactggtcatgc

SEQ ID NO: 858308 - DNA, 25 bp, Mus musculus
tgatctcttccagtactggtcatgc

SEQ ID NO: 858309 - DNA, 25 bp, Mus musculus
tgatctcttgctaatcagggaccaa

SEQ ID NO: 858310 - DNA, 25 bp, Mus musculus
tgatctcttgcttatcagggaccaa

SEQ ID NO: 858311 - DNA, 25 bp, Mus musculus
tgatctcttttacccttaacaactt

SEQ ID NO: 858312 - DNA, 25 bp, Mus musculus
tgatctcttttagccttaacaactt

SEQ ID NO: 858313 - DNA, 25 bp, Mus musculus
tgatctgaaagcctcattcacccag

SEQ ID NO: 858314 - DNA, 25 bp, Mus musculus
tgatctgaaagcgtcattcacccag

SEQ ID NO: 858315 - DNA, 25 bp, Mus musculus
tgatctgaacgtacgctgcgagtcc

SEQ ID NO: 858316 - DNA, 25 bp, Mus musculus
tgatctgaacgttcgctgcgagtcc

SEQ ID NO: 858317 - DNA, 25 bp, Mus musculus
tgatctgagacaaggaaagttccaa

SEQ ID NO: 858318 - DNA, 25 bp, Mus musculus
tgatctgagacatggaaagttccaa

SEQ ID NO: 858319 - DNA, 25 bp, Mus musculus
tgatctgagatcctcttttgctgtc

SEQ ID NO: 858320 - DNA, 25 bp, Mus musculus
tgatctgagatcgtcttttgctgtc

SEQ ID NO: 858321 - DNA, 25 bp, Mus musculus
tgatctgagcatccctgccttggga

SEQ ID NO: 858322 - DNA, 25 bp, Mus musculus
tgatctgagcatgcctgccttggga

SEQ ID NO: 858323 - DNA, 25 bp, Mus musculus
tgatctgagccgatctgcgtgtagc

SEQ ID NO: 858324 - DNA, 25 bp, Mus musculus
tgatctgagccgttctgcgtgtagc

SEQ ID NO: 858325 - DNA, 25 bp, Mus musculus
tgatctgatggacacaaagctgaag

SEQ ID NO: 858326 - DNA, 25 bp, Mus musculus
tgatctgatggagacaaagctgaag

SEQ ID NO: 858327 - DNA, 25 bp, Mus musculus
tgatctgcaaggatagcatcagtct

SEQ ID NO: 858328 - DNA, 25 bp, Mus musculus
tgatctgcaaggttagcatcagtct

SEQ ID NO: 858329 - DNA, 25 bp, Mus musculus
tgatctgcacaccattaccacaagc

SEQ ID NO: 858330 - DNA, 25 bp, Mus musculus
tgatctgcacacgattaccacaagc

SEQ ID NO: 858331 - DNA, 25 bp, Mus musculus
tgatctgcacagaccaaccatcgtg

SEQ ID NO: 858332 - DNA, 25 bp, Mus musculus
tgatctgcacagtccaaccatcgtg

SEQ ID NO: 858333 - DNA, 25 bp, Mus musculus
tgatctgcagctcagctccgtggag

SEQ ID NO: 858334 - DNA, 25 bp, Mus musculus
tgatctgcagctgagctccgtggag

SEQ ID NO: 858335 - DNA, 25 bp, Mus musculus
tgatctgcaggcagctcatgctagc

SEQ ID NO: 858336 - DNA, 25 bp, Mus musculus
tgatctgcaggctgctcatgctagc

SEQ ID NO: 858337 - DNA, 25 bp, Mus musculus
tgatctgcatgtcacaatgtgtgct

SEQ ID NO: 858338 - DNA, 25 bp, Mus musculus
tgatctgcatgtgacaatgtgtgct

SEQ ID NO: 858339 - DNA, 25 bp, Mus musculus
tgatctgcccagaccattgaaaagt

SEQ ID NO: 858340 - DNA, 25 bp, Mus musculus
tgatctgcccagtccattgaaaagt

SEQ ID NO: 858341 - DNA, 25 bp, Mus musculus
tgatctgcccgtatgggctttttaa

SEQ ID NO: 858342 - DNA, 25 bp, Mus musculus
tgatctgcccgtttgggctttttaa

SEQ ID NO: 858343 - DNA, 25 bp, Mus musculus
tgatctgccgtcctcatggcagaga

SEQ ID NO: 858344 - DNA, 25 bp, Mus musculus
tgatctgccgtcgtcatggcagaga

SEQ ID NO: 858345 - DNA, 25 bp, Mus musculus
tgatctgccttcattacttgacact

SEQ ID NO: 858346 - DNA, 25 bp, Mus musculus
tgatctgccttctttacttgacact

SEQ ID NO: 858347 - DNA, 25 bp, Mus musculus
tgatctgcgccgagatgatgctgct

SEQ ID NO: 858348 - DNA, 25 bp, Mus musculus
tgatctgcgccgtgatgatgctgct

SEQ ID NO: 858349 - DNA, 25 bp, Mus musculus
tgatctgctaaaaactgcctgctcc

SEQ ID NO: 858350 - DNA, 25 bp, Mus musculus
tgatctgctaaatactgcctgctcc

SEQ ID NO: 858351 - DNA, 25 bp, Mus musculus
tgatctgctctccaaacgtttttac

SEQ ID NO: 858352 - DNA, 25 bp, Mus musculus
tgatctgctctcgaaacgtttttac

SEQ ID NO: 858353 - DNA, 25 bp, Mus musculus
tgatctgctgcaagtactacaaacc

SEQ ID NO: 858354 - DNA, 25 bp, Mus musculus
tgatctgctgcatgtactacaaacc

SEQ ID NO: 858355 - DNA, 25 bp, Mus musculus
tgatctgctgccagcaaacagtcat

SEQ ID NO: 858356 - DNA, 25 bp, Mus musculus
tgatctgctgcctgcaaacagtcat

SEQ ID NO: 858357 - DNA, 25 bp, Mus musculus
tgatctgcttccatcatgtctcaca

SEQ ID NO: 858358 - DNA, 25 bp, Mus musculus
tgatctgcttccttcatgtctcaca

SEQ ID NO: 858359 - DNA, 25 bp, Mus musculus
tgatctggaatgacgcatggcttca

SEQ ID NO: 858360 - DNA, 25 bp, Mus musculus
tgatctggaatgtcgcatggcttca

SEQ ID NO: 858361 - DNA, 25 bp, Mus musculus
tgatctggatgtcgacgatgctccg

SEQ ID NO: 858362 - DNA, 25 bp, Mus musculus
tgatctggatgtggacgatgctccg

SEQ ID NO: 858363 - DNA, 25 bp, Mus musculus
tgatctggccccagttagcccatga

SEQ ID NO: 858364 - DNA, 25 bp, Mus musculus
tgatctggcccctgttagcccatga

SEQ ID NO: 858365 - DNA, 25 bp, Mus musculus
tgatctggctctcctacctaaaagt

SEQ ID NO: 858366 - DNA, 25 bp, Mus musculus
tgatctggctctgctacctaaaagt

SEQ ID NO: 858367 - DNA, 25 bp, Mus musculus
tgatctggtctgctcaaggcaaaca

SEQ ID NO: 858368 - DNA, 25 bp, Mus musculus
tgatctggtctggtcaaggcaaaca

SEQ ID NO: 858369 - DNA, 25 bp, Mus musculus
tgatctgtacataggtaactcccac

SEQ ID NO: 858370 - DNA, 25 bp, Mus musculus
tgatctgtacattggtaactcccac

SEQ ID NO: 858371 - DNA, 25 bp, Mus musculus
tgatctgtatcgacaaagaaggccc

SEQ ID NO: 858372 - DNA, 25 bp, Mus musculus
tgatctgtatcgtcaaagaaggccc

SEQ ID NO: 858373 - DNA, 25 bp, Mus musculus
tgatctgtattcatatttcctaaga

SEQ ID NO: 858374 - DNA, 25 bp, Mus musculus
tgatctgtattcttatttcctaaga

SEQ ID NO: 858375 - DNA, 25 bp, Mus musculus
tgatctgtcaccattttcaggcact

SEQ ID NO: 858376 - DNA, 25 bp, Mus musculus
tgatctgtcacctttttcaggcact

SEQ ID NO: 858377 - DNA, 25 bp, Mus musculus
tgatctgtcactagggagtttgccc

SEQ ID NO: 858378 - DNA, 25 bp, Mus musculus
tgatctgtcacttgggagtttgccc

SEQ ID NO: 858379 - DNA, 25 bp, Mus musculus
tgatctgtcagcagtgctctcttag

SEQ ID NO: 858380 - DNA, 25 bp, Mus musculus
tgatctgtcagctgtgctctcttag

SEQ ID NO: 858381 - DNA, 25 bp, Mus musculus
tgatctgtcattcggtgttgggaac

SEQ ID NO: 858382 - DNA, 25 bp, Mus musculus
tgatctgtcattgggtgttgggaac

SEQ ID NO: 858383 - DNA, 25 bp, Mus musculus
tgatctgtccagagttgtaccatga

SEQ ID NO: 858384 - DNA, 25 bp, Mus musculus
tgatctgtccagtgttgtaccatga

SEQ ID NO: 858385 - DNA, 25 bp, Mus musculus
tgatctgtccttcccattgtaagat

SEQ ID NO: 858386 - DNA, 25 bp, Mus musculus
tgatctgtccttgccattgtaagat

SEQ ID NO: 858387 - DNA, 25 bp, Mus musculus
tgatctgtcttcaaggactttctcc

SEQ ID NO: 858388 - DNA, 25 bp, Mus musculus
tgatctgtcttctaggactttctcc

SEQ ID NO: 858389 - DNA, 25 bp, Mus musculus
tgatctgtgatcaccaaggcgtttg

SEQ ID NO: 858390 - DNA, 25 bp, Mus musculus
tgatctgtgatctccaaggcgtttg

SEQ ID NO: 858391 - DNA, 25 bp, Mus musculus
tgatctgtgccacaatttccatgca

SEQ ID NO: 858392 - DNA, 25 bp, Mus musculus
tgatctgtgccagaatttccatgca

SEQ ID NO: 858393 - DNA, 25 bp, Mus musculus
tgatctgtggaaagcatttcactgg

SEQ ID NO: 858394 - DNA, 25 bp, Mus musculus
tgatctgtggaatgcatttcactgg

SEQ ID NO: 858395 - DNA, 25 bp, Mus musculus
tgatctgtgggcctgtaacgcgcca

SEQ ID NO: 858396 - DNA, 25 bp, Mus musculus
tgatctgtgggcgtgtaacgcgcca

SEQ ID NO: 858397 - DNA, 25 bp, Mus musculus
tgatctgtgtaccttccaagtgcta

SEQ ID NO: 858398 - DNA, 25 bp, Mus musculus
tgatctgtgtacgttccaagtgcta

SEQ ID NO: 858399 - DNA, 25 bp, Mus musculus
tgatctgtgtgtagcaaggacttgc

SEQ ID NO: 858400 - DNA, 25 bp, Mus musculus
tgatctgtgtgttgcaaggacttgc

SEQ ID NO: 858401 - DNA, 25 bp, Mus musculus
tgatctgttcataaggccggacacc

SEQ ID NO: 858402 - DNA, 25 bp, Mus musculus
tgatctgttcattaggccggacacc

SEQ ID NO: 858403 - DNA, 25 bp, Mus musculus
tgatctgttgatagtgggtcctgca

SEQ ID NO: 858404 - DNA, 25 bp, Mus musculus
tgatctgttgattgtgggtcctgca

SEQ ID NO: 858405 - DNA, 25 bp, Mus musculus
tgatctgtttatactctcctactgt

SEQ ID NO: 858406 - DNA, 25 bp, Mus musculus
tgatctgtttattctctcctactgt

SEQ ID NO: 858407 - DNA, 25 bp, Mus musculus
tgatcttaaatgacgctgctctcag

SEQ ID NO: 858408 - DNA, 25 bp, Mus musculus
tgatcttaaatgtcgctgctctcag

SEQ ID NO: 858409 - DNA, 25 bp, Mus musculus
tgatcttaagagcatcagcaagatg

SEQ ID NO: 858410 - DNA, 25 bp, Mus musculus
tgatcttaagaggatcagcaagatg

SEQ ID NO: 858411 - DNA, 25 bp, Mus musculus
tgatcttaccctcttcaacatacat

SEQ ID NO: 858412 - DNA, 25 bp, Mus musculus
tgatcttaccctgttcaacatacat

SEQ ID NO: 858413 - DNA, 25 bp, Mus musculus
tgatcttattctcctcatcactggg

SEQ ID NO: 858414 - DNA, 25 bp, Mus musculus
tgatcttattctgctcatcactggg

SEQ ID NO: 858415 - DNA, 25 bp, Mus musculus
tgatcttattgccaagttccttcca

SEQ ID NO: 858416 - DNA, 25 bp, Mus musculus
tgatcttattgcgaagttccttcca

SEQ ID NO: 858417 - DNA, 25 bp, Mus musculus
tgatcttcaagacgcttctgtggca

SEQ ID NO: 858418 - DNA, 25 bp, Mus musculus
tgatcttcaagaggcttctgtggca

SEQ ID NO: 858419 - DNA, 25 bp, Mus musculus
tgatcttccagcaaatttcacgcca

SEQ ID NO: 858420 - DNA, 25 bp, Mus musculus
tgatcttccagctaatttcacgcca

SEQ ID NO: 858421 - DNA, 25 bp, Mus musculus
tgatcttccagtcgcggcacacagg

SEQ ID NO: 858422 - DNA, 25 bp, Mus musculus
tgatcttccagtggcggcacacagg

SEQ ID NO: 858423 - DNA, 25 bp, Mus musculus
tgatcttcccttagaaataaaccta

SEQ ID NO: 858424 - DNA, 25 bp, Mus musculus
tgatcttccctttgaaataaaccta

SEQ ID NO: 858425 - DNA, 25 bp, Mus musculus
tgatcttccttacagcccaggctgt

SEQ ID NO: 858426 - DNA, 25 bp, Mus musculus
tgatcttccttagagcccaggctgt

SEQ ID NO: 858427 - DNA, 25 bp, Mus musculus
tgatcttccttcactaagttaaaga

SEQ ID NO: 858428 - DNA, 25 bp, Mus musculus
tgatcttccttctctaagttaaaga

SEQ ID NO: 858429 - DNA, 25 bp, Mus musculus
tgatcttcgaccagagcatcacgtt

SEQ ID NO: 858430 - DNA, 25 bp, Mus musculus
tgatcttcgacctgagcatcacgtt

SEQ ID NO: 858431 - DNA, 25 bp, Mus musculus
tgatcttcgaggacgctgacaacac

SEQ ID NO: 858432 - DNA, 25 bp, Mus musculus
tgatcttcgaggtcgctgacaacac

SEQ ID NO: 858433 - DNA, 25 bp, Mus musculus
tgatcttctaagacaaacccagctc

SEQ ID NO: 858434 - DNA, 25 bp, Mus musculus
tgatcttctaagctgtggcctcact

SEQ ID NO: 858435 - DNA, 25 bp, Mus musculus
tgatcttctaaggtgtggcctcact

SEQ ID NO: 858436 - DNA, 25 bp, Mus musculus
tgatcttctaagtcaaacccagctc

SEQ ID NO: 858437 - DNA, 25 bp, Mus musculus
tgatcttcttccaggctatctggtt

SEQ ID NO: 858438 - DNA, 25 bp, Mus musculus
tgatcttcttcctggctatctggtt

SEQ ID NO: 858439 - DNA, 25 bp, Mus musculus
tgatcttcttgtatggcacccaact

SEQ ID NO: 858440 - DNA, 25 bp, Mus musculus
tgatcttcttgtccaccaaatgcta

SEQ ID NO: 858441 - DNA, 25 bp, Mus musculus
tgatcttcttgtgcaccaaatgcta

SEQ ID NO: 858442 - DNA, 25 bp, Mus musculus
tgatcttcttgtttggcacccaact

SEQ ID NO: 858443 - DNA, 25 bp, Mus musculus
tgatcttctttgactcattctcaag

SEQ ID NO: 858444 - DNA, 25 bp, Mus musculus
tgatcttctttgtctcattctcaag

SEQ ID NO: 858445 - DNA, 25 bp, Mus musculus
tgatcttgaaagctgaattccttta

SEQ ID NO: 858446 - DNA, 25 bp, Mus musculus
tgatcttgaaaggtgaattccttta

SEQ ID NO: 858447 - DNA, 25 bp, Mus musculus
tgatcttgaagccatgccatgcagt

SEQ ID NO: 858448 - DNA, 25 bp, Mus musculus
tgatcttgaagcgatgccatgcagt

SEQ ID NO: 858449 - DNA, 25 bp, Mus musculus
tgatcttgagtgagcttatgcccca

SEQ ID NO: 858450 - DNA, 25 bp, Mus musculus
tgatcttgagtgtgcttatgcccca

SEQ ID NO: 858451 - DNA, 25 bp, Mus musculus
tgatcttgatcactaccgggactgg

SEQ ID NO: 858452 - DNA, 25 bp, Mus musculus
tgatcttgatcagtaccgggactgg

SEQ ID NO: 858453 - DNA, 25 bp, Mus musculus
tgatcttgccaccaaaattccctga

SEQ ID NO: 858454 - DNA, 25 bp, Mus musculus
tgatcttgccacgaaaattccctga

SEQ ID NO: 858455 - DNA, 25 bp, Mus musculus
tgatcttgccccaaactgtgaattg

SEQ ID NO: 858456 - DNA, 25 bp, Mus musculus
tgatcttgcccctaactgtgaattg

SEQ ID NO: 858457 - DNA, 25 bp, Mus musculus
tgatcttggacacaccacctcatgg

SEQ ID NO: 858458 - DNA, 25 bp, Mus musculus
tgatcttggacagaccacctcatgg

SEQ ID NO: 858459 - DNA, 25 bp, Mus musculus
tgatcttggtgacttccagtttgcc

SEQ ID NO: 858460 - DNA, 25 bp, Mus musculus
tgatcttggtgagttccagtttgcc

SEQ ID NO: 858461 - DNA, 25 bp, Mus musculus
tgatcttgtcttcaattctgcacct

SEQ ID NO: 858462 - DNA, 25 bp, Mus musculus
tgatcttgtcttgaattctgcacct

SEQ ID NO: 858463 - DNA, 25 bp, Mus musculus
tgatcttgtgaaacagctccacctg

SEQ ID NO: 858464 - DNA, 25 bp, Mus musculus
tgatcttgtgaatcagctccacctg

SEQ ID NO: 858465 - DNA, 25 bp, Mus musculus
tgatcttgttacacactgtggttca

SEQ ID NO: 858466 - DNA, 25 bp, Mus musculus
tgatcttgttactcactgtggttca

SEQ ID NO: 858467 - DNA, 25 bp, Mus musculus
tgatctttagtgaaggtccctggga

SEQ ID NO: 858468 - DNA, 25 bp, Mus musculus
tgatctttagtgtaggtccctggga

SEQ ID NO: 858469 - DNA, 25 bp, Mus musculus
tgatctttatcccacatgagctgca

SEQ ID NO: 858470 - DNA, 25 bp, Mus musculus
tgatctttatccgacatgagctgca

SEQ ID NO: 858471 - DNA, 25 bp, Mus musculus
tgatctttatggctggagcttatta

SEQ ID NO: 858472 - DNA, 25 bp, Mus musculus
tgatctttatgggtggagcttatta

SEQ ID NO: 858473 - DNA, 25 bp, Mus musculus
tgatctttcaggatctttccggcga

SEQ ID NO: 858474 - DNA, 25 bp, Mus musculus
tgatctttcaggttctttccggcga

SEQ ID NO: 858475 - DNA, 25 bp, Mus musculus
tgatctttccacattccgtggtttc

SEQ ID NO: 858476 - DNA, 25 bp, Mus musculus
tgatctttccactttccgtggtttc

SEQ ID NO: 858477 - DNA, 25 bp, Mus musculus
tgatctttcttaattacacctctaa

SEQ ID NO: 858478 - DNA, 25 bp, Mus musculus
tgatctttcttatttacacctctaa

SEQ ID NO: 858479 - DNA, 25 bp, Mus musculus
tgatctttgacaaatttgcacttga

SEQ ID NO: 858480 - DNA, 25 bp, Mus musculus
tgatctttgacatatttgcacttga

SEQ ID NO: 858481 - DNA, 25 bp, Mus musculus
tgatctttgagactgggcttccttt

SEQ ID NO: 858482 - DNA, 25 bp, Mus musculus
tgatctttgagagtgggcttccttt

SEQ ID NO: 858483 - DNA, 25 bp, Mus musculus
tgatctttgcacaccaacaacggaa

SEQ ID NO: 858484 - DNA, 25 bp, Mus musculus
tgatctttgcactccaacaacggaa

SEQ ID NO: 858485 - DNA, 25 bp, Mus musculus
tgatctttggctactggagaatgat

SEQ ID NO: 858486 - DNA, 25 bp, Mus musculus
tgatctttggcttctggagaatgat

SEQ ID NO: 858487 - DNA, 25 bp, Mus musculus
tgatctttgtaaccggtcaactccc

SEQ ID NO: 858488 - DNA, 25 bp, Mus musculus
tgatctttgtaagcggtcaactccc

SEQ ID NO: 858489 - DNA, 25 bp, Mus musculus
tgatctttgtttaccactccatttt

SEQ ID NO: 858490 - DNA, 25 bp, Mus musculus
tgatctttgttttccactccatttt

SEQ ID NO: 858491 - DNA, 25 bp, Mus musculus
tgatcttttcatcaaggcgcctttc

SEQ ID NO: 858492 - DNA, 25 bp, Mus musculus
tgatcttttcatgaaggcgcctttc

SEQ ID NO: 858493 - DNA, 25 bp, Mus musculus
tgatcttttccaccttcagagatgg

SEQ ID NO: 858494 - DNA, 25 bp, Mus musculus
tgatcttttccagcttcagagatgg

SEQ ID NO: 858495 - DNA, 25 bp, Mus musculus
tgatcttttgcgcttctacccgatg

SEQ ID NO: 858496 - DNA, 25 bp, Mus musculus
tgatcttttgcggttctacccgatg

SEQ ID NO: 858497 - DNA, 25 bp, Mus musculus
tgatcttttgttcacattttttcct

SEQ ID NO: 858498 - DNA, 25 bp, Mus musculus
tgatcttttgttgacattttttcct

SEQ ID NO: 858499 - DNA, 25 bp, Mus musculus
tgatgaaaaatgcttgagtgtcaca

SEQ ID NO: 858500 - DNA, 25 bp, Mus musculus
tgatgaaaaatggttgagtgtcaca

SEQ ID NO: 858501 - DNA, 25 bp, Mus musculus
tgatgaaaacctcgccaataataaa

SEQ ID NO: 858502 - DNA, 25 bp, Mus musculus
tgatgaaaacctggccaataataaa

SEQ ID NO: 858503 - DNA, 25 bp, Mus musculus
tgatgaaacaataggttcttcccag

SEQ ID NO: 858504 - DNA, 25 bp, Mus musculus
tgatgaaacaattggttcttcccag

SEQ ID NO: 858505 - DNA, 25 bp, Mus musculus
tgatgaaacagcaggccacaccagt

SEQ ID NO: 858506 - DNA, 25 bp, Mus musculus
tgatgaaacagctggccacaccagt

SEQ ID NO: 858507 - DNA, 25 bp, Mus musculus
tgatgaaaccctcttgctctgtcac

SEQ ID NO: 858508 - DNA, 25 bp, Mus musculus
tgatgaaaccctgttgctctgtcac

SEQ ID NO: 858509 - DNA, 25 bp, Mus musculus
tgatgaaagaaccaatgcccacgtg

SEQ ID NO: 858510 - DNA, 25 bp, Mus musculus
tgatgaaagaacgaatgcccacgtg

SEQ ID NO: 858511 - DNA, 25 bp, Mus musculus
tgatgaaaggttagccacgcggcgt

SEQ ID NO: 858512 - DNA, 25 bp, Mus musculus
tgatgaaaggtttgccacgcggcgt

SEQ ID NO: 858513 - DNA, 25 bp, Mus musculus
tgatgaaatcccattggaccggttt

SEQ ID NO: 858514 - DNA, 25 bp, Mus musculus
tgatgaaatccctttggaccggttt

SEQ ID NO: 858515 - DNA, 25 bp, Mus musculus
tgatgaaatctactgctctcctcag

SEQ ID NO: 858516 - DNA, 25 bp, Mus musculus
tgatgaaatctagtgctctcctcag

SEQ ID NO: 858517 - DNA, 25 bp, Mus musculus
tgatgaaatctcatgctgcacacct

SEQ ID NO: 858518 - DNA, 25 bp, Mus musculus
tgatgaaatctcttgctgcacacct

SEQ ID NO: 858519 - DNA, 25 bp, Mus musculus
tgatgaaatggtcttcttcccgtgt

SEQ ID NO: 858520 - DNA, 25 bp, Mus musculus
tgatgaaatggtgttcttcccgtgt

SEQ ID NO: 858521 - DNA, 25 bp, Mus musculus
tgatgaacaactacagaaaaatggc

SEQ ID NO: 858522 - DNA, 25 bp, Mus musculus
tgatgaacaacttcagaaaaatggc

SEQ ID NO: 858523 - DNA, 25 bp, Mus musculus
tgatgaacacgcattgttgctaaac

SEQ ID NO: 858524 - DNA, 25 bp, Mus musculus
tgatgaacacgctttgttgctaaac

SEQ ID NO: 858525 - DNA, 25 bp, Mus musculus
tgatgaacactgagaccacctgatt

SEQ ID NO: 858526 - DNA, 25 bp, Mus musculus
tgatgaacactgtgaccacctgatt

SEQ ID NO: 858527 - DNA, 25 bp, Mus musculus
tgatgaacagcaatctgggcatgca

SEQ ID NO: 858528 - DNA, 25 bp, Mus musculus
tgatgaacagcattctgggcatgca

SEQ ID NO: 858529 - DNA, 25 bp, Mus musculus
tgatgaacaggtcccacagcacagg

SEQ ID NO: 858530 - DNA, 25 bp, Mus musculus
tgatgaacaggtgccacagcacagg

SEQ ID NO: 858531 - DNA, 25 bp, Mus musculus
tgatgaaccagcaccgccgtgaact

SEQ ID NO: 858532 - DNA, 25 bp, Mus musculus
tgatgaaccagctccgccgtgaact

SEQ ID NO: 858533 - DNA, 25 bp, Mus musculus
tgatgaacccagatcccgggcctta

SEQ ID NO: 858534 - DNA, 25 bp, Mus musculus
tgatgaacccagttcccgggcctta

SEQ ID NO: 858535 - DNA, 25 bp, Mus musculus
tgatgaacgatgactctacccgcta

SEQ ID NO: 858536 - DNA, 25 bp, Mus musculus
tgatgaacgatgtctctacccgcta

SEQ ID NO: 858537 - DNA, 25 bp, Mus musculus
tgatgaactctacacccgattgttg

SEQ ID NO: 858538 - DNA, 25 bp, Mus musculus
tgatgaactctagacccgattgttg

SEQ ID NO: 858539 - DNA, 25 bp, Mus musculus
tgatgaacttcaaccttaaacctta

SEQ ID NO: 858540 - DNA, 25 bp, Mus musculus
tgatgaacttcatccttaaacctta

SEQ ID NO: 858541 - DNA, 25 bp, Mus musculus
tgatgaacttctcgtgactctcact

SEQ ID NO: 858542 - DNA, 25 bp, Mus musculus
tgatgaacttctggtgactctcact

SEQ ID NO: 858543 - DNA, 25 bp, Mus musculus
tgatgaagacctcgacagtagcagc

SEQ ID NO: 858544 - DNA, 25 bp, Mus musculus
tgatgaagacctggacagtagcagc

SEQ ID NO: 858545 - DNA, 25 bp, Mus musculus
tgatgaagagccactgcctagactt

SEQ ID NO: 858546 - DNA, 25 bp, Mus musculus
tgatgaagagcctctgcctagactt

SEQ ID NO: 858547 - DNA, 25 bp, Mus musculus
tgatgaagatctctcaggtcctgag

SEQ ID NO: 858548 - DNA, 25 bp, Mus musculus
tgatgaagatctgtcaggtcctgag

SEQ ID NO: 858549 - DNA, 25 bp, Mus musculus
tgatgaagcaatcgtctcctccttt

SEQ ID NO: 858550 - DNA, 25 bp, Mus musculus
tgatgaagcaatggtctcctccttt

SEQ ID NO: 858551 - DNA, 25 bp, Mus musculus
tgatgaagcctaagacctgctcgac

SEQ ID NO: 858552 - DNA, 25 bp, Mus musculus
tgatgaagcctatgacctgctcgac

SEQ ID NO: 858553 - DNA, 25 bp, Mus musculus
tgatgaagcttgcactctctcagct

SEQ ID NO: 858554 - DNA, 25 bp, Mus musculus
tgatgaagcttggactctctcagct

SEQ ID NO: 858555 - DNA, 25 bp, Mus musculus
tgatgaaggtaacttccctgcctac

SEQ ID NO: 858556 - DNA, 25 bp, Mus musculus
tgatgaaggtaagttccctgcctac

SEQ ID NO: 858557 - DNA, 25 bp, Mus musculus
tgatgaaggtcacgctcagctgaat

SEQ ID NO: 858558 - DNA, 25 bp, Mus musculus
tgatgaaggtcaggctcagctgaat

SEQ ID NO: 858559 - DNA, 25 bp, Mus musculus
tgatgaagtggtacggctgctaaac

SEQ ID NO: 858560 - DNA, 25 bp, Mus musculus
tgatgaagtggttcggctgctaaac

SEQ ID NO: 858561 - DNA, 25 bp, Mus musculus
tgatgaatctcacttgcatccagag

SEQ ID NO: 858562 - DNA, 25 bp, Mus musculus
tgatgaatctcagttgcatccagag

SEQ ID NO: 858563 - DNA, 25 bp, Mus musculus
tgatgaatggatatgcctctctgcc

SEQ ID NO: 858564 - DNA, 25 bp, Mus musculus
tgatgaatggatttgcctctctgcc

SEQ ID NO: 858565 - DNA, 25 bp, Mus musculus
tgatgaatgtgcagctgctcgcctg

SEQ ID NO: 858566 - DNA, 25 bp, Mus musculus
tgatgaatgtgctgctgctcgcctg

SEQ ID NO: 858567 - DNA, 25 bp, Mus musculus
tgatgaattctcaagacccaccatt

SEQ ID NO: 858568 - DNA, 25 bp, Mus musculus
tgatgaattctctagacccaccatt

SEQ ID NO: 858569 - DNA, 25 bp, Mus musculus
tgatgaattctgaccatctccctag

SEQ ID NO: 858570 - DNA, 25 bp, Mus musculus
tgatgaattctgacccttaactccc

SEQ ID NO: 858571 - DNA, 25 bp, Mus musculus
tgatgaattctgtccatctccctag

SEQ ID NO: 858572 - DNA, 25 bp, Mus musculus
tgatgaattctgtcccttaactccc

SEQ ID NO: 858573 - DNA, 25 bp, Mus musculus
tgatgacaacagagcccgagtcgtt

SEQ ID NO: 858574 - DNA, 25 bp, Mus musculus
tgatgacaacagtgcccgagtcgtt

SEQ ID NO: 858575 - DNA, 25 bp, Mus musculus
tgatgacaactacgtcaacctccgg

SEQ ID NO: 858576 - DNA, 25 bp, Mus musculus
tgatgacaactaggtcaacctccgg

SEQ ID NO: 858577 - DNA, 25 bp, Mus musculus
tgatgacacacccatccgatgggag

SEQ ID NO: 858578 - DNA, 25 bp, Mus musculus
tgatgacacaccgatccgatgggag

SEQ ID NO: 858579 - DNA, 25 bp, Mus musculus
tgatgacacccaatgctatttaatt

SEQ ID NO: 858580 - DNA, 25 bp, Mus musculus
tgatgacacccattgctatttaatt

SEQ ID NO: 858581 - DNA, 25 bp, Mus musculus
tgatgacacggtaccaccaggagaa

SEQ ID NO: 858582 - DNA, 25 bp, Mus musculus
tgatgacacggttccaccaggagaa

SEQ ID NO: 858583 - DNA, 25 bp, Mus musculus
tgatgacactggatctgctaatccc

SEQ ID NO: 858584 - DNA, 25 bp, Mus musculus
tgatgacactggttctgctaatccc

SEQ ID NO: 858585 - DNA, 25 bp, Mus musculus
tgatgacagaatatatttggttgcc

SEQ ID NO: 858586 - DNA, 25 bp, Mus musculus
tgatgacagaatttatttggttgcc

SEQ ID NO: 858587 - DNA, 25 bp, Mus musculus
tgatgacagagccaacttctaccca

SEQ ID NO: 858588 - DNA, 25 bp, Mus musculus
tgatgacagagcgaacttctaccca

SEQ ID NO: 858589 - DNA, 25 bp, Mus musculus
tgatgacagagtaggttctgggacc

SEQ ID NO: 858590 - DNA, 25 bp, Mus musculus
tgatgacagagttggttctgggacc

SEQ ID NO: 858591 - DNA, 25 bp, Mus musculus
tgatgacagccactctcttctatat

SEQ ID NO: 858592 - DNA, 25 bp, Mus musculus
tgatgacagccagtctcttctatat

SEQ ID NO: 858593 - DNA, 25 bp, Mus musculus
tgatgacagtacacgttcggccagc

SEQ ID NO: 858594 - DNA, 25 bp, Mus musculus
tgatgacagtactcgttcggccagc

SEQ ID NO: 858595 - DNA, 25 bp, Mus musculus
tgatgacagtctatgtgttattcca

SEQ ID NO: 858596 - DNA, 25 bp, Mus musculus
tgatgacagtctttgtgttattcca

SEQ ID NO: 858597 - DNA, 25 bp, Mus musculus
tgatgacagtttactcttccatccc

SEQ ID NO: 858598 - DNA, 25 bp, Mus musculus
tgatgacagttttctcttccatccc

SEQ ID NO: 858599 - DNA, 25 bp, Mus musculus
tgatgacatcatactccactcctgg

SEQ ID NO: 858600 - DNA, 25 bp, Mus musculus
tgatgacatcattctccactcctgg

SEQ ID NO: 858601 - DNA, 25 bp, Mus musculus
tgatgacatcgtcggtttctccggg

SEQ ID NO: 858602 - DNA, 25 bp, Mus musculus
tgatgacatcgtgggtttctccggg

SEQ ID NO: 858603 - DNA, 25 bp, Mus musculus
tgatgacatgttactcccattaaga

SEQ ID NO: 858604 - DNA, 25 bp, Mus musculus
tgatgacatgtttctcccattaaga

SEQ ID NO: 858605 - DNA, 25 bp, Mus musculus
tgatgacattacaggagcacgtgca

SEQ ID NO: 858606 - DNA, 25 bp, Mus musculus
tgatgacattactggagcacgtgca

SEQ ID NO: 858607 - DNA, 25 bp, Mus musculus
tgatgacattgtctctggccacaag

SEQ ID NO: 858608 - DNA, 25 bp, Mus musculus
tgatgacattgtgtctggccacaag

SEQ ID NO: 858609 - DNA, 25 bp, Mus musculus
tgatgaccaaagaaagacaaacgct

SEQ ID NO: 858610 - DNA, 25 bp, Mus musculus
tgatgaccaaagtaagacaaacgct

SEQ ID NO: 858611 - DNA, 25 bp, Mus musculus
tgatgaccaacgagctgctggctgg

SEQ ID NO: 858612 - DNA, 25 bp, Mus musculus
tgatgaccaacgtgctgctggctgg

SEQ ID NO: 858613 - DNA, 25 bp, Mus musculus
tgatgaccaaggctcccgcacgttc

SEQ ID NO: 858614 - DNA, 25 bp, Mus musculus
tgatgaccaagggtcccgcacgttc

SEQ ID NO: 858615 - DNA, 25 bp, Mus musculus
tgatgaccaagtcccgtctggagca

SEQ ID NO: 858616 - DNA, 25 bp, Mus musculus
tgatgaccaagtgccgtctggagca

SEQ ID NO: 858617 - DNA, 25 bp, Mus musculus
tgatgaccacctagttcctagagat

SEQ ID NO: 858618 - DNA, 25 bp, Mus musculus
tgatgaccaccttgttcctagagat

SEQ ID NO: 858619 - DNA, 25 bp, Mus musculus
tgatgaccacgtcctctgacacggc

SEQ ID NO: 858620 - DNA, 25 bp, Mus musculus
tgatgaccacgtgctctgacacggc

SEQ ID NO: 858621 - DNA, 25 bp, Mus musculus
tgatgaccagctcagccactttgtg

SEQ ID NO: 858622 - DNA, 25 bp, Mus musculus
tgatgaccagctgagccactttgtg

SEQ ID NO: 858623 - DNA, 25 bp, Mus musculus
tgatgaccagtaattccagagtaag

SEQ ID NO: 858624 - DNA, 25 bp, Mus musculus
tgatgaccagtatttccagagtaag

SEQ ID NO: 858625 - DNA, 25 bp, Mus musculus
tgatgacccacaatctctagcatga

SEQ ID NO: 858626 - DNA, 25 bp, Mus musculus
tgatgacccacattctctagcatga

SEQ ID NO: 858627 - DNA, 25 bp, Mus musculus
tgatgacccaggaaaaccacacttt

SEQ ID NO: 858628 - DNA, 25 bp, Mus musculus
tgatgacccaggtaaaccacacttt

SEQ ID NO: 858629 - DNA, 25 bp, Mus musculus
tgatgaccccgaatatgaccctggc

SEQ ID NO: 858630 - DNA, 25 bp, Mus musculus
tgatgaccccgaccaatttcctgat

SEQ ID NO: 858631 - DNA, 25 bp, Mus musculus
tgatgaccccgagcaatttcctgat

SEQ ID NO: 858632 - DNA, 25 bp, Mus musculus
tgatgaccccgattatgaccctggc

SEQ ID NO: 858633 - DNA, 25 bp, Mus musculus
tgatgacccgccagtcatactgcag

SEQ ID NO: 858634 - DNA, 25 bp, Mus musculus
tgatgacccgcctgtcatactgcag

SEQ ID NO: 858635 - DNA, 25 bp, Mus musculus
tgatgaccctccatcagcttacgat

SEQ ID NO: 858636 - DNA, 25 bp, Mus musculus
tgatgaccctccttcagcttacgat

SEQ ID NO: 858637 - DNA, 25 bp, Mus musculus
tgatgaccgcatcaatgagcctccc

SEQ ID NO: 858638 - DNA, 25 bp, Mus musculus
tgatgaccgcatgaatgagcctccc

SEQ ID NO: 858639 - DNA, 25 bp, Mus musculus
tgatgaccgtggagttctgggcctc

SEQ ID NO: 858640 - DNA, 25 bp, Mus musculus
tgatgaccgtggtgttctgggcctc

SEQ ID NO: 858641 - DNA, 25 bp, Mus musculus
tgatgacctaagacaggacccaatt

SEQ ID NO: 858642 - DNA, 25 bp, Mus musculus
tgatgacctaagagcggtcccatgt

SEQ ID NO: 858643 - DNA, 25 bp, Mus musculus
tgatgacctaagtcaggacccaatt

SEQ ID NO: 858644 - DNA, 25 bp, Mus musculus
tgatgacctaagtgcggtcccatgt

SEQ ID NO: 858645 - DNA, 25 bp, Mus musculus
tgatgacctcatacactaggcgatt

SEQ ID NO: 858646 - DNA, 25 bp, Mus musculus
tgatgacctcatcttctagcctaaa

SEQ ID NO: 858647 - DNA, 25 bp, Mus musculus
tgatgacctcatgttctagcctaaa

SEQ ID NO: 858648 - DNA, 25 bp, Mus musculus
tgatgacctcattcactaggcgatt

SEQ ID NO: 858649 - DNA, 25 bp, Mus musculus
tgatgacctcgtatctcattgcttc

SEQ ID NO: 858650 - DNA, 25 bp, Mus musculus
tgatgacctcgtttctcattgcttc

SEQ ID NO: 858651 - DNA, 25 bp, Mus musculus
tgatgacctgacccctggctggcag

SEQ ID NO: 858652 - DNA, 25 bp, Mus musculus
tgatgacctgacgcctggctggcag

SEQ ID NO: 858653 - DNA, 25 bp, Mus musculus
tgatgacctgcactgaaaggcaagg

SEQ ID NO: 858654 - DNA, 25 bp, Mus musculus
tgatgacctgcagtgaaaggcaagg

SEQ ID NO: 858655 - DNA, 25 bp, Mus musculus
tgatgacctggaagacgagctctat

SEQ ID NO: 858656 - DNA, 25 bp, Mus musculus
tgatgacctggaccctaatagcctg

SEQ ID NO: 858657 - DNA, 25 bp, Mus musculus
tgatgacctggagcctaatagcctg

SEQ ID NO: 858658 - DNA, 25 bp, Mus musculus
tgatgacctggatgacgagctctat

SEQ ID NO: 858659 - DNA, 25 bp, Mus musculus
tgatgaccttcaccgtgcgacacag

SEQ ID NO: 858660 - DNA, 25 bp, Mus musculus
tgatgaccttcagcgtgcgacacag

SEQ ID NO: 858661 - DNA, 25 bp, Mus musculus
tgatgacgacgaaactgggaaaatt

SEQ ID NO: 858662 - DNA, 25 bp, Mus musculus
tgatgacgacgatactgggaaaatt

SEQ ID NO: 858663 - DNA, 25 bp, Mus musculus
tgatgacgaggaatcggaagcccag

SEQ ID NO: 858664 - DNA, 25 bp, Mus musculus
tgatgacgaggattcggaagcccag

SEQ ID NO: 858665 - DNA, 25 bp, Mus musculus
tgatgacgcttcactgtggatctga

SEQ ID NO: 858666 - DNA, 25 bp, Mus musculus
tgatgacgcttctctgtggatctga

SEQ ID NO: 858667 - DNA, 25 bp, Mus musculus
tgatgacgtaaccagttgacccttc

SEQ ID NO: 858668 - DNA, 25 bp, Mus musculus
tgatgacgtaacgagttgacccttc

SEQ ID NO: 858669 - DNA, 25 bp, Mus musculus
tgatgacgtcatcctcctggacacc

SEQ ID NO: 858670 - DNA, 25 bp, Mus musculus
tgatgacgtcatgctcctggacacc

SEQ ID NO: 858671 - DNA, 25 bp, Mus musculus
tgatgactaattacacttcagatat

SEQ ID NO: 858672 - DNA, 25 bp, Mus musculus
tgatgactaatttcacttcagatat

SEQ ID NO: 858673 - DNA, 25 bp, Mus musculus
tgatgactacctaggtcccaggagc

SEQ ID NO: 858674 - DNA, 25 bp, Mus musculus
tgatgactaccttggtcccaggagc

SEQ ID NO: 858675 - DNA, 25 bp, Mus musculus
tgatgactagtactcccattccctg

SEQ ID NO: 858676 - DNA, 25 bp, Mus musculus
tgatgactagtagtcccattccctg

SEQ ID NO: 858677 - DNA, 25 bp, Mus musculus
tgatgactcacactgaggaggcctg

SEQ ID NO: 858678 - DNA, 25 bp, Mus musculus
tgatgactcacagtgaggaggcctg

SEQ ID NO: 858679 - DNA, 25 bp, Mus musculus
tgatgactccacactcagtgaaagt

SEQ ID NO: 858680 - DNA, 25 bp, Mus musculus
tgatgactccacactgctttttaga

SEQ ID NO: 858681 - DNA, 25 bp, Mus musculus
tgatgactccactctcagtgaaagt

SEQ ID NO: 858682 - DNA, 25 bp, Mus musculus
tgatgactccactctgctttttaga

SEQ ID NO: 858683 - DNA, 25 bp, Mus musculus
tgatgactctttccttctgaacttc

SEQ ID NO: 858684 - DNA, 25 bp, Mus musculus
tgatgactctttgcttctgaacttc

SEQ ID NO: 858685 - DNA, 25 bp, Mus musculus
tgatgactgcacactggcggtttag

SEQ ID NO: 858686 - DNA, 25 bp, Mus musculus
tgatgactgcactctggcggtttag

SEQ ID NO: 858687 - DNA, 25 bp, Mus musculus
tgatgactgcatagagagacactcg

SEQ ID NO: 858688 - DNA, 25 bp, Mus musculus
tgatgactgcattgagagacactcg

SEQ ID NO: 858689 - DNA, 25 bp, Mus musculus
tgatgactgggacagcgggctgaat

SEQ ID NO: 858690 - DNA, 25 bp, Mus musculus
tgatgactgggagagcgggctgaat

SEQ ID NO: 858691 - DNA, 25 bp, Mus musculus
tgatgactgtcaaggagtatcctta

SEQ ID NO: 858692 - DNA, 25 bp, Mus musculus
tgatgactgtcatggagtatcctta

SEQ ID NO: 858693 - DNA, 25 bp, Mus musculus
tgatgactgtcgagtggtttccacc

SEQ ID NO: 858694 - DNA, 25 bp, Mus musculus
tgatgactgtcgtgtggtttccacc

SEQ ID NO: 858695 - DNA, 25 bp, Mus musculus
tgatgactgttcagtgaagacgtaa

SEQ ID NO: 858696 - DNA, 25 bp, Mus musculus
tgatgactgttctgtgaagacgtaa

SEQ ID NO: 858697 - DNA, 25 bp, Mus musculus
tgatgacttcaacaagccatacccc

SEQ ID NO: 858698 - DNA, 25 bp, Mus musculus
tgatgacttcaagaagccatacccc

SEQ ID NO: 858699 - DNA, 25 bp, Mus musculus
tgatgactttatatggtgaacctga

SEQ ID NO: 858700 - DNA, 25 bp, Mus musculus
tgatgactttatttggtgaacctga

SEQ ID NO: 858701 - DNA, 25 bp, Mus musculus
tgatgactttgcctcagcctcttag

SEQ ID NO: 858702 - DNA, 25 bp, Mus musculus
tgatgactttgcgtcagcctcttag

SEQ ID NO: 858703 - DNA, 25 bp, Mus musculus
tgatgacttttgagcagtttgctaa

SEQ ID NO: 858704 - DNA, 25 bp, Mus musculus
tgatgacttttgtgcagtttgctaa

SEQ ID NO: 858705 - DNA, 25 bp, Mus musculus
tgatgagaaccacaaccaccacctg

SEQ ID NO: 858706 - DNA, 25 bp, Mus musculus
tgatgagaaccagaaccaccacctg

SEQ ID NO: 858707 - DNA, 25 bp, Mus musculus
tgatgagaagaaccgtgcctcccag

SEQ ID NO: 858708 - DNA, 25 bp, Mus musculus
tgatgagaagaagcgtgcctcccag

SEQ ID NO: 858709 - DNA, 25 bp, Mus musculus
tgatgagaatctccccaccaggtta

SEQ ID NO: 858710 - DNA, 25 bp, Mus musculus
tgatgagaatctgcccaccaggtta

SEQ ID NO: 858711 - DNA, 25 bp, Mus musculus
tgatgagacctcaaatccgccttcc

SEQ ID NO: 858712 - DNA, 25 bp, Mus musculus
tgatgagacctctaatccgccttcc

SEQ ID NO: 858713 - DNA, 25 bp, Mus musculus
tgatgagaccttccggctgctgtgc

SEQ ID NO: 858714 - DNA, 25 bp, Mus musculus
tgatgagaccttgcggctgctgtgc

SEQ ID NO: 858715 - DNA, 25 bp, Mus musculus
tgatgagactgtcatctggactgtg

SEQ ID NO: 858716 - DNA, 25 bp, Mus musculus
tgatgagactgtgatctggactgtg

SEQ ID NO: 858717 - DNA, 25 bp, Mus musculus
tgatgagagagaatcccagttcccc

SEQ ID NO: 858718 - DNA, 25 bp, Mus musculus
tgatgagagagattcccagttcccc

SEQ ID NO: 858719 - DNA, 25 bp, Mus musculus
tgatgagagcatcgtacccttgcat

SEQ ID NO: 858720 - DNA, 25 bp, Mus musculus
tgatgagagcatggtacccttgcat

SEQ ID NO: 858721 - DNA, 25 bp, Mus musculus
tgatgagagtgtcctctggcagctc

SEQ ID NO: 858722 - DNA, 25 bp, Mus musculus
tgatgagagtgtgctctggcagctc

SEQ ID NO: 858723 - DNA, 25 bp, Mus musculus
tgatgagatcgcagggacagaaccc

SEQ ID NO: 858724 - DNA, 25 bp, Mus musculus
tgatgagatcgctgggacagaaccc

SEQ ID NO: 858725 - DNA, 25 bp, Mus musculus
tgatgagatgcacccgacagccgag

SEQ ID NO: 858726 - DNA, 25 bp, Mus musculus
tgatgagatgcagccgacagccgag

SEQ ID NO: 858727 - DNA, 25 bp, Mus musculus
tgatgagcacggctttgacaactgt

SEQ ID NO: 858728 - DNA, 25 bp, Mus musculus
tgatgagcacgggtttgacaactgt

SEQ ID NO: 858729 - DNA, 25 bp, Mus musculus
tgatgagcagctacggcgatgtctc

SEQ ID NO: 858730 - DNA, 25 bp, Mus musculus
tgatgagcagcttcggcgatgtctc

SEQ ID NO: 858731 - DNA, 25 bp, Mus musculus
tgatgagcaggacactgcacctcac

SEQ ID NO: 858732 - DNA, 25 bp, Mus musculus
tgatgagcaggagactgcacctcac

SEQ ID NO: 858733 - DNA, 25 bp, Mus musculus
tgatgagcagtgctgaccctgcctg

SEQ ID NO: 858734 - DNA, 25 bp, Mus musculus
tgatgagcagtggtgaccctgcctg

SEQ ID NO: 858735 - DNA, 25 bp, Mus musculus
tgatgagccaatcacccccaaggat

SEQ ID NO: 858736 - DNA, 25 bp, Mus musculus
tgatgagccaatgacccccaaggat

SEQ ID NO: 858737 - DNA, 25 bp, Mus musculus
tgatgagccccgagggtctgcctgc

SEQ ID NO: 858738 - DNA, 25 bp, Mus musculus
tgatgagccccgtgggtctgcctgc

SEQ ID NO: 858739 - DNA, 25 bp, Mus musculus
tgatgagccgtccatggctgacatg

SEQ ID NO: 858740 - DNA, 25 bp, Mus musculus
tgatgagccgtcgatggctgacatg

SEQ ID NO: 858741 - DNA, 25 bp, Mus musculus
tgatgagccttacggcccctttgta

SEQ ID NO: 858742 - DNA, 25 bp, Mus musculus
tgatgagccttagggcccctttgta

SEQ ID NO: 858743 - DNA, 25 bp, Mus musculus
tgatgagctatactgccaaatttgc

SEQ ID NO: 858744 - DNA, 25 bp, Mus musculus
tgatgagctatagtgccaaatttgc

SEQ ID NO: 858745 - DNA, 25 bp, Mus musculus
tgatgagctcatcactgtctacagc

SEQ ID NO: 858746 - DNA, 25 bp, Mus musculus
tgatgagctcatgactgtctacagc

SEQ ID NO: 858747 - DNA, 25 bp, Mus musculus
tgatgagctctaacactttgtgaag

SEQ ID NO: 858748 - DNA, 25 bp, Mus musculus
tgatgagctctatcactttgtgaag

SEQ ID NO: 858749 - DNA, 25 bp, Mus musculus
tgatgagctctgaacaaaccctgta

SEQ ID NO: 858750 - DNA, 25 bp, Mus musculus
tgatgagctctgtacaaaccctgta

SEQ ID NO: 858751 - DNA, 25 bp, Mus musculus
tgatgagcttccacacaggtcagct

SEQ ID NO: 858752 - DNA, 25 bp, Mus musculus
tgatgagcttcctcacaggtcagct

SEQ ID NO: 858753 - DNA, 25 bp, Mus musculus
tgatgaggaactaggccctgcctga

SEQ ID NO: 858754 - DNA, 25 bp, Mus musculus
tgatgaggaacttggccctgcctga

SEQ ID NO: 858755 - DNA, 25 bp, Mus musculus
tgatgaggaaggcactctgctcctt

SEQ ID NO: 858756 - DNA, 25 bp, Mus musculus
tgatgaggaagggactctgctcctt

SEQ ID NO: 858757 - DNA, 25 bp, Mus musculus
tgatgaggaccaactgccgcttcga

SEQ ID NO: 858758 - DNA, 25 bp, Mus musculus
tgatgaggaccatctgccgcttcga

SEQ ID NO: 858759 - DNA, 25 bp, Mus musculus
tgatgaggacccagctgagcctgaa

SEQ ID NO: 858760 - DNA, 25 bp, Mus musculus
tgatgaggaccctgctgagcctgaa

SEQ ID NO: 858761 - DNA, 25 bp, Mus musculus
tgatgaggagctccgaccattgcca

SEQ ID NO: 858762 - DNA, 25 bp, Mus musculus
tgatgaggagctgcgaccattgcca

SEQ ID NO: 858763 - DNA, 25 bp, Mus musculus
tgatgaggcgccagcctccacagca

SEQ ID NO: 858764 - DNA, 25 bp, Mus musculus
tgatgaggcgccattccaggagaaa

SEQ ID NO: 858765 - DNA, 25 bp, Mus musculus
tgatgaggcgcctgcctccacagca

SEQ ID NO: 858766 - DNA, 25 bp, Mus musculus
tgatgaggcgcctttccaggagaaa

SEQ ID NO: 858767 - DNA, 25 bp, Mus musculus
tgatgagggtagctaggcgtcggcc

SEQ ID NO: 858768 - DNA, 25 bp, Mus musculus
tgatgagggtaggtaggcgtcggcc

SEQ ID NO: 858769 - DNA, 25 bp, Mus musculus
tgatgaggtacaacctgcagtgcct

SEQ ID NO: 858770 - DNA, 25 bp, Mus musculus
tgatgaggtacatcctgcagtgcct

SEQ ID NO: 858771 - DNA, 25 bp, Mus musculus
tgatgaggtcgtaccaatgaagtca

SEQ ID NO: 858772 - DNA, 25 bp, Mus musculus
tgatgaggtcgttccaatgaagtca

SEQ ID NO: 858773 - DNA, 25 bp, Mus musculus
tgatgaggtgggagatcttccctcc

SEQ ID NO: 858774 - DNA, 25 bp, Mus musculus
tgatgaggtgggtgatcttccctcc

SEQ ID NO: 858775 - DNA, 25 bp, Mus musculus
tgatgaggtttcagcgcctccgtcc

SEQ ID NO: 858776 - DNA, 25 bp, Mus musculus
tgatgaggtttctgcgcctccgtcc

SEQ ID NO: 858777 - DNA, 25 bp, Mus musculus
tgatgagtaaccaccagggagaagt

SEQ ID NO: 858778 - DNA, 25 bp, Mus musculus
tgatgagtaacctccagggagaagt

SEQ ID NO: 858779 - DNA, 25 bp, Mus musculus
tgatgagtagcaagcacctgccgcc

SEQ ID NO: 858780 - DNA, 25 bp, Mus musculus
tgatgagtagcatgcacctgccgcc

SEQ ID NO: 858781 - DNA, 25 bp, Mus musculus
tgatgagtagctctccttgtaacca

SEQ ID NO: 858782 - DNA, 25 bp, Mus musculus
tgatgagtagctgtccttgtaacca

SEQ ID NO: 858783 - DNA, 25 bp, Mus musculus
tgatgagtcaccatcattcttggtg

SEQ ID NO: 858784 - DNA, 25 bp, Mus musculus
tgatgagtcaccttcattcttggtg

SEQ ID NO: 858785 - DNA, 25 bp, Mus musculus
tgatgagtcgctattcacctgagca

SEQ ID NO: 858786 - DNA, 25 bp, Mus musculus
tgatgagtcgcttttcacctgagca

SEQ ID NO: 858787 - DNA, 25 bp, Mus musculus
tgatgagtgattagcaactgcctgt

SEQ ID NO: 858788 - DNA, 25 bp, Mus musculus
tgatgagtgatttgcaactgcctgt

SEQ ID NO: 858789 - DNA, 25 bp, Mus musculus
tgatgagtgttcaatcacccacaat

SEQ ID NO: 858790 - DNA, 25 bp, Mus musculus
tgatgagtgttctatcacccacaat

SEQ ID NO: 858791 - DNA, 25 bp, Mus musculus
tgatgagttagaaggtccagcccct

SEQ ID NO: 858792 - DNA, 25 bp, Mus musculus
tgatgagttagatggtccagcccct

SEQ ID NO: 858793 - DNA, 25 bp, Mus musculus
tgatgagttccacttattgcagaga

SEQ ID NO: 858794 - DNA, 25 bp, Mus musculus
tgatgagttccagttattgcagaga

SEQ ID NO: 858795 - DNA, 25 bp, Mus musculus
tgatgagttcctcacaagatgcctg

SEQ ID NO: 858796 - DNA, 25 bp, Mus musculus
tgatgagttcctgacaagatgcctg

SEQ ID NO: 858797 - DNA, 25 bp, Mus musculus
tgatgagtttccaaccctgagcttt

SEQ ID NO: 858798 - DNA, 25 bp, Mus musculus
tgatgagtttcctaccctgagcttt

SEQ ID NO: 858799 - DNA, 25 bp, Mus musculus
tgatgataccaccccaaagcccatg

SEQ ID NO: 858800 - DNA, 25 bp, Mus musculus
tgatgataccacgccaaagcccatg

SEQ ID NO: 858801 - DNA, 25 bp, Mus musculus
tgatgatatactatacttctttgtg

SEQ ID NO: 858802 - DNA, 25 bp, Mus musculus
tgatgatatactttacttctttgtg

SEQ ID NO: 858803 - DNA, 25 bp, Mus musculus
tgatgatatgaacccaccctcttct

SEQ ID NO: 858804 - DNA, 25 bp, Mus musculus
tgatgatatgaagccaccctcttct

SEQ ID NO: 858805 - DNA, 25 bp, Mus musculus
tgatgatattttctgcttagcctgg

SEQ ID NO: 858806 - DNA, 25 bp, Mus musculus
tgatgatattttgtgcttagcctgg

SEQ ID NO: 858807 - DNA, 25 bp, Mus musculus
tgatgatcacacacactttccgttt

SEQ ID NO: 858808 - DNA, 25 bp, Mus musculus
tgatgatcacactcactttccgttt

SEQ ID NO: 858809 - DNA, 25 bp, Mus musculus
tgatgatccacactgttccagtgct

SEQ ID NO: 858810 - DNA, 25 bp, Mus musculus
tgatgatccacagtgttccagtgct

SEQ ID NO: 858811 - DNA, 25 bp, Mus musculus
tgatgatccatcaggctggccctaa

SEQ ID NO: 858812 - DNA, 25 bp, Mus musculus
tgatgatccatctggctggccctaa

SEQ ID NO: 858813 - DNA, 25 bp, Mus musculus
tgatgatccattccctttgggtgac

SEQ ID NO: 858814 - DNA, 25 bp, Mus musculus
tgatgatccattgcctttgggtgac

SEQ ID NO: 858815 - DNA, 25 bp, Mus musculus
tgatgatccccacctgtatttggct

SEQ ID NO: 858816 - DNA, 25 bp, Mus musculus
tgatgatccccagctgtatttggct

SEQ ID NO: 858817 - DNA, 25 bp, Mus musculus
tgatgatccctgagtactgctgatt

SEQ ID NO: 858818 - DNA, 25 bp, Mus musculus
tgatgatccctgtgtactgctgatt

SEQ ID NO: 858819 - DNA, 25 bp, Mus musculus
tgatgatcctgcaacgcgactcttt

SEQ ID NO: 858820 - DNA, 25 bp, Mus musculus
tgatgatcctgctacgcgactcttt

SEQ ID NO: 858821 - DNA, 25 bp, Mus musculus
tgatgatccttgcatatcaccacag

SEQ ID NO: 858822 - DNA, 25 bp, Mus musculus
tgatgatccttggatatcaccacag

SEQ ID NO: 858823 - DNA, 25 bp, Mus musculus
tgatgatctcacagtcgaccgatga

SEQ ID NO: 858824 - DNA, 25 bp, Mus musculus
tgatgatctcactgtcgaccgatga

SEQ ID NO: 858825 - DNA, 25 bp, Mus musculus
tgatgatctgtaatgcttgcactga

SEQ ID NO: 858826 - DNA, 25 bp, Mus musculus
tgatgatctgtattgcttgcactga

SEQ ID NO: 858827 - DNA, 25 bp, Mus musculus
tgatgatctgttacctcgtgctcta

SEQ ID NO: 858828 - DNA, 25 bp, Mus musculus
tgatgatctgtttcctcgtgctcta

SEQ ID NO: 858829 - DNA, 25 bp, Mus musculus
tgatgatcttctagatgccaaccgc

SEQ ID NO: 858830 - DNA, 25 bp, Mus musculus
tgatgatcttcttgatgccaaccgc

SEQ ID NO: 858831 - DNA, 25 bp, Mus musculus
tgatgatgaacaccacagcacattg

SEQ ID NO: 858832 - DNA, 25 bp, Mus musculus
tgatgatgaacagcacagcacattg

SEQ ID NO: 858833 - DNA, 25 bp, Mus musculus
tgatgatgacctctatcccttcatt

SEQ ID NO: 858834 - DNA, 25 bp, Mus musculus
tgatgatgacctgtatcccttcatt

SEQ ID NO: 858835 - DNA, 25 bp, Mus musculus
tgatgatgagccagttgctgaccct

SEQ ID NO: 858836 - DNA, 25 bp, Mus musculus
tgatgatgagcctgttgctgaccct

SEQ ID NO: 858837 - DNA, 25 bp, Mus musculus
tgatgatgataacgagggcgccatt

SEQ ID NO: 858838 - DNA, 25 bp, Mus musculus
tgatgatgataaggagggcgccatt

SEQ ID NO: 858839 - DNA, 25 bp, Mus musculus
tgatgatgcagaccaacgtcccagg

SEQ ID NO: 858840 - DNA, 25 bp, Mus musculus
tgatgatgcagagcaacgtcccagg

SEQ ID NO: 858841 - DNA, 25 bp, Mus musculus
tgatgatgcatcagcacctggcagt

SEQ ID NO: 858842 - DNA, 25 bp, Mus musculus
tgatgatgcatctgcacctggcagt

SEQ ID NO: 858843 - DNA, 25 bp, Mus musculus
tgatgatgcctaagtgggctgctct

SEQ ID NO: 858844 - DNA, 25 bp, Mus musculus
tgatgatgcctatgtgggctgctct

SEQ ID NO: 858845 - DNA, 25 bp, Mus musculus
tgatgatgcgctagctctttcctct

SEQ ID NO: 858846 - DNA, 25 bp, Mus musculus
tgatgatgcgcttgctctttcctct

SEQ ID NO: 858847 - DNA, 25 bp, Mus musculus
tgatgatgctcacacttccttttag

SEQ ID NO: 858848 - DNA, 25 bp, Mus musculus
tgatgatgctcagacttccttttag

SEQ ID NO: 858849 - DNA, 25 bp, Mus musculus
tgatgatgggccacctggagagctt

SEQ ID NO: 858850 - DNA, 25 bp, Mus musculus
tgatgatgggcctcctggagagctt

SEQ ID NO: 858851 - DNA, 25 bp, Mus musculus
tgatgatggtccattctcaccagca

SEQ ID NO: 858852 - DNA, 25 bp, Mus musculus
tgatgatggtcctttctcaccagca

SEQ ID NO: 858853 - DNA, 25 bp, Mus musculus
tgatgatgtataccgtagccctggc

SEQ ID NO: 858854 - DNA, 25 bp, Mus musculus
tgatgatgtatagcgtagccctggc

SEQ ID NO: 858855 - DNA, 25 bp, Mus musculus
tgatgatgtattcattccaggggcc

SEQ ID NO: 858856 - DNA, 25 bp, Mus musculus
tgatgatgtattgattccaggggcc

SEQ ID NO: 858857 - DNA, 25 bp, Mus musculus
tgatgatgtcataccagaaaaggac

SEQ ID NO: 858858 - DNA, 25 bp, Mus musculus
tgatgatgtcattccagaaaaggac

SEQ ID NO: 858859 - DNA, 25 bp, Mus musculus
tgatgatgtgtgacctccagagcta

SEQ ID NO: 858860 - DNA, 25 bp, Mus musculus
tgatgatgtgtgtcctccagagcta

SEQ ID NO: 858861 - DNA, 25 bp, Mus musculus
tgatgatgttcaattcccgtttctc

SEQ ID NO: 858862 - DNA, 25 bp, Mus musculus
tgatgatgttcatttcccgtttctc

SEQ ID NO: 858863 - DNA, 25 bp, Mus musculus
tgatgatgttctactgctggtttat

SEQ ID NO: 858864 - DNA, 25 bp, Mus musculus
tgatgatgttcttctgctggtttat

SEQ ID NO: 858865 - DNA, 25 bp, Mus musculus
tgatgattcattactaagctggaga

SEQ ID NO: 858866 - DNA, 25 bp, Mus musculus
tgatgattcatttctaagctggaga

SEQ ID NO: 858867 - DNA, 25 bp, Mus musculus
tgatgattccagagcagtagtgcca

SEQ ID NO: 858868 - DNA, 25 bp, Mus musculus
tgatgattccagtgcagtagtgcca

SEQ ID NO: 858869 - DNA, 25 bp, Mus musculus
tgatgattctgtatgggactccctc

SEQ ID NO: 858870 - DNA, 25 bp, Mus musculus
tgatgattctgtttgggactccctc

SEQ ID NO: 858871 - DNA, 25 bp, Mus musculus
tgatgattgccccaagtctgacaac

SEQ ID NO: 858872 - DNA, 25 bp, Mus musculus
tgatgattgcccgaagtctgacaac

SEQ ID NO: 858873 - DNA, 25 bp, Mus musculus
tgatgatttcagacttgagccgctt

SEQ ID NO: 858874 - DNA, 25 bp, Mus musculus
tgatgatttcagtcttgagccgctt

SEQ ID NO: 858875 - DNA, 25 bp, Mus musculus
tgatgatttctgagattctccaaat

SEQ ID NO: 858876 - DNA, 25 bp, Mus musculus
tgatgatttctgtgattctccaaat

SEQ ID NO: 858877 - DNA, 25 bp, Mus musculus
tgatgatttgttcctgagaagtgga

SEQ ID NO: 858878 - DNA, 25 bp, Mus musculus
tgatgatttgttgctgagaagtgga

SEQ ID NO: 858879 - DNA, 25 bp, Mus musculus
tgatgattttctagtctgacagttt

SEQ ID NO: 858880 - DNA, 25 bp, Mus musculus
tgatgattttcttgtctgacagttt

SEQ ID NO: 858881 - DNA, 25 bp, Mus musculus
tgatgattttgactgctacctggcc

SEQ ID NO: 858882 - DNA, 25 bp, Mus musculus
tgatgattttgagtgctacctggcc

SEQ ID NO: 858883 - DNA, 25 bp, Mus musculus
tgatgcaaaaccaccaccagctacg

SEQ ID NO: 858884 - DNA, 25 bp, Mus musculus
tgatgcaaaacctccaccagctacg

SEQ ID NO: 858885 - DNA, 25 bp, Mus musculus
tgatgcaaagctccgtcctttacag

SEQ ID NO: 858886 - DNA, 25 bp, Mus musculus
tgatgcaaagctgcgtcctttacag

SEQ ID NO: 858887 - DNA, 25 bp, Mus musculus
tgatgcaaatatctccagccgctac

SEQ ID NO: 858888 - DNA, 25 bp, Mus musculus
tgatgcaaatatgtccagccgctac

SEQ ID NO: 858889 - DNA, 25 bp, Mus musculus
tgatgcaaccaacgagaggaatctc

SEQ ID NO: 858890 - DNA, 25 bp, Mus musculus
tgatgcaaccaaggagaggaatctc

SEQ ID NO: 858891 - DNA, 25 bp, Mus musculus
tgatgcaacctgaatttcccaatgg

SEQ ID NO: 858892 - DNA, 25 bp, Mus musculus
tgatgcaacctgtatttcccaatgg

SEQ ID NO: 858893 - DNA, 25 bp, Mus musculus
tgatgcaactacagtctaaattgta

SEQ ID NO: 858894 - DNA, 25 bp, Mus musculus
tgatgcaactactgtctaaattgta

SEQ ID NO: 858895 - DNA, 25 bp, Mus musculus
tgatgcaagacgaccctgaaactat

SEQ ID NO: 858896 - DNA, 25 bp, Mus musculus
tgatgcaagacgtccctgaaactat

SEQ ID NO: 858897 - DNA, 25 bp, Mus musculus
tgatgcaagcctccttgtggaactg

SEQ ID NO: 858898 - DNA, 25 bp, Mus musculus
tgatgcaagcctgcttgtggaactg

SEQ ID NO: 858899 - DNA, 25 bp, Mus musculus
tgatgcaaggagctcccacaccaga

SEQ ID NO: 858900 - DNA, 25 bp, Mus musculus
tgatgcaaggaggtcccacaccaga

SEQ ID NO: 858901 - DNA, 25 bp, Mus musculus
tgatgcaaggcacgacccaggttca

SEQ ID NO: 858902 - DNA, 25 bp, Mus musculus
tgatgcaaggcaggacccaggttca

SEQ ID NO: 858903 - DNA, 25 bp, Mus musculus
tgatgcaaggctcaccacaccaaca

SEQ ID NO: 858904 - DNA, 25 bp, Mus musculus
tgatgcaaggctgaccacaccaaca

SEQ ID NO: 858905 - DNA, 25 bp, Mus musculus
tgatgcaagtgcacctccaatctat

SEQ ID NO: 858906 - DNA, 25 bp, Mus musculus
tgatgcaagtgctcctccaatctat

SEQ ID NO: 858907 - DNA, 25 bp, Mus musculus
tgatgcaccatcatatactctgaat

SEQ ID NO: 858908 - DNA, 25 bp, Mus musculus
tgatgcaccatcttatactctgaat

SEQ ID NO: 858909 - DNA, 25 bp, Mus musculus
tgatgcaccgctccgagaacaacca

SEQ ID NO: 858910 - DNA, 25 bp, Mus musculus
tgatgcaccgctgcgagaacaacca

SEQ ID NO: 858911 - DNA, 25 bp, Mus musculus
tgatgcacctagcttccgtgtggaa

SEQ ID NO: 858912 - DNA, 25 bp, Mus musculus
tgatgcacctaggttccgtgtggaa

SEQ ID NO: 858913 - DNA, 25 bp, Mus musculus
tgatgcacctttaattgcctcatgg

SEQ ID NO: 858914 - DNA, 25 bp, Mus musculus
tgatgcaccttttattgcctcatgg

SEQ ID NO: 858915 - DNA, 25 bp, Mus musculus
tgatgcacgcctccattcagcaact

SEQ ID NO: 858916 - DNA, 25 bp, Mus musculus
tgatgcacgcctgcattcagcaact

SEQ ID NO: 858917 - DNA, 25 bp, Mus musculus
tgatgcagaaacattcacctcccag

SEQ ID NO: 858918 - DNA, 25 bp, Mus musculus
tgatgcagaaactttcacctcccag

SEQ ID NO: 858919 - DNA, 25 bp, Mus musculus
tgatgcagaaatacagagctttcgg

SEQ ID NO: 858920 - DNA, 25 bp, Mus musculus
tgatgcagaaattcagagctttcgg

SEQ ID NO: 858921 - DNA, 25 bp, Mus musculus
tgatgcagacatcattcccgagctc

SEQ ID NO: 858922 - DNA, 25 bp, Mus musculus
tgatgcagacatgattcccgagctc

SEQ ID NO: 858923 - DNA, 25 bp, Mus musculus
tgatgcagactgctagctgtcactg

SEQ ID NO: 858924 - DNA, 25 bp, Mus musculus
tgatgcagactggtagctgtcactg

SEQ ID NO: 858925 - DNA, 25 bp, Mus musculus
tgatgcagagcaagtccctggtgac

SEQ ID NO: 858926 - DNA, 25 bp, Mus musculus
tgatgcagagcatgtccctggtgac

SEQ ID NO: 858927 - DNA, 25 bp, Mus musculus
tgatgcagatcgagtgtgaggtcat

SEQ ID NO: 858928 - DNA, 25 bp, Mus musculus
tgatgcagatcgtgtgtgaggtcat

SEQ ID NO: 858929 - DNA, 25 bp, Mus musculus
tgatgcagattcagcatgtgtcact

SEQ ID NO: 858930 - DNA, 25 bp, Mus musculus
tgatgcagattctgcatgtgtcact

SEQ ID NO: 858931 - DNA, 25 bp, Mus musculus
tgatgcagcccaacaaagcttcttt

SEQ ID NO: 858932 - DNA, 25 bp, Mus musculus
tgatgcagcccatcaaagcttcttt

SEQ ID NO: 858933 - DNA, 25 bp, Mus musculus
tgatgcaggtacattctgtaagcct

SEQ ID NO: 858934 - DNA, 25 bp, Mus musculus
tgatgcaggtactttctgtaagcct

SEQ ID NO: 858935 - DNA, 25 bp, Mus musculus
tgatgcagtcatctcaggcatccct

SEQ ID NO: 858936 - DNA, 25 bp, Mus musculus
tgatgcagtcatgtcaggcatccct

SEQ ID NO: 858937 - DNA, 25 bp, Mus musculus
tgatgcagtcctaatacaaaaccga

SEQ ID NO: 858938 - DNA, 25 bp, Mus musculus
tgatgcagtccttatacaaaaccga

SEQ ID NO: 858939 - DNA, 25 bp, Mus musculus
tgatgcatactcaagccagcttctc

SEQ ID NO: 858940 - DNA, 25 bp, Mus musculus
tgatgcatactctagccagcttctc

SEQ ID NO: 858941 - DNA, 25 bp, Mus musculus
tgatgcatcagcctgtcactcggaa

SEQ ID NO: 858942 - DNA, 25 bp, Mus musculus
tgatgcatcagcgtgtcactcggaa

SEQ ID NO: 858943 - DNA, 25 bp, Mus musculus
tgatgcatccacaacttcaggctat

SEQ ID NO: 858944 - DNA, 25 bp, Mus musculus
tgatgcatccactacttcaggctat

SEQ ID NO: 858945 - DNA, 25 bp, Mus musculus
tgatgcatctagcaaccagtgtgat

SEQ ID NO: 858946 - DNA, 25 bp, Mus musculus
tgatgcatctaggaaccagtgtgat

SEQ ID NO: 858947 - DNA, 25 bp, Mus musculus
tgatgcatctgtacctgcgacttca

SEQ ID NO: 858948 - DNA, 25 bp, Mus musculus
tgatgcatctgttcctgcgacttca

SEQ ID NO: 858949 - DNA, 25 bp, Mus musculus
tgatgcatgcgcaggagctaggcct

SEQ ID NO: 858950 - DNA, 25 bp, Mus musculus
tgatgcatgcgctggagctaggcct

SEQ ID NO: 858951 - DNA, 25 bp, Mus musculus
tgatgcatggtcagagtttgaaaac

SEQ ID NO: 858952 - DNA, 25 bp, Mus musculus
tgatgcatggtctgagtttgaaaac

SEQ ID NO: 858953 - DNA, 25 bp, Mus musculus
tgatgcatgttgctttctaagaaag

SEQ ID NO: 858954 - DNA, 25 bp, Mus musculus
tgatgcatgttggtttctaagaaag

SEQ ID NO: 858955 - DNA, 25 bp, Mus musculus
tgatgcattaagagctttgctagaa

SEQ ID NO: 858956 - DNA, 25 bp, Mus musculus
tgatgcattaagtgctttgctagaa

SEQ ID NO: 858957 - DNA, 25 bp, Mus musculus
tgatgcattataatgtctgttgaat

SEQ ID NO: 858958 - DNA, 25 bp, Mus musculus
tgatgcattatattgtctgttgaat

SEQ ID NO: 858959 - DNA, 25 bp, Mus musculus
tgatgcattctaacaaaagcttggc

SEQ ID NO: 858960 - DNA, 25 bp, Mus musculus
tgatgcattctatcaaaagcttggc

SEQ ID NO: 858961 - DNA, 25 bp, Mus musculus
tgatgccaacatactggtcacgctg

SEQ ID NO: 858962 - DNA, 25 bp, Mus musculus
tgatgccaacattctggtcacgctg

SEQ ID NO: 858963 - DNA, 25 bp, Mus musculus
tgatgccaagctagtctgcctgtta

SEQ ID NO: 858964 - DNA, 25 bp, Mus musculus
tgatgccaagcttgtctgcctgtta

SEQ ID NO: 858965 - DNA, 25 bp, Mus musculus
tgatgccaaggcattctaacatgga

SEQ ID NO: 858966 - DNA, 25 bp, Mus musculus
tgatgccaaggctttctaacatgga

SEQ ID NO: 858967 - DNA, 25 bp, Mus musculus
tgatgccaagttcccagttgaccct

SEQ ID NO: 858968 - DNA, 25 bp, Mus musculus
tgatgccaagttgccagttgaccct

SEQ ID NO: 858969 - DNA, 25 bp, Mus musculus
tgatgccaatcacactagcaccatt

SEQ ID NO: 858970 - DNA, 25 bp, Mus musculus
tgatgccaatcagactagcaccatt

SEQ ID NO: 858971 - DNA, 25 bp, Mus musculus
tgatgccacactcttcaatccttgt

SEQ ID NO: 858972 - DNA, 25 bp, Mus musculus
tgatgccacactgttcaatccttgt

SEQ ID NO: 858973 - DNA, 25 bp, Mus musculus
tgatgccacagaaaccagtgactct

SEQ ID NO: 858974 - DNA, 25 bp, Mus musculus
tgatgccacagataccagtgactct

SEQ ID NO: 858975 - DNA, 25 bp, Mus musculus
tgatgccacattccatagccacctg

SEQ ID NO: 858976 - DNA, 25 bp, Mus musculus
tgatgccacattgcatagccacctg

SEQ ID NO: 858977 - DNA, 25 bp, Mus musculus
tgatgccagaagacagcatgcctct

SEQ ID NO: 858978 - DNA, 25 bp, Mus musculus
tgatgccagaagtcagcatgcctct

SEQ ID NO: 858979 - DNA, 25 bp, Mus musculus
tgatgccagacgctgctgagtctct

SEQ ID NO: 858980 - DNA, 25 bp, Mus musculus
tgatgccagacggtgctgagtctct

SEQ ID NO: 858981 - DNA, 25 bp, Mus musculus
tgatgccatcacagggtccagtgtc

SEQ ID NO: 858982 - DNA, 25 bp, Mus musculus
tgatgccatcactgggtccagtgtc

SEQ ID NO: 858983 - DNA, 25 bp, Mus musculus
tgatgccattcaagagtctgctcag

SEQ ID NO: 858984 - DNA, 25 bp, Mus musculus
tgatgccattcatgagtctgctcag

SEQ ID NO: 858985 - DNA, 25 bp, Mus musculus
tgatgccatttgacagagcctgttt

SEQ ID NO: 858986 - DNA, 25 bp, Mus musculus
tgatgccatttgtcagagcctgttt

SEQ ID NO: 858987 - DNA, 25 bp, Mus musculus
tgatgccattttcccagacctgaat

SEQ ID NO: 858988 - DNA, 25 bp, Mus musculus
tgatgccattttgccagacctgaat

SEQ ID NO: 858989 - DNA, 25 bp, Mus musculus
tgatgcccaagtctttcaagttctt

SEQ ID NO: 858990 - DNA, 25 bp, Mus musculus
tgatgcccaagtgtttcaagttctt

SEQ ID NO: 858991 - DNA, 25 bp, Mus musculus
tgatgcccaccactgttttgcctat

SEQ ID NO: 858992 - DNA, 25 bp, Mus musculus
tgatgcccaccagtgttttgcctat

SEQ ID NO: 858993 - DNA, 25 bp, Mus musculus
tgatgcccacccagcaggctgcaga

SEQ ID NO: 858994 - DNA, 25 bp, Mus musculus
tgatgcccaccctgcaggctgcaga

SEQ ID NO: 858995 - DNA, 25 bp, Mus musculus
tgatgcccaccgcaaggagatctgc

SEQ ID NO: 858996 - DNA, 25 bp, Mus musculus
tgatgcccaccggaaggagatctgc

SEQ ID NO: 858997 - DNA, 25 bp, Mus musculus
tgatgcccagaccatatgttatgaa

SEQ ID NO: 858998 - DNA, 25 bp, Mus musculus
tgatgcccagacgatatgttatgaa

SEQ ID NO: 858999 - DNA, 25 bp, Mus musculus
tgatgcccagagaacaggaatgcta

SEQ ID NO: 859000 - DNA, 25 bp, Mus musculus
tgatgcccagagtacaggaatgcta

SEQ ID NO: 859001 - DNA, 25 bp, Mus musculus
tgatgcccagcgactgcaggatgac

SEQ ID NO: 859002 - DNA, 25 bp, Mus musculus
tgatgcccagcgtctgcaggatgac

SEQ ID NO: 859003 - DNA, 25 bp, Mus musculus
tgatgcccagtcaaaacaccttcga

SEQ ID NO: 859004 - DNA, 25 bp, Mus musculus
tgatgcccagtctaaacaccttcga

SEQ ID NO: 859005 - DNA, 25 bp, Mus musculus
tgatgcccatatctgcccagagtag

SEQ ID NO: 859006 - DNA, 25 bp, Mus musculus
tgatgcccatatgtgcccagagtag

SEQ ID NO: 859007 - DNA, 25 bp, Mus musculus
tgatgccccagtctttctttaccag

SEQ ID NO: 859008 - DNA, 25 bp, Mus musculus
tgatgccccagtgtttctttaccag

SEQ ID NO: 859009 - DNA, 25 bp, Mus musculus
tgatgccccgagaccacaggtgggt

SEQ ID NO: 859010 - DNA, 25 bp, Mus musculus
tgatgccccgagtccacaggtgggt

SEQ ID NO: 859011 - DNA, 25 bp, Mus musculus
tgatgcccctgactatgatgcaaga

SEQ ID NO: 859012 - DNA, 25 bp, Mus musculus
tgatgcccctgagtatgatgcaaga

SEQ ID NO: 859013 - DNA, 25 bp, Mus musculus
tgatgcccgaccaatctgctaaaga

SEQ ID NO: 859014 - DNA, 25 bp, Mus musculus
tgatgcccgacctatctgctaaaga

SEQ ID NO: 859015 - DNA, 25 bp, Mus musculus
tgatgccctaccacacagtgtgtgt

SEQ ID NO: 859016 - DNA, 25 bp, Mus musculus
tgatgccctacctcacagtgtgtgt

SEQ ID NO: 859017 - DNA, 25 bp, Mus musculus
tgatgccctcgtccgggacaaggcc

SEQ ID NO: 859018 - DNA, 25 bp, Mus musculus
tgatgccctcgtgcgggacaaggcc

SEQ ID NO: 859019 - DNA, 25 bp, Mus musculus
tgatgccctcttatgcagctgtgca

SEQ ID NO: 859020 - DNA, 25 bp, Mus musculus
tgatgccctcttttgcagctgtgca

SEQ ID NO: 859021 - DNA, 25 bp, Mus musculus
tgatgccctgaacttgactctggaa

SEQ ID NO: 859022 - DNA, 25 bp, Mus musculus
tgatgccctgaagttgactctggaa

SEQ ID NO: 859023 - DNA, 25 bp, Mus musculus
tgatgccctgagacctaatgttctt

SEQ ID NO: 859024 - DNA, 25 bp, Mus musculus
tgatgccctgagtcctaatgttctt

SEQ ID NO: 859025 - DNA, 25 bp, Mus musculus
tgatgccctggaccccgaggatttg

SEQ ID NO: 859026 - DNA, 25 bp, Mus musculus
tgatgccctggagcccgaggatttg

SEQ ID NO: 859027 - DNA, 25 bp, Mus musculus
tgatgcccttacacttatgttactg

SEQ ID NO: 859028 - DNA, 25 bp, Mus musculus
tgatgcccttactcttatgttactg

SEQ ID NO: 859029 - DNA, 25 bp, Mus musculus
tgatgccctttcctctatcataagt

SEQ ID NO: 859030 - DNA, 25 bp, Mus musculus
tgatgccctttcgtctatcataagt

SEQ ID NO: 859031 - DNA, 25 bp, Mus musculus
tgatgccgggccatacattttccaa

SEQ ID NO: 859032 - DNA, 25 bp, Mus musculus
tgatgccgggccttacattttccaa

SEQ ID NO: 859033 - DNA, 25 bp, Mus musculus
tgatgcctaagtagctgctagaccc

SEQ ID NO: 859034 - DNA, 25 bp, Mus musculus
tgatgcctaagttgctgctagaccc

SEQ ID NO: 859035 - DNA, 25 bp, Mus musculus
tgatgcctacctatttagtttcaac

SEQ ID NO: 859036 - DNA, 25 bp, Mus musculus
tgatgcctacctttttagtttcaac

SEQ ID NO: 859037 - DNA, 25 bp, Mus musculus
tgatgcctacttccccagattactg

SEQ ID NO: 859038 - DNA, 25 bp, Mus musculus
tgatgcctacttgcccagattactg

SEQ ID NO: 859039 - DNA, 25 bp, Mus musculus
tgatgcctatctcacacttttttcc

SEQ ID NO: 859040 - DNA, 25 bp, Mus musculus
tgatgcctatctgacacttttttcc

SEQ ID NO: 859041 - DNA, 25 bp, Mus musculus
tgatgcctccatcctgggccagtag

SEQ ID NO: 859042 - DNA, 25 bp, Mus musculus
tgatgcctccatgctgggccagtag

SEQ ID NO: 859043 - DNA, 25 bp, Mus musculus
tgatgcctcccacacaacactgttt

SEQ ID NO: 859044 - DNA, 25 bp, Mus musculus
tgatgcctcccagacaacactgttt

SEQ ID NO: 859045 - DNA, 25 bp, Mus musculus
tgatgcctcgccagcaaatgacaat

SEQ ID NO: 859046 - DNA, 25 bp, Mus musculus
tgatgcctcgcctgcaaatgacaat

SEQ ID NO: 859047 - DNA, 25 bp, Mus musculus
tgatgcctctccaacaggtaacagt

SEQ ID NO: 859048 - DNA, 25 bp, Mus musculus
tgatgcctctcctacaggtaacagt

SEQ ID NO: 859049 - DNA, 25 bp, Mus musculus
tgatgcctctctctatcccaggctg

SEQ ID NO: 859050 - DNA, 25 bp, Mus musculus
tgatgcctctctgtatcccaggctg

SEQ ID NO: 859051 - DNA, 25 bp, Mus musculus
tgatgcctgcatccaaaaccacttc

SEQ ID NO: 859052 - DNA, 25 bp, Mus musculus
tgatgcctgcatgcaaaaccacttc

SEQ ID NO: 859053 - DNA, 25 bp, Mus musculus
tgatgcctgccaacacacgcatggg

SEQ ID NO: 859054 - DNA, 25 bp, Mus musculus
tgatgcctgccacccatgtttgact

SEQ ID NO: 859055 - DNA, 25 bp, Mus musculus
tgatgcctgccagccatgtttgact

SEQ ID NO: 859056 - DNA, 25 bp, Mus musculus
tgatgcctgccatcacacgcatggg

SEQ ID NO: 859057 - DNA, 25 bp, Mus musculus
tgatgcctgctaagactagcaatta

SEQ ID NO: 859058 - DNA, 25 bp, Mus musculus
tgatgcctgctacaaccctatctgg

SEQ ID NO: 859059 - DNA, 25 bp, Mus musculus
tgatgcctgctagaaccctatctgg

SEQ ID NO: 859060 - DNA, 25 bp, Mus musculus
tgatgcctgctatgactagcaatta

SEQ ID NO: 859061 - DNA, 25 bp, Mus musculus
tgatgccttcttaatgccttacatt

SEQ ID NO: 859062 - DNA, 25 bp, Mus musculus
tgatgccttctttatgccttacatt

SEQ ID NO: 859063 - DNA, 25 bp, Mus musculus
tgatgccttgtgacccatgactgat

SEQ ID NO: 859064 - DNA, 25 bp, Mus musculus
tgatgccttgtgtcccatgactgat

SEQ ID NO: 859065 - DNA, 25 bp, Mus musculus
tgatgcctttgacacgctgtttgac

SEQ ID NO: 859066 - DNA, 25 bp, Mus musculus
tgatgcctttgagacgctgtttgac

SEQ ID NO: 859067 - DNA, 25 bp, Mus musculus
tgatgcgacagtatttagcccctag

SEQ ID NO: 859068 - DNA, 25 bp, Mus musculus
tgatgcgacagtttttagcccctag

SEQ ID NO: 859069 - DNA, 25 bp, Mus musculus
tgatgcgactgtaaccacggtggga

SEQ ID NO: 859070 - DNA, 25 bp, Mus musculus
tgatgcgactgttaccacggtggga

SEQ ID NO: 859071 - DNA, 25 bp, Mus musculus
tgatgcgccaccaggaatccagtct

SEQ ID NO: 859072 - DNA, 25 bp, Mus musculus
tgatgcgccacctggaatccagtct

SEQ ID NO: 859073 - DNA, 25 bp, Mus musculus
tgatgcgccattattagcacctgtg

SEQ ID NO: 859074 - DNA, 25 bp, Mus musculus
tgatgcgccatttttagcacctgtg

SEQ ID NO: 859075 - DNA, 25 bp, Mus musculus
tgatgcgcggtgagtttgactcgct

SEQ ID NO: 859076 - DNA, 25 bp, Mus musculus
tgatgcgcggtgtgtttgactcgct

SEQ ID NO: 859077 - DNA, 25 bp, Mus musculus
tgatgcgctgataggcctaccgtag

SEQ ID NO: 859078 - DNA, 25 bp, Mus musculus
tgatgcgctgattggcctaccgtag

SEQ ID NO: 859079 - DNA, 25 bp, Mus musculus
tgatgcgctgcaaacgccggctcaa

SEQ ID NO: 859080 - DNA, 25 bp, Mus musculus
tgatgcgctgcatacgccggctcaa

SEQ ID NO: 859081 - DNA, 25 bp, Mus musculus
tgatgcgctggtccactcttgttga

SEQ ID NO: 859082 - DNA, 25 bp, Mus musculus
tgatgcgctggtgcactcttgttga

SEQ ID NO: 859083 - DNA, 25 bp, Mus musculus
tgatgcgcttgcactttcctctgct

SEQ ID NO: 859084 - DNA, 25 bp, Mus musculus
tgatgcgcttgctctttcctctgct

SEQ ID NO: 859085 - DNA, 25 bp, Mus musculus
tgatgcggatgcacacttgggctga

SEQ ID NO: 859086 - DNA, 25 bp, Mus musculus
tgatgcggatgctcacttgggctga

SEQ ID NO: 859087 - DNA, 25 bp, Mus musculus
tgatgcggatttatggaggcgtgca

SEQ ID NO: 859088 - DNA, 25 bp, Mus musculus
tgatgcggatttttggaggcgtgca

SEQ ID NO: 859089 - DNA, 25 bp, Mus musculus
tgatgcggctgcaatcaaacagcat

SEQ ID NO: 859090 - DNA, 25 bp, Mus musculus
tgatgcggctgctatcaaacagcat

SEQ ID NO: 859091 - DNA, 25 bp, Mus musculus
tgatgcgggattacacccccagtgg

SEQ ID NO: 859092 - DNA, 25 bp, Mus musculus
tgatgcgggatttcacccccagtgg

SEQ ID NO: 859093 - DNA, 25 bp, Mus musculus
tgatgcggtacacggcatttctcct

SEQ ID NO: 859094 - DNA, 25 bp, Mus musculus
tgatgcggtacagggcatttctcct

SEQ ID NO: 859095 - DNA, 25 bp, Mus musculus
tgatgcggtgccagctccagtgatc

SEQ ID NO: 859096 - DNA, 25 bp, Mus musculus
tgatgcggtgcctgctccagtgatc

SEQ ID NO: 859097 - DNA, 25 bp, Mus musculus
tgatgcgtattaacagggctagaag

SEQ ID NO: 859098 - DNA, 25 bp, Mus musculus
tgatgcgtattatcagggctagaag

SEQ ID NO: 859099 - DNA, 25 bp, Mus musculus
tgatgcgtctgtacagtgcactccg

SEQ ID NO: 859100 - DNA, 25 bp, Mus musculus
tgatgcgtctgttcagtgcactccg

SEQ ID NO: 859101 - DNA, 25 bp, Mus musculus
tgatgctaaaaacagggtacctccc

SEQ ID NO: 859102 - DNA, 25 bp, Mus musculus
tgatgctaaaaagagggtacctccc

SEQ ID NO: 859103 - DNA, 25 bp, Mus musculus
tgatgctaagcactctcctgctgag

SEQ ID NO: 859104 - DNA, 25 bp, Mus musculus
tgatgctaagcactttcctcctaca

SEQ ID NO: 859105 - DNA, 25 bp, Mus musculus
tgatgctaagcagtctcctgctgag

SEQ ID NO: 859106 - DNA, 25 bp, Mus musculus
tgatgctaagcagtttcctcctaca

SEQ ID NO: 859107 - DNA, 25 bp, Mus musculus
tgatgctaatgacgtcactctgttg

SEQ ID NO: 859108 - DNA, 25 bp, Mus musculus
tgatgctaatgaggtcactctgttg

SEQ ID NO: 859109 - DNA, 25 bp, Mus musculus
tgatgctacacacagtgctcccagt

SEQ ID NO: 859110 - DNA, 25 bp, Mus musculus
tgatgctacacagagtgctcccagt

SEQ ID NO: 859111 - DNA, 25 bp, Mus musculus
tgatgctacctgaacaacatttgta

SEQ ID NO: 859112 - DNA, 25 bp, Mus musculus
tgatgctacctgtacaacatttgta

SEQ ID NO: 859113 - DNA, 25 bp, Mus musculus
tgatgctacggcatttgtttttcca

SEQ ID NO: 859114 - DNA, 25 bp, Mus musculus
tgatgctacggcttttgtttttcca

SEQ ID NO: 859115 - DNA, 25 bp, Mus musculus
tgatgctactatcctgtttgacaca

SEQ ID NO: 859116 - DNA, 25 bp, Mus musculus
tgatgctactatgctgtttgacaca

SEQ ID NO: 859117 - DNA, 25 bp, Mus musculus
tgatgctacttcctcctctgggaag

SEQ ID NO: 859118 - DNA, 25 bp, Mus musculus
tgatgctacttcgtcctctgggaag

SEQ ID NO: 859119 - DNA, 25 bp, Mus musculus
tgatgctagcatcgaacccgctgtg

SEQ ID NO: 859120 - DNA, 25 bp, Mus musculus
tgatgctagcatggaacccgctgtg

SEQ ID NO: 859121 - DNA, 25 bp, Mus musculus
tgatgctagggcaggaatccgcaag

SEQ ID NO: 859122 - DNA, 25 bp, Mus musculus
tgatgctagggctggaatccgcaag

SEQ ID NO: 859123 - DNA, 25 bp, Mus musculus
tgatgctatatcctctgaaggcccg

SEQ ID NO: 859124 - DNA, 25 bp, Mus musculus
tgatgctatatcgtctgaaggcccg

SEQ ID NO: 859125 - DNA, 25 bp, Mus musculus
tgatgctatccacaaggaccttctt

SEQ ID NO: 859126 - DNA, 25 bp, Mus musculus
tgatgctatccagaaggaccttctt

SEQ ID NO: 859127 - DNA, 25 bp, Mus musculus
tgatgctatgagcagcaagcaagtc

SEQ ID NO: 859128 - DNA, 25 bp, Mus musculus
tgatgctatgaggagcaagcaagtc

SEQ ID NO: 859129 - DNA, 25 bp, Mus musculus
tgatgctcaagacaagcctgctctt

SEQ ID NO: 859130 - DNA, 25 bp, Mus musculus
tgatgctcaagagaagcctgctctt

SEQ ID NO: 859131 - DNA, 25 bp, Mus musculus
tgatgctcaattacttatttgaatc

SEQ ID NO: 859132 - DNA, 25 bp, Mus musculus
tgatgctcaatttcttatttgaatc

SEQ ID NO: 859133 - DNA, 25 bp, Mus musculus
tgatgctcagagatgccccaaggca

SEQ ID NO: 859134 - DNA, 25 bp, Mus musculus
tgatgctcagagttgccccaaggca

SEQ ID NO: 859135 - DNA, 25 bp, Mus musculus
tgatgctcagatccgaacaatccat

SEQ ID NO: 859136 - DNA, 25 bp, Mus musculus
tgatgctcagatgcgaacaatccat

SEQ ID NO: 859137 - DNA, 25 bp, Mus musculus
tgatgctcagcactcaagtgccttt

SEQ ID NO: 859138 - DNA, 25 bp, Mus musculus
tgatgctcagcagtcaagtgccttt

SEQ ID NO: 859139 - DNA, 25 bp, Mus musculus
tgatgctcagctaagggtcagggca

SEQ ID NO: 859140 - DNA, 25 bp, Mus musculus
tgatgctcagcttagggtcagggca

SEQ ID NO: 859141 - DNA, 25 bp, Mus musculus
tgatgctcagggaaggatgcgttct

SEQ ID NO: 859142 - DNA, 25 bp, Mus musculus
tgatgctcagggtaggatgcgttct

SEQ ID NO: 859143 - DNA, 25 bp, Mus musculus
tgatgctcccagagcaaaacctgct

SEQ ID NO: 859144 - DNA, 25 bp, Mus musculus
tgatgctcccagtgcaaaacctgct

SEQ ID NO: 859145 - DNA, 25 bp, Mus musculus
tgatgctccggaatgggtccatcaa

SEQ ID NO: 859146 - DNA, 25 bp, Mus musculus
tgatgctccggattgggtccatcaa

SEQ ID NO: 859147 - DNA, 25 bp, Mus musculus
tgatgctcctacacctggaaagaag

SEQ ID NO: 859148 - DNA, 25 bp, Mus musculus
tgatgctcctactcctggaaagaag

SEQ ID NO: 859149 - DNA, 25 bp, Mus musculus
tgatgctcgagtagtaaaattacat

SEQ ID NO: 859150 - DNA, 25 bp, Mus musculus
tgatgctcgagttgtaaaattacat

SEQ ID NO: 859151 - DNA, 25 bp, Mus musculus
tgatgctctacaacacaggtgggtc

SEQ ID NO: 859152 - DNA, 25 bp, Mus musculus
tgatgctctacatcacaggtgggtc

SEQ ID NO: 859153 - DNA, 25 bp, Mus musculus
tgatgctctaccacctgtatcagta

SEQ ID NO: 859154 - DNA, 25 bp, Mus musculus
tgatgctctacctcctgtatcagta

SEQ ID NO: 859155 - DNA, 25 bp, Mus musculus
tgatgctctctactgaactcttaag

SEQ ID NO: 859156 - DNA, 25 bp, Mus musculus
tgatgctctctagtgaactcttaag

SEQ ID NO: 859157 - DNA, 25 bp, Mus musculus
tgatgctctctccacatagtataga

SEQ ID NO: 859158 - DNA, 25 bp, Mus musculus
tgatgctctctcgacatagtataga

SEQ ID NO: 859159 - DNA, 25 bp, Mus musculus
tgatgctcttggatctgtcctccaa

SEQ ID NO: 859160 - DNA, 25 bp, Mus musculus
tgatgctcttggttctgtcctccaa

SEQ ID NO: 859161 - DNA, 25 bp, Mus musculus
tgatgctgactaagccatccactgt

SEQ ID NO: 859162 - DNA, 25 bp, Mus musculus
tgatgctgactatgccatccactgt

SEQ ID NO: 859163 - DNA, 25 bp, Mus musculus
tgatgctgaggaactgaggaccctg

SEQ ID NO: 859164 - DNA, 25 bp, Mus musculus
tgatgctgaggatctgaggaccctg

SEQ ID NO: 859165 - DNA, 25 bp, Mus musculus
tgatgctgatccagctctgagtgag

SEQ ID NO: 859166 - DNA, 25 bp, Mus musculus
tgatgctgatcctgctctgagtgag

SEQ ID NO: 859167 - DNA, 25 bp, Mus musculus
tgatgctgatgcctgaccatggaga

SEQ ID NO: 859168 - DNA, 25 bp, Mus musculus
tgatgctgatgcgtgaccatggaga

SEQ ID NO: 859169 - DNA, 25 bp, Mus musculus
tgatgctgcagaagagaacctctct

SEQ ID NO: 859170 - DNA, 25 bp, Mus musculus
tgatgctgcagatgagaacctctct

SEQ ID NO: 859171 - DNA, 25 bp, Mus musculus
tgatgctgcaggaaccagggttaga

SEQ ID NO: 859172 - DNA, 25 bp, Mus musculus
tgatgctgcaggtaccagggttaga

SEQ ID NO: 859173 - DNA, 25 bp, Mus musculus
tgatgctgcagtcaccaacgtggag

SEQ ID NO: 859174 - DNA, 25 bp, Mus musculus
tgatgctgcagtgaccaacgtggag

SEQ ID NO: 859175 - DNA, 25 bp, Mus musculus
tgatgctgcatgctttttatcccac

SEQ ID NO: 859176 - DNA, 25 bp, Mus musculus
tgatgctgcatggtttttatcccac

SEQ ID NO: 859177 - DNA, 25 bp, Mus musculus
tgatgctgccggaatgactgactac

SEQ ID NO: 859178 - DNA, 25 bp, Mus musculus
tgatgctgccggtatgactgactac

SEQ ID NO: 859179 - DNA, 25 bp, Mus musculus
tgatgctggattagtgactcacccc

SEQ ID NO: 859180 - DNA, 25 bp, Mus musculus
tgatgctggatttgtgactcacccc

SEQ ID NO: 859181 - DNA, 25 bp, Mus musculus
tgatgctggcatatgcttcatcccc

SEQ ID NO: 859182 - DNA, 25 bp, Mus musculus
tgatgctggcatttgcttcatcccc

SEQ ID NO: 859183 - DNA, 25 bp, Mus musculus
tgatgctggtttctgagcttttgtt

SEQ ID NO: 859184 - DNA, 25 bp, Mus musculus
tgatgctggtttgtgagcttttgtt

SEQ ID NO: 859185 - DNA, 25 bp, Mus musculus
tgatgctgtaaaactctatggcttt

SEQ ID NO: 859186 - DNA, 25 bp, Mus musculus
tgatgctgtaaatctctatggcttt

SEQ ID NO: 859187 - DNA, 25 bp, Mus musculus
tgatgctgtcaacctgagccacgtg

SEQ ID NO: 859188 - DNA, 25 bp, Mus musculus
tgatgctgtcaagctgagccacgtg

SEQ ID NO: 859189 - DNA, 25 bp, Mus musculus
tgatgctgtcttccacaaagtgatc

SEQ ID NO: 859190 - DNA, 25 bp, Mus musculus
tgatgctgtcttgcacaaagtgatc

SEQ ID NO: 859191 - DNA, 25 bp, Mus musculus
tgatgctgtgtaagccaactgccct

SEQ ID NO: 859192 - DNA, 25 bp, Mus musculus
tgatgctgtgtatgccaactgccct

SEQ ID NO: 859193 - DNA, 25 bp, Mus musculus
tgatgctgtttcctcttgttagccc

SEQ ID NO: 859194 - DNA, 25 bp, Mus musculus
tgatgctgtttcgtcttgttagccc

SEQ ID NO: 859195 - DNA, 25 bp, Mus musculus
tgatgcttaactctgtgggctcgta

SEQ ID NO: 859196 - DNA, 25 bp, Mus musculus
tgatgcttaactgtgtgggctcgta

SEQ ID NO: 859197 - DNA, 25 bp, Mus musculus
tgatgcttacacaggtctcttaggt

SEQ ID NO: 859198 - DNA, 25 bp, Mus musculus
tgatgcttacactggtctcttaggt

SEQ ID NO: 859199 - DNA, 25 bp, Mus musculus
tgatgcttataaccaaatactgctg

SEQ ID NO: 859200 - DNA, 25 bp, Mus musculus
tgatgcttataagcaaatactgctg

SEQ ID NO: 859201 - DNA, 25 bp, Mus musculus
tgatgcttatagctctctggctggc

SEQ ID NO: 859202 - DNA, 25 bp, Mus musculus
tgatgcttataggtctctggctggc

SEQ ID NO: 859203 - DNA, 25 bp, Mus musculus
tgatgcttatatactgccactacag

SEQ ID NO: 859204 - DNA, 25 bp, Mus musculus
tgatgcttatattctgccactacag

SEQ ID NO: 859205 - DNA, 25 bp, Mus musculus
tgatgcttcaaacaacacctcctgg

SEQ ID NO: 859206 - DNA, 25 bp, Mus musculus
tgatgcttcaaacaatacctcctgg

SEQ ID NO: 859207 - DNA, 25 bp, Mus musculus
tgatgcttcaaagaacacctcctgg

SEQ ID NO: 859208 - DNA, 25 bp, Mus musculus
tgatgcttcaaagaatacctcctgg

SEQ ID NO: 859209 - DNA, 25 bp, Mus musculus
tgatgcttcaccaaacgatccaaca

SEQ ID NO: 859210 - DNA, 25 bp, Mus musculus
tgatgcttcaccattcctttaataa

SEQ ID NO: 859211 - DNA, 25 bp, Mus musculus
tgatgcttcacctaacgatccaaca

SEQ ID NO: 859212 - DNA, 25 bp, Mus musculus
tgatgcttcacctttcctttaataa

SEQ ID NO: 859213 - DNA, 25 bp, Mus musculus
tgatgcttcagtcgctaagtgtgct

SEQ ID NO: 859214 - DNA, 25 bp, Mus musculus
tgatgcttcagtggctaagtgtgct

SEQ ID NO: 859215 - DNA, 25 bp, Mus musculus
tgatgcttcatcagacatgcaggtg

SEQ ID NO: 859216 - DNA, 25 bp, Mus musculus
tgatgcttcatctgacatgcaggtg

SEQ ID NO: 859217 - DNA, 25 bp, Mus musculus
tgatgcttccatatcacagttcctg

SEQ ID NO: 859218 - DNA, 25 bp, Mus musculus
tgatgcttccatttcacagttcctg

SEQ ID NO: 859219 - DNA, 25 bp, Mus musculus
tgatgcttctttctcatgtcaggca

SEQ ID NO: 859220 - DNA, 25 bp, Mus musculus
tgatgcttctttgtcatgtcaggca

SEQ ID NO: 859221 - DNA, 25 bp, Mus musculus
tgatgcttgcatacgcagagccctg

SEQ ID NO: 859222 - DNA, 25 bp, Mus musculus
tgatgcttgcattcgcagagccctg

SEQ ID NO: 859223 - DNA, 25 bp, Mus musculus
tgatgcttggagagaccaaccccgc

SEQ ID NO: 859224 - DNA, 25 bp, Mus musculus
tgatgcttggagtgaccaaccccgc

SEQ ID NO: 859225 - DNA, 25 bp, Mus musculus
tgatgcttgtcaatgccccgtgttc

SEQ ID NO: 859226 - DNA, 25 bp, Mus musculus
tgatgcttgtcattgccccgtgttc

SEQ ID NO: 859227 - DNA, 25 bp, Mus musculus
tgatgcttgttgagacttggcctat

SEQ ID NO: 859228 - DNA, 25 bp, Mus musculus
tgatgcttgttgtgacttggcctat

SEQ ID NO: 859229 - DNA, 25 bp, Mus musculus
tgatgctttcagatgatgtaatcca

SEQ ID NO: 859230 - DNA, 25 bp, Mus musculus
tgatgctttcagttgatgtaatcca

SEQ ID NO: 859231 - DNA, 25 bp, Mus musculus
tgatgcttttacagtcctggaagaa

SEQ ID NO: 859232 - DNA, 25 bp, Mus musculus
tgatgcttttactgtcctggaagaa

SEQ ID NO: 859233 - DNA, 25 bp, Mus musculus
tgatgcttttggaccagagcggcaa

SEQ ID NO: 859234 - DNA, 25 bp, Mus musculus
tgatgcttttggtccagagcggcaa

SEQ ID NO: 859235 - DNA, 25 bp, Mus musculus
tgatgctttttgatggcttcccctt

SEQ ID NO: 859236 - DNA, 25 bp, Mus musculus
tgatgctttttgttggcttcccctt

SEQ ID NO: 859237 - DNA, 25 bp, Mus musculus
tgatgcttttttcctgtctggccat

SEQ ID NO: 859238 - DNA, 25 bp, Mus musculus
tgatgcttttttgctgtctggccat

SEQ ID NO: 859239 - DNA, 25 bp, Mus musculus
tgatggaaagaaccctgagccttgg

SEQ ID NO: 859240 - DNA, 25 bp, Mus musculus
tgatggaaagaagcctgagccttgg

SEQ ID NO: 859241 - DNA, 25 bp, Mus musculus
tgatggaaatcaagacccgagaggt

SEQ ID NO: 859242 - DNA, 25 bp, Mus musculus
tgatggaaatcatgacccgagaggt

SEQ ID NO: 859243 - DNA, 25 bp, Mus musculus
tgatggaaatctcgtgctggacccc

SEQ ID NO: 859244 - DNA, 25 bp, Mus musculus
tgatggaaatctggtgctggacccc

SEQ ID NO: 859245 - DNA, 25 bp, Mus musculus
tgatggaacagcctcctagggagat

SEQ ID NO: 859246 - DNA, 25 bp, Mus musculus
tgatggaacagcgtcctagggagat

SEQ ID NO: 859247 - DNA, 25 bp, Mus musculus
tgatggaacatcagggctccctaca

SEQ ID NO: 859248 - DNA, 25 bp, Mus musculus
tgatggaacatctgggctccctaca

SEQ ID NO: 859249 - DNA, 25 bp, Mus musculus
tgatggaacttcacgcaggctgctg

SEQ ID NO: 859250 - DNA, 25 bp, Mus musculus
tgatggaacttctcgcaggctgctg

SEQ ID NO: 859251 - DNA, 25 bp, Mus musculus
tgatggaacttgcagcttccagttc

SEQ ID NO: 859252 - DNA, 25 bp, Mus musculus
tgatggaacttggagcttccagttc

SEQ ID NO: 859253 - DNA, 25 bp, Mus musculus
tgatggaagcttcgttacccaccct

SEQ ID NO: 859254 - DNA, 25 bp, Mus musculus
tgatggaagcttggttacccaccct

SEQ ID NO: 859255 - DNA, 25 bp, Mus musculus
tgatggaaggctacaagtggcactt

SEQ ID NO: 859256 - DNA, 25 bp, Mus musculus
tgatggaaggcttcaagtggcactt

SEQ ID NO: 859257 - DNA, 25 bp, Mus musculus
tgatggaagggcattgacgtgtcat

SEQ ID NO: 859258 - DNA, 25 bp, Mus musculus
tgatggaagggctttgacgtgtcat

SEQ ID NO: 859259 - DNA, 25 bp, Mus musculus
tgatggaagtaacacctaggtcata

SEQ ID NO: 859260 - DNA, 25 bp, Mus musculus
tgatggaagtaagacctaggtcata

SEQ ID NO: 859261 - DNA, 25 bp, Mus musculus
tgatggaatgcccttgtctacacct

SEQ ID NO: 859262 - DNA, 25 bp, Mus musculus
tgatggaatgccgttgtctacacct

SEQ ID NO: 859263 - DNA, 25 bp, Mus musculus
tgatggaattgtacagagacctgca

SEQ ID NO: 859264 - DNA, 25 bp, Mus musculus
tgatggaattgttcagagacctgca

SEQ ID NO: 859265 - DNA, 25 bp, Mus musculus
tgatggacacccagggactggacat

SEQ ID NO: 859266 - DNA, 25 bp, Mus musculus
tgatggacaccctgggactggacat

SEQ ID NO: 859267 - DNA, 25 bp, Mus musculus
tgatggacatccaggcttctactgt

SEQ ID NO: 859268 - DNA, 25 bp, Mus musculus
tgatggacatcctggcttctactgt

SEQ ID NO: 859269 - DNA, 25 bp, Mus musculus
tgatggacatcgacccggtggacaa

SEQ ID NO: 859270 - DNA, 25 bp, Mus musculus
tgatggacatcgtcccggtggacaa

SEQ ID NO: 859271 - DNA, 25 bp, Mus musculus
tgatggaccacaccaagtccccttt

SEQ ID NO: 859272 - DNA, 25 bp, Mus musculus
tgatggaccacagcaagtccccttt

SEQ ID NO: 859273 - DNA, 25 bp, Mus musculus
tgatggaccagacctttcagtgtga

SEQ ID NO: 859274 - DNA, 25 bp, Mus musculus
tgatggaccagagctttcagtgtga

SEQ ID NO: 859275 - DNA, 25 bp, Mus musculus
tgatggacccgtccttctgtgagga

SEQ ID NO: 859276 - DNA, 25 bp, Mus musculus
tgatggacccgtgcttctgtgagga

SEQ ID NO: 859277 - DNA, 25 bp, Mus musculus
tgatggacgaacacgcccgaggaac

SEQ ID NO: 859278 - DNA, 25 bp, Mus musculus
tgatggacgaactcgcccgaggaac

SEQ ID NO: 859279 - DNA, 25 bp, Mus musculus
tgatggacgcgtctgcactgcttac

SEQ ID NO: 859280 - DNA, 25 bp, Mus musculus
tgatggacgcgtgtgcactgcttac

SEQ ID NO: 859281 - DNA, 25 bp, Mus musculus
tgatggacggacactgattctgcag

SEQ ID NO: 859282 - DNA, 25 bp, Mus musculus
tgatggacggactctgattctgcag

SEQ ID NO: 859283 - DNA, 25 bp, Mus musculus
tgatggactgtcactggcagcccct

SEQ ID NO: 859284 - DNA, 25 bp, Mus musculus
tgatggactgtctctggcagcccct

SEQ ID NO: 859285 - DNA, 25 bp, Mus musculus
tgatggactgtgcaatttgggctaa

SEQ ID NO: 859286 - DNA, 25 bp, Mus musculus
tgatggactgtggaatttgggctaa

SEQ ID NO: 859287 - DNA, 25 bp, Mus musculus
tgatggacttacattcccagtgtgc

SEQ ID NO: 859288 - DNA, 25 bp, Mus musculus
tgatggacttactttcccagtgtgc

SEQ ID NO: 859289 - DNA, 25 bp, Mus musculus
tgatggagaagcacacctgacaccc

SEQ ID NO: 859290 - DNA, 25 bp, Mus musculus
tgatggagaagctcacctgacaccc

SEQ ID NO: 859291 - DNA, 25 bp, Mus musculus
tgatggagagaactgatttccagaa

SEQ ID NO: 859292 - DNA, 25 bp, Mus musculus
tgatggagagaagtgatttccagaa

SEQ ID NO: 859293 - DNA, 25 bp, Mus musculus
tgatggagatgtaccccgagcacgg

SEQ ID NO: 859294 - DNA, 25 bp, Mus musculus
tgatggagatgttccccgagcacgg

SEQ ID NO: 859295 - DNA, 25 bp, Mus musculus
tgatggagcctcaatcagcgtccag

SEQ ID NO: 859296 - DNA, 25 bp, Mus musculus
tgatggagcctctatcagcgtccag

SEQ ID NO: 859297 - DNA, 25 bp, Mus musculus
tgatggagctccagacttaccgcta

SEQ ID NO: 859298 - DNA, 25 bp, Mus musculus
tgatggagctcctgacttaccgcta

SEQ ID NO: 859299 - DNA, 25 bp, Mus musculus
tgatggaggcgcaccctcaaataat

SEQ ID NO: 859300 - DNA, 25 bp, Mus musculus
tgatggaggcgctccctcaaataat

SEQ ID NO: 859301 - DNA, 25 bp, Mus musculus
tgatggaggtacacccttacctgtc

SEQ ID NO: 859302 - DNA, 25 bp, Mus musculus
tgatggaggtactcccttacctgtc

SEQ ID NO: 859303 - DNA, 25 bp, Mus musculus
tgatggagtagcattccatgctcct

SEQ ID NO: 859304 - DNA, 25 bp, Mus musculus
tgatggagtagctttccatgctcct

SEQ ID NO: 859305 - DNA, 25 bp, Mus musculus
tgatggagtctcagggaggcttact

SEQ ID NO: 859306 - DNA, 25 bp, Mus musculus
tgatggagtctctgggaggcttact

SEQ ID NO: 859307 - DNA, 25 bp, Mus musculus
tgatggagtgtgaacgtccctgcca

SEQ ID NO: 859308 - DNA, 25 bp, Mus musculus
tgatggagtgtgtacgtccctgcca

SEQ ID NO: 859309 - DNA, 25 bp, Mus musculus
tgatggagttacagctccagctcca

SEQ ID NO: 859310 - DNA, 25 bp, Mus musculus
tgatggagttactgctccagctcca

SEQ ID NO: 859311 - DNA, 25 bp, Mus musculus
tgatggataactcattctgtgtggt

SEQ ID NO: 859312 - DNA, 25 bp, Mus musculus
tgatggataactgattctgtgtggt

SEQ ID NO: 859313 - DNA, 25 bp, Mus musculus
tgatggatacaacgcctccagacca

SEQ ID NO: 859314 - DNA, 25 bp, Mus musculus
tgatggatacaaggcctccagacca

SEQ ID NO: 859315 - DNA, 25 bp, Mus musculus
tgatggatatgtcagtgctcaataa

SEQ ID NO: 859316 - DNA, 25 bp, Mus musculus
tgatggatatgtgagtgctcaataa

SEQ ID NO: 859317 - DNA, 25 bp, Mus musculus
tgatggatccctattttattttgtg

SEQ ID NO: 859318 - DNA, 25 bp, Mus musculus
tgatggatcccttttttattttgtg

SEQ ID NO: 859319 - DNA, 25 bp, Mus musculus
tgatggatcgccatcagagagtaaa

SEQ ID NO: 859320 - DNA, 25 bp, Mus musculus
tgatggatcgccttcagagagtaaa

SEQ ID NO: 859321 - DNA, 25 bp, Mus musculus
tgatggattccaaccttctttttta

SEQ ID NO: 859322 - DNA, 25 bp, Mus musculus
tgatggattccatccttctttttta

SEQ ID NO: 859323 - DNA, 25 bp, Mus musculus
tgatggattcctcagcacatttcac

SEQ ID NO: 859324 - DNA, 25 bp, Mus musculus
tgatggattcctgagcacatttcac

SEQ ID NO: 859325 - DNA, 25 bp, Mus musculus
tgatggattgagcaggccttcccgc

SEQ ID NO: 859326 - DNA, 25 bp, Mus musculus
tgatggattgaggaggccttcccgc

SEQ ID NO: 859327 - DNA, 25 bp, Mus musculus
tgatggattggccaaaggccccttc

SEQ ID NO: 859328 - DNA, 25 bp, Mus musculus
tgatggattggcgaaaggccccttc

SEQ ID NO: 859329 - DNA, 25 bp, Mus musculus
tgatggattgtgctgtggtttatcc

SEQ ID NO: 859330 - DNA, 25 bp, Mus musculus
tgatggattgtggtgtggtttatcc

SEQ ID NO: 859331 - DNA, 25 bp, Mus musculus
tgatggattttgagacgttcctgcc

SEQ ID NO: 859332 - DNA, 25 bp, Mus musculus
tgatggattttgtgacgttcctgcc

SEQ ID NO: 859333 - DNA, 25 bp, Mus musculus
tgatggcaaaggacagctggaactt

SEQ ID NO: 859334 - DNA, 25 bp, Mus musculus
tgatggcaaaggtcagctggaactt

SEQ ID NO: 859335 - DNA, 25 bp, Mus musculus
tgatggcaacctctacagtagcctg

SEQ ID NO: 859336 - DNA, 25 bp, Mus musculus
tgatggcaacctgtacagtagcctg

SEQ ID NO: 859337 - DNA, 25 bp, Mus musculus
tgatggcaagctaaagaagagaggc

SEQ ID NO: 859338 - DNA, 25 bp, Mus musculus
tgatggcaagcttaagaagagaggc

SEQ ID NO: 859339 - DNA, 25 bp, Mus musculus
tgatggcaagtccttttcttcctta

SEQ ID NO: 859340 - DNA, 25 bp, Mus musculus
tgatggcaagtcgttttcttcctta

SEQ ID NO: 859341 - DNA, 25 bp, Mus musculus
tgatggcacccaactgtcattccag

SEQ ID NO: 859342 - DNA, 25 bp, Mus musculus
tgatggcacccatctgtcattccag

SEQ ID NO: 859343 - DNA, 25 bp, Mus musculus
tgatggcaccggagccgctagagaa

SEQ ID NO: 859344 - DNA, 25 bp, Mus musculus
tgatggcaccggtgccgctagagaa

SEQ ID NO: 859345 - DNA, 25 bp, Mus musculus
tgatggcactggagttcctggttgc

SEQ ID NO: 859346 - DNA, 25 bp, Mus musculus
tgatggcactggtgttcctggttgc

SEQ ID NO: 859347 - DNA, 25 bp, Mus musculus
tgatggcacttgatagattggtaaa

SEQ ID NO: 859348 - DNA, 25 bp, Mus musculus
tgatggcacttgttagattggtaaa

SEQ ID NO: 859349 - DNA, 25 bp, Mus musculus
tgatggcagagccttgtttttctcc

SEQ ID NO: 859350 - DNA, 25 bp, Mus musculus
tgatggcagagcgttgtttttctcc

SEQ ID NO: 859351 - DNA, 25 bp, Mus musculus
tgatggcagcagctagctgtgtaaa

SEQ ID NO: 859352 - DNA, 25 bp, Mus musculus
tgatggcagcaggtagctgtgtaaa

SEQ ID NO: 859353 - DNA, 25 bp, Mus musculus
tgatggcagccgaggtgctttcaga

SEQ ID NO: 859354 - DNA, 25 bp, Mus musculus
tgatggcagccgtggtgctttcaga

SEQ ID NO: 859355 - DNA, 25 bp, Mus musculus
tgatggcaggcactacatgtcaccc

SEQ ID NO: 859356 - DNA, 25 bp, Mus musculus
tgatggcaggcagtacatgtcaccc

SEQ ID NO: 859357 - DNA, 25 bp, Mus musculus
tgatggcagtccaagctgctggcgc

SEQ ID NO: 859358 - DNA, 25 bp, Mus musculus
tgatggcagtcctagctgctggcgc

SEQ ID NO: 859359 - DNA, 25 bp, Mus musculus
tgatggcatgtactgctttgtcggc

SEQ ID NO: 859360 - DNA, 25 bp, Mus musculus
tgatggcatgtagtgctttgtcggc

SEQ ID NO: 859361 - DNA, 25 bp, Mus musculus
tgatggcatgtcatcagatgtccct

SEQ ID NO: 859362 - DNA, 25 bp, Mus musculus
tgatggcatgtcttcagatgtccct

SEQ ID NO: 859363 - DNA, 25 bp, Mus musculus
tgatggccaaacaccccagaaacgt

SEQ ID NO: 859364 - DNA, 25 bp, Mus musculus
tgatggccaaactccccagaaacgt

SEQ ID NO: 859365 - DNA, 25 bp, Mus musculus
tgatggccaacaaaactaggatttt

SEQ ID NO: 859366 - DNA, 25 bp, Mus musculus
tgatggccaacataactaggatttt

SEQ ID NO: 859367 - DNA, 25 bp, Mus musculus
tgatggccaattccagttcactggt

SEQ ID NO: 859368 - DNA, 25 bp, Mus musculus
tgatggccaattgcagttcactggt

SEQ ID NO: 859369 - DNA, 25 bp, Mus musculus
tgatggccacataccttgctgaggt

SEQ ID NO: 859370 - DNA, 25 bp, Mus musculus
tgatggccacattccttgctgaggt

SEQ ID NO: 859371 - DNA, 25 bp, Mus musculus
tgatggccactgcttaccgtaagga

SEQ ID NO: 859372 - DNA, 25 bp, Mus musculus
tgatggccactggttaccgtaagga

SEQ ID NO: 859373 - DNA, 25 bp, Mus musculus
tgatggccagagacctgtgaccgtg

SEQ ID NO: 859374 - DNA, 25 bp, Mus musculus
tgatggccagagtcctgtgaccgtg

SEQ ID NO: 859375 - DNA, 25 bp, Mus musculus
tgatggccagtgcatatcccttaca

SEQ ID NO: 859376 - DNA, 25 bp, Mus musculus
tgatggccagtggatatcccttaca

SEQ ID NO: 859377 - DNA, 25 bp, Mus musculus
tgatggccatcactacttcaacact

SEQ ID NO: 859378 - DNA, 25 bp, Mus musculus
tgatggccatcagtacttcaacact

SEQ ID NO: 859379 - DNA, 25 bp, Mus musculus
tgatggccatgtctgataccccaat

SEQ ID NO: 859380 - DNA, 25 bp, Mus musculus
tgatggccatgtgtgataccccaat

SEQ ID NO: 859381 - DNA, 25 bp, Mus musculus
tgatggccccatcaagggtaactta

SEQ ID NO: 859382 - DNA, 25 bp, Mus musculus
tgatggccccatgaagggtaactta

SEQ ID NO: 859383 - DNA, 25 bp, Mus musculus
tgatggcccctgaatttatgagtga

SEQ ID NO: 859384 - DNA, 25 bp, Mus musculus
tgatggcccctgtatttatgagtga

SEQ ID NO: 859385 - DNA, 25 bp, Mus musculus
tgatggccctcgaaggacactttct

SEQ ID NO: 859386 - DNA, 25 bp, Mus musculus
tgatggccctcgtaggacactttct

SEQ ID NO: 859387 - DNA, 25 bp, Mus musculus
tgatggccctggagaccctacagta

SEQ ID NO: 859388 - DNA, 25 bp, Mus musculus
tgatggccctggtgaccctacagta

SEQ ID NO: 859389 - DNA, 25 bp, Mus musculus
tgatggccctttccacataccatag

SEQ ID NO: 859390 - DNA, 25 bp, Mus musculus
tgatggccctttgcacataccatag

SEQ ID NO: 859391 - DNA, 25 bp, Mus musculus
tgatggccgactaaatggttttgtg

SEQ ID NO: 859392 - DNA, 25 bp, Mus musculus
tgatggccgacttaatggttttgtg

SEQ ID NO: 859393 - DNA, 25 bp, Mus musculus
tgatggccgccacgctgtgcttgtc

SEQ ID NO: 859394 - DNA, 25 bp, Mus musculus
tgatggccgccaggctgtgcttgtc

SEQ ID NO: 859395 - DNA, 25 bp, Mus musculus
tgatggccgggcacttcatcttcag

SEQ ID NO: 859396 - DNA, 25 bp, Mus musculus
tgatggccgggctcttcatcttcag

SEQ ID NO: 859397 - DNA, 25 bp, Mus musculus
tgatggcggattagccatgcccagt

SEQ ID NO: 859398 - DNA, 25 bp, Mus musculus
tgatggcggatttgccatgcccagt

SEQ ID NO: 859399 - DNA, 25 bp, Mus musculus
tgatggcgtcacagctgactgccca

SEQ ID NO: 859400 - DNA, 25 bp, Mus musculus
tgatggcgtcactgctgactgccca

SEQ ID NO: 859401 - DNA, 25 bp, Mus musculus
tgatggcgttccagttcccaggact

SEQ ID NO: 859402 - DNA, 25 bp, Mus musculus
tgatggcgttcctgttcccaggact

SEQ ID NO: 859403 - DNA, 25 bp, Mus musculus
tgatggcgtttcaggttgggcccca

SEQ ID NO: 859404 - DNA, 25 bp, Mus musculus
tgatggcgtttctggttgggcccca

SEQ ID NO: 859405 - DNA, 25 bp, Mus musculus
tgatggcgttttactgttccctaga

SEQ ID NO: 859406 - DNA, 25 bp, Mus musculus
tgatggcgtttttctgttccctaga

SEQ ID NO: 859407 - DNA, 25 bp, Mus musculus
tgatggctagccctgaagatcagtc

SEQ ID NO: 859408 - DNA, 25 bp, Mus musculus
tgatggctagccgtgaagatcagtc

SEQ ID NO: 859409 - DNA, 25 bp, Mus musculus
tgatggctatgtcggttggctaatt

SEQ ID NO: 859410 - DNA, 25 bp, Mus musculus
tgatggctatgtgggttggctaatt

SEQ ID NO: 859411 - DNA, 25 bp, Mus musculus
tgatggctcctgaccatgaagcagt

SEQ ID NO: 859412 - DNA, 25 bp, Mus musculus
tgatggctcctgtccatgaagcagt

SEQ ID NO: 859413 - DNA, 25 bp, Mus musculus
tgatggctgcacatgatgattcatt

SEQ ID NO: 859414 - DNA, 25 bp, Mus musculus
tgatggctgcacttgatgattcatt

SEQ ID NO: 859415 - DNA, 25 bp, Mus musculus
tgatggctgcccagcgacaggccac

SEQ ID NO: 859416 - DNA, 25 bp, Mus musculus
tgatggctgccctgcgacaggccac

SEQ ID NO: 859417 - DNA, 25 bp, Mus musculus
tgatggctgcttagcctgcaccgtg

SEQ ID NO: 859418 - DNA, 25 bp, Mus musculus
tgatggctgctttgcctgcaccgtg

SEQ ID NO: 859419 - DNA, 25 bp, Mus musculus
tgatggctggacagacctgcaggaa

SEQ ID NO: 859420 - DNA, 25 bp, Mus musculus
tgatggctggactgacctgcaggaa

SEQ ID NO: 859421 - DNA, 25 bp, Mus musculus
tgatggctgggaccgtccctcatct

SEQ ID NO: 859422 - DNA, 25 bp, Mus musculus
tgatggctgggagcgtccctcatct

SEQ ID NO: 859423 - DNA, 25 bp, Mus musculus
tgatggctgtacaagagactcctgc

SEQ ID NO: 859424 - DNA, 25 bp, Mus musculus
tgatggctgtactagagactcctgc

SEQ ID NO: 859425 - DNA, 25 bp, Mus musculus
tgatggctgtctccctacagaaaat

SEQ ID NO: 859426 - DNA, 25 bp, Mus musculus
tgatggctgtctgcctacagaaaat

SEQ ID NO: 859427 - DNA, 25 bp, Mus musculus
tgatggctgtgaagcccgatactgg

SEQ ID NO: 859428 - DNA, 25 bp, Mus musculus
tgatggctgtgatgcccgatactgg

SEQ ID NO: 859429 - DNA, 25 bp, Mus musculus
tgatggcttacccagcagggcctaa

SEQ ID NO: 859430 - DNA, 25 bp, Mus musculus
tgatggcttaccgagcagggcctaa

SEQ ID NO: 859431 - DNA, 25 bp, Mus musculus
tgatggcttgtgagaagcagctgca

SEQ ID NO: 859432 - DNA, 25 bp, Mus musculus
tgatggcttgtgtgaagcagctgca

SEQ ID NO: 859433 - DNA, 25 bp, Mus musculus
tgatgggaactcagcttttaaaaaa

SEQ ID NO: 859434 - DNA, 25 bp, Mus musculus
tgatgggaactctgcttttaaaaaa

SEQ ID NO: 859435 - DNA, 25 bp, Mus musculus
tgatgggaaggtccacatccttggt

SEQ ID NO: 859436 - DNA, 25 bp, Mus musculus
tgatgggaaggtgcacatccttggt

SEQ ID NO: 859437 - DNA, 25 bp, Mus musculus
tgatgggacagacctttactccctg

SEQ ID NO: 859438 - DNA, 25 bp, Mus musculus
tgatgggacagacttcccgagcatc

SEQ ID NO: 859439 - DNA, 25 bp, Mus musculus
tgatgggacagagctttactccctg

SEQ ID NO: 859440 - DNA, 25 bp, Mus musculus
tgatgggacagagttcccgagcatc

SEQ ID NO: 859441 - DNA, 25 bp, Mus musculus
tgatgggacattaccacagtactga

SEQ ID NO: 859442 - DNA, 25 bp, Mus musculus
tgatgggacatttccacagtactga

SEQ ID NO: 859443 - DNA, 25 bp, Mus musculus
tgatgggaccgcacttgggctcgca

SEQ ID NO: 859444 - DNA, 25 bp, Mus musculus
tgatgggaccgctcttgggctcgca

SEQ ID NO: 859445 - DNA, 25 bp, Mus musculus
tgatgggactccacatttggctggc

SEQ ID NO: 859446 - DNA, 25 bp, Mus musculus
tgatgggactcctcatttggctggc

SEQ ID NO: 859447 - DNA, 25 bp, Mus musculus
tgatgggagctgagacagccctttc

SEQ ID NO: 859448 - DNA, 25 bp, Mus musculus
tgatgggagctgtgacagccctttc

SEQ ID NO: 859449 - DNA, 25 bp, Mus musculus
tgatgggagtcaaggaccctttggt

SEQ ID NO: 859450 - DNA, 25 bp, Mus musculus
tgatgggagtcatggaccctttggt

SEQ ID NO: 859451 - DNA, 25 bp, Mus musculus
tgatgggagtctcatgttccagcaa

SEQ ID NO: 859452 - DNA, 25 bp, Mus musculus
tgatgggagtctgatgttccagcaa

SEQ ID NO: 859453 - DNA, 25 bp, Mus musculus
tgatgggatcacacacaccagcgga

SEQ ID NO: 859454 - DNA, 25 bp, Mus musculus
tgatgggatcactcacaccagcgga

SEQ ID NO: 859455 - DNA, 25 bp, Mus musculus
tgatgggcaacaccttcttttaggc

SEQ ID NO: 859456 - DNA, 25 bp, Mus musculus
tgatgggcaacagcttcttttaggc

SEQ ID NO: 859457 - DNA, 25 bp, Mus musculus
tgatgggcacaaactcctactttct

SEQ ID NO: 859458 - DNA, 25 bp, Mus musculus
tgatgggcacaatctcctactttct

SEQ ID NO: 859459 - DNA, 25 bp, Mus musculus
tgatgggcagcgattaagttactat

SEQ ID NO: 859460 - DNA, 25 bp, Mus musculus
tgatgggcagcgtttaagttactat

SEQ ID NO: 859461 - DNA, 25 bp, Mus musculus
tgatgggcatgacaccggctttgta

SEQ ID NO: 859462 - DNA, 25 bp, Mus musculus
tgatgggcatgagaccggctttgta

SEQ ID NO: 859463 - DNA, 25 bp, Mus musculus
tgatgggccatgctttctgctggaa

SEQ ID NO: 859464 - DNA, 25 bp, Mus musculus
tgatgggccatggtttctgctggaa

SEQ ID NO: 859465 - DNA, 25 bp, Mus musculus
tgatgggcccagaactagcagtgcc

SEQ ID NO: 859466 - DNA, 25 bp, Mus musculus
tgatgggcccagtactagcagtgcc

SEQ ID NO: 859467 - DNA, 25 bp, Mus musculus
tgatgggcccatatcaaggtgtccc

SEQ ID NO: 859468 - DNA, 25 bp, Mus musculus
tgatgggcccatcctatgtatccgg

SEQ ID NO: 859469 - DNA, 25 bp, Mus musculus
tgatgggcccatgctatgtatccgg

SEQ ID NO: 859470 - DNA, 25 bp, Mus musculus
tgatgggcccatttcaaggtgtccc

SEQ ID NO: 859471 - DNA, 25 bp, Mus musculus
tgatgggcccttcactgagcaggac

SEQ ID NO: 859472 - DNA, 25 bp, Mus musculus
tgatgggcccttgactgagcaggac

SEQ ID NO: 859473 - DNA, 25 bp, Mus musculus
tgatgggcgtttctgaccacgtgaa

SEQ ID NO: 859474 - DNA, 25 bp, Mus musculus
tgatgggcgtttgtgaccacgtgaa

SEQ ID NO: 859475 - DNA, 25 bp, Mus musculus
tgatgggctaataaaggactgctta

SEQ ID NO: 859476 - DNA, 25 bp, Mus musculus
tgatgggctaattaaggactgctta

SEQ ID NO: 859477 - DNA, 25 bp, Mus musculus
tgatgggctattacctgagcaacca

SEQ ID NO: 859478 - DNA, 25 bp, Mus musculus
tgatgggctatttcctgagcaacca

SEQ ID NO: 859479 - DNA, 25 bp, Mus musculus
tgatgggctccactacacggtaata

SEQ ID NO: 859480 - DNA, 25 bp, Mus musculus
tgatgggctccagtacacggtaata

SEQ ID NO: 859481 - DNA, 25 bp, Mus musculus
tgatgggctgccagatctgggacac

SEQ ID NO: 859482 - DNA, 25 bp, Mus musculus
tgatgggctgcctgatctgggacac

SEQ ID NO: 859483 - DNA, 25 bp, Mus musculus
tgatgggggcatatacctctaatcc

SEQ ID NO: 859484 - DNA, 25 bp, Mus musculus
tgatgggggcatttacctctaatcc

SEQ ID NO: 859485 - DNA, 25 bp, Mus musculus
tgatgggtaccaagactccgttgag

SEQ ID NO: 859486 - DNA, 25 bp, Mus musculus
tgatgggtaccatgactccgttgag

SEQ ID NO: 859487 - DNA, 25 bp, Mus musculus
tgatgggtcaccaggaaagaagctg

SEQ ID NO: 859488 - DNA, 25 bp, Mus musculus
tgatgggtcacctggaaagaagctg

SEQ ID NO: 859489 - DNA, 25 bp, Mus musculus
tgatgggtcccaagctgctggcaga

SEQ ID NO: 859490 - DNA, 25 bp, Mus musculus
tgatgggtcccatgctgctggcaga

SEQ ID NO: 859491 - DNA, 25 bp, Mus musculus
tgatgggtctgcctttctttctgga

SEQ ID NO: 859492 - DNA, 25 bp, Mus musculus
tgatgggtctgcgtttctttctgga

SEQ ID NO: 859493 - DNA, 25 bp, Mus musculus
tgatgggtgaccattgtgtactgtg

SEQ ID NO: 859494 - DNA, 25 bp, Mus musculus
tgatgggtgacctttgtgtactgtg

SEQ ID NO: 859495 - DNA, 25 bp, Mus musculus
tgatgggttccacatctgtccattt

SEQ ID NO: 859496 - DNA, 25 bp, Mus musculus
tgatgggttccagatctgtccattt

SEQ ID NO: 859497 - DNA, 25 bp, Mus musculus
tgatgggtttccacatcacacctgt

SEQ ID NO: 859498 - DNA, 25 bp, Mus musculus
tgatgggtttcctcatcacacctgt

SEQ ID NO: 859499 - DNA, 25 bp, Mus musculus
tgatggtaaagcatgccctttaata

SEQ ID NO: 859500 - DNA, 25 bp, Mus musculus
tgatggtaaagcttgccctttaata

SEQ ID NO: 859501 - DNA, 25 bp, Mus musculus
tgatggtaccttcgctgtcttttaa

SEQ ID NO: 859502 - DNA, 25 bp, Mus musculus
tgatggtaccttggctgtcttttaa

SEQ ID NO: 859503 - DNA, 25 bp, Mus musculus
tgatggtagtcgctaccgggacctc

SEQ ID NO: 859504 - DNA, 25 bp, Mus musculus
tgatggtagtcggtaccgggacctc

SEQ ID NO: 859505 - DNA, 25 bp, Mus musculus
tgatggtagtggctggcttctttac

SEQ ID NO: 859506 - DNA, 25 bp, Mus musculus
tgatggtagtgggtggcttctttac

SEQ ID NO: 859507 - DNA, 25 bp, Mus musculus
tgatggtattcaagcacaggcctgc

SEQ ID NO: 859508 - DNA, 25 bp, Mus musculus
tgatggtattcatgcacaggcctgc

SEQ ID NO: 859509 - DNA, 25 bp, Mus musculus
tgatggtcacaacccatgcacctta

SEQ ID NO: 859510 - DNA, 25 bp, Mus musculus
tgatggtcacaagccatgcacctta

SEQ ID NO: 859511 - DNA, 25 bp, Mus musculus
tgatggtcaccacaacgctgctgac

SEQ ID NO: 859512 - DNA, 25 bp, Mus musculus
tgatggtcaccagaacgctgctgac

SEQ ID NO: 859513 - DNA, 25 bp, Mus musculus
tgatggtcactaatagtgggtgagt

SEQ ID NO: 859514 - DNA, 25 bp, Mus musculus
tgatggtcactattagtgggtgagt

SEQ ID NO: 859515 - DNA, 25 bp, Mus musculus
tgatggtcatgaatgctaacacagc

SEQ ID NO: 859516 - DNA, 25 bp, Mus musculus
tgatggtcatgattgctaacacagc

SEQ ID NO: 859517 - DNA, 25 bp, Mus musculus
tgatggtccacacggcttccttgca

SEQ ID NO: 859518 - DNA, 25 bp, Mus musculus
tgatggtccacagggcttccttgca

SEQ ID NO: 859519 - DNA, 25 bp, Mus musculus
tgatggtccagaaccttgcgacatg

SEQ ID NO: 859520 - DNA, 25 bp, Mus musculus
tgatggtccagatccttgcgacatg

SEQ ID NO: 859521 - DNA, 25 bp, Mus musculus
tgatggtcccagagcgcacggtgat

SEQ ID NO: 859522 - DNA, 25 bp, Mus musculus
tgatggtcccagtgcgcacggtgat

SEQ ID NO: 859523 - DNA, 25 bp, Mus musculus
tgatggtccgcacatgtcccatgcc

SEQ ID NO: 859524 - DNA, 25 bp, Mus musculus
tgatggtccgcagatgtcccatgcc

SEQ ID NO: 859525 - DNA, 25 bp, Mus musculus
tgatggtctgcgaggaagctctaga

SEQ ID NO: 859526 - DNA, 25 bp, Mus musculus
tgatggtctgcgtggaagctctaga

SEQ ID NO: 859527 - DNA, 25 bp, Mus musculus
tgatggtctgtcatctacctttgaa

SEQ ID NO: 859528 - DNA, 25 bp, Mus musculus
tgatggtctgtcttctacctttgaa

SEQ ID NO: 859529 - DNA, 25 bp, Mus musculus
tgatggtgaaccaggaccttcagct

SEQ ID NO: 859530 - DNA, 25 bp, Mus musculus
tgatggtgaacctggaccttcagct

SEQ ID NO: 859531 - DNA, 25 bp, Mus musculus
tgatggtgacacatctagctctgag

SEQ ID NO: 859532 - DNA, 25 bp, Mus musculus
tgatggtgacacttctagctctgag

SEQ ID NO: 859533 - DNA, 25 bp, Mus musculus
tgatggtgaccaagctagcccctag

SEQ ID NO: 859534 - DNA, 25 bp, Mus musculus
tgatggtgaccacgcccggcttaca

SEQ ID NO: 859535 - DNA, 25 bp, Mus musculus
tgatggtgaccaggcccggcttaca

SEQ ID NO: 859536 - DNA, 25 bp, Mus musculus
tgatggtgaccatgctagcccctag

SEQ ID NO: 859537 - DNA, 25 bp, Mus musculus
tgatggtgactcagatccagcccca

SEQ ID NO: 859538 - DNA, 25 bp, Mus musculus
tgatggtgactctgatccagcccca

SEQ ID NO: 859539 - DNA, 25 bp, Mus musculus
tgatggtgactgagtacagctgtgc

SEQ ID NO: 859540 - DNA, 25 bp, Mus musculus
tgatggtgactgtgtacagctgtgc

SEQ ID NO: 859541 - DNA, 25 bp, Mus musculus
tgatggtgcacaacctggtgcctcc

SEQ ID NO: 859542 - DNA, 25 bp, Mus musculus
tgatggtgcacatcctggtgcctcc

SEQ ID NO: 859543 - DNA, 25 bp, Mus musculus
tgatggtgccatctttctggtaccc

SEQ ID NO: 859544 - DNA, 25 bp, Mus musculus
tgatggtgccatgtttctggtaccc

SEQ ID NO: 859545 - DNA, 25 bp, Mus musculus
tgatggtgctcactgtcacactgaa

SEQ ID NO: 859546 - DNA, 25 bp, Mus musculus
tgatggtgctcagtgtcacactgaa

SEQ ID NO: 859547 - DNA, 25 bp, Mus musculus
tgatggtgctgtcgtctgctttcca

SEQ ID NO: 859548 - DNA, 25 bp, Mus musculus
tgatggtgctgtggtctgctttcca

SEQ ID NO: 859549 - DNA, 25 bp, Mus musculus
tgatggtgcttgaggtccctatatt

SEQ ID NO: 859550 - DNA, 25 bp, Mus musculus
tgatggtgcttgtggtccctatatt

SEQ ID NO: 859551 - DNA, 25 bp, Mus musculus
tgatggtggaacactgtgccggtat

SEQ ID NO: 859552 - DNA, 25 bp, Mus musculus
tgatggtggaactctgtgccggtat

SEQ ID NO: 859553 - DNA, 25 bp, Mus musculus
tgatggtggattactagacctgtca

SEQ ID NO: 859554 - DNA, 25 bp, Mus musculus
tgatggtggatttctagacctgtca

SEQ ID NO: 859555 - DNA, 25 bp, Mus musculus
tgatggtggctaatcaataaaactt

SEQ ID NO: 859556 - DNA, 25 bp, Mus musculus
tgatggtggctattcaataaaactt

SEQ ID NO: 859557 - DNA, 25 bp, Mus musculus
tgatggtgtcgcacaccgtgtgaga

SEQ ID NO: 859558 - DNA, 25 bp, Mus musculus
tgatggtgtcgctcaccgtgtgaga

SEQ ID NO: 859559 - DNA, 25 bp, Mus musculus
tgatggtgtcggatatacacacatt

SEQ ID NO: 859560 - DNA, 25 bp, Mus musculus
tgatggtgtcggttatacacacatt

SEQ ID NO: 859561 - DNA, 25 bp, Mus musculus
tgatggttaccacaagcgacccgac

SEQ ID NO: 859562 - DNA, 25 bp, Mus musculus
tgatggttaccacggacacgtgctc

SEQ ID NO: 859563 - DNA, 25 bp, Mus musculus
tgatggttaccagaagcgacccgac

SEQ ID NO: 859564 - DNA, 25 bp, Mus musculus
tgatggttaccagggacacgtgctc

SEQ ID NO: 859565 - DNA, 25 bp, Mus musculus
tgatggttattcaccgttctcctct

SEQ ID NO: 859566 - DNA, 25 bp, Mus musculus
tgatggttattctccgttctcctct

SEQ ID NO: 859567 - DNA, 25 bp, Mus musculus
tgatggttcactatctcctattgaa

SEQ ID NO: 859568 - DNA, 25 bp, Mus musculus
tgatggttcactttctcctattgaa

SEQ ID NO: 859569 - DNA, 25 bp, Mus musculus
tgatggttcattagccgatctgctc

SEQ ID NO: 859570 - DNA, 25 bp, Mus musculus
tgatggttcattcataaaccccaat

SEQ ID NO: 859571 - DNA, 25 bp, Mus musculus
tgatggttcattgataaaccccaat

SEQ ID NO: 859572 - DNA, 25 bp, Mus musculus
tgatggttcatttgccgatctgctc

SEQ ID NO: 859573 - DNA, 25 bp, Mus musculus
tgatggttccgtacagcgttcattt

SEQ ID NO: 859574 - DNA, 25 bp, Mus musculus
tgatggttccgttcagcgttcattt

SEQ ID NO: 859575 - DNA, 25 bp, Mus musculus
tgatggttctctacacaaggtataa

SEQ ID NO: 859576 - DNA, 25 bp, Mus musculus
tgatggttctcttcacaaggtataa

SEQ ID NO: 859577 - DNA, 25 bp, Mus musculus
tgatggttgctacagcagcactaga

SEQ ID NO: 859578 - DNA, 25 bp, Mus musculus
tgatggttgctagagcagcactaga

SEQ ID NO: 859579 - DNA, 25 bp, Mus musculus
tgatggttggctctgctcagatctt

SEQ ID NO: 859580 - DNA, 25 bp, Mus musculus
tgatggttggctgtgctcagatctt

SEQ ID NO: 859581 - DNA, 25 bp, Mus musculus
tgatggtttcctctatgcagtgggt

SEQ ID NO: 859582 - DNA, 25 bp, Mus musculus
tgatggtttcctgtatgcagtgggt

SEQ ID NO: 859583 - DNA, 25 bp, Mus musculus
tgatggttttacaggccaaggcctt

SEQ ID NO: 859584 - DNA, 25 bp, Mus musculus
tgatggttttactggccaaggcctt

SEQ ID NO: 859585 - DNA, 25 bp, Mus musculus
tgatgtaacatcacttctgcgtgca

SEQ ID NO: 859586 - DNA, 25 bp, Mus musculus
tgatgtaacatctcttctgcgtgca

SEQ ID NO: 859587 - DNA, 25 bp, Mus musculus
tgatgtaagccacggctctgcccag

SEQ ID NO: 859588 - DNA, 25 bp, Mus musculus
tgatgtaagccagggctctgcccag

SEQ ID NO: 859589 - DNA, 25 bp, Mus musculus
tgatgtaatagtctgaacctctttc

SEQ ID NO: 859590 - DNA, 25 bp, Mus musculus
tgatgtaatagtgtgaacctctttc

SEQ ID NO: 859591 - DNA, 25 bp, Mus musculus
tgatgtaatgctattgactccagag

SEQ ID NO: 859592 - DNA, 25 bp, Mus musculus
tgatgtaatgcttttgactccagag

SEQ ID NO: 859593 - DNA, 25 bp, Mus musculus
tgatgtaatgttaccctcttctaat

SEQ ID NO: 859594 - DNA, 25 bp, Mus musculus
tgatgtaatgtttccctcttctaat

SEQ ID NO: 859595 - DNA, 25 bp, Mus musculus
tgatgtaattaccatgtttcatttg

SEQ ID NO: 859596 - DNA, 25 bp, Mus musculus
tgatgtaattacgatgtttcatttg

SEQ ID NO: 859597 - DNA, 25 bp, Mus musculus
tgatgtacacctaggacagcattgt

SEQ ID NO: 859598 - DNA, 25 bp, Mus musculus
tgatgtacaccttggacagcattgt

SEQ ID NO: 859599 - DNA, 25 bp, Mus musculus
tgatgtacactcagctgatgccagc

SEQ ID NO: 859600 - DNA, 25 bp, Mus musculus
tgatgtacactctgctgatgccagc

SEQ ID NO: 859601 - DNA, 25 bp, Mus musculus
tgatgtacatcactgactgcctcag

SEQ ID NO: 859602 - DNA, 25 bp, Mus musculus
tgatgtacatcagtgactgcctcag

SEQ ID NO: 859603 - DNA, 25 bp, Mus musculus
tgatgtaccactctctaggctgtgt

SEQ ID NO: 859604 - DNA, 25 bp, Mus musculus
tgatgtaccactgtctaggctgtgt

SEQ ID NO: 859605 - DNA, 25 bp, Mus musculus
tgatgtacccctacatcttccatat

SEQ ID NO: 859606 - DNA, 25 bp, Mus musculus
tgatgtaccccttcatcttccatat

SEQ ID NO: 859607 - DNA, 25 bp, Mus musculus
tgatgtactaataacacccatgcat

SEQ ID NO: 859608 - DNA, 25 bp, Mus musculus
tgatgtactaattacacccatgcat

SEQ ID NO: 859609 - DNA, 25 bp, Mus musculus
tgatgtactgccagcatagactgct

SEQ ID NO: 859610 - DNA, 25 bp, Mus musculus
tgatgtactgcctgcatagactgct

SEQ ID NO: 859611 - DNA, 25 bp, Mus musculus
tgatgtactttcaccattagcttaa

SEQ ID NO: 859612 - DNA, 25 bp, Mus musculus
tgatgtactttctccattagcttaa

SEQ ID NO: 859613 - DNA, 25 bp, Mus musculus
tgatgtagccacaattcagccctct

SEQ ID NO: 859614 - DNA, 25 bp, Mus musculus
tgatgtagccactattcagccctct

SEQ ID NO: 859615 - DNA, 25 bp, Mus musculus
tgatgtagctatcgaaattttctct

SEQ ID NO: 859616 - DNA, 25 bp, Mus musculus
tgatgtagctatggaaattttctct

SEQ ID NO: 859617 - DNA, 25 bp, Mus musculus
tgatgtaggtacatcgttctttttt

SEQ ID NO: 859618 - DNA, 25 bp, Mus musculus
tgatgtaggtacttcgttctttttt

SEQ ID NO: 859619 - DNA, 25 bp, Mus musculus
tgatgtagtcatctctatttagagg

SEQ ID NO: 859620 - DNA, 25 bp, Mus musculus
tgatgtagtcatgtctatttagagg

SEQ ID NO: 859621 - DNA, 25 bp, Mus musculus
tgatgtagtgaccagcccagcagtc

SEQ ID NO: 859622 - DNA, 25 bp, Mus musculus
tgatgtagtgacgagcccagcagtc

SEQ ID NO: 859623 - DNA, 25 bp, Mus musculus
tgatgtagtgctcgatgtgaaaccc

SEQ ID NO: 859624 - DNA, 25 bp, Mus musculus
tgatgtagtgctggatgtgaaaccc

SEQ ID NO: 859625 - DNA, 25 bp, Mus musculus
tgatgtatgcccacaagcacttgaa

SEQ ID NO: 859626 - DNA, 25 bp, Mus musculus
tgatgtatgccctcaagcacttgaa

SEQ ID NO: 859627 - DNA, 25 bp, Mus musculus
tgatgtatgctgaacgctacgcgta

SEQ ID NO: 859628 - DNA, 25 bp, Mus musculus
tgatgtatgctgtacgctacgcgta

SEQ ID NO: 859629 - DNA, 25 bp, Mus musculus
tgatgtattaccaaacttccctgtt

SEQ ID NO: 859630 - DNA, 25 bp, Mus musculus
tgatgtattacctaacttccctgtt

SEQ ID NO: 859631 - DNA, 25 bp, Mus musculus
tgatgtattctcagtaaggttcaga

SEQ ID NO: 859632 - DNA, 25 bp, Mus musculus
tgatgtattctctgtaaggttcaga

SEQ ID NO: 859633 - DNA, 25 bp, Mus musculus
tgatgtatttttcttcactattttt

SEQ ID NO: 859634 - DNA, 25 bp, Mus musculus
tgatgtatttttgttcactattttt

SEQ ID NO: 859635 - DNA, 25 bp, Mus musculus
tgatgtcaacagatgctgctagcct

SEQ ID NO: 859636 - DNA, 25 bp, Mus musculus
tgatgtcaacagttgctgctagcct

SEQ ID NO: 859637 - DNA, 25 bp, Mus musculus
tgatgtcaacctacctggacagagc

SEQ ID NO: 859638 - DNA, 25 bp, Mus musculus
tgatgtcaaccttcctggacagagc

SEQ ID NO: 859639 - DNA, 25 bp, Mus musculus
tgatgtcaacgtcatcatggctgcc

SEQ ID NO: 859640 - DNA, 25 bp, Mus musculus
tgatgtcaacgtgatcatggctgcc

SEQ ID NO: 859641 - DNA, 25 bp, Mus musculus
tgatgtcaacttatttctgcggcct

SEQ ID NO: 859642 - DNA, 25 bp, Mus musculus
tgatgtcaacttttttctgcggcct

SEQ ID NO: 859643 - DNA, 25 bp, Mus musculus
tgatgtcacataaccgctggactgg

SEQ ID NO: 859644 - DNA, 25 bp, Mus musculus
tgatgtcacatatccgctggactgg

SEQ ID NO: 859645 - DNA, 25 bp, Mus musculus
tgatgtcaccaccttccaagaatta

SEQ ID NO: 859646 - DNA, 25 bp, Mus musculus
tgatgtcaccacgttccaagaatta

SEQ ID NO: 859647 - DNA, 25 bp, Mus musculus
tgatgtcaccatcactcttgggaaa

SEQ ID NO: 859648 - DNA, 25 bp, Mus musculus
tgatgtcaccatgactcttgggaaa

SEQ ID NO: 859649 - DNA, 25 bp, Mus musculus
tgatgtcaccgcatctcgaaataaa

SEQ ID NO: 859650 - DNA, 25 bp, Mus musculus
tgatgtcaccgcttctcgaaataaa

SEQ ID NO: 859651 - DNA, 25 bp, Mus musculus
tgatgtcacggcagatactcactct

SEQ ID NO: 859652 - DNA, 25 bp, Mus musculus
tgatgtcacggctgatactcactct

SEQ ID NO: 859653 - DNA, 25 bp, Mus musculus
tgatgtcacgtgaggccagactggc

SEQ ID NO: 859654 - DNA, 25 bp, Mus musculus
tgatgtcacgtgtggccagactggc

SEQ ID NO: 859655 - DNA, 25 bp, Mus musculus
tgatgtcactcactctttgcaacat

SEQ ID NO: 859656 - DNA, 25 bp, Mus musculus
tgatgtcactcagtctttgcaacat

SEQ ID NO: 859657 - DNA, 25 bp, Mus musculus
tgatgtcactttccacaacttcatt

SEQ ID NO: 859658 - DNA, 25 bp, Mus musculus
tgatgtcactttgcacaacttcatt

SEQ ID NO: 859659 - DNA, 25 bp, Mus musculus
tgatgtcatctcatcgtgggctcca

SEQ ID NO: 859660 - DNA, 25 bp, Mus musculus
tgatgtcatctcttcgtgggctcca

SEQ ID NO: 859661 - DNA, 25 bp, Mus musculus
tgatgtcatcttccacagaacgtgt

SEQ ID NO: 859662 - DNA, 25 bp, Mus musculus
tgatgtcatcttgcacagaacgtgt

SEQ ID NO: 859663 - DNA, 25 bp, Mus musculus
tgatgtcatggtcggacttggcccc

SEQ ID NO: 859664 - DNA, 25 bp, Mus musculus
tgatgtcatggtgggacttggcccc

SEQ ID NO: 859665 - DNA, 25 bp, Mus musculus
tgatgtcattaaagggctctgggat

SEQ ID NO: 859666 - DNA, 25 bp, Mus musculus
tgatgtcattaatgggctctgggat

SEQ ID NO: 859667 - DNA, 25 bp, Mus musculus
tgatgtcattgacctggacccctat

SEQ ID NO: 859668 - DNA, 25 bp, Mus musculus
tgatgtcattgagctggacccctat

SEQ ID NO: 859669 - DNA, 25 bp, Mus musculus
tgatgtccaagtaaccacgtgggaa

SEQ ID NO: 859670 - DNA, 25 bp, Mus musculus
tgatgtccaagttaccacgtgggaa

SEQ ID NO: 859671 - DNA, 25 bp, Mus musculus
tgatgtccacatccagtgtactgtg

SEQ ID NO: 859672 - DNA, 25 bp, Mus musculus
tgatgtccacatgcagtgtactgtg

SEQ ID NO: 859673 - DNA, 25 bp, Mus musculus
tgatgtccacccagctgaagcatga

SEQ ID NO: 859674 - DNA, 25 bp, Mus musculus
tgatgtccaccctgctgaagcatga

SEQ ID NO: 859675 - DNA, 25 bp, Mus musculus
tgatgtccagtactatacccccaga

SEQ ID NO: 859676 - DNA, 25 bp, Mus musculus
tgatgtccagtagtatacccccaga

SEQ ID NO: 859677 - DNA, 25 bp, Mus musculus
tgatgtccagttcccaagcacattg

SEQ ID NO: 859678 - DNA, 25 bp, Mus musculus
tgatgtccagttgccaagcacattg

SEQ ID NO: 859679 - DNA, 25 bp, Mus musculus
tgatgtccataactgctccctataa

SEQ ID NO: 859680 - DNA, 25 bp, Mus musculus
tgatgtccataagtgctccctataa

SEQ ID NO: 859681 - DNA, 25 bp, Mus musculus
tgatgtccatacatggccccaaaaa

SEQ ID NO: 859682 - DNA, 25 bp, Mus musculus
tgatgtccatacctcgcacccaaaa

SEQ ID NO: 859683 - DNA, 25 bp, Mus musculus
tgatgtccatacgtcgcacccaaaa

SEQ ID NO: 859684 - DNA, 25 bp, Mus musculus
tgatgtccatacttggccccaaaaa

SEQ ID NO: 859685 - DNA, 25 bp, Mus musculus
tgatgtccatctcgtgccccgggag

SEQ ID NO: 859686 - DNA, 25 bp, Mus musculus
tgatgtccatctggtgccccgggag

SEQ ID NO: 859687 - DNA, 25 bp, Mus musculus
tgatgtcccaagatgctgtttccgg

SEQ ID NO: 859688 - DNA, 25 bp, Mus musculus
tgatgtcccaagttgctgtttccgg

SEQ ID NO: 859689 - DNA, 25 bp, Mus musculus
tgatgtcccattcggtttacctgat

SEQ ID NO: 859690 - DNA, 25 bp, Mus musculus
tgatgtcccattgggtttacctgat

SEQ ID NO: 859691 - DNA, 25 bp, Mus musculus
tgatgtccccgtcgtattacctcca

SEQ ID NO: 859692 - DNA, 25 bp, Mus musculus
tgatgtccccgtggtattacctcca

SEQ ID NO: 859693 - DNA, 25 bp, Mus musculus
tgatgtcccgaacaagtcaccacaa

SEQ ID NO: 859694 - DNA, 25 bp, Mus musculus
tgatgtcccgaagaagtcaccacaa

SEQ ID NO: 859695 - DNA, 25 bp, Mus musculus
tgatgtcccgtgaactatagctagt

SEQ ID NO: 859696 - DNA, 25 bp, Mus musculus
tgatgtcccgtgtactatagctagt

SEQ ID NO: 859697 - DNA, 25 bp, Mus musculus
tgatgtccctatcttttatccttga

SEQ ID NO: 859698 - DNA, 25 bp, Mus musculus
tgatgtccctatgttttatccttga

SEQ ID NO: 859699 - DNA, 25 bp, Mus musculus
tgatgtccgcatcttgtgtcagtgg

SEQ ID NO: 859700 - DNA, 25 bp, Mus musculus
tgatgtccgcatgttgtgtcagtgg

SEQ ID NO: 859701 - DNA, 25 bp, Mus musculus
tgatgtcctcatcacccaggtagat

SEQ ID NO: 859702 - DNA, 25 bp, Mus musculus
tgatgtcctcatgacccaggtagat

SEQ ID NO: 859703 - DNA, 25 bp, Mus musculus
tgatgtcctgtcatctttcagcaga

SEQ ID NO: 859704 - DNA, 25 bp, Mus musculus
tgatgtcctgtcttctttcagcaga

SEQ ID NO: 859705 - DNA, 25 bp, Mus musculus
tgatgtccttcccaaaaccagccaa

SEQ ID NO: 859706 - DNA, 25 bp, Mus musculus
tgatgtccttccgaaaaccagccaa

SEQ ID NO: 859707 - DNA, 25 bp, Mus musculus
tgatgtccttgaacttcttatcgcc

SEQ ID NO: 859708 - DNA, 25 bp, Mus musculus
tgatgtccttgatcttcttatcgcc

SEQ ID NO: 859709 - DNA, 25 bp, Mus musculus
tgatgtcgaactctttggcgcctta

SEQ ID NO: 859710 - DNA, 25 bp, Mus musculus
tgatgtcgaactgtttggcgcctta

SEQ ID NO: 859711 - DNA, 25 bp, Mus musculus
tgatgtcggtatccacagccattac

SEQ ID NO: 859712 - DNA, 25 bp, Mus musculus
tgatgtcggtatgcacagccattac

SEQ ID NO: 859713 - DNA, 25 bp, Mus musculus
tgatgtcgtttcatacagtgataac

SEQ ID NO: 859714 - DNA, 25 bp, Mus musculus
tgatgtcgtttcttacagtgataac

SEQ ID NO: 859715 - DNA, 25 bp, Mus musculus
tgatgtctaaggacaaacagcaaga

SEQ ID NO: 859716 - DNA, 25 bp, Mus musculus
tgatgtctaaggtcaaacagcaaga

SEQ ID NO: 859717 - DNA, 25 bp, Mus musculus
tgatgtctagatccctgtagcctgt

SEQ ID NO: 859718 - DNA, 25 bp, Mus musculus
tgatgtctagatgcctgtagcctgt

SEQ ID NO: 859719 - DNA, 25 bp, Mus musculus
tgatgtctcagccaaatctaatgaa

SEQ ID NO: 859720 - DNA, 25 bp, Mus musculus
tgatgtctcagccaatgccgtgcgg

SEQ ID NO: 859721 - DNA, 25 bp, Mus musculus
tgatgtctcagcgaaatctaatgaa

SEQ ID NO: 859722 - DNA, 25 bp, Mus musculus
tgatgtctcagcgaatgccgtgcgg

SEQ ID NO: 859723 - DNA, 25 bp, Mus musculus
tgatgtctcctgacttttgctcagc

SEQ ID NO: 859724 - DNA, 25 bp, Mus musculus
tgatgtctcctgtcttttgctcagc

SEQ ID NO: 859725 - DNA, 25 bp, Mus musculus
tgatgtctcgttaagctcttcacag

SEQ ID NO: 859726 - DNA, 25 bp, Mus musculus
tgatgtctcgtttagctcttcacag

SEQ ID NO: 859727 - DNA, 25 bp, Mus musculus
tgatgtctctacatgaaggagccgt

SEQ ID NO: 859728 - DNA, 25 bp, Mus musculus
tgatgtctctacttgaaggagccgt

SEQ ID NO: 859729 - DNA, 25 bp, Mus musculus
tgatgtctctcacacaaggcaaggt

SEQ ID NO: 859730 - DNA, 25 bp, Mus musculus
tgatgtctctcagacaaggcaaggt

SEQ ID NO: 859731 - DNA, 25 bp, Mus musculus
tgatgtctctgtcccgattattacc

SEQ ID NO: 859732 - DNA, 25 bp, Mus musculus
tgatgtctctgtgccgattattacc

SEQ ID NO: 859733 - DNA, 25 bp, Mus musculus
tgatgtctgactcgcttactgccag

SEQ ID NO: 859734 - DNA, 25 bp, Mus musculus
tgatgtctgactggcttactgccag

SEQ ID NO: 859735 - DNA, 25 bp, Mus musculus
tgatgtctgagaaccagggcgctct

SEQ ID NO: 859736 - DNA, 25 bp, Mus musculus
tgatgtctgagatccagggcgctct

SEQ ID NO: 859737 - DNA, 25 bp, Mus musculus
tgatgtctgccaagtactctggttg

SEQ ID NO: 859738 - DNA, 25 bp, Mus musculus
tgatgtctgccacagaaccttccgc

SEQ ID NO: 859739 - DNA, 25 bp, Mus musculus
tgatgtctgccagagaaccttccgc

SEQ ID NO: 859740 - DNA, 25 bp, Mus musculus
tgatgtctgccatgtactctggttg

SEQ ID NO: 859741 - DNA, 25 bp, Mus musculus
tgatgtctggtgagatgcctgcagt

SEQ ID NO: 859742 - DNA, 25 bp, Mus musculus
tgatgtctggtgtgatgcctgcagt

SEQ ID NO: 859743 - DNA, 25 bp, Mus musculus
tgatgtctgtcgatgtacctgaccc

SEQ ID NO: 859744 - DNA, 25 bp, Mus musculus
tgatgtctgtcgttgtacctgaccc

SEQ ID NO: 859745 - DNA, 25 bp, Mus musculus
tgatgtctgtctcatcatggcttcc

SEQ ID NO: 859746 - DNA, 25 bp, Mus musculus
tgatgtctgtctgatcatggcttcc

SEQ ID NO: 859747 - DNA, 25 bp, Mus musculus
tgatgtctgtggactgtgctgctac

SEQ ID NO: 859748 - DNA, 25 bp, Mus musculus
tgatgtctgtggtctgtgctgctac

SEQ ID NO: 859749 - DNA, 25 bp, Mus musculus
tgatgtctgttgcaagacctgtccc

SEQ ID NO: 859750 - DNA, 25 bp, Mus musculus
tgatgtctgttggaagacctgtccc

SEQ ID NO: 859751 - DNA, 25 bp, Mus musculus
tgatgtctttgtcccaagcagcaat

SEQ ID NO: 859752 - DNA, 25 bp, Mus musculus
tgatgtctttgtgccaagcagcaat

SEQ ID NO: 859753 - DNA, 25 bp, Mus musculus
tgatgtgaatccacgatgggcagca

SEQ ID NO: 859754 - DNA, 25 bp, Mus musculus
tgatgtgaatcccaaggcctatccc

SEQ ID NO: 859755 - DNA, 25 bp, Mus musculus
tgatgtgaatccgaaggcctatccc

SEQ ID NO: 859756 - DNA, 25 bp, Mus musculus
tgatgtgaatcctcgatgggcagca

SEQ ID NO: 859757 - DNA, 25 bp, Mus musculus
tgatgtgaccccctctcgagcttga

SEQ ID NO: 859758 - DNA, 25 bp, Mus musculus
tgatgtgaccccgtctcgagcttga

SEQ ID NO: 859759 - DNA, 25 bp, Mus musculus
tgatgtgacccgatggcctcgtgac

SEQ ID NO: 859760 - DNA, 25 bp, Mus musculus
tgatgtgacccgttggcctcgtgac

SEQ ID NO: 859761 - DNA, 25 bp, Mus musculus
tgatgtgacgaacagcgctgccacc

SEQ ID NO: 859762 - DNA, 25 bp, Mus musculus
tgatgtgacgaagagcgctgccacc

SEQ ID NO: 859763 - DNA, 25 bp, Mus musculus
tgatgtgacgatctgggcagactct

SEQ ID NO: 859764 - DNA, 25 bp, Mus musculus
tgatgtgacgatgtgggcagactct

SEQ ID NO: 859765 - DNA, 25 bp, Mus musculus
tgatgtgagttgagtctgaaagcca

SEQ ID NO: 859766 - DNA, 25 bp, Mus musculus
tgatgtgagttgtgtctgaaagcca

SEQ ID NO: 859767 - DNA, 25 bp, Mus musculus
tgatgtgataagaacagtaagttac

SEQ ID NO: 859768 - DNA, 25 bp, Mus musculus
tgatgtgataagtacagtaagttac

SEQ ID NO: 859769 - DNA, 25 bp, Mus musculus
tgatgtgatttcctaagtgttgtac

SEQ ID NO: 859770 - DNA, 25 bp, Mus musculus
tgatgtgatttcgtaagtgttgtac

SEQ ID NO: 859771 - DNA, 25 bp, Mus musculus
tgatgtgcaaagagtcgtccatgta

SEQ ID NO: 859772 - DNA, 25 bp, Mus musculus
tgatgtgcaaagtgtcgtccatgta

SEQ ID NO: 859773 - DNA, 25 bp, Mus musculus
tgatgtgcacccacaggacgacaaa

SEQ ID NO: 859774 - DNA, 25 bp, Mus musculus
tgatgtgcaccctcaggacgacaaa

SEQ ID NO: 859775 - DNA, 25 bp, Mus musculus
tgatgtgcagcaaagggtattaaat

SEQ ID NO: 859776 - DNA, 25 bp, Mus musculus
tgatgtgcagcatagggtattaaat

SEQ ID NO: 859777 - DNA, 25 bp, Mus musculus
tgatgtgcagttcagccaggaagac

SEQ ID NO: 859778 - DNA, 25 bp, Mus musculus
tgatgtgcagttgagccaggaagac

SEQ ID NO: 859779 - DNA, 25 bp, Mus musculus
tgatgtgccaatcaaagccctccgt

SEQ ID NO: 859780 - DNA, 25 bp, Mus musculus
tgatgtgccaatgaaagccctccgt

SEQ ID NO: 859781 - DNA, 25 bp, Mus musculus
tgatgtgccacaacgtgtctgtcat

SEQ ID NO: 859782 - DNA, 25 bp, Mus musculus
tgatgtgccacatcgtgtctgtcat

SEQ ID NO: 859783 - DNA, 25 bp, Mus musculus
tgatgtgccaggaaccgcagcgcca

SEQ ID NO: 859784 - DNA, 25 bp, Mus musculus
tgatgtgccaggtaccgcagcgcca

SEQ ID NO: 859785 - DNA, 25 bp, Mus musculus
tgatgtgcccttccaggtggtatgc

SEQ ID NO: 859786 - DNA, 25 bp, Mus musculus
tgatgtgcccttgcaggtggtatgc

SEQ ID NO: 859787 - DNA, 25 bp, Mus musculus
tgatgtgctagaaccgtgtatgtct

SEQ ID NO: 859788 - DNA, 25 bp, Mus musculus
tgatgtgctagatccgtgtatgtct

SEQ ID NO: 859789 - DNA, 25 bp, Mus musculus
tgatgtgctctcctaactcattttg

SEQ ID NO: 859790 - DNA, 25 bp, Mus musculus
tgatgtgctctcgtaactcattttg

SEQ ID NO: 859791 - DNA, 25 bp, Mus musculus
tgatgtgctgagactccatgcagag

SEQ ID NO: 859792 - DNA, 25 bp, Mus musculus
tgatgtgctgagtctccatgcagag

SEQ ID NO: 859793 - DNA, 25 bp, Mus musculus
tgatgtgctgccaggtgcaccgcta

SEQ ID NO: 859794 - DNA, 25 bp, Mus musculus
tgatgtgctgcctggtgcaccgcta

SEQ ID NO: 859795 - DNA, 25 bp, Mus musculus
tgatgtgctgtaagggctcggcctt

SEQ ID NO: 859796 - DNA, 25 bp, Mus musculus
tgatgtgctgtatgggctcggcctt

SEQ ID NO: 859797 - DNA, 25 bp, Mus musculus
tgatgtgcttataacccacccagga

SEQ ID NO: 859798 - DNA, 25 bp, Mus musculus
tgatgtgcttattacccacccagga

SEQ ID NO: 859799 - DNA, 25 bp, Mus musculus
tgatgtgcttctctgtgttggccaa

SEQ ID NO: 859800 - DNA, 25 bp, Mus musculus
tgatgtgcttctgtgtgttggccaa

SEQ ID NO: 859801 - DNA, 25 bp, Mus musculus
tgatgtgcttggaatctggcttttc

SEQ ID NO: 859802 - DNA, 25 bp, Mus musculus
tgatgtgcttggtatctggcttttc

SEQ ID NO: 859803 - DNA, 25 bp, Mus musculus
tgatgtgcttttccagtatcttcag

SEQ ID NO: 859804 - DNA, 25 bp, Mus musculus
tgatgtgcttttgcagtatcttcag

SEQ ID NO: 859805 - DNA, 25 bp, Mus musculus
tgatgtggaatcatggctgcagtga

SEQ ID NO: 859806 - DNA, 25 bp, Mus musculus
tgatgtggaatcttggctgcagtga

SEQ ID NO: 859807 - DNA, 25 bp, Mus musculus
tgatgtggaccgcttcctcattaac

SEQ ID NO: 859808 - DNA, 25 bp, Mus musculus
tgatgtggaccggttcctcattaac

SEQ ID NO: 859809 - DNA, 25 bp, Mus musculus
tgatgtggacctaggatgtctccaa

SEQ ID NO: 859810 - DNA, 25 bp, Mus musculus
tgatgtggaccttggatgtctccaa

SEQ ID NO: 859811 - DNA, 25 bp, Mus musculus
tgatgtggacgaccaccctgagaca

SEQ ID NO: 859812 - DNA, 25 bp, Mus musculus
tgatgtggacgagcaccctgagaca

SEQ ID NO: 859813 - DNA, 25 bp, Mus musculus
tgatgtggcagacgcttcttcctac

SEQ ID NO: 859814 - DNA, 25 bp, Mus musculus
tgatgtggcagaggcttcttcctac

SEQ ID NO: 859815 - DNA, 25 bp, Mus musculus
tgatgtggcattcttcttgcctctg

SEQ ID NO: 859816 - DNA, 25 bp, Mus musculus
tgatgtggcattgttcttgcctctg

SEQ ID NO: 859817 - DNA, 25 bp, Mus musculus
tgatgtggccagacagcagagagct

SEQ ID NO: 859818 - DNA, 25 bp, Mus musculus
tgatgtggccagtcagcagagagct

SEQ ID NO: 859819 - DNA, 25 bp, Mus musculus
tgatgtggcccaacctgtcatgact

SEQ ID NO: 859820 - DNA, 25 bp, Mus musculus
tgatgtggcccatcctgtcatgact

SEQ ID NO: 859821 - DNA, 25 bp, Mus musculus
tgatgtggccctagtcacttcagag

SEQ ID NO: 859822 - DNA, 25 bp, Mus musculus
tgatgtggcccttgtcacttcagag

SEQ ID NO: 859823 - DNA, 25 bp, Mus musculus
tgatgtggcctgctcctgctcatga

SEQ ID NO: 859824 - DNA, 25 bp, Mus musculus
tgatgtggcctggtcctgctcatga

SEQ ID NO: 859825 - DNA, 25 bp, Mus musculus
tgatgtggcggcctgttatgccaac

SEQ ID NO: 859826 - DNA, 25 bp, Mus musculus
tgatgtggcggcgtgttatgccaac

SEQ ID NO: 859827 - DNA, 25 bp, Mus musculus
tgatgtgggaggacccagctctctg

SEQ ID NO: 859828 - DNA, 25 bp, Mus musculus
tgatgtgggaggtcccagctctctg

SEQ ID NO: 859829 - DNA, 25 bp, Mus musculus
tgatgtgggcagactctcttaggaa

SEQ ID NO: 859830 - DNA, 25 bp, Mus musculus
tgatgtgggcagtctctcttaggaa

SEQ ID NO: 859831 - DNA, 25 bp, Mus musculus
tgatgtggtattcacctgcaacctt

SEQ ID NO: 859832 - DNA, 25 bp, Mus musculus
tgatgtggtattgacctgcaacctt

SEQ ID NO: 859833 - DNA, 25 bp, Mus musculus
tgatgtggtgcgcttacacgtgtac

SEQ ID NO: 859834 - DNA, 25 bp, Mus musculus
tgatgtggtgcggttacacgtgtac

SEQ ID NO: 859835 - DNA, 25 bp, Mus musculus
tgatgtggtgttccaactgcagcgc

SEQ ID NO: 859836 - DNA, 25 bp, Mus musculus
tgatgtggtgttgcaactgcagcgc

SEQ ID NO: 859837 - DNA, 25 bp, Mus musculus
tgatgtggttcccaatgacccaagt

SEQ ID NO: 859838 - DNA, 25 bp, Mus musculus
tgatgtggttccgaatgacccaagt

SEQ ID NO: 859839 - DNA, 25 bp, Mus musculus
tgatgtggttgtatgctttcctttc

SEQ ID NO: 859840 - DNA, 25 bp, Mus musculus
tgatgtggttgtttgctttcctttc

SEQ ID NO: 859841 - DNA, 25 bp, Mus musculus
tgatgtggtttcagtgtagtgtgca

SEQ ID NO: 859842 - DNA, 25 bp, Mus musculus
tgatgtggtttctgtgtagtgtgca

SEQ ID NO: 859843 - DNA, 25 bp, Mus musculus
tgatgtgtaaatatgcagtgcgtgg

SEQ ID NO: 859844 - DNA, 25 bp, Mus musculus
tgatgtgtaaatttgcagtgcgtgg

SEQ ID NO: 859845 - DNA, 25 bp, Mus musculus
tgatgtgtacatccgtgtaacagaa

SEQ ID NO: 859846 - DNA, 25 bp, Mus musculus
tgatgtgtacatgcgtgtaacagaa

SEQ ID NO: 859847 - DNA, 25 bp, Mus musculus
tgatgtgtattccattccgctcgcc

SEQ ID NO: 859848 - DNA, 25 bp, Mus musculus
tgatgtgtattcgattccgctcgcc

SEQ ID NO: 859849 - DNA, 25 bp, Mus musculus
tgatgtgtccaccagaaacctcctg

SEQ ID NO: 859850 - DNA, 25 bp, Mus musculus
tgatgtgtccacgagaaacctcctg

SEQ ID NO: 859851 - DNA, 25 bp, Mus musculus
tgatgtgtccagctcaacctttgtg

SEQ ID NO: 859852 - DNA, 25 bp, Mus musculus
tgatgtgtccaggtcaacctttgtg

SEQ ID NO: 859853 - DNA, 25 bp, Mus musculus
tgatgtgtgataaagcacctcagaa

SEQ ID NO: 859854 - DNA, 25 bp, Mus musculus
tgatgtgtgatatagcacctcagaa

SEQ ID NO: 859855 - DNA, 25 bp, Mus musculus
tgatgtgtgcaaatattgggccagc

SEQ ID NO: 859856 - DNA, 25 bp, Mus musculus
tgatgtgtgcaattattgggccagc

SEQ ID NO: 859857 - DNA, 25 bp, Mus musculus
tgatgtgtgccacttcaccagagaa

SEQ ID NO: 859858 - DNA, 25 bp, Mus musculus
tgatgtgtgccagttcaccagagaa

SEQ ID NO: 859859 - DNA, 25 bp, Mus musculus
tgatgtgtgctcaccacagttcaca

SEQ ID NO: 859860 - DNA, 25 bp, Mus musculus
tgatgtgtgctctccacagttcaca

SEQ ID NO: 859861 - DNA, 25 bp, Mus musculus
tgatgtgtggccacgctcaggacat

SEQ ID NO: 859862 - DNA, 25 bp, Mus musculus
tgatgtgtggcctcgctcaggacat

SEQ ID NO: 859863 - DNA, 25 bp, Mus musculus
tgatgtgtgtctacagatgcaactg

SEQ ID NO: 859864 - DNA, 25 bp, Mus musculus
tgatgtgtgtcttcagatgcaactg

SEQ ID NO: 859865 - DNA, 25 bp, Mus musculus
tgatgtgtgtgcagccacgctcagc

SEQ ID NO: 859866 - DNA, 25 bp, Mus musculus
tgatgtgtgtgctgccacgctcagc

SEQ ID NO: 859867 - DNA, 25 bp, Mus musculus
tgatgtgttagtcctcggctgccac

SEQ ID NO: 859868 - DNA, 25 bp, Mus musculus
tgatgtgttagtgctcggctgccac

SEQ ID NO: 859869 - DNA, 25 bp, Mus musculus
tgatgtgttcagataggagccccgt

SEQ ID NO: 859870 - DNA, 25 bp, Mus musculus
tgatgtgttcagttaggagccccgt

SEQ ID NO: 859871 - DNA, 25 bp, Mus musculus
tgatgtgttcatagcttgtggtcct

SEQ ID NO: 859872 - DNA, 25 bp, Mus musculus
tgatgtgttcattgcttgtggtcct

SEQ ID NO: 859873 - DNA, 25 bp, Mus musculus
tgatgtgttccaacatctctgcaaa

SEQ ID NO: 859874 - DNA, 25 bp, Mus musculus
tgatgtgttccatcatctctgcaaa

SEQ ID NO: 859875 - DNA, 25 bp, Mus musculus
tgatgtgttgacacgtgccggccat

SEQ ID NO: 859876 - DNA, 25 bp, Mus musculus
tgatgtgttgactcgtgccggccat

SEQ ID NO: 859877 - DNA, 25 bp, Mus musculus
tgatgtgttgggagccctgttaccc

SEQ ID NO: 859878 - DNA, 25 bp, Mus musculus
tgatgtgttgggtgccctgttaccc

SEQ ID NO: 859879 - DNA, 25 bp, Mus musculus
tgatgtgttggtcgctttgtctgaa

SEQ ID NO: 859880 - DNA, 25 bp, Mus musculus
tgatgtgttggtggctttgtctgaa

SEQ ID NO: 859881 - DNA, 25 bp, Mus musculus
tgatgtgttttgaccccatgggtca

SEQ ID NO: 859882 - DNA, 25 bp, Mus musculus
tgatgtgttttgtccccatgggtca

SEQ ID NO: 859883 - DNA, 25 bp, Mus musculus
tgatgttacttgcttttacttaata

SEQ ID NO: 859884 - DNA, 25 bp, Mus musculus
tgatgttacttggttttacttaata

SEQ ID NO: 859885 - DNA, 25 bp, Mus musculus
tgatgttagcagacacctctctgtg

SEQ ID NO: 859886 - DNA, 25 bp, Mus musculus
tgatgttagcagtcacctctctgtg

SEQ ID NO: 859887 - DNA, 25 bp, Mus musculus
tgatgttataggagtccccgcagtt

SEQ ID NO: 859888 - DNA, 25 bp, Mus musculus
tgatgttataggtgtccccgcagtt

SEQ ID NO: 859889 - DNA, 25 bp, Mus musculus
tgatgttatctcacctggaaggccc

SEQ ID NO: 859890 - DNA, 25 bp, Mus musculus
tgatgttatctctcctggaaggccc

SEQ ID NO: 859891 - DNA, 25 bp, Mus musculus
tgatgttatctgataatgcctttac

SEQ ID NO: 859892 - DNA, 25 bp, Mus musculus
tgatgttatctgttaatgcctttac

SEQ ID NO: 859893 - DNA, 25 bp, Mus musculus
tgatgttatgtgaagctgctgctcc

SEQ ID NO: 859894 - DNA, 25 bp, Mus musculus
tgatgttatgtgtagctgctgctcc

SEQ ID NO: 859895 - DNA, 25 bp, Mus musculus
tgatgttattttcttacagcttttg

SEQ ID NO: 859896 - DNA, 25 bp, Mus musculus
tgatgttattttgttacagcttttg

SEQ ID NO: 859897 - DNA, 25 bp, Mus musculus
tgatgttcagatcgtgtgtactttt

SEQ ID NO: 859898 - DNA, 25 bp, Mus musculus
tgatgttcagatggtgtgtactttt

SEQ ID NO: 859899 - DNA, 25 bp, Mus musculus
tgatgttcagcaaggtgtcctcatt

SEQ ID NO: 859900 - DNA, 25 bp, Mus musculus
tgatgttcagcatggtgtcctcatt

SEQ ID NO: 859901 - DNA, 25 bp, Mus musculus
tgatgttcaggactatgccgataat

SEQ ID NO: 859902 - DNA, 25 bp, Mus musculus
tgatgttcaggagtatgccgataat

SEQ ID NO: 859903 - DNA, 25 bp, Mus musculus
tgatgttcagtactccatagcctcc

SEQ ID NO: 859904 - DNA, 25 bp, Mus musculus
tgatgttcagtagtccatagcctcc

SEQ ID NO: 859905 - DNA, 25 bp, Mus musculus
tgatgttcataaattgacctctcaa

SEQ ID NO: 859906 - DNA, 25 bp, Mus musculus
tgatgttcataatttgacctctcaa

SEQ ID NO: 859907 - DNA, 25 bp, Mus musculus
tgatgttcatttcccgtttctcatc

SEQ ID NO: 859908 - DNA, 25 bp, Mus musculus
tgatgttcatttgccgtttctcatc

SEQ ID NO: 859909 - DNA, 25 bp, Mus musculus
tgatgttccactcccacgttagcgt

SEQ ID NO: 859910 - DNA, 25 bp, Mus musculus
tgatgttccactgccacgttagcgt

SEQ ID NO: 859911 - DNA, 25 bp, Mus musculus
tgatgttccaggaattgtggaccat

SEQ ID NO: 859912 - DNA, 25 bp, Mus musculus
tgatgttccaggtattgtggaccat

SEQ ID NO: 859913 - DNA, 25 bp, Mus musculus
tgatgttccatacggacacctttct

SEQ ID NO: 859914 - DNA, 25 bp, Mus musculus
tgatgttccatagggacacctttct

SEQ ID NO: 859915 - DNA, 25 bp, Mus musculus
tgatgttccatcataaccatgtgca

SEQ ID NO: 859916 - DNA, 25 bp, Mus musculus
tgatgttccatcttaaccatgtgca

SEQ ID NO: 859917 - DNA, 25 bp, Mus musculus
tgatgttccctgctacctcaaggag

SEQ ID NO: 859918 - DNA, 25 bp, Mus musculus
tgatgttccctggtacctcaaggag

SEQ ID NO: 859919 - DNA, 25 bp, Mus musculus
tgatgttcggatcatgttccgccag

SEQ ID NO: 859920 - DNA, 25 bp, Mus musculus
tgatgttcggatgatgttccgccag

SEQ ID NO: 859921 - DNA, 25 bp, Mus musculus
tgatgttctatgagacaaagcccat

SEQ ID NO: 859922 - DNA, 25 bp, Mus musculus
tgatgttctatgtgacaaagcccat

SEQ ID NO: 859923 - DNA, 25 bp, Mus musculus
tgatgttctcaactgtctatgcaca

SEQ ID NO: 859924 - DNA, 25 bp, Mus musculus
tgatgttctcaagtgtctatgcaca

SEQ ID NO: 859925 - DNA, 25 bp, Mus musculus
tgatgttctccaccaaaagtccata

SEQ ID NO: 859926 - DNA, 25 bp, Mus musculus
tgatgttctccagcaaaagtccata

SEQ ID NO: 859927 - DNA, 25 bp, Mus musculus
tgatgttcttttcacctatcaccac

SEQ ID NO: 859928 - DNA, 25 bp, Mus musculus
tgatgttcttttgacctatcaccac

SEQ ID NO: 859929 - DNA, 25 bp, Mus musculus
tgatgttgagacagtctcctccggc

SEQ ID NO: 859930 - DNA, 25 bp, Mus musculus
tgatgttgagactgtctcctccggc

SEQ ID NO: 859931 - DNA, 25 bp, Mus musculus
tgatgttgcaccattggccttacaa

SEQ ID NO: 859932 - DNA, 25 bp, Mus musculus
tgatgttgcacctttggccttacaa

SEQ ID NO: 859933 - DNA, 25 bp, Mus musculus
tgatgttgccaacggaccctgtgaa

SEQ ID NO: 859934 - DNA, 25 bp, Mus musculus
tgatgttgccaagggaccctgtgaa

SEQ ID NO: 859935 - DNA, 25 bp, Mus musculus
tgatgttgctacagctgaccacttt

SEQ ID NO: 859936 - DNA, 25 bp, Mus musculus
tgatgttgctactgctgaccacttt

SEQ ID NO: 859937 - DNA, 25 bp, Mus musculus
tgatgttggaacagagggtgggact

SEQ ID NO: 859938 - DNA, 25 bp, Mus musculus
tgatgttggaactgagggtgggact

SEQ ID NO: 859939 - DNA, 25 bp, Mus musculus
tgatgttggcttcgtgtgtctgaac

SEQ ID NO: 859940 - DNA, 25 bp, Mus musculus
tgatgttggcttggtgtgtctgaac

SEQ ID NO: 859941 - DNA, 25 bp, Mus musculus
tgatgttgggtccttgttcaccaca

SEQ ID NO: 859942 - DNA, 25 bp, Mus musculus
tgatgttgggtcgttgttcaccaca

SEQ ID NO: 859943 - DNA, 25 bp, Mus musculus
tgatgttggtttatacttttccact

SEQ ID NO: 859944 - DNA, 25 bp, Mus musculus
tgatgttggtttttacttttccact

SEQ ID NO: 859945 - DNA, 25 bp, Mus musculus
tgatgttgtatcagcagtgctatag

SEQ ID NO: 859946 - DNA, 25 bp, Mus musculus
tgatgttgtatctgcagtgctatag

SEQ ID NO: 859947 - DNA, 25 bp, Mus musculus
tgatgttgtattagcctctcagcca

SEQ ID NO: 859948 - DNA, 25 bp, Mus musculus
tgatgttgtatttgcctctcagcca

SEQ ID NO: 859949 - DNA, 25 bp, Mus musculus
tgatgttgtcctagtgactggcctt

SEQ ID NO: 859950 - DNA, 25 bp, Mus musculus
tgatgttgtccttgtgactggcctt

SEQ ID NO: 859951 - DNA, 25 bp, Mus musculus
tgatgtttacaaccctgccttttac

SEQ ID NO: 859952 - DNA, 25 bp, Mus musculus
tgatgtttacaagcctgccttttac

SEQ ID NO: 859953 - DNA, 25 bp, Mus musculus
tgatgtttcaccaacctctgattac

SEQ ID NO: 859954 - DNA, 25 bp, Mus musculus
tgatgtttcacctacctctgattac

SEQ ID NO: 859955 - DNA, 25 bp, Mus musculus
tgatgtttcattcactgaccccagg

SEQ ID NO: 859956 - DNA, 25 bp, Mus musculus
tgatgtttcattgactgaccccagg

SEQ ID NO: 859957 - DNA, 25 bp, Mus musculus
tgatgtttccccaaagggccccaag

SEQ ID NO: 859958 - DNA, 25 bp, Mus musculus
tgatgtttcccctaagggccccaag

SEQ ID NO: 859959 - DNA, 25 bp, Mus musculus
tgatgtttctcacctgtgccttcag

SEQ ID NO: 859960 - DNA, 25 bp, Mus musculus
tgatgtttctcagctgtgccttcag

SEQ ID NO: 859961 - DNA, 25 bp, Mus musculus
tgatgtttctccattgctcaacttg

SEQ ID NO: 859962 - DNA, 25 bp, Mus musculus
tgatgtttctcctttgctcaacttg

SEQ ID NO: 859963 - DNA, 25 bp, Mus musculus
tgatgtttctttactcctggagctc

SEQ ID NO: 859964 - DNA, 25 bp, Mus musculus
tgatgtttcttttctcctggagctc

SEQ ID NO: 859965 - DNA, 25 bp, Mus musculus
tgatgtttgacacccattgtttatc

SEQ ID NO: 859966 - DNA, 25 bp, Mus musculus
tgatgtttgacagccattgtttatc

SEQ ID NO: 859967 - DNA, 25 bp, Mus musculus
tgatgtttgcacaaggagctcctga

SEQ ID NO: 859968 - DNA, 25 bp, Mus musculus
tgatgtttgcactaggagctcctga

SEQ ID NO: 859969 - DNA, 25 bp, Mus musculus
tgatgtttgcagaagcccactctgg

SEQ ID NO: 859970 - DNA, 25 bp, Mus musculus
tgatgtttgcagtagcccactctgg

SEQ ID NO: 859971 - DNA, 25 bp, Mus musculus
tgatgtttgcgccaggtccgagaat

SEQ ID NO: 859972 - DNA, 25 bp, Mus musculus
tgatgtttgcgcgaggtccgagaat

SEQ ID NO: 859973 - DNA, 25 bp, Mus musculus
tgatgtttggtcatttggtgtcctc

SEQ ID NO: 859974 - DNA, 25 bp, Mus musculus
tgatgtttggtcttttggtgtcctc

SEQ ID NO: 859975 - DNA, 25 bp, Mus musculus
tgatgttttagcatgtcctcaaaat

SEQ ID NO: 859976 - DNA, 25 bp, Mus musculus
tgatgttttagcttgtcctcaaaat

SEQ ID NO: 859977 - DNA, 25 bp, Mus musculus
tgatgttttccccatacagctagaa

SEQ ID NO: 859978 - DNA, 25 bp, Mus musculus
tgatgttttcccgatacagctagaa

SEQ ID NO: 859979 - DNA, 25 bp, Mus musculus
tgatgttttctcatgcattttcttc

SEQ ID NO: 859980 - DNA, 25 bp, Mus musculus
tgatgttttctcttgcattttcttc

SEQ ID NO: 859981 - DNA, 25 bp, Mus musculus
tgatgttttgacagtctggtcctgt

SEQ ID NO: 859982 - DNA, 25 bp, Mus musculus
tgatgttttgactgtctggtcctgt

SEQ ID NO: 859983 - DNA, 25 bp, Mus musculus
tgatgttttgtacccataactaaat

SEQ ID NO: 859984 - DNA, 25 bp, Mus musculus
tgatgttttgtagccataactaaat

SEQ ID NO: 859985 - DNA, 25 bp, Mus musculus
tgattaaactatagaaatgcctgca

SEQ ID NO: 859986 - DNA, 25 bp, Mus musculus
tgattaaactattgaaatgcctgca

SEQ ID NO: 859987 - DNA, 25 bp, Mus musculus
tgattaaacttccacatcctggcgg

SEQ ID NO: 859988 - DNA, 25 bp, Mus musculus
tgattaaacttcgacatcctggcgg

SEQ ID NO: 859989 - DNA, 25 bp, Mus musculus
tgattaaataccagggccctgcgtt

SEQ ID NO: 859990 - DNA, 25 bp, Mus musculus
tgattaaatacctgggccctgcgtt

SEQ ID NO: 859991 - DNA, 25 bp, Mus musculus
tgattaaccaccactagccaggact

SEQ ID NO: 859992 - DNA, 25 bp, Mus musculus
tgattaaccacctctagccaggact

SEQ ID NO: 859993 - DNA, 25 bp, Mus musculus
tgattaacccgcctcaggcctgtat

SEQ ID NO: 859994 - DNA, 25 bp, Mus musculus
tgattaacccgcgtcaggcctgtat

SEQ ID NO: 859995 - DNA, 25 bp, Mus musculus
tgattaacgacaccctcaacattgc

SEQ ID NO: 859996 - DNA, 25 bp, Mus musculus
tgattaacgacagcctcaacattgc

SEQ ID NO: 859997 - DNA, 25 bp, Mus musculus
tgattaactatcagtttttcccaaa

SEQ ID NO: 859998 - DNA, 25 bp, Mus musculus
tgattaactatctgtttttcccaaa

SEQ ID NO: 859999 - DNA, 25 bp, Mus musculus
tgattaactgtccttcacaccatgt

SEQ ID NO: 860000 - DNA, 25 bp, Mus musculus
tgattaactgtcgttcacaccatgt

SEQ ID NO: 860001 - DNA, 25 bp, Mus musculus
tgattaagccaaacaccaagccatg

SEQ ID NO: 860002 - DNA, 25 bp, Mus musculus
tgattaagccaatcaccaagccatg

SEQ ID NO: 860003 - DNA, 25 bp, Mus musculus
tgattaaggacacatgattattttc

SEQ ID NO: 860004 - DNA, 25 bp, Mus musculus
tgattaaggacagatgattattttc

SEQ ID NO: 860005 - DNA, 25 bp, Mus musculus
tgattaaggctccccttctatatac

SEQ ID NO: 860006 - DNA, 25 bp, Mus musculus
tgattaaggctcgccttctatatac

SEQ ID NO: 860007 - DNA, 25 bp, Mus musculus
tgattaatagtcatgcccttttcct

SEQ ID NO: 860008 - DNA, 25 bp, Mus musculus
tgattaatagtcttgcccttttcct

SEQ ID NO: 860009 - DNA, 25 bp, Mus musculus
tgattaatccgtctctgtgctcaga

SEQ ID NO: 860010 - DNA, 25 bp, Mus musculus
tgattaatccgtgtctgtgctcaga

SEQ ID NO: 860011 - DNA, 25 bp, Mus musculus
tgattaatgttcaaggagctgcctt

SEQ ID NO: 860012 - DNA, 25 bp, Mus musculus
tgattaatgttctaggagctgcctt

SEQ ID NO: 860013 - DNA, 25 bp, Mus musculus
tgattaattaagctacccatgatgc

SEQ ID NO: 860014 - DNA, 25 bp, Mus musculus
tgattaattaaggtacccatgatgc

SEQ ID NO: 860015 - DNA, 25 bp, Mus musculus
tgattacaaaggcagttagacagat

SEQ ID NO: 860016 - DNA, 25 bp, Mus musculus
tgattacaaagggagttagacagat

SEQ ID NO: 860017 - DNA, 25 bp, Mus musculus
tgattacaaagtacagttcgtgctg

SEQ ID NO: 860018 - DNA, 25 bp, Mus musculus
tgattacaaagttcagttcgtgctg

SEQ ID NO: 860019 - DNA, 25 bp, Mus musculus
tgattacaacagacgactaccaggg

SEQ ID NO: 860020 - DNA, 25 bp, Mus musculus
tgattacaacagagtcatccgcctc

SEQ ID NO: 860021 - DNA, 25 bp, Mus musculus
tgattacaacagtcgactaccaggg

SEQ ID NO: 860022 - DNA, 25 bp, Mus musculus
tgattacaacagtgtcatccgcctc

SEQ ID NO: 860023 - DNA, 25 bp, Mus musculus
tgattacactgacgccatgcaaaac

SEQ ID NO: 860024 - DNA, 25 bp, Mus musculus
tgattacactgaggccatgcaaaac

SEQ ID NO: 860025 - DNA, 25 bp, Mus musculus
tgattacagggaacaagtgccccga

SEQ ID NO: 860026 - DNA, 25 bp, Mus musculus
tgattacagggatcaagtgccccga

SEQ ID NO: 860027 - DNA, 25 bp, Mus musculus
tgattacagtgtagccttcgaggag

SEQ ID NO: 860028 - DNA, 25 bp, Mus musculus
tgattacagtgttgccttcgaggag

SEQ ID NO: 860029 - DNA, 25 bp, Mus musculus
tgattacatccacagtacaccttgc

SEQ ID NO: 860030 - DNA, 25 bp, Mus musculus
tgattacatccagagtacaccttgc

SEQ ID NO: 860031 - DNA, 25 bp, Mus musculus
tgattacatcggaggctgccagctg

SEQ ID NO: 860032 - DNA, 25 bp, Mus musculus
tgattacatcggtggctgccagctg

SEQ ID NO: 860033 - DNA, 25 bp, Mus musculus
tgattaccatctatggcctctgcag

SEQ ID NO: 860034 - DNA, 25 bp, Mus musculus
tgattaccatctttggcctctgcag

SEQ ID NO: 860035 - DNA, 25 bp, Mus musculus
tgattacccttcctctagctagagt

SEQ ID NO: 860036 - DNA, 25 bp, Mus musculus
tgattacccttcgtctagctagagt

SEQ ID NO: 860037 - DNA, 25 bp, Mus musculus
tgattaccggctagacctgacagag

SEQ ID NO: 860038 - DNA, 25 bp, Mus musculus
tgattaccggcttgacctgacagag

SEQ ID NO: 860039 - DNA, 25 bp, Mus musculus
tgattacctcttctactgcattgaa

SEQ ID NO: 860040 - DNA, 25 bp, Mus musculus
tgattacctcttgtactgcattgaa

SEQ ID NO: 860041 - DNA, 25 bp, Mus musculus
tgattacctgtcatacatttctgtt

SEQ ID NO: 860042 - DNA, 25 bp, Mus musculus
tgattacctgtcttacatttctgtt

SEQ ID NO: 860043 - DNA, 25 bp, Mus musculus
tgattactacgacaccggcgaggaa

SEQ ID NO: 860044 - DNA, 25 bp, Mus musculus
tgattactacgagaccggcgaggaa

SEQ ID NO: 860045 - DNA, 25 bp, Mus musculus
tgattactacgccttttccaaagat

SEQ ID NO: 860046 - DNA, 25 bp, Mus musculus
tgattactacgcgttttccaaagat

SEQ ID NO: 860047 - DNA, 25 bp, Mus musculus
tgattactgcatatctgctcttggt

SEQ ID NO: 860048 - DNA, 25 bp, Mus musculus
tgattactgcatttctgctcttggt

SEQ ID NO: 860049 - DNA, 25 bp, Mus musculus
tgattactgtctaggcactggctga

SEQ ID NO: 860050 - DNA, 25 bp, Mus musculus
tgattactgtcttggcactggctga

SEQ ID NO: 860051 - DNA, 25 bp, Mus musculus
tgattactgtgtccttcctatgggc

SEQ ID NO: 860052 - DNA, 25 bp, Mus musculus
tgattactgtgtgcttcctatgggc

SEQ ID NO: 860053 - DNA, 25 bp, Mus musculus
tgattacttaggcatagaagtttta

SEQ ID NO: 860054 - DNA, 25 bp, Mus musculus
tgattacttagggatagaagtttta

SEQ ID NO: 860055 - DNA, 25 bp, Mus musculus
tgattacttctgagtctctacccaa

SEQ ID NO: 860056 - DNA, 25 bp, Mus musculus
tgattacttctgtgtctctacccaa

SEQ ID NO: 860057 - DNA, 25 bp, Mus musculus
tgattacttgaaccttaagcttagt

SEQ ID NO: 860058 - DNA, 25 bp, Mus musculus
tgattacttgaagcttaagcttagt

SEQ ID NO: 860059 - DNA, 25 bp, Mus musculus
tgattacttgcacccatcccaggtg

SEQ ID NO: 860060 - DNA, 25 bp, Mus musculus
tgattacttgcagccatcccaggtg

SEQ ID NO: 860061 - DNA, 25 bp, Mus musculus
tgattagaacctacccagaagccag

SEQ ID NO: 860062 - DNA, 25 bp, Mus musculus
tgattagaaccttcccagaagccag

SEQ ID NO: 860063 - DNA, 25 bp, Mus musculus
tgattagacctacgatcaccctgtc

SEQ ID NO: 860064 - DNA, 25 bp, Mus musculus
tgattagacctaggatcaccctgtc

SEQ ID NO: 860065 - DNA, 25 bp, Mus musculus
tgattagagcccagcatctttccct

SEQ ID NO: 860066 - DNA, 25 bp, Mus musculus
tgattagagccctgcatctttccct

SEQ ID NO: 860067 - DNA, 25 bp, Mus musculus
tgattagatcatagtctcaccctcc

SEQ ID NO: 860068 - DNA, 25 bp, Mus musculus
tgattagatcattgtctcaccctcc

SEQ ID NO: 860069 - DNA, 25 bp, Mus musculus
tgattagcagctcggttggtctaga

SEQ ID NO: 860070 - DNA, 25 bp, Mus musculus
tgattagcagctgggttggtctaga

SEQ ID NO: 860071 - DNA, 25 bp, Mus musculus
tgattagccggcatctttaatgctc

SEQ ID NO: 860072 - DNA, 25 bp, Mus musculus
tgattagccggcttctttaatgctc

SEQ ID NO: 860073 - DNA, 25 bp, Mus musculus
tgattagcgcaactgaggccattca

SEQ ID NO: 860074 - DNA, 25 bp, Mus musculus
tgattagcgcaagtgaggccattca

SEQ ID NO: 860075 - DNA, 25 bp, Mus musculus
tgattagctttgactctaaccccat

SEQ ID NO: 860076 - DNA, 25 bp, Mus musculus
tgattagctttgtctctaaccccat

SEQ ID NO: 860077 - DNA, 25 bp, Mus musculus
tgattaggacctagaccttctctca

SEQ ID NO: 860078 - DNA, 25 bp, Mus musculus
tgattaggaccttgaccttctctca

SEQ ID NO: 860079 - DNA, 25 bp, Mus musculus
tgattaggcacccacttcagtggtg

SEQ ID NO: 860080 - DNA, 25 bp, Mus musculus
tgattaggcaccgacttcagtggtg

SEQ ID NO: 860081 - DNA, 25 bp, Mus musculus
tgattagggcccattggttgtttag

SEQ ID NO: 860082 - DNA, 25 bp, Mus musculus
tgattagggccctttggttgtttag

SEQ ID NO: 860083 - DNA, 25 bp, Mus musculus
tgattaggtataatccccaccggaa

SEQ ID NO: 860084 - DNA, 25 bp, Mus musculus
tgattaggtatattccccaccggaa

SEQ ID NO: 860085 - DNA, 25 bp, Mus musculus
tgattaggtccccttatggcaggaa

SEQ ID NO: 860086 - DNA, 25 bp, Mus musculus
tgattaggtcccgttatggcaggaa

SEQ ID NO: 860087 - DNA, 25 bp, Mus musculus
tgattagtcataactgcccaactcc

SEQ ID NO: 860088 - DNA, 25 bp, Mus musculus
tgattagtcatatctgcccaactcc

SEQ ID NO: 860089 - DNA, 25 bp, Mus musculus
tgattagtgagcctgccccagctgg

SEQ ID NO: 860090 - DNA, 25 bp, Mus musculus
tgattagtgagcgtgccccagctgg

SEQ ID NO: 860091 - DNA, 25 bp, Mus musculus
tgattagttccacatgcatccctat

SEQ ID NO: 860092 - DNA, 25 bp, Mus musculus
tgattagttccagatgcatccctat

SEQ ID NO: 860093 - DNA, 25 bp, Mus musculus
tgattagtttccaccaggctgcaca

SEQ ID NO: 860094 - DNA, 25 bp, Mus musculus
tgattagtttcctccaggctgcaca

SEQ ID NO: 860095 - DNA, 25 bp, Mus musculus
tgattataaaatctccccatccctg

SEQ ID NO: 860096 - DNA, 25 bp, Mus musculus
tgattataaaatgtccccatccctg

SEQ ID NO: 860097 - DNA, 25 bp, Mus musculus
tgattatcacggctgtgtacactgt

SEQ ID NO: 860098 - DNA, 25 bp, Mus musculus
tgattatcacgggtgtgtacactgt

SEQ ID NO: 860099 - DNA, 25 bp, Mus musculus
tgattatcatcacagcagggagcaa

SEQ ID NO: 860100 - DNA, 25 bp, Mus musculus
tgattatcatcagagcagggagcaa

SEQ ID NO: 860101 - DNA, 25 bp, Mus musculus
tgattatccacaagaccacgcgcat

SEQ ID NO: 860102 - DNA, 25 bp, Mus musculus
tgattatccacatgaccacgcgcat

SEQ ID NO: 860103 - DNA, 25 bp, Mus musculus
tgattatccatcacacttctcagag

SEQ ID NO: 860104 - DNA, 25 bp, Mus musculus
tgattatccatctcacttctcagag

SEQ ID NO: 860105 - DNA, 25 bp, Mus musculus
tgattatcgtgcaagcaagcatgct

SEQ ID NO: 860106 - DNA, 25 bp, Mus musculus
tgattatcgtgctagcaagcatgct

SEQ ID NO: 860107 - DNA, 25 bp, Mus musculus
tgattatctcacctacaactgcctc

SEQ ID NO: 860108 - DNA, 25 bp, Mus musculus
tgattatctcacgtacaactgcctc

SEQ ID NO: 860109 - DNA, 25 bp, Mus musculus
tgattatctcagaggtgtcaccagg

SEQ ID NO: 860110 - DNA, 25 bp, Mus musculus
tgattatctcagtggtgtcaccagg

SEQ ID NO: 860111 - DNA, 25 bp, Mus musculus
tgattatctttccttccactctgag

SEQ ID NO: 860112 - DNA, 25 bp, Mus musculus
tgattatctttcgttccactctgag

SEQ ID NO: 860113 - DNA, 25 bp, Mus musculus
tgattatgagccatctgcccaagaa

SEQ ID NO: 860114 - DNA, 25 bp, Mus musculus
tgattatgagccttctgcccaagaa

SEQ ID NO: 860115 - DNA, 25 bp, Mus musculus
tgattatggcttctgctctttccac

SEQ ID NO: 860116 - DNA, 25 bp, Mus musculus
tgattatggcttgtgctctttccac

SEQ ID NO: 860117 - DNA, 25 bp, Mus musculus
tgattatgttttctagacctttcca

SEQ ID NO: 860118 - DNA, 25 bp, Mus musculus
tgattatgttttgtagacctttcca

SEQ ID NO: 860119 - DNA, 25 bp, Mus musculus
tgattattaatcacccctgaaattg

SEQ ID NO: 860120 - DNA, 25 bp, Mus musculus
tgattattaatctcccctgaaattg

SEQ ID NO: 860121 - DNA, 25 bp, Mus musculus
tgattattccccaggcagtggtgtt

SEQ ID NO: 860122 - DNA, 25 bp, Mus musculus
tgattattcccctggcagtggtgtt

SEQ ID NO: 860123 - DNA, 25 bp, Mus musculus
tgattattgctgcagcgctcacgga

SEQ ID NO: 860124 - DNA, 25 bp, Mus musculus
tgattattgctggagcgctcacgga

SEQ ID NO: 860125 - DNA, 25 bp, Mus musculus
tgattattttgtcgtctttttcttt

SEQ ID NO: 860126 - DNA, 25 bp, Mus musculus
tgattattttgtggtctttttcttt

SEQ ID NO: 860127 - DNA, 25 bp, Mus musculus
tgattcaaaaccaggcaccatccgt

SEQ ID NO: 860128 - DNA, 25 bp, Mus musculus
tgattcaaaacctggcaccatccgt

SEQ ID NO: 860129 - DNA, 25 bp, Mus musculus
tgattcaaatgtactcccaatgccc

SEQ ID NO: 860130 - DNA, 25 bp, Mus musculus
tgattcaaatgttctcccaatgccc

SEQ ID NO: 860131 - DNA, 25 bp, Mus musculus
tgattcaaccaaatattttcaaatt

SEQ ID NO: 860132 - DNA, 25 bp, Mus musculus
tgattcaaccaattattttcaaatt

SEQ ID NO: 860133 - DNA, 25 bp, Mus musculus
tgattcaaccctaagaccagcacgt

SEQ ID NO: 860134 - DNA, 25 bp, Mus musculus
tgattcaacccttagaccagcacgt

SEQ ID NO: 860135 - DNA, 25 bp, Mus musculus
tgattcaagatccttttggccacca

SEQ ID NO: 860136 - DNA, 25 bp, Mus musculus
tgattcaagatcgttttggccacca

SEQ ID NO: 860137 - DNA, 25 bp, Mus musculus
tgattcaagtgcatgcccattgctc

SEQ ID NO: 860138 - DNA, 25 bp, Mus musculus
tgattcaagtgcttgcccattgctc

SEQ ID NO: 860139 - DNA, 25 bp, Mus musculus
tgattcaatccactttcacatttac

SEQ ID NO: 860140 - DNA, 25 bp, Mus musculus
tgattcaatccagtttcacatttac

SEQ ID NO: 860141 - DNA, 25 bp, Mus musculus
tgattcacagctactccctaagtat

SEQ ID NO: 860142 - DNA, 25 bp, Mus musculus
tgattcacagcttctccctaagtat

SEQ ID NO: 860143 - DNA, 25 bp, Mus musculus
tgattcacccttcctaacttaagga

SEQ ID NO: 860144 - DNA, 25 bp, Mus musculus
tgattcacccttgctaacttaagga

SEQ ID NO: 860145 - DNA, 25 bp, Mus musculus
tgattcacgggtagcctggacgtta

SEQ ID NO: 860146 - DNA, 25 bp, Mus musculus
tgattcacgggttgcctggacgtta

SEQ ID NO: 860147 - DNA, 25 bp, Mus musculus
tgattcacttacacaggccacatgt

SEQ ID NO: 860148 - DNA, 25 bp, Mus musculus
tgattcacttactcaggccacatgt

SEQ ID NO: 860149 - DNA, 25 bp, Mus musculus
tgattcagaagaatcctctccactt

SEQ ID NO: 860150 - DNA, 25 bp, Mus musculus
tgattcagaagattcctctccactt

SEQ ID NO: 860151 - DNA, 25 bp, Mus musculus
tgattcagattcacaccagctcttt

SEQ ID NO: 860152 - DNA, 25 bp, Mus musculus
tgattcagattctcaccagctcttt

SEQ ID NO: 860153 - DNA, 25 bp, Mus musculus
tgattcagcaagagtaccccagcgg

SEQ ID NO: 860154 - DNA, 25 bp, Mus musculus
tgattcagcaagtgtaccccagcgg

SEQ ID NO: 860155 - DNA, 25 bp, Mus musculus
tgattcagcgtgacaatggctctct

SEQ ID NO: 860156 - DNA, 25 bp, Mus musculus
tgattcagcgtgtcaatggctctct

SEQ ID NO: 860157 - DNA, 25 bp, Mus musculus
tgattcagggcccattccttaggag

SEQ ID NO: 860158 - DNA, 25 bp, Mus musculus
tgattcagggccgattccttaggag

SEQ ID NO: 860159 - DNA, 25 bp, Mus musculus
tgattcagtcaacattcactctcca

SEQ ID NO: 860160 - DNA, 25 bp, Mus musculus
tgattcagtcaagattcactctcca

SEQ ID NO: 860161 - DNA, 25 bp, Mus musculus
tgattcagtggtccgcggtaacaga

SEQ ID NO: 860162 - DNA, 25 bp, Mus musculus
tgattcagtggtgcgcggtaacaga

SEQ ID NO: 860163 - DNA, 25 bp, Mus musculus
tgattcataactcctgtctgggtcc

SEQ ID NO: 860164 - DNA, 25 bp, Mus musculus
tgattcataactgctgtctgggtcc

SEQ ID NO: 860165 - DNA, 25 bp, Mus musculus
tgattcataattacctggtctgttt

SEQ ID NO: 860166 - DNA, 25 bp, Mus musculus
tgattcataatttcctggtctgttt

SEQ ID NO: 860167 - DNA, 25 bp, Mus musculus
tgattcatacttcccagtgctgaca

SEQ ID NO: 860168 - DNA, 25 bp, Mus musculus
tgattcatacttgccagtgctgaca

SEQ ID NO: 860169 - DNA, 25 bp, Mus musculus
tgattcatccaacttcactccaggg

SEQ ID NO: 860170 - DNA, 25 bp, Mus musculus
tgattcatccaagttcactccaggg

SEQ ID NO: 860171 - DNA, 25 bp, Mus musculus
tgattcatctgaccgataaggccat

SEQ ID NO: 860172 - DNA, 25 bp, Mus musculus
tgattcatctgagcgataaggccat

SEQ ID NO: 860173 - DNA, 25 bp, Mus musculus
tgattcatcttcaccaaattcacca

SEQ ID NO: 860174 - DNA, 25 bp, Mus musculus
tgattcatcttctccaaattcacca

SEQ ID NO: 860175 - DNA, 25 bp, Mus musculus
tgattcatgagccagaaccgcatat

SEQ ID NO: 860176 - DNA, 25 bp, Mus musculus
tgattcatgagcgagaaccgcatat

SEQ ID NO: 860177 - DNA, 25 bp, Mus musculus
tgattcatgtacagactaatacaga

SEQ ID NO: 860178 - DNA, 25 bp, Mus musculus
tgattcatgtactgactaatacaga

SEQ ID NO: 860179 - DNA, 25 bp, Mus musculus
tgattcattcatagagaagcgtctc

SEQ ID NO: 860180 - DNA, 25 bp, Mus musculus
tgattcattcattgagaagcgtctc

SEQ ID NO: 860181 - DNA, 25 bp, Mus musculus
tgattcatttcacaacctaggccac

SEQ ID NO: 860182 - DNA, 25 bp, Mus musculus
tgattcatttcagaacctaggccac

SEQ ID NO: 860183 - DNA, 25 bp, Mus musculus
tgattcattttcagcgggcgaaccc

SEQ ID NO: 860184 - DNA, 25 bp, Mus musculus
tgattcattttctgcgggcgaaccc

SEQ ID NO: 860185 - DNA, 25 bp, Mus musculus
tgattccaagaaacccactcactag

SEQ ID NO: 860186 - DNA, 25 bp, Mus musculus
tgattccaagaatcccactcactag

SEQ ID NO: 860187 - DNA, 25 bp, Mus musculus
tgattccaatctcggagcttgcacc

SEQ ID NO: 860188 - DNA, 25 bp, Mus musculus
tgattccaatctgggagcttgcacc

SEQ ID NO: 860189 - DNA, 25 bp, Mus musculus
tgattccacaaacctttctgacctc

SEQ ID NO: 860190 - DNA, 25 bp, Mus musculus
tgattccacaaagctttctgacctc

SEQ ID NO: 860191 - DNA, 25 bp, Mus musculus
tgattccaggccacaagatcataag

SEQ ID NO: 860192 - DNA, 25 bp, Mus musculus
tgattccaggcctcaagatcataag

SEQ ID NO: 860193 - DNA, 25 bp, Mus musculus
tgattccagtacaaccagagtgaag

SEQ ID NO: 860194 - DNA, 25 bp, Mus musculus
tgattccagtactaccagagtgaag

SEQ ID NO: 860195 - DNA, 25 bp, Mus musculus
tgattccatagtccgtcagcgtgac

SEQ ID NO: 860196 - DNA, 25 bp, Mus musculus
tgattccatagtgcgtcagcgtgac

SEQ ID NO: 860197 - DNA, 25 bp, Mus musculus
tgattccatcataaatgcgctagtg

SEQ ID NO: 860198 - DNA, 25 bp, Mus musculus
tgattccatcattaatgcgctagtg

SEQ ID NO: 860199 - DNA, 25 bp, Mus musculus
tgattccatcccacaccaaagttgg

SEQ ID NO: 860200 - DNA, 25 bp, Mus musculus
tgattccatccctcaccaaagttgg

SEQ ID NO: 860201 - DNA, 25 bp, Mus musculus
tgattcccacagatactcgatccta

SEQ ID NO: 860202 - DNA, 25 bp, Mus musculus
tgattcccacagttactcgatccta

SEQ ID NO: 860203 - DNA, 25 bp, Mus musculus
tgattcccagcactccccatttgat

SEQ ID NO: 860204 - DNA, 25 bp, Mus musculus
tgattcccagcagtccccatttgat

SEQ ID NO: 860205 - DNA, 25 bp, Mus musculus
tgattcccaggtattgtgcctctgt

SEQ ID NO: 860206 - DNA, 25 bp, Mus musculus
tgattcccaggttttgtgcctctgt

SEQ ID NO: 860207 - DNA, 25 bp, Mus musculus
tgattcccattcaccatatttcatc

SEQ ID NO: 860208 - DNA, 25 bp, Mus musculus
tgattcccattctccatatttcatc

SEQ ID NO: 860209 - DNA, 25 bp, Mus musculus
tgattccccattatccactatagtg

SEQ ID NO: 860210 - DNA, 25 bp, Mus musculus
tgattccccattttccactatagtg

SEQ ID NO: 860211 - DNA, 25 bp, Mus musculus
tgattcccctacatttcatgtttgg

SEQ ID NO: 860212 - DNA, 25 bp, Mus musculus
tgattcccctacttttcatgtttgg

SEQ ID NO: 860213 - DNA, 25 bp, Mus musculus
tgattcccctagagaagtcactgga

SEQ ID NO: 860214 - DNA, 25 bp, Mus musculus
tgattcccctagtgaagtcactgga

SEQ ID NO: 860215 - DNA, 25 bp, Mus musculus
tgattcccctcaactaaaactgaag

SEQ ID NO: 860216 - DNA, 25 bp, Mus musculus
tgattcccctcatctaaaactgaag

SEQ ID NO: 860217 - DNA, 25 bp, Mus musculus
tgattcccgacacttagaccagaac

SEQ ID NO: 860218 - DNA, 25 bp, Mus musculus
tgattcccgacagttagaccagaac

SEQ ID NO: 860219 - DNA, 25 bp, Mus musculus
tgattccgggaacccttattactat

SEQ ID NO: 860220 - DNA, 25 bp, Mus musculus
tgattccgggaagccttattactat

SEQ ID NO: 860221 - DNA, 25 bp, Mus musculus
tgattccgtagaatctcttgtctgc

SEQ ID NO: 860222 - DNA, 25 bp, Mus musculus
tgattccgtagattctcttgtctgc

SEQ ID NO: 860223 - DNA, 25 bp, Mus musculus
tgattccgtttcattacagtataat

SEQ ID NO: 860224 - DNA, 25 bp, Mus musculus
tgattccgtttctttacagtataat

SEQ ID NO: 860225 - DNA, 25 bp, Mus musculus
tgattcctagcgacagcttggacta

SEQ ID NO: 860226 - DNA, 25 bp, Mus musculus
tgattcctagcgtcagcttggacta

SEQ ID NO: 860227 - DNA, 25 bp, Mus musculus
tgattcctcacacagtccattcaac

SEQ ID NO: 860228 - DNA, 25 bp, Mus musculus
tgattcctcacagagtccattcaac

SEQ ID NO: 860229 - DNA, 25 bp, Mus musculus
tgattcctccaactctggctcagaa

SEQ ID NO: 860230 - DNA, 25 bp, Mus musculus
tgattcctccaagtctggctcagaa

SEQ ID NO: 860231 - DNA, 25 bp, Mus musculus
tgattcctctgaccgttgtgagcaa

SEQ ID NO: 860232 - DNA, 25 bp, Mus musculus
tgattcctctgagcgttgtgagcaa

SEQ ID NO: 860233 - DNA, 25 bp, Mus musculus
tgattcctgaacacctgtagctctt

SEQ ID NO: 860234 - DNA, 25 bp, Mus musculus
tgattcctgaactcctgtagctctt

SEQ ID NO: 860235 - DNA, 25 bp, Mus musculus
tgattcctgcagagaccttctaggc

SEQ ID NO: 860236 - DNA, 25 bp, Mus musculus
tgattcctgcagtgaccttctaggc

SEQ ID NO: 860237 - DNA, 25 bp, Mus musculus
tgattcctggcacgctcatagccat

SEQ ID NO: 860238 - DNA, 25 bp, Mus musculus
tgattcctggcaggctcatagccat

SEQ ID NO: 860239 - DNA, 25 bp, Mus musculus
tgattcctgtgaaaactctattctc

SEQ ID NO: 860240 - DNA, 25 bp, Mus musculus
tgattcctgtgataactctattctc

SEQ ID NO: 860241 - DNA, 25 bp, Mus musculus
tgattccttcatctttgctttcgtt

SEQ ID NO: 860242 - DNA, 25 bp, Mus musculus
tgattccttcatgtttgctttcgtt

SEQ ID NO: 860243 - DNA, 25 bp, Mus musculus
tgattccttcttatggccttcttgg

SEQ ID NO: 860244 - DNA, 25 bp, Mus musculus
tgattccttcttttggccttcttgg

SEQ ID NO: 860245 - DNA, 25 bp, Mus musculus
tgattccttgaaaatctgccaccct

SEQ ID NO: 860246 - DNA, 25 bp, Mus musculus
tgattccttgaatatctgccaccct

SEQ ID NO: 860247 - DNA, 25 bp, Mus musculus
tgattccttgcaaactatagagtgt

SEQ ID NO: 860248 - DNA, 25 bp, Mus musculus
tgattccttgcatactatagagtgt

SEQ ID NO: 860249 - DNA, 25 bp, Mus musculus
tgattcgaggctcggatttgaagct

SEQ ID NO: 860250 - DNA, 25 bp, Mus musculus
tgattcgaggctgggatttgaagct

SEQ ID NO: 860251 - DNA, 25 bp, Mus musculus
tgattcgatcacaactattagcaaa

SEQ ID NO: 860252 - DNA, 25 bp, Mus musculus
tgattcgatcactactattagcaaa

SEQ ID NO: 860253 - DNA, 25 bp, Mus musculus
tgattcgcatttctgttactgtgac

SEQ ID NO: 860254 - DNA, 25 bp, Mus musculus
tgattcgcatttgtgttactgtgac

SEQ ID NO: 860255 - DNA, 25 bp, Mus musculus
tgattcgcgtgtaagcagcttggcc

SEQ ID NO: 860256 - DNA, 25 bp, Mus musculus
tgattcgcgtgttagcagcttggcc

SEQ ID NO: 860257 - DNA, 25 bp, Mus musculus
tgattcgctcatctaccattccgct

SEQ ID NO: 860258 - DNA, 25 bp, Mus musculus
tgattcgctcatgtaccattccgct

SEQ ID NO: 860259 - DNA, 25 bp, Mus musculus
tgattcgcttacctcactggagtac

SEQ ID NO: 860260 - DNA, 25 bp, Mus musculus
tgattcgcttacgtcactggagtac

SEQ ID NO: 860261 - DNA, 25 bp, Mus musculus
tgattcggctgtagtctttgtgaaa

SEQ ID NO: 860262 - DNA, 25 bp, Mus musculus
tgattcggctgttgtctttgtgaaa

SEQ ID NO: 860263 - DNA, 25 bp, Mus musculus
tgattcgggcttatacttgttcttt

SEQ ID NO: 860264 - DNA, 25 bp, Mus musculus
tgattcgggcttttacttgttcttt

SEQ ID NO: 860265 - DNA, 25 bp, Mus musculus
tgattcgtcgagctcccatcttcag

SEQ ID NO: 860266 - DNA, 25 bp, Mus musculus
tgattcgtcgaggtcccatcttcag

SEQ ID NO: 860267 - DNA, 25 bp, Mus musculus
tgattcgtgtctcgtgtcttcgaac

SEQ ID NO: 860268 - DNA, 25 bp, Mus musculus
tgattcgtgtctggtgtcttcgaac

SEQ ID NO: 860269 - DNA, 25 bp, Mus musculus
tgattctaactaagtcccaccaggt

SEQ ID NO: 860270 - DNA, 25 bp, Mus musculus
tgattctaactatgtcccaccaggt

SEQ ID NO: 860271 - DNA, 25 bp, Mus musculus
tgattctacaagcacactgcagcca

SEQ ID NO: 860272 - DNA, 25 bp, Mus musculus
tgattctacaaggacactgcagcca

SEQ ID NO: 860273 - DNA, 25 bp, Mus musculus
tgattctactttccattgacctcac

SEQ ID NO: 860274 - DNA, 25 bp, Mus musculus
tgattctactttgcattgacctcac

SEQ ID NO: 860275 - DNA, 25 bp, Mus musculus
tgattctagccaataactcttcctc

SEQ ID NO: 860276 - DNA, 25 bp, Mus musculus
tgattctagccattaactcttcctc

SEQ ID NO: 860277 - DNA, 25 bp, Mus musculus
tgattctattgaacatcacctgccc

SEQ ID NO: 860278 - DNA, 25 bp, Mus musculus
tgattctattgatcatcacctgccc

SEQ ID NO: 860279 - DNA, 25 bp, Mus musculus
tgattctatttgatcatcaatgctt

SEQ ID NO: 860280 - DNA, 25 bp, Mus musculus
tgattctatttgttcatcaatgctt

SEQ ID NO: 860281 - DNA, 25 bp, Mus musculus
tgattctcaaccaccttttcttgta

SEQ ID NO: 860282 - DNA, 25 bp, Mus musculus
tgattctcaacctccttttcttgta

SEQ ID NO: 860283 - DNA, 25 bp, Mus musculus
tgattctcaccgacctgaagtcaaa

SEQ ID NO: 860284 - DNA, 25 bp, Mus musculus
tgattctcaccgtcctgaagtcaaa

SEQ ID NO: 860285 - DNA, 25 bp, Mus musculus
tgattctcagtcatgcccgagtgaa

SEQ ID NO: 860286 - DNA, 25 bp, Mus musculus
tgattctcagtcttgcccgagtgaa

SEQ ID NO: 860287 - DNA, 25 bp, Mus musculus
tgattctccagaacctccaaacaaa

SEQ ID NO: 860288 - DNA, 25 bp, Mus musculus
tgattctccagatcctccaaacaaa

SEQ ID NO: 860289 - DNA, 25 bp, Mus musculus
tgattctccagtaccttgattcaga

SEQ ID NO: 860290 - DNA, 25 bp, Mus musculus
tgattctccagttccttgattcaga

SEQ ID NO: 860291 - DNA, 25 bp, Mus musculus
tgattctccccaattaaccactaat

SEQ ID NO: 860292 - DNA, 25 bp, Mus musculus
tgattctccccatttaaccactaat

SEQ ID NO: 860293 - DNA, 25 bp, Mus musculus
tgattctcccctccggagttatagg

SEQ ID NO: 860294 - DNA, 25 bp, Mus musculus
tgattctcccctgcggagttatagg

SEQ ID NO: 860295 - DNA, 25 bp, Mus musculus
tgattctccgacacatatcagtgga

SEQ ID NO: 860296 - DNA, 25 bp, Mus musculus
tgattctccgactcatatcagtgga

SEQ ID NO: 860297 - DNA, 25 bp, Mus musculus
tgattctcctcaactccagtatgta

SEQ ID NO: 860298 - DNA, 25 bp, Mus musculus
tgattctcctcatctccagtatgta

SEQ ID NO: 860299 - DNA, 25 bp, Mus musculus
tgattctcgagtctcgctccggcca

SEQ ID NO: 860300 - DNA, 25 bp, Mus musculus
tgattctcgagtgtcgctccggcca

SEQ ID NO: 860301 - DNA, 25 bp, Mus musculus
tgattctctcctctcagactctaaa

SEQ ID NO: 860302 - DNA, 25 bp, Mus musculus
tgattctctcctgtcagactctaaa

SEQ ID NO: 860303 - DNA, 25 bp, Mus musculus
tgattctctctgaggtcggaattta

SEQ ID NO: 860304 - DNA, 25 bp, Mus musculus
tgattctctctgtggtcggaattta

SEQ ID NO: 860305 - DNA, 25 bp, Mus musculus
tgattctctgcccaggagactactg

SEQ ID NO: 860306 - DNA, 25 bp, Mus musculus
tgattctctgccgaggagactactg

SEQ ID NO: 860307 - DNA, 25 bp, Mus musculus
tgattctctggacggaaagagctct

SEQ ID NO: 860308 - DNA, 25 bp, Mus musculus
tgattctctggagggaaagagctct

SEQ ID NO: 860309 - DNA, 25 bp, Mus musculus
tgattctctgtgatggatacggtgt

SEQ ID NO: 860310 - DNA, 25 bp, Mus musculus
tgattctctgtgttggatacggtgt

SEQ ID NO: 860311 - DNA, 25 bp, Mus musculus
tgattctcttcacaccctgtatgtc

SEQ ID NO: 860312 - DNA, 25 bp, Mus musculus
tgattctcttcacccattgagcaca

SEQ ID NO: 860313 - DNA, 25 bp, Mus musculus
tgattctcttcagaccctgtatgtc

SEQ ID NO: 860314 - DNA, 25 bp, Mus musculus
tgattctcttcagccattgagcaca

SEQ ID NO: 860315 - DNA, 25 bp, Mus musculus
tgattctcttctctgggtgcttaaa

SEQ ID NO: 860316 - DNA, 25 bp, Mus musculus
tgattctcttctgtgggtgcttaaa

SEQ ID NO: 860317 - DNA, 25 bp, Mus musculus
tgattctcttgcatctacttcacaa

SEQ ID NO: 860318 - DNA, 25 bp, Mus musculus
tgattctcttgcttctacttcacaa

SEQ ID NO: 860319 - DNA, 25 bp, Mus musculus
tgattctcttggctccacataatag

SEQ ID NO: 860320 - DNA, 25 bp, Mus musculus
tgattctcttgggtccacataatag

SEQ ID NO: 860321 - DNA, 25 bp, Mus musculus
tgattctgaggcaccttaccaatac

SEQ ID NO: 860322 - DNA, 25 bp, Mus musculus
tgattctgaggctccttaccaatac

SEQ ID NO: 860323 - DNA, 25 bp, Mus musculus
tgattctgagggacacccctgcata

SEQ ID NO: 860324 - DNA, 25 bp, Mus musculus
tgattctgagggtcacccctgcata

SEQ ID NO: 860325 - DNA, 25 bp, Mus musculus
tgattctgcaagacctgaccttcgt

SEQ ID NO: 860326 - DNA, 25 bp, Mus musculus
tgattctgcaagtcctgaccttcgt

SEQ ID NO: 860327 - DNA, 25 bp, Mus musculus
tgattctgctccctgaactgtattg

SEQ ID NO: 860328 - DNA, 25 bp, Mus musculus
tgattctgctccgtgaactgtattg

SEQ ID NO: 860329 - DNA, 25 bp, Mus musculus
tgattctggtcacccaggttcaaac

SEQ ID NO: 860330 - DNA, 25 bp, Mus musculus
tgattctggtcagccaggttcaaac

SEQ ID NO: 860331 - DNA, 25 bp, Mus musculus
tgattctgtagacgtaccactcact

SEQ ID NO: 860332 - DNA, 25 bp, Mus musculus
tgattctgtagaggtaccactcact

SEQ ID NO: 860333 - DNA, 25 bp, Mus musculus
tgattctgtgttcacactcctgctt

SEQ ID NO: 860334 - DNA, 25 bp, Mus musculus
tgattctgtgttgacactcctgctt

SEQ ID NO: 860335 - DNA, 25 bp, Mus musculus
tgattcttactgaggctaaccttga

SEQ ID NO: 860336 - DNA, 25 bp, Mus musculus
tgattcttactgtggctaaccttga

SEQ ID NO: 860337 - DNA, 25 bp, Mus musculus
tgattcttatgacccaaatgacttg

SEQ ID NO: 860338 - DNA, 25 bp, Mus musculus
tgattcttatgagccaaatgacttg

SEQ ID NO: 860339 - DNA, 25 bp, Mus musculus
tgattcttatttatagcaaatggag

SEQ ID NO: 860340 - DNA, 25 bp, Mus musculus
tgattcttatttttagcaaatggag

SEQ ID NO: 860341 - DNA, 25 bp, Mus musculus
tgattcttccatatctagctccagt

SEQ ID NO: 860342 - DNA, 25 bp, Mus musculus
tgattcttccatttctagctccagt

SEQ ID NO: 860343 - DNA, 25 bp, Mus musculus
tgattcttcccactctgactttcag

SEQ ID NO: 860344 - DNA, 25 bp, Mus musculus
tgattcttcccagtctgactttcag

SEQ ID NO: 860345 - DNA, 25 bp, Mus musculus
tgattcttcccgatgtgcttggcaa

SEQ ID NO: 860346 - DNA, 25 bp, Mus musculus
tgattcttcccgttgtgcttggcaa

SEQ ID NO: 860347 - DNA, 25 bp, Mus musculus
tgattcttccttaagcttaaccttt

SEQ ID NO: 860348 - DNA, 25 bp, Mus musculus
tgattcttcctttagcttaaccttt

SEQ ID NO: 860349 - DNA, 25 bp, Mus musculus
tgattcttcgcactgtttttcaaat

SEQ ID NO: 860350 - DNA, 25 bp, Mus musculus
tgattcttcgcagtgtttttcaaat

SEQ ID NO: 860351 - DNA, 25 bp, Mus musculus
tgattcttctcaaccgggttacaga

SEQ ID NO: 860352 - DNA, 25 bp, Mus musculus
tgattcttctcatccgggttacaga

SEQ ID NO: 860353 - DNA, 25 bp, Mus musculus
tgattcttctccaggatgaccttgc

SEQ ID NO: 860354 - DNA, 25 bp, Mus musculus
tgattcttctcctggatgaccttgc

SEQ ID NO: 860355 - DNA, 25 bp, Mus musculus
tgattcttcttgatttccgctatta

SEQ ID NO: 860356 - DNA, 25 bp, Mus musculus
tgattcttcttgttttccgctatta

SEQ ID NO: 860357 - DNA, 25 bp, Mus musculus
tgattcttgctcacatatagctaag

SEQ ID NO: 860358 - DNA, 25 bp, Mus musculus
tgattcttgctctcatatagctaag

SEQ ID NO: 860359 - DNA, 25 bp, Mus musculus
tgattcttggccctgccaatatttg

SEQ ID NO: 860360 - DNA, 25 bp, Mus musculus
tgattcttggccgtgccaatatttg

SEQ ID NO: 860361 - DNA, 25 bp, Mus musculus
tgattcttgtgcctgttctcaagac

SEQ ID NO: 860362 - DNA, 25 bp, Mus musculus
tgattcttgtgcgtgttctcaagac

SEQ ID NO: 860363 - DNA, 25 bp, Mus musculus
tgattcttgttaatagttctcaaaa

SEQ ID NO: 860364 - DNA, 25 bp, Mus musculus
tgattcttgttattagttctcaaaa

SEQ ID NO: 860365 - DNA, 25 bp, Mus musculus
tgattctttaagcatccaactccac

SEQ ID NO: 860366 - DNA, 25 bp, Mus musculus
tgattctttaaggatccaactccac

SEQ ID NO: 860367 - DNA, 25 bp, Mus musculus
tgattctttcccacctaagtgaggt

SEQ ID NO: 860368 - DNA, 25 bp, Mus musculus
tgattctttcccagttctccttggt

SEQ ID NO: 860369 - DNA, 25 bp, Mus musculus
tgattctttccctcctaagtgaggt

SEQ ID NO: 860370 - DNA, 25 bp, Mus musculus
tgattctttccctgttctccttggt

SEQ ID NO: 860371 - DNA, 25 bp, Mus musculus
tgattctttccgactgctacaggaa

SEQ ID NO: 860372 - DNA, 25 bp, Mus musculus
tgattctttccgtctgctacaggaa

SEQ ID NO: 860373 - DNA, 25 bp, Mus musculus
tgattctttggaactgagccctcaa

SEQ ID NO: 860374 - DNA, 25 bp, Mus musculus
tgattctttggatctgagccctcaa

SEQ ID NO: 860375 - DNA, 25 bp, Mus musculus
tgattcttttgcctactctcaagat

SEQ ID NO: 860376 - DNA, 25 bp, Mus musculus
tgattcttttgcgtactctcaagat

SEQ ID NO: 860377 - DNA, 25 bp, Mus musculus
tgattcttttggacacccatgccca

SEQ ID NO: 860378 - DNA, 25 bp, Mus musculus
tgattcttttggtcacccatgccca

SEQ ID NO: 860379 - DNA, 25 bp, Mus musculus
tgattgaaaaacaaccacctggatt

SEQ ID NO: 860380 - DNA, 25 bp, Mus musculus
tgattgaaaaactaccacctggatt

SEQ ID NO: 860381 - DNA, 25 bp, Mus musculus
tgattgaaacccatgaacctagaga

SEQ ID NO: 860382 - DNA, 25 bp, Mus musculus
tgattgaaacccattaacaactctt

SEQ ID NO: 860383 - DNA, 25 bp, Mus musculus
tgattgaaacccttgaacctagaga

SEQ ID NO: 860384 - DNA, 25 bp, Mus musculus
tgattgaaaccctttaacaactctt

SEQ ID NO: 860385 - DNA, 25 bp, Mus musculus
tgattgaaagtgagagccctcactg

SEQ ID NO: 860386 - DNA, 25 bp, Mus musculus
tgattgaaagtgtgagccctcactg

SEQ ID NO: 860387 - DNA, 25 bp, Mus musculus
tgattgaacaccctgagtacggaga

SEQ ID NO: 860388 - DNA, 25 bp, Mus musculus
tgattgaacaccgtgagtacggaga

SEQ ID NO: 860389 - DNA, 25 bp, Mus musculus
tgattgaacgaacacttcccctgta

SEQ ID NO: 860390 - DNA, 25 bp, Mus musculus
tgattgaacgaagacttcccctgta

SEQ ID NO: 860391 - DNA, 25 bp, Mus musculus
tgattgacaccaaagacttcccagt

SEQ ID NO: 860392 - DNA, 25 bp, Mus musculus
tgattgacaccatagacttcccagt

SEQ ID NO: 860393 - DNA, 25 bp, Mus musculus
tgattgacagaaacccctgtggtcg

SEQ ID NO: 860394 - DNA, 25 bp, Mus musculus
tgattgacagaatcccctgtggtcg

SEQ ID NO: 860395 - DNA, 25 bp, Mus musculus
tgattgaccggtcggaaaggacact

SEQ ID NO: 860396 - DNA, 25 bp, Mus musculus
tgattgaccggtgggaaaggacact

SEQ ID NO: 860397 - DNA, 25 bp, Mus musculus
tgattgacgaggaagggtccagccc

SEQ ID NO: 860398 - DNA, 25 bp, Mus musculus
tgattgacgaggtagggtccagccc

SEQ ID NO: 860399 - DNA, 25 bp, Mus musculus
tgattgagggccagcatggttccta

SEQ ID NO: 860400 - DNA, 25 bp, Mus musculus
tgattgagggcctgcatggttccta

SEQ ID NO: 860401 - DNA, 25 bp, Mus musculus
tgattgagtgcaccctctgtgggac

SEQ ID NO: 860402 - DNA, 25 bp, Mus musculus
tgattgagtgcagcctctgtgggac

SEQ ID NO: 860403 - DNA, 25 bp, Mus musculus
tgattgatcattatccctgaccttt

SEQ ID NO: 860404 - DNA, 25 bp, Mus musculus
tgattgatcattttccctgaccttt

SEQ ID NO: 860405 - DNA, 25 bp, Mus musculus
tgattgattaccacgtctggccctg

SEQ ID NO: 860406 - DNA, 25 bp, Mus musculus
tgattgattacctcgtctggccctg

SEQ ID NO: 860407 - DNA, 25 bp, Mus musculus
tgattgattgaaaggatctcactat

SEQ ID NO: 860408 - DNA, 25 bp, Mus musculus
tgattgattgaatggatctcactat

SEQ ID NO: 860409 - DNA, 25 bp, Mus musculus
tgattgattttcattcagcagccct

SEQ ID NO: 860410 - DNA, 25 bp, Mus musculus
tgattgattttctttcagcagccct

SEQ ID NO: 860411 - DNA, 25 bp, Mus musculus
tgattgcaaacaacacgacggtgga

SEQ ID NO: 860412 - DNA, 25 bp, Mus musculus
tgattgcaaacatcacgacggtgga

SEQ ID NO: 860413 - DNA, 25 bp, Mus musculus
tgattgcagaggagcctctctgctt

SEQ ID NO: 860414 - DNA, 25 bp, Mus musculus
tgattgcagaggtgcctctctgctt

SEQ ID NO: 860415 - DNA, 25 bp, Mus musculus
tgattgcagcaaacccttcactcat

SEQ ID NO: 860416 - DNA, 25 bp, Mus musculus
tgattgcagcaatcccttcactcat

SEQ ID NO: 860417 - DNA, 25 bp, Mus musculus
tgattgcagccacactggtttttga

SEQ ID NO: 860418 - DNA, 25 bp, Mus musculus
tgattgcagccagactggtttttga

SEQ ID NO: 860419 - DNA, 25 bp, Mus musculus
tgattgcccagactgtgacagcggt

SEQ ID NO: 860420 - DNA, 25 bp, Mus musculus
tgattgcccagagtgtgacagcggt

SEQ ID NO: 860421 - DNA, 25 bp, Mus musculus
tgattgccttccaaaacacctgcct

SEQ ID NO: 860422 - DNA, 25 bp, Mus musculus
tgattgccttcctaaacacctgcct

SEQ ID NO: 860423 - DNA, 25 bp, Mus musculus
tgattgcgggtacagatcactctgg

SEQ ID NO: 860424 - DNA, 25 bp, Mus musculus
tgattgcgggtagagatcactctgg

SEQ ID NO: 860425 - DNA, 25 bp, Mus musculus
tgattgctgcctagctggctagccc

SEQ ID NO: 860426 - DNA, 25 bp, Mus musculus
tgattgctgccttgctggctagccc

SEQ ID NO: 860427 - DNA, 25 bp, Mus musculus
tgattgctggttcttccaagatgaa

SEQ ID NO: 860428 - DNA, 25 bp, Mus musculus
tgattgctggttgttccaagatgaa

SEQ ID NO: 860429 - DNA, 25 bp, Mus musculus
tgattgcttcccatggagacggcct

SEQ ID NO: 860430 - DNA, 25 bp, Mus musculus
tgattgcttcccttggagacggcct

SEQ ID NO: 860431 - DNA, 25 bp, Mus musculus
tgattgcttgccctcagtcatgcac

SEQ ID NO: 860432 - DNA, 25 bp, Mus musculus
tgattgcttgccgtcagtcatgcac

SEQ ID NO: 860433 - DNA, 25 bp, Mus musculus
tgattgcttttgagtttgctacccc

SEQ ID NO: 860434 - DNA, 25 bp, Mus musculus
tgattgcttttgtgtttgctacccc

SEQ ID NO: 860435 - DNA, 25 bp, Mus musculus
tgattggaatcaacctgagcttctg

SEQ ID NO: 860436 - DNA, 25 bp, Mus musculus
tgattggaatcatcctgagcttctg

SEQ ID NO: 860437 - DNA, 25 bp, Mus musculus
tgattggactttaaacctaccgaat

SEQ ID NO: 860438 - DNA, 25 bp, Mus musculus
tgattggacttttaacctaccgaat

SEQ ID NO: 860439 - DNA, 25 bp, Mus musculus
tgattggagatcaggccagtttggc

SEQ ID NO: 860440 - DNA, 25 bp, Mus musculus
tgattggagatctggccagtttggc

SEQ ID NO: 860441 - DNA, 25 bp, Mus musculus
tgattggcacagacatgactcctaa

SEQ ID NO: 860442 - DNA, 25 bp, Mus musculus
tgattggcacagtcatgactcctaa

SEQ ID NO: 860443 - DNA, 25 bp, Mus musculus
tgattggcaggaacagtgtagtaaa

SEQ ID NO: 860444 - DNA, 25 bp, Mus musculus
tgattggcaggatcagtgtagtaaa

SEQ ID NO: 860445 - DNA, 25 bp, Mus musculus
tgattggcaggcagagaggctcaat

SEQ ID NO: 860446 - DNA, 25 bp, Mus musculus
tgattggcaggctgagaggctcaat

SEQ ID NO: 860447 - DNA, 25 bp, Mus musculus
tgattggcatagaccacagcgcaca

SEQ ID NO: 860448 - DNA, 25 bp, Mus musculus
tgattggcatagtccacagcgcaca

SEQ ID NO: 860449 - DNA, 25 bp, Mus musculus
tgattggccagtatattcgctccac

SEQ ID NO: 860450 - DNA, 25 bp, Mus musculus
tgattggccagtttattcgctccac

SEQ ID NO: 860451 - DNA, 25 bp, Mus musculus
tgattggccccaaatatcccataag

SEQ ID NO: 860452 - DNA, 25 bp, Mus musculus
tgattggccccacaaaccacacaaa

SEQ ID NO: 860453 - DNA, 25 bp, Mus musculus
tgattggccccagaaaccacacaaa

SEQ ID NO: 860454 - DNA, 25 bp, Mus musculus
tgattggccccatatatcccataag

SEQ ID NO: 860455 - DNA, 25 bp, Mus musculus
tgattggccgcaccctggttatcga

SEQ ID NO: 860456 - DNA, 25 bp, Mus musculus
tgattggccgcagcctggttatcga

SEQ ID NO: 860457 - DNA, 25 bp, Mus musculus
tgattggcctcaaatttgtcacagt

SEQ ID NO: 860458 - DNA, 25 bp, Mus musculus
tgattggcctcatatttgtcacagt

SEQ ID NO: 860459 - DNA, 25 bp, Mus musculus
tgattggcggctactctggcaacca

SEQ ID NO: 860460 - DNA, 25 bp, Mus musculus
tgattggcggcttctctggcaacca

SEQ ID NO: 860461 - DNA, 25 bp, Mus musculus
tgattggcttgacagatttttcccc

SEQ ID NO: 860462 - DNA, 25 bp, Mus musculus
tgattggcttgagagatttttcccc

SEQ ID NO: 860463 - DNA, 25 bp, Mus musculus
tgattgggcttcaggttggcctttc

SEQ ID NO: 860464 - DNA, 25 bp, Mus musculus
tgattgggcttctggttggcctttc

SEQ ID NO: 860465 - DNA, 25 bp, Mus musculus
tgattgggtcctcaggccttgaagc

SEQ ID NO: 860466 - DNA, 25 bp, Mus musculus
tgattgggtcctgaggccttgaagc

SEQ ID NO: 860467 - DNA, 25 bp, Mus musculus
tgattggtaaccaccatctggcaaa

SEQ ID NO: 860468 - DNA, 25 bp, Mus musculus
tgattggtaacctccatctggcaaa

SEQ ID NO: 860469 - DNA, 25 bp, Mus musculus
tgattggtacacctcccgaaaccta

SEQ ID NO: 860470 - DNA, 25 bp, Mus musculus
tgattggtacacgtcccgaaaccta

SEQ ID NO: 860471 - DNA, 25 bp, Mus musculus
tgattggtaccactgtgaaccgtcc

SEQ ID NO: 860472 - DNA, 25 bp, Mus musculus
tgattggtaccagtgtgaaccgtcc

SEQ ID NO: 860473 - DNA, 25 bp, Mus musculus
tgattggtccgacggcatctccagc

SEQ ID NO: 860474 - DNA, 25 bp, Mus musculus
tgattggtccgagggcatctccagc

SEQ ID NO: 860475 - DNA, 25 bp, Mus musculus
tgattggtcgccctcgtttccccat

SEQ ID NO: 860476 - DNA, 25 bp, Mus musculus
tgattggtcgccgtcgtttccccat

SEQ ID NO: 860477 - DNA, 25 bp, Mus musculus
tgattggtgacacgcccgagtgtcc

SEQ ID NO: 860478 - DNA, 25 bp, Mus musculus
tgattggtgacaggcccgagtgtcc

SEQ ID NO: 860479 - DNA, 25 bp, Mus musculus
tgattggtgaccagacaagtgcctg

SEQ ID NO: 860480 - DNA, 25 bp, Mus musculus
tgattggtgacctgacaagtgcctg

SEQ ID NO: 860481 - DNA, 25 bp, Mus musculus
tgattggttcttaagctgtacagct

SEQ ID NO: 860482 - DNA, 25 bp, Mus musculus
tgattggttctttagctgtacagct

SEQ ID NO: 860483 - DNA, 25 bp, Mus musculus
tgattggttgctaaggtttggtttt

SEQ ID NO: 860484 - DNA, 25 bp, Mus musculus
tgattggttgctccaccccagacaa

SEQ ID NO: 860485 - DNA, 25 bp, Mus musculus
tgattggttgctgcaccccagacaa

SEQ ID NO: 860486 - DNA, 25 bp, Mus musculus
tgattggttgcttaggtttggtttt

SEQ ID NO: 860487 - DNA, 25 bp, Mus musculus
tgattgtaagcaccgaccatgccca

SEQ ID NO: 860488 - DNA, 25 bp, Mus musculus
tgattgtaagcagcgaccatgccca

SEQ ID NO: 860489 - DNA, 25 bp, Mus musculus
tgattgtaccctcggcctcacgtgg

SEQ ID NO: 860490 - DNA, 25 bp, Mus musculus
tgattgtaccctgggcctcacgtgg

SEQ ID NO: 860491 - DNA, 25 bp, Mus musculus
tgattgtagcatctgcagaccctat

SEQ ID NO: 860492 - DNA, 25 bp, Mus musculus
tgattgtagcatgtgcagaccctat

SEQ ID NO: 860493 - DNA, 25 bp, Mus musculus
tgattgtatatcactggccagattt

SEQ ID NO: 860494 - DNA, 25 bp, Mus musculus
tgattgtatatctctggccagattt

SEQ ID NO: 860495 - DNA, 25 bp, Mus musculus
tgattgtcaagcatttcctcctgag

SEQ ID NO: 860496 - DNA, 25 bp, Mus musculus
tgattgtcaagcttttcctcctgag

SEQ ID NO: 860497 - DNA, 25 bp, Mus musculus
tgattgtccctgagactgctgcttc

SEQ ID NO: 860498 - DNA, 25 bp, Mus musculus
tgattgtccctgtgactgctgcttc

SEQ ID NO: 860499 - DNA, 25 bp, Mus musculus
tgattgtccttaacatcgtcatcct

SEQ ID NO: 860500 - DNA, 25 bp, Mus musculus
tgattgtccttatcatcgtcatcct

SEQ ID NO: 860501 - DNA, 25 bp, Mus musculus
tgattgtgaagaacggtggttacgc

SEQ ID NO: 860502 - DNA, 25 bp, Mus musculus
tgattgtgaagatcggtggttacgc

SEQ ID NO: 860503 - DNA, 25 bp, Mus musculus
tgattgtgcctcagacactagacct

SEQ ID NO: 860504 - DNA, 25 bp, Mus musculus
tgattgtgcctctgacactagacct

SEQ ID NO: 860505 - DNA, 25 bp, Mus musculus
tgattgtgcgcgcttctaagttacc

SEQ ID NO: 860506 - DNA, 25 bp, Mus musculus
tgattgtgcgcggttctaagttacc

SEQ ID NO: 860507 - DNA, 25 bp, Mus musculus
tgattgtggtacctctgacttttct

SEQ ID NO: 860508 - DNA, 25 bp, Mus musculus
tgattgtggtacgtctgacttttct

SEQ ID NO: 860509 - DNA, 25 bp, Mus musculus
tgattgtggtcacaccctgacaaca

SEQ ID NO: 860510 - DNA, 25 bp, Mus musculus
tgattgtggtcagaccctgacaaca

SEQ ID NO: 860511 - DNA, 25 bp, Mus musculus
tgattgtgtcctccagattatctca

SEQ ID NO: 860512 - DNA, 25 bp, Mus musculus
tgattgtgtcctgcagattatctca

SEQ ID NO: 860513 - DNA, 25 bp, Mus musculus
tgattgttaatcactcactcccatg

SEQ ID NO: 860514 - DNA, 25 bp, Mus musculus
tgattgttaatctctcactcccatg

SEQ ID NO: 860515 - DNA, 25 bp, Mus musculus
tgattgttagtacaaaattgtgact

SEQ ID NO: 860516 - DNA, 25 bp, Mus musculus
tgattgttagtagaaaattgtgact

SEQ ID NO: 860517 - DNA, 25 bp, Mus musculus
tgattgttagtcatctcacaccacc

SEQ ID NO: 860518 - DNA, 25 bp, Mus musculus
tgattgttagtcttctcacaccacc

SEQ ID NO: 860519 - DNA, 25 bp, Mus musculus
tgattgttcaccattgcgttttgtt

SEQ ID NO: 860520 - DNA, 25 bp, Mus musculus
tgattgttcacctttgcgttttgtt

SEQ ID NO: 860521 - DNA, 25 bp, Mus musculus
tgattgttctccaagtctccaaagg

SEQ ID NO: 860522 - DNA, 25 bp, Mus musculus
tgattgttctcctagtctccaaagg

SEQ ID NO: 860523 - DNA, 25 bp, Mus musculus
tgattgttgcctacacatatttgtg

SEQ ID NO: 860524 - DNA, 25 bp, Mus musculus
tgattgttgccttcacatatttgtg

SEQ ID NO: 860525 - DNA, 25 bp, Mus musculus
tgattgtttttgaagcaaggctttc

SEQ ID NO: 860526 - DNA, 25 bp, Mus musculus
tgattgtttttgtagcaaggctttc

SEQ ID NO: 860527 - DNA, 25 bp, Mus musculus
tgatttaagcttctgcatcttcctg

SEQ ID NO: 860528 - DNA, 25 bp, Mus musculus
tgatttaagcttgtgcatcttcctg

SEQ ID NO: 860529 - DNA, 25 bp, Mus musculus
tgatttacagctccagtcctgctaa

SEQ ID NO: 860530 - DNA, 25 bp, Mus musculus
tgatttacagctgcagtcctgctaa

SEQ ID NO: 860531 - DNA, 25 bp, Mus musculus
tgatttacaggaatcaaatctctct

SEQ ID NO: 860532 - DNA, 25 bp, Mus musculus
tgatttacaggattcaaatctctct

SEQ ID NO: 860533 - DNA, 25 bp, Mus musculus
tgatttacctcactgtttaacagtt

SEQ ID NO: 860534 - DNA, 25 bp, Mus musculus
tgatttacctcagtgtttaacagtt

SEQ ID NO: 860535 - DNA, 25 bp, Mus musculus
tgatttacctgtcccgacgggactt

SEQ ID NO: 860536 - DNA, 25 bp, Mus musculus
tgatttacctgtgccgacgggactt

SEQ ID NO: 860537 - DNA, 25 bp, Mus musculus
tgatttacgacgacggcgcttcgag

SEQ ID NO: 860538 - DNA, 25 bp, Mus musculus
tgatttacgacgtcggcgcttcgag

SEQ ID NO: 860539 - DNA, 25 bp, Mus musculus
tgatttacgccacttacttcgcagc

SEQ ID NO: 860540 - DNA, 25 bp, Mus musculus
tgatttacgccagttacttcgcagc

SEQ ID NO: 860541 - DNA, 25 bp, Mus musculus
tgatttactcagagccacctgacag

SEQ ID NO: 860542 - DNA, 25 bp, Mus musculus
tgatttactcagtgccacctgacag

SEQ ID NO: 860543 - DNA, 25 bp, Mus musculus
tgatttagacttctccacttagcgg

SEQ ID NO: 860544 - DNA, 25 bp, Mus musculus
tgatttagacttgtccacttagcgg

SEQ ID NO: 860545 - DNA, 25 bp, Mus musculus
tgatttagcccgataccttgacaac

SEQ ID NO: 860546 - DNA, 25 bp, Mus musculus
tgatttagcccgttaccttgacaac

SEQ ID NO: 860547 - DNA, 25 bp, Mus musculus
tgatttagctgtaccatgggttctg

SEQ ID NO: 860548 - DNA, 25 bp, Mus musculus
tgatttagctgttccatgggttctg

SEQ ID NO: 860549 - DNA, 25 bp, Mus musculus
tgatttaggtcgagttgatccaact

SEQ ID NO: 860550 - DNA, 25 bp, Mus musculus
tgatttaggtcgtgttgatccaact

SEQ ID NO: 860551 - DNA, 25 bp, Mus musculus
tgatttagtaccagtcagcttgcct

SEQ ID NO: 860552 - DNA, 25 bp, Mus musculus
tgatttagtacctgtcagcttgcct

SEQ ID NO: 860553 - DNA, 25 bp, Mus musculus
tgatttatcatccatgtctgcatgt

SEQ ID NO: 860554 - DNA, 25 bp, Mus musculus
tgatttatcatcgatgtctgcatgt

SEQ ID NO: 860555 - DNA, 25 bp, Mus musculus
tgatttatcctgaattatagctcct

SEQ ID NO: 860556 - DNA, 25 bp, Mus musculus
tgatttatcctgtattatagctcct

SEQ ID NO: 860557 - DNA, 25 bp, Mus musculus
tgatttatgtccagggtttaattcg

SEQ ID NO: 860558 - DNA, 25 bp, Mus musculus
tgatttatgtcctgggtttaattcg

SEQ ID NO: 860559 - DNA, 25 bp, Mus musculus
tgatttattgctatctatcctgtgc

SEQ ID NO: 860560 - DNA, 25 bp, Mus musculus
tgatttattgctttctatcctgtgc

SEQ ID NO: 860561 - DNA, 25 bp, Mus musculus
tgatttatttgaccttagtgacaca

SEQ ID NO: 860562 - DNA, 25 bp, Mus musculus
tgatttatttgagcttagtgacaca

SEQ ID NO: 860563 - DNA, 25 bp, Mus musculus
tgatttcaaactccttagttggcgt

SEQ ID NO: 860564 - DNA, 25 bp, Mus musculus
tgatttcaaactgcttagttggcgt

SEQ ID NO: 860565 - DNA, 25 bp, Mus musculus
tgatttcaacagcacccagttctca

SEQ ID NO: 860566 - DNA, 25 bp, Mus musculus
tgatttcaacaggacccagttctca

SEQ ID NO: 860567 - DNA, 25 bp, Mus musculus
tgatttcaaggcacagtccttcttt

SEQ ID NO: 860568 - DNA, 25 bp, Mus musculus
tgatttcaaggctcagtccttcttt

SEQ ID NO: 860569 - DNA, 25 bp, Mus musculus
tgatttcaatcaattgcctctctgc

SEQ ID NO: 860570 - DNA, 25 bp, Mus musculus
tgatttcaatcatttgcctctctgc

SEQ ID NO: 860571 - DNA, 25 bp, Mus musculus
tgatttcacatcacccagatcatga

SEQ ID NO: 860572 - DNA, 25 bp, Mus musculus
tgatttcacatctcccagatcatga

SEQ ID NO: 860573 - DNA, 25 bp, Mus musculus
tgatttcaccacaactttcattctc

SEQ ID NO: 860574 - DNA, 25 bp, Mus musculus
tgatttcaccactactttcattctc

SEQ ID NO: 860575 - DNA, 25 bp, Mus musculus
tgatttcacggacggccacagtacc

SEQ ID NO: 860576 - DNA, 25 bp, Mus musculus
tgatttcacggagggccacagtacc

SEQ ID NO: 860577 - DNA, 25 bp, Mus musculus
tgatttcactgcctcagatgtgcct

SEQ ID NO: 860578 - DNA, 25 bp, Mus musculus
tgatttcactgcgtcagatgtgcct

SEQ ID NO: 860579 - DNA, 25 bp, Mus musculus
tgatttcactgtctatattacctgt

SEQ ID NO: 860580 - DNA, 25 bp, Mus musculus
tgatttcactgtgtatattacctgt

SEQ ID NO: 860581 - DNA, 25 bp, Mus musculus
tgatttcagaatacctcccctaaaa

SEQ ID NO: 860582 - DNA, 25 bp, Mus musculus
tgatttcagaattcctcccctaaaa

SEQ ID NO: 860583 - DNA, 25 bp, Mus musculus
tgatttcagctcatcagcaggacat

SEQ ID NO: 860584 - DNA, 25 bp, Mus musculus
tgatttcagctcttcagcaggacat

SEQ ID NO: 860585 - DNA, 25 bp, Mus musculus
tgatttcatactagtgtgtaccgta

SEQ ID NO: 860586 - DNA, 25 bp, Mus musculus
tgatttcatacttgtgtgtaccgta

SEQ ID NO: 860587 - DNA, 25 bp, Mus musculus
tgatttcatctgagttacaccttta

SEQ ID NO: 860588 - DNA, 25 bp, Mus musculus
tgatttcatctgtgttacaccttta

SEQ ID NO: 860589 - DNA, 25 bp, Mus musculus
tgatttcatggtatcctctttttac

SEQ ID NO: 860590 - DNA, 25 bp, Mus musculus
tgatttcatggtttcctctttttac

SEQ ID NO: 860591 - DNA, 25 bp, Mus musculus
tgatttccaactattccccgagtgg

SEQ ID NO: 860592 - DNA, 25 bp, Mus musculus
tgatttccaacttttccccgagtgg

SEQ ID NO: 860593 - DNA, 25 bp, Mus musculus
tgatttccacaaccgtttctcgttt

SEQ ID NO: 860594 - DNA, 25 bp, Mus musculus
tgatttccacaagcgtttctcgttt

SEQ ID NO: 860595 - DNA, 25 bp, Mus musculus
tgatttccacacacttcccaggaat

SEQ ID NO: 860596 - DNA, 25 bp, Mus musculus
tgatttccacactcttcccaggaat

SEQ ID NO: 860597 - DNA, 25 bp, Mus musculus
tgatttccaccaactgggacttgga

SEQ ID NO: 860598 - DNA, 25 bp, Mus musculus
tgatttccaccatctgggacttgga

SEQ ID NO: 860599 - DNA, 25 bp, Mus musculus
tgatttccagccacagcagttcaaa

SEQ ID NO: 860600 - DNA, 25 bp, Mus musculus
tgatttccagcctcagcagttcaaa

SEQ ID NO: 860601 - DNA, 25 bp, Mus musculus
tgatttccaggaacgggcaacgcca

SEQ ID NO: 860602 - DNA, 25 bp, Mus musculus
tgatttccaggatcgggcaacgcca

SEQ ID NO: 860603 - DNA, 25 bp, Mus musculus
tgatttccatgtctgtgttgttgct

SEQ ID NO: 860604 - DNA, 25 bp, Mus musculus
tgatttccatgtgtgtgttgttgct

SEQ ID NO: 860605 - DNA, 25 bp, Mus musculus
tgatttcccacgctttccggaggcg

SEQ ID NO: 860606 - DNA, 25 bp, Mus musculus
tgatttcccacggtttccggaggcg

SEQ ID NO: 860607 - DNA, 25 bp, Mus musculus
tgatttccccacaaattcatttttg

SEQ ID NO: 860608 - DNA, 25 bp, Mus musculus
tgatttccccactaattcatttttg

SEQ ID NO: 860609 - DNA, 25 bp, Mus musculus
tgatttccccctagaaactccctat

SEQ ID NO: 860610 - DNA, 25 bp, Mus musculus
tgatttcccccttgaaactccctat

SEQ ID NO: 860611 - DNA, 25 bp, Mus musculus
tgatttccccttagagagcaagtgt

SEQ ID NO: 860612 - DNA, 25 bp, Mus musculus
tgatttcccctttgagagcaagtgt

SEQ ID NO: 860613 - DNA, 25 bp, Mus musculus
tgatttccttagcagacgagacgta

SEQ ID NO: 860614 - DNA, 25 bp, Mus musculus
tgatttccttaggagacgagacgta

SEQ ID NO: 860615 - DNA, 25 bp, Mus musculus
tgatttccttggaatccagcagaga

SEQ ID NO: 860616 - DNA, 25 bp, Mus musculus
tgatttccttggtatccagcagaga

SEQ ID NO: 860617 - DNA, 25 bp, Mus musculus
tgatttctacttcgcaacctttttt

SEQ ID NO: 860618 - DNA, 25 bp, Mus musculus
tgatttctacttggcaacctttttt

SEQ ID NO: 860619 - DNA, 25 bp, Mus musculus
tgatttctagttctattttcctgaa

SEQ ID NO: 860620 - DNA, 25 bp, Mus musculus
tgatttctagttgtattttcctgaa

SEQ ID NO: 860621 - DNA, 25 bp, Mus musculus
tgatttctatctacaggcactacct

SEQ ID NO: 860622 - DNA, 25 bp, Mus musculus
tgatttctatcttcaggcactacct

SEQ ID NO: 860623 - DNA, 25 bp, Mus musculus
tgatttctcaaaacaccagacccac

SEQ ID NO: 860624 - DNA, 25 bp, Mus musculus
tgatttctcaaatcaccagacccac

SEQ ID NO: 860625 - DNA, 25 bp, Mus musculus
tgatttctccagcttgctcaagtac

SEQ ID NO: 860626 - DNA, 25 bp, Mus musculus
tgatttctccaggttgctcaagtac

SEQ ID NO: 860627 - DNA, 25 bp, Mus musculus
tgatttctccctctaatcgcaatat

SEQ ID NO: 860628 - DNA, 25 bp, Mus musculus
tgatttctccctgtaatcgcaatat

SEQ ID NO: 860629 - DNA, 25 bp, Mus musculus
tgatttctccgcaaaaatttttcct

SEQ ID NO: 860630 - DNA, 25 bp, Mus musculus
tgatttctccgctaaaatttttcct

SEQ ID NO: 860631 - DNA, 25 bp, Mus musculus
tgatttctcctgatttgtctttctc

SEQ ID NO: 860632 - DNA, 25 bp, Mus musculus
tgatttctcctgttttgtctttctc

SEQ ID NO: 860633 - DNA, 25 bp, Mus musculus
tgatttctccttactgcgaacaaca

SEQ ID NO: 860634 - DNA, 25 bp, Mus musculus
tgatttctcctttctgcgaacaaca

SEQ ID NO: 860635 - DNA, 25 bp, Mus musculus
tgatttctgaacaggcagagatcca

SEQ ID NO: 860636 - DNA, 25 bp, Mus musculus
tgatttctgaactggcagagatcca

SEQ ID NO: 860637 - DNA, 25 bp, Mus musculus
tgatttctgagtctgagcccagctg

SEQ ID NO: 860638 - DNA, 25 bp, Mus musculus
tgatttctgagtgtgagcccagctg

SEQ ID NO: 860639 - DNA, 25 bp, Mus musculus
tgatttctgatcactatccataaaa

SEQ ID NO: 860640 - DNA, 25 bp, Mus musculus
tgatttctgatctctatccataaaa

SEQ ID NO: 860641 - DNA, 25 bp, Mus musculus
tgatttctgtcaacagtcggccttc

SEQ ID NO: 860642 - DNA, 25 bp, Mus musculus
tgatttctgtcatcagtcggccttc

SEQ ID NO: 860643 - DNA, 25 bp, Mus musculus
tgatttcttacacgctacgtttgga

SEQ ID NO: 860644 - DNA, 25 bp, Mus musculus
tgatttcttacaggctacgtttgga

SEQ ID NO: 860645 - DNA, 25 bp, Mus musculus
tgatttcttccaatggttttcgttt

SEQ ID NO: 860646 - DNA, 25 bp, Mus musculus
tgatttcttccattggttttcgttt

SEQ ID NO: 860647 - DNA, 25 bp, Mus musculus
tgatttcttcgacaagatgaaccaa

SEQ ID NO: 860648 - DNA, 25 bp, Mus musculus
tgatttcttcgagaagatgaaccaa

SEQ ID NO: 860649 - DNA, 25 bp, Mus musculus
tgatttgaacggacctcagctctac

SEQ ID NO: 860650 - DNA, 25 bp, Mus musculus
tgatttgaacggtcctcagctctac

SEQ ID NO: 860651 - DNA, 25 bp, Mus musculus
tgatttgaacttcgctatcccctgt

SEQ ID NO: 860652 - DNA, 25 bp, Mus musculus
tgatttgaacttggctatcccctgt

SEQ ID NO: 860653 - DNA, 25 bp, Mus musculus
tgatttgaatatagcccacttgaat

SEQ ID NO: 860654 - DNA, 25 bp, Mus musculus
tgatttgaatattgcccacttgaat

SEQ ID NO: 860655 - DNA, 25 bp, Mus musculus
tgatttgaatcacgctccagaaagg

SEQ ID NO: 860656 - DNA, 25 bp, Mus musculus
tgatttgaatcaggctccagaaagg

SEQ ID NO: 860657 - DNA, 25 bp, Mus musculus
tgatttgaccatagtgaattcctcc

SEQ ID NO: 860658 - DNA, 25 bp, Mus musculus
tgatttgaccattgtgaattcctcc

SEQ ID NO: 860659 - DNA, 25 bp, Mus musculus
tgatttgagggtcggaacctcgcaa

SEQ ID NO: 860660 - DNA, 25 bp, Mus musculus
tgatttgagggtgggaacctcgcaa

SEQ ID NO: 860661 - DNA, 25 bp, Mus musculus
tgatttgagtgcatgctttaggctg

SEQ ID NO: 860662 - DNA, 25 bp, Mus musculus
tgatttgagtgcttgctttaggctg

SEQ ID NO: 860663 - DNA, 25 bp, Mus musculus
tgatttgatcacatatgccggctat

SEQ ID NO: 860664 - DNA, 25 bp, Mus musculus
tgatttgatcacttatgccggctat

SEQ ID NO: 860665 - DNA, 25 bp, Mus musculus
tgatttgatccaagttatatatgat

SEQ ID NO: 860666 - DNA, 25 bp, Mus musculus
tgatttgatccatgttatatatgat

SEQ ID NO: 860667 - DNA, 25 bp, Mus musculus
tgatttgcacataggccacttccca

SEQ ID NO: 860668 - DNA, 25 bp, Mus musculus
tgatttgcacattggccacttccca

SEQ ID NO: 860669 - DNA, 25 bp, Mus musculus
tgatttgcacttagataccctgtta

SEQ ID NO: 860670 - DNA, 25 bp, Mus musculus
tgatttgcactttgataccctgtta

SEQ ID NO: 860671 - DNA, 25 bp, Mus musculus
tgatttgcccacagtgtcctgattg

SEQ ID NO: 860672 - DNA, 25 bp, Mus musculus
tgatttgcccactgtgtcctgattg

SEQ ID NO: 860673 - DNA, 25 bp, Mus musculus
tgatttgcctaacgtcagtctctgt

SEQ ID NO: 860674 - DNA, 25 bp, Mus musculus
tgatttgcctaaggtcagtctctgt

SEQ ID NO: 860675 - DNA, 25 bp, Mus musculus
tgatttgcctgaaaacagttgccag

SEQ ID NO: 860676 - DNA, 25 bp, Mus musculus
tgatttgcctgataacagttgccag

SEQ ID NO: 860677 - DNA, 25 bp, Mus musculus
tgatttgctccaaggcacttcacac

SEQ ID NO: 860678 - DNA, 25 bp, Mus musculus
tgatttgctccatggcacttcacac

SEQ ID NO: 860679 - DNA, 25 bp, Mus musculus
tgatttgctcctagtggcttgctca

SEQ ID NO: 860680 - DNA, 25 bp, Mus musculus
tgatttgctccttgtggcttgctca

SEQ ID NO: 860681 - DNA, 25 bp, Mus musculus
tgatttgcttctcgctggctctgta

SEQ ID NO: 860682 - DNA, 25 bp, Mus musculus
tgatttgcttctggctggctctgta

SEQ ID NO: 860683 - DNA, 25 bp, Mus musculus
tgatttgcttgaacacacgtgccag

SEQ ID NO: 860684 - DNA, 25 bp, Mus musculus
tgatttgcttgatcacacgtgccag

SEQ ID NO: 860685 - DNA, 25 bp, Mus musculus
tgatttggaaataccttcctggccc

SEQ ID NO: 860686 - DNA, 25 bp, Mus musculus
tgatttggaaattccttcctggccc

SEQ ID NO: 860687 - DNA, 25 bp, Mus musculus
tgatttgggctcacaactgatttga

SEQ ID NO: 860688 - DNA, 25 bp, Mus musculus
tgatttgggctctcaactgatttga

SEQ ID NO: 860689 - DNA, 25 bp, Mus musculus
tgatttgtaaaaaccgagccccacc

SEQ ID NO: 860690 - DNA, 25 bp, Mus musculus
tgatttgtaaaatccgagccccacc

SEQ ID NO: 860691 - DNA, 25 bp, Mus musculus
tgatttgtaccaattcttacccctc

SEQ ID NO: 860692 - DNA, 25 bp, Mus musculus
tgatttgtaccatttcttacccctc

SEQ ID NO: 860693 - DNA, 25 bp, Mus musculus
tgatttgtatatatcactggttaaa

SEQ ID NO: 860694 - DNA, 25 bp, Mus musculus
tgatttgtatatttcactggttaaa

SEQ ID NO: 860695 - DNA, 25 bp, Mus musculus
tgatttgtcatcaaaagacttgaaa

SEQ ID NO: 860696 - DNA, 25 bp, Mus musculus
tgatttgtcatctaaagacttgaaa

SEQ ID NO: 860697 - DNA, 25 bp, Mus musculus
tgatttgtccttcaaactctcagaa

SEQ ID NO: 860698 - DNA, 25 bp, Mus musculus
tgatttgtccttgaaactctcagaa

SEQ ID NO: 860699 - DNA, 25 bp, Mus musculus
tgatttgtctcaagccctggcaggg

SEQ ID NO: 860700 - DNA, 25 bp, Mus musculus
tgatttgtctcatgccctggcaggg

SEQ ID NO: 860701 - DNA, 25 bp, Mus musculus
tgatttgtgccaaacaagtgctggg

SEQ ID NO: 860702 - DNA, 25 bp, Mus musculus
tgatttgtgccatacaagtgctggg

SEQ ID NO: 860703 - DNA, 25 bp, Mus musculus
tgatttgttaagacttccagcggat

SEQ ID NO: 860704 - DNA, 25 bp, Mus musculus
tgatttgttaagtcttccagcggat

SEQ ID NO: 860705 - DNA, 25 bp, Mus musculus
tgatttgttcccctttgtctctgag

SEQ ID NO: 860706 - DNA, 25 bp, Mus musculus
tgatttgttcccgtttgtctctgag

SEQ ID NO: 860707 - DNA, 25 bp, Mus musculus
tgatttgttcgtatgctcctctgca

SEQ ID NO: 860708 - DNA, 25 bp, Mus musculus
tgatttgttcgtttgctcctctgca

SEQ ID NO: 860709 - DNA, 25 bp, Mus musculus
tgatttgttgctctctcttgggaaa

SEQ ID NO: 860710 - DNA, 25 bp, Mus musculus
tgatttgttgctgtctcttgggaaa

SEQ ID NO: 860711 - DNA, 25 bp, Mus musculus
tgattttaatccatgagtctgtgtg

SEQ ID NO: 860712 - DNA, 25 bp, Mus musculus
tgattttaatccttgagtctgtgtg

SEQ ID NO: 860713 - DNA, 25 bp, Mus musculus
tgattttaatgcaccagagctgtga

SEQ ID NO: 860714 - DNA, 25 bp, Mus musculus
tgattttaatgctccagagctgtga

SEQ ID NO: 860715 - DNA, 25 bp, Mus musculus
tgattttacaagattgggtttctct

SEQ ID NO: 860716 - DNA, 25 bp, Mus musculus
tgattttacaagtttgggtttctct

SEQ ID NO: 860717 - DNA, 25 bp, Mus musculus
tgattttacagacgtccacagttaa

SEQ ID NO: 860718 - DNA, 25 bp, Mus musculus
tgattttacagaggtccacagttaa

SEQ ID NO: 860719 - DNA, 25 bp, Mus musculus
tgattttacctgattcgtccagcac

SEQ ID NO: 860720 - DNA, 25 bp, Mus musculus
tgattttacctgtttcgtccagcac

SEQ ID NO: 860721 - DNA, 25 bp, Mus musculus
tgattttactatagtccaagacccc

SEQ ID NO: 860722 - DNA, 25 bp, Mus musculus
tgattttactattgtccaagacccc

SEQ ID NO: 860723 - DNA, 25 bp, Mus musculus
tgattttactctcggtgcctcttac

SEQ ID NO: 860724 - DNA, 25 bp, Mus musculus
tgattttactctgggtgcctcttac

SEQ ID NO: 860725 - DNA, 25 bp, Mus musculus
tgattttactggaattctttagacc

SEQ ID NO: 860726 - DNA, 25 bp, Mus musculus
tgattttactggtattctttagacc

SEQ ID NO: 860727 - DNA, 25 bp, Mus musculus
tgattttactttccctgaaaccaca

SEQ ID NO: 860728 - DNA, 25 bp, Mus musculus
tgattttactttgcctgaaaccaca

SEQ ID NO: 860729 - DNA, 25 bp, Mus musculus
tgattttagaccaggtaactctttt

SEQ ID NO: 860730 - DNA, 25 bp, Mus musculus
tgattttagacctggtaactctttt

SEQ ID NO: 860731 - DNA, 25 bp, Mus musculus
tgattttattaccaggttaccctgt

SEQ ID NO: 860732 - DNA, 25 bp, Mus musculus
tgattttattacgaggttaccctgt

SEQ ID NO: 860733 - DNA, 25 bp, Mus musculus
tgattttattatcccattggacaac

SEQ ID NO: 860734 - DNA, 25 bp, Mus musculus
tgattttattatgccattggacaac

SEQ ID NO: 860735 - DNA, 25 bp, Mus musculus
tgattttattttcaaacgaggccct

SEQ ID NO: 860736 - DNA, 25 bp, Mus musculus
tgattttattttgaaacgaggccct

SEQ ID NO: 860737 - DNA, 25 bp, Mus musculus
tgattttcagggacaaagcagcatg

SEQ ID NO: 860738 - DNA, 25 bp, Mus musculus
tgattttcagggtcaaagcagcatg

SEQ ID NO: 860739 - DNA, 25 bp, Mus musculus
tgattttcataaagctgagaaaaca

SEQ ID NO: 860740 - DNA, 25 bp, Mus musculus
tgattttcataatgctgagaaaaca

SEQ ID NO: 860741 - DNA, 25 bp, Mus musculus
tgattttcatagagtcgtaatagcc

SEQ ID NO: 860742 - DNA, 25 bp, Mus musculus
tgattttcatagtgtcgtaatagcc

SEQ ID NO: 860743 - DNA, 25 bp, Mus musculus
tgattttcattcaggccgcctgcag

SEQ ID NO: 860744 - DNA, 25 bp, Mus musculus
tgattttcattctggccgcctgcag

SEQ ID NO: 860745 - DNA, 25 bp, Mus musculus
tgattttccattcagcacctagagc

SEQ ID NO: 860746 - DNA, 25 bp, Mus musculus
tgattttccattgagcacctagagc

SEQ ID NO: 860747 - DNA, 25 bp, Mus musculus
tgattttcccacaatgatgctgctg

SEQ ID NO: 860748 - DNA, 25 bp, Mus musculus
tgattttcccactatgatgctgctg

SEQ ID NO: 860749 - DNA, 25 bp, Mus musculus
tgattttccccaccatctacaataa

SEQ ID NO: 860750 - DNA, 25 bp, Mus musculus
tgattttccccagcatctacaataa

SEQ ID NO: 860751 - DNA, 25 bp, Mus musculus
tgattttccgttacaacagcaaccc

SEQ ID NO: 860752 - DNA, 25 bp, Mus musculus
tgattttccgtttcaacagcaaccc

SEQ ID NO: 860753 - DNA, 25 bp, Mus musculus
tgattttcctgtacatccttcttgc

SEQ ID NO: 860754 - DNA, 25 bp, Mus musculus
tgattttcctgttcatccttcttgc

SEQ ID NO: 860755 - DNA, 25 bp, Mus musculus
tgattttcgtctccgtgcacgactg

SEQ ID NO: 860756 - DNA, 25 bp, Mus musculus
tgattttcgtctgcgtgcacgactg

SEQ ID NO: 860757 - DNA, 25 bp, Mus musculus
tgattttcttcaactcacaggaggg

SEQ ID NO: 860758 - DNA, 25 bp, Mus musculus
tgattttcttcatctcacaggaggg

SEQ ID NO: 860759 - DNA, 25 bp, Mus musculus
tgattttgaccacgccgcacaagac

SEQ ID NO: 860760 - DNA, 25 bp, Mus musculus
tgattttgaccaggccgcacaagac

SEQ ID NO: 860761 - DNA, 25 bp, Mus musculus
tgattttgattgacccaagagccct

SEQ ID NO: 860762 - DNA, 25 bp, Mus musculus
tgattttgattgtcccaagagccct

SEQ ID NO: 860763 - DNA, 25 bp, Mus musculus
tgattttgcagaacaccacagtggg

SEQ ID NO: 860764 - DNA, 25 bp, Mus musculus
tgattttgcagatcaccacagtggg

SEQ ID NO: 860765 - DNA, 25 bp, Mus musculus
tgattttgcgatatcagatgctttg

SEQ ID NO: 860766 - DNA, 25 bp, Mus musculus
tgattttgcgatttcagatgctttg

SEQ ID NO: 860767 - DNA, 25 bp, Mus musculus
tgattttggatcattcacttccttc

SEQ ID NO: 860768 - DNA, 25 bp, Mus musculus
tgattttggatctttcacttccttc

SEQ ID NO: 860769 - DNA, 25 bp, Mus musculus
tgattttggcctagagagcacttgc

SEQ ID NO: 860770 - DNA, 25 bp, Mus musculus
tgattttggccttgagagcacttgc

SEQ ID NO: 860771 - DNA, 25 bp, Mus musculus
tgattttggtgcaaaagttccccaa

SEQ ID NO: 860772 - DNA, 25 bp, Mus musculus
tgattttggtgctaaagttccccaa

SEQ ID NO: 860773 - DNA, 25 bp, Mus musculus
tgattttgtattcttcactagtatg

SEQ ID NO: 860774 - DNA, 25 bp, Mus musculus
tgattttgtattgttcactagtatg

SEQ ID NO: 860775 - DNA, 25 bp, Mus musculus
tgattttgttccctgcacccacgtg

SEQ ID NO: 860776 - DNA, 25 bp, Mus musculus
tgattttgttccgtgcacccacgtg

SEQ ID NO: 860777 - DNA, 25 bp, Mus musculus
tgatttttatccactgttacagatt

SEQ ID NO: 860778 - DNA, 25 bp, Mus musculus
tgatttttatcctctgttacagatt

SEQ ID NO: 860779 - DNA, 25 bp, Mus musculus
tgatttttatctagtctgggacccc

SEQ ID NO: 860780 - DNA, 25 bp, Mus musculus
tgatttttatcttgtctgggacccc

SEQ ID NO: 860781 - DNA, 25 bp, Mus musculus
tgatttttcaaaaggctcagcaagc

SEQ ID NO: 860782 - DNA, 25 bp, Mus musculus
tgatttttcaaatggctcagcaagc

SEQ ID NO: 860783 - DNA, 25 bp, Mus musculus
tgatttttcaacctctaccacttag

SEQ ID NO: 860784 - DNA, 25 bp, Mus musculus
tgatttttcaacgtctaccacttag

SEQ ID NO: 860785 - DNA, 25 bp, Mus musculus
tgatttttcagcacacagtgacaga

SEQ ID NO: 860786 - DNA, 25 bp, Mus musculus
tgatttttcagctcacagtgacaga

SEQ ID NO: 860787 - DNA, 25 bp, Mus musculus
tgatttttcattcctctgtggttcc

SEQ ID NO: 860788 - DNA, 25 bp, Mus musculus
tgatttttcattgctctgtggttcc

SEQ ID NO: 860789 - DNA, 25 bp, Mus musculus
tgatttttccctaccgaactggaag

SEQ ID NO: 860790 - DNA, 25 bp, Mus musculus
tgatttttcccttccgaactggaag

SEQ ID NO: 860791 - DNA, 25 bp, Mus musculus
tgatttttctaacttcccttggcca

SEQ ID NO: 860792 - DNA, 25 bp, Mus musculus
tgatttttctaagttcccttggcca

SEQ ID NO: 860793 - DNA, 25 bp, Mus musculus
tgatttttctatccagagttgctgt

SEQ ID NO: 860794 - DNA, 25 bp, Mus musculus
tgatttttctatgcagagttgctgt

SEQ ID NO: 860795 - DNA, 25 bp, Mus musculus
tgatttttctccctacagcacaaaa

SEQ ID NO: 860796 - DNA, 25 bp, Mus musculus
tgatttttctccgtacagcacaaaa

SEQ ID NO: 860797 - DNA, 25 bp, Mus musculus
tgatttttctcgcaagaccttgaag

SEQ ID NO: 860798 - DNA, 25 bp, Mus musculus
tgatttttctcggaagaccttgaag

SEQ ID NO: 860799 - DNA, 25 bp, Mus musculus
tgatttttgattacctcctcttgtc

SEQ ID NO: 860800 - DNA, 25 bp, Mus musculus
tgatttttgatttcctcctcttgtc

SEQ ID NO: 860801 - DNA, 25 bp, Mus musculus
tgatttttgggtattcttgtggtcc

SEQ ID NO: 860802 - DNA, 25 bp, Mus musculus
tgatttttgggttttcttgtggtcc

SEQ ID NO: 860803 - DNA, 25 bp, Mus musculus
tgatttttgtctaccgttcgtgttc

SEQ ID NO: 860804 - DNA, 25 bp, Mus musculus
tgatttttgtcttccgttcgtgttc

SEQ ID NO: 860805 - DNA, 25 bp, Mus musculus
tgattttttatgctcatttctgctt

SEQ ID NO: 860806 - DNA, 25 bp, Mus musculus
tgattttttatggtcatttctgctt

SEQ ID NO: 860807 - DNA, 25 bp, Mus musculus
tgattttttcttcggcaggtttgca

SEQ ID NO: 860808 - DNA, 25 bp, Mus musculus
tgattttttcttgggcaggtttgca

SEQ ID NO: 860809 - DNA, 25 bp, Mus musculus
tgcaaaaaaccccagtgtggccttc

SEQ ID NO: 860810 - DNA, 25 bp, Mus musculus
tgcaaaaaacccgagtgtggccttc

SEQ ID NO: 860811 - DNA, 25 bp, Mus musculus
tgcaaaaagtgtcgccttccgaacc

SEQ ID NO: 860812 - DNA, 25 bp, Mus musculus
tgcaaaaagtgtggccttccgaacc

SEQ ID NO: 860813 - DNA, 25 bp, Mus musculus
tgcaaaacaacaacacagacacctt

SEQ ID NO: 860814 - DNA, 25 bp, Mus musculus
tgcaaaacaacatcacagacacctt

SEQ ID NO: 860815 - DNA, 25 bp, Mus musculus
tgcaaaacagacatcgccttcagaa

SEQ ID NO: 860816 - DNA, 25 bp, Mus musculus
tgcaaaacagacttcgccttcagaa

SEQ ID NO: 860817 - DNA, 25 bp, Mus musculus
tgcaaaacattgaagcttagctcat

SEQ ID NO: 860818 - DNA, 25 bp, Mus musculus
tgcaaaacattgtagcttagctcat

SEQ ID NO: 860819 - DNA, 25 bp, Mus musculus
tgcaaaaccatcatttctagctccc

SEQ ID NO: 860820 - DNA, 25 bp, Mus musculus
tgcaaaaccatcttttctagctccc

SEQ ID NO: 860821 - DNA, 25 bp, Mus musculus
tgcaaaaccatgctgcacgtgcccg

SEQ ID NO: 860822 - DNA, 25 bp, Mus musculus
tgcaaaaccatggtgcacgtgcccg

SEQ ID NO: 860823 - DNA, 25 bp, Mus musculus
tgcaaaaccccgaagtctttaacag

SEQ ID NO: 860824 - DNA, 25 bp, Mus musculus
tgcaaaaccccgtagtctttaacag

SEQ ID NO: 860825 - DNA, 25 bp, Mus musculus
tgcaaaaccgtcacctcagtggagc

SEQ ID NO: 860826 - DNA, 25 bp, Mus musculus
tgcaaaaccgtctcctcagtggagc

SEQ ID NO: 860827 - DNA, 25 bp, Mus musculus
tgcaaaaccttgaactagagtccag

SEQ ID NO: 860828 - DNA, 25 bp, Mus musculus
tgcaaaaccttgtactagagtccag

SEQ ID NO: 860829 - DNA, 25 bp, Mus musculus
tgcaaaacttcccagttgccagctg

SEQ ID NO: 860830 - DNA, 25 bp, Mus musculus
tgcaaaacttccgagttgccagctg

SEQ ID NO: 860831 - DNA, 25 bp, Mus musculus
tgcaaaagagccatgcctcacggtt

SEQ ID NO: 860832 - DNA, 25 bp, Mus musculus
tgcaaaagagccttgcctcacggtt

SEQ ID NO: 860833 - DNA, 25 bp, Mus musculus
tgcaaaagaggcatttggccccaga

SEQ ID NO: 860834 - DNA, 25 bp, Mus musculus
tgcaaaagaggcttttggccccaga

SEQ ID NO: 860835 - DNA, 25 bp, Mus musculus
tgcaaaagatcaactgtccccactg

SEQ ID NO: 860836 - DNA, 25 bp, Mus musculus
tgcaaaagatcatctgtccccactg

SEQ ID NO: 860837 - DNA, 25 bp, Mus musculus
tgcaaaagatctacacttgccccgt

SEQ ID NO: 860838 - DNA, 25 bp, Mus musculus
tgcaaaagatcttcacttgccccgt

SEQ ID NO: 860839 - DNA, 25 bp, Mus musculus
tgcaaaaggccgcacaggcagctgt

SEQ ID NO: 860840 - DNA, 25 bp, Mus musculus
tgcaaaaggccggacaggcagctgt

SEQ ID NO: 860841 - DNA, 25 bp, Mus musculus
tgcaaaatacacatccaggtctccc

SEQ ID NO: 860842 - DNA, 25 bp, Mus musculus
tgcaaaatacacttccaggtctccc

SEQ ID NO: 860843 - DNA, 25 bp, Mus musculus
tgcaaaatactgacatctcgggaaa

SEQ ID NO: 860844 - DNA, 25 bp, Mus musculus
tgcaaaatactgtcatctcgggaaa

SEQ ID NO: 860845 - DNA, 25 bp, Mus musculus
tgcaaaatcctcaacgttctacaac

SEQ ID NO: 860846 - DNA, 25 bp, Mus musculus
tgcaaaatcctctacgttctacaac

SEQ ID NO: 860847 - DNA, 25 bp, Mus musculus
tgcaaaatgcacattcccaggctct

SEQ ID NO: 860848 - DNA, 25 bp, Mus musculus
tgcaaaatgcactttcccaggctct

SEQ ID NO: 860849 - DNA, 25 bp, Mus musculus
tgcaaaattcctctgccatctggcc

SEQ ID NO: 860850 - DNA, 25 bp, Mus musculus
tgcaaaattcctgtgccatctggcc

SEQ ID NO: 860851 - DNA, 25 bp, Mus musculus
tgcaaacaatggacagagattcttc

SEQ ID NO: 860852 - DNA, 25 bp, Mus musculus
tgcaaacaatggtcagagattcttc

SEQ ID NO: 860853 - DNA, 25 bp, Mus musculus
tgcaaacacatgatgatcctcctgc

SEQ ID NO: 860854 - DNA, 25 bp, Mus musculus
tgcaaacacatgttgatcctcctgc

SEQ ID NO: 860855 - DNA, 25 bp, Mus musculus
tgcaaacagacaaacggacagcaat

SEQ ID NO: 860856 - DNA, 25 bp, Mus musculus
tgcaaacagacatacggacagcaat

SEQ ID NO: 860857 - DNA, 25 bp, Mus musculus
tgcaaacagcagcttggtccgtcaa

SEQ ID NO: 860858 - DNA, 25 bp, Mus musculus
tgcaaacagcaggttggtccgtcaa

SEQ ID NO: 860859 - DNA, 25 bp, Mus musculus
tgcaaacagccactcattctctaac

SEQ ID NO: 860860 - DNA, 25 bp, Mus musculus
tgcaaacagccagtcattctctaac

SEQ ID NO: 860861 - DNA, 25 bp, Mus musculus
tgcaaacagggacttccagaataga

SEQ ID NO: 860862 - DNA, 25 bp, Mus musculus
tgcaaacagggagttccagaataga

SEQ ID NO: 860863 - DNA, 25 bp, Mus musculus
tgcaaacagtacacgcaagccctga

SEQ ID NO: 860864 - DNA, 25 bp, Mus musculus
tgcaaacagtactcgcaagccctga

SEQ ID NO: 860865 - DNA, 25 bp, Mus musculus
tgcaaacatcagctgttcactttgg

SEQ ID NO: 860866 - DNA, 25 bp, Mus musculus
tgcaaacatcaggtgttcactttgg

SEQ ID NO: 860867 - DNA, 25 bp, Mus musculus
tgcaaacatgagaaccacagtggct

SEQ ID NO: 860868 - DNA, 25 bp, Mus musculus
tgcaaacatgagtaccacagtggct

SEQ ID NO: 860869 - DNA, 25 bp, Mus musculus
tgcaaaccaacaaatccggctcggg

SEQ ID NO: 860870 - DNA, 25 bp, Mus musculus
tgcaaaccaacatatccggctcggg

SEQ ID NO: 860871 - DNA, 25 bp, Mus musculus
tgcaaaccatccatatgtggctcag

SEQ ID NO: 860872 - DNA, 25 bp, Mus musculus
tgcaaaccatccttatgtggctcag

SEQ ID NO: 860873 - DNA, 25 bp, Mus musculus
tgcaaaccatttacgcggttcaggc

SEQ ID NO: 860874 - DNA, 25 bp, Mus musculus
tgcaaaccattttcgcggttcaggc

SEQ ID NO: 860875 - DNA, 25 bp, Mus musculus
tgcaaacccagtcgaaggatctact

SEQ ID NO: 860876 - DNA, 25 bp, Mus musculus
tgcaaacccagtggaaggatctact

SEQ ID NO: 860877 - DNA, 25 bp, Mus musculus
tgcaaacccctacaccaggtagttt

SEQ ID NO: 860878 - DNA, 25 bp, Mus musculus
tgcaaacccctagaccaggtagttt

SEQ ID NO: 860879 - DNA, 25 bp, Mus musculus
tgcaaacccgaacctgttgtctgaa

SEQ ID NO: 860880 - DNA, 25 bp, Mus musculus
tgcaaacccgaagctgttgtctgaa

SEQ ID NO: 860881 - DNA, 25 bp, Mus musculus
tgcaaaccctccaaagagccagaat

SEQ ID NO: 860882 - DNA, 25 bp, Mus musculus
tgcaaaccctccatgcagttctttg

SEQ ID NO: 860883 - DNA, 25 bp, Mus musculus
tgcaaaccctcctaagagccagaat

SEQ ID NO: 860884 - DNA, 25 bp, Mus musculus
tgcaaaccctccttgcagttctttg

SEQ ID NO: 860885 - DNA, 25 bp, Mus musculus
tgcaaaccggttcttttttatcgtg

SEQ ID NO: 860886 - DNA, 25 bp, Mus musculus
tgcaaaccggttgttttttatcgtg

SEQ ID NO: 860887 - DNA, 25 bp, Mus musculus
tgcaaacctatgatccacgtgggtg

SEQ ID NO: 860888 - DNA, 25 bp, Mus musculus
tgcaaacctatgttccacgtgggtg

SEQ ID NO: 860889 - DNA, 25 bp, Mus musculus
tgcaaacctcggacagagtacaaat

SEQ ID NO: 860890 - DNA, 25 bp, Mus musculus
tgcaaacctcggtcagagtacaaat

SEQ ID NO: 860891 - DNA, 25 bp, Mus musculus
tgcaaacctgtacttgcctttcaat

SEQ ID NO: 860892 - DNA, 25 bp, Mus musculus
tgcaaacctgtagttgcctttcaat

SEQ ID NO: 860893 - DNA, 25 bp, Mus musculus
tgcaaacgattcaaagagggtacct

SEQ ID NO: 860894 - DNA, 25 bp, Mus musculus
tgcaaacgattctaagagggtacct

SEQ ID NO: 860895 - DNA, 25 bp, Mus musculus
tgcaaacgattgacgggttttgttt

SEQ ID NO: 860896 - DNA, 25 bp, Mus musculus
tgcaaacgattgtcgggttttgttt

SEQ ID NO: 860897 - DNA, 25 bp, Mus musculus
tgcaaacgctagatcgggaggaccc

SEQ ID NO: 860898 - DNA, 25 bp, Mus musculus
tgcaaacgctagttcgggaggaccc

SEQ ID NO: 860899 - DNA, 25 bp, Mus musculus
tgcaaactacctctaaccctgtggg

SEQ ID NO: 860900 - DNA, 25 bp, Mus musculus
tgcaaactacctgtaaccctgtggg

SEQ ID NO: 860901 - DNA, 25 bp, Mus musculus
tgcaaactcactcacagcaccgata

SEQ ID NO: 860902 - DNA, 25 bp, Mus musculus
tgcaaactcactgacagcaccgata

SEQ ID NO: 860903 - DNA, 25 bp, Mus musculus
tgcaaactccctacctttttattag

SEQ ID NO: 860904 - DNA, 25 bp, Mus musculus
tgcaaactcccttcctttttattag

SEQ ID NO: 860905 - DNA, 25 bp, Mus musculus
tgcaaactctgtcaggccatctgtc

SEQ ID NO: 860906 - DNA, 25 bp, Mus musculus
tgcaaactctgtgaggccatctgtc

SEQ ID NO: 860907 - DNA, 25 bp, Mus musculus
tgcaaactgatcacaggctgttcct

SEQ ID NO: 860908 - DNA, 25 bp, Mus musculus
tgcaaactgatctcaggctgttcct

SEQ ID NO: 860909 - DNA, 25 bp, Mus musculus
tgcaaactgcaacagaactttttat

SEQ ID NO: 860910 - DNA, 25 bp, Mus musculus
tgcaaactgcaagagaactttttat

SEQ ID NO: 860911 - DNA, 25 bp, Mus musculus
tgcaaactgcataggctgccatagt

SEQ ID NO: 860912 - DNA, 25 bp, Mus musculus
tgcaaactgcattggctgccatagt

SEQ ID NO: 860913 - DNA, 25 bp, Mus musculus
tgcaaactgccgaggctcagcttat

SEQ ID NO: 860914 - DNA, 25 bp, Mus musculus
tgcaaactgccgtggctcagcttat

SEQ ID NO: 860915 - DNA, 25 bp, Mus musculus
tgcaaactgttcacctatataatta

SEQ ID NO: 860916 - DNA, 25 bp, Mus musculus
tgcaaactgttctcctatataatta

SEQ ID NO: 860917 - DNA, 25 bp, Mus musculus
tgcaaacttcccagggtgagtgtga

SEQ ID NO: 860918 - DNA, 25 bp, Mus musculus
tgcaaacttccctgggtgagtgtga

SEQ ID NO: 860919 - DNA, 25 bp, Mus musculus
tgcaaactttgcaaaccgacctcat

SEQ ID NO: 860920 - DNA, 25 bp, Mus musculus
tgcaaactttgctaaccgacctcat

SEQ ID NO: 860921 - DNA, 25 bp, Mus musculus
tgcaaagaagccatactgacctccg

SEQ ID NO: 860922 - DNA, 25 bp, Mus musculus
tgcaaagaagccttactgacctccg

SEQ ID NO: 860923 - DNA, 25 bp, Mus musculus
tgcaaagacttgatgtacctaggtt

SEQ ID NO: 860924 - DNA, 25 bp, Mus musculus
tgcaaagacttgttgtacctaggtt

SEQ ID NO: 860925 - DNA, 25 bp, Mus musculus
tgcaaagagagccattacctaccag

SEQ ID NO: 860926 - DNA, 25 bp, Mus musculus
tgcaaagagagcgattacctaccag

SEQ ID NO: 860927 - DNA, 25 bp, Mus musculus
tgcaaagataccacctctatgctag

SEQ ID NO: 860928 - DNA, 25 bp, Mus musculus
tgcaaagatacctcctctatgctag

SEQ ID NO: 860929 - DNA, 25 bp, Mus musculus
tgcaaagcaagacctgaagcccact

SEQ ID NO: 860930 - DNA, 25 bp, Mus musculus
tgcaaagcaagactccacacggctg

SEQ ID NO: 860931 - DNA, 25 bp, Mus musculus
tgcaaagcaagagctgaagcccact

SEQ ID NO: 860932 - DNA, 25 bp, Mus musculus
tgcaaagcaagagtccacacggctg

SEQ ID NO: 860933 - DNA, 25 bp, Mus musculus
tgcaaagcacacaacgggcatgttt

SEQ ID NO: 860934 - DNA, 25 bp, Mus musculus
tgcaaagcacactacgggcatgttt

SEQ ID NO: 860935 - DNA, 25 bp, Mus musculus
tgcaaagcagtgaacccaaggagga

SEQ ID NO: 860936 - DNA, 25 bp, Mus musculus
tgcaaagcagtgtacccaaggagga

SEQ ID NO: 860937 - DNA, 25 bp, Mus musculus
tgcaaagcatatcaccctcaaggta

SEQ ID NO: 860938 - DNA, 25 bp, Mus musculus
tgcaaagcatatgaccctcaaggta

SEQ ID NO: 860939 - DNA, 25 bp, Mus musculus
tgcaaagccaacatctcttcttcaa

SEQ ID NO: 860940 - DNA, 25 bp, Mus musculus
tgcaaagccaacttctcttcttcaa

SEQ ID NO: 860941 - DNA, 25 bp, Mus musculus
tgcaaagccactcgtgccaaggtca

SEQ ID NO: 860942 - DNA, 25 bp, Mus musculus
tgcaaagccactggtgccaaggtca

SEQ ID NO: 860943 - DNA, 25 bp, Mus musculus
tgcaaagcccgaaaattgagttgga

SEQ ID NO: 860944 - DNA, 25 bp, Mus musculus
tgcaaagcccgataattgagttgga

SEQ ID NO: 860945 - DNA, 25 bp, Mus musculus
tgcaaagccctcaggtagacaagaa

SEQ ID NO: 860946 - DNA, 25 bp, Mus musculus
tgcaaagccctctggtagacaagaa

SEQ ID NO: 860947 - DNA, 25 bp, Mus musculus
tgcaaagcctcccagagagcctgag

SEQ ID NO: 860948 - DNA, 25 bp, Mus musculus
tgcaaagcctccgagagagcctgag

SEQ ID NO: 860949 - DNA, 25 bp, Mus musculus
tgcaaagcctggaacgcctcggaag

SEQ ID NO: 860950 - DNA, 25 bp, Mus musculus
tgcaaagcctggtacgcctcggaag

SEQ ID NO: 860951 - DNA, 25 bp, Mus musculus
tgcaaagcctttcgaagccgtgaag

SEQ ID NO: 860952 - DNA, 25 bp, Mus musculus
tgcaaagcctttggaagccgtgaag

SEQ ID NO: 860953 - DNA, 25 bp, Mus musculus
tgcaaagcgcgtctgtggtctatga

SEQ ID NO: 860954 - DNA, 25 bp, Mus musculus
tgcaaagcgcgtgtgtggtctatga

SEQ ID NO: 860955 - DNA, 25 bp, Mus musculus
tgcaaagctgacaccccattgttca

SEQ ID NO: 860956 - DNA, 25 bp, Mus musculus
tgcaaagctgactccccattgttca

SEQ ID NO: 860957 - DNA, 25 bp, Mus musculus
tgcaaagctgtgatctcagtcttta

SEQ ID NO: 860958 - DNA, 25 bp, Mus musculus
tgcaaagctgtgttctcagtcttta

SEQ ID NO: 860959 - DNA, 25 bp, Mus musculus
tgcaaaggacaaactggcaacctac

SEQ ID NO: 860960 - DNA, 25 bp, Mus musculus
tgcaaaggacaatctggcaacctac

SEQ ID NO: 860961 - DNA, 25 bp, Mus musculus
tgcaaaggaggcactgttctctctg

SEQ ID NO: 860962 - DNA, 25 bp, Mus musculus
tgcaaaggaggctctgttctctctg

SEQ ID NO: 860963 - DNA, 25 bp, Mus musculus
tgcaaaggccataggagagttccag

SEQ ID NO: 860964 - DNA, 25 bp, Mus musculus
tgcaaaggccattggagagttccag

SEQ ID NO: 860965 - DNA, 25 bp, Mus musculus
tgcaaagggtcgagtttgtttccca

SEQ ID NO: 860966 - DNA, 25 bp, Mus musculus
tgcaaagggtcgtgtttgtttccca

SEQ ID NO: 860967 - DNA, 25 bp, Mus musculus
tgcaaagtacccacacatataaaat

SEQ ID NO: 860968 - DNA, 25 bp, Mus musculus
tgcaaagtaccctcacatataaaat

SEQ ID NO: 860969 - DNA, 25 bp, Mus musculus
tgcaaagtccacagctgtatccatc

SEQ ID NO: 860970 - DNA, 25 bp, Mus musculus
tgcaaagtccactgctgtatccatc

SEQ ID NO: 860971 - DNA, 25 bp, Mus musculus
tgcaaagtcctcaggtgctctcaga

SEQ ID NO: 860972 - DNA, 25 bp, Mus musculus
tgcaaagtcctccattccttaaata

SEQ ID NO: 860973 - DNA, 25 bp, Mus musculus
tgcaaagtcctcgattccttaaata

SEQ ID NO: 860974 - DNA, 25 bp, Mus musculus
tgcaaagtcctctggtgctctcaga

SEQ ID NO: 860975 - DNA, 25 bp, Mus musculus
tgcaaagtcggacacaagcatctac

SEQ ID NO: 860976 - DNA, 25 bp, Mus musculus
tgcaaagtcggagacaagcatctac

SEQ ID NO: 860977 - DNA, 25 bp, Mus musculus
tgcaaagtgactcttgagccgcccg

SEQ ID NO: 860978 - DNA, 25 bp, Mus musculus
tgcaaagtgactgttgagccgcccg

SEQ ID NO: 860979 - DNA, 25 bp, Mus musculus
tgcaaagtgagcactttcgatcccg

SEQ ID NO: 860980 - DNA, 25 bp, Mus musculus
tgcaaagtgagctctttcgatcccg

SEQ ID NO: 860981 - DNA, 25 bp, Mus musculus
tgcaaagtgcccagagtcctatcca

SEQ ID NO: 860982 - DNA, 25 bp, Mus musculus
tgcaaagtgccctgagtcctatcca

SEQ ID NO: 860983 - DNA, 25 bp, Mus musculus
tgcaaagtgttccagtgtgacctca

SEQ ID NO: 860984 - DNA, 25 bp, Mus musculus
tgcaaagtgttcgagtgtgacctca

SEQ ID NO: 860985 - DNA, 25 bp, Mus musculus
tgcaaagtgtttccagccagggtgt

SEQ ID NO: 860986 - DNA, 25 bp, Mus musculus
tgcaaagtgtttgcagccagggtgt

SEQ ID NO: 860987 - DNA, 25 bp, Mus musculus
tgcaaagttgagagttttctttctg

SEQ ID NO: 860988 - DNA, 25 bp, Mus musculus
tgcaaagttgagtgttttctttctg

SEQ ID NO: 860989 - DNA, 25 bp, Mus musculus
tgcaaagttgtgattcccttttatc

SEQ ID NO: 860990 - DNA, 25 bp, Mus musculus
tgcaaagttgtgtttcccttttatc

SEQ ID NO: 860991 - DNA, 25 bp, Mus musculus
tgcaaataactcactcttggtcctg

SEQ ID NO: 860992 - DNA, 25 bp, Mus musculus
tgcaaataactctctcttggtcctg

SEQ ID NO: 860993 - DNA, 25 bp, Mus musculus
tgcaaatactataccctggccgtag

SEQ ID NO: 860994 - DNA, 25 bp, Mus musculus
tgcaaatactattccctggccgtag

SEQ ID NO: 860995 - DNA, 25 bp, Mus musculus
tgcaaatacttaagtgctactggta

SEQ ID NO: 860996 - DNA, 25 bp, Mus musculus
tgcaaatacttatgtgctactggta

SEQ ID NO: 860997 - DNA, 25 bp, Mus musculus
tgcaaatactttcccttctgtaggc

SEQ ID NO: 860998 - DNA, 25 bp, Mus musculus
tgcaaatactttgccttctgtaggc

SEQ ID NO: 860999 - DNA, 25 bp, Mus musculus
tgcaaatagctaaaccacacaggag

SEQ ID NO: 861000 - DNA, 25 bp, Mus musculus
tgcaaatagctataccacacaggag

SEQ ID NO: 861001 - DNA, 25 bp, Mus musculus
tgcaaatatggaactgtaacaacga

SEQ ID NO: 861002 - DNA, 25 bp, Mus musculus
tgcaaatatggatctgtaacaacga

SEQ ID NO: 861003 - DNA, 25 bp, Mus musculus
tgcaaatcactgacttcattcggca

SEQ ID NO: 861004 - DNA, 25 bp, Mus musculus
tgcaaatcactgtcttcattcggca

SEQ ID NO: 861005 - DNA, 25 bp, Mus musculus
tgcaaatcagggagtctgccaggcc

SEQ ID NO: 861006 - DNA, 25 bp, Mus musculus
tgcaaatcagggtgtctgccaggcc

SEQ ID NO: 861007 - DNA, 25 bp, Mus musculus
tgcaaatcagtaacccagagagttt

SEQ ID NO: 861008 - DNA, 25 bp, Mus musculus
tgcaaatcagtatcccagagagttt

SEQ ID NO: 861009 - DNA, 25 bp, Mus musculus
tgcaaatccacccaaacagttgtcc

SEQ ID NO: 861010 - DNA, 25 bp, Mus musculus
tgcaaatccaccgaaacagttgtcc

SEQ ID NO: 861011 - DNA, 25 bp, Mus musculus
tgcaaatccaggagccagttccgga

SEQ ID NO: 861012 - DNA, 25 bp, Mus musculus
tgcaaatccaggtgccagttccgga

SEQ ID NO: 861013 - DNA, 25 bp, Mus musculus
tgcaaatccgcccattggtttgacc

SEQ ID NO: 861014 - DNA, 25 bp, Mus musculus
tgcaaatccgccgattggtttgacc

SEQ ID NO: 861015 - DNA, 25 bp, Mus musculus
tgcaaatcgaaccaaccctgcaatt

SEQ ID NO: 861016 - DNA, 25 bp, Mus musculus
tgcaaatcgaacgaaccctgcaatt

SEQ ID NO: 861017 - DNA, 25 bp, Mus musculus
tgcaaatcttcactcttaaaccctt

SEQ ID NO: 861018 - DNA, 25 bp, Mus musculus
tgcaaatcttcagtcttaaaccctt

SEQ ID NO: 861019 - DNA, 25 bp, Mus musculus
tgcaaatgccgtattcttctaaggg

SEQ ID NO: 861020 - DNA, 25 bp, Mus musculus
tgcaaatgccgttttcttctaaggg

SEQ ID NO: 861021 - DNA, 25 bp, Mus musculus
tgcaaatgcctgatttctccgcaat

SEQ ID NO: 861022 - DNA, 25 bp, Mus musculus
tgcaaatgcctgttttctccgcaat

SEQ ID NO: 861023 - DNA, 25 bp, Mus musculus
tgcaaatgccttactaaatccttgg

SEQ ID NO: 861024 - DNA, 25 bp, Mus musculus
tgcaaatgcctttctaaatccttgg

SEQ ID NO: 861025 - DNA, 25 bp, Mus musculus
tgcaaatgcttgactgggtgtacga

SEQ ID NO: 861026 - DNA, 25 bp, Mus musculus
tgcaaatgcttgtctgggtgtacga

SEQ ID NO: 861027 - DNA, 25 bp, Mus musculus
tgcaaatggcatatgcttgtggccc

SEQ ID NO: 861028 - DNA, 25 bp, Mus musculus
tgcaaatggcatttgcttgtggccc

SEQ ID NO: 861029 - DNA, 25 bp, Mus musculus
tgcaaatggccgaattttttcccaa

SEQ ID NO: 861030 - DNA, 25 bp, Mus musculus
tgcaaatggccgtattttttcccaa

SEQ ID NO: 861031 - DNA, 25 bp, Mus musculus
tgcaaatggcttccctggcacggat

SEQ ID NO: 861032 - DNA, 25 bp, Mus musculus
tgcaaatggcttgcctggcacggat

SEQ ID NO: 861033 - DNA, 25 bp, Mus musculus
tgcaaatgggtcaccggtgtccttt

SEQ ID NO: 861034 - DNA, 25 bp, Mus musculus
tgcaaatgggtctccggtgtccttt

SEQ ID NO: 861035 - DNA, 25 bp, Mus musculus
tgcaaatggtacactggacagccta

SEQ ID NO: 861036 - DNA, 25 bp, Mus musculus
tgcaaatggtactctggacagccta

SEQ ID NO: 861037 - DNA, 25 bp, Mus musculus
tgcaaatgtgcgaacctgccagaaa

SEQ ID NO: 861038 - DNA, 25 bp, Mus musculus
tgcaaatgtgcgtacctgccagaaa

SEQ ID NO: 861039 - DNA, 25 bp, Mus musculus
tgcaaatgttaccttcacctatctg

SEQ ID NO: 861040 - DNA, 25 bp, Mus musculus
tgcaaatgttacgttcacctatctg

SEQ ID NO: 861041 - DNA, 25 bp, Mus musculus
tgcaaatgttggcttcctcctactt

SEQ ID NO: 861042 - DNA, 25 bp, Mus musculus
tgcaaatgttgggttcctcctactt

SEQ ID NO: 861043 - DNA, 25 bp, Mus musculus
tgcaaattacaaatcctgtctctgt

SEQ ID NO: 861044 - DNA, 25 bp, Mus musculus
tgcaaattacaattcctgtctctgt

SEQ ID NO: 861045 - DNA, 25 bp, Mus musculus
tgcaaattggccacaaccttcttta

SEQ ID NO: 861046 - DNA, 25 bp, Mus musculus
tgcaaattggcctcaaccttcttta

SEQ ID NO: 861047 - DNA, 25 bp, Mus musculus
tgcaaatttctaactctccacaatc

SEQ ID NO: 861048 - DNA, 25 bp, Mus musculus
tgcaaatttctatctctccacaatc

SEQ ID NO: 861049 - DNA, 25 bp, Mus musculus
tgcaaatttgagattagcctgagct

SEQ ID NO: 861050 - DNA, 25 bp, Mus musculus
tgcaaatttgagtttagcctgagct

SEQ ID NO: 861051 - DNA, 25 bp, Mus musculus
tgcaacaaatcccttagtcactgac

SEQ ID NO: 861052 - DNA, 25 bp, Mus musculus
tgcaacaaatccgttagtcactgac

SEQ ID NO: 861053 - DNA, 25 bp, Mus musculus
tgcaacaacaccccaatggcataga

SEQ ID NO: 861054 - DNA, 25 bp, Mus musculus
tgcaacaacaccgcaatggcataga

SEQ ID NO: 861055 - DNA, 25 bp, Mus musculus
tgcaacaagcgcatcacccagaaga

SEQ ID NO: 861056 - DNA, 25 bp, Mus musculus
tgcaacaagcgcttcacccagaaga

SEQ ID NO: 861057 - DNA, 25 bp, Mus musculus
tgcaacacaaatcggatctactttt

SEQ ID NO: 861058 - DNA, 25 bp, Mus musculus
tgcaacacaaatgggatctactttt

SEQ ID NO: 861059 - DNA, 25 bp, Mus musculus
tgcaacacatggcagcttccacagt

SEQ ID NO: 861060 - DNA, 25 bp, Mus musculus
tgcaacacatgggagcttccacagt

SEQ ID NO: 861061 - DNA, 25 bp, Mus musculus
tgcaacaccctgaggaagcccacag

SEQ ID NO: 861062 - DNA, 25 bp, Mus musculus
tgcaacaccctgtggaagcccacag

SEQ ID NO: 861063 - DNA, 25 bp, Mus musculus
tgcaacactggaccagcgtgggcta

SEQ ID NO: 861064 - DNA, 25 bp, Mus musculus
tgcaacactggagcagcgtgggcta

SEQ ID NO: 861065 - DNA, 25 bp, Mus musculus
tgcaacagagacagactaacccatg

SEQ ID NO: 861066 - DNA, 25 bp, Mus musculus
tgcaacagagactgactaacccatg

SEQ ID NO: 861067 - DNA, 25 bp, Mus musculus
tgcaacagagtccctcgctgtgcag

SEQ ID NO: 861068 - DNA, 25 bp, Mus musculus
tgcaacagagtcgctcgctgtgcag

SEQ ID NO: 861069 - DNA, 25 bp, Mus musculus
tgcaacagatgtccagatatgattc

SEQ ID NO: 861070 - DNA, 25 bp, Mus musculus
tgcaacagatgtgcagatatgattc

SEQ ID NO: 861071 - DNA, 25 bp, Mus musculus
tgcaacagcaacaagtgcccctaag

SEQ ID NO: 861072 - DNA, 25 bp, Mus musculus
tgcaacagcaactagtgcccctaag

SEQ ID NO: 861073 - DNA, 25 bp, Mus musculus
tgcaacagccctataggtggaagca

SEQ ID NO: 861074 - DNA, 25 bp, Mus musculus
tgcaacagccctttaggtggaagca

SEQ ID NO: 861075 - DNA, 25 bp, Mus musculus
tgcaacagcggtaccacagatactt

SEQ ID NO: 861076 - DNA, 25 bp, Mus musculus
tgcaacagcggttccacagatactt

SEQ ID NO: 861077 - DNA, 25 bp, Mus musculus
tgcaacagctacacttcatggccat

SEQ ID NO: 861078 - DNA, 25 bp, Mus musculus
tgcaacagctactcttcatggccat

SEQ ID NO: 861079 - DNA, 25 bp, Mus musculus
tgcaacagctcaagagatccctcta

SEQ ID NO: 861080 - DNA, 25 bp, Mus musculus
tgcaacagctcatgagatccctcta

SEQ ID NO: 861081 - DNA, 25 bp, Mus musculus
tgcaacaggacaagatagcttgaat

SEQ ID NO: 861082 - DNA, 25 bp, Mus musculus
tgcaacaggacatgatagcttgaat

SEQ ID NO: 861083 - DNA, 25 bp, Mus musculus
tgcaacatagtgctcaggctctcta

SEQ ID NO: 861084 - DNA, 25 bp, Mus musculus
tgcaacatagtggtcaggctctcta

SEQ ID NO: 861085 - DNA, 25 bp, Mus musculus
tgcaacatctgcacttggagcactg

SEQ ID NO: 861086 - DNA, 25 bp, Mus musculus
tgcaacatctgctcttggagcactg

SEQ ID NO: 861087 - DNA, 25 bp, Mus musculus
tgcaacatgcttaactcagcctctt

SEQ ID NO: 861088 - DNA, 25 bp, Mus musculus
tgcaacatgctttactcagcctctt

SEQ ID NO: 861089 - DNA, 25 bp, Mus musculus
tgcaacatggagctcagccttctgt

SEQ ID NO: 861090 - DNA, 25 bp, Mus musculus
tgcaacatggaggtcagccttctgt

SEQ ID NO: 861091 - DNA, 25 bp, Mus musculus
tgcaacatgtgcactggtttggaga

SEQ ID NO: 861092 - DNA, 25 bp, Mus musculus
tgcaacatgtgctctggtttggaga

SEQ ID NO: 861093 - DNA, 25 bp, Mus musculus
tgcaacattattcctctccagagat

SEQ ID NO: 861094 - DNA, 25 bp, Mus musculus
tgcaacattattgctctccagagat

SEQ ID NO: 861095 - DNA, 25 bp, Mus musculus
tgcaacattccgcttttaactctat

SEQ ID NO: 861096 - DNA, 25 bp, Mus musculus
tgcaacattccggttttaactctat

SEQ ID NO: 861097 - DNA, 25 bp, Mus musculus
tgcaaccaaaagctactccaaccat

SEQ ID NO: 861098 - DNA, 25 bp, Mus musculus
tgcaaccaaaaggtactccaaccat

SEQ ID NO: 861099 - DNA, 25 bp, Mus musculus
tgcaaccacttcatatgtttctatt

SEQ ID NO: 861100 - DNA, 25 bp, Mus musculus
tgcaaccacttcttatgtttctatt

SEQ ID NO: 861101 - DNA, 25 bp, Mus musculus
tgcaaccagatgattcagttctaaa

SEQ ID NO: 861102 - DNA, 25 bp, Mus musculus
tgcaaccagatgtttcagttctaaa

SEQ ID NO: 861103 - DNA, 25 bp, Mus musculus
tgcaaccagcaacattacctgaagt

SEQ ID NO: 861104 - DNA, 25 bp, Mus musculus
tgcaaccagcaagattacctgaagt

SEQ ID NO: 861105 - DNA, 25 bp, Mus musculus
tgcaaccatattacattattttcgt

SEQ ID NO: 861106 - DNA, 25 bp, Mus musculus
tgcaaccatatttcattattttcgt

SEQ ID NO: 861107 - DNA, 25 bp, Mus musculus
tgcaaccatgttaccctttcctgaa

SEQ ID NO: 861108 - DNA, 25 bp, Mus musculus
tgcaaccatgttctcctgatggcca

SEQ ID NO: 861109 - DNA, 25 bp, Mus musculus
tgcaaccatgttgtcctgatggcca

SEQ ID NO: 861110 - DNA, 25 bp, Mus musculus
tgcaaccatgtttccctttcctgaa

SEQ ID NO: 861111 - DNA, 25 bp, Mus musculus
tgcaacccaaacacggtgggacctt

SEQ ID NO: 861112 - DNA, 25 bp, Mus musculus
tgcaacccaaactcggtgggacctt

SEQ ID NO: 861113 - DNA, 25 bp, Mus musculus
tgcaacccaatcaactcagtttcag

SEQ ID NO: 861114 - DNA, 25 bp, Mus musculus
tgcaacccaatctactcagtttcag

SEQ ID NO: 861115 - DNA, 25 bp, Mus musculus
tgcaacccaggcattctttgactgt

SEQ ID NO: 861116 - DNA, 25 bp, Mus musculus
tgcaacccaggctttctttgactgt

SEQ ID NO: 861117 - DNA, 25 bp, Mus musculus
tgcaacccagttatcccaccttaga

SEQ ID NO: 861118 - DNA, 25 bp, Mus musculus
tgcaacccagttttcccaccttaga

SEQ ID NO: 861119 - DNA, 25 bp, Mus musculus
tgcaacccatccattctgaggcttg

SEQ ID NO: 861120 - DNA, 25 bp, Mus musculus
tgcaacccatcctttctgaggcttg

SEQ ID NO: 861121 - DNA, 25 bp, Mus musculus
tgcaaccccaagactgattgtgctt

SEQ ID NO: 861122 - DNA, 25 bp, Mus musculus
tgcaaccccaagtctgattgtgctt

SEQ ID NO: 861123 - DNA, 25 bp, Mus musculus
tgcaaccccaccataaataaacgtt

SEQ ID NO: 861124 - DNA, 25 bp, Mus musculus
tgcaaccccaccttaaataaacgtt

SEQ ID NO: 861125 - DNA, 25 bp, Mus musculus
tgcaaccctgacaagaacgtctgtg

SEQ ID NO: 861126 - DNA, 25 bp, Mus musculus
tgcaaccctgactagaacgtctgtg

SEQ ID NO: 861127 - DNA, 25 bp, Mus musculus
tgcaaccctgctctgtttggagaat

SEQ ID NO: 861128 - DNA, 25 bp, Mus musculus
tgcaaccctgctgtgtttggagaat

SEQ ID NO: 861129 - DNA, 25 bp, Mus musculus
tgcaacccttatacagagtcaattt

SEQ ID NO: 861130 - DNA, 25 bp, Mus musculus
tgcaacccttattcagagtcaattt

SEQ ID NO: 861131 - DNA, 25 bp, Mus musculus
tgcaacccttttctacttgagacat

SEQ ID NO: 861132 - DNA, 25 bp, Mus musculus
tgcaacccttttgtacttgagacat

SEQ ID NO: 861133 - DNA, 25 bp, Mus musculus
tgcaacctatccaaaacctgagcta

SEQ ID NO: 861134 - DNA, 25 bp, Mus musculus
tgcaacctatcctaaacctgagcta

SEQ ID NO: 861135 - DNA, 25 bp, Mus musculus
tgcaacctcgctatgttttactttt

SEQ ID NO: 861136 - DNA, 25 bp, Mus musculus
tgcaacctcgctttgttttactttt

SEQ ID NO: 861137 - DNA, 25 bp, Mus musculus
tgcaacctctcacagttcccagaga

SEQ ID NO: 861138 - DNA, 25 bp, Mus musculus
tgcaacctctcagagttcccagaga

SEQ ID NO: 861139 - DNA, 25 bp, Mus musculus
tgcaacctcttcagaattcccaaga

SEQ ID NO: 861140 - DNA, 25 bp, Mus musculus
tgcaacctcttctgaattcccaaga

SEQ ID NO: 861141 - DNA, 25 bp, Mus musculus
tgcaacctgcaacgtggtattactt

SEQ ID NO: 861142 - DNA, 25 bp, Mus musculus
tgcaacctgcaaggtggtattactt

SEQ ID NO: 861143 - DNA, 25 bp, Mus musculus
tgcaaccttgaaatgctccaggaag

SEQ ID NO: 861144 - DNA, 25 bp, Mus musculus
tgcaaccttgaattgctccaggaag

SEQ ID NO: 861145 - DNA, 25 bp, Mus musculus
tgcaaccttgctagacagagtgtgt

SEQ ID NO: 861146 - DNA, 25 bp, Mus musculus
tgcaaccttgcttgacagagtgtgt

SEQ ID NO: 861147 - DNA, 25 bp, Mus musculus
tgcaacgactggcaaaaattatttt

SEQ ID NO: 861148 - DNA, 25 bp, Mus musculus
tgcaacgactgggaaaaattatttt

SEQ ID NO: 861149 - DNA, 25 bp, Mus musculus
tgcaacggtacgaggagctgaagaa

SEQ ID NO: 861150 - DNA, 25 bp, Mus musculus
tgcaacggtacgtggagctgaagaa

SEQ ID NO: 861151 - DNA, 25 bp, Mus musculus
tgcaacggtgcaatggcctttttca

SEQ ID NO: 861152 - DNA, 25 bp, Mus musculus
tgcaacggtgcattggcctttttca

SEQ ID NO: 861153 - DNA, 25 bp, Mus musculus
tgcaacgtctcgctgccacagatgg

SEQ ID NO: 861154 - DNA, 25 bp, Mus musculus
tgcaacgtctcggtgccacagatgg

SEQ ID NO: 861155 - DNA, 25 bp, Mus musculus
tgcaacgtgtgcctggatccgataa

SEQ ID NO: 861156 - DNA, 25 bp, Mus musculus
tgcaacgtgtgcgtggatccgataa

SEQ ID NO: 861157 - DNA, 25 bp, Mus musculus
tgcaacgtttgaagagtggttcccc

SEQ ID NO: 861158 - DNA, 25 bp, Mus musculus
tgcaacgtttgatgagtggttcccc

SEQ ID NO: 861159 - DNA, 25 bp, Mus musculus
tgcaactaagtgcttatcacttcaa

SEQ ID NO: 861160 - DNA, 25 bp, Mus musculus
tgcaactaagtggttatcacttcaa

SEQ ID NO: 861161 - DNA, 25 bp, Mus musculus
tgcaactagcacaccctgaagaaag

SEQ ID NO: 861162 - DNA, 25 bp, Mus musculus
tgcaactagcactccctgaagaaag

SEQ ID NO: 861163 - DNA, 25 bp, Mus musculus
tgcaactagtagatcccaaaccctt

SEQ ID NO: 861164 - DNA, 25 bp, Mus musculus
tgcaactagtagttcccaaaccctt

SEQ ID NO: 861165 - DNA, 25 bp, Mus musculus
tgcaactatacacgtgtgcttccct

SEQ ID NO: 861166 - DNA, 25 bp, Mus musculus
tgcaactatacaggtgtgcttccct

SEQ ID NO: 861167 - DNA, 25 bp, Mus musculus
tgcaactcaagcaccaggcgtctga

SEQ ID NO: 861168 - DNA, 25 bp, Mus musculus
tgcaactcaagctccaggcgtctga

SEQ ID NO: 861169 - DNA, 25 bp, Mus musculus
tgcaactcaccacgtgtaacctgga

SEQ ID NO: 861170 - DNA, 25 bp, Mus musculus
tgcaactcaccaggtgtaacctgga

SEQ ID NO: 861171 - DNA, 25 bp, Mus musculus
tgcaactcacggcacagtcgcaagt

SEQ ID NO: 861172 - DNA, 25 bp, Mus musculus
tgcaactcacgggacagtcgcaagt

SEQ ID NO: 861173 - DNA, 25 bp, Mus musculus
tgcaactcagcaatattccatctat

SEQ ID NO: 861174 - DNA, 25 bp, Mus musculus
tgcaactcagcattattccatctat

SEQ ID NO: 861175 - DNA, 25 bp, Mus musculus
tgcaactccacccagtattcaggag

SEQ ID NO: 861176 - DNA, 25 bp, Mus musculus
tgcaactccaccgagtattcaggag

SEQ ID NO: 861177 - DNA, 25 bp, Mus musculus
tgcaactccaggactagggatgcct

SEQ ID NO: 861178 - DNA, 25 bp, Mus musculus
tgcaactccaggtctagggatgcct

SEQ ID NO: 861179 - DNA, 25 bp, Mus musculus
tgcaactcttcgaattccaacagga

SEQ ID NO: 861180 - DNA, 25 bp, Mus musculus
tgcaactcttcgtattccaacagga

SEQ ID NO: 861181 - DNA, 25 bp, Mus musculus
tgcaactctttcaatctcacaccaa

SEQ ID NO: 861182 - DNA, 25 bp, Mus musculus
tgcaactctttctatctcacaccaa

SEQ ID NO: 861183 - DNA, 25 bp, Mus musculus
tgcaactgagttccagaacgctttt

SEQ ID NO: 861184 - DNA, 25 bp, Mus musculus
tgcaactgagttgcagaacgctttt

SEQ ID NO: 861185 - DNA, 25 bp, Mus musculus
tgcaactgccaacctctaacaagag

SEQ ID NO: 861186 - DNA, 25 bp, Mus musculus
tgcaactgccaagctctaacaagag

SEQ ID NO: 861187 - DNA, 25 bp, Mus musculus
tgcaactgtctacatcagatgtggc

SEQ ID NO: 861188 - DNA, 25 bp, Mus musculus
tgcaactgtctagatcagatgtggc

SEQ ID NO: 861189 - DNA, 25 bp, Mus musculus
tgcaactgtgcaccaaagacctgag

SEQ ID NO: 861190 - DNA, 25 bp, Mus musculus
tgcaactgtgcagcaaagacctgag

SEQ ID NO: 861191 - DNA, 25 bp, Mus musculus
tgcaactgtttaatgatgacgcttc

SEQ ID NO: 861192 - DNA, 25 bp, Mus musculus
tgcaactgtttattgatgacgcttc

SEQ ID NO: 861193 - DNA, 25 bp, Mus musculus
tgcaacttaactagtcaacactggg

SEQ ID NO: 861194 - DNA, 25 bp, Mus musculus
tgcaacttaacttgtcaacactggg

SEQ ID NO: 861195 - DNA, 25 bp, Mus musculus
tgcaacttatatccctaaggctcag

SEQ ID NO: 861196 - DNA, 25 bp, Mus musculus
tgcaacttatatgcctaaggctcag

SEQ ID NO: 861197 - DNA, 25 bp, Mus musculus
tgcaacttattgataacctgagtag

SEQ ID NO: 861198 - DNA, 25 bp, Mus musculus
tgcaacttattgttaacctgagtag

SEQ ID NO: 861199 - DNA, 25 bp, Mus musculus
tgcaacttccgacggacacaccggg

SEQ ID NO: 861200 - DNA, 25 bp, Mus musculus
tgcaacttccgagggacacaccggg

SEQ ID NO: 861201 - DNA, 25 bp, Mus musculus
tgcaacttcctcctcaaaacagaat

SEQ ID NO: 861202 - DNA, 25 bp, Mus musculus
tgcaacttcctcgtcaaaacagaat

SEQ ID NO: 861203 - DNA, 25 bp, Mus musculus
tgcaacttctctctaactcacatca

SEQ ID NO: 861204 - DNA, 25 bp, Mus musculus
tgcaacttctctgtaactcacatca

SEQ ID NO: 861205 - DNA, 25 bp, Mus musculus
tgcaacttctggctttgacatcaca

SEQ ID NO: 861206 - DNA, 25 bp, Mus musculus
tgcaacttctgggtttgacatcaca

SEQ ID NO: 861207 - DNA, 25 bp, Mus musculus
tgcaactttggacctgtcctgagct

SEQ ID NO: 861208 - DNA, 25 bp, Mus musculus
tgcaactttggagctgtcctgagct

SEQ ID NO: 861209 - DNA, 25 bp, Mus musculus
tgcaactttgtcacctttatgagga

SEQ ID NO: 861210 - DNA, 25 bp, Mus musculus
tgcaactttgtctcctttatgagga

SEQ ID NO: 861211 - DNA, 25 bp, Mus musculus
tgcaacttttgcaattccctttcct

SEQ ID NO: 861212 - DNA, 25 bp, Mus musculus
tgcaacttttgctattccctttcct

SEQ ID NO: 861213 - DNA, 25 bp, Mus musculus
tgcaagaaacccctacaaatttgag

SEQ ID NO: 861214 - DNA, 25 bp, Mus musculus
tgcaagaaacccgtacaaatttgag

SEQ ID NO: 861215 - DNA, 25 bp, Mus musculus
tgcaagaagccccatggtgagcgac

SEQ ID NO: 861216 - DNA, 25 bp, Mus musculus
tgcaagaagcccgatggtgagcgac

SEQ ID NO: 861217 - DNA, 25 bp, Mus musculus
tgcaagaagtctccaaccccatgca

SEQ ID NO: 861218 - DNA, 25 bp, Mus musculus
tgcaagaagtctgcaaccccatgca

SEQ ID NO: 861219 - DNA, 25 bp, Mus musculus
tgcaagaatcacagaacatcacagt

SEQ ID NO: 861220 - DNA, 25 bp, Mus musculus
tgcaagaatcactgaacatcacagt

SEQ ID NO: 861221 - DNA, 25 bp, Mus musculus
tgcaagacaaccaggttatcgccct

SEQ ID NO: 861222 - DNA, 25 bp, Mus musculus
tgcaagacaaccagtgctgtagaga

SEQ ID NO: 861223 - DNA, 25 bp, Mus musculus
tgcaagacaacctggttatcgccct

SEQ ID NO: 861224 - DNA, 25 bp, Mus musculus
tgcaagacaacctgtgctgtagaga

SEQ ID NO: 861225 - DNA, 25 bp, Mus musculus
tgcaagacattactacggtagtagc

SEQ ID NO: 861226 - DNA, 25 bp, Mus musculus
tgcaagacattagtacggtagtagc

SEQ ID NO: 861227 - DNA, 25 bp, Mus musculus
tgcaagaccaaacggcctctgtttt

SEQ ID NO: 861228 - DNA, 25 bp, Mus musculus
tgcaagaccaaagggcctctgtttt

SEQ ID NO: 861229 - DNA, 25 bp, Mus musculus
tgcaagaccacgagggaggcccaga

SEQ ID NO: 861230 - DNA, 25 bp, Mus musculus
tgcaagaccacgtgggaggcccaga

SEQ ID NO: 861231 - DNA, 25 bp, Mus musculus
tgcaagacccggatgaggaattcat

SEQ ID NO: 861232 - DNA, 25 bp, Mus musculus
tgcaagacccggttgaggaattcat

SEQ ID NO: 861233 - DNA, 25 bp, Mus musculus
tgcaagacccgtcgcaactcagtgt

SEQ ID NO: 861234 - DNA, 25 bp, Mus musculus
tgcaagacccgtggcaactcagtgt

SEQ ID NO: 861235 - DNA, 25 bp, Mus musculus
tgcaagacctgtctggcttggcttc

SEQ ID NO: 861236 - DNA, 25 bp, Mus musculus
tgcaagacctgtgtggcttggcttc

SEQ ID NO: 861237 - DNA, 25 bp, Mus musculus
tgcaagacgcagaagatgcccctgt

SEQ ID NO: 861238 - DNA, 25 bp, Mus musculus
tgcaagacgcagtagatgcccctgt

SEQ ID NO: 861239 - DNA, 25 bp, Mus musculus
tgcaagactatgaccgggctcgaca

SEQ ID NO: 861240 - DNA, 25 bp, Mus musculus
tgcaagactatgtccgggctcgaca

SEQ ID NO: 861241 - DNA, 25 bp, Mus musculus
tgcaagagaagccacactccggtta

SEQ ID NO: 861242 - DNA, 25 bp, Mus musculus
tgcaagagaagcgacactccggtta

SEQ ID NO: 861243 - DNA, 25 bp, Mus musculus
tgcaagagcagcactccctactgag

SEQ ID NO: 861244 - DNA, 25 bp, Mus musculus
tgcaagagcagctctccctactgag

SEQ ID NO: 861245 - DNA, 25 bp, Mus musculus
tgcaagagggctccacacctaaaga

SEQ ID NO: 861246 - DNA, 25 bp, Mus musculus
tgcaagagggctgcacacctaaaga

SEQ ID NO: 861247 - DNA, 25 bp, Mus musculus
tgcaagataatccagcaatccagta

SEQ ID NO: 861248 - DNA, 25 bp, Mus musculus
tgcaagataatcgagcaatccagta

SEQ ID NO: 861249 - DNA, 25 bp, Mus musculus
tgcaagatacttaaggcctgaccct

SEQ ID NO: 861250 - DNA, 25 bp, Mus musculus
tgcaagatactttaggcctgaccct

SEQ ID NO: 861251 - DNA, 25 bp, Mus musculus
tgcaagatattcctctgagctagtg

SEQ ID NO: 861252 - DNA, 25 bp, Mus musculus
tgcaagatattcgtctgagctagtg

SEQ ID NO: 861253 - DNA, 25 bp, Mus musculus
tgcaagatcactcgctgtcccatga

SEQ ID NO: 861254 - DNA, 25 bp, Mus musculus
tgcaagatcactggctgtcccatga

SEQ ID NO: 861255 - DNA, 25 bp, Mus musculus
tgcaagatcgcactacggtagtaac

SEQ ID NO: 861256 - DNA, 25 bp, Mus musculus
tgcaagatcgcagtacggtagtaac

SEQ ID NO: 861257 - DNA, 25 bp, Mus musculus
tgcaagatctggatactacggtagt

SEQ ID NO: 861258 - DNA, 25 bp, Mus musculus
tgcaagatctggttactacggtagt

SEQ ID NO: 861259 - DNA, 25 bp, Mus musculus
tgcaagatgaatccggctacgagaa

SEQ ID NO: 861260 - DNA, 25 bp, Mus musculus
tgcaagatgaatgcggctacgagaa

SEQ ID NO: 861261 - DNA, 25 bp, Mus musculus
tgcaagatgcatctggccagctgtt

SEQ ID NO: 861262 - DNA, 25 bp, Mus musculus
tgcaagatgcatgtggccagctgtt

SEQ ID NO: 861263 - DNA, 25 bp, Mus musculus
tgcaagatgcccacctagagtgtag

SEQ ID NO: 861264 - DNA, 25 bp, Mus musculus
tgcaagatgccctcctagagtgtag

SEQ ID NO: 861265 - DNA, 25 bp, Mus musculus
tgcaagatggaaacctttccttccc

SEQ ID NO: 861266 - DNA, 25 bp, Mus musculus
tgcaagatggaatcctttccttccc

SEQ ID NO: 861267 - DNA, 25 bp, Mus musculus
tgcaagattatgatcctttctccat

SEQ ID NO: 861268 - DNA, 25 bp, Mus musculus
tgcaagattatgttcctttctccat

SEQ ID NO: 861269 - DNA, 25 bp, Mus musculus
tgcaagcaacatatacccaggccgg

SEQ ID NO: 861270 - DNA, 25 bp, Mus musculus
tgcaagcaacatttacccaggccgg

SEQ ID NO: 861271 - DNA, 25 bp, Mus musculus
tgcaagcacattcggctgtctccat

SEQ ID NO: 861272 - DNA, 25 bp, Mus musculus
tgcaagcacattgggctgtctccat

SEQ ID NO: 861273 - DNA, 25 bp, Mus musculus
tgcaagcagcgcagcctaagtgacc

SEQ ID NO: 861274 - DNA, 25 bp, Mus musculus
tgcaagcagcgctgcctaagtgacc

SEQ ID NO: 861275 - DNA, 25 bp, Mus musculus
tgcaagcaggacagaagctgaattc

SEQ ID NO: 861276 - DNA, 25 bp, Mus musculus
tgcaagcaggactgaagctgaattc

SEQ ID NO: 861277 - DNA, 25 bp, Mus musculus
tgcaagccaaagatttccaggtaaa

SEQ ID NO: 861278 - DNA, 25 bp, Mus musculus
tgcaagccaaagttttccaggtaaa

SEQ ID NO: 861279 - DNA, 25 bp, Mus musculus
tgcaagccacctcactgagcactgt

SEQ ID NO: 861280 - DNA, 25 bp, Mus musculus
tgcaagccacctgactgagcactgt

SEQ ID NO: 861281 - DNA, 25 bp, Mus musculus
tgcaagccacttacaatcacatcag

SEQ ID NO: 861282 - DNA, 25 bp, Mus musculus
tgcaagccactttcaatcacatcag

SEQ ID NO: 861283 - DNA, 25 bp, Mus musculus
tgcaagccagaccacagtgccagat

SEQ ID NO: 861284 - DNA, 25 bp, Mus musculus
tgcaagccagaccatggatactgga

SEQ ID NO: 861285 - DNA, 25 bp, Mus musculus
tgcaagccagacgacagtgccagat

SEQ ID NO: 861286 - DNA, 25 bp, Mus musculus
tgcaagccagacgatggatactgga

SEQ ID NO: 861287 - DNA, 25 bp, Mus musculus
tgcaagccagctccccaggagcaag

SEQ ID NO: 861288 - DNA, 25 bp, Mus musculus
tgcaagccagctgcccaggagcaag

SEQ ID NO: 861289 - DNA, 25 bp, Mus musculus
tgcaagccaggactcgccgcaaaga

SEQ ID NO: 861290 - DNA, 25 bp, Mus musculus
tgcaagccaggagtcgccgcaaaga

SEQ ID NO: 861291 - DNA, 25 bp, Mus musculus
tgcaagccagttcttgtcttccgaa

SEQ ID NO: 861292 - DNA, 25 bp, Mus musculus
tgcaagccagttgttgtcttccgaa

SEQ ID NO: 861293 - DNA, 25 bp, Mus musculus
tgcaagccatgtactagctcactgc

SEQ ID NO: 861294 - DNA, 25 bp, Mus musculus
tgcaagccatgttctagctcactgc

SEQ ID NO: 861295 - DNA, 25 bp, Mus musculus
tgcaagccctcactcaagatatagt

SEQ ID NO: 861296 - DNA, 25 bp, Mus musculus
tgcaagccctcagtcaagatatagt

SEQ ID NO: 861297 - DNA, 25 bp, Mus musculus
tgcaagcctgaccattctgccctaa

SEQ ID NO: 861298 - DNA, 25 bp, Mus musculus
tgcaagcctgacgattctgccctaa

SEQ ID NO: 861299 - DNA, 25 bp, Mus musculus
tgcaagccttgccagatagcagtga

SEQ ID NO: 861300 - DNA, 25 bp, Mus musculus
tgcaagccttgcgagatagcagtga

SEQ ID NO: 861301 - DNA, 25 bp, Mus musculus
tgcaagccttgtagttgtgctacgg

SEQ ID NO: 861302 - DNA, 25 bp, Mus musculus
tgcaagccttgttgttgtgctacgg

SEQ ID NO: 861303 - DNA, 25 bp, Mus musculus
tgcaagcgccccatcacaggtggga

SEQ ID NO: 861304 - DNA, 25 bp, Mus musculus
tgcaagcgccccttcacaggtggga

SEQ ID NO: 861305 - DNA, 25 bp, Mus musculus
tgcaagctagtaaattttcttacat

SEQ ID NO: 861306 - DNA, 25 bp, Mus musculus
tgcaagctagtatattttcttacat

SEQ ID NO: 861307 - DNA, 25 bp, Mus musculus
tgcaagctcagcaccgtggaacatg

SEQ ID NO: 861308 - DNA, 25 bp, Mus musculus
tgcaagctcagctccgtggaacatg

SEQ ID NO: 861309 - DNA, 25 bp, Mus musculus
tgcaagctctagaaacacatggacc

SEQ ID NO: 861310 - DNA, 25 bp, Mus musculus
tgcaagctctagtaacacatggacc

SEQ ID NO: 861311 - DNA, 25 bp, Mus musculus
tgcaagctctcaaggacatcctaaa

SEQ ID NO: 861312 - DNA, 25 bp, Mus musculus
tgcaagctctcatggacatcctaaa

SEQ ID NO: 861313 - DNA, 25 bp, Mus musculus
tgcaagctgaccaggctgacatcac

SEQ ID NO: 861314 - DNA, 25 bp, Mus musculus
tgcaagctgacctggctgacatcac

SEQ ID NO: 861315 - DNA, 25 bp, Mus musculus
tgcaagctggccaatacactacaac

SEQ ID NO: 861316 - DNA, 25 bp, Mus musculus
tgcaagctggccatctgcaccatag

SEQ ID NO: 861317 - DNA, 25 bp, Mus musculus
tgcaagctggcctatacactacaac

SEQ ID NO: 861318 - DNA, 25 bp, Mus musculus
tgcaagctggccttctgcaccatag

SEQ ID NO: 861319 - DNA, 25 bp, Mus musculus
tgcaagctgtgcctataactaaagt

SEQ ID NO: 861320 - DNA, 25 bp, Mus musculus
tgcaagctgtgcgtataactaaagt

SEQ ID NO: 861321 - DNA, 25 bp, Mus musculus
tgcaagcttagcactctacagttga

SEQ ID NO: 861322 - DNA, 25 bp, Mus musculus
tgcaagcttagctctctacagttga

SEQ ID NO: 861323 - DNA, 25 bp, Mus musculus
tgcaagcttgttattgtgccacact

SEQ ID NO: 861324 - DNA, 25 bp, Mus musculus
tgcaagcttgtttttgtgccacact

SEQ ID NO: 861325 - DNA, 25 bp, Mus musculus
tgcaagctttctcctggtgggctgt

SEQ ID NO: 861326 - DNA, 25 bp, Mus musculus
tgcaagctttctgctggtgggctgt

SEQ ID NO: 861327 - DNA, 25 bp, Mus musculus
tgcaaggactatatgctgccccagt

SEQ ID NO: 861328 - DNA, 25 bp, Mus musculus
tgcaaggactatttgctgccccagt

SEQ ID NO: 861329 - DNA, 25 bp, Mus musculus
tgcaaggactcccagtgagggacat

SEQ ID NO: 861330 - DNA, 25 bp, Mus musculus
tgcaaggactccgagtgagggacat

SEQ ID NO: 861331 - DNA, 25 bp, Mus musculus
tgcaaggactgcaacctagcggtga

SEQ ID NO: 861332 - DNA, 25 bp, Mus musculus
tgcaaggactgctacctagcggtga

SEQ ID NO: 861333 - DNA, 25 bp, Mus musculus
tgcaaggagtacaaccctcccgaga

SEQ ID NO: 861334 - DNA, 25 bp, Mus musculus
tgcaaggagtactaccctcccgaga

SEQ ID NO: 861335 - DNA, 25 bp, Mus musculus
tgcaaggcacacacacagcgacttt

SEQ ID NO: 861336 - DNA, 25 bp, Mus musculus
tgcaaggcacactcacagcgacttt

SEQ ID NO: 861337 - DNA, 25 bp, Mus musculus
tgcaaggcagggaccccgtgtgaat

SEQ ID NO: 861338 - DNA, 25 bp, Mus musculus
tgcaaggcagggtccccgtgtgaat

SEQ ID NO: 861339 - DNA, 25 bp, Mus musculus
tgcaaggcatacaatcccgaagatt

SEQ ID NO: 861340 - DNA, 25 bp, Mus musculus
tgcaaggcatactatcccgaagatt

SEQ ID NO: 861341 - DNA, 25 bp, Mus musculus
tgcaaggccaccacaaagtcacagt

SEQ ID NO: 861342 - DNA, 25 bp, Mus musculus
tgcaaggccacctcaaagtcacagt

SEQ ID NO: 861343 - DNA, 25 bp, Mus musculus
tgcaaggccatcaaaccttcttctg

SEQ ID NO: 861344 - DNA, 25 bp, Mus musculus
tgcaaggccatcagagctacacttc

SEQ ID NO: 861345 - DNA, 25 bp, Mus musculus
tgcaaggccatctaaccttcttctg

SEQ ID NO: 861346 - DNA, 25 bp, Mus musculus
tgcaaggccatctgagctacacttc

SEQ ID NO: 861347 - DNA, 25 bp, Mus musculus
tgcaaggcccaccatgtgtgcctct

SEQ ID NO: 861348 - DNA, 25 bp, Mus musculus
tgcaaggcccacgatgtgtgcctct

SEQ ID NO: 861349 - DNA, 25 bp, Mus musculus
tgcaaggccctaagtctaagtacta

SEQ ID NO: 861350 - DNA, 25 bp, Mus musculus
tgcaaggccctatgtctaagtacta

SEQ ID NO: 861351 - DNA, 25 bp, Mus musculus
tgcaaggcctgcctttatcctgaga

SEQ ID NO: 861352 - DNA, 25 bp, Mus musculus
tgcaaggcctgcgtttatcctgaga

SEQ ID NO: 861353 - DNA, 25 bp, Mus musculus
tgcaaggcctgtcgagagtccgtta

SEQ ID NO: 861354 - DNA, 25 bp, Mus musculus
tgcaaggcctgtggagagtccgtta

SEQ ID NO: 861355 - DNA, 25 bp, Mus musculus
tgcaaggcgctgaccaacacattgg

SEQ ID NO: 861356 - DNA, 25 bp, Mus musculus
tgcaaggcgctgtccaacacattgg

SEQ ID NO: 861357 - DNA, 25 bp, Mus musculus
tgcaaggctagcatgaccacaccat

SEQ ID NO: 861358 - DNA, 25 bp, Mus musculus
tgcaaggctagcttgaccacaccat

SEQ ID NO: 861359 - DNA, 25 bp, Mus musculus
tgcaagggaatgatttttactctaa

SEQ ID NO: 861360 - DNA, 25 bp, Mus musculus
tgcaagggaatgttttttactctaa

SEQ ID NO: 861361 - DNA, 25 bp, Mus musculus
tgcaagggcaaaagccggcctcaat

SEQ ID NO: 861362 - DNA, 25 bp, Mus musculus
tgcaagggcaaatgccggcctcaat

SEQ ID NO: 861363 - DNA, 25 bp, Mus musculus
tgcaagggctttaacacgaactctc

SEQ ID NO: 861364 - DNA, 25 bp, Mus musculus
tgcaagggcttttacacgaactctc

SEQ ID NO: 861365 - DNA, 25 bp, Mus musculus
tgcaagggtcccaggtctcccttta

SEQ ID NO: 861366 - DNA, 25 bp, Mus musculus
tgcaagggtccctggtctcccttta

SEQ ID NO: 861367 - DNA, 25 bp, Mus musculus
tgcaagggtcttacaagttgtggat

SEQ ID NO: 861368 - DNA, 25 bp, Mus musculus
tgcaagggtctttcaagttgtggat

SEQ ID NO: 861369 - DNA, 25 bp, Mus musculus
tgcaaggtcgacaactcctgggaaa

SEQ ID NO: 861370 - DNA, 25 bp, Mus musculus
tgcaaggtcgactactcctgggaaa

SEQ ID NO: 861371 - DNA, 25 bp, Mus musculus
tgcaaggtgcatatttactattgtt

SEQ ID NO: 861372 - DNA, 25 bp, Mus musculus
tgcaaggtgcatttttactattgtt

SEQ ID NO: 861373 - DNA, 25 bp, Mus musculus
tgcaaggtgcccagcaactggaaga

SEQ ID NO: 861374 - DNA, 25 bp, Mus musculus
tgcaaggtgccctgcaactggaaga

SEQ ID NO: 861375 - DNA, 25 bp, Mus musculus
tgcaaggtgctcagcggcccagtga

SEQ ID NO: 861376 - DNA, 25 bp, Mus musculus
tgcaaggtgctctgcggcccagtga

SEQ ID NO: 861377 - DNA, 25 bp, Mus musculus
tgcaaggtggacagccagttacttc

SEQ ID NO: 861378 - DNA, 25 bp, Mus musculus
tgcaaggtggactgccagttacttc

SEQ ID NO: 861379 - DNA, 25 bp, Mus musculus
tgcaaggtgggtactgccatgcccg

SEQ ID NO: 861380 - DNA, 25 bp, Mus musculus
tgcaaggtgggttctgccatgcccg

SEQ ID NO: 861381 - DNA, 25 bp, Mus musculus
tgcaaggtggttcactgcacccttt

SEQ ID NO: 861382 - DNA, 25 bp, Mus musculus
tgcaaggtggttgactgcacccttt

SEQ ID NO: 861383 - DNA, 25 bp, Mus musculus
tgcaaggtgtatattcatcccaggg

SEQ ID NO: 861384 - DNA, 25 bp, Mus musculus
tgcaaggtgtattttcatcccaggg

SEQ ID NO: 861385 - DNA, 25 bp, Mus musculus
tgcaaggttaccagggttgttccaa

SEQ ID NO: 861386 - DNA, 25 bp, Mus musculus
tgcaaggttacctgggttgttccaa

SEQ ID NO: 861387 - DNA, 25 bp, Mus musculus
tgcaaggttgctacctgcagtgtgg

SEQ ID NO: 861388 - DNA, 25 bp, Mus musculus
tgcaaggttgcttcctgcagtgtgg

SEQ ID NO: 861389 - DNA, 25 bp, Mus musculus
tgcaagtaaaccagtgttaacactt

SEQ ID NO: 861390 - DNA, 25 bp, Mus musculus
tgcaagtaaacctgtgttaacactt

SEQ ID NO: 861391 - DNA, 25 bp, Mus musculus
tgcaagtaactccacacaggattgt

SEQ ID NO: 861392 - DNA, 25 bp, Mus musculus
tgcaagtaactcgacacaggattgt

SEQ ID NO: 861393 - DNA, 25 bp, Mus musculus
tgcaagtacacgcttggcccagcct

SEQ ID NO: 861394 - DNA, 25 bp, Mus musculus
tgcaagtacacggttggcccagcct

SEQ ID NO: 861395 - DNA, 25 bp, Mus musculus
tgcaagtaccctattgctgatccac

SEQ ID NO: 861396 - DNA, 25 bp, Mus musculus
tgcaagtaccctccagagcaagaca

SEQ ID NO: 861397 - DNA, 25 bp, Mus musculus
tgcaagtaccctgcagagcaagaca

SEQ ID NO: 861398 - DNA, 25 bp, Mus musculus
tgcaagtacccttttgctgatccac

SEQ ID NO: 861399 - DNA, 25 bp, Mus musculus
tgcaagtagcagagcccttccagtg

SEQ ID NO: 861400 - DNA, 25 bp, Mus musculus
tgcaagtagcagtgcccttccagtg

SEQ ID NO: 861401 - DNA, 25 bp, Mus musculus
tgcaagtatatgaaattagcctgga

SEQ ID NO: 861402 - DNA, 25 bp, Mus musculus
tgcaagtatatgtaattagcctgga

SEQ ID NO: 861403 - DNA, 25 bp, Mus musculus
tgcaagtcaagaaaccgaggcgccc

SEQ ID NO: 861404 - DNA, 25 bp, Mus musculus
tgcaagtcaagataccgaggcgccc

SEQ ID NO: 861405 - DNA, 25 bp, Mus musculus
tgcaagtcacacacggacggagcca

SEQ ID NO: 861406 - DNA, 25 bp, Mus musculus
tgcaagtcacactcggacggagcca

SEQ ID NO: 861407 - DNA, 25 bp, Mus musculus
tgcaagtcagtaactatgccacctc

SEQ ID NO: 861408 - DNA, 25 bp, Mus musculus
tgcaagtcagtatctatgccacctc

SEQ ID NO: 861409 - DNA, 25 bp, Mus musculus
tgcaagtcatccatgtcattcctta

SEQ ID NO: 861410 - DNA, 25 bp, Mus musculus
tgcaagtcatccttgtcattcctta

SEQ ID NO: 861411 - DNA, 25 bp, Mus musculus
tgcaagtccaggcatactgtctgtg

SEQ ID NO: 861412 - DNA, 25 bp, Mus musculus
tgcaagtccagggatactgtctgtg

SEQ ID NO: 861413 - DNA, 25 bp, Mus musculus
tgcaagtcctagaccactcggttat

SEQ ID NO: 861414 - DNA, 25 bp, Mus musculus
tgcaagtcctagtccactcggttat

SEQ ID NO: 861415 - DNA, 25 bp, Mus musculus
tgcaagtcctccagactacagtgac

SEQ ID NO: 861416 - DNA, 25 bp, Mus musculus
tgcaagtcctcctgactacagtgac

SEQ ID NO: 861417 - DNA, 25 bp, Mus musculus
tgcaagtctgtccatcttcagctaa

SEQ ID NO: 861418 - DNA, 25 bp, Mus musculus
tgcaagtctgtcgatcttcagctaa

SEQ ID NO: 861419 - DNA, 25 bp, Mus musculus
tgcaagtcttcccaccgagaggtta

SEQ ID NO: 861420 - DNA, 25 bp, Mus musculus
tgcaagtcttccgaccgagaggtta

SEQ ID NO: 861421 - DNA, 25 bp, Mus musculus
tgcaagtgacctaaagtcccaacct

SEQ ID NO: 861422 - DNA, 25 bp, Mus musculus
tgcaagtgaccttaagtcccaacct

SEQ ID NO: 861423 - DNA, 25 bp, Mus musculus
tgcaagtgagaccatatgccccacc

SEQ ID NO: 861424 - DNA, 25 bp, Mus musculus
tgcaagtgagacgatatgccccacc

SEQ ID NO: 861425 - DNA, 25 bp, Mus musculus
tgcaagtgcctcaccacaggatcgg

SEQ ID NO: 861426 - DNA, 25 bp, Mus musculus
tgcaagtgcctctccacaggatcgg

SEQ ID NO: 861427 - DNA, 25 bp, Mus musculus
tgcaagtgctatagatgccttgagg

SEQ ID NO: 861428 - DNA, 25 bp, Mus musculus
tgcaagtgctattgatgccttgagg

SEQ ID NO: 861429 - DNA, 25 bp, Mus musculus
tgcaagtggattaaaacgactggtc

SEQ ID NO: 861430 - DNA, 25 bp, Mus musculus
tgcaagtggatttaaacgactggtc

SEQ ID NO: 861431 - DNA, 25 bp, Mus musculus
tgcaagtgtcaactttcctgtcaca

SEQ ID NO: 861432 - DNA, 25 bp, Mus musculus
tgcaagtgtcaagtttcctgtcaca

SEQ ID NO: 861433 - DNA, 25 bp, Mus musculus
tgcaagtgtcgtctgcggttgtctc

SEQ ID NO: 861434 - DNA, 25 bp, Mus musculus
tgcaagtgtcgtgtgcggttgtctc

SEQ ID NO: 861435 - DNA, 25 bp, Mus musculus
tgcaagtgttctctcaggaagtagg

SEQ ID NO: 861436 - DNA, 25 bp, Mus musculus
tgcaagtgttctgtcaggaagtagg

SEQ ID NO: 861437 - DNA, 25 bp, Mus musculus
tgcaagttatacacagcacagcttt

SEQ ID NO: 861438 - DNA, 25 bp, Mus musculus
tgcaagttatactcagcacagcttt

SEQ ID NO: 861439 - DNA, 25 bp, Mus musculus
tgcaagttcacacaggtcctcaaga

SEQ ID NO: 861440 - DNA, 25 bp, Mus musculus
tgcaagttcacagaggtcctcaaga

SEQ ID NO: 861441 - DNA, 25 bp, Mus musculus
tgcaagttcaccagtccgtatctac

SEQ ID NO: 861442 - DNA, 25 bp, Mus musculus
tgcaagttcacctgtccgtatctac

SEQ ID NO: 861443 - DNA, 25 bp, Mus musculus
tgcaagttcactatgccaggcccag

SEQ ID NO: 861444 - DNA, 25 bp, Mus musculus
tgcaagttcactatgtatatgaaaa

SEQ ID NO: 861445 - DNA, 25 bp, Mus musculus
tgcaagttcactttgccaggcccag

SEQ ID NO: 861446 - DNA, 25 bp, Mus musculus
tgcaagttcactttgtatatgaaaa

SEQ ID NO: 861447 - DNA, 25 bp, Mus musculus
tgcaagttcagaccctaaagtcacc

SEQ ID NO: 861448 - DNA, 25 bp, Mus musculus
tgcaagttcagagcctaaagtcacc

SEQ ID NO: 861449 - DNA, 25 bp, Mus musculus
tgcaagtttggcacactctccatat

SEQ ID NO: 861450 - DNA, 25 bp, Mus musculus
tgcaagtttggctcactctccatat

SEQ ID NO: 861451 - DNA, 25 bp, Mus musculus
tgcaagtttgtcaaccagtaaaaga

SEQ ID NO: 861452 - DNA, 25 bp, Mus musculus
tgcaagtttgtctaccagtaaaaga

SEQ ID NO: 861453 - DNA, 25 bp, Mus musculus
tgcaataaacaacacatcttcaata

SEQ ID NO: 861454 - DNA, 25 bp, Mus musculus
tgcaataaacaagacatcttcaata

SEQ ID NO: 861455 - DNA, 25 bp, Mus musculus
tgcaataaataaacaacctgtgttc

SEQ ID NO: 861456 - DNA, 25 bp, Mus musculus
tgcaataaataatcaacctgtgttc

SEQ ID NO: 861457 - DNA, 25 bp, Mus musculus
tgcaataatcctacagtgtctcccc

SEQ ID NO: 861458 - DNA, 25 bp, Mus musculus
tgcaataatccttcagtgtctcccc

SEQ ID NO: 861459 - DNA, 25 bp, Mus musculus
tgcaatacattgctgctcatactat

SEQ ID NO: 861460 - DNA, 25 bp, Mus musculus
tgcaatacattggtgctcatactat

SEQ ID NO: 861461 - DNA, 25 bp, Mus musculus
tgcaatagcactcgaagcccagaaa

SEQ ID NO: 861462 - DNA, 25 bp, Mus musculus
tgcaatagcactggaagcccagaaa

SEQ ID NO: 861463 - DNA, 25 bp, Mus musculus
tgcaatagcccactgcctctgtgaa

SEQ ID NO: 861464 - DNA, 25 bp, Mus musculus
tgcaatagcccagtgcctctgtgaa

SEQ ID NO: 861465 - DNA, 25 bp, Mus musculus
tgcaatagtgacaccaatcctggtg

SEQ ID NO: 861466 - DNA, 25 bp, Mus musculus
tgcaatagtgactccaatcctggtg

SEQ ID NO: 861467 - DNA, 25 bp, Mus musculus
tgcaatatactcatgtaccactggg

SEQ ID NO: 861468 - DNA, 25 bp, Mus musculus
tgcaatatactcttgtaccactggg

SEQ ID NO: 861469 - DNA, 25 bp, Mus musculus
tgcaatatcaccaaccttgtacaaa

SEQ ID NO: 861470 - DNA, 25 bp, Mus musculus
tgcaatatcaccactgttccttttc

SEQ ID NO: 861471 - DNA, 25 bp, Mus musculus
tgcaatatcacctaccttgtacaaa

SEQ ID NO: 861472 - DNA, 25 bp, Mus musculus
tgcaatatcacctctgttccttttc

SEQ ID NO: 861473 - DNA, 25 bp, Mus musculus
tgcaatatctctacccatcttaaac

SEQ ID NO: 861474 - DNA, 25 bp, Mus musculus
tgcaatatctcttcccatcttaaac

SEQ ID NO: 861475 - DNA, 25 bp, Mus musculus
tgcaatatgtgtcggtgacatcccc

SEQ ID NO: 861476 - DNA, 25 bp, Mus musculus
tgcaatatgtgtgggtgacatcccc

SEQ ID NO: 861477 - DNA, 25 bp, Mus musculus
tgcaatattgaaaccagtgtctgtg

SEQ ID NO: 861478 - DNA, 25 bp, Mus musculus
tgcaatattgaatccagtgtctgtg

SEQ ID NO: 861479 - DNA, 25 bp, Mus musculus
tgcaatcaaggcagtgtcccaagaa

SEQ ID NO: 861480 - DNA, 25 bp, Mus musculus
tgcaatcaaggctgtgtcccaagaa

SEQ ID NO: 861481 - DNA, 25 bp, Mus musculus
tgcaatcactttacttcagctttat

SEQ ID NO: 861482 - DNA, 25 bp, Mus musculus
tgcaatcacttttcttcagctttat

SEQ ID NO: 861483 - DNA, 25 bp, Mus musculus
tgcaatcagcttacttcttctgcat

SEQ ID NO: 861484 - DNA, 25 bp, Mus musculus
tgcaatcagctttcttcttctgcat

SEQ ID NO: 861485 - DNA, 25 bp, Mus musculus
tgcaatcagtgtcttaaagcctttg

SEQ ID NO: 861486 - DNA, 25 bp, Mus musculus
tgcaatcagtgtgttaaagcctttg

SEQ ID NO: 861487 - DNA, 25 bp, Mus musculus
tgcaatcatgtacacctgttttgtt

SEQ ID NO: 861488 - DNA, 25 bp, Mus musculus
tgcaatcatgtagacctgttttgtt

SEQ ID NO: 861489 - DNA, 25 bp, Mus musculus
tgcaatcatgtgattggtctgaatc

SEQ ID NO: 861490 - DNA, 25 bp, Mus musculus
tgcaatcatgtgtttggtctgaatc

SEQ ID NO: 861491 - DNA, 25 bp, Mus musculus
tgcaatcattaacacgctggcggtc

SEQ ID NO: 861492 - DNA, 25 bp, Mus musculus
tgcaatcattaagacgctggcggtc

SEQ ID NO: 861493 - DNA, 25 bp, Mus musculus
tgcaatccacagaggtcgcgccggg

SEQ ID NO: 861494 - DNA, 25 bp, Mus musculus
tgcaatccacagtggtcgcgccggg

SEQ ID NO: 861495 - DNA, 25 bp, Mus musculus
tgcaatccagacaagggagcttccc

SEQ ID NO: 861496 - DNA, 25 bp, Mus musculus
tgcaatccagactagggagcttccc

SEQ ID NO: 861497 - DNA, 25 bp, Mus musculus
tgcaatcccagccagtggtttgatc

SEQ ID NO: 861498 - DNA, 25 bp, Mus musculus
tgcaatcccagcgagtggtttgatc

SEQ ID NO: 861499 - DNA, 25 bp, Mus musculus
tgcaatcccaggacgaaggagagtc

SEQ ID NO: 861500 - DNA, 25 bp, Mus musculus
tgcaatcccaggtcgaaggagagtc

SEQ ID NO: 861501 - DNA, 25 bp, Mus musculus
tgcaatccgtttagaggtccagtgt

SEQ ID NO: 861502 - DNA, 25 bp, Mus musculus
tgcaatccgttttgaggtccagtgt

SEQ ID NO: 861503 - DNA, 25 bp, Mus musculus
tgcaatcctgaacgcggtctgcatc

SEQ ID NO: 861504 - DNA, 25 bp, Mus musculus
tgcaatcctgaaggcggtctgcatc

SEQ ID NO: 861505 - DNA, 25 bp, Mus musculus
tgcaatcgaaaactcctacatgttt

SEQ ID NO: 861506 - DNA, 25 bp, Mus musculus
tgcaatcgaaaagtcctacatgttt

SEQ ID NO: 861507 - DNA, 25 bp, Mus musculus
tgcaatcgattgctctcttactaca

SEQ ID NO: 861508 - DNA, 25 bp, Mus musculus
tgcaatcgattggtctcttactaca

SEQ ID NO: 861509 - DNA, 25 bp, Mus musculus
tgcaatctcattcctcagcaatgtg

SEQ ID NO: 861510 - DNA, 25 bp, Mus musculus
tgcaatctcattgctcagcaatgtg

SEQ ID NO: 861511 - DNA, 25 bp, Mus musculus
tgcaatctccctcagcaaaagaaaa

SEQ ID NO: 861512 - DNA, 25 bp, Mus musculus
tgcaatctccctgagcaaaagaaaa

SEQ ID NO: 861513 - DNA, 25 bp, Mus musculus
tgcaatctgagtaagggtccgtgtt

SEQ ID NO: 861514 - DNA, 25 bp, Mus musculus
tgcaatctgagttagggtccgtgtt

SEQ ID NO: 861515 - DNA, 25 bp, Mus musculus
tgcaatctgggtcgctgctgatgct

SEQ ID NO: 861516 - DNA, 25 bp, Mus musculus
tgcaatctgggtggctgctgatgct

SEQ ID NO: 861517 - DNA, 25 bp, Mus musculus
tgcaatcttgtaatgtggcctgaaa

SEQ ID NO: 861518 - DNA, 25 bp, Mus musculus
tgcaatcttgtattgtggcctgaaa

SEQ ID NO: 861519 - DNA, 25 bp, Mus musculus
tgcaatgaaatgaatcctccccttc

SEQ ID NO: 861520 - DNA, 25 bp, Mus musculus
tgcaatgaaatgtatcctccccttc

SEQ ID NO: 861521 - DNA, 25 bp, Mus musculus
tgcaatgaactccaacccagatact

SEQ ID NO: 861522 - DNA, 25 bp, Mus musculus
tgcaatgaactcgaacccagatact

SEQ ID NO: 861523 - DNA, 25 bp, Mus musculus
tgcaatgaggacactaaactcaagt

SEQ ID NO: 861524 - DNA, 25 bp, Mus musculus
tgcaatgaggactctaaactcaagt

SEQ ID NO: 861525 - DNA, 25 bp, Mus musculus
tgcaatgatacaatccctgaggact

SEQ ID NO: 861526 - DNA, 25 bp, Mus musculus
tgcaatgatacattccctgaggact

SEQ ID NO: 861527 - DNA, 25 bp, Mus musculus
tgcaatgattatcctgcttctgcca

SEQ ID NO: 861528 - DNA, 25 bp, Mus musculus
tgcaatgattatgctgcttctgcca

SEQ ID NO: 861529 - DNA, 25 bp, Mus musculus
tgcaatgcacaaagaggcagccgtc

SEQ ID NO: 861530 - DNA, 25 bp, Mus musculus
tgcaatgcacaatgaggcagccgtc

SEQ ID NO: 861531 - DNA, 25 bp, Mus musculus
tgcaatgcaccaattgtttttgtct

SEQ ID NO: 861532 - DNA, 25 bp, Mus musculus
tgcaatgcaccatttgtttttgtct

SEQ ID NO: 861533 - DNA, 25 bp, Mus musculus
tgcaatgcatgtattctcacttaaa

SEQ ID NO: 861534 - DNA, 25 bp, Mus musculus
tgcaatgcatgttttctcacttaaa

SEQ ID NO: 861535 - DNA, 25 bp, Mus musculus
tgcaatgctaaacggctcgcttaca

SEQ ID NO: 861536 - DNA, 25 bp, Mus musculus
tgcaatgctaaagggctcgcttaca

SEQ ID NO: 861537 - DNA, 25 bp, Mus musculus
tgcaatgctgagagcaggccaccag

SEQ ID NO: 861538 - DNA, 25 bp, Mus musculus
tgcaatgctgagtgcaggccaccag

SEQ ID NO: 861539 - DNA, 25 bp, Mus musculus
tgcaatgcttttaaaaccgttccaa

SEQ ID NO: 861540 - DNA, 25 bp, Mus musculus
tgcaatgctttttaaaccgttccaa

SEQ ID NO: 861541 - DNA, 25 bp, Mus musculus
tgcaatggacaactccagggtgttg

SEQ ID NO: 861542 - DNA, 25 bp, Mus musculus
tgcaatggacaagtccagggtgttg

SEQ ID NO: 861543 - DNA, 25 bp, Mus musculus
tgcaatggatgccttcgtgtgtgaa

SEQ ID NO: 861544 - DNA, 25 bp, Mus musculus
tgcaatggatgcgttcgtgtgtgaa

SEQ ID NO: 861545 - DNA, 25 bp, Mus musculus
tgcaatggcggcaaggtgattcccc

SEQ ID NO: 861546 - DNA, 25 bp, Mus musculus
tgcaatggcggctaggtgattcccc

SEQ ID NO: 861547 - DNA, 25 bp, Mus musculus
tgcaatgtagaactgctcaaagcct

SEQ ID NO: 861548 - DNA, 25 bp, Mus musculus
tgcaatgtagaagtgctcaaagcct

SEQ ID NO: 861549 - DNA, 25 bp, Mus musculus
tgcaatgtatttagctacagcttgt

SEQ ID NO: 861550 - DNA, 25 bp, Mus musculus
tgcaatgtattttgctacagcttgt

SEQ ID NO: 861551 - DNA, 25 bp, Mus musculus
tgcaatgtctgtcctggtgccccag

SEQ ID NO: 861552 - DNA, 25 bp, Mus musculus
tgcaatgtctgtgctggtgccccag

SEQ ID NO: 861553 - DNA, 25 bp, Mus musculus
tgcaatgtgaatctatccaaaccag

SEQ ID NO: 861554 - DNA, 25 bp, Mus musculus
tgcaatgtgaatgtatccaaaccag

SEQ ID NO: 861555 - DNA, 25 bp, Mus musculus
tgcaatgtgggtatcctgctaaatt

SEQ ID NO: 861556 - DNA, 25 bp, Mus musculus
tgcaatgtgggtttcctgctaaatt

SEQ ID NO: 861557 - DNA, 25 bp, Mus musculus
tgcaatgtgtctatacaagggtctc

SEQ ID NO: 861558 - DNA, 25 bp, Mus musculus
tgcaatgtgtctttacaagggtctc

SEQ ID NO: 861559 - DNA, 25 bp, Mus musculus
tgcaatgtgtgcctgaagtctccga

SEQ ID NO: 861560 - DNA, 25 bp, Mus musculus
tgcaatgtgtgcgtgaagtctccga

SEQ ID NO: 861561 - DNA, 25 bp, Mus musculus
tgcaatgttaacaggctagcagata

SEQ ID NO: 861562 - DNA, 25 bp, Mus musculus
tgcaatgttaactggctagcagata

SEQ ID NO: 861563 - DNA, 25 bp, Mus musculus
tgcaatgttccacagctcgtgatgt

SEQ ID NO: 861564 - DNA, 25 bp, Mus musculus
tgcaatgttccagagctcgtgatgt

SEQ ID NO: 861565 - DNA, 25 bp, Mus musculus
tgcaatgttctcagagctccaggtc

SEQ ID NO: 861566 - DNA, 25 bp, Mus musculus
tgcaatgttctctgagctccaggtc

SEQ ID NO: 861567 - DNA, 25 bp, Mus musculus
tgcaatgttgagaaaaggcttcctt

SEQ ID NO: 861568 - DNA, 25 bp, Mus musculus
tgcaatgttgagaaaatcccgggaa

SEQ ID NO: 861569 - DNA, 25 bp, Mus musculus
tgcaatgttgagtaaaggcttcctt

SEQ ID NO: 861570 - DNA, 25 bp, Mus musculus
tgcaatgttgagtaaatcccgggaa

SEQ ID NO: 861571 - DNA, 25 bp, Mus musculus
tgcaatgtttaaagctggcacagca

SEQ ID NO: 861572 - DNA, 25 bp, Mus musculus
tgcaatgtttaatgctggcacagca

SEQ ID NO: 861573 - DNA, 25 bp, Mus musculus
tgcaattaactgctcagcccatctt

SEQ ID NO: 861574 - DNA, 25 bp, Mus musculus
tgcaattaactggtcagcccatctt

SEQ ID NO: 861575 - DNA, 25 bp, Mus musculus
tgcaattaagtccatgtgtgatgtg

SEQ ID NO: 861576 - DNA, 25 bp, Mus musculus
tgcaattaagtcgatgtgtgatgtg

SEQ ID NO: 861577 - DNA, 25 bp, Mus musculus
tgcaattaatatatgagtggtttcc

SEQ ID NO: 861578 - DNA, 25 bp, Mus musculus
tgcaattaatatttgagtggtttcc

SEQ ID NO: 861579 - DNA, 25 bp, Mus musculus
tgcaattacagactccctcttgtgt

SEQ ID NO: 861580 - DNA, 25 bp, Mus musculus
tgcaattacagagtccctcttgtgt

SEQ ID NO: 861581 - DNA, 25 bp, Mus musculus
tgcaattacagtactcccatgaggg

SEQ ID NO: 861582 - DNA, 25 bp, Mus musculus
tgcaattacagttctcccatgaggg

SEQ ID NO: 861583 - DNA, 25 bp, Mus musculus
tgcaattatcttatcatggtgtcaa

SEQ ID NO: 861584 - DNA, 25 bp, Mus musculus
tgcaattatcttttcatggtgtcaa

SEQ ID NO: 861585 - DNA, 25 bp, Mus musculus
tgcaattccatcctagcgcagaagc

SEQ ID NO: 861586 - DNA, 25 bp, Mus musculus
tgcaattccatcgtagcgcagaagc

SEQ ID NO: 861587 - DNA, 25 bp, Mus musculus
tgcaattcccttagtgcctgttaga

SEQ ID NO: 861588 - DNA, 25 bp, Mus musculus
tgcaattccctttgtgcctgttaga

SEQ ID NO: 861589 - DNA, 25 bp, Mus musculus
tgcaattccgagatataccaggcga

SEQ ID NO: 861590 - DNA, 25 bp, Mus musculus
tgcaattccgagttataccaggcga

SEQ ID NO: 861591 - DNA, 25 bp, Mus musculus
tgcaattcctgtctttcatgtcctt

SEQ ID NO: 861592 - DNA, 25 bp, Mus musculus
tgcaattcctgtgtttcatgtcctt

SEQ ID NO: 861593 - DNA, 25 bp, Mus musculus
tgcaattctgatccgcttttagcat

SEQ ID NO: 861594 - DNA, 25 bp, Mus musculus
tgcaattctgatgcgcttttagcat

SEQ ID NO: 861595 - DNA, 25 bp, Mus musculus
tgcaattctgtgcttcagccaactc

SEQ ID NO: 861596 - DNA, 25 bp, Mus musculus
tgcaattctgtggttcagccaactc

SEQ ID NO: 861597 - DNA, 25 bp, Mus musculus
tgcaattcttccatctaggatcctt

SEQ ID NO: 861598 - DNA, 25 bp, Mus musculus
tgcaattcttccttctaggatcctt

SEQ ID NO: 861599 - DNA, 25 bp, Mus musculus
tgcaattgctcaaccattcatctgg

SEQ ID NO: 861600 - DNA, 25 bp, Mus musculus
tgcaattgctcatccattcatctgg

SEQ ID NO: 861601 - DNA, 25 bp, Mus musculus
tgcaattggtaaacttgctgtttcc

SEQ ID NO: 861602 - DNA, 25 bp, Mus musculus
tgcaattggtaatcttgctgtttcc

SEQ ID NO: 861603 - DNA, 25 bp, Mus musculus
tgcaattgtgttccctttacctttc

SEQ ID NO: 861604 - DNA, 25 bp, Mus musculus
tgcaattgtgttgcctttacctttc

SEQ ID NO: 861605 - DNA, 25 bp, Mus musculus
tgcaattgttacatccgcccatgtt

SEQ ID NO: 861606 - DNA, 25 bp, Mus musculus
tgcaattgttacttccgcccatgtt

SEQ ID NO: 861607 - DNA, 25 bp, Mus musculus
tgcaatttagccaggaaagtaagtt

SEQ ID NO: 861608 - DNA, 25 bp, Mus musculus
tgcaatttagcctggaaagtaagtt

SEQ ID NO: 861609 - DNA, 25 bp, Mus musculus
tgcaatttcaggcagcaatccaaga

SEQ ID NO: 861610 - DNA, 25 bp, Mus musculus
tgcaatttcagggagcaatccaaga

SEQ ID NO: 861611 - DNA, 25 bp, Mus musculus
tgcaatttgatccactttccttaca

SEQ ID NO: 861612 - DNA, 25 bp, Mus musculus
tgcaatttgatcgactttccttaca

SEQ ID NO: 861613 - DNA, 25 bp, Mus musculus
tgcaattttccacctacgtacatat

SEQ ID NO: 861614 - DNA, 25 bp, Mus musculus
tgcaattttccagctacgtacatat

SEQ ID NO: 861615 - DNA, 25 bp, Mus musculus
tgcaattttcctaccacgttatcta

SEQ ID NO: 861616 - DNA, 25 bp, Mus musculus
tgcaattttccttccacgttatcta

SEQ ID NO: 861617 - DNA, 25 bp, Mus musculus
tgcaattttgacaagcttagctggc

SEQ ID NO: 861618 - DNA, 25 bp, Mus musculus
tgcaattttgactagcttagctggc

SEQ ID NO: 861619 - DNA, 25 bp, Mus musculus
tgcacaaaacccatgtaccgctaat

SEQ ID NO: 861620 - DNA, 25 bp, Mus musculus
tgcacaaaacccttgtaccgctaat

SEQ ID NO: 861621 - DNA, 25 bp, Mus musculus
tgcacaaacaaccttcacctgggca

SEQ ID NO: 861622 - DNA, 25 bp, Mus musculus
tgcacaaacaacgttcacctgggca

SEQ ID NO: 861623 - DNA, 25 bp, Mus musculus
tgcacaaagccactgagatctcacc

SEQ ID NO: 861624 - DNA, 25 bp, Mus musculus
tgcacaaagccagtgagatctcacc

SEQ ID NO: 861625 - DNA, 25 bp, Mus musculus
tgcacaaagcctcagtccaaagcct

SEQ ID NO: 861626 - DNA, 25 bp, Mus musculus
tgcacaaagcctcctcttgtaacaa

SEQ ID NO: 861627 - DNA, 25 bp, Mus musculus
tgcacaaagcctgagtccaaagcct

SEQ ID NO: 861628 - DNA, 25 bp, Mus musculus
tgcacaaagcctgctcttgtaacaa

SEQ ID NO: 861629 - DNA, 25 bp, Mus musculus
tgcacaaagcggagacctacctgcg

SEQ ID NO: 861630 - DNA, 25 bp, Mus musculus
tgcacaaagcggtgacctacctgcg

SEQ ID NO: 861631 - DNA, 25 bp, Mus musculus
tgcacaaaggacactctgtgtggct

SEQ ID NO: 861632 - DNA, 25 bp, Mus musculus
tgcacaaaggactctctgtgtggct

SEQ ID NO: 861633 - DNA, 25 bp, Mus musculus
tgcacaaataaaccctcaatcaatg

SEQ ID NO: 861634 - DNA, 25 bp, Mus musculus
tgcacaaataaagcctcaatcaatg

SEQ ID NO: 861635 - DNA, 25 bp, Mus musculus
tgcacaacagagatatcttcaaata

SEQ ID NO: 861636 - DNA, 25 bp, Mus musculus
tgcacaacagagttatcttcaaata

SEQ ID NO: 861637 - DNA, 25 bp, Mus musculus
tgcacaaccaccatactgagaagag

SEQ ID NO: 861638 - DNA, 25 bp, Mus musculus
tgcacaaccaccttactgagaagag

SEQ ID NO: 861639 - DNA, 25 bp, Mus musculus
tgcacaaccagcatttacctaatac

SEQ ID NO: 861640 - DNA, 25 bp, Mus musculus
tgcacaaccagcttttacctaatac

SEQ ID NO: 861641 - DNA, 25 bp, Mus musculus
tgcacaacccaacaagcggctggat

SEQ ID NO: 861642 - DNA, 25 bp, Mus musculus
tgcacaacccaagaagcggctggat

SEQ ID NO: 861643 - DNA, 25 bp, Mus musculus
tgcacaactaccagagtcctttagc

SEQ ID NO: 861644 - DNA, 25 bp, Mus musculus
tgcacaactacctgagtcctttagc

SEQ ID NO: 861645 - DNA, 25 bp, Mus musculus
tgcacaactgttctctgaacctaga

SEQ ID NO: 861646 - DNA, 25 bp, Mus musculus
tgcacaactgttgtctgaacctaga

SEQ ID NO: 861647 - DNA, 25 bp, Mus musculus
tgcacaagaaccacttggtgtcgtt

SEQ ID NO: 861648 - DNA, 25 bp, Mus musculus
tgcacaagaacctcttggtgtcgtt

SEQ ID NO: 861649 - DNA, 25 bp, Mus musculus
tgcacaagattgacctctaggctag

SEQ ID NO: 861650 - DNA, 25 bp, Mus musculus
tgcacaagattgtcctctaggctag

SEQ ID NO: 861651 - DNA, 25 bp, Mus musculus
tgcacaagcctgagttcccagatgg

SEQ ID NO: 861652 - DNA, 25 bp, Mus musculus
tgcacaagcctgtgttcccagatgg

SEQ ID NO: 861653 - DNA, 25 bp, Mus musculus
tgcacaagctcccacatgggtggat

SEQ ID NO: 861654 - DNA, 25 bp, Mus musculus
tgcacaagctccgacatgggtggat

SEQ ID NO: 861655 - DNA, 25 bp, Mus musculus
tgcacaaggagtaccacgataaagc

SEQ ID NO: 861656 - DNA, 25 bp, Mus musculus
tgcacaaggagttccacgataaagc

SEQ ID NO: 861657 - DNA, 25 bp, Mus musculus
tgcacaaggccgagagcgccatcgt

SEQ ID NO: 861658 - DNA, 25 bp, Mus musculus
tgcacaaggccgtgagcgccatcgt

SEQ ID NO: 861659 - DNA, 25 bp, Mus musculus
tgcacaagttctatgctccttagac

SEQ ID NO: 861660 - DNA, 25 bp, Mus musculus
tgcacaagttctttgctccttagac

SEQ ID NO: 861661 - DNA, 25 bp, Mus musculus
tgcacaagttgtcacccaagcgatg

SEQ ID NO: 861662 - DNA, 25 bp, Mus musculus
tgcacaagttgtgacccaagcgatg

SEQ ID NO: 861663 - DNA, 25 bp, Mus musculus
tgcacaataaacatgtggacccact

SEQ ID NO: 861664 - DNA, 25 bp, Mus musculus
tgcacaataaacttgtggacccact

SEQ ID NO: 861665 - DNA, 25 bp, Mus musculus
tgcacaatagcacctcatcatcata

SEQ ID NO: 861666 - DNA, 25 bp, Mus musculus
tgcacaatagcagctcatcatcata

SEQ ID NO: 861667 - DNA, 25 bp, Mus musculus
tgcacaatgactaccaggccctgaa

SEQ ID NO: 861668 - DNA, 25 bp, Mus musculus
tgcacaatgacttccaggccctgaa

SEQ ID NO: 861669 - DNA, 25 bp, Mus musculus
tgcacaatgcatacagcgtactgct

SEQ ID NO: 861670 - DNA, 25 bp, Mus musculus
tgcacaatgcattcagcgtactgct

SEQ ID NO: 861671 - DNA, 25 bp, Mus musculus
tgcacaatgcctcatggaagccttt

SEQ ID NO: 861672 - DNA, 25 bp, Mus musculus
tgcacaatgcctgatggaagccttt

SEQ ID NO: 861673 - DNA, 25 bp, Mus musculus
tgcacaatgggcaggccaagcacct

SEQ ID NO: 861674 - DNA, 25 bp, Mus musculus
tgcacaatgggctggccaagcacct

SEQ ID NO: 861675 - DNA, 25 bp, Mus musculus
tgcacacaaagtatctccctggaga

SEQ ID NO: 861676 - DNA, 25 bp, Mus musculus
tgcacacaaagtttctccctggaga

SEQ ID NO: 861677 - DNA, 25 bp, Mus musculus
tgcacacaacatataatttcatagc

SEQ ID NO: 861678 - DNA, 25 bp, Mus musculus
tgcacacaacatttaatttcatagc

SEQ ID NO: 861679 - DNA, 25 bp, Mus musculus
tgcacacaagcgactgttcagttgg

SEQ ID NO: 861680 - DNA, 25 bp, Mus musculus
tgcacacaagcgtctgttcagttgg

SEQ ID NO: 861681 - DNA, 25 bp, Mus musculus
tgcacacacactcagcacatggcag

SEQ ID NO: 861682 - DNA, 25 bp, Mus musculus
tgcacacacactgagcacatggcag

SEQ ID NO: 861683 - DNA, 25 bp, Mus musculus
tgcacacacaggaggcagtgcacct

SEQ ID NO: 861684 - DNA, 25 bp, Mus musculus
tgcacacacaggtggcagtgcacct

SEQ ID NO: 861685 - DNA, 25 bp, Mus musculus
tgcacacacataatctagctccata

SEQ ID NO: 861686 - DNA, 25 bp, Mus musculus
tgcacacacatattctagctccata

SEQ ID NO: 861687 - DNA, 25 bp, Mus musculus
tgcacacaccagacgggaagggtat

SEQ ID NO: 861688 - DNA, 25 bp, Mus musculus
tgcacacaccagtcgggaagggtat

SEQ ID NO: 861689 - DNA, 25 bp, Mus musculus
tgcacacaccttcccgctggaaaag

SEQ ID NO: 861690 - DNA, 25 bp, Mus musculus
tgcacacaccttgccgctggaaaag

SEQ ID NO: 861691 - DNA, 25 bp, Mus musculus
tgcacacagaataaaattagacgct

SEQ ID NO: 861692 - DNA, 25 bp, Mus musculus
tgcacacagaattaaattagacgct

SEQ ID NO: 861693 - DNA, 25 bp, Mus musculus
tgcacacagatgcacttcctgtgaa

SEQ ID NO: 861694 - DNA, 25 bp, Mus musculus
tgcacacagatggacttcctgtgaa

SEQ ID NO: 861695 - DNA, 25 bp, Mus musculus
tgcacacagcctaacccagatggat

SEQ ID NO: 861696 - DNA, 25 bp, Mus musculus
tgcacacagccttacccagatggat

SEQ ID NO: 861697 - DNA, 25 bp, Mus musculus
tgcacacaggagagggcagcaacat

SEQ ID NO: 861698 - DNA, 25 bp, Mus musculus
tgcacacaggagtgggcagcaacat

SEQ ID NO: 861699 - DNA, 25 bp, Mus musculus
tgcacacaggccatcccatctgagt

SEQ ID NO: 861700 - DNA, 25 bp, Mus musculus
tgcacacaggccttcccatctgagt

SEQ ID NO: 861701 - DNA, 25 bp, Mus musculus
tgcacacaggtcattattttacaag

SEQ ID NO: 861702 - DNA, 25 bp, Mus musculus
tgcacacaggtctttattttacaag

SEQ ID NO: 861703 - DNA, 25 bp, Mus musculus
tgcacacaggtgaaagcctcagaaa

SEQ ID NO: 861704 - DNA, 25 bp, Mus musculus
tgcacacaggtgtaagcctcagaaa

SEQ ID NO: 861705 - DNA, 25 bp, Mus musculus
tgcacacatcctacagtacagtttt

SEQ ID NO: 861706 - DNA, 25 bp, Mus musculus
tgcacacatccttcagtacagtttt

SEQ ID NO: 861707 - DNA, 25 bp, Mus musculus
tgcacacatctgatgactgtccaaa

SEQ ID NO: 861708 - DNA, 25 bp, Mus musculus
tgcacacatctgttgactgtccaaa

SEQ ID NO: 861709 - DNA, 25 bp, Mus musculus
tgcacacatgcaagggagctctcca

SEQ ID NO: 861710 - DNA, 25 bp, Mus musculus
tgcacacatgcatgggagctctcca

SEQ ID NO: 861711 - DNA, 25 bp, Mus musculus
tgcacaccaaccaacactgtagtag

SEQ ID NO: 861712 - DNA, 25 bp, Mus musculus
tgcacaccaacctacactgtagtag

SEQ ID NO: 861713 - DNA, 25 bp, Mus musculus
tgcacaccagagcacacatggaggt

SEQ ID NO: 861714 - DNA, 25 bp, Mus musculus
tgcacaccagaggacacatggaggt

SEQ ID NO: 861715 - DNA, 25 bp, Mus musculus
tgcacaccagctcagtggccaagga

SEQ ID NO: 861716 - DNA, 25 bp, Mus musculus
tgcacaccagctgagtggccaagga

SEQ ID NO: 861717 - DNA, 25 bp, Mus musculus
tgcacaccatctatagaagggccag

SEQ ID NO: 861718 - DNA, 25 bp, Mus musculus
tgcacaccatctttagaagggccag

SEQ ID NO: 861719 - DNA, 25 bp, Mus musculus
tgcacaccctggctgagtttggatg

SEQ ID NO: 861720 - DNA, 25 bp, Mus musculus
tgcacaccctgggtgagtttggatg

SEQ ID NO: 861721 - DNA, 25 bp, Mus musculus
tgcacacccttgacatttctttaag

SEQ ID NO: 861722 - DNA, 25 bp, Mus musculus
tgcacacccttgtcatttctttaag

SEQ ID NO: 861723 - DNA, 25 bp, Mus musculus
tgcacaccgctcctactaatcaaag

SEQ ID NO: 861724 - DNA, 25 bp, Mus musculus
tgcacaccgctcgtactaatcaaag

SEQ ID NO: 861725 - DNA, 25 bp, Mus musculus
tgcacaccggtcatcagaaaccatt

SEQ ID NO: 861726 - DNA, 25 bp, Mus musculus
tgcacaccggtcttcagaaaccatt

SEQ ID NO: 861727 - DNA, 25 bp, Mus musculus
tgcacaccggtgacttgagaactga

SEQ ID NO: 861728 - DNA, 25 bp, Mus musculus
tgcacaccggtgagacttatgttta

SEQ ID NO: 861729 - DNA, 25 bp, Mus musculus
tgcacaccggtgtcttgagaactga

SEQ ID NO: 861730 - DNA, 25 bp, Mus musculus
tgcacaccggtgtgacttatgttta

SEQ ID NO: 861731 - DNA, 25 bp, Mus musculus
tgcacaccggttcctaggctaaaca

SEQ ID NO: 861732 - DNA, 25 bp, Mus musculus
tgcacaccggttgctaggctaaaca

SEQ ID NO: 861733 - DNA, 25 bp, Mus musculus
tgcacacctaagcaaaaggatgttt

SEQ ID NO: 861734 - DNA, 25 bp, Mus musculus
tgcacacctaaggaaaaggatgttt

SEQ ID NO: 861735 - DNA, 25 bp, Mus musculus
tgcacacctaatatcacaacttcac

SEQ ID NO: 861736 - DNA, 25 bp, Mus musculus
tgcacacctaatttcacaacttcac

SEQ ID NO: 861737 - DNA, 25 bp, Mus musculus
tgcacacctgaccaagattccaaat

SEQ ID NO: 861738 - DNA, 25 bp, Mus musculus
tgcacacctgacgaagattccaaat

SEQ ID NO: 861739 - DNA, 25 bp, Mus musculus
tgcacacctgccagatatagcgttg

SEQ ID NO: 861740 - DNA, 25 bp, Mus musculus
tgcacacctgcctgatatagcgttg

SEQ ID NO: 861741 - DNA, 25 bp, Mus musculus
tgcacacctggactctgtgtccgca

SEQ ID NO: 861742 - DNA, 25 bp, Mus musculus
tgcacacctggagtctgtgtccgca

SEQ ID NO: 861743 - DNA, 25 bp, Mus musculus
tgcacacctgggagctaggagctgt

SEQ ID NO: 861744 - DNA, 25 bp, Mus musculus
tgcacacctgggtgctaggagctgt

SEQ ID NO: 861745 - DNA, 25 bp, Mus musculus
tgcacacctgtgatcagatgtatgt

SEQ ID NO: 861746 - DNA, 25 bp, Mus musculus
tgcacacctgtgctaagacatacag

SEQ ID NO: 861747 - DNA, 25 bp, Mus musculus
tgcacacctgtggtaagacatacag

SEQ ID NO: 861748 - DNA, 25 bp, Mus musculus
tgcacacctgtgttcagatgtatgt

SEQ ID NO: 861749 - DNA, 25 bp, Mus musculus
tgcacaccttaaccctcaacaagaa

SEQ ID NO: 861750 - DNA, 25 bp, Mus musculus
tgcacaccttaactctagcactgag

SEQ ID NO: 861751 - DNA, 25 bp, Mus musculus
tgcacaccttaagcctcaacaagaa

SEQ ID NO: 861752 - DNA, 25 bp, Mus musculus
tgcacaccttaagtctagcactgag

SEQ ID NO: 861753 - DNA, 25 bp, Mus musculus
tgcacacgcccaaatgaagcggttt

SEQ ID NO: 861754 - DNA, 25 bp, Mus musculus
tgcacacgcccatatgaagcggttt

SEQ ID NO: 861755 - DNA, 25 bp, Mus musculus
tgcacacgcgcacggaaaacaccta

SEQ ID NO: 861756 - DNA, 25 bp, Mus musculus
tgcacacgcgcagggaaaacaccta

SEQ ID NO: 861757 - DNA, 25 bp, Mus musculus
tgcacacgcgtgagagtttgcacaa

SEQ ID NO: 861758 - DNA, 25 bp, Mus musculus
tgcacacgcgtgcacatgctcgtgt

SEQ ID NO: 861759 - DNA, 25 bp, Mus musculus
tgcacacgcgtggacatgctcgtgt

SEQ ID NO: 861760 - DNA, 25 bp, Mus musculus
tgcacacgcgtgtgagtttgcacaa

SEQ ID NO: 861761 - DNA, 25 bp, Mus musculus
tgcacacgctgcaggagatcaccga

SEQ ID NO: 861762 - DNA, 25 bp, Mus musculus
tgcacacgctgctggagatcaccga

SEQ ID NO: 861763 - DNA, 25 bp, Mus musculus
tgcacacgggtgagcttccgaagca

SEQ ID NO: 861764 - DNA, 25 bp, Mus musculus
tgcacacgggtgtgcttccgaagca

SEQ ID NO: 861765 - DNA, 25 bp, Mus musculus
tgcacacgtgctaacatatatcaaa

SEQ ID NO: 861766 - DNA, 25 bp, Mus musculus
tgcacacgtgctcaggagtgagcct

SEQ ID NO: 861767 - DNA, 25 bp, Mus musculus
tgcacacgtgctgaggagtgagcct

SEQ ID NO: 861768 - DNA, 25 bp, Mus musculus
tgcacacgtgcttacatatatcaaa

SEQ ID NO: 861769 - DNA, 25 bp, Mus musculus
tgcacacgtggcctgtacatggtca

SEQ ID NO: 861770 - DNA, 25 bp, Mus musculus
tgcacacgtggcgtgtacatggtca

SEQ ID NO: 861771 - DNA, 25 bp, Mus musculus
tgcacactaacactcctgtgatcct

SEQ ID NO: 861772 - DNA, 25 bp, Mus musculus
tgcacactaacagtcctgtgatcct

SEQ ID NO: 861773 - DNA, 25 bp, Mus musculus
tgcacactaacccacggtacagttg

SEQ ID NO: 861774 - DNA, 25 bp, Mus musculus
tgcacactaaccgacggtacagttg

SEQ ID NO: 861775 - DNA, 25 bp, Mus musculus
tgcacactaggcagcctgcatattt

SEQ ID NO: 861776 - DNA, 25 bp, Mus musculus
tgcacactaggctgcctgcatattt

SEQ ID NO: 861777 - DNA, 25 bp, Mus musculus
tgcacactatttcacggatccaaga

SEQ ID NO: 861778 - DNA, 25 bp, Mus musculus
tgcacactatttgacggatccaaga

SEQ ID NO: 861779 - DNA, 25 bp, Mus musculus
tgcacactctgaactcactgtatga

SEQ ID NO: 861780 - DNA, 25 bp, Mus musculus
tgcacactctgatctcactgtatga

SEQ ID NO: 861781 - DNA, 25 bp, Mus musculus
tgcacactgacaccctacaagctga

SEQ ID NO: 861782 - DNA, 25 bp, Mus musculus
tgcacactgacagcctacaagctga

SEQ ID NO: 861783 - DNA, 25 bp, Mus musculus
tgcacactgagacccttgccttaaa

SEQ ID NO: 861784 - DNA, 25 bp, Mus musculus
tgcacactgagagccttgccttaaa

SEQ ID NO: 861785 - DNA, 25 bp, Mus musculus
tgcacactgcgtaccatgaaggttc

SEQ ID NO: 861786 - DNA, 25 bp, Mus musculus
tgcacactgcgttccatgaaggttc

SEQ ID NO: 861787 - DNA, 25 bp, Mus musculus
tgcacactggcgcaagttcaagaat

SEQ ID NO: 861788 - DNA, 25 bp, Mus musculus
tgcacactggcggaagttcaagaat

SEQ ID NO: 861789 - DNA, 25 bp, Mus musculus
tgcacactgggactaccacttggac

SEQ ID NO: 861790 - DNA, 25 bp, Mus musculus
tgcacactgggagtaccacttggac

SEQ ID NO: 861791 - DNA, 25 bp, Mus musculus
tgcacactgggtcagcagaaagcag

SEQ ID NO: 861792 - DNA, 25 bp, Mus musculus
tgcacactgggtgagcagaaagcag

SEQ ID NO: 861793 - DNA, 25 bp, Mus musculus
tgcacactgtcccttgaccttcagt

SEQ ID NO: 861794 - DNA, 25 bp, Mus musculus
tgcacactgtccgttgaccttcagt

SEQ ID NO: 861795 - DNA, 25 bp, Mus musculus
tgcacactgtggacttggtaggaac

SEQ ID NO: 861796 - DNA, 25 bp, Mus musculus
tgcacactgtggtcttggtaggaac

SEQ ID NO: 861797 - DNA, 25 bp, Mus musculus
tgcacactgtgtatggcacgctgac

SEQ ID NO: 861798 - DNA, 25 bp, Mus musculus
tgcacactgtgtttggcacgctgac

SEQ ID NO: 861799 - DNA, 25 bp, Mus musculus
tgcacacttaacacgcagttcccgt

SEQ ID NO: 861800 - DNA, 25 bp, Mus musculus
tgcacacttaactcgcagttcccgt

SEQ ID NO: 861801 - DNA, 25 bp, Mus musculus
tgcacacttatacgtcactgctgtt

SEQ ID NO: 861802 - DNA, 25 bp, Mus musculus
tgcacacttataggtcactgctgtt

SEQ ID NO: 861803 - DNA, 25 bp, Mus musculus
tgcacacttgatccctgacatgaat

SEQ ID NO: 861804 - DNA, 25 bp, Mus musculus
tgcacacttgatgcctgacatgaat

SEQ ID NO: 861805 - DNA, 25 bp, Mus musculus
tgcacactttacacagaagcacagc

SEQ ID NO: 861806 - DNA, 25 bp, Mus musculus
tgcacactttactcagaagcacagc

SEQ ID NO: 861807 - DNA, 25 bp, Mus musculus
tgcacagaaaacatacttgagctgt

SEQ ID NO: 861808 - DNA, 25 bp, Mus musculus
tgcacagaaaacttacttgagctgt

SEQ ID NO: 861809 - DNA, 25 bp, Mus musculus
tgcacagaagcaacttcgtcatcgt

SEQ ID NO: 861810 - DNA, 25 bp, Mus musculus
tgcacagaagcatcttcgtcatcgt

SEQ ID NO: 861811 - DNA, 25 bp, Mus musculus
tgcacagaagttctgccctgttctg

SEQ ID NO: 861812 - DNA, 25 bp, Mus musculus
tgcacagaagttgtgccctgttctg

SEQ ID NO: 861813 - DNA, 25 bp, Mus musculus
tgcacagacacacgcatcctctgaa

SEQ ID NO: 861814 - DNA, 25 bp, Mus musculus
tgcacagacacaggcatcctctgaa

SEQ ID NO: 861815 - DNA, 25 bp, Mus musculus
tgcacagacagacaggccgagccag

SEQ ID NO: 861816 - DNA, 25 bp, Mus musculus
tgcacagacagagaggccgagccag

SEQ ID NO: 861817 - DNA, 25 bp, Mus musculus
tgcacagacaggctttcacataaat

SEQ ID NO: 861818 - DNA, 25 bp, Mus musculus
tgcacagacagggtttcacataaat

SEQ ID NO: 861819 - DNA, 25 bp, Mus musculus
tgcacagacattcagagtgcctaat

SEQ ID NO: 861820 - DNA, 25 bp, Mus musculus
tgcacagacattgagagtgcctaat

SEQ ID NO: 861821 - DNA, 25 bp, Mus musculus
tgcacagaccctagacagagacctc

SEQ ID NO: 861822 - DNA, 25 bp, Mus musculus
tgcacagacccttgacagagacctc

SEQ ID NO: 861823 - DNA, 25 bp, Mus musculus
tgcacagacttgattgcatccttca

SEQ ID NO: 861824 - DNA, 25 bp, Mus musculus
tgcacagacttgtttgcatccttca

SEQ ID NO: 861825 - DNA, 25 bp, Mus musculus
tgcacagagtcacgctgggtctctt

SEQ ID NO: 861826 - DNA, 25 bp, Mus musculus
tgcacagagtcaggctgggtctctt

SEQ ID NO: 861827 - DNA, 25 bp, Mus musculus
tgcacagatactcgcagccctgcag

SEQ ID NO: 861828 - DNA, 25 bp, Mus musculus
tgcacagatactggcagccctgcag

SEQ ID NO: 861829 - DNA, 25 bp, Mus musculus
tgcacagatgatctcgcagacgtga

SEQ ID NO: 861830 - DNA, 25 bp, Mus musculus
tgcacagatgatgtcgcagacgtga

SEQ ID NO: 861831 - DNA, 25 bp, Mus musculus
tgcacagatgtgcataaagctcaag

SEQ ID NO: 861832 - DNA, 25 bp, Mus musculus
tgcacagatgtggataaagctcaag

SEQ ID NO: 861833 - DNA, 25 bp, Mus musculus
tgcacagcacagatgggccatgagt

SEQ ID NO: 861834 - DNA, 25 bp, Mus musculus
tgcacagcacagttgggccatgagt

SEQ ID NO: 861835 - DNA, 25 bp, Mus musculus
tgcacagcaccgcacagtaccagga

SEQ ID NO: 861836 - DNA, 25 bp, Mus musculus
tgcacagcaccggacagtaccagga

SEQ ID NO: 861837 - DNA, 25 bp, Mus musculus
tgcacagcagctaattaagtcaagg

SEQ ID NO: 861838 - DNA, 25 bp, Mus musculus
tgcacagcagcttattaagtcaagg

SEQ ID NO: 861839 - DNA, 25 bp, Mus musculus
tgcacagcaggcagcggctacaaca

SEQ ID NO: 861840 - DNA, 25 bp, Mus musculus
tgcacagcaggctgcggctacaaca

SEQ ID NO: 861841 - DNA, 25 bp, Mus musculus
tgcacagcagtgattcaaggacaac

SEQ ID NO: 861842 - DNA, 25 bp, Mus musculus
tgcacagcagtgtttcaaggacaac

SEQ ID NO: 861843 - DNA, 25 bp, Mus musculus
tgcacagcattgcaccccagagtga

SEQ ID NO: 861844 - DNA, 25 bp, Mus musculus
tgcacagcattggaccccagagtga

SEQ ID NO: 861845 - DNA, 25 bp, Mus musculus
tgcacagccaggatcaggtttaagg

SEQ ID NO: 861846 - DNA, 25 bp, Mus musculus
tgcacagccaggttcaggtttaagg

SEQ ID NO: 861847 - DNA, 25 bp, Mus musculus
tgcacagccatcagactacaagaag

SEQ ID NO: 861848 - DNA, 25 bp, Mus musculus
tgcacagccatctgactacaagaag

SEQ ID NO: 861849 - DNA, 25 bp, Mus musculus
tgcacagcccacactttggtgtatg

SEQ ID NO: 861850 - DNA, 25 bp, Mus musculus
tgcacagcccactctttggtgtatg

SEQ ID NO: 861851 - DNA, 25 bp, Mus musculus
tgcacagcccatcgtttctgaagat

SEQ ID NO: 861852 - DNA, 25 bp, Mus musculus
tgcacagcccatggtttctgaagat

SEQ ID NO: 861853 - DNA, 25 bp, Mus musculus
tgcacagcctcactttggagcacta

SEQ ID NO: 861854 - DNA, 25 bp, Mus musculus
tgcacagcctcagtttggagcacta

SEQ ID NO: 861855 - DNA, 25 bp, Mus musculus
tgcacagcctgtattggtgcctgcc

SEQ ID NO: 861856 - DNA, 25 bp, Mus musculus
tgcacagcctgttttggtgcctgcc

SEQ ID NO: 861857 - DNA, 25 bp, Mus musculus
tgcacagccttgatgcatttttgta

SEQ ID NO: 861858 - DNA, 25 bp, Mus musculus
tgcacagccttgttgcatttttgta

SEQ ID NO: 861859 - DNA, 25 bp, Mus musculus
tgcacagcgcgtatggaccaacaac

SEQ ID NO: 861860 - DNA, 25 bp, Mus musculus
tgcacagcgcgtttggaccaacaac

SEQ ID NO: 861861 - DNA, 25 bp, Mus musculus
tgcacagcgctgaggatctcttcaa

SEQ ID NO: 861862 - DNA, 25 bp, Mus musculus
tgcacagcgctgtggatctcttcaa

SEQ ID NO: 861863 - DNA, 25 bp, Mus musculus
tgcacagctagacctcgctggatga

SEQ ID NO: 861864 - DNA, 25 bp, Mus musculus
tgcacagctagagctcgctggatga

SEQ ID NO: 861865 - DNA, 25 bp, Mus musculus
tgcacagctcctctctgaggtacat

SEQ ID NO: 861866 - DNA, 25 bp, Mus musculus
tgcacagctcctgtctgaggtacat

SEQ ID NO: 861867 - DNA, 25 bp, Mus musculus
tgcacagctctaaatgatcgaccca

SEQ ID NO: 861868 - DNA, 25 bp, Mus musculus
tgcacagctctatatgatcgaccca

SEQ ID NO: 861869 - DNA, 25 bp, Mus musculus
tgcacagcttacactcctgttaagt

SEQ ID NO: 861870 - DNA, 25 bp, Mus musculus
tgcacagcttactctcctgttaagt

SEQ ID NO: 861871 - DNA, 25 bp, Mus musculus
tgcacagcttttatatgagtagtac

SEQ ID NO: 861872 - DNA, 25 bp, Mus musculus
tgcacagcttttttatgagtagtac

SEQ ID NO: 861873 - DNA, 25 bp, Mus musculus
tgcacaggaaatagacagggctttt

SEQ ID NO: 861874 - DNA, 25 bp, Mus musculus
tgcacaggaaattgacagggctttt

SEQ ID NO: 861875 - DNA, 25 bp, Mus musculus
tgcacaggactgctagtgactgact

SEQ ID NO: 861876 - DNA, 25 bp, Mus musculus
tgcacaggactggtagtgactgact

SEQ ID NO: 861877 - DNA, 25 bp, Mus musculus
tgcacaggatttcagttcttatctc

SEQ ID NO: 861878 - DNA, 25 bp, Mus musculus
tgcacaggatttgagttcttatctc

SEQ ID NO: 861879 - DNA, 25 bp, Mus musculus
tgcacaggccggagccccaggaaga

SEQ ID NO: 861880 - DNA, 25 bp, Mus musculus
tgcacaggccggtgccccaggaaga

SEQ ID NO: 861881 - DNA, 25 bp, Mus musculus
tgcacaggcttgatctgctctgaat

SEQ ID NO: 861882 - DNA, 25 bp, Mus musculus
tgcacaggcttgttctgctctgaat

SEQ ID NO: 861883 - DNA, 25 bp, Mus musculus
tgcacagggtgcatagacaaaacaa

SEQ ID NO: 861884 - DNA, 25 bp, Mus musculus
tgcacagggtgcttagacaaaacaa

SEQ ID NO: 861885 - DNA, 25 bp, Mus musculus
tgcacagggttgacatagaaagcct

SEQ ID NO: 861886 - DNA, 25 bp, Mus musculus
tgcacagggttgtcatagaaagcct

SEQ ID NO: 861887 - DNA, 25 bp, Mus musculus
tgcacaggttctacaggctttgtta

SEQ ID NO: 861888 - DNA, 25 bp, Mus musculus
tgcacaggttcttcaggctttgtta

SEQ ID NO: 861889 - DNA, 25 bp, Mus musculus
tgcacaggtttaactttgtcttgat

SEQ ID NO: 861890 - DNA, 25 bp, Mus musculus
tgcacaggtttatctttgtcttgat

SEQ ID NO: 861891 - DNA, 25 bp, Mus musculus
tgcacaggtttcagaccctactttt

SEQ ID NO: 861892 - DNA, 25 bp, Mus musculus
tgcacaggtttctgaccctactttt

SEQ ID NO: 861893 - DNA, 25 bp, Mus musculus
tgcacagtaactcatgtaacttggg

SEQ ID NO: 861894 - DNA, 25 bp, Mus musculus
tgcacagtaactgatgtaacttggg

SEQ ID NO: 861895 - DNA, 25 bp, Mus musculus
tgcacagtaagtattcctttcccat

SEQ ID NO: 861896 - DNA, 25 bp, Mus musculus
tgcacagtaagttttcctttcccat

SEQ ID NO: 861897 - DNA, 25 bp, Mus musculus
tgcacagtacatactcatctagaga

SEQ ID NO: 861898 - DNA, 25 bp, Mus musculus
tgcacagtacattctcatctagaga

SEQ ID NO: 861899 - DNA, 25 bp, Mus musculus
tgcacagtaggaacagcacctgctt

SEQ ID NO: 861900 - DNA, 25 bp, Mus musculus
tgcacagtaggatcagcacctgctt

SEQ ID NO: 861901 - DNA, 25 bp, Mus musculus
tgcacagtcaaaacgttgtccacct

SEQ ID NO: 861902 - DNA, 25 bp, Mus musculus
tgcacagtcaaatcgttgtccacct

SEQ ID NO: 861903 - DNA, 25 bp, Mus musculus
tgcacagtcacacctgaagaccaga

SEQ ID NO: 861904 - DNA, 25 bp, Mus musculus
tgcacagtcacagctgaagaccaga

SEQ ID NO: 861905 - DNA, 25 bp, Mus musculus
tgcacagtcatcaactatccttaag

SEQ ID NO: 861906 - DNA, 25 bp, Mus musculus
tgcacagtcatctactatccttaag

SEQ ID NO: 861907 - DNA, 25 bp, Mus musculus
tgcacagtccctcgctaacttgata

SEQ ID NO: 861908 - DNA, 25 bp, Mus musculus
tgcacagtccctggctaacttgata

SEQ ID NO: 861909 - DNA, 25 bp, Mus musculus
tgcacagtcggcattgttacagcag

SEQ ID NO: 861910 - DNA, 25 bp, Mus musculus
tgcacagtcggctttgttacagcag

SEQ ID NO: 861911 - DNA, 25 bp, Mus musculus
tgcacagtctgaatcacaaggagtt

SEQ ID NO: 861912 - DNA, 25 bp, Mus musculus
tgcacagtctgattcacaaggagtt

SEQ ID NO: 861913 - DNA, 25 bp, Mus musculus
tgcacagtgcaaattcctttttaat

SEQ ID NO: 861914 - DNA, 25 bp, Mus musculus
tgcacagtgcaatttcctttttaat

SEQ ID NO: 861915 - DNA, 25 bp, Mus musculus
tgcacagtgcagacgtagagggatt

SEQ ID NO: 861916 - DNA, 25 bp, Mus musculus
tgcacagtgcagtcgtagagggatt

SEQ ID NO: 861917 - DNA, 25 bp, Mus musculus
tgcacagtgcctaagacgagttctt

SEQ ID NO: 861918 - DNA, 25 bp, Mus musculus
tgcacagtgccttagacgagttctt

SEQ ID NO: 861919 - DNA, 25 bp, Mus musculus
tgcacagtgctcacccagtgcttcg

SEQ ID NO: 861920 - DNA, 25 bp, Mus musculus
tgcacagtgctctcccagtgcttcg

SEQ ID NO: 861921 - DNA, 25 bp, Mus musculus
tgcacagtgcttccccaaccatgtt

SEQ ID NO: 861922 - DNA, 25 bp, Mus musculus
tgcacagtgcttgcccaaccatgtt

SEQ ID NO: 861923 - DNA, 25 bp, Mus musculus
tgcacagtggcaaggctatctatgt

SEQ ID NO: 861924 - DNA, 25 bp, Mus musculus
tgcacagtggcatggctatctatgt

SEQ ID NO: 861925 - DNA, 25 bp, Mus musculus
tgcacagtgtgccaaaatgtttttt

SEQ ID NO: 861926 - DNA, 25 bp, Mus musculus
tgcacagtgtgcgaaaatgtttttt

SEQ ID NO: 861927 - DNA, 25 bp, Mus musculus
tgcacagttatgagccctcccatga

SEQ ID NO: 861928 - DNA, 25 bp, Mus musculus
tgcacagttatgtgccctcccatga

SEQ ID NO: 861929 - DNA, 25 bp, Mus musculus
tgcacagttcaacccacatacagat

SEQ ID NO: 861930 - DNA, 25 bp, Mus musculus
tgcacagttcaagccacatacagat

SEQ ID NO: 861931 - DNA, 25 bp, Mus musculus
tgcacagttctcattctcctttgac

SEQ ID NO: 861932 - DNA, 25 bp, Mus musculus
tgcacagttctccatagcagctttg

SEQ ID NO: 861933 - DNA, 25 bp, Mus musculus
tgcacagttctcgatagcagctttg

SEQ ID NO: 861934 - DNA, 25 bp, Mus musculus
tgcacagttctctttctcctttgac

SEQ ID NO: 861935 - DNA, 25 bp, Mus musculus
tgcacagttctgatggattcactag

SEQ ID NO: 861936 - DNA, 25 bp, Mus musculus
tgcacagttctgttggattcactag

SEQ ID NO: 861937 - DNA, 25 bp, Mus musculus
tgcacagtttgcattgagactcctt

SEQ ID NO: 861938 - DNA, 25 bp, Mus musculus
tgcacagtttgctttgagactcctt

SEQ ID NO: 861939 - DNA, 25 bp, Mus musculus
tgcacatacccaagacacatacaca

SEQ ID NO: 861940 - DNA, 25 bp, Mus musculus
tgcacatacccatgacacatacaca

SEQ ID NO: 861941 - DNA, 25 bp, Mus musculus
tgcacataccccactagtatggttt

SEQ ID NO: 861942 - DNA, 25 bp, Mus musculus
tgcacatacccctctagtatggttt

SEQ ID NO: 861943 - DNA, 25 bp, Mus musculus
tgcacatactccaatccacttggaa

SEQ ID NO: 861944 - DNA, 25 bp, Mus musculus
tgcacatactcctatccacttggaa

SEQ ID NO: 861945 - DNA, 25 bp, Mus musculus
tgcacatagggcacaagtattttgt

SEQ ID NO: 861946 - DNA, 25 bp, Mus musculus
tgcacatagggctcaagtattttgt

SEQ ID NO: 861947 - DNA, 25 bp, Mus musculus
tgcacatatattcatttccaggaaa

SEQ ID NO: 861948 - DNA, 25 bp, Mus musculus
tgcacatatattgatttccaggaaa

SEQ ID NO: 861949 - DNA, 25 bp, Mus musculus
tgcacatatggaaagtcactttagt

SEQ ID NO: 861950 - DNA, 25 bp, Mus musculus
tgcacatatggatagtcactttagt

SEQ ID NO: 861951 - DNA, 25 bp, Mus musculus
tgcacatcaccacttgccatgttca

SEQ ID NO: 861952 - DNA, 25 bp, Mus musculus
tgcacatcaccagttgccatgttca

SEQ ID NO: 861953 - DNA, 25 bp, Mus musculus
tgcacatcagccaatactacttcat

SEQ ID NO: 861954 - DNA, 25 bp, Mus musculus
tgcacatcagcctatactacttcat

SEQ ID NO: 861955 - DNA, 25 bp, Mus musculus
tgcacatcatcccagaaatgaactc

SEQ ID NO: 861956 - DNA, 25 bp, Mus musculus
tgcacatcatccgagaaatgaactc

SEQ ID NO: 861957 - DNA, 25 bp, Mus musculus
tgcacatcccacagtcagggtagcc

SEQ ID NO: 861958 - DNA, 25 bp, Mus musculus
tgcacatcccactgtcagggtagcc

SEQ ID NO: 861959 - DNA, 25 bp, Mus musculus
tgcacatccctgactgtgcagtatg

SEQ ID NO: 861960 - DNA, 25 bp, Mus musculus
tgcacatccctgtctgtgcagtatg

SEQ ID NO: 861961 - DNA, 25 bp, Mus musculus
tgcacatcccttccatttcgggcaa

SEQ ID NO: 861962 - DNA, 25 bp, Mus musculus
tgcacatcccttgcatttcgggcaa

SEQ ID NO: 861963 - DNA, 25 bp, Mus musculus
tgcacatcgccaaggctctgggaat

SEQ ID NO: 861964 - DNA, 25 bp, Mus musculus
tgcacatcgccatggctctgggaat

SEQ ID NO: 861965 - DNA, 25 bp, Mus musculus
tgcacatcgtgcacatcgactttgg

SEQ ID NO: 861966 - DNA, 25 bp, Mus musculus
tgcacatcgtgctcatcgactttgg

SEQ ID NO: 861967 - DNA, 25 bp, Mus musculus
tgcacatctaagagagaccatctga

SEQ ID NO: 861968 - DNA, 25 bp, Mus musculus
tgcacatctaagtgagaccatctga

SEQ ID NO: 861969 - DNA, 25 bp, Mus musculus
tgcacatctattacccacacatgta

SEQ ID NO: 861970 - DNA, 25 bp, Mus musculus
tgcacatctatttcccacacatgta

SEQ ID NO: 861971 - DNA, 25 bp, Mus musculus
tgcacatctgtgattcctggttttc

SEQ ID NO: 861972 - DNA, 25 bp, Mus musculus
tgcacatctgtgtttcctggttttc

SEQ ID NO: 861973 - DNA, 25 bp, Mus musculus
tgcacatgaataatactgctacagt

SEQ ID NO: 861974 - DNA, 25 bp, Mus musculus
tgcacatgaatactggactgttcct

SEQ ID NO: 861975 - DNA, 25 bp, Mus musculus
tgcacatgaatagtggactgttcct

SEQ ID NO: 861976 - DNA, 25 bp, Mus musculus
tgcacatgaatattactgctacagt

SEQ ID NO: 861977 - DNA, 25 bp, Mus musculus
tgcacatgacatcgtgtacaaacac

SEQ ID NO: 861978 - DNA, 25 bp, Mus musculus
tgcacatgacatctgcttactacat

SEQ ID NO: 861979 - DNA, 25 bp, Mus musculus
tgcacatgacatggtgtacaaacac

SEQ ID NO: 861980 - DNA, 25 bp, Mus musculus
tgcacatgacatgtgcttactacat

SEQ ID NO: 861981 - DNA, 25 bp, Mus musculus
tgcacatgacttcgagcaggtccag

SEQ ID NO: 861982 - DNA, 25 bp, Mus musculus
tgcacatgacttggagcaggtccag

SEQ ID NO: 861983 - DNA, 25 bp, Mus musculus
tgcacatgagctcgggttcacaagt

SEQ ID NO: 861984 - DNA, 25 bp, Mus musculus
tgcacatgagctggggttcacaagt

SEQ ID NO: 861985 - DNA, 25 bp, Mus musculus
tgcacatgagtacctggcatcccca

SEQ ID NO: 861986 - DNA, 25 bp, Mus musculus
tgcacatgagtagctggcatcccca

SEQ ID NO: 861987 - DNA, 25 bp, Mus musculus
tgcacatgattcaggcagccctaga

SEQ ID NO: 861988 - DNA, 25 bp, Mus musculus
tgcacatgattctggcagccctaga

SEQ ID NO: 861989 - DNA, 25 bp, Mus musculus
tgcacatgcaggatcctaaggtcct

SEQ ID NO: 861990 - DNA, 25 bp, Mus musculus
tgcacatgcaggttcctaaggtcct

SEQ ID NO: 861991 - DNA, 25 bp, Mus musculus
tgcacatgcccgcaattttgtccat

SEQ ID NO: 861992 - DNA, 25 bp, Mus musculus
tgcacatgcccggaattttgtccat

SEQ ID NO: 861993 - DNA, 25 bp, Mus musculus
tgcacatgcgttacagagtctgctt

SEQ ID NO: 861994 - DNA, 25 bp, Mus musculus
tgcacatgcgtttcagagtctgctt

SEQ ID NO: 861995 - DNA, 25 bp, Mus musculus
tgcacatggcacagacacggacttt

SEQ ID NO: 861996 - DNA, 25 bp, Mus musculus
tgcacatggcactgacacggacttt

SEQ ID NO: 861997 - DNA, 25 bp, Mus musculus
tgcacatggcctcttgcaccaatgt

SEQ ID NO: 861998 - DNA, 25 bp, Mus musculus
tgcacatggcctgttgcaccaatgt

SEQ ID NO: 861999 - DNA, 25 bp, Mus musculus
tgcacatggctcagctaggagcttt

SEQ ID NO: 862000 - DNA, 25 bp, Mus musculus
tgcacatggctctgctaggagcttt

SEQ ID NO: 862001 - DNA, 25 bp, Mus musculus
tgcacatggtgtacagaaatatatg

SEQ ID NO: 862002 - DNA, 25 bp, Mus musculus
tgcacatggtgttcagaaatatatg

SEQ ID NO: 862003 - DNA, 25 bp, Mus musculus
tgcacatgtaggcattcagggcata

SEQ ID NO: 862004 - DNA, 25 bp, Mus musculus
tgcacatgtagggattcagggcata

SEQ ID NO: 862005 - DNA, 25 bp, Mus musculus
tgcacatgtggcaaaaaacaaagac

SEQ ID NO: 862006 - DNA, 25 bp, Mus musculus
tgcacatgtggctaaaaacaaagac

SEQ ID NO: 862007 - DNA, 25 bp, Mus musculus
tgcacattatagaaagttccactgt

SEQ ID NO: 862008 - DNA, 25 bp, Mus musculus
tgcacattatagtaagttccactgt

SEQ ID NO: 862009 - DNA, 25 bp, Mus musculus
tgcacattccacaattcagacacag

SEQ ID NO: 862010 - DNA, 25 bp, Mus musculus
tgcacattccactattcagacacag

SEQ ID NO: 862011 - DNA, 25 bp, Mus musculus
tgcacattccataactcagctactg

SEQ ID NO: 862012 - DNA, 25 bp, Mus musculus
tgcacattccattactcagctactg

SEQ ID NO: 862013 - DNA, 25 bp, Mus musculus
tgcacattcccactggtaggacatg

SEQ ID NO: 862014 - DNA, 25 bp, Mus musculus
tgcacattcccagtggtaggacatg

SEQ ID NO: 862015 - DNA, 25 bp, Mus musculus
tgcacattctaacagtcaaagcaga

SEQ ID NO: 862016 - DNA, 25 bp, Mus musculus
tgcacattctaagagtcaaagcaga

SEQ ID NO: 862017 - DNA, 25 bp, Mus musculus
tgcacattctgcagacgagcatata

SEQ ID NO: 862018 - DNA, 25 bp, Mus musculus
tgcacattctgctgacgagcatata

SEQ ID NO: 862019 - DNA, 25 bp, Mus musculus
tgcacattcttcaggcaaatctcta

SEQ ID NO: 862020 - DNA, 25 bp, Mus musculus
tgcacattcttctggcaaatctcta

SEQ ID NO: 862021 - DNA, 25 bp, Mus musculus
tgcacattgatacggtctcctgtct

SEQ ID NO: 862022 - DNA, 25 bp, Mus musculus
tgcacattgatagggtctcctgtct

SEQ ID NO: 862023 - DNA, 25 bp, Mus musculus
tgcacattgctgaacaagtaacttt

SEQ ID NO: 862024 - DNA, 25 bp, Mus musculus
tgcacattgctgtacaagtaacttt

SEQ ID NO: 862025 - DNA, 25 bp, Mus musculus
tgcacattgggcctctgggatctat

SEQ ID NO: 862026 - DNA, 25 bp, Mus musculus
tgcacattgggcgtctgggatctat

SEQ ID NO: 862027 - DNA, 25 bp, Mus musculus
tgcacattggtgcttctgggacaaa

SEQ ID NO: 862028 - DNA, 25 bp, Mus musculus
tgcacattggtggttctgggacaaa

SEQ ID NO: 862029 - DNA, 25 bp, Mus musculus
tgcacatttgatcaataccatttag

SEQ ID NO: 862030 - DNA, 25 bp, Mus musculus
tgcacatttgatgaataccatttag

SEQ ID NO: 862031 - DNA, 25 bp, Mus musculus
tgcacatttgcacatgacacagcga

SEQ ID NO: 862032 - DNA, 25 bp, Mus musculus
tgcacatttgcagatgacacagcga

SEQ ID NO: 862033 - DNA, 25 bp, Mus musculus
tgcacatttgctcggaaagttccga

SEQ ID NO: 862034 - DNA, 25 bp, Mus musculus
tgcacatttgctgggaaagttccga

SEQ ID NO: 862035 - DNA, 25 bp, Mus musculus
tgcacatttgtaatctgctacttgt

SEQ ID NO: 862036 - DNA, 25 bp, Mus musculus
tgcacatttgtattctgctacttgt

SEQ ID NO: 862037 - DNA, 25 bp, Mus musculus
tgcacatttgttaccgtgagctgga

SEQ ID NO: 862038 - DNA, 25 bp, Mus musculus
tgcacatttgtttccgtgagctgga

SEQ ID NO: 862039 - DNA, 25 bp, Mus musculus
tgcacattttctatgattcctttgt

SEQ ID NO: 862040 - DNA, 25 bp, Mus musculus
tgcacattttctttgattcctttgt

SEQ ID NO: 862041 - DNA, 25 bp, Mus musculus
tgcacattttgaatccccacaggaa

SEQ ID NO: 862042 - DNA, 25 bp, Mus musculus
tgcacattttgattccccacaggaa

SEQ ID NO: 862043 - DNA, 25 bp, Mus musculus
tgcacattttggctctcttcagaat

SEQ ID NO: 862044 - DNA, 25 bp, Mus musculus
tgcacattttgggtctcttcagaat

SEQ ID NO: 862045 - DNA, 25 bp, Mus musculus
tgcacattttttagcagctttaatg

SEQ ID NO: 862046 - DNA, 25 bp, Mus musculus
tgcacatttttttgcagctttaatg

SEQ ID NO: 862047 - DNA, 25 bp, Mus musculus
tgcaccaaaaatacttctccttcta

SEQ ID NO: 862048 - DNA, 25 bp, Mus musculus
tgcaccaaaaattcttctccttcta

SEQ ID NO: 862049 - DNA, 25 bp, Mus musculus
tgcaccaaaactctacatattatta

SEQ ID NO: 862050 - DNA, 25 bp, Mus musculus
tgcaccaaaactgtacatattatta

SEQ ID NO: 862051 - DNA, 25 bp, Mus musculus
tgcaccaaagataccaccttcaggg

SEQ ID NO: 862052 - DNA, 25 bp, Mus musculus
tgcaccaaagattccaccttcaggg

SEQ ID NO: 862053 - DNA, 25 bp, Mus musculus
tgcaccaaagccatagcagacggag

SEQ ID NO: 862054 - DNA, 25 bp, Mus musculus
tgcaccaaagccttagcagacggag

SEQ ID NO: 862055 - DNA, 25 bp, Mus musculus
tgcaccaaaggcatctcgatctaaa

SEQ ID NO: 862056 - DNA, 25 bp, Mus musculus
tgcaccaaaggcttctcgatctaaa

SEQ ID NO: 862057 - DNA, 25 bp, Mus musculus
tgcaccaaatccattttatgctgtg

SEQ ID NO: 862058 - DNA, 25 bp, Mus musculus
tgcaccaaatcctttttatgctgtg

SEQ ID NO: 862059 - DNA, 25 bp, Mus musculus
tgcaccaaatgaaaggcccacaaag

SEQ ID NO: 862060 - DNA, 25 bp, Mus musculus
tgcaccaaatgataggcccacaaag

SEQ ID NO: 862061 - DNA, 25 bp, Mus musculus
tgcaccaacagacccaccatgtatg

SEQ ID NO: 862062 - DNA, 25 bp, Mus musculus
tgcaccaacagagccaccatgtatg

SEQ ID NO: 862063 - DNA, 25 bp, Mus musculus
tgcaccaacaggctctgacagactt

SEQ ID NO: 862064 - DNA, 25 bp, Mus musculus
tgcaccaacagggtctgacagactt

SEQ ID NO: 862065 - DNA, 25 bp, Mus musculus
tgcaccaaccagcaaggctacagga

SEQ ID NO: 862066 - DNA, 25 bp, Mus musculus
tgcaccaaccaggaaggctacagga

SEQ ID NO: 862067 - DNA, 25 bp, Mus musculus
tgcaccaacttgacactctgatgaa

SEQ ID NO: 862068 - DNA, 25 bp, Mus musculus
tgcaccaacttgtcactctgatgaa

SEQ ID NO: 862069 - DNA, 25 bp, Mus musculus
tgcaccaagataccatgctcttgag

SEQ ID NO: 862070 - DNA, 25 bp, Mus musculus
tgcaccaagatagcatgctcttgag

SEQ ID NO: 862071 - DNA, 25 bp, Mus musculus
tgcaccaaggacatgcctcccatgg

SEQ ID NO: 862072 - DNA, 25 bp, Mus musculus
tgcaccaaggacttgcctcccatgg

SEQ ID NO: 862073 - DNA, 25 bp, Mus musculus
tgcaccacagagcacgctagtttgg

SEQ ID NO: 862074 - DNA, 25 bp, Mus musculus
tgcaccacagaggacgctagtttgg

SEQ ID NO: 862075 - DNA, 25 bp, Mus musculus
tgcaccacagatcctggcagtaggt

SEQ ID NO: 862076 - DNA, 25 bp, Mus musculus
tgcaccacagatgctggcagtaggt

SEQ ID NO: 862077 - DNA, 25 bp, Mus musculus
tgcaccacaggccatttgttgatat

SEQ ID NO: 862078 - DNA, 25 bp, Mus musculus
tgcaccacaggcgatttgttgatat

SEQ ID NO: 862079 - DNA, 25 bp, Mus musculus
tgcaccaccataacagctacagaaa

SEQ ID NO: 862080 - DNA, 25 bp, Mus musculus
tgcaccaccatatcagctacagaaa

SEQ ID NO: 862081 - DNA, 25 bp, Mus musculus
tgcaccaccattaccaggttctgat

SEQ ID NO: 862082 - DNA, 25 bp, Mus musculus
tgcaccaccatttccaggttctgat

SEQ ID NO: 862083 - DNA, 25 bp, Mus musculus
tgcaccacctccctttatagtcagg

SEQ ID NO: 862084 - DNA, 25 bp, Mus musculus
tgcaccacctccgtttatagtcagg

SEQ ID NO: 862085 - DNA, 25 bp, Mus musculus
tgcaccaccttaactgttgcttttg

SEQ ID NO: 862086 - DNA, 25 bp, Mus musculus
tgcaccaccttatctgttgcttttg

SEQ ID NO: 862087 - DNA, 25 bp, Mus musculus
tgcaccactatacctgcttttgagg

SEQ ID NO: 862088 - DNA, 25 bp, Mus musculus
tgcaccactatagctgcttttgagg

SEQ ID NO: 862089 - DNA, 25 bp, Mus musculus
tgcaccactatgaagaaccactgtc

SEQ ID NO: 862090 - DNA, 25 bp, Mus musculus
tgcaccactatgtagaaccactgtc

SEQ ID NO: 862091 - DNA, 25 bp, Mus musculus
tgcaccactcctcgacagagctttt

SEQ ID NO: 862092 - DNA, 25 bp, Mus musculus
tgcaccactcctggacagagctttt

SEQ ID NO: 862093 - DNA, 25 bp, Mus musculus
tgcaccactcttctttcgactgtcg

SEQ ID NO: 862094 - DNA, 25 bp, Mus musculus
tgcaccactcttgtttcgactgtcg

SEQ ID NO: 862095 - DNA, 25 bp, Mus musculus
tgcaccactgcgaaagacctgaagg

SEQ ID NO: 862096 - DNA, 25 bp, Mus musculus
tgcaccactgcgtaagacctgaagg

SEQ ID NO: 862097 - DNA, 25 bp, Mus musculus
tgcaccactggacgaacatgagttt

SEQ ID NO: 862098 - DNA, 25 bp, Mus musculus
tgcaccactggaggaacatgagttt

SEQ ID NO: 862099 - DNA, 25 bp, Mus musculus
tgcaccagaacaccatcactcaagt

SEQ ID NO: 862100 - DNA, 25 bp, Mus musculus
tgcaccagaacagcatcactcaagt

SEQ ID NO: 862101 - DNA, 25 bp, Mus musculus
tgcaccagacaaaaggccacctgtg

SEQ ID NO: 862102 - DNA, 25 bp, Mus musculus
tgcaccagacaataggccacctgtg

SEQ ID NO: 862103 - DNA, 25 bp, Mus musculus
tgcaccagagagcaggtggccttcc

SEQ ID NO: 862104 - DNA, 25 bp, Mus musculus
tgcaccagagaggaggtggccttcc

SEQ ID NO: 862105 - DNA, 25 bp, Mus musculus
tgcaccagaggacccatgtttcttt

SEQ ID NO: 862106 - DNA, 25 bp, Mus musculus
tgcaccagaggagccatgtttcttt

SEQ ID NO: 862107 - DNA, 25 bp, Mus musculus
tgcaccagcattcgcgataataaat

SEQ ID NO: 862108 - DNA, 25 bp, Mus musculus
tgcaccagcattggcgataataaat

SEQ ID NO: 862109 - DNA, 25 bp, Mus musculus
tgcaccaggaggcaattgctcccca

SEQ ID NO: 862110 - DNA, 25 bp, Mus musculus
tgcaccaggagggaattgctcccca

SEQ ID NO: 862111 - DNA, 25 bp, Mus musculus
tgcaccagggcacgctccagataaa

SEQ ID NO: 862112 - DNA, 25 bp, Mus musculus
tgcaccagggcaggctccagataaa

SEQ ID NO: 862113 - DNA, 25 bp, Mus musculus
tgcaccagggtcaacgtccgagagt

SEQ ID NO: 862114 - DNA, 25 bp, Mus musculus
tgcaccagggtctacgtccgagagt

SEQ ID NO: 862115 - DNA, 25 bp, Mus musculus
tgcaccaggtcacgatcattgccct

SEQ ID NO: 862116 - DNA, 25 bp, Mus musculus
tgcaccaggtcaggatcattgccct

SEQ ID NO: 862117 - DNA, 25 bp, Mus musculus
tgcaccagtaccaggtggccatgat

SEQ ID NO: 862118 - DNA, 25 bp, Mus musculus
tgcaccagtacctggtggccatgat

SEQ ID NO: 862119 - DNA, 25 bp, Mus musculus
tgcaccagtccccaaacagaggagt

SEQ ID NO: 862120 - DNA, 25 bp, Mus musculus
tgcaccagtcccgaaacagaggagt

SEQ ID NO: 862121 - DNA, 25 bp, Mus musculus
tgcaccagtgtgcaatggagtctcc

SEQ ID NO: 862122 - DNA, 25 bp, Mus musculus
tgcaccagtgtggaatggagtctcc

SEQ ID NO: 862123 - DNA, 25 bp, Mus musculus
tgcaccataactcacacatttcaat

SEQ ID NO: 862124 - DNA, 25 bp, Mus musculus
tgcaccataactgacacatttcaat

SEQ ID NO: 862125 - DNA, 25 bp, Mus musculus
tgcaccatacacatagtgccaccat

SEQ ID NO: 862126 - DNA, 25 bp, Mus musculus
tgcaccatacacttagtgccaccat

SEQ ID NO: 862127 - DNA, 25 bp, Mus musculus
tgcaccatcataagcaatttttgtc

SEQ ID NO: 862128 - DNA, 25 bp, Mus musculus
tgcaccatcatatgcaatttttgtc

SEQ ID NO: 862129 - DNA, 25 bp, Mus musculus
tgcaccatctgcaaagcttctgtgg

SEQ ID NO: 862130 - DNA, 25 bp, Mus musculus
tgcaccatctgctaagcttctgtgg

SEQ ID NO: 862131 - DNA, 25 bp, Mus musculus
tgcaccatcttaaaggcctcatgac

SEQ ID NO: 862132 - DNA, 25 bp, Mus musculus
tgcaccatcttataggcctcatgac

SEQ ID NO: 862133 - DNA, 25 bp, Mus musculus
tgcaccatgatacattcactcacac

SEQ ID NO: 862134 - DNA, 25 bp, Mus musculus
tgcaccatgatagattcactcacac

SEQ ID NO: 862135 - DNA, 25 bp, Mus musculus
tgcaccatgcatcttttaggccagt

SEQ ID NO: 862136 - DNA, 25 bp, Mus musculus
tgcaccatgcatgttttaggccagt

SEQ ID NO: 862137 - DNA, 25 bp, Mus musculus
tgcaccatggcgctgggcaaaatta

SEQ ID NO: 862138 - DNA, 25 bp, Mus musculus
tgcaccatggcggtgggcaaaatta

SEQ ID NO: 862139 - DNA, 25 bp, Mus musculus
tgcaccatgttgacacgtgtcatct

SEQ ID NO: 862140 - DNA, 25 bp, Mus musculus
tgcaccatgttgtcacgtgtcatct

SEQ ID NO: 862141 - DNA, 25 bp, Mus musculus
tgcaccattttacatcccattagga

SEQ ID NO: 862142 - DNA, 25 bp, Mus musculus
tgcaccattttagatcccattagga

SEQ ID NO: 862143 - DNA, 25 bp, Mus musculus
tgcacccaacgacacacctgagtaa

SEQ ID NO: 862144 - DNA, 25 bp, Mus musculus
tgcacccaacgagacacctgagtaa

SEQ ID NO: 862145 - DNA, 25 bp, Mus musculus
tgcacccacagtccactgaggagag

SEQ ID NO: 862146 - DNA, 25 bp, Mus musculus
tgcacccacagtgcactgaggagag

SEQ ID NO: 862147 - DNA, 25 bp, Mus musculus
tgcacccacctgaggtctctaaagg

SEQ ID NO: 862148 - DNA, 25 bp, Mus musculus
tgcacccacctgtggtctctaaagg

SEQ ID NO: 862149 - DNA, 25 bp, Mus musculus
tgcacccagcttcccagtttgggag

SEQ ID NO: 862150 - DNA, 25 bp, Mus musculus
tgcacccagcttgccagtttgggag

SEQ ID NO: 862151 - DNA, 25 bp, Mus musculus
tgcacccagtccaatagttctcaga

SEQ ID NO: 862152 - DNA, 25 bp, Mus musculus
tgcacccagtccatgatttgagttc

SEQ ID NO: 862153 - DNA, 25 bp, Mus musculus
tgcacccagtcctatagttctcaga

SEQ ID NO: 862154 - DNA, 25 bp, Mus musculus
tgcacccagtccttgatttgagttc

SEQ ID NO: 862155 - DNA, 25 bp, Mus musculus
tgcacccagtttcccggcgaagtat

SEQ ID NO: 862156 - DNA, 25 bp, Mus musculus
tgcacccagtttgccggcgaagtat

SEQ ID NO: 862157 - DNA, 25 bp, Mus musculus
tgcacccatatcacttcgagttact

SEQ ID NO: 862158 - DNA, 25 bp, Mus musculus
tgcacccatatctcttcgagttact

SEQ ID NO: 862159 - DNA, 25 bp, Mus musculus
tgcacccatcctcgattctgagaaa

SEQ ID NO: 862160 - DNA, 25 bp, Mus musculus
tgcacccatcctggattctgagaaa

SEQ ID NO: 862161 - DNA, 25 bp, Mus musculus
tgcacccatgcaaatgatgacagat

SEQ ID NO: 862162 - DNA, 25 bp, Mus musculus
tgcacccatgcaagagtggttcttg

SEQ ID NO: 862163 - DNA, 25 bp, Mus musculus
tgcacccatgcatatgatgacagat

SEQ ID NO: 862164 - DNA, 25 bp, Mus musculus
tgcacccatgcatgagtggttcttg

SEQ ID NO: 862165 - DNA, 25 bp, Mus musculus
tgcacccatgtgactgctgtggttt

SEQ ID NO: 862166 - DNA, 25 bp, Mus musculus
tgcacccatgtgtctgctgtggttt

SEQ ID NO: 862167 - DNA, 25 bp, Mus musculus
tgcacccattccatagaggctactt

SEQ ID NO: 862168 - DNA, 25 bp, Mus musculus
tgcacccattccttagaggctactt

SEQ ID NO: 862169 - DNA, 25 bp, Mus musculus
tgcaccccacgcagggagcaacaat

SEQ ID NO: 862170 - DNA, 25 bp, Mus musculus
tgcaccccacgctgggagcaacaat

SEQ ID NO: 862171 - DNA, 25 bp, Mus musculus
tgcaccccagatacagagtctcagg

SEQ ID NO: 862172 - DNA, 25 bp, Mus musculus
tgcaccccagattcagagtctcagg

SEQ ID NO: 862173 - DNA, 25 bp, Mus musculus
tgcaccccaggcatggcagtagcat

SEQ ID NO: 862174 - DNA, 25 bp, Mus musculus
tgcaccccaggcttggcagtagcat

SEQ ID NO: 862175 - DNA, 25 bp, Mus musculus
tgcaccccgcaacttcaacatgaag

SEQ ID NO: 862176 - DNA, 25 bp, Mus musculus
tgcaccccgcaagttcaacatgaag

SEQ ID NO: 862177 - DNA, 25 bp, Mus musculus
tgcacccctcatcgaacttttaaaa

SEQ ID NO: 862178 - DNA, 25 bp, Mus musculus
tgcacccctcatggaacttttaaaa

SEQ ID NO: 862179 - DNA, 25 bp, Mus musculus
tgcacccctgtcacacgaaggtggg

SEQ ID NO: 862180 - DNA, 25 bp, Mus musculus
tgcacccctgtctcacgaaggtggg

SEQ ID NO: 862181 - DNA, 25 bp, Mus musculus
tgcacccgaatgaccagtggagcct

SEQ ID NO: 862182 - DNA, 25 bp, Mus musculus
tgcacccgaatgtccagtggagcct

SEQ ID NO: 862183 - DNA, 25 bp, Mus musculus
tgcacccggctgctccttcctgtct

SEQ ID NO: 862184 - DNA, 25 bp, Mus musculus
tgcacccggctggtccttcctgtct

SEQ ID NO: 862185 - DNA, 25 bp, Mus musculus
tgcacccgggacattgtgctacctg

SEQ ID NO: 862186 - DNA, 25 bp, Mus musculus
tgcacccgggactttgtgctacctg

SEQ ID NO: 862187 - DNA, 25 bp, Mus musculus
tgcacccgggtgatgaaggcctcac

SEQ ID NO: 862188 - DNA, 25 bp, Mus musculus
tgcacccgggtgttgaaggcctcac

SEQ ID NO: 862189 - DNA, 25 bp, Mus musculus
tgcacccgtccacatatttggattt

SEQ ID NO: 862190 - DNA, 25 bp, Mus musculus
tgcacccgtccagatatttggattt

SEQ ID NO: 862191 - DNA, 25 bp, Mus musculus
tgcacccgtgtgctagtcttactgc

SEQ ID NO: 862192 - DNA, 25 bp, Mus musculus
tgcacccgtgtggtagtcttactgc

SEQ ID NO: 862193 - DNA, 25 bp, Mus musculus
tgcaccctaagcagcagagcaccaa

SEQ ID NO: 862194 - DNA, 25 bp, Mus musculus
tgcaccctaagctgcagagcaccaa

SEQ ID NO: 862195 - DNA, 25 bp, Mus musculus
tgcaccctatctctcattatgaaac

SEQ ID NO: 862196 - DNA, 25 bp, Mus musculus
tgcaccctatctgtcattatgaaac

SEQ ID NO: 862197 - DNA, 25 bp, Mus musculus
tgcaccctcaacagagtggctaata

SEQ ID NO: 862198 - DNA, 25 bp, Mus musculus
tgcaccctcaactgagtggctaata

SEQ ID NO: 862199 - DNA, 25 bp, Mus musculus
tgcaccctctacagacatctatttt

SEQ ID NO: 862200 - DNA, 25 bp, Mus musculus
tgcaccctctactgacatctatttt

SEQ ID NO: 862201 - DNA, 25 bp, Mus musculus
tgcaccctcttgacatcattgtgga

SEQ ID NO: 862202 - DNA, 25 bp, Mus musculus
tgcaccctcttgtcatcattgtgga

SEQ ID NO: 862203 - DNA, 25 bp, Mus musculus
tgcaccctctttcctgactgaaaat

SEQ ID NO: 862204 - DNA, 25 bp, Mus musculus
tgcaccctctttgctgactgaaaat

SEQ ID NO: 862205 - DNA, 25 bp, Mus musculus
tgcaccctgaaacctggacccaaag

SEQ ID NO: 862206 - DNA, 25 bp, Mus musculus
tgcaccctgaaagctggacccaaag

SEQ ID NO: 862207 - DNA, 25 bp, Mus musculus
tgcaccctgatcatgatgtcctgag

SEQ ID NO: 862208 - DNA, 25 bp, Mus musculus
tgcaccctgatcttgatgtcctgag

SEQ ID NO: 862209 - DNA, 25 bp, Mus musculus
tgcaccctgggaaggctaccaacca

SEQ ID NO: 862210 - DNA, 25 bp, Mus musculus
tgcaccctgggatggctaccaacca

SEQ ID NO: 862211 - DNA, 25 bp, Mus musculus
tgcaccctgtgcaatgattatgctt

SEQ ID NO: 862212 - DNA, 25 bp, Mus musculus
tgcaccctgtgctatgattatgctt

SEQ ID NO: 862213 - DNA, 25 bp, Mus musculus
tgcaccctttgacatgacctgttgt

SEQ ID NO: 862214 - DNA, 25 bp, Mus musculus
tgcaccctttgacttccggtggaaa

SEQ ID NO: 862215 - DNA, 25 bp, Mus musculus
tgcaccctttgagatgacctgttgt

SEQ ID NO: 862216 - DNA, 25 bp, Mus musculus
tgcaccctttgagttccggtggaaa

SEQ ID NO: 862217 - DNA, 25 bp, Mus musculus
tgcacccttttaatctttactagtt

SEQ ID NO: 862218 - DNA, 25 bp, Mus musculus
tgcacccttttattctttactagtt

SEQ ID NO: 862219 - DNA, 25 bp, Mus musculus
tgcaccgaaggcaccagcaacaatt

SEQ ID NO: 862220 - DNA, 25 bp, Mus musculus
tgcaccgaaggctccagcaacaatt

SEQ ID NO: 862221 - DNA, 25 bp, Mus musculus
tgcaccgacgttcacacactggtga

SEQ ID NO: 862222 - DNA, 25 bp, Mus musculus
tgcaccgacgttgacacactggtga

SEQ ID NO: 862223 - DNA, 25 bp, Mus musculus
tgcaccgagtctaccaggagagctc

SEQ ID NO: 862224 - DNA, 25 bp, Mus musculus
tgcaccgagtcttccaggagagctc

SEQ ID NO: 862225 - DNA, 25 bp, Mus musculus
tgcaccgagtgtcgctacaagttca

SEQ ID NO: 862226 - DNA, 25 bp, Mus musculus
tgcaccgagtgtggctacaagttca

SEQ ID NO: 862227 - DNA, 25 bp, Mus musculus
tgcaccgcaggacagtctcaagtga

SEQ ID NO: 862228 - DNA, 25 bp, Mus musculus
tgcaccgcaggagagtctcaagtga

SEQ ID NO: 862229 - DNA, 25 bp, Mus musculus
tgcaccgccacaacaaacggcagag

SEQ ID NO: 862230 - DNA, 25 bp, Mus musculus
tgcaccgccacatcaaacggcagag

SEQ ID NO: 862231 - DNA, 25 bp, Mus musculus
tgcaccgccatcagtatatcaaatc

SEQ ID NO: 862232 - DNA, 25 bp, Mus musculus
tgcaccgccatctgtatatcaaatc

SEQ ID NO: 862233 - DNA, 25 bp, Mus musculus
tgcaccgcgcctcagagagatatgg

SEQ ID NO: 862234 - DNA, 25 bp, Mus musculus
tgcaccgcgcctgagagagatatgg

SEQ ID NO: 862235 - DNA, 25 bp, Mus musculus
tgcaccgcgtgaccagatcgtttgt

SEQ ID NO: 862236 - DNA, 25 bp, Mus musculus
tgcaccgcgtgagcagatcgtttgt

SEQ ID NO: 862237 - DNA, 25 bp, Mus musculus
tgcaccgctgctctcttactggctg

SEQ ID NO: 862238 - DNA, 25 bp, Mus musculus
tgcaccgctgctgtcttactggctg

SEQ ID NO: 862239 - DNA, 25 bp, Mus musculus
tgcaccggcacgagaagatccacac

SEQ ID NO: 862240 - DNA, 25 bp, Mus musculus
tgcaccggcacgtgaagatccacac

SEQ ID NO: 862241 - DNA, 25 bp, Mus musculus
tgcaccggcctcactcagatcgaaa

SEQ ID NO: 862242 - DNA, 25 bp, Mus musculus
tgcaccggcctctctcagatcgaaa

SEQ ID NO: 862243 - DNA, 25 bp, Mus musculus
tgcaccgtctgcctgggaaaagatg

SEQ ID NO: 862244 - DNA, 25 bp, Mus musculus
tgcaccgtctgcgtgggaaaagatg

SEQ ID NO: 862245 - DNA, 25 bp, Mus musculus
tgcaccgtcttgaggtcaacataag

SEQ ID NO: 862246 - DNA, 25 bp, Mus musculus
tgcaccgtcttgtggtcaacataag

SEQ ID NO: 862247 - DNA, 25 bp, Mus musculus
tgcaccgtgctgaattccaagtatg

SEQ ID NO: 862248 - DNA, 25 bp, Mus musculus
tgcaccgtgctgtattccaagtatg

SEQ ID NO: 862249 - DNA, 25 bp, Mus musculus
tgcacctaagggaaggcagtgtcct

SEQ ID NO: 862250 - DNA, 25 bp, Mus musculus
tgcacctaagggtaggcagtgtcct

SEQ ID NO: 862251 - DNA, 25 bp, Mus musculus
tgcacctacaacacctatgtttcag

SEQ ID NO: 862252 - DNA, 25 bp, Mus musculus
tgcacctacaactcctatgtttcag

SEQ ID NO: 862253 - DNA, 25 bp, Mus musculus
tgcacctacaccaaagggcctcagg

SEQ ID NO: 862254 - DNA, 25 bp, Mus musculus
tgcacctacacctaagggcctcagg

SEQ ID NO: 862255 - DNA, 25 bp, Mus musculus
tgcacctacatgacggcggtctttc

SEQ ID NO: 862256 - DNA, 25 bp, Mus musculus
tgcacctacatgtcggcggtctttc

SEQ ID NO: 862257 - DNA, 25 bp, Mus musculus
tgcacctactgtatctactcaggag

SEQ ID NO: 862258 - DNA, 25 bp, Mus musculus
tgcacctactgtttctactcaggag

SEQ ID NO: 862259 - DNA, 25 bp, Mus musculus
tgcacctagagcaattgccatcttt

SEQ ID NO: 862260 - DNA, 25 bp, Mus musculus
tgcacctagagctattgccatcttt

SEQ ID NO: 862261 - DNA, 25 bp, Mus musculus
tgcacctagtataaaaattgctttg

SEQ ID NO: 862262 - DNA, 25 bp, Mus musculus
tgcacctagtattaaaattgctttg

SEQ ID NO: 862263 - DNA, 25 bp, Mus musculus
tgcacctatcagactatttactcaa

SEQ ID NO: 862264 - DNA, 25 bp, Mus musculus
tgcacctatcagtctatttactcaa

SEQ ID NO: 862265 - DNA, 25 bp, Mus musculus
tgcacctatgacaacctgcaacttt

SEQ ID NO: 862266 - DNA, 25 bp, Mus musculus
tgcacctatgactacctgcaacttt

SEQ ID NO: 862267 - DNA, 25 bp, Mus musculus
tgcacctatgtaaccccagtgcttg

SEQ ID NO: 862268 - DNA, 25 bp, Mus musculus
tgcacctatgtatccccagtgcttg

SEQ ID NO: 862269 - DNA, 25 bp, Mus musculus
tgcacctattgtaatatcgaagagc

SEQ ID NO: 862270 - DNA, 25 bp, Mus musculus
tgcacctattgttatatcgaagagc

SEQ ID NO: 862271 - DNA, 25 bp, Mus musculus
tgcacctcacctctatagtcgttct

SEQ ID NO: 862272 - DNA, 25 bp, Mus musculus
tgcacctcacctgtatagtcgttct

SEQ ID NO: 862273 - DNA, 25 bp, Mus musculus
tgcacctcacttagctaatacatga

SEQ ID NO: 862274 - DNA, 25 bp, Mus musculus
tgcacctcactttgctaatacatga

SEQ ID NO: 862275 - DNA, 25 bp, Mus musculus
tgcacctcatctcggattcaagagc

SEQ ID NO: 862276 - DNA, 25 bp, Mus musculus
tgcacctcatctgggattcaagagc

SEQ ID NO: 862277 - DNA, 25 bp, Mus musculus
tgcacctcatgcagtcagcactggg

SEQ ID NO: 862278 - DNA, 25 bp, Mus musculus
tgcacctcatgctgtcagcactggg

SEQ ID NO: 862279 - DNA, 25 bp, Mus musculus
tgcacctccagtcagtggtcagcag

SEQ ID NO: 862280 - DNA, 25 bp, Mus musculus
tgcacctccagtgagtggtcagcag

SEQ ID NO: 862281 - DNA, 25 bp, Mus musculus
tgcacctcctgcatgtcagaggcct

SEQ ID NO: 862282 - DNA, 25 bp, Mus musculus
tgcacctcctgcttgtcagaggcct

SEQ ID NO: 862283 - DNA, 25 bp, Mus musculus
tgcacctcctttacggtagagatgg

SEQ ID NO: 862284 - DNA, 25 bp, Mus musculus
tgcacctccttttcggtagagatgg

SEQ ID NO: 862285 - DNA, 25 bp, Mus musculus
tgcacctcgtcaccagtactataat

SEQ ID NO: 862286 - DNA, 25 bp, Mus musculus
tgcacctcgtcagcagtactataat

SEQ ID NO: 862287 - DNA, 25 bp, Mus musculus
tgcacctctaccacatagttcaaag

SEQ ID NO: 862288 - DNA, 25 bp, Mus musculus
tgcacctctacctcatagttcaaag

SEQ ID NO: 862289 - DNA, 25 bp, Mus musculus
tgcacctctgcaaacaacaaacaac

SEQ ID NO: 862290 - DNA, 25 bp, Mus musculus
tgcacctctgcacgtatctgctttc

SEQ ID NO: 862291 - DNA, 25 bp, Mus musculus
tgcacctctgcaggtatctgctttc

SEQ ID NO: 862292 - DNA, 25 bp, Mus musculus
tgcacctctgcatacaacaaacaac

SEQ ID NO: 862293 - DNA, 25 bp, Mus musculus
tgcacctctggaatgcaggtcctaa

SEQ ID NO: 862294 - DNA, 25 bp, Mus musculus
tgcacctctggattgcaggtcctaa

SEQ ID NO: 862295 - DNA, 25 bp, Mus musculus
tgcacctcttcccatcagtatcagt

SEQ ID NO: 862296 - DNA, 25 bp, Mus musculus
tgcacctcttccgatcagtatcagt

SEQ ID NO: 862297 - DNA, 25 bp, Mus musculus
tgcacctcttgcaaaactcagactg

SEQ ID NO: 862298 - DNA, 25 bp, Mus musculus
tgcacctcttgctaaactcagactg

SEQ ID NO: 862299 - DNA, 25 bp, Mus musculus
tgcacctgacctctgagagtcactg

SEQ ID NO: 862300 - DNA, 25 bp, Mus musculus
tgcacctgacctgtgagagtcactg

SEQ ID NO: 862301 - DNA, 25 bp, Mus musculus
tgcacctgcacgagagctcattgtg

SEQ ID NO: 862302 - DNA, 25 bp, Mus musculus
tgcacctgcacgtgagctcattgtg

SEQ ID NO: 862303 - DNA, 25 bp, Mus musculus
tgcacctgcactataagccccatta

SEQ ID NO: 862304 - DNA, 25 bp, Mus musculus
tgcacctgcactttaagccccatta

SEQ ID NO: 862305 - DNA, 25 bp, Mus musculus
tgcacctgcaggacacacgcaaaga

SEQ ID NO: 862306 - DNA, 25 bp, Mus musculus
tgcacctgcaggtcacacgcaaaga

SEQ ID NO: 862307 - DNA, 25 bp, Mus musculus
tgcacctgcgacatcaggccttagt

SEQ ID NO: 862308 - DNA, 25 bp, Mus musculus
tgcacctgcgacttcaggccttagt

SEQ ID NO: 862309 - DNA, 25 bp, Mus musculus
tgcacctgcgatagttcttattttt

SEQ ID NO: 862310 - DNA, 25 bp, Mus musculus
tgcacctgcgattgttcttattttt

SEQ ID NO: 862311 - DNA, 25 bp, Mus musculus
tgcacctgcgcaagcagcattctgg

SEQ ID NO: 862312 - DNA, 25 bp, Mus musculus
tgcacctgcgcatgcagcattctgg

SEQ ID NO: 862313 - DNA, 25 bp, Mus musculus
tgcacctgctatactacctgctaag

SEQ ID NO: 862314 - DNA, 25 bp, Mus musculus
tgcacctgctattctacctgctaag

SEQ ID NO: 862315 - DNA, 25 bp, Mus musculus
tgcacctgctcacagccaatgggaa

SEQ ID NO: 862316 - DNA, 25 bp, Mus musculus
tgcacctgctcagagccaatgggaa

SEQ ID NO: 862317 - DNA, 25 bp, Mus musculus
tgcacctgctgtcatgtctgcggca

SEQ ID NO: 862318 - DNA, 25 bp, Mus musculus
tgcacctgctgtctctgtctactaa

SEQ ID NO: 862319 - DNA, 25 bp, Mus musculus
tgcacctgctgtgatgtctgcggca

SEQ ID NO: 862320 - DNA, 25 bp, Mus musculus
tgcacctgctgtgtctgtctactaa

SEQ ID NO: 862321 - DNA, 25 bp, Mus musculus
tgcacctggcttacaacaactcttt

SEQ ID NO: 862322 - DNA, 25 bp, Mus musculus
tgcacctggctttcaacaactcttt

SEQ ID NO: 862323 - DNA, 25 bp, Mus musculus
tgcacctggtttcagcaaggtggct

SEQ ID NO: 862324 - DNA, 25 bp, Mus musculus
tgcacctggtttgagcaaggtggct

SEQ ID NO: 862325 - DNA, 25 bp, Mus musculus
tgcacctgtaccacttggtctttga

SEQ ID NO: 862326 - DNA, 25 bp, Mus musculus
tgcacctgtacctcttggtctttga

SEQ ID NO: 862327 - DNA, 25 bp, Mus musculus
tgcacctgtactacggcgcgatggg

SEQ ID NO: 862328 - DNA, 25 bp, Mus musculus
tgcacctgtacttcggcgcgatggg

SEQ ID NO: 862329 - DNA, 25 bp, Mus musculus
tgcacctgtgccacggaagtctgtg

SEQ ID NO: 862330 - DNA, 25 bp, Mus musculus
tgcacctgtgcctcggaagtctgtg

SEQ ID NO: 862331 - DNA, 25 bp, Mus musculus
tgcacctgtgtgagcaggagcctga

SEQ ID NO: 862332 - DNA, 25 bp, Mus musculus
tgcacctgtgtgtgcaggagcctga

SEQ ID NO: 862333 - DNA, 25 bp, Mus musculus
tgcacctgttgtctgtggtcccgtg

SEQ ID NO: 862334 - DNA, 25 bp, Mus musculus
tgcacctgttgtgtgtggtcccgtg

SEQ ID NO: 862335 - DNA, 25 bp, Mus musculus
tgcacctgtttgagaacccagcctt

SEQ ID NO: 862336 - DNA, 25 bp, Mus musculus
tgcacctgtttgtgaacccagcctt

SEQ ID NO: 862337 - DNA, 25 bp, Mus musculus
tgcaccttcagcattcacagacttt

SEQ ID NO: 862338 - DNA, 25 bp, Mus musculus
tgcaccttcagctttcacagacttt

SEQ ID NO: 862339 - DNA, 25 bp, Mus musculus
tgcaccttcatcaacgacttctaca

SEQ ID NO: 862340 - DNA, 25 bp, Mus musculus
tgcaccttcatctacgacttctaca

SEQ ID NO: 862341 - DNA, 25 bp, Mus musculus
tgcaccttcatgagatagcaccagt

SEQ ID NO: 862342 - DNA, 25 bp, Mus musculus
tgcaccttcatgtgatagcaccagt

SEQ ID NO: 862343 - DNA, 25 bp, Mus musculus
tgcaccttccctagtctgtaaccag

SEQ ID NO: 862344 - DNA, 25 bp, Mus musculus
tgcaccttcccttgtctgtaaccag

SEQ ID NO: 862345 - DNA, 25 bp, Mus musculus
tgcaccttccttagttctgatcata

SEQ ID NO: 862346 - DNA, 25 bp, Mus musculus
tgcaccttcctttgttctgatcata

SEQ ID NO: 862347 - DNA, 25 bp, Mus musculus
tgcaccttgaggaagagacaggccg

SEQ ID NO: 862348 - DNA, 25 bp, Mus musculus
tgcaccttgaggtagagacaggccg

SEQ ID NO: 862349 - DNA, 25 bp, Mus musculus
tgcaccttgcaaacactctcaagtg

SEQ ID NO: 862350 - DNA, 25 bp, Mus musculus
tgcaccttgcaatcactctcaagtg

SEQ ID NO: 862351 - DNA, 25 bp, Mus musculus
tgcaccttgcatcgtttctcattgc

SEQ ID NO: 862352 - DNA, 25 bp, Mus musculus
tgcaccttgcatggtttctcattgc

SEQ ID NO: 862353 - DNA, 25 bp, Mus musculus
tgcaccttgctcaatcatctggcaa

SEQ ID NO: 862354 - DNA, 25 bp, Mus musculus
tgcaccttgctctatcatctggcaa

SEQ ID NO: 862355 - DNA, 25 bp, Mus musculus
tgcaccttgtcgacatgaacttcgt

SEQ ID NO: 862356 - DNA, 25 bp, Mus musculus
tgcaccttgtcgtcatgaacttcgt

SEQ ID NO: 862357 - DNA, 25 bp, Mus musculus
tgcaccttgtggcttgcgctctgga

SEQ ID NO: 862358 - DNA, 25 bp, Mus musculus
tgcaccttgtgggttgcgctctgga

SEQ ID NO: 862359 - DNA, 25 bp, Mus musculus
tgcaccttgtttattccagttcaca

SEQ ID NO: 862360 - DNA, 25 bp, Mus musculus
tgcaccttgttttttccagttcaca

SEQ ID NO: 862361 - DNA, 25 bp, Mus musculus
tgcacctttagtacttcagcaacac

SEQ ID NO: 862362 - DNA, 25 bp, Mus musculus
tgcacctttagtccccatattttgg

SEQ ID NO: 862363 - DNA, 25 bp, Mus musculus
tgcacctttagtgcccatattttgg

SEQ ID NO: 862364 - DNA, 25 bp, Mus musculus
tgcacctttagttcttcagcaacac

SEQ ID NO: 862365 - DNA, 25 bp, Mus musculus
tgcacctttcgtataaccctgtcat

SEQ ID NO: 862366 - DNA, 25 bp, Mus musculus
tgcacctttcgtttaaccctgtcat

SEQ ID NO: 862367 - DNA, 25 bp, Mus musculus
tgcaccttttgcacaccccatttta

SEQ ID NO: 862368 - DNA, 25 bp, Mus musculus
tgcaccttttgctcaccccatttta

SEQ ID NO: 862369 - DNA, 25 bp, Mus musculus
tgcacgaagctcaaaaggaccaggt

SEQ ID NO: 862370 - DNA, 25 bp, Mus musculus
tgcacgaagctctaaaggaccaggt

SEQ ID NO: 862371 - DNA, 25 bp, Mus musculus
tgcacgaattttcactttcccaaaa

SEQ ID NO: 862372 - DNA, 25 bp, Mus musculus
tgcacgaattttgactttcccaaaa

SEQ ID NO: 862373 - DNA, 25 bp, Mus musculus
tgcacgacccaacgcgacaggagct

SEQ ID NO: 862374 - DNA, 25 bp, Mus musculus
tgcacgacccaaggcgacaggagct

SEQ ID NO: 862375 - DNA, 25 bp, Mus musculus
tgcacgacccagaacagagttaaac

SEQ ID NO: 862376 - DNA, 25 bp, Mus musculus
tgcacgacccagtacagagttaaac

SEQ ID NO: 862377 - DNA, 25 bp, Mus musculus
tgcacgacctgacctgctggattag

SEQ ID NO: 862378 - DNA, 25 bp, Mus musculus
tgcacgacctgagctgctggattag

SEQ ID NO: 862379 - DNA, 25 bp, Mus musculus
tgcacgacctgcacatcttggatgg

SEQ ID NO: 862380 - DNA, 25 bp, Mus musculus
tgcacgacctgctcatcttggatgg

SEQ ID NO: 862381 - DNA, 25 bp, Mus musculus
tgcacgacgacgaggtgacggtcac

SEQ ID NO: 862382 - DNA, 25 bp, Mus musculus
tgcacgacgacgtggtgacggtcac

SEQ ID NO: 862383 - DNA, 25 bp, Mus musculus
tgcacgactcccctgtatgtattta

SEQ ID NO: 862384 - DNA, 25 bp, Mus musculus
tgcacgactcccgtgtatgtattta

SEQ ID NO: 862385 - DNA, 25 bp, Mus musculus
tgcacgactgcaccattttaataaa

SEQ ID NO: 862386 - DNA, 25 bp, Mus musculus
tgcacgactgcagcattttaataaa

SEQ ID NO: 862387 - DNA, 25 bp, Mus musculus
tgcacgagtcacaccggaacttggg

SEQ ID NO: 862388 - DNA, 25 bp, Mus musculus
tgcacgagtcactccggaacttggg

SEQ ID NO: 862389 - DNA, 25 bp, Mus musculus
tgcacgcacacactcggaagaaggt

SEQ ID NO: 862390 - DNA, 25 bp, Mus musculus
tgcacgcacacagtcggaagaaggt

SEQ ID NO: 862391 - DNA, 25 bp, Mus musculus
tgcacgcacgcaaacactctgaaat

SEQ ID NO: 862392 - DNA, 25 bp, Mus musculus
tgcacgcacgcatacactctgaaat

SEQ ID NO: 862393 - DNA, 25 bp, Mus musculus
tgcacgcagataccatctacagcgg

SEQ ID NO: 862394 - DNA, 25 bp, Mus musculus
tgcacgcagatagcatctacagcgg

SEQ ID NO: 862395 - DNA, 25 bp, Mus musculus
tgcacgcaggctagtggcattgtgt

SEQ ID NO: 862396 - DNA, 25 bp, Mus musculus
tgcacgcaggcttgtggcattgtgt

SEQ ID NO: 862397 - DNA, 25 bp, Mus musculus
tgcacgcagggtagttgacccggaa

SEQ ID NO: 862398 - DNA, 25 bp, Mus musculus
tgcacgcagggttgttgacccggaa

SEQ ID NO: 862399 - DNA, 25 bp, Mus musculus
tgcacgcatataagtgtgtcgcccc

SEQ ID NO: 862400 - DNA, 25 bp, Mus musculus
tgcacgcatatatgtgtgtcgcccc

SEQ ID NO: 862401 - DNA, 25 bp, Mus musculus
tgcacgcatatgaataacgccttat

SEQ ID NO: 862402 - DNA, 25 bp, Mus musculus
tgcacgcatatgtataacgccttat

SEQ ID NO: 862403 - DNA, 25 bp, Mus musculus
tgcacgcatgcgagtgcgagcaaat

SEQ ID NO: 862404 - DNA, 25 bp, Mus musculus
tgcacgcatgcgtgtgcgagcaaat

SEQ ID NO: 862405 - DNA, 25 bp, Mus musculus
tgcacgcatttgaccatacgacaga

SEQ ID NO: 862406 - DNA, 25 bp, Mus musculus
tgcacgcatttgtccatacgacaga

SEQ ID NO: 862407 - DNA, 25 bp, Mus musculus
tgcacgccaagcagaatgtgagtga

SEQ ID NO: 862408 - DNA, 25 bp, Mus musculus
tgcacgccaagctgaatgtgagtga

SEQ ID NO: 862409 - DNA, 25 bp, Mus musculus
tgcacgccacacagaacagtgagct

SEQ ID NO: 862410 - DNA, 25 bp, Mus musculus
tgcacgccacactgaacagtgagct

SEQ ID NO: 862411 - DNA, 25 bp, Mus musculus
tgcacgcccagacatcgggctgaat

SEQ ID NO: 862412 - DNA, 25 bp, Mus musculus
tgcacgcccagagatcgggctgaat

SEQ ID NO: 862413 - DNA, 25 bp, Mus musculus
tgcacgcctgcaagattgtcaccaa

SEQ ID NO: 862414 - DNA, 25 bp, Mus musculus
tgcacgcctgcatgattgtcaccaa

SEQ ID NO: 862415 - DNA, 25 bp, Mus musculus
tgcacgcgctccaaattgagggtaa

SEQ ID NO: 862416 - DNA, 25 bp, Mus musculus
tgcacgcgctcctaattgagggtaa

SEQ ID NO: 862417 - DNA, 25 bp, Mus musculus
tgcacgcgtgccagaggtagtcatt

SEQ ID NO: 862418 - DNA, 25 bp, Mus musculus
tgcacgcgtgcctgaggtagtcatt

SEQ ID NO: 862419 - DNA, 25 bp, Mus musculus
tgcacgctcgggacacaggtggcaa

SEQ ID NO: 862420 - DNA, 25 bp, Mus musculus
tgcacgctcgggtcacaggtggcaa

SEQ ID NO: 862421 - DNA, 25 bp, Mus musculus
tgcacgctctctctgtgtatttaag

SEQ ID NO: 862422 - DNA, 25 bp, Mus musculus
tgcacgctctctgtgtgtatttaag

SEQ ID NO: 862423 - DNA, 25 bp, Mus musculus
tgcacgctgacaactctatcaatat

SEQ ID NO: 862424 - DNA, 25 bp, Mus musculus
tgcacgctgacatctctatcaatat

SEQ ID NO: 862425 - DNA, 25 bp, Mus musculus
tgcacgctgatgaccattgagatag

SEQ ID NO: 862426 - DNA, 25 bp, Mus musculus
tgcacgctgatgaccctgactatat

SEQ ID NO: 862427 - DNA, 25 bp, Mus musculus
tgcacgctgatgtccattgagatag

SEQ ID NO: 862428 - DNA, 25 bp, Mus musculus
tgcacgctgatgtccctgactatat

SEQ ID NO: 862429 - DNA, 25 bp, Mus musculus
tgcacggaagagctctgaccacctg

SEQ ID NO: 862430 - DNA, 25 bp, Mus musculus
tgcacggaagaggtctgaccacctg

SEQ ID NO: 862431 - DNA, 25 bp, Mus musculus
tgcacggacgacatgatctcatgaa

SEQ ID NO: 862432 - DNA, 25 bp, Mus musculus
tgcacggacgacttgatctcatgaa

SEQ ID NO: 862433 - DNA, 25 bp, Mus musculus
tgcacggccaggaaggcgcctgctt

SEQ ID NO: 862434 - DNA, 25 bp, Mus musculus
tgcacggccaggtaggcgcctgctt

SEQ ID NO: 862435 - DNA, 25 bp, Mus musculus
tgcacggcccttccggtgagatcga

SEQ ID NO: 862436 - DNA, 25 bp, Mus musculus
tgcacggcccttgcggtgagatcga

SEQ ID NO: 862437 - DNA, 25 bp, Mus musculus
tgcacggcttgcaagaacatggctt

SEQ ID NO: 862438 - DNA, 25 bp, Mus musculus
tgcacggcttgctagaacatggctt

SEQ ID NO: 862439 - DNA, 25 bp, Mus musculus
tgcacgggatcaagcttttccatgt

SEQ ID NO: 862440 - DNA, 25 bp, Mus musculus
tgcacgggatcatgcttttccatgt

SEQ ID NO: 862441 - DNA, 25 bp, Mus musculus
tgcacgggcaacagattggcagacc

SEQ ID NO: 862442 - DNA, 25 bp, Mus musculus
tgcacgggcaactgattggcagacc

SEQ ID NO: 862443 - DNA, 25 bp, Mus musculus
tgcacgggtcatcgcttgttaacaa

SEQ ID NO: 862444 - DNA, 25 bp, Mus musculus
tgcacgggtcatggcttgttaacaa

SEQ ID NO: 862445 - DNA, 25 bp, Mus musculus
tgcacggtactcatcctgcactgaa

SEQ ID NO: 862446 - DNA, 25 bp, Mus musculus
tgcacggtactcttcctgcactgaa

SEQ ID NO: 862447 - DNA, 25 bp, Mus musculus
tgcacggtggttactcggcgagcct

SEQ ID NO: 862448 - DNA, 25 bp, Mus musculus
tgcacggtggtttctcggcgagcct

SEQ ID NO: 862449 - DNA, 25 bp, Mus musculus
tgcacggttcttacttatgctatag

SEQ ID NO: 862450 - DNA, 25 bp, Mus musculus
tgcacggttctttcttatgctatag

SEQ ID NO: 862451 - DNA, 25 bp, Mus musculus
tgcacggttgcaaaagcctgacccg

SEQ ID NO: 862452 - DNA, 25 bp, Mus musculus
tgcacggttgcataagcctgacccg

SEQ ID NO: 862453 - DNA, 25 bp, Mus musculus
tgcacggttgctcctggaagatcaa

SEQ ID NO: 862454 - DNA, 25 bp, Mus musculus
tgcacggttgctgctggaagatcaa

SEQ ID NO: 862455 - DNA, 25 bp, Mus musculus
tgcacggtttcacagtagtgtcact

SEQ ID NO: 862456 - DNA, 25 bp, Mus musculus
tgcacggtttcagagtagtgtcact

SEQ ID NO: 862457 - DNA, 25 bp, Mus musculus
tgcacgtacagcaacttggaaagct

SEQ ID NO: 862458 - DNA, 25 bp, Mus musculus
tgcacgtacagctacttggaaagct

SEQ ID NO: 862459 - DNA, 25 bp, Mus musculus
tgcacgtaccctatgaaggaacctt

SEQ ID NO: 862460 - DNA, 25 bp, Mus musculus
tgcacgtaccctttgaaggaacctt

SEQ ID NO: 862461 - DNA, 25 bp, Mus musculus
tgcacgtccgtgaaaacataaaggt

SEQ ID NO: 862462 - DNA, 25 bp, Mus musculus
tgcacgtccgtgtaaacataaaggt

SEQ ID NO: 862463 - DNA, 25 bp, Mus musculus
tgcacgtcgtagcttccgcctttgc

SEQ ID NO: 862464 - DNA, 25 bp, Mus musculus
tgcacgtcgtaggttccgcctttgc

SEQ ID NO: 862465 - DNA, 25 bp, Mus musculus
tgcacgtgatgacatcagtgagctc

SEQ ID NO: 862466 - DNA, 25 bp, Mus musculus
tgcacgtgatgagatcagtgagctc

SEQ ID NO: 862467 - DNA, 25 bp, Mus musculus
tgcacgtgcaaaaaatcttctgaaa

SEQ ID NO: 862468 - DNA, 25 bp, Mus musculus
tgcacgtgcaaataatcttctgaaa

SEQ ID NO: 862469 - DNA, 25 bp, Mus musculus
tgcacgtgcctaaactagtgagcat

SEQ ID NO: 862470 - DNA, 25 bp, Mus musculus
tgcacgtgcctatactagtgagcat

SEQ ID NO: 862471 - DNA, 25 bp, Mus musculus
tgcacgtgcttgaagacaccatcgc

SEQ ID NO: 862472 - DNA, 25 bp, Mus musculus
tgcacgtgcttgtagacaccatcgc

SEQ ID NO: 862473 - DNA, 25 bp, Mus musculus
tgcacgtggcttctgagaacgctca

SEQ ID NO: 862474 - DNA, 25 bp, Mus musculus
tgcacgtggcttgtgagaacgctca

SEQ ID NO: 862475 - DNA, 25 bp, Mus musculus
tgcacgtgtatgactggagggatct

SEQ ID NO: 862476 - DNA, 25 bp, Mus musculus
tgcacgtgtatgtctggagggatct

SEQ ID NO: 862477 - DNA, 25 bp, Mus musculus
tgcacgtgtctcatggcagtgtcac

SEQ ID NO: 862478 - DNA, 25 bp, Mus musculus
tgcacgtgtctcttggcagtgtcac

SEQ ID NO: 862479 - DNA, 25 bp, Mus musculus
tgcacgtgtgtcagttttgagtgtc

SEQ ID NO: 862480 - DNA, 25 bp, Mus musculus
tgcacgtgtgtctgttttgagtgtc

SEQ ID NO: 862481 - DNA, 25 bp, Mus musculus
tgcacgttcactaccacagagactt

SEQ ID NO: 862482 - DNA, 25 bp, Mus musculus
tgcacgttcacttccacagagactt

SEQ ID NO: 862483 - DNA, 25 bp, Mus musculus
tgcacgttctggcacatcctggaat

SEQ ID NO: 862484 - DNA, 25 bp, Mus musculus
tgcacgttctgggacatcctggaat

SEQ ID NO: 862485 - DNA, 25 bp, Mus musculus
tgcacgttctgtcacttggcacttc

SEQ ID NO: 862486 - DNA, 25 bp, Mus musculus
tgcacgttctgtgacttggcacttc

SEQ ID NO: 862487 - DNA, 25 bp, Mus musculus
tgcactaagcaaatgtttcccataa

SEQ ID NO: 862488 - DNA, 25 bp, Mus musculus
tgcactaagcaattgtttcccataa

SEQ ID NO: 862489 - DNA, 25 bp, Mus musculus
tgcactaagctccagatgacttttc

SEQ ID NO: 862490 - DNA, 25 bp, Mus musculus
tgcactaagctcgagatgacttttc

SEQ ID NO: 862491 - DNA, 25 bp, Mus musculus
tgcactaaggacacacggcccagcg

SEQ ID NO: 862492 - DNA, 25 bp, Mus musculus
tgcactaaggactcacggcccagcg

SEQ ID NO: 862493 - DNA, 25 bp, Mus musculus
tgcactaatgcacccctgtgaggga

SEQ ID NO: 862494 - DNA, 25 bp, Mus musculus
tgcactaatgcagccctgtgaggga

SEQ ID NO: 862495 - DNA, 25 bp, Mus musculus
tgcactacactgatggaggaagtta

SEQ ID NO: 862496 - DNA, 25 bp, Mus musculus
tgcactacactgttggaggaagtta

SEQ ID NO: 862497 - DNA, 25 bp, Mus musculus
tgcactacagtgcttcatctacgac

SEQ ID NO: 862498 - DNA, 25 bp, Mus musculus
tgcactacagtggttcatctacgac

SEQ ID NO: 862499 - DNA, 25 bp, Mus musculus
tgcactacatatccggttcaagttt

SEQ ID NO: 862500 - DNA, 25 bp, Mus musculus
tgcactacatatgcggttcaagttt

SEQ ID NO: 862501 - DNA, 25 bp, Mus musculus
tgcactacatgccacactcatatgt

SEQ ID NO: 862502 - DNA, 25 bp, Mus musculus
tgcactacatgcgacactcatatgt

SEQ ID NO: 862503 - DNA, 25 bp, Mus musculus
tgcactaccgagattcagcatttgg

SEQ ID NO: 862504 - DNA, 25 bp, Mus musculus
tgcactaccgagtttcagcatttgg

SEQ ID NO: 862505 - DNA, 25 bp, Mus musculus
tgcactacgggccattttcgtttaa

SEQ ID NO: 862506 - DNA, 25 bp, Mus musculus
tgcactacgggcgattttcgtttaa

SEQ ID NO: 862507 - DNA, 25 bp, Mus musculus
tgcactactacacccaaagttggtc

SEQ ID NO: 862508 - DNA, 25 bp, Mus musculus
tgcactactacagccaaagttggtc

SEQ ID NO: 862509 - DNA, 25 bp, Mus musculus
tgcactacttgaagtcctcatatcg

SEQ ID NO: 862510 - DNA, 25 bp, Mus musculus
tgcactacttgatgtcctcatatcg

SEQ ID NO: 862511 - DNA, 25 bp, Mus musculus
tgcactagaaggacgtctctgctgc

SEQ ID NO: 862512 - DNA, 25 bp, Mus musculus
tgcactagaaggtcgtctctgctgc

SEQ ID NO: 862513 - DNA, 25 bp, Mus musculus
tgcactaggagcacctgatcaaata

SEQ ID NO: 862514 - DNA, 25 bp, Mus musculus
tgcactaggagctcctgatcaaata

SEQ ID NO: 862515 - DNA, 25 bp, Mus musculus
tgcactaggctacgctgccagggct

SEQ ID NO: 862516 - DNA, 25 bp, Mus musculus
tgcactaggctaggctgccagggct

SEQ ID NO: 862517 - DNA, 25 bp, Mus musculus
tgcactagtaagacaaacactcttg

SEQ ID NO: 862518 - DNA, 25 bp, Mus musculus
tgcactagtaagtcaaacactcttg

SEQ ID NO: 862519 - DNA, 25 bp, Mus musculus
tgcactatggtgctgttcaaatact

SEQ ID NO: 862520 - DNA, 25 bp, Mus musculus
tgcactatggtggtgttcaaatact

SEQ ID NO: 862521 - DNA, 25 bp, Mus musculus
tgcactattgcaaaacgggtgtttt

SEQ ID NO: 862522 - DNA, 25 bp, Mus musculus
tgcactattgcataacgggtgtttt

SEQ ID NO: 862523 - DNA, 25 bp, Mus musculus
tgcactcaacaacccatactattac

SEQ ID NO: 862524 - DNA, 25 bp, Mus musculus
tgcactcaacaagccatactattac

SEQ ID NO: 862525 - DNA, 25 bp, Mus musculus
tgcactcaagagaccttatgtgtga

SEQ ID NO: 862526 - DNA, 25 bp, Mus musculus
tgcactcaagagtccttatgtgtga

SEQ ID NO: 862527 - DNA, 25 bp, Mus musculus
tgcactcaaggtcgaccagagggtt

SEQ ID NO: 862528 - DNA, 25 bp, Mus musculus
tgcactcaaggtggaccagagggtt

SEQ ID NO: 862529 - DNA, 25 bp, Mus musculus
tgcactcacatacaaagggacactg

SEQ ID NO: 862530 - DNA, 25 bp, Mus musculus
tgcactcacatagaaagggacactg

SEQ ID NO: 862531 - DNA, 25 bp, Mus musculus
tgcactcaccagaagtggcgctgaa

SEQ ID NO: 862532 - DNA, 25 bp, Mus musculus
tgcactcaccagtagtggcgctgaa

SEQ ID NO: 862533 - DNA, 25 bp, Mus musculus
tgcactcacgtgaaattgtttcctt

SEQ ID NO: 862534 - DNA, 25 bp, Mus musculus
tgcactcacgtgtaattgtttcctt

SEQ ID NO: 862535 - DNA, 25 bp, Mus musculus
tgcactcagagaagctcaagacata

SEQ ID NO: 862536 - DNA, 25 bp, Mus musculus
tgcactcagagatgctcaagacata

SEQ ID NO: 862537 - DNA, 25 bp, Mus musculus
tgcactcagataaggcagactcagt

SEQ ID NO: 862538 - DNA, 25 bp, Mus musculus
tgcactcagatatggcagactcagt

SEQ ID NO: 862539 - DNA, 25 bp, Mus musculus
tgcactcagctgcaaccaagagttc

SEQ ID NO: 862540 - DNA, 25 bp, Mus musculus
tgcactcagctggaaccaagagttc

SEQ ID NO: 862541 - DNA, 25 bp, Mus musculus
tgcactcaggaaatgacggctcggt

SEQ ID NO: 862542 - DNA, 25 bp, Mus musculus
tgcactcaggaattgacggctcggt

SEQ ID NO: 862543 - DNA, 25 bp, Mus musculus
tgcactcagggacagatctgcgtca

SEQ ID NO: 862544 - DNA, 25 bp, Mus musculus
tgcactcagggagagatctgcgtca

SEQ ID NO: 862545 - DNA, 25 bp, Mus musculus
tgcactcagtaaatcattctccttg

SEQ ID NO: 862546 - DNA, 25 bp, Mus musculus
tgcactcagtaattcattctccttg

SEQ ID NO: 862547 - DNA, 25 bp, Mus musculus
tgcactcatagcagcggccctggaa

SEQ ID NO: 862548 - DNA, 25 bp, Mus musculus
tgcactcatagctgcggccctggaa

SEQ ID NO: 862549 - DNA, 25 bp, Mus musculus
tgcactcatctcagttgtctgtctg

SEQ ID NO: 862550 - DNA, 25 bp, Mus musculus
tgcactcatctctgttgtctgtctg

SEQ ID NO: 862551 - DNA, 25 bp, Mus musculus
tgcactcatgtactgtttctgtagt

SEQ ID NO: 862552 - DNA, 25 bp, Mus musculus
tgcactcatgtagtgtttctgtagt

SEQ ID NO: 862553 - DNA, 25 bp, Mus musculus
tgcactcattaaacgacgggaatac

SEQ ID NO: 862554 - DNA, 25 bp, Mus musculus
tgcactcattaatcgacgggaatac

SEQ ID NO: 862555 - DNA, 25 bp, Mus musculus
tgcactccagttatacattaattcg

SEQ ID NO: 862556 - DNA, 25 bp, Mus musculus
tgcactccagttttacattaattcg

SEQ ID NO: 862557 - DNA, 25 bp, Mus musculus
tgcactccatcacatcacctgtagg

SEQ ID NO: 862558 - DNA, 25 bp, Mus musculus
tgcactccatcagatcacctgtagg

SEQ ID NO: 862559 - DNA, 25 bp, Mus musculus
tgcactcccacacaaagcccctcaa

SEQ ID NO: 862560 - DNA, 25 bp, Mus musculus
tgcactcccacagaaagcccctcaa

SEQ ID NO: 862561 - DNA, 25 bp, Mus musculus
tgcactccccttaattatcgttgga

SEQ ID NO: 862562 - DNA, 25 bp, Mus musculus
tgcactcccctttattatcgttgga

SEQ ID NO: 862563 - DNA, 25 bp, Mus musculus
tgcactccctgaaaagtggatacta

SEQ ID NO: 862564 - DNA, 25 bp, Mus musculus
tgcactccctgataagtggatacta

SEQ ID NO: 862565 - DNA, 25 bp, Mus musculus
tgcactcctgcaagacaagtacggt

SEQ ID NO: 862566 - DNA, 25 bp, Mus musculus
tgcactcctgcatgacaagtacggt

SEQ ID NO: 862567 - DNA, 25 bp, Mus musculus
tgcactccttccactcagcatgaca

SEQ ID NO: 862568 - DNA, 25 bp, Mus musculus
tgcactccttcctctcagcatgaca

SEQ ID NO: 862569 - DNA, 25 bp, Mus musculus
tgcactcgatgcagataacgcggga

SEQ ID NO: 862570 - DNA, 25 bp, Mus musculus
tgcactcgatgctgataacgcggga

SEQ ID NO: 862571 - DNA, 25 bp, Mus musculus
tgcactcgcggtatccacaggattg

SEQ ID NO: 862572 - DNA, 25 bp, Mus musculus
tgcactcgcggtttccacaggattg

SEQ ID NO: 862573 - DNA, 25 bp, Mus musculus
tgcactcgggaaaggatctacactg

SEQ ID NO: 862574 - DNA, 25 bp, Mus musculus
tgcactcgggaatggatctacactg

SEQ ID NO: 862575 - DNA, 25 bp, Mus musculus
tgcactcgggtgctatgacttcaaa

SEQ ID NO: 862576 - DNA, 25 bp, Mus musculus
tgcactcgggtggtatgacttcaaa

SEQ ID NO: 862577 - DNA, 25 bp, Mus musculus
tgcactcgtccgacccgagggagca

SEQ ID NO: 862578 - DNA, 25 bp, Mus musculus
tgcactcgtccgtcccgagggagca

SEQ ID NO: 862579 - DNA, 25 bp, Mus musculus
tgcactcgtgttaggtcagtccctc

SEQ ID NO: 862580 - DNA, 25 bp, Mus musculus
tgcactcgtgtttggtcagtccctc

SEQ ID NO: 862581 - DNA, 25 bp, Mus musculus
tgcactcgttttcgcattgcagcta

SEQ ID NO: 862582 - DNA, 25 bp, Mus musculus
tgcactcgttttggcattgcagcta

SEQ ID NO: 862583 - DNA, 25 bp, Mus musculus
tgcactctcaggaaaccttggcctc

SEQ ID NO: 862584 - DNA, 25 bp, Mus musculus
tgcactctcaggtaaccttggcctc

SEQ ID NO: 862585 - DNA, 25 bp, Mus musculus
tgcactctcctgagacgtagtagca

SEQ ID NO: 862586 - DNA, 25 bp, Mus musculus
tgcactctcctgtgacgtagtagca

SEQ ID NO: 862587 - DNA, 25 bp, Mus musculus
tgcactctcgtcatgaattacatca

SEQ ID NO: 862588 - DNA, 25 bp, Mus musculus
tgcactctcgtcttgaattacatca

SEQ ID NO: 862589 - DNA, 25 bp, Mus musculus
tgcactctctcacagggacaaactt

SEQ ID NO: 862590 - DNA, 25 bp, Mus musculus
tgcactctctcagagggacaaactt

SEQ ID NO: 862591 - DNA, 25 bp, Mus musculus
tgcactctgcagacttagccaactg

SEQ ID NO: 862592 - DNA, 25 bp, Mus musculus
tgcactctgcagtcttagccaactg

SEQ ID NO: 862593 - DNA, 25 bp, Mus musculus
tgcactctgctcctggattttccaa

SEQ ID NO: 862594 - DNA, 25 bp, Mus musculus
tgcactctgctcgtggattttccaa

SEQ ID NO: 862595 - DNA, 25 bp, Mus musculus
tgcactctggatatggagccaagag

SEQ ID NO: 862596 - DNA, 25 bp, Mus musculus
tgcactctggatttggagccaagag

SEQ ID NO: 862597 - DNA, 25 bp, Mus musculus
tgcactctgtctctgggcaatgcag

SEQ ID NO: 862598 - DNA, 25 bp, Mus musculus
tgcactctgtctgtgggcaatgcag

SEQ ID NO: 862599 - DNA, 25 bp, Mus musculus
tgcactcttcaactttaccactcaa

SEQ ID NO: 862600 - DNA, 25 bp, Mus musculus
tgcactcttcaagtttaccactcaa

SEQ ID NO: 862601 - DNA, 25 bp, Mus musculus
tgcactcttctcacgttttgttgaa

SEQ ID NO: 862602 - DNA, 25 bp, Mus musculus
tgcactcttctctcgttttgttgaa

SEQ ID NO: 862603 - DNA, 25 bp, Mus musculus
tgcactgaagtccagaataggtcaa

SEQ ID NO: 862604 - DNA, 25 bp, Mus musculus
tgcactgaagtcgagaataggtcaa

SEQ ID NO: 862605 - DNA, 25 bp, Mus musculus
tgcactgaagttattgagccccaga

SEQ ID NO: 862606 - DNA, 25 bp, Mus musculus
tgcactgaagtttttgagccccaga

SEQ ID NO: 862607 - DNA, 25 bp, Mus musculus
tgcactgaatgaagttacacccaag

SEQ ID NO: 862608 - DNA, 25 bp, Mus musculus
tgcactgaatgatgttacacccaag

SEQ ID NO: 862609 - DNA, 25 bp, Mus musculus
tgcactgaattgactcatctggttt

SEQ ID NO: 862610 - DNA, 25 bp, Mus musculus
tgcactgaattgtctcatctggttt

SEQ ID NO: 862611 - DNA, 25 bp, Mus musculus
tgcactgacacccacatcattgaga

SEQ ID NO: 862612 - DNA, 25 bp, Mus musculus
tgcactgacaccgacatcattgaga

SEQ ID NO: 862613 - DNA, 25 bp, Mus musculus
tgcactgacctgagccccgagactg

SEQ ID NO: 862614 - DNA, 25 bp, Mus musculus
tgcactgacctgtgccccgagactg

SEQ ID NO: 862615 - DNA, 25 bp, Mus musculus
tgcactgactttatccagaccaaag

SEQ ID NO: 862616 - DNA, 25 bp, Mus musculus
tgcactgactttttccagaccaaag

SEQ ID NO: 862617 - DNA, 25 bp, Mus musculus
tgcactgagagactcacactccctt

SEQ ID NO: 862618 - DNA, 25 bp, Mus musculus
tgcactgagagagtcacactccctt

SEQ ID NO: 862619 - DNA, 25 bp, Mus musculus
tgcactgagcacagggactaaaggt

SEQ ID NO: 862620 - DNA, 25 bp, Mus musculus
tgcactgagcactgggactaaaggt

SEQ ID NO: 862621 - DNA, 25 bp, Mus musculus
tgcactgagccacccatgcgttagg

SEQ ID NO: 862622 - DNA, 25 bp, Mus musculus
tgcactgagccagccatgcgttagg

SEQ ID NO: 862623 - DNA, 25 bp, Mus musculus
tgcactgatcgcagccaatgcactc

SEQ ID NO: 862624 - DNA, 25 bp, Mus musculus
tgcactgatcgctgccaatgcactc

SEQ ID NO: 862625 - DNA, 25 bp, Mus musculus
tgcactgatgcaactcactgtttaa

SEQ ID NO: 862626 - DNA, 25 bp, Mus musculus
tgcactgatgcatctcactgtttaa

SEQ ID NO: 862627 - DNA, 25 bp, Mus musculus
tgcactgatgccagtcagctgcagg

SEQ ID NO: 862628 - DNA, 25 bp, Mus musculus
tgcactgatgccctggttctgacat

SEQ ID NO: 862629 - DNA, 25 bp, Mus musculus
tgcactgatgccgtggttctgacat

SEQ ID NO: 862630 - DNA, 25 bp, Mus musculus
tgcactgatgcctgtcagctgcagg

SEQ ID NO: 862631 - DNA, 25 bp, Mus musculus
tgcactgatgtgacaaaccttattc

SEQ ID NO: 862632 - DNA, 25 bp, Mus musculus
tgcactgatgtgtcaaaccttattc

SEQ ID NO: 862633 - DNA, 25 bp, Mus musculus
tgcactgattaaatcctggtcttgg

SEQ ID NO: 862634 - DNA, 25 bp, Mus musculus
tgcactgattaattcctggtcttgg

SEQ ID NO: 862635 - DNA, 25 bp, Mus musculus
tgcactgattccattccggatttga

SEQ ID NO: 862636 - DNA, 25 bp, Mus musculus
tgcactgattcctttccggatttga

SEQ ID NO: 862637 - DNA, 25 bp, Mus musculus
tgcactgcaaaccattctacctaag

SEQ ID NO: 862638 - DNA, 25 bp, Mus musculus
tgcactgcaaacgattctacctaag

SEQ ID NO: 862639 - DNA, 25 bp, Mus musculus
tgcactgcactgatctgccaactgt

SEQ ID NO: 862640 - DNA, 25 bp, Mus musculus
tgcactgcactgttctgccaactgt

SEQ ID NO: 862641 - DNA, 25 bp, Mus musculus
tgcactgcagcaattccgaaccact

SEQ ID NO: 862642 - DNA, 25 bp, Mus musculus
tgcactgcagcatttccgaaccact

SEQ ID NO: 862643 - DNA, 25 bp, Mus musculus
tgcactgcatggaatctgcactcag

SEQ ID NO: 862644 - DNA, 25 bp, Mus musculus
tgcactgcatggtatctgcactcag

SEQ ID NO: 862645 - DNA, 25 bp, Mus musculus
tgcactgccacacaaatgcctgaaa

SEQ ID NO: 862646 - DNA, 25 bp, Mus musculus
tgcactgccacagaaatgcctgaaa

SEQ ID NO: 862647 - DNA, 25 bp, Mus musculus
tgcactgccatgctcagccttgtca

SEQ ID NO: 862648 - DNA, 25 bp, Mus musculus
tgcactgccatggtcagccttgtca

SEQ ID NO: 862649 - DNA, 25 bp, Mus musculus
tgcactgcccagagttaggagacgt

SEQ ID NO: 862650 - DNA, 25 bp, Mus musculus
tgcactgcccagtgttaggagacgt

SEQ ID NO: 862651 - DNA, 25 bp, Mus musculus
tgcactgccgagctgtccatcaaag

SEQ ID NO: 862652 - DNA, 25 bp, Mus musculus
tgcactgccgaggtgtccatcaaag

SEQ ID NO: 862653 - DNA, 25 bp, Mus musculus
tgcactgccgtcagatttcctttct

SEQ ID NO: 862654 - DNA, 25 bp, Mus musculus
tgcactgccgtctgatttcctttct

SEQ ID NO: 862655 - DNA, 25 bp, Mus musculus
tgcactgcctgacagacatcctttt

SEQ ID NO: 862656 - DNA, 25 bp, Mus musculus
tgcactgcctgagagacatcctttt

SEQ ID NO: 862657 - DNA, 25 bp, Mus musculus
tgcactgcgagcagtgggcaacatt

SEQ ID NO: 862658 - DNA, 25 bp, Mus musculus
tgcactgcgagctgtgggcaacatt

SEQ ID NO: 862659 - DNA, 25 bp, Mus musculus
tgcactgcggctcagaagatcactt

SEQ ID NO: 862660 - DNA, 25 bp, Mus musculus
tgcactgcggctgagaagatcactt

SEQ ID NO: 862661 - DNA, 25 bp, Mus musculus
tgcactgctccaagctggcagaaga

SEQ ID NO: 862662 - DNA, 25 bp, Mus musculus
tgcactgctccatgctggcagaaga

SEQ ID NO: 862663 - DNA, 25 bp, Mus musculus
tgcactgctcttacactatgacagc

SEQ ID NO: 862664 - DNA, 25 bp, Mus musculus
tgcactgctctttcactatgacagc

SEQ ID NO: 862665 - DNA, 25 bp, Mus musculus
tgcactgctgcaatactgccctcag

SEQ ID NO: 862666 - DNA, 25 bp, Mus musculus
tgcactgctgcattactgccctcag

SEQ ID NO: 862667 - DNA, 25 bp, Mus musculus
tgcactgcttttcaccatccaagac

SEQ ID NO: 862668 - DNA, 25 bp, Mus musculus
tgcactgcttttgaccatccaagac

SEQ ID NO: 862669 - DNA, 25 bp, Mus musculus
tgcactggatcaactggacttcaaa

SEQ ID NO: 862670 - DNA, 25 bp, Mus musculus
tgcactggatcatctggacttcaaa

SEQ ID NO: 862671 - DNA, 25 bp, Mus musculus
tgcactggcactagtgactgtgcta

SEQ ID NO: 862672 - DNA, 25 bp, Mus musculus
tgcactggcacttgtgactgtgcta

SEQ ID NO: 862673 - DNA, 25 bp, Mus musculus
tgcactggcccaaggcaatgccgtg

SEQ ID NO: 862674 - DNA, 25 bp, Mus musculus
tgcactggcccatggcaatgccgtg

SEQ ID NO: 862675 - DNA, 25 bp, Mus musculus
tgcactggcctgagtggaatggata

SEQ ID NO: 862676 - DNA, 25 bp, Mus musculus
tgcactggcctgtgtggaatggata

SEQ ID NO: 862677 - DNA, 25 bp, Mus musculus
tgcactggctttaatgtcccacctt

SEQ ID NO: 862678 - DNA, 25 bp, Mus musculus
tgcactggcttttatgtcccacctt

SEQ ID NO: 862679 - DNA, 25 bp, Mus musculus
tgcactgggaaccaacgtctctgat

SEQ ID NO: 862680 - DNA, 25 bp, Mus musculus
tgcactgggaacgaacgtctctgat

SEQ ID NO: 862681 - DNA, 25 bp, Mus musculus
tgcactgggagacaaaaaacatacg

SEQ ID NO: 862682 - DNA, 25 bp, Mus musculus
tgcactgggagagaaaaaacatacg

SEQ ID NO: 862683 - DNA, 25 bp, Mus musculus
tgcactgtacataccacgagcattg

SEQ ID NO: 862684 - DNA, 25 bp, Mus musculus
tgcactgtacattccacgagcattg

SEQ ID NO: 862685 - DNA, 25 bp, Mus musculus
tgcactgtagtcaggtcctgcaaga

SEQ ID NO: 862686 - DNA, 25 bp, Mus musculus
tgcactgtagtctggtcctgcaaga

SEQ ID NO: 862687 - DNA, 25 bp, Mus musculus
tgcactgtcaggctgaggttctcag

SEQ ID NO: 862688 - DNA, 25 bp, Mus musculus
tgcactgtcagggtgaggttctcag

SEQ ID NO: 862689 - DNA, 25 bp, Mus musculus
tgcactgtccagcagggcaaagacc

SEQ ID NO: 862690 - DNA, 25 bp, Mus musculus
tgcactgtccaggagggcaaagacc

SEQ ID NO: 862691 - DNA, 25 bp, Mus musculus
tgcactgtccctatgtagctgtggc

SEQ ID NO: 862692 - DNA, 25 bp, Mus musculus
tgcactgtccctttgtagctgtggc

SEQ ID NO: 862693 - DNA, 25 bp, Mus musculus
tgcactgtctagatcctgttttttg

SEQ ID NO: 862694 - DNA, 25 bp, Mus musculus
tgcactgtctagttcctgttttttg

SEQ ID NO: 862695 - DNA, 25 bp, Mus musculus
tgcactgtcttgacattccattcat

SEQ ID NO: 862696 - DNA, 25 bp, Mus musculus
tgcactgtcttgtcattccattcat

SEQ ID NO: 862697 - DNA, 25 bp, Mus musculus
tgcactgtgacaatcctatacatac

SEQ ID NO: 862698 - DNA, 25 bp, Mus musculus
tgcactgtgacattcctatacatac

SEQ ID NO: 862699 - DNA, 25 bp, Mus musculus
tgcactgtgaccatgaccaatccct

SEQ ID NO: 862700 - DNA, 25 bp, Mus musculus
tgcactgtgaccttgaccaatccct

SEQ ID NO: 862701 - DNA, 25 bp, Mus musculus
tgcactgtgatgactgacgcaacat

SEQ ID NO: 862702 - DNA, 25 bp, Mus musculus
tgcactgtgatgtctgacgcaacat

SEQ ID NO: 862703 - DNA, 25 bp, Mus musculus
tgcactgtgctgaaacatagaggtt

SEQ ID NO: 862704 - DNA, 25 bp, Mus musculus
tgcactgtgctgtaacatagaggtt

SEQ ID NO: 862705 - DNA, 25 bp, Mus musculus
tgcactgtggacaatctgtggattc

SEQ ID NO: 862706 - DNA, 25 bp, Mus musculus
tgcactgtggactatctgtggattc

SEQ ID NO: 862707 - DNA, 25 bp, Mus musculus
tgcactgtggagacagtagacttca

SEQ ID NO: 862708 - DNA, 25 bp, Mus musculus
tgcactgtggagtcagtagacttca

SEQ ID NO: 862709 - DNA, 25 bp, Mus musculus
tgcactgtggcacgcatctagccat

SEQ ID NO: 862710 - DNA, 25 bp, Mus musculus
tgcactgtggcaggcatctagccat

SEQ ID NO: 862711 - DNA, 25 bp, Mus musculus
tgcactgtggccacactttttataa

SEQ ID NO: 862712 - DNA, 25 bp, Mus musculus
tgcactgtggcccatgttacagaag

SEQ ID NO: 862713 - DNA, 25 bp, Mus musculus
tgcactgtggccgatgttacagaag

SEQ ID NO: 862714 - DNA, 25 bp, Mus musculus
tgcactgtggcctcactttttataa

SEQ ID NO: 862715 - DNA, 25 bp, Mus musculus
tgcactgtggctccatgcagtcggt

SEQ ID NO: 862716 - DNA, 25 bp, Mus musculus
tgcactgtggctgcatgcagtcggt

SEQ ID NO: 862717 - DNA, 25 bp, Mus musculus
tgcactgtggtgaaaaatgactgtt

SEQ ID NO: 862718 - DNA, 25 bp, Mus musculus
tgcactgtggtgtaaaatgactgtt

SEQ ID NO: 862719 - DNA, 25 bp, Mus musculus
tgcactgtgtcaaccatgccaaaca

SEQ ID NO: 862720 - DNA, 25 bp, Mus musculus
tgcactgtgtcatccatgccaaaca

SEQ ID NO: 862721 - DNA, 25 bp, Mus musculus
tgcactgttaacctcatagctacca

SEQ ID NO: 862722 - DNA, 25 bp, Mus musculus
tgcactgttaacgtcatagctacca

SEQ ID NO: 862723 - DNA, 25 bp, Mus musculus
tgcactgttagcaggatggcagctt

SEQ ID NO: 862724 - DNA, 25 bp, Mus musculus
tgcactgttagctggatggcagctt

SEQ ID NO: 862725 - DNA, 25 bp, Mus musculus
tgcactgttcacagtatttggagaa

SEQ ID NO: 862726 - DNA, 25 bp, Mus musculus
tgcactgttcactgtatttggagaa

SEQ ID NO: 862727 - DNA, 25 bp, Mus musculus
tgcactgttctgatgaactctgagg

SEQ ID NO: 862728 - DNA, 25 bp, Mus musculus
tgcactgttctgttgaactctgagg

SEQ ID NO: 862729 - DNA, 25 bp, Mus musculus
tgcactgttgtcatgtttcactgat

SEQ ID NO: 862730 - DNA, 25 bp, Mus musculus
tgcactgttgtcttgtttcactgat

SEQ ID NO: 862731 - DNA, 25 bp, Mus musculus
tgcactgttgtgacttgttggccat

SEQ ID NO: 862732 - DNA, 25 bp, Mus musculus
tgcactgttgtgtcttgttggccat

SEQ ID NO: 862733 - DNA, 25 bp, Mus musculus
tgcacttaaatacctgacagcctgt

SEQ ID NO: 862734 - DNA, 25 bp, Mus musculus
tgcacttaaatagctgacagcctgt

SEQ ID NO: 862735 - DNA, 25 bp, Mus musculus
tgcacttaccccaacttcaaaaatg

SEQ ID NO: 862736 - DNA, 25 bp, Mus musculus
tgcacttacccctacttcaaaaatg

SEQ ID NO: 862737 - DNA, 25 bp, Mus musculus
tgcacttactagctttcaattacac

SEQ ID NO: 862738 - DNA, 25 bp, Mus musculus
tgcacttactaggtttcaattacac

SEQ ID NO: 862739 - DNA, 25 bp, Mus musculus
tgcacttagcttctacaccatagag

SEQ ID NO: 862740 - DNA, 25 bp, Mus musculus
tgcacttagcttgtacaccatagag

SEQ ID NO: 862741 - DNA, 25 bp, Mus musculus
tgcacttatgcgatgcttcacttaa

SEQ ID NO: 862742 - DNA, 25 bp, Mus musculus
tgcacttatgcgttgcttcacttaa

SEQ ID NO: 862743 - DNA, 25 bp, Mus musculus
tgcacttattctatccgcagagtct

SEQ ID NO: 862744 - DNA, 25 bp, Mus musculus
tgcacttattctttccgcagagtct

SEQ ID NO: 862745 - DNA, 25 bp, Mus musculus
tgcacttcccccataaatcaataaa

SEQ ID NO: 862746 - DNA, 25 bp, Mus musculus
tgcacttcccccttaaatcaataaa

SEQ ID NO: 862747 - DNA, 25 bp, Mus musculus
tgcacttcgccaattttctataggt

SEQ ID NO: 862748 - DNA, 25 bp, Mus musculus
tgcacttcgccatttttctataggt

SEQ ID NO: 862749 - DNA, 25 bp, Mus musculus
tgcacttcggttacactgtctttct

SEQ ID NO: 862750 - DNA, 25 bp, Mus musculus
tgcacttcggtttcactgtctttct

SEQ ID NO: 862751 - DNA, 25 bp, Mus musculus
tgcacttctcagctacaggcagcag

SEQ ID NO: 862752 - DNA, 25 bp, Mus musculus
tgcacttctcaggtacaggcagcag

SEQ ID NO: 862753 - DNA, 25 bp, Mus musculus
tgcacttgaccacagctgaagctac

SEQ ID NO: 862754 - DNA, 25 bp, Mus musculus
tgcacttgaccagagctgaagctac

SEQ ID NO: 862755 - DNA, 25 bp, Mus musculus
tgcacttgagtaaaaggctttctac

SEQ ID NO: 862756 - DNA, 25 bp, Mus musculus
tgcacttgagtataaggctttctac

SEQ ID NO: 862757 - DNA, 25 bp, Mus musculus
tgcacttgcagactcccatggttca

SEQ ID NO: 862758 - DNA, 25 bp, Mus musculus
tgcacttgcagagtcccatggttca

SEQ ID NO: 862759 - DNA, 25 bp, Mus musculus
tgcacttgcagtacacaagcagttt

SEQ ID NO: 862760 - DNA, 25 bp, Mus musculus
tgcacttgcagttcacaagcagttt

SEQ ID NO: 862761 - DNA, 25 bp, Mus musculus
tgcacttgccggcttttttacatag

SEQ ID NO: 862762 - DNA, 25 bp, Mus musculus
tgcacttgccgggttttttacatag

SEQ ID NO: 862763 - DNA, 25 bp, Mus musculus
tgcacttgcctcatgtgtactggaa

SEQ ID NO: 862764 - DNA, 25 bp, Mus musculus
tgcacttgcctcttgtgtactggaa

SEQ ID NO: 862765 - DNA, 25 bp, Mus musculus
tgcacttgctctagcggcgtgttaa

SEQ ID NO: 862766 - DNA, 25 bp, Mus musculus
tgcacttgctcttgcggcgtgttaa

SEQ ID NO: 862767 - DNA, 25 bp, Mus musculus
tgcacttgctgacattgcacagtca

SEQ ID NO: 862768 - DNA, 25 bp, Mus musculus
tgcacttgctgagattgcacagtca

SEQ ID NO: 862769 - DNA, 25 bp, Mus musculus
tgcacttgctgcactcgggaagaac

SEQ ID NO: 862770 - DNA, 25 bp, Mus musculus
tgcacttgctgctctcgggaagaac

SEQ ID NO: 862771 - DNA, 25 bp, Mus musculus
tgcacttgctttacccataattcat

SEQ ID NO: 862772 - DNA, 25 bp, Mus musculus
tgcacttgcttttcccataattcat

SEQ ID NO: 862773 - DNA, 25 bp, Mus musculus
tgcacttggataaggcctcccagag

SEQ ID NO: 862774 - DNA, 25 bp, Mus musculus
tgcacttggatatggcctcccagag

SEQ ID NO: 862775 - DNA, 25 bp, Mus musculus
tgcacttggtacattggaacgcagt

SEQ ID NO: 862776 - DNA, 25 bp, Mus musculus
tgcacttggtactttggaacgcagt

SEQ ID NO: 862777 - DNA, 25 bp, Mus musculus
tgcacttgtcatcagttacgccagt

SEQ ID NO: 862778 - DNA, 25 bp, Mus musculus
tgcacttgtcatgagttacgccagt

SEQ ID NO: 862779 - DNA, 25 bp, Mus musculus
tgcacttgtgagcccacgtgtgatg

SEQ ID NO: 862780 - DNA, 25 bp, Mus musculus
tgcacttgtgaggccacgtgtgatg

SEQ ID NO: 862781 - DNA, 25 bp, Mus musculus
tgcacttgttacacgctgctagaca

SEQ ID NO: 862782 - DNA, 25 bp, Mus musculus
tgcacttgttactcgctgctagaca

SEQ ID NO: 862783 - DNA, 25 bp, Mus musculus
tgcactttaaccaaggtactattgg

SEQ ID NO: 862784 - DNA, 25 bp, Mus musculus
tgcactttaacctaggtactattgg

SEQ ID NO: 862785 - DNA, 25 bp, Mus musculus
tgcactttaccccagtagccctgaa

SEQ ID NO: 862786 - DNA, 25 bp, Mus musculus
tgcactttacccgagtagccctgaa

SEQ ID NO: 862787 - DNA, 25 bp, Mus musculus
tgcactttagcacaaggactcagag

SEQ ID NO: 862788 - DNA, 25 bp, Mus musculus
tgcactttagcagaaggactcagag

SEQ ID NO: 862789 - DNA, 25 bp, Mus musculus
tgcactttcacccatagcgagtaaa

SEQ ID NO: 862790 - DNA, 25 bp, Mus musculus
tgcactttcaccgatagcgagtaaa

SEQ ID NO: 862791 - DNA, 25 bp, Mus musculus
tgcactttcatcaatgcctcaaacc

SEQ ID NO: 862792 - DNA, 25 bp, Mus musculus
tgcactttcatctatgcctcaaacc

SEQ ID NO: 862793 - DNA, 25 bp, Mus musculus
tgcactttccctacctaaatatgtg

SEQ ID NO: 862794 - DNA, 25 bp, Mus musculus
tgcactttcccttcctaaatatgtg

SEQ ID NO: 862795 - DNA, 25 bp, Mus musculus
tgcactttgaagagatgagcgaaag

SEQ ID NO: 862796 - DNA, 25 bp, Mus musculus
tgcactttgaagtgatgagcgaaag

SEQ ID NO: 862797 - DNA, 25 bp, Mus musculus
tgcactttgactaccacattcatgc

SEQ ID NO: 862798 - DNA, 25 bp, Mus musculus
tgcactttgacttccacattcatgc

SEQ ID NO: 862799 - DNA, 25 bp, Mus musculus
tgcactttgcttaaaaccaatcgta

SEQ ID NO: 862800 - DNA, 25 bp, Mus musculus
tgcactttgcttagctaggagcttt

SEQ ID NO: 862801 - DNA, 25 bp, Mus musculus
tgcactttgctttaaaccaatcgta

SEQ ID NO: 862802 - DNA, 25 bp, Mus musculus
tgcactttgctttgctaggagcttt

SEQ ID NO: 862803 - DNA, 25 bp, Mus musculus
tgcacttttgaaatcccctgcaggt

SEQ ID NO: 862804 - DNA, 25 bp, Mus musculus
tgcacttttgaaccctttggacggt

SEQ ID NO: 862805 - DNA, 25 bp, Mus musculus
tgcacttttgaagcctttggacggt

SEQ ID NO: 862806 - DNA, 25 bp, Mus musculus
tgcacttttgaattcccctgcaggt

SEQ ID NO: 862807 - DNA, 25 bp, Mus musculus
tgcacttttgcaactaacacctcta

SEQ ID NO: 862808 - DNA, 25 bp, Mus musculus
tgcacttttgcatctaacacctcta

SEQ ID NO: 862809 - DNA, 25 bp, Mus musculus
tgcactttttataaagacgcccctc

SEQ ID NO: 862810 - DNA, 25 bp, Mus musculus
tgcactttttattaagacgcccctc

SEQ ID NO: 862811 - DNA, 25 bp, Mus musculus
tgcactttttccagtagatttgtag

SEQ ID NO: 862812 - DNA, 25 bp, Mus musculus
tgcactttttcctgtagatttgtag

SEQ ID NO: 862813 - DNA, 25 bp, Mus musculus
tgcagaaaagccctgtgttccggag

SEQ ID NO: 862814 - DNA, 25 bp, Mus musculus
tgcagaaaagccgtgtgttccggag

SEQ ID NO: 862815 - DNA, 25 bp, Mus musculus
tgcagaaaatcacacgccgtcatcc

SEQ ID NO: 862816 - DNA, 25 bp, Mus musculus
tgcagaaaatcagacgccgtcatcc

SEQ ID NO: 862817 - DNA, 25 bp, Mus musculus
tgcagaaacacaccttttgtccttg

SEQ ID NO: 862818 - DNA, 25 bp, Mus musculus
tgcagaaacacagcttttgtccttg

SEQ ID NO: 862819 - DNA, 25 bp, Mus musculus
tgcagaaagccacccaggagtttac

SEQ ID NO: 862820 - DNA, 25 bp, Mus musculus
tgcagaaagccagccaggagtttac

SEQ ID NO: 862821 - DNA, 25 bp, Mus musculus
tgcagaaagtgactgccaccgccaa

SEQ ID NO: 862822 - DNA, 25 bp, Mus musculus
tgcagaaagtgagtgccaccgccaa

SEQ ID NO: 862823 - DNA, 25 bp, Mus musculus
tgcagaaatctcatcggcccggtca

SEQ ID NO: 862824 - DNA, 25 bp, Mus musculus
tgcagaaatctcttcggcccggtca

SEQ ID NO: 862825 - DNA, 25 bp, Mus musculus
tgcagaaatctgagacccacccata

SEQ ID NO: 862826 - DNA, 25 bp, Mus musculus
tgcagaaatctgtgacccacccata

SEQ ID NO: 862827 - DNA, 25 bp, Mus musculus
tgcagaaattaaagtgatggcccag

SEQ ID NO: 862828 - DNA, 25 bp, Mus musculus
tgcagaaattaatgtgatggcccag

SEQ ID NO: 862829 - DNA, 25 bp, Mus musculus
tgcagaacaagtaggttgggccttt

SEQ ID NO: 862830 - DNA, 25 bp, Mus musculus
tgcagaacaagttggttgggccttt

SEQ ID NO: 862831 - DNA, 25 bp, Mus musculus
tgcagaacatccatggcccactctg

SEQ ID NO: 862832 - DNA, 25 bp, Mus musculus
tgcagaacatccttggcccactctg

SEQ ID NO: 862833 - DNA, 25 bp, Mus musculus
tgcagaaccacaccttcacagagaa

SEQ ID NO: 862834 - DNA, 25 bp, Mus musculus
tgcagaaccacagcttcacagagaa

SEQ ID NO: 862835 - DNA, 25 bp, Mus musculus
tgcagaaccccaaggattcagagga

SEQ ID NO: 862836 - DNA, 25 bp, Mus musculus
tgcagaaccccatggattcagagga

SEQ ID NO: 862837 - DNA, 25 bp, Mus musculus
tgcagaaccctgactatcacaatca

SEQ ID NO: 862838 - DNA, 25 bp, Mus musculus
tgcagaaccctgtctatcacaatca

SEQ ID NO: 862839 - DNA, 25 bp, Mus musculus
tgcagaacccttcactcttgcagac

SEQ ID NO: 862840 - DNA, 25 bp, Mus musculus
tgcagaacccttgactcttgcagac

SEQ ID NO: 862841 - DNA, 25 bp, Mus musculus
tgcagaacctctcagcccaaagtgg

SEQ ID NO: 862842 - DNA, 25 bp, Mus musculus
tgcagaacctctctgttgaccttag

SEQ ID NO: 862843 - DNA, 25 bp, Mus musculus
tgcagaacctctgagcccaaagtgg

SEQ ID NO: 862844 - DNA, 25 bp, Mus musculus
tgcagaacctctgtgttgaccttag

SEQ ID NO: 862845 - DNA, 25 bp, Mus musculus
tgcagaactaatcttttgccttgtt

SEQ ID NO: 862846 - DNA, 25 bp, Mus musculus
tgcagaactaatgttttgccttgtt

SEQ ID NO: 862847 - DNA, 25 bp, Mus musculus
tgcagaactatcacaccgaggccct

SEQ ID NO: 862848 - DNA, 25 bp, Mus musculus
tgcagaactatctcaccgaggccct

SEQ ID NO: 862849 - DNA, 25 bp, Mus musculus
tgcagaactgaacctctgagggcca

SEQ ID NO: 862850 - DNA, 25 bp, Mus musculus
tgcagaactgaagctctgagggcca

SEQ ID NO: 862851 - DNA, 25 bp, Mus musculus
tgcagaactgctacgttgatgagac

SEQ ID NO: 862852 - DNA, 25 bp, Mus musculus
tgcagaactgcttcgttgatgagac

SEQ ID NO: 862853 - DNA, 25 bp, Mus musculus
tgcagaactggacggctttagaccc

SEQ ID NO: 862854 - DNA, 25 bp, Mus musculus
tgcagaactggagggctttagaccc

SEQ ID NO: 862855 - DNA, 25 bp, Mus musculus
tgcagaactgttctgtacctacaga

SEQ ID NO: 862856 - DNA, 25 bp, Mus musculus
tgcagaactgttgtgtacctacaga

SEQ ID NO: 862857 - DNA, 25 bp, Mus musculus
tgcagaacttccagcgcatcttgga

SEQ ID NO: 862858 - DNA, 25 bp, Mus musculus
tgcagaacttcctgcgcatcttgga

SEQ ID NO: 862859 - DNA, 25 bp, Mus musculus
tgcagaacttgcaggtgggccaccc

SEQ ID NO: 862860 - DNA, 25 bp, Mus musculus
tgcagaacttgctggtgggccaccc

SEQ ID NO: 862861 - DNA, 25 bp, Mus musculus
tgcagaagagacaggctgctactca

SEQ ID NO: 862862 - DNA, 25 bp, Mus musculus
tgcagaagagactggctgctactca

SEQ ID NO: 862863 - DNA, 25 bp, Mus musculus
tgcagaagatggaccttgcccttgt

SEQ ID NO: 862864 - DNA, 25 bp, Mus musculus
tgcagaagatggtccttgcccttgt

SEQ ID NO: 862865 - DNA, 25 bp, Mus musculus
tgcagaagcaaaatgaacgccataa

SEQ ID NO: 862866 - DNA, 25 bp, Mus musculus
tgcagaagcaaattgaacgccataa

SEQ ID NO: 862867 - DNA, 25 bp, Mus musculus
tgcagaagcactatcgctgccagtg

SEQ ID NO: 862868 - DNA, 25 bp, Mus musculus
tgcagaagcactttcgctgccagtg

SEQ ID NO: 862869 - DNA, 25 bp, Mus musculus
tgcagaagccagaggttcccttttg

SEQ ID NO: 862870 - DNA, 25 bp, Mus musculus
tgcagaagccagtggttcccttttg

SEQ ID NO: 862871 - DNA, 25 bp, Mus musculus
tgcagaagcctaccctttacggtta

SEQ ID NO: 862872 - DNA, 25 bp, Mus musculus
tgcagaagcctagcctttacggtta

SEQ ID NO: 862873 - DNA, 25 bp, Mus musculus
tgcagaagcggcacgcgcgagtcac

SEQ ID NO: 862874 - DNA, 25 bp, Mus musculus
tgcagaagcggctcgcgcgagtcac

SEQ ID NO: 862875 - DNA, 25 bp, Mus musculus
tgcagaagcgtgatgtatggcccag

SEQ ID NO: 862876 - DNA, 25 bp, Mus musculus
tgcagaagcgtgttgtatggcccag

SEQ ID NO: 862877 - DNA, 25 bp, Mus musculus
tgcagaagcgttctggctcacccct

SEQ ID NO: 862878 - DNA, 25 bp, Mus musculus
tgcagaagcgttgtggctcacccct

SEQ ID NO: 862879 - DNA, 25 bp, Mus musculus
tgcagaagctggcatgtacttaagt

SEQ ID NO: 862880 - DNA, 25 bp, Mus musculus
tgcagaagctgggatgtacttaagt

SEQ ID NO: 862881 - DNA, 25 bp, Mus musculus
tgcagaaggaaaatgcttcctttgt

SEQ ID NO: 862882 - DNA, 25 bp, Mus musculus
tgcagaaggaaattgcttcctttgt

SEQ ID NO: 862883 - DNA, 25 bp, Mus musculus
tgcagaaggactagccctggccaga

SEQ ID NO: 862884 - DNA, 25 bp, Mus musculus
tgcagaaggacttgccctggccaga

SEQ ID NO: 862885 - DNA, 25 bp, Mus musculus
tgcagaaggagcaaggatgtcctca

SEQ ID NO: 862886 - DNA, 25 bp, Mus musculus
tgcagaaggagctaggatgtcctca

SEQ ID NO: 862887 - DNA, 25 bp, Mus musculus
tgcagaagggcaagctccagctcct

SEQ ID NO: 862888 - DNA, 25 bp, Mus musculus
tgcagaagggcatgctccagctcct

SEQ ID NO: 862889 - DNA, 25 bp, Mus musculus
tgcagaagtaacacaagccccttag

SEQ ID NO: 862890 - DNA, 25 bp, Mus musculus
tgcagaagtaactcaagccccttag

SEQ ID NO: 862891 - DNA, 25 bp, Mus musculus
tgcagaagtctcaggcggctgccac

SEQ ID NO: 862892 - DNA, 25 bp, Mus musculus
tgcagaagtctctggcggctgccac

SEQ ID NO: 862893 - DNA, 25 bp, Mus musculus
tgcagaagtggtatgagcccaccct

SEQ ID NO: 862894 - DNA, 25 bp, Mus musculus
tgcagaagtggtttgagcccaccct

SEQ ID NO: 862895 - DNA, 25 bp, Mus musculus
tgcagaataaggcacttccaagttt

SEQ ID NO: 862896 - DNA, 25 bp, Mus musculus
tgcagaataaggctgtggacgacat

SEQ ID NO: 862897 - DNA, 25 bp, Mus musculus
tgcagaataagggacttccaagttt

SEQ ID NO: 862898 - DNA, 25 bp, Mus musculus
tgcagaataagggtgtggacgacat

SEQ ID NO: 862899 - DNA, 25 bp, Mus musculus
tgcagaatacccaatatttaggaat

SEQ ID NO: 862900 - DNA, 25 bp, Mus musculus
tgcagaataccctatatttaggaat

SEQ ID NO: 862901 - DNA, 25 bp, Mus musculus
tgcagaatatctacatctaccccaa

SEQ ID NO: 862902 - DNA, 25 bp, Mus musculus
tgcagaatatcttcatctaccccaa

SEQ ID NO: 862903 - DNA, 25 bp, Mus musculus
tgcagaatccccattaccttcagta

SEQ ID NO: 862904 - DNA, 25 bp, Mus musculus
tgcagaatcccctttaccttcagta

SEQ ID NO: 862905 - DNA, 25 bp, Mus musculus
tgcagaatcgaaccagcttacggat

SEQ ID NO: 862906 - DNA, 25 bp, Mus musculus
tgcagaatcgaagcagcttacggat

SEQ ID NO: 862907 - DNA, 25 bp, Mus musculus
tgcagaatcggcaggcgcatgcgaa

SEQ ID NO: 862908 - DNA, 25 bp, Mus musculus
tgcagaatcggctggcgcatgcgaa

SEQ ID NO: 862909 - DNA, 25 bp, Mus musculus
tgcagaatctccactccgaggaaag

SEQ ID NO: 862910 - DNA, 25 bp, Mus musculus
tgcagaatctcctctccgaggaaag

SEQ ID NO: 862911 - DNA, 25 bp, Mus musculus
tgcagaatgagcatcgtcctcagac

SEQ ID NO: 862912 - DNA, 25 bp, Mus musculus
tgcagaatgagcttcgtcctcagac

SEQ ID NO: 862913 - DNA, 25 bp, Mus musculus
tgcagaatgcagaccctagtgggct

SEQ ID NO: 862914 - DNA, 25 bp, Mus musculus
tgcagaatgcagtccctagtgggct

SEQ ID NO: 862915 - DNA, 25 bp, Mus musculus
tgcagaatgctcaacatgaccctct

SEQ ID NO: 862916 - DNA, 25 bp, Mus musculus
tgcagaatgctctacatgaccctct

SEQ ID NO: 862917 - DNA, 25 bp, Mus musculus
tgcagaattcatcctacccagtatt

SEQ ID NO: 862918 - DNA, 25 bp, Mus musculus
tgcagaattcatgctacccagtatt

SEQ ID NO: 862919 - DNA, 25 bp, Mus musculus
tgcagaatttcaagtctcccgttcg

SEQ ID NO: 862920 - DNA, 25 bp, Mus musculus
tgcagaatttcatgtctcccgttcg

SEQ ID NO: 862921 - DNA, 25 bp, Mus musculus
tgcagacaagaaaccggacaggcct

SEQ ID NO: 862922 - DNA, 25 bp, Mus musculus
tgcagacaagaatccggacaggcct

SEQ ID NO: 862923 - DNA, 25 bp, Mus musculus
tgcagacaagcaagggttttaaagt

SEQ ID NO: 862924 - DNA, 25 bp, Mus musculus
tgcagacaagcatgggttttaaagt

SEQ ID NO: 862925 - DNA, 25 bp, Mus musculus
tgcagacaagtgacttctccatgcg

SEQ ID NO: 862926 - DNA, 25 bp, Mus musculus
tgcagacaagtgtcttctccatgcg

SEQ ID NO: 862927 - DNA, 25 bp, Mus musculus
tgcagacacagtaatacctgccttt

SEQ ID NO: 862928 - DNA, 25 bp, Mus musculus
tgcagacacagtatcagaacgaaac

SEQ ID NO: 862929 - DNA, 25 bp, Mus musculus
tgcagacacagttatacctgccttt

SEQ ID NO: 862930 - DNA, 25 bp, Mus musculus
tgcagacacagtttcagaacgaaac

SEQ ID NO: 862931 - DNA, 25 bp, Mus musculus
tgcagacacatgacagggcactttt

SEQ ID NO: 862932 - DNA, 25 bp, Mus musculus
tgcagacacatgtcagggcactttt

SEQ ID NO: 862933 - DNA, 25 bp, Mus musculus
tgcagacactacatgtggcaatgac

SEQ ID NO: 862934 - DNA, 25 bp, Mus musculus
tgcagacactacttgtggcaatgac

SEQ ID NO: 862935 - DNA, 25 bp, Mus musculus
tgcagacagagaccgcttagtgcgt

SEQ ID NO: 862936 - DNA, 25 bp, Mus musculus
tgcagacagagagcgcttagtgcgt

SEQ ID NO: 862937 - DNA, 25 bp, Mus musculus
tgcagacagagtatcttttccttct

SEQ ID NO: 862938 - DNA, 25 bp, Mus musculus
tgcagacagagtttcttttccttct

SEQ ID NO: 862939 - DNA, 25 bp, Mus musculus
tgcagacagattccaacaccttaac

SEQ ID NO: 862940 - DNA, 25 bp, Mus musculus
tgcagacagattgcaacaccttaac

SEQ ID NO: 862941 - DNA, 25 bp, Mus musculus
tgcagacagcctcggaagactattg

SEQ ID NO: 862942 - DNA, 25 bp, Mus musculus
tgcagacagcctgggaagactattg

SEQ ID NO: 862943 - DNA, 25 bp, Mus musculus
tgcagacaggacaccatcacaggat

SEQ ID NO: 862944 - DNA, 25 bp, Mus musculus
tgcagacaggactccatcacaggat

SEQ ID NO: 862945 - DNA, 25 bp, Mus musculus
tgcagacagtaaacaccaccacagt

SEQ ID NO: 862946 - DNA, 25 bp, Mus musculus
tgcagacagtaatcaccaccacagt

SEQ ID NO: 862947 - DNA, 25 bp, Mus musculus
tgcagacagttgatgagcacactaa

SEQ ID NO: 862948 - DNA, 25 bp, Mus musculus
tgcagacagttgttgagcacactaa

SEQ ID NO: 862949 - DNA, 25 bp, Mus musculus
tgcagacattgtccagttgctactg

SEQ ID NO: 862950 - DNA, 25 bp, Mus musculus
tgcagacattgtgcagttgctactg

SEQ ID NO: 862951 - DNA, 25 bp, Mus musculus
tgcagacatttgaactccaaccatt

SEQ ID NO: 862952 - DNA, 25 bp, Mus musculus
tgcagacatttgtactccaaccatt

SEQ ID NO: 862953 - DNA, 25 bp, Mus musculus
tgcagaccaaaaacctccagtgtta

SEQ ID NO: 862954 - DNA, 25 bp, Mus musculus
tgcagaccaaaatcctccagtgtta

SEQ ID NO: 862955 - DNA, 25 bp, Mus musculus
tgcagaccagggagctcagtcgctg

SEQ ID NO: 862956 - DNA, 25 bp, Mus musculus
tgcagaccagggtgctcagtcgctg

SEQ ID NO: 862957 - DNA, 25 bp, Mus musculus
tgcagaccatccaaccatcaagtgt

SEQ ID NO: 862958 - DNA, 25 bp, Mus musculus
tgcagaccatcctaccatcaagtgt

SEQ ID NO: 862959 - DNA, 25 bp, Mus musculus
tgcagacccaatcaccgcaggtcag

SEQ ID NO: 862960 - DNA, 25 bp, Mus musculus
tgcagacccaatgaccgcaggtcag

SEQ ID NO: 862961 - DNA, 25 bp, Mus musculus
tgcagacccagaacagcgactggta

SEQ ID NO: 862962 - DNA, 25 bp, Mus musculus
tgcagacccagatcagcgactggta

SEQ ID NO: 862963 - DNA, 25 bp, Mus musculus
tgcagaccccggattctattttgca

SEQ ID NO: 862964 - DNA, 25 bp, Mus musculus
tgcagaccccggtttctattttgca

SEQ ID NO: 862965 - DNA, 25 bp, Mus musculus
tgcagacccctgataacctgtcggt

SEQ ID NO: 862966 - DNA, 25 bp, Mus musculus
tgcagacccctgttaacctgtcggt

SEQ ID NO: 862967 - DNA, 25 bp, Mus musculus
tgcagacccgaaccactggatatgt

SEQ ID NO: 862968 - DNA, 25 bp, Mus musculus
tgcagacccgaagcactggatatgt

SEQ ID NO: 862969 - DNA, 25 bp, Mus musculus
tgcagaccgcagatgggttacctgt

SEQ ID NO: 862970 - DNA, 25 bp, Mus musculus
tgcagaccgcagttgggttacctgt

SEQ ID NO: 862971 - DNA, 25 bp, Mus musculus
tgcagaccgtccaggaggctgtgat

SEQ ID NO: 862972 - DNA, 25 bp, Mus musculus
tgcagaccgtcctggaggctgtgat

SEQ ID NO: 862973 - DNA, 25 bp, Mus musculus
tgcagacctaccagcctgtgaggaa

SEQ ID NO: 862974 - DNA, 25 bp, Mus musculus
tgcagacctacctgcctgtgaggaa

SEQ ID NO: 862975 - DNA, 25 bp, Mus musculus
tgcagacctcggatgttgagcattt

SEQ ID NO: 862976 - DNA, 25 bp, Mus musculus
tgcagacctcggttgttgagcattt

SEQ ID NO: 862977 - DNA, 25 bp, Mus musculus
tgcagacctgaactccatggaaaag

SEQ ID NO: 862978 - DNA, 25 bp, Mus musculus
tgcagacctgaagtccatggaaaag

SEQ ID NO: 862979 - DNA, 25 bp, Mus musculus
tgcagacctgctcgacaagatgctg

SEQ ID NO: 862980 - DNA, 25 bp, Mus musculus
tgcagacctgctggacaagatgctg

SEQ ID NO: 862981 - DNA, 25 bp, Mus musculus
tgcagacctggcaatggcgttcagc

SEQ ID NO: 862982 - DNA, 25 bp, Mus musculus
tgcagacctggctatggcgttcagc

SEQ ID NO: 862983 - DNA, 25 bp, Mus musculus
tgcagacgctccaggaacggcagat

SEQ ID NO: 862984 - DNA, 25 bp, Mus musculus
tgcagacgctcctggaacggcagat

SEQ ID NO: 862985 - DNA, 25 bp, Mus musculus
tgcagacgtgctctgaaattcagtt

SEQ ID NO: 862986 - DNA, 25 bp, Mus musculus
tgcagacgtgctgtgaaattcagtt

SEQ ID NO: 862987 - DNA, 25 bp, Mus musculus
tgcagactaaacaggccgccatgga

SEQ ID NO: 862988 - DNA, 25 bp, Mus musculus
tgcagactaaacagggaggcgctct

SEQ ID NO: 862989 - DNA, 25 bp, Mus musculus
tgcagactaaactggccgccatgga

SEQ ID NO: 862990 - DNA, 25 bp, Mus musculus
tgcagactaaactgggaggcgctct

SEQ ID NO: 862991 - DNA, 25 bp, Mus musculus
tgcagactcaaacgtgtccccagac

SEQ ID NO: 862992 - DNA, 25 bp, Mus musculus
tgcagactcaaaggtgtccccagac

SEQ ID NO: 862993 - DNA, 25 bp, Mus musculus
tgcagactccctatccatgtggatt

SEQ ID NO: 862994 - DNA, 25 bp, Mus musculus
tgcagactccctttccatgtggatt

SEQ ID NO: 862995 - DNA, 25 bp, Mus musculus
tgcagactccttcgaccacaaaaag

SEQ ID NO: 862996 - DNA, 25 bp, Mus musculus
tgcagactccttggaccacaaaaag

SEQ ID NO: 862997 - DNA, 25 bp, Mus musculus
tgcagactcgagaggccggatgcct

SEQ ID NO: 862998 - DNA, 25 bp, Mus musculus
tgcagactcgagtggccggatgcct

SEQ ID NO: 862999 - DNA, 25 bp, Mus musculus
tgcagactctcaagtggtgcaataa

SEQ ID NO: 863000 - DNA, 25 bp, Mus musculus
tgcagactctcatgtggtgcaataa

SEQ ID NO: 863001 - DNA, 25 bp, Mus musculus
tgcagactctcccatggttgctgtt

SEQ ID NO: 863002 - DNA, 25 bp, Mus musculus
tgcagactctccgatggttgctgtt

SEQ ID NO: 863003 - DNA, 25 bp, Mus musculus
tgcagactctgcctgggacttgtga

SEQ ID NO: 863004 - DNA, 25 bp, Mus musculus
tgcagactctgcgtgggacttgtga

SEQ ID NO: 863005 - DNA, 25 bp, Mus musculus
tgcagactgaagatttgcccgacat

SEQ ID NO: 863006 - DNA, 25 bp, Mus musculus
tgcagactgaagttttgcccgacat

SEQ ID NO: 863007 - DNA, 25 bp, Mus musculus
tgcagactgcagaggatgacactca

SEQ ID NO: 863008 - DNA, 25 bp, Mus musculus
tgcagactgcagctgcgtgctaccg

SEQ ID NO: 863009 - DNA, 25 bp, Mus musculus
tgcagactgcaggtgcgtgctaccg

SEQ ID NO: 863010 - DNA, 25 bp, Mus musculus
tgcagactgcagtggatgacactca

SEQ ID NO: 863011 - DNA, 25 bp, Mus musculus
tgcagactggaaagggaccccatcc

SEQ ID NO: 863012 - DNA, 25 bp, Mus musculus
tgcagactggaatgggaccccatcc

SEQ ID NO: 863013 - DNA, 25 bp, Mus musculus
tgcagactggagcattctgctcttt

SEQ ID NO: 863014 - DNA, 25 bp, Mus musculus
tgcagactggaggattctgctcttt

SEQ ID NO: 863015 - DNA, 25 bp, Mus musculus
tgcagactggatacgcatcagtgag

SEQ ID NO: 863016 - DNA, 25 bp, Mus musculus
tgcagactggattcgcatcagtgag

SEQ ID NO: 863017 - DNA, 25 bp, Mus musculus
tgcagactggcgaggcccaggcatc

SEQ ID NO: 863018 - DNA, 25 bp, Mus musculus
tgcagactggcgtggcccaggcatc

SEQ ID NO: 863019 - DNA, 25 bp, Mus musculus
tgcagactgtttattggatccccaa

SEQ ID NO: 863020 - DNA, 25 bp, Mus musculus
tgcagactgttttttggatccccaa

SEQ ID NO: 863021 - DNA, 25 bp, Mus musculus
tgcagacttaagcacactcttcatc

SEQ ID NO: 863022 - DNA, 25 bp, Mus musculus
tgcagacttaaggacactcttcatc

SEQ ID NO: 863023 - DNA, 25 bp, Mus musculus
tgcagacttatgatgacctggtggc

SEQ ID NO: 863024 - DNA, 25 bp, Mus musculus
tgcagacttatgttgacctggtggc

SEQ ID NO: 863025 - DNA, 25 bp, Mus musculus
tgcagacttctaagattttaggagt

SEQ ID NO: 863026 - DNA, 25 bp, Mus musculus
tgcagacttctatgattttaggagt

SEQ ID NO: 863027 - DNA, 25 bp, Mus musculus
tgcagacttgttcgctgtaggctta

SEQ ID NO: 863028 - DNA, 25 bp, Mus musculus
tgcagacttgttggctgtaggctta

SEQ ID NO: 863029 - DNA, 25 bp, Mus musculus
tgcagagaatctcgcttcctaagat

SEQ ID NO: 863030 - DNA, 25 bp, Mus musculus
tgcagagaatctggcttcctaagat

SEQ ID NO: 863031 - DNA, 25 bp, Mus musculus
tgcagagacaggctcagctgcctca

SEQ ID NO: 863032 - DNA, 25 bp, Mus musculus
tgcagagacagggtcagctgcctca

SEQ ID NO: 863033 - DNA, 25 bp, Mus musculus
tgcagagaccagcaagtatgcccca

SEQ ID NO: 863034 - DNA, 25 bp, Mus musculus
tgcagagaccaggaagtatgcccca

SEQ ID NO: 863035 - DNA, 25 bp, Mus musculus
tgcagagacccaccctgaggctggc

SEQ ID NO: 863036 - DNA, 25 bp, Mus musculus
tgcagagacccagcctgaggctggc

SEQ ID NO: 863037 - DNA, 25 bp, Mus musculus
tgcagagaccgcaacatcagaagat

SEQ ID NO: 863038 - DNA, 25 bp, Mus musculus
tgcagagaccgctacatcagaagat

SEQ ID NO: 863039 - DNA, 25 bp, Mus musculus
tgcagagactcacccgttgtcatga

SEQ ID NO: 863040 - DNA, 25 bp, Mus musculus
tgcagagactcactagggcggaact

SEQ ID NO: 863041 - DNA, 25 bp, Mus musculus
tgcagagactcagccgttgtcatga

SEQ ID NO: 863042 - DNA, 25 bp, Mus musculus
tgcagagactcagtagggcggaact

SEQ ID NO: 863043 - DNA, 25 bp, Mus musculus
tgcagagactctatcgggcttttcg

SEQ ID NO: 863044 - DNA, 25 bp, Mus musculus
tgcagagactctttcgggcttttcg

SEQ ID NO: 863045 - DNA, 25 bp, Mus musculus
tgcagagacttaaagtgccagagtg

SEQ ID NO: 863046 - DNA, 25 bp, Mus musculus
tgcagagacttatagtgccagagtg

SEQ ID NO: 863047 - DNA, 25 bp, Mus musculus
tgcagagagctgaagccctggtcta

SEQ ID NO: 863048 - DNA, 25 bp, Mus musculus
tgcagagagctgtagccctggtcta

SEQ ID NO: 863049 - DNA, 25 bp, Mus musculus
tgcagagaggagattgggtttgtac

SEQ ID NO: 863050 - DNA, 25 bp, Mus musculus
tgcagagaggagtttgggtttgtac

SEQ ID NO: 863051 - DNA, 25 bp, Mus musculus
tgcagagaggtaccttcagactcaa

SEQ ID NO: 863052 - DNA, 25 bp, Mus musculus
tgcagagaggtagcttcagactcaa

SEQ ID NO: 863053 - DNA, 25 bp, Mus musculus
tgcagagaggtgacttttaacttca

SEQ ID NO: 863054 - DNA, 25 bp, Mus musculus
tgcagagaggtgtcttttaacttca

SEQ ID NO: 863055 - DNA, 25 bp, Mus musculus
tgcagagatgcacacaagccacagt

SEQ ID NO: 863056 - DNA, 25 bp, Mus musculus
tgcagagatgcagacaagccacagt

SEQ ID NO: 863057 - DNA, 25 bp, Mus musculus
tgcagagattccaccgaggcgagat

SEQ ID NO: 863058 - DNA, 25 bp, Mus musculus
tgcagagattcctccgaggcgagat

SEQ ID NO: 863059 - DNA, 25 bp, Mus musculus
tgcagagatttcaagcagctgtttg

SEQ ID NO: 863060 - DNA, 25 bp, Mus musculus
tgcagagatttctagcagctgtttg

SEQ ID NO: 863061 - DNA, 25 bp, Mus musculus
tgcagagcaaggagaagggcaacac

SEQ ID NO: 863062 - DNA, 25 bp, Mus musculus
tgcagagcaaggtgaagggcaacac

SEQ ID NO: 863063 - DNA, 25 bp, Mus musculus
tgcagagcacagaatgtcatttcgt

SEQ ID NO: 863064 - DNA, 25 bp, Mus musculus
tgcagagcacagtatgtcatttcgt

SEQ ID NO: 863065 - DNA, 25 bp, Mus musculus
tgcagagcagaaccatggtgttgaa

SEQ ID NO: 863066 - DNA, 25 bp, Mus musculus
tgcagagcagaagcatggtgttgaa

SEQ ID NO: 863067 - DNA, 25 bp, Mus musculus
tgcagagcagacaagctgccttctg

SEQ ID NO: 863068 - DNA, 25 bp, Mus musculus
tgcagagcagactagctgccttctg

SEQ ID NO: 863069 - DNA, 25 bp, Mus musculus
tgcagagccactcatcaacttggat

SEQ ID NO: 863070 - DNA, 25 bp, Mus musculus
tgcagagccactgatcaacttggat

SEQ ID NO: 863071 - DNA, 25 bp, Mus musculus
tgcagagcccagaatggttccttcc

SEQ ID NO: 863072 - DNA, 25 bp, Mus musculus
tgcagagcccagagacaagggcgac

SEQ ID NO: 863073 - DNA, 25 bp, Mus musculus
tgcagagcccagtatggttccttcc

SEQ ID NO: 863074 - DNA, 25 bp, Mus musculus
tgcagagcccagtgacaagggcgac

SEQ ID NO: 863075 - DNA, 25 bp, Mus musculus
tgcagagcccatctggccaatcacg

SEQ ID NO: 863076 - DNA, 25 bp, Mus musculus
tgcagagcccatgtggccaatcacg

SEQ ID NO: 863077 - DNA, 25 bp, Mus musculus
tgcagagccccaactgtaaccagag

SEQ ID NO: 863078 - DNA, 25 bp, Mus musculus
tgcagagccccatctgtaaccagag

SEQ ID NO: 863079 - DNA, 25 bp, Mus musculus
tgcagagccctactgtgtttttatg

SEQ ID NO: 863080 - DNA, 25 bp, Mus musculus
tgcagagccctagtgtgtttttatg

SEQ ID NO: 863081 - DNA, 25 bp, Mus musculus
tgcagagccgccaggacgagaacca

SEQ ID NO: 863082 - DNA, 25 bp, Mus musculus
tgcagagccgcctggacgagaacca

SEQ ID NO: 863083 - DNA, 25 bp, Mus musculus
tgcagagcctcgctgtttataacag

SEQ ID NO: 863084 - DNA, 25 bp, Mus musculus
tgcagagcctcggtgtttataacag

SEQ ID NO: 863085 - DNA, 25 bp, Mus musculus
tgcagagcgaagagactcacgccat

SEQ ID NO: 863086 - DNA, 25 bp, Mus musculus
tgcagagcgaagtgactcacgccat

SEQ ID NO: 863087 - DNA, 25 bp, Mus musculus
tgcagagcgaccagcacagtggact

SEQ ID NO: 863088 - DNA, 25 bp, Mus musculus
tgcagagcgacctgcacagtggact

SEQ ID NO: 863089 - DNA, 25 bp, Mus musculus
tgcagagcgcgtatgcaccagccag

SEQ ID NO: 863090 - DNA, 25 bp, Mus musculus
tgcagagcgcgtttgcaccagccag

SEQ ID NO: 863091 - DNA, 25 bp, Mus musculus
tgcagagcggccagaccatcgcgct

SEQ ID NO: 863092 - DNA, 25 bp, Mus musculus
tgcagagcggcctgaccatcgcgct

SEQ ID NO: 863093 - DNA, 25 bp, Mus musculus
tgcagagctaagcagtgcccactgg

SEQ ID NO: 863094 - DNA, 25 bp, Mus musculus
tgcagagctaaggagtgcccactgg

SEQ ID NO: 863095 - DNA, 25 bp, Mus musculus
tgcagagctaccactacccattgtc

SEQ ID NO: 863096 - DNA, 25 bp, Mus musculus
tgcagagctacctctacccattgtc

SEQ ID NO: 863097 - DNA, 25 bp, Mus musculus
tgcagagctgcaacgacttattcaa

SEQ ID NO: 863098 - DNA, 25 bp, Mus musculus
tgcagagctgcatcgacttattcaa

SEQ ID NO: 863099 - DNA, 25 bp, Mus musculus
tgcagagctgtgacatagccttatt

SEQ ID NO: 863100 - DNA, 25 bp, Mus musculus
tgcagagctgtgtcatagccttatt

SEQ ID NO: 863101 - DNA, 25 bp, Mus musculus
tgcagagctgttcctgtgcgtgcca

SEQ ID NO: 863102 - DNA, 25 bp, Mus musculus
tgcagagctgttccttttaattgta

SEQ ID NO: 863103 - DNA, 25 bp, Mus musculus
tgcagagctgttcgtatttatgcct

SEQ ID NO: 863104 - DNA, 25 bp, Mus musculus
tgcagagctgttgctgtgcgtgcca

SEQ ID NO: 863105 - DNA, 25 bp, Mus musculus
tgcagagctgttgcttttaattgta

SEQ ID NO: 863106 - DNA, 25 bp, Mus musculus
tgcagagctgttggtatttatgcct

SEQ ID NO: 863107 - DNA, 25 bp, Mus musculus
tgcagagcttgaagtccccacttta

SEQ ID NO: 863108 - DNA, 25 bp, Mus musculus
tgcagagcttgatgtccccacttta

SEQ ID NO: 863109 - DNA, 25 bp, Mus musculus
tgcagaggaatgcatgtccctggtc

SEQ ID NO: 863110 - DNA, 25 bp, Mus musculus
tgcagaggaatggatgtccctggtc

SEQ ID NO: 863111 - DNA, 25 bp, Mus musculus
tgcagaggaggcaacggctcacaat

SEQ ID NO: 863112 - DNA, 25 bp, Mus musculus
tgcagaggaggctacggctcacaat

SEQ ID NO: 863113 - DNA, 25 bp, Mus musculus
tgcagaggatgcagccaccaaggca

SEQ ID NO: 863114 - DNA, 25 bp, Mus musculus
tgcagaggatgctgccaccaaggca

SEQ ID NO: 863115 - DNA, 25 bp, Mus musculus
tgcagaggccaacagatttatccgt

SEQ ID NO: 863116 - DNA, 25 bp, Mus musculus
tgcagaggccaagagatttatccgt

SEQ ID NO: 863117 - DNA, 25 bp, Mus musculus
tgcagaggctcaacaaatcccgagg

SEQ ID NO: 863118 - DNA, 25 bp, Mus musculus
tgcagaggctcatcaaatcccgagg

SEQ ID NO: 863119 - DNA, 25 bp, Mus musculus
tgcagaggctcccatgagtattcat

SEQ ID NO: 863120 - DNA, 25 bp, Mus musculus
tgcagaggctccgatgagtattcat

SEQ ID NO: 863121 - DNA, 25 bp, Mus musculus
tgcagagggctaagacaggaccgca

SEQ ID NO: 863122 - DNA, 25 bp, Mus musculus
tgcagagggctatgacaggaccgca

SEQ ID NO: 863123 - DNA, 25 bp, Mus musculus
tgcagagggctcagccccgagatga

SEQ ID NO: 863124 - DNA, 25 bp, Mus musculus
tgcagagggctctgccccgagatga

SEQ ID NO: 863125 - DNA, 25 bp, Mus musculus
tgcagaggtcccacagagggtctga

SEQ ID NO: 863126 - DNA, 25 bp, Mus musculus
tgcagaggtcccatctggttcctga

SEQ ID NO: 863127 - DNA, 25 bp, Mus musculus
tgcagaggtccctcagagggtctga

SEQ ID NO: 863128 - DNA, 25 bp, Mus musculus
tgcagaggtcccttctggttcctga

SEQ ID NO: 863129 - DNA, 25 bp, Mus musculus
tgcagaggtctcaatgggtgaccct

SEQ ID NO: 863130 - DNA, 25 bp, Mus musculus
tgcagaggtctcacaaagtgggagc

SEQ ID NO: 863131 - DNA, 25 bp, Mus musculus
tgcagaggtctctatgggtgaccct

SEQ ID NO: 863132 - DNA, 25 bp, Mus musculus
tgcagaggtctctcaaagtgggagc

SEQ ID NO: 863133 - DNA, 25 bp, Mus musculus
tgcagaggtggtccggcctgcgctc

SEQ ID NO: 863134 - DNA, 25 bp, Mus musculus
tgcagaggtggtgcggcctgcgctc

SEQ ID NO: 863135 - DNA, 25 bp, Mus musculus
tgcagagtagcacgaagtgtacaca

SEQ ID NO: 863136 - DNA, 25 bp, Mus musculus
tgcagagtagcaggaagtgtacaca

SEQ ID NO: 863137 - DNA, 25 bp, Mus musculus
tgcagagtcgtcatgccatgcagct

SEQ ID NO: 863138 - DNA, 25 bp, Mus musculus
tgcagagtcgtcttgccatgcagct

SEQ ID NO: 863139 - DNA, 25 bp, Mus musculus
tgcagagtctccaggtttctgtctc

SEQ ID NO: 863140 - DNA, 25 bp, Mus musculus
tgcagagtctcctggtttctgtctc

SEQ ID NO: 863141 - DNA, 25 bp, Mus musculus
tgcagagtctctctggcgtacctgg

SEQ ID NO: 863142 - DNA, 25 bp, Mus musculus
tgcagagtctctgtggcgtacctgg

SEQ ID NO: 863143 - DNA, 25 bp, Mus musculus
tgcagagtcttgacattccagcctg

SEQ ID NO: 863144 - DNA, 25 bp, Mus musculus
tgcagagtcttgtcattccagcctg

SEQ ID NO: 863145 - DNA, 25 bp, Mus musculus
tgcagagtgagtatcgctacaaggc

SEQ ID NO: 863146 - DNA, 25 bp, Mus musculus
tgcagagtgagtttcgctacaaggc

SEQ ID NO: 863147 - DNA, 25 bp, Mus musculus
tgcagagtggtcatctgtgagcctt

SEQ ID NO: 863148 - DNA, 25 bp, Mus musculus
tgcagagtggtcttctgtgagcctt

SEQ ID NO: 863149 - DNA, 25 bp, Mus musculus
tgcagagttcagacctaggagtgaa

SEQ ID NO: 863150 - DNA, 25 bp, Mus musculus
tgcagagttcagtcctaggagtgaa

SEQ ID NO: 863151 - DNA, 25 bp, Mus musculus
tgcagagttctacgtacaccacccg

SEQ ID NO: 863152 - DNA, 25 bp, Mus musculus
tgcagagttctaggtacaccacccg

SEQ ID NO: 863153 - DNA, 25 bp, Mus musculus
tgcagagttctgaccttatatgttc

SEQ ID NO: 863154 - DNA, 25 bp, Mus musculus
tgcagagttctgtccttatatgttc

SEQ ID NO: 863155 - DNA, 25 bp, Mus musculus
tgcagataaaccctctgccctatag

SEQ ID NO: 863156 - DNA, 25 bp, Mus musculus
tgcagataaaccgtctgccctatag

SEQ ID NO: 863157 - DNA, 25 bp, Mus musculus
tgcagataaccaccaccaactaatg

SEQ ID NO: 863158 - DNA, 25 bp, Mus musculus
tgcagataaccagcaccaactaatg

SEQ ID NO: 863159 - DNA, 25 bp, Mus musculus
tgcagatcagaacagggtccaccta

SEQ ID NO: 863160 - DNA, 25 bp, Mus musculus
tgcagatcagaagagggtccaccta

SEQ ID NO: 863161 - DNA, 25 bp, Mus musculus
tgcagatcccatcccagctcataag

SEQ ID NO: 863162 - DNA, 25 bp, Mus musculus
tgcagatcccatgccagctcataag

SEQ ID NO: 863163 - DNA, 25 bp, Mus musculus
tgcagatcctcacctgccgtttttt

SEQ ID NO: 863164 - DNA, 25 bp, Mus musculus
tgcagatcctcagctgccgtttttt

SEQ ID NO: 863165 - DNA, 25 bp, Mus musculus
tgcagatcctgcctgtatttttgtc

SEQ ID NO: 863166 - DNA, 25 bp, Mus musculus
tgcagatcctgcgtgtatttttgtc

SEQ ID NO: 863167 - DNA, 25 bp, Mus musculus
tgcagatcctttactaccgagttct

SEQ ID NO: 863168 - DNA, 25 bp, Mus musculus
tgcagatccttttctaccgagttct

SEQ ID NO: 863169 - DNA, 25 bp, Mus musculus
tgcagatctaagacgctccgtacag

SEQ ID NO: 863170 - DNA, 25 bp, Mus musculus
tgcagatctaagtcgctccgtacag

SEQ ID NO: 863171 - DNA, 25 bp, Mus musculus
tgcagatctctgaaaacagacctgt

SEQ ID NO: 863172 - DNA, 25 bp, Mus musculus
tgcagatctctgtaaacagacctgt

SEQ ID NO: 863173 - DNA, 25 bp, Mus musculus
tgcagatctgcaatcgctcactggt

SEQ ID NO: 863174 - DNA, 25 bp, Mus musculus
tgcagatctgcattcgctcactggt

SEQ ID NO: 863175 - DNA, 25 bp, Mus musculus
tgcagatcttcgaggttatcatctc

SEQ ID NO: 863176 - DNA, 25 bp, Mus musculus
tgcagatcttcgtggttatcatctc

SEQ ID NO: 863177 - DNA, 25 bp, Mus musculus
tgcagatgaactatttagccctcca

SEQ ID NO: 863178 - DNA, 25 bp, Mus musculus
tgcagatgaactttttagccctcca

SEQ ID NO: 863179 - DNA, 25 bp, Mus musculus
tgcagatgcacacatataggccaca

SEQ ID NO: 863180 - DNA, 25 bp, Mus musculus
tgcagatgcacagatataggccaca

SEQ ID NO: 863181 - DNA, 25 bp, Mus musculus
tgcagatgcatcagcaggccagcta

SEQ ID NO: 863182 - DNA, 25 bp, Mus musculus
tgcagatgcatctgcaggccagcta

SEQ ID NO: 863183 - DNA, 25 bp, Mus musculus
tgcagatgccttctgctggtgacac

SEQ ID NO: 863184 - DNA, 25 bp, Mus musculus
tgcagatgccttgtgctggtgacac

SEQ ID NO: 863185 - DNA, 25 bp, Mus musculus
tgcagatgcggcagtgatccaggct

SEQ ID NO: 863186 - DNA, 25 bp, Mus musculus
tgcagatgcggctgtgatccaggct

SEQ ID NO: 863187 - DNA, 25 bp, Mus musculus
tgcagatgctcaacggagctgtctt

SEQ ID NO: 863188 - DNA, 25 bp, Mus musculus
tgcagatgctcaagagacctcagct

SEQ ID NO: 863189 - DNA, 25 bp, Mus musculus
tgcagatgctcatcggagctgtctt

SEQ ID NO: 863190 - DNA, 25 bp, Mus musculus
tgcagatgctcatgagacctcagct

SEQ ID NO: 863191 - DNA, 25 bp, Mus musculus
tgcagatgctctaaacaaccaaaga

SEQ ID NO: 863192 - DNA, 25 bp, Mus musculus
tgcagatgctctacccaaccgaaga

SEQ ID NO: 863193 - DNA, 25 bp, Mus musculus
tgcagatgctctctttacattttct

SEQ ID NO: 863194 - DNA, 25 bp, Mus musculus
tgcagatgctctgtttacattttct

SEQ ID NO: 863195 - DNA, 25 bp, Mus musculus
tgcagatgctcttaacaaccaaaga

SEQ ID NO: 863196 - DNA, 25 bp, Mus musculus
tgcagatgctcttcccaaccgaaga

SEQ ID NO: 863197 - DNA, 25 bp, Mus musculus
tgcagatgctggcaatgtcctttga

SEQ ID NO: 863198 - DNA, 25 bp, Mus musculus
tgcagatgctgggaatgtcctttga

SEQ ID NO: 863199 - DNA, 25 bp, Mus musculus
tgcagatggaaaaagcttcttgctg

SEQ ID NO: 863200 - DNA, 25 bp, Mus musculus
tgcagatggaaatagcttcttgctg

SEQ ID NO: 863201 - DNA, 25 bp, Mus musculus
tgcagatggaggaggagtacatcca

SEQ ID NO: 863202 - DNA, 25 bp, Mus musculus
tgcagatggaggtggagtacatcca

SEQ ID NO: 863203 - DNA, 25 bp, Mus musculus
tgcagatggcagactctttggaggg

SEQ ID NO: 863204 - DNA, 25 bp, Mus musculus
tgcagatggcagtctctttggaggg

SEQ ID NO: 863205 - DNA, 25 bp, Mus musculus
tgcagatggcgcacagctacatcat

SEQ ID NO: 863206 - DNA, 25 bp, Mus musculus
tgcagatggcgctcagctacatcat

SEQ ID NO: 863207 - DNA, 25 bp, Mus musculus
tgcagatggctgagtctgttctcat

SEQ ID NO: 863208 - DNA, 25 bp, Mus musculus
tgcagatggctgtgtctgttctcat

SEQ ID NO: 863209 - DNA, 25 bp, Mus musculus
tgcagatggtacaagcatacgcctt

SEQ ID NO: 863210 - DNA, 25 bp, Mus musculus
tgcagatggtactagcatacgcctt

SEQ ID NO: 863211 - DNA, 25 bp, Mus musculus
tgcagatgtccaacctgaggctgta

SEQ ID NO: 863212 - DNA, 25 bp, Mus musculus
tgcagatgtccatcctgaggctgta

SEQ ID NO: 863213 - DNA, 25 bp, Mus musculus
tgcagatgtgatcacagagcccttt

SEQ ID NO: 863214 - DNA, 25 bp, Mus musculus
tgcagatgtgatgacagagcccttt

SEQ ID NO: 863215 - DNA, 25 bp, Mus musculus
tgcagatgtgcacctgatccctagc

SEQ ID NO: 863216 - DNA, 25 bp, Mus musculus
tgcagatgtgcagctgatccctagc

SEQ ID NO: 863217 - DNA, 25 bp, Mus musculus
tgcagattactaacagtgcacttct

SEQ ID NO: 863218 - DNA, 25 bp, Mus musculus
tgcagattactatcagtgcacttct

SEQ ID NO: 863219 - DNA, 25 bp, Mus musculus
tgcagattccatccgacttctagtt

SEQ ID NO: 863220 - DNA, 25 bp, Mus musculus
tgcagattccatgcgacttctagtt

SEQ ID NO: 863221 - DNA, 25 bp, Mus musculus
tgcagattcctacacactcaaacaa

SEQ ID NO: 863222 - DNA, 25 bp, Mus musculus
tgcagattcctagacactcaaacaa

SEQ ID NO: 863223 - DNA, 25 bp, Mus musculus
tgcagattccttattgagggtttat

SEQ ID NO: 863224 - DNA, 25 bp, Mus musculus
tgcagattccttctttgtattgtaa

SEQ ID NO: 863225 - DNA, 25 bp, Mus musculus
tgcagattccttgtttgtattgtaa

SEQ ID NO: 863226 - DNA, 25 bp, Mus musculus
tgcagattcctttttgagggtttat

SEQ ID NO: 863227 - DNA, 25 bp, Mus musculus
tgcagattctttacacatccctgtt

SEQ ID NO: 863228 - DNA, 25 bp, Mus musculus
tgcagattcttttcacatccctgtt

SEQ ID NO: 863229 - DNA, 25 bp, Mus musculus
tgcagatttgctattggatatccca

SEQ ID NO: 863230 - DNA, 25 bp, Mus musculus
tgcagatttgcttttggatatccca

SEQ ID NO: 863231 - DNA, 25 bp, Mus musculus
tgcagcaaaccgcaagatgcccctt

SEQ ID NO: 863232 - DNA, 25 bp, Mus musculus
tgcagcaaaccggaagatgcccctt

SEQ ID NO: 863233 - DNA, 25 bp, Mus musculus
tgcagcaaactgatctttttctcat

SEQ ID NO: 863234 - DNA, 25 bp, Mus musculus
tgcagcaaactgttctttttctcat

SEQ ID NO: 863235 - DNA, 25 bp, Mus musculus
tgcagcaaagataaccccaaggtcc

SEQ ID NO: 863236 - DNA, 25 bp, Mus musculus
tgcagcaaagattaccccaaggtcc

SEQ ID NO: 863237 - DNA, 25 bp, Mus musculus
tgcagcaacaggagcaaatgccctc

SEQ ID NO: 863238 - DNA, 25 bp, Mus musculus
tgcagcaacaggcaaagtagagatc

SEQ ID NO: 863239 - DNA, 25 bp, Mus musculus
tgcagcaacagggaaagtagagatc

SEQ ID NO: 863240 - DNA, 25 bp, Mus musculus
tgcagcaacaggtgcaaatgccctc

SEQ ID NO: 863241 - DNA, 25 bp, Mus musculus
tgcagcaacatgacttcacctctca

SEQ ID NO: 863242 - DNA, 25 bp, Mus musculus
tgcagcaacatgtcttcacctctca

SEQ ID NO: 863243 - DNA, 25 bp, Mus musculus
tgcagcaagaccagtccctcagctc

SEQ ID NO: 863244 - DNA, 25 bp, Mus musculus
tgcagcaagacctgtccctcagctc

SEQ ID NO: 863245 - DNA, 25 bp, Mus musculus
tgcagcaagcacctatatccactat

SEQ ID NO: 863246 - DNA, 25 bp, Mus musculus
tgcagcaagcacgtatatccactat

SEQ ID NO: 863247 - DNA, 25 bp, Mus musculus
tgcagcaaggcccacgccgtatagg

SEQ ID NO: 863248 - DNA, 25 bp, Mus musculus
tgcagcaaggccgacgccgtatagg

SEQ ID NO: 863249 - DNA, 25 bp, Mus musculus
tgcagcaagggcattggagacaact

SEQ ID NO: 863250 - DNA, 25 bp, Mus musculus
tgcagcaagggctttggagacaact

SEQ ID NO: 863251 - DNA, 25 bp, Mus musculus
tgcagcaagtgcctggcaaccctga

SEQ ID NO: 863252 - DNA, 25 bp, Mus musculus
tgcagcaagtgcgtggcaaccctga

SEQ ID NO: 863253 - DNA, 25 bp, Mus musculus
tgcagcaagttgatctacccctggt

SEQ ID NO: 863254 - DNA, 25 bp, Mus musculus
tgcagcaagttgttctacccctggt

SEQ ID NO: 863255 - DNA, 25 bp, Mus musculus
tgcagcaatcctcagtcagtgcctt

SEQ ID NO: 863256 - DNA, 25 bp, Mus musculus
tgcagcaatcctgagtcagtgcctt

SEQ ID NO: 863257 - DNA, 25 bp, Mus musculus
tgcagcaatgcacagatgtcaccag

SEQ ID NO: 863258 - DNA, 25 bp, Mus musculus
tgcagcaatgcagagatgtcaccag

SEQ ID NO: 863259 - DNA, 25 bp, Mus musculus
tgcagcaattaacatctggccatag

SEQ ID NO: 863260 - DNA, 25 bp, Mus musculus
tgcagcaattaagatctggccatag

SEQ ID NO: 863261 - DNA, 25 bp, Mus musculus
tgcagcacaatgactccctcaatgt

SEQ ID NO: 863262 - DNA, 25 bp, Mus musculus
tgcagcacaatgtctccctcaatgt

SEQ ID NO: 863263 - DNA, 25 bp, Mus musculus
tgcagcacaccaccagaaggttttt

SEQ ID NO: 863264 - DNA, 25 bp, Mus musculus
tgcagcacaccagcagaaggttttt

SEQ ID NO: 863265 - DNA, 25 bp, Mus musculus
tgcagcacactccttggaatctttc

SEQ ID NO: 863266 - DNA, 25 bp, Mus musculus
tgcagcacactcgttggaatctttc

SEQ ID NO: 863267 - DNA, 25 bp, Mus musculus
tgcagcacataaattccccaggact

SEQ ID NO: 863268 - DNA, 25 bp, Mus musculus
tgcagcacataatttccccaggact

SEQ ID NO: 863269 - DNA, 25 bp, Mus musculus
tgcagcacatcaccgaccgggaaaa

SEQ ID NO: 863270 - DNA, 25 bp, Mus musculus
tgcagcacatcagcgaccgggaaaa

SEQ ID NO: 863271 - DNA, 25 bp, Mus musculus
tgcagcaccatgactacaacacata

SEQ ID NO: 863272 - DNA, 25 bp, Mus musculus
tgcagcaccatgtctacaacacata

SEQ ID NO: 863273 - DNA, 25 bp, Mus musculus
tgcagcacccatcgcacagtctgta

SEQ ID NO: 863274 - DNA, 25 bp, Mus musculus
tgcagcacccatggcacagtctgta

SEQ ID NO: 863275 - DNA, 25 bp, Mus musculus
tgcagcaccctgcagttactgtatg

SEQ ID NO: 863276 - DNA, 25 bp, Mus musculus
tgcagcaccctggagttactgtatg

SEQ ID NO: 863277 - DNA, 25 bp, Mus musculus
tgcagcaccgctcgcagtattttga

SEQ ID NO: 863278 - DNA, 25 bp, Mus musculus
tgcagcaccgctggcagtattttga

SEQ ID NO: 863279 - DNA, 25 bp, Mus musculus
tgcagcacctacaaagtccgaagac

SEQ ID NO: 863280 - DNA, 25 bp, Mus musculus
tgcagcacctactaagtccgaagac

SEQ ID NO: 863281 - DNA, 25 bp, Mus musculus
tgcagcacctagagggcagaaggct

SEQ ID NO: 863282 - DNA, 25 bp, Mus musculus
tgcagcacctagtgggcagaaggct

SEQ ID NO: 863283 - DNA, 25 bp, Mus musculus
tgcagcacctggaattccctaagaa

SEQ ID NO: 863284 - DNA, 25 bp, Mus musculus
tgcagcacctggagggccccaagat

SEQ ID NO: 863285 - DNA, 25 bp, Mus musculus
tgcagcacctggtattccctaagaa

SEQ ID NO: 863286 - DNA, 25 bp, Mus musculus
tgcagcacctggtgggccccaagat

SEQ ID NO: 863287 - DNA, 25 bp, Mus musculus
tgcagcacctgtcgaacacttagcg

SEQ ID NO: 863288 - DNA, 25 bp, Mus musculus
tgcagcacctgtggaacacttagcg

SEQ ID NO: 863289 - DNA, 25 bp, Mus musculus
tgcagcacgagcactccaagaaaga

SEQ ID NO: 863290 - DNA, 25 bp, Mus musculus
tgcagcacgagctctccaagaaaga

SEQ ID NO: 863291 - DNA, 25 bp, Mus musculus
tgcagcacggcaagtctaataggat

SEQ ID NO: 863292 - DNA, 25 bp, Mus musculus
tgcagcacggcaatgtctactcagg

SEQ ID NO: 863293 - DNA, 25 bp, Mus musculus
tgcagcacggcacgatgaagttata

SEQ ID NO: 863294 - DNA, 25 bp, Mus musculus
tgcagcacggcaggatgaagttata

SEQ ID NO: 863295 - DNA, 25 bp, Mus musculus
tgcagcacggcatgtctaataggat

SEQ ID NO: 863296 - DNA, 25 bp, Mus musculus
tgcagcacggcattgtctactcagg

SEQ ID NO: 863297 - DNA, 25 bp, Mus musculus
tgcagcacgtagacagactttcttt

SEQ ID NO: 863298 - DNA, 25 bp, Mus musculus
tgcagcacgtagtcagactttcttt

SEQ ID NO: 863299 - DNA, 25 bp, Mus musculus
tgcagcactagacggtagccacgga

SEQ ID NO: 863300 - DNA, 25 bp, Mus musculus
tgcagcactagagggtagccacgga

SEQ ID NO: 863301 - DNA, 25 bp, Mus musculus
tgcagcacttttacaggtccatttg

SEQ ID NO: 863302 - DNA, 25 bp, Mus musculus
tgcagcactttttcaggtccatttg

SEQ ID NO: 863303 - DNA, 25 bp, Mus musculus
tgcagcagaattagtcctctgttct

SEQ ID NO: 863304 - DNA, 25 bp, Mus musculus
tgcagcagaatttgtcctctgttct

SEQ ID NO: 863305 - DNA, 25 bp, Mus musculus
tgcagcagagttctctagccccaga

SEQ ID NO: 863306 - DNA, 25 bp, Mus musculus
tgcagcagagttgtctagccccaga

SEQ ID NO: 863307 - DNA, 25 bp, Mus musculus
tgcagcagatgcagtgcggccatgt

SEQ ID NO: 863308 - DNA, 25 bp, Mus musculus
tgcagcagatgctgtgcggccatgt

SEQ ID NO: 863309 - DNA, 25 bp, Mus musculus
tgcagcagcactaccgcaacctgga

SEQ ID NO: 863310 - DNA, 25 bp, Mus musculus
tgcagcagcacttccgcaacctgga

SEQ ID NO: 863311 - DNA, 25 bp, Mus musculus
tgcagcagcagcacgtgcctttaat

SEQ ID NO: 863312 - DNA, 25 bp, Mus musculus
tgcagcagcagctcgtgcctttaat

SEQ ID NO: 863313 - DNA, 25 bp, Mus musculus
tgcagcagcataccagcatcgtctg

SEQ ID NO: 863314 - DNA, 25 bp, Mus musculus
tgcagcagcatagcagcatcgtctg

SEQ ID NO: 863315 - DNA, 25 bp, Mus musculus
tgcagcagcattaatatccttttct

SEQ ID NO: 863316 - DNA, 25 bp, Mus musculus
tgcagcagcatttatatccttttct

SEQ ID NO: 863317 - DNA, 25 bp, Mus musculus
tgcagcagcgctcggaccaggtgga

SEQ ID NO: 863318 - DNA, 25 bp, Mus musculus
tgcagcagcgctgggaccaggtgga

SEQ ID NO: 863319 - DNA, 25 bp, Mus musculus
tgcagcagctaactcagaactgtta

SEQ ID NO: 863320 - DNA, 25 bp, Mus musculus
tgcagcagctaagtcagaactgtta

SEQ ID NO: 863321 - DNA, 25 bp, Mus musculus
tgcagcagctgtaggaaagcctttt

SEQ ID NO: 863322 - DNA, 25 bp, Mus musculus
tgcagcagctgttggaaagcctttt

SEQ ID NO: 863323 - DNA, 25 bp, Mus musculus
tgcagcagcttactgcctggcaaac

SEQ ID NO: 863324 - DNA, 25 bp, Mus musculus
tgcagcagcttagtgcctggcaaac

SEQ ID NO: 863325 - DNA, 25 bp, Mus musculus
tgcagcaggactatgaccgggccat

SEQ ID NO: 863326 - DNA, 25 bp, Mus musculus
tgcagcaggactttgaccgggccat

SEQ ID NO: 863327 - DNA, 25 bp, Mus musculus
tgcagcaggattaccttctgtaggt

SEQ ID NO: 863328 - DNA, 25 bp, Mus musculus
tgcagcaggatttccttctgtaggt

SEQ ID NO: 863329 - DNA, 25 bp, Mus musculus
tgcagcaggccacgatcacagatgt

SEQ ID NO: 863330 - DNA, 25 bp, Mus musculus
tgcagcaggccaggatcacagatgt

SEQ ID NO: 863331 - DNA, 25 bp, Mus musculus
tgcagcaggcttaggacagaactag

SEQ ID NO: 863332 - DNA, 25 bp, Mus musculus
tgcagcaggctttggacagaactag

SEQ ID NO: 863333 - DNA, 25 bp, Mus musculus
tgcagcagggccagaggactgtgct

SEQ ID NO: 863334 - DNA, 25 bp, Mus musculus
tgcagcagggcctgaggactgtgct

SEQ ID NO: 863335 - DNA, 25 bp, Mus musculus
tgcagcagggctacactcactcgac

SEQ ID NO: 863336 - DNA, 25 bp, Mus musculus
tgcagcagggctactaggcagacca

SEQ ID NO: 863337 - DNA, 25 bp, Mus musculus
tgcagcagggctctaactactcaag

SEQ ID NO: 863338 - DNA, 25 bp, Mus musculus
tgcagcagggctgtaactactcaag

SEQ ID NO: 863339 - DNA, 25 bp, Mus musculus
tgcagcagggcttcactcactcgac

SEQ ID NO: 863340 - DNA, 25 bp, Mus musculus
tgcagcagggcttctaggcagacca

SEQ ID NO: 863341 - DNA, 25 bp, Mus musculus
tgcagcagtaacagactcccaagtt

SEQ ID NO: 863342 - DNA, 25 bp, Mus musculus
tgcagcagtaactgactcccaagtt

SEQ ID NO: 863343 - DNA, 25 bp, Mus musculus
tgcagcagtcctagctagctcagat

SEQ ID NO: 863344 - DNA, 25 bp, Mus musculus
tgcagcagtccttgctagctcagat

SEQ ID NO: 863345 - DNA, 25 bp, Mus musculus
tgcagcagtggccaaactggatgct

SEQ ID NO: 863346 - DNA, 25 bp, Mus musculus
tgcagcagtggcgaaactggatgct

SEQ ID NO: 863347 - DNA, 25 bp, Mus musculus
tgcagcagtgtcatgtgtggaagtc

SEQ ID NO: 863348 - DNA, 25 bp, Mus musculus
tgcagcagtgtcttgtgtggaagtc

SEQ ID NO: 863349 - DNA, 25 bp, Mus musculus
tgcagcagtgtgcccaggtttaaaa

SEQ ID NO: 863350 - DNA, 25 bp, Mus musculus
tgcagcagtgtggccaggtttaaaa

SEQ ID NO: 863351 - DNA, 25 bp, Mus musculus
tgcagcagttgaaccgataaggcca

SEQ ID NO: 863352 - DNA, 25 bp, Mus musculus
tgcagcagttgacacaggcccaggt

SEQ ID NO: 863353 - DNA, 25 bp, Mus musculus
tgcagcagttgagacaggcccaggt

SEQ ID NO: 863354 - DNA, 25 bp, Mus musculus
tgcagcagttgatccgataaggcca

SEQ ID NO: 863355 - DNA, 25 bp, Mus musculus
tgcagcagtttgatggtaaggtgac

SEQ ID NO: 863356 - DNA, 25 bp, Mus musculus
tgcagcagtttgttggtaaggtgac

SEQ ID NO: 863357 - DNA, 25 bp, Mus musculus
tgcagcataaatccgagaggccttt

SEQ ID NO: 863358 - DNA, 25 bp, Mus musculus
tgcagcataaatgcgagaggccttt

SEQ ID NO: 863359 - DNA, 25 bp, Mus musculus
tgcagcatacttctcgggacgtcaa

SEQ ID NO: 863360 - DNA, 25 bp, Mus musculus
tgcagcatacttgtcgggacgtcaa

SEQ ID NO: 863361 - DNA, 25 bp, Mus musculus
tgcagcatagacattaatatttcct

SEQ ID NO: 863362 - DNA, 25 bp, Mus musculus
tgcagcatagactttaatatttcct

SEQ ID NO: 863363 - DNA, 25 bp, Mus musculus
tgcagcatagatactgtcttgaagt

SEQ ID NO: 863364 - DNA, 25 bp, Mus musculus
tgcagcatagatctctgctctcctt

SEQ ID NO: 863365 - DNA, 25 bp, Mus musculus
tgcagcatagatgtctgctctcctt

SEQ ID NO: 863366 - DNA, 25 bp, Mus musculus
tgcagcatagattctgtcttgaagt

SEQ ID NO: 863367 - DNA, 25 bp, Mus musculus
tgcagcatcaagaagcccaggaagc

SEQ ID NO: 863368 - DNA, 25 bp, Mus musculus
tgcagcatcaagtagcccaggaagc

SEQ ID NO: 863369 - DNA, 25 bp, Mus musculus
tgcagcatcctacaatcgcctttgc

SEQ ID NO: 863370 - DNA, 25 bp, Mus musculus
tgcagcatcctagaatcgcctttgc

SEQ ID NO: 863371 - DNA, 25 bp, Mus musculus
tgcagcatcctgctgccgtgttaac

SEQ ID NO: 863372 - DNA, 25 bp, Mus musculus
tgcagcatcctggtgccgtgttaac

SEQ ID NO: 863373 - DNA, 25 bp, Mus musculus
tgcagcatcgcaagcagatcgggct

SEQ ID NO: 863374 - DNA, 25 bp, Mus musculus
tgcagcatcgcatgcagatcgggct

SEQ ID NO: 863375 - DNA, 25 bp, Mus musculus
tgcagcatctaaaccatcaagtgag

SEQ ID NO: 863376 - DNA, 25 bp, Mus musculus
tgcagcatctaatccatcaagtgag

SEQ ID NO: 863377 - DNA, 25 bp, Mus musculus
tgcagcatctctagacggaaggcct

SEQ ID NO: 863378 - DNA, 25 bp, Mus musculus
tgcagcatctcttgacggaaggcct

SEQ ID NO: 863379 - DNA, 25 bp, Mus musculus
tgcagcatcttgagacagagttcac

SEQ ID NO: 863380 - DNA, 25 bp, Mus musculus
tgcagcatcttgtgacagagttcac

SEQ ID NO: 863381 - DNA, 25 bp, Mus musculus
tgcagcatgcacactggtatgccat

SEQ ID NO: 863382 - DNA, 25 bp, Mus musculus
tgcagcatgcactctggtatgccat

SEQ ID NO: 863383 - DNA, 25 bp, Mus musculus
tgcagcatgcatacatccaggaaaa

SEQ ID NO: 863384 - DNA, 25 bp, Mus musculus
tgcagcatgcattcatccaggaaaa

SEQ ID NO: 863385 - DNA, 25 bp, Mus musculus
tgcagcatgctacactacgatccct

SEQ ID NO: 863386 - DNA, 25 bp, Mus musculus
tgcagcatgctagactacgatccct

SEQ ID NO: 863387 - DNA, 25 bp, Mus musculus
tgcagcatggaccaggactcagcgt

SEQ ID NO: 863388 - DNA, 25 bp, Mus musculus
tgcagcatggacgaggactcagcgt

SEQ ID NO: 863389 - DNA, 25 bp, Mus musculus
tgcagcatgggtacacgtgggcact

SEQ ID NO: 863390 - DNA, 25 bp, Mus musculus
tgcagcatgggttcacgtgggcact

SEQ ID NO: 863391 - DNA, 25 bp, Mus musculus
tgcagcatgtggagtaagcgtcgtc

SEQ ID NO: 863392 - DNA, 25 bp, Mus musculus
tgcagcatgtggtgtaagcgtcgtc

SEQ ID NO: 863393 - DNA, 25 bp, Mus musculus
tgcagcatttcaacgaggtggagac

SEQ ID NO: 863394 - DNA, 25 bp, Mus musculus
tgcagcatttcatcgaggtggagac

SEQ ID NO: 863395 - DNA, 25 bp, Mus musculus
tgcagcatttggcagtgtggaaaat

SEQ ID NO: 863396 - DNA, 25 bp, Mus musculus
tgcagcatttgggagtgtggaaaat

SEQ ID NO: 863397 - DNA, 25 bp, Mus musculus
tgcagccaaaaaatatgtatagggt

SEQ ID NO: 863398 - DNA, 25 bp, Mus musculus
tgcagccaaaaattatgtatagggt

SEQ ID NO: 863399 - DNA, 25 bp, Mus musculus
tgcagccaaacacttatccagactc

SEQ ID NO: 863400 - DNA, 25 bp, Mus musculus
tgcagccaaacagttatccagactc

SEQ ID NO: 863401 - DNA, 25 bp, Mus musculus
tgcagccaacataaacgccctggat

SEQ ID NO: 863402 - DNA, 25 bp, Mus musculus
tgcagccaacattaacgccctggat

SEQ ID NO: 863403 - DNA, 25 bp, Mus musculus
tgcagccaagcaaagtgtcgacagt

SEQ ID NO: 863404 - DNA, 25 bp, Mus musculus
tgcagccaagcaaccgtgtgacaga

SEQ ID NO: 863405 - DNA, 25 bp, Mus musculus
tgcagccaagcatagtgtcgacagt

SEQ ID NO: 863406 - DNA, 25 bp, Mus musculus
tgcagccaagcatccgtgtgacaga

SEQ ID NO: 863407 - DNA, 25 bp, Mus musculus
tgcagccacaataggcttcctcaga

SEQ ID NO: 863408 - DNA, 25 bp, Mus musculus
tgcagccacaattggcttcctcaga

SEQ ID NO: 863409 - DNA, 25 bp, Mus musculus
tgcagccacacactgtaggcacggg

SEQ ID NO: 863410 - DNA, 25 bp, Mus musculus
tgcagccacacagtgtaggcacggg

SEQ ID NO: 863411 - DNA, 25 bp, Mus musculus
tgcagccacacgaatttgaggtcat

SEQ ID NO: 863412 - DNA, 25 bp, Mus musculus
tgcagccacacgtatttgaggtcat

SEQ ID NO: 863413 - DNA, 25 bp, Mus musculus
tgcagccacagccagtattgcagga

SEQ ID NO: 863414 - DNA, 25 bp, Mus musculus
tgcagccacagcgagtattgcagga

SEQ ID NO: 863415 - DNA, 25 bp, Mus musculus
tgcagccacatcattatgtaaacat

SEQ ID NO: 863416 - DNA, 25 bp, Mus musculus
tgcagccacatctttatgtaaacat

SEQ ID NO: 863417 - DNA, 25 bp, Mus musculus
tgcagccacgagcagaattgccctg

SEQ ID NO: 863418 - DNA, 25 bp, Mus musculus
tgcagccacgaggagaattgccctg

SEQ ID NO: 863419 - DNA, 25 bp, Mus musculus
tgcagccactggcaaggatcacctt

SEQ ID NO: 863420 - DNA, 25 bp, Mus musculus
tgcagccactgggaaggatcacctt

SEQ ID NO: 863421 - DNA, 25 bp, Mus musculus
tgcagccagagactcttcgacatct

SEQ ID NO: 863422 - DNA, 25 bp, Mus musculus
tgcagccagagagtcttcgacatct

SEQ ID NO: 863423 - DNA, 25 bp, Mus musculus
tgcagccagaggagccaacgcggaa

SEQ ID NO: 863424 - DNA, 25 bp, Mus musculus
tgcagccagaggtgccaacgcggaa

SEQ ID NO: 863425 - DNA, 25 bp, Mus musculus
tgcagccagagtagtatgagacctt

SEQ ID NO: 863426 - DNA, 25 bp, Mus musculus
tgcagccagagttgtatgagacctt

SEQ ID NO: 863427 - DNA, 25 bp, Mus musculus
tgcagccagccaaagactctcagag

SEQ ID NO: 863428 - DNA, 25 bp, Mus musculus
tgcagccagccatagactctcagag

SEQ ID NO: 863429 - DNA, 25 bp, Mus musculus
tgcagccagcccagctgtctttggg

SEQ ID NO: 863430 - DNA, 25 bp, Mus musculus
tgcagccagccctgctgtctttggg

SEQ ID NO: 863431 - DNA, 25 bp, Mus musculus
tgcagccatagcagggcaacagcaa

SEQ ID NO: 863432 - DNA, 25 bp, Mus musculus
tgcagccatagctgggcaacagcaa

SEQ ID NO: 863433 - DNA, 25 bp, Mus musculus
tgcagccatttgaggtttgtcggac

SEQ ID NO: 863434 - DNA, 25 bp, Mus musculus
tgcagccatttgtggtttgtcggac

SEQ ID NO: 863435 - DNA, 25 bp, Mus musculus
tgcagcccaactaatagctctaggt

SEQ ID NO: 863436 - DNA, 25 bp, Mus musculus
tgcagcccaacttatagctctaggt

SEQ ID NO: 863437 - DNA, 25 bp, Mus musculus
tgcagcccaagcacatgagggaggc

SEQ ID NO: 863438 - DNA, 25 bp, Mus musculus
tgcagcccaagctcatgagggaggc

SEQ ID NO: 863439 - DNA, 25 bp, Mus musculus
tgcagcccaatgaggcagtatacac

SEQ ID NO: 863440 - DNA, 25 bp, Mus musculus
tgcagcccaatgtggcagtatacac

SEQ ID NO: 863441 - DNA, 25 bp, Mus musculus
tgcagcccacagagccttggaggat

SEQ ID NO: 863442 - DNA, 25 bp, Mus musculus
tgcagcccacagtgccttggaggat

SEQ ID NO: 863443 - DNA, 25 bp, Mus musculus
tgcagcccagagaacttccctatgc

SEQ ID NO: 863444 - DNA, 25 bp, Mus musculus
tgcagcccagagtacttccctatgc

SEQ ID NO: 863445 - DNA, 25 bp, Mus musculus
tgcagcccagttcggcagctgctgt

SEQ ID NO: 863446 - DNA, 25 bp, Mus musculus
tgcagcccagttctcagtgattgat

SEQ ID NO: 863447 - DNA, 25 bp, Mus musculus
tgcagcccagttgggcagctgctgt

SEQ ID NO: 863448 - DNA, 25 bp, Mus musculus
tgcagcccagttgtcagtgattgat

SEQ ID NO: 863449 - DNA, 25 bp, Mus musculus
tgcagcccatgcatgatgccagcaa

SEQ ID NO: 863450 - DNA, 25 bp, Mus musculus
tgcagcccatgcttgatgccagcaa

SEQ ID NO: 863451 - DNA, 25 bp, Mus musculus
tgcagccccaaactagtcatctctt

SEQ ID NO: 863452 - DNA, 25 bp, Mus musculus
tgcagccccaaagtagtcatctctt

SEQ ID NO: 863453 - DNA, 25 bp, Mus musculus
tgcagccccaacaagactgacattt

SEQ ID NO: 863454 - DNA, 25 bp, Mus musculus
tgcagccccaactagactgacattt

SEQ ID NO: 863455 - DNA, 25 bp, Mus musculus
tgcagccccggaaaagacagaggtc

SEQ ID NO: 863456 - DNA, 25 bp, Mus musculus
tgcagccccggataagacagaggtc

SEQ ID NO: 863457 - DNA, 25 bp, Mus musculus
tgcagccccgggaggaatagccaac

SEQ ID NO: 863458 - DNA, 25 bp, Mus musculus
tgcagccccgggagtctgctcgctg

SEQ ID NO: 863459 - DNA, 25 bp, Mus musculus
tgcagccccgggtggaatagccaac

SEQ ID NO: 863460 - DNA, 25 bp, Mus musculus
tgcagccccgggtgtctgctcgctg

SEQ ID NO: 863461 - DNA, 25 bp, Mus musculus
tgcagcccggccagtgcggctcgta

SEQ ID NO: 863462 - DNA, 25 bp, Mus musculus
tgcagcccggcctgtgcggctcgta

SEQ ID NO: 863463 - DNA, 25 bp, Mus musculus
tgcagcccgtgacattgtccagttt

SEQ ID NO: 863464 - DNA, 25 bp, Mus musculus
tgcagcccgtgagattgtccagttt

SEQ ID NO: 863465 - DNA, 25 bp, Mus musculus
tgcagccctccgaaatttgtggata

SEQ ID NO: 863466 - DNA, 25 bp, Mus musculus
tgcagccctccgtaatttgtggata

SEQ ID NO: 863467 - DNA, 25 bp, Mus musculus
tgcagccctcctcgatgaagcactg

SEQ ID NO: 863468 - DNA, 25 bp, Mus musculus
tgcagccctcctggatgaagcactg

SEQ ID NO: 863469 - DNA, 25 bp, Mus musculus
tgcagccctcggactcagttttctt

SEQ ID NO: 863470 - DNA, 25 bp, Mus musculus
tgcagccctcggtctcagttttctt

SEQ ID NO: 863471 - DNA, 25 bp, Mus musculus
tgcagccctctcatatggaaagttc

SEQ ID NO: 863472 - DNA, 25 bp, Mus musculus
tgcagccctctcttatggaaagttc

SEQ ID NO: 863473 - DNA, 25 bp, Mus musculus
tgcagccctgctcatattgatgctt

SEQ ID NO: 863474 - DNA, 25 bp, Mus musculus
tgcagccctgctgatattgatgctt

SEQ ID NO: 863475 - DNA, 25 bp, Mus musculus
tgcagccctgtaagtggaacaacaa

SEQ ID NO: 863476 - DNA, 25 bp, Mus musculus
tgcagccctgtatgtggaacaacaa

SEQ ID NO: 863477 - DNA, 25 bp, Mus musculus
tgcagcccttgtaaaattacttagc

SEQ ID NO: 863478 - DNA, 25 bp, Mus musculus
tgcagcccttgttaaattacttagc

SEQ ID NO: 863479 - DNA, 25 bp, Mus musculus
tgcagccgacgcctattatcagttt

SEQ ID NO: 863480 - DNA, 25 bp, Mus musculus
tgcagccgacgcgtattatcagttt

SEQ ID NO: 863481 - DNA, 25 bp, Mus musculus
tgcagccgcactaagagggccggat

SEQ ID NO: 863482 - DNA, 25 bp, Mus musculus
tgcagccgcacttagagggccggat

SEQ ID NO: 863483 - DNA, 25 bp, Mus musculus
tgcagccgctggcaaaacgccaggt

SEQ ID NO: 863484 - DNA, 25 bp, Mus musculus
tgcagccgctgggaaaacgccaggt

SEQ ID NO: 863485 - DNA, 25 bp, Mus musculus
tgcagccgcttcagtcacgaatgtg

SEQ ID NO: 863486 - DNA, 25 bp, Mus musculus
tgcagccgcttctgtcacgaatgtg

SEQ ID NO: 863487 - DNA, 25 bp, Mus musculus
tgcagccggagtaatagcccgagca

SEQ ID NO: 863488 - DNA, 25 bp, Mus musculus
tgcagccggagttatagcccgagca

SEQ ID NO: 863489 - DNA, 25 bp, Mus musculus
tgcagccggctgcttggacacacac

SEQ ID NO: 863490 - DNA, 25 bp, Mus musculus
tgcagccggctggttggacacacac

SEQ ID NO: 863491 - DNA, 25 bp, Mus musculus
tgcagcctcaatattctttgtgctt

SEQ ID NO: 863492 - DNA, 25 bp, Mus musculus
tgcagcctcaattttctttgtgctt

SEQ ID NO: 863493 - DNA, 25 bp, Mus musculus
tgcagcctccggaatgattgcgatt

SEQ ID NO: 863494 - DNA, 25 bp, Mus musculus
tgcagcctccggtatgattgcgatt

SEQ ID NO: 863495 - DNA, 25 bp, Mus musculus
tgcagcctcctcagaggtcagatta

SEQ ID NO: 863496 - DNA, 25 bp, Mus musculus
tgcagcctcctctgaggtcagatta

SEQ ID NO: 863497 - DNA, 25 bp, Mus musculus
tgcagcctcctgaaccagttcatga

SEQ ID NO: 863498 - DNA, 25 bp, Mus musculus
tgcagcctcctgtaccagttcatga

SEQ ID NO: 863499 - DNA, 25 bp, Mus musculus
tgcagcctctttagtaatgtcttct

SEQ ID NO: 863500 - DNA, 25 bp, Mus musculus
tgcagcctcttttgtaatgtcttct

SEQ ID NO: 863501 - DNA, 25 bp, Mus musculus
tgcagcctgaaacccgcgtgttttc

SEQ ID NO: 863502 - DNA, 25 bp, Mus musculus
tgcagcctgaaacgacactgaagtc

SEQ ID NO: 863503 - DNA, 25 bp, Mus musculus
tgcagcctgaaagccgcgtgttttc

SEQ ID NO: 863504 - DNA, 25 bp, Mus musculus
tgcagcctgaaaggacactgaagtc

SEQ ID NO: 863505 - DNA, 25 bp, Mus musculus
tgcagcctgaagacattgccactta

SEQ ID NO: 863506 - DNA, 25 bp, Mus musculus
tgcagcctgaagtcattgccactta

SEQ ID NO: 863507 - DNA, 25 bp, Mus musculus
tgcagcctggctctacccgggagaa

SEQ ID NO: 863508 - DNA, 25 bp, Mus musculus
tgcagcctggctgtacccgggagaa

SEQ ID NO: 863509 - DNA, 25 bp, Mus musculus
tgcagcctgtacagctctgaagcat

SEQ ID NO: 863510 - DNA, 25 bp, Mus musculus
tgcagcctgtactgctctgaagcat

SEQ ID NO: 863511 - DNA, 25 bp, Mus musculus
tgcagcctgttcacttgtctcgccg

SEQ ID NO: 863512 - DNA, 25 bp, Mus musculus
tgcagcctgttctcttgtctcgccg

SEQ ID NO: 863513 - DNA, 25 bp, Mus musculus
tgcagccttgcacagtaactcggag

SEQ ID NO: 863514 - DNA, 25 bp, Mus musculus
tgcagccttgcactcttgccagaca

SEQ ID NO: 863515 - DNA, 25 bp, Mus musculus
tgcagccttgcagagtaactcggag

SEQ ID NO: 863516 - DNA, 25 bp, Mus musculus
tgcagccttgcagtcttgccagaca

SEQ ID NO: 863517 - DNA, 25 bp, Mus musculus
tgcagcctttgcctaagatcacctc

SEQ ID NO: 863518 - DNA, 25 bp, Mus musculus
tgcagcctttgcgtaagatcacctc

SEQ ID NO: 863519 - DNA, 25 bp, Mus musculus
tgcagcctttgtcaatcagtacacc

SEQ ID NO: 863520 - DNA, 25 bp, Mus musculus
tgcagcctttgtgaatcagtacacc

SEQ ID NO: 863521 - DNA, 25 bp, Mus musculus
tgcagcgacagaactagccgcactg

SEQ ID NO: 863522 - DNA, 25 bp, Mus musculus
tgcagcgacagatctagccgcactg

SEQ ID NO: 863523 - DNA, 25 bp, Mus musculus
tgcagcgacagcagctatgggcacc

SEQ ID NO: 863524 - DNA, 25 bp, Mus musculus
tgcagcgacagccaacctacgactt

SEQ ID NO: 863525 - DNA, 25 bp, Mus musculus
tgcagcgacagcgaacctacgactt

SEQ ID NO: 863526 - DNA, 25 bp, Mus musculus
tgcagcgacagctgctatgggcacc

SEQ ID NO: 863527 - DNA, 25 bp, Mus musculus
tgcagcgagcgcaccgaggtcttca

SEQ ID NO: 863528 - DNA, 25 bp, Mus musculus
tgcagcgagcgctccgaggtcttca

SEQ ID NO: 863529 - DNA, 25 bp, Mus musculus
tgcagcgagtgcatgcctgtgtatg

SEQ ID NO: 863530 - DNA, 25 bp, Mus musculus
tgcagcgagtgcttgcctgtgtatg

SEQ ID NO: 863531 - DNA, 25 bp, Mus musculus
tgcagcgattcccaagccagattga

SEQ ID NO: 863532 - DNA, 25 bp, Mus musculus
tgcagcgattccgaagccagattga

SEQ ID NO: 863533 - DNA, 25 bp, Mus musculus
tgcagcgcagagctcaggtgatcat

SEQ ID NO: 863534 - DNA, 25 bp, Mus musculus
tgcagcgcagaggtcaggtgatcat

SEQ ID NO: 863535 - DNA, 25 bp, Mus musculus
tgcagcgcatagagacgtcctaact

SEQ ID NO: 863536 - DNA, 25 bp, Mus musculus
tgcagcgcatagtgacgtcctaact

SEQ ID NO: 863537 - DNA, 25 bp, Mus musculus
tgcagcgccatcacaagggtcagaa

SEQ ID NO: 863538 - DNA, 25 bp, Mus musculus
tgcagcgccatctcaagggtcagaa

SEQ ID NO: 863539 - DNA, 25 bp, Mus musculus
tgcagcgcccacatgctggttggag

SEQ ID NO: 863540 - DNA, 25 bp, Mus musculus
tgcagcgcccacttgctggttggag

SEQ ID NO: 863541 - DNA, 25 bp, Mus musculus
tgcagcgccccaaccaggagcagaa

SEQ ID NO: 863542 - DNA, 25 bp, Mus musculus
tgcagcgccccatccaggagcagaa

SEQ ID NO: 863543 - DNA, 25 bp, Mus musculus
tgcagcgcctggcaactggcaagca

SEQ ID NO: 863544 - DNA, 25 bp, Mus musculus
tgcagcgcctgggaactggcaagca

SEQ ID NO: 863545 - DNA, 25 bp, Mus musculus
tgcagcgcctttctgttacagtagc

SEQ ID NO: 863546 - DNA, 25 bp, Mus musculus
tgcagcgcctttgtgttacagtagc

SEQ ID NO: 863547 - DNA, 25 bp, Mus musculus
tgcagcgctccaaaacccaaaagtc

SEQ ID NO: 863548 - DNA, 25 bp, Mus musculus
tgcagcgctccataacccaaaagtc

SEQ ID NO: 863549 - DNA, 25 bp, Mus musculus
tgcagcgctggaaaagacccatcaa

SEQ ID NO: 863550 - DNA, 25 bp, Mus musculus
tgcagcgctggataagacccatcaa

SEQ ID NO: 863551 - DNA, 25 bp, Mus musculus
tgcagcggaccgacgcgatgacgta

SEQ ID NO: 863552 - DNA, 25 bp, Mus musculus
tgcagcggaccgtcgcgatgacgta

SEQ ID NO: 863553 - DNA, 25 bp, Mus musculus
tgcagcggactccactctcgtgtga

SEQ ID NO: 863554 - DNA, 25 bp, Mus musculus
tgcagcggactcgactctcgtgtga

SEQ ID NO: 863555 - DNA, 25 bp, Mus musculus
tgcagcggcatgaagatgagctaag

SEQ ID NO: 863556 - DNA, 25 bp, Mus musculus
tgcagcggcatgtagatgagctaag

SEQ ID NO: 863557 - DNA, 25 bp, Mus musculus
tgcagcggcgcaccatctacggcga

SEQ ID NO: 863558 - DNA, 25 bp, Mus musculus
tgcagcggcgcagcatctacggcga

SEQ ID NO: 863559 - DNA, 25 bp, Mus musculus
tgcagcggcgggacgtttttaccag

SEQ ID NO: 863560 - DNA, 25 bp, Mus musculus
tgcagcggcgggtcgtttttaccag

SEQ ID NO: 863561 - DNA, 25 bp, Mus musculus
tgcagcgggactactcggagacgta

SEQ ID NO: 863562 - DNA, 25 bp, Mus musculus
tgcagcgggacttctcggagacgta

SEQ ID NO: 863563 - DNA, 25 bp, Mus musculus
tgcagcgggccacctacgaatacat

SEQ ID NO: 863564 - DNA, 25 bp, Mus musculus
tgcagcgggccagctacgaatacat

SEQ ID NO: 863565 - DNA, 25 bp, Mus musculus
tgcagcgggttccttttgtgcttcc

SEQ ID NO: 863566 - DNA, 25 bp, Mus musculus
tgcagcgggttcgttttgtgcttcc

SEQ ID NO: 863567 - DNA, 25 bp, Mus musculus
tgcagcggtgtgaggcttgcaattt

SEQ ID NO: 863568 - DNA, 25 bp, Mus musculus
tgcagcggtgtgtggcttgcaattt

SEQ ID NO: 863569 - DNA, 25 bp, Mus musculus
tgcagcgtccgtagcatggactgct

SEQ ID NO: 863570 - DNA, 25 bp, Mus musculus
tgcagcgtccgttgcatggactgct

SEQ ID NO: 863571 - DNA, 25 bp, Mus musculus
tgcagcgtctctacgacaagacaga

SEQ ID NO: 863572 - DNA, 25 bp, Mus musculus
tgcagcgtctcttcgacaagacaga

SEQ ID NO: 863573 - DNA, 25 bp, Mus musculus
tgcagcgtcttgagttctccaagga

SEQ ID NO: 863574 - DNA, 25 bp, Mus musculus
tgcagcgtcttgtgttctccaagga

SEQ ID NO: 863575 - DNA, 25 bp, Mus musculus
tgcagcgtgcccatctgtcgagaac

SEQ ID NO: 863576 - DNA, 25 bp, Mus musculus
tgcagcgtgcccttctgtcgagaac

SEQ ID NO: 863577 - DNA, 25 bp, Mus musculus
tgcagcgtgggcacttcgtgatccg

SEQ ID NO: 863578 - DNA, 25 bp, Mus musculus
tgcagcgtgggctcttcgtgatccg

SEQ ID NO: 863579 - DNA, 25 bp, Mus musculus
tgcagcgttgctagagttcctcatc

SEQ ID NO: 863580 - DNA, 25 bp, Mus musculus
tgcagcgttgcttgagttcctcatc

SEQ ID NO: 863581 - DNA, 25 bp, Mus musculus
tgcagctaagacacaggcaatgggt

SEQ ID NO: 863582 - DNA, 25 bp, Mus musculus
tgcagctaagactcaggcaatgggt

SEQ ID NO: 863583 - DNA, 25 bp, Mus musculus
tgcagctaagctatccaacagatgg

SEQ ID NO: 863584 - DNA, 25 bp, Mus musculus
tgcagctaagctttccaacagatgg

SEQ ID NO: 863585 - DNA, 25 bp, Mus musculus
tgcagctaatatacctctcaaaaat

SEQ ID NO: 863586 - DNA, 25 bp, Mus musculus
tgcagctaatattcctctcaaaaat

SEQ ID NO: 863587 - DNA, 25 bp, Mus musculus
tgcagctacagcagcggccttggca

SEQ ID NO: 863588 - DNA, 25 bp, Mus musculus
tgcagctacagctgcggccttggca

SEQ ID NO: 863589 - DNA, 25 bp, Mus musculus
tgcagctactacaaataaatgtgac

SEQ ID NO: 863590 - DNA, 25 bp, Mus musculus
tgcagctactactaataaatgtgac

SEQ ID NO: 863591 - DNA, 25 bp, Mus musculus
tgcagctactttagatgtccccagg

SEQ ID NO: 863592 - DNA, 25 bp, Mus musculus
tgcagctacttttgatgtccccagg

SEQ ID NO: 863593 - DNA, 25 bp, Mus musculus
tgcagctagattctggctaagcatg

SEQ ID NO: 863594 - DNA, 25 bp, Mus musculus
tgcagctagattgtggctaagcatg

SEQ ID NO: 863595 - DNA, 25 bp, Mus musculus
tgcagctagcagagggcctcgtaca

SEQ ID NO: 863596 - DNA, 25 bp, Mus musculus
tgcagctagcagtgggcctcgtaca

SEQ ID NO: 863597 - DNA, 25 bp, Mus musculus
tgcagctagggtcagtgcttgttct

SEQ ID NO: 863598 - DNA, 25 bp, Mus musculus
tgcagctagggtgagtgcttgttct

SEQ ID NO: 863599 - DNA, 25 bp, Mus musculus
tgcagctcaaaacagtgcctcctgc

SEQ ID NO: 863600 - DNA, 25 bp, Mus musculus
tgcagctcaaaagagtgcctcctgc

SEQ ID NO: 863601 - DNA, 25 bp, Mus musculus
tgcagctcaacaatagcttcagtat

SEQ ID NO: 863602 - DNA, 25 bp, Mus musculus
tgcagctcaacattagcttcagtat

SEQ ID NO: 863603 - DNA, 25 bp, Mus musculus
tgcagctcaatgaacccttggattt

SEQ ID NO: 863604 - DNA, 25 bp, Mus musculus
tgcagctcaatgtacccttggattt

SEQ ID NO: 863605 - DNA, 25 bp, Mus musculus
tgcagctcacgccagaggtgcaact

SEQ ID NO: 863606 - DNA, 25 bp, Mus musculus
tgcagctcacgcgagaggtgcaact

SEQ ID NO: 863607 - DNA, 25 bp, Mus musculus
tgcagctcagacaacagtattccat

SEQ ID NO: 863608 - DNA, 25 bp, Mus musculus
tgcagctcagactacagtattccat

SEQ ID NO: 863609 - DNA, 25 bp, Mus musculus
tgcagctcagccagaaatggagtcc

SEQ ID NO: 863610 - DNA, 25 bp, Mus musculus
tgcagctcagcctgaaatggagtcc

SEQ ID NO: 863611 - DNA, 25 bp, Mus musculus
tgcagctcatcgagttcgctatagt

SEQ ID NO: 863612 - DNA, 25 bp, Mus musculus
tgcagctcatcgtgttcgctatagt

SEQ ID NO: 863613 - DNA, 25 bp, Mus musculus
tgcagctcatgtcgcagagtgcgaa

SEQ ID NO: 863614 - DNA, 25 bp, Mus musculus
tgcagctcatgtggcagagtgcgaa

SEQ ID NO: 863615 - DNA, 25 bp, Mus musculus
tgcagctccagtacacgatcacctc

SEQ ID NO: 863616 - DNA, 25 bp, Mus musculus
tgcagctccagttcacgatcacctc

SEQ ID NO: 863617 - DNA, 25 bp, Mus musculus
tgcagctccatgaggcccagggaat

SEQ ID NO: 863618 - DNA, 25 bp, Mus musculus
tgcagctccatgtggcccagggaat

SEQ ID NO: 863619 - DNA, 25 bp, Mus musculus
tgcagctcccggacttataggaaat

SEQ ID NO: 863620 - DNA, 25 bp, Mus musculus
tgcagctcccggtcttataggaaat

SEQ ID NO: 863621 - DNA, 25 bp, Mus musculus
tgcagctccctcagtaaaggtgatt

SEQ ID NO: 863622 - DNA, 25 bp, Mus musculus
tgcagctccctctgtaaaggtgatt

SEQ ID NO: 863623 - DNA, 25 bp, Mus musculus
tgcagctcctgccaagaactaactt

SEQ ID NO: 863624 - DNA, 25 bp, Mus musculus
tgcagctcctgcgaagaactaactt

SEQ ID NO: 863625 - DNA, 25 bp, Mus musculus
tgcagctcgacaagggttacaaagt

SEQ ID NO: 863626 - DNA, 25 bp, Mus musculus
tgcagctcgacatgggttacaaagt

SEQ ID NO: 863627 - DNA, 25 bp, Mus musculus
tgcagctcggatactgatgtggaca

SEQ ID NO: 863628 - DNA, 25 bp, Mus musculus
tgcagctcggattctgatgtggaca

SEQ ID NO: 863629 - DNA, 25 bp, Mus musculus
tgcagctctacacccatgtttctga

SEQ ID NO: 863630 - DNA, 25 bp, Mus musculus
tgcagctctacagccatgtttctga

SEQ ID NO: 863631 - DNA, 25 bp, Mus musculus
tgcagctctaccagaggtacccggc

SEQ ID NO: 863632 - DNA, 25 bp, Mus musculus
tgcagctctacctgaggtacccggc

SEQ ID NO: 863633 - DNA, 25 bp, Mus musculus
tgcagctctactctgtccatcaagc

SEQ ID NO: 863634 - DNA, 25 bp, Mus musculus
tgcagctctactgtgtccatcaagc

SEQ ID NO: 863635 - DNA, 25 bp, Mus musculus
tgcagctctattattcactcgttca

SEQ ID NO: 863636 - DNA, 25 bp, Mus musculus
tgcagctctatttttcactcgttca

SEQ ID NO: 863637 - DNA, 25 bp, Mus musculus
tgcagctctcacaggtgttgcttag

SEQ ID NO: 863638 - DNA, 25 bp, Mus musculus
tgcagctctcactggtgttgcttag

SEQ ID NO: 863639 - DNA, 25 bp, Mus musculus
tgcagctctcatctaaacctctcgg

SEQ ID NO: 863640 - DNA, 25 bp, Mus musculus
tgcagctctcatgtaaacctctcgg

SEQ ID NO: 863641 - DNA, 25 bp, Mus musculus
tgcagctctccgagaagcctacgaa

SEQ ID NO: 863642 - DNA, 25 bp, Mus musculus
tgcagctctccgtgaagcctacgaa

SEQ ID NO: 863643 - DNA, 25 bp, Mus musculus
tgcagctctcctagagttcgcagag

SEQ ID NO: 863644 - DNA, 25 bp, Mus musculus
tgcagctctccttgagttcgcagag

SEQ ID NO: 863645 - DNA, 25 bp, Mus musculus
tgcagctctcttccactggctggag

SEQ ID NO: 863646 - DNA, 25 bp, Mus musculus
tgcagctctcttgcactggctggag

SEQ ID NO: 863647 - DNA, 25 bp, Mus musculus
tgcagctctggcacagcgtgacctg

SEQ ID NO: 863648 - DNA, 25 bp, Mus musculus
tgcagctctggctcagcgtgacctg

SEQ ID NO: 863649 - DNA, 25 bp, Mus musculus
tgcagctctggtaccgaactcttga

SEQ ID NO: 863650 - DNA, 25 bp, Mus musculus
tgcagctctggttccgaactcttga

SEQ ID NO: 863651 - DNA, 25 bp, Mus musculus
tgcagctcttctagccgttagcatt

SEQ ID NO: 863652 - DNA, 25 bp, Mus musculus
tgcagctcttctcgcagagctagaa

SEQ ID NO: 863653 - DNA, 25 bp, Mus musculus
tgcagctcttctggcagagctagaa

SEQ ID NO: 863654 - DNA, 25 bp, Mus musculus
tgcagctcttcttgccgttagcatt

SEQ ID NO: 863655 - DNA, 25 bp, Mus musculus
tgcagctcttggacgttgtcccgac

SEQ ID NO: 863656 - DNA, 25 bp, Mus musculus
tgcagctcttggtcgttgtcccgac

SEQ ID NO: 863657 - DNA, 25 bp, Mus musculus
tgcagctgagcaccttccgagagga

SEQ ID NO: 863658 - DNA, 25 bp, Mus musculus
tgcagctgagcagcttccgagagga

SEQ ID NO: 863659 - DNA, 25 bp, Mus musculus
tgcagctgatcactgctctcacaaa

SEQ ID NO: 863660 - DNA, 25 bp, Mus musculus
tgcagctgatcagtgctctcacaaa

SEQ ID NO: 863661 - DNA, 25 bp, Mus musculus
tgcagctgatgtatttatcccacca

SEQ ID NO: 863662 - DNA, 25 bp, Mus musculus
tgcagctgatgtttttatcccacca

SEQ ID NO: 863663 - DNA, 25 bp, Mus musculus
tgcagctgcaatccaagagggcctg

SEQ ID NO: 863664 - DNA, 25 bp, Mus musculus
tgcagctgcaatgcaagagggcctg

SEQ ID NO: 863665 - DNA, 25 bp, Mus musculus
tgcagctgcaggagccaaaaaagct

SEQ ID NO: 863666 - DNA, 25 bp, Mus musculus
tgcagctgcaggtgccaaaaaagct

SEQ ID NO: 863667 - DNA, 25 bp, Mus musculus
tgcagctgctcactccggagagttg

SEQ ID NO: 863668 - DNA, 25 bp, Mus musculus
tgcagctgctcagtccggagagttg

SEQ ID NO: 863669 - DNA, 25 bp, Mus musculus
tgcagctgctccctctgcggcagat

SEQ ID NO: 863670 - DNA, 25 bp, Mus musculus
tgcagctgctccgtctgcggcagat

SEQ ID NO: 863671 - DNA, 25 bp, Mus musculus
tgcagctgctgcaaacaagaagcct

SEQ ID NO: 863672 - DNA, 25 bp, Mus musculus
tgcagctgctgctaacaagaagcct

SEQ ID NO: 863673 - DNA, 25 bp, Mus musculus
tgcagctgctggagaggttatcaat

SEQ ID NO: 863674 - DNA, 25 bp, Mus musculus
tgcagctgctggtgaggttatcaat

SEQ ID NO: 863675 - DNA, 25 bp, Mus musculus
tgcagctgcttccactgggatgtct

SEQ ID NO: 863676 - DNA, 25 bp, Mus musculus
tgcagctgcttcgactgggatgtct

SEQ ID NO: 863677 - DNA, 25 bp, Mus musculus
tgcagctggaccagtggaccttgct

SEQ ID NO: 863678 - DNA, 25 bp, Mus musculus
tgcagctggacctgtggaccttgct

SEQ ID NO: 863679 - DNA, 25 bp, Mus musculus
tgcagctggatgagttcctgttgta

SEQ ID NO: 863680 - DNA, 25 bp, Mus musculus
tgcagctggatgtgttcctgttgta

SEQ ID NO: 863681 - DNA, 25 bp, Mus musculus
tgcagctgggaaccaccaaggcctg

SEQ ID NO: 863682 - DNA, 25 bp, Mus musculus
tgcagctgggaagcaccaaggcctg

SEQ ID NO: 863683 - DNA, 25 bp, Mus musculus
tgcagcttcactatgttcttttcgt

SEQ ID NO: 863684 - DNA, 25 bp, Mus musculus
tgcagcttcactttgttcttttcgt

SEQ ID NO: 863685 - DNA, 25 bp, Mus musculus
tgcagcttccacaaacaggttagaa

SEQ ID NO: 863686 - DNA, 25 bp, Mus musculus
tgcagcttccactaacaggttagaa

SEQ ID NO: 863687 - DNA, 25 bp, Mus musculus
tgcagcttccagcaggtaaggcgct

SEQ ID NO: 863688 - DNA, 25 bp, Mus musculus
tgcagcttccaggaggtaaggcgct

SEQ ID NO: 863689 - DNA, 25 bp, Mus musculus
tgcagcttcccactcacgggaggag

SEQ ID NO: 863690 - DNA, 25 bp, Mus musculus
tgcagcttcccagtcacgggaggag

SEQ ID NO: 863691 - DNA, 25 bp, Mus musculus
tgcagcttccctctttcttattttt

SEQ ID NO: 863692 - DNA, 25 bp, Mus musculus
tgcagcttccctgtttcttattttt

SEQ ID NO: 863693 - DNA, 25 bp, Mus musculus
tgcagcttccttaccctgtttatcc

SEQ ID NO: 863694 - DNA, 25 bp, Mus musculus
tgcagcttcctttccctgtttatcc

SEQ ID NO: 863695 - DNA, 25 bp, Mus musculus
tgcagcttcggaaaccctgcttgag

SEQ ID NO: 863696 - DNA, 25 bp, Mus musculus
tgcagcttcggataccctgcttgag

SEQ ID NO: 863697 - DNA, 25 bp, Mus musculus
tgcagcttcgtcacttgagggatga

SEQ ID NO: 863698 - DNA, 25 bp, Mus musculus
tgcagcttcgtctcttgagggatga

SEQ ID NO: 863699 - DNA, 25 bp, Mus musculus
tgcagcttctccacactgtagtaaa

SEQ ID NO: 863700 - DNA, 25 bp, Mus musculus
tgcagcttctcctcactgtagtaaa

SEQ ID NO: 863701 - DNA, 25 bp, Mus musculus
tgcagcttctctacttattgtggaa

SEQ ID NO: 863702 - DNA, 25 bp, Mus musculus
tgcagcttctcttcttattgtggaa

SEQ ID NO: 863703 - DNA, 25 bp, Mus musculus
tgcagcttcttcagtctgtgaggtt

SEQ ID NO: 863704 - DNA, 25 bp, Mus musculus
tgcagcttcttctgtctgtgaggtt

SEQ ID NO: 863705 - DNA, 25 bp, Mus musculus
tgcagcttgaggcaaagaccaccaa

SEQ ID NO: 863706 - DNA, 25 bp, Mus musculus
tgcagcttgagggaaagaccaccaa

SEQ ID NO: 863707 - DNA, 25 bp, Mus musculus
tgcagcttgcgtctgcacaggacac

SEQ ID NO: 863708 - DNA, 25 bp, Mus musculus
tgcagcttgcgtgtgcacaggacac

SEQ ID NO: 863709 - DNA, 25 bp, Mus musculus
tgcagcttgctgagggagacacaca

SEQ ID NO: 863710 - DNA, 25 bp, Mus musculus
tgcagcttgctgtgggagacacaca

SEQ ID NO: 863711 - DNA, 25 bp, Mus musculus
tgcagcttgcttccctgcggattag

SEQ ID NO: 863712 - DNA, 25 bp, Mus musculus
tgcagcttgcttcgttagcccagca

SEQ ID NO: 863713 - DNA, 25 bp, Mus musculus
tgcagcttgcttgcctgcggattag

SEQ ID NO: 863714 - DNA, 25 bp, Mus musculus
tgcagcttgcttggttagcccagca

SEQ ID NO: 863715 - DNA, 25 bp, Mus musculus
tgcagcttggccagtatgctggagt

SEQ ID NO: 863716 - DNA, 25 bp, Mus musculus
tgcagcttggcctgtatgctggagt

SEQ ID NO: 863717 - DNA, 25 bp, Mus musculus
tgcagcttggcgcaggccttatcca

SEQ ID NO: 863718 - DNA, 25 bp, Mus musculus
tgcagcttggcggaggccttatcca

SEQ ID NO: 863719 - DNA, 25 bp, Mus musculus
tgcagcttgggcagtctctgcagcg

SEQ ID NO: 863720 - DNA, 25 bp, Mus musculus
tgcagcttgggctgtctctgcagcg

SEQ ID NO: 863721 - DNA, 25 bp, Mus musculus
tgcagcttggtgaccgcggcctcta

SEQ ID NO: 863722 - DNA, 25 bp, Mus musculus
tgcagcttggtgtccgcggcctcta

SEQ ID NO: 863723 - DNA, 25 bp, Mus musculus
tgcagcttgtccatagcccactgag

SEQ ID NO: 863724 - DNA, 25 bp, Mus musculus
tgcagcttgtccttagcccactgag

SEQ ID NO: 863725 - DNA, 25 bp, Mus musculus
tgcagcttgtggattcaggcaaggt

SEQ ID NO: 863726 - DNA, 25 bp, Mus musculus
tgcagcttgtggtttcaggcaaggt

SEQ ID NO: 863727 - DNA, 25 bp, Mus musculus
tgcagcttgtgtatgtctaaccaac

SEQ ID NO: 863728 - DNA, 25 bp, Mus musculus
tgcagcttgtgtttgtctaaccaac

SEQ ID NO: 863729 - DNA, 25 bp, Mus musculus
tgcagctttcatcccctttgaaaaa

SEQ ID NO: 863730 - DNA, 25 bp, Mus musculus
tgcagctttcatgccctttgaaaaa

SEQ ID NO: 863731 - DNA, 25 bp, Mus musculus
tgcagctttccccaggctgtacagc

SEQ ID NO: 863732 - DNA, 25 bp, Mus musculus
tgcagctttcccgaggctgtacagc

SEQ ID NO: 863733 - DNA, 25 bp, Mus musculus
tgcagctttcgcctcctaaaatatg

SEQ ID NO: 863734 - DNA, 25 bp, Mus musculus
tgcagctttcgcgtcctaaaatatg

SEQ ID NO: 863735 - DNA, 25 bp, Mus musculus
tgcagctttctgctggtgacagcga

SEQ ID NO: 863736 - DNA, 25 bp, Mus musculus
tgcagctttctggtggtgacagcga

SEQ ID NO: 863737 - DNA, 25 bp, Mus musculus
tgcagctttggcatggccccatgca

SEQ ID NO: 863738 - DNA, 25 bp, Mus musculus
tgcagctttggcttggccccatgca

SEQ ID NO: 863739 - DNA, 25 bp, Mus musculus
tgcagcttttacataaccctgtagt

SEQ ID NO: 863740 - DNA, 25 bp, Mus musculus
tgcagcttttacttaaccctgtagt

SEQ ID NO: 863741 - DNA, 25 bp, Mus musculus
tgcagcttttagagacccagggtgg

SEQ ID NO: 863742 - DNA, 25 bp, Mus musculus
tgcagcttttagtgacccagggtgg

SEQ ID NO: 863743 - DNA, 25 bp, Mus musculus
tgcaggaaacctcaagtctgtgtgg

SEQ ID NO: 863744 - DNA, 25 bp, Mus musculus
tgcaggaaacctgaagtctgtgtgg

SEQ ID NO: 863745 - DNA, 25 bp, Mus musculus
tgcaggaaagttcctctccagctca

SEQ ID NO: 863746 - DNA, 25 bp, Mus musculus
tgcaggaaagttgctctccagctca

SEQ ID NO: 863747 - DNA, 25 bp, Mus musculus
tgcaggaacccaagactaaattata

SEQ ID NO: 863748 - DNA, 25 bp, Mus musculus
tgcaggaacccatgactaaattata

SEQ ID NO: 863749 - DNA, 25 bp, Mus musculus
tgcaggaactgcctacctagagagc

SEQ ID NO: 863750 - DNA, 25 bp, Mus musculus
tgcaggaactgcgtacctagagagc

SEQ ID NO: 863751 - DNA, 25 bp, Mus musculus
tgcaggaactttccctgacccaaga

SEQ ID NO: 863752 - DNA, 25 bp, Mus musculus
tgcaggaactttgcctgacccaaga

SEQ ID NO: 863753 - DNA, 25 bp, Mus musculus
tgcaggaagagtaccacaagtttaa

SEQ ID NO: 863754 - DNA, 25 bp, Mus musculus
tgcaggaagagttccacaagtttaa

SEQ ID NO: 863755 - DNA, 25 bp, Mus musculus
tgcaggaaggagcaagccccagctt

SEQ ID NO: 863756 - DNA, 25 bp, Mus musculus
tgcaggaaggaggaagccccagctt

SEQ ID NO: 863757 - DNA, 25 bp, Mus musculus
tgcaggaatgttcccgcactgtcaa

SEQ ID NO: 863758 - DNA, 25 bp, Mus musculus
tgcaggaatgttgccgcactgtcaa

SEQ ID NO: 863759 - DNA, 25 bp, Mus musculus
tgcaggacacggatctcagtaagcg

SEQ ID NO: 863760 - DNA, 25 bp, Mus musculus
tgcaggacacggttctcagtaagcg

SEQ ID NO: 863761 - DNA, 25 bp, Mus musculus
tgcaggacactgaggccttgctctt

SEQ ID NO: 863762 - DNA, 25 bp, Mus musculus
tgcaggacactgtggccttgctctt

SEQ ID NO: 863763 - DNA, 25 bp, Mus musculus
tgcaggacagcgattaggaactagt

SEQ ID NO: 863764 - DNA, 25 bp, Mus musculus
tgcaggacagcgtttaggaactagt

SEQ ID NO: 863765 - DNA, 25 bp, Mus musculus
tgcaggacagttacttctcaccgta

SEQ ID NO: 863766 - DNA, 25 bp, Mus musculus
tgcaggacagtttcttctcaccgta

SEQ ID NO: 863767 - DNA, 25 bp, Mus musculus
tgcaggacattgcatgatgtgtctg

SEQ ID NO: 863768 - DNA, 25 bp, Mus musculus
tgcaggacattggatgatgtgtctg

SEQ ID NO: 863769 - DNA, 25 bp, Mus musculus
tgcaggaccagcatttccaaaaaac

SEQ ID NO: 863770 - DNA, 25 bp, Mus musculus
tgcaggaccagcttttccaaaaaac

SEQ ID NO: 863771 - DNA, 25 bp, Mus musculus
tgcaggaccagtctgccgacgcgtc

SEQ ID NO: 863772 - DNA, 25 bp, Mus musculus
tgcaggaccagtgtgccgacgcgtc

SEQ ID NO: 863773 - DNA, 25 bp, Mus musculus
tgcaggacctgaccaattgagcttc

SEQ ID NO: 863774 - DNA, 25 bp, Mus musculus
tgcaggacctgacctctgccttcat

SEQ ID NO: 863775 - DNA, 25 bp, Mus musculus
tgcaggacctgagcaattgagcttc

SEQ ID NO: 863776 - DNA, 25 bp, Mus musculus
tgcaggacctgagctctgccttcat

SEQ ID NO: 863777 - DNA, 25 bp, Mus musculus
tgcaggacctgccagagaacacgga

SEQ ID NO: 863778 - DNA, 25 bp, Mus musculus
tgcaggacctgcgagagaacacgga

SEQ ID NO: 863779 - DNA, 25 bp, Mus musculus
tgcaggacgcagaccaaagacatgg

SEQ ID NO: 863780 - DNA, 25 bp, Mus musculus
tgcaggacgcagtccaaagacatgg

SEQ ID NO: 863781 - DNA, 25 bp, Mus musculus
tgcaggactcagaactttccggaga

SEQ ID NO: 863782 - DNA, 25 bp, Mus musculus
tgcaggactcagtactttccggaga

SEQ ID NO: 863783 - DNA, 25 bp, Mus musculus
tgcaggagctgcaatcttccaggaa

SEQ ID NO: 863784 - DNA, 25 bp, Mus musculus
tgcaggagctgctatcttccaggaa

SEQ ID NO: 863785 - DNA, 25 bp, Mus musculus
tgcaggaggcaactgaggcctatct

SEQ ID NO: 863786 - DNA, 25 bp, Mus musculus
tgcaggaggcaagtgaggcctatct

SEQ ID NO: 863787 - DNA, 25 bp, Mus musculus
tgcaggaggccaccatgctagctga

SEQ ID NO: 863788 - DNA, 25 bp, Mus musculus
tgcaggaggccagcatgctagctga

SEQ ID NO: 863789 - DNA, 25 bp, Mus musculus
tgcaggaggcccctaactctgaacc

SEQ ID NO: 863790 - DNA, 25 bp, Mus musculus
tgcaggaggcccgtaactctgaacc

SEQ ID NO: 863791 - DNA, 25 bp, Mus musculus
tgcaggaggtcacaaccaggtggat

SEQ ID NO: 863792 - DNA, 25 bp, Mus musculus
tgcaggaggtcagaaccaggtggat

SEQ ID NO: 863793 - DNA, 25 bp, Mus musculus
tgcaggaggtcgacatccaggaact

SEQ ID NO: 863794 - DNA, 25 bp, Mus musculus
tgcaggaggtcgtcatccaggaact

SEQ ID NO: 863795 - DNA, 25 bp, Mus musculus
tgcaggaggtgcagaccccagaatc

SEQ ID NO: 863796 - DNA, 25 bp, Mus musculus
tgcaggaggtgcatccttcacagtg

SEQ ID NO: 863797 - DNA, 25 bp, Mus musculus
tgcaggaggtgctgaccccagaatc

SEQ ID NO: 863798 - DNA, 25 bp, Mus musculus
tgcaggaggtgcttccttcacagtg

SEQ ID NO: 863799 - DNA, 25 bp, Mus musculus
tgcaggaggttgctttctgtcccat

SEQ ID NO: 863800 - DNA, 25 bp, Mus musculus
tgcaggaggttggtttctgtcccat

SEQ ID NO: 863801 - DNA, 25 bp, Mus musculus
tgcaggagtaccagcggagagaagg

SEQ ID NO: 863802 - DNA, 25 bp, Mus musculus
tgcaggagtacctgcggagagaagg

SEQ ID NO: 863803 - DNA, 25 bp, Mus musculus
tgcaggagtgccctaactctggtat

SEQ ID NO: 863804 - DNA, 25 bp, Mus musculus
tgcaggagtgccgtaactctggtat

SEQ ID NO: 863805 - DNA, 25 bp, Mus musculus
tgcaggagttccacactgacatgaa

SEQ ID NO: 863806 - DNA, 25 bp, Mus musculus
tgcaggagttcctcactgacatgaa

SEQ ID NO: 863807 - DNA, 25 bp, Mus musculus
tgcaggagttcgcaaaccggctttt

SEQ ID NO: 863808 - DNA, 25 bp, Mus musculus
tgcaggagttcggaaaccggctttt

SEQ ID NO: 863809 - DNA, 25 bp, Mus musculus
tgcaggagttctccccttggtcagg

SEQ ID NO: 863810 - DNA, 25 bp, Mus musculus
tgcaggagttctgcccttggtcagg

SEQ ID NO: 863811 - DNA, 25 bp, Mus musculus
tgcaggatacagacacccaaatacc

SEQ ID NO: 863812 - DNA, 25 bp, Mus musculus
tgcaggatacagtcacccaaatacc

SEQ ID NO: 863813 - DNA, 25 bp, Mus musculus
tgcaggatacatcccatattcccat

SEQ ID NO: 863814 - DNA, 25 bp, Mus musculus
tgcaggatacatgccatattcccat

SEQ ID NO: 863815 - DNA, 25 bp, Mus musculus
tgcaggatactcattgtgggatact

SEQ ID NO: 863816 - DNA, 25 bp, Mus musculus
tgcaggatactctttgtgggatact

SEQ ID NO: 863817 - DNA, 25 bp, Mus musculus
tgcaggatctgtcgccagctacaga

SEQ ID NO: 863818 - DNA, 25 bp, Mus musculus
tgcaggatctgtggccagctacaga

SEQ ID NO: 863819 - DNA, 25 bp, Mus musculus
tgcaggatgagcatggcagccagct

SEQ ID NO: 863820 - DNA, 25 bp, Mus musculus
tgcaggatgagcttggcagccagct

SEQ ID NO: 863821 - DNA, 25 bp, Mus musculus
tgcaggatgataaccaggtcatggt

SEQ ID NO: 863822 - DNA, 25 bp, Mus musculus
tgcaggatgatatccaggtcatggt

SEQ ID NO: 863823 - DNA, 25 bp, Mus musculus
tgcaggatgattcttgaaagttcaa

SEQ ID NO: 863824 - DNA, 25 bp, Mus musculus
tgcaggatgattgttgaaagttcaa

SEQ ID NO: 863825 - DNA, 25 bp, Mus musculus
tgcaggatgtgcaaaaagattcaaa

SEQ ID NO: 863826 - DNA, 25 bp, Mus musculus
tgcaggatgtgctaaaagattcaaa

SEQ ID NO: 863827 - DNA, 25 bp, Mus musculus
tgcaggattgcactagctccacaat

SEQ ID NO: 863828 - DNA, 25 bp, Mus musculus
tgcaggattgcagtagctccacaat

SEQ ID NO: 863829 - DNA, 25 bp, Mus musculus
tgcaggattggaaggtggcctacct

SEQ ID NO: 863830 - DNA, 25 bp, Mus musculus
tgcaggattggatggtggcctacct

SEQ ID NO: 863831 - DNA, 25 bp, Mus musculus
tgcaggcaaaagacaccactgagga

SEQ ID NO: 863832 - DNA, 25 bp, Mus musculus
tgcaggcaaaagtcaccactgagga

SEQ ID NO: 863833 - DNA, 25 bp, Mus musculus
tgcaggcaaacacccaaattacaaa

SEQ ID NO: 863834 - DNA, 25 bp, Mus musculus
tgcaggcaaacagccaaattacaaa

SEQ ID NO: 863835 - DNA, 25 bp, Mus musculus
tgcaggcaagccacagtttgggtac

SEQ ID NO: 863836 - DNA, 25 bp, Mus musculus
tgcaggcaagccattggcccactga

SEQ ID NO: 863837 - DNA, 25 bp, Mus musculus
tgcaggcaagcctcagtttgggtac

SEQ ID NO: 863838 - DNA, 25 bp, Mus musculus
tgcaggcaagcctttggcccactga

SEQ ID NO: 863839 - DNA, 25 bp, Mus musculus
tgcaggcaccatctttcgggacttg

SEQ ID NO: 863840 - DNA, 25 bp, Mus musculus
tgcaggcaccatgtttcgggacttg

SEQ ID NO: 863841 - DNA, 25 bp, Mus musculus
tgcaggcactgcatgtacacagtag

SEQ ID NO: 863842 - DNA, 25 bp, Mus musculus
tgcaggcactgcttgtacacagtag

SEQ ID NO: 863843 - DNA, 25 bp, Mus musculus
tgcaggcactggagcccaaacagat

SEQ ID NO: 863844 - DNA, 25 bp, Mus musculus
tgcaggcactggtgcccaaacagat

SEQ ID NO: 863845 - DNA, 25 bp, Mus musculus
tgcaggcagcctaattcagttcctt

SEQ ID NO: 863846 - DNA, 25 bp, Mus musculus
tgcaggcagccttattcagttcctt

SEQ ID NO: 863847 - DNA, 25 bp, Mus musculus
tgcaggcagcggacaccttaaactt

SEQ ID NO: 863848 - DNA, 25 bp, Mus musculus
tgcaggcagcggtcaccttaaactt

SEQ ID NO: 863849 - DNA, 25 bp, Mus musculus
tgcaggcagctcaaattggactccg

SEQ ID NO: 863850 - DNA, 25 bp, Mus musculus
tgcaggcagctctaattggactccg

SEQ ID NO: 863851 - DNA, 25 bp, Mus musculus
tgcaggcagtgtaaagggcttttcg

SEQ ID NO: 863852 - DNA, 25 bp, Mus musculus
tgcaggcagtgttaagggcttttcg

SEQ ID NO: 863853 - DNA, 25 bp, Mus musculus
tgcaggcatacactcaacacataaa

SEQ ID NO: 863854 - DNA, 25 bp, Mus musculus
tgcaggcatacagtcaacacataaa

SEQ ID NO: 863855 - DNA, 25 bp, Mus musculus
tgcaggcatcacctttccttagatg

SEQ ID NO: 863856 - DNA, 25 bp, Mus musculus
tgcaggcatcacgtttccttagatg

SEQ ID NO: 863857 - DNA, 25 bp, Mus musculus
tgcaggcatggaaggccgacaccca

SEQ ID NO: 863858 - DNA, 25 bp, Mus musculus
tgcaggcatggatggccgacaccca

SEQ ID NO: 863859 - DNA, 25 bp, Mus musculus
tgcaggcattgaagcgcgcaggcaa

SEQ ID NO: 863860 - DNA, 25 bp, Mus musculus
tgcaggcattgatgcgcgcaggcaa

SEQ ID NO: 863861 - DNA, 25 bp, Mus musculus
tgcaggccaacaatgcaaaggcagt

SEQ ID NO: 863862 - DNA, 25 bp, Mus musculus
tgcaggccaacaccgagtcaggcgt

SEQ ID NO: 863863 - DNA, 25 bp, Mus musculus
tgcaggccaacagcgagtcaggcgt

SEQ ID NO: 863864 - DNA, 25 bp, Mus musculus
tgcaggccaacattgcaaaggcagt

SEQ ID NO: 863865 - DNA, 25 bp, Mus musculus
tgcaggccaagcaaaaggcgcaggc

SEQ ID NO: 863866 - DNA, 25 bp, Mus musculus
tgcaggccaagctaaaggcgcaggc

SEQ ID NO: 863867 - DNA, 25 bp, Mus musculus
tgcaggccacatataacccaggctg

SEQ ID NO: 863868 - DNA, 25 bp, Mus musculus
tgcaggccacatttaacccaggctg

SEQ ID NO: 863869 - DNA, 25 bp, Mus musculus
tgcaggccactcacttcagatttta

SEQ ID NO: 863870 - DNA, 25 bp, Mus musculus
tgcaggccactctcttcagatttta

SEQ ID NO: 863871 - DNA, 25 bp, Mus musculus
tgcaggccagttctgaacaagacaa

SEQ ID NO: 863872 - DNA, 25 bp, Mus musculus
tgcaggccagttgtgaacaagacaa

SEQ ID NO: 863873 - DNA, 25 bp, Mus musculus
tgcaggccatcactcccaagcagag

SEQ ID NO: 863874 - DNA, 25 bp, Mus musculus
tgcaggccatcagtcccaagcagag

SEQ ID NO: 863875 - DNA, 25 bp, Mus musculus
tgcaggccatgtcgacagcctgtta

SEQ ID NO: 863876 - DNA, 25 bp, Mus musculus
tgcaggccatgtggacagcctgtta

SEQ ID NO: 863877 - DNA, 25 bp, Mus musculus
tgcaggccattcaaccggaggcggc

SEQ ID NO: 863878 - DNA, 25 bp, Mus musculus
tgcaggccattctaccggaggcggc

SEQ ID NO: 863879 - DNA, 25 bp, Mus musculus
tgcaggcccagcaggtctagcagga

SEQ ID NO: 863880 - DNA, 25 bp, Mus musculus
tgcaggcccagctggtctagcagga

SEQ ID NO: 863881 - DNA, 25 bp, Mus musculus
tgcaggcccctgctgtgaactgaat

SEQ ID NO: 863882 - DNA, 25 bp, Mus musculus
tgcaggcccctggtgtgaactgaat

SEQ ID NO: 863883 - DNA, 25 bp, Mus musculus
tgcaggccctgaacgctgctgtgga

SEQ ID NO: 863884 - DNA, 25 bp, Mus musculus
tgcaggccctgacaggcttacggca

SEQ ID NO: 863885 - DNA, 25 bp, Mus musculus
tgcaggccctgagaggcttacggca

SEQ ID NO: 863886 - DNA, 25 bp, Mus musculus
tgcaggccctgatcgctgctgtgga

SEQ ID NO: 863887 - DNA, 25 bp, Mus musculus
tgcaggccctttctatctcacattg

SEQ ID NO: 863888 - DNA, 25 bp, Mus musculus
tgcaggccctttgtatctcacattg

SEQ ID NO: 863889 - DNA, 25 bp, Mus musculus
tgcaggccgagaagttgacctcctc

SEQ ID NO: 863890 - DNA, 25 bp, Mus musculus
tgcaggccgagatgttgacctcctc

SEQ ID NO: 863891 - DNA, 25 bp, Mus musculus
tgcaggccgctaatccgagcagcat

SEQ ID NO: 863892 - DNA, 25 bp, Mus musculus
tgcaggccgctattccgagcagcat

SEQ ID NO: 863893 - DNA, 25 bp, Mus musculus
tgcaggccgggactcaggattcctc

SEQ ID NO: 863894 - DNA, 25 bp, Mus musculus
tgcaggccgggagtcaggattcctc

SEQ ID NO: 863895 - DNA, 25 bp, Mus musculus
tgcaggcctaacactcgcgtttctt

SEQ ID NO: 863896 - DNA, 25 bp, Mus musculus
tgcaggcctaactctcgcgtttctt

SEQ ID NO: 863897 - DNA, 25 bp, Mus musculus
tgcaggcctcatattgtcatagttg

SEQ ID NO: 863898 - DNA, 25 bp, Mus musculus
tgcaggcctcattttgtcatagttg

SEQ ID NO: 863899 - DNA, 25 bp, Mus musculus
tgcaggcctgcaaaccaagcattag

SEQ ID NO: 863900 - DNA, 25 bp, Mus musculus
tgcaggcctgcataccaagcattag

SEQ ID NO: 863901 - DNA, 25 bp, Mus musculus
tgcaggcctggtaagcacttggagc

SEQ ID NO: 863902 - DNA, 25 bp, Mus musculus
tgcaggcctggttagcacttggagc

SEQ ID NO: 863903 - DNA, 25 bp, Mus musculus
tgcaggcctgtcacccgaaaacaaa

SEQ ID NO: 863904 - DNA, 25 bp, Mus musculus
tgcaggcctgtctcccgaaaacaaa

SEQ ID NO: 863905 - DNA, 25 bp, Mus musculus
tgcaggccttgaccttactatatag

SEQ ID NO: 863906 - DNA, 25 bp, Mus musculus
tgcaggccttgagcttactatatag

SEQ ID NO: 863907 - DNA, 25 bp, Mus musculus
tgcaggccttggagcgtgtctttga

SEQ ID NO: 863908 - DNA, 25 bp, Mus musculus
tgcaggccttggtgcgtgtctttga

SEQ ID NO: 863909 - DNA, 25 bp, Mus musculus
tgcaggcgcccacagagttcagaag

SEQ ID NO: 863910 - DNA, 25 bp, Mus musculus
tgcaggcgcccagagagttcagaag

SEQ ID NO: 863911 - DNA, 25 bp, Mus musculus
tgcaggcgcctactactcggcatca

SEQ ID NO: 863912 - DNA, 25 bp, Mus musculus
tgcaggcgcctagtactcggcatca

SEQ ID NO: 863913 - DNA, 25 bp, Mus musculus
tgcaggcgctggactctgaagatgc

SEQ ID NO: 863914 - DNA, 25 bp, Mus musculus
tgcaggcgctggtctctgaagatgc

SEQ ID NO: 863915 - DNA, 25 bp, Mus musculus
tgcaggcggacaatctgtgtattcc

SEQ ID NO: 863916 - DNA, 25 bp, Mus musculus
tgcaggcggacattctgtgtattcc

SEQ ID NO: 863917 - DNA, 25 bp, Mus musculus
tgcaggcgggtacaaaggacccttt

SEQ ID NO: 863918 - DNA, 25 bp, Mus musculus
tgcaggcgggtagaaaggacccttt

SEQ ID NO: 863919 - DNA, 25 bp, Mus musculus
tgcaggcgtctcacagaagaaagga

SEQ ID NO: 863920 - DNA, 25 bp, Mus musculus
tgcaggcgtctctcagaagaaagga

SEQ ID NO: 863921 - DNA, 25 bp, Mus musculus
tgcaggctactgcaggattcttgag

SEQ ID NO: 863922 - DNA, 25 bp, Mus musculus
tgcaggctactggaggattcttgag

SEQ ID NO: 863923 - DNA, 25 bp, Mus musculus
tgcaggctagagaggcagagaacct

SEQ ID NO: 863924 - DNA, 25 bp, Mus musculus
tgcaggctagagtggcagagaacct

SEQ ID NO: 863925 - DNA, 25 bp, Mus musculus
tgcaggctagatcctcgcacggctt

SEQ ID NO: 863926 - DNA, 25 bp, Mus musculus
tgcaggctagatgctcgcacggctt

SEQ ID NO: 863927 - DNA, 25 bp, Mus musculus
tgcaggctcaagcagcatcccagga

SEQ ID NO: 863928 - DNA, 25 bp, Mus musculus
tgcaggctcaaggagcatcccagga

SEQ ID NO: 863929 - DNA, 25 bp, Mus musculus
tgcaggctcacaagcatcagtctct

SEQ ID NO: 863930 - DNA, 25 bp, Mus musculus
tgcaggctcacatgcatcagtctct

SEQ ID NO: 863931 - DNA, 25 bp, Mus musculus
tgcaggctcagacgccatgatggct

SEQ ID NO: 863932 - DNA, 25 bp, Mus musculus
tgcaggctcagaggccatgatggct

SEQ ID NO: 863933 - DNA, 25 bp, Mus musculus
tgcaggctccatatgctgttacagc

SEQ ID NO: 863934 - DNA, 25 bp, Mus musculus
tgcaggctccatttgctgttacagc

SEQ ID NO: 863935 - DNA, 25 bp, Mus musculus
tgcaggctccggagcctcctggctg

SEQ ID NO: 863936 - DNA, 25 bp, Mus musculus
tgcaggctccggtgcctcctggctg

SEQ ID NO: 863937 - DNA, 25 bp, Mus musculus
tgcaggctcgtacctagcaggctag

SEQ ID NO: 863938 - DNA, 25 bp, Mus musculus
tgcaggctcgtagctagcaggctag

SEQ ID NO: 863939 - DNA, 25 bp, Mus musculus
tgcaggctctaccaggccttatagc

SEQ ID NO: 863940 - DNA, 25 bp, Mus musculus
tgcaggctctacgaggccttatagc

SEQ ID NO: 863941 - DNA, 25 bp, Mus musculus
tgcaggctctgtactaatgttccct

SEQ ID NO: 863942 - DNA, 25 bp, Mus musculus
tgcaggctctgtccacgataatgaa

SEQ ID NO: 863943 - DNA, 25 bp, Mus musculus
tgcaggctctgtgcacgataatgaa

SEQ ID NO: 863944 - DNA, 25 bp, Mus musculus
tgcaggctctgttctaatgttccct

SEQ ID NO: 863945 - DNA, 25 bp, Mus musculus
tgcaggctgatgagtccaagctcct

SEQ ID NO: 863946 - DNA, 25 bp, Mus musculus
tgcaggctgatgtgtccaagctcct

SEQ ID NO: 863947 - DNA, 25 bp, Mus musculus
tgcaggctgcttcgctttacataat

SEQ ID NO: 863948 - DNA, 25 bp, Mus musculus
tgcaggctgcttggctttacataat

SEQ ID NO: 863949 - DNA, 25 bp, Mus musculus
tgcaggctgtagaggtggtcatcac

SEQ ID NO: 863950 - DNA, 25 bp, Mus musculus
tgcaggctgtagtggtggtcatcac

SEQ ID NO: 863951 - DNA, 25 bp, Mus musculus
tgcaggctgtcacaaacacccaggt

SEQ ID NO: 863952 - DNA, 25 bp, Mus musculus
tgcaggctgtcagaaacacccaggt

SEQ ID NO: 863953 - DNA, 25 bp, Mus musculus
tgcaggctttctaccggccattcaa

SEQ ID NO: 863954 - DNA, 25 bp, Mus musculus
tgcaggctttcttccggccattcaa

SEQ ID NO: 863955 - DNA, 25 bp, Mus musculus
tgcagggaacccaagtgacccatag

SEQ ID NO: 863956 - DNA, 25 bp, Mus musculus
tgcagggaaccctagtgacccatag

SEQ ID NO: 863957 - DNA, 25 bp, Mus musculus
tgcagggaactacagacccgtccga

SEQ ID NO: 863958 - DNA, 25 bp, Mus musculus
tgcagggaactagagacccgtccga

SEQ ID NO: 863959 - DNA, 25 bp, Mus musculus
tgcagggaagatccctgagcgctca

SEQ ID NO: 863960 - DNA, 25 bp, Mus musculus
tgcagggaagatgcctgagcgctca

SEQ ID NO: 863961 - DNA, 25 bp, Mus musculus
tgcagggacagaatgccctcctggt

SEQ ID NO: 863962 - DNA, 25 bp, Mus musculus
tgcagggacagattgccctcctggt

SEQ ID NO: 863963 - DNA, 25 bp, Mus musculus
tgcagggacatcattgccacgcatg

SEQ ID NO: 863964 - DNA, 25 bp, Mus musculus
tgcagggacatctttgccacgcatg

SEQ ID NO: 863965 - DNA, 25 bp, Mus musculus
tgcagggaccagaaacatcacattc

SEQ ID NO: 863966 - DNA, 25 bp, Mus musculus
tgcagggaccagtaacatcacattc

SEQ ID NO: 863967 - DNA, 25 bp, Mus musculus
tgcagggacttgaatccagccatat

SEQ ID NO: 863968 - DNA, 25 bp, Mus musculus
tgcagggacttgtatccagccatat

SEQ ID NO: 863969 - DNA, 25 bp, Mus musculus
tgcagggagactcctccaaggctca

SEQ ID NO: 863970 - DNA, 25 bp, Mus musculus
tgcagggagactgctccaaggctca

SEQ ID NO: 863971 - DNA, 25 bp, Mus musculus
tgcagggaggaccactcagtgtaca

SEQ ID NO: 863972 - DNA, 25 bp, Mus musculus
tgcagggaggacgactcagtgtaca

SEQ ID NO: 863973 - DNA, 25 bp, Mus musculus
tgcagggaggccaggcctatttttt

SEQ ID NO: 863974 - DNA, 25 bp, Mus musculus
tgcagggaggcctggcctatttttt

SEQ ID NO: 863975 - DNA, 25 bp, Mus musculus
tgcagggagtccaaagcatgtccgg

SEQ ID NO: 863976 - DNA, 25 bp, Mus musculus
tgcagggagtcctaagcatgtccgg

SEQ ID NO: 863977 - DNA, 25 bp, Mus musculus
tgcagggatattcaccaggacatgt

SEQ ID NO: 863978 - DNA, 25 bp, Mus musculus
tgcagggatattgaccaggacatgt

SEQ ID NO: 863979 - DNA, 25 bp, Mus musculus
tgcagggatgccatgcgctcagtga

SEQ ID NO: 863980 - DNA, 25 bp, Mus musculus
tgcagggatgccttgcgctcagtga

SEQ ID NO: 863981 - DNA, 25 bp, Mus musculus
tgcagggatgttaaccggcttcact

SEQ ID NO: 863982 - DNA, 25 bp, Mus musculus
tgcagggatgtttaccggcttcact

SEQ ID NO: 863983 - DNA, 25 bp, Mus musculus
tgcagggattaacggcttgccccac

SEQ ID NO: 863984 - DNA, 25 bp, Mus musculus
tgcagggattaagggcttgccccac

SEQ ID NO: 863985 - DNA, 25 bp, Mus musculus
tgcagggcaactcgctgtgccaaga

SEQ ID NO: 863986 - DNA, 25 bp, Mus musculus
tgcagggcaactggctgtgccaaga

SEQ ID NO: 863987 - DNA, 25 bp, Mus musculus
tgcagggccaggaccagcgcaccga

SEQ ID NO: 863988 - DNA, 25 bp, Mus musculus
tgcagggccaggtccagcgcaccga

SEQ ID NO: 863989 - DNA, 25 bp, Mus musculus
tgcagggcccttagctatggtgtcc

SEQ ID NO: 863990 - DNA, 25 bp, Mus musculus
tgcagggccctttgctatggtgtcc

SEQ ID NO: 863991 - DNA, 25 bp, Mus musculus
tgcagggccgtgaacagagctctga

SEQ ID NO: 863992 - DNA, 25 bp, Mus musculus
tgcagggccgtgtacagagctctga

SEQ ID NO: 863993 - DNA, 25 bp, Mus musculus
tgcagggcgcgtcgtctcttcagaa

SEQ ID NO: 863994 - DNA, 25 bp, Mus musculus
tgcagggcgcgtggtctcttcagaa

SEQ ID NO: 863995 - DNA, 25 bp, Mus musculus
tgcagggcgcttatctgactttctg

SEQ ID NO: 863996 - DNA, 25 bp, Mus musculus
tgcagggcgcttttctgactttctg

SEQ ID NO: 863997 - DNA, 25 bp, Mus musculus
tgcagggcggccagggctccttctg

SEQ ID NO: 863998 - DNA, 25 bp, Mus musculus
tgcagggcggcctgggctccttctg

SEQ ID NO: 863999 - DNA, 25 bp, Mus musculus
tgcagggctgaaaagttcccactgt

SEQ ID NO: 864000 - DNA, 25 bp, Mus musculus
tgcagggctgaatagttcccactgt

SEQ ID NO: 864001 - DNA, 25 bp, Mus musculus
tgcagggctgcactatcacatacat

SEQ ID NO: 864002 - DNA, 25 bp, Mus musculus
tgcagggctgcagtatcacatacat

SEQ ID NO: 864003 - DNA, 25 bp, Mus musculus
tgcagggcttatcccaagagctaag

SEQ ID NO: 864004 - DNA, 25 bp, Mus musculus
tgcagggcttatgccaagagctaag

SEQ ID NO: 864005 - DNA, 25 bp, Mus musculus
tgcagggcttcaaaccccaggtctt

SEQ ID NO: 864006 - DNA, 25 bp, Mus musculus
tgcagggcttcataccccaggtctt

SEQ ID NO: 864007 - DNA, 25 bp, Mus musculus
tgcagggcttgtccagtccagcacc

SEQ ID NO: 864008 - DNA, 25 bp, Mus musculus
tgcagggcttgtgcagtccagcacc

SEQ ID NO: 864009 - DNA, 25 bp, Mus musculus
tgcagggctttgagcagtcccagca

SEQ ID NO: 864010 - DNA, 25 bp, Mus musculus
tgcagggctttgtgcagtcccagca

SEQ ID NO: 864011 - DNA, 25 bp, Mus musculus
tgcaggggacatctggcctaactct

SEQ ID NO: 864012 - DNA, 25 bp, Mus musculus
tgcaggggacatgtggcctaactct

SEQ ID NO: 864013 - DNA, 25 bp, Mus musculus
tgcagggtcaacagtgcagctttcc

SEQ ID NO: 864014 - DNA, 25 bp, Mus musculus
tgcagggtcaactgtgcagctttcc

SEQ ID NO: 864015 - DNA, 25 bp, Mus musculus
tgcagggtcagcaagcagcatccca

SEQ ID NO: 864016 - DNA, 25 bp, Mus musculus
tgcagggtcagctagcagcatccca

SEQ ID NO: 864017 - DNA, 25 bp, Mus musculus
tgcagggtccgaacctaggatgcaa

SEQ ID NO: 864018 - DNA, 25 bp, Mus musculus
tgcagggtccgatcctaggatgcaa

SEQ ID NO: 864019 - DNA, 25 bp, Mus musculus
tgcagggtcctgaggcagcacttgc

SEQ ID NO: 864020 - DNA, 25 bp, Mus musculus
tgcagggtcctgtggcagcacttgc

SEQ ID NO: 864021 - DNA, 25 bp, Mus musculus
tgcagggtctatcaaaagacgactt

SEQ ID NO: 864022 - DNA, 25 bp, Mus musculus
tgcagggtctatgaaaagacgactt

SEQ ID NO: 864023 - DNA, 25 bp, Mus musculus
tgcagggtctgcaactaggactgtg

SEQ ID NO: 864024 - DNA, 25 bp, Mus musculus
tgcagggtctgctactaggactgtg

SEQ ID NO: 864025 - DNA, 25 bp, Mus musculus
tgcagggtggccagtgtcatacaac

SEQ ID NO: 864026 - DNA, 25 bp, Mus musculus
tgcagggtggcctgtgtcatacaac

SEQ ID NO: 864027 - DNA, 25 bp, Mus musculus
tgcagggttaggatcagagccctca

SEQ ID NO: 864028 - DNA, 25 bp, Mus musculus
tgcagggttaggttcagagccctca

SEQ ID NO: 864029 - DNA, 25 bp, Mus musculus
tgcagggttcagacatgttgttatt

SEQ ID NO: 864030 - DNA, 25 bp, Mus musculus
tgcagggttcagtcatgttgttatt

SEQ ID NO: 864031 - DNA, 25 bp, Mus musculus
tgcagggttcatcaggatcctctct

SEQ ID NO: 864032 - DNA, 25 bp, Mus musculus
tgcagggttcatgaggatcctctct

SEQ ID NO: 864033 - DNA, 25 bp, Mus musculus
tgcagggtttttctgacaaccacct

SEQ ID NO: 864034 - DNA, 25 bp, Mus musculus
tgcagggtttttgtgacaaccacct

SEQ ID NO: 864035 - DNA, 25 bp, Mus musculus
tgcaggtaagatagccagcggctct

SEQ ID NO: 864036 - DNA, 25 bp, Mus musculus
tgcaggtaagattgccagcggctct

SEQ ID NO: 864037 - DNA, 25 bp, Mus musculus
tgcaggtacacaaggctctacagct

SEQ ID NO: 864038 - DNA, 25 bp, Mus musculus
tgcaggtacacatggctctacagct

SEQ ID NO: 864039 - DNA, 25 bp, Mus musculus
tgcaggtaccgaccctctaaagggt

SEQ ID NO: 864040 - DNA, 25 bp, Mus musculus
tgcaggtaccgagcctctaaagggt

SEQ ID NO: 864041 - DNA, 25 bp, Mus musculus
tgcaggtacgagagggtcccttcct

SEQ ID NO: 864042 - DNA, 25 bp, Mus musculus
tgcaggtacgagtgggtcccttcct

SEQ ID NO: 864043 - DNA, 25 bp, Mus musculus
tgcaggtactgacgacggcaccaga

SEQ ID NO: 864044 - DNA, 25 bp, Mus musculus
tgcaggtactgaggacggcaccaga

SEQ ID NO: 864045 - DNA, 25 bp, Mus musculus
tgcaggtacttgagaccagggtcca

SEQ ID NO: 864046 - DNA, 25 bp, Mus musculus
tgcaggtacttgtgaccagggtcca

SEQ ID NO: 864047 - DNA, 25 bp, Mus musculus
tgcaggtcccagacaacacagtcag

SEQ ID NO: 864048 - DNA, 25 bp, Mus musculus
tgcaggtcccagtcaacacagtcag

SEQ ID NO: 864049 - DNA, 25 bp, Mus musculus
tgcaggtcgactagatggcttccca

SEQ ID NO: 864050 - DNA, 25 bp, Mus musculus
tgcaggtcgacttgatggcttccca

SEQ ID NO: 864051 - DNA, 25 bp, Mus musculus
tgcaggtcgcacagcatttaaatct

SEQ ID NO: 864052 - DNA, 25 bp, Mus musculus
tgcaggtcgcactgcatttaaatct

SEQ ID NO: 864053 - DNA, 25 bp, Mus musculus
tgcaggtcgcctagaagctggagct

SEQ ID NO: 864054 - DNA, 25 bp, Mus musculus
tgcaggtcgccttgaagctggagct

SEQ ID NO: 864055 - DNA, 25 bp, Mus musculus
tgcaggtcgggtacctcgtaccaag

SEQ ID NO: 864056 - DNA, 25 bp, Mus musculus
tgcaggtcgggttcctcgtaccaag

SEQ ID NO: 864057 - DNA, 25 bp, Mus musculus
tgcaggtcgtgtcattgctgcccag

SEQ ID NO: 864058 - DNA, 25 bp, Mus musculus
tgcaggtcgtgtgattgctgcccag

SEQ ID NO: 864059 - DNA, 25 bp, Mus musculus
tgcaggtctgccaggtgaggacaca

SEQ ID NO: 864060 - DNA, 25 bp, Mus musculus
tgcaggtctgcctggtgaggacaca

SEQ ID NO: 864061 - DNA, 25 bp, Mus musculus
tgcaggtcttgcagaaccctctgtt

SEQ ID NO: 864062 - DNA, 25 bp, Mus musculus
tgcaggtcttgctgaaccctctgtt

SEQ ID NO: 864063 - DNA, 25 bp, Mus musculus
tgcaggtgaaatcctctcatcccga

SEQ ID NO: 864064 - DNA, 25 bp, Mus musculus
tgcaggtgaaatgctctcatcccga

SEQ ID NO: 864065 - DNA, 25 bp, Mus musculus
tgcaggtgcactatgtctgtgttgt

SEQ ID NO: 864066 - DNA, 25 bp, Mus musculus
tgcaggtgcactttgtctgtgttgt

SEQ ID NO: 864067 - DNA, 25 bp, Mus musculus
tgcaggtggctcataaaatagaata

SEQ ID NO: 864068 - DNA, 25 bp, Mus musculus
tgcaggtggctcttaaaatagaata

SEQ ID NO: 864069 - DNA, 25 bp, Mus musculus
tgcaggtgtccaagcagtgatccat

SEQ ID NO: 864070 - DNA, 25 bp, Mus musculus
tgcaggtgtccaccagcatagcctg

SEQ ID NO: 864071 - DNA, 25 bp, Mus musculus
tgcaggtgtccagcagcatagcctg

SEQ ID NO: 864072 - DNA, 25 bp, Mus musculus
tgcaggtgtccatgcagtgatccat

SEQ ID NO: 864073 - DNA, 25 bp, Mus musculus
tgcaggttaagtccctaaggtttcc

SEQ ID NO: 864074 - DNA, 25 bp, Mus musculus
tgcaggttaagtgcctaaggtttcc

SEQ ID NO: 864075 - DNA, 25 bp, Mus musculus
tgcaggttatgcaagtaccctattg

SEQ ID NO: 864076 - DNA, 25 bp, Mus musculus
tgcaggttatgctagtaccctattg

SEQ ID NO: 864077 - DNA, 25 bp, Mus musculus
tgcaggttcaagagctggtgctgcc

SEQ ID NO: 864078 - DNA, 25 bp, Mus musculus
tgcaggttcaagtgctggtgctgcc

SEQ ID NO: 864079 - DNA, 25 bp, Mus musculus
tgcaggttcattacaggctcactaa

SEQ ID NO: 864080 - DNA, 25 bp, Mus musculus
tgcaggttcatttcaggctcactaa

SEQ ID NO: 864081 - DNA, 25 bp, Mus musculus
tgcaggttccagattgttcccttca

SEQ ID NO: 864082 - DNA, 25 bp, Mus musculus
tgcaggttccagtttgttcccttca

SEQ ID NO: 864083 - DNA, 25 bp, Mus musculus
tgcaggttcccgaggccacagtgct

SEQ ID NO: 864084 - DNA, 25 bp, Mus musculus
tgcaggttcccgtggccacagtgct

SEQ ID NO: 864085 - DNA, 25 bp, Mus musculus
tgcaggttcctgatcactgggtgag

SEQ ID NO: 864086 - DNA, 25 bp, Mus musculus
tgcaggttcctgttcactgggtgag

SEQ ID NO: 864087 - DNA, 25 bp, Mus musculus
tgcaggttctccatccttaaggtaa

SEQ ID NO: 864088 - DNA, 25 bp, Mus musculus
tgcaggttctccttccttaaggtaa

SEQ ID NO: 864089 - DNA, 25 bp, Mus musculus
tgcaggttctgaagctaaccgcgca

SEQ ID NO: 864090 - DNA, 25 bp, Mus musculus
tgcaggttctgatgctaaccgcgca

SEQ ID NO: 864091 - DNA, 25 bp, Mus musculus
tgcaggttgataaaacacccaaact

SEQ ID NO: 864092 - DNA, 25 bp, Mus musculus
tgcaggttgatataacacccaaact

SEQ ID NO: 864093 - DNA, 25 bp, Mus musculus
tgcaggttggaaatagcccgtatct

SEQ ID NO: 864094 - DNA, 25 bp, Mus musculus
tgcaggttggaattagcccgtatct

SEQ ID NO: 864095 - DNA, 25 bp, Mus musculus
tgcaggttgtttacttaccaccttt

SEQ ID NO: 864096 - DNA, 25 bp, Mus musculus
tgcaggttgttttcttaccaccttt

SEQ ID NO: 864097 - DNA, 25 bp, Mus musculus
tgcaggtttagtaggcaggccatct

SEQ ID NO: 864098 - DNA, 25 bp, Mus musculus
tgcaggtttagttggcaggccatct

SEQ ID NO: 864099 - DNA, 25 bp, Mus musculus
tgcaggtttatcatctgccacagaa

SEQ ID NO: 864100 - DNA, 25 bp, Mus musculus
tgcaggtttatcttctgccacagaa

SEQ ID NO: 864101 - DNA, 25 bp, Mus musculus
tgcaggtttctaaggctgctcacaa

SEQ ID NO: 864102 - DNA, 25 bp, Mus musculus
tgcaggtttctatggctgctcacaa

SEQ ID NO: 864103 - DNA, 25 bp, Mus musculus
tgcaggtttggcctatgaaatagat

SEQ ID NO: 864104 - DNA, 25 bp, Mus musculus
tgcaggtttggcgtatgaaatagat

SEQ ID NO: 864105 - DNA, 25 bp, Mus musculus
tgcaggtttgtgcaagctcggcttc

SEQ ID NO: 864106 - DNA, 25 bp, Mus musculus
tgcaggtttgtggaagctcggcttc

SEQ ID NO: 864107 - DNA, 25 bp, Mus musculus
tgcagtaaaccccagccagtcggtg

SEQ ID NO: 864108 - DNA, 25 bp, Mus musculus
tgcagtaaacccgagccagtcggtg

SEQ ID NO: 864109 - DNA, 25 bp, Mus musculus
tgcagtaagctcctaacaacgcact

SEQ ID NO: 864110 - DNA, 25 bp, Mus musculus
tgcagtaagctcgtaacaacgcact

SEQ ID NO: 864111 - DNA, 25 bp, Mus musculus
tgcagtacacacagccaacaagtgc

SEQ ID NO: 864112 - DNA, 25 bp, Mus musculus
tgcagtacacactgccaacaagtgc

SEQ ID NO: 864113 - DNA, 25 bp, Mus musculus
tgcagtacagctcaggcacaggcca

SEQ ID NO: 864114 - DNA, 25 bp, Mus musculus
tgcagtacagctgaggcacaggcca

SEQ ID NO: 864115 - DNA, 25 bp, Mus musculus
tgcagtacatccagaaccccatctg

SEQ ID NO: 864116 - DNA, 25 bp, Mus musculus
tgcagtacatcctgaaccccatctg

SEQ ID NO: 864117 - DNA, 25 bp, Mus musculus
tgcagtaccaccctcggtctaagca

SEQ ID NO: 864118 - DNA, 25 bp, Mus musculus
tgcagtaccaccgtcggtctaagca

SEQ ID NO: 864119 - DNA, 25 bp, Mus musculus
tgcagtacccacagggcatgcggct

SEQ ID NO: 864120 - DNA, 25 bp, Mus musculus
tgcagtacccactgggcatgcggct

SEQ ID NO: 864121 - DNA, 25 bp, Mus musculus
tgcagtacctagaacttcttaaccc

SEQ ID NO: 864122 - DNA, 25 bp, Mus musculus
tgcagtacctagtacttcttaaccc

SEQ ID NO: 864123 - DNA, 25 bp, Mus musculus
tgcagtacctgtccccagaatgtag

SEQ ID NO: 864124 - DNA, 25 bp, Mus musculus
tgcagtacctgtgcccagaatgtag

SEQ ID NO: 864125 - DNA, 25 bp, Mus musculus
tgcagtaccttgacctccgctggaa

SEQ ID NO: 864126 - DNA, 25 bp, Mus musculus
tgcagtaccttgtcctccgctggaa

SEQ ID NO: 864127 - DNA, 25 bp, Mus musculus
tgcagtactgctatttgtgtggttt

SEQ ID NO: 864128 - DNA, 25 bp, Mus musculus
tgcagtactgctttttgtgtggttt

SEQ ID NO: 864129 - DNA, 25 bp, Mus musculus
tgcagtagaaagcatctctctccaa

SEQ ID NO: 864130 - DNA, 25 bp, Mus musculus
tgcagtagaaaggatctctctccaa

SEQ ID NO: 864131 - DNA, 25 bp, Mus musculus
tgcagtagactgcaggccacttcta

SEQ ID NO: 864132 - DNA, 25 bp, Mus musculus
tgcagtagactggaggccacttcta

SEQ ID NO: 864133 - DNA, 25 bp, Mus musculus
tgcagtagcacacctgtggtggcat

SEQ ID NO: 864134 - DNA, 25 bp, Mus musculus
tgcagtagcacagctgtggtggcat

SEQ ID NO: 864135 - DNA, 25 bp, Mus musculus
tgcagtagctaccacatggctatct

SEQ ID NO: 864136 - DNA, 25 bp, Mus musculus
tgcagtagctacgacatggctatct

SEQ ID NO: 864137 - DNA, 25 bp, Mus musculus
tgcagtaggcgcagggtcctcctga

SEQ ID NO: 864138 - DNA, 25 bp, Mus musculus
tgcagtaggcgctgggtcctcctga

SEQ ID NO: 864139 - DNA, 25 bp, Mus musculus
tgcagtataacaaattttgaacaac

SEQ ID NO: 864140 - DNA, 25 bp, Mus musculus
tgcagtataacaacctctcaagcta

SEQ ID NO: 864141 - DNA, 25 bp, Mus musculus
tgcagtataacatattttgaacaac

SEQ ID NO: 864142 - DNA, 25 bp, Mus musculus
tgcagtataacatcctctcaagcta

SEQ ID NO: 864143 - DNA, 25 bp, Mus musculus
tgcagtataagtatttcctacatag

SEQ ID NO: 864144 - DNA, 25 bp, Mus musculus
tgcagtataagtttttcctacatag

SEQ ID NO: 864145 - DNA, 25 bp, Mus musculus
tgcagtataattacacctctcgtcc

SEQ ID NO: 864146 - DNA, 25 bp, Mus musculus
tgcagtataatttcacctctcgtcc

SEQ ID NO: 864147 - DNA, 25 bp, Mus musculus
tgcagtatagcaaccatccagatta

SEQ ID NO: 864148 - DNA, 25 bp, Mus musculus
tgcagtatagcatccatccagatta

SEQ ID NO: 864149 - DNA, 25 bp, Mus musculus
tgcagtatattaccctatcccattt

SEQ ID NO: 864150 - DNA, 25 bp, Mus musculus
tgcagtatattagcctatcccattt

SEQ ID NO: 864151 - DNA, 25 bp, Mus musculus
tgcagtatcaccacctgtgagctca

SEQ ID NO: 864152 - DNA, 25 bp, Mus musculus
tgcagtatcacctcctgtgagctca

SEQ ID NO: 864153 - DNA, 25 bp, Mus musculus
tgcagtatccatctgatcctataat

SEQ ID NO: 864154 - DNA, 25 bp, Mus musculus
tgcagtatccatgtgatcctataat

SEQ ID NO: 864155 - DNA, 25 bp, Mus musculus
tgcagtatctcaacctcatcaatta

SEQ ID NO: 864156 - DNA, 25 bp, Mus musculus
tgcagtatctcatcctcatcaatta

SEQ ID NO: 864157 - DNA, 25 bp, Mus musculus
tgcagtatcttcctgctatcagagc

SEQ ID NO: 864158 - DNA, 25 bp, Mus musculus
tgcagtatcttcgtgctatcagagc

SEQ ID NO: 864159 - DNA, 25 bp, Mus musculus
tgcagtattccaaccagcaatgggt

SEQ ID NO: 864160 - DNA, 25 bp, Mus musculus
tgcagtattccatccagcaatgggt

SEQ ID NO: 864161 - DNA, 25 bp, Mus musculus
tgcagtattcctccagttctcaaag

SEQ ID NO: 864162 - DNA, 25 bp, Mus musculus
tgcagtattcctgcagttctcaaag

SEQ ID NO: 864163 - DNA, 25 bp, Mus musculus
tgcagtatttcaaggttctatcaaa

SEQ ID NO: 864164 - DNA, 25 bp, Mus musculus
tgcagtatttcatggttctatcaaa

SEQ ID NO: 864165 - DNA, 25 bp, Mus musculus
tgcagtcaaaaacaggtcatgttcc

SEQ ID NO: 864166 - DNA, 25 bp, Mus musculus
tgcagtcaaaaagaggtcatgttcc

SEQ ID NO: 864167 - DNA, 25 bp, Mus musculus
tgcagtcaagccacgtttccttttc

SEQ ID NO: 864168 - DNA, 25 bp, Mus musculus
tgcagtcaagcctcgtttccttttc

SEQ ID NO: 864169 - DNA, 25 bp, Mus musculus
tgcagtcaatctatgctgatagcaa

SEQ ID NO: 864170 - DNA, 25 bp, Mus musculus
tgcagtcaatctttgctgatagcaa

SEQ ID NO: 864171 - DNA, 25 bp, Mus musculus
tgcagtcaattaagccgtatccctg

SEQ ID NO: 864172 - DNA, 25 bp, Mus musculus
tgcagtcaattatgccgtatccctg

SEQ ID NO: 864173 - DNA, 25 bp, Mus musculus
tgcagtcacattcaccctctctgaa

SEQ ID NO: 864174 - DNA, 25 bp, Mus musculus
tgcagtcacattgaccctctctgaa

SEQ ID NO: 864175 - DNA, 25 bp, Mus musculus
tgcagtcacccaaaaagtagaaagc

SEQ ID NO: 864176 - DNA, 25 bp, Mus musculus
tgcagtcacccataaagtagaaagc

SEQ ID NO: 864177 - DNA, 25 bp, Mus musculus
tgcagtcacgtgaacttccttccat

SEQ ID NO: 864178 - DNA, 25 bp, Mus musculus
tgcagtcacgtgtacttccttccat

SEQ ID NO: 864179 - DNA, 25 bp, Mus musculus
tgcagtcactatagttcttactgta

SEQ ID NO: 864180 - DNA, 25 bp, Mus musculus
tgcagtcactattgttcttactgta

SEQ ID NO: 864181 - DNA, 25 bp, Mus musculus
tgcagtcactgaatggtagctgagt

SEQ ID NO: 864182 - DNA, 25 bp, Mus musculus
tgcagtcactgattggtagctgagt

SEQ ID NO: 864183 - DNA, 25 bp, Mus musculus
tgcagtcacttgaagtatccaaaga

SEQ ID NO: 864184 - DNA, 25 bp, Mus musculus
tgcagtcacttgtagtatccaaaga

SEQ ID NO: 864185 - DNA, 25 bp, Mus musculus
tgcagtcaggacactcattcatata

SEQ ID NO: 864186 - DNA, 25 bp, Mus musculus
tgcagtcaggactctcattcatata

SEQ ID NO: 864187 - DNA, 25 bp, Mus musculus
tgcagtcagtttaaggaccctcatc

SEQ ID NO: 864188 - DNA, 25 bp, Mus musculus
tgcagtcagttttaggaccctcatc

SEQ ID NO: 864189 - DNA, 25 bp, Mus musculus
tgcagtcatgcaatcccaaaagcca

SEQ ID NO: 864190 - DNA, 25 bp, Mus musculus
tgcagtcatgcaatcctcgtaattc

SEQ ID NO: 864191 - DNA, 25 bp, Mus musculus
tgcagtcatgcattcccaaaagcca

SEQ ID NO: 864192 - DNA, 25 bp, Mus musculus
tgcagtcatgcattcctcgtaattc

SEQ ID NO: 864193 - DNA, 25 bp, Mus musculus
tgcagtccaacactgcctcagtggg

SEQ ID NO: 864194 - DNA, 25 bp, Mus musculus
tgcagtccaacagtgcctcagtggg

SEQ ID NO: 864195 - DNA, 25 bp, Mus musculus
tgcagtccaaccacattcaagtatg

SEQ ID NO: 864196 - DNA, 25 bp, Mus musculus
tgcagtccaacctcattcaagtatg

SEQ ID NO: 864197 - DNA, 25 bp, Mus musculus
tgcagtccaactcgtacacacgttt

SEQ ID NO: 864198 - DNA, 25 bp, Mus musculus
tgcagtccaactggtacacacgttt

SEQ ID NO: 864199 - DNA, 25 bp, Mus musculus
tgcagtccaagtcacgctagtcgat

SEQ ID NO: 864200 - DNA, 25 bp, Mus musculus
tgcagtccaagtgacgctagtcgat

SEQ ID NO: 864201 - DNA, 25 bp, Mus musculus
tgcagtccacctctttgtaactttt

SEQ ID NO: 864202 - DNA, 25 bp, Mus musculus
tgcagtccacctgtttgtaactttt

SEQ ID NO: 864203 - DNA, 25 bp, Mus musculus
tgcagtccaggcaccgcaggcagca

SEQ ID NO: 864204 - DNA, 25 bp, Mus musculus
tgcagtccaggctccgcaggcagca

SEQ ID NO: 864205 - DNA, 25 bp, Mus musculus
tgcagtcccaaaacaaagcgagctt

SEQ ID NO: 864206 - DNA, 25 bp, Mus musculus
tgcagtcccaaatcaaagcgagctt

SEQ ID NO: 864207 - DNA, 25 bp, Mus musculus
tgcagtcccaagcacggtgtccagg

SEQ ID NO: 864208 - DNA, 25 bp, Mus musculus
tgcagtcccaaggacggtgtccagg

SEQ ID NO: 864209 - DNA, 25 bp, Mus musculus
tgcagtccctggagtcaaggatcag

SEQ ID NO: 864210 - DNA, 25 bp, Mus musculus
tgcagtccctggtgtcaaggatcag

SEQ ID NO: 864211 - DNA, 25 bp, Mus musculus
tgcagtccctttaccgaggcttcaa

SEQ ID NO: 864212 - DNA, 25 bp, Mus musculus
tgcagtcccttttccgaggcttcaa

SEQ ID NO: 864213 - DNA, 25 bp, Mus musculus
tgcagtccgcggcaactgttttaag

SEQ ID NO: 864214 - DNA, 25 bp, Mus musculus
tgcagtccgcgggaactgttttaag

SEQ ID NO: 864215 - DNA, 25 bp, Mus musculus
tgcagtcctcatatatgcccggcag

SEQ ID NO: 864216 - DNA, 25 bp, Mus musculus
tgcagtcctcatttatgcccggcag

SEQ ID NO: 864217 - DNA, 25 bp, Mus musculus
tgcagtcctgccaggcgcaacagag

SEQ ID NO: 864218 - DNA, 25 bp, Mus musculus
tgcagtcctgcctggcgcaacagag

SEQ ID NO: 864219 - DNA, 25 bp, Mus musculus
tgcagtcctggacacagctaggcca

SEQ ID NO: 864220 - DNA, 25 bp, Mus musculus
tgcagtcctggagacagctaggcca

SEQ ID NO: 864221 - DNA, 25 bp, Mus musculus
tgcagtcctgtgcaggccgctagac

SEQ ID NO: 864222 - DNA, 25 bp, Mus musculus
tgcagtcctgtggaggccgctagac

SEQ ID NO: 864223 - DNA, 25 bp, Mus musculus
tgcagtccttcaataggtatatgac

SEQ ID NO: 864224 - DNA, 25 bp, Mus musculus
tgcagtccttcattaggtatatgac

SEQ ID NO: 864225 - DNA, 25 bp, Mus musculus
tgcagtccttgcagggccacatatg

SEQ ID NO: 864226 - DNA, 25 bp, Mus musculus
tgcagtccttgctgggccacatatg

SEQ ID NO: 864227 - DNA, 25 bp, Mus musculus
tgcagtccttgtatcttggtggcaa

SEQ ID NO: 864228 - DNA, 25 bp, Mus musculus
tgcagtccttgtttcttggtggcaa

SEQ ID NO: 864229 - DNA, 25 bp, Mus musculus
tgcagtcgcccaactttgaggtaga

SEQ ID NO: 864230 - DNA, 25 bp, Mus musculus
tgcagtcgcccatctttgaggtaga

SEQ ID NO: 864231 - DNA, 25 bp, Mus musculus
tgcagtctactgaccctgtgtgttg

SEQ ID NO: 864232 - DNA, 25 bp, Mus musculus
tgcagtctactgtccctgtgtgttg

SEQ ID NO: 864233 - DNA, 25 bp, Mus musculus
tgcagtctaggcctcgtgtataaat

SEQ ID NO: 864234 - DNA, 25 bp, Mus musculus
tgcagtctaggcgtcgtgtataaat

SEQ ID NO: 864235 - DNA, 25 bp, Mus musculus
tgcagtctcagcatccaggctggag

SEQ ID NO: 864236 - DNA, 25 bp, Mus musculus
tgcagtctcagcttccaggctggag

SEQ ID NO: 864237 - DNA, 25 bp, Mus musculus
tgcagtctccagctgaagcttcagt

SEQ ID NO: 864238 - DNA, 25 bp, Mus musculus
tgcagtctccaggtgaagcttcagt

SEQ ID NO: 864239 - DNA, 25 bp, Mus musculus
tgcagtctccccagatctgagggag

SEQ ID NO: 864240 - DNA, 25 bp, Mus musculus
tgcagtctcccctgatctgagggag

SEQ ID NO: 864241 - DNA, 25 bp, Mus musculus
tgcagtctcctgctcatcaactgga

SEQ ID NO: 864242 - DNA, 25 bp, Mus musculus
tgcagtctcctggtcatcaactgga

SEQ ID NO: 864243 - DNA, 25 bp, Mus musculus
tgcagtctctgtcttcttgtttgaa

SEQ ID NO: 864244 - DNA, 25 bp, Mus musculus
tgcagtctctgtgttcttgtttgaa

SEQ ID NO: 864245 - DNA, 25 bp, Mus musculus
tgcagtctgaagacccacactacag

SEQ ID NO: 864246 - DNA, 25 bp, Mus musculus
tgcagtctgaagtcccacactacag

SEQ ID NO: 864247 - DNA, 25 bp, Mus musculus
tgcagtctgcacacgttatatatac

SEQ ID NO: 864248 - DNA, 25 bp, Mus musculus
tgcagtctgcactcgttatatatac

SEQ ID NO: 864249 - DNA, 25 bp, Mus musculus
tgcagtctgcatatctcagcaggta

SEQ ID NO: 864250 - DNA, 25 bp, Mus musculus
tgcagtctgcatttctcagcaggta

SEQ ID NO: 864251 - DNA, 25 bp, Mus musculus
tgcagtctggtgaatttttgcacat

SEQ ID NO: 864252 - DNA, 25 bp, Mus musculus
tgcagtctggtgtatttttgcacat

SEQ ID NO: 864253 - DNA, 25 bp, Mus musculus
tgcagtctgtgaatgcttctgtaaa

SEQ ID NO: 864254 - DNA, 25 bp, Mus musculus
tgcagtctgtgattgcttctgtaaa

SEQ ID NO: 864255 - DNA, 25 bp, Mus musculus
tgcagtcttataattccttcatagt

SEQ ID NO: 864256 - DNA, 25 bp, Mus musculus
tgcagtcttatatttccttcatagt

SEQ ID NO: 864257 - DNA, 25 bp, Mus musculus
tgcagtcttcaacggcttttaatag

SEQ ID NO: 864258 - DNA, 25 bp, Mus musculus
tgcagtcttcaagggcttttaatag

SEQ ID NO: 864259 - DNA, 25 bp, Mus musculus
tgcagtcttcggcacttcattttcc

SEQ ID NO: 864260 - DNA, 25 bp, Mus musculus
tgcagtcttcgggacttcattttcc

SEQ ID NO: 864261 - DNA, 25 bp, Mus musculus
tgcagtcttctgcacttaatccact

SEQ ID NO: 864262 - DNA, 25 bp, Mus musculus
tgcagtcttctggacttaatccact

SEQ ID NO: 864263 - DNA, 25 bp, Mus musculus
tgcagtcttgaccttttgggctcaa

SEQ ID NO: 864264 - DNA, 25 bp, Mus musculus
tgcagtcttgacgttttgggctcaa

SEQ ID NO: 864265 - DNA, 25 bp, Mus musculus
tgcagtgaatgtcgccttgcccttg

SEQ ID NO: 864266 - DNA, 25 bp, Mus musculus
tgcagtgaatgtggccttgcccttg

SEQ ID NO: 864267 - DNA, 25 bp, Mus musculus
tgcagtgaccctccggactgggttc

SEQ ID NO: 864268 - DNA, 25 bp, Mus musculus
tgcagtgaccctgcggactgggttc

SEQ ID NO: 864269 - DNA, 25 bp, Mus musculus
tgcagtgacctcaagagcttctatc

SEQ ID NO: 864270 - DNA, 25 bp, Mus musculus
tgcagtgacctctagagcttctatc

SEQ ID NO: 864271 - DNA, 25 bp, Mus musculus
tgcagtgactaaaccctgaggtggt

SEQ ID NO: 864272 - DNA, 25 bp, Mus musculus
tgcagtgactaatccctgaggtggt

SEQ ID NO: 864273 - DNA, 25 bp, Mus musculus
tgcagtgactgccttgagagccctg

SEQ ID NO: 864274 - DNA, 25 bp, Mus musculus
tgcagtgactgcgttgagagccctg

SEQ ID NO: 864275 - DNA, 25 bp, Mus musculus
tgcagtgacttacatggaatatgtt

SEQ ID NO: 864276 - DNA, 25 bp, Mus musculus
tgcagtgacttagatggaatatgtt

SEQ ID NO: 864277 - DNA, 25 bp, Mus musculus
tgcagtgagaccacggcacgcggac

SEQ ID NO: 864278 - DNA, 25 bp, Mus musculus
tgcagtgagacctcggcacgcggac

SEQ ID NO: 864279 - DNA, 25 bp, Mus musculus
tgcagtgagcagacaataccatgga

SEQ ID NO: 864280 - DNA, 25 bp, Mus musculus
tgcagtgagcagtcaataccatgga

SEQ ID NO: 864281 - DNA, 25 bp, Mus musculus
tgcagtgagccccggctacatgtcc

SEQ ID NO: 864282 - DNA, 25 bp, Mus musculus
tgcagtgagcccgggctacatgtcc

SEQ ID NO: 864283 - DNA, 25 bp, Mus musculus
tgcagtgagggcctaggcctacccc

SEQ ID NO: 864284 - DNA, 25 bp, Mus musculus
tgcagtgagggcgtaggcctacccc

SEQ ID NO: 864285 - DNA, 25 bp, Mus musculus
tgcagtgagtagaccagacccgctt

SEQ ID NO: 864286 - DNA, 25 bp, Mus musculus
tgcagtgagtagtccagacccgctt

SEQ ID NO: 864287 - DNA, 25 bp, Mus musculus
tgcagtgagtggagtgaaacaaaca

SEQ ID NO: 864288 - DNA, 25 bp, Mus musculus
tgcagtgagtggtgtgaaacaaaca

SEQ ID NO: 864289 - DNA, 25 bp, Mus musculus
tgcagtgagtttatcagccctttct

SEQ ID NO: 864290 - DNA, 25 bp, Mus musculus
tgcagtgagtttttcagccctttct

SEQ ID NO: 864291 - DNA, 25 bp, Mus musculus
tgcagtgcaaacaaatacttctggg

SEQ ID NO: 864292 - DNA, 25 bp, Mus musculus
tgcagtgcaaactaatacttctggg

SEQ ID NO: 864293 - DNA, 25 bp, Mus musculus
tgcagtgcaaccaacagcaacctag

SEQ ID NO: 864294 - DNA, 25 bp, Mus musculus
tgcagtgcaacctacagcaacctag

SEQ ID NO: 864295 - DNA, 25 bp, Mus musculus
tgcagtgcagatcttacctcttgct

SEQ ID NO: 864296 - DNA, 25 bp, Mus musculus
tgcagtgcagatgttacctcttgct

SEQ ID NO: 864297 - DNA, 25 bp, Mus musculus
tgcagtgcagccagaatgcgactca

SEQ ID NO: 864298 - DNA, 25 bp, Mus musculus
tgcagtgcagcctgaatgcgactca

SEQ ID NO: 864299 - DNA, 25 bp, Mus musculus
tgcagtgcattgacacaggctcaca

SEQ ID NO: 864300 - DNA, 25 bp, Mus musculus
tgcagtgcattgtcacaggctcaca

SEQ ID NO: 864301 - DNA, 25 bp, Mus musculus
tgcagtgccacacttgagcccattt

SEQ ID NO: 864302 - DNA, 25 bp, Mus musculus
tgcagtgccacagttgagcccattt

SEQ ID NO: 864303 - DNA, 25 bp, Mus musculus
tgcagtgccccaacaggccatgaga

SEQ ID NO: 864304 - DNA, 25 bp, Mus musculus
tgcagtgccccatcaggccatgaga

SEQ ID NO: 864305 - DNA, 25 bp, Mus musculus
tgcagtgccgagacctaccaggatt

SEQ ID NO: 864306 - DNA, 25 bp, Mus musculus
tgcagtgccgagtcctaccaggatt

SEQ ID NO: 864307 - DNA, 25 bp, Mus musculus
tgcagtgcgttccagcttttatcag

SEQ ID NO: 864308 - DNA, 25 bp, Mus musculus
tgcagtgcgttcgagcttttatcag

SEQ ID NO: 864309 - DNA, 25 bp, Mus musculus
tgcagtgctcagagaccctggaaga

SEQ ID NO: 864310 - DNA, 25 bp, Mus musculus
tgcagtgctcagtgaccctggaaga

SEQ ID NO: 864311 - DNA, 25 bp, Mus musculus
tgcagtgctctcaggaaggtcggca

SEQ ID NO: 864312 - DNA, 25 bp, Mus musculus
tgcagtgctctctggaaggtcggca

SEQ ID NO: 864313 - DNA, 25 bp, Mus musculus
tgcagtgctgaccacttgtcttctg

SEQ ID NO: 864314 - DNA, 25 bp, Mus musculus
tgcagtgctgacgacttgtcttctg

SEQ ID NO: 864315 - DNA, 25 bp, Mus musculus
tgcagtgctgctacataattcacaa

SEQ ID NO: 864316 - DNA, 25 bp, Mus musculus
tgcagtgctgcttcataattcacaa

SEQ ID NO: 864317 - DNA, 25 bp, Mus musculus
tgcagtgcttgcaagaagaccttta

SEQ ID NO: 864318 - DNA, 25 bp, Mus musculus
tgcagtgcttgctagaagaccttta

SEQ ID NO: 864319 - DNA, 25 bp, Mus musculus
tgcagtggaccccatgggaacccag

SEQ ID NO: 864320 - DNA, 25 bp, Mus musculus
tgcagtggacccgatgggaacccag

SEQ ID NO: 864321 - DNA, 25 bp, Mus musculus
tgcagtggcagaaggctcctctagc

SEQ ID NO: 864322 - DNA, 25 bp, Mus musculus
tgcagtggcagatggctcctctagc

SEQ ID NO: 864323 - DNA, 25 bp, Mus musculus
tgcagtggcagcacacgggactgaa

SEQ ID NO: 864324 - DNA, 25 bp, Mus musculus
tgcagtggcagctcacgggactgaa

SEQ ID NO: 864325 - DNA, 25 bp, Mus musculus
tgcagtggccacctggctaaacctg

SEQ ID NO: 864326 - DNA, 25 bp, Mus musculus
tgcagtggccacgtggctaaacctg

SEQ ID NO: 864327 - DNA, 25 bp, Mus musculus
tgcagtggcgtaacagtcctttgct

SEQ ID NO: 864328 - DNA, 25 bp, Mus musculus
tgcagtggcgtatcagtcctttgct

SEQ ID NO: 864329 - DNA, 25 bp, Mus musculus
tgcagtggctggataaagtccttac

SEQ ID NO: 864330 - DNA, 25 bp, Mus musculus
tgcagtggctggttaaagtccttac

SEQ ID NO: 864331 - DNA, 25 bp, Mus musculus
tgcagtgggcataagtccctttctc

SEQ ID NO: 864332 - DNA, 25 bp, Mus musculus
tgcagtgggcattagtccctttctc

SEQ ID NO: 864333 - DNA, 25 bp, Mus musculus
tgcagtggtctcaatctgttgcaaa

SEQ ID NO: 864334 - DNA, 25 bp, Mus musculus
tgcagtggtctctatctgttgcaaa

SEQ ID NO: 864335 - DNA, 25 bp, Mus musculus
tgcagtggtgacacaggaggaccct

SEQ ID NO: 864336 - DNA, 25 bp, Mus musculus
tgcagtggtgactcaggaggaccct

SEQ ID NO: 864337 - DNA, 25 bp, Mus musculus
tgcagtggtgtaaaagcttattaaa

SEQ ID NO: 864338 - DNA, 25 bp, Mus musculus
tgcagtggtgtataagcttattaaa

SEQ ID NO: 864339 - DNA, 25 bp, Mus musculus
tgcagtggttagctaagtgtgtctt

SEQ ID NO: 864340 - DNA, 25 bp, Mus musculus
tgcagtggttaggtaagtgtgtctt

SEQ ID NO: 864341 - DNA, 25 bp, Mus musculus
tgcagtgtacacaggcctgttctac

SEQ ID NO: 864342 - DNA, 25 bp, Mus musculus
tgcagtgtacactggcctgttctac

SEQ ID NO: 864343 - DNA, 25 bp, Mus musculus
tgcagtgtacgacacaggaagccat

SEQ ID NO: 864344 - DNA, 25 bp, Mus musculus
tgcagtgtacgagacaggaagccat

SEQ ID NO: 864345 - DNA, 25 bp, Mus musculus
tgcagtgtagttccttgaataaaca

SEQ ID NO: 864346 - DNA, 25 bp, Mus musculus
tgcagtgtagttgcttgaataaaca

SEQ ID NO: 864347 - DNA, 25 bp, Mus musculus
tgcagtgtatgcagtgccctgggtt

SEQ ID NO: 864348 - DNA, 25 bp, Mus musculus
tgcagtgtatgctgtgccctgggtt

SEQ ID NO: 864349 - DNA, 25 bp, Mus musculus
tgcagtgtctgactccatgattcga

SEQ ID NO: 864350 - DNA, 25 bp, Mus musculus
tgcagtgtctgagtccatgattcga

SEQ ID NO: 864351 - DNA, 25 bp, Mus musculus
tgcagtgtgatcagagcctccatca

SEQ ID NO: 864352 - DNA, 25 bp, Mus musculus
tgcagtgtgatctgagcctccatca

SEQ ID NO: 864353 - DNA, 25 bp, Mus musculus
tgcagtgtgcacatactactagtta

SEQ ID NO: 864354 - DNA, 25 bp, Mus musculus
tgcagtgtgcaccttgatagtcaca

SEQ ID NO: 864355 - DNA, 25 bp, Mus musculus
tgcagtgtgcacgttgatagtcaca

SEQ ID NO: 864356 - DNA, 25 bp, Mus musculus
tgcagtgtgcacttactactagtta

SEQ ID NO: 864357 - DNA, 25 bp, Mus musculus
tgcagtgtgcgcaaggacccgtgct

SEQ ID NO: 864358 - DNA, 25 bp, Mus musculus
tgcagtgtgcgctaggacccgtgct

SEQ ID NO: 864359 - DNA, 25 bp, Mus musculus
tgcagtgtgctcagggttcctggct

SEQ ID NO: 864360 - DNA, 25 bp, Mus musculus
tgcagtgtgctctgggttcctggct

SEQ ID NO: 864361 - DNA, 25 bp, Mus musculus
tgcagtgttagcagttattacaggc

SEQ ID NO: 864362 - DNA, 25 bp, Mus musculus
tgcagtgttagctgttattacaggc

SEQ ID NO: 864363 - DNA, 25 bp, Mus musculus
tgcagtgttctcactacaatggcca

SEQ ID NO: 864364 - DNA, 25 bp, Mus musculus
tgcagtgttctctctacaatggcca

SEQ ID NO: 864365 - DNA, 25 bp, Mus musculus
tgcagtgttgacacatctagattct

SEQ ID NO: 864366 - DNA, 25 bp, Mus musculus
tgcagtgttgactcatctagattct

SEQ ID NO: 864367 - DNA, 25 bp, Mus musculus
tgcagtgttgcaagtttttaagttc

SEQ ID NO: 864368 - DNA, 25 bp, Mus musculus
tgcagtgttgcatgtttttaagttc

SEQ ID NO: 864369 - DNA, 25 bp, Mus musculus
tgcagtgttggaagcccagcagcct

SEQ ID NO: 864370 - DNA, 25 bp, Mus musculus
tgcagtgttggatgcccagcagcct

SEQ ID NO: 864371 - DNA, 25 bp, Mus musculus
tgcagtgtttgtactcagggaccct

SEQ ID NO: 864372 - DNA, 25 bp, Mus musculus
tgcagtgtttgttctcagggaccct

SEQ ID NO: 864373 - DNA, 25 bp, Mus musculus
tgcagttaactaaggcggaggtcac

SEQ ID NO: 864374 - DNA, 25 bp, Mus musculus
tgcagttaactatggcggaggtcac

SEQ ID NO: 864375 - DNA, 25 bp, Mus musculus
tgcagttaccaccatacaaggcctt

SEQ ID NO: 864376 - DNA, 25 bp, Mus musculus
tgcagttaccacgatacaaggcctt

SEQ ID NO: 864377 - DNA, 25 bp, Mus musculus
tgcagttaccgacgccgtgtcaaaa

SEQ ID NO: 864378 - DNA, 25 bp, Mus musculus
tgcagttaccgaggccgtgtcaaaa

SEQ ID NO: 864379 - DNA, 25 bp, Mus musculus
tgcagttacttccatagacagctaa

SEQ ID NO: 864380 - DNA, 25 bp, Mus musculus
tgcagttacttcgatagacagctaa

SEQ ID NO: 864381 - DNA, 25 bp, Mus musculus
tgcagttagcatatcccagtgaggg

SEQ ID NO: 864382 - DNA, 25 bp, Mus musculus
tgcagttagcatttcccagtgaggg

SEQ ID NO: 864383 - DNA, 25 bp, Mus musculus
tgcagttatttcattgagtcagaac

SEQ ID NO: 864384 - DNA, 25 bp, Mus musculus
tgcagttatttctttgagtcagaac

SEQ ID NO: 864385 - DNA, 25 bp, Mus musculus
tgcagttcaagcaaaggccacagac

SEQ ID NO: 864386 - DNA, 25 bp, Mus musculus
tgcagttcaagctaaggccacagac

SEQ ID NO: 864387 - DNA, 25 bp, Mus musculus
tgcagttcagaaaactgagtcctct

SEQ ID NO: 864388 - DNA, 25 bp, Mus musculus
tgcagttcagaatactgagtcctct

SEQ ID NO: 864389 - DNA, 25 bp, Mus musculus
tgcagttcagttcctcctgagttaa

SEQ ID NO: 864390 - DNA, 25 bp, Mus musculus
tgcagttcagttgctcctgagttaa

SEQ ID NO: 864391 - DNA, 25 bp, Mus musculus
tgcagttcattccatgcctcatata

SEQ ID NO: 864392 - DNA, 25 bp, Mus musculus
tgcagttcattcgatgcctcatata

SEQ ID NO: 864393 - DNA, 25 bp, Mus musculus
tgcagttccctcacaggtcagaagg

SEQ ID NO: 864394 - DNA, 25 bp, Mus musculus
tgcagttccctctcaggtcagaagg

SEQ ID NO: 864395 - DNA, 25 bp, Mus musculus
tgcagttccggaaccccatggagat

SEQ ID NO: 864396 - DNA, 25 bp, Mus musculus
tgcagttccggatccccatggagat

SEQ ID NO: 864397 - DNA, 25 bp, Mus musculus
tgcagttcctctcggacacatgcta

SEQ ID NO: 864398 - DNA, 25 bp, Mus musculus
tgcagttcctctgggacacatgcta

SEQ ID NO: 864399 - DNA, 25 bp, Mus musculus
tgcagttcctttctgtccgacaaga

SEQ ID NO: 864400 - DNA, 25 bp, Mus musculus
tgcagttcctttgtgtccgacaaga

SEQ ID NO: 864401 - DNA, 25 bp, Mus musculus
tgcagttcgcacacacggtgaatgc

SEQ ID NO: 864402 - DNA, 25 bp, Mus musculus
tgcagttcgcactcacggtgaatgc

SEQ ID NO: 864403 - DNA, 25 bp, Mus musculus
tgcagttctacacaccgttcggtga

SEQ ID NO: 864404 - DNA, 25 bp, Mus musculus
tgcagttctacagaccgttcggtga

SEQ ID NO: 864405 - DNA, 25 bp, Mus musculus
tgcagttctcataagcacctttaga

SEQ ID NO: 864406 - DNA, 25 bp, Mus musculus
tgcagttctcattagcacctttaga

SEQ ID NO: 864407 - DNA, 25 bp, Mus musculus
tgcagttctccaagttacagtcctt

SEQ ID NO: 864408 - DNA, 25 bp, Mus musculus
tgcagttctccatgttacagtcctt

SEQ ID NO: 864409 - DNA, 25 bp, Mus musculus
tgcagttctgacagcggtggaagtt

SEQ ID NO: 864410 - DNA, 25 bp, Mus musculus
tgcagttctgacatctggatctgaa

SEQ ID NO: 864411 - DNA, 25 bp, Mus musculus
tgcagttctgactgcggtggaagtt

SEQ ID NO: 864412 - DNA, 25 bp, Mus musculus
tgcagttctgacttctggatctgaa

SEQ ID NO: 864413 - DNA, 25 bp, Mus musculus
tgcagttctggtacggagtctctaa

SEQ ID NO: 864414 - DNA, 25 bp, Mus musculus
tgcagttctggttcggagtctctaa

SEQ ID NO: 864415 - DNA, 25 bp, Mus musculus
tgcagttcttgcaggatcacaaaca

SEQ ID NO: 864416 - DNA, 25 bp, Mus musculus
tgcagttcttgctggatcacaaaca

SEQ ID NO: 864417 - DNA, 25 bp, Mus musculus
tgcagttcttttctcacttgggcca

SEQ ID NO: 864418 - DNA, 25 bp, Mus musculus
tgcagttcttttgtcacttgggcca

SEQ ID NO: 864419 - DNA, 25 bp, Mus musculus
tgcagttgcatccacagctccactt

SEQ ID NO: 864420 - DNA, 25 bp, Mus musculus
tgcagttgcatcgacagctccactt

SEQ ID NO: 864421 - DNA, 25 bp, Mus musculus
tgcagttgccagatcaggtttaagc

SEQ ID NO: 864422 - DNA, 25 bp, Mus musculus
tgcagttgccagttcaggtttaagc

SEQ ID NO: 864423 - DNA, 25 bp, Mus musculus
tgcagttgctgcaacccataattca

SEQ ID NO: 864424 - DNA, 25 bp, Mus musculus
tgcagttgctgctacccataattca

SEQ ID NO: 864425 - DNA, 25 bp, Mus musculus
tgcagttggctaccggccatttact

SEQ ID NO: 864426 - DNA, 25 bp, Mus musculus
tgcagttggctagcggccatttact

SEQ ID NO: 864427 - DNA, 25 bp, Mus musculus
tgcagttggcttcccaagcaggctc

SEQ ID NO: 864428 - DNA, 25 bp, Mus musculus
tgcagttggcttgccaagcaggctc

SEQ ID NO: 864429 - DNA, 25 bp, Mus musculus
tgcagttggtgcaggccccactgca

SEQ ID NO: 864430 - DNA, 25 bp, Mus musculus
tgcagttggtgctggccccactgca

SEQ ID NO: 864431 - DNA, 25 bp, Mus musculus
tgcagttgtataagttgtttgtcag

SEQ ID NO: 864432 - DNA, 25 bp, Mus musculus
tgcagttgtatatgttgtttgtcag

SEQ ID NO: 864433 - DNA, 25 bp, Mus musculus
tgcagttgtcagaaagaatcggaaa

SEQ ID NO: 864434 - DNA, 25 bp, Mus musculus
tgcagttgtcagtaagaatcggaaa

SEQ ID NO: 864435 - DNA, 25 bp, Mus musculus
tgcagttgttttaagccgtcaaagt

SEQ ID NO: 864436 - DNA, 25 bp, Mus musculus
tgcagttgtttttagccgtcaaagt

SEQ ID NO: 864437 - DNA, 25 bp, Mus musculus
tgcagtttaaatccatcttgctaaa

SEQ ID NO: 864438 - DNA, 25 bp, Mus musculus
tgcagtttaaatgcatcttgctaaa

SEQ ID NO: 864439 - DNA, 25 bp, Mus musculus
tgcagtttacgcaggccatttttct

SEQ ID NO: 864440 - DNA, 25 bp, Mus musculus
tgcagtttacgctggccatttttct

SEQ ID NO: 864441 - DNA, 25 bp, Mus musculus
tgcagtttatttctcattgtgtatg

SEQ ID NO: 864442 - DNA, 25 bp, Mus musculus
tgcagtttatttgtcattgtgtatg

SEQ ID NO: 864443 - DNA, 25 bp, Mus musculus
tgcagtttcctcatggcagtttggg

SEQ ID NO: 864444 - DNA, 25 bp, Mus musculus
tgcagtttcctcttggcagtttggg

SEQ ID NO: 864445 - DNA, 25 bp, Mus musculus
tgcagtttctgcctttaagccaaag

SEQ ID NO: 864446 - DNA, 25 bp, Mus musculus
tgcagtttctgcgtttaagccaaag

SEQ ID NO: 864447 - DNA, 25 bp, Mus musculus
tgcagtttcttcaccagcccttgca

SEQ ID NO: 864448 - DNA, 25 bp, Mus musculus
tgcagtttcttctccagcccttgca

SEQ ID NO: 864449 - DNA, 25 bp, Mus musculus
tgcagtttgcaacaccaggacggtc

SEQ ID NO: 864450 - DNA, 25 bp, Mus musculus
tgcagtttgcaagaccaggacggtc

SEQ ID NO: 864451 - DNA, 25 bp, Mus musculus
tgcagtttgcagcaagcactagcgt

SEQ ID NO: 864452 - DNA, 25 bp, Mus musculus
tgcagtttgcaggaagcactagcgt

SEQ ID NO: 864453 - DNA, 25 bp, Mus musculus
tgcagtttggcacgaccgtcagtta

SEQ ID NO: 864454 - DNA, 25 bp, Mus musculus
tgcagtttggcaggaccgtcagtta

SEQ ID NO: 864455 - DNA, 25 bp, Mus musculus
tgcagtttgtcgctagggatttcct

SEQ ID NO: 864456 - DNA, 25 bp, Mus musculus
tgcagtttgtcggtagggatttcct

SEQ ID NO: 864457 - DNA, 25 bp, Mus musculus
tgcagtttgtggagcccagccggca

SEQ ID NO: 864458 - DNA, 25 bp, Mus musculus
tgcagtttgtggtgcccagccggca

SEQ ID NO: 864459 - DNA, 25 bp, Mus musculus
tgcagttttggacaggatagatgtt

SEQ ID NO: 864460 - DNA, 25 bp, Mus musculus
tgcagttttggagaggatagatgtt

SEQ ID NO: 864461 - DNA, 25 bp, Mus musculus
tgcataaaacctattggtttccact

SEQ ID NO: 864462 - DNA, 25 bp, Mus musculus
tgcataaaaccttttggtttccact

SEQ ID NO: 864463 - DNA, 25 bp, Mus musculus
tgcataaagaaacccctcagcccaa

SEQ ID NO: 864464 - DNA, 25 bp, Mus musculus
tgcataaagaaagccctcagcccaa

SEQ ID NO: 864465 - DNA, 25 bp, Mus musculus
tgcataaagactatcctggagcacc

SEQ ID NO: 864466 - DNA, 25 bp, Mus musculus
tgcataaagactttcctggagcacc

SEQ ID NO: 864467 - DNA, 25 bp, Mus musculus
tgcataaagcaacgtcaaggaactt

SEQ ID NO: 864468 - DNA, 25 bp, Mus musculus
tgcataaagcaaggtcaaggaactt

SEQ ID NO: 864469 - DNA, 25 bp, Mus musculus
tgcataacagacatgaggtaccagt

SEQ ID NO: 864470 - DNA, 25 bp, Mus musculus
tgcataacagacttgaggtaccagt

SEQ ID NO: 864471 - DNA, 25 bp, Mus musculus
tgcataaccatcagtttccttacca

SEQ ID NO: 864472 - DNA, 25 bp, Mus musculus
tgcataaccatctgtttccttacca

SEQ ID NO: 864473 - DNA, 25 bp, Mus musculus
tgcataactctgagtgcagccctta

SEQ ID NO: 864474 - DNA, 25 bp, Mus musculus
tgcataactctgtgtgcagccctta

SEQ ID NO: 864475 - DNA, 25 bp, Mus musculus
tgcataagacaacccaaccaagact

SEQ ID NO: 864476 - DNA, 25 bp, Mus musculus
tgcataagacaagccaaccaagact

SEQ ID NO: 864477 - DNA, 25 bp, Mus musculus
tgcataagatacacgtgccgtctcc

SEQ ID NO: 864478 - DNA, 25 bp, Mus musculus
tgcataagatactcgtgccgtctcc

SEQ ID NO: 864479 - DNA, 25 bp, Mus musculus
tgcataaggacccgtgtttcctttt

SEQ ID NO: 864480 - DNA, 25 bp, Mus musculus
tgcataaggaccggtgtttcctttt

SEQ ID NO: 864481 - DNA, 25 bp, Mus musculus
tgcataaggccccacgtttgagcac

SEQ ID NO: 864482 - DNA, 25 bp, Mus musculus
tgcataaggcccgacgtttgagcac

SEQ ID NO: 864483 - DNA, 25 bp, Mus musculus
tgcataagtgagaccaagccagtca

SEQ ID NO: 864484 - DNA, 25 bp, Mus musculus
tgcataagtgagtccaagccagtca

SEQ ID NO: 864485 - DNA, 25 bp, Mus musculus
tgcataataaacagggcgtggcggc

SEQ ID NO: 864486 - DNA, 25 bp, Mus musculus
tgcataataaactgggcgtggcggc

SEQ ID NO: 864487 - DNA, 25 bp, Mus musculus
tgcataatacctacacctgcttgtt

SEQ ID NO: 864488 - DNA, 25 bp, Mus musculus
tgcataataccttcacctgcttgtt

SEQ ID NO: 864489 - DNA, 25 bp, Mus musculus
tgcataatccgtctaacccagaatt

SEQ ID NO: 864490 - DNA, 25 bp, Mus musculus
tgcataatccgtgtaacccagaatt

SEQ ID NO: 864491 - DNA, 25 bp, Mus musculus
tgcataatgggcatccaacttctcg

SEQ ID NO: 864492 - DNA, 25 bp, Mus musculus
tgcataatgggcttccaacttctcg

SEQ ID NO: 864493 - DNA, 25 bp, Mus musculus
tgcataatgtatcacaggaaccgaa

SEQ ID NO: 864494 - DNA, 25 bp, Mus musculus
tgcataatgtatgacaggaaccgaa

SEQ ID NO: 864495 - DNA, 25 bp, Mus musculus
tgcataatgtctacagggcttcagt

SEQ ID NO: 864496 - DNA, 25 bp, Mus musculus
tgcataatgtcttcagggcttcagt

SEQ ID NO: 864497 - DNA, 25 bp, Mus musculus
tgcataattgctcggagttggcttt

SEQ ID NO: 864498 - DNA, 25 bp, Mus musculus
tgcataattgctgggagttggcttt

SEQ ID NO: 864499 - DNA, 25 bp, Mus musculus
tgcatacaacccctaaaattcctgg

SEQ ID NO: 864500 - DNA, 25 bp, Mus musculus
tgcatacaacccgtaaaattcctgg

SEQ ID NO: 864501 - DNA, 25 bp, Mus musculus
tgcatacacgaacacctcacacaga

SEQ ID NO: 864502 - DNA, 25 bp, Mus musculus
tgcatacacgaagacctcacacaga

SEQ ID NO: 864503 - DNA, 25 bp, Mus musculus
tgcatacagaatagtggactcccaa

SEQ ID NO: 864504 - DNA, 25 bp, Mus musculus
tgcatacagaattgtggactcccaa

SEQ ID NO: 864505 - DNA, 25 bp, Mus musculus
tgcatacagggcagcctcgtcggag

SEQ ID NO: 864506 - DNA, 25 bp, Mus musculus
tgcatacagggctgcctcgtcggag

SEQ ID NO: 864507 - DNA, 25 bp, Mus musculus
tgcatacagtgccaattttctcctc

SEQ ID NO: 864508 - DNA, 25 bp, Mus musculus
tgcatacagtgcgaattttctcctc

SEQ ID NO: 864509 - DNA, 25 bp, Mus musculus
tgcatacagtgtaagcattgtgacc

SEQ ID NO: 864510 - DNA, 25 bp, Mus musculus
tgcatacagtgttagcattgtgacc

SEQ ID NO: 864511 - DNA, 25 bp, Mus musculus
tgcatacatacgagagacctggtct

SEQ ID NO: 864512 - DNA, 25 bp, Mus musculus
tgcatacatacgtgagacctggtct

SEQ ID NO: 864513 - DNA, 25 bp, Mus musculus
tgcatacatatgaccacatttgtgg

SEQ ID NO: 864514 - DNA, 25 bp, Mus musculus
tgcatacatatgtccacatttgtgg

SEQ ID NO: 864515 - DNA, 25 bp, Mus musculus
tgcatacatctacctagaccacatg

SEQ ID NO: 864516 - DNA, 25 bp, Mus musculus
tgcatacatctagctagaccacatg

SEQ ID NO: 864517 - DNA, 25 bp, Mus musculus
tgcataccccatccttaatgagtag

SEQ ID NO: 864518 - DNA, 25 bp, Mus musculus
tgcataccccatgcttaatgagtag

SEQ ID NO: 864519 - DNA, 25 bp, Mus musculus
tgcatacctccccaggtaatcaagc

SEQ ID NO: 864520 - DNA, 25 bp, Mus musculus
tgcatacctcccgaggtaatcaagc

SEQ ID NO: 864521 - DNA, 25 bp, Mus musculus
tgcatacctgagaaacacgctggct

SEQ ID NO: 864522 - DNA, 25 bp, Mus musculus
tgcatacctgagtaacacgctggct

SEQ ID NO: 864523 - DNA, 25 bp, Mus musculus
tgcatacgcattccttttcttcagc

SEQ ID NO: 864524 - DNA, 25 bp, Mus musculus
tgcatacgcattgcttttcttcagc

SEQ ID NO: 864525 - DNA, 25 bp, Mus musculus
tgcatactcttgctatcacttacat

SEQ ID NO: 864526 - DNA, 25 bp, Mus musculus
tgcatactcttggtatcacttacat

SEQ ID NO: 864527 - DNA, 25 bp, Mus musculus
tgcatactctttaccctgtcttttc

SEQ ID NO: 864528 - DNA, 25 bp, Mus musculus
tgcatactcttttccctgtcttttc

SEQ ID NO: 864529 - DNA, 25 bp, Mus musculus
tgcatactggctcggctcctccttg

SEQ ID NO: 864530 - DNA, 25 bp, Mus musculus
tgcatactggctgggctcctccttg

SEQ ID NO: 864531 - DNA, 25 bp, Mus musculus
tgcatactgtcactagctctcatgt

SEQ ID NO: 864532 - DNA, 25 bp, Mus musculus
tgcatactgtcagtagctctcatgt

SEQ ID NO: 864533 - DNA, 25 bp, Mus musculus
tgcatacttgttcctcagttttcct

SEQ ID NO: 864534 - DNA, 25 bp, Mus musculus
tgcatacttgttgctcagttttcct

SEQ ID NO: 864535 - DNA, 25 bp, Mus musculus
tgcatactttgtatactgcctcacc

SEQ ID NO: 864536 - DNA, 25 bp, Mus musculus
tgcatactttgtttactgcctcacc

SEQ ID NO: 864537 - DNA, 25 bp, Mus musculus
tgcatagagaccaccctggagaggg

SEQ ID NO: 864538 - DNA, 25 bp, Mus musculus
tgcatagagacctccctggagaggg

SEQ ID NO: 864539 - DNA, 25 bp, Mus musculus
tgcatagatcttcaggttttcccct

SEQ ID NO: 864540 - DNA, 25 bp, Mus musculus
tgcatagatcttgaggttttcccct

SEQ ID NO: 864541 - DNA, 25 bp, Mus musculus
tgcatagattttccacggaacccct

SEQ ID NO: 864542 - DNA, 25 bp, Mus musculus
tgcatagattttgcacggaacccct

SEQ ID NO: 864543 - DNA, 25 bp, Mus musculus
tgcatagcactcacagacctttttt

SEQ ID NO: 864544 - DNA, 25 bp, Mus musculus
tgcatagcactctcagacctttttt

SEQ ID NO: 864545 - DNA, 25 bp, Mus musculus
tgcatagcactgagtcctcgggaag

SEQ ID NO: 864546 - DNA, 25 bp, Mus musculus
tgcatagcactgagtcgttggtcca

SEQ ID NO: 864547 - DNA, 25 bp, Mus musculus
tgcatagcactgtgtcctcgggaag

SEQ ID NO: 864548 - DNA, 25 bp, Mus musculus
tgcatagcactgtgtcgttggtcca

SEQ ID NO: 864549 - DNA, 25 bp, Mus musculus
tgcatagcccaaaccagtcttgaac

SEQ ID NO: 864550 - DNA, 25 bp, Mus musculus
tgcatagcccaatccagtcttgaac

SEQ ID NO: 864551 - DNA, 25 bp, Mus musculus
tgcatagcctccaactctataggta

SEQ ID NO: 864552 - DNA, 25 bp, Mus musculus
tgcatagcctcctactctataggta

SEQ ID NO: 864553 - DNA, 25 bp, Mus musculus
tgcatagcgtgtacaaggacagtcg

SEQ ID NO: 864554 - DNA, 25 bp, Mus musculus
tgcatagcgtgttcaaggacagtcg

SEQ ID NO: 864555 - DNA, 25 bp, Mus musculus
tgcatagctttactccggcactcgg

SEQ ID NO: 864556 - DNA, 25 bp, Mus musculus
tgcatagctttagtccggcactcgg

SEQ ID NO: 864557 - DNA, 25 bp, Mus musculus
tgcataggaggaatgctgtagctaa

SEQ ID NO: 864558 - DNA, 25 bp, Mus musculus
tgcataggaggattgctgtagctaa

SEQ ID NO: 864559 - DNA, 25 bp, Mus musculus
tgcataggctttcaaccacggctaa

SEQ ID NO: 864560 - DNA, 25 bp, Mus musculus
tgcataggctttcctgtcctgggac

SEQ ID NO: 864561 - DNA, 25 bp, Mus musculus
tgcataggctttgaaccacggctaa

SEQ ID NO: 864562 - DNA, 25 bp, Mus musculus
tgcataggctttgctgtcctgggac

SEQ ID NO: 864563 - DNA, 25 bp, Mus musculus
tgcatagtacacagctttctgaggg

SEQ ID NO: 864564 - DNA, 25 bp, Mus musculus
tgcatagtacactgctttctgaggg

SEQ ID NO: 864565 - DNA, 25 bp, Mus musculus
tgcatagtctctctctaccctatta

SEQ ID NO: 864566 - DNA, 25 bp, Mus musculus
tgcatagtctctgtctaccctatta

SEQ ID NO: 864567 - DNA, 25 bp, Mus musculus
tgcatagtgcgcatggaggccagaa

SEQ ID NO: 864568 - DNA, 25 bp, Mus musculus
tgcatagtgcgcttggaggccagaa

SEQ ID NO: 864569 - DNA, 25 bp, Mus musculus
tgcatagtgctaaccaggctaaaga

SEQ ID NO: 864570 - DNA, 25 bp, Mus musculus
tgcatagtgctatccaggctaaaga

SEQ ID NO: 864571 - DNA, 25 bp, Mus musculus
tgcatagtggtccgtctgacacatc

SEQ ID NO: 864572 - DNA, 25 bp, Mus musculus
tgcatagtggtcggtctgacacatc

SEQ ID NO: 864573 - DNA, 25 bp, Mus musculus
tgcatagttcctaaatactcttggg

SEQ ID NO: 864574 - DNA, 25 bp, Mus musculus
tgcatagttccttaatactcttggg

SEQ ID NO: 864575 - DNA, 25 bp, Mus musculus
tgcatatacacaacccattcctttc

SEQ ID NO: 864576 - DNA, 25 bp, Mus musculus
tgcatatacacatcccattcctttc

SEQ ID NO: 864577 - DNA, 25 bp, Mus musculus
tgcatatacagcagccctctatact

SEQ ID NO: 864578 - DNA, 25 bp, Mus musculus
tgcatatacagctgccctctatact

SEQ ID NO: 864579 - DNA, 25 bp, Mus musculus
tgcatatatgccagatgcccagaga

SEQ ID NO: 864580 - DNA, 25 bp, Mus musculus
tgcatatatgcctgatgcccagaga

SEQ ID NO: 864581 - DNA, 25 bp, Mus musculus
tgcatatcatcgacacacaaagctg

SEQ ID NO: 864582 - DNA, 25 bp, Mus musculus
tgcatatcatcgtcacacaaagctg

SEQ ID NO: 864583 - DNA, 25 bp, Mus musculus
tgcatatcccctccgagttgagcaa

SEQ ID NO: 864584 - DNA, 25 bp, Mus musculus
tgcatatcccctgcgagttgagcaa

SEQ ID NO: 864585 - DNA, 25 bp, Mus musculus
tgcatatctcagaagtcttcacaag

SEQ ID NO: 864586 - DNA, 25 bp, Mus musculus
tgcatatctcagtagtcttcacaag

SEQ ID NO: 864587 - DNA, 25 bp, Mus musculus
tgcatatctggtcgctcacagcgga

SEQ ID NO: 864588 - DNA, 25 bp, Mus musculus
tgcatatctggtggctcacagcgga

SEQ ID NO: 864589 - DNA, 25 bp, Mus musculus
tgcatatgaccaagcctcttgccat

SEQ ID NO: 864590 - DNA, 25 bp, Mus musculus
tgcatatgaccatgcctcttgccat

SEQ ID NO: 864591 - DNA, 25 bp, Mus musculus
tgcatatgacccaaccccttaagaa

SEQ ID NO: 864592 - DNA, 25 bp, Mus musculus
tgcatatgaccctaccccttaagaa

SEQ ID NO: 864593 - DNA, 25 bp, Mus musculus
tgcatatgccgacaatattttctat

SEQ ID NO: 864594 - DNA, 25 bp, Mus musculus
tgcatatgccgagaatattttctat

SEQ ID NO: 864595 - DNA, 25 bp, Mus musculus
tgcatatgctatattcatctttctg

SEQ ID NO: 864596 - DNA, 25 bp, Mus musculus
tgcatatgctattttcatctttctg

SEQ ID NO: 864597 - DNA, 25 bp, Mus musculus
tgcatatggtctcaaggtttcctcc

SEQ ID NO: 864598 - DNA, 25 bp, Mus musculus
tgcatatggtctgaaggtttcctcc

SEQ ID NO: 864599 - DNA, 25 bp, Mus musculus
tgcatatgtagcagtaccccctgag

SEQ ID NO: 864600 - DNA, 25 bp, Mus musculus
tgcatatgtagctgtaccccctgag

SEQ ID NO: 864601 - DNA, 25 bp, Mus musculus
tgcatatgtgacctaggagcgctca

SEQ ID NO: 864602 - DNA, 25 bp, Mus musculus
tgcatatgtgacgtaggagcgctca

SEQ ID NO: 864603 - DNA, 25 bp, Mus musculus
tgcatatgttacacctcggaaccat

SEQ ID NO: 864604 - DNA, 25 bp, Mus musculus
tgcatatgttactcctcggaaccat

SEQ ID NO: 864605 - DNA, 25 bp, Mus musculus
tgcatattagagatgctccctgggt

SEQ ID NO: 864606 - DNA, 25 bp, Mus musculus
tgcatattagagttgctccctgggt

SEQ ID NO: 864607 - DNA, 25 bp, Mus musculus
tgcatattatcacaacggtcccatt

SEQ ID NO: 864608 - DNA, 25 bp, Mus musculus
tgcatattatcagaacggtcccatt

SEQ ID NO: 864609 - DNA, 25 bp, Mus musculus
tgcatattatctcccttgttcttat

SEQ ID NO: 864610 - DNA, 25 bp, Mus musculus
tgcatattatctgccttgttcttat

SEQ ID NO: 864611 - DNA, 25 bp, Mus musculus
tgcatattccggcttttgttcttgg

SEQ ID NO: 864612 - DNA, 25 bp, Mus musculus
tgcatattccgggttttgttcttgg

SEQ ID NO: 864613 - DNA, 25 bp, Mus musculus
tgcatatttaggaggcacacccaaa

SEQ ID NO: 864614 - DNA, 25 bp, Mus musculus
tgcatatttaggtggcacacccaaa

SEQ ID NO: 864615 - DNA, 25 bp, Mus musculus
tgcatatttggcacactgcacaaat

SEQ ID NO: 864616 - DNA, 25 bp, Mus musculus
tgcatatttggctcactgcacaaat

SEQ ID NO: 864617 - DNA, 25 bp, Mus musculus
tgcatatttttcaaagacaccttat

SEQ ID NO: 864618 - DNA, 25 bp, Mus musculus
tgcatatttttctaagacaccttat

SEQ ID NO: 864619 - DNA, 25 bp, Mus musculus
tgcatcaaaagcatggccatctgcc

SEQ ID NO: 864620 - DNA, 25 bp, Mus musculus
tgcatcaaaagcttggccatctgcc

SEQ ID NO: 864621 - DNA, 25 bp, Mus musculus
tgcatcaaacagcagtcgctgctca

SEQ ID NO: 864622 - DNA, 25 bp, Mus musculus
tgcatcaaacaggagtcgctgctca

SEQ ID NO: 864623 - DNA, 25 bp, Mus musculus
tgcatcaacaccactatctgctaat

SEQ ID NO: 864624 - DNA, 25 bp, Mus musculus
tgcatcaacacctctatctgctaat

SEQ ID NO: 864625 - DNA, 25 bp, Mus musculus
tgcatcaaccgtcacaaccgactgg

SEQ ID NO: 864626 - DNA, 25 bp, Mus musculus
tgcatcaaccgtgacaaccgactgg

SEQ ID NO: 864627 - DNA, 25 bp, Mus musculus
tgcatcaaccttaacccgagacaat

SEQ ID NO: 864628 - DNA, 25 bp, Mus musculus
tgcatcaacctttacccgagacaat

SEQ ID NO: 864629 - DNA, 25 bp, Mus musculus
tgcatcacatgcagcctgagtcact

SEQ ID NO: 864630 - DNA, 25 bp, Mus musculus
tgcatcacatgcagtaggacatcat

SEQ ID NO: 864631 - DNA, 25 bp, Mus musculus
tgcatcacatgctgcctgagtcact

SEQ ID NO: 864632 - DNA, 25 bp, Mus musculus
tgcatcacatgctgtaggacatcat

SEQ ID NO: 864633 - DNA, 25 bp, Mus musculus
tgcatcaccaaactgcggacattac

SEQ ID NO: 864634 - DNA, 25 bp, Mus musculus
tgcatcaccaaagtgcggacattac

SEQ ID NO: 864635 - DNA, 25 bp, Mus musculus
tgcatcaccatcacttgtgttgttt

SEQ ID NO: 864636 - DNA, 25 bp, Mus musculus
tgcatcaccatctcttgtgttgttt

SEQ ID NO: 864637 - DNA, 25 bp, Mus musculus
tgcatcaccatgaaggagcctgtct

SEQ ID NO: 864638 - DNA, 25 bp, Mus musculus
tgcatcaccatgactggccttggga

SEQ ID NO: 864639 - DNA, 25 bp, Mus musculus
tgcatcaccatgtaggagcctgtct

SEQ ID NO: 864640 - DNA, 25 bp, Mus musculus
tgcatcaccatgtctggccttggga

SEQ ID NO: 864641 - DNA, 25 bp, Mus musculus
tgcatcaccctcaatttctggaaag

SEQ ID NO: 864642 - DNA, 25 bp, Mus musculus
tgcatcaccctctatttctggaaag

SEQ ID NO: 864643 - DNA, 25 bp, Mus musculus
tgcatcaccgccatggccaagaagt

SEQ ID NO: 864644 - DNA, 25 bp, Mus musculus
tgcatcaccgccttggccaagaagt

SEQ ID NO: 864645 - DNA, 25 bp, Mus musculus
tgcatcacctgtcttccctctgtgt

SEQ ID NO: 864646 - DNA, 25 bp, Mus musculus
tgcatcacctgtgttccctctgtgt

SEQ ID NO: 864647 - DNA, 25 bp, Mus musculus
tgcatcactactacctggctaagct

SEQ ID NO: 864648 - DNA, 25 bp, Mus musculus
tgcatcactacttcctggctaagct

SEQ ID NO: 864649 - DNA, 25 bp, Mus musculus
tgcatcactagcaacaaaggaaaaa

SEQ ID NO: 864650 - DNA, 25 bp, Mus musculus
tgcatcactagctacaaaggaaaaa

SEQ ID NO: 864651 - DNA, 25 bp, Mus musculus
tgcatcactctcaccttttgtttac

SEQ ID NO: 864652 - DNA, 25 bp, Mus musculus
tgcatcactctctccttttgtttac

SEQ ID NO: 864653 - DNA, 25 bp, Mus musculus
tgcatcagacgccgttccacctggg

SEQ ID NO: 864654 - DNA, 25 bp, Mus musculus
tgcatcagacgcggttccacctggg

SEQ ID NO: 864655 - DNA, 25 bp, Mus musculus
tgcatcagcctgaggacgccaggtt

SEQ ID NO: 864656 - DNA, 25 bp, Mus musculus
tgcatcagcctgtggacgccaggtt

SEQ ID NO: 864657 - DNA, 25 bp, Mus musculus
tgcatcagcgcgaggagcagctcac

SEQ ID NO: 864658 - DNA, 25 bp, Mus musculus
tgcatcagcgcgtggagcagctcac

SEQ ID NO: 864659 - DNA, 25 bp, Mus musculus
tgcatcagcggcactgccagcttaa

SEQ ID NO: 864660 - DNA, 25 bp, Mus musculus
tgcatcagcggctctgccagcttaa

SEQ ID NO: 864661 - DNA, 25 bp, Mus musculus
tgcatcagctctacttctgagagac

SEQ ID NO: 864662 - DNA, 25 bp, Mus musculus
tgcatcagctcttcttctgagagac

SEQ ID NO: 864663 - DNA, 25 bp, Mus musculus
tgcatcaggacgcagcatccagagt

SEQ ID NO: 864664 - DNA, 25 bp, Mus musculus
tgcatcaggacggagcatccagagt

SEQ ID NO: 864665 - DNA, 25 bp, Mus musculus
tgcatcaggactctcccggagctgt

SEQ ID NO: 864666 - DNA, 25 bp, Mus musculus
tgcatcaggactgtcccggagctgt

SEQ ID NO: 864667 - DNA, 25 bp, Mus musculus
tgcatcagtcagagatcttctgctt

SEQ ID NO: 864668 - DNA, 25 bp, Mus musculus
tgcatcagtcagtgatcttctgctt

SEQ ID NO: 864669 - DNA, 25 bp, Mus musculus
tgcatcagtgcaatagagtctagta

SEQ ID NO: 864670 - DNA, 25 bp, Mus musculus
tgcatcagtgcattagagtctagta

SEQ ID NO: 864671 - DNA, 25 bp, Mus musculus
tgcatcagtgctctagggaccaact

SEQ ID NO: 864672 - DNA, 25 bp, Mus musculus
tgcatcagtgctgtagggaccaact

SEQ ID NO: 864673 - DNA, 25 bp, Mus musculus
tgcatcatcactattttattaggat

SEQ ID NO: 864674 - DNA, 25 bp, Mus musculus
tgcatcatcacttttttattaggat

SEQ ID NO: 864675 - DNA, 25 bp, Mus musculus
tgcatcatgatactaggccttcttg

SEQ ID NO: 864676 - DNA, 25 bp, Mus musculus
tgcatcatgatagtaggccttcttg

SEQ ID NO: 864677 - DNA, 25 bp, Mus musculus
tgcatcatgcagcattaaatactcc

SEQ ID NO: 864678 - DNA, 25 bp, Mus musculus
tgcatcatgcaggattaaatactcc

SEQ ID NO: 864679 - DNA, 25 bp, Mus musculus
tgcatcatgcatcactcactcaggg

SEQ ID NO: 864680 - DNA, 25 bp, Mus musculus
tgcatcatgcatgactcactcaggg

SEQ ID NO: 864681 - DNA, 25 bp, Mus musculus
tgcatcatgcttaaccctgcgacat

SEQ ID NO: 864682 - DNA, 25 bp, Mus musculus
tgcatcatgctttaccctgcgacat

SEQ ID NO: 864683 - DNA, 25 bp, Mus musculus
tgcatcatggctagcttcctggagc

SEQ ID NO: 864684 - DNA, 25 bp, Mus musculus
tgcatcatggcttgcttcctggagc

SEQ ID NO: 864685 - DNA, 25 bp, Mus musculus
tgcatcatgtgactaacggctctct

SEQ ID NO: 864686 - DNA, 25 bp, Mus musculus
tgcatcatgtgagtaacggctctct

SEQ ID NO: 864687 - DNA, 25 bp, Mus musculus
tgcatcattatgcacagaagtactg

SEQ ID NO: 864688 - DNA, 25 bp, Mus musculus
tgcatcattatggacagaagtactg

SEQ ID NO: 864689 - DNA, 25 bp, Mus musculus
tgcatcattcagcagcttgttagaa

SEQ ID NO: 864690 - DNA, 25 bp, Mus musculus
tgcatcattcaggagcttgttagaa

SEQ ID NO: 864691 - DNA, 25 bp, Mus musculus
tgcatcattctgatttcaccttggg

SEQ ID NO: 864692 - DNA, 25 bp, Mus musculus
tgcatcattctgttttcaccttggg

SEQ ID NO: 864693 - DNA, 25 bp, Mus musculus
tgcatccaaattccaaataccagag

SEQ ID NO: 864694 - DNA, 25 bp, Mus musculus
tgcatccaaattgcaaataccagag

SEQ ID NO: 864695 - DNA, 25 bp, Mus musculus
tgcatccacatgctgctatgtcaag

SEQ ID NO: 864696 - DNA, 25 bp, Mus musculus
tgcatccacatggtgctatgtcaag

SEQ ID NO: 864697 - DNA, 25 bp, Mus musculus
tgcatccactggagctgccaaggct

SEQ ID NO: 864698 - DNA, 25 bp, Mus musculus
tgcatccactggtgctgccaaggct

SEQ ID NO: 864699 - DNA, 25 bp, Mus musculus
tgcatccagaagacccttcatcagg

SEQ ID NO: 864700 - DNA, 25 bp, Mus musculus
tgcatccagaagtcccttcatcagg

SEQ ID NO: 864701 - DNA, 25 bp, Mus musculus
tgcatccagggaaataaccattaat

SEQ ID NO: 864702 - DNA, 25 bp, Mus musculus
tgcatccagggatataaccattaat

SEQ ID NO: 864703 - DNA, 25 bp, Mus musculus
tgcatccatccgagacaaacgttcc

SEQ ID NO: 864704 - DNA, 25 bp, Mus musculus
tgcatccatccgtgacaaacgttcc

SEQ ID NO: 864705 - DNA, 25 bp, Mus musculus
tgcatccatgcaagttacaccacag

SEQ ID NO: 864706 - DNA, 25 bp, Mus musculus
tgcatccatgcatgttacaccacag

SEQ ID NO: 864707 - DNA, 25 bp, Mus musculus
tgcatccattctaaacagcctttat

SEQ ID NO: 864708 - DNA, 25 bp, Mus musculus
tgcatccattcttaacagcctttat

SEQ ID NO: 864709 - DNA, 25 bp, Mus musculus
tgcatcccaagtagtgtaagattaa

SEQ ID NO: 864710 - DNA, 25 bp, Mus musculus
tgcatcccaagttgtgtaagattaa

SEQ ID NO: 864711 - DNA, 25 bp, Mus musculus
tgcatcccacttctaaatgttccat

SEQ ID NO: 864712 - DNA, 25 bp, Mus musculus
tgcatcccacttgtaaatgttccat

SEQ ID NO: 864713 - DNA, 25 bp, Mus musculus
tgcatcccagccagaactgttaatg

SEQ ID NO: 864714 - DNA, 25 bp, Mus musculus
tgcatcccagcctgaactgttaatg

SEQ ID NO: 864715 - DNA, 25 bp, Mus musculus
tgcatcccagttagtccattccgga

SEQ ID NO: 864716 - DNA, 25 bp, Mus musculus
tgcatcccagtttgtccattccgga

SEQ ID NO: 864717 - DNA, 25 bp, Mus musculus
tgcatccccattctagcagtggagg

SEQ ID NO: 864718 - DNA, 25 bp, Mus musculus
tgcatccccattgtagcagtggagg

SEQ ID NO: 864719 - DNA, 25 bp, Mus musculus
tgcatcccgaccatcaatttttatt

SEQ ID NO: 864720 - DNA, 25 bp, Mus musculus
tgcatcccgaccttcaatttttatt

SEQ ID NO: 864721 - DNA, 25 bp, Mus musculus
tgcatcccgtaccacacaaagaaga

SEQ ID NO: 864722 - DNA, 25 bp, Mus musculus
tgcatcccgtacgacacaaagaaga

SEQ ID NO: 864723 - DNA, 25 bp, Mus musculus
tgcatcccgtatcatctgtcttcta

SEQ ID NO: 864724 - DNA, 25 bp, Mus musculus
tgcatcccgtatgatctgtcttcta

SEQ ID NO: 864725 - DNA, 25 bp, Mus musculus
tgcatccctctaagacctacaataa

SEQ ID NO: 864726 - DNA, 25 bp, Mus musculus
tgcatccctctatgacctacaataa

SEQ ID NO: 864727 - DNA, 25 bp, Mus musculus
tgcatccctgaacccaactttatgg

SEQ ID NO: 864728 - DNA, 25 bp, Mus musculus
tgcatccctgaagccaactttatgg

SEQ ID NO: 864729 - DNA, 25 bp, Mus musculus
tgcatccctgggagctttctgaagg

SEQ ID NO: 864730 - DNA, 25 bp, Mus musculus
tgcatccctgggtgctttctgaagg

SEQ ID NO: 864731 - DNA, 25 bp, Mus musculus
tgcatcccttcaatggcacctacag

SEQ ID NO: 864732 - DNA, 25 bp, Mus musculus
tgcatcccttcattggcacctacag

SEQ ID NO: 864733 - DNA, 25 bp, Mus musculus
tgcatcccttggactccaggttgaa

SEQ ID NO: 864734 - DNA, 25 bp, Mus musculus
tgcatcccttggtctccaggttgaa

SEQ ID NO: 864735 - DNA, 25 bp, Mus musculus
tgcatcccttgtagtttggtggtgt

SEQ ID NO: 864736 - DNA, 25 bp, Mus musculus
tgcatcccttgttgtttggtggtgt

SEQ ID NO: 864737 - DNA, 25 bp, Mus musculus
tgcatccgcccgagtgcaactgtct

SEQ ID NO: 864738 - DNA, 25 bp, Mus musculus
tgcatccgcccgtgtgcaactgtct

SEQ ID NO: 864739 - DNA, 25 bp, Mus musculus
tgcatccgcggtacagttcacagct

SEQ ID NO: 864740 - DNA, 25 bp, Mus musculus
tgcatccgcggttcagttcacagct

SEQ ID NO: 864741 - DNA, 25 bp, Mus musculus
tgcatccgggctctacaagacgaca

SEQ ID NO: 864742 - DNA, 25 bp, Mus musculus
tgcatccgggctgtacaagacgaca

SEQ ID NO: 864743 - DNA, 25 bp, Mus musculus
tgcatccggtggagtttggctccat

SEQ ID NO: 864744 - DNA, 25 bp, Mus musculus
tgcatccggtggtgtttggctccat

SEQ ID NO: 864745 - DNA, 25 bp, Mus musculus
tgcatccgtctccattaaaatccat

SEQ ID NO: 864746 - DNA, 25 bp, Mus musculus
tgcatccgtctcgattaaaatccat

SEQ ID NO: 864747 - DNA, 25 bp, Mus musculus
tgcatccgtcttcgcatccttactt

SEQ ID NO: 864748 - DNA, 25 bp, Mus musculus
tgcatccgtcttggcatccttactt

SEQ ID NO: 864749 - DNA, 25 bp, Mus musculus
tgcatcctcattacatgtggtttcc

SEQ ID NO: 864750 - DNA, 25 bp, Mus musculus
tgcatcctcatttcatgtggtttcc

SEQ ID NO: 864751 - DNA, 25 bp, Mus musculus
tgcatcctcctgagatttgaaatgt

SEQ ID NO: 864752 - DNA, 25 bp, Mus musculus
tgcatcctcctgtgatttgaaatgt

SEQ ID NO: 864753 - DNA, 25 bp, Mus musculus
tgcatcctctctcccaatatatttt

SEQ ID NO: 864754 - DNA, 25 bp, Mus musculus
tgcatcctctctgccaatatatttt

SEQ ID NO: 864755 - DNA, 25 bp, Mus musculus
tgcatcctctggcaatacgctcctt

SEQ ID NO: 864756 - DNA, 25 bp, Mus musculus
tgcatcctctgggaatacgctcctt

SEQ ID NO: 864757 - DNA, 25 bp, Mus musculus
tgcatcctgaccctggccatgatga

SEQ ID NO: 864758 - DNA, 25 bp, Mus musculus
tgcatcctgaccgtggccatgatga

SEQ ID NO: 864759 - DNA, 25 bp, Mus musculus
tgcatcctgggtcctttaacctttt

SEQ ID NO: 864760 - DNA, 25 bp, Mus musculus
tgcatcctgggtgctttaacctttt

SEQ ID NO: 864761 - DNA, 25 bp, Mus musculus
tgcatccttcgcagtgcatgagttt

SEQ ID NO: 864762 - DNA, 25 bp, Mus musculus
tgcatccttcgctgtgcatgagttt

SEQ ID NO: 864763 - DNA, 25 bp, Mus musculus
tgcatcctttaccattgctacacaa

SEQ ID NO: 864764 - DNA, 25 bp, Mus musculus
tgcatcctttacgattgctacacaa

SEQ ID NO: 864765 - DNA, 25 bp, Mus musculus
tgcatcctttggactcaggtgggag

SEQ ID NO: 864766 - DNA, 25 bp, Mus musculus
tgcatcctttggtctcaggtgggag

SEQ ID NO: 864767 - DNA, 25 bp, Mus musculus
tgcatcctttgtagttacccttaac

SEQ ID NO: 864768 - DNA, 25 bp, Mus musculus
tgcatcctttgttgttacccttaac

SEQ ID NO: 864769 - DNA, 25 bp, Mus musculus
tgcatccttttcaagaaagcgccgt

SEQ ID NO: 864770 - DNA, 25 bp, Mus musculus
tgcatccttttctagaaagcgccgt

SEQ ID NO: 864771 - DNA, 25 bp, Mus musculus
tgcatcgacggcactgcatcaggaa

SEQ ID NO: 864772 - DNA, 25 bp, Mus musculus
tgcatcgacggctctgcatcaggaa

SEQ ID NO: 864773 - DNA, 25 bp, Mus musculus
tgcatcgagttcagtttctgtggaa

SEQ ID NO: 864774 - DNA, 25 bp, Mus musculus
tgcatcgagttctgtttctgtggaa

SEQ ID NO: 864775 - DNA, 25 bp, Mus musculus
tgcatcgcacaaatcacaccaactg

SEQ ID NO: 864776 - DNA, 25 bp, Mus musculus
tgcatcgcacaattcacaccaactg

SEQ ID NO: 864777 - DNA, 25 bp, Mus musculus
tgcatcgcagcccaagagtctagga

SEQ ID NO: 864778 - DNA, 25 bp, Mus musculus
tgcatcgcagccgaagagtctagga

SEQ ID NO: 864779 - DNA, 25 bp, Mus musculus
tgcatcgccatcactgtatggttat

SEQ ID NO: 864780 - DNA, 25 bp, Mus musculus
tgcatcgccatctctgtatggttat

SEQ ID NO: 864781 - DNA, 25 bp, Mus musculus
tgcatcgccggactccccaaagatg

SEQ ID NO: 864782 - DNA, 25 bp, Mus musculus
tgcatcgccggagtccccaaagatg

SEQ ID NO: 864783 - DNA, 25 bp, Mus musculus
tgcatcgctggcatgatcttcttga

SEQ ID NO: 864784 - DNA, 25 bp, Mus musculus
tgcatcgctggcttgatcttcttga

SEQ ID NO: 864785 - DNA, 25 bp, Mus musculus
tgcatcggcgtgacataagatccat

SEQ ID NO: 864786 - DNA, 25 bp, Mus musculus
tgcatcggcgtgtcataagatccat

SEQ ID NO: 864787 - DNA, 25 bp, Mus musculus
tgcatcggtgccctgtcagtactag

SEQ ID NO: 864788 - DNA, 25 bp, Mus musculus
tgcatcggtgccgtgtcagtactag

SEQ ID NO: 864789 - DNA, 25 bp, Mus musculus
tgcatcggtttgctcatcccacatc

SEQ ID NO: 864790 - DNA, 25 bp, Mus musculus
tgcatcggtttggtcatcccacatc

SEQ ID NO: 864791 - DNA, 25 bp, Mus musculus
tgcatcgtcagtaccttcggactgt

SEQ ID NO: 864792 - DNA, 25 bp, Mus musculus
tgcatcgtcagttccttcggactgt

SEQ ID NO: 864793 - DNA, 25 bp, Mus musculus
tgcatcgttaacaacgtgtctgcag

SEQ ID NO: 864794 - DNA, 25 bp, Mus musculus
tgcatcgttaactacgtgtctgcag

SEQ ID NO: 864795 - DNA, 25 bp, Mus musculus
tgcatctaacataggcgggaacctg

SEQ ID NO: 864796 - DNA, 25 bp, Mus musculus
tgcatctaacattggcgggaacctg

SEQ ID NO: 864797 - DNA, 25 bp, Mus musculus
tgcatctaacccaggacagtctttg

SEQ ID NO: 864798 - DNA, 25 bp, Mus musculus
tgcatctaaccctggacagtctttg

SEQ ID NO: 864799 - DNA, 25 bp, Mus musculus
tgcatctagcttatcggataccatt

SEQ ID NO: 864800 - DNA, 25 bp, Mus musculus
tgcatctagcttttcggataccatt

SEQ ID NO: 864801 - DNA, 25 bp, Mus musculus
tgcatctcagcaattggcccagcag

SEQ ID NO: 864802 - DNA, 25 bp, Mus musculus
tgcatctcagcatttggcccagcag

SEQ ID NO: 864803 - DNA, 25 bp, Mus musculus
tgcatctcatgcacaccagttactt

SEQ ID NO: 864804 - DNA, 25 bp, Mus musculus
tgcatctcatgctcaccagttactt

SEQ ID NO: 864805 - DNA, 25 bp, Mus musculus
tgcatctcatttcactagctctcag

SEQ ID NO: 864806 - DNA, 25 bp, Mus musculus
tgcatctcatttgactagctctcag

SEQ ID NO: 864807 - DNA, 25 bp, Mus musculus
tgcatctccagtcccaaggacatgt

SEQ ID NO: 864808 - DNA, 25 bp, Mus musculus
tgcatctccagtgccaaggacatgt

SEQ ID NO: 864809 - DNA, 25 bp, Mus musculus
tgcatctcctgactttggactgtag

SEQ ID NO: 864810 - DNA, 25 bp, Mus musculus
tgcatctcctgagtttggactgtag

SEQ ID NO: 864811 - DNA, 25 bp, Mus musculus
tgcatctcctggatgcggcgcttgg

SEQ ID NO: 864812 - DNA, 25 bp, Mus musculus
tgcatctcctggttgcggcgcttgg

SEQ ID NO: 864813 - DNA, 25 bp, Mus musculus
tgcatctcctgtctcaccagaatac

SEQ ID NO: 864814 - DNA, 25 bp, Mus musculus
tgcatctcctgtgtcaccagaatac

SEQ ID NO: 864815 - DNA, 25 bp, Mus musculus
tgcatctccttgatggcttcctgag

SEQ ID NO: 864816 - DNA, 25 bp, Mus musculus
tgcatctccttgttggcttcctgag

SEQ ID NO: 864817 - DNA, 25 bp, Mus musculus
tgcatctctgccactgttaaagagt

SEQ ID NO: 864818 - DNA, 25 bp, Mus musculus
tgcatctctgccatccttaaataca

SEQ ID NO: 864819 - DNA, 25 bp, Mus musculus
tgcatctctgcctctgttaaagagt

SEQ ID NO: 864820 - DNA, 25 bp, Mus musculus
tgcatctctgccttccttaaataca

SEQ ID NO: 864821 - DNA, 25 bp, Mus musculus
tgcatctgaatgagtcgtggtccca

SEQ ID NO: 864822 - DNA, 25 bp, Mus musculus
tgcatctgaatgcaggtgcctctct

SEQ ID NO: 864823 - DNA, 25 bp, Mus musculus
tgcatctgaatggaggtgcctctct

SEQ ID NO: 864824 - DNA, 25 bp, Mus musculus
tgcatctgaatgtgtcgtggtccca

SEQ ID NO: 864825 - DNA, 25 bp, Mus musculus
tgcatctgagctctgaaccactgtt

SEQ ID NO: 864826 - DNA, 25 bp, Mus musculus
tgcatctgagctgtgaaccactgtt

SEQ ID NO: 864827 - DNA, 25 bp, Mus musculus
tgcatctgagtgaaccccaccagga

SEQ ID NO: 864828 - DNA, 25 bp, Mus musculus
tgcatctgagtgtaccccaccagga

SEQ ID NO: 864829 - DNA, 25 bp, Mus musculus
tgcatctgatggaacacactgtctc

SEQ ID NO: 864830 - DNA, 25 bp, Mus musculus
tgcatctgatggtacacactgtctc

SEQ ID NO: 864831 - DNA, 25 bp, Mus musculus
tgcatctgcagtcctcaaataaaga

SEQ ID NO: 864832 - DNA, 25 bp, Mus musculus
tgcatctgcagtgctcaaataaaga

SEQ ID NO: 864833 - DNA, 25 bp, Mus musculus
tgcatctgcccaaacacattgttag

SEQ ID NO: 864834 - DNA, 25 bp, Mus musculus
tgcatctgcccatacacattgttag

SEQ ID NO: 864835 - DNA, 25 bp, Mus musculus
tgcatctgccctactttacagtgaa

SEQ ID NO: 864836 - DNA, 25 bp, Mus musculus
tgcatctgcccttctttacagtgaa

SEQ ID NO: 864837 - DNA, 25 bp, Mus musculus
tgcatctgctccatcaagtctaata

SEQ ID NO: 864838 - DNA, 25 bp, Mus musculus
tgcatctgctccttcaagtctaata

SEQ ID NO: 864839 - DNA, 25 bp, Mus musculus
tgcatctgctggaatctcttttcta

SEQ ID NO: 864840 - DNA, 25 bp, Mus musculus
tgcatctgctggtatctcttttcta

SEQ ID NO: 864841 - DNA, 25 bp, Mus musculus
tgcatctggagacacttgcctggtg

SEQ ID NO: 864842 - DNA, 25 bp, Mus musculus
tgcatctggagagacttgcctggtg

SEQ ID NO: 864843 - DNA, 25 bp, Mus musculus
tgcatctggctgatctgtatgtgtg

SEQ ID NO: 864844 - DNA, 25 bp, Mus musculus
tgcatctggctgttctgtatgtgtg

SEQ ID NO: 864845 - DNA, 25 bp, Mus musculus
tgcatctgggcaatcagctgctggc

SEQ ID NO: 864846 - DNA, 25 bp, Mus musculus
tgcatctgggcattcagctgctggc

SEQ ID NO: 864847 - DNA, 25 bp, Mus musculus
tgcatctgggtgacatagtgtcaag

SEQ ID NO: 864848 - DNA, 25 bp, Mus musculus
tgcatctgggtgtcatagtgtcaag

SEQ ID NO: 864849 - DNA, 25 bp, Mus musculus
tgcatctggtcactaatcacttact

SEQ ID NO: 864850 - DNA, 25 bp, Mus musculus
tgcatctggtcagtaatcacttact

SEQ ID NO: 864851 - DNA, 25 bp, Mus musculus
tgcatctgtggaaaagtccccagga

SEQ ID NO: 864852 - DNA, 25 bp, Mus musculus
tgcatctgtggataagtccccagga

SEQ ID NO: 864853 - DNA, 25 bp, Mus musculus
tgcatctgtgttctgtcgggtgtca

SEQ ID NO: 864854 - DNA, 25 bp, Mus musculus
tgcatctgtgttgtgtcgggtgtca

SEQ ID NO: 864855 - DNA, 25 bp, Mus musculus
tgcatcttaaagctcactgttcctg

SEQ ID NO: 864856 - DNA, 25 bp, Mus musculus
tgcatcttaaaggtcactgttcctg

SEQ ID NO: 864857 - DNA, 25 bp, Mus musculus
tgcatcttagatccgctggccttta

SEQ ID NO: 864858 - DNA, 25 bp, Mus musculus
tgcatcttagatgcgctggccttta

SEQ ID NO: 864859 - DNA, 25 bp, Mus musculus
tgcatcttatagagccaggcaccta

SEQ ID NO: 864860 - DNA, 25 bp, Mus musculus
tgcatcttatagtgccaggcaccta

SEQ ID NO: 864861 - DNA, 25 bp, Mus musculus
tgcatcttatgtaggagcctaagtc

SEQ ID NO: 864862 - DNA, 25 bp, Mus musculus
tgcatcttatgttggagcctaagtc

SEQ ID NO: 864863 - DNA, 25 bp, Mus musculus
tgcatcttccccatagattctgtga

SEQ ID NO: 864864 - DNA, 25 bp, Mus musculus
tgcatcttccccttagattctgtga

SEQ ID NO: 864865 - DNA, 25 bp, Mus musculus
tgcatcttctgcagtaaatgctgta

SEQ ID NO: 864866 - DNA, 25 bp, Mus musculus
tgcatcttctgctgtaaatgctgta

SEQ ID NO: 864867 - DNA, 25 bp, Mus musculus
tgcatcttgaaaccggccttagctg

SEQ ID NO: 864868 - DNA, 25 bp, Mus musculus
tgcatcttgaaagcggccttagctg

SEQ ID NO: 864869 - DNA, 25 bp, Mus musculus
tgcatcttgctgagtcccatcaggt

SEQ ID NO: 864870 - DNA, 25 bp, Mus musculus
tgcatcttgctgtgtcccatcaggt

SEQ ID NO: 864871 - DNA, 25 bp, Mus musculus
tgcatcttggatacaagtactttac

SEQ ID NO: 864872 - DNA, 25 bp, Mus musculus
tgcatcttggattcaagtactttac

SEQ ID NO: 864873 - DNA, 25 bp, Mus musculus
tgcatctttaagaggacccaggact

SEQ ID NO: 864874 - DNA, 25 bp, Mus musculus
tgcatctttaagtggacccaggact

SEQ ID NO: 864875 - DNA, 25 bp, Mus musculus
tgcatctttcttcctaagaagtatg

SEQ ID NO: 864876 - DNA, 25 bp, Mus musculus
tgcatctttcttgctaagaagtatg

SEQ ID NO: 864877 - DNA, 25 bp, Mus musculus
tgcatctttgcaccctctcaggaaa

SEQ ID NO: 864878 - DNA, 25 bp, Mus musculus
tgcatctttgcagcctctcaggaaa

SEQ ID NO: 864879 - DNA, 25 bp, Mus musculus
tgcatgaaacccacgaagccccatg

SEQ ID NO: 864880 - DNA, 25 bp, Mus musculus
tgcatgaaaccctcgaagccccatg

SEQ ID NO: 864881 - DNA, 25 bp, Mus musculus
tgcatgaaagttacagggccaggct

SEQ ID NO: 864882 - DNA, 25 bp, Mus musculus
tgcatgaaagtttcagggccaggct

SEQ ID NO: 864883 - DNA, 25 bp, Mus musculus
tgcatgaacatgacgctgctgttgt

SEQ ID NO: 864884 - DNA, 25 bp, Mus musculus
tgcatgaacatgtcgctgctgttgt

SEQ ID NO: 864885 - DNA, 25 bp, Mus musculus
tgcatgaactcacctggcagtcttc

SEQ ID NO: 864886 - DNA, 25 bp, Mus musculus
tgcatgaactcagctggcagtcttc

SEQ ID NO: 864887 - DNA, 25 bp, Mus musculus
tgcatgaagagtccattcagtcccc

SEQ ID NO: 864888 - DNA, 25 bp, Mus musculus
tgcatgaagagtgcattcagtcccc

SEQ ID NO: 864889 - DNA, 25 bp, Mus musculus
tgcatgaatgaaaacaacctctgta

SEQ ID NO: 864890 - DNA, 25 bp, Mus musculus
tgcatgaatgaatacaacctctgta

SEQ ID NO: 864891 - DNA, 25 bp, Mus musculus
tgcatgacacacatggcatctactt

SEQ ID NO: 864892 - DNA, 25 bp, Mus musculus
tgcatgacacacttggcatctactt

SEQ ID NO: 864893 - DNA, 25 bp, Mus musculus
tgcatgacccaccaccatgtacaag

SEQ ID NO: 864894 - DNA, 25 bp, Mus musculus
tgcatgacccacgaccatgtacaag

SEQ ID NO: 864895 - DNA, 25 bp, Mus musculus
tgcatgactgtgaagcccacgcagg

SEQ ID NO: 864896 - DNA, 25 bp, Mus musculus
tgcatgactgtgtagcccacgcagg

SEQ ID NO: 864897 - DNA, 25 bp, Mus musculus
tgcatgaggtgcacacgttcgtgtc

SEQ ID NO: 864898 - DNA, 25 bp, Mus musculus
tgcatgaggtgctcacgttcgtgtc

SEQ ID NO: 864899 - DNA, 25 bp, Mus musculus
tgcatgagtccgatccttggaatca

SEQ ID NO: 864900 - DNA, 25 bp, Mus musculus
tgcatgagtccgttccttggaatca

SEQ ID NO: 864901 - DNA, 25 bp, Mus musculus
tgcatgatacttcaccctcaaagac

SEQ ID NO: 864902 - DNA, 25 bp, Mus musculus
tgcatgatacttgaccctcaaagac

SEQ ID NO: 864903 - DNA, 25 bp, Mus musculus
tgcatgatccagctactaccttgag

SEQ ID NO: 864904 - DNA, 25 bp, Mus musculus
tgcatgatccaggtactaccttgag

SEQ ID NO: 864905 - DNA, 25 bp, Mus musculus
tgcatgcaatgcagagcaccttaat

SEQ ID NO: 864906 - DNA, 25 bp, Mus musculus
tgcatgcaatgctgagcaccttaat

SEQ ID NO: 864907 - DNA, 25 bp, Mus musculus
tgcatgcacatgaacgtaggtgcct

SEQ ID NO: 864908 - DNA, 25 bp, Mus musculus
tgcatgcacatgctgcccaggcata

SEQ ID NO: 864909 - DNA, 25 bp, Mus musculus
tgcatgcacatggtgcccaggcata

SEQ ID NO: 864910 - DNA, 25 bp, Mus musculus
tgcatgcacatgtacgtaggtgcct

SEQ ID NO: 864911 - DNA, 25 bp, Mus musculus
tgcatgcacctgatctcagaaccaa

SEQ ID NO: 864912 - DNA, 25 bp, Mus musculus
tgcatgcacctgttctcagaaccaa

SEQ ID NO: 864913 - DNA, 25 bp, Mus musculus
tgcatgcaccttctttctcgcttag

SEQ ID NO: 864914 - DNA, 25 bp, Mus musculus
tgcatgcaccttgtttctcgcttag

SEQ ID NO: 864915 - DNA, 25 bp, Mus musculus
tgcatgcacgcacgtgagtcacaca

SEQ ID NO: 864916 - DNA, 25 bp, Mus musculus
tgcatgcacgcaggtgagtcacaca

SEQ ID NO: 864917 - DNA, 25 bp, Mus musculus
tgcatgcagaatacagaccttgagg

SEQ ID NO: 864918 - DNA, 25 bp, Mus musculus
tgcatgcagaattcagaccttgagg

SEQ ID NO: 864919 - DNA, 25 bp, Mus musculus
tgcatgcaggcacattgattgtagt

SEQ ID NO: 864920 - DNA, 25 bp, Mus musculus
tgcatgcaggcagattgattgtagt

SEQ ID NO: 864921 - DNA, 25 bp, Mus musculus
tgcatgcagggcaaactctcagggt

SEQ ID NO: 864922 - DNA, 25 bp, Mus musculus
tgcatgcagggctaactctcagggt

SEQ ID NO: 864923 - DNA, 25 bp, Mus musculus
tgcatgcagtgtccttctgtctaga

SEQ ID NO: 864924 - DNA, 25 bp, Mus musculus
tgcatgcagtgtgcttctgtctaga

SEQ ID NO: 864925 - DNA, 25 bp, Mus musculus
tgcatgcatcccataatagccattt

SEQ ID NO: 864926 - DNA, 25 bp, Mus musculus
tgcatgcatcccttaatagccattt

SEQ ID NO: 864927 - DNA, 25 bp, Mus musculus
tgcatgcatgcgctagatctgcctt

SEQ ID NO: 864928 - DNA, 25 bp, Mus musculus
tgcatgcatgcggtagatctgcctt

SEQ ID NO: 864929 - DNA, 25 bp, Mus musculus
tgcatgcatgctccgctaccagaag

SEQ ID NO: 864930 - DNA, 25 bp, Mus musculus
tgcatgcatgctgcgctaccagaag

SEQ ID NO: 864931 - DNA, 25 bp, Mus musculus
tgcatgccaccccttgagaaactga

SEQ ID NO: 864932 - DNA, 25 bp, Mus musculus
tgcatgccacccgttgagaaactga

SEQ ID NO: 864933 - DNA, 25 bp, Mus musculus
tgcatgccacctctgaggcgaagga

SEQ ID NO: 864934 - DNA, 25 bp, Mus musculus
tgcatgccacctgtgaggcgaagga

SEQ ID NO: 864935 - DNA, 25 bp, Mus musculus
tgcatgccagacataatctttttca

SEQ ID NO: 864936 - DNA, 25 bp, Mus musculus
tgcatgccagacttaatctttttca

SEQ ID NO: 864937 - DNA, 25 bp, Mus musculus
tgcatgccagccaaagactcttggg

SEQ ID NO: 864938 - DNA, 25 bp, Mus musculus
tgcatgccagcctaagactcttggg

SEQ ID NO: 864939 - DNA, 25 bp, Mus musculus
tgcatgccatcaagtttcccgccat

SEQ ID NO: 864940 - DNA, 25 bp, Mus musculus
tgcatgccatcatgtttcccgccat

SEQ ID NO: 864941 - DNA, 25 bp, Mus musculus
tgcatgcccacactcttgatgatcc

SEQ ID NO: 864942 - DNA, 25 bp, Mus musculus
tgcatgcccacagtcttgatgatcc

SEQ ID NO: 864943 - DNA, 25 bp, Mus musculus
tgcatgccgtggatcctaaagattt

SEQ ID NO: 864944 - DNA, 25 bp, Mus musculus
tgcatgccgtggttcctaaagattt

SEQ ID NO: 864945 - DNA, 25 bp, Mus musculus
tgcatgcctaggagccgggatcaat

SEQ ID NO: 864946 - DNA, 25 bp, Mus musculus
tgcatgcctaggtgccgggatcaat

SEQ ID NO: 864947 - DNA, 25 bp, Mus musculus
tgcatgcctgccaattattttaaat

SEQ ID NO: 864948 - DNA, 25 bp, Mus musculus
tgcatgcctgcctattattttaaat

SEQ ID NO: 864949 - DNA, 25 bp, Mus musculus
tgcatgcgctaaccctggacttgat

SEQ ID NO: 864950 - DNA, 25 bp, Mus musculus
tgcatgcgctaagcctggacttgat

SEQ ID NO: 864951 - DNA, 25 bp, Mus musculus
tgcatgcgtgcactgtattatttac

SEQ ID NO: 864952 - DNA, 25 bp, Mus musculus
tgcatgcgtgcagtgtattatttac

SEQ ID NO: 864953 - DNA, 25 bp, Mus musculus
tgcatgcgtgccatgtatggacata

SEQ ID NO: 864954 - DNA, 25 bp, Mus musculus
tgcatgcgtgccttgtatggacata

SEQ ID NO: 864955 - DNA, 25 bp, Mus musculus
tgcatgctagcaacagttctttaat

SEQ ID NO: 864956 - DNA, 25 bp, Mus musculus
tgcatgctagcaccagggcttgctg

SEQ ID NO: 864957 - DNA, 25 bp, Mus musculus
tgcatgctagcagcagggcttgctg

SEQ ID NO: 864958 - DNA, 25 bp, Mus musculus
tgcatgctagcatcagttctttaat

SEQ ID NO: 864959 - DNA, 25 bp, Mus musculus
tgcatgctagctacaaacttaaaat

SEQ ID NO: 864960 - DNA, 25 bp, Mus musculus
tgcatgctagcttcaaacttaaaat

SEQ ID NO: 864961 - DNA, 25 bp, Mus musculus
tgcatgctatgcatgaccacaggac

SEQ ID NO: 864962 - DNA, 25 bp, Mus musculus
tgcatgctatgcttgaccacaggac

SEQ ID NO: 864963 - DNA, 25 bp, Mus musculus
tgcatgctcagtccctgcctcagat

SEQ ID NO: 864964 - DNA, 25 bp, Mus musculus
tgcatgctcagtgcctgcctcagat

SEQ ID NO: 864965 - DNA, 25 bp, Mus musculus
tgcatgctccagctgatgatcccat

SEQ ID NO: 864966 - DNA, 25 bp, Mus musculus
tgcatgctccaggtgatgatcccat

SEQ ID NO: 864967 - DNA, 25 bp, Mus musculus
tgcatgctcctgcagtgagctacct

SEQ ID NO: 864968 - DNA, 25 bp, Mus musculus
tgcatgctcctggagtgagctacct

SEQ ID NO: 864969 - DNA, 25 bp, Mus musculus
tgcatgctccttaagacaccagttg

SEQ ID NO: 864970 - DNA, 25 bp, Mus musculus
tgcatgctcctttagacaccagttg

SEQ ID NO: 864971 - DNA, 25 bp, Mus musculus
tgcatgctctctcaggcacttaaca

SEQ ID NO: 864972 - DNA, 25 bp, Mus musculus
tgcatgctctctcttgtcgttggag

SEQ ID NO: 864973 - DNA, 25 bp, Mus musculus
tgcatgctctctgaggcacttaaca

SEQ ID NO: 864974 - DNA, 25 bp, Mus musculus
tgcatgctctctgttgtcgttggag

SEQ ID NO: 864975 - DNA, 25 bp, Mus musculus
tgcatgctgaataccaacttgagat

SEQ ID NO: 864976 - DNA, 25 bp, Mus musculus
tgcatgctgaattccaacttgagat

SEQ ID NO: 864977 - DNA, 25 bp, Mus musculus
tgcatgctgcagattttccccagcc

SEQ ID NO: 864978 - DNA, 25 bp, Mus musculus
tgcatgctgcagtttttccccagcc

SEQ ID NO: 864979 - DNA, 25 bp, Mus musculus
tgcatgcttgagacagtctctctct

SEQ ID NO: 864980 - DNA, 25 bp, Mus musculus
tgcatgcttgagtcagtctctctct

SEQ ID NO: 864981 - DNA, 25 bp, Mus musculus
tgcatgcttgccatgagagtcagct

SEQ ID NO: 864982 - DNA, 25 bp, Mus musculus
tgcatgcttgccttgagagtcagct

SEQ ID NO: 864983 - DNA, 25 bp, Mus musculus
tgcatgcttgttcatttggctggct

SEQ ID NO: 864984 - DNA, 25 bp, Mus musculus
tgcatgcttgttgatttggctggct

SEQ ID NO: 864985 - DNA, 25 bp, Mus musculus
tgcatgctttgcatagggttgtgtg

SEQ ID NO: 864986 - DNA, 25 bp, Mus musculus
tgcatgctttgcttagggttgtgtg

SEQ ID NO: 864987 - DNA, 25 bp, Mus musculus
tgcatgctttttctttaccctgact

SEQ ID NO: 864988 - DNA, 25 bp, Mus musculus
tgcatgctttttgtttaccctgact

SEQ ID NO: 864989 - DNA, 25 bp, Mus musculus
tgcatggacacccttcttaatacaa

SEQ ID NO: 864990 - DNA, 25 bp, Mus musculus
tgcatggacaccgttcttaatacaa

SEQ ID NO: 864991 - DNA, 25 bp, Mus musculus
tgcatggacattagtacctcccctt

SEQ ID NO: 864992 - DNA, 25 bp, Mus musculus
tgcatggacatttgtacctcccctt

SEQ ID NO: 864993 - DNA, 25 bp, Mus musculus
tgcatggaccttatgtttaacttac

SEQ ID NO: 864994 - DNA, 25 bp, Mus musculus
tgcatggaccttttgtttaacttac

SEQ ID NO: 864995 - DNA, 25 bp, Mus musculus
tgcatggagtgtatcttctgagcct

SEQ ID NO: 864996 - DNA, 25 bp, Mus musculus
tgcatggagtgtttcttctgagcct

SEQ ID NO: 864997 - DNA, 25 bp, Mus musculus
tgcatggatgttaaccgaattcaat

SEQ ID NO: 864998 - DNA, 25 bp, Mus musculus
tgcatggatgtttaccgaattcaat

SEQ ID NO: 864999 - DNA, 25 bp, Mus musculus
tgcatggcaagtactgtacccctca

SEQ ID NO: 865000 - DNA, 25 bp, Mus musculus
tgcatggcaagttctgtacccctca

SEQ ID NO: 865001 - DNA, 25 bp, Mus musculus
tgcatggccactacatgctgcatgc

SEQ ID NO: 865002 - DNA, 25 bp, Mus musculus
tgcatggccacttcatgctgcatgc

SEQ ID NO: 865003 - DNA, 25 bp, Mus musculus
tgcatggcccatcgtaggtgttttg

SEQ ID NO: 865004 - DNA, 25 bp, Mus musculus
tgcatggcccatggtaggtgttttg

SEQ ID NO: 865005 - DNA, 25 bp, Mus musculus
tgcatggccccaattttattctttg

SEQ ID NO: 865006 - DNA, 25 bp, Mus musculus
tgcatggccccatttttattctttg

SEQ ID NO: 865007 - DNA, 25 bp, Mus musculus
tgcatggccgacacggtcgtgaagc

SEQ ID NO: 865008 - DNA, 25 bp, Mus musculus
tgcatggccgactcggtcgtgaagc

SEQ ID NO: 865009 - DNA, 25 bp, Mus musculus
tgcatggccgttcttagttggtgga

SEQ ID NO: 865010 - DNA, 25 bp, Mus musculus
tgcatggccgttgttagttggtgga

SEQ ID NO: 865011 - DNA, 25 bp, Mus musculus
tgcatggctcctcccctggtaaagc

SEQ ID NO: 865012 - DNA, 25 bp, Mus musculus
tgcatggctcctgccctggtaaagc

SEQ ID NO: 865013 - DNA, 25 bp, Mus musculus
tgcatggctgtcagtgcatcacatt

SEQ ID NO: 865014 - DNA, 25 bp, Mus musculus
tgcatggctgtctgtgcatcacatt

SEQ ID NO: 865015 - DNA, 25 bp, Mus musculus
tgcatgggaaccaacagacacagtc

SEQ ID NO: 865016 - DNA, 25 bp, Mus musculus
tgcatgggaacctacagacacagtc

SEQ ID NO: 865017 - DNA, 25 bp, Mus musculus
tgcatgggacccaggatcggatcca

SEQ ID NO: 865018 - DNA, 25 bp, Mus musculus
tgcatgggaccctggatcggatcca

SEQ ID NO: 865019 - DNA, 25 bp, Mus musculus
tgcatgggcactcgacctgagacat

SEQ ID NO: 865020 - DNA, 25 bp, Mus musculus
tgcatgggcactggacctgagacat

SEQ ID NO: 865021 - DNA, 25 bp, Mus musculus
tgcatgggccccagcagacacgtgg

SEQ ID NO: 865022 - DNA, 25 bp, Mus musculus
tgcatgggcccctgcagacacgtgg

SEQ ID NO: 865023 - DNA, 25 bp, Mus musculus
tgcatgggcgagctgatgacctcta

SEQ ID NO: 865024 - DNA, 25 bp, Mus musculus
tgcatgggcgaggtgatgacctcta

SEQ ID NO: 865025 - DNA, 25 bp, Mus musculus
tgcatgggcttcattttgcaccctg

SEQ ID NO: 865026 - DNA, 25 bp, Mus musculus
tgcatgggcttctttttgcaccctg

SEQ ID NO: 865027 - DNA, 25 bp, Mus musculus
tgcatggtaaatctagactttcccc

SEQ ID NO: 865028 - DNA, 25 bp, Mus musculus
tgcatggtaaatgtagactttcccc

SEQ ID NO: 865029 - DNA, 25 bp, Mus musculus
tgcatggtccatccttatgagttca

SEQ ID NO: 865030 - DNA, 25 bp, Mus musculus
tgcatggtccatgcttatgagttca

SEQ ID NO: 865031 - DNA, 25 bp, Mus musculus
tgcatggtctaactctttgtgtatc

SEQ ID NO: 865032 - DNA, 25 bp, Mus musculus
tgcatggtctaagtctttgtgtatc

SEQ ID NO: 865033 - DNA, 25 bp, Mus musculus
tgcatggtggcaaattctaactggc

SEQ ID NO: 865034 - DNA, 25 bp, Mus musculus
tgcatggtggcatattctaactggc

SEQ ID NO: 865035 - DNA, 25 bp, Mus musculus
tgcatggtgtggacttgccctcgtg

SEQ ID NO: 865036 - DNA, 25 bp, Mus musculus
tgcatggtgtggtcttgccctcgtg

SEQ ID NO: 865037 - DNA, 25 bp, Mus musculus
tgcatggttattctgagtcctcctt

SEQ ID NO: 865038 - DNA, 25 bp, Mus musculus
tgcatggttattgtgagtcctcctt

SEQ ID NO: 865039 - DNA, 25 bp, Mus musculus
tgcatggtttgcctgagctttgaac

SEQ ID NO: 865040 - DNA, 25 bp, Mus musculus
tgcatggtttgcgtgagctttgaac

SEQ ID NO: 865041 - DNA, 25 bp, Mus musculus
tgcatgtacttactgcctcctctgt

SEQ ID NO: 865042 - DNA, 25 bp, Mus musculus
tgcatgtacttagtgcctcctctgt

SEQ ID NO: 865043 - DNA, 25 bp, Mus musculus
tgcatgtagtgcctaaagttttccc

SEQ ID NO: 865044 - DNA, 25 bp, Mus musculus
tgcatgtagtgcgtaaagttttccc

SEQ ID NO: 865045 - DNA, 25 bp, Mus musculus
tgcatgtcacttccttaatgagcca

SEQ ID NO: 865046 - DNA, 25 bp, Mus musculus
tgcatgtcacttgcttaatgagcca

SEQ ID NO: 865047 - DNA, 25 bp, Mus musculus
tgcatgtcccagaagtttccaaaaa

SEQ ID NO: 865048 - DNA, 25 bp, Mus musculus
tgcatgtcccagtagtttccaaaaa

SEQ ID NO: 865049 - DNA, 25 bp, Mus musculus
tgcatgtccctcattaaccagttta

SEQ ID NO: 865050 - DNA, 25 bp, Mus musculus
tgcatgtccctctttaaccagttta

SEQ ID NO: 865051 - DNA, 25 bp, Mus musculus
tgcatgtcctatcagccacagggat

SEQ ID NO: 865052 - DNA, 25 bp, Mus musculus
tgcatgtcctatgagccacagggat

SEQ ID NO: 865053 - DNA, 25 bp, Mus musculus
tgcatgtctaagaacgcacggccgg

SEQ ID NO: 865054 - DNA, 25 bp, Mus musculus
tgcatgtctaagtacgcacggccgg

SEQ ID NO: 865055 - DNA, 25 bp, Mus musculus
tgcatgtctccaaatctccagggct

SEQ ID NO: 865056 - DNA, 25 bp, Mus musculus
tgcatgtctccatatctccagggct

SEQ ID NO: 865057 - DNA, 25 bp, Mus musculus
tgcatgtctcctccatgtgaggaag

SEQ ID NO: 865058 - DNA, 25 bp, Mus musculus
tgcatgtctcctgcatgtgaggaag

SEQ ID NO: 865059 - DNA, 25 bp, Mus musculus
tgcatgtctcgcattccagagttta

SEQ ID NO: 865060 - DNA, 25 bp, Mus musculus
tgcatgtctcgctttccagagttta

SEQ ID NO: 865061 - DNA, 25 bp, Mus musculus
tgcatgtctctcagggtagcacaat

SEQ ID NO: 865062 - DNA, 25 bp, Mus musculus
tgcatgtctctctgggtagcacaat

SEQ ID NO: 865063 - DNA, 25 bp, Mus musculus
tgcatgtctgtacttggtttttcag

SEQ ID NO: 865064 - DNA, 25 bp, Mus musculus
tgcatgtctgtagttggtttttcag

SEQ ID NO: 865065 - DNA, 25 bp, Mus musculus
tgcatgtctgttatggcccattcaa

SEQ ID NO: 865066 - DNA, 25 bp, Mus musculus
tgcatgtctgttttggcccattcaa

SEQ ID NO: 865067 - DNA, 25 bp, Mus musculus
tgcatgtgacctctgctgttgtcac

SEQ ID NO: 865068 - DNA, 25 bp, Mus musculus
tgcatgtgacctgtgctgttgtcac

SEQ ID NO: 865069 - DNA, 25 bp, Mus musculus
tgcatgtgcactcactctgagttgt

SEQ ID NO: 865070 - DNA, 25 bp, Mus musculus
tgcatgtgcactgactctgagttgt

SEQ ID NO: 865071 - DNA, 25 bp, Mus musculus
tgcatgtgctgcacccaatgactga

SEQ ID NO: 865072 - DNA, 25 bp, Mus musculus
tgcatgtgctgctcccaatgactga

SEQ ID NO: 865073 - DNA, 25 bp, Mus musculus
tgcatgtggcccacctggtaaagtg

SEQ ID NO: 865074 - DNA, 25 bp, Mus musculus
tgcatgtggccctcctggtaaagtg

SEQ ID NO: 865075 - DNA, 25 bp, Mus musculus
tgcatgtgggacacacattcctcca

SEQ ID NO: 865076 - DNA, 25 bp, Mus musculus
tgcatgtgggactcacattcctcca

SEQ ID NO: 865077 - DNA, 25 bp, Mus musculus
tgcatgtgggtgacactgtgcagcc

SEQ ID NO: 865078 - DNA, 25 bp, Mus musculus
tgcatgtgggtgtcactgtgcagcc

SEQ ID NO: 865079 - DNA, 25 bp, Mus musculus
tgcatgtggtgcataaaaataccat

SEQ ID NO: 865080 - DNA, 25 bp, Mus musculus
tgcatgtggtgcttaaaaataccat

SEQ ID NO: 865081 - DNA, 25 bp, Mus musculus
tgcatgtgtgtgatccatcatccct

SEQ ID NO: 865082 - DNA, 25 bp, Mus musculus
tgcatgtgtgtgttccatcatccct

SEQ ID NO: 865083 - DNA, 25 bp, Mus musculus
tgcatgtgtgttctgccttttgaca

SEQ ID NO: 865084 - DNA, 25 bp, Mus musculus
tgcatgtgtgttgtgccttttgaca

SEQ ID NO: 865085 - DNA, 25 bp, Mus musculus
tgcatgtgttaccaggctgctaaat

SEQ ID NO: 865086 - DNA, 25 bp, Mus musculus
tgcatgtgttacgaggctgctaaat

SEQ ID NO: 865087 - DNA, 25 bp, Mus musculus
tgcatgttactgagttctgtttcct

SEQ ID NO: 865088 - DNA, 25 bp, Mus musculus
tgcatgttactgtgttctgtttcct

SEQ ID NO: 865089 - DNA, 25 bp, Mus musculus
tgcatgttcacacttaggtcctaaa

SEQ ID NO: 865090 - DNA, 25 bp, Mus musculus
tgcatgttcacagttaggtcctaaa

SEQ ID NO: 865091 - DNA, 25 bp, Mus musculus
tgcatgttcatccagctccagggaa

SEQ ID NO: 865092 - DNA, 25 bp, Mus musculus
tgcatgttcatcgagctccagggaa

SEQ ID NO: 865093 - DNA, 25 bp, Mus musculus
tgcatgttctgtcgctccggatgag

SEQ ID NO: 865094 - DNA, 25 bp, Mus musculus
tgcatgttctgtggctccggatgag

SEQ ID NO: 865095 - DNA, 25 bp, Mus musculus
tgcatgttgcatacgacttgagctt

SEQ ID NO: 865096 - DNA, 25 bp, Mus musculus
tgcatgttgcattcgacttgagctt

SEQ ID NO: 865097 - DNA, 25 bp, Mus musculus
tgcatgttgggacccacttgtactc

SEQ ID NO: 865098 - DNA, 25 bp, Mus musculus
tgcatgttgggagccacttgtactc

SEQ ID NO: 865099 - DNA, 25 bp, Mus musculus
tgcatgtttatgaccgagtgacagt

SEQ ID NO: 865100 - DNA, 25 bp, Mus musculus
tgcatgtttatgtccgagtgacagt

SEQ ID NO: 865101 - DNA, 25 bp, Mus musculus
tgcatgtttctcaccaggcagacag

SEQ ID NO: 865102 - DNA, 25 bp, Mus musculus
tgcatgtttctctccaggcagacag

SEQ ID NO: 865103 - DNA, 25 bp, Mus musculus
tgcatgtttctgacacacgctgtga

SEQ ID NO: 865104 - DNA, 25 bp, Mus musculus
tgcatgtttctgtcacacgctgtga

SEQ ID NO: 865105 - DNA, 25 bp, Mus musculus
tgcatgtttgcaagtctgtacgact

SEQ ID NO: 865106 - DNA, 25 bp, Mus musculus
tgcatgtttgcatgtctgtacgact

SEQ ID NO: 865107 - DNA, 25 bp, Mus musculus
tgcatgtttgtgaggtggccgcatc

SEQ ID NO: 865108 - DNA, 25 bp, Mus musculus
tgcatgtttgtgtggtggccgcatc

SEQ ID NO: 865109 - DNA, 25 bp, Mus musculus
tgcatgttttcactctgtaagtccc

SEQ ID NO: 865110 - DNA, 25 bp, Mus musculus
tgcatgttttcagtctgtaagtccc

SEQ ID NO: 865111 - DNA, 25 bp, Mus musculus
tgcatgttttttctttaccccaatt

SEQ ID NO: 865112 - DNA, 25 bp, Mus musculus
tgcatgttttttgtttaccccaatt

SEQ ID NO: 865113 - DNA, 25 bp, Mus musculus
tgcattaacttaaccaagatgggct

SEQ ID NO: 865114 - DNA, 25 bp, Mus musculus
tgcattaacttatccaagatgggct

SEQ ID NO: 865115 - DNA, 25 bp, Mus musculus
tgcattaagctaaccagtacatact

SEQ ID NO: 865116 - DNA, 25 bp, Mus musculus
tgcattaagctatccagtacatact

SEQ ID NO: 865117 - DNA, 25 bp, Mus musculus
tgcattaagctcacctcagtttgat

SEQ ID NO: 865118 - DNA, 25 bp, Mus musculus
tgcattaagctctcctcagtttgat

SEQ ID NO: 865119 - DNA, 25 bp, Mus musculus
tgcattacaacaccgtccctaatac

SEQ ID NO: 865120 - DNA, 25 bp, Mus musculus
tgcattacaacagcgtccctaatac

SEQ ID NO: 865121 - DNA, 25 bp, Mus musculus
tgcattacaactctatccttaccaa

SEQ ID NO: 865122 - DNA, 25 bp, Mus musculus
tgcattacaactgtatccttaccaa

SEQ ID NO: 865123 - DNA, 25 bp, Mus musculus
tgcattacctgccagcgagtcaagg

SEQ ID NO: 865124 - DNA, 25 bp, Mus musculus
tgcattacctgcgagcgagtcaagg

SEQ ID NO: 865125 - DNA, 25 bp, Mus musculus
tgcattacctttcccattttgtaga

SEQ ID NO: 865126 - DNA, 25 bp, Mus musculus
tgcattacctttgccattttgtaga

SEQ ID NO: 865127 - DNA, 25 bp, Mus musculus
tgcattactacccagcagttccctg

SEQ ID NO: 865128 - DNA, 25 bp, Mus musculus
tgcattactaccgagcagttccctg

SEQ ID NO: 865129 - DNA, 25 bp, Mus musculus
tgcattagcactaaccagtcattag

SEQ ID NO: 865130 - DNA, 25 bp, Mus musculus
tgcattagcacttaccagtcattag

SEQ ID NO: 865131 - DNA, 25 bp, Mus musculus
tgcattagcggtagccatgttcacc

SEQ ID NO: 865132 - DNA, 25 bp, Mus musculus
tgcattagcggttgccatgttcacc

SEQ ID NO: 865133 - DNA, 25 bp, Mus musculus
tgcattagtcacaaaccacctctag

SEQ ID NO: 865134 - DNA, 25 bp, Mus musculus
tgcattagtcactaaccacctctag

SEQ ID NO: 865135 - DNA, 25 bp, Mus musculus
tgcattatcaaaaactcagccaaga

SEQ ID NO: 865136 - DNA, 25 bp, Mus musculus
tgcattatcaaatactcagccaaga

SEQ ID NO: 865137 - DNA, 25 bp, Mus musculus
tgcattatcacacccaacccttcaa

SEQ ID NO: 865138 - DNA, 25 bp, Mus musculus
tgcattatcacagccaacccttcaa

SEQ ID NO: 865139 - DNA, 25 bp, Mus musculus
tgcattatgaagaggcatttcactc

SEQ ID NO: 865140 - DNA, 25 bp, Mus musculus
tgcattatgaagtggcatttcactc

SEQ ID NO: 865141 - DNA, 25 bp, Mus musculus
tgcattatgtttatccctattcccc

SEQ ID NO: 865142 - DNA, 25 bp, Mus musculus
tgcattatgtttttccctattcccc

SEQ ID NO: 865143 - DNA, 25 bp, Mus musculus
tgcattattattccaccagtgagct

SEQ ID NO: 865144 - DNA, 25 bp, Mus musculus
tgcattattattgcaccagtgagct

SEQ ID NO: 865145 - DNA, 25 bp, Mus musculus
tgcattattcatcgctgtctttggg

SEQ ID NO: 865146 - DNA, 25 bp, Mus musculus
tgcattattcatggctgtctttggg

SEQ ID NO: 865147 - DNA, 25 bp, Mus musculus
tgcattattgctactgtgatacata

SEQ ID NO: 865148 - DNA, 25 bp, Mus musculus
tgcattattgcttctgtgatacata

SEQ ID NO: 865149 - DNA, 25 bp, Mus musculus
tgcattatttctatccctgttctct

SEQ ID NO: 865150 - DNA, 25 bp, Mus musculus
tgcattatttctttccctgttctct

SEQ ID NO: 865151 - DNA, 25 bp, Mus musculus
tgcattcaaagcagggcacccagct

SEQ ID NO: 865152 - DNA, 25 bp, Mus musculus
tgcattcaaagctgggcacccagct

SEQ ID NO: 865153 - DNA, 25 bp, Mus musculus
tgcattcaacttccttctttatggc

SEQ ID NO: 865154 - DNA, 25 bp, Mus musculus
tgcattcaacttgcttctttatggc

SEQ ID NO: 865155 - DNA, 25 bp, Mus musculus
tgcattcaagaaaatcctcatcaaa

SEQ ID NO: 865156 - DNA, 25 bp, Mus musculus
tgcattcaagaatatcctcatcaaa

SEQ ID NO: 865157 - DNA, 25 bp, Mus musculus
tgcattcaagagaaaacgcaggtga

SEQ ID NO: 865158 - DNA, 25 bp, Mus musculus
tgcattcaagagtaaacgcaggtga

SEQ ID NO: 865159 - DNA, 25 bp, Mus musculus
tgcattcaaggcacgctcggctctc

SEQ ID NO: 865160 - DNA, 25 bp, Mus musculus
tgcattcaaggctcgctcggctctc

SEQ ID NO: 865161 - DNA, 25 bp, Mus musculus
tgcattcaatgaaacccgggaagaa

SEQ ID NO: 865162 - DNA, 25 bp, Mus musculus
tgcattcaatgatacccgggaagaa

SEQ ID NO: 865163 - DNA, 25 bp, Mus musculus
tgcattcaatgccacatcattccta

SEQ ID NO: 865164 - DNA, 25 bp, Mus musculus
tgcattcaatgcgacatcattccta

SEQ ID NO: 865165 - DNA, 25 bp, Mus musculus
tgcattcagactctttcccaagctg

SEQ ID NO: 865166 - DNA, 25 bp, Mus musculus
tgcattcagactgtttcccaagctg

SEQ ID NO: 865167 - DNA, 25 bp, Mus musculus
tgcattcagtatcctagcctcagag

SEQ ID NO: 865168 - DNA, 25 bp, Mus musculus
tgcattcagtatgctagcctcagag

SEQ ID NO: 865169 - DNA, 25 bp, Mus musculus
tgcattcatacacgcatacatttgt

SEQ ID NO: 865170 - DNA, 25 bp, Mus musculus
tgcattcatacaggcatacatttgt

SEQ ID NO: 865171 - DNA, 25 bp, Mus musculus
tgcattcatgcacactatgttccaa

SEQ ID NO: 865172 - DNA, 25 bp, Mus musculus
tgcattcatgcagactatgttccaa

SEQ ID NO: 865173 - DNA, 25 bp, Mus musculus
tgcattcatggcatccacttgtaaa

SEQ ID NO: 865174 - DNA, 25 bp, Mus musculus
tgcattcatggcttccacttgtaaa

SEQ ID NO: 865175 - DNA, 25 bp, Mus musculus
tgcattcatgggatggtcagtactt

SEQ ID NO: 865176 - DNA, 25 bp, Mus musculus
tgcattcatgggttggtcagtactt

SEQ ID NO: 865177 - DNA, 25 bp, Mus musculus
tgcattcatgtaaaacacccatccc

SEQ ID NO: 865178 - DNA, 25 bp, Mus musculus
tgcattcatgtataacacccatccc

SEQ ID NO: 865179 - DNA, 25 bp, Mus musculus
tgcattcatgtcaaagcagcttaat

SEQ ID NO: 865180 - DNA, 25 bp, Mus musculus
tgcattcatgtctaagcagcttaat

SEQ ID NO: 865181 - DNA, 25 bp, Mus musculus
tgcattcattccaaaagacttgagg

SEQ ID NO: 865182 - DNA, 25 bp, Mus musculus
tgcattcattcctaaagacttgagg

SEQ ID NO: 865183 - DNA, 25 bp, Mus musculus
tgcattcattgactccataggtggt

SEQ ID NO: 865184 - DNA, 25 bp, Mus musculus
tgcattcattgagtccataggtggt

SEQ ID NO: 865185 - DNA, 25 bp, Mus musculus
tgcattccatccagtttcctacatt

SEQ ID NO: 865186 - DNA, 25 bp, Mus musculus
tgcattccatcctgtttcctacatt

SEQ ID NO: 865187 - DNA, 25 bp, Mus musculus
tgcattccatgcagaagggctcaac

SEQ ID NO: 865188 - DNA, 25 bp, Mus musculus
tgcattccatgctgaagggctcaac

SEQ ID NO: 865189 - DNA, 25 bp, Mus musculus
tgcattccatttcccttgttctgaa

SEQ ID NO: 865190 - DNA, 25 bp, Mus musculus
tgcattccatttgccttgttctgaa

SEQ ID NO: 865191 - DNA, 25 bp, Mus musculus
tgcattcccagtcggcagtgatggc

SEQ ID NO: 865192 - DNA, 25 bp, Mus musculus
tgcattcccagtgggcagtgatggc

SEQ ID NO: 865193 - DNA, 25 bp, Mus musculus
tgcattccccaacaaccactaagtt

SEQ ID NO: 865194 - DNA, 25 bp, Mus musculus
tgcattccccaagaaccactaagtt

SEQ ID NO: 865195 - DNA, 25 bp, Mus musculus
tgcattcccggcactgatacaagaa

SEQ ID NO: 865196 - DNA, 25 bp, Mus musculus
tgcattcccggctctgatacaagaa

SEQ ID NO: 865197 - DNA, 25 bp, Mus musculus
tgcattccctccaatccgtaattaa

SEQ ID NO: 865198 - DNA, 25 bp, Mus musculus
tgcattccctcctatccgtaattaa

SEQ ID NO: 865199 - DNA, 25 bp, Mus musculus
tgcattcctcacctgtgacacaagt

SEQ ID NO: 865200 - DNA, 25 bp, Mus musculus
tgcattcctcacgtgtgacacaagt

SEQ ID NO: 865201 - DNA, 25 bp, Mus musculus
tgcattcctttaactgtaattacag

SEQ ID NO: 865202 - DNA, 25 bp, Mus musculus
tgcattcctttatctgtaattacag

SEQ ID NO: 865203 - DNA, 25 bp, Mus musculus
tgcattctaataactaagccagtgg

SEQ ID NO: 865204 - DNA, 25 bp, Mus musculus
tgcattctaatatctaagccagtgg

SEQ ID NO: 865205 - DNA, 25 bp, Mus musculus
tgcattctcgggatgctggcagact

SEQ ID NO: 865206 - DNA, 25 bp, Mus musculus
tgcattctcgggttgctggcagact

SEQ ID NO: 865207 - DNA, 25 bp, Mus musculus
tgcattctctcaaggcccaggtcac

SEQ ID NO: 865208 - DNA, 25 bp, Mus musculus
tgcattctctcatggcccaggtcac

SEQ ID NO: 865209 - DNA, 25 bp, Mus musculus
tgcattctctggactgggttcccat

SEQ ID NO: 865210 - DNA, 25 bp, Mus musculus
tgcattctctggtctgggttcccat

SEQ ID NO: 865211 - DNA, 25 bp, Mus musculus
tgcattctctgtccatagccgattt

SEQ ID NO: 865212 - DNA, 25 bp, Mus musculus
tgcattctctgtgcatagccgattt

SEQ ID NO: 865213 - DNA, 25 bp, Mus musculus
tgcattctcttcagtggcttgtagg

SEQ ID NO: 865214 - DNA, 25 bp, Mus musculus
tgcattctcttctgtggcttgtagg

SEQ ID NO: 865215 - DNA, 25 bp, Mus musculus
tgcattctctttctgacatccctga

SEQ ID NO: 865216 - DNA, 25 bp, Mus musculus
tgcattctctttgtgacatccctga

SEQ ID NO: 865217 - DNA, 25 bp, Mus musculus
tgcattctgaggctacttcaggtct

SEQ ID NO: 865218 - DNA, 25 bp, Mus musculus
tgcattctgagggtacttcaggtct

SEQ ID NO: 865219 - DNA, 25 bp, Mus musculus
tgcattctggatcttctattgggaa

SEQ ID NO: 865220 - DNA, 25 bp, Mus musculus
tgcattctggatgttctattgggaa

SEQ ID NO: 865221 - DNA, 25 bp, Mus musculus
tgcattctgtcgatatatgattgac

SEQ ID NO: 865222 - DNA, 25 bp, Mus musculus
tgcattctgtcgttatatgattgac

SEQ ID NO: 865223 - DNA, 25 bp, Mus musculus
tgcattctgttacacttctctggct

SEQ ID NO: 865224 - DNA, 25 bp, Mus musculus
tgcattctgttagacttctctggct

SEQ ID NO: 865225 - DNA, 25 bp, Mus musculus
tgcattcttactatcctagcctcag

SEQ ID NO: 865226 - DNA, 25 bp, Mus musculus
tgcattcttactttcctagcctcag

SEQ ID NO: 865227 - DNA, 25 bp, Mus musculus
tgcattcttaggctactgtgaggtc

SEQ ID NO: 865228 - DNA, 25 bp, Mus musculus
tgcattcttagggtactgtgaggtc

SEQ ID NO: 865229 - DNA, 25 bp, Mus musculus
tgcattcttggtatgctggctttac

SEQ ID NO: 865230 - DNA, 25 bp, Mus musculus
tgcattcttggtttgctggctttac

SEQ ID NO: 865231 - DNA, 25 bp, Mus musculus
tgcattgaacacaaccatgacaact

SEQ ID NO: 865232 - DNA, 25 bp, Mus musculus
tgcattgaacactaccatgacaact

SEQ ID NO: 865233 - DNA, 25 bp, Mus musculus
tgcattgaagtaatgtttaactcat

SEQ ID NO: 865234 - DNA, 25 bp, Mus musculus
tgcattgaagtattgtttaactcat

SEQ ID NO: 865235 - DNA, 25 bp, Mus musculus
tgcattgacagcagtggccgcgcca

SEQ ID NO: 865236 - DNA, 25 bp, Mus musculus
tgcattgacagctgtggccgcgcca

SEQ ID NO: 865237 - DNA, 25 bp, Mus musculus
tgcattgacatcaaatcagttgact

SEQ ID NO: 865238 - DNA, 25 bp, Mus musculus
tgcattgacatctaatcagttgact

SEQ ID NO: 865239 - DNA, 25 bp, Mus musculus
tgcattgagaaacccagcgtcgtcc

SEQ ID NO: 865240 - DNA, 25 bp, Mus musculus
tgcattgagaaagccagcgtcgtcc

SEQ ID NO: 865241 - DNA, 25 bp, Mus musculus
tgcattgcatcacctgccagcatag

SEQ ID NO: 865242 - DNA, 25 bp, Mus musculus
tgcattgcatcagctgccagcatag

SEQ ID NO: 865243 - DNA, 25 bp, Mus musculus
tgcattgccactactaaaatcctag

SEQ ID NO: 865244 - DNA, 25 bp, Mus musculus
tgcattgccacttctaaaatcctag

SEQ ID NO: 865245 - DNA, 25 bp, Mus musculus
tgcattgccgcccttgtgtaaacaa

SEQ ID NO: 865246 - DNA, 25 bp, Mus musculus
tgcattgccgccgttgtgtaaacaa

SEQ ID NO: 865247 - DNA, 25 bp, Mus musculus
tgcattgccgtaaccagtcttgtac

SEQ ID NO: 865248 - DNA, 25 bp, Mus musculus
tgcattgccgtatccagtcttgtac

SEQ ID NO: 865249 - DNA, 25 bp, Mus musculus
tgcattgcgtcgcacctgaccatct

SEQ ID NO: 865250 - DNA, 25 bp, Mus musculus
tgcattgcgtcggacctgaccatct

SEQ ID NO: 865251 - DNA, 25 bp, Mus musculus
tgcattgctacaacagtacccgtga

SEQ ID NO: 865252 - DNA, 25 bp, Mus musculus
tgcattgctacatcagtacccgtga

SEQ ID NO: 865253 - DNA, 25 bp, Mus musculus
tgcattgctattcagttcacttgga

SEQ ID NO: 865254 - DNA, 25 bp, Mus musculus
tgcattgctattgagttcacttgga

SEQ ID NO: 865255 - DNA, 25 bp, Mus musculus
tgcattgctcacatctgtgtcttcc

SEQ ID NO: 865256 - DNA, 25 bp, Mus musculus
tgcattgctcacttctgtgtcttcc

SEQ ID NO: 865257 - DNA, 25 bp, Mus musculus
tgcattggcaaaactacctctttag

SEQ ID NO: 865258 - DNA, 25 bp, Mus musculus
tgcattggcaaatctacctctttag

SEQ ID NO: 865259 - DNA, 25 bp, Mus musculus
tgcattggcatcatggttcttgact

SEQ ID NO: 865260 - DNA, 25 bp, Mus musculus
tgcattggcatcttggttcttgact

SEQ ID NO: 865261 - DNA, 25 bp, Mus musculus
tgcattggccatattagtgagcatt

SEQ ID NO: 865262 - DNA, 25 bp, Mus musculus
tgcattggccattttagtgagcatt

SEQ ID NO: 865263 - DNA, 25 bp, Mus musculus
tgcattgtagcaaccttgtccaaat

SEQ ID NO: 865264 - DNA, 25 bp, Mus musculus
tgcattgtagcatccttgtccaaat

SEQ ID NO: 865265 - DNA, 25 bp, Mus musculus
tgcattgtcatcactaatccttgga

SEQ ID NO: 865266 - DNA, 25 bp, Mus musculus
tgcattgtcatcatcccgaacggaa

SEQ ID NO: 865267 - DNA, 25 bp, Mus musculus
tgcattgtcatctctaatccttgga

SEQ ID NO: 865268 - DNA, 25 bp, Mus musculus
tgcattgtcatcttcccgaacggaa

SEQ ID NO: 865269 - DNA, 25 bp, Mus musculus
tgcattgtcttacggatgtttagat

SEQ ID NO: 865270 - DNA, 25 bp, Mus musculus
tgcattgtcttagggatgtttagat

SEQ ID NO: 865271 - DNA, 25 bp, Mus musculus
tgcattgtgggcaccacctgctggc

SEQ ID NO: 865272 - DNA, 25 bp, Mus musculus
tgcattgtgggctccacctgctggc

SEQ ID NO: 865273 - DNA, 25 bp, Mus musculus
tgcattgttagtcgctgtccctaga

SEQ ID NO: 865274 - DNA, 25 bp, Mus musculus
tgcattgttagtggctgtccctaga

SEQ ID NO: 865275 - DNA, 25 bp, Mus musculus
tgcattgttgcactctcccaagtct

SEQ ID NO: 865276 - DNA, 25 bp, Mus musculus
tgcattgttgcagtctcccaagtct

SEQ ID NO: 865277 - DNA, 25 bp, Mus musculus
tgcatttactccacactcattattg

SEQ ID NO: 865278 - DNA, 25 bp, Mus musculus
tgcatttactcctcactcattattg

SEQ ID NO: 865279 - DNA, 25 bp, Mus musculus
tgcatttactctagtcagccaacat

SEQ ID NO: 865280 - DNA, 25 bp, Mus musculus
tgcatttactcttgtcagccaacat

SEQ ID NO: 865281 - DNA, 25 bp, Mus musculus
tgcatttactttccttcaagaagac

SEQ ID NO: 865282 - DNA, 25 bp, Mus musculus
tgcatttactttgcttcaagaagac

SEQ ID NO: 865283 - DNA, 25 bp, Mus musculus
tgcatttatatgagtgatccctggt

SEQ ID NO: 865284 - DNA, 25 bp, Mus musculus
tgcatttatatgtgtgatccctggt

SEQ ID NO: 865285 - DNA, 25 bp, Mus musculus
tgcatttatgcacgttagtgattaa

SEQ ID NO: 865286 - DNA, 25 bp, Mus musculus
tgcatttatgcaggttagtgattaa

SEQ ID NO: 865287 - DNA, 25 bp, Mus musculus
tgcatttatttaagatactgttaga

SEQ ID NO: 865288 - DNA, 25 bp, Mus musculus
tgcatttatttatgatactgttaga

SEQ ID NO: 865289 - DNA, 25 bp, Mus musculus
tgcatttcaaagagactatggcatc

SEQ ID NO: 865290 - DNA, 25 bp, Mus musculus
tgcatttcaaagtgactatggcatc

SEQ ID NO: 865291 - DNA, 25 bp, Mus musculus
tgcatttcatcaatggtcaggtcga

SEQ ID NO: 865292 - DNA, 25 bp, Mus musculus
tgcatttcatcattggtcaggtcga

SEQ ID NO: 865293 - DNA, 25 bp, Mus musculus
tgcatttcattaatctacataggga

SEQ ID NO: 865294 - DNA, 25 bp, Mus musculus
tgcatttcattattctacataggga

SEQ ID NO: 865295 - DNA, 25 bp, Mus musculus
tgcatttcatttcaggtggtcacag

SEQ ID NO: 865296 - DNA, 25 bp, Mus musculus
tgcatttcatttgaggtggtcacag

SEQ ID NO: 865297 - DNA, 25 bp, Mus musculus
tgcatttccagaatggcctttgcca

SEQ ID NO: 865298 - DNA, 25 bp, Mus musculus
tgcatttccagattggcctttgcca

SEQ ID NO: 865299 - DNA, 25 bp, Mus musculus
tgcatttcccaacaagcagaactaa

SEQ ID NO: 865300 - DNA, 25 bp, Mus musculus
tgcatttcccaagaagcagaactaa

SEQ ID NO: 865301 - DNA, 25 bp, Mus musculus
tgcatttcccagaagtgactattga

SEQ ID NO: 865302 - DNA, 25 bp, Mus musculus
tgcatttcccagtagtgactattga

SEQ ID NO: 865303 - DNA, 25 bp, Mus musculus
tgcatttcccctcttcacagatact

SEQ ID NO: 865304 - DNA, 25 bp, Mus musculus
tgcatttcccctgttcacagatact

SEQ ID NO: 865305 - DNA, 25 bp, Mus musculus
tgcatttccttccagagacttttgt

SEQ ID NO: 865306 - DNA, 25 bp, Mus musculus
tgcatttccttcgagagacttttgt

SEQ ID NO: 865307 - DNA, 25 bp, Mus musculus
tgcatttctggcaatcacttgtaac

SEQ ID NO: 865308 - DNA, 25 bp, Mus musculus
tgcatttctggctatcacttgtaac

SEQ ID NO: 865309 - DNA, 25 bp, Mus musculus
tgcatttctggtcccaaggaggtca

SEQ ID NO: 865310 - DNA, 25 bp, Mus musculus
tgcatttctggtgccaaggaggtca

SEQ ID NO: 865311 - DNA, 25 bp, Mus musculus
tgcatttcttcactgtttctggcca

SEQ ID NO: 865312 - DNA, 25 bp, Mus musculus
tgcatttcttcagtgtttctggcca

SEQ ID NO: 865313 - DNA, 25 bp, Mus musculus
tgcatttgaactcattcccctggct

SEQ ID NO: 865314 - DNA, 25 bp, Mus musculus
tgcatttgaactgattcccctggct

SEQ ID NO: 865315 - DNA, 25 bp, Mus musculus
tgcatttgaagccagtgtgccacac

SEQ ID NO: 865316 - DNA, 25 bp, Mus musculus
tgcatttgaagcgagtgtgccacac

SEQ ID NO: 865317 - DNA, 25 bp, Mus musculus
tgcatttgaccaccttatccttaca

SEQ ID NO: 865318 - DNA, 25 bp, Mus musculus
tgcatttgaccagcttatccttaca

SEQ ID NO: 865319 - DNA, 25 bp, Mus musculus
tgcatttgatcaccactcttgttct

SEQ ID NO: 865320 - DNA, 25 bp, Mus musculus
tgcatttgatcagcactcttgttct

SEQ ID NO: 865321 - DNA, 25 bp, Mus musculus
tgcatttgatgtatgtctctctggg

SEQ ID NO: 865322 - DNA, 25 bp, Mus musculus
tgcatttgatgtttgtctctctggg

SEQ ID NO: 865323 - DNA, 25 bp, Mus musculus
tgcatttgccggcttcccaaaagca

SEQ ID NO: 865324 - DNA, 25 bp, Mus musculus
tgcatttgccgggttcccaaaagca

SEQ ID NO: 865325 - DNA, 25 bp, Mus musculus
tgcatttgcctgagagtccatgtga

SEQ ID NO: 865326 - DNA, 25 bp, Mus musculus
tgcatttgcctgtgagtccatgtga

SEQ ID NO: 865327 - DNA, 25 bp, Mus musculus
tgcatttgcgctatgtgtgttttgt

SEQ ID NO: 865328 - DNA, 25 bp, Mus musculus
tgcatttgcgctttgtgtgttttgt

SEQ ID NO: 865329 - DNA, 25 bp, Mus musculus
tgcatttgtctaaatgtgtatctgt

SEQ ID NO: 865330 - DNA, 25 bp, Mus musculus
tgcatttgtctatatgtgtatctgt

SEQ ID NO: 865331 - DNA, 25 bp, Mus musculus
tgcatttgttttcttccctattttt

SEQ ID NO: 865332 - DNA, 25 bp, Mus musculus
tgcatttgttttgttccctattttt

SEQ ID NO: 865333 - DNA, 25 bp, Mus musculus
tgcattttcaacacataggatttaa

SEQ ID NO: 865334 - DNA, 25 bp, Mus musculus
tgcattttcaactcataggatttaa

SEQ ID NO: 865335 - DNA, 25 bp, Mus musculus
tgcattttcaagaaactgctgctgt

SEQ ID NO: 865336 - DNA, 25 bp, Mus musculus
tgcattttcaagtaactgctgctgt

SEQ ID NO: 865337 - DNA, 25 bp, Mus musculus
tgcattttctcacgaagcaggaaga

SEQ ID NO: 865338 - DNA, 25 bp, Mus musculus
tgcattttctcaggaagcaggaaga

SEQ ID NO: 865339 - DNA, 25 bp, Mus musculus
tgcattttgcatacccttaacatcg

SEQ ID NO: 865340 - DNA, 25 bp, Mus musculus
tgcattttgcattcccttaacatcg

SEQ ID NO: 865341 - DNA, 25 bp, Mus musculus
tgcatttttctgacccacgagatat

SEQ ID NO: 865342 - DNA, 25 bp, Mus musculus
tgcatttttctgtcccacgagatat

SEQ ID NO: 865343 - DNA, 25 bp, Mus musculus
tgcattttttaaccctttccacttc

SEQ ID NO: 865344 - DNA, 25 bp, Mus musculus
tgcattttttaagcctttccacttc

SEQ ID NO: 865345 - DNA, 25 bp, Mus musculus
tgcattttttgtcttgtgtcagata

SEQ ID NO: 865346 - DNA, 25 bp, Mus musculus
tgcattttttgtgttgtgtcagata

SEQ ID NO: 865347 - DNA, 25 bp, Mus musculus
tgccaaaaagagaagcagtcatttc

SEQ ID NO: 865348 - DNA, 25 bp, Mus musculus
tgccaaaaagagtagcagtcatttc

SEQ ID NO: 865349 - DNA, 25 bp, Mus musculus
tgccaaaaccgtatctccttttgag

SEQ ID NO: 865350 - DNA, 25 bp, Mus musculus
tgccaaaaccgtttctccttttgag

SEQ ID NO: 865351 - DNA, 25 bp, Mus musculus
tgccaaaacctccaaagttagaaat

SEQ ID NO: 865352 - DNA, 25 bp, Mus musculus
tgccaaaacctcgaaagttagaaat

SEQ ID NO: 865353 - DNA, 25 bp, Mus musculus
tgccaaaagcctaactggtaaaaag

SEQ ID NO: 865354 - DNA, 25 bp, Mus musculus
tgccaaaagccttactggtaaaaag

SEQ ID NO: 865355 - DNA, 25 bp, Mus musculus
tgccaaaattccaccaaacaccaag

SEQ ID NO: 865356 - DNA, 25 bp, Mus musculus
tgccaaaattcctccaaacaccaag

SEQ ID NO: 865357 - DNA, 25 bp, Mus musculus
tgccaaaccattactacacattctg

SEQ ID NO: 865358 - DNA, 25 bp, Mus musculus
tgccaaaccatttctacacattctg

SEQ ID NO: 865359 - DNA, 25 bp, Mus musculus
tgccaaaccgtgaaggtgttcagaa

SEQ ID NO: 865360 - DNA, 25 bp, Mus musculus
tgccaaaccgtgtaggtgttcagaa

SEQ ID NO: 865361 - DNA, 25 bp, Mus musculus
tgccaaactggacctgcagcaggga

SEQ ID NO: 865362 - DNA, 25 bp, Mus musculus
tgccaaactggagctgcagcaggga

SEQ ID NO: 865363 - DNA, 25 bp, Mus musculus
tgccaaactggtattttccatctat

SEQ ID NO: 865364 - DNA, 25 bp, Mus musculus
tgccaaactggttttttccatctat

SEQ ID NO: 865365 - DNA, 25 bp, Mus musculus
tgccaaagactgcatgaccctctgt

SEQ ID NO: 865366 - DNA, 25 bp, Mus musculus
tgccaaagactggatgaccctctgt

SEQ ID NO: 865367 - DNA, 25 bp, Mus musculus
tgccaaagatgacccactggagttt

SEQ ID NO: 865368 - DNA, 25 bp, Mus musculus
tgccaaagatgagccactggagttt

SEQ ID NO: 865369 - DNA, 25 bp, Mus musculus
tgccaaagcaatcctaatgtccctg

SEQ ID NO: 865370 - DNA, 25 bp, Mus musculus
tgccaaagcaatgctaatgtccctg

SEQ ID NO: 865371 - DNA, 25 bp, Mus musculus
tgccaaagccagagtctccctcaga

SEQ ID NO: 865372 - DNA, 25 bp, Mus musculus
tgccaaagccagtgtctccctcaga

SEQ ID NO: 865373 - DNA, 25 bp, Mus musculus
tgccaaagccccagtgattagaata

SEQ ID NO: 865374 - DNA, 25 bp, Mus musculus
tgccaaagcccctgtgattagaata

SEQ ID NO: 865375 - DNA, 25 bp, Mus musculus
tgccaaagccttccgactcagagaa

SEQ ID NO: 865376 - DNA, 25 bp, Mus musculus
tgccaaagccttgcgactcagagaa

SEQ ID NO: 865377 - DNA, 25 bp, Mus musculus
tgccaaagctctacatcatgggctg

SEQ ID NO: 865378 - DNA, 25 bp, Mus musculus
tgccaaagctcttcatcatgggctg

SEQ ID NO: 865379 - DNA, 25 bp, Mus musculus
tgccaaagctgaactccccaaatat

SEQ ID NO: 865380 - DNA, 25 bp, Mus musculus
tgccaaagctgatctccccaaatat

SEQ ID NO: 865381 - DNA, 25 bp, Mus musculus
tgccaaaggcccctcagaagatttt

SEQ ID NO: 865382 - DNA, 25 bp, Mus musculus
tgccaaaggcccgtcagaagatttt

SEQ ID NO: 865383 - DNA, 25 bp, Mus musculus
tgccaaagggttaacagaccccaca

SEQ ID NO: 865384 - DNA, 25 bp, Mus musculus
tgccaaagggtttacagaccccaca

SEQ ID NO: 865385 - DNA, 25 bp, Mus musculus
tgccaaagtcgcacctagtcaggga

SEQ ID NO: 865386 - DNA, 25 bp, Mus musculus
tgccaaagtcgctcctagtcaggga

SEQ ID NO: 865387 - DNA, 25 bp, Mus musculus
tgccaaagtctcaatgttaatatac

SEQ ID NO: 865388 - DNA, 25 bp, Mus musculus
tgccaaagtctctatgttaatatac

SEQ ID NO: 865389 - DNA, 25 bp, Mus musculus
tgccaaagtggcagcgtctgactgg

SEQ ID NO: 865390 - DNA, 25 bp, Mus musculus
tgccaaagtggctgcgtctgactgg

SEQ ID NO: 865391 - DNA, 25 bp, Mus musculus
tgccaaatccctaacctgtgataga

SEQ ID NO: 865392 - DNA, 25 bp, Mus musculus
tgccaaatcccttacctgtgataga

SEQ ID NO: 865393 - DNA, 25 bp, Mus musculus
tgccaaatctaaccatcttccaata

SEQ ID NO: 865394 - DNA, 25 bp, Mus musculus
tgccaaatctaagcatcttccaata

SEQ ID NO: 865395 - DNA, 25 bp, Mus musculus
tgccaaatgaccaacaatacagaag

SEQ ID NO: 865396 - DNA, 25 bp, Mus musculus
tgccaaatgacctacaatacagaag

SEQ ID NO: 865397 - DNA, 25 bp, Mus musculus
tgccaaatgctgataggttgccata

SEQ ID NO: 865398 - DNA, 25 bp, Mus musculus
tgccaaatgctgttaggttgccata

SEQ ID NO: 865399 - DNA, 25 bp, Mus musculus
tgccaaattggcagaggctcacgtt

SEQ ID NO: 865400 - DNA, 25 bp, Mus musculus
tgccaaattggctgaggctcacgtt

SEQ ID NO: 865401 - DNA, 25 bp, Mus musculus
tgccaaattgtacctgacaccaagt

SEQ ID NO: 865402 - DNA, 25 bp, Mus musculus
tgccaaattgtagctgacaccaagt

SEQ ID NO: 865403 - DNA, 25 bp, Mus musculus
tgccaacaaccacacagtctttttt

SEQ ID NO: 865404 - DNA, 25 bp, Mus musculus
tgccaacaaccagacagtctttttt

SEQ ID NO: 865405 - DNA, 25 bp, Mus musculus
tgccaacacagaatgctgccagatt

SEQ ID NO: 865406 - DNA, 25 bp, Mus musculus
tgccaacacagattgctgccagatt

SEQ ID NO: 865407 - DNA, 25 bp, Mus musculus
tgccaacacctaacattctcaaagg

SEQ ID NO: 865408 - DNA, 25 bp, Mus musculus
tgccaacacctatcattctcaaagg

SEQ ID NO: 865409 - DNA, 25 bp, Mus musculus
tgccaacacttgcacatagctttgt

SEQ ID NO: 865410 - DNA, 25 bp, Mus musculus
tgccaacacttggacatagctttgt

SEQ ID NO: 865411 - DNA, 25 bp, Mus musculus
tgccaacagcccctgaagtgtctga

SEQ ID NO: 865412 - DNA, 25 bp, Mus musculus
tgccaacagcccgtgaagtgtctga

SEQ ID NO: 865413 - DNA, 25 bp, Mus musculus
tgccaacaggccatactgatctgag

SEQ ID NO: 865414 - DNA, 25 bp, Mus musculus
tgccaacaggccttactgatctgag

SEQ ID NO: 865415 - DNA, 25 bp, Mus musculus
tgccaacaggctccccgaagcgagt

SEQ ID NO: 865416 - DNA, 25 bp, Mus musculus
tgccaacaggctgcccgaagcgagt

SEQ ID NO: 865417 - DNA, 25 bp, Mus musculus
tgccaacagggacagccccagtgga

SEQ ID NO: 865418 - DNA, 25 bp, Mus musculus
tgccaacagggagagccccagtgga

SEQ ID NO: 865419 - DNA, 25 bp, Mus musculus
tgccaacatattccaagcactcagt

SEQ ID NO: 865420 - DNA, 25 bp, Mus musculus
tgccaacatattgcaagcactcagt

SEQ ID NO: 865421 - DNA, 25 bp, Mus musculus
tgccaacatctacccagacataaac

SEQ ID NO: 865422 - DNA, 25 bp, Mus musculus
tgccaacatctagccagacataaac

SEQ ID NO: 865423 - DNA, 25 bp, Mus musculus
tgccaacatgtgatgtcaccttagt

SEQ ID NO: 865424 - DNA, 25 bp, Mus musculus
tgccaacatgtgttgtcaccttagt

SEQ ID NO: 865425 - DNA, 25 bp, Mus musculus
tgccaacattccaccatttttgttt

SEQ ID NO: 865426 - DNA, 25 bp, Mus musculus
tgccaacattcctccatttttgttt

SEQ ID NO: 865427 - DNA, 25 bp, Mus musculus
tgccaaccacctagtgtgtgttgtt

SEQ ID NO: 865428 - DNA, 25 bp, Mus musculus
tgccaaccaccttgtgtgtgttgtt

SEQ ID NO: 865429 - DNA, 25 bp, Mus musculus
tgccaaccatacactactagctttt

SEQ ID NO: 865430 - DNA, 25 bp, Mus musculus
tgccaaccatactctactagctttt

SEQ ID NO: 865431 - DNA, 25 bp, Mus musculus
tgccaaccatctatcgaccctctac

SEQ ID NO: 865432 - DNA, 25 bp, Mus musculus
tgccaaccatctttcgaccctctac

SEQ ID NO: 865433 - DNA, 25 bp, Mus musculus
tgccaaccatgtataccctgtagtc

SEQ ID NO: 865434 - DNA, 25 bp, Mus musculus
tgccaaccatgtttaccctgtagtc

SEQ ID NO: 865435 - DNA, 25 bp, Mus musculus
tgccaacccactacaccagattgaa

SEQ ID NO: 865436 - DNA, 25 bp, Mus musculus
tgccaacccacttcaccagattgaa

SEQ ID NO: 865437 - DNA, 25 bp, Mus musculus
tgccaacccgcaacaaggcagacat

SEQ ID NO: 865438 - DNA, 25 bp, Mus musculus
tgccaacccgcatcaaggcagacat

SEQ ID NO: 865439 - DNA, 25 bp, Mus musculus
tgccaaccctcacacttgacaagaa

SEQ ID NO: 865440 - DNA, 25 bp, Mus musculus
tgccaaccctcagacttgacaagaa

SEQ ID NO: 865441 - DNA, 25 bp, Mus musculus
tgccaaccgaagcctaaggtccaaa

SEQ ID NO: 865442 - DNA, 25 bp, Mus musculus
tgccaaccgaaggctaaggtccaaa

SEQ ID NO: 865443 - DNA, 25 bp, Mus musculus
tgccaaccgagcctttgtcagcatg

SEQ ID NO: 865444 - DNA, 25 bp, Mus musculus
tgccaaccgagcgtttgtcagcatg

SEQ ID NO: 865445 - DNA, 25 bp, Mus musculus
tgccaaccggtaccttgctatgaag

SEQ ID NO: 865446 - DNA, 25 bp, Mus musculus
tgccaaccggtagcttgctatgaag

SEQ ID NO: 865447 - DNA, 25 bp, Mus musculus
tgccaacctagcaataaggagctct

SEQ ID NO: 865448 - DNA, 25 bp, Mus musculus
tgccaacctagctataaggagctct

SEQ ID NO: 865449 - DNA, 25 bp, Mus musculus
tgccaacctcttacgtgcgcctttc

SEQ ID NO: 865450 - DNA, 25 bp, Mus musculus
tgccaacctctttcgtgcgcctttc

SEQ ID NO: 865451 - DNA, 25 bp, Mus musculus
tgccaacctgtcacctgtagagaga

SEQ ID NO: 865452 - DNA, 25 bp, Mus musculus
tgccaacctgtctcctgtagagaga

SEQ ID NO: 865453 - DNA, 25 bp, Mus musculus
tgccaacgagtaaagggattttcct

SEQ ID NO: 865454 - DNA, 25 bp, Mus musculus
tgccaacgagtatagggattttcct

SEQ ID NO: 865455 - DNA, 25 bp, Mus musculus
tgccaacgcaagctcacagggatga

SEQ ID NO: 865456 - DNA, 25 bp, Mus musculus
tgccaacgcaaggtcacagggatga

SEQ ID NO: 865457 - DNA, 25 bp, Mus musculus
tgccaacgcagtcgccttggtcttg

SEQ ID NO: 865458 - DNA, 25 bp, Mus musculus
tgccaacgcagtggccttggtcttg

SEQ ID NO: 865459 - DNA, 25 bp, Mus musculus
tgccaacgtggtaatgtcccttgac

SEQ ID NO: 865460 - DNA, 25 bp, Mus musculus
tgccaacgtggttatgtcccttgac

SEQ ID NO: 865461 - DNA, 25 bp, Mus musculus
tgccaactatttagaggatgttgag

SEQ ID NO: 865462 - DNA, 25 bp, Mus musculus
tgccaactattttgaggatgttgag

SEQ ID NO: 865463 - DNA, 25 bp, Mus musculus
tgccaactcactagggatacctgtt

SEQ ID NO: 865464 - DNA, 25 bp, Mus musculus
tgccaactcacttgggatacctgtt

SEQ ID NO: 865465 - DNA, 25 bp, Mus musculus
tgccaactccagatctgtgggcggg

SEQ ID NO: 865466 - DNA, 25 bp, Mus musculus
tgccaactccagttctgtgggcggg

SEQ ID NO: 865467 - DNA, 25 bp, Mus musculus
tgccaactccatcgtcgtggtcgga

SEQ ID NO: 865468 - DNA, 25 bp, Mus musculus
tgccaactccatggtcgtggtcgga

SEQ ID NO: 865469 - DNA, 25 bp, Mus musculus
tgccaactctgcactacagatcatg

SEQ ID NO: 865470 - DNA, 25 bp, Mus musculus
tgccaactctgctctacagatcatg

SEQ ID NO: 865471 - DNA, 25 bp, Mus musculus
tgccaactcttacgcacacatgtgt

SEQ ID NO: 865472 - DNA, 25 bp, Mus musculus
tgccaactcttaggcacacatgtgt

SEQ ID NO: 865473 - DNA, 25 bp, Mus musculus
tgccaactgagaaggacgagcgact

SEQ ID NO: 865474 - DNA, 25 bp, Mus musculus
tgccaactgagatggacgagcgact

SEQ ID NO: 865475 - DNA, 25 bp, Mus musculus
tgccaactgtcaacttgaccaggtt

SEQ ID NO: 865476 - DNA, 25 bp, Mus musculus
tgccaactgtcatcttgaccaggtt

SEQ ID NO: 865477 - DNA, 25 bp, Mus musculus
tgccaacttgctccggatgtttttt

SEQ ID NO: 865478 - DNA, 25 bp, Mus musculus
tgccaacttgctgcggatgtttttt

SEQ ID NO: 865479 - DNA, 25 bp, Mus musculus
tgccaacttgttactttctgtgtac

SEQ ID NO: 865480 - DNA, 25 bp, Mus musculus
tgccaacttgtttctttctgtgtac

SEQ ID NO: 865481 - DNA, 25 bp, Mus musculus
tgccaacttttaatgaaacagacat

SEQ ID NO: 865482 - DNA, 25 bp, Mus musculus
tgccaacttttattgaaacagacat

SEQ ID NO: 865483 - DNA, 25 bp, Mus musculus
tgccaagaagttctgctccatcatt

SEQ ID NO: 865484 - DNA, 25 bp, Mus musculus
tgccaagaagttgtgctccatcatt

SEQ ID NO: 865485 - DNA, 25 bp, Mus musculus
tgccaagaattgagcatgatgcccc

SEQ ID NO: 865486 - DNA, 25 bp, Mus musculus
tgccaagaattgtgcatgatgcccc

SEQ ID NO: 865487 - DNA, 25 bp, Mus musculus
tgccaagacagcaacaagcattgtg

SEQ ID NO: 865488 - DNA, 25 bp, Mus musculus
tgccaagacagctacaagcattgtg

SEQ ID NO: 865489 - DNA, 25 bp, Mus musculus
tgccaagacccaaagagctcagatg

SEQ ID NO: 865490 - DNA, 25 bp, Mus musculus
tgccaagacccatagagctcagatg

SEQ ID NO: 865491 - DNA, 25 bp, Mus musculus
tgccaagactggaaagctctctccc

SEQ ID NO: 865492 - DNA, 25 bp, Mus musculus
tgccaagactggtaagctctctccc

SEQ ID NO: 865493 - DNA, 25 bp, Mus musculus
tgccaagagccaattttaatctaca

SEQ ID NO: 865494 - DNA, 25 bp, Mus musculus
tgccaagagccatttttaatctaca

SEQ ID NO: 865495 - DNA, 25 bp, Mus musculus
tgccaagatgcccaatctactacta

SEQ ID NO: 865496 - DNA, 25 bp, Mus musculus
tgccaagatgccgaatctactacta

SEQ ID NO: 865497 - DNA, 25 bp, Mus musculus
tgccaagattatcccaaagcctgtt

SEQ ID NO: 865498 - DNA, 25 bp, Mus musculus
tgccaagattatgccaaagcctgtt

SEQ ID NO: 865499 - DNA, 25 bp, Mus musculus
tgccaagattcacccttcaaggagg

SEQ ID NO: 865500 - DNA, 25 bp, Mus musculus
tgccaagattcagccttcaaggagg

SEQ ID NO: 865501 - DNA, 25 bp, Mus musculus
tgccaagcacaactacaccgaaaag

SEQ ID NO: 865502 - DNA, 25 bp, Mus musculus
tgccaagcacaagtacaccgaaaag

SEQ ID NO: 865503 - DNA, 25 bp, Mus musculus
tgccaagcactcaacagacacagat

SEQ ID NO: 865504 - DNA, 25 bp, Mus musculus
tgccaagcactctacagacacagat

SEQ ID NO: 865505 - DNA, 25 bp, Mus musculus
tgccaagcagctctggttgatgata

SEQ ID NO: 865506 - DNA, 25 bp, Mus musculus
tgccaagcagctgtggttgatgata

SEQ ID NO: 865507 - DNA, 25 bp, Mus musculus
tgccaagccaacaggccgggattac

SEQ ID NO: 865508 - DNA, 25 bp, Mus musculus
tgccaagccaactggccgggattac

SEQ ID NO: 865509 - DNA, 25 bp, Mus musculus
tgccaagctcagcacgaggaactgc

SEQ ID NO: 865510 - DNA, 25 bp, Mus musculus
tgccaagctcaggacgaggaactgc

SEQ ID NO: 865511 - DNA, 25 bp, Mus musculus
tgccaagctgagaggcttacaggtg

SEQ ID NO: 865512 - DNA, 25 bp, Mus musculus
tgccaagctgagtggcttacaggtg

SEQ ID NO: 865513 - DNA, 25 bp, Mus musculus
tgccaagctggacaacctgaccttg

SEQ ID NO: 865514 - DNA, 25 bp, Mus musculus
tgccaagctggagaacctgaccttg

SEQ ID NO: 865515 - DNA, 25 bp, Mus musculus
tgccaagctgggaagtctcaacttc

SEQ ID NO: 865516 - DNA, 25 bp, Mus musculus
tgccaagctgggattgcaggtcatc

SEQ ID NO: 865517 - DNA, 25 bp, Mus musculus
tgccaagctgggtagtctcaacttc

SEQ ID NO: 865518 - DNA, 25 bp, Mus musculus
tgccaagctgggtttgcaggtcatc

SEQ ID NO: 865519 - DNA, 25 bp, Mus musculus
tgccaaggagacacccagagtcagg

SEQ ID NO: 865520 - DNA, 25 bp, Mus musculus
tgccaaggagactcccagagtcagg

SEQ ID NO: 865521 - DNA, 25 bp, Mus musculus
tgccaaggcataatcagctccacga

SEQ ID NO: 865522 - DNA, 25 bp, Mus musculus
tgccaaggcatattcagctccacga

SEQ ID NO: 865523 - DNA, 25 bp, Mus musculus
tgccaaggccaaaactagacagtgt

SEQ ID NO: 865524 - DNA, 25 bp, Mus musculus
tgccaaggccaatactagacagtgt

SEQ ID NO: 865525 - DNA, 25 bp, Mus musculus
tgccaaggcctaaagtttcccctaa

SEQ ID NO: 865526 - DNA, 25 bp, Mus musculus
tgccaaggcctatagtttcccctaa

SEQ ID NO: 865527 - DNA, 25 bp, Mus musculus
tgccaagggctcaccgccatgtaat

SEQ ID NO: 865528 - DNA, 25 bp, Mus musculus
tgccaagggctctccgccatgtaat

SEQ ID NO: 865529 - DNA, 25 bp, Mus musculus
tgccaagggtatattaccactactt

SEQ ID NO: 865530 - DNA, 25 bp, Mus musculus
tgccaagggtattttaccactactt

SEQ ID NO: 865531 - DNA, 25 bp, Mus musculus
tgccaagggttaagcaggctcttcc

SEQ ID NO: 865532 - DNA, 25 bp, Mus musculus
tgccaagggttatgcaggctcttcc

SEQ ID NO: 865533 - DNA, 25 bp, Mus musculus
tgccaaggtcaaccaatacccttac

SEQ ID NO: 865534 - DNA, 25 bp, Mus musculus
tgccaaggtcaagcaatacccttac

SEQ ID NO: 865535 - DNA, 25 bp, Mus musculus
tgccaaggtgaactccaaggactcc

SEQ ID NO: 865536 - DNA, 25 bp, Mus musculus
tgccaaggtgaagtccaaggactcc

SEQ ID NO: 865537 - DNA, 25 bp, Mus musculus
tgccaaggttcacagcatgtttgct

SEQ ID NO: 865538 - DNA, 25 bp, Mus musculus
tgccaaggttcagagcatgtttgct

SEQ ID NO: 865539 - DNA, 25 bp, Mus musculus
tgccaaggttttaggcggcttccaa

SEQ ID NO: 865540 - DNA, 25 bp, Mus musculus
tgccaaggtttttggcggcttccaa

SEQ ID NO: 865541 - DNA, 25 bp, Mus musculus
tgccaagtacaaagacctgttctct

SEQ ID NO: 865542 - DNA, 25 bp, Mus musculus
tgccaagtacaatgacctgttctct

SEQ ID NO: 865543 - DNA, 25 bp, Mus musculus
tgccaagtactgcacggctactgct

SEQ ID NO: 865544 - DNA, 25 bp, Mus musculus
tgccaagtactggacggctactgct

SEQ ID NO: 865545 - DNA, 25 bp, Mus musculus
tgccaagtagggaagattccacacg

SEQ ID NO: 865546 - DNA, 25 bp, Mus musculus
tgccaagtagggtagattccacacg

SEQ ID NO: 865547 - DNA, 25 bp, Mus musculus
tgccaagtcagtctattccctttac

SEQ ID NO: 865548 - DNA, 25 bp, Mus musculus
tgccaagtcagtgtattccctttac

SEQ ID NO: 865549 - DNA, 25 bp, Mus musculus
tgccaagtcctcagactgcacattg

SEQ ID NO: 865550 - DNA, 25 bp, Mus musculus
tgccaagtcctccaagcagtacctg

SEQ ID NO: 865551 - DNA, 25 bp, Mus musculus
tgccaagtcctcgaagcagtacctg

SEQ ID NO: 865552 - DNA, 25 bp, Mus musculus
tgccaagtcctctgactgcacattg

SEQ ID NO: 865553 - DNA, 25 bp, Mus musculus
tgccaagtggcaacacatcgagcgt

SEQ ID NO: 865554 - DNA, 25 bp, Mus musculus
tgccaagtggcatcacatcgagcgt

SEQ ID NO: 865555 - DNA, 25 bp, Mus musculus
tgccaagtgtggaaccttcctttgt

SEQ ID NO: 865556 - DNA, 25 bp, Mus musculus
tgccaagtgtggtaccttcctttgt

SEQ ID NO: 865557 - DNA, 25 bp, Mus musculus
tgccaagttccaaagtgagcgctcc

SEQ ID NO: 865558 - DNA, 25 bp, Mus musculus
tgccaagttccatagtgagcgctcc

SEQ ID NO: 865559 - DNA, 25 bp, Mus musculus
tgccaataaagtcttttgattgcct

SEQ ID NO: 865560 - DNA, 25 bp, Mus musculus
tgccaataaagtgttttgattgcct

SEQ ID NO: 865561 - DNA, 25 bp, Mus musculus
tgccaataagtacatgttcattcag

SEQ ID NO: 865562 - DNA, 25 bp, Mus musculus
tgccaataagtagatgttcattcag

SEQ ID NO: 865563 - DNA, 25 bp, Mus musculus
tgccaatatctactgtggtgtcatt

SEQ ID NO: 865564 - DNA, 25 bp, Mus musculus
tgccaatatctagtgtggtgtcatt

SEQ ID NO: 865565 - DNA, 25 bp, Mus musculus
tgccaatatcttatcagcaggttat

SEQ ID NO: 865566 - DNA, 25 bp, Mus musculus
tgccaatatcttttcagcaggttat

SEQ ID NO: 865567 - DNA, 25 bp, Mus musculus
tgccaatcacagctttactctttca

SEQ ID NO: 865568 - DNA, 25 bp, Mus musculus
tgccaatcacaggtttactctttca

SEQ ID NO: 865569 - DNA, 25 bp, Mus musculus
tgccaatcagccactgacaggaaag

SEQ ID NO: 865570 - DNA, 25 bp, Mus musculus
tgccaatcagcctctgacaggaaag

SEQ ID NO: 865571 - DNA, 25 bp, Mus musculus
tgccaatcaggtagctccttgagag

SEQ ID NO: 865572 - DNA, 25 bp, Mus musculus
tgccaatcaggttgctccttgagag

SEQ ID NO: 865573 - DNA, 25 bp, Mus musculus
tgccaatctaggagtcttgactttt

SEQ ID NO: 865574 - DNA, 25 bp, Mus musculus
tgccaatctaggtgtcttgactttt

SEQ ID NO: 865575 - DNA, 25 bp, Mus musculus
tgccaatctcatacaggactcagtg

SEQ ID NO: 865576 - DNA, 25 bp, Mus musculus
tgccaatctcattcaggactcagtg

SEQ ID NO: 865577 - DNA, 25 bp, Mus musculus
tgccaatctgtgataatttaaaagt

SEQ ID NO: 865578 - DNA, 25 bp, Mus musculus
tgccaatctgtgttaatttaaaagt

SEQ ID NO: 865579 - DNA, 25 bp, Mus musculus
tgccaatctttcctagggtctgatg

SEQ ID NO: 865580 - DNA, 25 bp, Mus musculus
tgccaatctttcgtagggtctgatg

SEQ ID NO: 865581 - DNA, 25 bp, Mus musculus
tgccaatggcatcgtctggaagact

SEQ ID NO: 865582 - DNA, 25 bp, Mus musculus
tgccaatggcatggtctggaagact

SEQ ID NO: 865583 - DNA, 25 bp, Mus musculus
tgccaatggccactttatttgcagc

SEQ ID NO: 865584 - DNA, 25 bp, Mus musculus
tgccaatggccagtttatttgcagc

SEQ ID NO: 865585 - DNA, 25 bp, Mus musculus
tgccaatgtccgcatcatcaagaac

SEQ ID NO: 865586 - DNA, 25 bp, Mus musculus
tgccaatgtccggatcatcaagaac

SEQ ID NO: 865587 - DNA, 25 bp, Mus musculus
tgccaatgtgcacctccttgatata

SEQ ID NO: 865588 - DNA, 25 bp, Mus musculus
tgccaatgtgcagctccttgatata

SEQ ID NO: 865589 - DNA, 25 bp, Mus musculus
tgccaatgttatccagcaggctggt

SEQ ID NO: 865590 - DNA, 25 bp, Mus musculus
tgccaatgttatgcagcaggctggt

SEQ ID NO: 865591 - DNA, 25 bp, Mus musculus
tgccaatgttttcaccgttccttga

SEQ ID NO: 865592 - DNA, 25 bp, Mus musculus
tgccaatgttttgaccgttccttga

SEQ ID NO: 865593 - DNA, 25 bp, Mus musculus
tgccaattatacacaactcctacct

SEQ ID NO: 865594 - DNA, 25 bp, Mus musculus
tgccaattatactcaactcctacct

SEQ ID NO: 865595 - DNA, 25 bp, Mus musculus
tgccaattcacacccttctacgagt

SEQ ID NO: 865596 - DNA, 25 bp, Mus musculus
tgccaattcacagccttctacgagt

SEQ ID NO: 865597 - DNA, 25 bp, Mus musculus
tgccaattcctaagtcctattgcca

SEQ ID NO: 865598 - DNA, 25 bp, Mus musculus
tgccaattcctatgtcctattgcca

SEQ ID NO: 865599 - DNA, 25 bp, Mus musculus
tgccaattggctcactcagtatgaa

SEQ ID NO: 865600 - DNA, 25 bp, Mus musculus
tgccaattggctgactcagtatgaa

SEQ ID NO: 865601 - DNA, 25 bp, Mus musculus
tgccaatttcttaatgacgcacaaa

SEQ ID NO: 865602 - DNA, 25 bp, Mus musculus
tgccaatttctttatgacgcacaaa

SEQ ID NO: 865603 - DNA, 25 bp, Mus musculus
tgccaatttgctatgaatctttcat

SEQ ID NO: 865604 - DNA, 25 bp, Mus musculus
tgccaatttgctttgaatctttcat

SEQ ID NO: 865605 - DNA, 25 bp, Mus musculus
tgccaatttggcatatcatatgaat

SEQ ID NO: 865606 - DNA, 25 bp, Mus musculus
tgccaatttggcttatcatatgaat

SEQ ID NO: 865607 - DNA, 25 bp, Mus musculus
tgccaatttggtccagtcctgtgtt

SEQ ID NO: 865608 - DNA, 25 bp, Mus musculus
tgccaatttggtgcagtcctgtgtt

SEQ ID NO: 865609 - DNA, 25 bp, Mus musculus
tgccaattttaaccctcctttatgt

SEQ ID NO: 865610 - DNA, 25 bp, Mus musculus
tgccaattttaagcctcctttatgt

SEQ ID NO: 865611 - DNA, 25 bp, Mus musculus
tgccacaacgcccatgtggagtgag

SEQ ID NO: 865612 - DNA, 25 bp, Mus musculus
tgccacaacgccgatgtggagtgag

SEQ ID NO: 865613 - DNA, 25 bp, Mus musculus
tgccacaactgactggattgctatt

SEQ ID NO: 865614 - DNA, 25 bp, Mus musculus
tgccacaactgagtggattgctatt

SEQ ID NO: 865615 - DNA, 25 bp, Mus musculus
tgccacaactggaaatgctcaagaa

SEQ ID NO: 865616 - DNA, 25 bp, Mus musculus
tgccacaactggtaatgctcaagaa

SEQ ID NO: 865617 - DNA, 25 bp, Mus musculus
tgccacaaggctatacggtgctggt

SEQ ID NO: 865618 - DNA, 25 bp, Mus musculus
tgccacaaggctttacggtgctggt

SEQ ID NO: 865619 - DNA, 25 bp, Mus musculus
tgccacaagggcagaggtgcctcct

SEQ ID NO: 865620 - DNA, 25 bp, Mus musculus
tgccacaagggctgaggtgcctcct

SEQ ID NO: 865621 - DNA, 25 bp, Mus musculus
tgccacaagtctaatcagggtcctc

SEQ ID NO: 865622 - DNA, 25 bp, Mus musculus
tgccacaagtcttatcagggtcctc

SEQ ID NO: 865623 - DNA, 25 bp, Mus musculus
tgccacaatcgccacactacagaag

SEQ ID NO: 865624 - DNA, 25 bp, Mus musculus
tgccacaatcgcgacactacagaag

SEQ ID NO: 865625 - DNA, 25 bp, Mus musculus
tgccacacagagaccagaagggttt

SEQ ID NO: 865626 - DNA, 25 bp, Mus musculus
tgccacacagagtccagaagggttt

SEQ ID NO: 865627 - DNA, 25 bp, Mus musculus
tgccacacagctccaacagtgctaa

SEQ ID NO: 865628 - DNA, 25 bp, Mus musculus
tgccacacagctgcaacagtgctaa

SEQ ID NO: 865629 - DNA, 25 bp, Mus musculus
tgccacacagtgaaacaacctgagg

SEQ ID NO: 865630 - DNA, 25 bp, Mus musculus
tgccacacagtgtaacaacctgagg

SEQ ID NO: 865631 - DNA, 25 bp, Mus musculus
tgccacaccagcaggtcgacaaagg

SEQ ID NO: 865632 - DNA, 25 bp, Mus musculus
tgccacaccagctggtcgacaaagg

SEQ ID NO: 865633 - DNA, 25 bp, Mus musculus
tgccacaccagtctctggacacaaa

SEQ ID NO: 865634 - DNA, 25 bp, Mus musculus
tgccacaccagtgtctggacacaaa

SEQ ID NO: 865635 - DNA, 25 bp, Mus musculus
tgccacaccggtcctttggatttta

SEQ ID NO: 865636 - DNA, 25 bp, Mus musculus
tgccacaccggtgctttggatttta

SEQ ID NO: 865637 - DNA, 25 bp, Mus musculus
tgccacaccttgctagagctgctca

SEQ ID NO: 865638 - DNA, 25 bp, Mus musculus
tgccacaccttggtagagctgctca

SEQ ID NO: 865639 - DNA, 25 bp, Mus musculus
tgccacacgggtccgctcaataaat

SEQ ID NO: 865640 - DNA, 25 bp, Mus musculus
tgccacacgggtgcgctcaataaat

SEQ ID NO: 865641 - DNA, 25 bp, Mus musculus
tgccacactcaccaaaactgaagct

SEQ ID NO: 865642 - DNA, 25 bp, Mus musculus
tgccacactcacgaaaactgaagct

SEQ ID NO: 865643 - DNA, 25 bp, Mus musculus
tgccacactggcatcttacaatgtt

SEQ ID NO: 865644 - DNA, 25 bp, Mus musculus
tgccacactggcttcttacaatgtt

SEQ ID NO: 865645 - DNA, 25 bp, Mus musculus
tgccacagacaactggagggtttct

SEQ ID NO: 865646 - DNA, 25 bp, Mus musculus
tgccacagacaagtggagggtttct

SEQ ID NO: 865647 - DNA, 25 bp, Mus musculus
tgccacagacccatggaaatcttgt

SEQ ID NO: 865648 - DNA, 25 bp, Mus musculus
tgccacagacccttggaaatcttgt

SEQ ID NO: 865649 - DNA, 25 bp, Mus musculus
tgccacagactgacagaggtccgag

SEQ ID NO: 865650 - DNA, 25 bp, Mus musculus
tgccacagactgtcagaggtccgag

SEQ ID NO: 865651 - DNA, 25 bp, Mus musculus
tgccacagagctagctagactcctt

SEQ ID NO: 865652 - DNA, 25 bp, Mus musculus
tgccacagagcttgctagactcctt

SEQ ID NO: 865653 - DNA, 25 bp, Mus musculus
tgccacagaggtccgtctgaatcga

SEQ ID NO: 865654 - DNA, 25 bp, Mus musculus
tgccacagaggtgcgtctgaatcga

SEQ ID NO: 865655 - DNA, 25 bp, Mus musculus
tgccacagattactcaagttgccat

SEQ ID NO: 865656 - DNA, 25 bp, Mus musculus
tgccacagattagtcaagttgccat

SEQ ID NO: 865657 - DNA, 25 bp, Mus musculus
tgccacagcaagagccacggacaac

SEQ ID NO: 865658 - DNA, 25 bp, Mus musculus
tgccacagcaagtgccacggacaac

SEQ ID NO: 865659 - DNA, 25 bp, Mus musculus
tgccacagccctctactgaaaagca

SEQ ID NO: 865660 - DNA, 25 bp, Mus musculus
tgccacagccctgtactgaaaagca

SEQ ID NO: 865661 - DNA, 25 bp, Mus musculus
tgccacagctgacgaggcctaggct

SEQ ID NO: 865662 - DNA, 25 bp, Mus musculus
tgccacagctgaggaggcctaggct

SEQ ID NO: 865663 - DNA, 25 bp, Mus musculus
tgccacaggatcatctcttctttta

SEQ ID NO: 865664 - DNA, 25 bp, Mus musculus
tgccacaggatcttctcttctttta

SEQ ID NO: 865665 - DNA, 25 bp, Mus musculus
tgccacaggcatctccaatctcagt

SEQ ID NO: 865666 - DNA, 25 bp, Mus musculus
tgccacaggcatgtccaatctcagt

SEQ ID NO: 865667 - DNA, 25 bp, Mus musculus
tgccacaggccacacggagactgac

SEQ ID NO: 865668 - DNA, 25 bp, Mus musculus
tgccacaggccagacggagactgac

SEQ ID NO: 865669 - DNA, 25 bp, Mus musculus
tgccacagggacagtaccttaactg

SEQ ID NO: 865670 - DNA, 25 bp, Mus musculus
tgccacagggactgtaccttaactg

SEQ ID NO: 865671 - DNA, 25 bp, Mus musculus
tgccacagggccattatcaccatct

SEQ ID NO: 865672 - DNA, 25 bp, Mus musculus
tgccacagggcctttatcaccatct

SEQ ID NO: 865673 - DNA, 25 bp, Mus musculus
tgccacagtgaactccggcctcagg

SEQ ID NO: 865674 - DNA, 25 bp, Mus musculus
tgccacagtgaagtccggcctcagg

SEQ ID NO: 865675 - DNA, 25 bp, Mus musculus
tgccacagttggaaaagttcttgct

SEQ ID NO: 865676 - DNA, 25 bp, Mus musculus
tgccacagttggtaaagttcttgct

SEQ ID NO: 865677 - DNA, 25 bp, Mus musculus
tgccacatagcacaacacaggaata

SEQ ID NO: 865678 - DNA, 25 bp, Mus musculus
tgccacatagcagaacacaggaata

SEQ ID NO: 865679 - DNA, 25 bp, Mus musculus
tgccacatcggaatctggtgccaag

SEQ ID NO: 865680 - DNA, 25 bp, Mus musculus
tgccacatcggattctggtgccaag

SEQ ID NO: 865681 - DNA, 25 bp, Mus musculus
tgccacatgctgcaccaagggaagt

SEQ ID NO: 865682 - DNA, 25 bp, Mus musculus
tgccacatgctggaccaagggaagt

SEQ ID NO: 865683 - DNA, 25 bp, Mus musculus
tgccacatgggaacaattgctaggg

SEQ ID NO: 865684 - DNA, 25 bp, Mus musculus
tgccacatgggatcaattgctaggg

SEQ ID NO: 865685 - DNA, 25 bp, Mus musculus
tgccacatgtttaccaccaaagctt

SEQ ID NO: 865686 - DNA, 25 bp, Mus musculus
tgccacatgttttccaccaaagctt

SEQ ID NO: 865687 - DNA, 25 bp, Mus musculus
tgccacattcttaccctgggagtgg

SEQ ID NO: 865688 - DNA, 25 bp, Mus musculus
tgccacattctttccctgggagtgg

SEQ ID NO: 865689 - DNA, 25 bp, Mus musculus
tgccacattgagatgatcctcactg

SEQ ID NO: 865690 - DNA, 25 bp, Mus musculus
tgccacattgagttgatcctcactg

SEQ ID NO: 865691 - DNA, 25 bp, Mus musculus
tgccacattgcaagtctgttttgta

SEQ ID NO: 865692 - DNA, 25 bp, Mus musculus
tgccacattgcatgtctgttttgta

SEQ ID NO: 865693 - DNA, 25 bp, Mus musculus
tgccacattggtcagttgacaattt

SEQ ID NO: 865694 - DNA, 25 bp, Mus musculus
tgccacattggtgagttgacaattt

SEQ ID NO: 865695 - DNA, 25 bp, Mus musculus
tgccacattgtgcttcacttaggaa

SEQ ID NO: 865696 - DNA, 25 bp, Mus musculus
tgccacattgtggttcacttaggaa

SEQ ID NO: 865697 - DNA, 25 bp, Mus musculus
tgccaccaaaaaatgaggccaatgt

SEQ ID NO: 865698 - DNA, 25 bp, Mus musculus
tgccaccaaaaattgaggccaatgt

SEQ ID NO: 865699 - DNA, 25 bp, Mus musculus
tgccaccaaatgactaaaccaccat

SEQ ID NO: 865700 - DNA, 25 bp, Mus musculus
tgccaccaaatgtctaaaccaccat

SEQ ID NO: 865701 - DNA, 25 bp, Mus musculus
tgccaccaacaacctcgggaattaa

SEQ ID NO: 865702 - DNA, 25 bp, Mus musculus
tgccaccaacaagctcgggaattaa

SEQ ID NO: 865703 - DNA, 25 bp, Mus musculus
tgccaccaacacacagaattacgct

SEQ ID NO: 865704 - DNA, 25 bp, Mus musculus
tgccaccaacactcagaattacgct

SEQ ID NO: 865705 - DNA, 25 bp, Mus musculus
tgccaccaagccagacataacagtt

SEQ ID NO: 865706 - DNA, 25 bp, Mus musculus
tgccaccaagcctgacataacagtt

SEQ ID NO: 865707 - DNA, 25 bp, Mus musculus
tgccaccaaggaccaggcatctgga

SEQ ID NO: 865708 - DNA, 25 bp, Mus musculus
tgccaccaaggagcaggcatctgga

SEQ ID NO: 865709 - DNA, 25 bp, Mus musculus
tgccaccacattcactgctttttaa

SEQ ID NO: 865710 - DNA, 25 bp, Mus musculus
tgccaccacattgactgctttttaa

SEQ ID NO: 865711 - DNA, 25 bp, Mus musculus
tgccaccacctcagggctgcagatg

SEQ ID NO: 865712 - DNA, 25 bp, Mus musculus
tgccaccacctctgggctgcagatg

SEQ ID NO: 865713 - DNA, 25 bp, Mus musculus
tgccaccacggtctcttatttatgg

SEQ ID NO: 865714 - DNA, 25 bp, Mus musculus
tgccaccacggtgtcttatttatgg

SEQ ID NO: 865715 - DNA, 25 bp, Mus musculus
tgccaccacgtgaaaatagtatcgg

SEQ ID NO: 865716 - DNA, 25 bp, Mus musculus
tgccaccacgtgtaaatagtatcgg

SEQ ID NO: 865717 - DNA, 25 bp, Mus musculus
tgccaccagtttagtccttatgact

SEQ ID NO: 865718 - DNA, 25 bp, Mus musculus
tgccaccagttttgtccttatgact

SEQ ID NO: 865719 - DNA, 25 bp, Mus musculus
tgccaccatacccagtgtattaggt

SEQ ID NO: 865720 - DNA, 25 bp, Mus musculus
tgccaccataccgagtgtattaggt

SEQ ID NO: 865721 - DNA, 25 bp, Mus musculus
tgccaccatcatattcttgctaggg

SEQ ID NO: 865722 - DNA, 25 bp, Mus musculus
tgccaccatcattttcttgctaggg

SEQ ID NO: 865723 - DNA, 25 bp, Mus musculus
tgccaccatgtccaacaaaacataa

SEQ ID NO: 865724 - DNA, 25 bp, Mus musculus
tgccaccatgtcgaacaaaacataa

SEQ ID NO: 865725 - DNA, 25 bp, Mus musculus
tgccaccattgtacagaaaccattt

SEQ ID NO: 865726 - DNA, 25 bp, Mus musculus
tgccaccattgttcagaaaccattt

SEQ ID NO: 865727 - DNA, 25 bp, Mus musculus
tgccacccacggaaacagagtccag

SEQ ID NO: 865728 - DNA, 25 bp, Mus musculus
tgccacccacggtaacagagtccag

SEQ ID NO: 865729 - DNA, 25 bp, Mus musculus
tgccacccatatccctatgttatca

SEQ ID NO: 865730 - DNA, 25 bp, Mus musculus
tgccacccatatgcctatgttatca

SEQ ID NO: 865731 - DNA, 25 bp, Mus musculus
tgccaccccacaagatgcagagtct

SEQ ID NO: 865732 - DNA, 25 bp, Mus musculus
tgccaccccacatgatgcagagtct

SEQ ID NO: 865733 - DNA, 25 bp, Mus musculus
tgccaccccagtcttaatcagtggt

SEQ ID NO: 865734 - DNA, 25 bp, Mus musculus
tgccaccccagtgttaatcagtggt

SEQ ID NO: 865735 - DNA, 25 bp, Mus musculus
tgccaccccatcaattgcaagaaca

SEQ ID NO: 865736 - DNA, 25 bp, Mus musculus
tgccaccccatctattgcaagaaca

SEQ ID NO: 865737 - DNA, 25 bp, Mus musculus
tgccaccccgaacacactgatgtga

SEQ ID NO: 865738 - DNA, 25 bp, Mus musculus
tgccaccccgaagacactgatgtga

SEQ ID NO: 865739 - DNA, 25 bp, Mus musculus
tgccacccggccatagagatgattg

SEQ ID NO: 865740 - DNA, 25 bp, Mus musculus
tgccacccggccttagagatgattg

SEQ ID NO: 865741 - DNA, 25 bp, Mus musculus
tgccacccgggacttgaggtcacgt

SEQ ID NO: 865742 - DNA, 25 bp, Mus musculus
tgccacccgggagttgaggtcacgt

SEQ ID NO: 865743 - DNA, 25 bp, Mus musculus
tgccaccctcctacgatgaagttgt

SEQ ID NO: 865744 - DNA, 25 bp, Mus musculus
tgccaccctccttcgatgaagttgt

SEQ ID NO: 865745 - DNA, 25 bp, Mus musculus
tgccaccctgggaatcgaattctga

SEQ ID NO: 865746 - DNA, 25 bp, Mus musculus
tgccaccctgggtatcgaattctga

SEQ ID NO: 865747 - DNA, 25 bp, Mus musculus
tgccaccgatgactatgctgtgcca

SEQ ID NO: 865748 - DNA, 25 bp, Mus musculus
tgccaccgatgagtatgctgtgcca

SEQ ID NO: 865749 - DNA, 25 bp, Mus musculus
tgccaccggcagacaggaggatagt

SEQ ID NO: 865750 - DNA, 25 bp, Mus musculus
tgccaccggcagtcaggaggatagt

SEQ ID NO: 865751 - DNA, 25 bp, Mus musculus
tgccaccgggcacggagtgatctta

SEQ ID NO: 865752 - DNA, 25 bp, Mus musculus
tgccaccgggcagggagtgatctta

SEQ ID NO: 865753 - DNA, 25 bp, Mus musculus
tgccaccggtgacagttccagggac

SEQ ID NO: 865754 - DNA, 25 bp, Mus musculus
tgccaccggtgagagttccagggac

SEQ ID NO: 865755 - DNA, 25 bp, Mus musculus
tgccacctagctatcaaaacacttg

SEQ ID NO: 865756 - DNA, 25 bp, Mus musculus
tgccacctagctttcaaaacacttg

SEQ ID NO: 865757 - DNA, 25 bp, Mus musculus
tgccacctcaagagcacttggaaca

SEQ ID NO: 865758 - DNA, 25 bp, Mus musculus
tgccacctcaagtgcacttggaaca

SEQ ID NO: 865759 - DNA, 25 bp, Mus musculus
tgccacctcagcagcaatggctgct

SEQ ID NO: 865760 - DNA, 25 bp, Mus musculus
tgccacctcagctgcaatggctgct

SEQ ID NO: 865761 - DNA, 25 bp, Mus musculus
tgccacctcatgctctgattcaggg

SEQ ID NO: 865762 - DNA, 25 bp, Mus musculus
tgccacctcatggtctgattcaggg

SEQ ID NO: 865763 - DNA, 25 bp, Mus musculus
tgccacctcattcttcaacgagagg

SEQ ID NO: 865764 - DNA, 25 bp, Mus musculus
tgccacctcattgttcaacgagagg

SEQ ID NO: 865765 - DNA, 25 bp, Mus musculus
tgccacctctacagctataatttaa

SEQ ID NO: 865766 - DNA, 25 bp, Mus musculus
tgccacctctactgctataatttaa

SEQ ID NO: 865767 - DNA, 25 bp, Mus musculus
tgccacctcttcactgggtggctca

SEQ ID NO: 865768 - DNA, 25 bp, Mus musculus
tgccacctcttctctgggtggctca

SEQ ID NO: 865769 - DNA, 25 bp, Mus musculus
tgccacctgagtccgattctcaaaa

SEQ ID NO: 865770 - DNA, 25 bp, Mus musculus
tgccacctgagtgcgattctcaaaa

SEQ ID NO: 865771 - DNA, 25 bp, Mus musculus
tgccacctgattcgtcaatacccag

SEQ ID NO: 865772 - DNA, 25 bp, Mus musculus
tgccacctgattggtcaatacccag

SEQ ID NO: 865773 - DNA, 25 bp, Mus musculus
tgccacctgcagagatgttatgtca

SEQ ID NO: 865774 - DNA, 25 bp, Mus musculus
tgccacctgcagtgatgttatgtca

SEQ ID NO: 865775 - DNA, 25 bp, Mus musculus
tgccacctggaaaagaatcctgtct

SEQ ID NO: 865776 - DNA, 25 bp, Mus musculus
tgccacctggaatagaatcctgtct

SEQ ID NO: 865777 - DNA, 25 bp, Mus musculus
tgccacctggtaccttaaactcggt

SEQ ID NO: 865778 - DNA, 25 bp, Mus musculus
tgccacctggtagcttaaactcggt

SEQ ID NO: 865779 - DNA, 25 bp, Mus musculus
tgccaccttatcaatgtgtctgtct

SEQ ID NO: 865780 - DNA, 25 bp, Mus musculus
tgccaccttatctatgtgtctgtct

SEQ ID NO: 865781 - DNA, 25 bp, Mus musculus
tgccaccttgtacggtgctggtttt

SEQ ID NO: 865782 - DNA, 25 bp, Mus musculus
tgccaccttgtagggtgctggtttt

SEQ ID NO: 865783 - DNA, 25 bp, Mus musculus
tgccacgactggagcctacatttga

SEQ ID NO: 865784 - DNA, 25 bp, Mus musculus
tgccacgactggtgcctacatttga

SEQ ID NO: 865785 - DNA, 25 bp, Mus musculus
tgccacgactttccatgccgagctg

SEQ ID NO: 865786 - DNA, 25 bp, Mus musculus
tgccacgactttgcatgccgagctg

SEQ ID NO: 865787 - DNA, 25 bp, Mus musculus
tgccacgatcttattgtcatttatt

SEQ ID NO: 865788 - DNA, 25 bp, Mus musculus
tgccacgatctttttgtcatttatt

SEQ ID NO: 865789 - DNA, 25 bp, Mus musculus
tgccacgcatctacatgaagggcgc

SEQ ID NO: 865790 - DNA, 25 bp, Mus musculus
tgccacgcatcttcatgaagggcgc

SEQ ID NO: 865791 - DNA, 25 bp, Mus musculus
tgccacgccagcagcagagaaatgg

SEQ ID NO: 865792 - DNA, 25 bp, Mus musculus
tgccacgccagcagtcggctcaatg

SEQ ID NO: 865793 - DNA, 25 bp, Mus musculus
tgccacgccagctgcagagaaatgg

SEQ ID NO: 865794 - DNA, 25 bp, Mus musculus
tgccacgccagctgtcggctcaatg

SEQ ID NO: 865795 - DNA, 25 bp, Mus musculus
tgccacgctctactaacgaattatg

SEQ ID NO: 865796 - DNA, 25 bp, Mus musculus
tgccacgctctagtaacgaattatg

SEQ ID NO: 865797 - DNA, 25 bp, Mus musculus
tgccacggcacgctgctgagggagg

SEQ ID NO: 865798 - DNA, 25 bp, Mus musculus
tgccacggcacggtgctgagggagg

SEQ ID NO: 865799 - DNA, 25 bp, Mus musculus
tgccacggctcaagtacacggagca

SEQ ID NO: 865800 - DNA, 25 bp, Mus musculus
tgccacggctcatgtacacggagca

SEQ ID NO: 865801 - DNA, 25 bp, Mus musculus
tgccacggctggcttcttggagaac

SEQ ID NO: 865802 - DNA, 25 bp, Mus musculus
tgccacggctgggttcttggagaac

SEQ ID NO: 865803 - DNA, 25 bp, Mus musculus
tgccacgtacccacgggatgaagaa

SEQ ID NO: 865804 - DNA, 25 bp, Mus musculus
tgccacgtaccctcgggatgaagaa

SEQ ID NO: 865805 - DNA, 25 bp, Mus musculus
tgccacgtgctgctggttcagatca

SEQ ID NO: 865806 - DNA, 25 bp, Mus musculus
tgccacgtgctggtggttcagatca

SEQ ID NO: 865807 - DNA, 25 bp, Mus musculus
tgccactaatggacctgtacttcac

SEQ ID NO: 865808 - DNA, 25 bp, Mus musculus
tgccactaatggtcctgtacttcac

SEQ ID NO: 865809 - DNA, 25 bp, Mus musculus
tgccactaatttagactggatttaa

SEQ ID NO: 865810 - DNA, 25 bp, Mus musculus
tgccactaattttgactggatttaa

SEQ ID NO: 865811 - DNA, 25 bp, Mus musculus
tgccactacaacctggagttgggct

SEQ ID NO: 865812 - DNA, 25 bp, Mus musculus
tgccactacaacgtggagttgggct

SEQ ID NO: 865813 - DNA, 25 bp, Mus musculus
tgccactaccacaacatttggcttt

SEQ ID NO: 865814 - DNA, 25 bp, Mus musculus
tgccactaccactacatttggcttt

SEQ ID NO: 865815 - DNA, 25 bp, Mus musculus
tgccactactttataatgcctccta

SEQ ID NO: 865816 - DNA, 25 bp, Mus musculus
tgccactactttttaatgcctccta

SEQ ID NO: 865817 - DNA, 25 bp, Mus musculus
tgccactcaacacctcttgagtcgt

SEQ ID NO: 865818 - DNA, 25 bp, Mus musculus
tgccactcaacagctcttgagtcgt

SEQ ID NO: 865819 - DNA, 25 bp, Mus musculus
tgccactcaccgcagcaaggtgata

SEQ ID NO: 865820 - DNA, 25 bp, Mus musculus
tgccactcaccggagcaaggtgata

SEQ ID NO: 865821 - DNA, 25 bp, Mus musculus
tgccactcagagcaatgacccggat

SEQ ID NO: 865822 - DNA, 25 bp, Mus musculus
tgccactcagaggaatgacccggat

SEQ ID NO: 865823 - DNA, 25 bp, Mus musculus
tgccactcatctctaaccgtgagct

SEQ ID NO: 865824 - DNA, 25 bp, Mus musculus
tgccactcatctgtaaccgtgagct

SEQ ID NO: 865825 - DNA, 25 bp, Mus musculus
tgccactcctggaatctgcaatgtg

SEQ ID NO: 865826 - DNA, 25 bp, Mus musculus
tgccactcctggtatctgcaatgtg

SEQ ID NO: 865827 - DNA, 25 bp, Mus musculus
tgccactcgaccaaagctctgagga

SEQ ID NO: 865828 - DNA, 25 bp, Mus musculus
tgccactcgacctaagctctgagga

SEQ ID NO: 865829 - DNA, 25 bp, Mus musculus
tgccactcgattctgtccaaaggaa

SEQ ID NO: 865830 - DNA, 25 bp, Mus musculus
tgccactcgattgtgtccaaaggaa

SEQ ID NO: 865831 - DNA, 25 bp, Mus musculus
tgccactcttaaagctggagctttg

SEQ ID NO: 865832 - DNA, 25 bp, Mus musculus
tgccactcttaatgctggagctttg

SEQ ID NO: 865833 - DNA, 25 bp, Mus musculus
tgccactgaaaaacgaagcccatag

SEQ ID NO: 865834 - DNA, 25 bp, Mus musculus
tgccactgaaaatcgaagcccatag

SEQ ID NO: 865835 - DNA, 25 bp, Mus musculus
tgccactgaatgcttgtaatcttat

SEQ ID NO: 865836 - DNA, 25 bp, Mus musculus
tgccactgaatggttgtaatcttat

SEQ ID NO: 865837 - DNA, 25 bp, Mus musculus
tgccactgaattctatgtacccttc

SEQ ID NO: 865838 - DNA, 25 bp, Mus musculus
tgccactgaattgtatgtacccttc

SEQ ID NO: 865839 - DNA, 25 bp, Mus musculus
tgccactgagcaatactagagttat

SEQ ID NO: 865840 - DNA, 25 bp, Mus musculus
tgccactgagcattactagagttat

SEQ ID NO: 865841 - DNA, 25 bp, Mus musculus
tgccactgcaggacggagacactgt

SEQ ID NO: 865842 - DNA, 25 bp, Mus musculus
tgccactgcaggtcggagacactgt

SEQ ID NO: 865843 - DNA, 25 bp, Mus musculus
tgccactgcatgaggtttgggctct

SEQ ID NO: 865844 - DNA, 25 bp, Mus musculus
tgccactgcatgtggtttgggctct

SEQ ID NO: 865845 - DNA, 25 bp, Mus musculus
tgccactgccagctcttagtacagt

SEQ ID NO: 865846 - DNA, 25 bp, Mus musculus
tgccactgccaggtcttagtacagt

SEQ ID NO: 865847 - DNA, 25 bp, Mus musculus
tgccactggctcagggctgtaaccc

SEQ ID NO: 865848 - DNA, 25 bp, Mus musculus
tgccactggctctgggctgtaaccc

SEQ ID NO: 865849 - DNA, 25 bp, Mus musculus
tgccactggcttatcaaacactgtc

SEQ ID NO: 865850 - DNA, 25 bp, Mus musculus
tgccactggcttttcaaacactgtc

SEQ ID NO: 865851 - DNA, 25 bp, Mus musculus
tgccactggtcaaaatggcttacca

SEQ ID NO: 865852 - DNA, 25 bp, Mus musculus
tgccactggtcataatggcttacca

SEQ ID NO: 865853 - DNA, 25 bp, Mus musculus
tgccactggtgacggcccctttgga

SEQ ID NO: 865854 - DNA, 25 bp, Mus musculus
tgccactggtgagggcccctttgga

SEQ ID NO: 865855 - DNA, 25 bp, Mus musculus
tgccactgtcacattctatcaggtg

SEQ ID NO: 865856 - DNA, 25 bp, Mus musculus
tgccactgtcactttctatcaggtg

SEQ ID NO: 865857 - DNA, 25 bp, Mus musculus
tgccactgtcctctaataaagtctg

SEQ ID NO: 865858 - DNA, 25 bp, Mus musculus
tgccactgtcctgtaataaagtctg

SEQ ID NO: 865859 - DNA, 25 bp, Mus musculus
tgccactgtgaccaacccaaatgaa

SEQ ID NO: 865860 - DNA, 25 bp, Mus musculus
tgccactgtgacgaacccaaatgaa

SEQ ID NO: 865861 - DNA, 25 bp, Mus musculus
tgccactgtgtgagcgaacctactg

SEQ ID NO: 865862 - DNA, 25 bp, Mus musculus
tgccactgtgtgtgcgaacctactg

SEQ ID NO: 865863 - DNA, 25 bp, Mus musculus
tgccacttactaacaggccttttaa

SEQ ID NO: 865864 - DNA, 25 bp, Mus musculus
tgccacttactatcaggccttttaa

SEQ ID NO: 865865 - DNA, 25 bp, Mus musculus
tgccacttaggaaataagcagtcct

SEQ ID NO: 865866 - DNA, 25 bp, Mus musculus
tgccacttaggatataagcagtcct

SEQ ID NO: 865867 - DNA, 25 bp, Mus musculus
tgccacttcacaactggtagcccag

SEQ ID NO: 865868 - DNA, 25 bp, Mus musculus
tgccacttcacatctggtagcccag

SEQ ID NO: 865869 - DNA, 25 bp, Mus musculus
tgccacttcactacttaaggcgagc

SEQ ID NO: 865870 - DNA, 25 bp, Mus musculus
tgccacttcacttcttaaggcgagc

SEQ ID NO: 865871 - DNA, 25 bp, Mus musculus
tgccacttcataagcttggcctgac

SEQ ID NO: 865872 - DNA, 25 bp, Mus musculus
tgccacttcatatgcttggcctgac

SEQ ID NO: 865873 - DNA, 25 bp, Mus musculus
tgccacttggtcctgggaggtcaaa

SEQ ID NO: 865874 - DNA, 25 bp, Mus musculus
tgccacttggtcgtgggaggtcaaa

SEQ ID NO: 865875 - DNA, 25 bp, Mus musculus
tgccactttggcagaggatgtcact

SEQ ID NO: 865876 - DNA, 25 bp, Mus musculus
tgccactttggctgaggatgtcact

SEQ ID NO: 865877 - DNA, 25 bp, Mus musculus
tgccactttgtcaatttctgtttcc

SEQ ID NO: 865878 - DNA, 25 bp, Mus musculus
tgccactttgtctatttctgtttcc

SEQ ID NO: 865879 - DNA, 25 bp, Mus musculus
tgccactttgtgaacgtgtgaaaat

SEQ ID NO: 865880 - DNA, 25 bp, Mus musculus
tgccactttgtgtacgtgtgaaaat

SEQ ID NO: 865881 - DNA, 25 bp, Mus musculus
tgccacttttctcttgtcacttgaa

SEQ ID NO: 865882 - DNA, 25 bp, Mus musculus
tgccacttttctgttgtcacttgaa

SEQ ID NO: 865883 - DNA, 25 bp, Mus musculus
tgccagaaccgcactttaagttttt

SEQ ID NO: 865884 - DNA, 25 bp, Mus musculus
tgccagaaccgctctttaagttttt

SEQ ID NO: 865885 - DNA, 25 bp, Mus musculus
tgccagaactaccaacctgagcttt

SEQ ID NO: 865886 - DNA, 25 bp, Mus musculus
tgccagaactacgaacctgagcttt

SEQ ID NO: 865887 - DNA, 25 bp, Mus musculus
tgccagaatccaacctccatgatgt

SEQ ID NO: 865888 - DNA, 25 bp, Mus musculus
tgccagaatccatcctccatgatgt

SEQ ID NO: 865889 - DNA, 25 bp, Mus musculus
tgccagacacacacgtggtgtatat

SEQ ID NO: 865890 - DNA, 25 bp, Mus musculus
tgccagacacactcgtggtgtatat

SEQ ID NO: 865891 - DNA, 25 bp, Mus musculus
tgccagacagttacttcccacatga

SEQ ID NO: 865892 - DNA, 25 bp, Mus musculus
tgccagacagtttcttcccacatga

SEQ ID NO: 865893 - DNA, 25 bp, Mus musculus
tgccagaccagaagcagtcacaagt

SEQ ID NO: 865894 - DNA, 25 bp, Mus musculus
tgccagaccagatgcagtcacaagt

SEQ ID NO: 865895 - DNA, 25 bp, Mus musculus
tgccagacctggcagggaagccata

SEQ ID NO: 865896 - DNA, 25 bp, Mus musculus
tgccagacctgggagggaagccata

SEQ ID NO: 865897 - DNA, 25 bp, Mus musculus
tgccagaccttacattatgcccttt

SEQ ID NO: 865898 - DNA, 25 bp, Mus musculus
tgccagaccttagattatgcccttt

SEQ ID NO: 865899 - DNA, 25 bp, Mus musculus
tgccagacgcctccactggaaaggc

SEQ ID NO: 865900 - DNA, 25 bp, Mus musculus
tgccagacgcctgcactggaaaggc

SEQ ID NO: 865901 - DNA, 25 bp, Mus musculus
tgccagacgcttcgttctgaggagt

SEQ ID NO: 865902 - DNA, 25 bp, Mus musculus
tgccagacgcttggttctgaggagt

SEQ ID NO: 865903 - DNA, 25 bp, Mus musculus
tgccagactatcacgtctaaatgac

SEQ ID NO: 865904 - DNA, 25 bp, Mus musculus
tgccagactatctcgtctaaatgac

SEQ ID NO: 865905 - DNA, 25 bp, Mus musculus
tgccagactcttccgactcaaatgc

SEQ ID NO: 865906 - DNA, 25 bp, Mus musculus
tgccagactcttgcgactcaaatgc

SEQ ID NO: 865907 - DNA, 25 bp, Mus musculus
tgccagagaccaaccaggacgtgga

SEQ ID NO: 865908 - DNA, 25 bp, Mus musculus
tgccagagaccacagtttcgggtct

SEQ ID NO: 865909 - DNA, 25 bp, Mus musculus
tgccagagaccagagtttcgggtct

SEQ ID NO: 865910 - DNA, 25 bp, Mus musculus
tgccagagaccatccaggacgtgga

SEQ ID NO: 865911 - DNA, 25 bp, Mus musculus
tgccagagacctagggccagccgct

SEQ ID NO: 865912 - DNA, 25 bp, Mus musculus
tgccagagaccttgggccagccgct

SEQ ID NO: 865913 - DNA, 25 bp, Mus musculus
tgccagagaggacttttgcctgcat

SEQ ID NO: 865914 - DNA, 25 bp, Mus musculus
tgccagagaggagttttgcctgcat

SEQ ID NO: 865915 - DNA, 25 bp, Mus musculus
tgccagagccacagggtgaagacaa

SEQ ID NO: 865916 - DNA, 25 bp, Mus musculus
tgccagagccactgggtgaagacaa

SEQ ID NO: 865917 - DNA, 25 bp, Mus musculus
tgccagagccggctcactgtgcaca

SEQ ID NO: 865918 - DNA, 25 bp, Mus musculus
tgccagagccgggtcactgtgcaca

SEQ ID NO: 865919 - DNA, 25 bp, Mus musculus
tgccagagctccaactcaaagtggt

SEQ ID NO: 865920 - DNA, 25 bp, Mus musculus
tgccagagctcctactcaaagtggt

SEQ ID NO: 865921 - DNA, 25 bp, Mus musculus
tgccagagctctattacctgcaaga

SEQ ID NO: 865922 - DNA, 25 bp, Mus musculus
tgccagagctcttttacctgcaaga

SEQ ID NO: 865923 - DNA, 25 bp, Mus musculus
tgccagagctgcattcctggatctc

SEQ ID NO: 865924 - DNA, 25 bp, Mus musculus
tgccagagctgctttcctggatctc

SEQ ID NO: 865925 - DNA, 25 bp, Mus musculus
tgccagagcttgagattggcaggca

SEQ ID NO: 865926 - DNA, 25 bp, Mus musculus
tgccagagcttgtgattggcaggca

SEQ ID NO: 865927 - DNA, 25 bp, Mus musculus
tgccagaggcgcacctgcaacacgg

SEQ ID NO: 865928 - DNA, 25 bp, Mus musculus
tgccagaggcgctcctgcaacacgg

SEQ ID NO: 865929 - DNA, 25 bp, Mus musculus
tgccagaggctacacaagaagattc

SEQ ID NO: 865930 - DNA, 25 bp, Mus musculus
tgccagaggctagacaagaagattc

SEQ ID NO: 865931 - DNA, 25 bp, Mus musculus
tgccagagtcaacccatgttacaag

SEQ ID NO: 865932 - DNA, 25 bp, Mus musculus
tgccagagtcaagccatgttacaag

SEQ ID NO: 865933 - DNA, 25 bp, Mus musculus
tgccagagtccaaagtaatcggtac

SEQ ID NO: 865934 - DNA, 25 bp, Mus musculus
tgccagagtccatagtaatcggtac

SEQ ID NO: 865935 - DNA, 25 bp, Mus musculus
tgccagagtggcctctgtacctctg

SEQ ID NO: 865936 - DNA, 25 bp, Mus musculus
tgccagagtggcgtctgtacctctg

SEQ ID NO: 865937 - DNA, 25 bp, Mus musculus
tgccagatactgaatattctaccat

SEQ ID NO: 865938 - DNA, 25 bp, Mus musculus
tgccagatactgtatattctaccat

SEQ ID NO: 865939 - DNA, 25 bp, Mus musculus
tgccagatgcgcagtgtggatccat

SEQ ID NO: 865940 - DNA, 25 bp, Mus musculus
tgccagatgcgctgtgtggatccat

SEQ ID NO: 865941 - DNA, 25 bp, Mus musculus
tgccagatggcacacttaaatataa

SEQ ID NO: 865942 - DNA, 25 bp, Mus musculus
tgccagatggcagacttaaatataa

SEQ ID NO: 865943 - DNA, 25 bp, Mus musculus
tgccagattcctaaaacatgcaaat

SEQ ID NO: 865944 - DNA, 25 bp, Mus musculus
tgccagattccttaaacatgcaaat

SEQ ID NO: 865945 - DNA, 25 bp, Mus musculus
tgccagcaaatgaacaggttatcag

SEQ ID NO: 865946 - DNA, 25 bp, Mus musculus
tgccagcaaatgtacaggttatcag

SEQ ID NO: 865947 - DNA, 25 bp, Mus musculus
tgccagcaaccacggagcagcatct

SEQ ID NO: 865948 - DNA, 25 bp, Mus musculus
tgccagcaaccagggagcagcatct

SEQ ID NO: 865949 - DNA, 25 bp, Mus musculus
tgccagcaagcactctactactgaa

SEQ ID NO: 865950 - DNA, 25 bp, Mus musculus
tgccagcaagcagtctactactgaa

SEQ ID NO: 865951 - DNA, 25 bp, Mus musculus
tgccagcaagcccagtgactggaac

SEQ ID NO: 865952 - DNA, 25 bp, Mus musculus
tgccagcaagccgagtgactggaac

SEQ ID NO: 865953 - DNA, 25 bp, Mus musculus
tgccagcacctaaggaccacagtta

SEQ ID NO: 865954 - DNA, 25 bp, Mus musculus
tgccagcacctatggaccacagtta

SEQ ID NO: 865955 - DNA, 25 bp, Mus musculus
tgccagcacgtccaaggctgcttac

SEQ ID NO: 865956 - DNA, 25 bp, Mus musculus
tgccagcacgtcgaaggctgcttac

SEQ ID NO: 865957 - DNA, 25 bp, Mus musculus
tgccagcagaaaagtccatccaaaa

SEQ ID NO: 865958 - DNA, 25 bp, Mus musculus
tgccagcagaaatgtccatccaaaa

SEQ ID NO: 865959 - DNA, 25 bp, Mus musculus
tgccagcagaatcgacagcagcgct

SEQ ID NO: 865960 - DNA, 25 bp, Mus musculus
tgccagcagaatggacagcagcgct

SEQ ID NO: 865961 - DNA, 25 bp, Mus musculus
tgccagcagacaaaaacatacagtt

SEQ ID NO: 865962 - DNA, 25 bp, Mus musculus
tgccagcagacataaacatacagtt

SEQ ID NO: 865963 - DNA, 25 bp, Mus musculus
tgccagcagcacatgaacagctcag

SEQ ID NO: 865964 - DNA, 25 bp, Mus musculus
tgccagcagcacttgaacagctcag

SEQ ID NO: 865965 - DNA, 25 bp, Mus musculus
tgccagcatttacgcagtgagtgca

SEQ ID NO: 865966 - DNA, 25 bp, Mus musculus
tgccagcatttaggcagtgagtgca

SEQ ID NO: 865967 - DNA, 25 bp, Mus musculus
tgccagccaagcagttgcgagactg

SEQ ID NO: 865968 - DNA, 25 bp, Mus musculus
tgccagccaagctgttgcgagactg

SEQ ID NO: 865969 - DNA, 25 bp, Mus musculus
tgccagccaaggaatcagtcccggg

SEQ ID NO: 865970 - DNA, 25 bp, Mus musculus
tgccagccaaggtatcagtcccggg

SEQ ID NO: 865971 - DNA, 25 bp, Mus musculus
tgccagccaccaacggaagcagtag

SEQ ID NO: 865972 - DNA, 25 bp, Mus musculus
tgccagccaccatcggaagcagtag

SEQ ID NO: 865973 - DNA, 25 bp, Mus musculus
tgccagccactacagtaaccactaa

SEQ ID NO: 865974 - DNA, 25 bp, Mus musculus
tgccagccactagagtaaccactaa

SEQ ID NO: 865975 - DNA, 25 bp, Mus musculus
tgccagccagggacaagactgtggt

SEQ ID NO: 865976 - DNA, 25 bp, Mus musculus
tgccagccagggtcaagactgtggt

SEQ ID NO: 865977 - DNA, 25 bp, Mus musculus
tgccagccatgcactgtattaggga

SEQ ID NO: 865978 - DNA, 25 bp, Mus musculus
tgccagccatgcctaaggattgcta

SEQ ID NO: 865979 - DNA, 25 bp, Mus musculus
tgccagccatgcgtaaggattgcta

SEQ ID NO: 865980 - DNA, 25 bp, Mus musculus
tgccagccatgctctgtattaggga

SEQ ID NO: 865981 - DNA, 25 bp, Mus musculus
tgccagccatttacaaagtagtctc

SEQ ID NO: 865982 - DNA, 25 bp, Mus musculus
tgccagccattttcaaagtagtctc

SEQ ID NO: 865983 - DNA, 25 bp, Mus musculus
tgccagcccaccatgagactacaaa

SEQ ID NO: 865984 - DNA, 25 bp, Mus musculus
tgccagcccaccttgagactacaaa

SEQ ID NO: 865985 - DNA, 25 bp, Mus musculus
tgccagcccatcatcaagacagtgg

SEQ ID NO: 865986 - DNA, 25 bp, Mus musculus
tgccagcccatcttcaagacagtgg

SEQ ID NO: 865987 - DNA, 25 bp, Mus musculus
tgccagcccctgaatgcacaaatca

SEQ ID NO: 865988 - DNA, 25 bp, Mus musculus
tgccagcccctgtatgcacaaatca

SEQ ID NO: 865989 - DNA, 25 bp, Mus musculus
tgccagccctggagcgcgcattgcg

SEQ ID NO: 865990 - DNA, 25 bp, Mus musculus
tgccagccctggtgcgcgcattgcg

SEQ ID NO: 865991 - DNA, 25 bp, Mus musculus
tgccagcccttcaagacttaattct

SEQ ID NO: 865992 - DNA, 25 bp, Mus musculus
tgccagcccttctagacttaattct

SEQ ID NO: 865993 - DNA, 25 bp, Mus musculus
tgccagccggagattgatgaagcct

SEQ ID NO: 865994 - DNA, 25 bp, Mus musculus
tgccagccggagtttgatgaagcct

SEQ ID NO: 865995 - DNA, 25 bp, Mus musculus
tgccagccgggacgagcccatcgaa

SEQ ID NO: 865996 - DNA, 25 bp, Mus musculus
tgccagccgggaggagcccatcgaa

SEQ ID NO: 865997 - DNA, 25 bp, Mus musculus
tgccagccggtgaacgtgtaagcct

SEQ ID NO: 865998 - DNA, 25 bp, Mus musculus
tgccagccggtgtacgtgtaagcct

SEQ ID NO: 865999 - DNA, 25 bp, Mus musculus
tgccagcctataccctgctaaggaa

SEQ ID NO: 866000 - DNA, 25 bp, Mus musculus
tgccagcctatagcctgctaaggaa

SEQ ID NO: 866001 - DNA, 25 bp, Mus musculus
tgccagcctctaactcaggtagagt

SEQ ID NO: 866002 - DNA, 25 bp, Mus musculus
tgccagcctctatctcaggtagagt

SEQ ID NO: 866003 - DNA, 25 bp, Mus musculus
tgccagcctgaactgtacgtgccaa

SEQ ID NO: 866004 - DNA, 25 bp, Mus musculus
tgccagcctgaagtgtacgtgccaa

SEQ ID NO: 866005 - DNA, 25 bp, Mus musculus
tgccagcctgagacaagagacccca

SEQ ID NO: 866006 - DNA, 25 bp, Mus musculus
tgccagcctgagtcaagagacccca

SEQ ID NO: 866007 - DNA, 25 bp, Mus musculus
tgccagcctgcactatcgggtgaca

SEQ ID NO: 866008 - DNA, 25 bp, Mus musculus
tgccagcctgcagtatcgggtgaca

SEQ ID NO: 866009 - DNA, 25 bp, Mus musculus
tgccagcctgcccttctagagaaag

SEQ ID NO: 866010 - DNA, 25 bp, Mus musculus
tgccagcctgccgttctagagaaag

SEQ ID NO: 866011 - DNA, 25 bp, Mus musculus
tgccagcctgtccatgatgacgcta

SEQ ID NO: 866012 - DNA, 25 bp, Mus musculus
tgccagcctgtcgatgatgacgcta

SEQ ID NO: 866013 - DNA, 25 bp, Mus musculus
tgccagccttgcataagccatttgt

SEQ ID NO: 866014 - DNA, 25 bp, Mus musculus
tgccagccttgcttaagccatttgt

SEQ ID NO: 866015 - DNA, 25 bp, Mus musculus
tgccagcgcgaacgaactctttaat

SEQ ID NO: 866016 - DNA, 25 bp, Mus musculus
tgccagcgcgaaggaactctttaat

SEQ ID NO: 866017 - DNA, 25 bp, Mus musculus
tgccagcgtcggctcaaacataagc

SEQ ID NO: 866018 - DNA, 25 bp, Mus musculus
tgccagcgtcgggtcaaacataagc

SEQ ID NO: 866019 - DNA, 25 bp, Mus musculus
tgccagcgtctaagatcctcttgtg

SEQ ID NO: 866020 - DNA, 25 bp, Mus musculus
tgccagcgtctatgatcctcttgtg

SEQ ID NO: 866021 - DNA, 25 bp, Mus musculus
tgccagcgtgagagtcttactttca

SEQ ID NO: 866022 - DNA, 25 bp, Mus musculus
tgccagcgtgagtgtcttactttca

SEQ ID NO: 866023 - DNA, 25 bp, Mus musculus
tgccagctacagagtcccatttaaa

SEQ ID NO: 866024 - DNA, 25 bp, Mus musculus
tgccagctacagtgtcccatttaaa

SEQ ID NO: 866025 - DNA, 25 bp, Mus musculus
tgccagctacggaaacactaccact

SEQ ID NO: 866026 - DNA, 25 bp, Mus musculus
tgccagctacggtaacactaccact

SEQ ID NO: 866027 - DNA, 25 bp, Mus musculus
tgccagctagtgaatccccaacata

SEQ ID NO: 866028 - DNA, 25 bp, Mus musculus
tgccagctagtgtatccccaacata

SEQ ID NO: 866029 - DNA, 25 bp, Mus musculus
tgccagctatcactgggatgtctct

SEQ ID NO: 866030 - DNA, 25 bp, Mus musculus
tgccagctatcagtgggatgtctct

SEQ ID NO: 866031 - DNA, 25 bp, Mus musculus
tgccagctccggacttgcagggaga

SEQ ID NO: 866032 - DNA, 25 bp, Mus musculus
tgccagctccggtcttgcagggaga

SEQ ID NO: 866033 - DNA, 25 bp, Mus musculus
tgccagctcgtgacgtggtgaaaca

SEQ ID NO: 866034 - DNA, 25 bp, Mus musculus
tgccagctcgtgtcgtggtgaaaca

SEQ ID NO: 866035 - DNA, 25 bp, Mus musculus
tgccagctctttacacagatctcta

SEQ ID NO: 866036 - DNA, 25 bp, Mus musculus
tgccagctctttatagactgtcccc

SEQ ID NO: 866037 - DNA, 25 bp, Mus musculus
tgccagctctttctaatactgacct

SEQ ID NO: 866038 - DNA, 25 bp, Mus musculus
tgccagctctttgtaatactgacct

SEQ ID NO: 866039 - DNA, 25 bp, Mus musculus
tgccagctcttttcacagatctcta

SEQ ID NO: 866040 - DNA, 25 bp, Mus musculus
tgccagctctttttagactgtcccc

SEQ ID NO: 866041 - DNA, 25 bp, Mus musculus
tgccagctgaggatggttccccagg

SEQ ID NO: 866042 - DNA, 25 bp, Mus musculus
tgccagctgaggttggttccccagg

SEQ ID NO: 866043 - DNA, 25 bp, Mus musculus
tgccagctgtctagccaaagacatt

SEQ ID NO: 866044 - DNA, 25 bp, Mus musculus
tgccagctgtcttgccaaagacatt

SEQ ID NO: 866045 - DNA, 25 bp, Mus musculus
tgccagcttctgagacctactgata

SEQ ID NO: 866046 - DNA, 25 bp, Mus musculus
tgccagcttctgtgacctactgata

SEQ ID NO: 866047 - DNA, 25 bp, Mus musculus
tgccagcttgtcagtcattgagcaa

SEQ ID NO: 866048 - DNA, 25 bp, Mus musculus
tgccagcttgtctgtcattgagcaa

SEQ ID NO: 866049 - DNA, 25 bp, Mus musculus
tgccagctttcgacggtattccaga

SEQ ID NO: 866050 - DNA, 25 bp, Mus musculus
tgccagctttcgtcggtattccaga

SEQ ID NO: 866051 - DNA, 25 bp, Mus musculus
tgccaggaaggccagctttctcacg

SEQ ID NO: 866052 - DNA, 25 bp, Mus musculus
tgccaggaaggcgagctttctcacg

SEQ ID NO: 866053 - DNA, 25 bp, Mus musculus
tgccaggacagcagagcacacagat

SEQ ID NO: 866054 - DNA, 25 bp, Mus musculus
tgccaggacagccaatgctaggtag

SEQ ID NO: 866055 - DNA, 25 bp, Mus musculus
tgccaggacagcgaatgctaggtag

SEQ ID NO: 866056 - DNA, 25 bp, Mus musculus
tgccaggacagctgagcacacagat

SEQ ID NO: 866057 - DNA, 25 bp, Mus musculus
tgccaggacaggcagccacgactta

SEQ ID NO: 866058 - DNA, 25 bp, Mus musculus
tgccaggacagggagccacgactta

SEQ ID NO: 866059 - DNA, 25 bp, Mus musculus
tgccaggacagtagacggagcccca

SEQ ID NO: 866060 - DNA, 25 bp, Mus musculus
tgccaggacagttgacggagcccca

SEQ ID NO: 866061 - DNA, 25 bp, Mus musculus
tgccaggaccacccctactgtgtag

SEQ ID NO: 866062 - DNA, 25 bp, Mus musculus
tgccaggaccacgcctactgtgtag

SEQ ID NO: 866063 - DNA, 25 bp, Mus musculus
tgccaggactctatcaccaggtgaa

SEQ ID NO: 866064 - DNA, 25 bp, Mus musculus
tgccaggactctttcaccaggtgaa

SEQ ID NO: 866065 - DNA, 25 bp, Mus musculus
tgccaggagagtcacgttcgtaatg

SEQ ID NO: 866066 - DNA, 25 bp, Mus musculus
tgccaggagagtgacgttcgtaatg

SEQ ID NO: 866067 - DNA, 25 bp, Mus musculus
tgccaggagccactagttcctttga

SEQ ID NO: 866068 - DNA, 25 bp, Mus musculus
tgccaggagccagtagttcctttga

SEQ ID NO: 866069 - DNA, 25 bp, Mus musculus
tgccaggagcttcccttggaaatca

SEQ ID NO: 866070 - DNA, 25 bp, Mus musculus
tgccaggagcttgccttggaaatca

SEQ ID NO: 866071 - DNA, 25 bp, Mus musculus
tgccaggatagacccagcatcaagg

SEQ ID NO: 866072 - DNA, 25 bp, Mus musculus
tgccaggatagagccagcatcaagg

SEQ ID NO: 866073 - DNA, 25 bp, Mus musculus
tgccaggatctcataggcgcatgct

SEQ ID NO: 866074 - DNA, 25 bp, Mus musculus
tgccaggatctcttaggcgcatgct

SEQ ID NO: 866075 - DNA, 25 bp, Mus musculus
tgccaggattggaggaacctcgaag

SEQ ID NO: 866076 - DNA, 25 bp, Mus musculus
tgccaggattggtggaacctcgaag

SEQ ID NO: 866077 - DNA, 25 bp, Mus musculus
tgccaggcaacaccagagcactgaa

SEQ ID NO: 866078 - DNA, 25 bp, Mus musculus
tgccaggcaacagcagagcactgaa

SEQ ID NO: 866079 - DNA, 25 bp, Mus musculus
tgccaggcaaccattctaaccataa

SEQ ID NO: 866080 - DNA, 25 bp, Mus musculus
tgccaggcaacctttctaaccataa

SEQ ID NO: 866081 - DNA, 25 bp, Mus musculus
tgccaggcaaggatttgtatggcct

SEQ ID NO: 866082 - DNA, 25 bp, Mus musculus
tgccaggcaaggttttgtatggcct

SEQ ID NO: 866083 - DNA, 25 bp, Mus musculus
tgccaggcacctacaagctgagtgt

SEQ ID NO: 866084 - DNA, 25 bp, Mus musculus
tgccaggcacctcagccgactggtg

SEQ ID NO: 866085 - DNA, 25 bp, Mus musculus
tgccaggcacctgagccgactggtg

SEQ ID NO: 866086 - DNA, 25 bp, Mus musculus
tgccaggcaccttcaagctgagtgt

SEQ ID NO: 866087 - DNA, 25 bp, Mus musculus
tgccaggcactgaatgtcacgagac

SEQ ID NO: 866088 - DNA, 25 bp, Mus musculus
tgccaggcactgtatgtcacgagac

SEQ ID NO: 866089 - DNA, 25 bp, Mus musculus
tgccaggcagcaacttcactttttt

SEQ ID NO: 866090 - DNA, 25 bp, Mus musculus
tgccaggcagcatcttcactttttt

SEQ ID NO: 866091 - DNA, 25 bp, Mus musculus
tgccaggcattacggagagtgtctt

SEQ ID NO: 866092 - DNA, 25 bp, Mus musculus
tgccaggcattagggagagtgtctt

SEQ ID NO: 866093 - DNA, 25 bp, Mus musculus
tgccaggccctcctttgtgaaccta

SEQ ID NO: 866094 - DNA, 25 bp, Mus musculus
tgccaggccctcgtttgtgaaccta

SEQ ID NO: 866095 - DNA, 25 bp, Mus musculus
tgccaggcgctacacatgtacagag

SEQ ID NO: 866096 - DNA, 25 bp, Mus musculus
tgccaggcgctagacatgtacagag

SEQ ID NO: 866097 - DNA, 25 bp, Mus musculus
tgccaggcggacctgtgtaccttta

SEQ ID NO: 866098 - DNA, 25 bp, Mus musculus
tgccaggcggacgtgtgtaccttta

SEQ ID NO: 866099 - DNA, 25 bp, Mus musculus
tgccaggcggagagcacagtcagtt

SEQ ID NO: 866100 - DNA, 25 bp, Mus musculus
tgccaggcggagtgcacagtcagtt

SEQ ID NO: 866101 - DNA, 25 bp, Mus musculus
tgccaggctcctaaaatgacatgta

SEQ ID NO: 866102 - DNA, 25 bp, Mus musculus
tgccaggctccttaaatgacatgta

SEQ ID NO: 866103 - DNA, 25 bp, Mus musculus
tgccaggctcgccagcaagaaggct

SEQ ID NO: 866104 - DNA, 25 bp, Mus musculus
tgccaggctcgcgagcaagaaggct

SEQ ID NO: 866105 - DNA, 25 bp, Mus musculus
tgccaggctgatctgcaagcacaaa

SEQ ID NO: 866106 - DNA, 25 bp, Mus musculus
tgccaggctgatgtgcaagcacaaa

SEQ ID NO: 866107 - DNA, 25 bp, Mus musculus
tgccaggcttacaaccattcaggag

SEQ ID NO: 866108 - DNA, 25 bp, Mus musculus
tgccaggcttactaccattcaggag

SEQ ID NO: 866109 - DNA, 25 bp, Mus musculus
tgccagggaccaccatggatgagca

SEQ ID NO: 866110 - DNA, 25 bp, Mus musculus
tgccagggaccagcatggatgagca

SEQ ID NO: 866111 - DNA, 25 bp, Mus musculus
tgccagggacgcagctgctattcag

SEQ ID NO: 866112 - DNA, 25 bp, Mus musculus
tgccagggacgctgctgctattcag

SEQ ID NO: 866113 - DNA, 25 bp, Mus musculus
tgccagggagacaagtacacacctt

SEQ ID NO: 866114 - DNA, 25 bp, Mus musculus
tgccagggagactagtacacacctt

SEQ ID NO: 866115 - DNA, 25 bp, Mus musculus
tgccagggaggtctttcaaatgtca

SEQ ID NO: 866116 - DNA, 25 bp, Mus musculus
tgccagggaggtgtttcaaatgtca

SEQ ID NO: 866117 - DNA, 25 bp, Mus musculus
tgccagggctgcataccaagtcgct

SEQ ID NO: 866118 - DNA, 25 bp, Mus musculus
tgccagggctgcatcaaagggactg

SEQ ID NO: 866119 - DNA, 25 bp, Mus musculus
tgccagggctgcttaccaagtcgct

SEQ ID NO: 866120 - DNA, 25 bp, Mus musculus
tgccagggctgcttcaaagggactg

SEQ ID NO: 866121 - DNA, 25 bp, Mus musculus
tgccagggcttgacttagcattatt

SEQ ID NO: 866122 - DNA, 25 bp, Mus musculus
tgccagggcttgtcttagcattatt

SEQ ID NO: 866123 - DNA, 25 bp, Mus musculus
tgccagggtccacgaggaactccag

SEQ ID NO: 866124 - DNA, 25 bp, Mus musculus
tgccagggtccaggaggaactccag

SEQ ID NO: 866125 - DNA, 25 bp, Mus musculus
tgccagggtgttccctttcaatttc

SEQ ID NO: 866126 - DNA, 25 bp, Mus musculus
tgccagggtgttgcctttcaatttc

SEQ ID NO: 866127 - DNA, 25 bp, Mus musculus
tgccaggtagagaaatagtgtccat

SEQ ID NO: 866128 - DNA, 25 bp, Mus musculus
tgccaggtagagtaatagtgtccat

SEQ ID NO: 866129 - DNA, 25 bp, Mus musculus
tgccaggtcactcatgaaggtcaca

SEQ ID NO: 866130 - DNA, 25 bp, Mus musculus
tgccaggtcactgatgaaggtcaca

SEQ ID NO: 866131 - DNA, 25 bp, Mus musculus
tgccaggtgcaactaagtaaaaatg

SEQ ID NO: 866132 - DNA, 25 bp, Mus musculus
tgccaggtgcaagtaagtaaaaatg

SEQ ID NO: 866133 - DNA, 25 bp, Mus musculus
tgccaggtgccgagttcgtgcagaa

SEQ ID NO: 866134 - DNA, 25 bp, Mus musculus
tgccaggtgccgtgttcgtgcagaa

SEQ ID NO: 866135 - DNA, 25 bp, Mus musculus
tgccaggtgtggagacctgccgtta

SEQ ID NO: 866136 - DNA, 25 bp, Mus musculus
tgccaggtgtggtgacctgccgtta

SEQ ID NO: 866137 - DNA, 25 bp, Mus musculus
tgccaggttagcatgctgccagcgg

SEQ ID NO: 866138 - DNA, 25 bp, Mus musculus
tgccaggttagcttgctgccagcgg

SEQ ID NO: 866139 - DNA, 25 bp, Mus musculus
tgccaggtttttagaacgggagcct

SEQ ID NO: 866140 - DNA, 25 bp, Mus musculus
tgccaggttttttgaacgggagcct

SEQ ID NO: 866141 - DNA, 25 bp, Mus musculus
tgccagtagggcattgcatagctct

SEQ ID NO: 866142 - DNA, 25 bp, Mus musculus
tgccagtagggctttgcatagctct

SEQ ID NO: 866143 - DNA, 25 bp, Mus musculus
tgccagtccatgaatcctcagaaca

SEQ ID NO: 866144 - DNA, 25 bp, Mus musculus
tgccagtccatgtatcctcagaaca

SEQ ID NO: 866145 - DNA, 25 bp, Mus musculus
tgccagtctataccgggtaccagag

SEQ ID NO: 866146 - DNA, 25 bp, Mus musculus
tgccagtctatagcgggtaccagag

SEQ ID NO: 866147 - DNA, 25 bp, Mus musculus
tgccagtctgacctagctgcacaga

SEQ ID NO: 866148 - DNA, 25 bp, Mus musculus
tgccagtctgacgtagctgcacaga

SEQ ID NO: 866149 - DNA, 25 bp, Mus musculus
tgccagtctgtcattcatccaaatt

SEQ ID NO: 866150 - DNA, 25 bp, Mus musculus
tgccagtctgtctttcatccaaatt

SEQ ID NO: 866151 - DNA, 25 bp, Mus musculus
tgccagtctttaaatttaccaccgt

SEQ ID NO: 866152 - DNA, 25 bp, Mus musculus
tgccagtctttatatttaccaccgt

SEQ ID NO: 866153 - DNA, 25 bp, Mus musculus
tgccagtgaacccagttgccagaaa

SEQ ID NO: 866154 - DNA, 25 bp, Mus musculus
tgccagtgaaccgagttgccagaaa

SEQ ID NO: 866155 - DNA, 25 bp, Mus musculus
tgccagtgacctccctaaagtacag

SEQ ID NO: 866156 - DNA, 25 bp, Mus musculus
tgccagtgacctgcctaaagtacag

SEQ ID NO: 866157 - DNA, 25 bp, Mus musculus
tgccagtgattcagctatgccaact

SEQ ID NO: 866158 - DNA, 25 bp, Mus musculus
tgccagtgattctgctatgccaact

SEQ ID NO: 866159 - DNA, 25 bp, Mus musculus
tgccagtgccgtatcttcggcagcg

SEQ ID NO: 866160 - DNA, 25 bp, Mus musculus
tgccagtgccgtttcttcggcagcg

SEQ ID NO: 866161 - DNA, 25 bp, Mus musculus
tgccagtgcctactggaactgtcca

SEQ ID NO: 866162 - DNA, 25 bp, Mus musculus
tgccagtgcctagtggaactgtcca

SEQ ID NO: 866163 - DNA, 25 bp, Mus musculus
tgccagtggctgactttgtacagat

SEQ ID NO: 866164 - DNA, 25 bp, Mus musculus
tgccagtggctgtctttgtacagat

SEQ ID NO: 866165 - DNA, 25 bp, Mus musculus
tgccagtggcttacaccaagagctg

SEQ ID NO: 866166 - DNA, 25 bp, Mus musculus
tgccagtggctttcaccaagagctg

SEQ ID NO: 866167 - DNA, 25 bp, Mus musculus
tgccagtgggcaatttgtcattttt

SEQ ID NO: 866168 - DNA, 25 bp, Mus musculus
tgccagtgggcattttgtcattttt

SEQ ID NO: 866169 - DNA, 25 bp, Mus musculus
tgccagtgtaccctaaagcagacat

SEQ ID NO: 866170 - DNA, 25 bp, Mus musculus
tgccagtgtaccgtaaagcagacat

SEQ ID NO: 866171 - DNA, 25 bp, Mus musculus
tgccagtgtatgacgctgaattctt

SEQ ID NO: 866172 - DNA, 25 bp, Mus musculus
tgccagtgtatgaggaattctcttc

SEQ ID NO: 866173 - DNA, 25 bp, Mus musculus
tgccagtgtatgtcgctgaattctt

SEQ ID NO: 866174 - DNA, 25 bp, Mus musculus
tgccagtgtatgtggaattctcttc

SEQ ID NO: 866175 - DNA, 25 bp, Mus musculus
tgccagtgtcacaatgcacgtgcta

SEQ ID NO: 866176 - DNA, 25 bp, Mus musculus
tgccagtgtcacacttcaagtgcta

SEQ ID NO: 866177 - DNA, 25 bp, Mus musculus
tgccagtgtcactatgcacgtgcta

SEQ ID NO: 866178 - DNA, 25 bp, Mus musculus
tgccagtgtcactcttcaagtgcta

SEQ ID NO: 866179 - DNA, 25 bp, Mus musculus
tgccagtgtcgcagatggagctccc

SEQ ID NO: 866180 - DNA, 25 bp, Mus musculus
tgccagtgtcgctgatggagctccc

SEQ ID NO: 866181 - DNA, 25 bp, Mus musculus
tgccagtgtcttacaggatgtcaac

SEQ ID NO: 866182 - DNA, 25 bp, Mus musculus
tgccagtgtctttcaggatgtcaac

SEQ ID NO: 866183 - DNA, 25 bp, Mus musculus
tgccagtgtgggagcccactcagtt

SEQ ID NO: 866184 - DNA, 25 bp, Mus musculus
tgccagtgtgggtgcccactcagtt

SEQ ID NO: 866185 - DNA, 25 bp, Mus musculus
tgccagtgttgacaataagcccatt

SEQ ID NO: 866186 - DNA, 25 bp, Mus musculus
tgccagtgttgagaataagcccatt

SEQ ID NO: 866187 - DNA, 25 bp, Mus musculus
tgccagttacaaatacacttactaa

SEQ ID NO: 866188 - DNA, 25 bp, Mus musculus
tgccagttacaattacacttactaa

SEQ ID NO: 866189 - DNA, 25 bp, Mus musculus
tgccagttacataccgctgtgcgga

SEQ ID NO: 866190 - DNA, 25 bp, Mus musculus
tgccagttacattccgctgtgcgga

SEQ ID NO: 866191 - DNA, 25 bp, Mus musculus
tgccagttacccacatatgaccaga

SEQ ID NO: 866192 - DNA, 25 bp, Mus musculus
tgccagttaccctcatatgaccaga

SEQ ID NO: 866193 - DNA, 25 bp, Mus musculus
tgccagttatgtacgaccggaagga

SEQ ID NO: 866194 - DNA, 25 bp, Mus musculus
tgccagttatgttcgaccggaagga

SEQ ID NO: 866195 - DNA, 25 bp, Mus musculus
tgccagttcatgaaaattcctgatg

SEQ ID NO: 866196 - DNA, 25 bp, Mus musculus
tgccagttcatgtaaattcctgatg

SEQ ID NO: 866197 - DNA, 25 bp, Mus musculus
tgccagttccctagggtgcccattg

SEQ ID NO: 866198 - DNA, 25 bp, Mus musculus
tgccagttcccttgggtgcccattg

SEQ ID NO: 866199 - DNA, 25 bp, Mus musculus
tgccagttccgcattccaccaaaga

SEQ ID NO: 866200 - DNA, 25 bp, Mus musculus
tgccagttccgctttccaccaaaga

SEQ ID NO: 866201 - DNA, 25 bp, Mus musculus
tgccagttcctactgagagcttctt

SEQ ID NO: 866202 - DNA, 25 bp, Mus musculus
tgccagttcctagtgagagcttctt

SEQ ID NO: 866203 - DNA, 25 bp, Mus musculus
tgccagttgacccaagtcctcagaa

SEQ ID NO: 866204 - DNA, 25 bp, Mus musculus
tgccagttgaccgaagtcctcagaa

SEQ ID NO: 866205 - DNA, 25 bp, Mus musculus
tgccagttgagcaccggaccgagcg

SEQ ID NO: 866206 - DNA, 25 bp, Mus musculus
tgccagttgagctccggaccgagcg

SEQ ID NO: 866207 - DNA, 25 bp, Mus musculus
tgccagttgcctcgagctctgcttt

SEQ ID NO: 866208 - DNA, 25 bp, Mus musculus
tgccagttgcctggagctctgcttt

SEQ ID NO: 866209 - DNA, 25 bp, Mus musculus
tgccagttgtcccagttacttggaa

SEQ ID NO: 866210 - DNA, 25 bp, Mus musculus
tgccagttgtccgagttacttggaa

SEQ ID NO: 866211 - DNA, 25 bp, Mus musculus
tgccagttgtgcaaccccaaaacag

SEQ ID NO: 866212 - DNA, 25 bp, Mus musculus
tgccagttgtgctaccccaaaacag

SEQ ID NO: 866213 - DNA, 25 bp, Mus musculus
tgccagttgtgtcatggtgctgcac

SEQ ID NO: 866214 - DNA, 25 bp, Mus musculus
tgccagttgtgtgatggtgctgcac

SEQ ID NO: 866215 - DNA, 25 bp, Mus musculus
tgccagtttcttctgctgttttgaa

SEQ ID NO: 866216 - DNA, 25 bp, Mus musculus
tgccagtttcttgtgctgttttgaa

SEQ ID NO: 866217 - DNA, 25 bp, Mus musculus
tgccagtttgctcagaagcactatt

SEQ ID NO: 866218 - DNA, 25 bp, Mus musculus
tgccagtttgctgagaagcactatt

SEQ ID NO: 866219 - DNA, 25 bp, Mus musculus
tgccagtttggcctgatgtcacgtg

SEQ ID NO: 866220 - DNA, 25 bp, Mus musculus
tgccagtttggcgtgatgtcacgtg

SEQ ID NO: 866221 - DNA, 25 bp, Mus musculus
tgccagttttcaatccacattggaa

SEQ ID NO: 866222 - DNA, 25 bp, Mus musculus
tgccagttttcattccacattggaa

SEQ ID NO: 866223 - DNA, 25 bp, Mus musculus
tgccagttttgcaccttatctaata

SEQ ID NO: 866224 - DNA, 25 bp, Mus musculus
tgccagttttgctccttatctaata

SEQ ID NO: 866225 - DNA, 25 bp, Mus musculus
tgccagtttttgagcacgggtgctg

SEQ ID NO: 866226 - DNA, 25 bp, Mus musculus
tgccagtttttgtgcacgggtgctg

SEQ ID NO: 866227 - DNA, 25 bp, Mus musculus
tgccataaaacaatttcttccccgg

SEQ ID NO: 866228 - DNA, 25 bp, Mus musculus
tgccataaaacattttcttccccgg

SEQ ID NO: 866229 - DNA, 25 bp, Mus musculus
tgccataaactgcagatggacacac

SEQ ID NO: 866230 - DNA, 25 bp, Mus musculus
tgccataaactggagatggacacac

SEQ ID NO: 866231 - DNA, 25 bp, Mus musculus
tgccataaagttcgagcggatgctc

SEQ ID NO: 866232 - DNA, 25 bp, Mus musculus
tgccataaagttggagcggatgctc

SEQ ID NO: 866233 - DNA, 25 bp, Mus musculus
tgccatacaagcatggagtgtcttt

SEQ ID NO: 866234 - DNA, 25 bp, Mus musculus
tgccatacaagcttggagtgtcttt

SEQ ID NO: 866235 - DNA, 25 bp, Mus musculus
tgccatacacccagaggagttcttc

SEQ ID NO: 866236 - DNA, 25 bp, Mus musculus
tgccatacaccctgaggagttcttc

SEQ ID NO: 866237 - DNA, 25 bp, Mus musculus
tgccataccactatgggtcttttta

SEQ ID NO: 866238 - DNA, 25 bp, Mus musculus
tgccataccactttgggtcttttta

SEQ ID NO: 866239 - DNA, 25 bp, Mus musculus
tgccatacccagcaccttaatttat

SEQ ID NO: 866240 - DNA, 25 bp, Mus musculus
tgccatacccaggaccttaatttat

SEQ ID NO: 866241 - DNA, 25 bp, Mus musculus
tgccatactgcaaccatggtgtcat

SEQ ID NO: 866242 - DNA, 25 bp, Mus musculus
tgccatactgcatccatggtgtcat

SEQ ID NO: 866243 - DNA, 25 bp, Mus musculus
tgccatagaaatcctgcccagcttt

SEQ ID NO: 866244 - DNA, 25 bp, Mus musculus
tgccatagaaatgctgcccagcttt

SEQ ID NO: 866245 - DNA, 25 bp, Mus musculus
tgccatagataactgctggtcccct

SEQ ID NO: 866246 - DNA, 25 bp, Mus musculus
tgccatagataagtgctggtcccct

SEQ ID NO: 866247 - DNA, 25 bp, Mus musculus
tgccatagatgcaggagtggccttt

SEQ ID NO: 866248 - DNA, 25 bp, Mus musculus
tgccatagatgctggagtggccttt

SEQ ID NO: 866249 - DNA, 25 bp, Mus musculus
tgccatagcatcattgccacctaca

SEQ ID NO: 866250 - DNA, 25 bp, Mus musculus
tgccatagcatctttgccacctaca

SEQ ID NO: 866251 - DNA, 25 bp, Mus musculus
tgccatagctgcctgctgacgtaac

SEQ ID NO: 866252 - DNA, 25 bp, Mus musculus
tgccatagctgcgtgctgacgtaac

SEQ ID NO: 866253 - DNA, 25 bp, Mus musculus
tgccataggaggcagcttcagactg

SEQ ID NO: 866254 - DNA, 25 bp, Mus musculus
tgccataggagggagcttcagactg

SEQ ID NO: 866255 - DNA, 25 bp, Mus musculus
tgccatatgggtcttagggcttgaa

SEQ ID NO: 866256 - DNA, 25 bp, Mus musculus
tgccatatgggtgttagggcttgaa

SEQ ID NO: 866257 - DNA, 25 bp, Mus musculus
tgccatatgtgtccccatggaagcc

SEQ ID NO: 866258 - DNA, 25 bp, Mus musculus
tgccatatgtgtgcccatggaagcc

SEQ ID NO: 866259 - DNA, 25 bp, Mus musculus
tgccatattaaacctgtcagtttca

SEQ ID NO: 866260 - DNA, 25 bp, Mus musculus
tgccatattaaagctgtcagtttca

SEQ ID NO: 866261 - DNA, 25 bp, Mus musculus
tgccatattatcagtccacttgttc

SEQ ID NO: 866262 - DNA, 25 bp, Mus musculus
tgccatattatctgtccacttgttc

SEQ ID NO: 866263 - DNA, 25 bp, Mus musculus
tgccatattcagatagtcgacgcct

SEQ ID NO: 866264 - DNA, 25 bp, Mus musculus
tgccatattcagttagtcgacgcct

SEQ ID NO: 866265 - DNA, 25 bp, Mus musculus
tgccatattcttagcaattctgttt

SEQ ID NO: 866266 - DNA, 25 bp, Mus musculus
tgccatattctttgcaattctgttt

SEQ ID NO: 866267 - DNA, 25 bp, Mus musculus
tgccatattgctactgctgcgggag

SEQ ID NO: 866268 - DNA, 25 bp, Mus musculus
tgccatattgcttctgctgcgggag

SEQ ID NO: 866269 - DNA, 25 bp, Mus musculus
tgccatattggcctctttcataggc

SEQ ID NO: 866270 - DNA, 25 bp, Mus musculus
tgccatattggcgtctttcataggc

SEQ ID NO: 866271 - DNA, 25 bp, Mus musculus
tgccatatttgcagatttttacaga

SEQ ID NO: 866272 - DNA, 25 bp, Mus musculus
tgccatatttgctgatttttacaga

SEQ ID NO: 866273 - DNA, 25 bp, Mus musculus
tgccatattttgaccactgcttgaa

SEQ ID NO: 866274 - DNA, 25 bp, Mus musculus
tgccatattttgtccactgcttgaa

SEQ ID NO: 866275 - DNA, 25 bp, Mus musculus
tgccatcaaagtcaaccggcctttt

SEQ ID NO: 866276 - DNA, 25 bp, Mus musculus
tgccatcaaagtgaaccggcctttt

SEQ ID NO: 866277 - DNA, 25 bp, Mus musculus
tgccatcaacgtctctcaaaagagg

SEQ ID NO: 866278 - DNA, 25 bp, Mus musculus
tgccatcaacgtgtctcaaaagagg

SEQ ID NO: 866279 - DNA, 25 bp, Mus musculus
tgccatcaactactcggtgtacggg

SEQ ID NO: 866280 - DNA, 25 bp, Mus musculus
tgccatcaactagtcggtgtacggg

SEQ ID NO: 866281 - DNA, 25 bp, Mus musculus
tgccatcaagaaacccatttgggag

SEQ ID NO: 866282 - DNA, 25 bp, Mus musculus
tgccatcaagaatcccatttgggag

SEQ ID NO: 866283 - DNA, 25 bp, Mus musculus
tgccatcaagataaccctagaaatt

SEQ ID NO: 866284 - DNA, 25 bp, Mus musculus
tgccatcaagattaccctagaaatt

SEQ ID NO: 866285 - DNA, 25 bp, Mus musculus
tgccatcaatctaccacttgacatt

SEQ ID NO: 866286 - DNA, 25 bp, Mus musculus
tgccatcaatcttccacttgacatt

SEQ ID NO: 866287 - DNA, 25 bp, Mus musculus
tgccatcaatgaaaagatcccttta

SEQ ID NO: 866288 - DNA, 25 bp, Mus musculus
tgccatcaatgataagatcccttta

SEQ ID NO: 866289 - DNA, 25 bp, Mus musculus
tgccatcaatggaaccagcctggtg

SEQ ID NO: 866290 - DNA, 25 bp, Mus musculus
tgccatcaatggcaacccatcctgg

SEQ ID NO: 866291 - DNA, 25 bp, Mus musculus
tgccatcaatgggaacccatcctgg

SEQ ID NO: 866292 - DNA, 25 bp, Mus musculus
tgccatcaatggtaccagcctggtg

SEQ ID NO: 866293 - DNA, 25 bp, Mus musculus
tgccatcactcccaagatgctagag

SEQ ID NO: 866294 - DNA, 25 bp, Mus musculus
tgccatcactccgaagatgctagag

SEQ ID NO: 866295 - DNA, 25 bp, Mus musculus
tgccatcagacacggcgtgcagctg

SEQ ID NO: 866296 - DNA, 25 bp, Mus musculus
tgccatcagacagggcgtgcagctg

SEQ ID NO: 866297 - DNA, 25 bp, Mus musculus
tgccatcagatcatcctttgactag

SEQ ID NO: 866298 - DNA, 25 bp, Mus musculus
tgccatcagatcttcctttgactag

SEQ ID NO: 866299 - DNA, 25 bp, Mus musculus
tgccatcagcatcatctctaattac

SEQ ID NO: 866300 - DNA, 25 bp, Mus musculus
tgccatcagcatgatctctaattac

SEQ ID NO: 866301 - DNA, 25 bp, Mus musculus
tgccatcagcggagtttaagcattg

SEQ ID NO: 866302 - DNA, 25 bp, Mus musculus
tgccatcagcggtgtttaagcattg

SEQ ID NO: 866303 - DNA, 25 bp, Mus musculus
tgccatcagtccctttatgagtgag

SEQ ID NO: 866304 - DNA, 25 bp, Mus musculus
tgccatcagtccgtttatgagtgag

SEQ ID NO: 866305 - DNA, 25 bp, Mus musculus
tgccatcagtggagtagtaacccgc

SEQ ID NO: 866306 - DNA, 25 bp, Mus musculus
tgccatcagtggtgtagtaacccgc

SEQ ID NO: 866307 - DNA, 25 bp, Mus musculus
tgccatcagttcatcaccaacatga

SEQ ID NO: 866308 - DNA, 25 bp, Mus musculus
tgccatcagttcttcaccaacatga

SEQ ID NO: 866309 - DNA, 25 bp, Mus musculus
tgccatcatgtcacaagtgctggga

SEQ ID NO: 866310 - DNA, 25 bp, Mus musculus
tgccatcatgtctcaagtgctggga

SEQ ID NO: 866311 - DNA, 25 bp, Mus musculus
tgccatcattccctctagaaggagc

SEQ ID NO: 866312 - DNA, 25 bp, Mus musculus
tgccatcattccgtctagaaggagc

SEQ ID NO: 866313 - DNA, 25 bp, Mus musculus
tgccatcattgacaatctacttatg

SEQ ID NO: 866314 - DNA, 25 bp, Mus musculus
tgccatcattgagaatctacttatg

SEQ ID NO: 866315 - DNA, 25 bp, Mus musculus
tgccatccaaggacaagggccctgg

SEQ ID NO: 866316 - DNA, 25 bp, Mus musculus
tgccatccaaggtcaagggccctgg

SEQ ID NO: 866317 - DNA, 25 bp, Mus musculus
tgccatccagcaagtcatcaactat

SEQ ID NO: 866318 - DNA, 25 bp, Mus musculus
tgccatccagcatgtcatcaactat

SEQ ID NO: 866319 - DNA, 25 bp, Mus musculus
tgccatccagtccatgaacggcttt

SEQ ID NO: 866320 - DNA, 25 bp, Mus musculus
tgccatccagtcgatgaacggcttt

SEQ ID NO: 866321 - DNA, 25 bp, Mus musculus
tgccatcccactacatttggttcat

SEQ ID NO: 866322 - DNA, 25 bp, Mus musculus
tgccatcccacttcatttggttcat

SEQ ID NO: 866323 - DNA, 25 bp, Mus musculus
tgccatcccagtcctagtgatgact

SEQ ID NO: 866324 - DNA, 25 bp, Mus musculus
tgccatcccagtgctagtgatgact

SEQ ID NO: 866325 - DNA, 25 bp, Mus musculus
tgccatcccatgagctaatcacaag

SEQ ID NO: 866326 - DNA, 25 bp, Mus musculus
tgccatcccatgtgctaatcacaag

SEQ ID NO: 866327 - DNA, 25 bp, Mus musculus
tgccatcccgtaattccatgagggt

SEQ ID NO: 866328 - DNA, 25 bp, Mus musculus
tgccatcccgtatttccatgagggt

SEQ ID NO: 866329 - DNA, 25 bp, Mus musculus
tgccatccctcacgttaacgaagaa

SEQ ID NO: 866330 - DNA, 25 bp, Mus musculus
tgccatccctcaggttaacgaagaa

SEQ ID NO: 866331 - DNA, 25 bp, Mus musculus
tgccatccctgacggtcagttcatt

SEQ ID NO: 866332 - DNA, 25 bp, Mus musculus
tgccatccctgagggtcagttcatt

SEQ ID NO: 866333 - DNA, 25 bp, Mus musculus
tgccatcccttgaacacaaatgtgt

SEQ ID NO: 866334 - DNA, 25 bp, Mus musculus
tgccatcccttgtacacaaatgtgt

SEQ ID NO: 866335 - DNA, 25 bp, Mus musculus
tgccatccgctcaagcgagctgtga

SEQ ID NO: 866336 - DNA, 25 bp, Mus musculus
tgccatccgctctagcgagctgtga

SEQ ID NO: 866337 - DNA, 25 bp, Mus musculus
tgccatcctggtagctattctaaga

SEQ ID NO: 866338 - DNA, 25 bp, Mus musculus
tgccatcctggttgctattctaaga

SEQ ID NO: 866339 - DNA, 25 bp, Mus musculus
tgccatccttttcggcatgttggat

SEQ ID NO: 866340 - DNA, 25 bp, Mus musculus
tgccatccttttgggcatgttggat

SEQ ID NO: 866341 - DNA, 25 bp, Mus musculus
tgccatcggattattaccaccagta

SEQ ID NO: 866342 - DNA, 25 bp, Mus musculus
tgccatcggatttttaccaccagta

SEQ ID NO: 866343 - DNA, 25 bp, Mus musculus
tgccatcgtaaaacctgttccaaat

SEQ ID NO: 866344 - DNA, 25 bp, Mus musculus
tgccatcgtaaatcctgttccaaat

SEQ ID NO: 866345 - DNA, 25 bp, Mus musculus
tgccatcgtcggatgttttaacttt

SEQ ID NO: 866346 - DNA, 25 bp, Mus musculus
tgccatcgtcggttgttttaacttt

SEQ ID NO: 866347 - DNA, 25 bp, Mus musculus
tgccatctaacgctactcactggat

SEQ ID NO: 866348 - DNA, 25 bp, Mus musculus
tgccatctaacggtactcactggat

SEQ ID NO: 866349 - DNA, 25 bp, Mus musculus
tgccatctaccccaaacttttgtta

SEQ ID NO: 866350 - DNA, 25 bp, Mus musculus
tgccatctacccgaaacttttgtta

SEQ ID NO: 866351 - DNA, 25 bp, Mus musculus
tgccatctagaccagaagttcctaa

SEQ ID NO: 866352 - DNA, 25 bp, Mus musculus
tgccatctagacgagaagttcctaa

SEQ ID NO: 866353 - DNA, 25 bp, Mus musculus
tgccatctatggctcagtggtcctg

SEQ ID NO: 866354 - DNA, 25 bp, Mus musculus
tgccatctatgggtcagtggtcctg

SEQ ID NO: 866355 - DNA, 25 bp, Mus musculus
tgccatctcatgctgttggattggt

SEQ ID NO: 866356 - DNA, 25 bp, Mus musculus
tgccatctcatggtgttggattggt

SEQ ID NO: 866357 - DNA, 25 bp, Mus musculus
tgccatctccttaggccgaagctta

SEQ ID NO: 866358 - DNA, 25 bp, Mus musculus
tgccatctcctttggccgaagctta

SEQ ID NO: 866359 - DNA, 25 bp, Mus musculus
tgccatctcggccatatctgatgag

SEQ ID NO: 866360 - DNA, 25 bp, Mus musculus
tgccatctcggcgatatctgatgag

SEQ ID NO: 866361 - DNA, 25 bp, Mus musculus
tgccatctctagagacttgcaagaa

SEQ ID NO: 866362 - DNA, 25 bp, Mus musculus
tgccatctctagtgacttgcaagaa

SEQ ID NO: 866363 - DNA, 25 bp, Mus musculus
tgccatctctctatctgggagttta

SEQ ID NO: 866364 - DNA, 25 bp, Mus musculus
tgccatctctctttctgggagttta

SEQ ID NO: 866365 - DNA, 25 bp, Mus musculus
tgccatctctgcctgagtattaggt

SEQ ID NO: 866366 - DNA, 25 bp, Mus musculus
tgccatctctgcgtgagtattaggt

SEQ ID NO: 866367 - DNA, 25 bp, Mus musculus
tgccatctgcctccattagacacag

SEQ ID NO: 866368 - DNA, 25 bp, Mus musculus
tgccatctgcctgcattagacacag

SEQ ID NO: 866369 - DNA, 25 bp, Mus musculus
tgccatctggcccactaaataaggt

SEQ ID NO: 866370 - DNA, 25 bp, Mus musculus
tgccatctggccgactaaataaggt

SEQ ID NO: 866371 - DNA, 25 bp, Mus musculus
tgccatctgtttaacggcatcatgg

SEQ ID NO: 866372 - DNA, 25 bp, Mus musculus
tgccatctgttttacggcatcatgg

SEQ ID NO: 866373 - DNA, 25 bp, Mus musculus
tgccatcttagcactttacctttga

SEQ ID NO: 866374 - DNA, 25 bp, Mus musculus
tgccatcttagctctttacctttga

SEQ ID NO: 866375 - DNA, 25 bp, Mus musculus
tgccatcttattaggttgtcagtgc

SEQ ID NO: 866376 - DNA, 25 bp, Mus musculus
tgccatcttatttggttgtcagtgc

SEQ ID NO: 866377 - DNA, 25 bp, Mus musculus
tgccatcttcagcagcccgagtgtg

SEQ ID NO: 866378 - DNA, 25 bp, Mus musculus
tgccatcttcaggagcccgagtgtg

SEQ ID NO: 866379 - DNA, 25 bp, Mus musculus
tgccatcttgaaaattccctcattt

SEQ ID NO: 866380 - DNA, 25 bp, Mus musculus
tgccatcttgaatattccctcattt

SEQ ID NO: 866381 - DNA, 25 bp, Mus musculus
tgccatcttgctactgcacagaaaa

SEQ ID NO: 866382 - DNA, 25 bp, Mus musculus
tgccatcttgcttctgcacagaaaa

SEQ ID NO: 866383 - DNA, 25 bp, Mus musculus
tgccatcttgggatacagctaatac

SEQ ID NO: 866384 - DNA, 25 bp, Mus musculus
tgccatcttgggttacagctaatac

SEQ ID NO: 866385 - DNA, 25 bp, Mus musculus
tgccatcttgttcctggagcatagg

SEQ ID NO: 866386 - DNA, 25 bp, Mus musculus
tgccatcttgttgctggagcatagg

SEQ ID NO: 866387 - DNA, 25 bp, Mus musculus
tgccatctttctcttaccatctgat

SEQ ID NO: 866388 - DNA, 25 bp, Mus musculus
tgccatctttctgttaccatctgat

SEQ ID NO: 866389 - DNA, 25 bp, Mus musculus
tgccatgaactgaggtctatagaaa

SEQ ID NO: 866390 - DNA, 25 bp, Mus musculus
tgccatgaactgtggtctatagaaa

SEQ ID NO: 866391 - DNA, 25 bp, Mus musculus
tgccatgaatttcccctgcaggaga

SEQ ID NO: 866392 - DNA, 25 bp, Mus musculus
tgccatgaatttgccctgcaggaga

SEQ ID NO: 866393 - DNA, 25 bp, Mus musculus
tgccatgacaaaatgtttggtccaa

SEQ ID NO: 866394 - DNA, 25 bp, Mus musculus
tgccatgacaaattgtttggtccaa

SEQ ID NO: 866395 - DNA, 25 bp, Mus musculus
tgccatgaccaacctgccagactat

SEQ ID NO: 866396 - DNA, 25 bp, Mus musculus
tgccatgaccaagctgccagactat

SEQ ID NO: 866397 - DNA, 25 bp, Mus musculus
tgccatgagccactgttgagccaag

SEQ ID NO: 866398 - DNA, 25 bp, Mus musculus
tgccatgagccagtgttgagccaag

SEQ ID NO: 866399 - DNA, 25 bp, Mus musculus
tgccatgcaggtcttgggactcaaa

SEQ ID NO: 866400 - DNA, 25 bp, Mus musculus
tgccatgcaggtgttgggactcaaa

SEQ ID NO: 866401 - DNA, 25 bp, Mus musculus
tgccatgcagttcggttttagctgt

SEQ ID NO: 866402 - DNA, 25 bp, Mus musculus
tgccatgcagttgggttttagctgt

SEQ ID NO: 866403 - DNA, 25 bp, Mus musculus
tgccatgccaggcttttctcaggag

SEQ ID NO: 866404 - DNA, 25 bp, Mus musculus
tgccatgccagggttttctcaggag

SEQ ID NO: 866405 - DNA, 25 bp, Mus musculus
tgccatgcccatccctgtagtcttt

SEQ ID NO: 866406 - DNA, 25 bp, Mus musculus
tgccatgcccatgcctgtagtcttt

SEQ ID NO: 866407 - DNA, 25 bp, Mus musculus
tgccatgccttgactcaattttgca

SEQ ID NO: 866408 - DNA, 25 bp, Mus musculus
tgccatgccttgtctcaattttgca

SEQ ID NO: 866409 - DNA, 25 bp, Mus musculus
tgccatgctaaacgtttctgaattc

SEQ ID NO: 866410 - DNA, 25 bp, Mus musculus
tgccatgctaaaggtttctgaattc

SEQ ID NO: 866411 - DNA, 25 bp, Mus musculus
tgccatgctgcaacaaggtatcttg

SEQ ID NO: 866412 - DNA, 25 bp, Mus musculus
tgccatgctgcacctagaacttcgc

SEQ ID NO: 866413 - DNA, 25 bp, Mus musculus
tgccatgctgcagctagaacttcgc

SEQ ID NO: 866414 - DNA, 25 bp, Mus musculus
tgccatgctgcatcaaggtatcttg

SEQ ID NO: 866415 - DNA, 25 bp, Mus musculus
tgccatgctgccatttagcactgag

SEQ ID NO: 866416 - DNA, 25 bp, Mus musculus
tgccatgctgccttttagcactgag

SEQ ID NO: 866417 - DNA, 25 bp, Mus musculus
tgccatgctggcagatttcatcgat

SEQ ID NO: 866418 - DNA, 25 bp, Mus musculus
tgccatgctggccaaactttattct

SEQ ID NO: 866419 - DNA, 25 bp, Mus musculus
tgccatgctggcgaaactttattct

SEQ ID NO: 866420 - DNA, 25 bp, Mus musculus
tgccatgctggctgatttcatcgat

SEQ ID NO: 866421 - DNA, 25 bp, Mus musculus
tgccatggaaccattcttgtctgtc

SEQ ID NO: 866422 - DNA, 25 bp, Mus musculus
tgccatggaacctttcttgtctgtc

SEQ ID NO: 866423 - DNA, 25 bp, Mus musculus
tgccatggaggaatacagcgtaagt

SEQ ID NO: 866424 - DNA, 25 bp, Mus musculus
tgccatggaggacgccaatttttta

SEQ ID NO: 866425 - DNA, 25 bp, Mus musculus
tgccatggaggaggccaatttttta

SEQ ID NO: 866426 - DNA, 25 bp, Mus musculus
tgccatggaggattacagcgtaagt

SEQ ID NO: 866427 - DNA, 25 bp, Mus musculus
tgccatggccgcagtagacactaca

SEQ ID NO: 866428 - DNA, 25 bp, Mus musculus
tgccatggccgctgtagacactaca

SEQ ID NO: 866429 - DNA, 25 bp, Mus musculus
tgccatggtgtcagcagaagtcatg

SEQ ID NO: 866430 - DNA, 25 bp, Mus musculus
tgccatggtgtctgcagaagtcatg

SEQ ID NO: 866431 - DNA, 25 bp, Mus musculus
tgccatgtaatacaccaacactctc

SEQ ID NO: 866432 - DNA, 25 bp, Mus musculus
tgccatgtaatagaccaacactctc

SEQ ID NO: 866433 - DNA, 25 bp, Mus musculus
tgccatgtacccagcctgagggaat

SEQ ID NO: 866434 - DNA, 25 bp, Mus musculus
tgccatgtaccctgcctgagggaat

SEQ ID NO: 866435 - DNA, 25 bp, Mus musculus
tgccatgtaccgagctagttaactg

SEQ ID NO: 866436 - DNA, 25 bp, Mus musculus
tgccatgtaccgtgctagttaactg

SEQ ID NO: 866437 - DNA, 25 bp, Mus musculus
tgccatgtagtgaccccagagcatt

SEQ ID NO: 866438 - DNA, 25 bp, Mus musculus
tgccatgtagtgtccccagagcatt

SEQ ID NO: 866439 - DNA, 25 bp, Mus musculus
tgccatgtatgcagatatgtcgcga

SEQ ID NO: 866440 - DNA, 25 bp, Mus musculus
tgccatgtatgctgatatgtcgcga

SEQ ID NO: 866441 - DNA, 25 bp, Mus musculus
tgccatgtcccacgtggaccaggag

SEQ ID NO: 866442 - DNA, 25 bp, Mus musculus
tgccatgtcccaggtggaccaggag

SEQ ID NO: 866443 - DNA, 25 bp, Mus musculus
tgccatgtcctcattgaggctgcaa

SEQ ID NO: 866444 - DNA, 25 bp, Mus musculus
tgccatgtcctctttgaggctgcaa

SEQ ID NO: 866445 - DNA, 25 bp, Mus musculus
tgccatgtcctgcagtagcaccaga

SEQ ID NO: 866446 - DNA, 25 bp, Mus musculus
tgccatgtcctggagtagcaccaga

SEQ ID NO: 866447 - DNA, 25 bp, Mus musculus
tgccatgtctttatccaaaggagaa

SEQ ID NO: 866448 - DNA, 25 bp, Mus musculus
tgccatgtctttttccaaaggagaa

SEQ ID NO: 866449 - DNA, 25 bp, Mus musculus
tgccatgtgcatccatcctgggata

SEQ ID NO: 866450 - DNA, 25 bp, Mus musculus
tgccatgtgcatgcatcctgggata

SEQ ID NO: 866451 - DNA, 25 bp, Mus musculus
tgccatgtgcctcagaagcagaaag

SEQ ID NO: 866452 - DNA, 25 bp, Mus musculus
tgccatgtgcctgagaagcagaaag

SEQ ID NO: 866453 - DNA, 25 bp, Mus musculus
tgccatgtggccaggtgcaagttga

SEQ ID NO: 866454 - DNA, 25 bp, Mus musculus
tgccatgtggcctggtgcaagttga

SEQ ID NO: 866455 - DNA, 25 bp, Mus musculus
tgccatgtggctcattacttgtgct

SEQ ID NO: 866456 - DNA, 25 bp, Mus musculus
tgccatgtggctgattacttgtgct

SEQ ID NO: 866457 - DNA, 25 bp, Mus musculus
tgccatgtgtatctggacccagacc

SEQ ID NO: 866458 - DNA, 25 bp, Mus musculus
tgccatgtgtatgtggacccagacc

SEQ ID NO: 866459 - DNA, 25 bp, Mus musculus
tgccatgtttgtaaacaagaagctt

SEQ ID NO: 866460 - DNA, 25 bp, Mus musculus
tgccatgtttgttaacaagaagctt

SEQ ID NO: 866461 - DNA, 25 bp, Mus musculus
tgccatgttttgaccctgacaggag

SEQ ID NO: 866462 - DNA, 25 bp, Mus musculus
tgccatgttttgtccctgacaggag

SEQ ID NO: 866463 - DNA, 25 bp, Mus musculus
tgccattaatcaccagaccaacgtc

SEQ ID NO: 866464 - DNA, 25 bp, Mus musculus
tgccattaatcagcagaccaacgtc

SEQ ID NO: 866465 - DNA, 25 bp, Mus musculus
tgccattaatcgcagactgtgctgt

SEQ ID NO: 866466 - DNA, 25 bp, Mus musculus
tgccattaatcggagactgtgctgt

SEQ ID NO: 866467 - DNA, 25 bp, Mus musculus
tgccattacgggattgtccgaccgt

SEQ ID NO: 866468 - DNA, 25 bp, Mus musculus
tgccattacgggtttgtccgaccgt

SEQ ID NO: 866469 - DNA, 25 bp, Mus musculus
tgccattaggtaatagaaatcgtct

SEQ ID NO: 866470 - DNA, 25 bp, Mus musculus
tgccattaggtattagaaatcgtct

SEQ ID NO: 866471 - DNA, 25 bp, Mus musculus
tgccattatcccataactcatgcaa

SEQ ID NO: 866472 - DNA, 25 bp, Mus musculus
tgccattatcccttaactcatgcaa

SEQ ID NO: 866473 - DNA, 25 bp, Mus musculus
tgccattatttcactgacacttaag

SEQ ID NO: 866474 - DNA, 25 bp, Mus musculus
tgccattatttctctgacacttaag

SEQ ID NO: 866475 - DNA, 25 bp, Mus musculus
tgccattcacagagcaggcgaagga

SEQ ID NO: 866476 - DNA, 25 bp, Mus musculus
tgccattcacagcaggtcctgtgaa

SEQ ID NO: 866477 - DNA, 25 bp, Mus musculus
tgccattcacaggaggtcctgtgaa

SEQ ID NO: 866478 - DNA, 25 bp, Mus musculus
tgccattcacagtgcaggcgaagga

SEQ ID NO: 866479 - DNA, 25 bp, Mus musculus
tgccattcagaaagctacaacccag

SEQ ID NO: 866480 - DNA, 25 bp, Mus musculus
tgccattcagaatgctacaacccag

SEQ ID NO: 866481 - DNA, 25 bp, Mus musculus
tgccattcccagctctatgggtcaa

SEQ ID NO: 866482 - DNA, 25 bp, Mus musculus
tgccattcccaggtctatgggtcaa

SEQ ID NO: 866483 - DNA, 25 bp, Mus musculus
tgccattcccatctgtttcaaaaca

SEQ ID NO: 866484 - DNA, 25 bp, Mus musculus
tgccattcccatgtgtttcaaaaca

SEQ ID NO: 866485 - DNA, 25 bp, Mus musculus
tgccattcccctagatgctggagaa

SEQ ID NO: 866486 - DNA, 25 bp, Mus musculus
tgccattccccttgatgctggagaa

SEQ ID NO: 866487 - DNA, 25 bp, Mus musculus
tgccattcccttaggttgaaaccct

SEQ ID NO: 866488 - DNA, 25 bp, Mus musculus
tgccattccctttggttgaaaccct

SEQ ID NO: 866489 - DNA, 25 bp, Mus musculus
tgccattcctcaccatgtgcattaa

SEQ ID NO: 866490 - DNA, 25 bp, Mus musculus
tgccattcctcagcatgtgcattaa

SEQ ID NO: 866491 - DNA, 25 bp, Mus musculus
tgccattctccccttaactgggaaa

SEQ ID NO: 866492 - DNA, 25 bp, Mus musculus
tgccattctcccgttaactgggaaa

SEQ ID NO: 866493 - DNA, 25 bp, Mus musculus
tgccattctggacttgtctctttag

SEQ ID NO: 866494 - DNA, 25 bp, Mus musculus
tgccattctggagttgtctctttag

SEQ ID NO: 866495 - DNA, 25 bp, Mus musculus
tgccattgagtcagccttggtggaa

SEQ ID NO: 866496 - DNA, 25 bp, Mus musculus
tgccattgagtctgccttggtggaa

SEQ ID NO: 866497 - DNA, 25 bp, Mus musculus
tgccattgcactcttattgagcccc

SEQ ID NO: 866498 - DNA, 25 bp, Mus musculus
tgccattgcactgttattgagcccc

SEQ ID NO: 866499 - DNA, 25 bp, Mus musculus
tgccattgccacataattatcacat

SEQ ID NO: 866500 - DNA, 25 bp, Mus musculus
tgccattgccacttaattatcacat

SEQ ID NO: 866501 - DNA, 25 bp, Mus musculus
tgccattgctcaatgctgtcagttg

SEQ ID NO: 866502 - DNA, 25 bp, Mus musculus
tgccattgctcattgctgtcagttg

SEQ ID NO: 866503 - DNA, 25 bp, Mus musculus
tgccattgcttaagcagacagtaga

SEQ ID NO: 866504 - DNA, 25 bp, Mus musculus
tgccattgcttatgcagacagtaga

SEQ ID NO: 866505 - DNA, 25 bp, Mus musculus
tgccattggctcacaggtgtctgaa

SEQ ID NO: 866506 - DNA, 25 bp, Mus musculus
tgccattggctctcaggtgtctgaa

SEQ ID NO: 866507 - DNA, 25 bp, Mus musculus
tgccattgggcacttaacttctcat

SEQ ID NO: 866508 - DNA, 25 bp, Mus musculus
tgccattgggcagttaacttctcat

SEQ ID NO: 866509 - DNA, 25 bp, Mus musculus
tgccattgtttcaaatctccatctt

SEQ ID NO: 866510 - DNA, 25 bp, Mus musculus
tgccattgtttctaatctccatctt

SEQ ID NO: 866511 - DNA, 25 bp, Mus musculus
tgccatttacataacagccacataa

SEQ ID NO: 866512 - DNA, 25 bp, Mus musculus
tgccatttacattacagccacataa

SEQ ID NO: 866513 - DNA, 25 bp, Mus musculus
tgccatttagtcacactgtaaccca

SEQ ID NO: 866514 - DNA, 25 bp, Mus musculus
tgccatttagtctcactgtaaccca

SEQ ID NO: 866515 - DNA, 25 bp, Mus musculus
tgccatttcctacgtagatctggaa

SEQ ID NO: 866516 - DNA, 25 bp, Mus musculus
tgccatttcctaggtagatctggaa

SEQ ID NO: 866517 - DNA, 25 bp, Mus musculus
tgccatttctccattaagccagatg

SEQ ID NO: 866518 - DNA, 25 bp, Mus musculus
tgccatttctcctttaagccagatg

SEQ ID NO: 866519 - DNA, 25 bp, Mus musculus
tgccatttctctcaaggtttccttt

SEQ ID NO: 866520 - DNA, 25 bp, Mus musculus
tgccatttctctgaaggtttccttt

SEQ ID NO: 866521 - DNA, 25 bp, Mus musculus
tgccatttctgtccacggagggatt

SEQ ID NO: 866522 - DNA, 25 bp, Mus musculus
tgccatttctgtgcacggagggatt

SEQ ID NO: 866523 - DNA, 25 bp, Mus musculus
tgccatttcttgctggacggagtcc

SEQ ID NO: 866524 - DNA, 25 bp, Mus musculus
tgccatttcttggtggacggagtcc

SEQ ID NO: 866525 - DNA, 25 bp, Mus musculus
tgccatttgaggaagcagacccaag

SEQ ID NO: 866526 - DNA, 25 bp, Mus musculus
tgccatttgaggtagcagacccaag

SEQ ID NO: 866527 - DNA, 25 bp, Mus musculus
tgccatttgcaccatcaagacaagc

SEQ ID NO: 866528 - DNA, 25 bp, Mus musculus
tgccatttgcacgatcaagacaagc

SEQ ID NO: 866529 - DNA, 25 bp, Mus musculus
tgccatttggtcaaacccacttttt

SEQ ID NO: 866530 - DNA, 25 bp, Mus musculus
tgccatttggtctaacccacttttt

SEQ ID NO: 866531 - DNA, 25 bp, Mus musculus
tgccattttagccatcaatccttca

SEQ ID NO: 866532 - DNA, 25 bp, Mus musculus
tgccattttagcgatcaatccttca

SEQ ID NO: 866533 - DNA, 25 bp, Mus musculus
tgccattttattctttgccatatgt

SEQ ID NO: 866534 - DNA, 25 bp, Mus musculus
tgccattttattgtttgccatatgt

SEQ ID NO: 866535 - DNA, 25 bp, Mus musculus
tgccattttgagaccagctaagaca

SEQ ID NO: 866536 - DNA, 25 bp, Mus musculus
tgccattttgagtccagctaagaca

SEQ ID NO: 866537 - DNA, 25 bp, Mus musculus
tgccattttggtatttagctcctcg

SEQ ID NO: 866538 - DNA, 25 bp, Mus musculus
tgccattttggtttttagctcctcg

SEQ ID NO: 866539 - DNA, 25 bp, Mus musculus
tgcccaaaacacacatgcccaaagg

SEQ ID NO: 866540 - DNA, 25 bp, Mus musculus
tgcccaaaacactcatgcccaaagg

SEQ ID NO: 866541 - DNA, 25 bp, Mus musculus
tgcccaaaatcacagtcatcaccag

SEQ ID NO: 866542 - DNA, 25 bp, Mus musculus
tgcccaaaatcagagtcatcaccag

SEQ ID NO: 866543 - DNA, 25 bp, Mus musculus
tgcccaaactcacttgtctatatcc

SEQ ID NO: 866544 - DNA, 25 bp, Mus musculus
tgcccaaactcagttgtctatatcc

SEQ ID NO: 866545 - DNA, 25 bp, Mus musculus
tgcccaaactgaaatacctgctgcc

SEQ ID NO: 866546 - DNA, 25 bp, Mus musculus
tgcccaaactgaatcgcaacagtcc

SEQ ID NO: 866547 - DNA, 25 bp, Mus musculus
tgcccaaactgatatacctgctgcc

SEQ ID NO: 866548 - DNA, 25 bp, Mus musculus
tgcccaaactgattcgcaacagtcc

SEQ ID NO: 866549 - DNA, 25 bp, Mus musculus
tgcccaaagacacttccttgagttg

SEQ ID NO: 866550 - DNA, 25 bp, Mus musculus
tgcccaaagacagttccttgagttg

SEQ ID NO: 866551 - DNA, 25 bp, Mus musculus
tgcccaaagagcacgaacatttttc

SEQ ID NO: 866552 - DNA, 25 bp, Mus musculus
tgcccaaagagctcgaacatttttc

SEQ ID NO: 866553 - DNA, 25 bp, Mus musculus
tgcccaaagctacaccctaaggaaa

SEQ ID NO: 866554 - DNA, 25 bp, Mus musculus
tgcccaaagctagaccctaaggaaa

SEQ ID NO: 866555 - DNA, 25 bp, Mus musculus
tgcccaaagctgagagctgcttcag

SEQ ID NO: 866556 - DNA, 25 bp, Mus musculus
tgcccaaagctgtgagctgcttcag

SEQ ID NO: 866557 - DNA, 25 bp, Mus musculus
tgcccaaagcttcttgtgaccttgc

SEQ ID NO: 866558 - DNA, 25 bp, Mus musculus
tgcccaaagcttgttgtgaccttgc

SEQ ID NO: 866559 - DNA, 25 bp, Mus musculus
tgcccaaaggacacgggttgtctga

SEQ ID NO: 866560 - DNA, 25 bp, Mus musculus
tgcccaaaggactcgggttgtctga

SEQ ID NO: 866561 - DNA, 25 bp, Mus musculus
tgcccaaagtacagccaacgcagtt

SEQ ID NO: 866562 - DNA, 25 bp, Mus musculus
tgcccaaagtactgccaacgcagtt

SEQ ID NO: 866563 - DNA, 25 bp, Mus musculus
tgcccaaagtggactatgtcctcat

SEQ ID NO: 866564 - DNA, 25 bp, Mus musculus
tgcccaaagtggtctatgtcctcat

SEQ ID NO: 866565 - DNA, 25 bp, Mus musculus
tgcccaacagggatcctccagagag

SEQ ID NO: 866566 - DNA, 25 bp, Mus musculus
tgcccaacagggttcctccagagag

SEQ ID NO: 866567 - DNA, 25 bp, Mus musculus
tgcccaacccttaagtcattcttaa

SEQ ID NO: 866568 - DNA, 25 bp, Mus musculus
tgcccaaccctttagtcattcttaa

SEQ ID NO: 866569 - DNA, 25 bp, Mus musculus
tgcccaacctaaatcctgacagatg

SEQ ID NO: 866570 - DNA, 25 bp, Mus musculus
tgcccaacctaattcctgacagatg

SEQ ID NO: 866571 - DNA, 25 bp, Mus musculus
tgcccaacctcaaggacgcaaggct

SEQ ID NO: 866572 - DNA, 25 bp, Mus musculus
tgcccaacctcatggacgcaaggct

SEQ ID NO: 866573 - DNA, 25 bp, Mus musculus
tgcccaacttcaccgagtgctggtg

SEQ ID NO: 866574 - DNA, 25 bp, Mus musculus
tgcccaacttcaccgctgaggatta

SEQ ID NO: 866575 - DNA, 25 bp, Mus musculus
tgcccaacttcagcgagtgctggtg

SEQ ID NO: 866576 - DNA, 25 bp, Mus musculus
tgcccaacttcagcgctgaggatta

SEQ ID NO: 866577 - DNA, 25 bp, Mus musculus
tgcccaagaaatcacagtagctgtt

SEQ ID NO: 866578 - DNA, 25 bp, Mus musculus
tgcccaagaaatgacagtagctgtt

SEQ ID NO: 866579 - DNA, 25 bp, Mus musculus
tgcccaagaacccacgacgagaaga

SEQ ID NO: 866580 - DNA, 25 bp, Mus musculus
tgcccaagaaccgacgacgagaaga

SEQ ID NO: 866581 - DNA, 25 bp, Mus musculus
tgcccaagagaaatgccagaccact

SEQ ID NO: 866582 - DNA, 25 bp, Mus musculus
tgcccaagagaattgccagaccact

SEQ ID NO: 866583 - DNA, 25 bp, Mus musculus
tgcccaagagctatgatcacttttt

SEQ ID NO: 866584 - DNA, 25 bp, Mus musculus
tgcccaagagctttgatcacttttt

SEQ ID NO: 866585 - DNA, 25 bp, Mus musculus
tgcccaagattaacccaacactagg

SEQ ID NO: 866586 - DNA, 25 bp, Mus musculus
tgcccaagattatcccaacactagg

SEQ ID NO: 866587 - DNA, 25 bp, Mus musculus
tgcccaagccccacagactggtgaa

SEQ ID NO: 866588 - DNA, 25 bp, Mus musculus
tgcccaagcccctcagactggtgaa

SEQ ID NO: 866589 - DNA, 25 bp, Mus musculus
tgcccaagctgacggattcaatctg

SEQ ID NO: 866590 - DNA, 25 bp, Mus musculus
tgcccaagctgagggattcaatctg

SEQ ID NO: 866591 - DNA, 25 bp, Mus musculus
tgcccaaggatgctgccctacaagt

SEQ ID NO: 866592 - DNA, 25 bp, Mus musculus
tgcccaaggatggtgccctacaagt

SEQ ID NO: 866593 - DNA, 25 bp, Mus musculus
tgcccaaggctcagtctttctctgc

SEQ ID NO: 866594 - DNA, 25 bp, Mus musculus
tgcccaaggctctgtctttctctgc

SEQ ID NO: 866595 - DNA, 25 bp, Mus musculus
tgcccaaggcttacgagcagtactt

SEQ ID NO: 866596 - DNA, 25 bp, Mus musculus
tgcccaaggctttcgagcagtactt

SEQ ID NO: 866597 - DNA, 25 bp, Mus musculus
tgcccaagggtcagggacgcagcac

SEQ ID NO: 866598 - DNA, 25 bp, Mus musculus
tgcccaagggtctgggacgcagcac

SEQ ID NO: 866599 - DNA, 25 bp, Mus musculus
tgcccaaggtcaacaagaaggctgg

SEQ ID NO: 866600 - DNA, 25 bp, Mus musculus
tgcccaaggtcacagcagtgcgcag

SEQ ID NO: 866601 - DNA, 25 bp, Mus musculus
tgcccaaggtcagagcagtgcgcag

SEQ ID NO: 866602 - DNA, 25 bp, Mus musculus
tgcccaaggtcatcaagaaggctgg

SEQ ID NO: 866603 - DNA, 25 bp, Mus musculus
tgcccaaggtgcctgagatgcccaa

SEQ ID NO: 866604 - DNA, 25 bp, Mus musculus
tgcccaaggtgcgtgagatgcccaa

SEQ ID NO: 866605 - DNA, 25 bp, Mus musculus
tgcccaatcctgcttagtccttttt

SEQ ID NO: 866606 - DNA, 25 bp, Mus musculus
tgcccaatcctggttagtccttttt

SEQ ID NO: 866607 - DNA, 25 bp, Mus musculus
tgcccaatctctaaaaagcgtacgt

SEQ ID NO: 866608 - DNA, 25 bp, Mus musculus
tgcccaatctcttaaaagcgtacgt

SEQ ID NO: 866609 - DNA, 25 bp, Mus musculus
tgcccaatggacagcccaggcctag

SEQ ID NO: 866610 - DNA, 25 bp, Mus musculus
tgcccaatggactgcccaggcctag

SEQ ID NO: 866611 - DNA, 25 bp, Mus musculus
tgcccaattccacaatcatgatcca

SEQ ID NO: 866612 - DNA, 25 bp, Mus musculus
tgcccaattccagaatcatgatcca

SEQ ID NO: 866613 - DNA, 25 bp, Mus musculus
tgcccaattctgctcatcttgatgg

SEQ ID NO: 866614 - DNA, 25 bp, Mus musculus
tgcccaattctggtcatcttgatgg

SEQ ID NO: 866615 - DNA, 25 bp, Mus musculus
tgcccaattttgattcttcaatttt

SEQ ID NO: 866616 - DNA, 25 bp, Mus musculus
tgcccaattttgtttcttcaatttt

SEQ ID NO: 866617 - DNA, 25 bp, Mus musculus
tgcccacaaaggagcccaagccggg

SEQ ID NO: 866618 - DNA, 25 bp, Mus musculus
tgcccacaaaggtgcccaagccggg

SEQ ID NO: 866619 - DNA, 25 bp, Mus musculus
tgcccacaacacaaaaatgcctttc

SEQ ID NO: 866620 - DNA, 25 bp, Mus musculus
tgcccacaacactaaaatgcctttc

SEQ ID NO: 866621 - DNA, 25 bp, Mus musculus
tgcccacaagaaccactgtcgggag

SEQ ID NO: 866622 - DNA, 25 bp, Mus musculus
tgcccacaagaagcactgtcgggag

SEQ ID NO: 866623 - DNA, 25 bp, Mus musculus
tgcccacaagacatctgactttgca

SEQ ID NO: 866624 - DNA, 25 bp, Mus musculus
tgcccacaagacttctgactttgca

SEQ ID NO: 866625 - DNA, 25 bp, Mus musculus
tgcccacaagctattcaaccttaac

SEQ ID NO: 866626 - DNA, 25 bp, Mus musculus
tgcccacaagcttttcaaccttaac

SEQ ID NO: 866627 - DNA, 25 bp, Mus musculus
tgcccacaaggcaacttgagaggag

SEQ ID NO: 866628 - DNA, 25 bp, Mus musculus
tgcccacaaggctacttgagaggag

SEQ ID NO: 866629 - DNA, 25 bp, Mus musculus
tgcccacaccttcattgtaatctaa

SEQ ID NO: 866630 - DNA, 25 bp, Mus musculus
tgcccacaccttgattgtaatctaa

SEQ ID NO: 866631 - DNA, 25 bp, Mus musculus
tgcccacacgtcaatcttggattac

SEQ ID NO: 866632 - DNA, 25 bp, Mus musculus
tgcccacacgtctatcttggattac

SEQ ID NO: 866633 - DNA, 25 bp, Mus musculus
tgcccacactcaacatgcagtagac

SEQ ID NO: 866634 - DNA, 25 bp, Mus musculus
tgcccacactcatcatgcagtagac

SEQ ID NO: 866635 - DNA, 25 bp, Mus musculus
tgcccacagcaaactcacagtgcag

SEQ ID NO: 866636 - DNA, 25 bp, Mus musculus
tgcccacagcaatctcacagtgcag

SEQ ID NO: 866637 - DNA, 25 bp, Mus musculus
tgcccacagctgcacatggtcaaga

SEQ ID NO: 866638 - DNA, 25 bp, Mus musculus
tgcccacagctggacatggtcaaga

SEQ ID NO: 866639 - DNA, 25 bp, Mus musculus
tgcccacagggaagtcagcagccta

SEQ ID NO: 866640 - DNA, 25 bp, Mus musculus
tgcccacagggatgtcagcagccta

SEQ ID NO: 866641 - DNA, 25 bp, Mus musculus
tgcccacagtcacggtaggtctgcc

SEQ ID NO: 866642 - DNA, 25 bp, Mus musculus
tgcccacagtcagggtaggtctgcc

SEQ ID NO: 866643 - DNA, 25 bp, Mus musculus
tgcccacatctgagtgtgacctaac

SEQ ID NO: 866644 - DNA, 25 bp, Mus musculus
tgcccacatctgtgtgtgacctaac

SEQ ID NO: 866645 - DNA, 25 bp, Mus musculus
tgcccacatcttctggaggcagaat

SEQ ID NO: 866646 - DNA, 25 bp, Mus musculus
tgcccacatcttgtggaggcagaat

SEQ ID NO: 866647 - DNA, 25 bp, Mus musculus
tgcccacatgcaagaatacttaggt

SEQ ID NO: 866648 - DNA, 25 bp, Mus musculus
tgcccacatgcatgaatacttaggt

SEQ ID NO: 866649 - DNA, 25 bp, Mus musculus
tgcccacatgtacagcgtccctttg

SEQ ID NO: 866650 - DNA, 25 bp, Mus musculus
tgcccacatgtagagcgtccctttg

SEQ ID NO: 866651 - DNA, 25 bp, Mus musculus
tgcccacattccaaagcacatgagt

SEQ ID NO: 866652 - DNA, 25 bp, Mus musculus
tgcccacattccaggtagctggagg

SEQ ID NO: 866653 - DNA, 25 bp, Mus musculus
tgcccacattcctaagcacatgagt

SEQ ID NO: 866654 - DNA, 25 bp, Mus musculus
tgcccacattcctggtagctggagg

SEQ ID NO: 866655 - DNA, 25 bp, Mus musculus
tgcccacatttgcactttaggtctg

SEQ ID NO: 866656 - DNA, 25 bp, Mus musculus
tgcccacatttggactttaggtctg

SEQ ID NO: 866657 - DNA, 25 bp, Mus musculus
tgcccaccaagtctccaaatggatg

SEQ ID NO: 866658 - DNA, 25 bp, Mus musculus
tgcccaccaagtgtccaaatggatg

SEQ ID NO: 866659 - DNA, 25 bp, Mus musculus
tgcccaccaggaaaccgcatggata

SEQ ID NO: 866660 - DNA, 25 bp, Mus musculus
tgcccaccaggataccgcatggata

SEQ ID NO: 866661 - DNA, 25 bp, Mus musculus
tgcccaccatggatctcattagtaa

SEQ ID NO: 866662 - DNA, 25 bp, Mus musculus
tgcccaccatggttctcattagtaa

SEQ ID NO: 866663 - DNA, 25 bp, Mus musculus
tgcccacccatcatcgaggaggaaa

SEQ ID NO: 866664 - DNA, 25 bp, Mus musculus
tgcccacccatcttcgaggaggaaa

SEQ ID NO: 866665 - DNA, 25 bp, Mus musculus
tgcccaccctacactggaaaatgtg

SEQ ID NO: 866666 - DNA, 25 bp, Mus musculus
tgcccaccctactctggaaaatgtg

SEQ ID NO: 866667 - DNA, 25 bp, Mus musculus
tgcccaccctctcaaaggttgttag

SEQ ID NO: 866668 - DNA, 25 bp, Mus musculus
tgcccaccctctgaaaggttgttag

SEQ ID NO: 866669 - DNA, 25 bp, Mus musculus
tgcccaccctttcaatgaactgtgt

SEQ ID NO: 866670 - DNA, 25 bp, Mus musculus
tgcccaccctttgaatgaactgtgt

SEQ ID NO: 866671 - DNA, 25 bp, Mus musculus
tgcccaccgcaacggagtgtagcca

SEQ ID NO: 866672 - DNA, 25 bp, Mus musculus
tgcccaccgcaagggagtgtagcca

SEQ ID NO: 866673 - DNA, 25 bp, Mus musculus
tgcccacctcacaaggtcatattgc

SEQ ID NO: 866674 - DNA, 25 bp, Mus musculus
tgcccacctcactaggtcatattgc

SEQ ID NO: 866675 - DNA, 25 bp, Mus musculus
tgcccaccttcacgtcctatttaag

SEQ ID NO: 866676 - DNA, 25 bp, Mus musculus
tgcccaccttcaggtcctatttaag

SEQ ID NO: 866677 - DNA, 25 bp, Mus musculus
tgcccacgagggatttgtatctcac

SEQ ID NO: 866678 - DNA, 25 bp, Mus musculus
tgcccacgagggttttgtatctcac

SEQ ID NO: 866679 - DNA, 25 bp, Mus musculus
tgcccacgattaatagaacctgttt

SEQ ID NO: 866680 - DNA, 25 bp, Mus musculus
tgcccacgattattagaacctgttt

SEQ ID NO: 866681 - DNA, 25 bp, Mus musculus
tgcccacgccgaagctactgctgtt

SEQ ID NO: 866682 - DNA, 25 bp, Mus musculus
tgcccacgccgatgctactgctgtt

SEQ ID NO: 866683 - DNA, 25 bp, Mus musculus
tgcccacgcttgagacagtcattgt

SEQ ID NO: 866684 - DNA, 25 bp, Mus musculus
tgcccacgcttgtgacagtcattgt

SEQ ID NO: 866685 - DNA, 25 bp, Mus musculus
tgcccacggagacagtgccacatgc

SEQ ID NO: 866686 - DNA, 25 bp, Mus musculus
tgcccacggagagagtgccacatgc

SEQ ID NO: 866687 - DNA, 25 bp, Mus musculus
tgcccacggtttccaggtttgtatg

SEQ ID NO: 866688 - DNA, 25 bp, Mus musculus
tgcccacggtttgcaggtttgtatg

SEQ ID NO: 866689 - DNA, 25 bp, Mus musculus
tgcccacgtggcatttggctgagac

SEQ ID NO: 866690 - DNA, 25 bp, Mus musculus
tgcccacgtggcttttggctgagac

SEQ ID NO: 866691 - DNA, 25 bp, Mus musculus
tgcccacgttaacacctgaaggaga

SEQ ID NO: 866692 - DNA, 25 bp, Mus musculus
tgcccacgttaagacctgaaggaga

SEQ ID NO: 866693 - DNA, 25 bp, Mus musculus
tgcccactactgcttttgtaactgg

SEQ ID NO: 866694 - DNA, 25 bp, Mus musculus
tgcccactactggttttgtaactgg

SEQ ID NO: 866695 - DNA, 25 bp, Mus musculus
tgcccactcaaacgatgtcattagt

SEQ ID NO: 866696 - DNA, 25 bp, Mus musculus
tgcccactcaaaggatgtcattagt

SEQ ID NO: 866697 - DNA, 25 bp, Mus musculus
tgcccactcatgcagctaacagaca

SEQ ID NO: 866698 - DNA, 25 bp, Mus musculus
tgcccactcatggagctaacagaca

SEQ ID NO: 866699 - DNA, 25 bp, Mus musculus
tgcccactcattatgagcagccata

SEQ ID NO: 866700 - DNA, 25 bp, Mus musculus
tgcccactcattttgagcagccata

SEQ ID NO: 866701 - DNA, 25 bp, Mus musculus
tgcccactcctcaggcatatgtgga

SEQ ID NO: 866702 - DNA, 25 bp, Mus musculus
tgcccactcctctggcatatgtgga

SEQ ID NO: 866703 - DNA, 25 bp, Mus musculus
tgcccactgaagagaagccaagtaa

SEQ ID NO: 866704 - DNA, 25 bp, Mus musculus
tgcccactgaagtgaagccaagtaa

SEQ ID NO: 866705 - DNA, 25 bp, Mus musculus
tgcccactgagcactgcaaagccaa

SEQ ID NO: 866706 - DNA, 25 bp, Mus musculus
tgcccactgagctctgcaaagccaa

SEQ ID NO: 866707 - DNA, 25 bp, Mus musculus
tgcccactgataccctggaatttct

SEQ ID NO: 866708 - DNA, 25 bp, Mus musculus
tgcccactgatacgcctttggaaaa

SEQ ID NO: 866709 - DNA, 25 bp, Mus musculus
tgcccactgatagcctggaatttct

SEQ ID NO: 866710 - DNA, 25 bp, Mus musculus
tgcccactgataggcctttggaaaa

SEQ ID NO: 866711 - DNA, 25 bp, Mus musculus
tgcccactgcacagtggttacagca

SEQ ID NO: 866712 - DNA, 25 bp, Mus musculus
tgcccactgcactgtggttacagca

SEQ ID NO: 866713 - DNA, 25 bp, Mus musculus
tgcccactggccactggcgtgtgct

SEQ ID NO: 866714 - DNA, 25 bp, Mus musculus
tgcccactggcctctggcgtgtgct

SEQ ID NO: 866715 - DNA, 25 bp, Mus musculus
tgcccactgggaaccttcagttgaa

SEQ ID NO: 866716 - DNA, 25 bp, Mus musculus
tgcccactgggatccttcagttgaa

SEQ ID NO: 866717 - DNA, 25 bp, Mus musculus
tgcccactggtactgactagcggtc

SEQ ID NO: 866718 - DNA, 25 bp, Mus musculus
tgcccactggtagtgactagcggtc

SEQ ID NO: 866719 - DNA, 25 bp, Mus musculus
tgcccactgtcaacgctgattggaa

SEQ ID NO: 866720 - DNA, 25 bp, Mus musculus
tgcccactgtcatcgctgattggaa

SEQ ID NO: 866721 - DNA, 25 bp, Mus musculus
tgcccacttaacacagccaaaattt

SEQ ID NO: 866722 - DNA, 25 bp, Mus musculus
tgcccacttaactcagccaaaattt

SEQ ID NO: 866723 - DNA, 25 bp, Mus musculus
tgcccacttctgaatctagtttatg

SEQ ID NO: 866724 - DNA, 25 bp, Mus musculus
tgcccacttctgtatctagtttatg

SEQ ID NO: 866725 - DNA, 25 bp, Mus musculus
tgcccacttggacctctggtcatga

SEQ ID NO: 866726 - DNA, 25 bp, Mus musculus
tgcccacttggagctctggtcatga

SEQ ID NO: 866727 - DNA, 25 bp, Mus musculus
tgcccacttggtccctggaggtgaa

SEQ ID NO: 866728 - DNA, 25 bp, Mus musculus
tgcccacttggtgcctggaggtgaa

SEQ ID NO: 866729 - DNA, 25 bp, Mus musculus
tgcccacttgtgatcttgtcttagc

SEQ ID NO: 866730 - DNA, 25 bp, Mus musculus
tgcccacttgtgttcttgtcttagc

SEQ ID NO: 866731 - DNA, 25 bp, Mus musculus
tgcccagaaagaaccagccacaagc

SEQ ID NO: 866732 - DNA, 25 bp, Mus musculus
tgcccagaaagatccagccacaagc

SEQ ID NO: 866733 - DNA, 25 bp, Mus musculus
tgcccagaaagcagtgcacgatgat

SEQ ID NO: 866734 - DNA, 25 bp, Mus musculus
tgcccagaaagctgtgcacgatgat

SEQ ID NO: 866735 - DNA, 25 bp, Mus musculus
tgcccagaataaatttcacataaat

SEQ ID NO: 866736 - DNA, 25 bp, Mus musculus
tgcccagaataattttcacataaat

SEQ ID NO: 866737 - DNA, 25 bp, Mus musculus
tgcccagacaagagtgccaccttct

SEQ ID NO: 866738 - DNA, 25 bp, Mus musculus
tgcccagacaagtgtgccaccttct

SEQ ID NO: 866739 - DNA, 25 bp, Mus musculus
tgcccagacacacatctttcagaaa

SEQ ID NO: 866740 - DNA, 25 bp, Mus musculus
tgcccagacacagatctttcagaaa

SEQ ID NO: 866741 - DNA, 25 bp, Mus musculus
tgcccagacagtctcaccaggaagt

SEQ ID NO: 866742 - DNA, 25 bp, Mus musculus
tgcccagacagtgtcaccaggaagt

SEQ ID NO: 866743 - DNA, 25 bp, Mus musculus
tgcccagacatactctgtgctgctc

SEQ ID NO: 866744 - DNA, 25 bp, Mus musculus
tgcccagacatagtctgtgctgctc

SEQ ID NO: 866745 - DNA, 25 bp, Mus musculus
tgcccagaccagacggtaggttttg

SEQ ID NO: 866746 - DNA, 25 bp, Mus musculus
tgcccagaccagatctaaggaggtt

SEQ ID NO: 866747 - DNA, 25 bp, Mus musculus
tgcccagaccagtcggtaggttttg

SEQ ID NO: 866748 - DNA, 25 bp, Mus musculus
tgcccagaccagttctaaggaggtt

SEQ ID NO: 866749 - DNA, 25 bp, Mus musculus
tgcccagacctgaattccagccttt

SEQ ID NO: 866750 - DNA, 25 bp, Mus musculus
tgcccagacctgtattccagccttt

SEQ ID NO: 866751 - DNA, 25 bp, Mus musculus
tgcccagacgccactttattaaagc

SEQ ID NO: 866752 - DNA, 25 bp, Mus musculus
tgcccagacgcctctttattaaagc

SEQ ID NO: 866753 - DNA, 25 bp, Mus musculus
tgcccagactggacatcttggtctt

SEQ ID NO: 866754 - DNA, 25 bp, Mus musculus
tgcccagactggtcatcttggtctt

SEQ ID NO: 866755 - DNA, 25 bp, Mus musculus
tgcccagactttcctcagtggtaac

SEQ ID NO: 866756 - DNA, 25 bp, Mus musculus
tgcccagactttgctcagtggtaac

SEQ ID NO: 866757 - DNA, 25 bp, Mus musculus
tgcccagagagtcagccgccatgta

SEQ ID NO: 866758 - DNA, 25 bp, Mus musculus
tgcccagagagtgagccgccatgta

SEQ ID NO: 866759 - DNA, 25 bp, Mus musculus
tgcccagagcatatgtgctgcgctg

SEQ ID NO: 866760 - DNA, 25 bp, Mus musculus
tgcccagagcatttgtgctgcgctg

SEQ ID NO: 866761 - DNA, 25 bp, Mus musculus
tgcccagaggcaattgttctccttt

SEQ ID NO: 866762 - DNA, 25 bp, Mus musculus
tgcccagaggcatttgttctccttt

SEQ ID NO: 866763 - DNA, 25 bp, Mus musculus
tgcccagaggccagtctcgcacagg

SEQ ID NO: 866764 - DNA, 25 bp, Mus musculus
tgcccagaggcctgtctcgcacagg

SEQ ID NO: 866765 - DNA, 25 bp, Mus musculus
tgcccagagggtcccaacgcctatg

SEQ ID NO: 866766 - DNA, 25 bp, Mus musculus
tgcccagagggtgccaacgcctatg

SEQ ID NO: 866767 - DNA, 25 bp, Mus musculus
tgcccagatcagaccaggaccagaa

SEQ ID NO: 866768 - DNA, 25 bp, Mus musculus
tgcccagatcagtccaggaccagaa

SEQ ID NO: 866769 - DNA, 25 bp, Mus musculus
tgcccagatcgcaaagcctgtgagg

SEQ ID NO: 866770 - DNA, 25 bp, Mus musculus
tgcccagatcgctaagcctgtgagg

SEQ ID NO: 866771 - DNA, 25 bp, Mus musculus
tgcccagattcactggatctcggta

SEQ ID NO: 866772 - DNA, 25 bp, Mus musculus
tgcccagattcagtggatctcggta

SEQ ID NO: 866773 - DNA, 25 bp, Mus musculus
tgcccagattctaacagggttcctg

SEQ ID NO: 866774 - DNA, 25 bp, Mus musculus
tgcccagattcttacagggttcctg

SEQ ID NO: 866775 - DNA, 25 bp, Mus musculus
tgcccagcagagagacagttacccc

SEQ ID NO: 866776 - DNA, 25 bp, Mus musculus
tgcccagcagagtgacagttacccc

SEQ ID NO: 866777 - DNA, 25 bp, Mus musculus
tgcccagcagtcacttcgttgaagt

SEQ ID NO: 866778 - DNA, 25 bp, Mus musculus
tgcccagcagtctcttcgttgaagt

SEQ ID NO: 866779 - DNA, 25 bp, Mus musculus
tgcccagcatcaccgaatactacag

SEQ ID NO: 866780 - DNA, 25 bp, Mus musculus
tgcccagcatcagcgaatactacag

SEQ ID NO: 866781 - DNA, 25 bp, Mus musculus
tgcccagcatggactcaaatgtcta

SEQ ID NO: 866782 - DNA, 25 bp, Mus musculus
tgcccagcatggtctcaaatgtcta

SEQ ID NO: 866783 - DNA, 25 bp, Mus musculus
tgcccagccaaacgattttatatat

SEQ ID NO: 866784 - DNA, 25 bp, Mus musculus
tgcccagccaaaggattttatatat

SEQ ID NO: 866785 - DNA, 25 bp, Mus musculus
tgcccagccaagagatttgaaattt

SEQ ID NO: 866786 - DNA, 25 bp, Mus musculus
tgcccagccaagtgatttgaaattt

SEQ ID NO: 866787 - DNA, 25 bp, Mus musculus
tgcccagccagaaaaacaggatgtt

SEQ ID NO: 866788 - DNA, 25 bp, Mus musculus
tgcccagccagataaacaggatgtt

SEQ ID NO: 866789 - DNA, 25 bp, Mus musculus
tgcccagccaggcttgcagggaaaa

SEQ ID NO: 866790 - DNA, 25 bp, Mus musculus
tgcccagccagggttgcagggaaaa

SEQ ID NO: 866791 - DNA, 25 bp, Mus musculus
tgcccagccatcatcaatcaaattg

SEQ ID NO: 866792 - DNA, 25 bp, Mus musculus
tgcccagccatcttcaatcaaattg

SEQ ID NO: 866793 - DNA, 25 bp, Mus musculus
tgcccagcccggcactgataatgtg

SEQ ID NO: 866794 - DNA, 25 bp, Mus musculus
tgcccagcccgggactgataatgtg

SEQ ID NO: 866795 - DNA, 25 bp, Mus musculus
tgcccagcctgcaacatttgacaag

SEQ ID NO: 866796 - DNA, 25 bp, Mus musculus
tgcccagcctgctacatttgacaag

SEQ ID NO: 866797 - DNA, 25 bp, Mus musculus
tgcccagcctggctattgggaaatg

SEQ ID NO: 866798 - DNA, 25 bp, Mus musculus
tgcccagcctgggtattgggaaatg

SEQ ID NO: 866799 - DNA, 25 bp, Mus musculus
tgcccagcggctaagaggagttgct

SEQ ID NO: 866800 - DNA, 25 bp, Mus musculus
tgcccagcggctctaagttttcatc

SEQ ID NO: 866801 - DNA, 25 bp, Mus musculus
tgcccagcggctgtaagttttcatc

SEQ ID NO: 866802 - DNA, 25 bp, Mus musculus
tgcccagcggcttagaggagttgct

SEQ ID NO: 866803 - DNA, 25 bp, Mus musculus
tgcccagcgtgtcctatagcatctg

SEQ ID NO: 866804 - DNA, 25 bp, Mus musculus
tgcccagcgtgtgctatagcatctg

SEQ ID NO: 866805 - DNA, 25 bp, Mus musculus
tgcccagctaaaaaccactcatgac

SEQ ID NO: 866806 - DNA, 25 bp, Mus musculus
tgcccagctaaataccactcatgac

SEQ ID NO: 866807 - DNA, 25 bp, Mus musculus
tgcccagctaagaaagtctttagat

SEQ ID NO: 866808 - DNA, 25 bp, Mus musculus
tgcccagctaagtaagtctttagat

SEQ ID NO: 866809 - DNA, 25 bp, Mus musculus
tgcccagctatacccttggtgagag

SEQ ID NO: 866810 - DNA, 25 bp, Mus musculus
tgcccagctatagccttggtgagag

SEQ ID NO: 866811 - DNA, 25 bp, Mus musculus
tgcccagctccacgtgaatgtagca

SEQ ID NO: 866812 - DNA, 25 bp, Mus musculus
tgcccagctccaggtgaatgtagca

SEQ ID NO: 866813 - DNA, 25 bp, Mus musculus
tgcccagctcccatgagagcagaga

SEQ ID NO: 866814 - DNA, 25 bp, Mus musculus
tgcccagctcccttgagagcagaga

SEQ ID NO: 866815 - DNA, 25 bp, Mus musculus
tgcccagctgtcagagtgctgttta

SEQ ID NO: 866816 - DNA, 25 bp, Mus musculus
tgcccagctgtctgagtgctgttta

SEQ ID NO: 866817 - DNA, 25 bp, Mus musculus
tgcccagcttgacttcttaatccat

SEQ ID NO: 866818 - DNA, 25 bp, Mus musculus
tgcccagcttgagttcttaatccat

SEQ ID NO: 866819 - DNA, 25 bp, Mus musculus
tgcccagcttggaagaggtatctca

SEQ ID NO: 866820 - DNA, 25 bp, Mus musculus
tgcccagcttggtagaggtatctca

SEQ ID NO: 866821 - DNA, 25 bp, Mus musculus
tgcccaggacaaagaaccggagaaa

SEQ ID NO: 866822 - DNA, 25 bp, Mus musculus
tgcccaggacaatgaaccggagaaa

SEQ ID NO: 866823 - DNA, 25 bp, Mus musculus
tgcccaggagccatacgtgcttcaa

SEQ ID NO: 866824 - DNA, 25 bp, Mus musculus
tgcccaggagccttacgtgcttcaa

SEQ ID NO: 866825 - DNA, 25 bp, Mus musculus
tgcccaggagctcacagttcctgca

SEQ ID NO: 866826 - DNA, 25 bp, Mus musculus
tgcccaggagctgacagttcctgca

SEQ ID NO: 866827 - DNA, 25 bp, Mus musculus
tgcccaggagtaccaccatctacaa

SEQ ID NO: 866828 - DNA, 25 bp, Mus musculus
tgcccaggagtagcaccatctacaa

SEQ ID NO: 866829 - DNA, 25 bp, Mus musculus
tgcccaggagttcctagaccacagt

SEQ ID NO: 866830 - DNA, 25 bp, Mus musculus
tgcccaggagttgctagaccacagt

SEQ ID NO: 866831 - DNA, 25 bp, Mus musculus
tgcccaggatacatcatcagctcaa

SEQ ID NO: 866832 - DNA, 25 bp, Mus musculus
tgcccaggatacttcatcagctcaa

SEQ ID NO: 866833 - DNA, 25 bp, Mus musculus
tgcccaggatttaaacagtccagtt

SEQ ID NO: 866834 - DNA, 25 bp, Mus musculus
tgcccaggattttaacagtccagtt

SEQ ID NO: 866835 - DNA, 25 bp, Mus musculus
tgcccaggcaacagaatgttccggt

SEQ ID NO: 866836 - DNA, 25 bp, Mus musculus
tgcccaggcaactgaatgttccggt

SEQ ID NO: 866837 - DNA, 25 bp, Mus musculus
tgcccaggcgcaatgctcatgtgaa

SEQ ID NO: 866838 - DNA, 25 bp, Mus musculus
tgcccaggcgcattgctcatgtgaa

SEQ ID NO: 866839 - DNA, 25 bp, Mus musculus
tgcccaggctgtcgaaaggaaagct

SEQ ID NO: 866840 - DNA, 25 bp, Mus musculus
tgcccaggctgtggaaaggaaagct

SEQ ID NO: 866841 - DNA, 25 bp, Mus musculus
tgcccagggaaaccggcgttacgac

SEQ ID NO: 866842 - DNA, 25 bp, Mus musculus
tgcccagggaaagcggcgttacgac

SEQ ID NO: 866843 - DNA, 25 bp, Mus musculus
tgcccagggattcgacctggacctg

SEQ ID NO: 866844 - DNA, 25 bp, Mus musculus
tgcccagggattggacctggacctg

SEQ ID NO: 866845 - DNA, 25 bp, Mus musculus
tgcccagggcgtatgtggaacctta

SEQ ID NO: 866846 - DNA, 25 bp, Mus musculus
tgcccagggcgtttgtggaacctta

SEQ ID NO: 866847 - DNA, 25 bp, Mus musculus
tgcccagggtggagacgagttctta

SEQ ID NO: 866848 - DNA, 25 bp, Mus musculus
tgcccagggtggtgacgagttctta

SEQ ID NO: 866849 - DNA, 25 bp, Mus musculus
tgcccaggtgacaagagcgcgttac

SEQ ID NO: 866850 - DNA, 25 bp, Mus musculus
tgcccaggtgactagagcgcgttac

SEQ ID NO: 866851 - DNA, 25 bp, Mus musculus
tgcccaggttctagcatgtatccta

SEQ ID NO: 866852 - DNA, 25 bp, Mus musculus
tgcccaggttcttgcatgtatccta

SEQ ID NO: 866853 - DNA, 25 bp, Mus musculus
tgcccagtaacacgctctagccttt

SEQ ID NO: 866854 - DNA, 25 bp, Mus musculus
tgcccagtaacaggctctagccttt

SEQ ID NO: 866855 - DNA, 25 bp, Mus musculus
tgcccagtaactagttccaatttcc

SEQ ID NO: 866856 - DNA, 25 bp, Mus musculus
tgcccagtaacttgttccaatttcc

SEQ ID NO: 866857 - DNA, 25 bp, Mus musculus
tgcccagtaatgaaccagaacagct

SEQ ID NO: 866858 - DNA, 25 bp, Mus musculus
tgcccagtaatgtaccagaacagct

SEQ ID NO: 866859 - DNA, 25 bp, Mus musculus
tgcccagtacaacccttcgaaattc

SEQ ID NO: 866860 - DNA, 25 bp, Mus musculus
tgcccagtacaagccttcgaaattc

SEQ ID NO: 866861 - DNA, 25 bp, Mus musculus
tgcccagtaggcaacctcgaggatt

SEQ ID NO: 866862 - DNA, 25 bp, Mus musculus
tgcccagtaggctacctcgaggatt

SEQ ID NO: 866863 - DNA, 25 bp, Mus musculus
tgcccagtatatcttcccaacatga

SEQ ID NO: 866864 - DNA, 25 bp, Mus musculus
tgcccagtatatgttcccaacatga

SEQ ID NO: 866865 - DNA, 25 bp, Mus musculus
tgcccagtcatgaccttttctcaaa

SEQ ID NO: 866866 - DNA, 25 bp, Mus musculus
tgcccagtcatgtccttttctcaaa

SEQ ID NO: 866867 - DNA, 25 bp, Mus musculus
tgcccagtcattcggtgctagttag

SEQ ID NO: 866868 - DNA, 25 bp, Mus musculus
tgcccagtcattgggtgctagttag

SEQ ID NO: 866869 - DNA, 25 bp, Mus musculus
tgcccagtctaccattaaaccatgt

SEQ ID NO: 866870 - DNA, 25 bp, Mus musculus
tgcccagtctacgattaaaccatgt

SEQ ID NO: 866871 - DNA, 25 bp, Mus musculus
tgcccagtctagatcatttttgtat

SEQ ID NO: 866872 - DNA, 25 bp, Mus musculus
tgcccagtctagttcatttttgtat

SEQ ID NO: 866873 - DNA, 25 bp, Mus musculus
tgcccagtctccagattcttttaaa

SEQ ID NO: 866874 - DNA, 25 bp, Mus musculus
tgcccagtctcctgattcttttaaa

SEQ ID NO: 866875 - DNA, 25 bp, Mus musculus
tgcccagtctgtacttaactcatga

SEQ ID NO: 866876 - DNA, 25 bp, Mus musculus
tgcccagtctgttcttaactcatga

SEQ ID NO: 866877 - DNA, 25 bp, Mus musculus
tgcccagtcttcagaggattttcta

SEQ ID NO: 866878 - DNA, 25 bp, Mus musculus
tgcccagtcttctgaggattttcta

SEQ ID NO: 866879 - DNA, 25 bp, Mus musculus
tgcccagtgcagactagaaacctag

SEQ ID NO: 866880 - DNA, 25 bp, Mus musculus
tgcccagtgcagtctagaaacctag

SEQ ID NO: 866881 - DNA, 25 bp, Mus musculus
tgcccagtgctgacctagtgtgtgc

SEQ ID NO: 866882 - DNA, 25 bp, Mus musculus
tgcccagtgctgtcctagtgtgtgc

SEQ ID NO: 866883 - DNA, 25 bp, Mus musculus
tgcccagtgcttcttgctacatttt

SEQ ID NO: 866884 - DNA, 25 bp, Mus musculus
tgcccagtgcttgttgctacatttt

SEQ ID NO: 866885 - DNA, 25 bp, Mus musculus
tgcccagtggccctgcttatgaact

SEQ ID NO: 866886 - DNA, 25 bp, Mus musculus
tgcccagtggccgtgcttatgaact

SEQ ID NO: 866887 - DNA, 25 bp, Mus musculus
tgcccagtgttgcagttccagacat

SEQ ID NO: 866888 - DNA, 25 bp, Mus musculus
tgcccagtgttggagttccagacat

SEQ ID NO: 866889 - DNA, 25 bp, Mus musculus
tgcccagttactacgggtgctttta

SEQ ID NO: 866890 - DNA, 25 bp, Mus musculus
tgcccagttacttcgggtgctttta

SEQ ID NO: 866891 - DNA, 25 bp, Mus musculus
tgcccagttatcaatattagctcaa

SEQ ID NO: 866892 - DNA, 25 bp, Mus musculus
tgcccagttatctatattagctcaa

SEQ ID NO: 866893 - DNA, 25 bp, Mus musculus
tgcccagttcataataatctctctt

SEQ ID NO: 866894 - DNA, 25 bp, Mus musculus
tgcccagttcatattttgtgtcagg

SEQ ID NO: 866895 - DNA, 25 bp, Mus musculus
tgcccagttcattataatctctctt

SEQ ID NO: 866896 - DNA, 25 bp, Mus musculus
tgcccagttcattttttgtgtcagg

SEQ ID NO: 866897 - DNA, 25 bp, Mus musculus
tgcccagttcctctgtaactacagg

SEQ ID NO: 866898 - DNA, 25 bp, Mus musculus
tgcccagttcctgtgtaactacagg

SEQ ID NO: 866899 - DNA, 25 bp, Mus musculus
tgcccagttctcagagactgtgtct

SEQ ID NO: 866900 - DNA, 25 bp, Mus musculus
tgcccagttctctgagactgtgtct

SEQ ID NO: 866901 - DNA, 25 bp, Mus musculus
tgcccagttctgaggataacatgct

SEQ ID NO: 866902 - DNA, 25 bp, Mus musculus
tgcccagttctgtggataacatgct

SEQ ID NO: 866903 - DNA, 25 bp, Mus musculus
tgcccagttcttaacctccaataaa

SEQ ID NO: 866904 - DNA, 25 bp, Mus musculus
tgcccagttctttacctccaataaa

SEQ ID NO: 866905 - DNA, 25 bp, Mus musculus
tgcccagttgttagtgtcggtgcta

SEQ ID NO: 866906 - DNA, 25 bp, Mus musculus
tgcccagttgtttgtgtcggtgcta

SEQ ID NO: 866907 - DNA, 25 bp, Mus musculus
tgcccagtttccaaaattccttcag

SEQ ID NO: 866908 - DNA, 25 bp, Mus musculus
tgcccagtttcctaaattccttcag

SEQ ID NO: 866909 - DNA, 25 bp, Mus musculus
tgcccataatccctgtatcaaacaa

SEQ ID NO: 866910 - DNA, 25 bp, Mus musculus
tgcccataatccgtgtatcaaacaa

SEQ ID NO: 866911 - DNA, 25 bp, Mus musculus
tgcccataatggacttaaactcaca

SEQ ID NO: 866912 - DNA, 25 bp, Mus musculus
tgcccataatggtcttaaactcaca

SEQ ID NO: 866913 - DNA, 25 bp, Mus musculus
tgcccatacagtatcctgcttagat

SEQ ID NO: 866914 - DNA, 25 bp, Mus musculus
tgcccatacagtttcctgcttagat

SEQ ID NO: 866915 - DNA, 25 bp, Mus musculus
tgcccataccttagaagcctgctct

SEQ ID NO: 866916 - DNA, 25 bp, Mus musculus
tgcccatacctttgaagcctgctct

SEQ ID NO: 866917 - DNA, 25 bp, Mus musculus
tgcccatagcggagggagcagctct

SEQ ID NO: 866918 - DNA, 25 bp, Mus musculus
tgcccatagcggtgggagcagctct

SEQ ID NO: 866919 - DNA, 25 bp, Mus musculus
tgcccataggtgaccaatactcgag

SEQ ID NO: 866920 - DNA, 25 bp, Mus musculus
tgcccataggtgtccaatactcgag

SEQ ID NO: 866921 - DNA, 25 bp, Mus musculus
tgcccatagtttccataaggactgg

SEQ ID NO: 866922 - DNA, 25 bp, Mus musculus
tgcccatagtttgcataaggactgg

SEQ ID NO: 866923 - DNA, 25 bp, Mus musculus
tgcccatatcacatccattttgtat

SEQ ID NO: 866924 - DNA, 25 bp, Mus musculus
tgcccatatcacttccattttgtat

SEQ ID NO: 866925 - DNA, 25 bp, Mus musculus
tgcccatatctgcagtcccttgcaa

SEQ ID NO: 866926 - DNA, 25 bp, Mus musculus
tgcccatatctggagtcccttgcaa

SEQ ID NO: 866927 - DNA, 25 bp, Mus musculus
tgcccatcaaggattgctccagacc

SEQ ID NO: 866928 - DNA, 25 bp, Mus musculus
tgcccatcaaggtttgctccagacc

SEQ ID NO: 866929 - DNA, 25 bp, Mus musculus
tgcccatcacaacgaccctgaattt

SEQ ID NO: 866930 - DNA, 25 bp, Mus musculus
tgcccatcacaaggaccctgaattt

SEQ ID NO: 866931 - DNA, 25 bp, Mus musculus
tgcccatcagtacaacaggacaagt

SEQ ID NO: 866932 - DNA, 25 bp, Mus musculus
tgcccatcagtagaacaggacaagt

SEQ ID NO: 866933 - DNA, 25 bp, Mus musculus
tgcccatcattaacccttacaaaat

SEQ ID NO: 866934 - DNA, 25 bp, Mus musculus
tgcccatcattatcccttacaaaat

SEQ ID NO: 866935 - DNA, 25 bp, Mus musculus
tgcccatcatttcattcatccttgc

SEQ ID NO: 866936 - DNA, 25 bp, Mus musculus
tgcccatcatttgattcatccttgc

SEQ ID NO: 866937 - DNA, 25 bp, Mus musculus
tgcccatccctaatacaaacactgg

SEQ ID NO: 866938 - DNA, 25 bp, Mus musculus
tgcccatccctattacaaacactgg

SEQ ID NO: 866939 - DNA, 25 bp, Mus musculus
tgcccatcctggactttatccggag

SEQ ID NO: 866940 - DNA, 25 bp, Mus musculus
tgcccatcctggtctttatccggag

SEQ ID NO: 866941 - DNA, 25 bp, Mus musculus
tgcccatcctgtctgaagccagtta

SEQ ID NO: 866942 - DNA, 25 bp, Mus musculus
tgcccatcctgtgtgaagccagtta

SEQ ID NO: 866943 - DNA, 25 bp, Mus musculus
tgcccatcgggccacagtgtgcaaa

SEQ ID NO: 866944 - DNA, 25 bp, Mus musculus
tgcccatcgggcgacagtgtgcaaa

SEQ ID NO: 866945 - DNA, 25 bp, Mus musculus
tgcccatctaccaatgaatgctgaa

SEQ ID NO: 866946 - DNA, 25 bp, Mus musculus
tgcccatctacctatgaatgctgaa

SEQ ID NO: 866947 - DNA, 25 bp, Mus musculus
tgcccatctcatagtttctaacttt

SEQ ID NO: 866948 - DNA, 25 bp, Mus musculus
tgcccatctcattgtttctaacttt

SEQ ID NO: 866949 - DNA, 25 bp, Mus musculus
tgcccatctcttctgtctgatttta

SEQ ID NO: 866950 - DNA, 25 bp, Mus musculus
tgcccatctcttgtgtctgatttta

SEQ ID NO: 866951 - DNA, 25 bp, Mus musculus
tgcccatctgaacacccatgatgaa

SEQ ID NO: 866952 - DNA, 25 bp, Mus musculus
tgcccatctgaagacccatgatgaa

SEQ ID NO: 866953 - DNA, 25 bp, Mus musculus
tgcccatctgagagtctacttgtat

SEQ ID NO: 866954 - DNA, 25 bp, Mus musculus
tgcccatctgagtgtctacttgtat

SEQ ID NO: 866955 - DNA, 25 bp, Mus musculus
tgcccatctgcaactagagacccat

SEQ ID NO: 866956 - DNA, 25 bp, Mus musculus
tgcccatctgcatctagagacccat

SEQ ID NO: 866957 - DNA, 25 bp, Mus musculus
tgcccatcttctcagttgtaaagga

SEQ ID NO: 866958 - DNA, 25 bp, Mus musculus
tgcccatcttctgagttgtaaagga

SEQ ID NO: 866959 - DNA, 25 bp, Mus musculus
tgcccatcttgaatgttctgcacag

SEQ ID NO: 866960 - DNA, 25 bp, Mus musculus
tgcccatcttgattgttctgcacag

SEQ ID NO: 866961 - DNA, 25 bp, Mus musculus
tgcccatcttttaccaatatttagt

SEQ ID NO: 866962 - DNA, 25 bp, Mus musculus
tgcccatctttttccaatatttagt

SEQ ID NO: 866963 - DNA, 25 bp, Mus musculus
tgcccatgaaagagccggtccacag

SEQ ID NO: 866964 - DNA, 25 bp, Mus musculus
tgcccatgaaagtgccggtccacag

SEQ ID NO: 866965 - DNA, 25 bp, Mus musculus
tgcccatgacagcaagcacactgga

SEQ ID NO: 866966 - DNA, 25 bp, Mus musculus
tgcccatgacaggaagcacactgga

SEQ ID NO: 866967 - DNA, 25 bp, Mus musculus
tgcccatgagccaggtacctccaaa

SEQ ID NO: 866968 - DNA, 25 bp, Mus musculus
tgcccatgagcctggtacctccaaa

SEQ ID NO: 866969 - DNA, 25 bp, Mus musculus
tgcccatgaggaacacatcctgtct

SEQ ID NO: 866970 - DNA, 25 bp, Mus musculus
tgcccatgaggatcacatcctgtct

SEQ ID NO: 866971 - DNA, 25 bp, Mus musculus
tgcccatgatgcaagctatctccaa

SEQ ID NO: 866972 - DNA, 25 bp, Mus musculus
tgcccatgatgctagctatctccaa

SEQ ID NO: 866973 - DNA, 25 bp, Mus musculus
tgcccatgccacagtatgtactgag

SEQ ID NO: 866974 - DNA, 25 bp, Mus musculus
tgcccatgccactgtatgtactgag

SEQ ID NO: 866975 - DNA, 25 bp, Mus musculus
tgcccatgccgacggcccaagttct

SEQ ID NO: 866976 - DNA, 25 bp, Mus musculus
tgcccatgccgagggcccaagttct

SEQ ID NO: 866977 - DNA, 25 bp, Mus musculus
tgcccatgcgccaatgatgctaatg

SEQ ID NO: 866978 - DNA, 25 bp, Mus musculus
tgcccatgcgcctatgatgctaatg

SEQ ID NO: 866979 - DNA, 25 bp, Mus musculus
tgcccatgctctatgctgcacgtag

SEQ ID NO: 866980 - DNA, 25 bp, Mus musculus
tgcccatgctctttgctgcacgtag

SEQ ID NO: 866981 - DNA, 25 bp, Mus musculus
tgcccatggatcacataaagtgctg

SEQ ID NO: 866982 - DNA, 25 bp, Mus musculus
tgcccatggatctcataaagtgctg

SEQ ID NO: 866983 - DNA, 25 bp, Mus musculus
tgcccatggcttaatttatgagtgt

SEQ ID NO: 866984 - DNA, 25 bp, Mus musculus
tgcccatggctttatttatgagtgt

SEQ ID NO: 866985 - DNA, 25 bp, Mus musculus
tgcccatgggcactggttcatcagc

SEQ ID NO: 866986 - DNA, 25 bp, Mus musculus
tgcccatgggcagtggttcatcagc

SEQ ID NO: 866987 - DNA, 25 bp, Mus musculus
tgcccatggtcaatcagaaactatt

SEQ ID NO: 866988 - DNA, 25 bp, Mus musculus
tgcccatggtcattcagaaactatt

SEQ ID NO: 866989 - DNA, 25 bp, Mus musculus
tgcccatgtggactgttttctgagc

SEQ ID NO: 866990 - DNA, 25 bp, Mus musculus
tgcccatgtggagtgttttctgagc

SEQ ID NO: 866991 - DNA, 25 bp, Mus musculus
tgcccatgtggtctaggaacttttt

SEQ ID NO: 866992 - DNA, 25 bp, Mus musculus
tgcccatgtggtgtaggaacttttt

SEQ ID NO: 866993 - DNA, 25 bp, Mus musculus
tgcccatgtgtcactatttatgcgt

SEQ ID NO: 866994 - DNA, 25 bp, Mus musculus
tgcccatgtgtctctatttatgcgt

SEQ ID NO: 866995 - DNA, 25 bp, Mus musculus
tgcccatgttgacgctaggaaccaa

SEQ ID NO: 866996 - DNA, 25 bp, Mus musculus
tgcccatgttgaggctaggaaccaa

SEQ ID NO: 866997 - DNA, 25 bp, Mus musculus
tgcccatgtttgaccgactgcaaaa

SEQ ID NO: 866998 - DNA, 25 bp, Mus musculus
tgcccatgtttgagctggtggaaca

SEQ ID NO: 866999 - DNA, 25 bp, Mus musculus
tgcccatgtttgtccgactgcaaaa

SEQ ID NO: 867000 - DNA, 25 bp, Mus musculus
tgcccatgtttgtgctggtggaaca

SEQ ID NO: 867001 - DNA, 25 bp, Mus musculus
tgcccattcaaacctaaaacctgtc

SEQ ID NO: 867002 - DNA, 25 bp, Mus musculus
tgcccattcaaagctaaaacctgtc

SEQ ID NO: 867003 - DNA, 25 bp, Mus musculus
tgcccattccaaatgtcctcgatag

SEQ ID NO: 867004 - DNA, 25 bp, Mus musculus
tgcccattccaattgtcctcgatag

SEQ ID NO: 867005 - DNA, 25 bp, Mus musculus
tgcccattccctacagctatttgtc

SEQ ID NO: 867006 - DNA, 25 bp, Mus musculus
tgcccattcccttcagctatttgtc

SEQ ID NO: 867007 - DNA, 25 bp, Mus musculus
tgcccattctagactttgcttcatt

SEQ ID NO: 867008 - DNA, 25 bp, Mus musculus
tgcccattctagtctttgcttcatt

SEQ ID NO: 867009 - DNA, 25 bp, Mus musculus
tgcccattgacaaacttgtgcccat

SEQ ID NO: 867010 - DNA, 25 bp, Mus musculus
tgcccattgacatacttgtgcccat

SEQ ID NO: 867011 - DNA, 25 bp, Mus musculus
tgcccattgcccacagaacggtgga

SEQ ID NO: 867012 - DNA, 25 bp, Mus musculus
tgcccattgccctcagaacggtgga

SEQ ID NO: 867013 - DNA, 25 bp, Mus musculus
tgcccattgctacaaggctcaagag

SEQ ID NO: 867014 - DNA, 25 bp, Mus musculus
tgcccattgctagaaggctcaagag

SEQ ID NO: 867015 - DNA, 25 bp, Mus musculus
tgcccattgggacattctgtctatt

SEQ ID NO: 867016 - DNA, 25 bp, Mus musculus
tgcccattgggagattctgtctatt

SEQ ID NO: 867017 - DNA, 25 bp, Mus musculus
tgcccattggtcaccactccagata

SEQ ID NO: 867018 - DNA, 25 bp, Mus musculus
tgcccattggtctccactccagata

SEQ ID NO: 867019 - DNA, 25 bp, Mus musculus
tgcccattgtgtactcggagttgac

SEQ ID NO: 867020 - DNA, 25 bp, Mus musculus
tgcccattgtgttctcggagttgac

SEQ ID NO: 867021 - DNA, 25 bp, Mus musculus
tgcccattgtttcagatcgttctac

SEQ ID NO: 867022 - DNA, 25 bp, Mus musculus
tgcccattgtttgagatcgttctac

SEQ ID NO: 867023 - DNA, 25 bp, Mus musculus
tgcccatttagcactcctttatagt

SEQ ID NO: 867024 - DNA, 25 bp, Mus musculus
tgcccatttagctctcctttatagt

SEQ ID NO: 867025 - DNA, 25 bp, Mus musculus
tgcccatttatgcttttcttctcac

SEQ ID NO: 867026 - DNA, 25 bp, Mus musculus
tgcccatttatggttttcttctcac

SEQ ID NO: 867027 - DNA, 25 bp, Mus musculus
tgcccatttgccactttgttataaa

SEQ ID NO: 867028 - DNA, 25 bp, Mus musculus
tgcccatttgcctctttgttataaa

SEQ ID NO: 867029 - DNA, 25 bp, Mus musculus
tgccccaaaatgaggactgcctgat

SEQ ID NO: 867030 - DNA, 25 bp, Mus musculus
tgccccaaaatgtggactgcctgat

SEQ ID NO: 867031 - DNA, 25 bp, Mus musculus
tgccccaaaccaccagatcttttat

SEQ ID NO: 867032 - DNA, 25 bp, Mus musculus
tgccccaaaccagcagatcttttat

SEQ ID NO: 867033 - DNA, 25 bp, Mus musculus
tgccccaaagcgatctcgtttcctt

SEQ ID NO: 867034 - DNA, 25 bp, Mus musculus
tgccccaaagcgttctcgtttcctt

SEQ ID NO: 867035 - DNA, 25 bp, Mus musculus
tgccccaacaggaactttgtgtggt

SEQ ID NO: 867036 - DNA, 25 bp, Mus musculus
tgccccaacaggtactttgtgtggt

SEQ ID NO: 867037 - DNA, 25 bp, Mus musculus
tgccccaacataagaactgcctgat

SEQ ID NO: 867038 - DNA, 25 bp, Mus musculus
tgccccaacatatgaactgcctgat

SEQ ID NO: 867039 - DNA, 25 bp, Mus musculus
tgccccaaccaaagaaatctgaaat

SEQ ID NO: 867040 - DNA, 25 bp, Mus musculus
tgccccaaccaatgaaatctgaaat

SEQ ID NO: 867041 - DNA, 25 bp, Mus musculus
tgccccaaccatctactgtttcttg

SEQ ID NO: 867042 - DNA, 25 bp, Mus musculus
tgccccaaccatgtactgtttcttg

SEQ ID NO: 867043 - DNA, 25 bp, Mus musculus
tgccccaacctgaaggagactggta

SEQ ID NO: 867044 - DNA, 25 bp, Mus musculus
tgccccaacctgtaggagactggta

SEQ ID NO: 867045 - DNA, 25 bp, Mus musculus
tgccccaactccctatcccttggta

SEQ ID NO: 867046 - DNA, 25 bp, Mus musculus
tgccccaactccgtatcccttggta

SEQ ID NO: 867047 - DNA, 25 bp, Mus musculus
tgccccaactctcacttcgaataag

SEQ ID NO: 867048 - DNA, 25 bp, Mus musculus
tgccccaactctgacttcgaataag

SEQ ID NO: 867049 - DNA, 25 bp, Mus musculus
tgccccaactgtcgaacccattaca

SEQ ID NO: 867050 - DNA, 25 bp, Mus musculus
tgccccaactgtggaacccattaca

SEQ ID NO: 867051 - DNA, 25 bp, Mus musculus
tgccccaagacccagaataatcaat

SEQ ID NO: 867052 - DNA, 25 bp, Mus musculus
tgccccaagaccgagaataatcaat

SEQ ID NO: 867053 - DNA, 25 bp, Mus musculus
tgccccaaggaaacgtgcgggagct

SEQ ID NO: 867054 - DNA, 25 bp, Mus musculus
tgccccaaggaatcgtgcgggagct

SEQ ID NO: 867055 - DNA, 25 bp, Mus musculus
tgccccaaggcacaagtcatacaca

SEQ ID NO: 867056 - DNA, 25 bp, Mus musculus
tgccccaaggcagaagtcatacaca

SEQ ID NO: 867057 - DNA, 25 bp, Mus musculus
tgccccaaggctagccctttaatta

SEQ ID NO: 867058 - DNA, 25 bp, Mus musculus
tgccccaaggcttgccctttaatta

SEQ ID NO: 867059 - DNA, 25 bp, Mus musculus
tgccccaagggtctccagtttcgct

SEQ ID NO: 867060 - DNA, 25 bp, Mus musculus
tgccccaagggtgtccagtttcgct

SEQ ID NO: 867061 - DNA, 25 bp, Mus musculus
tgccccaagtgccacaaggaggtgt

SEQ ID NO: 867062 - DNA, 25 bp, Mus musculus
tgccccaagtgcgacaaggaggtgt

SEQ ID NO: 867063 - DNA, 25 bp, Mus musculus
tgccccaagtgtcttgtaaatgttc

SEQ ID NO: 867064 - DNA, 25 bp, Mus musculus
tgccccaagtgtgttgtaaatgttc

SEQ ID NO: 867065 - DNA, 25 bp, Mus musculus
tgccccaagttcatagatccggact

SEQ ID NO: 867066 - DNA, 25 bp, Mus musculus
tgccccaagttcttagatccggact

SEQ ID NO: 867067 - DNA, 25 bp, Mus musculus
tgccccaatatgagaactgccttat

SEQ ID NO: 867068 - DNA, 25 bp, Mus musculus
tgccccaatatgtgaactgccttat

SEQ ID NO: 867069 - DNA, 25 bp, Mus musculus
tgccccaatggcaaaggctctttct

SEQ ID NO: 867070 - DNA, 25 bp, Mus musculus
tgccccaatggctaaggctctttct

SEQ ID NO: 867071 - DNA, 25 bp, Mus musculus
tgccccacagaacgttcctagtcag

SEQ ID NO: 867072 - DNA, 25 bp, Mus musculus
tgccccacagaaggttcctagtcag

SEQ ID NO: 867073 - DNA, 25 bp, Mus musculus
tgccccacagagaccaatgacattt

SEQ ID NO: 867074 - DNA, 25 bp, Mus musculus
tgccccacagagtccaatgacattt

SEQ ID NO: 867075 - DNA, 25 bp, Mus musculus
tgccccacagttcacaatcagtatg

SEQ ID NO: 867076 - DNA, 25 bp, Mus musculus
tgccccacagttgacaatcagtatg

SEQ ID NO: 867077 - DNA, 25 bp, Mus musculus
tgccccacatagacttttgtgttac

SEQ ID NO: 867078 - DNA, 25 bp, Mus musculus
tgccccacatagtcttttgtgttac

SEQ ID NO: 867079 - DNA, 25 bp, Mus musculus
tgccccacatttaatgctacctaga

SEQ ID NO: 867080 - DNA, 25 bp, Mus musculus
tgccccacattttatgctacctaga

SEQ ID NO: 867081 - DNA, 25 bp, Mus musculus
tgccccaccagtccaagtataaggt

SEQ ID NO: 867082 - DNA, 25 bp, Mus musculus
tgccccaccagtgcaagtataaggt

SEQ ID NO: 867083 - DNA, 25 bp, Mus musculus
tgccccacgtagagctctgaagatg

SEQ ID NO: 867084 - DNA, 25 bp, Mus musculus
tgccccacgtagtgctctgaagatg

SEQ ID NO: 867085 - DNA, 25 bp, Mus musculus
tgccccactaaaccatgacagttgt

SEQ ID NO: 867086 - DNA, 25 bp, Mus musculus
tgccccactaaagcatgacagttgt

SEQ ID NO: 867087 - DNA, 25 bp, Mus musculus
tgccccactatcatgcagtgaggat

SEQ ID NO: 867088 - DNA, 25 bp, Mus musculus
tgccccactatcttgcagtgaggat

SEQ ID NO: 867089 - DNA, 25 bp, Mus musculus
tgccccacttacatgaccttaagag

SEQ ID NO: 867090 - DNA, 25 bp, Mus musculus
tgccccacttacttgaccttaagag

SEQ ID NO: 867091 - DNA, 25 bp, Mus musculus
tgccccagaagaacagctggaccgt

SEQ ID NO: 867092 - DNA, 25 bp, Mus musculus
tgccccagaagatcagctggaccgt

SEQ ID NO: 867093 - DNA, 25 bp, Mus musculus
tgccccagaccccataggagaaatc

SEQ ID NO: 867094 - DNA, 25 bp, Mus musculus
tgccccagacccgataggagaaatc

SEQ ID NO: 867095 - DNA, 25 bp, Mus musculus
tgccccagacgccaacaggatggag

SEQ ID NO: 867096 - DNA, 25 bp, Mus musculus
tgccccagacgcgaacaggatggag

SEQ ID NO: 867097 - DNA, 25 bp, Mus musculus
tgccccagactgcagatgagatcca

SEQ ID NO: 867098 - DNA, 25 bp, Mus musculus
tgccccagactggagatgagatcca

SEQ ID NO: 867099 - DNA, 25 bp, Mus musculus
tgccccagagaaagtacatatgtat

SEQ ID NO: 867100 - DNA, 25 bp, Mus musculus
tgccccagagaatgtacatatgtat

SEQ ID NO: 867101 - DNA, 25 bp, Mus musculus
tgccccagaggaaggtgcccttagt

SEQ ID NO: 867102 - DNA, 25 bp, Mus musculus
tgccccagaggatggtgcccttagt

SEQ ID NO: 867103 - DNA, 25 bp, Mus musculus
tgccccagaggcaatgacatgaaat

SEQ ID NO: 867104 - DNA, 25 bp, Mus musculus
tgccccagaggcatagcataattgg

SEQ ID NO: 867105 - DNA, 25 bp, Mus musculus
tgccccagaggctatgacatgaaat

SEQ ID NO: 867106 - DNA, 25 bp, Mus musculus
tgccccagaggcttagcataattgg

SEQ ID NO: 867107 - DNA, 25 bp, Mus musculus
tgccccagatcgattgtacagaaat

SEQ ID NO: 867108 - DNA, 25 bp, Mus musculus
tgccccagatcgtttgtacagaaat

SEQ ID NO: 867109 - DNA, 25 bp, Mus musculus
tgccccagatttcgtcttcagaaca

SEQ ID NO: 867110 - DNA, 25 bp, Mus musculus
tgccccagatttggtcttcagaaca

SEQ ID NO: 867111 - DNA, 25 bp, Mus musculus
tgccccagcctgaagattgagtatg

SEQ ID NO: 867112 - DNA, 25 bp, Mus musculus
tgccccagcctgagggatgatgtca

SEQ ID NO: 867113 - DNA, 25 bp, Mus musculus
tgccccagcctgtagattgagtatg

SEQ ID NO: 867114 - DNA, 25 bp, Mus musculus
tgccccagcctgtgggatgatgtca

SEQ ID NO: 867115 - DNA, 25 bp, Mus musculus
tgccccagctcgctgttggctgtgt

SEQ ID NO: 867116 - DNA, 25 bp, Mus musculus
tgccccagctcggtgttggctgtgt

SEQ ID NO: 867117 - DNA, 25 bp, Mus musculus
tgccccagctttagatacaaggaaa

SEQ ID NO: 867118 - DNA, 25 bp, Mus musculus
tgccccagcttttgatacaaggaaa

SEQ ID NO: 867119 - DNA, 25 bp, Mus musculus
tgccccaggaaacactcaggctgaa

SEQ ID NO: 867120 - DNA, 25 bp, Mus musculus
tgccccaggaaacggtcacgaagct

SEQ ID NO: 867121 - DNA, 25 bp, Mus musculus
tgccccaggaaactcacctgatgtg

SEQ ID NO: 867122 - DNA, 25 bp, Mus musculus
tgccccaggaaagactcaggctgaa

SEQ ID NO: 867123 - DNA, 25 bp, Mus musculus
tgccccaggaaagggtcacgaagct

SEQ ID NO: 867124 - DNA, 25 bp, Mus musculus
tgccccaggaaagtcacctgatgtg

SEQ ID NO: 867125 - DNA, 25 bp, Mus musculus
tgccccaggccgatatggtgtttag

SEQ ID NO: 867126 - DNA, 25 bp, Mus musculus
tgccccaggccgttatggtgtttag

SEQ ID NO: 867127 - DNA, 25 bp, Mus musculus
tgccccagggctatgatcagttcta

SEQ ID NO: 867128 - DNA, 25 bp, Mus musculus
tgccccagggctttgatcagttcta

SEQ ID NO: 867129 - DNA, 25 bp, Mus musculus
tgccccagggtcagcattgtaactg

SEQ ID NO: 867130 - DNA, 25 bp, Mus musculus
tgccccagggtctgcattgtaactg

SEQ ID NO: 867131 - DNA, 25 bp, Mus musculus
tgccccaggtagaggtcttcagggt

SEQ ID NO: 867132 - DNA, 25 bp, Mus musculus
tgccccaggtagtggtcttcagggt

SEQ ID NO: 867133 - DNA, 25 bp, Mus musculus
tgccccaggtcgagtgtattcagta

SEQ ID NO: 867134 - DNA, 25 bp, Mus musculus
tgccccaggtcgtgtgtattcagta

SEQ ID NO: 867135 - DNA, 25 bp, Mus musculus
tgccccagtggaaagctaaccctga

SEQ ID NO: 867136 - DNA, 25 bp, Mus musculus
tgccccagtggatagctaaccctga

SEQ ID NO: 867137 - DNA, 25 bp, Mus musculus
tgccccagtggccaccagaaatggt

SEQ ID NO: 867138 - DNA, 25 bp, Mus musculus
tgccccagtggcgaccagaaatggt

SEQ ID NO: 867139 - DNA, 25 bp, Mus musculus
tgccccagtgtgacaagaggccaca

SEQ ID NO: 867140 - DNA, 25 bp, Mus musculus
tgccccagtgtgtcaagaggccaca

SEQ ID NO: 867141 - DNA, 25 bp, Mus musculus
tgccccataaccagatttgtcccta

SEQ ID NO: 867142 - DNA, 25 bp, Mus musculus
tgccccataacccagttacatgtta

SEQ ID NO: 867143 - DNA, 25 bp, Mus musculus
tgccccataaccgagttacatgtta

SEQ ID NO: 867144 - DNA, 25 bp, Mus musculus
tgccccataacctgatttgtcccta

SEQ ID NO: 867145 - DNA, 25 bp, Mus musculus
tgccccatacccagaggaacaggct

SEQ ID NO: 867146 - DNA, 25 bp, Mus musculus
tgccccataccctgaggaacaggct

SEQ ID NO: 867147 - DNA, 25 bp, Mus musculus
tgccccatagttctgcccagcagag

SEQ ID NO: 867148 - DNA, 25 bp, Mus musculus
tgccccatagttgtgcccagcagag

SEQ ID NO: 867149 - DNA, 25 bp, Mus musculus
tgccccatatccacggtgtagcact

SEQ ID NO: 867150 - DNA, 25 bp, Mus musculus
tgccccatatcctcggtgtagcact

SEQ ID NO: 867151 - DNA, 25 bp, Mus musculus
tgccccatatggaaaagctgaactt

SEQ ID NO: 867152 - DNA, 25 bp, Mus musculus
tgccccatatggtaaagctgaactt

SEQ ID NO: 867153 - DNA, 25 bp, Mus musculus
tgccccatccccaataaagaagtga

SEQ ID NO: 867154 - DNA, 25 bp, Mus musculus
tgccccatccccataaatgtaaatg

SEQ ID NO: 867155 - DNA, 25 bp, Mus musculus
tgccccatcccctataaagaagtga

SEQ ID NO: 867156 - DNA, 25 bp, Mus musculus
tgccccatccccttaaatgtaaatg

SEQ ID NO: 867157 - DNA, 25 bp, Mus musculus
tgccccatccctcacatgggatggt

SEQ ID NO: 867158 - DNA, 25 bp, Mus musculus
tgccccatccctctggttttttact

SEQ ID NO: 867159 - DNA, 25 bp, Mus musculus
tgccccatccctgacatgggatggt

SEQ ID NO: 867160 - DNA, 25 bp, Mus musculus
tgccccatccctgtggttttttact

SEQ ID NO: 867161 - DNA, 25 bp, Mus musculus
tgccccatcgctacagcagtagcga

SEQ ID NO: 867162 - DNA, 25 bp, Mus musculus
tgccccatcgcttcagcagtagcga

SEQ ID NO: 867163 - DNA, 25 bp, Mus musculus
tgccccatcttgatatttctcttct

SEQ ID NO: 867164 - DNA, 25 bp, Mus musculus
tgccccatcttgttatttctcttct

SEQ ID NO: 867165 - DNA, 25 bp, Mus musculus
tgccccatgacaagaccaagtgctt

SEQ ID NO: 867166 - DNA, 25 bp, Mus musculus
tgccccatgacatgaccaagtgctt

SEQ ID NO: 867167 - DNA, 25 bp, Mus musculus
tgccccatgggaatgcaacaagctg

SEQ ID NO: 867168 - DNA, 25 bp, Mus musculus
tgccccatgggattgcaacaagctg

SEQ ID NO: 867169 - DNA, 25 bp, Mus musculus
tgccccatgtgccattgaatgtcat

SEQ ID NO: 867170 - DNA, 25 bp, Mus musculus
tgccccatgtgcgattgaatgtcat

SEQ ID NO: 867171 - DNA, 25 bp, Mus musculus
tgccccattctgaacatagactgtt

SEQ ID NO: 867172 - DNA, 25 bp, Mus musculus
tgccccattctgctgctaaaacaaa

SEQ ID NO: 867173 - DNA, 25 bp, Mus musculus
tgccccattctggtgctaaaacaaa

SEQ ID NO: 867174 - DNA, 25 bp, Mus musculus
tgccccattctgtacatagactgtt

SEQ ID NO: 867175 - DNA, 25 bp, Mus musculus
tgccccatttccacttgggtctaat

SEQ ID NO: 867176 - DNA, 25 bp, Mus musculus
tgccccatttcctcttgggtctaat

SEQ ID NO: 867177 - DNA, 25 bp, Mus musculus
tgcccccattcccaaggaacagagg

SEQ ID NO: 867178 - DNA, 25 bp, Mus musculus
tgcccccattccgaaggaacagagg

SEQ ID NO: 867179 - DNA, 25 bp, Mus musculus
tgccccctccaaattcattaaagat

SEQ ID NO: 867180 - DNA, 25 bp, Mus musculus
tgccccctccaatttcattaaagat

SEQ ID NO: 867181 - DNA, 25 bp, Mus musculus
tgccccgacaagcacctaaggagtg

SEQ ID NO: 867182 - DNA, 25 bp, Mus musculus
tgccccgacaaggacctaaggagtg

SEQ ID NO: 867183 - DNA, 25 bp, Mus musculus
tgccccgagtctatttgtgtttgta

SEQ ID NO: 867184 - DNA, 25 bp, Mus musculus
tgccccgagtctttttgtgtttgta

SEQ ID NO: 867185 - DNA, 25 bp, Mus musculus
tgccccgagtgcagggccacaagga

SEQ ID NO: 867186 - DNA, 25 bp, Mus musculus
tgccccgagtgctgggccacaagga

SEQ ID NO: 867187 - DNA, 25 bp, Mus musculus
tgccccgattggctctcaactgtgt

SEQ ID NO: 867188 - DNA, 25 bp, Mus musculus
tgccccgattgggtctcaactgtgt

SEQ ID NO: 867189 - DNA, 25 bp, Mus musculus
tgccccgcagccaggtctatgaaga

SEQ ID NO: 867190 - DNA, 25 bp, Mus musculus
tgccccgcagcctggtctatgaaga

SEQ ID NO: 867191 - DNA, 25 bp, Mus musculus
tgccccgctagacctgagagcagca

SEQ ID NO: 867192 - DNA, 25 bp, Mus musculus
tgccccgctagagctgagagcagca

SEQ ID NO: 867193 - DNA, 25 bp, Mus musculus
tgccccggccagatgtgcagccagg

SEQ ID NO: 867194 - DNA, 25 bp, Mus musculus
tgccccggccagttgtgcagccagg

SEQ ID NO: 867195 - DNA, 25 bp, Mus musculus
tgccccggccatctgattgtgtttg

SEQ ID NO: 867196 - DNA, 25 bp, Mus musculus
tgccccggccatgtgattgtgtttg

SEQ ID NO: 867197 - DNA, 25 bp, Mus musculus
tgccccgggaccatgattcaaagtt

SEQ ID NO: 867198 - DNA, 25 bp, Mus musculus
tgccccgggaccttgattcaaagtt

SEQ ID NO: 867199 - DNA, 25 bp, Mus musculus
tgccccgggcatactgtaccaacag

SEQ ID NO: 867200 - DNA, 25 bp, Mus musculus
tgccccgggcattctgtaccaacag

SEQ ID NO: 867201 - DNA, 25 bp, Mus musculus
tgccccgggcttcccagttaccact

SEQ ID NO: 867202 - DNA, 25 bp, Mus musculus
tgccccgggcttgccagttaccact

SEQ ID NO: 867203 - DNA, 25 bp, Mus musculus
tgccccggttctcactaaagcaagg

SEQ ID NO: 867204 - DNA, 25 bp, Mus musculus
tgccccggttctgactaaagcaagg

SEQ ID NO: 867205 - DNA, 25 bp, Mus musculus
tgccccgtacacctactgatgggta

SEQ ID NO: 867206 - DNA, 25 bp, Mus musculus
tgccccgtacacgtactgatgggta

SEQ ID NO: 867207 - DNA, 25 bp, Mus musculus
tgccccgtttccatttcaatcagaa

SEQ ID NO: 867208 - DNA, 25 bp, Mus musculus
tgccccgtttccttttcaatcagaa

SEQ ID NO: 867209 - DNA, 25 bp, Mus musculus
tgccccgtttgaatgctaaggttga

SEQ ID NO: 867210 - DNA, 25 bp, Mus musculus
tgccccgtttgattgctaaggttga

SEQ ID NO: 867211 - DNA, 25 bp, Mus musculus
tgccccgtttgcaagccagataagt

SEQ ID NO: 867212 - DNA, 25 bp, Mus musculus
tgccccgtttgctagccagataagt

SEQ ID NO: 867213 - DNA, 25 bp, Mus musculus
tgcccctaaaatcaccacttgtttc

SEQ ID NO: 867214 - DNA, 25 bp, Mus musculus
tgcccctaaaatgaccacttgtttc

SEQ ID NO: 867215 - DNA, 25 bp, Mus musculus
tgcccctaagccaggatcctaaaga

SEQ ID NO: 867216 - DNA, 25 bp, Mus musculus
tgcccctaagcctggatcctaaaga

SEQ ID NO: 867217 - DNA, 25 bp, Mus musculus
tgcccctacttgaacatcttagcac

SEQ ID NO: 867218 - DNA, 25 bp, Mus musculus
tgcccctacttgtacatcttagcac

SEQ ID NO: 867219 - DNA, 25 bp, Mus musculus
tgcccctagaccctcattggaagaa

SEQ ID NO: 867220 - DNA, 25 bp, Mus musculus
tgcccctagaccgtcattggaagaa

SEQ ID NO: 867221 - DNA, 25 bp, Mus musculus
tgcccctagactctgagttgcttga

SEQ ID NO: 867222 - DNA, 25 bp, Mus musculus
tgcccctagactgtgagttgcttga

SEQ ID NO: 867223 - DNA, 25 bp, Mus musculus
tgcccctagagtagagacactgtct

SEQ ID NO: 867224 - DNA, 25 bp, Mus musculus
tgcccctagagttgagacactgtct

SEQ ID NO: 867225 - DNA, 25 bp, Mus musculus
tgcccctagcttagtcacatacaca

SEQ ID NO: 867226 - DNA, 25 bp, Mus musculus
tgcccctagctttgtcacatacaca

SEQ ID NO: 867227 - DNA, 25 bp, Mus musculus
tgcccctaggcacttaaccaagaca

SEQ ID NO: 867228 - DNA, 25 bp, Mus musculus
tgcccctaggcagttaaccaagaca

SEQ ID NO: 867229 - DNA, 25 bp, Mus musculus
tgcccctatattaggagcctggaca

SEQ ID NO: 867230 - DNA, 25 bp, Mus musculus
tgcccctatatttggagcctggaca

SEQ ID NO: 867231 - DNA, 25 bp, Mus musculus
tgcccctcaacgagagccatcttga

SEQ ID NO: 867232 - DNA, 25 bp, Mus musculus
tgcccctcaacgtgagccatcttga

SEQ ID NO: 867233 - DNA, 25 bp, Mus musculus
tgcccctcaagcatccctagtgagg

SEQ ID NO: 867234 - DNA, 25 bp, Mus musculus
tgcccctcaagcttccctagtgagg

SEQ ID NO: 867235 - DNA, 25 bp, Mus musculus
tgcccctcaattacggaggctgaga

SEQ ID NO: 867236 - DNA, 25 bp, Mus musculus
tgcccctcaatttcggaggctgaga

SEQ ID NO: 867237 - DNA, 25 bp, Mus musculus
tgcccctcacacagaattactatca

SEQ ID NO: 867238 - DNA, 25 bp, Mus musculus
tgcccctcacactgaattactatca

SEQ ID NO: 867239 - DNA, 25 bp, Mus musculus
tgcccctcacatacattagtcatga

SEQ ID NO: 867240 - DNA, 25 bp, Mus musculus
tgcccctcacattcattagtcatga

SEQ ID NO: 867241 - DNA, 25 bp, Mus musculus
tgcccctcactaaatacttttagct

SEQ ID NO: 867242 - DNA, 25 bp, Mus musculus
tgcccctcactatatacttttagct

SEQ ID NO: 867243 - DNA, 25 bp, Mus musculus
tgcccctcagaacaatgatcacttt

SEQ ID NO: 867244 - DNA, 25 bp, Mus musculus
tgcccctcagaacagaacaattatg

SEQ ID NO: 867245 - DNA, 25 bp, Mus musculus
tgcccctcagaagaatgatcacttt

SEQ ID NO: 867246 - DNA, 25 bp, Mus musculus
tgcccctcagaagagaacaattatg

SEQ ID NO: 867247 - DNA, 25 bp, Mus musculus
tgcccctcagggaaagcgacacata

SEQ ID NO: 867248 - DNA, 25 bp, Mus musculus
tgcccctcagggtaagcgacacata

SEQ ID NO: 867249 - DNA, 25 bp, Mus musculus
tgcccctcagtacatccgtgtgctt

SEQ ID NO: 867250 - DNA, 25 bp, Mus musculus
tgcccctcagtacttggtcttgtaa

SEQ ID NO: 867251 - DNA, 25 bp, Mus musculus
tgcccctcagtagatccgtgtgctt

SEQ ID NO: 867252 - DNA, 25 bp, Mus musculus
tgcccctcagtagttggtcttgtaa

SEQ ID NO: 867253 - DNA, 25 bp, Mus musculus
tgcccctccactactgagatcaaat

SEQ ID NO: 867254 - DNA, 25 bp, Mus musculus
tgcccctccacttctgagatcaaat

SEQ ID NO: 867255 - DNA, 25 bp, Mus musculus
tgcccctccagcaagggacaataaa

SEQ ID NO: 867256 - DNA, 25 bp, Mus musculus
tgcccctccagctagggacaataaa

SEQ ID NO: 867257 - DNA, 25 bp, Mus musculus
tgcccctccaggctatgctgagcag

SEQ ID NO: 867258 - DNA, 25 bp, Mus musculus
tgcccctccagggtatgctgagcag

SEQ ID NO: 867259 - DNA, 25 bp, Mus musculus
tgcccctccagtcttcagggataga

SEQ ID NO: 867260 - DNA, 25 bp, Mus musculus
tgcccctccagtgttcagggataga

SEQ ID NO: 867261 - DNA, 25 bp, Mus musculus
tgcccctccataatgttgtctttga

SEQ ID NO: 867262 - DNA, 25 bp, Mus musculus
tgcccctccatattgttgtctttga

SEQ ID NO: 867263 - DNA, 25 bp, Mus musculus
tgcccctcccatagaactgtaggct

SEQ ID NO: 867264 - DNA, 25 bp, Mus musculus
tgcccctcccattgaactgtaggct

SEQ ID NO: 867265 - DNA, 25 bp, Mus musculus
tgcccctcctttataaagtcaatat

SEQ ID NO: 867266 - DNA, 25 bp, Mus musculus
tgcccctcctttttaaagtcaatat

SEQ ID NO: 867267 - DNA, 25 bp, Mus musculus
tgcccctctgctaggaagtaacaga

SEQ ID NO: 867268 - DNA, 25 bp, Mus musculus
tgcccctctgcttggaagtaacaga

SEQ ID NO: 867269 - DNA, 25 bp, Mus musculus
tgcccctctggcactgaggacttag

SEQ ID NO: 867270 - DNA, 25 bp, Mus musculus
tgcccctctggctctgaggacttag

SEQ ID NO: 867271 - DNA, 25 bp, Mus musculus
tgcccctgacacatggacagctgat

SEQ ID NO: 867272 - DNA, 25 bp, Mus musculus
tgcccctgacacttggacagctgat

SEQ ID NO: 867273 - DNA, 25 bp, Mus musculus
tgcccctgacataaaatccttggtg

SEQ ID NO: 867274 - DNA, 25 bp, Mus musculus
tgcccctgacattaaatccttggtg

SEQ ID NO: 867275 - DNA, 25 bp, Mus musculus
tgcccctgaccaagcgtgaggaggt

SEQ ID NO: 867276 - DNA, 25 bp, Mus musculus
tgcccctgaccatgcgtgaggaggt

SEQ ID NO: 867277 - DNA, 25 bp, Mus musculus
tgcccctgacctcgtgaagttccaa

SEQ ID NO: 867278 - DNA, 25 bp, Mus musculus
tgcccctgacctggtgaagttccaa

SEQ ID NO: 867279 - DNA, 25 bp, Mus musculus
tgcccctgagatcccaagcttctaa

SEQ ID NO: 867280 - DNA, 25 bp, Mus musculus
tgcccctgagatgccaagcttctaa

SEQ ID NO: 867281 - DNA, 25 bp, Mus musculus
tgcccctgatctctcaattcctgga

SEQ ID NO: 867282 - DNA, 25 bp, Mus musculus
tgcccctgatctgtcaattcctgga

SEQ ID NO: 867283 - DNA, 25 bp, Mus musculus
tgcccctgatggagtctcatatgca

SEQ ID NO: 867284 - DNA, 25 bp, Mus musculus
tgcccctgatggtgtctcatatgca

SEQ ID NO: 867285 - DNA, 25 bp, Mus musculus
tgcccctgcagactcatgtgtgttt

SEQ ID NO: 867286 - DNA, 25 bp, Mus musculus
tgcccctgcagagtcatgtgtgttt

SEQ ID NO: 867287 - DNA, 25 bp, Mus musculus
tgcccctgcctgaagtggcgcgcga

SEQ ID NO: 867288 - DNA, 25 bp, Mus musculus
tgcccctgcctgtagtggcgcgcga

SEQ ID NO: 867289 - DNA, 25 bp, Mus musculus
tgcccctgcgctcagattcagttct

SEQ ID NO: 867290 - DNA, 25 bp, Mus musculus
tgcccctgcgctgagattcagttct

SEQ ID NO: 867291 - DNA, 25 bp, Mus musculus
tgcccctgctgtatcataaccggaa

SEQ ID NO: 867292 - DNA, 25 bp, Mus musculus
tgcccctgctgtttcataaccggaa

SEQ ID NO: 867293 - DNA, 25 bp, Mus musculus
tgcccctgcttgctagcgggaactg

SEQ ID NO: 867294 - DNA, 25 bp, Mus musculus
tgcccctgcttggtagcgggaactg

SEQ ID NO: 867295 - DNA, 25 bp, Mus musculus
tgcccctggcggcttatccaatgtc

SEQ ID NO: 867296 - DNA, 25 bp, Mus musculus
tgcccctggcgggttatccaatgtc

SEQ ID NO: 867297 - DNA, 25 bp, Mus musculus
tgcccctgggacaggcagttcctga

SEQ ID NO: 867298 - DNA, 25 bp, Mus musculus
tgcccctgggactggcagttcctga

SEQ ID NO: 867299 - DNA, 25 bp, Mus musculus
tgcccctgtactatggagagccaga

SEQ ID NO: 867300 - DNA, 25 bp, Mus musculus
tgcccctgtactttggagagccaga

SEQ ID NO: 867301 - DNA, 25 bp, Mus musculus
tgcccctgtgagaagaacgaataat

SEQ ID NO: 867302 - DNA, 25 bp, Mus musculus
tgcccctgtgagtagaacgaataat

SEQ ID NO: 867303 - DNA, 25 bp, Mus musculus
tgcccctgtgctagtttctataact

SEQ ID NO: 867304 - DNA, 25 bp, Mus musculus
tgcccctgtgcttgtttctataact

SEQ ID NO: 867305 - DNA, 25 bp, Mus musculus
tgcccctgtggaagtctgttactgc

SEQ ID NO: 867306 - DNA, 25 bp, Mus musculus
tgcccctgtggatgtctgttactgc

SEQ ID NO: 867307 - DNA, 25 bp, Mus musculus
tgcccctgtgggacccgaaggaaca

SEQ ID NO: 867308 - DNA, 25 bp, Mus musculus
tgcccctgtgggtcccgaaggaaca

SEQ ID NO: 867309 - DNA, 25 bp, Mus musculus
tgcccctgtgttaggttcctgcaaa

SEQ ID NO: 867310 - DNA, 25 bp, Mus musculus
tgcccctgtgttctggaaccaaaga

SEQ ID NO: 867311 - DNA, 25 bp, Mus musculus
tgcccctgtgttgtggaaccaaaga

SEQ ID NO: 867312 - DNA, 25 bp, Mus musculus
tgcccctgtgtttggttcctgcaaa

SEQ ID NO: 867313 - DNA, 25 bp, Mus musculus
tgcccctgttcaaaattccagcttt

SEQ ID NO: 867314 - DNA, 25 bp, Mus musculus
tgcccctgttcataattccagcttt

SEQ ID NO: 867315 - DNA, 25 bp, Mus musculus
tgccccttacccagctgttctgctt

SEQ ID NO: 867316 - DNA, 25 bp, Mus musculus
tgccccttaccctgctgttctgctt

SEQ ID NO: 867317 - DNA, 25 bp, Mus musculus
tgccccttactgaatcctagtggat

SEQ ID NO: 867318 - DNA, 25 bp, Mus musculus
tgccccttactgtatcctagtggat

SEQ ID NO: 867319 - DNA, 25 bp, Mus musculus
tgccccttaggcaaaacccaggaat

SEQ ID NO: 867320 - DNA, 25 bp, Mus musculus
tgccccttaggctaaacccaggaat

SEQ ID NO: 867321 - DNA, 25 bp, Mus musculus
tgccccttatgtacacatgcgtgta

SEQ ID NO: 867322 - DNA, 25 bp, Mus musculus
tgccccttatgttcacatgcgtgta

SEQ ID NO: 867323 - DNA, 25 bp, Mus musculus
tgccccttccccaattaataaatgt

SEQ ID NO: 867324 - DNA, 25 bp, Mus musculus
tgccccttcccctattaataaatgt

SEQ ID NO: 867325 - DNA, 25 bp, Mus musculus
tgccccttcgatcgcatgggcagag

SEQ ID NO: 867326 - DNA, 25 bp, Mus musculus
tgccccttcgatggcatgggcagag

SEQ ID NO: 867327 - DNA, 25 bp, Mus musculus
tgccccttctctatggccacagaaa

SEQ ID NO: 867328 - DNA, 25 bp, Mus musculus
tgccccttctctttggccacagaaa

SEQ ID NO: 867329 - DNA, 25 bp, Mus musculus
tgccccttgaatccacagtgctctg

SEQ ID NO: 867330 - DNA, 25 bp, Mus musculus
tgccccttgaatgcacagtgctctg

SEQ ID NO: 867331 - DNA, 25 bp, Mus musculus
tgccccttgatgagtgatgtcacca

SEQ ID NO: 867332 - DNA, 25 bp, Mus musculus
tgccccttgatgtgtgatgtcacca

SEQ ID NO: 867333 - DNA, 25 bp, Mus musculus
tgccccttggatccaccggagagat

SEQ ID NO: 867334 - DNA, 25 bp, Mus musculus
tgccccttggatgcaccggagagat

SEQ ID NO: 867335 - DNA, 25 bp, Mus musculus
tgccccttgggcatgtttctactga

SEQ ID NO: 867336 - DNA, 25 bp, Mus musculus
tgccccttgggcttgtttctactga

SEQ ID NO: 867337 - DNA, 25 bp, Mus musculus
tgccccttgtcaacatgcagtcttt

SEQ ID NO: 867338 - DNA, 25 bp, Mus musculus
tgccccttgtcaatgctgttctaga

SEQ ID NO: 867339 - DNA, 25 bp, Mus musculus
tgccccttgtcatcatgcagtcttt

SEQ ID NO: 867340 - DNA, 25 bp, Mus musculus
tgccccttgtcattgctgttctaga

SEQ ID NO: 867341 - DNA, 25 bp, Mus musculus
tgcccctttaggactccttgtgaaa

SEQ ID NO: 867342 - DNA, 25 bp, Mus musculus
tgcccctttaggtctccttgtgaaa

SEQ ID NO: 867343 - DNA, 25 bp, Mus musculus
tgcccctttctcattatataaactt

SEQ ID NO: 867344 - DNA, 25 bp, Mus musculus
tgcccctttctctttatataaactt

SEQ ID NO: 867345 - DNA, 25 bp, Mus musculus
tgcccctttgtacctccgagtaggg

SEQ ID NO: 867346 - DNA, 25 bp, Mus musculus
tgcccctttgtagctccgagtaggg

SEQ ID NO: 867347 - DNA, 25 bp, Mus musculus
tgcccctttgtccagctaatggaga

SEQ ID NO: 867348 - DNA, 25 bp, Mus musculus
tgcccctttgtccttatacctaaat

SEQ ID NO: 867349 - DNA, 25 bp, Mus musculus
tgcccctttgtcgagctaatggaga

SEQ ID NO: 867350 - DNA, 25 bp, Mus musculus
tgcccctttgtcgttatacctaaat

SEQ ID NO: 867351 - DNA, 25 bp, Mus musculus
tgccccttttccagacatttgcata

SEQ ID NO: 867352 - DNA, 25 bp, Mus musculus
tgccccttttcctgacatttgcata

SEQ ID NO: 867353 - DNA, 25 bp, Mus musculus
tgcccgaagatccaagtccaagtcc

SEQ ID NO: 867354 - DNA, 25 bp, Mus musculus
tgcccgaagatcgaagtccaagtcc

SEQ ID NO: 867355 - DNA, 25 bp, Mus musculus
tgcccgaccctgagtttgagagtat

SEQ ID NO: 867356 - DNA, 25 bp, Mus musculus
tgcccgaccctgtgtttgagagtat

SEQ ID NO: 867357 - DNA, 25 bp, Mus musculus
tgcccgacctgcaggtcattgcaga

SEQ ID NO: 867358 - DNA, 25 bp, Mus musculus
tgcccgacctgctggtcattgcaga

SEQ ID NO: 867359 - DNA, 25 bp, Mus musculus
tgcccgacgggaatgtcatttacat

SEQ ID NO: 867360 - DNA, 25 bp, Mus musculus
tgcccgacgggattgtcatttacat

SEQ ID NO: 867361 - DNA, 25 bp, Mus musculus
tgcccgacggtaaacagtgcccatg

SEQ ID NO: 867362 - DNA, 25 bp, Mus musculus
tgcccgacggtatacagtgcccatg

SEQ ID NO: 867363 - DNA, 25 bp, Mus musculus
tgcccgactcacagtcacaaaggtg

SEQ ID NO: 867364 - DNA, 25 bp, Mus musculus
tgcccgactcactgtcacaaaggtg

SEQ ID NO: 867365 - DNA, 25 bp, Mus musculus
tgcccgactttgaactggttactgc

SEQ ID NO: 867366 - DNA, 25 bp, Mus musculus
tgcccgactttgtactggttactgc

SEQ ID NO: 867367 - DNA, 25 bp, Mus musculus
tgcccgagatgcagttggtgcccaa

SEQ ID NO: 867368 - DNA, 25 bp, Mus musculus
tgcccgagatgctgttggtgcccaa

SEQ ID NO: 867369 - DNA, 25 bp, Mus musculus
tgcccgagcaaaatgaggacaccga

SEQ ID NO: 867370 - DNA, 25 bp, Mus musculus
tgcccgagcaaattgaggacaccga

SEQ ID NO: 867371 - DNA, 25 bp, Mus musculus
tgcccgagctgtccggaatcaccag

SEQ ID NO: 867372 - DNA, 25 bp, Mus musculus
tgcccgagctgtgcggaatcaccag

SEQ ID NO: 867373 - DNA, 25 bp, Mus musculus
tgcccgaggacacatacgccacgat

SEQ ID NO: 867374 - DNA, 25 bp, Mus musculus
tgcccgaggacagatacgccacgat

SEQ ID NO: 867375 - DNA, 25 bp, Mus musculus
tgcccgaggagcaggtactgaacgc

SEQ ID NO: 867376 - DNA, 25 bp, Mus musculus
tgcccgaggagctggtactgaacgc

SEQ ID NO: 867377 - DNA, 25 bp, Mus musculus
tgcccgagtagcatacagggccttt

SEQ ID NO: 867378 - DNA, 25 bp, Mus musculus
tgcccgagtagcttacagggccttt

SEQ ID NO: 867379 - DNA, 25 bp, Mus musculus
tgcccgatacacagcgctagataaa

SEQ ID NO: 867380 - DNA, 25 bp, Mus musculus
tgcccgatacactgcgctagataaa

SEQ ID NO: 867381 - DNA, 25 bp, Mus musculus
tgcccgatctctcagtgagttgcaa

SEQ ID NO: 867382 - DNA, 25 bp, Mus musculus
tgcccgatctctgagtgagttgcaa

SEQ ID NO: 867383 - DNA, 25 bp, Mus musculus
tgcccgattttaagcgctacagcaa

SEQ ID NO: 867384 - DNA, 25 bp, Mus musculus
tgcccgattttatgcgctacagcaa

SEQ ID NO: 867385 - DNA, 25 bp, Mus musculus
tgcccgcaaaccaggagtcagttta

SEQ ID NO: 867386 - DNA, 25 bp, Mus musculus
tgcccgcaaacctggagtcagttta

SEQ ID NO: 867387 - DNA, 25 bp, Mus musculus
tgcccgccagtcatcgatacagaaa

SEQ ID NO: 867388 - DNA, 25 bp, Mus musculus
tgcccgccagtcttcgatacagaaa

SEQ ID NO: 867389 - DNA, 25 bp, Mus musculus
tgcccgccagtgacagcaagtagat

SEQ ID NO: 867390 - DNA, 25 bp, Mus musculus
tgcccgccagtgtcagcaagtagat

SEQ ID NO: 867391 - DNA, 25 bp, Mus musculus
tgcccgccgcgcattcgtgggtttt

SEQ ID NO: 867392 - DNA, 25 bp, Mus musculus
tgcccgccgcgctttcgtgggtttt

SEQ ID NO: 867393 - DNA, 25 bp, Mus musculus
tgcccgcctggcaagtttttaatac

SEQ ID NO: 867394 - DNA, 25 bp, Mus musculus
tgcccgcctggctagtttttaatac

SEQ ID NO: 867395 - DNA, 25 bp, Mus musculus
tgcccgcgggcaaaatgaaccaccg

SEQ ID NO: 867396 - DNA, 25 bp, Mus musculus
tgcccgcgggcataatgaaccaccg

SEQ ID NO: 867397 - DNA, 25 bp, Mus musculus
tgcccgcgggtgagtttccttttga

SEQ ID NO: 867398 - DNA, 25 bp, Mus musculus
tgcccgcgggtgtgtttccttttga

SEQ ID NO: 867399 - DNA, 25 bp, Mus musculus
tgcccgctctgaatgaagaagaact

SEQ ID NO: 867400 - DNA, 25 bp, Mus musculus
tgcccgctctgattgaagaagaact

SEQ ID NO: 867401 - DNA, 25 bp, Mus musculus
tgcccgctgaggctttggttatttc

SEQ ID NO: 867402 - DNA, 25 bp, Mus musculus
tgcccgctgagggtttggttatttc

SEQ ID NO: 867403 - DNA, 25 bp, Mus musculus
tgcccgctgcagatggatctgacac

SEQ ID NO: 867404 - DNA, 25 bp, Mus musculus
tgcccgctgcagttggatctgacac

SEQ ID NO: 867405 - DNA, 25 bp, Mus musculus
tgcccgctgctaaaaaggtctctga

SEQ ID NO: 867406 - DNA, 25 bp, Mus musculus
tgcccgctgctataaaggtctctga

SEQ ID NO: 867407 - DNA, 25 bp, Mus musculus
tgcccgctggctatatagggtagct

SEQ ID NO: 867408 - DNA, 25 bp, Mus musculus
tgcccgctggctttatagggtagct

SEQ ID NO: 867409 - DNA, 25 bp, Mus musculus
tgcccgctgggcacctgcatgatga

SEQ ID NO: 867410 - DNA, 25 bp, Mus musculus
tgcccgctgggctcctgcatgatga

SEQ ID NO: 867411 - DNA, 25 bp, Mus musculus
tgcccggaaggtcccagagtcttta

SEQ ID NO: 867412 - DNA, 25 bp, Mus musculus
tgcccggaaggtgccagagtcttta

SEQ ID NO: 867413 - DNA, 25 bp, Mus musculus
tgcccggaattcagatcaagaagga

SEQ ID NO: 867414 - DNA, 25 bp, Mus musculus
tgcccggaattctgatcaagaagga

SEQ ID NO: 867415 - DNA, 25 bp, Mus musculus
tgcccggacactcgagatcccttta

SEQ ID NO: 867416 - DNA, 25 bp, Mus musculus
tgcccggacactggagatcccttta

SEQ ID NO: 867417 - DNA, 25 bp, Mus musculus
tgcccggagacaccttgaatacttg

SEQ ID NO: 867418 - DNA, 25 bp, Mus musculus
tgcccggagacagcttgaatacttg

SEQ ID NO: 867419 - DNA, 25 bp, Mus musculus
tgcccggagtgccctgacatcctgt

SEQ ID NO: 867420 - DNA, 25 bp, Mus musculus
tgcccggagtgcgctgacatcctgt

SEQ ID NO: 867421 - DNA, 25 bp, Mus musculus
tgcccggagtgtcccgatgactgct

SEQ ID NO: 867422 - DNA, 25 bp, Mus musculus
tgcccggagtgtgccgatgactgct

SEQ ID NO: 867423 - DNA, 25 bp, Mus musculus
tgcccggatggcagcagtagttcta

SEQ ID NO: 867424 - DNA, 25 bp, Mus musculus
tgcccggatggctgcagtagttcta

SEQ ID NO: 867425 - DNA, 25 bp, Mus musculus
tgcccggattgacgctatgccccaa

SEQ ID NO: 867426 - DNA, 25 bp, Mus musculus
tgcccggattgaggctatgccccaa

SEQ ID NO: 867427 - DNA, 25 bp, Mus musculus
tgcccggcacagattccttaagcaa

SEQ ID NO: 867428 - DNA, 25 bp, Mus musculus
tgcccggcacagtttccttaagcaa

SEQ ID NO: 867429 - DNA, 25 bp, Mus musculus
tgcccggcacatattcattcactat

SEQ ID NO: 867430 - DNA, 25 bp, Mus musculus
tgcccggcacattttcattcactat

SEQ ID NO: 867431 - DNA, 25 bp, Mus musculus
tgcccggcacttcgcctttttctta

SEQ ID NO: 867432 - DNA, 25 bp, Mus musculus
tgcccggcacttggcctttttctta

SEQ ID NO: 867433 - DNA, 25 bp, Mus musculus
tgcccggcagaacagctcagacaaa

SEQ ID NO: 867434 - DNA, 25 bp, Mus musculus
tgcccggcagaagagctcagacaaa

SEQ ID NO: 867435 - DNA, 25 bp, Mus musculus
tgcccggcagacattttcatttcaa

SEQ ID NO: 867436 - DNA, 25 bp, Mus musculus
tgcccggcagactttttcatttcaa

SEQ ID NO: 867437 - DNA, 25 bp, Mus musculus
tgcccggcccgcagatcatttttat

SEQ ID NO: 867438 - DNA, 25 bp, Mus musculus
tgcccggcccgctgatcatttttat

SEQ ID NO: 867439 - DNA, 25 bp, Mus musculus
tgcccggcccttatataattatttg

SEQ ID NO: 867440 - DNA, 25 bp, Mus musculus
tgcccggcccttttataattatttg

SEQ ID NO: 867441 - DNA, 25 bp, Mus musculus
tgcccggcctctacctagaggtaat

SEQ ID NO: 867442 - DNA, 25 bp, Mus musculus
tgcccggcctcttcctagaggtaat

SEQ ID NO: 867443 - DNA, 25 bp, Mus musculus
tgcccggcggtcatttgtattttaa

SEQ ID NO: 867444 - DNA, 25 bp, Mus musculus
tgcccggcggtcttttgtattttaa

SEQ ID NO: 867445 - DNA, 25 bp, Mus musculus
tgcccggctaggaaccatttcattt

SEQ ID NO: 867446 - DNA, 25 bp, Mus musculus
tgcccggctaggtaccatttcattt

SEQ ID NO: 867447 - DNA, 25 bp, Mus musculus
tgcccggctccaaacgtatcaagca

SEQ ID NO: 867448 - DNA, 25 bp, Mus musculus
tgcccggctccatacgtatcaagca

SEQ ID NO: 867449 - DNA, 25 bp, Mus musculus
tgcccggctgacagcaggttcttaa

SEQ ID NO: 867450 - DNA, 25 bp, Mus musculus
tgcccggctgactgcaggttcttaa

SEQ ID NO: 867451 - DNA, 25 bp, Mus musculus
tgcccggctgccagaaagcacagat

SEQ ID NO: 867452 - DNA, 25 bp, Mus musculus
tgcccggctgcctgaaagcacagat

SEQ ID NO: 867453 - DNA, 25 bp, Mus musculus
tgcccggcttcaatatttatatttg

SEQ ID NO: 867454 - DNA, 25 bp, Mus musculus
tgcccggcttcattatttatatttg

SEQ ID NO: 867455 - DNA, 25 bp, Mus musculus
tgcccggcttcccatgtgtaacagc

SEQ ID NO: 867456 - DNA, 25 bp, Mus musculus
tgcccggcttccgatgtgtaacagc

SEQ ID NO: 867457 - DNA, 25 bp, Mus musculus
tgcccgggagagactgtctgagatc

SEQ ID NO: 867458 - DNA, 25 bp, Mus musculus
tgcccgggagagtctgtctgagatc

SEQ ID NO: 867459 - DNA, 25 bp, Mus musculus
tgcccgggcaacaggctgaatcaag

SEQ ID NO: 867460 - DNA, 25 bp, Mus musculus
tgcccgggcaactggctgaatcaag

SEQ ID NO: 867461 - DNA, 25 bp, Mus musculus
tgcccgggccaaaaacgtgcaggaa

SEQ ID NO: 867462 - DNA, 25 bp, Mus musculus
tgcccgggccaataacgtgcaggaa

SEQ ID NO: 867463 - DNA, 25 bp, Mus musculus
tgcccgggcggcaaggtttggaatt

SEQ ID NO: 867464 - DNA, 25 bp, Mus musculus
tgcccgggcggctaggtttggaatt

SEQ ID NO: 867465 - DNA, 25 bp, Mus musculus
tgcccgggtcatcatcgagaagtac

SEQ ID NO: 867466 - DNA, 25 bp, Mus musculus
tgcccgggtcatgatcgagaagtac

SEQ ID NO: 867467 - DNA, 25 bp, Mus musculus
tgcccgggtcggacttgaacttgta

SEQ ID NO: 867468 - DNA, 25 bp, Mus musculus
tgcccgggtcggtcttgaacttgta

SEQ ID NO: 867469 - DNA, 25 bp, Mus musculus
tgcccggtcaaactagaacattctt

SEQ ID NO: 867470 - DNA, 25 bp, Mus musculus
tgcccggtcaaagtagaacattctt

SEQ ID NO: 867471 - DNA, 25 bp, Mus musculus
tgcccggtctacagatgttgcagct

SEQ ID NO: 867472 - DNA, 25 bp, Mus musculus
tgcccggtctactgatgttgcagct

SEQ ID NO: 867473 - DNA, 25 bp, Mus musculus
tgcccggtcttacgaaactactaat

SEQ ID NO: 867474 - DNA, 25 bp, Mus musculus
tgcccggtcttaggaaactactaat

SEQ ID NO: 867475 - DNA, 25 bp, Mus musculus
tgcccggtgtcaattaaaagtggtt

SEQ ID NO: 867476 - DNA, 25 bp, Mus musculus
tgcccggtgtcatttaaaagtggtt

SEQ ID NO: 867477 - DNA, 25 bp, Mus musculus
tgcccggttggcaaggccttgtaag

SEQ ID NO: 867478 - DNA, 25 bp, Mus musculus
tgcccggttggctaggccttgtaag

SEQ ID NO: 867479 - DNA, 25 bp, Mus musculus
tgcccggttttgaacacttacttct

SEQ ID NO: 867480 - DNA, 25 bp, Mus musculus
tgcccggttttgtacacttacttct

SEQ ID NO: 867481 - DNA, 25 bp, Mus musculus
tgcccgtaatgccagcatgctggag

SEQ ID NO: 867482 - DNA, 25 bp, Mus musculus
tgcccgtaatgcgagcatgctggag

SEQ ID NO: 867483 - DNA, 25 bp, Mus musculus
tgcccgtagatgattttcctcattt

SEQ ID NO: 867484 - DNA, 25 bp, Mus musculus
tgcccgtagatgtttttcctcattt

SEQ ID NO: 867485 - DNA, 25 bp, Mus musculus
tgcccgtatgtactgggtcatactc

SEQ ID NO: 867486 - DNA, 25 bp, Mus musculus
tgcccgtatgtagtgggtcatactc

SEQ ID NO: 867487 - DNA, 25 bp, Mus musculus
tgcccgtcctgcacttcaatatgaa

SEQ ID NO: 867488 - DNA, 25 bp, Mus musculus
tgcccgtcctgctcttcaatatgaa

SEQ ID NO: 867489 - DNA, 25 bp, Mus musculus
tgcccgtcctggagatccaaaggat

SEQ ID NO: 867490 - DNA, 25 bp, Mus musculus
tgcccgtcctggtgatccaaaggat

SEQ ID NO: 867491 - DNA, 25 bp, Mus musculus
tgcccgtcctgtagcagaaatgaaa

SEQ ID NO: 867492 - DNA, 25 bp, Mus musculus
tgcccgtcctgttgcagaaatgaaa

SEQ ID NO: 867493 - DNA, 25 bp, Mus musculus
tgcccgtccttacccagggaccttg

SEQ ID NO: 867494 - DNA, 25 bp, Mus musculus
tgcccgtccttagccagggaccttg

SEQ ID NO: 867495 - DNA, 25 bp, Mus musculus
tgcccgtctccactgtcctcatgtt

SEQ ID NO: 867496 - DNA, 25 bp, Mus musculus
tgcccgtctccagtgtcctcatgtt

SEQ ID NO: 867497 - DNA, 25 bp, Mus musculus
tgcccgtctgacatggcctcaaagc

SEQ ID NO: 867498 - DNA, 25 bp, Mus musculus
tgcccgtctgacttggcctcaaagc

SEQ ID NO: 867499 - DNA, 25 bp, Mus musculus
tgcccgtctttgacagaggtcagcc

SEQ ID NO: 867500 - DNA, 25 bp, Mus musculus
tgcccgtctttgtcagaggtcagcc

SEQ ID NO: 867501 - DNA, 25 bp, Mus musculus
tgcccgtgaaggctggcgattaact

SEQ ID NO: 867502 - DNA, 25 bp, Mus musculus
tgcccgtgaagggtggcgattaact

SEQ ID NO: 867503 - DNA, 25 bp, Mus musculus
tgcccgtgagggctttgttttttct

SEQ ID NO: 867504 - DNA, 25 bp, Mus musculus
tgcccgtgaggggtttgttttttct

SEQ ID NO: 867505 - DNA, 25 bp, Mus musculus
tgcccgtgagtcacagcagataatg

SEQ ID NO: 867506 - DNA, 25 bp, Mus musculus
tgcccgtgagtctcagcagataatg

SEQ ID NO: 867507 - DNA, 25 bp, Mus musculus
tgcccgtgtttaaggttcatttaga

SEQ ID NO: 867508 - DNA, 25 bp, Mus musculus
tgcccgtgtttatggttcatttaga

SEQ ID NO: 867509 - DNA, 25 bp, Mus musculus
tgcccgttaatacttgactctggtt

SEQ ID NO: 867510 - DNA, 25 bp, Mus musculus
tgcccgttaatagttgactctggtt

SEQ ID NO: 867511 - DNA, 25 bp, Mus musculus
tgcccgttcatcactactagttcat

SEQ ID NO: 867512 - DNA, 25 bp, Mus musculus
tgcccgttcatctctactagttcat

SEQ ID NO: 867513 - DNA, 25 bp, Mus musculus
tgcccgtttccgattagagcagtta

SEQ ID NO: 867514 - DNA, 25 bp, Mus musculus
tgcccgtttccgtttagagcagtta

SEQ ID NO: 867515 - DNA, 25 bp, Mus musculus
tgcccgttttagaggtcagctgtaa

SEQ ID NO: 867516 - DNA, 25 bp, Mus musculus
tgcccgttttagtggtcagctgtaa

SEQ ID NO: 867517 - DNA, 25 bp, Mus musculus
tgcccgtttttcactgccaaagtgg

SEQ ID NO: 867518 - DNA, 25 bp, Mus musculus
tgcccgtttttctctgccaaagtgg

SEQ ID NO: 867519 - DNA, 25 bp, Mus musculus
tgccctaaaataaaagatcaagtat

SEQ ID NO: 867520 - DNA, 25 bp, Mus musculus
tgccctaaaatataagatcaagtat

SEQ ID NO: 867521 - DNA, 25 bp, Mus musculus
tgccctaaaatcatatgcctgaccc

SEQ ID NO: 867522 - DNA, 25 bp, Mus musculus
tgccctaaaatcttatgcctgaccc

SEQ ID NO: 867523 - DNA, 25 bp, Mus musculus
tgccctaaagaaacaaatatgtcag

SEQ ID NO: 867524 - DNA, 25 bp, Mus musculus
tgccctaaagaatcaaatatgtcag

SEQ ID NO: 867525 - DNA, 25 bp, Mus musculus
tgccctaaatgaacacctttctcca

SEQ ID NO: 867526 - DNA, 25 bp, Mus musculus
tgccctaaatgatcacctttctcca

SEQ ID NO: 867527 - DNA, 25 bp, Mus musculus
tgccctaagaggatggctttgccca

SEQ ID NO: 867528 - DNA, 25 bp, Mus musculus
tgccctaagaggttggctttgccca

SEQ ID NO: 867529 - DNA, 25 bp, Mus musculus
tgccctaagcaacaaagtgcctttc

SEQ ID NO: 867530 - DNA, 25 bp, Mus musculus
tgccctaagcaagaaagtgcctttc

SEQ ID NO: 867531 - DNA, 25 bp, Mus musculus
tgccctaagccccttgtagatcctt

SEQ ID NO: 867532 - DNA, 25 bp, Mus musculus
tgccctaagcccgttgtagatcctt

SEQ ID NO: 867533 - DNA, 25 bp, Mus musculus
tgccctaagcttcccattgttaagg

SEQ ID NO: 867534 - DNA, 25 bp, Mus musculus
tgccctaagcttgccattgttaagg

SEQ ID NO: 867535 - DNA, 25 bp, Mus musculus
tgccctaagttgacagcccaacaga

SEQ ID NO: 867536 - DNA, 25 bp, Mus musculus
tgccctaagttgtcagcccaacaga

SEQ ID NO: 867537 - DNA, 25 bp, Mus musculus
tgccctaatgggatgtctcaaaaag

SEQ ID NO: 867538 - DNA, 25 bp, Mus musculus
tgccctaatgggttgtctcaaaaag

SEQ ID NO: 867539 - DNA, 25 bp, Mus musculus
tgccctacagaaacctccagttggt

SEQ ID NO: 867540 - DNA, 25 bp, Mus musculus
tgccctacagaatcctccagttggt

SEQ ID NO: 867541 - DNA, 25 bp, Mus musculus
tgccctacagacctaattccaactg

SEQ ID NO: 867542 - DNA, 25 bp, Mus musculus
tgccctacagacgtaattccaactg

SEQ ID NO: 867543 - DNA, 25 bp, Mus musculus
tgccctacaggaaaagcctgagcct

SEQ ID NO: 867544 - DNA, 25 bp, Mus musculus
tgccctacaggataagcctgagcct

SEQ ID NO: 867545 - DNA, 25 bp, Mus musculus
tgccctacagggatccatagcaaca

SEQ ID NO: 867546 - DNA, 25 bp, Mus musculus
tgccctacagggttccatagcaaca

SEQ ID NO: 867547 - DNA, 25 bp, Mus musculus
tgccctacagtcagggagtctgaaa

SEQ ID NO: 867548 - DNA, 25 bp, Mus musculus
tgccctacagtctgggagtctgaaa

SEQ ID NO: 867549 - DNA, 25 bp, Mus musculus
tgccctacattcctgatgtggccaa

SEQ ID NO: 867550 - DNA, 25 bp, Mus musculus
tgccctacattcgtgatgtggccaa

SEQ ID NO: 867551 - DNA, 25 bp, Mus musculus
tgccctaccaggaccttagtgatag

SEQ ID NO: 867552 - DNA, 25 bp, Mus musculus
tgccctaccaggatgcccggaagtg

SEQ ID NO: 867553 - DNA, 25 bp, Mus musculus
tgccctaccaggtccttagtgatag

SEQ ID NO: 867554 - DNA, 25 bp, Mus musculus
tgccctaccaggttgcccggaagtg

SEQ ID NO: 867555 - DNA, 25 bp, Mus musculus
tgccctacccagctggaatggaaca

SEQ ID NO: 867556 - DNA, 25 bp, Mus musculus
tgccctacccaggtggaatggaaca

SEQ ID NO: 867557 - DNA, 25 bp, Mus musculus
tgccctacctctcgactttaaagtt

SEQ ID NO: 867558 - DNA, 25 bp, Mus musculus
tgccctacctctggactttaaagtt

SEQ ID NO: 867559 - DNA, 25 bp, Mus musculus
tgccctacctggacatggtgcgaga

SEQ ID NO: 867560 - DNA, 25 bp, Mus musculus
tgccctacctggtcatggtgcgaga

SEQ ID NO: 867561 - DNA, 25 bp, Mus musculus
tgccctacctgtcgaggatgctgca

SEQ ID NO: 867562 - DNA, 25 bp, Mus musculus
tgccctacctgtggaggatgctgca

SEQ ID NO: 867563 - DNA, 25 bp, Mus musculus
tgccctaccttgaagccatttacaa

SEQ ID NO: 867564 - DNA, 25 bp, Mus musculus
tgccctaccttgtagccatttacaa

SEQ ID NO: 867565 - DNA, 25 bp, Mus musculus
tgccctactaggatctaactgatgc

SEQ ID NO: 867566 - DNA, 25 bp, Mus musculus
tgccctactaggttctaactgatgc

SEQ ID NO: 867567 - DNA, 25 bp, Mus musculus
tgccctagagggagagtgctcagaa

SEQ ID NO: 867568 - DNA, 25 bp, Mus musculus
tgccctagagggtgagtgctcagaa

SEQ ID NO: 867569 - DNA, 25 bp, Mus musculus
tgccctagagtcagtgatcttgtca

SEQ ID NO: 867570 - DNA, 25 bp, Mus musculus
tgccctagagtctgtgatcttgtca

SEQ ID NO: 867571 - DNA, 25 bp, Mus musculus
tgccctagcaccatccggaagtttt

SEQ ID NO: 867572 - DNA, 25 bp, Mus musculus
tgccctagcaccttccggaagtttt

SEQ ID NO: 867573 - DNA, 25 bp, Mus musculus
tgccctagcagaagaccagagatat

SEQ ID NO: 867574 - DNA, 25 bp, Mus musculus
tgccctagcagatgaccagagatat

SEQ ID NO: 867575 - DNA, 25 bp, Mus musculus
tgccctagccaaaaattcatgttgt

SEQ ID NO: 867576 - DNA, 25 bp, Mus musculus
tgccctagccaataattcatgttgt

SEQ ID NO: 867577 - DNA, 25 bp, Mus musculus
tgccctagctatcgcttacacattc

SEQ ID NO: 867578 - DNA, 25 bp, Mus musculus
tgccctagctatggcttacacattc

SEQ ID NO: 867579 - DNA, 25 bp, Mus musculus
tgccctagctcaagtgaaatttttg

SEQ ID NO: 867580 - DNA, 25 bp, Mus musculus
tgccctagctcatgtgaaatttttg

SEQ ID NO: 867581 - DNA, 25 bp, Mus musculus
tgccctaggacacagccgggagcat

SEQ ID NO: 867582 - DNA, 25 bp, Mus musculus
tgccctaggacagagccgggagcat

SEQ ID NO: 867583 - DNA, 25 bp, Mus musculus
tgccctaggaccctcagtagttgga

SEQ ID NO: 867584 - DNA, 25 bp, Mus musculus
tgccctaggaccgtcagtagttgga

SEQ ID NO: 867585 - DNA, 25 bp, Mus musculus
tgccctaggcacaattgctgctgga

SEQ ID NO: 867586 - DNA, 25 bp, Mus musculus
tgccctaggcactattgctgctgga

SEQ ID NO: 867587 - DNA, 25 bp, Mus musculus
tgccctaggctcctgcaaaaaagat

SEQ ID NO: 867588 - DNA, 25 bp, Mus musculus
tgccctaggctcgtgcaaaaaagat

SEQ ID NO: 867589 - DNA, 25 bp, Mus musculus
tgccctagtggtctgaagtgttttc

SEQ ID NO: 867590 - DNA, 25 bp, Mus musculus
tgccctagtggtgtgaagtgttttc

SEQ ID NO: 867591 - DNA, 25 bp, Mus musculus
tgccctagttgcctctcagcaggtg

SEQ ID NO: 867592 - DNA, 25 bp, Mus musculus
tgccctagttgcgtctcagcaggtg

SEQ ID NO: 867593 - DNA, 25 bp, Mus musculus
tgccctatacatatgctcttcctat

SEQ ID NO: 867594 - DNA, 25 bp, Mus musculus
tgccctatacatttgctcttcctat

SEQ ID NO: 867595 - DNA, 25 bp, Mus musculus
tgccctatagccatgttgtgcacac

SEQ ID NO: 867596 - DNA, 25 bp, Mus musculus
tgccctatagccttgttgtgcacac

SEQ ID NO: 867597 - DNA, 25 bp, Mus musculus
tgccctatagtcccacactgcaggg

SEQ ID NO: 867598 - DNA, 25 bp, Mus musculus
tgccctatagtcgcacactgcaggg

SEQ ID NO: 867599 - DNA, 25 bp, Mus musculus
tgccctatatccaatccagctatat

SEQ ID NO: 867600 - DNA, 25 bp, Mus musculus
tgccctatatcctatccagctatat

SEQ ID NO: 867601 - DNA, 25 bp, Mus musculus
tgccctatcgaacatccaaggaaat

SEQ ID NO: 867602 - DNA, 25 bp, Mus musculus
tgccctatcgaagatccaaggaaat

SEQ ID NO: 867603 - DNA, 25 bp, Mus musculus
tgccctatctcacatttataccact

SEQ ID NO: 867604 - DNA, 25 bp, Mus musculus
tgccctatctcagatttataccact

SEQ ID NO: 867605 - DNA, 25 bp, Mus musculus
tgccctatctgtcggtagctgtgac

SEQ ID NO: 867606 - DNA, 25 bp, Mus musculus
tgccctatctgtgggtagctgtgac

SEQ ID NO: 867607 - DNA, 25 bp, Mus musculus
tgccctatgatgactgtgtgtttgg

SEQ ID NO: 867608 - DNA, 25 bp, Mus musculus
tgccctatgatgtctgtgtgtttgg

SEQ ID NO: 867609 - DNA, 25 bp, Mus musculus
tgccctatgcggacccagagtggag

SEQ ID NO: 867610 - DNA, 25 bp, Mus musculus
tgccctatgcggtcccagagtggag

SEQ ID NO: 867611 - DNA, 25 bp, Mus musculus
tgccctatgtttctgtacttctatt

SEQ ID NO: 867612 - DNA, 25 bp, Mus musculus
tgccctatgtttgtgtacttctatt

SEQ ID NO: 867613 - DNA, 25 bp, Mus musculus
tgccctattggcaggtttgacctac

SEQ ID NO: 867614 - DNA, 25 bp, Mus musculus
tgccctattggctggtttgacctac

SEQ ID NO: 867615 - DNA, 25 bp, Mus musculus
tgccctcaacatcaagactgccata

SEQ ID NO: 867616 - DNA, 25 bp, Mus musculus
tgccctcaacatctccacgtggagg

SEQ ID NO: 867617 - DNA, 25 bp, Mus musculus
tgccctcaacatgaagactgccata

SEQ ID NO: 867618 - DNA, 25 bp, Mus musculus
tgccctcaacatgtccacgtggagg

SEQ ID NO: 867619 - DNA, 25 bp, Mus musculus
tgccctcaagcacttttatttcctt

SEQ ID NO: 867620 - DNA, 25 bp, Mus musculus
tgccctcaagcagttttatttcctt

SEQ ID NO: 867621 - DNA, 25 bp, Mus musculus
tgccctcacagtcataacctgtaac

SEQ ID NO: 867622 - DNA, 25 bp, Mus musculus
tgccctcacagtgataacctgtaac

SEQ ID NO: 867623 - DNA, 25 bp, Mus musculus
tgccctcacccacgatacggtggta

SEQ ID NO: 867624 - DNA, 25 bp, Mus musculus
tgccctcacccaggatacggtggta

SEQ ID NO: 867625 - DNA, 25 bp, Mus musculus
tgccctcacgcgagacagagtagaa

SEQ ID NO: 867626 - DNA, 25 bp, Mus musculus
tgccctcacgcgtgacagagtagaa

SEQ ID NO: 867627 - DNA, 25 bp, Mus musculus
tgccctcacttaaacatcatcggat

SEQ ID NO: 867628 - DNA, 25 bp, Mus musculus
tgccctcacttatacatcatcggat

SEQ ID NO: 867629 - DNA, 25 bp, Mus musculus
tgccctcagaggacctgacggatac

SEQ ID NO: 867630 - DNA, 25 bp, Mus musculus
tgccctcagaggatgtctatgaatg

SEQ ID NO: 867631 - DNA, 25 bp, Mus musculus
tgccctcagaggtcctgacggatac

SEQ ID NO: 867632 - DNA, 25 bp, Mus musculus
tgccctcagaggttgtctatgaatg

SEQ ID NO: 867633 - DNA, 25 bp, Mus musculus
tgccctcagctgaaagaacgcacag

SEQ ID NO: 867634 - DNA, 25 bp, Mus musculus
tgccctcagctgcaaagaggcagtc

SEQ ID NO: 867635 - DNA, 25 bp, Mus musculus
tgccctcagctggaaagaggcagtc

SEQ ID NO: 867636 - DNA, 25 bp, Mus musculus
tgccctcagctgtaagaacgcacag

SEQ ID NO: 867637 - DNA, 25 bp, Mus musculus
tgccctcaggcgcactcaatggaag

SEQ ID NO: 867638 - DNA, 25 bp, Mus musculus
tgccctcaggcggactcaatggaag

SEQ ID NO: 867639 - DNA, 25 bp, Mus musculus
tgccctcagtagatcctgctgggaa

SEQ ID NO: 867640 - DNA, 25 bp, Mus musculus
tgccctcagtagttcctgctgggaa

SEQ ID NO: 867641 - DNA, 25 bp, Mus musculus
tgccctcatccaactgggagatttg

SEQ ID NO: 867642 - DNA, 25 bp, Mus musculus
tgccctcatccatctgggagatttg

SEQ ID NO: 867643 - DNA, 25 bp, Mus musculus
tgccctcatcttatacatctttgtt

SEQ ID NO: 867644 - DNA, 25 bp, Mus musculus
tgccctcatcttttacatctttgtt

SEQ ID NO: 867645 - DNA, 25 bp, Mus musculus
tgccctcatgccctgtggtgtttgg

SEQ ID NO: 867646 - DNA, 25 bp, Mus musculus
tgccctcatgccgtgtggtgtttgg

SEQ ID NO: 867647 - DNA, 25 bp, Mus musculus
tgccctcatggcaccagcatggaag

SEQ ID NO: 867648 - DNA, 25 bp, Mus musculus
tgccctcatggctccagcatggaag

SEQ ID NO: 867649 - DNA, 25 bp, Mus musculus
tgccctcatgttagtgtccagacag

SEQ ID NO: 867650 - DNA, 25 bp, Mus musculus
tgccctcatgtttgtgtccagacag

SEQ ID NO: 867651 - DNA, 25 bp, Mus musculus
tgccctcattcaagaccagctgaag

SEQ ID NO: 867652 - DNA, 25 bp, Mus musculus
tgccctcattcatgaccagctgaag

SEQ ID NO: 867653 - DNA, 25 bp, Mus musculus
tgccctcattccataatggcgtgga

SEQ ID NO: 867654 - DNA, 25 bp, Mus musculus
tgccctcattccttaatggcgtgga

SEQ ID NO: 867655 - DNA, 25 bp, Mus musculus
tgccctcattgcaccatgaattctg

SEQ ID NO: 867656 - DNA, 25 bp, Mus musculus
tgccctcattgctccatgaattctg

SEQ ID NO: 867657 - DNA, 25 bp, Mus musculus
tgccctcattgtctcctgaagattt

SEQ ID NO: 867658 - DNA, 25 bp, Mus musculus
tgccctcattgtgtcctgaagattt

SEQ ID NO: 867659 - DNA, 25 bp, Mus musculus
tgccctccaaatccaacggagatga

SEQ ID NO: 867660 - DNA, 25 bp, Mus musculus
tgccctccaaatgcaacggagatga

SEQ ID NO: 867661 - DNA, 25 bp, Mus musculus
tgccctccaaggacgtgtacaagta

SEQ ID NO: 867662 - DNA, 25 bp, Mus musculus
tgccctccaaggtcgtgtacaagta

SEQ ID NO: 867663 - DNA, 25 bp, Mus musculus
tgccctccaagtccacggatgcgga

SEQ ID NO: 867664 - DNA, 25 bp, Mus musculus
tgccctccaagtgcacggatgcgga

SEQ ID NO: 867665 - DNA, 25 bp, Mus musculus
tgccctccacagatgatttctatga

SEQ ID NO: 867666 - DNA, 25 bp, Mus musculus
tgccctccacagcatggttgaagct

SEQ ID NO: 867667 - DNA, 25 bp, Mus musculus
tgccctccacaggatggttgaagct

SEQ ID NO: 867668 - DNA, 25 bp, Mus musculus
tgccctccacagttgatttctatga

SEQ ID NO: 867669 - DNA, 25 bp, Mus musculus
tgccctccactcaccatggaatgat

SEQ ID NO: 867670 - DNA, 25 bp, Mus musculus
tgccctccactctccatggaatgat

SEQ ID NO: 867671 - DNA, 25 bp, Mus musculus
tgccctccagaaatcaagcctagag

SEQ ID NO: 867672 - DNA, 25 bp, Mus musculus
tgccctccagaattcaagcctagag

SEQ ID NO: 867673 - DNA, 25 bp, Mus musculus
tgccctccagccagagacgctgaga

SEQ ID NO: 867674 - DNA, 25 bp, Mus musculus
tgccctccagcctgagacgctgaga

SEQ ID NO: 867675 - DNA, 25 bp, Mus musculus
tgccctcccaggactaagtgaaaat

SEQ ID NO: 867676 - DNA, 25 bp, Mus musculus
tgccctcccaggtctaagtgaaaat

SEQ ID NO: 867677 - DNA, 25 bp, Mus musculus
tgccctcccattctaacaggactag

SEQ ID NO: 867678 - DNA, 25 bp, Mus musculus
tgccctcccattgtaacaggactag

SEQ ID NO: 867679 - DNA, 25 bp, Mus musculus
tgccctccctataggtggtttttag

SEQ ID NO: 867680 - DNA, 25 bp, Mus musculus
tgccctccctattggtggtttttag

SEQ ID NO: 867681 - DNA, 25 bp, Mus musculus
tgccctccctgcaggtgttactgtg

SEQ ID NO: 867682 - DNA, 25 bp, Mus musculus
tgccctccctgctggtgttactgtg

SEQ ID NO: 867683 - DNA, 25 bp, Mus musculus
tgccctcccttgctgatgcagtatc

SEQ ID NO: 867684 - DNA, 25 bp, Mus musculus
tgccctcccttggtgatgcagtatc

SEQ ID NO: 867685 - DNA, 25 bp, Mus musculus
tgccctccctttcaaaagctctgag

SEQ ID NO: 867686 - DNA, 25 bp, Mus musculus
tgccctccctttcttcgtgctatga

SEQ ID NO: 867687 - DNA, 25 bp, Mus musculus
tgccctccctttgaaaagctctgag

SEQ ID NO: 867688 - DNA, 25 bp, Mus musculus
tgccctccctttgttcgtgctatga

SEQ ID NO: 867689 - DNA, 25 bp, Mus musculus
tgccctccgacactcaggtaaatgt

SEQ ID NO: 867690 - DNA, 25 bp, Mus musculus
tgccctccgacagtcaggtaaatgt

SEQ ID NO: 867691 - DNA, 25 bp, Mus musculus
tgccctccgattactgaagtgccag

SEQ ID NO: 867692 - DNA, 25 bp, Mus musculus
tgccctccgatttctgaagtgccag

SEQ ID NO: 867693 - DNA, 25 bp, Mus musculus
tgccctccggatctttgcacacaaa

SEQ ID NO: 867694 - DNA, 25 bp, Mus musculus
tgccctccggatgtttgcacacaaa

SEQ ID NO: 867695 - DNA, 25 bp, Mus musculus
tgccctcctgaaaggcaagggcgcc

SEQ ID NO: 867696 - DNA, 25 bp, Mus musculus
tgccctcctgaatggcaagggcgcc

SEQ ID NO: 867697 - DNA, 25 bp, Mus musculus
tgccctcctgagagctgcatggtcc

SEQ ID NO: 867698 - DNA, 25 bp, Mus musculus
tgccctcctgagtgctgcatggtcc

SEQ ID NO: 867699 - DNA, 25 bp, Mus musculus
tgccctcctggacatggaggcctgt

SEQ ID NO: 867700 - DNA, 25 bp, Mus musculus
tgccctcctggagatggaggcctgt

SEQ ID NO: 867701 - DNA, 25 bp, Mus musculus
tgccctcgaattcccatacactggg

SEQ ID NO: 867702 - DNA, 25 bp, Mus musculus
tgccctcgaattgccatacactggg

SEQ ID NO: 867703 - DNA, 25 bp, Mus musculus
tgccctcggcttcttaatataactg

SEQ ID NO: 867704 - DNA, 25 bp, Mus musculus
tgccctcggcttgttaatataactg

SEQ ID NO: 867705 - DNA, 25 bp, Mus musculus
tgccctcgggaccaggcactcagaa

SEQ ID NO: 867706 - DNA, 25 bp, Mus musculus
tgccctcgggacgaggcactcagaa

SEQ ID NO: 867707 - DNA, 25 bp, Mus musculus
tgccctcgggtaactcgtgtgagga

SEQ ID NO: 867708 - DNA, 25 bp, Mus musculus
tgccctcgggtatctcgtgtgagga

SEQ ID NO: 867709 - DNA, 25 bp, Mus musculus
tgccctcgtgggaatttgttataag

SEQ ID NO: 867710 - DNA, 25 bp, Mus musculus
tgccctcgtgggtatttgttataag

SEQ ID NO: 867711 - DNA, 25 bp, Mus musculus
tgccctctacaccatgaactgatta

SEQ ID NO: 867712 - DNA, 25 bp, Mus musculus
tgccctctacacgatgaactgatta

SEQ ID NO: 867713 - DNA, 25 bp, Mus musculus
tgccctctatgaaatatacgcctgt

SEQ ID NO: 867714 - DNA, 25 bp, Mus musculus
tgccctctatgatatatacgcctgt

SEQ ID NO: 867715 - DNA, 25 bp, Mus musculus
tgccctctatgcctagcagaaattc

SEQ ID NO: 867716 - DNA, 25 bp, Mus musculus
tgccctctatgcgtagcagaaattc

SEQ ID NO: 867717 - DNA, 25 bp, Mus musculus
tgccctctcacactcttagtaatga

SEQ ID NO: 867718 - DNA, 25 bp, Mus musculus
tgccctctcacagtcttagtaatga

SEQ ID NO: 867719 - DNA, 25 bp, Mus musculus
tgccctctcagtaaagccatgttag

SEQ ID NO: 867720 - DNA, 25 bp, Mus musculus
tgccctctcagttaagccatgttag

SEQ ID NO: 867721 - DNA, 25 bp, Mus musculus
tgccctctcatcaattcctgcagga

SEQ ID NO: 867722 - DNA, 25 bp, Mus musculus
tgccctctcatctattcctgcagga

SEQ ID NO: 867723 - DNA, 25 bp, Mus musculus
tgccctctccaaaacaatggcagtg

SEQ ID NO: 867724 - DNA, 25 bp, Mus musculus
tgccctctccaatacaatggcagtg

SEQ ID NO: 867725 - DNA, 25 bp, Mus musculus
tgccctctcctcagttatactagat

SEQ ID NO: 867726 - DNA, 25 bp, Mus musculus
tgccctctcctctgttatactagat

SEQ ID NO: 867727 - DNA, 25 bp, Mus musculus
tgccctctgactctcgaggcaatag

SEQ ID NO: 867728 - DNA, 25 bp, Mus musculus
tgccctctgactgtcgaggcaatag

SEQ ID NO: 867729 - DNA, 25 bp, Mus musculus
tgccctctgaggcacctggcaggca

SEQ ID NO: 867730 - DNA, 25 bp, Mus musculus
tgccctctgagggacctggcaggca

SEQ ID NO: 867731 - DNA, 25 bp, Mus musculus
tgccctctggctcaggctgggttct

SEQ ID NO: 867732 - DNA, 25 bp, Mus musculus
tgccctctggctgaggctgggttct

SEQ ID NO: 867733 - DNA, 25 bp, Mus musculus
tgccctctgtcgactgttttaagtc

SEQ ID NO: 867734 - DNA, 25 bp, Mus musculus
tgccctctgtcgtctgttttaagtc

SEQ ID NO: 867735 - DNA, 25 bp, Mus musculus
tgccctctgtgcataattgcccgta

SEQ ID NO: 867736 - DNA, 25 bp, Mus musculus
tgccctctgtgcttaattgcccgta

SEQ ID NO: 867737 - DNA, 25 bp, Mus musculus
tgccctctgtgtactgactgatttt

SEQ ID NO: 867738 - DNA, 25 bp, Mus musculus
tgccctctgtgttctgactgatttt

SEQ ID NO: 867739 - DNA, 25 bp, Mus musculus
tgccctcttaacagcccaaggaaaa

SEQ ID NO: 867740 - DNA, 25 bp, Mus musculus
tgccctcttaactgcccaaggaaaa

SEQ ID NO: 867741 - DNA, 25 bp, Mus musculus
tgccctcttgctcaatatgcacttg

SEQ ID NO: 867742 - DNA, 25 bp, Mus musculus
tgccctcttgctgaatatgcacttg

SEQ ID NO: 867743 - DNA, 25 bp, Mus musculus
tgccctcttggtaggaaagctctcc

SEQ ID NO: 867744 - DNA, 25 bp, Mus musculus
tgccctcttggtaggttaaagcttg

SEQ ID NO: 867745 - DNA, 25 bp, Mus musculus
tgccctcttggttggaaagctctcc

SEQ ID NO: 867746 - DNA, 25 bp, Mus musculus
tgccctcttggttggttaaagcttg

SEQ ID NO: 867747 - DNA, 25 bp, Mus musculus
tgccctgaagacaaatgccagatga

SEQ ID NO: 867748 - DNA, 25 bp, Mus musculus
tgccctgaagactaatgccagatga

SEQ ID NO: 867749 - DNA, 25 bp, Mus musculus
tgccctgacaagctattgcacatct

SEQ ID NO: 867750 - DNA, 25 bp, Mus musculus
tgccctgacaaggtattgcacatct

SEQ ID NO: 867751 - DNA, 25 bp, Mus musculus
tgccctgacagtcatggtatctgtt

SEQ ID NO: 867752 - DNA, 25 bp, Mus musculus
tgccctgacagtgatggtatctgtt

SEQ ID NO: 867753 - DNA, 25 bp, Mus musculus
tgccctgacatcctcgaacaagtgg

SEQ ID NO: 867754 - DNA, 25 bp, Mus musculus
tgccctgacatcgtcgaacaagtgg

SEQ ID NO: 867755 - DNA, 25 bp, Mus musculus
tgccctgaccagattaccattatta

SEQ ID NO: 867756 - DNA, 25 bp, Mus musculus
tgccctgaccagtttaccattatta

SEQ ID NO: 867757 - DNA, 25 bp, Mus musculus
tgccctgaccggattgctgagtcaa

SEQ ID NO: 867758 - DNA, 25 bp, Mus musculus
tgccctgaccggtttgctgagtcaa

SEQ ID NO: 867759 - DNA, 25 bp, Mus musculus
tgccctgactcaatatgtggaacaa

SEQ ID NO: 867760 - DNA, 25 bp, Mus musculus
tgccctgactcacgtaagctgtgga

SEQ ID NO: 867761 - DNA, 25 bp, Mus musculus
tgccctgactcaggtaagctgtgga

SEQ ID NO: 867762 - DNA, 25 bp, Mus musculus
tgccctgactcattatgtggaacaa

SEQ ID NO: 867763 - DNA, 25 bp, Mus musculus
tgccctgagagtccaagattcttgc

SEQ ID NO: 867764 - DNA, 25 bp, Mus musculus
tgccctgagagtgcaagattcttgc

SEQ ID NO: 867765 - DNA, 25 bp, Mus musculus
tgccctgagcctccctaggtttaga

SEQ ID NO: 867766 - DNA, 25 bp, Mus musculus
tgccctgagcctgcctaggtttaga

SEQ ID NO: 867767 - DNA, 25 bp, Mus musculus
tgccctgagctgcaccagctagtgg

SEQ ID NO: 867768 - DNA, 25 bp, Mus musculus
tgccctgagctggaccagctagtgg

SEQ ID NO: 867769 - DNA, 25 bp, Mus musculus
tgccctgaggaaacaccatgaagat

SEQ ID NO: 867770 - DNA, 25 bp, Mus musculus
tgccctgaggaatcaccatgaagat

SEQ ID NO: 867771 - DNA, 25 bp, Mus musculus
tgccctgaggctacatgtacaacca

SEQ ID NO: 867772 - DNA, 25 bp, Mus musculus
tgccctgaggctcttttccagcctt

SEQ ID NO: 867773 - DNA, 25 bp, Mus musculus
tgccctgaggctgttttccagcctt

SEQ ID NO: 867774 - DNA, 25 bp, Mus musculus
tgccctgaggcttcatgtacaacca

SEQ ID NO: 867775 - DNA, 25 bp, Mus musculus
tgccctgagggaccgcctgtattac

SEQ ID NO: 867776 - DNA, 25 bp, Mus musculus
tgccctgagggagcgcctgtattac

SEQ ID NO: 867777 - DNA, 25 bp, Mus musculus
tgccctgaggttcagtcatctggta

SEQ ID NO: 867778 - DNA, 25 bp, Mus musculus
tgccctgaggttgagtcatctggta

SEQ ID NO: 867779 - DNA, 25 bp, Mus musculus
tgccctgagtcacgtttatcactta

SEQ ID NO: 867780 - DNA, 25 bp, Mus musculus
tgccctgagtcaggtttatcactta

SEQ ID NO: 867781 - DNA, 25 bp, Mus musculus
tgccctgagtttatggcctaccttc

SEQ ID NO: 867782 - DNA, 25 bp, Mus musculus
tgccctgagtttttggcctaccttc

SEQ ID NO: 867783 - DNA, 25 bp, Mus musculus
tgccctgatgaacaagttcctgagt

SEQ ID NO: 867784 - DNA, 25 bp, Mus musculus
tgccctgatgaagaagttcctgagt

SEQ ID NO: 867785 - DNA, 25 bp, Mus musculus
tgccctgatgataagcccctgttga

SEQ ID NO: 867786 - DNA, 25 bp, Mus musculus
tgccctgatgattagcccctgttga

SEQ ID NO: 867787 - DNA, 25 bp, Mus musculus
tgccctgatgcacctagctacagaa

SEQ ID NO: 867788 - DNA, 25 bp, Mus musculus
tgccctgatgcagctagctacagaa

SEQ ID NO: 867789 - DNA, 25 bp, Mus musculus
tgccctgatgctccaaatctaactg

SEQ ID NO: 867790 - DNA, 25 bp, Mus musculus
tgccctgatgctgcaaatctaactg

SEQ ID NO: 867791 - DNA, 25 bp, Mus musculus
tgccctgattatattcaaaccaatt

SEQ ID NO: 867792 - DNA, 25 bp, Mus musculus
tgccctgattattttcaaaccaatt

SEQ ID NO: 867793 - DNA, 25 bp, Mus musculus
tgccctgcaacaagcgtccaaaaaa

SEQ ID NO: 867794 - DNA, 25 bp, Mus musculus
tgccctgcaacatgcgtccaaaaaa

SEQ ID NO: 867795 - DNA, 25 bp, Mus musculus
tgccctgcaagtattagatccaatc

SEQ ID NO: 867796 - DNA, 25 bp, Mus musculus
tgccctgcaagtattcaatgtccct

SEQ ID NO: 867797 - DNA, 25 bp, Mus musculus
tgccctgcaagttttagatccaatc

SEQ ID NO: 867798 - DNA, 25 bp, Mus musculus
tgccctgcaagttttcaatgtccct

SEQ ID NO: 867799 - DNA, 25 bp, Mus musculus
tgccctgcacctatagacatttact

SEQ ID NO: 867800 - DNA, 25 bp, Mus musculus
tgccctgcacctttagacatttact

SEQ ID NO: 867801 - DNA, 25 bp, Mus musculus
tgccctgcactgagttcacctgtct

SEQ ID NO: 867802 - DNA, 25 bp, Mus musculus
tgccctgcactgcagtttaccaaga

SEQ ID NO: 867803 - DNA, 25 bp, Mus musculus
tgccctgcactggagtttaccaaga

SEQ ID NO: 867804 - DNA, 25 bp, Mus musculus
tgccctgcactgtgttcacctgtct

SEQ ID NO: 867805 - DNA, 25 bp, Mus musculus
tgccctgcagagaaatgtgtccatg

SEQ ID NO: 867806 - DNA, 25 bp, Mus musculus
tgccctgcagagtaatgtgtccatg

SEQ ID NO: 867807 - DNA, 25 bp, Mus musculus
tgccctgcagcacgttctacagaga

SEQ ID NO: 867808 - DNA, 25 bp, Mus musculus
tgccctgcagcaggttctacagaga

SEQ ID NO: 867809 - DNA, 25 bp, Mus musculus
tgccctgcagtgatgacatgcctgg

SEQ ID NO: 867810 - DNA, 25 bp, Mus musculus
tgccctgcagtgttgacatgcctgg

SEQ ID NO: 867811 - DNA, 25 bp, Mus musculus
tgccctgcccaaaaagagttcttac

SEQ ID NO: 867812 - DNA, 25 bp, Mus musculus
tgccctgcccaataagagttcttac

SEQ ID NO: 867813 - DNA, 25 bp, Mus musculus
tgccctgcgcaaactagtcattgac

SEQ ID NO: 867814 - DNA, 25 bp, Mus musculus
tgccctgcgcaatctagtcattgac

SEQ ID NO: 867815 - DNA, 25 bp, Mus musculus
tgccctgcgcgcagcggctttgacg

SEQ ID NO: 867816 - DNA, 25 bp, Mus musculus
tgccctgcgcgctgcggctttgacg

SEQ ID NO: 867817 - DNA, 25 bp, Mus musculus
tgccctgcgcggcttaaggttttta

SEQ ID NO: 867818 - DNA, 25 bp, Mus musculus
tgccctgcgcgggttaaggttttta

SEQ ID NO: 867819 - DNA, 25 bp, Mus musculus
tgccctgcgctgaattgtatcagca

SEQ ID NO: 867820 - DNA, 25 bp, Mus musculus
tgccctgcgctgtattgtatcagca

SEQ ID NO: 867821 - DNA, 25 bp, Mus musculus
tgccctgctaacaaagctccaggtt

SEQ ID NO: 867822 - DNA, 25 bp, Mus musculus
tgccctgctaacacctcttagggaa

SEQ ID NO: 867823 - DNA, 25 bp, Mus musculus
tgccctgctaactaagctccaggtt

SEQ ID NO: 867824 - DNA, 25 bp, Mus musculus
tgccctgctaactcctcttagggaa

SEQ ID NO: 867825 - DNA, 25 bp, Mus musculus
tgccctgctcaaccgaggatactcg

SEQ ID NO: 867826 - DNA, 25 bp, Mus musculus
tgccctgctcaagcgaggatactcg

SEQ ID NO: 867827 - DNA, 25 bp, Mus musculus
tgccctgctgatactcatttttgct

SEQ ID NO: 867828 - DNA, 25 bp, Mus musculus
tgccctgctgattctcatttttgct

SEQ ID NO: 867829 - DNA, 25 bp, Mus musculus
tgccctgctgccatatgtagggatg

SEQ ID NO: 867830 - DNA, 25 bp, Mus musculus
tgccctgctgccttatgtagggatg

SEQ ID NO: 867831 - DNA, 25 bp, Mus musculus
tgccctgctggcctgcaaagacaga

SEQ ID NO: 867832 - DNA, 25 bp, Mus musculus
tgccctgctggcgtgcaaagacaga

SEQ ID NO: 867833 - DNA, 25 bp, Mus musculus
tgccctgctgggatgactgctactg

SEQ ID NO: 867834 - DNA, 25 bp, Mus musculus
tgccctgctgggttgactgctactg

SEQ ID NO: 867835 - DNA, 25 bp, Mus musculus
tgccctgcttgcagagaatgccttt

SEQ ID NO: 867836 - DNA, 25 bp, Mus musculus
tgccctgcttgcatgtaaatatcaa

SEQ ID NO: 867837 - DNA, 25 bp, Mus musculus
tgccctgcttgctgagaatgccttt

SEQ ID NO: 867838 - DNA, 25 bp, Mus musculus
tgccctgcttgcttgtaaatatcaa

SEQ ID NO: 867839 - DNA, 25 bp, Mus musculus
tgccctgctttcaggttacttacat

SEQ ID NO: 867840 - DNA, 25 bp, Mus musculus
tgccctgctttctggttacttacat

SEQ ID NO: 867841 - DNA, 25 bp, Mus musculus
tgccctggaaagagggacttcagac

SEQ ID NO: 867842 - DNA, 25 bp, Mus musculus
tgccctggaaagtgggacttcagac

SEQ ID NO: 867843 - DNA, 25 bp, Mus musculus
tgccctggacctcacttgaaagtga

SEQ ID NO: 867844 - DNA, 25 bp, Mus musculus
tgccctggacctgacttgaaagtga

SEQ ID NO: 867845 - DNA, 25 bp, Mus musculus
tgccctggatggatgactctggaat

SEQ ID NO: 867846 - DNA, 25 bp, Mus musculus
tgccctggatggttgactctggaat

SEQ ID NO: 867847 - DNA, 25 bp, Mus musculus
tgccctggatttagccactttgaaa

SEQ ID NO: 867848 - DNA, 25 bp, Mus musculus
tgccctggattttgccactttgaaa

SEQ ID NO: 867849 - DNA, 25 bp, Mus musculus
tgccctggcaaaactcttcaagtta

SEQ ID NO: 867850 - DNA, 25 bp, Mus musculus
tgccctggcaaatctcttcaagtta

SEQ ID NO: 867851 - DNA, 25 bp, Mus musculus
tgccctggcaggacctaggcagaag

SEQ ID NO: 867852 - DNA, 25 bp, Mus musculus
tgccctggcaggtcctaggcagaag

SEQ ID NO: 867853 - DNA, 25 bp, Mus musculus
tgccctggccagacagtgggaattc

SEQ ID NO: 867854 - DNA, 25 bp, Mus musculus
tgccctggccagtcagtgggaattc

SEQ ID NO: 867855 - DNA, 25 bp, Mus musculus
tgccctggccggcatgatactcaga

SEQ ID NO: 867856 - DNA, 25 bp, Mus musculus
tgccctggccgggatgatactcaga

SEQ ID NO: 867857 - DNA, 25 bp, Mus musculus
tgccctggcgccagtggtaagcaga

SEQ ID NO: 867858 - DNA, 25 bp, Mus musculus
tgccctggcgcctgtggtaagcaga

SEQ ID NO: 867859 - DNA, 25 bp, Mus musculus
tgccctggctggaatgagaaaccct

SEQ ID NO: 867860 - DNA, 25 bp, Mus musculus
tgccctggctggtatgagaaaccct

SEQ ID NO: 867861 - DNA, 25 bp, Mus musculus
tgccctggcttcacatttgttgaaa

SEQ ID NO: 867862 - DNA, 25 bp, Mus musculus
tgccctggcttctcatttgttgaaa

SEQ ID NO: 867863 - DNA, 25 bp, Mus musculus
tgccctgggacaccctctataaaac

SEQ ID NO: 867864 - DNA, 25 bp, Mus musculus
tgccctgggacagcctctataaaac

SEQ ID NO: 867865 - DNA, 25 bp, Mus musculus
tgccctgggacgacagactgaactt

SEQ ID NO: 867866 - DNA, 25 bp, Mus musculus
tgccctgggacgtcagactgaactt

SEQ ID NO: 867867 - DNA, 25 bp, Mus musculus
tgccctgggatgattcacgccttaa

SEQ ID NO: 867868 - DNA, 25 bp, Mus musculus
tgccctgggatgtttcacgccttaa

SEQ ID NO: 867869 - DNA, 25 bp, Mus musculus
tgccctgggtgcaggtcaatgagaa

SEQ ID NO: 867870 - DNA, 25 bp, Mus musculus
tgccctgggtgctggtcaatgagaa

SEQ ID NO: 867871 - DNA, 25 bp, Mus musculus
tgccctgggttaacaactctcagta

SEQ ID NO: 867872 - DNA, 25 bp, Mus musculus
tgccctgggttatcaactctcagta

SEQ ID NO: 867873 - DNA, 25 bp, Mus musculus
tgccctgggtttcctttagctatag

SEQ ID NO: 867874 - DNA, 25 bp, Mus musculus
tgccctgggtttgctttagctatag

SEQ ID NO: 867875 - DNA, 25 bp, Mus musculus
tgccctggtacccttctatgagaaa

SEQ ID NO: 867876 - DNA, 25 bp, Mus musculus
tgccctggtaccgttctatgagaaa

SEQ ID NO: 867877 - DNA, 25 bp, Mus musculus
tgccctggtctgcagtgtctgaaga

SEQ ID NO: 867878 - DNA, 25 bp, Mus musculus
tgccctggtctggagtgtctgaaga

SEQ ID NO: 867879 - DNA, 25 bp, Mus musculus
tgccctggtgccctcttgagtatat

SEQ ID NO: 867880 - DNA, 25 bp, Mus musculus
tgccctggtgccgtcttgagtatat

SEQ ID NO: 867881 - DNA, 25 bp, Mus musculus
tgccctggtggccaagaccaaagtg

SEQ ID NO: 867882 - DNA, 25 bp, Mus musculus
tgccctggtggcgaagaccaaagtg

SEQ ID NO: 867883 - DNA, 25 bp, Mus musculus
tgccctggtgtaaaggttacctcct

SEQ ID NO: 867884 - DNA, 25 bp, Mus musculus
tgccctggtgtataggttacctcct

SEQ ID NO: 867885 - DNA, 25 bp, Mus musculus
tgccctggtttcattctatgaactg

SEQ ID NO: 867886 - DNA, 25 bp, Mus musculus
tgccctggtttccttgggaagtatg

SEQ ID NO: 867887 - DNA, 25 bp, Mus musculus
tgccctggtttcgttgggaagtatg

SEQ ID NO: 867888 - DNA, 25 bp, Mus musculus
tgccctggtttctttctatgaactg

SEQ ID NO: 867889 - DNA, 25 bp, Mus musculus
tgccctgtaaccctcgggagctgaa

SEQ ID NO: 867890 - DNA, 25 bp, Mus musculus
tgccctgtaaccgtcgggagctgaa

SEQ ID NO: 867891 - DNA, 25 bp, Mus musculus
tgccctgtaaggagagaccctcctc

SEQ ID NO: 867892 - DNA, 25 bp, Mus musculus
tgccctgtaaggtgagaccctcctc

SEQ ID NO: 867893 - DNA, 25 bp, Mus musculus
tgccctgtacgcatttccagaggac

SEQ ID NO: 867894 - DNA, 25 bp, Mus musculus
tgccctgtacgcttttccagaggac

SEQ ID NO: 867895 - DNA, 25 bp, Mus musculus
tgccctgtagttatctggctagaaa

SEQ ID NO: 867896 - DNA, 25 bp, Mus musculus
tgccctgtagttttctggctagaaa

SEQ ID NO: 867897 - DNA, 25 bp, Mus musculus
tgccctgtatacatactctgctaac

SEQ ID NO: 867898 - DNA, 25 bp, Mus musculus
tgccctgtatacttactctgctaac

SEQ ID NO: 867899 - DNA, 25 bp, Mus musculus
tgccctgtatccagaagccaagtaa

SEQ ID NO: 867900 - DNA, 25 bp, Mus musculus
tgccctgtatcctgaagccaagtaa

SEQ ID NO: 867901 - DNA, 25 bp, Mus musculus
tgccctgtcagcctacagaagaaaa

SEQ ID NO: 867902 - DNA, 25 bp, Mus musculus
tgccctgtcagcgtacagaagaaaa

SEQ ID NO: 867903 - DNA, 25 bp, Mus musculus
tgccctgtcaggcatgtacatgcct

SEQ ID NO: 867904 - DNA, 25 bp, Mus musculus
tgccctgtcagggatgtacatgcct

SEQ ID NO: 867905 - DNA, 25 bp, Mus musculus
tgccctgtcatcctgttgtgtggcg

SEQ ID NO: 867906 - DNA, 25 bp, Mus musculus
tgccctgtcatcgtgttgtgtggcg

SEQ ID NO: 867907 - DNA, 25 bp, Mus musculus
tgccctgtcgtcactgaatgccagg

SEQ ID NO: 867908 - DNA, 25 bp, Mus musculus
tgccctgtcgtctctgaatgccagg

SEQ ID NO: 867909 - DNA, 25 bp, Mus musculus
tgccctgtctccatctagtggaaaa

SEQ ID NO: 867910 - DNA, 25 bp, Mus musculus
tgccctgtctccttctagtggaaaa

SEQ ID NO: 867911 - DNA, 25 bp, Mus musculus
tgccctgtctctcgaagtactgaag

SEQ ID NO: 867912 - DNA, 25 bp, Mus musculus
tgccctgtctctggaagtactgaag

SEQ ID NO: 867913 - DNA, 25 bp, Mus musculus
tgccctgtgaaaactgctcatttgc

SEQ ID NO: 867914 - DNA, 25 bp, Mus musculus
tgccctgtgaaatctgctcatttgc

SEQ ID NO: 867915 - DNA, 25 bp, Mus musculus
tgccctgtgagaacagtggttgact

SEQ ID NO: 867916 - DNA, 25 bp, Mus musculus
tgccctgtgagatcagtggttgact

SEQ ID NO: 867917 - DNA, 25 bp, Mus musculus
tgccctgtgcacaagaatccttaat

SEQ ID NO: 867918 - DNA, 25 bp, Mus musculus
tgccctgtgcactagaatccttaat

SEQ ID NO: 867919 - DNA, 25 bp, Mus musculus
tgccctgtgccaatgagttttgtaa

SEQ ID NO: 867920 - DNA, 25 bp, Mus musculus
tgccctgtgccattgagttttgtaa

SEQ ID NO: 867921 - DNA, 25 bp, Mus musculus
tgccctgtgcctcgaaccaatggaa

SEQ ID NO: 867922 - DNA, 25 bp, Mus musculus
tgccctgtgcctggaaccaatggaa

SEQ ID NO: 867923 - DNA, 25 bp, Mus musculus
tgccctgtgcttcctaatatcattg

SEQ ID NO: 867924 - DNA, 25 bp, Mus musculus
tgccctgtgcttgctaatatcattg

SEQ ID NO: 867925 - DNA, 25 bp, Mus musculus
tgccctgtggatctgtcagtgctga

SEQ ID NO: 867926 - DNA, 25 bp, Mus musculus
tgccctgtggatgtgtcagtgctga

SEQ ID NO: 867927 - DNA, 25 bp, Mus musculus
tgccctgtggctcctcatgttcttc

SEQ ID NO: 867928 - DNA, 25 bp, Mus musculus
tgccctgtggctgctcatgttcttc

SEQ ID NO: 867929 - DNA, 25 bp, Mus musculus
tgccctgtgggacagcgcagcctaa

SEQ ID NO: 867930 - DNA, 25 bp, Mus musculus
tgccctgtgggagagcgcagcctaa

SEQ ID NO: 867931 - DNA, 25 bp, Mus musculus
tgccctgtgtacagtggactctcag

SEQ ID NO: 867932 - DNA, 25 bp, Mus musculus
tgccctgtgtactgtggactctcag

SEQ ID NO: 867933 - DNA, 25 bp, Mus musculus
tgccctgtgtccagtgcgacagaca

SEQ ID NO: 867934 - DNA, 25 bp, Mus musculus
tgccctgtgtcccatgggagcaatg

SEQ ID NO: 867935 - DNA, 25 bp, Mus musculus
tgccctgtgtccgatgggagcaatg

SEQ ID NO: 867936 - DNA, 25 bp, Mus musculus
tgccctgtgtcctgtgcgacagaca

SEQ ID NO: 867937 - DNA, 25 bp, Mus musculus
tgccctgtgttcagactcctgtgta

SEQ ID NO: 867938 - DNA, 25 bp, Mus musculus
tgccctgtgttcatcactcacacaa

SEQ ID NO: 867939 - DNA, 25 bp, Mus musculus
tgccctgtgttctgactcctgtgta

SEQ ID NO: 867940 - DNA, 25 bp, Mus musculus
tgccctgtgttcttcactcacacaa

SEQ ID NO: 867941 - DNA, 25 bp, Mus musculus
tgccctgtgttgaactgcctattta

SEQ ID NO: 867942 - DNA, 25 bp, Mus musculus
tgccctgtgttgtactgcctattta

SEQ ID NO: 867943 - DNA, 25 bp, Mus musculus
tgccctgttaaaactattaagtaca

SEQ ID NO: 867944 - DNA, 25 bp, Mus musculus
tgccctgttaaatctattaagtaca

SEQ ID NO: 867945 - DNA, 25 bp, Mus musculus
tgccctgttatcctaagtatctact

SEQ ID NO: 867946 - DNA, 25 bp, Mus musculus
tgccctgttatcgtaagtatctact

SEQ ID NO: 867947 - DNA, 25 bp, Mus musculus
tgccctgttctgatgtgagcaccat

SEQ ID NO: 867948 - DNA, 25 bp, Mus musculus
tgccctgttctgttgtgagcaccat

SEQ ID NO: 867949 - DNA, 25 bp, Mus musculus
tgccctgttggcaagagtctcaaac

SEQ ID NO: 867950 - DNA, 25 bp, Mus musculus
tgccctgttggctagagtctcaaac

SEQ ID NO: 867951 - DNA, 25 bp, Mus musculus
tgccctgttggtagtagtcgtgagt

SEQ ID NO: 867952 - DNA, 25 bp, Mus musculus
tgccctgttggttgtagtcgtgagt

SEQ ID NO: 867953 - DNA, 25 bp, Mus musculus
tgccctgttttcctggccagacaat

SEQ ID NO: 867954 - DNA, 25 bp, Mus musculus
tgccctgttttcgtggccagacaat

SEQ ID NO: 867955 - DNA, 25 bp, Mus musculus
tgcccttaactaagagcgtctccag

SEQ ID NO: 867956 - DNA, 25 bp, Mus musculus
tgcccttaactatgagcgtctccag

SEQ ID NO: 867957 - DNA, 25 bp, Mus musculus
tgcccttacataatgtggcctgaag

SEQ ID NO: 867958 - DNA, 25 bp, Mus musculus
tgcccttacatattgtggcctgaag

SEQ ID NO: 867959 - DNA, 25 bp, Mus musculus
tgcccttacattactgaggccacag

SEQ ID NO: 867960 - DNA, 25 bp, Mus musculus
tgcccttacatttctgaggccacag

SEQ ID NO: 867961 - DNA, 25 bp, Mus musculus
tgcccttactccacctaaagataat

SEQ ID NO: 867962 - DNA, 25 bp, Mus musculus
tgcccttactcctcctaaagataat

SEQ ID NO: 867963 - DNA, 25 bp, Mus musculus
tgcccttactctccagagaagctgg

SEQ ID NO: 867964 - DNA, 25 bp, Mus musculus
tgcccttactctgcagagaagctgg

SEQ ID NO: 867965 - DNA, 25 bp, Mus musculus
tgcccttacttacccagtgtttctc

SEQ ID NO: 867966 - DNA, 25 bp, Mus musculus
tgcccttacttagccagtgtttctc

SEQ ID NO: 867967 - DNA, 25 bp, Mus musculus
tgcccttagactatatttccagctc

SEQ ID NO: 867968 - DNA, 25 bp, Mus musculus
tgcccttagactttatttccagctc

SEQ ID NO: 867969 - DNA, 25 bp, Mus musculus
tgcccttagctgctgagccttctgt

SEQ ID NO: 867970 - DNA, 25 bp, Mus musculus
tgcccttagctggtgagccttctgt

SEQ ID NO: 867971 - DNA, 25 bp, Mus musculus
tgcccttagcttactaaagtttgct

SEQ ID NO: 867972 - DNA, 25 bp, Mus musculus
tgcccttagctttctaaagtttgct

SEQ ID NO: 867973 - DNA, 25 bp, Mus musculus
tgcccttaggaacagtcattgataa

SEQ ID NO: 867974 - DNA, 25 bp, Mus musculus
tgcccttaggaagagtcattgataa

SEQ ID NO: 867975 - DNA, 25 bp, Mus musculus
tgcccttcaactaccatacaaattg

SEQ ID NO: 867976 - DNA, 25 bp, Mus musculus
tgcccttcaacttccatacaaattg

SEQ ID NO: 867977 - DNA, 25 bp, Mus musculus
tgcccttcacgtcaggctgaaattg

SEQ ID NO: 867978 - DNA, 25 bp, Mus musculus
tgcccttcacgtgaggctgaaattg

SEQ ID NO: 867979 - DNA, 25 bp, Mus musculus
tgcccttcagctctgacttgagttt

SEQ ID NO: 867980 - DNA, 25 bp, Mus musculus
tgcccttcagctgtgacttgagttt

SEQ ID NO: 867981 - DNA, 25 bp, Mus musculus
tgcccttcagtgacaagcatgctgt

SEQ ID NO: 867982 - DNA, 25 bp, Mus musculus
tgcccttcagtgtcaagcatgctgt

SEQ ID NO: 867983 - DNA, 25 bp, Mus musculus
tgcccttcatctcgttggaaactaa

SEQ ID NO: 867984 - DNA, 25 bp, Mus musculus
tgcccttcatctggttggaaactaa

SEQ ID NO: 867985 - DNA, 25 bp, Mus musculus
tgcccttcatggacttcctgacgaa

SEQ ID NO: 867986 - DNA, 25 bp, Mus musculus
tgcccttcatggtcttcctgacgaa

SEQ ID NO: 867987 - DNA, 25 bp, Mus musculus
tgcccttcatgtatgctaccggaga

SEQ ID NO: 867988 - DNA, 25 bp, Mus musculus
tgcccttcatgtttgctaccggaga

SEQ ID NO: 867989 - DNA, 25 bp, Mus musculus
tgcccttccaccagcataagaaagt

SEQ ID NO: 867990 - DNA, 25 bp, Mus musculus
tgcccttccacctgcataagaaagt

SEQ ID NO: 867991 - DNA, 25 bp, Mus musculus
tgcccttccagaacattagatgctc

SEQ ID NO: 867992 - DNA, 25 bp, Mus musculus
tgcccttccagatcattagatgctc

SEQ ID NO: 867993 - DNA, 25 bp, Mus musculus
tgcccttccaggagatctgagtttg

SEQ ID NO: 867994 - DNA, 25 bp, Mus musculus
tgcccttccaggtgatctgagtttg

SEQ ID NO: 867995 - DNA, 25 bp, Mus musculus
tgcccttccatacctttctgtttgc

SEQ ID NO: 867996 - DNA, 25 bp, Mus musculus
tgcccttccatagctttctgtttgc

SEQ ID NO: 867997 - DNA, 25 bp, Mus musculus
tgcccttcccaacatgaataaaccg

SEQ ID NO: 867998 - DNA, 25 bp, Mus musculus
tgcccttcccaagatgaataaaccg

SEQ ID NO: 867999 - DNA, 25 bp, Mus musculus
tgcccttcccacaactttgttatta

SEQ ID NO: 868000 - DNA, 25 bp, Mus musculus
tgcccttcccactactttgttatta

SEQ ID NO: 868001 - DNA, 25 bp, Mus musculus
tgcccttccttacagctgtagatat

SEQ ID NO: 868002 - DNA, 25 bp, Mus musculus
tgcccttccttagagctgtagatat

SEQ ID NO: 868003 - DNA, 25 bp, Mus musculus
tgcccttcgcagcaaagacttgacc

SEQ ID NO: 868004 - DNA, 25 bp, Mus musculus
tgcccttcgcaggaaagacttgacc

SEQ ID NO: 868005 - DNA, 25 bp, Mus musculus
tgcccttcggcgagagcgggaaaaa

SEQ ID NO: 868006 - DNA, 25 bp, Mus musculus
tgcccttcggcgtgagcgggaaaaa

SEQ ID NO: 868007 - DNA, 25 bp, Mus musculus
tgcccttcggctccgacatggaaga

SEQ ID NO: 868008 - DNA, 25 bp, Mus musculus
tgcccttcggctgcgacatggaaga

SEQ ID NO: 868009 - DNA, 25 bp, Mus musculus
tgcccttctaacaaactgcttattt

SEQ ID NO: 868010 - DNA, 25 bp, Mus musculus
tgcccttctaactaactgcttattt

SEQ ID NO: 868011 - DNA, 25 bp, Mus musculus
tgcccttctcagacctctgaacagt

SEQ ID NO: 868012 - DNA, 25 bp, Mus musculus
tgcccttctcagtcctctgaacagt

SEQ ID NO: 868013 - DNA, 25 bp, Mus musculus
tgcccttctgaaccgtaaatacagg

SEQ ID NO: 868014 - DNA, 25 bp, Mus musculus
tgcccttctgaagcgtaaatacagg

SEQ ID NO: 868015 - DNA, 25 bp, Mus musculus
tgcccttctttactagtccctggga

SEQ ID NO: 868016 - DNA, 25 bp, Mus musculus
tgcccttctttagtagtccctggga

SEQ ID NO: 868017 - DNA, 25 bp, Mus musculus
tgcccttgaactaggctatgtagag

SEQ ID NO: 868018 - DNA, 25 bp, Mus musculus
tgcccttgaactatctgagccagag

SEQ ID NO: 868019 - DNA, 25 bp, Mus musculus
tgcccttgaacttggctatgtagag

SEQ ID NO: 868020 - DNA, 25 bp, Mus musculus
tgcccttgaactttctgagccagag

SEQ ID NO: 868021 - DNA, 25 bp, Mus musculus
tgcccttgaagcatcagcccgactt

SEQ ID NO: 868022 - DNA, 25 bp, Mus musculus
tgcccttgaagcttcagcccgactt

SEQ ID NO: 868023 - DNA, 25 bp, Mus musculus
tgcccttgaatccaagagatcctcc

SEQ ID NO: 868024 - DNA, 25 bp, Mus musculus
tgcccttgaatcgaagagatcctcc

SEQ ID NO: 868025 - DNA, 25 bp, Mus musculus
tgcccttgagctcatgtccctgagt

SEQ ID NO: 868026 - DNA, 25 bp, Mus musculus
tgcccttgagctgatgtccctgagt

SEQ ID NO: 868027 - DNA, 25 bp, Mus musculus
tgcccttgcagtcctggaactatgt

SEQ ID NO: 868028 - DNA, 25 bp, Mus musculus
tgcccttgcagtgctggaactatgt

SEQ ID NO: 868029 - DNA, 25 bp, Mus musculus
tgcccttgcctacgaagcccaaggt

SEQ ID NO: 868030 - DNA, 25 bp, Mus musculus
tgcccttgcctaggaagcccaaggt

SEQ ID NO: 868031 - DNA, 25 bp, Mus musculus
tgcccttgcctgctaagctgagtga

SEQ ID NO: 868032 - DNA, 25 bp, Mus musculus
tgcccttgcctgctaatgtcatcct

SEQ ID NO: 868033 - DNA, 25 bp, Mus musculus
tgcccttgcctggtaagctgagtga

SEQ ID NO: 868034 - DNA, 25 bp, Mus musculus
tgcccttgcctggtaatgtcatcct

SEQ ID NO: 868035 - DNA, 25 bp, Mus musculus
tgcccttgctccaaaaggcaactgt

SEQ ID NO: 868036 - DNA, 25 bp, Mus musculus
tgcccttgctcctaaaggcaactgt

SEQ ID NO: 868037 - DNA, 25 bp, Mus musculus
tgcccttgcttcacagatggtcatt

SEQ ID NO: 868038 - DNA, 25 bp, Mus musculus
tgcccttgcttctcagatggtcatt

SEQ ID NO: 868039 - DNA, 25 bp, Mus musculus
tgcccttggaacatgcctactttaa

SEQ ID NO: 868040 - DNA, 25 bp, Mus musculus
tgcccttggaacctgtgttgttcat

SEQ ID NO: 868041 - DNA, 25 bp, Mus musculus
tgcccttggaacgtgtgttgttcat

SEQ ID NO: 868042 - DNA, 25 bp, Mus musculus
tgcccttggaacttgcctactttaa

SEQ ID NO: 868043 - DNA, 25 bp, Mus musculus
tgcccttggactcatcctcagagaa

SEQ ID NO: 868044 - DNA, 25 bp, Mus musculus
tgcccttggactctgccactaaatg

SEQ ID NO: 868045 - DNA, 25 bp, Mus musculus
tgcccttggactgatcctcagagaa

SEQ ID NO: 868046 - DNA, 25 bp, Mus musculus
tgcccttggactgtgccactaaatg

SEQ ID NO: 868047 - DNA, 25 bp, Mus musculus
tgcccttggtctcgtcggaaccaaa

SEQ ID NO: 868048 - DNA, 25 bp, Mus musculus
tgcccttggtctggtcggaaccaaa

SEQ ID NO: 868049 - DNA, 25 bp, Mus musculus
tgcccttggtgtagtcagtgccgaa

SEQ ID NO: 868050 - DNA, 25 bp, Mus musculus
tgcccttggtgttgtcagtgccgaa

SEQ ID NO: 868051 - DNA, 25 bp, Mus musculus
tgcccttgtactccataaagtcctc

SEQ ID NO: 868052 - DNA, 25 bp, Mus musculus
tgcccttgtactgcataaagtcctc

SEQ ID NO: 868053 - DNA, 25 bp, Mus musculus
tgcccttgtagaccgcataagtcag

SEQ ID NO: 868054 - DNA, 25 bp, Mus musculus
tgcccttgtagagcgcataagtcag

SEQ ID NO: 868055 - DNA, 25 bp, Mus musculus
tgcccttgtgaccttaggttgtcaa

SEQ ID NO: 868056 - DNA, 25 bp, Mus musculus
tgcccttgtgacgttaggttgtcaa

SEQ ID NO: 868057 - DNA, 25 bp, Mus musculus
tgcccttgtgccatagttcagttcc

SEQ ID NO: 868058 - DNA, 25 bp, Mus musculus
tgcccttgtgccttagttcagttcc

SEQ ID NO: 868059 - DNA, 25 bp, Mus musculus
tgcccttgtgtcctcatcagaacag

SEQ ID NO: 868060 - DNA, 25 bp, Mus musculus
tgcccttgtgtcgtcatcagaacag

SEQ ID NO: 868061 - DNA, 25 bp, Mus musculus
tgcccttgttgtaagtggccatgtg

SEQ ID NO: 868062 - DNA, 25 bp, Mus musculus
tgcccttgttgttagtggccatgtg

SEQ ID NO: 868063 - DNA, 25 bp, Mus musculus
tgcccttgttttatgagtggtccta

SEQ ID NO: 868064 - DNA, 25 bp, Mus musculus
tgcccttgttttttgagtggtccta

SEQ ID NO: 868065 - DNA, 25 bp, Mus musculus
tgccctttaaagaggattactgaaa

SEQ ID NO: 868066 - DNA, 25 bp, Mus musculus
tgccctttaaagtggattactgaaa

SEQ ID NO: 868067 - DNA, 25 bp, Mus musculus
tgccctttaataacaggcgctgaag

SEQ ID NO: 868068 - DNA, 25 bp, Mus musculus
tgccctttaatatcaggcgctgaag

SEQ ID NO: 868069 - DNA, 25 bp, Mus musculus
tgccctttacttacctttgaacttg

SEQ ID NO: 868070 - DNA, 25 bp, Mus musculus
tgccctttactttcctttgaacttg

SEQ ID NO: 868071 - DNA, 25 bp, Mus musculus
tgccctttagcaacttctgctatgt

SEQ ID NO: 868072 - DNA, 25 bp, Mus musculus
tgccctttagcatcttctgctatgt

SEQ ID NO: 868073 - DNA, 25 bp, Mus musculus
tgccctttatgacatgttgcggtta

SEQ ID NO: 868074 - DNA, 25 bp, Mus musculus
tgccctttatgagatgttgcggtta

SEQ ID NO: 868075 - DNA, 25 bp, Mus musculus
tgccctttcactaacacagctagac

SEQ ID NO: 868076 - DNA, 25 bp, Mus musculus
tgccctttcactcctgtggtggagt

SEQ ID NO: 868077 - DNA, 25 bp, Mus musculus
tgccctttcactgctgtggtggagt

SEQ ID NO: 868078 - DNA, 25 bp, Mus musculus
tgccctttcacttacacagctagac

SEQ ID NO: 868079 - DNA, 25 bp, Mus musculus
tgccctttccacagttcttagataa

SEQ ID NO: 868080 - DNA, 25 bp, Mus musculus
tgccctttccacctggtagacagct

SEQ ID NO: 868081 - DNA, 25 bp, Mus musculus
tgccctttccacgtggtagacagct

SEQ ID NO: 868082 - DNA, 25 bp, Mus musculus
tgccctttccactgttcttagataa

SEQ ID NO: 868083 - DNA, 25 bp, Mus musculus
tgccctttccagcactgcagagtgg

SEQ ID NO: 868084 - DNA, 25 bp, Mus musculus
tgccctttccaggactgcagagtgg

SEQ ID NO: 868085 - DNA, 25 bp, Mus musculus
tgccctttctcccacatcggttttt

SEQ ID NO: 868086 - DNA, 25 bp, Mus musculus
tgccctttctccgacatcggttttt

SEQ ID NO: 868087 - DNA, 25 bp, Mus musculus
tgccctttctgaaggcccgtgtgga

SEQ ID NO: 868088 - DNA, 25 bp, Mus musculus
tgccctttctgaatgccacttgtaa

SEQ ID NO: 868089 - DNA, 25 bp, Mus musculus
tgccctttctgatggcccgtgtgga

SEQ ID NO: 868090 - DNA, 25 bp, Mus musculus
tgccctttctgattgccacttgtaa

SEQ ID NO: 868091 - DNA, 25 bp, Mus musculus
tgccctttctggcatgcagcacaag

SEQ ID NO: 868092 - DNA, 25 bp, Mus musculus
tgccctttctgggatgcagcacaag

SEQ ID NO: 868093 - DNA, 25 bp, Mus musculus
tgccctttcttgatccacagggtct

SEQ ID NO: 868094 - DNA, 25 bp, Mus musculus
tgccctttcttgcagttttccaaaa

SEQ ID NO: 868095 - DNA, 25 bp, Mus musculus
tgccctttcttggagttttccaaaa

SEQ ID NO: 868096 - DNA, 25 bp, Mus musculus
tgccctttcttgttccacagggtct

SEQ ID NO: 868097 - DNA, 25 bp, Mus musculus
tgccctttgaggaccgtgatttaag

SEQ ID NO: 868098 - DNA, 25 bp, Mus musculus
tgccctttgaggtccgtgatttaag

SEQ ID NO: 868099 - DNA, 25 bp, Mus musculus
tgccctttgatcatgttctctagga

SEQ ID NO: 868100 - DNA, 25 bp, Mus musculus
tgccctttgatcttgttctctagga

SEQ ID NO: 868101 - DNA, 25 bp, Mus musculus
tgccctttgatgacaccaatctcaa

SEQ ID NO: 868102 - DNA, 25 bp, Mus musculus
tgccctttgatgtcaccaatctcaa

SEQ ID NO: 868103 - DNA, 25 bp, Mus musculus
tgccctttgcagaatttctcctagt

SEQ ID NO: 868104 - DNA, 25 bp, Mus musculus
tgccctttgcagtatttctcctagt

SEQ ID NO: 868105 - DNA, 25 bp, Mus musculus
tgccctttgcctatagagcacagtg

SEQ ID NO: 868106 - DNA, 25 bp, Mus musculus
tgccctttgcctttagagcacagtg

SEQ ID NO: 868107 - DNA, 25 bp, Mus musculus
tgccctttggaaccacacttctgaa

SEQ ID NO: 868108 - DNA, 25 bp, Mus musculus
tgccctttggaagcacacttctgaa

SEQ ID NO: 868109 - DNA, 25 bp, Mus musculus
tgccctttgtccacctagttgaaac

SEQ ID NO: 868110 - DNA, 25 bp, Mus musculus
tgccctttgtcctcctagttgaaac

SEQ ID NO: 868111 - DNA, 25 bp, Mus musculus
tgccctttgtgaattcagtcttggt

SEQ ID NO: 868112 - DNA, 25 bp, Mus musculus
tgccctttgtgatttcagtcttggt

SEQ ID NO: 868113 - DNA, 25 bp, Mus musculus
tgccctttgtgtactgggaatcaaa

SEQ ID NO: 868114 - DNA, 25 bp, Mus musculus
tgccctttgtgttctgggaatcaaa

SEQ ID NO: 868115 - DNA, 25 bp, Mus musculus
tgcccttttgttctgctgagggagc

SEQ ID NO: 868116 - DNA, 25 bp, Mus musculus
tgcccttttgttgtgctgagggagc

SEQ ID NO: 868117 - DNA, 25 bp, Mus musculus
tgccgaaaccgaccagagataatgt

SEQ ID NO: 868118 - DNA, 25 bp, Mus musculus
tgccgaaaccgagcagagataatgt

SEQ ID NO: 868119 - DNA, 25 bp, Mus musculus
tgccgaaagcctcttgttcgcgaca

SEQ ID NO: 868120 - DNA, 25 bp, Mus musculus
tgccgaaagcctgttgttcgcgaca

SEQ ID NO: 868121 - DNA, 25 bp, Mus musculus
tgccgaaccagtagctcctaagagc

SEQ ID NO: 868122 - DNA, 25 bp, Mus musculus
tgccgaaccagttgctcctaagagc

SEQ ID NO: 868123 - DNA, 25 bp, Mus musculus
tgccgaactagaagaaagccctccc

SEQ ID NO: 868124 - DNA, 25 bp, Mus musculus
tgccgaactagatgaaagccctccc

SEQ ID NO: 868125 - DNA, 25 bp, Mus musculus
tgccgaagaggcactgttgaacccc

SEQ ID NO: 868126 - DNA, 25 bp, Mus musculus
tgccgaagaggctctgttgaacccc

SEQ ID NO: 868127 - DNA, 25 bp, Mus musculus
tgccgaagccaccattgttgtcatg

SEQ ID NO: 868128 - DNA, 25 bp, Mus musculus
tgccgaagccacgattgttgtcatg

SEQ ID NO: 868129 - DNA, 25 bp, Mus musculus
tgccgaagcttcatggacgccatat

SEQ ID NO: 868130 - DNA, 25 bp, Mus musculus
tgccgaagcttcttggacgccatat

SEQ ID NO: 868131 - DNA, 25 bp, Mus musculus
tgccgacaacagacttaccacagtt

SEQ ID NO: 868132 - DNA, 25 bp, Mus musculus
tgccgacaacagtcttaccacagtt

SEQ ID NO: 868133 - DNA, 25 bp, Mus musculus
tgccgacagaacacactgagctgtg

SEQ ID NO: 868134 - DNA, 25 bp, Mus musculus
tgccgacagaactcactgagctgtg

SEQ ID NO: 868135 - DNA, 25 bp, Mus musculus
tgccgacaggctacgtcctttttaa

SEQ ID NO: 868136 - DNA, 25 bp, Mus musculus
tgccgacaggcttcgtcctttttaa

SEQ ID NO: 868137 - DNA, 25 bp, Mus musculus
tgccgacatacacttaaggttctct

SEQ ID NO: 868138 - DNA, 25 bp, Mus musculus
tgccgacatacagttaaggttctct

SEQ ID NO: 868139 - DNA, 25 bp, Mus musculus
tgccgaccaatcataggccggtatg

SEQ ID NO: 868140 - DNA, 25 bp, Mus musculus
tgccgaccaatcttaggccggtatg

SEQ ID NO: 868141 - DNA, 25 bp, Mus musculus
tgccgacccaagacttcagcaagga

SEQ ID NO: 868142 - DNA, 25 bp, Mus musculus
tgccgacccaagtcttcagcaagga

SEQ ID NO: 868143 - DNA, 25 bp, Mus musculus
tgccgacccctacttaactctggtt

SEQ ID NO: 868144 - DNA, 25 bp, Mus musculus
tgccgacccctagttaactctggtt

SEQ ID NO: 868145 - DNA, 25 bp, Mus musculus
tgccgaccctacaggctggcagctg

SEQ ID NO: 868146 - DNA, 25 bp, Mus musculus
tgccgaccctactggctggcagctg

SEQ ID NO: 868147 - DNA, 25 bp, Mus musculus
tgccgaccctcgctgagaactgact

SEQ ID NO: 868148 - DNA, 25 bp, Mus musculus
tgccgaccctcggtgagaactgact

SEQ ID NO: 868149 - DNA, 25 bp, Mus musculus
tgccgactcggcaaccttttaaaat

SEQ ID NO: 868150 - DNA, 25 bp, Mus musculus
tgccgactcggctaccttttaaaat

SEQ ID NO: 868151 - DNA, 25 bp, Mus musculus
tgccgagaatcgaacttaacccatt

SEQ ID NO: 868152 - DNA, 25 bp, Mus musculus
tgccgagaatcgtacttaacccatt

SEQ ID NO: 868153 - DNA, 25 bp, Mus musculus
tgccgagacagcacctggagtacat

SEQ ID NO: 868154 - DNA, 25 bp, Mus musculus
tgccgagacagctcctggagtacat

SEQ ID NO: 868155 - DNA, 25 bp, Mus musculus
tgccgagaggagatctgcgttgcca

SEQ ID NO: 868156 - DNA, 25 bp, Mus musculus
tgccgagaggagttctgcgttgcca

SEQ ID NO: 868157 - DNA, 25 bp, Mus musculus
tgccgagcaagcctttcttaactga

SEQ ID NO: 868158 - DNA, 25 bp, Mus musculus
tgccgagcaagcgtttcttaactga

SEQ ID NO: 868159 - DNA, 25 bp, Mus musculus
tgccgagccaaaccctgtttgtttt

SEQ ID NO: 868160 - DNA, 25 bp, Mus musculus
tgccgagccaaagcctgtttgtttt

SEQ ID NO: 868161 - DNA, 25 bp, Mus musculus
tgccgagcccgcagaggagtcgcca

SEQ ID NO: 868162 - DNA, 25 bp, Mus musculus
tgccgagcccgctgaggagtcgcca

SEQ ID NO: 868163 - DNA, 25 bp, Mus musculus
tgccgagctaaccaaggtatttgaa

SEQ ID NO: 868164 - DNA, 25 bp, Mus musculus
tgccgagctaacgaaggtatttgaa

SEQ ID NO: 868165 - DNA, 25 bp, Mus musculus
tgccgagctaagatcacatctatta

SEQ ID NO: 868166 - DNA, 25 bp, Mus musculus
tgccgagctaagttcacatctatta

SEQ ID NO: 868167 - DNA, 25 bp, Mus musculus
tgccgagctgcgacacgtcatgacg

SEQ ID NO: 868168 - DNA, 25 bp, Mus musculus
tgccgagctgcgtcacgtcatgacg

SEQ ID NO: 868169 - DNA, 25 bp, Mus musculus
tgccgagctggtacgatgaggccaa

SEQ ID NO: 868170 - DNA, 25 bp, Mus musculus
tgccgagctggttcgatgaggccaa

SEQ ID NO: 868171 - DNA, 25 bp, Mus musculus
tgccgagctttgcttttctctggac

SEQ ID NO: 868172 - DNA, 25 bp, Mus musculus
tgccgagctttggttttctctggac

SEQ ID NO: 868173 - DNA, 25 bp, Mus musculus
tgccgaggagcaaggaccgtagttc

SEQ ID NO: 868174 - DNA, 25 bp, Mus musculus
tgccgaggagcatggaccgtagttc

SEQ ID NO: 868175 - DNA, 25 bp, Mus musculus
tgccgaggccgtctttgcttctgag

SEQ ID NO: 868176 - DNA, 25 bp, Mus musculus
tgccgaggccgtgtttgcttctgag

SEQ ID NO: 868177 - DNA, 25 bp, Mus musculus
tgccgaggcggcacgtgcgttcttc

SEQ ID NO: 868178 - DNA, 25 bp, Mus musculus
tgccgaggcggctcgtgcgttcttc

SEQ ID NO: 868179 - DNA, 25 bp, Mus musculus
tgccgagggagcagttcttgatgaa

SEQ ID NO: 868180 - DNA, 25 bp, Mus musculus
tgccgagggagctgttcttgatgaa

SEQ ID NO: 868181 - DNA, 25 bp, Mus musculus
tgccgagggtcacctagactcactt

SEQ ID NO: 868182 - DNA, 25 bp, Mus musculus
tgccgagggtcagctagactcactt

SEQ ID NO: 868183 - DNA, 25 bp, Mus musculus
tgccgagtccccaccgcggagggaa

SEQ ID NO: 868184 - DNA, 25 bp, Mus musculus
tgccgagtcccctccgcggagggaa

SEQ ID NO: 868185 - DNA, 25 bp, Mus musculus
tgccgagttgtcatctccaaagcaa

SEQ ID NO: 868186 - DNA, 25 bp, Mus musculus
tgccgagttgtcttctccaaagcaa

SEQ ID NO: 868187 - DNA, 25 bp, Mus musculus
tgccgagtttgcagatgcctttcat

SEQ ID NO: 868188 - DNA, 25 bp, Mus musculus
tgccgagtttgctgatgcctttcat

SEQ ID NO: 868189 - DNA, 25 bp, Mus musculus
tgccgatcgtctcacgcgcgctgat

SEQ ID NO: 868190 - DNA, 25 bp, Mus musculus
tgccgatcgtctgacgcgcgctgat

SEQ ID NO: 868191 - DNA, 25 bp, Mus musculus
tgccgatgccctacctacatggttt

SEQ ID NO: 868192 - DNA, 25 bp, Mus musculus
tgccgatgcccttcctacatggttt

SEQ ID NO: 868193 - DNA, 25 bp, Mus musculus
tgccgatgccggagtttttccttcc

SEQ ID NO: 868194 - DNA, 25 bp, Mus musculus
tgccgatgccggtgtttttccttcc

SEQ ID NO: 868195 - DNA, 25 bp, Mus musculus
tgccgatgccgtaaaagcaagtgct

SEQ ID NO: 868196 - DNA, 25 bp, Mus musculus
tgccgatgccgttaaagcaagtgct

SEQ ID NO: 868197 - DNA, 25 bp, Mus musculus
tgccgatggcttcacatgcgcagat

SEQ ID NO: 868198 - DNA, 25 bp, Mus musculus
tgccgatggcttcacgtaccccgta

SEQ ID NO: 868199 - DNA, 25 bp, Mus musculus
tgccgatggcttgacatgcgcagat

SEQ ID NO: 868200 - DNA, 25 bp, Mus musculus
tgccgatggcttgacgtaccccgta

SEQ ID NO: 868201 - DNA, 25 bp, Mus musculus
tgccgattacaacttgctggacctg

SEQ ID NO: 868202 - DNA, 25 bp, Mus musculus
tgccgattacaagttgctggacctg

SEQ ID NO: 868203 - DNA, 25 bp, Mus musculus
tgccgattccagagggctacgaagc

SEQ ID NO: 868204 - DNA, 25 bp, Mus musculus
tgccgattccagtgggctacgaagc

SEQ ID NO: 868205 - DNA, 25 bp, Mus musculus
tgccgatttgagatcgcgacacaat

SEQ ID NO: 868206 - DNA, 25 bp, Mus musculus
tgccgatttgagttcgcgacacaat

SEQ ID NO: 868207 - DNA, 25 bp, Mus musculus
tgccgatttgcacattaaatgactc

SEQ ID NO: 868208 - DNA, 25 bp, Mus musculus
tgccgatttgcagattaaatgactc

SEQ ID NO: 868209 - DNA, 25 bp, Mus musculus
tgccgattttctctcaacatttcta

SEQ ID NO: 868210 - DNA, 25 bp, Mus musculus
tgccgattttctgtcaacatttcta

SEQ ID NO: 868211 - DNA, 25 bp, Mus musculus
tgccgcaaaaaccttcctaactcaa

SEQ ID NO: 868212 - DNA, 25 bp, Mus musculus
tgccgcaaaaacgttcctaactcaa

SEQ ID NO: 868213 - DNA, 25 bp, Mus musculus
tgccgcaaacacagagataatttag

SEQ ID NO: 868214 - DNA, 25 bp, Mus musculus
tgccgcaaacactgagataatttag

SEQ ID NO: 868215 - DNA, 25 bp, Mus musculus
tgccgcaccttcagggagataattg

SEQ ID NO: 868216 - DNA, 25 bp, Mus musculus
tgccgcaccttctgggagataattg

SEQ ID NO: 868217 - DNA, 25 bp, Mus musculus
tgccgcaccttgcaaggcaattctg

SEQ ID NO: 868218 - DNA, 25 bp, Mus musculus
tgccgcaccttggaaggcaattctg

SEQ ID NO: 868219 - DNA, 25 bp, Mus musculus
tgccgcacgggtcatgaactctgga

SEQ ID NO: 868220 - DNA, 25 bp, Mus musculus
tgccgcacgggtgatgaactctgga

SEQ ID NO: 868221 - DNA, 25 bp, Mus musculus
tgccgcagacacatggattcagtac

SEQ ID NO: 868222 - DNA, 25 bp, Mus musculus
tgccgcagacacttggattcagtac

SEQ ID NO: 868223 - DNA, 25 bp, Mus musculus
tgccgcagacttcacttagtgttgg

SEQ ID NO: 868224 - DNA, 25 bp, Mus musculus
tgccgcagacttgacttagtgttgg

SEQ ID NO: 868225 - DNA, 25 bp, Mus musculus
tgccgcagcagccaacgtgtactcg

SEQ ID NO: 868226 - DNA, 25 bp, Mus musculus
tgccgcagcagcgaacgtgtactcg

SEQ ID NO: 868227 - DNA, 25 bp, Mus musculus
tgccgcagtctgcacaaggactatg

SEQ ID NO: 868228 - DNA, 25 bp, Mus musculus
tgccgcagtctggacaaggactatg

SEQ ID NO: 868229 - DNA, 25 bp, Mus musculus
tgccgcagtggacgccgaactttag

SEQ ID NO: 868230 - DNA, 25 bp, Mus musculus
tgccgcagtggaggccgaactttag

SEQ ID NO: 868231 - DNA, 25 bp, Mus musculus
tgccgcatcagacaggagcccagga

SEQ ID NO: 868232 - DNA, 25 bp, Mus musculus
tgccgcatcagagaggagcccagga

SEQ ID NO: 868233 - DNA, 25 bp, Mus musculus
tgccgcattcagaaacacgttccat

SEQ ID NO: 868234 - DNA, 25 bp, Mus musculus
tgccgcattcagtaacacgttccat

SEQ ID NO: 868235 - DNA, 25 bp, Mus musculus
tgccgccaaagcctatgaggtccag

SEQ ID NO: 868236 - DNA, 25 bp, Mus musculus
tgccgccaaagcgtatgaggtccag

SEQ ID NO: 868237 - DNA, 25 bp, Mus musculus
tgccgccacctcagatattttggaa

SEQ ID NO: 868238 - DNA, 25 bp, Mus musculus
tgccgccacctctgatattttggaa

SEQ ID NO: 868239 - DNA, 25 bp, Mus musculus
tgccgccagcgtctcgtcatggaga

SEQ ID NO: 868240 - DNA, 25 bp, Mus musculus
tgccgccagcgtgtcgtcatggaga

SEQ ID NO: 868241 - DNA, 25 bp, Mus musculus
tgccgccagctaaggagttggcgct

SEQ ID NO: 868242 - DNA, 25 bp, Mus musculus
tgccgccagctatggagttggcgct

SEQ ID NO: 868243 - DNA, 25 bp, Mus musculus
tgccgccatcggagtgctatagctt

SEQ ID NO: 868244 - DNA, 25 bp, Mus musculus
tgccgccatcggtgtgctatagctt

SEQ ID NO: 868245 - DNA, 25 bp, Mus musculus
tgccgccatgcacttcctttggaac

SEQ ID NO: 868246 - DNA, 25 bp, Mus musculus
tgccgccatgcagttcctttggaac

SEQ ID NO: 868247 - DNA, 25 bp, Mus musculus
tgccgccatggcagtcactgacaaa

SEQ ID NO: 868248 - DNA, 25 bp, Mus musculus
tgccgccatggctgtcactgacaaa

SEQ ID NO: 868249 - DNA, 25 bp, Mus musculus
tgccgccccaatatcgaaccccaag

SEQ ID NO: 868250 - DNA, 25 bp, Mus musculus
tgccgccccaatttcgaaccccaag

SEQ ID NO: 868251 - DNA, 25 bp, Mus musculus
tgccgccctcatagtgaccttgggt

SEQ ID NO: 868252 - DNA, 25 bp, Mus musculus
tgccgccctcattgtgaccttgggt

SEQ ID NO: 868253 - DNA, 25 bp, Mus musculus
tgccgccgttcgatgatgaatccag

SEQ ID NO: 868254 - DNA, 25 bp, Mus musculus
tgccgccgttcgttgatgaatccag

SEQ ID NO: 868255 - DNA, 25 bp, Mus musculus
tgccgcctgcttcgtttttatacga

SEQ ID NO: 868256 - DNA, 25 bp, Mus musculus
tgccgcctgcttggtttttatacga

SEQ ID NO: 868257 - DNA, 25 bp, Mus musculus
tgccgcctgtctacagccagagagg

SEQ ID NO: 868258 - DNA, 25 bp, Mus musculus
tgccgcctgtcttcagccagagagg

SEQ ID NO: 868259 - DNA, 25 bp, Mus musculus
tgccgcctgtttcttacgatgcaga

SEQ ID NO: 868260 - DNA, 25 bp, Mus musculus
tgccgcctgtttgttacgatgcaga

SEQ ID NO: 868261 - DNA, 25 bp, Mus musculus
tgccgccttggcctctagggttgaa

SEQ ID NO: 868262 - DNA, 25 bp, Mus musculus
tgccgccttggcgtctagggttgaa

SEQ ID NO: 868263 - DNA, 25 bp, Mus musculus
tgccgcgaacagatcctactgagat

SEQ ID NO: 868264 - DNA, 25 bp, Mus musculus
tgccgcgaacagttcctactgagat

SEQ ID NO: 868265 - DNA, 25 bp, Mus musculus
tgccgcgcagcaatatgtgagcctg

SEQ ID NO: 868266 - DNA, 25 bp, Mus musculus
tgccgcgcagcattatgtgagcctg

SEQ ID NO: 868267 - DNA, 25 bp, Mus musculus
tgccgcggcgtcatttagtgtgtct

SEQ ID NO: 868268 - DNA, 25 bp, Mus musculus
tgccgcggcgtcttttagtgtgtct

SEQ ID NO: 868269 - DNA, 25 bp, Mus musculus
tgccgcgggctcaggtccactcgaa

SEQ ID NO: 868270 - DNA, 25 bp, Mus musculus
tgccgcgggctctggtccactcgaa

SEQ ID NO: 868271 - DNA, 25 bp, Mus musculus
tgccgcgggtaccatgaagatctct

SEQ ID NO: 868272 - DNA, 25 bp, Mus musculus
tgccgcgggtacgatgaagatctct

SEQ ID NO: 868273 - DNA, 25 bp, Mus musculus
tgccgcgtcagtcatgccgaagcac

SEQ ID NO: 868274 - DNA, 25 bp, Mus musculus
tgccgcgtcagtgatgccgaagcac

SEQ ID NO: 868275 - DNA, 25 bp, Mus musculus
tgccgcgttaaaactcaactccgaa

SEQ ID NO: 868276 - DNA, 25 bp, Mus musculus
tgccgcgttaaatctcaactccgaa

SEQ ID NO: 868277 - DNA, 25 bp, Mus musculus
tgccgctagacacagttcacaggag

SEQ ID NO: 868278 - DNA, 25 bp, Mus musculus
tgccgctagacagagttcacaggag

SEQ ID NO: 868279 - DNA, 25 bp, Mus musculus
tgccgctcaggcaaatgtcaaactc

SEQ ID NO: 868280 - DNA, 25 bp, Mus musculus
tgccgctcaggctaatgtcaaactc

SEQ ID NO: 868281 - DNA, 25 bp, Mus musculus
tgccgctccactcaattactcgatt

SEQ ID NO: 868282 - DNA, 25 bp, Mus musculus
tgccgctccactgaattactcgatt

SEQ ID NO: 868283 - DNA, 25 bp, Mus musculus
tgccgctcttaactgactctctgta

SEQ ID NO: 868284 - DNA, 25 bp, Mus musculus
tgccgctcttaagtgactctctgta

SEQ ID NO: 868285 - DNA, 25 bp, Mus musculus
tgccgctgagaacagagccatcaag

SEQ ID NO: 868286 - DNA, 25 bp, Mus musculus
tgccgctgagaagagagccatcaag

SEQ ID NO: 868287 - DNA, 25 bp, Mus musculus
tgccgctgataacgcactgttcaca

SEQ ID NO: 868288 - DNA, 25 bp, Mus musculus
tgccgctgataaggcactgttcaca

SEQ ID NO: 868289 - DNA, 25 bp, Mus musculus
tgccgctgatgcataaaaccacagt

SEQ ID NO: 868290 - DNA, 25 bp, Mus musculus
tgccgctgatgcttaaaaccacagt

SEQ ID NO: 868291 - DNA, 25 bp, Mus musculus
tgccgctgcggcactccgagtgcga

SEQ ID NO: 868292 - DNA, 25 bp, Mus musculus
tgccgctgcggctctccgagtgcga

SEQ ID NO: 868293 - DNA, 25 bp, Mus musculus
tgccgctggccaaagtagctcagta

SEQ ID NO: 868294 - DNA, 25 bp, Mus musculus
tgccgctggccatagtagctcagta

SEQ ID NO: 868295 - DNA, 25 bp, Mus musculus
tgccgctggcgaaccggagtcacgc

SEQ ID NO: 868296 - DNA, 25 bp, Mus musculus
tgccgctggcgatccggagtcacgc

SEQ ID NO: 868297 - DNA, 25 bp, Mus musculus
tgccgctggctgcaagaagcatgaa

SEQ ID NO: 868298 - DNA, 25 bp, Mus musculus
tgccgctggctggaagaagcatgaa

SEQ ID NO: 868299 - DNA, 25 bp, Mus musculus
tgccgctgggttaccgaaatccgat

SEQ ID NO: 868300 - DNA, 25 bp, Mus musculus
tgccgctgggtttccgaaatccgat

SEQ ID NO: 868301 - DNA, 25 bp, Mus musculus
tgccgctgtcttacgagtcatttgt

SEQ ID NO: 868302 - DNA, 25 bp, Mus musculus
tgccgctgtctttcgagtcatttgt

SEQ ID NO: 868303 - DNA, 25 bp, Mus musculus
tgccgctgttgcagggtatcagcag

SEQ ID NO: 868304 - DNA, 25 bp, Mus musculus
tgccgctgttgctgggtatcagcag

SEQ ID NO: 868305 - DNA, 25 bp, Mus musculus
tgccgcttagagaacacagtccagg

SEQ ID NO: 868306 - DNA, 25 bp, Mus musculus
tgccgcttagagtacacagtccagg

SEQ ID NO: 868307 - DNA, 25 bp, Mus musculus
tgccgcttaggcagagcacggtgat

SEQ ID NO: 868308 - DNA, 25 bp, Mus musculus
tgccgcttaggctgagcacggtgat

SEQ ID NO: 868309 - DNA, 25 bp, Mus musculus
tgccgcttcctcatcaagagggaca

SEQ ID NO: 868310 - DNA, 25 bp, Mus musculus
tgccgcttcctcttcaagagggaca

SEQ ID NO: 868311 - DNA, 25 bp, Mus musculus
tgccgcttctggctacaagagtctt

SEQ ID NO: 868312 - DNA, 25 bp, Mus musculus
tgccgcttctgggtacaagagtctt

SEQ ID NO: 868313 - DNA, 25 bp, Mus musculus
tgccgcttggttaccccagaaaaga

SEQ ID NO: 868314 - DNA, 25 bp, Mus musculus
tgccgcttggtttccccagaaaaga

SEQ ID NO: 868315 - DNA, 25 bp, Mus musculus
tgccgctttcctaactctgtgataa

SEQ ID NO: 868316 - DNA, 25 bp, Mus musculus
tgccgctttccttactctgtgataa

SEQ ID NO: 868317 - DNA, 25 bp, Mus musculus
tgccgcttttcacttctaatatttc

SEQ ID NO: 868318 - DNA, 25 bp, Mus musculus
tgccgcttttcagttctaatatttc

SEQ ID NO: 868319 - DNA, 25 bp, Mus musculus
tgccggaagcagaggacactcccga

SEQ ID NO: 868320 - DNA, 25 bp, Mus musculus
tgccggaagcagtggacactcccga

SEQ ID NO: 868321 - DNA, 25 bp, Mus musculus
tgccggaatatcagcaggcggctat

SEQ ID NO: 868322 - DNA, 25 bp, Mus musculus
tgccggaatatctgcaggcggctat

SEQ ID NO: 868323 - DNA, 25 bp, Mus musculus
tgccggacattgatggcacccaaca

SEQ ID NO: 868324 - DNA, 25 bp, Mus musculus
tgccggacattgttggcacccaaca

SEQ ID NO: 868325 - DNA, 25 bp, Mus musculus
tgccggatcccaaccaaggaggttt

SEQ ID NO: 868326 - DNA, 25 bp, Mus musculus
tgccggatcccatccaaggaggttt

SEQ ID NO: 868327 - DNA, 25 bp, Mus musculus
tgccggatcctgcttcgtaaggaag

SEQ ID NO: 868328 - DNA, 25 bp, Mus musculus
tgccggatcctggttcgtaaggaag

SEQ ID NO: 868329 - DNA, 25 bp, Mus musculus
tgccggatgagtatctaggtatgat

SEQ ID NO: 868330 - DNA, 25 bp, Mus musculus
tgccggatgagtttctaggtatgat

SEQ ID NO: 868331 - DNA, 25 bp, Mus musculus
tgccggatgcagacactgaatttct

SEQ ID NO: 868332 - DNA, 25 bp, Mus musculus
tgccggatgcagtcactgaatttct

SEQ ID NO: 868333 - DNA, 25 bp, Mus musculus
tgccggcacatcacagactacaaga

SEQ ID NO: 868334 - DNA, 25 bp, Mus musculus
tgccggcacatctcagactacaaga

SEQ ID NO: 868335 - DNA, 25 bp, Mus musculus
tgccggcactggaatggcccagaat

SEQ ID NO: 868336 - DNA, 25 bp, Mus musculus
tgccggcactggtatggcccagaat

SEQ ID NO: 868337 - DNA, 25 bp, Mus musculus
tgccggcagctgatttggtacaatg

SEQ ID NO: 868338 - DNA, 25 bp, Mus musculus
tgccggcagctgttttggtacaatg

SEQ ID NO: 868339 - DNA, 25 bp, Mus musculus
tgccggcagtctatgatacacgtgt

SEQ ID NO: 868340 - DNA, 25 bp, Mus musculus
tgccggcagtctttgatacacgtgt

SEQ ID NO: 868341 - DNA, 25 bp, Mus musculus
tgccggcctcgtatggacctgaaga

SEQ ID NO: 868342 - DNA, 25 bp, Mus musculus
tgccggcctcgtttggacctgaaga

SEQ ID NO: 868343 - DNA, 25 bp, Mus musculus
tgccggcggaggatcctaatccgag

SEQ ID NO: 868344 - DNA, 25 bp, Mus musculus
tgccggcggaggttcctaatccgag

SEQ ID NO: 868345 - DNA, 25 bp, Mus musculus
tgccggctcagtagctctgactgtg

SEQ ID NO: 868346 - DNA, 25 bp, Mus musculus
tgccggctcagttgctctgactgtg

SEQ ID NO: 868347 - DNA, 25 bp, Mus musculus
tgccggctggatactgtctgataaa

SEQ ID NO: 868348 - DNA, 25 bp, Mus musculus
tgccggctggattctgtctgataaa

SEQ ID NO: 868349 - DNA, 25 bp, Mus musculus
tgccggcttaatctgccatttgcag

SEQ ID NO: 868350 - DNA, 25 bp, Mus musculus
tgccggcttaatgtgccatttgcag

SEQ ID NO: 868351 - DNA, 25 bp, Mus musculus
tgccggcttagtcgagctggattac

SEQ ID NO: 868352 - DNA, 25 bp, Mus musculus
tgccggcttagtggagctggattac

SEQ ID NO: 868353 - DNA, 25 bp, Mus musculus
tgccgggaagtcagacctcgatgct

SEQ ID NO: 868354 - DNA, 25 bp, Mus musculus
tgccgggaagtctgacctcgatgct

SEQ ID NO: 868355 - DNA, 25 bp, Mus musculus
tgccgggaccatcaggctgtgcctc

SEQ ID NO: 868356 - DNA, 25 bp, Mus musculus
tgccgggaccatgaggctgtgcctc

SEQ ID NO: 868357 - DNA, 25 bp, Mus musculus
tgccgggaccccaagggcaagtatg

SEQ ID NO: 868358 - DNA, 25 bp, Mus musculus
tgccgggacccctagggcaagtatg

SEQ ID NO: 868359 - DNA, 25 bp, Mus musculus
tgccgggactgaacctgacctatgc

SEQ ID NO: 868360 - DNA, 25 bp, Mus musculus
tgccgggactgatcctgacctatgc

SEQ ID NO: 868361 - DNA, 25 bp, Mus musculus
tgccgggatcaaagtctgttctggc

SEQ ID NO: 868362 - DNA, 25 bp, Mus musculus
tgccgggatcaatgtctgttctggc

SEQ ID NO: 868363 - DNA, 25 bp, Mus musculus
tgccgggccagcacagcaatgttgt

SEQ ID NO: 868364 - DNA, 25 bp, Mus musculus
tgccgggccagctcagcaatgttgt

SEQ ID NO: 868365 - DNA, 25 bp, Mus musculus
tgccgggcctgcctggacttcaagt

SEQ ID NO: 868366 - DNA, 25 bp, Mus musculus
tgccgggcctgcgtggacttcaagt

SEQ ID NO: 868367 - DNA, 25 bp, Mus musculus
tgccgggtaatcccttccttgcgac

SEQ ID NO: 868368 - DNA, 25 bp, Mus musculus
tgccgggtaatcgcttccttgcgac

SEQ ID NO: 868369 - DNA, 25 bp, Mus musculus
tgccgggtatttacaccagagtttt

SEQ ID NO: 868370 - DNA, 25 bp, Mus musculus
tgccgggtattttcaccagagtttt

SEQ ID NO: 868371 - DNA, 25 bp, Mus musculus
tgccgggtgaatcctgcagactgca

SEQ ID NO: 868372 - DNA, 25 bp, Mus musculus
tgccgggtgaatgctgcagactgca

SEQ ID NO: 868373 - DNA, 25 bp, Mus musculus
tgccgggttctcaaggctctctaca

SEQ ID NO: 868374 - DNA, 25 bp, Mus musculus
tgccgggttctctaggctctctaca

SEQ ID NO: 868375 - DNA, 25 bp, Mus musculus
tgccgggttgcactcattcactaga

SEQ ID NO: 868376 - DNA, 25 bp, Mus musculus
tgccgggttgcagtcattcactaga

SEQ ID NO: 868377 - DNA, 25 bp, Mus musculus
tgccgggttgtcctgactctcacat

SEQ ID NO: 868378 - DNA, 25 bp, Mus musculus
tgccgggttgtcgtgactctcacat

SEQ ID NO: 868379 - DNA, 25 bp, Mus musculus
tgccggtcatgcagggattgagtcc

SEQ ID NO: 868380 - DNA, 25 bp, Mus musculus
tgccggtcatgctgggattgagtcc

SEQ ID NO: 868381 - DNA, 25 bp, Mus musculus
tgccggtgtagtactgcttgctcat

SEQ ID NO: 868382 - DNA, 25 bp, Mus musculus
tgccggtgtagttctgcttgctcat

SEQ ID NO: 868383 - DNA, 25 bp, Mus musculus
tgccggttatgtcccattcccagga

SEQ ID NO: 868384 - DNA, 25 bp, Mus musculus
tgccggttatgtgccattcccagga

SEQ ID NO: 868385 - DNA, 25 bp, Mus musculus
tgccggttccccagagttgtcttca

SEQ ID NO: 868386 - DNA, 25 bp, Mus musculus
tgccggttcccctgagttgtcttca

SEQ ID NO: 868387 - DNA, 25 bp, Mus musculus
tgccggttgcttaaggctttccgga

SEQ ID NO: 868388 - DNA, 25 bp, Mus musculus
tgccggttgctttaggctttccgga

SEQ ID NO: 868389 - DNA, 25 bp, Mus musculus
tgccgtaaggtcacacatgtcccag

SEQ ID NO: 868390 - DNA, 25 bp, Mus musculus
tgccgtaaggtctcacatgtcccag

SEQ ID NO: 868391 - DNA, 25 bp, Mus musculus
tgccgtaatcaccaaggccagtatt

SEQ ID NO: 868392 - DNA, 25 bp, Mus musculus
tgccgtaatcacgaaggccagtatt

SEQ ID NO: 868393 - DNA, 25 bp, Mus musculus
tgccgtaatggcactgaggctgcat

SEQ ID NO: 868394 - DNA, 25 bp, Mus musculus
tgccgtaatggctctgaggctgcat

SEQ ID NO: 868395 - DNA, 25 bp, Mus musculus
tgccgtaccgccagcgaagagtgag

SEQ ID NO: 868396 - DNA, 25 bp, Mus musculus
tgccgtaccgcctgcgaagagtgag

SEQ ID NO: 868397 - DNA, 25 bp, Mus musculus
tgccgtacctctctttaatgttgat

SEQ ID NO: 868398 - DNA, 25 bp, Mus musculus
tgccgtacctctgtttaatgttgat

SEQ ID NO: 868399 - DNA, 25 bp, Mus musculus
tgccgtactgtgatgtgtcaatcag

SEQ ID NO: 868400 - DNA, 25 bp, Mus musculus
tgccgtactgtgttgtgtcaatcag

SEQ ID NO: 868401 - DNA, 25 bp, Mus musculus
tgccgtatccgaagggtttacttct

SEQ ID NO: 868402 - DNA, 25 bp, Mus musculus
tgccgtatccgatgggtttacttct

SEQ ID NO: 868403 - DNA, 25 bp, Mus musculus
tgccgtcacacaccagcaagtgaag

SEQ ID NO: 868404 - DNA, 25 bp, Mus musculus
tgccgtcacacagcagcaagtgaag

SEQ ID NO: 868405 - DNA, 25 bp, Mus musculus
tgccgtccaaacatgaagccttcaa

SEQ ID NO: 868406 - DNA, 25 bp, Mus musculus
tgccgtccaaacttgaagccttcaa

SEQ ID NO: 868407 - DNA, 25 bp, Mus musculus
tgccgtccaaatctaggccttttgt

SEQ ID NO: 868408 - DNA, 25 bp, Mus musculus
tgccgtccaaatgtaggccttttgt

SEQ ID NO: 868409 - DNA, 25 bp, Mus musculus
tgccgtccacggagatctccatgta

SEQ ID NO: 868410 - DNA, 25 bp, Mus musculus
tgccgtccacggtgatctccatgta

SEQ ID NO: 868411 - DNA, 25 bp, Mus musculus
tgccgtccactccaaaatcatgctt

SEQ ID NO: 868412 - DNA, 25 bp, Mus musculus
tgccgtccactcgaaaatcatgctt

SEQ ID NO: 868413 - DNA, 25 bp, Mus musculus
tgccgtcccatgaatcggaagacac

SEQ ID NO: 868414 - DNA, 25 bp, Mus musculus
tgccgtcccatgtatcggaagacac

SEQ ID NO: 868415 - DNA, 25 bp, Mus musculus
tgccgtcctcatatgagtggtttct

SEQ ID NO: 868416 - DNA, 25 bp, Mus musculus
tgccgtcctcatttgagtggtttct

SEQ ID NO: 868417 - DNA, 25 bp, Mus musculus
tgccgtcctgcaactgggaagctgt

SEQ ID NO: 868418 - DNA, 25 bp, Mus musculus
tgccgtcctgcatctgggaagctgt

SEQ ID NO: 868419 - DNA, 25 bp, Mus musculus
tgccgtcggtggacagtggctctct

SEQ ID NO: 868420 - DNA, 25 bp, Mus musculus
tgccgtcggtggtcagtggctctct

SEQ ID NO: 868421 - DNA, 25 bp, Mus musculus
tgccgtctcaaccagctggagagat

SEQ ID NO: 868422 - DNA, 25 bp, Mus musculus
tgccgtctcaacgagctggagagat

SEQ ID NO: 868423 - DNA, 25 bp, Mus musculus
tgccgtctctgtacttatgtttata

SEQ ID NO: 868424 - DNA, 25 bp, Mus musculus
tgccgtctctgttcttatgtttata

SEQ ID NO: 868425 - DNA, 25 bp, Mus musculus
tgccgtcttccactgagcttgtgtg

SEQ ID NO: 868426 - DNA, 25 bp, Mus musculus
tgccgtcttccagtgagcttgtgtg

SEQ ID NO: 868427 - DNA, 25 bp, Mus musculus
tgccgtgaccccaatttagctgtgt

SEQ ID NO: 868428 - DNA, 25 bp, Mus musculus
tgccgtgacccctatttagctgtgt

SEQ ID NO: 868429 - DNA, 25 bp, Mus musculus
tgccgtgaccgaaatgttcctcatt

SEQ ID NO: 868430 - DNA, 25 bp, Mus musculus
tgccgtgaccgatatgttcctcatt

SEQ ID NO: 868431 - DNA, 25 bp, Mus musculus
tgccgtgatttcagagagaattcta

SEQ ID NO: 868432 - DNA, 25 bp, Mus musculus
tgccgtgatttctgagagaattcta

SEQ ID NO: 868433 - DNA, 25 bp, Mus musculus
tgccgtgcacacctgctgagcttga

SEQ ID NO: 868434 - DNA, 25 bp, Mus musculus
tgccgtgcacacgtgctgagcttga

SEQ ID NO: 868435 - DNA, 25 bp, Mus musculus
tgccgtgcagggaatcttactggat

SEQ ID NO: 868436 - DNA, 25 bp, Mus musculus
tgccgtgcagggtatcttactggat

SEQ ID NO: 868437 - DNA, 25 bp, Mus musculus
tgccgtgccacgactgatgtgttag

SEQ ID NO: 868438 - DNA, 25 bp, Mus musculus
tgccgtgccacgtctgatgtgttag

SEQ ID NO: 868439 - DNA, 25 bp, Mus musculus
tgccgtgccactcgtacttctgaaa

SEQ ID NO: 868440 - DNA, 25 bp, Mus musculus
tgccgtgccactggtacttctgaaa

SEQ ID NO: 868441 - DNA, 25 bp, Mus musculus
tgccgtgcccaccaattagtgatgg

SEQ ID NO: 868442 - DNA, 25 bp, Mus musculus
tgccgtgcccacgaattagtgatgg

SEQ ID NO: 868443 - DNA, 25 bp, Mus musculus
tgccgtgctgtacacatttcatcaa

SEQ ID NO: 868444 - DNA, 25 bp, Mus musculus
tgccgtgctgtagacatttcatcaa

SEQ ID NO: 868445 - DNA, 25 bp, Mus musculus
tgccgtggcacacttgtagtggtca

SEQ ID NO: 868446 - DNA, 25 bp, Mus musculus
tgccgtggcacagttgtagtggtca

SEQ ID NO: 868447 - DNA, 25 bp, Mus musculus
tgccgtggccttctccagtgttagt

SEQ ID NO: 868448 - DNA, 25 bp, Mus musculus
tgccgtggccttgtccagtgttagt

SEQ ID NO: 868449 - DNA, 25 bp, Mus musculus
tgccgtgggaacctgaggcttcaca

SEQ ID NO: 868450 - DNA, 25 bp, Mus musculus
tgccgtgggaacgtgaggcttcaca

SEQ ID NO: 868451 - DNA, 25 bp, Mus musculus
tgccgtgggagcatctgcggctaca

SEQ ID NO: 868452 - DNA, 25 bp, Mus musculus
tgccgtgggagcttctgcggctaca

SEQ ID NO: 868453 - DNA, 25 bp, Mus musculus
tgccgtggtggcatactaaggacct

SEQ ID NO: 868454 - DNA, 25 bp, Mus musculus
tgccgtggtggcttactaaggacct

SEQ ID NO: 868455 - DNA, 25 bp, Mus musculus
tgccgtggttgaacatctactctgt

SEQ ID NO: 868456 - DNA, 25 bp, Mus musculus
tgccgtggttgatcatctactctgt

SEQ ID NO: 868457 - DNA, 25 bp, Mus musculus
tgccgtgtgcgtccatgtacacaca

SEQ ID NO: 868458 - DNA, 25 bp, Mus musculus
tgccgtgtgcgtgcatgtacacaca

SEQ ID NO: 868459 - DNA, 25 bp, Mus musculus
tgccgtgtggctcaatattaactac

SEQ ID NO: 868460 - DNA, 25 bp, Mus musculus
tgccgtgtggctgaatattaactac

SEQ ID NO: 868461 - DNA, 25 bp, Mus musculus
tgccgtgttagtccctataaccgga

SEQ ID NO: 868462 - DNA, 25 bp, Mus musculus
tgccgtgttagtgcctataaccgga

SEQ ID NO: 868463 - DNA, 25 bp, Mus musculus
tgccgtgttattccttagttgcttt

SEQ ID NO: 868464 - DNA, 25 bp, Mus musculus
tgccgtgttattgcttagttgcttt

SEQ ID NO: 868465 - DNA, 25 bp, Mus musculus
tgccgtgtttcccttatacttaggt

SEQ ID NO: 868466 - DNA, 25 bp, Mus musculus
tgccgtgtttccgttatacttaggt

SEQ ID NO: 868467 - DNA, 25 bp, Mus musculus
tgccgtgttttcaagctgatttgac

SEQ ID NO: 868468 - DNA, 25 bp, Mus musculus
tgccgtgttttctagctgatttgac

SEQ ID NO: 868469 - DNA, 25 bp, Mus musculus
tgccgttactcacatgaagttcagt

SEQ ID NO: 868470 - DNA, 25 bp, Mus musculus
tgccgttactcagatgaagttcagt

SEQ ID NO: 868471 - DNA, 25 bp, Mus musculus
tgccgttagcagagccagacacaga

SEQ ID NO: 868472 - DNA, 25 bp, Mus musculus
tgccgttagcagtgccagacacaga

SEQ ID NO: 868473 - DNA, 25 bp, Mus musculus
tgccgttcatgaagcccgccaaaga

SEQ ID NO: 868474 - DNA, 25 bp, Mus musculus
tgccgttcatgatgcccgccaaaga

SEQ ID NO: 868475 - DNA, 25 bp, Mus musculus
tgccgttcctgtctggtatttttaa

SEQ ID NO: 868476 - DNA, 25 bp, Mus musculus
tgccgttcctgtgtggtatttttaa

SEQ ID NO: 868477 - DNA, 25 bp, Mus musculus
tgccgttcgtttagcacctagtatg

SEQ ID NO: 868478 - DNA, 25 bp, Mus musculus
tgccgttcgttttgcacctagtatg

SEQ ID NO: 868479 - DNA, 25 bp, Mus musculus
tgccgttctcacctgctgatggctg

SEQ ID NO: 868480 - DNA, 25 bp, Mus musculus
tgccgttctcacgtgctgatggctg

SEQ ID NO: 868481 - DNA, 25 bp, Mus musculus
tgccgttcttgcagaaatcctagtt

SEQ ID NO: 868482 - DNA, 25 bp, Mus musculus
tgccgttcttgctgaaatcctagtt

SEQ ID NO: 868483 - DNA, 25 bp, Mus musculus
tgccgttcttggcaggtctcttacc

SEQ ID NO: 868484 - DNA, 25 bp, Mus musculus
tgccgttcttgggaggtctcttacc

SEQ ID NO: 868485 - DNA, 25 bp, Mus musculus
tgccgttgctctctacttctgtgta

SEQ ID NO: 868486 - DNA, 25 bp, Mus musculus
tgccgttgctctgtacttctgtgta

SEQ ID NO: 868487 - DNA, 25 bp, Mus musculus
tgccgttgtcttctcgtgattagag

SEQ ID NO: 868488 - DNA, 25 bp, Mus musculus
tgccgttgtcttgtcgtgattagag

SEQ ID NO: 868489 - DNA, 25 bp, Mus musculus
tgccgttgtgttacttttagagtca

SEQ ID NO: 868490 - DNA, 25 bp, Mus musculus
tgccgttgtgtttcttttagagtca

SEQ ID NO: 868491 - DNA, 25 bp, Mus musculus
tgccgtttatccaacaggcttaacc

SEQ ID NO: 868492 - DNA, 25 bp, Mus musculus
tgccgtttatcctacaggcttaacc

SEQ ID NO: 868493 - DNA, 25 bp, Mus musculus
tgccgtttctaccacagagcaggaa

SEQ ID NO: 868494 - DNA, 25 bp, Mus musculus
tgccgtttctacgacagagcaggaa

SEQ ID NO: 868495 - DNA, 25 bp, Mus musculus
tgccgtttctctactaaattcttgc

SEQ ID NO: 868496 - DNA, 25 bp, Mus musculus
tgccgtttctcttctaaattcttgc

SEQ ID NO: 868497 - DNA, 25 bp, Mus musculus
tgccgttttcccctcaagaatgaga

SEQ ID NO: 868498 - DNA, 25 bp, Mus musculus
tgccgttttcccgtcaagaatgaga

SEQ ID NO: 868499 - DNA, 25 bp, Mus musculus
tgcctaaaaaatcctgcagactaca

SEQ ID NO: 868500 - DNA, 25 bp, Mus musculus
tgcctaaaaaatgctgcagactaca

SEQ ID NO: 868501 - DNA, 25 bp, Mus musculus
tgcctaaaacccaaaactgatcctt

SEQ ID NO: 868502 - DNA, 25 bp, Mus musculus
tgcctaaaaccctaaactgatcctt

SEQ ID NO: 868503 - DNA, 25 bp, Mus musculus
tgcctaaaactaccacctcaggtga

SEQ ID NO: 868504 - DNA, 25 bp, Mus musculus
tgcctaaaactagcacctcaggtga

SEQ ID NO: 868505 - DNA, 25 bp, Mus musculus
tgcctaaaattaccacttgaggttt

SEQ ID NO: 868506 - DNA, 25 bp, Mus musculus
tgcctaaaattagcacttgaggttt

SEQ ID NO: 868507 - DNA, 25 bp, Mus musculus
tgcctaaagcagctggtactctcca

SEQ ID NO: 868508 - DNA, 25 bp, Mus musculus
tgcctaaagcaggtggtactctcca

SEQ ID NO: 868509 - DNA, 25 bp, Mus musculus
tgcctaaagtgtctatagatcttta

SEQ ID NO: 868510 - DNA, 25 bp, Mus musculus
tgcctaaagtgtgtatagatcttta

SEQ ID NO: 868511 - DNA, 25 bp, Mus musculus
tgcctaaattgtagggtctgcttct

SEQ ID NO: 868512 - DNA, 25 bp, Mus musculus
tgcctaaattgttgggtctgcttct

SEQ ID NO: 868513 - DNA, 25 bp, Mus musculus
tgcctaacacacatataagcccttc

SEQ ID NO: 868514 - DNA, 25 bp, Mus musculus
tgcctaacacacttataagcccttc

SEQ ID NO: 868515 - DNA, 25 bp, Mus musculus
tgcctaacatatcagcacccaagtt

SEQ ID NO: 868516 - DNA, 25 bp, Mus musculus
tgcctaacatatgagcacccaagtt

SEQ ID NO: 868517 - DNA, 25 bp, Mus musculus
tgcctaactgcactgagaaccactt

SEQ ID NO: 868518 - DNA, 25 bp, Mus musculus
tgcctaactgcagtgagaaccactt

SEQ ID NO: 868519 - DNA, 25 bp, Mus musculus
tgcctaagaggcagtcagcaggttg

SEQ ID NO: 868520 - DNA, 25 bp, Mus musculus
tgcctaagaggctgtcagcaggttg

SEQ ID NO: 868521 - DNA, 25 bp, Mus musculus
tgcctaagcagtatcatagcctgta

SEQ ID NO: 868522 - DNA, 25 bp, Mus musculus
tgcctaagcagtttcatagcctgta

SEQ ID NO: 868523 - DNA, 25 bp, Mus musculus
tgcctaagcctcctgagtacagaga

SEQ ID NO: 868524 - DNA, 25 bp, Mus musculus
tgcctaagcctcgtgagtacagaga

SEQ ID NO: 868525 - DNA, 25 bp, Mus musculus
tgcctaaggccaccggaaaatatat

SEQ ID NO: 868526 - DNA, 25 bp, Mus musculus
tgcctaaggccagcggaaaatatat

SEQ ID NO: 868527 - DNA, 25 bp, Mus musculus
tgcctaagggagatcgttcacagct

SEQ ID NO: 868528 - DNA, 25 bp, Mus musculus
tgcctaagggagttcgttcacagct

SEQ ID NO: 868529 - DNA, 25 bp, Mus musculus
tgcctaagtgccctggctagcacgt

SEQ ID NO: 868530 - DNA, 25 bp, Mus musculus
tgcctaagtgccgtggctagcacgt

SEQ ID NO: 868531 - DNA, 25 bp, Mus musculus
tgcctaagttaacttactatagaaa

SEQ ID NO: 868532 - DNA, 25 bp, Mus musculus
tgcctaagttaagttactatagaaa

SEQ ID NO: 868533 - DNA, 25 bp, Mus musculus
tgcctaatgtcaaactcagctcagt

SEQ ID NO: 868534 - DNA, 25 bp, Mus musculus
tgcctaatgtcatactcagctcagt

SEQ ID NO: 868535 - DNA, 25 bp, Mus musculus
tgcctaatttttagctagaacctgg

SEQ ID NO: 868536 - DNA, 25 bp, Mus musculus
tgcctaattttttgctagaacctgg

SEQ ID NO: 868537 - DNA, 25 bp, Mus musculus
tgcctacagagcaaaaggaaaacct

SEQ ID NO: 868538 - DNA, 25 bp, Mus musculus
tgcctacagagctaaaggaaaacct

SEQ ID NO: 868539 - DNA, 25 bp, Mus musculus
tgcctacagagtcatcatgtcccag

SEQ ID NO: 868540 - DNA, 25 bp, Mus musculus
tgcctacagagtctggctcgacctg

SEQ ID NO: 868541 - DNA, 25 bp, Mus musculus
tgcctacagagtgatcatgtcccag

SEQ ID NO: 868542 - DNA, 25 bp, Mus musculus
tgcctacagagtgtggctcgacctg

SEQ ID NO: 868543 - DNA, 25 bp, Mus musculus
tgcctacagtgccatagctgcagtc

SEQ ID NO: 868544 - DNA, 25 bp, Mus musculus
tgcctacagtgcgatagctgcagtc

SEQ ID NO: 868545 - DNA, 25 bp, Mus musculus
tgcctacatggcacagacagatcct

SEQ ID NO: 868546 - DNA, 25 bp, Mus musculus
tgcctacatggctcagacagatcct

SEQ ID NO: 868547 - DNA, 25 bp, Mus musculus
tgcctaccacagagatctctgctaa

SEQ ID NO: 868548 - DNA, 25 bp, Mus musculus
tgcctaccacagtgatctctgctaa

SEQ ID NO: 868549 - DNA, 25 bp, Mus musculus
tgcctaccactactgtcacgcatag

SEQ ID NO: 868550 - DNA, 25 bp, Mus musculus
tgcctaccactagtgtcacgcatag

SEQ ID NO: 868551 - DNA, 25 bp, Mus musculus
tgcctaccagacaacatagttgcct

SEQ ID NO: 868552 - DNA, 25 bp, Mus musculus
tgcctaccagactacatagttgcct

SEQ ID NO: 868553 - DNA, 25 bp, Mus musculus
tgcctaccatcgcaagatcccaaag

SEQ ID NO: 868554 - DNA, 25 bp, Mus musculus
tgcctaccatcggaagatcccaaag

SEQ ID NO: 868555 - DNA, 25 bp, Mus musculus
tgcctaccatggagaccacgggtga

SEQ ID NO: 868556 - DNA, 25 bp, Mus musculus
tgcctaccatggtgaccacgggtga

SEQ ID NO: 868557 - DNA, 25 bp, Mus musculus
tgcctaccgtgacccatatgctatg

SEQ ID NO: 868558 - DNA, 25 bp, Mus musculus
tgcctaccgtgagccatatgctatg

SEQ ID NO: 868559 - DNA, 25 bp, Mus musculus
tgcctaccgtggagtatgaggacct

SEQ ID NO: 868560 - DNA, 25 bp, Mus musculus
tgcctaccgtggtgtatgaggacct

SEQ ID NO: 868561 - DNA, 25 bp, Mus musculus
tgcctacctaaactatatctcagta

SEQ ID NO: 868562 - DNA, 25 bp, Mus musculus
tgcctacctaaagtatatctcagta

SEQ ID NO: 868563 - DNA, 25 bp, Mus musculus
tgcctacctcagcttacattctaac

SEQ ID NO: 868564 - DNA, 25 bp, Mus musculus
tgcctacctcaggttacattctaac

SEQ ID NO: 868565 - DNA, 25 bp, Mus musculus
tgcctacctcccctttctggtttgg

SEQ ID NO: 868566 - DNA, 25 bp, Mus musculus
tgcctacctcccgtttctggtttgg

SEQ ID NO: 868567 - DNA, 25 bp, Mus musculus
tgcctacctcggcagccaagaaatg

SEQ ID NO: 868568 - DNA, 25 bp, Mus musculus
tgcctacctcgggagccaagaaatg

SEQ ID NO: 868569 - DNA, 25 bp, Mus musculus
tgcctacctgaaagacaagctgccc

SEQ ID NO: 868570 - DNA, 25 bp, Mus musculus
tgcctacctgaatgacaagctgccc

SEQ ID NO: 868571 - DNA, 25 bp, Mus musculus
tgcctacctgctcatggaatcatcc

SEQ ID NO: 868572 - DNA, 25 bp, Mus musculus
tgcctacctgctgatggaatcatcc

SEQ ID NO: 868573 - DNA, 25 bp, Mus musculus
tgcctacgaagcaacacacagtcag

SEQ ID NO: 868574 - DNA, 25 bp, Mus musculus
tgcctacgaagctacacacagtcag

SEQ ID NO: 868575 - DNA, 25 bp, Mus musculus
tgcctacgactactgccccagatag

SEQ ID NO: 868576 - DNA, 25 bp, Mus musculus
tgcctacgactagtgccccagatag

SEQ ID NO: 868577 - DNA, 25 bp, Mus musculus
tgcctacggacacctcagagttgtt

SEQ ID NO: 868578 - DNA, 25 bp, Mus musculus
tgcctacggacagctcagagttgtt

SEQ ID NO: 868579 - DNA, 25 bp, Mus musculus
tgcctacggccaacgatgtgacagg

SEQ ID NO: 868580 - DNA, 25 bp, Mus musculus
tgcctacggccatcgatgtgacagg

SEQ ID NO: 868581 - DNA, 25 bp, Mus musculus
tgcctacgtgaaccacctgggtctc

SEQ ID NO: 868582 - DNA, 25 bp, Mus musculus
tgcctacgtgaagcacctgggtctc

SEQ ID NO: 868583 - DNA, 25 bp, Mus musculus
tgcctactactcaccaggtatgttc

SEQ ID NO: 868584 - DNA, 25 bp, Mus musculus
tgcctactactctccaggtatgttc

SEQ ID NO: 868585 - DNA, 25 bp, Mus musculus
tgcctactaggcaacaaaatacaaa

SEQ ID NO: 868586 - DNA, 25 bp, Mus musculus
tgcctactaggctacaaaatacaaa

SEQ ID NO: 868587 - DNA, 25 bp, Mus musculus
tgcctactcattattggtagcaaaa

SEQ ID NO: 868588 - DNA, 25 bp, Mus musculus
tgcctactcatttttggtagcaaaa

SEQ ID NO: 868589 - DNA, 25 bp, Mus musculus
tgcctactctcaacataatctcatt

SEQ ID NO: 868590 - DNA, 25 bp, Mus musculus
tgcctactctcatcataatctcatt

SEQ ID NO: 868591 - DNA, 25 bp, Mus musculus
tgcctactgaggcacgctgactcta

SEQ ID NO: 868592 - DNA, 25 bp, Mus musculus
tgcctactgagggacgctgactcta

SEQ ID NO: 868593 - DNA, 25 bp, Mus musculus
tgcctactgcctacagacaatgaca

SEQ ID NO: 868594 - DNA, 25 bp, Mus musculus
tgcctactgccttcagacaatgaca

SEQ ID NO: 868595 - DNA, 25 bp, Mus musculus
tgcctactggtccttcccaaataaa

SEQ ID NO: 868596 - DNA, 25 bp, Mus musculus
tgcctactggtcgttcccaaataaa

SEQ ID NO: 868597 - DNA, 25 bp, Mus musculus
tgcctactgtcccaagagctctttt

SEQ ID NO: 868598 - DNA, 25 bp, Mus musculus
tgcctactgtccgaagagctctttt

SEQ ID NO: 868599 - DNA, 25 bp, Mus musculus
tgcctacttaggatcttctgtctgt

SEQ ID NO: 868600 - DNA, 25 bp, Mus musculus
tgcctacttaggttcttctgtctgt

SEQ ID NO: 868601 - DNA, 25 bp, Mus musculus
tgcctacttgctagttcaacataag

SEQ ID NO: 868602 - DNA, 25 bp, Mus musculus
tgcctacttgcttgttcaacataag

SEQ ID NO: 868603 - DNA, 25 bp, Mus musculus
tgcctagaaatcctgataagagtga

SEQ ID NO: 868604 - DNA, 25 bp, Mus musculus
tgcctagaaatcgtgataagagtga

SEQ ID NO: 868605 - DNA, 25 bp, Mus musculus
tgcctagaatttcgagcaagcttct

SEQ ID NO: 868606 - DNA, 25 bp, Mus musculus
tgcctagaatttggagcaagcttct

SEQ ID NO: 868607 - DNA, 25 bp, Mus musculus
tgcctagacttgcatttctgtgttg

SEQ ID NO: 868608 - DNA, 25 bp, Mus musculus
tgcctagacttggatttctgtgttg

SEQ ID NO: 868609 - DNA, 25 bp, Mus musculus
tgcctagagagcatttaagggtttt

SEQ ID NO: 868610 - DNA, 25 bp, Mus musculus
tgcctagagagcttttaagggtttt

SEQ ID NO: 868611 - DNA, 25 bp, Mus musculus
tgcctagagcataaaggccctctct

SEQ ID NO: 868612 - DNA, 25 bp, Mus musculus
tgcctagagcattaaggccctctct

SEQ ID NO: 868613 - DNA, 25 bp, Mus musculus
tgcctagaggtactggagtccatct

SEQ ID NO: 868614 - DNA, 25 bp, Mus musculus
tgcctagaggtagtggagtccatct

SEQ ID NO: 868615 - DNA, 25 bp, Mus musculus
tgcctagagtccacaggttgatgct

SEQ ID NO: 868616 - DNA, 25 bp, Mus musculus
tgcctagagtcctcaggttgatgct

SEQ ID NO: 868617 - DNA, 25 bp, Mus musculus
tgcctagatttgatggttgctcatc

SEQ ID NO: 868618 - DNA, 25 bp, Mus musculus
tgcctagatttgttggttgctcatc

SEQ ID NO: 868619 - DNA, 25 bp, Mus musculus
tgcctagcaagacccgatctcagaa

SEQ ID NO: 868620 - DNA, 25 bp, Mus musculus
tgcctagcaagagccgatctcagaa

SEQ ID NO: 868621 - DNA, 25 bp, Mus musculus
tgcctagcaagcacacccgtgattg

SEQ ID NO: 868622 - DNA, 25 bp, Mus musculus
tgcctagcaagcccaaggccctggg

SEQ ID NO: 868623 - DNA, 25 bp, Mus musculus
tgcctagcaagcgcaaggccctggg

SEQ ID NO: 868624 - DNA, 25 bp, Mus musculus
tgcctagcaagctcacccgtgattg

SEQ ID NO: 868625 - DNA, 25 bp, Mus musculus
tgcctagcacatagttgttaactgt

SEQ ID NO: 868626 - DNA, 25 bp, Mus musculus
tgcctagcacattgttgttaactgt

SEQ ID NO: 868627 - DNA, 25 bp, Mus musculus
tgcctagcatagctgagccctgagt

SEQ ID NO: 868628 - DNA, 25 bp, Mus musculus
tgcctagcataggtgagccctgagt

SEQ ID NO: 868629 - DNA, 25 bp, Mus musculus
tgcctagcatgtctgcaaccctgca

SEQ ID NO: 868630 - DNA, 25 bp, Mus musculus
tgcctagcatgtgtgcaaccctgca

SEQ ID NO: 868631 - DNA, 25 bp, Mus musculus
tgcctagcccatcgtacagtaactc

SEQ ID NO: 868632 - DNA, 25 bp, Mus musculus
tgcctagcccatggtacagtaactc

SEQ ID NO: 868633 - DNA, 25 bp, Mus musculus
tgcctagcctaccattaagccactt

SEQ ID NO: 868634 - DNA, 25 bp, Mus musculus
tgcctagcctacgattaagccactt

SEQ ID NO: 868635 - DNA, 25 bp, Mus musculus
tgcctagccttcacatgtgtggata

SEQ ID NO: 868636 - DNA, 25 bp, Mus musculus
tgcctagccttctcatgtgtggata

SEQ ID NO: 868637 - DNA, 25 bp, Mus musculus
tgcctagctcacaagtctgttgtta

SEQ ID NO: 868638 - DNA, 25 bp, Mus musculus
tgcctagctcactagtctgttgtta

SEQ ID NO: 868639 - DNA, 25 bp, Mus musculus
tgcctagctgtaatctcaagtcctg

SEQ ID NO: 868640 - DNA, 25 bp, Mus musculus
tgcctagctgtattctcaagtcctg

SEQ ID NO: 868641 - DNA, 25 bp, Mus musculus
tgcctaggaagtagcctgcacgtga

SEQ ID NO: 868642 - DNA, 25 bp, Mus musculus
tgcctaggaagttgcctgcacgtga

SEQ ID NO: 868643 - DNA, 25 bp, Mus musculus
tgcctaggccttcagtatgagtttg

SEQ ID NO: 868644 - DNA, 25 bp, Mus musculus
tgcctaggccttgagtatgagtttg

SEQ ID NO: 868645 - DNA, 25 bp, Mus musculus
tgcctaggctgcacaagtccttggg

SEQ ID NO: 868646 - DNA, 25 bp, Mus musculus
tgcctaggctgctcaagtccttggg

SEQ ID NO: 868647 - DNA, 25 bp, Mus musculus
tgcctaggctggatatatagcaaga

SEQ ID NO: 868648 - DNA, 25 bp, Mus musculus
tgcctaggctggttatatagcaaga

SEQ ID NO: 868649 - DNA, 25 bp, Mus musculus
tgcctagggatgctattgccccaca

SEQ ID NO: 868650 - DNA, 25 bp, Mus musculus
tgcctagggatggtattgccccaca

SEQ ID NO: 868651 - DNA, 25 bp, Mus musculus
tgcctagggtctcagtcagttgtat

SEQ ID NO: 868652 - DNA, 25 bp, Mus musculus
tgcctagggtctctgtactgggata

SEQ ID NO: 868653 - DNA, 25 bp, Mus musculus
tgcctagggtctgagtcagttgtat

SEQ ID NO: 868654 - DNA, 25 bp, Mus musculus
tgcctagggtctgtgtactgggata

SEQ ID NO: 868655 - DNA, 25 bp, Mus musculus
tgcctaggtccaagtctgtttttaa

SEQ ID NO: 868656 - DNA, 25 bp, Mus musculus
tgcctaggtccatgtctgtttttaa

SEQ ID NO: 868657 - DNA, 25 bp, Mus musculus
tgcctaggtcttcctcagaggccaa

SEQ ID NO: 868658 - DNA, 25 bp, Mus musculus
tgcctaggtcttgctcagaggccaa

SEQ ID NO: 868659 - DNA, 25 bp, Mus musculus
tgcctaggtgagagctgtctccagt

SEQ ID NO: 868660 - DNA, 25 bp, Mus musculus
tgcctaggtgagtgctgtctccagt

SEQ ID NO: 868661 - DNA, 25 bp, Mus musculus
tgcctagtatatacccctgcacata

SEQ ID NO: 868662 - DNA, 25 bp, Mus musculus
tgcctagtatattcccctgcacata

SEQ ID NO: 868663 - DNA, 25 bp, Mus musculus
tgcctagtatgcatcaagttttgtt

SEQ ID NO: 868664 - DNA, 25 bp, Mus musculus
tgcctagtatgcttcaagttttgtt

SEQ ID NO: 868665 - DNA, 25 bp, Mus musculus
tgcctagtcctgcttctgtggacat

SEQ ID NO: 868666 - DNA, 25 bp, Mus musculus
tgcctagtcctggttctgtggacat

SEQ ID NO: 868667 - DNA, 25 bp, Mus musculus
tgcctagtgaacatacgcagcctgg

SEQ ID NO: 868668 - DNA, 25 bp, Mus musculus
tgcctagtgaacttacgcagcctgg

SEQ ID NO: 868669 - DNA, 25 bp, Mus musculus
tgcctagtgcggctaccgaaaccta

SEQ ID NO: 868670 - DNA, 25 bp, Mus musculus
tgcctagtgcgggtaccgaaaccta

SEQ ID NO: 868671 - DNA, 25 bp, Mus musculus
tgcctagtgtgtacaaggtgatcca

SEQ ID NO: 868672 - DNA, 25 bp, Mus musculus
tgcctagtgtgttcaaggtgatcca

SEQ ID NO: 868673 - DNA, 25 bp, Mus musculus
tgcctataactcaagctcttctgac

SEQ ID NO: 868674 - DNA, 25 bp, Mus musculus
tgcctataactctagctcttctgac

SEQ ID NO: 868675 - DNA, 25 bp, Mus musculus
tgcctataatcgcaccctggagctg

SEQ ID NO: 868676 - DNA, 25 bp, Mus musculus
tgcctataatcggaccctggagctg

SEQ ID NO: 868677 - DNA, 25 bp, Mus musculus
tgcctatactatacttcagagctgt

SEQ ID NO: 868678 - DNA, 25 bp, Mus musculus
tgcctatactatcctgtcttcctag

SEQ ID NO: 868679 - DNA, 25 bp, Mus musculus
tgcctatactatgctgtcttcctag

SEQ ID NO: 868680 - DNA, 25 bp, Mus musculus
tgcctatactattcttcagagctgt

SEQ ID NO: 868681 - DNA, 25 bp, Mus musculus
tgcctatagcatcctcccagggagg

SEQ ID NO: 868682 - DNA, 25 bp, Mus musculus
tgcctatagcatgctcccagggagg

SEQ ID NO: 868683 - DNA, 25 bp, Mus musculus
tgcctatcaccaatttagtctccta

SEQ ID NO: 868684 - DNA, 25 bp, Mus musculus
tgcctatcaccattttagtctccta

SEQ ID NO: 868685 - DNA, 25 bp, Mus musculus
tgcctatcagacatcctgcttatca

SEQ ID NO: 868686 - DNA, 25 bp, Mus musculus
tgcctatcagacttcctgcttatca

SEQ ID NO: 868687 - DNA, 25 bp, Mus musculus
tgcctatccggcactcttctgagca

SEQ ID NO: 868688 - DNA, 25 bp, Mus musculus
tgcctatccggctctcttctgagca

SEQ ID NO: 868689 - DNA, 25 bp, Mus musculus
tgcctatcgtgtagtgacccacact

SEQ ID NO: 868690 - DNA, 25 bp, Mus musculus
tgcctatcgtgttgtgacccacact

SEQ ID NO: 868691 - DNA, 25 bp, Mus musculus
tgcctatctgtcattggaaaacttt

SEQ ID NO: 868692 - DNA, 25 bp, Mus musculus
tgcctatctgtctttggaaaacttt

SEQ ID NO: 868693 - DNA, 25 bp, Mus musculus
tgcctatgagaacctctcttcaccg

SEQ ID NO: 868694 - DNA, 25 bp, Mus musculus
tgcctatgagaagctctcttcaccg

SEQ ID NO: 868695 - DNA, 25 bp, Mus musculus
tgcctatgccatcaacgtgtctcaa

SEQ ID NO: 868696 - DNA, 25 bp, Mus musculus
tgcctatgccatgaacgtgtctcaa

SEQ ID NO: 868697 - DNA, 25 bp, Mus musculus
tgcctatggaaaatgcacttctggg

SEQ ID NO: 868698 - DNA, 25 bp, Mus musculus
tgcctatggaaattgcacttctggg

SEQ ID NO: 868699 - DNA, 25 bp, Mus musculus
tgcctatgggttctcaggtgccgat

SEQ ID NO: 868700 - DNA, 25 bp, Mus musculus
tgcctatgggttgtcaggtgccgat

SEQ ID NO: 868701 - DNA, 25 bp, Mus musculus
tgcctatggtgacttcgacgcctac

SEQ ID NO: 868702 - DNA, 25 bp, Mus musculus
tgcctatggtgagttcgacgcctac

SEQ ID NO: 868703 - DNA, 25 bp, Mus musculus
tgcctatgtgagctttccaaggagg

SEQ ID NO: 868704 - DNA, 25 bp, Mus musculus
tgcctatgtgaggtttccaaggagg

SEQ ID NO: 868705 - DNA, 25 bp, Mus musculus
tgcctattcaccagaatgtacactg

SEQ ID NO: 868706 - DNA, 25 bp, Mus musculus
tgcctattcacctgaatgtacactg

SEQ ID NO: 868707 - DNA, 25 bp, Mus musculus
tgcctattggtcatccttggatgtc

SEQ ID NO: 868708 - DNA, 25 bp, Mus musculus
tgcctattggtcttccttggatgtc

SEQ ID NO: 868709 - DNA, 25 bp, Mus musculus
tgcctattgtctcccagctactctg

SEQ ID NO: 868710 - DNA, 25 bp, Mus musculus
tgcctattgtctgccagctactctg

SEQ ID NO: 868711 - DNA, 25 bp, Mus musculus
tgcctatttcacaggtcgctattgc

SEQ ID NO: 868712 - DNA, 25 bp, Mus musculus
tgcctatttcactggtcgctattgc

SEQ ID NO: 868713 - DNA, 25 bp, Mus musculus
tgcctatttgcaagtacctttgaaa

SEQ ID NO: 868714 - DNA, 25 bp, Mus musculus
tgcctatttgcatgtacctttgaaa

SEQ ID NO: 868715 - DNA, 25 bp, Mus musculus
tgcctatttgttagtctgtattgcc

SEQ ID NO: 868716 - DNA, 25 bp, Mus musculus
tgcctatttgtttgtctgtattgcc

SEQ ID NO: 868717 - DNA, 25 bp, Mus musculus
tgcctcaaaaacaaatgggccattg

SEQ ID NO: 868718 - DNA, 25 bp, Mus musculus
tgcctcaaaaactaatgggccattg

SEQ ID NO: 868719 - DNA, 25 bp, Mus musculus
tgcctcaaaaataaaccctgccttc

SEQ ID NO: 868720 - DNA, 25 bp, Mus musculus
tgcctcaaaaatcgccgtctttaga

SEQ ID NO: 868721 - DNA, 25 bp, Mus musculus
tgcctcaaaaatggccgtctttaga

SEQ ID NO: 868722 - DNA, 25 bp, Mus musculus
tgcctcaaaaattaaccctgccttc

SEQ ID NO: 868723 - DNA, 25 bp, Mus musculus
tgcctcaaaatgacccttaactctg

SEQ ID NO: 868724 - DNA, 25 bp, Mus musculus
tgcctcaaaatgtcccttaactctg

SEQ ID NO: 868725 - DNA, 25 bp, Mus musculus
tgcctcaaacctcacgattacatga

SEQ ID NO: 868726 - DNA, 25 bp, Mus musculus
tgcctcaaacctgacgattacatga

SEQ ID NO: 868727 - DNA, 25 bp, Mus musculus
tgcctcaaacggacctgggttgttc

SEQ ID NO: 868728 - DNA, 25 bp, Mus musculus
tgcctcaaacggtcctgggttgttc

SEQ ID NO: 868729 - DNA, 25 bp, Mus musculus
tgcctcaacctacccaagtacagaa

SEQ ID NO: 868730 - DNA, 25 bp, Mus musculus
tgcctcaacctagccaagtacagaa

SEQ ID NO: 868731 - DNA, 25 bp, Mus musculus
tgcctcaacgcaaaacagagcaaat

SEQ ID NO: 868732 - DNA, 25 bp, Mus musculus
tgcctcaacgcataacagagcaaat

SEQ ID NO: 868733 - DNA, 25 bp, Mus musculus
tgcctcaactatacctggcttgaat

SEQ ID NO: 868734 - DNA, 25 bp, Mus musculus
tgcctcaactattcctggcttgaat

SEQ ID NO: 868735 - DNA, 25 bp, Mus musculus
tgcctcaagcagcatggcctgagtg

SEQ ID NO: 868736 - DNA, 25 bp, Mus musculus
tgcctcaagcaggatggcctgagtg

SEQ ID NO: 868737 - DNA, 25 bp, Mus musculus
tgcctcaattccaccatttgtgaaa

SEQ ID NO: 868738 - DNA, 25 bp, Mus musculus
tgcctcaattcctccatttgtgaaa

SEQ ID NO: 868739 - DNA, 25 bp, Mus musculus
tgcctcaattctactctttgtgttg

SEQ ID NO: 868740 - DNA, 25 bp, Mus musculus
tgcctcaattcttctctttgtgttg

SEQ ID NO: 868741 - DNA, 25 bp, Mus musculus
tgcctcacaaatacccctattaatt

SEQ ID NO: 868742 - DNA, 25 bp, Mus musculus
tgcctcacaaattcccctattaatt

SEQ ID NO: 868743 - DNA, 25 bp, Mus musculus
tgcctcacaaccatcgtgaagtgtg

SEQ ID NO: 868744 - DNA, 25 bp, Mus musculus
tgcctcacaaccttcgtgaagtgtg

SEQ ID NO: 868745 - DNA, 25 bp, Mus musculus
tgcctcacactaccagatattgctt

SEQ ID NO: 868746 - DNA, 25 bp, Mus musculus
tgcctcacactagcagatattgctt

SEQ ID NO: 868747 - DNA, 25 bp, Mus musculus
tgcctcacagagcttgttatccaaa

SEQ ID NO: 868748 - DNA, 25 bp, Mus musculus
tgcctcacagaggttgttatccaaa

SEQ ID NO: 868749 - DNA, 25 bp, Mus musculus
tgcctcacatcaaggtgccattcag

SEQ ID NO: 868750 - DNA, 25 bp, Mus musculus
tgcctcacatcatggtgccattcag

SEQ ID NO: 868751 - DNA, 25 bp, Mus musculus
tgcctcaccattaacctcataggac

SEQ ID NO: 868752 - DNA, 25 bp, Mus musculus
tgcctcaccatttacctcataggac

SEQ ID NO: 868753 - DNA, 25 bp, Mus musculus
tgcctcacccaaatgcttacacggg

SEQ ID NO: 868754 - DNA, 25 bp, Mus musculus
tgcctcacccaattgcttacacggg

SEQ ID NO: 868755 - DNA, 25 bp, Mus musculus
tgcctcaccccaagggttgtggaag

SEQ ID NO: 868756 - DNA, 25 bp, Mus musculus
tgcctcaccccatgggttgtggaag

SEQ ID NO: 868757 - DNA, 25 bp, Mus musculus
tgcctcacgtggacacagtatgcat

SEQ ID NO: 868758 - DNA, 25 bp, Mus musculus
tgcctcacgtggtcacagtatgcat

SEQ ID NO: 868759 - DNA, 25 bp, Mus musculus
tgcctcacgtttccctgagaggtga

SEQ ID NO: 868760 - DNA, 25 bp, Mus musculus
tgcctcacgtttgcctgagaggtga

SEQ ID NO: 868761 - DNA, 25 bp, Mus musculus
tgcctcagaagacctgccagggtca

SEQ ID NO: 868762 - DNA, 25 bp, Mus musculus
tgcctcagaagagctgccagggtca

SEQ ID NO: 868763 - DNA, 25 bp, Mus musculus
tgcctcagaggaccctgggatgcaa

SEQ ID NO: 868764 - DNA, 25 bp, Mus musculus
tgcctcagaggagcctgggatgcaa

SEQ ID NO: 868765 - DNA, 25 bp, Mus musculus
tgcctcagatgactcctgcctgtat

SEQ ID NO: 868766 - DNA, 25 bp, Mus musculus
tgcctcagatgagtcctgcctgtat

SEQ ID NO: 868767 - DNA, 25 bp, Mus musculus
tgcctcagcagtcaaattcccagaa

SEQ ID NO: 868768 - DNA, 25 bp, Mus musculus
tgcctcagcagtgaaattcccagaa

SEQ ID NO: 868769 - DNA, 25 bp, Mus musculus
tgcctcagcataccctcttgaatat

SEQ ID NO: 868770 - DNA, 25 bp, Mus musculus
tgcctcagcatagcctcttgaatat

SEQ ID NO: 868771 - DNA, 25 bp, Mus musculus
tgcctcagcccaaagacaaattctt

SEQ ID NO: 868772 - DNA, 25 bp, Mus musculus
tgcctcagcccatagacaaattctt

SEQ ID NO: 868773 - DNA, 25 bp, Mus musculus
tgcctcagccctcaaagtggagatt

SEQ ID NO: 868774 - DNA, 25 bp, Mus musculus
tgcctcagccctgaaagtggagatt

SEQ ID NO: 868775 - DNA, 25 bp, Mus musculus
tgcctcagcggaaatgtttatacag

SEQ ID NO: 868776 - DNA, 25 bp, Mus musculus
tgcctcagcggatatgtttatacag

SEQ ID NO: 868777 - DNA, 25 bp, Mus musculus
tgcctcagctccatgattcatttta

SEQ ID NO: 868778 - DNA, 25 bp, Mus musculus
tgcctcagctccttgattcatttta

SEQ ID NO: 868779 - DNA, 25 bp, Mus musculus
tgcctcagctgccattcgatgtagt

SEQ ID NO: 868780 - DNA, 25 bp, Mus musculus
tgcctcagctgcgattcgatgtagt

SEQ ID NO: 868781 - DNA, 25 bp, Mus musculus
tgcctcaggagactgcacagactgg

SEQ ID NO: 868782 - DNA, 25 bp, Mus musculus
tgcctcaggagagtgcacagactgg

SEQ ID NO: 868783 - DNA, 25 bp, Mus musculus
tgcctcaggcccatgtggtggagat

SEQ ID NO: 868784 - DNA, 25 bp, Mus musculus
tgcctcaggcccttgtggtggagat

SEQ ID NO: 868785 - DNA, 25 bp, Mus musculus
tgcctcagggctaactctggttttc

SEQ ID NO: 868786 - DNA, 25 bp, Mus musculus
tgcctcagggctcccagagtacata

SEQ ID NO: 868787 - DNA, 25 bp, Mus musculus
tgcctcagggctgccagagtacata

SEQ ID NO: 868788 - DNA, 25 bp, Mus musculus
tgcctcagggcttactctggttttc

SEQ ID NO: 868789 - DNA, 25 bp, Mus musculus
tgcctcagtataattagcttaaaaa

SEQ ID NO: 868790 - DNA, 25 bp, Mus musculus
tgcctcagtatatttagcttaaaaa

SEQ ID NO: 868791 - DNA, 25 bp, Mus musculus
tgcctcagtccaatgtcagtgccgc

SEQ ID NO: 868792 - DNA, 25 bp, Mus musculus
tgcctcagtccattgtcagtgccgc

SEQ ID NO: 868793 - DNA, 25 bp, Mus musculus
tgcctcagtggcagtttaagagcac

SEQ ID NO: 868794 - DNA, 25 bp, Mus musculus
tgcctcagtggctgtttaagagcac

SEQ ID NO: 868795 - DNA, 25 bp, Mus musculus
tgcctcagtggtcttgcccctaaag

SEQ ID NO: 868796 - DNA, 25 bp, Mus musculus
tgcctcagtggtgttgcccctaaag

SEQ ID NO: 868797 - DNA, 25 bp, Mus musculus
tgcctcagttaccagacacggatga

SEQ ID NO: 868798 - DNA, 25 bp, Mus musculus
tgcctcagttacgagacacggatga

SEQ ID NO: 868799 - DNA, 25 bp, Mus musculus
tgcctcagttgtcacagcagccagt

SEQ ID NO: 868800 - DNA, 25 bp, Mus musculus
tgcctcagttgtgacagcagccagt

SEQ ID NO: 868801 - DNA, 25 bp, Mus musculus
tgcctcatagagctgccgtgtttag

SEQ ID NO: 868802 - DNA, 25 bp, Mus musculus
tgcctcatagaggtgccgtgtttag

SEQ ID NO: 868803 - DNA, 25 bp, Mus musculus
tgcctcatagttctatacaatggga

SEQ ID NO: 868804 - DNA, 25 bp, Mus musculus
tgcctcatagttgtatacaatggga

SEQ ID NO: 868805 - DNA, 25 bp, Mus musculus
tgcctcatatccatactaaggctgt

SEQ ID NO: 868806 - DNA, 25 bp, Mus musculus
tgcctcatatccttactaaggctgt

SEQ ID NO: 868807 - DNA, 25 bp, Mus musculus
tgcctcatcaggactgctggccagg

SEQ ID NO: 868808 - DNA, 25 bp, Mus musculus
tgcctcatcaggtctgctggccagg

SEQ ID NO: 868809 - DNA, 25 bp, Mus musculus
tgcctcatccctagagctgggacca

SEQ ID NO: 868810 - DNA, 25 bp, Mus musculus
tgcctcatcccttgagctgggacca

SEQ ID NO: 868811 - DNA, 25 bp, Mus musculus
tgcctcatctggaactgctgcctac

SEQ ID NO: 868812 - DNA, 25 bp, Mus musculus
tgcctcatctggtactgctgcctac

SEQ ID NO: 868813 - DNA, 25 bp, Mus musculus
tgcctcatcttccagagtactagga

SEQ ID NO: 868814 - DNA, 25 bp, Mus musculus
tgcctcatcttcgagagtactagga

SEQ ID NO: 868815 - DNA, 25 bp, Mus musculus
tgcctcatgaagctctccatactga

SEQ ID NO: 868816 - DNA, 25 bp, Mus musculus
tgcctcatgaaggtctccatactga

SEQ ID NO: 868817 - DNA, 25 bp, Mus musculus
tgcctcatgcttctagtaaaccacc

SEQ ID NO: 868818 - DNA, 25 bp, Mus musculus
tgcctcatgcttgtagtaaaccacc

SEQ ID NO: 868819 - DNA, 25 bp, Mus musculus
tgcctcatgttcaggatgcaccaca

SEQ ID NO: 868820 - DNA, 25 bp, Mus musculus
tgcctcatgttctggatgcaccaca

SEQ ID NO: 868821 - DNA, 25 bp, Mus musculus
tgcctcattatcctcgtactacaaa

SEQ ID NO: 868822 - DNA, 25 bp, Mus musculus
tgcctcattatcgtcgtactacaaa

SEQ ID NO: 868823 - DNA, 25 bp, Mus musculus
tgcctcattcttactgttccatcag

SEQ ID NO: 868824 - DNA, 25 bp, Mus musculus
tgcctcattctttctgttccatcag

SEQ ID NO: 868825 - DNA, 25 bp, Mus musculus
tgcctcattgatctttctctttaat

SEQ ID NO: 868826 - DNA, 25 bp, Mus musculus
tgcctcattgatgtttctctttaat

SEQ ID NO: 868827 - DNA, 25 bp, Mus musculus
tgcctcattggcactcagtttagga

SEQ ID NO: 868828 - DNA, 25 bp, Mus musculus
tgcctcattggctctcagtttagga

SEQ ID NO: 868829 - DNA, 25 bp, Mus musculus
tgcctcatttccatgggctatgact

SEQ ID NO: 868830 - DNA, 25 bp, Mus musculus
tgcctcatttccttgggctatgact

SEQ ID NO: 868831 - DNA, 25 bp, Mus musculus
tgcctccaacatagacgatgtcctt

SEQ ID NO: 868832 - DNA, 25 bp, Mus musculus
tgcctccaacattgacgatgtcctt

SEQ ID NO: 868833 - DNA, 25 bp, Mus musculus
tgcctccaacccctattacttgagg

SEQ ID NO: 868834 - DNA, 25 bp, Mus musculus
tgcctccaacccgtattacttgagg

SEQ ID NO: 868835 - DNA, 25 bp, Mus musculus
tgcctccaagctacaaaggatcccc

SEQ ID NO: 868836 - DNA, 25 bp, Mus musculus
tgcctccaagcttcaaaggatcccc

SEQ ID NO: 868837 - DNA, 25 bp, Mus musculus
tgcctccaaggcacagtgagctgag

SEQ ID NO: 868838 - DNA, 25 bp, Mus musculus
tgcctccaaggctcagtgagctgag

SEQ ID NO: 868839 - DNA, 25 bp, Mus musculus
tgcctccaagttcctattatagtgg

SEQ ID NO: 868840 - DNA, 25 bp, Mus musculus
tgcctccaagttcgctgaacatgtc

SEQ ID NO: 868841 - DNA, 25 bp, Mus musculus
tgcctccaagttgctattatagtgg

SEQ ID NO: 868842 - DNA, 25 bp, Mus musculus
tgcctccaagttggctgaacatgtc

SEQ ID NO: 868843 - DNA, 25 bp, Mus musculus
tgcctccaatgcagcgtagctgaat

SEQ ID NO: 868844 - DNA, 25 bp, Mus musculus
tgcctccaatgctgcgtagctgaat

SEQ ID NO: 868845 - DNA, 25 bp, Mus musculus
tgcctccacaggctcaggaacctgt

SEQ ID NO: 868846 - DNA, 25 bp, Mus musculus
tgcctccacagggtcaggaacctgt

SEQ ID NO: 868847 - DNA, 25 bp, Mus musculus
tgcctccaccggcacatgtaaatac

SEQ ID NO: 868848 - DNA, 25 bp, Mus musculus
tgcctccaccgggacatgtaaatac

SEQ ID NO: 868849 - DNA, 25 bp, Mus musculus
tgcctccaccttacttgagtgttag

SEQ ID NO: 868850 - DNA, 25 bp, Mus musculus
tgcctccacctttcttgagtgttag

SEQ ID NO: 868851 - DNA, 25 bp, Mus musculus
tgcctccacggaagactgtacagaa

SEQ ID NO: 868852 - DNA, 25 bp, Mus musculus
tgcctccacggatgactgtacagaa

SEQ ID NO: 868853 - DNA, 25 bp, Mus musculus
tgcctccactacctaagtgctagga

SEQ ID NO: 868854 - DNA, 25 bp, Mus musculus
tgcctccactacgtaagtgctagga

SEQ ID NO: 868855 - DNA, 25 bp, Mus musculus
tgcctccagcagagtgctagtgaag

SEQ ID NO: 868856 - DNA, 25 bp, Mus musculus
tgcctccagcagtgtgctagtgaag

SEQ ID NO: 868857 - DNA, 25 bp, Mus musculus
tgcctccagctactcagcaaaggtg

SEQ ID NO: 868858 - DNA, 25 bp, Mus musculus
tgcctccagctagtcagcaaaggtg

SEQ ID NO: 868859 - DNA, 25 bp, Mus musculus
tgcctccagctgacagactggtttc

SEQ ID NO: 868860 - DNA, 25 bp, Mus musculus
tgcctccagctgtcagactggtttc

SEQ ID NO: 868861 - DNA, 25 bp, Mus musculus
tgcctccagggaaggaacttgccat

SEQ ID NO: 868862 - DNA, 25 bp, Mus musculus
tgcctccagggatggaacttgccat

SEQ ID NO: 868863 - DNA, 25 bp, Mus musculus
tgcctccagtcacaaagcagtgttt

SEQ ID NO: 868864 - DNA, 25 bp, Mus musculus
tgcctccagtcagaaagcagtgttt

SEQ ID NO: 868865 - DNA, 25 bp, Mus musculus
tgcctccataccaacgaatggactt

SEQ ID NO: 868866 - DNA, 25 bp, Mus musculus
tgcctccatacctacgaatggactt

SEQ ID NO: 868867 - DNA, 25 bp, Mus musculus
tgcctccatggacctatcacttagc

SEQ ID NO: 868868 - DNA, 25 bp, Mus musculus
tgcctccatggagctatcacttagc

SEQ ID NO: 868869 - DNA, 25 bp, Mus musculus
tgcctccattttctgaaatctcttc

SEQ ID NO: 868870 - DNA, 25 bp, Mus musculus
tgcctccattttgtgaaatctcttc

SEQ ID NO: 868871 - DNA, 25 bp, Mus musculus
tgcctcccaaatctcagtattacag

SEQ ID NO: 868872 - DNA, 25 bp, Mus musculus
tgcctcccaaatgtcagtattacag

SEQ ID NO: 868873 - DNA, 25 bp, Mus musculus
tgcctcccaagtaatcatgctcatt

SEQ ID NO: 868874 - DNA, 25 bp, Mus musculus
tgcctcccaagttatcatgctcatt

SEQ ID NO: 868875 - DNA, 25 bp, Mus musculus
tgcctcccaatccttgaagacgaga

SEQ ID NO: 868876 - DNA, 25 bp, Mus musculus
tgcctcccaatcgttgaagacgaga

SEQ ID NO: 868877 - DNA, 25 bp, Mus musculus
tgcctcccaatgactggaattgcag

SEQ ID NO: 868878 - DNA, 25 bp, Mus musculus
tgcctcccaatgtctggaattgcag

SEQ ID NO: 868879 - DNA, 25 bp, Mus musculus
tgcctcccacctaaattttgtcttt

SEQ ID NO: 868880 - DNA, 25 bp, Mus musculus
tgcctcccaccttaattttgtcttt

SEQ ID NO: 868881 - DNA, 25 bp, Mus musculus
tgcctcccagggatactttttctgt

SEQ ID NO: 868882 - DNA, 25 bp, Mus musculus
tgcctcccagggttactttttctgt

SEQ ID NO: 868883 - DNA, 25 bp, Mus musculus
tgcctcccatagaagtatttcctca

SEQ ID NO: 868884 - DNA, 25 bp, Mus musculus
tgcctcccatagtagtatttcctca

SEQ ID NO: 868885 - DNA, 25 bp, Mus musculus
tgcctcccatgtagaaccactctgt

SEQ ID NO: 868886 - DNA, 25 bp, Mus musculus
tgcctcccatgttgaaccactctgt

SEQ ID NO: 868887 - DNA, 25 bp, Mus musculus
tgcctcccattcagttgtgttcagt

SEQ ID NO: 868888 - DNA, 25 bp, Mus musculus
tgcctcccattctgttgtgttcagt

SEQ ID NO: 868889 - DNA, 25 bp, Mus musculus
tgcctccccaacctgaggtggtgct

SEQ ID NO: 868890 - DNA, 25 bp, Mus musculus
tgcctccccaacgtgaggtggtgct

SEQ ID NO: 868891 - DNA, 25 bp, Mus musculus
tgcctccccagaagttggcacagag

SEQ ID NO: 868892 - DNA, 25 bp, Mus musculus
tgcctccccagatgttggcacagag

SEQ ID NO: 868893 - DNA, 25 bp, Mus musculus
tgcctcccctagaagaagcaggttt

SEQ ID NO: 868894 - DNA, 25 bp, Mus musculus
tgcctcccctagtagaagcaggttt

SEQ ID NO: 868895 - DNA, 25 bp, Mus musculus
tgcctcccgggcatctaaagatttt

SEQ ID NO: 868896 - DNA, 25 bp, Mus musculus
tgcctcccgggcttctaaagatttt

SEQ ID NO: 868897 - DNA, 25 bp, Mus musculus
tgcctccctaagaattgaccccaga

SEQ ID NO: 868898 - DNA, 25 bp, Mus musculus
tgcctccctaagtattgaccccaga

SEQ ID NO: 868899 - DNA, 25 bp, Mus musculus
tgcctccctcccaaattggtagaaa

SEQ ID NO: 868900 - DNA, 25 bp, Mus musculus
tgcctccctccctaattggtagaaa

SEQ ID NO: 868901 - DNA, 25 bp, Mus musculus
tgcctccctctgagagtagaaacag

SEQ ID NO: 868902 - DNA, 25 bp, Mus musculus
tgcctccctctgtgagtagaaacag

SEQ ID NO: 868903 - DNA, 25 bp, Mus musculus
tgcctccctcttcatttaagttgtg

SEQ ID NO: 868904 - DNA, 25 bp, Mus musculus
tgcctccctcttgatttaagttgtg

SEQ ID NO: 868905 - DNA, 25 bp, Mus musculus
tgcctccctggacgcctttgttttt

SEQ ID NO: 868906 - DNA, 25 bp, Mus musculus
tgcctccctggaggcctttgttttt

SEQ ID NO: 868907 - DNA, 25 bp, Mus musculus
tgcctcccttgtctaaattcttaaa

SEQ ID NO: 868908 - DNA, 25 bp, Mus musculus
tgcctcccttgtgtaaattcttaaa

SEQ ID NO: 868909 - DNA, 25 bp, Mus musculus
tgcctccgaaaaatagggatgctct

SEQ ID NO: 868910 - DNA, 25 bp, Mus musculus
tgcctccgaaaattagggatgctct

SEQ ID NO: 868911 - DNA, 25 bp, Mus musculus
tgcctccgggccaaaatttctgaaa

SEQ ID NO: 868912 - DNA, 25 bp, Mus musculus
tgcctccgggcctaaatttctgaaa

SEQ ID NO: 868913 - DNA, 25 bp, Mus musculus
tgcctccggtcacctaactgatgaa

SEQ ID NO: 868914 - DNA, 25 bp, Mus musculus
tgcctccggtcactaagagtcttgt

SEQ ID NO: 868915 - DNA, 25 bp, Mus musculus
tgcctccggtcagctaactgatgaa

SEQ ID NO: 868916 - DNA, 25 bp, Mus musculus
tgcctccggtcagtaagagtcttgt

SEQ ID NO: 868917 - DNA, 25 bp, Mus musculus
tgcctccgtggactgaggttcagac

SEQ ID NO: 868918 - DNA, 25 bp, Mus musculus
tgcctccgtggagtgaggttcagac

SEQ ID NO: 868919 - DNA, 25 bp, Mus musculus
tgcctccgtggccagtctatgatga

SEQ ID NO: 868920 - DNA, 25 bp, Mus musculus
tgcctccgtggcgagtctatgatga

SEQ ID NO: 868921 - DNA, 25 bp, Mus musculus
tgcctccgtgggaattccctaactt

SEQ ID NO: 868922 - DNA, 25 bp, Mus musculus
tgcctccgtgggtattccctaactt

SEQ ID NO: 868923 - DNA, 25 bp, Mus musculus
tgcctcctaaacactcatgttcata

SEQ ID NO: 868924 - DNA, 25 bp, Mus musculus
tgcctcctaaactctcatgttcata

SEQ ID NO: 868925 - DNA, 25 bp, Mus musculus
tgcctcctaaccaaagtctagtcta

SEQ ID NO: 868926 - DNA, 25 bp, Mus musculus
tgcctcctaacctaagtctagtcta

SEQ ID NO: 868927 - DNA, 25 bp, Mus musculus
tgcctcctaagcagacctgtcacaa

SEQ ID NO: 868928 - DNA, 25 bp, Mus musculus
tgcctcctaagctgacctgtcacaa

SEQ ID NO: 868929 - DNA, 25 bp, Mus musculus
tgcctcctacttatctatggacaag

SEQ ID NO: 868930 - DNA, 25 bp, Mus musculus
tgcctcctacttttctatggacaag

SEQ ID NO: 868931 - DNA, 25 bp, Mus musculus
tgcctcctagcaaagctgtagccat

SEQ ID NO: 868932 - DNA, 25 bp, Mus musculus
tgcctcctagcatagctgtagccat

SEQ ID NO: 868933 - DNA, 25 bp, Mus musculus
tgcctcctaggcaagagaccaggta

SEQ ID NO: 868934 - DNA, 25 bp, Mus musculus
tgcctcctaggctagagaccaggta

SEQ ID NO: 868935 - DNA, 25 bp, Mus musculus
tgcctcctattgaattgagcatggt

SEQ ID NO: 868936 - DNA, 25 bp, Mus musculus
tgcctcctattgtattgagcatggt

SEQ ID NO: 868937 - DNA, 25 bp, Mus musculus
tgcctcctcaatcctaagcaagtta

SEQ ID NO: 868938 - DNA, 25 bp, Mus musculus
tgcctcctcaatgctaagcaagtta

SEQ ID NO: 868939 - DNA, 25 bp, Mus musculus
tgcctcctcatcattttcttgaatg

SEQ ID NO: 868940 - DNA, 25 bp, Mus musculus
tgcctcctcatctttttcttgaatg

SEQ ID NO: 868941 - DNA, 25 bp, Mus musculus
tgcctcctctaaaacacacgtaaga

SEQ ID NO: 868942 - DNA, 25 bp, Mus musculus
tgcctcctctaatacacacgtaaga

SEQ ID NO: 868943 - DNA, 25 bp, Mus musculus
tgcctcctctgtacatttataaagt

SEQ ID NO: 868944 - DNA, 25 bp, Mus musculus
tgcctcctctgttcatttataaagt

SEQ ID NO: 868945 - DNA, 25 bp, Mus musculus
tgcctcctgacaagtatgagtgtct

SEQ ID NO: 868946 - DNA, 25 bp, Mus musculus
tgcctcctgacatgtatgagtgtct

SEQ ID NO: 868947 - DNA, 25 bp, Mus musculus
tgcctcctgaggatgtgtgcacctt

SEQ ID NO: 868948 - DNA, 25 bp, Mus musculus
tgcctcctgaggttgtgtgcacctt

SEQ ID NO: 868949 - DNA, 25 bp, Mus musculus
tgcctcctgatgcacttatcattga

SEQ ID NO: 868950 - DNA, 25 bp, Mus musculus
tgcctcctgatggacttatcattga

SEQ ID NO: 868951 - DNA, 25 bp, Mus musculus
tgcctcctgcaacaatgtccaagtg

SEQ ID NO: 868952 - DNA, 25 bp, Mus musculus
tgcctcctgcaagaatgtccaagtg

SEQ ID NO: 868953 - DNA, 25 bp, Mus musculus
tgcctcctgcagacaatgaagcact

SEQ ID NO: 868954 - DNA, 25 bp, Mus musculus
tgcctcctgcagtcaatgaagcact

SEQ ID NO: 868955 - DNA, 25 bp, Mus musculus
tgcctcctgctactgaaatctgcag

SEQ ID NO: 868956 - DNA, 25 bp, Mus musculus
tgcctcctgctagtgaaatctgcag

SEQ ID NO: 868957 - DNA, 25 bp, Mus musculus
tgcctcctgcttatggatcagaagt

SEQ ID NO: 868958 - DNA, 25 bp, Mus musculus
tgcctcctgcttttggatcagaagt

SEQ ID NO: 868959 - DNA, 25 bp, Mus musculus
tgcctcctggccatcagttcctgag

SEQ ID NO: 868960 - DNA, 25 bp, Mus musculus
tgcctcctggccttcagttcctgag

SEQ ID NO: 868961 - DNA, 25 bp, Mus musculus
tgcctcctggtcacgaactgtcata

SEQ ID NO: 868962 - DNA, 25 bp, Mus musculus
tgcctcctggtctcgaactgtcata

SEQ ID NO: 868963 - DNA, 25 bp, Mus musculus
tgcctcctgtctcgttgtgtgaaga

SEQ ID NO: 868964 - DNA, 25 bp, Mus musculus
tgcctcctgtctggttgtgtgaaga

SEQ ID NO: 868965 - DNA, 25 bp, Mus musculus
tgcctccttaagactgatggttaat

SEQ ID NO: 868966 - DNA, 25 bp, Mus musculus
tgcctccttaagtctgatggttaat

SEQ ID NO: 868967 - DNA, 25 bp, Mus musculus
tgcctccttaggagaccgttccatg

SEQ ID NO: 868968 - DNA, 25 bp, Mus musculus
tgcctccttaggtgaccgttccatg

SEQ ID NO: 868969 - DNA, 25 bp, Mus musculus
tgcctccttcgacaagtctatcaag

SEQ ID NO: 868970 - DNA, 25 bp, Mus musculus
tgcctccttcgagaagtctatcaag

SEQ ID NO: 868971 - DNA, 25 bp, Mus musculus
tgcctccttcttcctggtcagaggt

SEQ ID NO: 868972 - DNA, 25 bp, Mus musculus
tgcctccttcttgctggtcagaggt

SEQ ID NO: 868973 - DNA, 25 bp, Mus musculus
tgcctccttggaattagacttgaac

SEQ ID NO: 868974 - DNA, 25 bp, Mus musculus
tgcctccttggatttagacttgaac

SEQ ID NO: 868975 - DNA, 25 bp, Mus musculus
tgcctccttggtctctagaggtatt

SEQ ID NO: 868976 - DNA, 25 bp, Mus musculus
tgcctccttggtgtctagaggtatt

SEQ ID NO: 868977 - DNA, 25 bp, Mus musculus
tgcctccttgtactgtaagcactga

SEQ ID NO: 868978 - DNA, 25 bp, Mus musculus
tgcctccttgtagtgtaagcactga

SEQ ID NO: 868979 - DNA, 25 bp, Mus musculus
tgcctcctttccattgttactagaa

SEQ ID NO: 868980 - DNA, 25 bp, Mus musculus
tgcctcctttcctttgttactagaa

SEQ ID NO: 868981 - DNA, 25 bp, Mus musculus
tgcctcctttgaaaacacagcttgg

SEQ ID NO: 868982 - DNA, 25 bp, Mus musculus
tgcctcctttgataacacagcttgg

SEQ ID NO: 868983 - DNA, 25 bp, Mus musculus
tgcctccttttccctcgatttcgtt

SEQ ID NO: 868984 - DNA, 25 bp, Mus musculus
tgcctccttttcgctcgatttcgtt

SEQ ID NO: 868985 - DNA, 25 bp, Mus musculus
tgcctcctttttctccgggataagg

SEQ ID NO: 868986 - DNA, 25 bp, Mus musculus
tgcctcctttttgtccgggataagg

SEQ ID NO: 868987 - DNA, 25 bp, Mus musculus
tgcctcgaccacatgctatgaaaaa

SEQ ID NO: 868988 - DNA, 25 bp, Mus musculus
tgcctcgaccacttgctatgaaaaa

SEQ ID NO: 868989 - DNA, 25 bp, Mus musculus
tgcctcgagtgacttttcttcatgt

SEQ ID NO: 868990 - DNA, 25 bp, Mus musculus
tgcctcgagtgagttttcttcatgt

SEQ ID NO: 868991 - DNA, 25 bp, Mus musculus
tgcctcgcagatcttttcctagatt

SEQ ID NO: 868992 - DNA, 25 bp, Mus musculus
tgcctcgcagatgttttcctagatt

SEQ ID NO: 868993 - DNA, 25 bp, Mus musculus
tgcctcgccagtatcattcagacat

SEQ ID NO: 868994 - DNA, 25 bp, Mus musculus
tgcctcgccagtttcattcagacat

SEQ ID NO: 868995 - DNA, 25 bp, Mus musculus
tgcctcgccctgagattgactgaaa

SEQ ID NO: 868996 - DNA, 25 bp, Mus musculus
tgcctcgccctgtgattgactgaaa

SEQ ID NO: 868997 - DNA, 25 bp, Mus musculus
tgcctcgccttaaagctacagctgt

SEQ ID NO: 868998 - DNA, 25 bp, Mus musculus
tgcctcgccttatagctacagctgt

SEQ ID NO: 868999 - DNA, 25 bp, Mus musculus
tgcctcgctagtctctgtcagaaaa

SEQ ID NO: 869000 - DNA, 25 bp, Mus musculus
tgcctcgctagtgtctgtcagaaaa

SEQ ID NO: 869001 - DNA, 25 bp, Mus musculus
tgcctcggacgcaggtgccaggtct

SEQ ID NO: 869002 - DNA, 25 bp, Mus musculus
tgcctcggacgctggtgccaggtct

SEQ ID NO: 869003 - DNA, 25 bp, Mus musculus
tgcctcggagacaacgatgacatca

SEQ ID NO: 869004 - DNA, 25 bp, Mus musculus
tgcctcggagactacgatgacatca

SEQ ID NO: 869005 - DNA, 25 bp, Mus musculus
tgcctcggcacacccaagggaaaca

SEQ ID NO: 869006 - DNA, 25 bp, Mus musculus
tgcctcggcacagccaagggaaaca

SEQ ID NO: 869007 - DNA, 25 bp, Mus musculus
tgcctcggcactctctgctgggctg

SEQ ID NO: 869008 - DNA, 25 bp, Mus musculus
tgcctcggcactgtctgctgggctg

SEQ ID NO: 869009 - DNA, 25 bp, Mus musculus
tgcctcggcgacctgcgcgacatga

SEQ ID NO: 869010 - DNA, 25 bp, Mus musculus
tgcctcggcgacgtgcgcgacatga

SEQ ID NO: 869011 - DNA, 25 bp, Mus musculus
tgcctcggctgaattgcagagtact

SEQ ID NO: 869012 - DNA, 25 bp, Mus musculus
tgcctcggctgatttgcagagtact

SEQ ID NO: 869013 - DNA, 25 bp, Mus musculus
tgcctcggtgttctgcccaaatgta

SEQ ID NO: 869014 - DNA, 25 bp, Mus musculus
tgcctcggtgttgtgcccaaatgta

SEQ ID NO: 869015 - DNA, 25 bp, Mus musculus
tgcctcgtacctctggaaactcaat

SEQ ID NO: 869016 - DNA, 25 bp, Mus musculus
tgcctcgtacctgtggaaactcaat

SEQ ID NO: 869017 - DNA, 25 bp, Mus musculus
tgcctcgtcctcctggtgagaaagg

SEQ ID NO: 869018 - DNA, 25 bp, Mus musculus
tgcctcgtcctcgtggtgagaaagg

SEQ ID NO: 869019 - DNA, 25 bp, Mus musculus
tgcctcgtgaacagaacaactactg

SEQ ID NO: 869020 - DNA, 25 bp, Mus musculus
tgcctcgtgaactgaacaactactg

SEQ ID NO: 869021 - DNA, 25 bp, Mus musculus
tgcctcgtgcttatatcatagctct

SEQ ID NO: 869022 - DNA, 25 bp, Mus musculus
tgcctcgtgcttttatcatagctct

SEQ ID NO: 869023 - DNA, 25 bp, Mus musculus
tgcctcgtggctcctctagagttat

SEQ ID NO: 869024 - DNA, 25 bp, Mus musculus
tgcctcgtggctgctctagagttat

SEQ ID NO: 869025 - DNA, 25 bp, Mus musculus
tgcctcgttttccaggtggccacat

SEQ ID NO: 869026 - DNA, 25 bp, Mus musculus
tgcctcgttttcgaggtggccacat

SEQ ID NO: 869027 - DNA, 25 bp, Mus musculus
tgcctctaaaagctccagaactctg

SEQ ID NO: 869028 - DNA, 25 bp, Mus musculus
tgcctctaaaaggtccagaactctg

SEQ ID NO: 869029 - DNA, 25 bp, Mus musculus
tgcctctacctcagtaatggctggg

SEQ ID NO: 869030 - DNA, 25 bp, Mus musculus
tgcctctacctctgtaatggctggg

SEQ ID NO: 869031 - DNA, 25 bp, Mus musculus
tgcctctaccttatgtgtgatgtta

SEQ ID NO: 869032 - DNA, 25 bp, Mus musculus
tgcctctaccttcggcaagttaggt

SEQ ID NO: 869033 - DNA, 25 bp, Mus musculus
tgcctctaccttgggcaagttaggt

SEQ ID NO: 869034 - DNA, 25 bp, Mus musculus
tgcctctaccttttgtgtgatgtta

SEQ ID NO: 869035 - DNA, 25 bp, Mus musculus
tgcctctagcctatgttgactgtgt

SEQ ID NO: 869036 - DNA, 25 bp, Mus musculus
tgcctctagcctttgttgactgtgt

SEQ ID NO: 869037 - DNA, 25 bp, Mus musculus
tgcctctagcggacagccaagaaaa

SEQ ID NO: 869038 - DNA, 25 bp, Mus musculus
tgcctctagcggtcagccaagaaaa

SEQ ID NO: 869039 - DNA, 25 bp, Mus musculus
tgcctctagggcagtccttctctgc

SEQ ID NO: 869040 - DNA, 25 bp, Mus musculus
tgcctctagggctgtccttctctgc

SEQ ID NO: 869041 - DNA, 25 bp, Mus musculus
tgcctctagtccatctctgggtaaa

SEQ ID NO: 869042 - DNA, 25 bp, Mus musculus
tgcctctagtccttctctgggtaaa

SEQ ID NO: 869043 - DNA, 25 bp, Mus musculus
tgcctctcagctcacactggaatct

SEQ ID NO: 869044 - DNA, 25 bp, Mus musculus
tgcctctcagctgacactggaatct

SEQ ID NO: 869045 - DNA, 25 bp, Mus musculus
tgcctctcaggtcctgtctttatag

SEQ ID NO: 869046 - DNA, 25 bp, Mus musculus
tgcctctcaggtgctgtctttatag

SEQ ID NO: 869047 - DNA, 25 bp, Mus musculus
tgcctctcagttatcaacctcatga

SEQ ID NO: 869048 - DNA, 25 bp, Mus musculus
tgcctctcagttttcaacctcatga

SEQ ID NO: 869049 - DNA, 25 bp, Mus musculus
tgcctctcatgcctgtgtgtaacag

SEQ ID NO: 869050 - DNA, 25 bp, Mus musculus
tgcctctcatgcgtgtgtgtaacag

SEQ ID NO: 869051 - DNA, 25 bp, Mus musculus
tgcctctcattgacaaacaagagag

SEQ ID NO: 869052 - DNA, 25 bp, Mus musculus
tgcctctcattgtcaaacaagagag

SEQ ID NO: 869053 - DNA, 25 bp, Mus musculus
tgcctctccaaacatgacctcatgg

SEQ ID NO: 869054 - DNA, 25 bp, Mus musculus
tgcctctccaaagatgacctcatgg

SEQ ID NO: 869055 - DNA, 25 bp, Mus musculus
tgcctctccataccagcaatatgaa

SEQ ID NO: 869056 - DNA, 25 bp, Mus musculus
tgcctctccatagcagcaatatgaa

SEQ ID NO: 869057 - DNA, 25 bp, Mus musculus
tgcctctcccatcttataagacttg

SEQ ID NO: 869058 - DNA, 25 bp, Mus musculus
tgcctctcccatgttataagacttg

SEQ ID NO: 869059 - DNA, 25 bp, Mus musculus
tgcctctcctgaagtcaagtgacac

SEQ ID NO: 869060 - DNA, 25 bp, Mus musculus
tgcctctcctgatgtcaagtgacac

SEQ ID NO: 869061 - DNA, 25 bp, Mus musculus
tgcctctcggaaccttaactgtttg

SEQ ID NO: 869062 - DNA, 25 bp, Mus musculus
tgcctctcggaagcttaactgtttg

SEQ ID NO: 869063 - DNA, 25 bp, Mus musculus
tgcctctcggatattcaacttgaag

SEQ ID NO: 869064 - DNA, 25 bp, Mus musculus
tgcctctcggattttcaacttgaag

SEQ ID NO: 869065 - DNA, 25 bp, Mus musculus
tgcctctcgttgatgtcccatttaa

SEQ ID NO: 869066 - DNA, 25 bp, Mus musculus
tgcctctcgttgttgtcccatttaa

SEQ ID NO: 869067 - DNA, 25 bp, Mus musculus
tgcctctctaaacctaaactcttgg

SEQ ID NO: 869068 - DNA, 25 bp, Mus musculus
tgcctctctaaagctaaactcttgg

SEQ ID NO: 869069 - DNA, 25 bp, Mus musculus
tgcctctctctgatagctattagct

SEQ ID NO: 869070 - DNA, 25 bp, Mus musculus
tgcctctctctgttagctattagct

SEQ ID NO: 869071 - DNA, 25 bp, Mus musculus
tgcctctctgacaaccaggttctag

SEQ ID NO: 869072 - DNA, 25 bp, Mus musculus
tgcctctctgactaccaggttctag

SEQ ID NO: 869073 - DNA, 25 bp, Mus musculus
tgcctctctgagcatactagcagca

SEQ ID NO: 869074 - DNA, 25 bp, Mus musculus
tgcctctctgaggatactagcagca

SEQ ID NO: 869075 - DNA, 25 bp, Mus musculus
tgcctctctgccagtcagtcacaga

SEQ ID NO: 869076 - DNA, 25 bp, Mus musculus
tgcctctctgcctgtcagtcacaga

SEQ ID NO: 869077 - DNA, 25 bp, Mus musculus
tgcctctctgctacattttcttgat

SEQ ID NO: 869078 - DNA, 25 bp, Mus musculus
tgcctctctgcttcattttcttgat

SEQ ID NO: 869079 - DNA, 25 bp, Mus musculus
tgcctctctgtacttctcaggatgt

SEQ ID NO: 869080 - DNA, 25 bp, Mus musculus
tgcctctctgtagttctcaggatgt

SEQ ID NO: 869081 - DNA, 25 bp, Mus musculus
tgcctctcttctacttgaccctgga

SEQ ID NO: 869082 - DNA, 25 bp, Mus musculus
tgcctctcttcttcttgaccctgga

SEQ ID NO: 869083 - DNA, 25 bp, Mus musculus
tgcctctcttggaccaaaattcttt

SEQ ID NO: 869084 - DNA, 25 bp, Mus musculus
tgcctctcttggtccaaaattcttt

SEQ ID NO: 869085 - DNA, 25 bp, Mus musculus
tgcctctgaaggaagcttgtttgct

SEQ ID NO: 869086 - DNA, 25 bp, Mus musculus
tgcctctgaaggtagcttgtttgct

SEQ ID NO: 869087 - DNA, 25 bp, Mus musculus
tgcctctgacctcatgctcaagaac

SEQ ID NO: 869088 - DNA, 25 bp, Mus musculus
tgcctctgacctgatgctcaagaac

SEQ ID NO: 869089 - DNA, 25 bp, Mus musculus
tgcctctgagttctatctgcttaga

SEQ ID NO: 869090 - DNA, 25 bp, Mus musculus
tgcctctgagttgtatctgcttaga

SEQ ID NO: 869091 - DNA, 25 bp, Mus musculus
tgcctctgccacatggttgctgtgt

SEQ ID NO: 869092 - DNA, 25 bp, Mus musculus
tgcctctgccacttggttgctgtgt

SEQ ID NO: 869093 - DNA, 25 bp, Mus musculus
tgcctctgccctaggatcagatcat

SEQ ID NO: 869094 - DNA, 25 bp, Mus musculus
tgcctctgcccttggatcagatcat

SEQ ID NO: 869095 - DNA, 25 bp, Mus musculus
tgcctctgcctgaaagacactcagg

SEQ ID NO: 869096 - DNA, 25 bp, Mus musculus
tgcctctgcctgtaagacactcagg

SEQ ID NO: 869097 - DNA, 25 bp, Mus musculus
tgcctctgctccagataggaacctt

SEQ ID NO: 869098 - DNA, 25 bp, Mus musculus
tgcctctgctcctgataggaacctt

SEQ ID NO: 869099 - DNA, 25 bp, Mus musculus
tgcctctgctgtctctcctactgtg

SEQ ID NO: 869100 - DNA, 25 bp, Mus musculus
tgcctctgctgtgtctcctactgtg

SEQ ID NO: 869101 - DNA, 25 bp, Mus musculus
tgcctctggccaagatcaaatatag

SEQ ID NO: 869102 - DNA, 25 bp, Mus musculus
tgcctctggccatgatcaaatatag

SEQ ID NO: 869103 - DNA, 25 bp, Mus musculus
tgcctctggcctccaataggacata

SEQ ID NO: 869104 - DNA, 25 bp, Mus musculus
tgcctctggcctgcaataggacata

SEQ ID NO: 869105 - DNA, 25 bp, Mus musculus
tgcctctgggacatgctcacctgat

SEQ ID NO: 869106 - DNA, 25 bp, Mus musculus
tgcctctgggacttgctcacctgat

SEQ ID NO: 869107 - DNA, 25 bp, Mus musculus
tgcctctgtcataatgagctcatct

SEQ ID NO: 869108 - DNA, 25 bp, Mus musculus
tgcctctgtcattatgagctcatct

SEQ ID NO: 869109 - DNA, 25 bp, Mus musculus
tgcctctgtcccaaggaacacagag

SEQ ID NO: 869110 - DNA, 25 bp, Mus musculus
tgcctctgtccctaggaacacagag

SEQ ID NO: 869111 - DNA, 25 bp, Mus musculus
tgcctctgtctgaggacatgtccag

SEQ ID NO: 869112 - DNA, 25 bp, Mus musculus
tgcctctgtctgtggacatgtccag

SEQ ID NO: 869113 - DNA, 25 bp, Mus musculus
tgcctctgtgacaccagtgtggatt

SEQ ID NO: 869114 - DNA, 25 bp, Mus musculus
tgcctctgtgactccagtgtggatt

SEQ ID NO: 869115 - DNA, 25 bp, Mus musculus
tgcctctgtgccaatcgtttttggg

SEQ ID NO: 869116 - DNA, 25 bp, Mus musculus
tgcctctgtgcccactcgggcagga

SEQ ID NO: 869117 - DNA, 25 bp, Mus musculus
tgcctctgtgccgactcgggcagga

SEQ ID NO: 869118 - DNA, 25 bp, Mus musculus
tgcctctgtgcctatcgtttttggg

SEQ ID NO: 869119 - DNA, 25 bp, Mus musculus
tgcctctgtggaacccatactcttt

SEQ ID NO: 869120 - DNA, 25 bp, Mus musculus
tgcctctgtggatcccatactcttt

SEQ ID NO: 869121 - DNA, 25 bp, Mus musculus
tgcctctgtgtcatcatggtgctca

SEQ ID NO: 869122 - DNA, 25 bp, Mus musculus
tgcctctgtgtcttcatggtgctca

SEQ ID NO: 869123 - DNA, 25 bp, Mus musculus
tgcctcttatccaatgcaagcttac

SEQ ID NO: 869124 - DNA, 25 bp, Mus musculus
tgcctcttatcctatgcaagcttac

SEQ ID NO: 869125 - DNA, 25 bp, Mus musculus
tgcctcttattcacctggctgagga

SEQ ID NO: 869126 - DNA, 25 bp, Mus musculus
tgcctcttattcagctaagggccga

SEQ ID NO: 869127 - DNA, 25 bp, Mus musculus
tgcctcttattctcctggctgagga

SEQ ID NO: 869128 - DNA, 25 bp, Mus musculus
tgcctcttattctgctaagggccga

SEQ ID NO: 869129 - DNA, 25 bp, Mus musculus
tgcctcttcaataaaactctcctag

SEQ ID NO: 869130 - DNA, 25 bp, Mus musculus
tgcctcttcaattaaactctcctag

SEQ ID NO: 869131 - DNA, 25 bp, Mus musculus
tgcctcttcagcactgaggtactga

SEQ ID NO: 869132 - DNA, 25 bp, Mus musculus
tgcctcttcagctctgaggtactga

SEQ ID NO: 869133 - DNA, 25 bp, Mus musculus
tgcctcttcatcatgtagcgatggt

SEQ ID NO: 869134 - DNA, 25 bp, Mus musculus
tgcctcttcatcttgtagcgatggt

SEQ ID NO: 869135 - DNA, 25 bp, Mus musculus
tgcctcttcattatggtttcacgtt

SEQ ID NO: 869136 - DNA, 25 bp, Mus musculus
tgcctcttcattttggtttcacgtt

SEQ ID NO: 869137 - DNA, 25 bp, Mus musculus
tgcctcttccagctcaataggagaa

SEQ ID NO: 869138 - DNA, 25 bp, Mus musculus
tgcctcttccaggtcaataggagaa

SEQ ID NO: 869139 - DNA, 25 bp, Mus musculus
tgcctcttcccacctgtgatgaatg

SEQ ID NO: 869140 - DNA, 25 bp, Mus musculus
tgcctcttcccagctgtgatgaatg

SEQ ID NO: 869141 - DNA, 25 bp, Mus musculus
tgcctcttctacagtattctctgag

SEQ ID NO: 869142 - DNA, 25 bp, Mus musculus
tgcctcttctactgtattctctgag

SEQ ID NO: 869143 - DNA, 25 bp, Mus musculus
tgcctcttctttcgtcaacttggac

SEQ ID NO: 869144 - DNA, 25 bp, Mus musculus
tgcctcttctttggtcaacttggac

SEQ ID NO: 869145 - DNA, 25 bp, Mus musculus
tgcctcttgccaagacagtaattga

SEQ ID NO: 869146 - DNA, 25 bp, Mus musculus
tgcctcttgccatgacagtaattga

SEQ ID NO: 869147 - DNA, 25 bp, Mus musculus
tgcctcttgcctctgtgtgcttcat

SEQ ID NO: 869148 - DNA, 25 bp, Mus musculus
tgcctcttgcctgtgtgtgcttcat

SEQ ID NO: 869149 - DNA, 25 bp, Mus musculus
tgcctcttgctaaccaaatgggacc

SEQ ID NO: 869150 - DNA, 25 bp, Mus musculus
tgcctcttgctatccaaatgggacc

SEQ ID NO: 869151 - DNA, 25 bp, Mus musculus
tgcctcttggagctcagcattgcaa

SEQ ID NO: 869152 - DNA, 25 bp, Mus musculus
tgcctcttggaggtcagcattgcaa

SEQ ID NO: 869153 - DNA, 25 bp, Mus musculus
tgcctcttgttaatccttcacatca

SEQ ID NO: 869154 - DNA, 25 bp, Mus musculus
tgcctcttgttattccttcacatca

SEQ ID NO: 869155 - DNA, 25 bp, Mus musculus
tgcctctttgcaagcgttctgtcaa

SEQ ID NO: 869156 - DNA, 25 bp, Mus musculus
tgcctctttgcatgcgttctgtcaa

SEQ ID NO: 869157 - DNA, 25 bp, Mus musculus
tgcctcttttcaccctgtaagtgaa

SEQ ID NO: 869158 - DNA, 25 bp, Mus musculus
tgcctcttttcagcctgtaagtgaa

SEQ ID NO: 869159 - DNA, 25 bp, Mus musculus
tgcctgaaaagcaggagtgcccctg

SEQ ID NO: 869160 - DNA, 25 bp, Mus musculus
tgcctgaaaagctggagtgcccctg

SEQ ID NO: 869161 - DNA, 25 bp, Mus musculus
tgcctgaaatcccaagggttcttac

SEQ ID NO: 869162 - DNA, 25 bp, Mus musculus
tgcctgaaatccgaagggttcttac

SEQ ID NO: 869163 - DNA, 25 bp, Mus musculus
tgcctgaacctcacagcagagttga

SEQ ID NO: 869164 - DNA, 25 bp, Mus musculus
tgcctgaacctctcagcagagttga

SEQ ID NO: 869165 - DNA, 25 bp, Mus musculus
tgcctgaacgctagcctagttaaag

SEQ ID NO: 869166 - DNA, 25 bp, Mus musculus
tgcctgaacgcttgcctagttaaag

SEQ ID NO: 869167 - DNA, 25 bp, Mus musculus
tgcctgaactttagccctaacccag

SEQ ID NO: 869168 - DNA, 25 bp, Mus musculus
tgcctgaacttttgccctaacccag

SEQ ID NO: 869169 - DNA, 25 bp, Mus musculus
tgcctgaagcaacatagctgcagag

SEQ ID NO: 869170 - DNA, 25 bp, Mus musculus
tgcctgaagcaagatagctgcagag

SEQ ID NO: 869171 - DNA, 25 bp, Mus musculus
tgcctgaaggctctggtgtcctcct

SEQ ID NO: 869172 - DNA, 25 bp, Mus musculus
tgcctgaaggctgtggtgtcctcct

SEQ ID NO: 869173 - DNA, 25 bp, Mus musculus
tgcctgaatgatcctgagggtatca

SEQ ID NO: 869174 - DNA, 25 bp, Mus musculus
tgcctgaatgatgctgagggtatca

SEQ ID NO: 869175 - DNA, 25 bp, Mus musculus
tgcctgaatgtaagtgcatcattta

SEQ ID NO: 869176 - DNA, 25 bp, Mus musculus
tgcctgaatgtatgtgcatcattta

SEQ ID NO: 869177 - DNA, 25 bp, Mus musculus
tgcctgaattgtaccacctacatct

SEQ ID NO: 869178 - DNA, 25 bp, Mus musculus
tgcctgaattgttccacctacatct

SEQ ID NO: 869179 - DNA, 25 bp, Mus musculus
tgcctgacctctcctattttctagg

SEQ ID NO: 869180 - DNA, 25 bp, Mus musculus
tgcctgacctctgctattttctagg

SEQ ID NO: 869181 - DNA, 25 bp, Mus musculus
tgcctgacggacaccagctgacctt

SEQ ID NO: 869182 - DNA, 25 bp, Mus musculus
tgcctgacggactccagctgacctt

SEQ ID NO: 869183 - DNA, 25 bp, Mus musculus
tgcctgacggccaagtcatcactat

SEQ ID NO: 869184 - DNA, 25 bp, Mus musculus
tgcctgacggcctagtcatcactat

SEQ ID NO: 869185 - DNA, 25 bp, Mus musculus
tgcctgactgccatctctagaggga

SEQ ID NO: 869186 - DNA, 25 bp, Mus musculus
tgcctgactgccttctctagaggga

SEQ ID NO: 869187 - DNA, 25 bp, Mus musculus
tgcctgactttcctgatgcccttga

SEQ ID NO: 869188 - DNA, 25 bp, Mus musculus
tgcctgactttcgtgatgcccttga

SEQ ID NO: 869189 - DNA, 25 bp, Mus musculus
tgcctgagccccagagccttaaact

SEQ ID NO: 869190 - DNA, 25 bp, Mus musculus
tgcctgagcccctgagccttaaact

SEQ ID NO: 869191 - DNA, 25 bp, Mus musculus
tgcctgagccgaccccagaacggtg

SEQ ID NO: 869192 - DNA, 25 bp, Mus musculus
tgcctgagccgagcccagaacggtg

SEQ ID NO: 869193 - DNA, 25 bp, Mus musculus
tgcctgagctggagaagaacgagaa

SEQ ID NO: 869194 - DNA, 25 bp, Mus musculus
tgcctgagctggtgaagaacgagaa

SEQ ID NO: 869195 - DNA, 25 bp, Mus musculus
tgcctgagcttacctgctccaaaga

SEQ ID NO: 869196 - DNA, 25 bp, Mus musculus
tgcctgagcttagctgctccaaaga

SEQ ID NO: 869197 - DNA, 25 bp, Mus musculus
tgcctgagcttcatgaaagatttct

SEQ ID NO: 869198 - DNA, 25 bp, Mus musculus
tgcctgagcttcttgaaagatttct

SEQ ID NO: 869199 - DNA, 25 bp, Mus musculus
tgcctgaggtgccatactgagagaa

SEQ ID NO: 869200 - DNA, 25 bp, Mus musculus
tgcctgaggtgcgatactgagagaa

SEQ ID NO: 869201 - DNA, 25 bp, Mus musculus
tgcctgagtaagcagaggacccgct

SEQ ID NO: 869202 - DNA, 25 bp, Mus musculus
tgcctgagtaaggagaggacccgct

SEQ ID NO: 869203 - DNA, 25 bp, Mus musculus
tgcctgagtttgcatgtccacagag

SEQ ID NO: 869204 - DNA, 25 bp, Mus musculus
tgcctgagtttggatgtccacagag

SEQ ID NO: 869205 - DNA, 25 bp, Mus musculus
tgcctgataggtccttcattaccct

SEQ ID NO: 869206 - DNA, 25 bp, Mus musculus
tgcctgataggtgcttcattaccct

SEQ ID NO: 869207 - DNA, 25 bp, Mus musculus
tgcctgatcacaacactgatcacgg

SEQ ID NO: 869208 - DNA, 25 bp, Mus musculus
tgcctgatcacatcactgatcacgg

SEQ ID NO: 869209 - DNA, 25 bp, Mus musculus
tgcctgatgattccaactctgtacc

SEQ ID NO: 869210 - DNA, 25 bp, Mus musculus
tgcctgatgattgcaactctgtacc

SEQ ID NO: 869211 - DNA, 25 bp, Mus musculus
tgcctgatgtccacatcacctgaaa

SEQ ID NO: 869212 - DNA, 25 bp, Mus musculus
tgcctgatgtcctcatcacctgaaa

SEQ ID NO: 869213 - DNA, 25 bp, Mus musculus
tgcctgatgtctcccagcaagtgtg

SEQ ID NO: 869214 - DNA, 25 bp, Mus musculus
tgcctgatgtctgccagcaagtgtg

SEQ ID NO: 869215 - DNA, 25 bp, Mus musculus
tgcctgatgtttctctagccttaga

SEQ ID NO: 869216 - DNA, 25 bp, Mus musculus
tgcctgatgtttgtctagccttaga

SEQ ID NO: 869217 - DNA, 25 bp, Mus musculus
tgcctgattcgcacatcgttatttt

SEQ ID NO: 869218 - DNA, 25 bp, Mus musculus
tgcctgattcgctcatcgttatttt

SEQ ID NO: 869219 - DNA, 25 bp, Mus musculus
tgcctgattcggacggccaatggtg

SEQ ID NO: 869220 - DNA, 25 bp, Mus musculus
tgcctgattcggtcggccaatggtg

SEQ ID NO: 869221 - DNA, 25 bp, Mus musculus
tgcctgatttctatcttgcactcag

SEQ ID NO: 869222 - DNA, 25 bp, Mus musculus
tgcctgatttctttcttgcactcag

SEQ ID NO: 869223 - DNA, 25 bp, Mus musculus
tgcctgcaaactctggacaacttca

SEQ ID NO: 869224 - DNA, 25 bp, Mus musculus
tgcctgcaaactgtggacaacttca

SEQ ID NO: 869225 - DNA, 25 bp, Mus musculus
tgcctgcaccaaaaaagctgccttt

SEQ ID NO: 869226 - DNA, 25 bp, Mus musculus
tgcctgcaccaataaagctgccttt

SEQ ID NO: 869227 - DNA, 25 bp, Mus musculus
tgcctgcactgcaggaagctggctt

SEQ ID NO: 869228 - DNA, 25 bp, Mus musculus
tgcctgcactgctggaagctggctt

SEQ ID NO: 869229 - DNA, 25 bp, Mus musculus
tgcctgcacttaaatctgtatgaag

SEQ ID NO: 869230 - DNA, 25 bp, Mus musculus
tgcctgcacttatatctgtatgaag

SEQ ID NO: 869231 - DNA, 25 bp, Mus musculus
tgcctgcagagaatccttcactcat

SEQ ID NO: 869232 - DNA, 25 bp, Mus musculus
tgcctgcagagattccttcactcat

SEQ ID NO: 869233 - DNA, 25 bp, Mus musculus
tgcctgcagcagatacggagacccc

SEQ ID NO: 869234 - DNA, 25 bp, Mus musculus
tgcctgcagcagcttagtggtcaga

SEQ ID NO: 869235 - DNA, 25 bp, Mus musculus
tgcctgcagcaggttagtggtcaga

SEQ ID NO: 869236 - DNA, 25 bp, Mus musculus
tgcctgcagcagttacggagacccc

SEQ ID NO: 869237 - DNA, 25 bp, Mus musculus
tgcctgcagcatcggagtttagatc

SEQ ID NO: 869238 - DNA, 25 bp, Mus musculus
tgcctgcagcatgggagtttagatc

SEQ ID NO: 869239 - DNA, 25 bp, Mus musculus
tgcctgcagcttacagatgcactgt

SEQ ID NO: 869240 - DNA, 25 bp, Mus musculus
tgcctgcagcttatacttaaccctg

SEQ ID NO: 869241 - DNA, 25 bp, Mus musculus
tgcctgcagctttcagatgcactgt

SEQ ID NO: 869242 - DNA, 25 bp, Mus musculus
tgcctgcagcttttacttaaccctg

SEQ ID NO: 869243 - DNA, 25 bp, Mus musculus
tgcctgcagggactcacacaaatgt

SEQ ID NO: 869244 - DNA, 25 bp, Mus musculus
tgcctgcagggagtcacacaaatgt

SEQ ID NO: 869245 - DNA, 25 bp, Mus musculus
tgcctgcagggcatcagaacctttg

SEQ ID NO: 869246 - DNA, 25 bp, Mus musculus
tgcctgcagggcttcagaacctttg

SEQ ID NO: 869247 - DNA, 25 bp, Mus musculus
tgcctgcagtttctcttcagcatca

SEQ ID NO: 869248 - DNA, 25 bp, Mus musculus
tgcctgcagtttgtcttcagcatca

SEQ ID NO: 869249 - DNA, 25 bp, Mus musculus
tgcctgcatcacaaccagactgtag

SEQ ID NO: 869250 - DNA, 25 bp, Mus musculus
tgcctgcatcactaccagactgtag

SEQ ID NO: 869251 - DNA, 25 bp, Mus musculus
tgcctgcatcagcagcgacaccaaa

SEQ ID NO: 869252 - DNA, 25 bp, Mus musculus
tgcctgcatcaggagcgacaccaaa

SEQ ID NO: 869253 - DNA, 25 bp, Mus musculus
tgcctgcatcttcgaacgtcacatg

SEQ ID NO: 869254 - DNA, 25 bp, Mus musculus
tgcctgcatcttggaacgtcacatg

SEQ ID NO: 869255 - DNA, 25 bp, Mus musculus
tgcctgcatgtcaggtgcttgcaga

SEQ ID NO: 869256 - DNA, 25 bp, Mus musculus
tgcctgcatgtcattataccatgtg

SEQ ID NO: 869257 - DNA, 25 bp, Mus musculus
tgcctgcatgtctggtgcttgcaga

SEQ ID NO: 869258 - DNA, 25 bp, Mus musculus
tgcctgcatgtctttataccatgtg

SEQ ID NO: 869259 - DNA, 25 bp, Mus musculus
tgcctgcattacacgttaacctgtt

SEQ ID NO: 869260 - DNA, 25 bp, Mus musculus
tgcctgcattactcgttaacctgtt

SEQ ID NO: 869261 - DNA, 25 bp, Mus musculus
tgcctgcattgaaacagagcctgaa

SEQ ID NO: 869262 - DNA, 25 bp, Mus musculus
tgcctgcattgatacagagcctgaa

SEQ ID NO: 869263 - DNA, 25 bp, Mus musculus
tgcctgcattgcatggtttactggt

SEQ ID NO: 869264 - DNA, 25 bp, Mus musculus
tgcctgcattgcttggtttactggt

SEQ ID NO: 869265 - DNA, 25 bp, Mus musculus
tgcctgccaagaaaattactacaag

SEQ ID NO: 869266 - DNA, 25 bp, Mus musculus
tgcctgccaagataattactacaag

SEQ ID NO: 869267 - DNA, 25 bp, Mus musculus
tgcctgccaagccttataaagtgcc

SEQ ID NO: 869268 - DNA, 25 bp, Mus musculus
tgcctgccaagcgttataaagtgcc

SEQ ID NO: 869269 - DNA, 25 bp, Mus musculus
tgcctgccagagacttactgtgctt

SEQ ID NO: 869270 - DNA, 25 bp, Mus musculus
tgcctgccagagtcttactgtgctt

SEQ ID NO: 869271 - DNA, 25 bp, Mus musculus
tgcctgccagctagcctgtctgtct

SEQ ID NO: 869272 - DNA, 25 bp, Mus musculus
tgcctgccagctcttgggattacac

SEQ ID NO: 869273 - DNA, 25 bp, Mus musculus
tgcctgccagctgttgggattacac

SEQ ID NO: 869274 - DNA, 25 bp, Mus musculus
tgcctgccagcttgcctgtctgtct

SEQ ID NO: 869275 - DNA, 25 bp, Mus musculus
tgcctgccagggactattggaatga

SEQ ID NO: 869276 - DNA, 25 bp, Mus musculus
tgcctgccagggtctattggaatga

SEQ ID NO: 869277 - DNA, 25 bp, Mus musculus
tgcctgccagtcattgccatagaag

SEQ ID NO: 869278 - DNA, 25 bp, Mus musculus
tgcctgccagtctttgccatagaag

SEQ ID NO: 869279 - DNA, 25 bp, Mus musculus
tgcctgccatgtctttgtgtctgaa

SEQ ID NO: 869280 - DNA, 25 bp, Mus musculus
tgcctgccatgtgtttgtgtctgaa

SEQ ID NO: 869281 - DNA, 25 bp, Mus musculus
tgcctgcccacaatctgtagtctag

SEQ ID NO: 869282 - DNA, 25 bp, Mus musculus
tgcctgcccacattctgtagtctag

SEQ ID NO: 869283 - DNA, 25 bp, Mus musculus
tgcctgcccatgctggcaagagaaa

SEQ ID NO: 869284 - DNA, 25 bp, Mus musculus
tgcctgcccatggtggcaagagaaa

SEQ ID NO: 869285 - DNA, 25 bp, Mus musculus
tgcctgccctatatcataagcacag

SEQ ID NO: 869286 - DNA, 25 bp, Mus musculus
tgcctgccctatttcataagcacag

SEQ ID NO: 869287 - DNA, 25 bp, Mus musculus
tgcctgccctccattggaaaagaca

SEQ ID NO: 869288 - DNA, 25 bp, Mus musculus
tgcctgccctcctttggaaaagaca

SEQ ID NO: 869289 - DNA, 25 bp, Mus musculus
tgcctgccctggaattgcaacatta

SEQ ID NO: 869290 - DNA, 25 bp, Mus musculus
tgcctgccctggtattgcaacatta

SEQ ID NO: 869291 - DNA, 25 bp, Mus musculus
tgcctgccgagcacagtcttattct

SEQ ID NO: 869292 - DNA, 25 bp, Mus musculus
tgcctgccgagctcagtcttattct

SEQ ID NO: 869293 - DNA, 25 bp, Mus musculus
tgcctgccgcctcaagagcaagctg

SEQ ID NO: 869294 - DNA, 25 bp, Mus musculus
tgcctgccgcctgaagagcaagctg

SEQ ID NO: 869295 - DNA, 25 bp, Mus musculus
tgcctgccggaccataggaggccaa

SEQ ID NO: 869296 - DNA, 25 bp, Mus musculus
tgcctgccggacgataggaggccaa

SEQ ID NO: 869297 - DNA, 25 bp, Mus musculus
tgcctgccgtgcagggcagttaata

SEQ ID NO: 869298 - DNA, 25 bp, Mus musculus
tgcctgccgtgctgggcagttaata

SEQ ID NO: 869299 - DNA, 25 bp, Mus musculus
tgcctgcctaggaccttgcagggaa

SEQ ID NO: 869300 - DNA, 25 bp, Mus musculus
tgcctgcctaggtccttgcagggaa

SEQ ID NO: 869301 - DNA, 25 bp, Mus musculus
tgcctgcctctaacaccaggaagga

SEQ ID NO: 869302 - DNA, 25 bp, Mus musculus
tgcctgcctctatcaccaggaagga

SEQ ID NO: 869303 - DNA, 25 bp, Mus musculus
tgcctgcctctgaccgtattatagc

SEQ ID NO: 869304 - DNA, 25 bp, Mus musculus
tgcctgcctctgtccgtattatagc

SEQ ID NO: 869305 - DNA, 25 bp, Mus musculus
tgcctgcctggacacgagacattct

SEQ ID NO: 869306 - DNA, 25 bp, Mus musculus
tgcctgcctggagacgagacattct

SEQ ID NO: 869307 - DNA, 25 bp, Mus musculus
tgcctgcctggcactgcaatctgga

SEQ ID NO: 869308 - DNA, 25 bp, Mus musculus
tgcctgcctggctctgcaatctgga

SEQ ID NO: 869309 - DNA, 25 bp, Mus musculus
tgcctgcctgtgagtagcgcacaca

SEQ ID NO: 869310 - DNA, 25 bp, Mus musculus
tgcctgcctgtgtgtagcgcacaca

SEQ ID NO: 869311 - DNA, 25 bp, Mus musculus
tgcctgcctgttcagcaagttgaaa

SEQ ID NO: 869312 - DNA, 25 bp, Mus musculus
tgcctgcctgttgagcaagttgaaa

SEQ ID NO: 869313 - DNA, 25 bp, Mus musculus
tgcctgcctttgactgtgagctcat

SEQ ID NO: 869314 - DNA, 25 bp, Mus musculus
tgcctgcctttgtctgtgagctcat

SEQ ID NO: 869315 - DNA, 25 bp, Mus musculus
tgcctgcgaaaccactgggtgactg

SEQ ID NO: 869316 - DNA, 25 bp, Mus musculus
tgcctgcgaaacgactgggtgactg

SEQ ID NO: 869317 - DNA, 25 bp, Mus musculus
tgcctgcgggctcggtcctgtcaca

SEQ ID NO: 869318 - DNA, 25 bp, Mus musculus
tgcctgcgggctgggtcctgtcaca

SEQ ID NO: 869319 - DNA, 25 bp, Mus musculus
tgcctgcgggttccttttttagaag

SEQ ID NO: 869320 - DNA, 25 bp, Mus musculus
tgcctgcgggttgcttttttagaag

SEQ ID NO: 869321 - DNA, 25 bp, Mus musculus
tgcctgcgtcttaaaaaataagctg

SEQ ID NO: 869322 - DNA, 25 bp, Mus musculus
tgcctgcgtctttaaaaataagctg

SEQ ID NO: 869323 - DNA, 25 bp, Mus musculus
tgcctgctacagaacacaacatcac

SEQ ID NO: 869324 - DNA, 25 bp, Mus musculus
tgcctgctacagtacacaacatcac

SEQ ID NO: 869325 - DNA, 25 bp, Mus musculus
tgcctgctcaacaaccgcgtagact

SEQ ID NO: 869326 - DNA, 25 bp, Mus musculus
tgcctgctcaactaccgcgtagact

SEQ ID NO: 869327 - DNA, 25 bp, Mus musculus
tgcctgctcagtagaaatgcatgga

SEQ ID NO: 869328 - DNA, 25 bp, Mus musculus
tgcctgctcagttgaaatgcatgga

SEQ ID NO: 869329 - DNA, 25 bp, Mus musculus
tgcctgctccgccaaggaggagact

SEQ ID NO: 869330 - DNA, 25 bp, Mus musculus
tgcctgctccgcgaaggaggagact

SEQ ID NO: 869331 - DNA, 25 bp, Mus musculus
tgcctgctcctgaaggtcaaccaga

SEQ ID NO: 869332 - DNA, 25 bp, Mus musculus
tgcctgctcctgtaggtcaaccaga

SEQ ID NO: 869333 - DNA, 25 bp, Mus musculus
tgcctgctctgtatactgtgctcca

SEQ ID NO: 869334 - DNA, 25 bp, Mus musculus
tgcctgctctgtttactgtgctcca

SEQ ID NO: 869335 - DNA, 25 bp, Mus musculus
tgcctgctcttcataggacttctga

SEQ ID NO: 869336 - DNA, 25 bp, Mus musculus
tgcctgctcttcttaggacttctga

SEQ ID NO: 869337 - DNA, 25 bp, Mus musculus
tgcctgctgagcatggagacttcaa

SEQ ID NO: 869338 - DNA, 25 bp, Mus musculus
tgcctgctgagcttggagacttcaa

SEQ ID NO: 869339 - DNA, 25 bp, Mus musculus
tgcctgctgcctcagacagtaaaca

SEQ ID NO: 869340 - DNA, 25 bp, Mus musculus
tgcctgctgcctcgagcataaatgt

SEQ ID NO: 869341 - DNA, 25 bp, Mus musculus
tgcctgctgcctgagacagtaaaca

SEQ ID NO: 869342 - DNA, 25 bp, Mus musculus
tgcctgctgcctggagcataaatgt

SEQ ID NO: 869343 - DNA, 25 bp, Mus musculus
tgcctgctgctaactgctttcaaga

SEQ ID NO: 869344 - DNA, 25 bp, Mus musculus
tgcctgctgctatctgctttcaaga

SEQ ID NO: 869345 - DNA, 25 bp, Mus musculus
tgcctgctgcttatggcagctggaa

SEQ ID NO: 869346 - DNA, 25 bp, Mus musculus
tgcctgctgcttttggcagctggaa

SEQ ID NO: 869347 - DNA, 25 bp, Mus musculus
tgcctgctggtccagatgtaggact

SEQ ID NO: 869348 - DNA, 25 bp, Mus musculus
tgcctgctggtcgagatgtaggact

SEQ ID NO: 869349 - DNA, 25 bp, Mus musculus
tgcctgctggttatactgccacttc

SEQ ID NO: 869350 - DNA, 25 bp, Mus musculus
tgcctgctggttttactgccacttc

SEQ ID NO: 869351 - DNA, 25 bp, Mus musculus
tgcctgctgtccaaatgaaccatgt

SEQ ID NO: 869352 - DNA, 25 bp, Mus musculus
tgcctgctgtcccaagtggtcaggg

SEQ ID NO: 869353 - DNA, 25 bp, Mus musculus
tgcctgctgtccgaagtggtcaggg

SEQ ID NO: 869354 - DNA, 25 bp, Mus musculus
tgcctgctgtcctaatgaaccatgt

SEQ ID NO: 869355 - DNA, 25 bp, Mus musculus
tgcctgctgtctcttaccatggtct

SEQ ID NO: 869356 - DNA, 25 bp, Mus musculus
tgcctgctgtctgttaccatggtct

SEQ ID NO: 869357 - DNA, 25 bp, Mus musculus
tgcctgctgtggagtgatcacatcc

SEQ ID NO: 869358 - DNA, 25 bp, Mus musculus
tgcctgctgtggtgtgatcacatcc

SEQ ID NO: 869359 - DNA, 25 bp, Mus musculus
tgcctgctgttccacaaagcttaaa

SEQ ID NO: 869360 - DNA, 25 bp, Mus musculus
tgcctgctgttcgacaaagcttaaa

SEQ ID NO: 869361 - DNA, 25 bp, Mus musculus
tgcctgcttcctaccgtaataataa

SEQ ID NO: 869362 - DNA, 25 bp, Mus musculus
tgcctgcttcctcttgctataggtc

SEQ ID NO: 869363 - DNA, 25 bp, Mus musculus
tgcctgcttcctgttgctataggtc

SEQ ID NO: 869364 - DNA, 25 bp, Mus musculus
tgcctgcttccttccgtaataataa

SEQ ID NO: 869365 - DNA, 25 bp, Mus musculus
tgcctgcttctaccttgtgttacag

SEQ ID NO: 869366 - DNA, 25 bp, Mus musculus
tgcctgcttctagcttgtgttacag

SEQ ID NO: 869367 - DNA, 25 bp, Mus musculus
tgcctgcttggcatactggctctga

SEQ ID NO: 869368 - DNA, 25 bp, Mus musculus
tgcctgcttggcttactggctctga

SEQ ID NO: 869369 - DNA, 25 bp, Mus musculus
tgcctgctttagaacaccatttata

SEQ ID NO: 869370 - DNA, 25 bp, Mus musculus
tgcctgctttagtacaccatttata

SEQ ID NO: 869371 - DNA, 25 bp, Mus musculus
tgcctgctttcacctacattaatta

SEQ ID NO: 869372 - DNA, 25 bp, Mus musculus
tgcctgctttcactgagctagtcag

SEQ ID NO: 869373 - DNA, 25 bp, Mus musculus
tgcctgctttcagctacattaatta

SEQ ID NO: 869374 - DNA, 25 bp, Mus musculus
tgcctgctttcagtgagctagtcag

SEQ ID NO: 869375 - DNA, 25 bp, Mus musculus
tgcctgctttccaggacctgaaaat

SEQ ID NO: 869376 - DNA, 25 bp, Mus musculus
tgcctgctttcctggacctgaaaat

SEQ ID NO: 869377 - DNA, 25 bp, Mus musculus
tgcctgctttggatctgtgggatga

SEQ ID NO: 869378 - DNA, 25 bp, Mus musculus
tgcctgctttggttctgtgggatga

SEQ ID NO: 869379 - DNA, 25 bp, Mus musculus
tgcctgctttgtaagagggtggact

SEQ ID NO: 869380 - DNA, 25 bp, Mus musculus
tgcctgctttgttagagggtggact

SEQ ID NO: 869381 - DNA, 25 bp, Mus musculus
tgcctgcttttgagcacctaacact

SEQ ID NO: 869382 - DNA, 25 bp, Mus musculus
tgcctgcttttgtgcacctaacact

SEQ ID NO: 869383 - DNA, 25 bp, Mus musculus
tgcctggaaacaaagctaaggtgac

SEQ ID NO: 869384 - DNA, 25 bp, Mus musculus
tgcctggaaacacaacttgaacaaa

SEQ ID NO: 869385 - DNA, 25 bp, Mus musculus
tgcctggaaacagaacttgaacaaa

SEQ ID NO: 869386 - DNA, 25 bp, Mus musculus
tgcctggaaacatagctaaggtgac

SEQ ID NO: 869387 - DNA, 25 bp, Mus musculus
tgcctggaacatctgtattatcccg

SEQ ID NO: 869388 - DNA, 25 bp, Mus musculus
tgcctggaacatgtgtattatcccg

SEQ ID NO: 869389 - DNA, 25 bp, Mus musculus
tgcctggaagggatatgcagacatt

SEQ ID NO: 869390 - DNA, 25 bp, Mus musculus
tgcctggaagggttatgcagacatt

SEQ ID NO: 869391 - DNA, 25 bp, Mus musculus
tgcctggaatgccttctctctaaat

SEQ ID NO: 869392 - DNA, 25 bp, Mus musculus
tgcctggaatgcgttctctctaaat

SEQ ID NO: 869393 - DNA, 25 bp, Mus musculus
tgcctggacaggagactttctttaa

SEQ ID NO: 869394 - DNA, 25 bp, Mus musculus
tgcctggacaggtgactttctttaa

SEQ ID NO: 869395 - DNA, 25 bp, Mus musculus
tgcctggactccactcaagttgaag

SEQ ID NO: 869396 - DNA, 25 bp, Mus musculus
tgcctggactcctctcaagttgaag

SEQ ID NO: 869397 - DNA, 25 bp, Mus musculus
tgcctggactctctactacgcattt

SEQ ID NO: 869398 - DNA, 25 bp, Mus musculus
tgcctggactctgtactacgcattt

SEQ ID NO: 869399 - DNA, 25 bp, Mus musculus
tgcctggagagtcagcacctaataa

SEQ ID NO: 869400 - DNA, 25 bp, Mus musculus
tgcctggagagtgagcacctaataa

SEQ ID NO: 869401 - DNA, 25 bp, Mus musculus
tgcctggagcatcttaacagcccca

SEQ ID NO: 869402 - DNA, 25 bp, Mus musculus
tgcctggagcatgttaacagcccca

SEQ ID NO: 869403 - DNA, 25 bp, Mus musculus
tgcctggagcgccattatgctgcct

SEQ ID NO: 869404 - DNA, 25 bp, Mus musculus
tgcctggagcgcgattatgctgcct

SEQ ID NO: 869405 - DNA, 25 bp, Mus musculus
tgcctggaggccactattccactaa

SEQ ID NO: 869406 - DNA, 25 bp, Mus musculus
tgcctggaggcctctattccactaa

SEQ ID NO: 869407 - DNA, 25 bp, Mus musculus
tgcctggagtatatttggtacaaat

SEQ ID NO: 869408 - DNA, 25 bp, Mus musculus
tgcctggagtatttttggtacaaat

SEQ ID NO: 869409 - DNA, 25 bp, Mus musculus
tgcctggatccccacggagaggata

SEQ ID NO: 869410 - DNA, 25 bp, Mus musculus
tgcctggatcccgacggagaggata

SEQ ID NO: 869411 - DNA, 25 bp, Mus musculus
tgcctggatgtacctctgtgcgttc

SEQ ID NO: 869412 - DNA, 25 bp, Mus musculus
tgcctggatgtagctctgtgcgttc

SEQ ID NO: 869413 - DNA, 25 bp, Mus musculus
tgcctggcaagtcagttcctgttct

SEQ ID NO: 869414 - DNA, 25 bp, Mus musculus
tgcctggcaagtgagttcctgttct

SEQ ID NO: 869415 - DNA, 25 bp, Mus musculus
tgcctggcacacagacactgaatct

SEQ ID NO: 869416 - DNA, 25 bp, Mus musculus
tgcctggcacactgacactgaatct

SEQ ID NO: 869417 - DNA, 25 bp, Mus musculus
tgcctggcacagctgacacttgaaa

SEQ ID NO: 869418 - DNA, 25 bp, Mus musculus
tgcctggcacaggtgacacttgaaa

SEQ ID NO: 869419 - DNA, 25 bp, Mus musculus
tgcctggcaccaaggcttttgtggg

SEQ ID NO: 869420 - DNA, 25 bp, Mus musculus
tgcctggcaccaccaacctgagaaa

SEQ ID NO: 869421 - DNA, 25 bp, Mus musculus
tgcctggcaccagcaacctgagaaa

SEQ ID NO: 869422 - DNA, 25 bp, Mus musculus
tgcctggcaccatggcttttgtggg

SEQ ID NO: 869423 - DNA, 25 bp, Mus musculus
tgcctggcactcaggtaaatgatgg

SEQ ID NO: 869424 - DNA, 25 bp, Mus musculus
tgcctggcactctggtaaatgatgg

SEQ ID NO: 869425 - DNA, 25 bp, Mus musculus
tgcctggcagcacggcagatttgta

SEQ ID NO: 869426 - DNA, 25 bp, Mus musculus
tgcctggcagcagggcagatttgta

SEQ ID NO: 869427 - DNA, 25 bp, Mus musculus
tgcctggcatacatagtgtatttca

SEQ ID NO: 869428 - DNA, 25 bp, Mus musculus
tgcctggcatacttagtgtatttca

SEQ ID NO: 869429 - DNA, 25 bp, Mus musculus
tgcctggcatctactggtatctgca

SEQ ID NO: 869430 - DNA, 25 bp, Mus musculus
tgcctggcatcttctggtatctgca

SEQ ID NO: 869431 - DNA, 25 bp, Mus musculus
tgcctggcccagaatatgcagaatg

SEQ ID NO: 869432 - DNA, 25 bp, Mus musculus
tgcctggcccagctcaggcttaaaa

SEQ ID NO: 869433 - DNA, 25 bp, Mus musculus
tgcctggcccaggtcaggcttaaaa

SEQ ID NO: 869434 - DNA, 25 bp, Mus musculus
tgcctggcccagtatatgcagaatg

SEQ ID NO: 869435 - DNA, 25 bp, Mus musculus
tgcctggccctgctcagtatgagat

SEQ ID NO: 869436 - DNA, 25 bp, Mus musculus
tgcctggccctggtcagtatgagat

SEQ ID NO: 869437 - DNA, 25 bp, Mus musculus
tgcctggcccttagaagtggctttg

SEQ ID NO: 869438 - DNA, 25 bp, Mus musculus
tgcctggccctttgaagtggctttg

SEQ ID NO: 869439 - DNA, 25 bp, Mus musculus
tgcctggcctaccaacatgttgcag

SEQ ID NO: 869440 - DNA, 25 bp, Mus musculus
tgcctggcctacgaacatgttgcag

SEQ ID NO: 869441 - DNA, 25 bp, Mus musculus
tgcctggcctccaaaggctataatg

SEQ ID NO: 869442 - DNA, 25 bp, Mus musculus
tgcctggcctcctaaggctataatg

SEQ ID NO: 869443 - DNA, 25 bp, Mus musculus
tgcctggcctctactagcaagtagt

SEQ ID NO: 869444 - DNA, 25 bp, Mus musculus
tgcctggcctcttctagcaagtagt

SEQ ID NO: 869445 - DNA, 25 bp, Mus musculus
tgcctggccttgaggttacattggg

SEQ ID NO: 869446 - DNA, 25 bp, Mus musculus
tgcctggccttgtggttacattggg

SEQ ID NO: 869447 - DNA, 25 bp, Mus musculus
tgcctggcctttccgggcgtgaaaa

SEQ ID NO: 869448 - DNA, 25 bp, Mus musculus
tgcctggcctttgcgggcgtgaaaa

SEQ ID NO: 869449 - DNA, 25 bp, Mus musculus
tgcctggctactctagggtgagcat

SEQ ID NO: 869450 - DNA, 25 bp, Mus musculus
tgcctggctactgtagggtgagcat

SEQ ID NO: 869451 - DNA, 25 bp, Mus musculus
tgcctggctatgctgtacttctgag

SEQ ID NO: 869452 - DNA, 25 bp, Mus musculus
tgcctggctatggtgtacttctgag

SEQ ID NO: 869453 - DNA, 25 bp, Mus musculus
tgcctggctccaccttcaaataatg

SEQ ID NO: 869454 - DNA, 25 bp, Mus musculus
tgcctggctccagcttcaaataatg

SEQ ID NO: 869455 - DNA, 25 bp, Mus musculus
tgcctggctctcaagtatgaccaag

SEQ ID NO: 869456 - DNA, 25 bp, Mus musculus
tgcctggctctctagtatgaccaag

SEQ ID NO: 869457 - DNA, 25 bp, Mus musculus
tgcctggctgagaacccaagggaga

SEQ ID NO: 869458 - DNA, 25 bp, Mus musculus
tgcctggctgagtacccaagggaga

SEQ ID NO: 869459 - DNA, 25 bp, Mus musculus
tgcctggctgctaccgcatgcggag

SEQ ID NO: 869460 - DNA, 25 bp, Mus musculus
tgcctggctgcttccgcatgcggag

SEQ ID NO: 869461 - DNA, 25 bp, Mus musculus
tgcctggctgtcaacctagtaggat

SEQ ID NO: 869462 - DNA, 25 bp, Mus musculus
tgcctggctgtctacctagtaggat

SEQ ID NO: 869463 - DNA, 25 bp, Mus musculus
tgcctggcttccaacttgggtatag

SEQ ID NO: 869464 - DNA, 25 bp, Mus musculus
tgcctggcttccattctattctgga

SEQ ID NO: 869465 - DNA, 25 bp, Mus musculus
tgcctggcttcctacttgggtatag

SEQ ID NO: 869466 - DNA, 25 bp, Mus musculus
tgcctggcttcctttctattctgga

SEQ ID NO: 869467 - DNA, 25 bp, Mus musculus
tgcctggcttcgaacttgcaatcct

SEQ ID NO: 869468 - DNA, 25 bp, Mus musculus
tgcctggcttcgtacttgcaatcct

SEQ ID NO: 869469 - DNA, 25 bp, Mus musculus
tgcctggctttaatgagctttcaag

SEQ ID NO: 869470 - DNA, 25 bp, Mus musculus
tgcctggctttattgagctttcaag

SEQ ID NO: 869471 - DNA, 25 bp, Mus musculus
tgcctgggaaagcgaaccgcgcttc

SEQ ID NO: 869472 - DNA, 25 bp, Mus musculus
tgcctgggaaagggaaccgcgcttc

SEQ ID NO: 869473 - DNA, 25 bp, Mus musculus
tgcctgggaacaattgcagcctgca

SEQ ID NO: 869474 - DNA, 25 bp, Mus musculus
tgcctgggaacatttgcagcctgca

SEQ ID NO: 869475 - DNA, 25 bp, Mus musculus
tgcctgggaagcagatttcatctaa

SEQ ID NO: 869476 - DNA, 25 bp, Mus musculus
tgcctgggaagctgatttcatctaa

SEQ ID NO: 869477 - DNA, 25 bp, Mus musculus
tgcctgggacagaggtgcctagtca

SEQ ID NO: 869478 - DNA, 25 bp, Mus musculus
tgcctgggacagtggtgcctagtca

SEQ ID NO: 869479 - DNA, 25 bp, Mus musculus
tgcctgggagccagaaagcggcatt

SEQ ID NO: 869480 - DNA, 25 bp, Mus musculus
tgcctgggagccagccatctcatag

SEQ ID NO: 869481 - DNA, 25 bp, Mus musculus
tgcctgggagcctgaaagcggcatt

SEQ ID NO: 869482 - DNA, 25 bp, Mus musculus
tgcctgggagcctgccatctcatag

SEQ ID NO: 869483 - DNA, 25 bp, Mus musculus
tgcctgggaggcaacacagacgaga

SEQ ID NO: 869484 - DNA, 25 bp, Mus musculus
tgcctgggaggctacacagacgaga

SEQ ID NO: 869485 - DNA, 25 bp, Mus musculus
tgcctgggatccaaagggttcctat

SEQ ID NO: 869486 - DNA, 25 bp, Mus musculus
tgcctgggatcctaagggttcctat

SEQ ID NO: 869487 - DNA, 25 bp, Mus musculus
tgcctgggatttcacattctcttga

SEQ ID NO: 869488 - DNA, 25 bp, Mus musculus
tgcctgggatttgacattctcttga

SEQ ID NO: 869489 - DNA, 25 bp, Mus musculus
tgcctgggcagcacttgtagatcgc

SEQ ID NO: 869490 - DNA, 25 bp, Mus musculus
tgcctgggcagctcttgtagatcgc

SEQ ID NO: 869491 - DNA, 25 bp, Mus musculus
tgcctgggcaggactcagcaagtgt

SEQ ID NO: 869492 - DNA, 25 bp, Mus musculus
tgcctgggcaggtctcagcaagtgt

SEQ ID NO: 869493 - DNA, 25 bp, Mus musculus
tgcctgggccttaacatgtgagatt

SEQ ID NO: 869494 - DNA, 25 bp, Mus musculus
tgcctgggcctttacatgtgagatt

SEQ ID NO: 869495 - DNA, 25 bp, Mus musculus
tgcctgggcgaccttttgagttcca

SEQ ID NO: 869496 - DNA, 25 bp, Mus musculus
tgcctgggcgacgttttgagttcca

SEQ ID NO: 869497 - DNA, 25 bp, Mus musculus
tgcctgggctaacgagatgctgccc

SEQ ID NO: 869498 - DNA, 25 bp, Mus musculus
tgcctgggctaaggagatgctgccc

SEQ ID NO: 869499 - DNA, 25 bp, Mus musculus
tgcctgggcttcctcaggagaatat

SEQ ID NO: 869500 - DNA, 25 bp, Mus musculus
tgcctgggcttcgtcaggagaatat

SEQ ID NO: 869501 - DNA, 25 bp, Mus musculus
tgcctggggaccagtgggcatccca

SEQ ID NO: 869502 - DNA, 25 bp, Mus musculus
tgcctggggacctgtgggcatccca

SEQ ID NO: 869503 - DNA, 25 bp, Mus musculus
tgcctgggtagacggtagcaccttt

SEQ ID NO: 869504 - DNA, 25 bp, Mus musculus
tgcctgggtagagggtagcaccttt

SEQ ID NO: 869505 - DNA, 25 bp, Mus musculus
tgcctgggttgtcatcatgtgttac

SEQ ID NO: 869506 - DNA, 25 bp, Mus musculus
tgcctgggttgtgatcatgtgttac

SEQ ID NO: 869507 - DNA, 25 bp, Mus musculus
tgcctggtaggactgcatgtaccca

SEQ ID NO: 869508 - DNA, 25 bp, Mus musculus
tgcctggtaggagtgcatgtaccca

SEQ ID NO: 869509 - DNA, 25 bp, Mus musculus
tgcctggtataacctccctgtgtaa

SEQ ID NO: 869510 - DNA, 25 bp, Mus musculus
tgcctggtataagctccctgtgtaa

SEQ ID NO: 869511 - DNA, 25 bp, Mus musculus
tgcctggtatgtaagaagccctagc

SEQ ID NO: 869512 - DNA, 25 bp, Mus musculus
tgcctggtatgttagaagccctagc

SEQ ID NO: 869513 - DNA, 25 bp, Mus musculus
tgcctggtcagacgtgagcactcaa

SEQ ID NO: 869514 - DNA, 25 bp, Mus musculus
tgcctggtcagaggtgagcactcaa

SEQ ID NO: 869515 - DNA, 25 bp, Mus musculus
tgcctggtctctcgcaccaagagta

SEQ ID NO: 869516 - DNA, 25 bp, Mus musculus
tgcctggtctctggcaccaagagta

SEQ ID NO: 869517 - DNA, 25 bp, Mus musculus
tgcctggtctgcacaagatcactgg

SEQ ID NO: 869518 - DNA, 25 bp, Mus musculus
tgcctggtctgctcaagatcactgg

SEQ ID NO: 869519 - DNA, 25 bp, Mus musculus
tgcctggtgagcctttgactgtgat

SEQ ID NO: 869520 - DNA, 25 bp, Mus musculus
tgcctggtgagcgtttgactgtgat

SEQ ID NO: 869521 - DNA, 25 bp, Mus musculus
tgcctggtgatcaattttgtttcct

SEQ ID NO: 869522 - DNA, 25 bp, Mus musculus
tgcctggtgatctattttgtttcct

SEQ ID NO: 869523 - DNA, 25 bp, Mus musculus
tgcctggtgtgtatacaggtcacat

SEQ ID NO: 869524 - DNA, 25 bp, Mus musculus
tgcctggtgtgtttacaggtcacat

SEQ ID NO: 869525 - DNA, 25 bp, Mus musculus
tgcctggttcacactgaggccagaa

SEQ ID NO: 869526 - DNA, 25 bp, Mus musculus
tgcctggttcactctgaggccagaa

SEQ ID NO: 869527 - DNA, 25 bp, Mus musculus
tgcctggttgtaacatgcaccttgc

SEQ ID NO: 869528 - DNA, 25 bp, Mus musculus
tgcctggttgtatcatgcaccttgc

SEQ ID NO: 869529 - DNA, 25 bp, Mus musculus
tgcctggtttgtataaaagcagcca

SEQ ID NO: 869530 - DNA, 25 bp, Mus musculus
tgcctggtttgtttaaaagcagcca

SEQ ID NO: 869531 - DNA, 25 bp, Mus musculus
tgcctgtaactcaacctgcaaggga

SEQ ID NO: 869532 - DNA, 25 bp, Mus musculus
tgcctgtaactctacctgcaaggga

SEQ ID NO: 869533 - DNA, 25 bp, Mus musculus
tgcctgtaacttactggcttccaga

SEQ ID NO: 869534 - DNA, 25 bp, Mus musculus
tgcctgtaactttctggcttccaga

SEQ ID NO: 869535 - DNA, 25 bp, Mus musculus
tgcctgtaagcaccgagtcactgat

SEQ ID NO: 869536 - DNA, 25 bp, Mus musculus
tgcctgtaagcagcgagtcactgat

SEQ ID NO: 869537 - DNA, 25 bp, Mus musculus
tgcctgtaatccacagcgtgctgca

SEQ ID NO: 869538 - DNA, 25 bp, Mus musculus
tgcctgtaatcctcagcgtgctgca

SEQ ID NO: 869539 - DNA, 25 bp, Mus musculus
tgcctgtaattcacacattcagaag

SEQ ID NO: 869540 - DNA, 25 bp, Mus musculus
tgcctgtaattctcacattcagaag

SEQ ID NO: 869541 - DNA, 25 bp, Mus musculus
tgcctgtacatccatggctttgagg

SEQ ID NO: 869542 - DNA, 25 bp, Mus musculus
tgcctgtacatcgatggctttgagg

SEQ ID NO: 869543 - DNA, 25 bp, Mus musculus
tgcctgtaccaaatgccgccttctg

SEQ ID NO: 869544 - DNA, 25 bp, Mus musculus
tgcctgtaccaattgccgccttctg

SEQ ID NO: 869545 - DNA, 25 bp, Mus musculus
tgcctgtacgcacagggccaacata

SEQ ID NO: 869546 - DNA, 25 bp, Mus musculus
tgcctgtacgcagagggccaacata

SEQ ID NO: 869547 - DNA, 25 bp, Mus musculus
tgcctgtagtgccatgtgtcttgag

SEQ ID NO: 869548 - DNA, 25 bp, Mus musculus
tgcctgtagtgcgatgtgtcttgag

SEQ ID NO: 869549 - DNA, 25 bp, Mus musculus
tgcctgtataacctccttctatgga

SEQ ID NO: 869550 - DNA, 25 bp, Mus musculus
tgcctgtataacgtccttctatgga

SEQ ID NO: 869551 - DNA, 25 bp, Mus musculus
tgcctgtatagtactctggaggtgg

SEQ ID NO: 869552 - DNA, 25 bp, Mus musculus
tgcctgtatagttctctggaggtgg

SEQ ID NO: 869553 - DNA, 25 bp, Mus musculus
tgcctgtatgcaagtaggcctcgct

SEQ ID NO: 869554 - DNA, 25 bp, Mus musculus
tgcctgtatgcacgtatgtgcacca

SEQ ID NO: 869555 - DNA, 25 bp, Mus musculus
tgcctgtatgcaggtatgtgcacca

SEQ ID NO: 869556 - DNA, 25 bp, Mus musculus
tgcctgtatgcatgtaggcctcgct

SEQ ID NO: 869557 - DNA, 25 bp, Mus musculus
tgcctgtatgtgattttgtgtatca

SEQ ID NO: 869558 - DNA, 25 bp, Mus musculus
tgcctgtatgtgtttttgtgtatca

SEQ ID NO: 869559 - DNA, 25 bp, Mus musculus
tgcctgtattatagcttttcttctg

SEQ ID NO: 869560 - DNA, 25 bp, Mus musculus
tgcctgtattattgcttttcttctg

SEQ ID NO: 869561 - DNA, 25 bp, Mus musculus
tgcctgtcacacatcatatgagtaa

SEQ ID NO: 869562 - DNA, 25 bp, Mus musculus
tgcctgtcacacttcatatgagtaa

SEQ ID NO: 869563 - DNA, 25 bp, Mus musculus
tgcctgtcacccctggtagagatat

SEQ ID NO: 869564 - DNA, 25 bp, Mus musculus
tgcctgtcacccgtggtagagatat

SEQ ID NO: 869565 - DNA, 25 bp, Mus musculus
tgcctgtcagccctcattgaaatac

SEQ ID NO: 869566 - DNA, 25 bp, Mus musculus
tgcctgtcagccgtcattgaaatac

SEQ ID NO: 869567 - DNA, 25 bp, Mus musculus
tgcctgtccattagattgattgttt

SEQ ID NO: 869568 - DNA, 25 bp, Mus musculus
tgcctgtccatttgattgattgttt

SEQ ID NO: 869569 - DNA, 25 bp, Mus musculus
tgcctgtccctgagttacttgaatc

SEQ ID NO: 869570 - DNA, 25 bp, Mus musculus
tgcctgtccctgtgttacttgaatc

SEQ ID NO: 869571 - DNA, 25 bp, Mus musculus
tgcctgtcctagagcgttgtttttc

SEQ ID NO: 869572 - DNA, 25 bp, Mus musculus
tgcctgtcctagtgcgttgtttttc

SEQ ID NO: 869573 - DNA, 25 bp, Mus musculus
tgcctgtcggctcccagtggtgacc

SEQ ID NO: 869574 - DNA, 25 bp, Mus musculus
tgcctgtcggctgccagtggtgacc

SEQ ID NO: 869575 - DNA, 25 bp, Mus musculus
tgcctgtcggttcacatcagcagtg

SEQ ID NO: 869576 - DNA, 25 bp, Mus musculus
tgcctgtcggttgacatcagcagtg

SEQ ID NO: 869577 - DNA, 25 bp, Mus musculus
tgcctgtctatcagtccacttgtct

SEQ ID NO: 869578 - DNA, 25 bp, Mus musculus
tgcctgtctatctgtccacttgtct

SEQ ID NO: 869579 - DNA, 25 bp, Mus musculus
tgcctgtctcagctcatttgtaaaa

SEQ ID NO: 869580 - DNA, 25 bp, Mus musculus
tgcctgtctcaggtcatttgtaaaa

SEQ ID NO: 869581 - DNA, 25 bp, Mus musculus
tgcctgtctctgacatgtgcacaca

SEQ ID NO: 869582 - DNA, 25 bp, Mus musculus
tgcctgtctctgtcatgtgcacaca

SEQ ID NO: 869583 - DNA, 25 bp, Mus musculus
tgcctgtctcttcggccagcagata

SEQ ID NO: 869584 - DNA, 25 bp, Mus musculus
tgcctgtctcttgggccagcagata

SEQ ID NO: 869585 - DNA, 25 bp, Mus musculus
tgcctgtcttacctcagactttctt

SEQ ID NO: 869586 - DNA, 25 bp, Mus musculus
tgcctgtcttacgtcagactttctt

SEQ ID NO: 869587 - DNA, 25 bp, Mus musculus
tgcctgtgaaggactgtctgtctgt

SEQ ID NO: 869588 - DNA, 25 bp, Mus musculus
tgcctgtgaaggtctgtctgtctgt

SEQ ID NO: 869589 - DNA, 25 bp, Mus musculus
tgcctgtgaattacagtccagcctg

SEQ ID NO: 869590 - DNA, 25 bp, Mus musculus
tgcctgtgaatttcagtccagcctg

SEQ ID NO: 869591 - DNA, 25 bp, Mus musculus
tgcctgtgaccaagatttcacgaag

SEQ ID NO: 869592 - DNA, 25 bp, Mus musculus
tgcctgtgaccatgatttcacgaag

SEQ ID NO: 869593 - DNA, 25 bp, Mus musculus
tgcctgtgacctaggatttatgaca

SEQ ID NO: 869594 - DNA, 25 bp, Mus musculus
tgcctgtgaccttggatttatgaca

SEQ ID NO: 869595 - DNA, 25 bp, Mus musculus
tgcctgtgagaaatatccatgtcct

SEQ ID NO: 869596 - DNA, 25 bp, Mus musculus
tgcctgtgagaattatccatgtcct

SEQ ID NO: 869597 - DNA, 25 bp, Mus musculus
tgcctgtgagccagcttgagtcaaa

SEQ ID NO: 869598 - DNA, 25 bp, Mus musculus
tgcctgtgagcctgcttgagtcaaa

SEQ ID NO: 869599 - DNA, 25 bp, Mus musculus
tgcctgtgaggccatggctctgtca

SEQ ID NO: 869600 - DNA, 25 bp, Mus musculus
tgcctgtgaggcgatggctctgtca

SEQ ID NO: 869601 - DNA, 25 bp, Mus musculus
tgcctgtgatcgagtgttgccattt

SEQ ID NO: 869602 - DNA, 25 bp, Mus musculus
tgcctgtgatcgtgtgttgccattt

SEQ ID NO: 869603 - DNA, 25 bp, Mus musculus
tgcctgtgatctccttcgggaatac

SEQ ID NO: 869604 - DNA, 25 bp, Mus musculus
tgcctgtgatctgcttcgggaatac

SEQ ID NO: 869605 - DNA, 25 bp, Mus musculus
tgcctgtgcacacaacatttggtca

SEQ ID NO: 869606 - DNA, 25 bp, Mus musculus
tgcctgtgcacagaacatttggtca

SEQ ID NO: 869607 - DNA, 25 bp, Mus musculus
tgcctgtgcagcctttgagcattca

SEQ ID NO: 869608 - DNA, 25 bp, Mus musculus
tgcctgtgcagcgtttgagcattca

SEQ ID NO: 869609 - DNA, 25 bp, Mus musculus
tgcctgtgcctaaagtcagtatgtg

SEQ ID NO: 869610 - DNA, 25 bp, Mus musculus
tgcctgtgcctatagtcagtatgtg

SEQ ID NO: 869611 - DNA, 25 bp, Mus musculus
tgcctgtgcctgatttctggaccag

SEQ ID NO: 869612 - DNA, 25 bp, Mus musculus
tgcctgtgcctgttttctggaccag

SEQ ID NO: 869613 - DNA, 25 bp, Mus musculus
tgcctgtggactcctggaggtcaac

SEQ ID NO: 869614 - DNA, 25 bp, Mus musculus
tgcctgtggactgctggaggtcaac

SEQ ID NO: 869615 - DNA, 25 bp, Mus musculus
tgcctgtggcacactttttaaaaaa

SEQ ID NO: 869616 - DNA, 25 bp, Mus musculus
tgcctgtggcactctttttaaaaaa

SEQ ID NO: 869617 - DNA, 25 bp, Mus musculus
tgcctgtggctgacccaagacaact

SEQ ID NO: 869618 - DNA, 25 bp, Mus musculus
tgcctgtggctgtcccaagacaact

SEQ ID NO: 869619 - DNA, 25 bp, Mus musculus
tgcctgtgggcactaagcatcactt

SEQ ID NO: 869620 - DNA, 25 bp, Mus musculus
tgcctgtgggcagtaagcatcactt

SEQ ID NO: 869621 - DNA, 25 bp, Mus musculus
tgcctgtgggccatgaactcattct

SEQ ID NO: 869622 - DNA, 25 bp, Mus musculus
tgcctgtgggccttgaactcattct

SEQ ID NO: 869623 - DNA, 25 bp, Mus musculus
tgcctgtgggttcagtttgatccat

SEQ ID NO: 869624 - DNA, 25 bp, Mus musculus
tgcctgtgggttgagtttgatccat

SEQ ID NO: 869625 - DNA, 25 bp, Mus musculus
tgcctgtggtcccaacagaggtaga

SEQ ID NO: 869626 - DNA, 25 bp, Mus musculus
tgcctgtggtccgaacagaggtaga

SEQ ID NO: 869627 - DNA, 25 bp, Mus musculus
tgcctgtgtctgaacacaccaacta

SEQ ID NO: 869628 - DNA, 25 bp, Mus musculus
tgcctgtgtctgtacacaccaacta

SEQ ID NO: 869629 - DNA, 25 bp, Mus musculus
tgcctgtgtggaaacgtctcatgaa

SEQ ID NO: 869630 - DNA, 25 bp, Mus musculus
tgcctgtgtggatacgtctcatgaa

SEQ ID NO: 869631 - DNA, 25 bp, Mus musculus
tgcctgtgtgtgacacgcccatggt

SEQ ID NO: 869632 - DNA, 25 bp, Mus musculus
tgcctgtgtgtgtcacgcccatggt

SEQ ID NO: 869633 - DNA, 25 bp, Mus musculus
tgcctgtgttcactcgcccaggtga

SEQ ID NO: 869634 - DNA, 25 bp, Mus musculus
tgcctgtgttcagtcgcccaggtga

SEQ ID NO: 869635 - DNA, 25 bp, Mus musculus
tgcctgtgttctatggttgtggaga

SEQ ID NO: 869636 - DNA, 25 bp, Mus musculus
tgcctgtgttctttggttgtggaga

SEQ ID NO: 869637 - DNA, 25 bp, Mus musculus
tgcctgtgttgcagcactactgtat

SEQ ID NO: 869638 - DNA, 25 bp, Mus musculus
tgcctgtgttgctgcactactgtat

SEQ ID NO: 869639 - DNA, 25 bp, Mus musculus
tgcctgttaactacactgtacataa

SEQ ID NO: 869640 - DNA, 25 bp, Mus musculus
tgcctgttaacttcactgtacataa

SEQ ID NO: 869641 - DNA, 25 bp, Mus musculus
tgcctgttaccaagctcctcatcat

SEQ ID NO: 869642 - DNA, 25 bp, Mus musculus
tgcctgttaccatgctcctcatcat

SEQ ID NO: 869643 - DNA, 25 bp, Mus musculus
tgcctgttacgaaccacttcaactg

SEQ ID NO: 869644 - DNA, 25 bp, Mus musculus
tgcctgttacgatccacttcaactg

SEQ ID NO: 869645 - DNA, 25 bp, Mus musculus
tgcctgttccaaaatggctccagat

SEQ ID NO: 869646 - DNA, 25 bp, Mus musculus
tgcctgttccaatatggctccagat

SEQ ID NO: 869647 - DNA, 25 bp, Mus musculus
tgcctgttcttgctcttgtccaaaa

SEQ ID NO: 869648 - DNA, 25 bp, Mus musculus
tgcctgttcttggtcttgtccaaaa

SEQ ID NO: 869649 - DNA, 25 bp, Mus musculus
tgcctgttgaatagccgtcactccg

SEQ ID NO: 869650 - DNA, 25 bp, Mus musculus
tgcctgttgaattgccgtcactccg

SEQ ID NO: 869651 - DNA, 25 bp, Mus musculus
tgcctgttgacacaactcttttgaa

SEQ ID NO: 869652 - DNA, 25 bp, Mus musculus
tgcctgttgacagaactcttttgaa

SEQ ID NO: 869653 - DNA, 25 bp, Mus musculus
tgcctgttgactaccacttgtaccg

SEQ ID NO: 869654 - DNA, 25 bp, Mus musculus
tgcctgttgacttccacttgtaccg

SEQ ID NO: 869655 - DNA, 25 bp, Mus musculus
tgcctgttgcagagaagctatttct

SEQ ID NO: 869656 - DNA, 25 bp, Mus musculus
tgcctgttgcagtgaagctatttct

SEQ ID NO: 869657 - DNA, 25 bp, Mus musculus
tgcctgttgcccaggtgtagttatc

SEQ ID NO: 869658 - DNA, 25 bp, Mus musculus
tgcctgttgccctggtgtagttatc

SEQ ID NO: 869659 - DNA, 25 bp, Mus musculus
tgcctgttgctcctaacaatctact

SEQ ID NO: 869660 - DNA, 25 bp, Mus musculus
tgcctgttgctccttacatcagaga

SEQ ID NO: 869661 - DNA, 25 bp, Mus musculus
tgcctgttgctcgtaacaatctact

SEQ ID NO: 869662 - DNA, 25 bp, Mus musculus
tgcctgttgctcgttacatcagaga

SEQ ID NO: 869663 - DNA, 25 bp, Mus musculus
tgcctgttgttacccagactcctgg

SEQ ID NO: 869664 - DNA, 25 bp, Mus musculus
tgcctgttgttagccagactcctgg

SEQ ID NO: 869665 - DNA, 25 bp, Mus musculus
tgcctgtttgaactttcccatgcgt

SEQ ID NO: 869666 - DNA, 25 bp, Mus musculus
tgcctgtttgaagtttcccatgcgt

SEQ ID NO: 869667 - DNA, 25 bp, Mus musculus
tgcctgtttgacactctgagccaca

SEQ ID NO: 869668 - DNA, 25 bp, Mus musculus
tgcctgtttgactctctgagccaca

SEQ ID NO: 869669 - DNA, 25 bp, Mus musculus
tgcctgtttgcaaatcatgatcttc

SEQ ID NO: 869670 - DNA, 25 bp, Mus musculus
tgcctgtttgcatatcatgatcttc

SEQ ID NO: 869671 - DNA, 25 bp, Mus musculus
tgcctgtttggaaccttgtacattt

SEQ ID NO: 869672 - DNA, 25 bp, Mus musculus
tgcctgtttggatccttgtacattt

SEQ ID NO: 869673 - DNA, 25 bp, Mus musculus
tgcctgtttgtgctgacacccgtca

SEQ ID NO: 869674 - DNA, 25 bp, Mus musculus
tgcctgtttgtggtgacacccgtca

SEQ ID NO: 869675 - DNA, 25 bp, Mus musculus
tgcctgttttatattcaggaagcag

SEQ ID NO: 869676 - DNA, 25 bp, Mus musculus
tgcctgttttattttcaggaagcag

SEQ ID NO: 869677 - DNA, 25 bp, Mus musculus
tgcctgttttctcttctggaggcca

SEQ ID NO: 869678 - DNA, 25 bp, Mus musculus
tgcctgttttctgttctggaggcca

SEQ ID NO: 869679 - DNA, 25 bp, Mus musculus
tgcctgttttgaacatctctcttca

SEQ ID NO: 869680 - DNA, 25 bp, Mus musculus
tgcctgttttgatcatctctcttca

SEQ ID NO: 869681 - DNA, 25 bp, Mus musculus
tgccttaaacctcaattgcaagttg

SEQ ID NO: 869682 - DNA, 25 bp, Mus musculus
tgccttaaacctcagccaccatggt

SEQ ID NO: 869683 - DNA, 25 bp, Mus musculus
tgccttaaacctgaattgcaagttg

SEQ ID NO: 869684 - DNA, 25 bp, Mus musculus
tgccttaaacctgagccaccatggt

SEQ ID NO: 869685 - DNA, 25 bp, Mus musculus
tgccttaaagtcctgtatttcccag

SEQ ID NO: 869686 - DNA, 25 bp, Mus musculus
tgccttaaagtcgtgtatttcccag

SEQ ID NO: 869687 - DNA, 25 bp, Mus musculus
tgccttaacccacgtttcgtgtaag

SEQ ID NO: 869688 - DNA, 25 bp, Mus musculus
tgccttaacccaggtttcgtgtaag

SEQ ID NO: 869689 - DNA, 25 bp, Mus musculus
tgccttaactccaaagccatttcag

SEQ ID NO: 869690 - DNA, 25 bp, Mus musculus
tgccttaactcctaagccatttcag

SEQ ID NO: 869691 - DNA, 25 bp, Mus musculus
tgccttaactctcacacctcgaaga

SEQ ID NO: 869692 - DNA, 25 bp, Mus musculus
tgccttaactctgacacctcgaaga

SEQ ID NO: 869693 - DNA, 25 bp, Mus musculus
tgccttaatttaactttccggattg

SEQ ID NO: 869694 - DNA, 25 bp, Mus musculus
tgccttaatttatctttccggattg

SEQ ID NO: 869695 - DNA, 25 bp, Mus musculus
tgccttaatttgctgtgggactgtc

SEQ ID NO: 869696 - DNA, 25 bp, Mus musculus
tgccttaatttggtgtgggactgtc

SEQ ID NO: 869697 - DNA, 25 bp, Mus musculus
tgccttacactgctatagccttagg

SEQ ID NO: 869698 - DNA, 25 bp, Mus musculus
tgccttacactggtatagccttagg

SEQ ID NO: 869699 - DNA, 25 bp, Mus musculus
tgccttacagatacgtcctgggtaa

SEQ ID NO: 869700 - DNA, 25 bp, Mus musculus
tgccttacagattcgtcctgggtaa

SEQ ID NO: 869701 - DNA, 25 bp, Mus musculus
tgccttacatgcagaccctgcagaa

SEQ ID NO: 869702 - DNA, 25 bp, Mus musculus
tgccttacatgctgaccctgcagaa

SEQ ID NO: 869703 - DNA, 25 bp, Mus musculus
tgccttacctacatgtcagctagga

SEQ ID NO: 869704 - DNA, 25 bp, Mus musculus
tgccttacctacttgtcagctagga

SEQ ID NO: 869705 - DNA, 25 bp, Mus musculus
tgccttacctggcttccaaatcgga

SEQ ID NO: 869706 - DNA, 25 bp, Mus musculus
tgccttacctgggttccaaatcgga

SEQ ID NO: 869707 - DNA, 25 bp, Mus musculus
tgccttacgattcagccaaatggtt

SEQ ID NO: 869708 - DNA, 25 bp, Mus musculus
tgccttacgattgagccaaatggtt

SEQ ID NO: 869709 - DNA, 25 bp, Mus musculus
tgccttacgcctcagtctgtggttg

SEQ ID NO: 869710 - DNA, 25 bp, Mus musculus
tgccttacgcctgagtctgtggttg

SEQ ID NO: 869711 - DNA, 25 bp, Mus musculus
tgccttacgtatcagtttagttcct

SEQ ID NO: 869712 - DNA, 25 bp, Mus musculus
tgccttacgtatgagtttagttcct

SEQ ID NO: 869713 - DNA, 25 bp, Mus musculus
tgccttactaatccacaagctgcag

SEQ ID NO: 869714 - DNA, 25 bp, Mus musculus
tgccttactaatgcacaagctgcag

SEQ ID NO: 869715 - DNA, 25 bp, Mus musculus
tgccttactgcaagttgacacataa

SEQ ID NO: 869716 - DNA, 25 bp, Mus musculus
tgccttactgcatgttgacacataa

SEQ ID NO: 869717 - DNA, 25 bp, Mus musculus
tgccttagcagaatcagtcagtcag

SEQ ID NO: 869718 - DNA, 25 bp, Mus musculus
tgccttagcagattcagtcagtcag

SEQ ID NO: 869719 - DNA, 25 bp, Mus musculus
tgccttagccacactcatctaagaa

SEQ ID NO: 869720 - DNA, 25 bp, Mus musculus
tgccttagccactctcatctaagaa

SEQ ID NO: 869721 - DNA, 25 bp, Mus musculus
tgccttagcccacacttggtgattc

SEQ ID NO: 869722 - DNA, 25 bp, Mus musculus
tgccttagcccagacttggtgattc

SEQ ID NO: 869723 - DNA, 25 bp, Mus musculus
tgccttagccttacgagatgtgagg

SEQ ID NO: 869724 - DNA, 25 bp, Mus musculus
tgccttagcctttcgagatgtgagg

SEQ ID NO: 869725 - DNA, 25 bp, Mus musculus
tgccttagtattctgttcctcatga

SEQ ID NO: 869726 - DNA, 25 bp, Mus musculus
tgccttagtattgtgttcctcatga

SEQ ID NO: 869727 - DNA, 25 bp, Mus musculus
tgccttagtgagatccctggtggtg

SEQ ID NO: 869728 - DNA, 25 bp, Mus musculus
tgccttagtgagttccctggtggtg

SEQ ID NO: 869729 - DNA, 25 bp, Mus musculus
tgccttataattcactgtccatgga

SEQ ID NO: 869730 - DNA, 25 bp, Mus musculus
tgccttataattgactgtccatgga

SEQ ID NO: 869731 - DNA, 25 bp, Mus musculus
tgccttatcagcctgccatggccag

SEQ ID NO: 869732 - DNA, 25 bp, Mus musculus
tgccttatcagcgtgccatggccag

SEQ ID NO: 869733 - DNA, 25 bp, Mus musculus
tgccttatcccactcaggacagata

SEQ ID NO: 869734 - DNA, 25 bp, Mus musculus
tgccttatcccagtcaggacagata

SEQ ID NO: 869735 - DNA, 25 bp, Mus musculus
tgccttatcttacacctgtctatat

SEQ ID NO: 869736 - DNA, 25 bp, Mus musculus
tgccttatcttagacctgtctatat

SEQ ID NO: 869737 - DNA, 25 bp, Mus musculus
tgccttattcctagaactgcatcct

SEQ ID NO: 869738 - DNA, 25 bp, Mus musculus
tgccttattccttgaactgcatcct

SEQ ID NO: 869739 - DNA, 25 bp, Mus musculus
tgccttcaaataccccttcctgtaa

SEQ ID NO: 869740 - DNA, 25 bp, Mus musculus
tgccttcaaatagcccttcctgtaa

SEQ ID NO: 869741 - DNA, 25 bp, Mus musculus
tgccttcaacatcaaagcaactgtg

SEQ ID NO: 869742 - DNA, 25 bp, Mus musculus
tgccttcaacatgaaagcaactgtg

SEQ ID NO: 869743 - DNA, 25 bp, Mus musculus
tgccttcaactactggagcatctcc

SEQ ID NO: 869744 - DNA, 25 bp, Mus musculus
tgccttcaactagtggagcatctcc

SEQ ID NO: 869745 - DNA, 25 bp, Mus musculus
tgccttcaagcacagtgcagctcac

SEQ ID NO: 869746 - DNA, 25 bp, Mus musculus
tgccttcaagcagagtgcagctcac

SEQ ID NO: 869747 - DNA, 25 bp, Mus musculus
tgccttcacttacgagcagctggtg

SEQ ID NO: 869748 - DNA, 25 bp, Mus musculus
tgccttcacttaggagcagctggtg

SEQ ID NO: 869749 - DNA, 25 bp, Mus musculus
tgccttcactttccagcagtgtctg

SEQ ID NO: 869750 - DNA, 25 bp, Mus musculus
tgccttcactttcttctacttcata

SEQ ID NO: 869751 - DNA, 25 bp, Mus musculus
tgccttcactttgcagcagtgtctg

SEQ ID NO: 869752 - DNA, 25 bp, Mus musculus
tgccttcactttgttctacttcata

SEQ ID NO: 869753 - DNA, 25 bp, Mus musculus
tgccttcagaaactgggccttgttc

SEQ ID NO: 869754 - DNA, 25 bp, Mus musculus
tgccttcagaaagtgggccttgttc

SEQ ID NO: 869755 - DNA, 25 bp, Mus musculus
tgccttcagagtcctacggttaaag

SEQ ID NO: 869756 - DNA, 25 bp, Mus musculus
tgccttcagagtgctacggttaaag

SEQ ID NO: 869757 - DNA, 25 bp, Mus musculus
tgccttcagatcaggatgtgactca

SEQ ID NO: 869758 - DNA, 25 bp, Mus musculus
tgccttcagatctggatgtgactca

SEQ ID NO: 869759 - DNA, 25 bp, Mus musculus
tgccttcagatgatattcttgtttt

SEQ ID NO: 869760 - DNA, 25 bp, Mus musculus
tgccttcagatgttattcttgtttt

SEQ ID NO: 869761 - DNA, 25 bp, Mus musculus
tgccttcagccacctatcctgggaa

SEQ ID NO: 869762 - DNA, 25 bp, Mus musculus
tgccttcagccagctatcctgggaa

SEQ ID NO: 869763 - DNA, 25 bp, Mus musculus
tgccttcagctcacacatgttttaa

SEQ ID NO: 869764 - DNA, 25 bp, Mus musculus
tgccttcagctctcacatgttttaa

SEQ ID NO: 869765 - DNA, 25 bp, Mus musculus
tgccttcaggagcaggatccagcaa

SEQ ID NO: 869766 - DNA, 25 bp, Mus musculus
tgccttcaggaggaggatccagcaa

SEQ ID NO: 869767 - DNA, 25 bp, Mus musculus
tgccttcagtcactagcgttaatgc

SEQ ID NO: 869768 - DNA, 25 bp, Mus musculus
tgccttcagtcagtagcgttaatgc

SEQ ID NO: 869769 - DNA, 25 bp, Mus musculus
tgccttcagttacttgtgctgtgtt

SEQ ID NO: 869770 - DNA, 25 bp, Mus musculus
tgccttcagttagttgtgctgtgtt

SEQ ID NO: 869771 - DNA, 25 bp, Mus musculus
tgccttcataacaggagtgaccagt

SEQ ID NO: 869772 - DNA, 25 bp, Mus musculus
tgccttcataactggagtgaccagt

SEQ ID NO: 869773 - DNA, 25 bp, Mus musculus
tgccttcatattctttttacaatca

SEQ ID NO: 869774 - DNA, 25 bp, Mus musculus
tgccttcatattgtttttacaatca

SEQ ID NO: 869775 - DNA, 25 bp, Mus musculus
tgccttcatcctatcagtcatgatg

SEQ ID NO: 869776 - DNA, 25 bp, Mus musculus
tgccttcatcctttcagtcatgatg

SEQ ID NO: 869777 - DNA, 25 bp, Mus musculus
tgccttcatctaacacgatcgatgt

SEQ ID NO: 869778 - DNA, 25 bp, Mus musculus
tgccttcatctatcacgatcgatgt

SEQ ID NO: 869779 - DNA, 25 bp, Mus musculus
tgccttcatcttccggacgagaaaa

SEQ ID NO: 869780 - DNA, 25 bp, Mus musculus
tgccttcatcttgcggacgagaaaa

SEQ ID NO: 869781 - DNA, 25 bp, Mus musculus
tgccttcatgctcaaccttacaaca

SEQ ID NO: 869782 - DNA, 25 bp, Mus musculus
tgccttcatgctgaaccttacaaca

SEQ ID NO: 869783 - DNA, 25 bp, Mus musculus
tgccttcattagaagatgctgtcct

SEQ ID NO: 869784 - DNA, 25 bp, Mus musculus
tgccttcattagtagatgctgtcct

SEQ ID NO: 869785 - DNA, 25 bp, Mus musculus
tgccttcattggagcagtctatggt

SEQ ID NO: 869786 - DNA, 25 bp, Mus musculus
tgccttcattggtgcagtctatggt

SEQ ID NO: 869787 - DNA, 25 bp, Mus musculus
tgccttcatttcaactcttctcgaa

SEQ ID NO: 869788 - DNA, 25 bp, Mus musculus
tgccttcatttctactcttctcgaa

SEQ ID NO: 869789 - DNA, 25 bp, Mus musculus
tgccttccaacaccaatgtatctgt

SEQ ID NO: 869790 - DNA, 25 bp, Mus musculus
tgccttccaacagcaatgtatctgt

SEQ ID NO: 869791 - DNA, 25 bp, Mus musculus
tgccttccaagtctgagcgagctaa

SEQ ID NO: 869792 - DNA, 25 bp, Mus musculus
tgccttccaagtgtgagcgagctaa

SEQ ID NO: 869793 - DNA, 25 bp, Mus musculus
tgccttccacaaccatgtgcgtgca

SEQ ID NO: 869794 - DNA, 25 bp, Mus musculus
tgccttccacaagcatgtgcgtgca

SEQ ID NO: 869795 - DNA, 25 bp, Mus musculus
tgccttccacagcacaatgcaatgt

SEQ ID NO: 869796 - DNA, 25 bp, Mus musculus
tgccttccacaggacaatgcaatgt

SEQ ID NO: 869797 - DNA, 25 bp, Mus musculus
tgccttccagagactgcttaagcta

SEQ ID NO: 869798 - DNA, 25 bp, Mus musculus
tgccttccagagtctgcttaagcta

SEQ ID NO: 869799 - DNA, 25 bp, Mus musculus
tgccttccagcaagatcatactgca

SEQ ID NO: 869800 - DNA, 25 bp, Mus musculus
tgccttccagcacagcattggctct

SEQ ID NO: 869801 - DNA, 25 bp, Mus musculus
tgccttccagcagagcattggctct

SEQ ID NO: 869802 - DNA, 25 bp, Mus musculus
tgccttccagcatgatcatactgca

SEQ ID NO: 869803 - DNA, 25 bp, Mus musculus
tgccttccataccttgaccaaagca

SEQ ID NO: 869804 - DNA, 25 bp, Mus musculus
tgccttccatacgttgaccaaagca

SEQ ID NO: 869805 - DNA, 25 bp, Mus musculus
tgccttccatgtagtttacctaatc

SEQ ID NO: 869806 - DNA, 25 bp, Mus musculus
tgccttccatgttgtttacctaatc

SEQ ID NO: 869807 - DNA, 25 bp, Mus musculus
tgccttccccatcggtgctgagggt

SEQ ID NO: 869808 - DNA, 25 bp, Mus musculus
tgccttccccatgggtgctgagggt

SEQ ID NO: 869809 - DNA, 25 bp, Mus musculus
tgccttcccggactgcgctcagtga

SEQ ID NO: 869810 - DNA, 25 bp, Mus musculus
tgccttcccggagtgcgctcagtga

SEQ ID NO: 869811 - DNA, 25 bp, Mus musculus
tgccttccctagcttggtccaagaa

SEQ ID NO: 869812 - DNA, 25 bp, Mus musculus
tgccttccctaggttggtccaagaa

SEQ ID NO: 869813 - DNA, 25 bp, Mus musculus
tgccttccctatccacgtgtttttt

SEQ ID NO: 869814 - DNA, 25 bp, Mus musculus
tgccttccctatgcacgtgtttttt

SEQ ID NO: 869815 - DNA, 25 bp, Mus musculus
tgccttccgtgtcctgggctaaaag

SEQ ID NO: 869816 - DNA, 25 bp, Mus musculus
tgccttccgtgtgctgggctaaaag

SEQ ID NO: 869817 - DNA, 25 bp, Mus musculus
tgccttcctcacatgtgggtatctg

SEQ ID NO: 869818 - DNA, 25 bp, Mus musculus
tgccttcctcacttgtgggtatctg

SEQ ID NO: 869819 - DNA, 25 bp, Mus musculus
tgccttcctcgtcaacaagagtgat

SEQ ID NO: 869820 - DNA, 25 bp, Mus musculus
tgccttcctcgtgaacaagagtgat

SEQ ID NO: 869821 - DNA, 25 bp, Mus musculus
tgccttcctgcacatgtgctgaaag

SEQ ID NO: 869822 - DNA, 25 bp, Mus musculus
tgccttcctgcagatgtgctgaaag

SEQ ID NO: 869823 - DNA, 25 bp, Mus musculus
tgccttcctgctccaagtttgaaaa

SEQ ID NO: 869824 - DNA, 25 bp, Mus musculus
tgccttcctgctcggagaatagtta

SEQ ID NO: 869825 - DNA, 25 bp, Mus musculus
tgccttcctgctgcaagtttgaaaa

SEQ ID NO: 869826 - DNA, 25 bp, Mus musculus
tgccttcctgctgggagaatagtta

SEQ ID NO: 869827 - DNA, 25 bp, Mus musculus
tgccttcctggcattgattttcatc

SEQ ID NO: 869828 - DNA, 25 bp, Mus musculus
tgccttcctggctttgattttcatc

SEQ ID NO: 869829 - DNA, 25 bp, Mus musculus
tgccttcctgggactagatggcacc

SEQ ID NO: 869830 - DNA, 25 bp, Mus musculus
tgccttcctgggtctagatggcacc

SEQ ID NO: 869831 - DNA, 25 bp, Mus musculus
tgccttcctggtaagtgactgctct

SEQ ID NO: 869832 - DNA, 25 bp, Mus musculus
tgccttcctggtcacgttgctcatc

SEQ ID NO: 869833 - DNA, 25 bp, Mus musculus
tgccttcctggtgacgttgctcatc

SEQ ID NO: 869834 - DNA, 25 bp, Mus musculus
tgccttcctggttagtgactgctct

SEQ ID NO: 869835 - DNA, 25 bp, Mus musculus
tgccttccttggacttggagagcca

SEQ ID NO: 869836 - DNA, 25 bp, Mus musculus
tgccttccttggtcttggagagcca

SEQ ID NO: 869837 - DNA, 25 bp, Mus musculus
tgccttcctttaaagatgatgcgag

SEQ ID NO: 869838 - DNA, 25 bp, Mus musculus
tgccttcctttatagatgatgcgag

SEQ ID NO: 869839 - DNA, 25 bp, Mus musculus
tgccttccttttcagggatgcgcgg

SEQ ID NO: 869840 - DNA, 25 bp, Mus musculus
tgccttccttttgagggatgcgcgg

SEQ ID NO: 869841 - DNA, 25 bp, Mus musculus
tgccttcgagttcccggagggttct

SEQ ID NO: 869842 - DNA, 25 bp, Mus musculus
tgccttcgagttgccggagggttct

SEQ ID NO: 869843 - DNA, 25 bp, Mus musculus
tgccttcgatgaagtttgcttcctc

SEQ ID NO: 869844 - DNA, 25 bp, Mus musculus
tgccttcgatgatgtttgcttcctc

SEQ ID NO: 869845 - DNA, 25 bp, Mus musculus
tgccttcgctctagggctcacgagt

SEQ ID NO: 869846 - DNA, 25 bp, Mus musculus
tgccttcgctcttgggctcacgagt

SEQ ID NO: 869847 - DNA, 25 bp, Mus musculus
tgccttcgtagcactggtattcact

SEQ ID NO: 869848 - DNA, 25 bp, Mus musculus
tgccttcgtagctctggtattcact

SEQ ID NO: 869849 - DNA, 25 bp, Mus musculus
tgccttcgtcacctttgcagatgat

SEQ ID NO: 869850 - DNA, 25 bp, Mus musculus
tgccttcgtcacgtttgcagatgat

SEQ ID NO: 869851 - DNA, 25 bp, Mus musculus
tgccttcgtgggatcctgggtaaaa

SEQ ID NO: 869852 - DNA, 25 bp, Mus musculus
tgccttcgtgggttcctgggtaaaa

SEQ ID NO: 869853 - DNA, 25 bp, Mus musculus
tgccttctaggcctctttcagagat

SEQ ID NO: 869854 - DNA, 25 bp, Mus musculus
tgccttctaggcgtctttcagagat

SEQ ID NO: 869855 - DNA, 25 bp, Mus musculus
tgccttctaggtaacagcgactcac

SEQ ID NO: 869856 - DNA, 25 bp, Mus musculus
tgccttctaggttacagcgactcac

SEQ ID NO: 869857 - DNA, 25 bp, Mus musculus
tgccttctatggcacttctataatg

SEQ ID NO: 869858 - DNA, 25 bp, Mus musculus
tgccttctatgggacttctataatg

SEQ ID NO: 869859 - DNA, 25 bp, Mus musculus
tgccttctcactctgttactcataa

SEQ ID NO: 869860 - DNA, 25 bp, Mus musculus
tgccttctcactgtgttactcataa

SEQ ID NO: 869861 - DNA, 25 bp, Mus musculus
tgccttctcaggatttaagctgctt

SEQ ID NO: 869862 - DNA, 25 bp, Mus musculus
tgccttctcaggttttaagctgctt

SEQ ID NO: 869863 - DNA, 25 bp, Mus musculus
tgccttctccaaagtatcaacttga

SEQ ID NO: 869864 - DNA, 25 bp, Mus musculus
tgccttctccaatgtatcaacttga

SEQ ID NO: 869865 - DNA, 25 bp, Mus musculus
tgccttctcgcacatttaagatctg

SEQ ID NO: 869866 - DNA, 25 bp, Mus musculus
tgccttctcgcagatttaagatctg

SEQ ID NO: 869867 - DNA, 25 bp, Mus musculus
tgccttctctaaatcgcgctatatt

SEQ ID NO: 869868 - DNA, 25 bp, Mus musculus
tgccttctctaattcgcgctatatt

SEQ ID NO: 869869 - DNA, 25 bp, Mus musculus
tgccttctctcacggtctggatgac

SEQ ID NO: 869870 - DNA, 25 bp, Mus musculus
tgccttctctcagggtctggatgac

SEQ ID NO: 869871 - DNA, 25 bp, Mus musculus
tgccttctctctctgggaccttgat

SEQ ID NO: 869872 - DNA, 25 bp, Mus musculus
tgccttctctctgtgggaccttgat

SEQ ID NO: 869873 - DNA, 25 bp, Mus musculus
tgccttctctggatctgggaataga

SEQ ID NO: 869874 - DNA, 25 bp, Mus musculus
tgccttctctggttctgggaataga

SEQ ID NO: 869875 - DNA, 25 bp, Mus musculus
tgccttctgaaacggcgggtcccca

SEQ ID NO: 869876 - DNA, 25 bp, Mus musculus
tgccttctgaaagggcgggtcccca

SEQ ID NO: 869877 - DNA, 25 bp, Mus musculus
tgccttctgagtccacggagtaaag

SEQ ID NO: 869878 - DNA, 25 bp, Mus musculus
tgccttctgagtgcacggagtaaag

SEQ ID NO: 869879 - DNA, 25 bp, Mus musculus
tgccttctgcccaaggaattcctac

SEQ ID NO: 869880 - DNA, 25 bp, Mus musculus
tgccttctgccctaggaattcctac

SEQ ID NO: 869881 - DNA, 25 bp, Mus musculus
tgccttctggaactctatgctgagt

SEQ ID NO: 869882 - DNA, 25 bp, Mus musculus
tgccttctggaagtctatgctgagt

SEQ ID NO: 869883 - DNA, 25 bp, Mus musculus
tgccttctgggaagcatcacatgtg

SEQ ID NO: 869884 - DNA, 25 bp, Mus musculus
tgccttctgggatgcatcacatgtg

SEQ ID NO: 869885 - DNA, 25 bp, Mus musculus
tgccttctggttacgagggcgatta

SEQ ID NO: 869886 - DNA, 25 bp, Mus musculus
tgccttctggtttcgagggcgatta

SEQ ID NO: 869887 - DNA, 25 bp, Mus musculus
tgccttctgtttaccctacaagaat

SEQ ID NO: 869888 - DNA, 25 bp, Mus musculus
tgccttctgtttcatcacaatctac

SEQ ID NO: 869889 - DNA, 25 bp, Mus musculus
tgccttctgtttgatcacaatctac

SEQ ID NO: 869890 - DNA, 25 bp, Mus musculus
tgccttctgttttccctacaagaat

SEQ ID NO: 869891 - DNA, 25 bp, Mus musculus
tgccttcttcacatttaccaagtct

SEQ ID NO: 869892 - DNA, 25 bp, Mus musculus
tgccttcttcacttttaccaagtct

SEQ ID NO: 869893 - DNA, 25 bp, Mus musculus
tgccttcttgctagcctgtgactta

SEQ ID NO: 869894 - DNA, 25 bp, Mus musculus
tgccttcttgcttgcctgtgactta

SEQ ID NO: 869895 - DNA, 25 bp, Mus musculus
tgccttctttccaatcctctaaata

SEQ ID NO: 869896 - DNA, 25 bp, Mus musculus
tgccttctttccagcaacaatggac

SEQ ID NO: 869897 - DNA, 25 bp, Mus musculus
tgccttctttcctatcctctaaata

SEQ ID NO: 869898 - DNA, 25 bp, Mus musculus
tgccttctttcctgcaacaatggac

SEQ ID NO: 869899 - DNA, 25 bp, Mus musculus
tgccttctttttcctcatgttaaaa

SEQ ID NO: 869900 - DNA, 25 bp, Mus musculus
tgccttctttttgctcatgttaaaa

SEQ ID NO: 869901 - DNA, 25 bp, Mus musculus
tgccttgaaacaacccttgcctggg

SEQ ID NO: 869902 - DNA, 25 bp, Mus musculus
tgccttgaaacatcccttgcctggg

SEQ ID NO: 869903 - DNA, 25 bp, Mus musculus
tgccttgaaaccctggtttagaact

SEQ ID NO: 869904 - DNA, 25 bp, Mus musculus
tgccttgaaaccgtggtttagaact

SEQ ID NO: 869905 - DNA, 25 bp, Mus musculus
tgccttgaaaggacagatgccagaa

SEQ ID NO: 869906 - DNA, 25 bp, Mus musculus
tgccttgaaaggtcagatgccagaa

SEQ ID NO: 869907 - DNA, 25 bp, Mus musculus
tgccttgaagatcctcttctctgaa

SEQ ID NO: 869908 - DNA, 25 bp, Mus musculus
tgccttgaagatgctcttctctgaa

SEQ ID NO: 869909 - DNA, 25 bp, Mus musculus
tgccttgaagtcacattctttgctg

SEQ ID NO: 869910 - DNA, 25 bp, Mus musculus
tgccttgaagtctcattctttgctg

SEQ ID NO: 869911 - DNA, 25 bp, Mus musculus
tgccttgacaacagcccttgacagg

SEQ ID NO: 869912 - DNA, 25 bp, Mus musculus
tgccttgacaactgcccttgacagg

SEQ ID NO: 869913 - DNA, 25 bp, Mus musculus
tgccttgaccttcacaagatggaag

SEQ ID NO: 869914 - DNA, 25 bp, Mus musculus
tgccttgaccttgacaagatggaag

SEQ ID NO: 869915 - DNA, 25 bp, Mus musculus
tgccttgactgtagtgctgggataa

SEQ ID NO: 869916 - DNA, 25 bp, Mus musculus
tgccttgactgttgtgctgggataa

SEQ ID NO: 869917 - DNA, 25 bp, Mus musculus
tgccttgactttaccagcaatccat

SEQ ID NO: 869918 - DNA, 25 bp, Mus musculus
tgccttgacttttccagcaatccat

SEQ ID NO: 869919 - DNA, 25 bp, Mus musculus
tgccttgagactacaggaaaatctt

SEQ ID NO: 869920 - DNA, 25 bp, Mus musculus
tgccttgagacttcaggaaaatctt

SEQ ID NO: 869921 - DNA, 25 bp, Mus musculus
tgccttgagcacagtcctggaacgt

SEQ ID NO: 869922 - DNA, 25 bp, Mus musculus
tgccttgagcactgtcctggaacgt

SEQ ID NO: 869923 - DNA, 25 bp, Mus musculus
tgccttgaggcaaccaaacttcgaa

SEQ ID NO: 869924 - DNA, 25 bp, Mus musculus
tgccttgaggcatccaaacttcgaa

SEQ ID NO: 869925 - DNA, 25 bp, Mus musculus
tgccttgagtttaaagtaaccaatc

SEQ ID NO: 869926 - DNA, 25 bp, Mus musculus
tgccttgagttttaagtaaccaatc

SEQ ID NO: 869927 - DNA, 25 bp, Mus musculus
tgccttgatgacaccttagtctcaa

SEQ ID NO: 869928 - DNA, 25 bp, Mus musculus
tgccttgatgactccttagtctcaa

SEQ ID NO: 869929 - DNA, 25 bp, Mus musculus
tgccttgcaaagcaagctttcctct

SEQ ID NO: 869930 - DNA, 25 bp, Mus musculus
tgccttgcaaaggaagctttcctct

SEQ ID NO: 869931 - DNA, 25 bp, Mus musculus
tgccttgcacttataaatctgtctt

SEQ ID NO: 869932 - DNA, 25 bp, Mus musculus
tgccttgcacttttaaatctgtctt

SEQ ID NO: 869933 - DNA, 25 bp, Mus musculus
tgccttgcagcgaagggctgtgttt

SEQ ID NO: 869934 - DNA, 25 bp, Mus musculus
tgccttgcagcgtagggctgtgttt

SEQ ID NO: 869935 - DNA, 25 bp, Mus musculus
tgccttgcatttcatcagtaatttt

SEQ ID NO: 869936 - DNA, 25 bp, Mus musculus
tgccttgcatttgatcagtaatttt

SEQ ID NO: 869937 - DNA, 25 bp, Mus musculus
tgccttgccagcacacagaattttg

SEQ ID NO: 869938 - DNA, 25 bp, Mus musculus
tgccttgccagctcacagaattttg

SEQ ID NO: 869939 - DNA, 25 bp, Mus musculus
tgccttgcccaaaatggaggcttag

SEQ ID NO: 869940 - DNA, 25 bp, Mus musculus
tgccttgcccaatatggaggcttag

SEQ ID NO: 869941 - DNA, 25 bp, Mus musculus
tgccttgcccacagtcaaagcttgg

SEQ ID NO: 869942 - DNA, 25 bp, Mus musculus
tgccttgcccactgtcaaagcttgg

SEQ ID NO: 869943 - DNA, 25 bp, Mus musculus
tgccttgcctagcacttaactgtct

SEQ ID NO: 869944 - DNA, 25 bp, Mus musculus
tgccttgcctaggacttaactgtct

SEQ ID NO: 869945 - DNA, 25 bp, Mus musculus
tgccttgcctgactgagctgcataa

SEQ ID NO: 869946 - DNA, 25 bp, Mus musculus
tgccttgcctgagtgagctgcataa

SEQ ID NO: 869947 - DNA, 25 bp, Mus musculus
tgccttgcgtatccacatgctgttg

SEQ ID NO: 869948 - DNA, 25 bp, Mus musculus
tgccttgcgtatgcacatgctgttg

SEQ ID NO: 869949 - DNA, 25 bp, Mus musculus
tgccttgctacaacacggtgcagat

SEQ ID NO: 869950 - DNA, 25 bp, Mus musculus
tgccttgctacatcacggtgcagat

SEQ ID NO: 869951 - DNA, 25 bp, Mus musculus
tgccttgctccaaccgtgcgtgtac

SEQ ID NO: 869952 - DNA, 25 bp, Mus musculus
tgccttgctccatccgtgcgtgtac

SEQ ID NO: 869953 - DNA, 25 bp, Mus musculus
tgccttgctgcaactcttctacaag

SEQ ID NO: 869954 - DNA, 25 bp, Mus musculus
tgccttgctgcatctcttctacaag

SEQ ID NO: 869955 - DNA, 25 bp, Mus musculus
tgccttgctgctcatttggaaactt

SEQ ID NO: 869956 - DNA, 25 bp, Mus musculus
tgccttgctgctgatttggaaactt

SEQ ID NO: 869957 - DNA, 25 bp, Mus musculus
tgccttgctggcaagcccaagggcc

SEQ ID NO: 869958 - DNA, 25 bp, Mus musculus
tgccttgctggctagcccaagggcc

SEQ ID NO: 869959 - DNA, 25 bp, Mus musculus
tgccttgcttccagtggagacgaca

SEQ ID NO: 869960 - DNA, 25 bp, Mus musculus
tgccttgcttcctgtggagacgaca

SEQ ID NO: 869961 - DNA, 25 bp, Mus musculus
tgccttggaaacatcccgctgtatt

SEQ ID NO: 869962 - DNA, 25 bp, Mus musculus
tgccttggaaacttcccgctgtatt

SEQ ID NO: 869963 - DNA, 25 bp, Mus musculus
tgccttggaattagcagacttctat

SEQ ID NO: 869964 - DNA, 25 bp, Mus musculus
tgccttggaatttgcagacttctat

SEQ ID NO: 869965 - DNA, 25 bp, Mus musculus
tgccttggactcaggtcatccattt

SEQ ID NO: 869966 - DNA, 25 bp, Mus musculus
tgccttggactctggtcatccattt

SEQ ID NO: 869967 - DNA, 25 bp, Mus musculus
tgccttggagcaactagttctgact

SEQ ID NO: 869968 - DNA, 25 bp, Mus musculus
tgccttggagcatctagttctgact

SEQ ID NO: 869969 - DNA, 25 bp, Mus musculus
tgccttggagtcagtggtgtccctc

SEQ ID NO: 869970 - DNA, 25 bp, Mus musculus
tgccttggagtctgtggtgtccctc

SEQ ID NO: 869971 - DNA, 25 bp, Mus musculus
tgccttggcatgacttcattgtcca

SEQ ID NO: 869972 - DNA, 25 bp, Mus musculus
tgccttggcatgtcttcattgtcca

SEQ ID NO: 869973 - DNA, 25 bp, Mus musculus
tgccttggccaacctcagtgaactg

SEQ ID NO: 869974 - DNA, 25 bp, Mus musculus
tgccttggccaagctcagtgaactg

SEQ ID NO: 869975 - DNA, 25 bp, Mus musculus
tgccttggcttcattcaatatactg

SEQ ID NO: 869976 - DNA, 25 bp, Mus musculus
tgccttggcttctttcaatatactg

SEQ ID NO: 869977 - DNA, 25 bp, Mus musculus
tgccttgggaaaaagatgagtacct

SEQ ID NO: 869978 - DNA, 25 bp, Mus musculus
tgccttgggaaatagatgagtacct

SEQ ID NO: 869979 - DNA, 25 bp, Mus musculus
tgccttgggcacctttcctaccggg

SEQ ID NO: 869980 - DNA, 25 bp, Mus musculus
tgccttgggcacgtttcctaccggg

SEQ ID NO: 869981 - DNA, 25 bp, Mus musculus
tgccttgggttcatattggtgggat

SEQ ID NO: 869982 - DNA, 25 bp, Mus musculus
tgccttgggttcttattggtgggat

SEQ ID NO: 869983 - DNA, 25 bp, Mus musculus
tgccttgggtttcgttctggtagat

SEQ ID NO: 869984 - DNA, 25 bp, Mus musculus
tgccttgggtttggttctggtagat

SEQ ID NO: 869985 - DNA, 25 bp, Mus musculus
tgccttggtcaacctactacggacg

SEQ ID NO: 869986 - DNA, 25 bp, Mus musculus
tgccttggtcaagctactacggacg

SEQ ID NO: 869987 - DNA, 25 bp, Mus musculus
tgccttggtcttaagtcttttacgt

SEQ ID NO: 869988 - DNA, 25 bp, Mus musculus
tgccttggtctttagtcttttacgt

SEQ ID NO: 869989 - DNA, 25 bp, Mus musculus
tgccttggtgttagtgttttctcaa

SEQ ID NO: 869990 - DNA, 25 bp, Mus musculus
tgccttggtgtttgtgttttctcaa

SEQ ID NO: 869991 - DNA, 25 bp, Mus musculus
tgccttggttatagtgtctcctcaa

SEQ ID NO: 869992 - DNA, 25 bp, Mus musculus
tgccttggttatctctttattcttc

SEQ ID NO: 869993 - DNA, 25 bp, Mus musculus
tgccttggttatgtctttattcttc

SEQ ID NO: 869994 - DNA, 25 bp, Mus musculus
tgccttggttattgtgtctcctcaa

SEQ ID NO: 869995 - DNA, 25 bp, Mus musculus
tgccttggttctctcaagacttgga

SEQ ID NO: 869996 - DNA, 25 bp, Mus musculus
tgccttggttctgtcaagacttgga

SEQ ID NO: 869997 - DNA, 25 bp, Mus musculus
tgccttgtacccaacacgtcggtat

SEQ ID NO: 869998 - DNA, 25 bp, Mus musculus
tgccttgtaccctacacgtcggtat

SEQ ID NO: 869999 - DNA, 25 bp, Mus musculus
tgccttgtagctcagcaagacctta

SEQ ID NO: 870000 - DNA, 25 bp, Mus musculus
tgccttgtagctgagcaagacctta

SEQ ID NO: 870001 - DNA, 25 bp, Mus musculus
tgccttgtcaacatggctgagcact

SEQ ID NO: 870002 - DNA, 25 bp, Mus musculus
tgccttgtcaacttggctgagcact

SEQ ID NO: 870003 - DNA, 25 bp, Mus musculus
tgccttgtcatcagagaacttcagt

SEQ ID NO: 870004 - DNA, 25 bp, Mus musculus
tgccttgtcatctgagaacttcagt

SEQ ID NO: 870005 - DNA, 25 bp, Mus musculus
tgccttgtcattatggttccttacc

SEQ ID NO: 870006 - DNA, 25 bp, Mus musculus
tgccttgtcattttggttccttacc

SEQ ID NO: 870007 - DNA, 25 bp, Mus musculus
tgccttgtcccacaagctggaacct

SEQ ID NO: 870008 - DNA, 25 bp, Mus musculus
tgccttgtcccagaagctggaacct

SEQ ID NO: 870009 - DNA, 25 bp, Mus musculus
tgccttgtccccaacaaaaaagatt

SEQ ID NO: 870010 - DNA, 25 bp, Mus musculus
tgccttgtcccctacaaaaaagatt

SEQ ID NO: 870011 - DNA, 25 bp, Mus musculus
tgccttgtcctgcatgtacatggct

SEQ ID NO: 870012 - DNA, 25 bp, Mus musculus
tgccttgtcctggatgtacatggct

SEQ ID NO: 870013 - DNA, 25 bp, Mus musculus
tgccttgtcgaaaaccacactcgga

SEQ ID NO: 870014 - DNA, 25 bp, Mus musculus
tgccttgtcgaataccacactcgga

SEQ ID NO: 870015 - DNA, 25 bp, Mus musculus
tgccttgtctatacagttccacaga

SEQ ID NO: 870016 - DNA, 25 bp, Mus musculus
tgccttgtctattcagttccacaga

SEQ ID NO: 870017 - DNA, 25 bp, Mus musculus
tgccttgtgactcctggaattatag

SEQ ID NO: 870018 - DNA, 25 bp, Mus musculus
tgccttgtgactgctggaattatag

SEQ ID NO: 870019 - DNA, 25 bp, Mus musculus
tgccttgtgctaccaatgctgtgac

SEQ ID NO: 870020 - DNA, 25 bp, Mus musculus
tgccttgtgctagcaatgctgtgac

SEQ ID NO: 870021 - DNA, 25 bp, Mus musculus
tgccttgtgctgcagacttcttatc

SEQ ID NO: 870022 - DNA, 25 bp, Mus musculus
tgccttgtgctggagacttcttatc

SEQ ID NO: 870023 - DNA, 25 bp, Mus musculus
tgccttgtgggactgctagatcctt

SEQ ID NO: 870024 - DNA, 25 bp, Mus musculus
tgccttgtgggagtgctagatcctt

SEQ ID NO: 870025 - DNA, 25 bp, Mus musculus
tgccttgtgtcaccatcctgatgac

SEQ ID NO: 870026 - DNA, 25 bp, Mus musculus
tgccttgtgtcagcatcctgatgac

SEQ ID NO: 870027 - DNA, 25 bp, Mus musculus
tgccttgttaaccttctaacctttg

SEQ ID NO: 870028 - DNA, 25 bp, Mus musculus
tgccttgttaacgttctaacctttg

SEQ ID NO: 870029 - DNA, 25 bp, Mus musculus
tgccttgttcatcgtcatttggatc

SEQ ID NO: 870030 - DNA, 25 bp, Mus musculus
tgccttgttcatggtcatttggatc

SEQ ID NO: 870031 - DNA, 25 bp, Mus musculus
tgccttgttcctctggcctgtacat

SEQ ID NO: 870032 - DNA, 25 bp, Mus musculus
tgccttgttcctgtggcctgtacat

SEQ ID NO: 870033 - DNA, 25 bp, Mus musculus
tgccttgtttcacaacagtctcttg

SEQ ID NO: 870034 - DNA, 25 bp, Mus musculus
tgccttgtttcagaacagtctcttg

SEQ ID NO: 870035 - DNA, 25 bp, Mus musculus
tgccttgtttctcgaggccttcaaa

SEQ ID NO: 870036 - DNA, 25 bp, Mus musculus
tgccttgtttctggaggccttcaaa

SEQ ID NO: 870037 - DNA, 25 bp, Mus musculus
tgccttgtttgaactctttgtttat

SEQ ID NO: 870038 - DNA, 25 bp, Mus musculus
tgccttgtttgatctctttgtttat

SEQ ID NO: 870039 - DNA, 25 bp, Mus musculus
tgcctttaacccagggccatatgat

SEQ ID NO: 870040 - DNA, 25 bp, Mus musculus
tgcctttaaccctgggccatatgat

SEQ ID NO: 870041 - DNA, 25 bp, Mus musculus
tgcctttaataccaaatttcacgtg

SEQ ID NO: 870042 - DNA, 25 bp, Mus musculus
tgcctttaatacgaaatttcacgtg

SEQ ID NO: 870043 - DNA, 25 bp, Mus musculus
tgcctttacctcagacacgagcaat

SEQ ID NO: 870044 - DNA, 25 bp, Mus musculus
tgcctttacctctgacacgagcaat

SEQ ID NO: 870045 - DNA, 25 bp, Mus musculus
tgcctttactcactttggtttgttt

SEQ ID NO: 870046 - DNA, 25 bp, Mus musculus
tgcctttactcagtttggtttgttt

SEQ ID NO: 870047 - DNA, 25 bp, Mus musculus
tgcctttagacacccttactgttga

SEQ ID NO: 870048 - DNA, 25 bp, Mus musculus
tgcctttagacagccttactgttga

SEQ ID NO: 870049 - DNA, 25 bp, Mus musculus
tgcctttagtctacagcagtggttc

SEQ ID NO: 870050 - DNA, 25 bp, Mus musculus
tgcctttagtcttcagcagtggttc

SEQ ID NO: 870051 - DNA, 25 bp, Mus musculus
tgcctttatatcctcttcctagctg

SEQ ID NO: 870052 - DNA, 25 bp, Mus musculus
tgcctttatatcgtcttcctagctg

SEQ ID NO: 870053 - DNA, 25 bp, Mus musculus
tgcctttatcctcccagagatggag

SEQ ID NO: 870054 - DNA, 25 bp, Mus musculus
tgcctttatcctgccagagatggag

SEQ ID NO: 870055 - DNA, 25 bp, Mus musculus
tgcctttcaagtctaagtttctgtg

SEQ ID NO: 870056 - DNA, 25 bp, Mus musculus
tgcctttcaagtgtaagtttctgtg

SEQ ID NO: 870057 - DNA, 25 bp, Mus musculus
tgcctttcacccaagcctggaaaag

SEQ ID NO: 870058 - DNA, 25 bp, Mus musculus
tgcctttcaccctagcctggaaaag

SEQ ID NO: 870059 - DNA, 25 bp, Mus musculus
tgcctttcacgcaaaagcagctcag

SEQ ID NO: 870060 - DNA, 25 bp, Mus musculus
tgcctttcacgctaaagcagctcag

SEQ ID NO: 870061 - DNA, 25 bp, Mus musculus
tgcctttcacttatctggacagtca

SEQ ID NO: 870062 - DNA, 25 bp, Mus musculus
tgcctttcacttttctggacagtca

SEQ ID NO: 870063 - DNA, 25 bp, Mus musculus
tgcctttcagctcatgccatagctt

SEQ ID NO: 870064 - DNA, 25 bp, Mus musculus
tgcctttcagctgatgccatagctt

SEQ ID NO: 870065 - DNA, 25 bp, Mus musculus
tgcctttcaggccatgacaccacgg

SEQ ID NO: 870066 - DNA, 25 bp, Mus musculus
tgcctttcaggcgatgacaccacgg

SEQ ID NO: 870067 - DNA, 25 bp, Mus musculus
tgcctttcagttcccttggtgaagt

SEQ ID NO: 870068 - DNA, 25 bp, Mus musculus
tgcctttcagttgccttggtgaagt

SEQ ID NO: 870069 - DNA, 25 bp, Mus musculus
tgcctttcatccatgcactgtgaag

SEQ ID NO: 870070 - DNA, 25 bp, Mus musculus
tgcctttcatccttgcactgtgaag

SEQ ID NO: 870071 - DNA, 25 bp, Mus musculus
tgcctttccagtacagctctgaaaa

SEQ ID NO: 870072 - DNA, 25 bp, Mus musculus
tgcctttccagttcagctctgaaaa

SEQ ID NO: 870073 - DNA, 25 bp, Mus musculus
tgcctttcccctatcatccagatga

SEQ ID NO: 870074 - DNA, 25 bp, Mus musculus
tgcctttcccctttcatccagatga

SEQ ID NO: 870075 - DNA, 25 bp, Mus musculus
tgcctttccctaatcctgaaataaa

SEQ ID NO: 870076 - DNA, 25 bp, Mus musculus
tgcctttccctattcctgaaataaa

SEQ ID NO: 870077 - DNA, 25 bp, Mus musculus
tgcctttccctgagaacctgcagag

SEQ ID NO: 870078 - DNA, 25 bp, Mus musculus
tgcctttccctgtgaacctgcagag

SEQ ID NO: 870079 - DNA, 25 bp, Mus musculus
tgcctttccgatagagactctcatt

SEQ ID NO: 870080 - DNA, 25 bp, Mus musculus
tgcctttccgattgagactctcatt

SEQ ID NO: 870081 - DNA, 25 bp, Mus musculus
tgcctttcctgtaagcataggacgt

SEQ ID NO: 870082 - DNA, 25 bp, Mus musculus
tgcctttcctgttagcataggacgt

SEQ ID NO: 870083 - DNA, 25 bp, Mus musculus
tgcctttctagaatgagttgtcatc

SEQ ID NO: 870084 - DNA, 25 bp, Mus musculus
tgcctttctagattgagttgtcatc

SEQ ID NO: 870085 - DNA, 25 bp, Mus musculus
tgcctttctcctagcaaagtatgct

SEQ ID NO: 870086 - DNA, 25 bp, Mus musculus
tgcctttctccttgcaaagtatgct

SEQ ID NO: 870087 - DNA, 25 bp, Mus musculus
tgcctttctctgcaggagccggagc

SEQ ID NO: 870088 - DNA, 25 bp, Mus musculus
tgcctttctctggaggagccggagc

SEQ ID NO: 870089 - DNA, 25 bp, Mus musculus
tgcctttctgctcacataaacttgc

SEQ ID NO: 870090 - DNA, 25 bp, Mus musculus
tgcctttctgctgacataaacttgc

SEQ ID NO: 870091 - DNA, 25 bp, Mus musculus
tgcctttctggtattctccatcaaa

SEQ ID NO: 870092 - DNA, 25 bp, Mus musculus
tgcctttctggttttctccatcaaa

SEQ ID NO: 870093 - DNA, 25 bp, Mus musculus
tgcctttcttcgagcttgccagtga

SEQ ID NO: 870094 - DNA, 25 bp, Mus musculus
tgcctttcttcgtgcttgccagtga

SEQ ID NO: 870095 - DNA, 25 bp, Mus musculus
tgcctttcttgacctggagttggga

SEQ ID NO: 870096 - DNA, 25 bp, Mus musculus
tgcctttcttgagctggagttggga

SEQ ID NO: 870097 - DNA, 25 bp, Mus musculus
tgcctttctttaactcggtggtgac

SEQ ID NO: 870098 - DNA, 25 bp, Mus musculus
tgcctttctttatctcggtggtgac

SEQ ID NO: 870099 - DNA, 25 bp, Mus musculus
tgcctttgaattcactccatggttc

SEQ ID NO: 870100 - DNA, 25 bp, Mus musculus
tgcctttgaattgactccatggttc

SEQ ID NO: 870101 - DNA, 25 bp, Mus musculus
tgcctttgaggccattggactggtt

SEQ ID NO: 870102 - DNA, 25 bp, Mus musculus
tgcctttgaggcgattggactggtt

SEQ ID NO: 870103 - DNA, 25 bp, Mus musculus
tgcctttgcattcctttgtctccca

SEQ ID NO: 870104 - DNA, 25 bp, Mus musculus
tgcctttgcattgctttgtctccca

SEQ ID NO: 870105 - DNA, 25 bp, Mus musculus
tgcctttgccatacatgacatggag

SEQ ID NO: 870106 - DNA, 25 bp, Mus musculus
tgcctttgccattcatgacatggag

SEQ ID NO: 870107 - DNA, 25 bp, Mus musculus
tgcctttgcggacaacctaagttca

SEQ ID NO: 870108 - DNA, 25 bp, Mus musculus
tgcctttgcggagaacctaagttca

SEQ ID NO: 870109 - DNA, 25 bp, Mus musculus
tgcctttgctcccatgaccaatggt

SEQ ID NO: 870110 - DNA, 25 bp, Mus musculus
tgcctttgctccgatgaccaatggt

SEQ ID NO: 870111 - DNA, 25 bp, Mus musculus
tgcctttgcttcaccataagtcagt

SEQ ID NO: 870112 - DNA, 25 bp, Mus musculus
tgcctttgcttctccataagtcagt

SEQ ID NO: 870113 - DNA, 25 bp, Mus musculus
tgcctttggaccaggctgagtcaga

SEQ ID NO: 870114 - DNA, 25 bp, Mus musculus
tgcctttggacctggctgagtcaga

SEQ ID NO: 870115 - DNA, 25 bp, Mus musculus
tgcctttggttcctgtgctcctaag

SEQ ID NO: 870116 - DNA, 25 bp, Mus musculus
tgcctttggttcgtgtgctcctaag

SEQ ID NO: 870117 - DNA, 25 bp, Mus musculus
tgcctttgtcaaataacttattttc

SEQ ID NO: 870118 - DNA, 25 bp, Mus musculus
tgcctttgtcaattaacttattttc

SEQ ID NO: 870119 - DNA, 25 bp, Mus musculus
tgcctttgtcatctctgaaaccttt

SEQ ID NO: 870120 - DNA, 25 bp, Mus musculus
tgcctttgtcatgtctgaaaccttt

SEQ ID NO: 870121 - DNA, 25 bp, Mus musculus
tgcctttgtctccagaatgcctggg

SEQ ID NO: 870122 - DNA, 25 bp, Mus musculus
tgcctttgtctcgagaatgcctggg

SEQ ID NO: 870123 - DNA, 25 bp, Mus musculus
tgcctttgtggtcgctcagatagag

SEQ ID NO: 870124 - DNA, 25 bp, Mus musculus
tgcctttgtggtggctcagatagag

SEQ ID NO: 870125 - DNA, 25 bp, Mus musculus
tgcctttgtgtgaagcttgcttgac

SEQ ID NO: 870126 - DNA, 25 bp, Mus musculus
tgcctttgtgtgtagcttgcttgac

SEQ ID NO: 870127 - DNA, 25 bp, Mus musculus
tgcctttgttctctgatttgttctg

SEQ ID NO: 870128 - DNA, 25 bp, Mus musculus
tgcctttgttctgtgatttgttctg

SEQ ID NO: 870129 - DNA, 25 bp, Mus musculus
tgccttttactgctttcaccaaaca

SEQ ID NO: 870130 - DNA, 25 bp, Mus musculus
tgccttttactggtttcaccaaaca

SEQ ID NO: 870131 - DNA, 25 bp, Mus musculus
tgccttttacttaactgcaaccttt

SEQ ID NO: 870132 - DNA, 25 bp, Mus musculus
tgccttttactttactgcaaccttt

SEQ ID NO: 870133 - DNA, 25 bp, Mus musculus
tgccttttaggcatacttcttgagt

SEQ ID NO: 870134 - DNA, 25 bp, Mus musculus
tgccttttaggcttacttcttgagt

SEQ ID NO: 870135 - DNA, 25 bp, Mus musculus
tgccttttatcccaggaggttttct

SEQ ID NO: 870136 - DNA, 25 bp, Mus musculus
tgccttttatccgaggaggttttct

SEQ ID NO: 870137 - DNA, 25 bp, Mus musculus
tgccttttattcaatcacgttgaag

SEQ ID NO: 870138 - DNA, 25 bp, Mus musculus
tgccttttattctatcacgttgaag

SEQ ID NO: 870139 - DNA, 25 bp, Mus musculus
tgccttttcaaacacaacgacgact

SEQ ID NO: 870140 - DNA, 25 bp, Mus musculus
tgccttttcaaagacaacgacgact

SEQ ID NO: 870141 - DNA, 25 bp, Mus musculus
tgccttttcagtacctaatgcagaa

SEQ ID NO: 870142 - DNA, 25 bp, Mus musculus
tgccttttcagttcctaatgcagaa

SEQ ID NO: 870143 - DNA, 25 bp, Mus musculus
tgccttttcatcctgtaaaccttag

SEQ ID NO: 870144 - DNA, 25 bp, Mus musculus
tgccttttcatcgtgtaaaccttag

SEQ ID NO: 870145 - DNA, 25 bp, Mus musculus
tgccttttccaaccacgttgactaa

SEQ ID NO: 870146 - DNA, 25 bp, Mus musculus
tgccttttccaagcacgttgactaa

SEQ ID NO: 870147 - DNA, 25 bp, Mus musculus
tgccttttccgtaggatgtccacat

SEQ ID NO: 870148 - DNA, 25 bp, Mus musculus
tgccttttccgttggatgtccacat

SEQ ID NO: 870149 - DNA, 25 bp, Mus musculus
tgccttttcctcagaacgaggcgtt

SEQ ID NO: 870150 - DNA, 25 bp, Mus musculus
tgccttttcctctgaacgaggcgtt

SEQ ID NO: 870151 - DNA, 25 bp, Mus musculus
tgccttttcctgactaaccttgaat

SEQ ID NO: 870152 - DNA, 25 bp, Mus musculus
tgccttttcctgtctaaccttgaat

SEQ ID NO: 870153 - DNA, 25 bp, Mus musculus
tgccttttctctaatatcccagtat

SEQ ID NO: 870154 - DNA, 25 bp, Mus musculus
tgccttttctctaggccggtaggaa

SEQ ID NO: 870155 - DNA, 25 bp, Mus musculus
tgccttttctcttatatcccagtat

SEQ ID NO: 870156 - DNA, 25 bp, Mus musculus
tgccttttctcttggccggtaggaa

SEQ ID NO: 870157 - DNA, 25 bp, Mus musculus
tgccttttctgtatacattggttaa

SEQ ID NO: 870158 - DNA, 25 bp, Mus musculus
tgccttttctgtttacattggttaa

SEQ ID NO: 870159 - DNA, 25 bp, Mus musculus
tgccttttgggcattctgaggatct

SEQ ID NO: 870160 - DNA, 25 bp, Mus musculus
tgccttttgggctttctgaggatct

SEQ ID NO: 870161 - DNA, 25 bp, Mus musculus
tgccttttgtaacacctttcctagt

SEQ ID NO: 870162 - DNA, 25 bp, Mus musculus
tgccttttgtaagacctttcctagt

SEQ ID NO: 870163 - DNA, 25 bp, Mus musculus
tgccttttgtatcccctgtgagatc

SEQ ID NO: 870164 - DNA, 25 bp, Mus musculus
tgccttttgtatgccctgtgagatc

SEQ ID NO: 870165 - DNA, 25 bp, Mus musculus
tgccttttgtggctattagctcctc

SEQ ID NO: 870166 - DNA, 25 bp, Mus musculus
tgccttttgtgggtattagctcctc

SEQ ID NO: 870167 - DNA, 25 bp, Mus musculus
tgcctttttatacactgtccttctt

SEQ ID NO: 870168 - DNA, 25 bp, Mus musculus
tgcctttttatagactgtccttctt

SEQ ID NO: 870169 - DNA, 25 bp, Mus musculus
tgcctttttatgcatgcttctcttc

SEQ ID NO: 870170 - DNA, 25 bp, Mus musculus
tgcctttttatggatgcttctcttc

SEQ ID NO: 870171 - DNA, 25 bp, Mus musculus
tgcctttttgccacctaatgttttt

SEQ ID NO: 870172 - DNA, 25 bp, Mus musculus
tgcctttttgcctcctaatgttttt

SEQ ID NO: 870173 - DNA, 25 bp, Mus musculus
tgcctttttgggagttctcttcaca

SEQ ID NO: 870174 - DNA, 25 bp, Mus musculus
tgcctttttgggatctgtggaccaa

SEQ ID NO: 870175 - DNA, 25 bp, Mus musculus
tgcctttttgggtgttctcttcaca

SEQ ID NO: 870176 - DNA, 25 bp, Mus musculus
tgcctttttgggttctgtggaccaa

SEQ ID NO: 870177 - DNA, 25 bp, Mus musculus
tgccttttttgcagacaagggtatg

SEQ ID NO: 870178 - DNA, 25 bp, Mus musculus
tgccttttttgctgacaagggtatg

SEQ ID NO: 870179 - DNA, 25 bp, Mus musculus
tgcgaaactcgcaatatgccgataa

SEQ ID NO: 870180 - DNA, 25 bp, Mus musculus
tgcgaaactcgctatatgccgataa

SEQ ID NO: 870181 - DNA, 25 bp, Mus musculus
tgcgaaaggcaaataatccccactt

SEQ ID NO: 870182 - DNA, 25 bp, Mus musculus
tgcgaaaggcaattaatccccactt

SEQ ID NO: 870183 - DNA, 25 bp, Mus musculus
tgcgaaagggcaccggtgacttaat

SEQ ID NO: 870184 - DNA, 25 bp, Mus musculus
tgcgaaagggcagcggtgacttaat

SEQ ID NO: 870185 - DNA, 25 bp, Mus musculus
tgcgaaatcaccatcattgaatcag

SEQ ID NO: 870186 - DNA, 25 bp, Mus musculus
tgcgaaatcaccttcattgaatcag

SEQ ID NO: 870187 - DNA, 25 bp, Mus musculus
tgcgaaatctcactgtcctttctgt

SEQ ID NO: 870188 - DNA, 25 bp, Mus musculus
tgcgaaatctcagtgtcctttctgt

SEQ ID NO: 870189 - DNA, 25 bp, Mus musculus
tgcgaaatcttgaacacctgaacgt

SEQ ID NO: 870190 - DNA, 25 bp, Mus musculus
tgcgaaatcttgcatagattatgct

SEQ ID NO: 870191 - DNA, 25 bp, Mus musculus
tgcgaaatcttggatagattatgct

SEQ ID NO: 870192 - DNA, 25 bp, Mus musculus
tgcgaaatcttgtacacctgaacgt

SEQ ID NO: 870193 - DNA, 25 bp, Mus musculus
tgcgaacaacagactcacagccaaa

SEQ ID NO: 870194 - DNA, 25 bp, Mus musculus
tgcgaacaacagtctcacagccaaa

SEQ ID NO: 870195 - DNA, 25 bp, Mus musculus
tgcgaaccacacagctagagaaagc

SEQ ID NO: 870196 - DNA, 25 bp, Mus musculus
tgcgaaccacactgctagagaaagc

SEQ ID NO: 870197 - DNA, 25 bp, Mus musculus
tgcgaaccttgacgactgctctcag

SEQ ID NO: 870198 - DNA, 25 bp, Mus musculus
tgcgaaccttgaggactgctctcag

SEQ ID NO: 870199 - DNA, 25 bp, Mus musculus
tgcgaacgactgcacaccgtggcag

SEQ ID NO: 870200 - DNA, 25 bp, Mus musculus
tgcgaacgactggacaccgtggcag

SEQ ID NO: 870201 - DNA, 25 bp, Mus musculus
tgcgaacgccgacctgtgcttcaga

SEQ ID NO: 870202 - DNA, 25 bp, Mus musculus
tgcgaacgccgagctgtgcttcaga

SEQ ID NO: 870203 - DNA, 25 bp, Mus musculus
tgcgaacgtgttcttttttaacagc

SEQ ID NO: 870204 - DNA, 25 bp, Mus musculus
tgcgaacgtgttgttttttaacagc

SEQ ID NO: 870205 - DNA, 25 bp, Mus musculus
tgcgaactgccaccgattacagaga

SEQ ID NO: 870206 - DNA, 25 bp, Mus musculus
tgcgaactgccagcgattacagaga

SEQ ID NO: 870207 - DNA, 25 bp, Mus musculus
tgcgaagaggttattctcccaagct

SEQ ID NO: 870208 - DNA, 25 bp, Mus musculus
tgcgaagaggtttttctcccaagct

SEQ ID NO: 870209 - DNA, 25 bp, Mus musculus
tgcgaagcccggcagggacacccta

SEQ ID NO: 870210 - DNA, 25 bp, Mus musculus
tgcgaagcccgggagggacacccta

SEQ ID NO: 870211 - DNA, 25 bp, Mus musculus
tgcgaagctacaacacccaggtgaa

SEQ ID NO: 870212 - DNA, 25 bp, Mus musculus
tgcgaagctacatcacccaggtgaa

SEQ ID NO: 870213 - DNA, 25 bp, Mus musculus
tgcgaagctataagagtcccacctt

SEQ ID NO: 870214 - DNA, 25 bp, Mus musculus
tgcgaagctatatgagtcccacctt

SEQ ID NO: 870215 - DNA, 25 bp, Mus musculus
tgcgaaggtattccaatctgatctt

SEQ ID NO: 870216 - DNA, 25 bp, Mus musculus
tgcgaaggtattgcaatctgatctt

SEQ ID NO: 870217 - DNA, 25 bp, Mus musculus
tgcgaaggtcaaacccatagaagag

SEQ ID NO: 870218 - DNA, 25 bp, Mus musculus
tgcgaaggtcaatcccatagaagag

SEQ ID NO: 870219 - DNA, 25 bp, Mus musculus
tgcgaagtgtcactggcttccagct

SEQ ID NO: 870220 - DNA, 25 bp, Mus musculus
tgcgaagtgtcagtggcttccagct

SEQ ID NO: 870221 - DNA, 25 bp, Mus musculus
tgcgaagtttccagccaggagttac

SEQ ID NO: 870222 - DNA, 25 bp, Mus musculus
tgcgaagtttcctgccaggagttac

SEQ ID NO: 870223 - DNA, 25 bp, Mus musculus
tgcgaatcccatcctgattacttta

SEQ ID NO: 870224 - DNA, 25 bp, Mus musculus
tgcgaatcccatgctgattacttta

SEQ ID NO: 870225 - DNA, 25 bp, Mus musculus
tgcgaattcacacctgacagttctg

SEQ ID NO: 870226 - DNA, 25 bp, Mus musculus
tgcgaattcacagctgacagttctg

SEQ ID NO: 870227 - DNA, 25 bp, Mus musculus
tgcgaatttttcaccccgttgtgtt

SEQ ID NO: 870228 - DNA, 25 bp, Mus musculus
tgcgaatttttctccccgttgtgtt

SEQ ID NO: 870229 - DNA, 25 bp, Mus musculus
tgcgacaatactcgcatcaccacgg

SEQ ID NO: 870230 - DNA, 25 bp, Mus musculus
tgcgacaatactggcatcaccacgg

SEQ ID NO: 870231 - DNA, 25 bp, Mus musculus
tgcgacaccagcctctaaagattgt

SEQ ID NO: 870232 - DNA, 25 bp, Mus musculus
tgcgacaccagcgtctaaagattgt

SEQ ID NO: 870233 - DNA, 25 bp, Mus musculus
tgcgacaccgtgcttacaggtgcta

SEQ ID NO: 870234 - DNA, 25 bp, Mus musculus
tgcgacaccgtggttacaggtgcta

SEQ ID NO: 870235 - DNA, 25 bp, Mus musculus
tgcgacactacaacaatctcatcac

SEQ ID NO: 870236 - DNA, 25 bp, Mus musculus
tgcgacactacatcaatctcatcac

SEQ ID NO: 870237 - DNA, 25 bp, Mus musculus
tgcgacactccaaacagacacatga

SEQ ID NO: 870238 - DNA, 25 bp, Mus musculus
tgcgacactccatacagacacatga

SEQ ID NO: 870239 - DNA, 25 bp, Mus musculus
tgcgacacttcaccctgccaaggag

SEQ ID NO: 870240 - DNA, 25 bp, Mus musculus
tgcgacacttcagcctgccaaggag

SEQ ID NO: 870241 - DNA, 25 bp, Mus musculus
tgcgacagcgtcagtagcctgccta

SEQ ID NO: 870242 - DNA, 25 bp, Mus musculus
tgcgacagcgtctgtagcctgccta

SEQ ID NO: 870243 - DNA, 25 bp, Mus musculus
tgcgacatggtcaagcagcccagat

SEQ ID NO: 870244 - DNA, 25 bp, Mus musculus
tgcgacatggtctagcagcccagat

SEQ ID NO: 870245 - DNA, 25 bp, Mus musculus
tgcgacattgagctgaggacacaca

SEQ ID NO: 870246 - DNA, 25 bp, Mus musculus
tgcgacattgaggtgaggacacaca

SEQ ID NO: 870247 - DNA, 25 bp, Mus musculus
tgcgaccacatcctagcagggaaaa

SEQ ID NO: 870248 - DNA, 25 bp, Mus musculus
tgcgaccacatcgtagcagggaaaa

SEQ ID NO: 870249 - DNA, 25 bp, Mus musculus
tgcgaccactgcagtcagacactgg

SEQ ID NO: 870250 - DNA, 25 bp, Mus musculus
tgcgaccactgctgtcagacactgg

SEQ ID NO: 870251 - DNA, 25 bp, Mus musculus
tgcgaccccgagaatcatgccaagg

SEQ ID NO: 870252 - DNA, 25 bp, Mus musculus
tgcgaccccgagtatcatgccaagg

SEQ ID NO: 870253 - DNA, 25 bp, Mus musculus
tgcgacctataaccttgattcacct

SEQ ID NO: 870254 - DNA, 25 bp, Mus musculus
tgcgacctataagcttgattcacct

SEQ ID NO: 870255 - DNA, 25 bp, Mus musculus
tgcgacctcacgatatctgctgaga

SEQ ID NO: 870256 - DNA, 25 bp, Mus musculus
tgcgacctcacgttatctgctgaga

SEQ ID NO: 870257 - DNA, 25 bp, Mus musculus
tgcgacctcctgatccatttgaatt

SEQ ID NO: 870258 - DNA, 25 bp, Mus musculus
tgcgacctcctgttccatttgaatt

SEQ ID NO: 870259 - DNA, 25 bp, Mus musculus
tgcgacctggacctgaccggagctt

SEQ ID NO: 870260 - DNA, 25 bp, Mus musculus
tgcgacctggacgtgaccggagctt

SEQ ID NO: 870261 - DNA, 25 bp, Mus musculus
tgcgacgcttcgaaagtacacctat

SEQ ID NO: 870262 - DNA, 25 bp, Mus musculus
tgcgacgcttcgtaagtacacctat

SEQ ID NO: 870263 - DNA, 25 bp, Mus musculus
tgcgacgtctgtcgacctgtaccag

SEQ ID NO: 870264 - DNA, 25 bp, Mus musculus
tgcgacgtctgtggacctgtaccag

SEQ ID NO: 870265 - DNA, 25 bp, Mus musculus
tgcgacgttctactcagccggccgg

SEQ ID NO: 870266 - DNA, 25 bp, Mus musculus
tgcgacgttctagtcagccggccgg

SEQ ID NO: 870267 - DNA, 25 bp, Mus musculus
tgcgactgccagaccaaggcaacaa

SEQ ID NO: 870268 - DNA, 25 bp, Mus musculus
tgcgactgccagtccaaggcaacaa

SEQ ID NO: 870269 - DNA, 25 bp, Mus musculus
tgcgactgcgaaagcgtacatgctc

SEQ ID NO: 870270 - DNA, 25 bp, Mus musculus
tgcgactgcgaatgcgtacatgctc

SEQ ID NO: 870271 - DNA, 25 bp, Mus musculus
tgcgactgctgacaccatgagcatc

SEQ ID NO: 870272 - DNA, 25 bp, Mus musculus
tgcgactgctgagaccatgagcatc

SEQ ID NO: 870273 - DNA, 25 bp, Mus musculus
tgcgactggcagatactcactttgt

SEQ ID NO: 870274 - DNA, 25 bp, Mus musculus
tgcgactggcagttactcactttgt

SEQ ID NO: 870275 - DNA, 25 bp, Mus musculus
tgcgactgttaaattcccactagat

SEQ ID NO: 870276 - DNA, 25 bp, Mus musculus
tgcgactgttaatttcccactagat

SEQ ID NO: 870277 - DNA, 25 bp, Mus musculus
tgcgacttattcctctacaacactc

SEQ ID NO: 870278 - DNA, 25 bp, Mus musculus
tgcgacttattcgtctacaacactc

SEQ ID NO: 870279 - DNA, 25 bp, Mus musculus
tgcgacttcaacagcaactcccact

SEQ ID NO: 870280 - DNA, 25 bp, Mus musculus
tgcgacttcaactgcaactcccact

SEQ ID NO: 870281 - DNA, 25 bp, Mus musculus
tgcgacttcactatacgacatactt

SEQ ID NO: 870282 - DNA, 25 bp, Mus musculus
tgcgacttcactttacgacatactt

SEQ ID NO: 870283 - DNA, 25 bp, Mus musculus
tgcgacttccacagaatcactcagc

SEQ ID NO: 870284 - DNA, 25 bp, Mus musculus
tgcgacttccactgaatcactcagc

SEQ ID NO: 870285 - DNA, 25 bp, Mus musculus
tgcgacttggctacaccagcaagga

SEQ ID NO: 870286 - DNA, 25 bp, Mus musculus
tgcgacttggcttcaccagcaagga

SEQ ID NO: 870287 - DNA, 25 bp, Mus musculus
tgcgagaaggccactatttcaaccc

SEQ ID NO: 870288 - DNA, 25 bp, Mus musculus
tgcgagaaggcctctatttcaaccc

SEQ ID NO: 870289 - DNA, 25 bp, Mus musculus
tgcgagacagcaaggcctgagaact

SEQ ID NO: 870290 - DNA, 25 bp, Mus musculus
tgcgagacagcatggcctgagaact

SEQ ID NO: 870291 - DNA, 25 bp, Mus musculus
tgcgagacccagagtacaggccaga

SEQ ID NO: 870292 - DNA, 25 bp, Mus musculus
tgcgagacccagtgtacaggccaga

SEQ ID NO: 870293 - DNA, 25 bp, Mus musculus
tgcgagagatcgagcacattcaggc

SEQ ID NO: 870294 - DNA, 25 bp, Mus musculus
tgcgagagatcgtgcacattcaggc

SEQ ID NO: 870295 - DNA, 25 bp, Mus musculus
tgcgagatgaaaagctggctcagct

SEQ ID NO: 870296 - DNA, 25 bp, Mus musculus
tgcgagatgaaatgctggctcagct

SEQ ID NO: 870297 - DNA, 25 bp, Mus musculus
tgcgagcaccggagacacttaacac

SEQ ID NO: 870298 - DNA, 25 bp, Mus musculus
tgcgagcaccggtgacacttaacac

SEQ ID NO: 870299 - DNA, 25 bp, Mus musculus
tgcgagccacagagctaactcatga

SEQ ID NO: 870300 - DNA, 25 bp, Mus musculus
tgcgagccacagtgctaactcatga

SEQ ID NO: 870301 - DNA, 25 bp, Mus musculus
tgcgagcctgtcacgtacactaggg

SEQ ID NO: 870302 - DNA, 25 bp, Mus musculus
tgcgagcctgtctcgtacactaggg

SEQ ID NO: 870303 - DNA, 25 bp, Mus musculus
tgcgagccttcactaaaatctttgt

SEQ ID NO: 870304 - DNA, 25 bp, Mus musculus
tgcgagccttcagtaaaatctttgt

SEQ ID NO: 870305 - DNA, 25 bp, Mus musculus
tgcgagcgaaacctacaccatgagt

SEQ ID NO: 870306 - DNA, 25 bp, Mus musculus
tgcgagcgaaacgtacaccatgagt

SEQ ID NO: 870307 - DNA, 25 bp, Mus musculus
tgcgagcgacagcaagctgcagctt

SEQ ID NO: 870308 - DNA, 25 bp, Mus musculus
tgcgagcgacaggaagctgcagctt

SEQ ID NO: 870309 - DNA, 25 bp, Mus musculus
tgcgagctcattagcttttactctg

SEQ ID NO: 870310 - DNA, 25 bp, Mus musculus
tgcgagctcatttgcttttactctg

SEQ ID NO: 870311 - DNA, 25 bp, Mus musculus
tgcgagcttaacattggactctttt

SEQ ID NO: 870312 - DNA, 25 bp, Mus musculus
tgcgagcttaactttggactctttt

SEQ ID NO: 870313 - DNA, 25 bp, Mus musculus
tgcgagcttccaaatccagaacagg

SEQ ID NO: 870314 - DNA, 25 bp, Mus musculus
tgcgagcttccatatccagaacagg

SEQ ID NO: 870315 - DNA, 25 bp, Mus musculus
tgcgaggcagacatgttgaggatac

SEQ ID NO: 870316 - DNA, 25 bp, Mus musculus
tgcgaggcagacttgttgaggatac

SEQ ID NO: 870317 - DNA, 25 bp, Mus musculus
tgcgaggcctgcaacatccggttta

SEQ ID NO: 870318 - DNA, 25 bp, Mus musculus
tgcgaggcctgctacatccggttta

SEQ ID NO: 870319 - DNA, 25 bp, Mus musculus
tgcgaggctgccaccggccagtgtc

SEQ ID NO: 870320 - DNA, 25 bp, Mus musculus
tgcgaggctgcctccggccagtgtc

SEQ ID NO: 870321 - DNA, 25 bp, Mus musculus
tgcgagggcaggaccatcggttcat

SEQ ID NO: 870322 - DNA, 25 bp, Mus musculus
tgcgagggcaggtccatcggttcat

SEQ ID NO: 870323 - DNA, 25 bp, Mus musculus
tgcgaggtccggcagtaacttttct

SEQ ID NO: 870324 - DNA, 25 bp, Mus musculus
tgcgaggtccgggagtaacttttct

SEQ ID NO: 870325 - DNA, 25 bp, Mus musculus
tgcgaggtctgcattgatcttcaca

SEQ ID NO: 870326 - DNA, 25 bp, Mus musculus
tgcgaggtctgctttgatcttcaca

SEQ ID NO: 870327 - DNA, 25 bp, Mus musculus
tgcgaggtgcctatctggacaagga

SEQ ID NO: 870328 - DNA, 25 bp, Mus musculus
tgcgaggtgcctttctggacaagga

SEQ ID NO: 870329 - DNA, 25 bp, Mus musculus
tgcgaggttataaacacgactggcc

SEQ ID NO: 870330 - DNA, 25 bp, Mus musculus
tgcgaggttatatacacgactggcc

SEQ ID NO: 870331 - DNA, 25 bp, Mus musculus
tgcgaggttttcctgcacgcggccc

SEQ ID NO: 870332 - DNA, 25 bp, Mus musculus
tgcgaggttttcgtgcacgcggccc

SEQ ID NO: 870333 - DNA, 25 bp, Mus musculus
tgcgagtccaccagttagctgagga

SEQ ID NO: 870334 - DNA, 25 bp, Mus musculus
tgcgagtccacctgttagctgagga

SEQ ID NO: 870335 - DNA, 25 bp, Mus musculus
tgcgagtctgggaaccgtgagctct

SEQ ID NO: 870336 - DNA, 25 bp, Mus musculus
tgcgagtctgggtaccgtgagctct

SEQ ID NO: 870337 - DNA, 25 bp, Mus musculus
tgcgagtgcgaaagtgctttccgac

SEQ ID NO: 870338 - DNA, 25 bp, Mus musculus
tgcgagtgcgaatgtgctttccgac

SEQ ID NO: 870339 - DNA, 25 bp, Mus musculus
tgcgagtggcaccatggtatttttt

SEQ ID NO: 870340 - DNA, 25 bp, Mus musculus
tgcgagtggcacgatggtatttttt

SEQ ID NO: 870341 - DNA, 25 bp, Mus musculus
tgcgagttccccatctagagaaccg

SEQ ID NO: 870342 - DNA, 25 bp, Mus musculus
tgcgagttccccttctagagaaccg

SEQ ID NO: 870343 - DNA, 25 bp, Mus musculus
tgcgagtttactcccttcttttaca

SEQ ID NO: 870344 - DNA, 25 bp, Mus musculus
tgcgagtttactgccttcttttaca

SEQ ID NO: 870345 - DNA, 25 bp, Mus musculus
tgcgataaaatcaagctttcagcta

SEQ ID NO: 870346 - DNA, 25 bp, Mus musculus
tgcgataaaatctagctttcagcta

SEQ ID NO: 870347 - DNA, 25 bp, Mus musculus
tgcgataacgatcgagcgctgcgtt

SEQ ID NO: 870348 - DNA, 25 bp, Mus musculus
tgcgataacgatggagcgctgcgtt

SEQ ID NO: 870349 - DNA, 25 bp, Mus musculus
tgcgatactgaacatgcaccgctat

SEQ ID NO: 870350 - DNA, 25 bp, Mus musculus
tgcgatactgaagatgcaccgctat

SEQ ID NO: 870351 - DNA, 25 bp, Mus musculus
tgcgatccacttacctatgcaatat

SEQ ID NO: 870352 - DNA, 25 bp, Mus musculus
tgcgatccactttcctatgcaatat

SEQ ID NO: 870353 - DNA, 25 bp, Mus musculus
tgcgatccaggtcttctcatttcca

SEQ ID NO: 870354 - DNA, 25 bp, Mus musculus
tgcgatccaggtgttctcatttcca

SEQ ID NO: 870355 - DNA, 25 bp, Mus musculus
tgcgatccattcacttaggtgctca

SEQ ID NO: 870356 - DNA, 25 bp, Mus musculus
tgcgatccattctcttaggtgctca

SEQ ID NO: 870357 - DNA, 25 bp, Mus musculus
tgcgatgatcgaagctacagctact

SEQ ID NO: 870358 - DNA, 25 bp, Mus musculus
tgcgatgatcgatgctacagctact

SEQ ID NO: 870359 - DNA, 25 bp, Mus musculus
tgcgatgccactcagatcctgggca

SEQ ID NO: 870360 - DNA, 25 bp, Mus musculus
tgcgatgccactgagatcctgggca

SEQ ID NO: 870361 - DNA, 25 bp, Mus musculus
tgcgatgccttcacatggaccatag

SEQ ID NO: 870362 - DNA, 25 bp, Mus musculus
tgcgatgccttctcatggaccatag

SEQ ID NO: 870363 - DNA, 25 bp, Mus musculus
tgcgatgccttgcagtagtttccca

SEQ ID NO: 870364 - DNA, 25 bp, Mus musculus
tgcgatgccttggagtagtttccca

SEQ ID NO: 870365 - DNA, 25 bp, Mus musculus
tgcgatggacacatctttccagatg

SEQ ID NO: 870366 - DNA, 25 bp, Mus musculus
tgcgatggacacttctttccagatg

SEQ ID NO: 870367 - DNA, 25 bp, Mus musculus
tgcgatgtaactaaccaccaaagag

SEQ ID NO: 870368 - DNA, 25 bp, Mus musculus
tgcgatgtaacttaccaccaaagag

SEQ ID NO: 870369 - DNA, 25 bp, Mus musculus
tgcgatgttaacaggagagcttgta

SEQ ID NO: 870370 - DNA, 25 bp, Mus musculus
tgcgatgttaactggagagcttgta

SEQ ID NO: 870371 - DNA, 25 bp, Mus musculus
tgcgatgtttctcttctgctgctaa

SEQ ID NO: 870372 - DNA, 25 bp, Mus musculus
tgcgatgtttctgttctgctgctaa

SEQ ID NO: 870373 - DNA, 25 bp, Mus musculus
tgcgattccagaagacattctccag

SEQ ID NO: 870374 - DNA, 25 bp, Mus musculus
tgcgattccagatgacattctccag

SEQ ID NO: 870375 - DNA, 25 bp, Mus musculus
tgcgattccatccaagggcttttga

SEQ ID NO: 870376 - DNA, 25 bp, Mus musculus
tgcgattccatcgaagggcttttga

SEQ ID NO: 870377 - DNA, 25 bp, Mus musculus
tgcgattcttccattacttccgtta

SEQ ID NO: 870378 - DNA, 25 bp, Mus musculus
tgcgattcttcctttacttccgtta

SEQ ID NO: 870379 - DNA, 25 bp, Mus musculus
tgcgattggcaaagccaggcaggct

SEQ ID NO: 870380 - DNA, 25 bp, Mus musculus
tgcgattggcaatgccaggcaggct

SEQ ID NO: 870381 - DNA, 25 bp, Mus musculus
tgcgcaaactctacggcggtccgag

SEQ ID NO: 870382 - DNA, 25 bp, Mus musculus
tgcgcaaactcttcggcggtccgag

SEQ ID NO: 870383 - DNA, 25 bp, Mus musculus
tgcgcaaaggctcgccgtcacagat

SEQ ID NO: 870384 - DNA, 25 bp, Mus musculus
tgcgcaaaggctggccgtcacagat

SEQ ID NO: 870385 - DNA, 25 bp, Mus musculus
tgcgcaacaactcctggaaggagaa

SEQ ID NO: 870386 - DNA, 25 bp, Mus musculus
tgcgcaacaactgctggaaggagaa

SEQ ID NO: 870387 - DNA, 25 bp, Mus musculus
tgcgcaatgggcaagcctcaggctc

SEQ ID NO: 870388 - DNA, 25 bp, Mus musculus
tgcgcaatgggctagcctcaggctc

SEQ ID NO: 870389 - DNA, 25 bp, Mus musculus
tgcgcacacaatctgacttcctgga

SEQ ID NO: 870390 - DNA, 25 bp, Mus musculus
tgcgcacacaatgtgacttcctgga

SEQ ID NO: 870391 - DNA, 25 bp, Mus musculus
tgcgcacagatccaccagaggcaaa

SEQ ID NO: 870392 - DNA, 25 bp, Mus musculus
tgcgcacagatcgaccagaggcaaa

SEQ ID NO: 870393 - DNA, 25 bp, Mus musculus
tgcgcacattcaaccgaaagccgaa

SEQ ID NO: 870394 - DNA, 25 bp, Mus musculus
tgcgcacattcatccgaaagccgaa

SEQ ID NO: 870395 - DNA, 25 bp, Mus musculus
tgcgcacattggaacttccacatac

SEQ ID NO: 870396 - DNA, 25 bp, Mus musculus
tgcgcacattggtacttccacatac

SEQ ID NO: 870397 - DNA, 25 bp, Mus musculus
tgcgcaccggcacaacagaacaagg

SEQ ID NO: 870398 - DNA, 25 bp, Mus musculus
tgcgcaccggcagaacagaacaagg

SEQ ID NO: 870399 - DNA, 25 bp, Mus musculus
tgcgcaccgtgcacaaggccaacaa

SEQ ID NO: 870400 - DNA, 25 bp, Mus musculus
tgcgcaccgtgctcaaggccaacaa

SEQ ID NO: 870401 - DNA, 25 bp, Mus musculus
tgcgcacgcctgaactggagcagct

SEQ ID NO: 870402 - DNA, 25 bp, Mus musculus
tgcgcacgcctgtactggagcagct

SEQ ID NO: 870403 - DNA, 25 bp, Mus musculus
tgcgcactaagtccttccaaattgt

SEQ ID NO: 870404 - DNA, 25 bp, Mus musculus
tgcgcactaagtgcttccaaattgt

SEQ ID NO: 870405 - DNA, 25 bp, Mus musculus
tgcgcactaccccaaacgctgaggg

SEQ ID NO: 870406 - DNA, 25 bp, Mus musculus
tgcgcactacccgaaacgctgaggg

SEQ ID NO: 870407 - DNA, 25 bp, Mus musculus
tgcgcactagatacatatttacaaa

SEQ ID NO: 870408 - DNA, 25 bp, Mus musculus
tgcgcactagattcatatttacaaa

SEQ ID NO: 870409 - DNA, 25 bp, Mus musculus
tgcgcactatgtctgagtccttgag

SEQ ID NO: 870410 - DNA, 25 bp, Mus musculus
tgcgcactatgtgtgagtccttgag

SEQ ID NO: 870411 - DNA, 25 bp, Mus musculus
tgcgcactattacctacagttcaac

SEQ ID NO: 870412 - DNA, 25 bp, Mus musculus
tgcgcactattagctacagttcaac

SEQ ID NO: 870413 - DNA, 25 bp, Mus musculus
tgcgcactcacacgatcttgctatc

SEQ ID NO: 870414 - DNA, 25 bp, Mus musculus
tgcgcactcacaggatcttgctatc

SEQ ID NO: 870415 - DNA, 25 bp, Mus musculus
tgcgcactctgccaaggcagcataa

SEQ ID NO: 870416 - DNA, 25 bp, Mus musculus
tgcgcactctgcgaaggcagcataa

SEQ ID NO: 870417 - DNA, 25 bp, Mus musculus
tgcgcagaaaacctaggccgaccga

SEQ ID NO: 870418 - DNA, 25 bp, Mus musculus
tgcgcagaaaacgtaggccgaccga

SEQ ID NO: 870419 - DNA, 25 bp, Mus musculus
tgcgcagaacctatgcagaagcaca

SEQ ID NO: 870420 - DNA, 25 bp, Mus musculus
tgcgcagaacctttgcagaagcaca

SEQ ID NO: 870421 - DNA, 25 bp, Mus musculus
tgcgcagacagcatccaattaccta

SEQ ID NO: 870422 - DNA, 25 bp, Mus musculus
tgcgcagacagcttccaattaccta

SEQ ID NO: 870423 - DNA, 25 bp, Mus musculus
tgcgcagaccgacttactgtgttcc

SEQ ID NO: 870424 - DNA, 25 bp, Mus musculus
tgcgcagaccgagttactgtgttcc

SEQ ID NO: 870425 - DNA, 25 bp, Mus musculus
tgcgcagacgctagaaacgatgtga

SEQ ID NO: 870426 - DNA, 25 bp, Mus musculus
tgcgcagacgcttgaaacgatgtga

SEQ ID NO: 870427 - DNA, 25 bp, Mus musculus
tgcgcagagctacagatgggaccaa

SEQ ID NO: 870428 - DNA, 25 bp, Mus musculus
tgcgcagagctagagatgggaccaa

SEQ ID NO: 870429 - DNA, 25 bp, Mus musculus
tgcgcagatgccagtgggtcgtccc

SEQ ID NO: 870430 - DNA, 25 bp, Mus musculus
tgcgcagatgcctgtgggtcgtccc

SEQ ID NO: 870431 - DNA, 25 bp, Mus musculus
tgcgcagcactgaggtaccctgaaa

SEQ ID NO: 870432 - DNA, 25 bp, Mus musculus
tgcgcagcactgtggtaccctgaaa

SEQ ID NO: 870433 - DNA, 25 bp, Mus musculus
tgcgcagcccaaaccggagtcctgg

SEQ ID NO: 870434 - DNA, 25 bp, Mus musculus
tgcgcagcccaatccggagtcctgg

SEQ ID NO: 870435 - DNA, 25 bp, Mus musculus
tgcgcagcccggcaatggagaaaat

SEQ ID NO: 870436 - DNA, 25 bp, Mus musculus
tgcgcagcccgggaatggagaaaat

SEQ ID NO: 870437 - DNA, 25 bp, Mus musculus
tgcgcagccgcaacagcaacctgaa

SEQ ID NO: 870438 - DNA, 25 bp, Mus musculus
tgcgcagccgcatcagcaacctgaa

SEQ ID NO: 870439 - DNA, 25 bp, Mus musculus
tgcgcagctcccagagtttatttat

SEQ ID NO: 870440 - DNA, 25 bp, Mus musculus
tgcgcagctccctgagtttatttat

SEQ ID NO: 870441 - DNA, 25 bp, Mus musculus
tgcgcagctcctagctttcccaaga

SEQ ID NO: 870442 - DNA, 25 bp, Mus musculus
tgcgcagctccttgctttcccaaga

SEQ ID NO: 870443 - DNA, 25 bp, Mus musculus
tgcgcaggacctattttgcgctgct

SEQ ID NO: 870444 - DNA, 25 bp, Mus musculus
tgcgcaggaccttttttgcgctgct

SEQ ID NO: 870445 - DNA, 25 bp, Mus musculus
tgcgcaggcagccactccgagtgct

SEQ ID NO: 870446 - DNA, 25 bp, Mus musculus
tgcgcaggcagcgactccgagtgct

SEQ ID NO: 870447 - DNA, 25 bp, Mus musculus
tgcgcaggcgctagccgaatttgga

SEQ ID NO: 870448 - DNA, 25 bp, Mus musculus
tgcgcaggcgcttgccgaatttgga

SEQ ID NO: 870449 - DNA, 25 bp, Mus musculus
tgcgcaggctgaaggacaagccaga

SEQ ID NO: 870450 - DNA, 25 bp, Mus musculus
tgcgcaggctgatggacaagccaga

SEQ ID NO: 870451 - DNA, 25 bp, Mus musculus
tgcgcagggacaagtctccaggccg

SEQ ID NO: 870452 - DNA, 25 bp, Mus musculus
tgcgcagggacatgtctccaggccg

SEQ ID NO: 870453 - DNA, 25 bp, Mus musculus
tgcgcagtccaactctttaatcttg

SEQ ID NO: 870454 - DNA, 25 bp, Mus musculus
tgcgcagtccaagtctttaatcttg

SEQ ID NO: 870455 - DNA, 25 bp, Mus musculus
tgcgcagtgcccaggtacagacgga

SEQ ID NO: 870456 - DNA, 25 bp, Mus musculus
tgcgcagtgcccatcacgcacgagg

SEQ ID NO: 870457 - DNA, 25 bp, Mus musculus
tgcgcagtgccctggtacagacgga

SEQ ID NO: 870458 - DNA, 25 bp, Mus musculus
tgcgcagtgcccttcacgcacgagg

SEQ ID NO: 870459 - DNA, 25 bp, Mus musculus
tgcgcagtgcttagtgcctggaata

SEQ ID NO: 870460 - DNA, 25 bp, Mus musculus
tgcgcagtgcttccgggtttcgaac

SEQ ID NO: 870461 - DNA, 25 bp, Mus musculus
tgcgcagtgcttgcgggtttcgaac

SEQ ID NO: 870462 - DNA, 25 bp, Mus musculus
tgcgcagtgctttgtgcctggaata

SEQ ID NO: 870463 - DNA, 25 bp, Mus musculus
tgcgcagtggacatacgtgcaattt

SEQ ID NO: 870464 - DNA, 25 bp, Mus musculus
tgcgcagtggacttacgtgcaattt

SEQ ID NO: 870465 - DNA, 25 bp, Mus musculus
tgcgcagtggcccaactcggtgtta

SEQ ID NO: 870466 - DNA, 25 bp, Mus musculus
tgcgcagtggccgaactcggtgtta

SEQ ID NO: 870467 - DNA, 25 bp, Mus musculus
tgcgcatcctaaccagtctgtaagc

SEQ ID NO: 870468 - DNA, 25 bp, Mus musculus
tgcgcatcctaagcagtctgtaagc

SEQ ID NO: 870469 - DNA, 25 bp, Mus musculus
tgcgcatcctttcacatctagtatc

SEQ ID NO: 870470 - DNA, 25 bp, Mus musculus
tgcgcatcctttgacatctagtatc

SEQ ID NO: 870471 - DNA, 25 bp, Mus musculus
tgcgcatcgagcagttccgaattcc

SEQ ID NO: 870472 - DNA, 25 bp, Mus musculus
tgcgcatcgagctgttccgaattcc

SEQ ID NO: 870473 - DNA, 25 bp, Mus musculus
tgcgcatcgtgacctggcacctgga

SEQ ID NO: 870474 - DNA, 25 bp, Mus musculus
tgcgcatcgtgagctggcacctgga

SEQ ID NO: 870475 - DNA, 25 bp, Mus musculus
tgcgcatctggaccccgagcttgag

SEQ ID NO: 870476 - DNA, 25 bp, Mus musculus
tgcgcatctggagcccgagcttgag

SEQ ID NO: 870477 - DNA, 25 bp, Mus musculus
tgcgcatgaagactcggctgcagac

SEQ ID NO: 870478 - DNA, 25 bp, Mus musculus
tgcgcatgaagagtcggctgcagac

SEQ ID NO: 870479 - DNA, 25 bp, Mus musculus
tgcgcatgacggacgcgcaggtcaa

SEQ ID NO: 870480 - DNA, 25 bp, Mus musculus
tgcgcatgacggtcgcgcaggtcaa

SEQ ID NO: 870481 - DNA, 25 bp, Mus musculus
tgcgcatgcgtgactggctcaaaaa

SEQ ID NO: 870482 - DNA, 25 bp, Mus musculus
tgcgcatgcgtgtctggctcaaaaa

SEQ ID NO: 870483 - DNA, 25 bp, Mus musculus
tgcgcatgggcaatactggagttgt

SEQ ID NO: 870484 - DNA, 25 bp, Mus musculus
tgcgcatgggcattactggagttgt

SEQ ID NO: 870485 - DNA, 25 bp, Mus musculus
tgcgcatggtgacagccgccacgct

SEQ ID NO: 870486 - DNA, 25 bp, Mus musculus
tgcgcatggtgagagccgccacgct

SEQ ID NO: 870487 - DNA, 25 bp, Mus musculus
tgcgcatggtggaacttacccgaat

SEQ ID NO: 870488 - DNA, 25 bp, Mus musculus
tgcgcatggtggtacttacccgaat

SEQ ID NO: 870489 - DNA, 25 bp, Mus musculus
tgcgcatgtgcaccttcagagcagg

SEQ ID NO: 870490 - DNA, 25 bp, Mus musculus
tgcgcatgtgcagcttcagagcagg

SEQ ID NO: 870491 - DNA, 25 bp, Mus musculus
tgcgcatgtgctcgctgctattgtg

SEQ ID NO: 870492 - DNA, 25 bp, Mus musculus
tgcgcatgtgctggctgctattgtg

SEQ ID NO: 870493 - DNA, 25 bp, Mus musculus
tgcgcattaacccagagcgcgctaa

SEQ ID NO: 870494 - DNA, 25 bp, Mus musculus
tgcgcattaaccgagagcgcgctaa

SEQ ID NO: 870495 - DNA, 25 bp, Mus musculus
tgcgcattataaactcagagcccat

SEQ ID NO: 870496 - DNA, 25 bp, Mus musculus
tgcgcattataatctcagagcccat

SEQ ID NO: 870497 - DNA, 25 bp, Mus musculus
tgcgcattggcgacttctcggtgct

SEQ ID NO: 870498 - DNA, 25 bp, Mus musculus
tgcgcattggcgtcttctcggtgct

SEQ ID NO: 870499 - DNA, 25 bp, Mus musculus
tgcgcattggctccgactggaagaa

SEQ ID NO: 870500 - DNA, 25 bp, Mus musculus
tgcgcattggctgcgactggaagaa

SEQ ID NO: 870501 - DNA, 25 bp, Mus musculus
tgcgcatttcgaatttgcttttcga

SEQ ID NO: 870502 - DNA, 25 bp, Mus musculus
tgcgcatttcgattttgcttttcga

SEQ ID NO: 870503 - DNA, 25 bp, Mus musculus
tgcgccaaacacactataccacaat

SEQ ID NO: 870504 - DNA, 25 bp, Mus musculus
tgcgccaaacactctataccacaat

SEQ ID NO: 870505 - DNA, 25 bp, Mus musculus
tgcgccaatagcactgcacttttgg

SEQ ID NO: 870506 - DNA, 25 bp, Mus musculus
tgcgccaatagctctgcacttttgg

SEQ ID NO: 870507 - DNA, 25 bp, Mus musculus
tgcgccacatcaaggtcctctggga

SEQ ID NO: 870508 - DNA, 25 bp, Mus musculus
tgcgccacatcatggtcctctggga

SEQ ID NO: 870509 - DNA, 25 bp, Mus musculus
tgcgccacgacacctggccactttt

SEQ ID NO: 870510 - DNA, 25 bp, Mus musculus
tgcgccacgacagctggccactttt

SEQ ID NO: 870511 - DNA, 25 bp, Mus musculus
tgcgccagaaaaatactcactccgt

SEQ ID NO: 870512 - DNA, 25 bp, Mus musculus
tgcgccagaaaattactcactccgt

SEQ ID NO: 870513 - DNA, 25 bp, Mus musculus
tgcgccagaaacctcctgtgggaga

SEQ ID NO: 870514 - DNA, 25 bp, Mus musculus
tgcgccagaaacgtcctgtgggaga

SEQ ID NO: 870515 - DNA, 25 bp, Mus musculus
tgcgccaggcatagctgacctaatt

SEQ ID NO: 870516 - DNA, 25 bp, Mus musculus
tgcgccaggcatcgtcttcaggatt

SEQ ID NO: 870517 - DNA, 25 bp, Mus musculus
tgcgccaggcatggtcttcaggatt

SEQ ID NO: 870518 - DNA, 25 bp, Mus musculus
tgcgccaggcattgctgacctaatt

SEQ ID NO: 870519 - DNA, 25 bp, Mus musculus
tgcgccaggccaagcaggagtcaaa

SEQ ID NO: 870520 - DNA, 25 bp, Mus musculus
tgcgccaggccatgcaggagtcaaa

SEQ ID NO: 870521 - DNA, 25 bp, Mus musculus
tgcgccaggcccaaaattataccag

SEQ ID NO: 870522 - DNA, 25 bp, Mus musculus
tgcgccaggcccagcagaacgtcga

SEQ ID NO: 870523 - DNA, 25 bp, Mus musculus
tgcgccaggccctaaattataccag

SEQ ID NO: 870524 - DNA, 25 bp, Mus musculus
tgcgccaggccctgcagaacgtcga

SEQ ID NO: 870525 - DNA, 25 bp, Mus musculus
tgcgccagggacaggacattcttca

SEQ ID NO: 870526 - DNA, 25 bp, Mus musculus
tgcgccagggactggacattcttca

SEQ ID NO: 870527 - DNA, 25 bp, Mus musculus
tgcgccagtcccaaagagctgcagg

SEQ ID NO: 870528 - DNA, 25 bp, Mus musculus
tgcgccagtccctaagagctgcagg

SEQ ID NO: 870529 - DNA, 25 bp, Mus musculus
tgcgccatgggcacctcagcgatgg

SEQ ID NO: 870530 - DNA, 25 bp, Mus musculus
tgcgccatgggctcctcagcgatgg

SEQ ID NO: 870531 - DNA, 25 bp, Mus musculus
tgcgccatgtctctactgtagcagg

SEQ ID NO: 870532 - DNA, 25 bp, Mus musculus
tgcgccatgtctgtactgtagcagg

SEQ ID NO: 870533 - DNA, 25 bp, Mus musculus
tgcgcccactttccggttgaaggtg

SEQ ID NO: 870534 - DNA, 25 bp, Mus musculus
tgcgcccactttgcggttgaaggtg

SEQ ID NO: 870535 - DNA, 25 bp, Mus musculus
tgcgcccagcaactggccagtgact

SEQ ID NO: 870536 - DNA, 25 bp, Mus musculus
tgcgcccagcaagtggccagtgact

SEQ ID NO: 870537 - DNA, 25 bp, Mus musculus
tgcgcccagggtcagcgtcacgtct

SEQ ID NO: 870538 - DNA, 25 bp, Mus musculus
tgcgcccagggtgagcgtcacgtct

SEQ ID NO: 870539 - DNA, 25 bp, Mus musculus
tgcgcccagtctacaaacactaagt

SEQ ID NO: 870540 - DNA, 25 bp, Mus musculus
tgcgcccagtcttcaaacactaagt

SEQ ID NO: 870541 - DNA, 25 bp, Mus musculus
tgcgccccagctctggatctgaatt

SEQ ID NO: 870542 - DNA, 25 bp, Mus musculus
tgcgccccagctgtggatctgaatt

SEQ ID NO: 870543 - DNA, 25 bp, Mus musculus
tgcgccccaggtacctagagataag

SEQ ID NO: 870544 - DNA, 25 bp, Mus musculus
tgcgccccaggttcctagagataag

SEQ ID NO: 870545 - DNA, 25 bp, Mus musculus
tgcgcccctacaaggtgtcagatat

SEQ ID NO: 870546 - DNA, 25 bp, Mus musculus
tgcgcccctacatggtgtcagatat

SEQ ID NO: 870547 - DNA, 25 bp, Mus musculus
tgcgcccgagacactttggcctgga

SEQ ID NO: 870548 - DNA, 25 bp, Mus musculus
tgcgcccgagactctttggcctgga

SEQ ID NO: 870549 - DNA, 25 bp, Mus musculus
tgcgccctgctgaactttgtggatg

SEQ ID NO: 870550 - DNA, 25 bp, Mus musculus
tgcgccctgctgtactttgtggatg

SEQ ID NO: 870551 - DNA, 25 bp, Mus musculus
tgcgccctgcttaaaaaatacccga

SEQ ID NO: 870552 - DNA, 25 bp, Mus musculus
tgcgccctgctttaaaaatacccga

SEQ ID NO: 870553 - DNA, 25 bp, Mus musculus
tgcgccctggttacagcaagctgac

SEQ ID NO: 870554 - DNA, 25 bp, Mus musculus
tgcgccctggtttcagcaagctgac

SEQ ID NO: 870555 - DNA, 25 bp, Mus musculus
tgcgccgagttcctgcggaccaaaa

SEQ ID NO: 870556 - DNA, 25 bp, Mus musculus
tgcgccgagttcgtgcggaccaaaa

SEQ ID NO: 870557 - DNA, 25 bp, Mus musculus
tgcgccgccttgaagaaactcaact

SEQ ID NO: 870558 - DNA, 25 bp, Mus musculus
tgcgccgccttgtagaaactcaact

SEQ ID NO: 870559 - DNA, 25 bp, Mus musculus
tgcgccggctccagcaaatgcaaag

SEQ ID NO: 870560 - DNA, 25 bp, Mus musculus
tgcgccggctcctgcaaatgcaaag

SEQ ID NO: 870561 - DNA, 25 bp, Mus musculus
tgcgccgggctgactttagaagcaa

SEQ ID NO: 870562 - DNA, 25 bp, Mus musculus
tgcgccgggctgtctttagaagcaa

SEQ ID NO: 870563 - DNA, 25 bp, Mus musculus
tgcgccgtgcctctgaaagcgtgtc

SEQ ID NO: 870564 - DNA, 25 bp, Mus musculus
tgcgccgtgcctgtgaaagcgtgtc

SEQ ID NO: 870565 - DNA, 25 bp, Mus musculus
tgcgccgtttcaagcaagccgaggg

SEQ ID NO: 870566 - DNA, 25 bp, Mus musculus
tgcgccgtttcatgcaagccgaggg

SEQ ID NO: 870567 - DNA, 25 bp, Mus musculus
tgcgcctaaattagcctctgcctgt

SEQ ID NO: 870568 - DNA, 25 bp, Mus musculus
tgcgcctaaatttgcctctgcctgt

SEQ ID NO: 870569 - DNA, 25 bp, Mus musculus
tgcgcctaactgcactatagccagt

SEQ ID NO: 870570 - DNA, 25 bp, Mus musculus
tgcgcctaactggactatagccagt

SEQ ID NO: 870571 - DNA, 25 bp, Mus musculus
tgcgcctagccaagcaactggaaga

SEQ ID NO: 870572 - DNA, 25 bp, Mus musculus
tgcgcctagccatgcaactggaaga

SEQ ID NO: 870573 - DNA, 25 bp, Mus musculus
tgcgcctagcgcagagatgtctcat

SEQ ID NO: 870574 - DNA, 25 bp, Mus musculus
tgcgcctagcgctgagatgtctcat

SEQ ID NO: 870575 - DNA, 25 bp, Mus musculus
tgcgcctagtggcatcaggcaccga

SEQ ID NO: 870576 - DNA, 25 bp, Mus musculus
tgcgcctagtgggatcaggcaccga

SEQ ID NO: 870577 - DNA, 25 bp, Mus musculus
tgcgcctatagcacccatgtgcccg

SEQ ID NO: 870578 - DNA, 25 bp, Mus musculus
tgcgcctatagcagccatgtggccc

SEQ ID NO: 870579 - DNA, 25 bp, Mus musculus
tgcgcctatagctcccatgtgcccg

SEQ ID NO: 870580 - DNA, 25 bp, Mus musculus
tgcgcctatagctgccatgtggccc

SEQ ID NO: 870581 - DNA, 25 bp, Mus musculus
tgcgcctcatctcagggcacagggt

SEQ ID NO: 870582 - DNA, 25 bp, Mus musculus
tgcgcctcatctgagggcacagggt

SEQ ID NO: 870583 - DNA, 25 bp, Mus musculus
tgcgcctcattaccgatactatgta

SEQ ID NO: 870584 - DNA, 25 bp, Mus musculus
tgcgcctcattagcgatactatgta

SEQ ID NO: 870585 - DNA, 25 bp, Mus musculus
tgcgcctccgagcaaacacttggtc

SEQ ID NO: 870586 - DNA, 25 bp, Mus musculus
tgcgcctccgaggaaacacttggtc

SEQ ID NO: 870587 - DNA, 25 bp, Mus musculus
tgcgcctcctagaggacttgagcaa

SEQ ID NO: 870588 - DNA, 25 bp, Mus musculus
tgcgcctcctagtggacttgagcaa

SEQ ID NO: 870589 - DNA, 25 bp, Mus musculus
tgcgcctctctcacaaggaataaat

SEQ ID NO: 870590 - DNA, 25 bp, Mus musculus
tgcgcctctctctcaaggaataaat

SEQ ID NO: 870591 - DNA, 25 bp, Mus musculus
tgcgcctctgggacgtacgtggtct

SEQ ID NO: 870592 - DNA, 25 bp, Mus musculus
tgcgcctctgggtcgtacgtggtct

SEQ ID NO: 870593 - DNA, 25 bp, Mus musculus
tgcgcctcttgaagcttaaccctaa

SEQ ID NO: 870594 - DNA, 25 bp, Mus musculus
tgcgcctcttgatgcttaaccctaa

SEQ ID NO: 870595 - DNA, 25 bp, Mus musculus
tgcgcctgacaacctttgagatgta

SEQ ID NO: 870596 - DNA, 25 bp, Mus musculus
tgcgcctgacaagctttgagatgta

SEQ ID NO: 870597 - DNA, 25 bp, Mus musculus
tgcgcctgcgcaacatatacgtcat

SEQ ID NO: 870598 - DNA, 25 bp, Mus musculus
tgcgcctgcgcatcatatacgtcat

SEQ ID NO: 870599 - DNA, 25 bp, Mus musculus
tgcgcctgggcaaagttgccatcga

SEQ ID NO: 870600 - DNA, 25 bp, Mus musculus
tgcgcctgggcatagttgccatcga

SEQ ID NO: 870601 - DNA, 25 bp, Mus musculus
tgcgcctgtgcgaatgtactaacat

SEQ ID NO: 870602 - DNA, 25 bp, Mus musculus
tgcgcctgtgcgtatgtactaacat

SEQ ID NO: 870603 - DNA, 25 bp, Mus musculus
tgcgccttgaagagatgtcctggaa

SEQ ID NO: 870604 - DNA, 25 bp, Mus musculus
tgcgccttgaagtgatgtcctggaa

SEQ ID NO: 870605 - DNA, 25 bp, Mus musculus
tgcgccttttgacggtgaagatctt

SEQ ID NO: 870606 - DNA, 25 bp, Mus musculus
tgcgccttttgagggtgaagatctt

SEQ ID NO: 870607 - DNA, 25 bp, Mus musculus
tgcgcgaccagcactagaccctgaa

SEQ ID NO: 870608 - DNA, 25 bp, Mus musculus
tgcgcgaccagctctagaccctgaa

SEQ ID NO: 870609 - DNA, 25 bp, Mus musculus
tgcgcgactcttcagaatgttctcc

SEQ ID NO: 870610 - DNA, 25 bp, Mus musculus
tgcgcgactcttgagaatgttctcc

SEQ ID NO: 870611 - DNA, 25 bp, Mus musculus
tgcgcgaggcgcaacagaacgactg

SEQ ID NO: 870612 - DNA, 25 bp, Mus musculus
tgcgcgaggcgctacagaacgactg

SEQ ID NO: 870613 - DNA, 25 bp, Mus musculus
tgcgcgatacttaaggttgtttgga

SEQ ID NO: 870614 - DNA, 25 bp, Mus musculus
tgcgcgatactttaggttgtttgga

SEQ ID NO: 870615 - DNA, 25 bp, Mus musculus
tgcgcgcatatgagcccgtccttaa

SEQ ID NO: 870616 - DNA, 25 bp, Mus musculus
tgcgcgcatatgtgcccgtccttaa

SEQ ID NO: 870617 - DNA, 25 bp, Mus musculus
tgcgcgcgtagtatgctttcttgta

SEQ ID NO: 870618 - DNA, 25 bp, Mus musculus
tgcgcgcgtagtttgctttcttgta

SEQ ID NO: 870619 - DNA, 25 bp, Mus musculus
tgcgcgctcccgatgctagtaggag

SEQ ID NO: 870620 - DNA, 25 bp, Mus musculus
tgcgcgctcccgttgctagtaggag

SEQ ID NO: 870621 - DNA, 25 bp, Mus musculus
tgcgcggagactctccagtcctcat

SEQ ID NO: 870622 - DNA, 25 bp, Mus musculus
tgcgcggagactgtccagtcctcat

SEQ ID NO: 870623 - DNA, 25 bp, Mus musculus
tgcgcggcctttacacgtgtcccag

SEQ ID NO: 870624 - DNA, 25 bp, Mus musculus
tgcgcggccttttcacgtgtcccag

SEQ ID NO: 870625 - DNA, 25 bp, Mus musculus
tgcgcggcgcctctctatcaagggc

SEQ ID NO: 870626 - DNA, 25 bp, Mus musculus
tgcgcggcgcctgtctatcaagggc

SEQ ID NO: 870627 - DNA, 25 bp, Mus musculus
tgcgcggtaccaatttgaggacgtt

SEQ ID NO: 870628 - DNA, 25 bp, Mus musculus
tgcgcggtaccattttgaggacgtt

SEQ ID NO: 870629 - DNA, 25 bp, Mus musculus
tgcgcggtgaaaccgaagccccgac

SEQ ID NO: 870630 - DNA, 25 bp, Mus musculus
tgcgcggtgaaagcgaagccccgac

SEQ ID NO: 870631 - DNA, 25 bp, Mus musculus
tgcgcgtaaacgactgcaaatcccg

SEQ ID NO: 870632 - DNA, 25 bp, Mus musculus
tgcgcgtaaacgtctgcaaatcccg

SEQ ID NO: 870633 - DNA, 25 bp, Mus musculus
tgcgcgtacggcactgtgacctcct

SEQ ID NO: 870634 - DNA, 25 bp, Mus musculus
tgcgcgtacggctctgtgacctcct

SEQ ID NO: 870635 - DNA, 25 bp, Mus musculus
tgcgcgtactacagtactaacttcc

SEQ ID NO: 870636 - DNA, 25 bp, Mus musculus
tgcgcgtactactgtactaacttcc

SEQ ID NO: 870637 - DNA, 25 bp, Mus musculus
tgcgcgtcatctcggaataccagaa

SEQ ID NO: 870638 - DNA, 25 bp, Mus musculus
tgcgcgtcatctgggaataccagaa

SEQ ID NO: 870639 - DNA, 25 bp, Mus musculus
tgcgcgtctatcccaggagtgctga

SEQ ID NO: 870640 - DNA, 25 bp, Mus musculus
tgcgcgtctatcgcaggagtgctga

SEQ ID NO: 870641 - DNA, 25 bp, Mus musculus
tgcgcgtgcataagtgtgctgtatg

SEQ ID NO: 870642 - DNA, 25 bp, Mus musculus
tgcgcgtgcatatgtgtgctgtatg

SEQ ID NO: 870643 - DNA, 25 bp, Mus musculus
tgcgcgtggcagataccgaatcagc

SEQ ID NO: 870644 - DNA, 25 bp, Mus musculus
tgcgcgtggcagttaccgaatcagc

SEQ ID NO: 870645 - DNA, 25 bp, Mus musculus
tgcgcgttctttacactggtttatc

SEQ ID NO: 870646 - DNA, 25 bp, Mus musculus
tgcgcgttcttttcactggtttatc

SEQ ID NO: 870647 - DNA, 25 bp, Mus musculus
tgcgctaactggactgtagggcaca

SEQ ID NO: 870648 - DNA, 25 bp, Mus musculus
tgcgctaactggtctgtagggcaca

SEQ ID NO: 870649 - DNA, 25 bp, Mus musculus
tgcgctaatttgctttagctggtgt

SEQ ID NO: 870650 - DNA, 25 bp, Mus musculus
tgcgctaatttggtttagctggtgt

SEQ ID NO: 870651 - DNA, 25 bp, Mus musculus
tgcgctacgcggaggatactgtgct

SEQ ID NO: 870652 - DNA, 25 bp, Mus musculus
tgcgctacgcggtggatactgtgct

SEQ ID NO: 870653 - DNA, 25 bp, Mus musculus
tgcgctacggtgactatgtcatcaa

SEQ ID NO: 870654 - DNA, 25 bp, Mus musculus
tgcgctacggtgtctatgtcatcaa

SEQ ID NO: 870655 - DNA, 25 bp, Mus musculus
tgcgctaggcttagatacccagcta

SEQ ID NO: 870656 - DNA, 25 bp, Mus musculus
tgcgctaggctttgatacccagcta

SEQ ID NO: 870657 - DNA, 25 bp, Mus musculus
tgcgctagtctgactaagggagctt

SEQ ID NO: 870658 - DNA, 25 bp, Mus musculus
tgcgctagtctgtctaagggagctt

SEQ ID NO: 870659 - DNA, 25 bp, Mus musculus
tgcgctcagggtagagcccaggatt

SEQ ID NO: 870660 - DNA, 25 bp, Mus musculus
tgcgctcagggttgagcccaggatt

SEQ ID NO: 870661 - DNA, 25 bp, Mus musculus
tgcgctcagtgaccaagcaggccat

SEQ ID NO: 870662 - DNA, 25 bp, Mus musculus
tgcgctcagtgagcaagcaggccat

SEQ ID NO: 870663 - DNA, 25 bp, Mus musculus
tgcgctcatgccaggttttttattt

SEQ ID NO: 870664 - DNA, 25 bp, Mus musculus
tgcgctcatgcctggttttttattt

SEQ ID NO: 870665 - DNA, 25 bp, Mus musculus
tgcgctccaggacgctatggcgaaa

SEQ ID NO: 870666 - DNA, 25 bp, Mus musculus
tgcgctccaggaggctatggcgaaa

SEQ ID NO: 870667 - DNA, 25 bp, Mus musculus
tgcgctccatacacaggtccaagaa

SEQ ID NO: 870668 - DNA, 25 bp, Mus musculus
tgcgctccatactcaggtccaagaa

SEQ ID NO: 870669 - DNA, 25 bp, Mus musculus
tgcgctcccggtatgcagtaaggaa

SEQ ID NO: 870670 - DNA, 25 bp, Mus musculus
tgcgctcccggtcgaacgtaaagtt

SEQ ID NO: 870671 - DNA, 25 bp, Mus musculus
tgcgctcccggtggaacgtaaagtt

SEQ ID NO: 870672 - DNA, 25 bp, Mus musculus
tgcgctcccggtttgcagtaaggaa

SEQ ID NO: 870673 - DNA, 25 bp, Mus musculus
tgcgctccggcacaatttacatgaa

SEQ ID NO: 870674 - DNA, 25 bp, Mus musculus
tgcgctccggcagaatttacatgaa

SEQ ID NO: 870675 - DNA, 25 bp, Mus musculus
tgcgctccgttcagtccactgttgt

SEQ ID NO: 870676 - DNA, 25 bp, Mus musculus
tgcgctccgttctgtccactgttgt

SEQ ID NO: 870677 - DNA, 25 bp, Mus musculus
tgcgctcgctggatgatttaacgtt

SEQ ID NO: 870678 - DNA, 25 bp, Mus musculus
tgcgctcgctggttgatttaacgtt

SEQ ID NO: 870679 - DNA, 25 bp, Mus musculus
tgcgctcggaacacaagaccaagga

SEQ ID NO: 870680 - DNA, 25 bp, Mus musculus
tgcgctcggaactcaagaccaagga

SEQ ID NO: 870681 - DNA, 25 bp, Mus musculus
tgcgctcggacaacagccgtgttga

SEQ ID NO: 870682 - DNA, 25 bp, Mus musculus
tgcgctcggacatcagccgtgttga

SEQ ID NO: 870683 - DNA, 25 bp, Mus musculus
tgcgctctatgtccgaatgctagct

SEQ ID NO: 870684 - DNA, 25 bp, Mus musculus
tgcgctctatgtgcgaatgctagct

SEQ ID NO: 870685 - DNA, 25 bp, Mus musculus
tgcgctctcgcgcatgttagaagag

SEQ ID NO: 870686 - DNA, 25 bp, Mus musculus
tgcgctctcgcggatgttagaagag

SEQ ID NO: 870687 - DNA, 25 bp, Mus musculus
tgcgctctggatctgtttagccgac

SEQ ID NO: 870688 - DNA, 25 bp, Mus musculus
tgcgctctggatgtgtttagccgac

SEQ ID NO: 870689 - DNA, 25 bp, Mus musculus
tgcgctcttaccaaaggagccatgt

SEQ ID NO: 870690 - DNA, 25 bp, Mus musculus
tgcgctcttacctaaggagccatgt

SEQ ID NO: 870691 - DNA, 25 bp, Mus musculus
tgcgctcttgtcctttacaggtgta

SEQ ID NO: 870692 - DNA, 25 bp, Mus musculus
tgcgctcttgtcgtttacaggtgta

SEQ ID NO: 870693 - DNA, 25 bp, Mus musculus
tgcgctctttcacttgtatgttttg

SEQ ID NO: 870694 - DNA, 25 bp, Mus musculus
tgcgctctttcagttgtatgttttg

SEQ ID NO: 870695 - DNA, 25 bp, Mus musculus
tgcgctgaaggaagaccacatcctg

SEQ ID NO: 870696 - DNA, 25 bp, Mus musculus
tgcgctgaaggatgaccacatcctg

SEQ ID NO: 870697 - DNA, 25 bp, Mus musculus
tgcgctgagatgaaccccaaggata

SEQ ID NO: 870698 - DNA, 25 bp, Mus musculus
tgcgctgagatgtaccccaaggata

SEQ ID NO: 870699 - DNA, 25 bp, Mus musculus
tgcgctgagcacatgaacctaacta

SEQ ID NO: 870700 - DNA, 25 bp, Mus musculus
tgcgctgagcacttgaacctaacta

SEQ ID NO: 870701 - DNA, 25 bp, Mus musculus
tgcgctgccatccagtgcaattgct

SEQ ID NO: 870702 - DNA, 25 bp, Mus musculus
tgcgctgccatcgagtgcaattgct

SEQ ID NO: 870703 - DNA, 25 bp, Mus musculus
tgcgctgcttcacctgcgggaagat

SEQ ID NO: 870704 - DNA, 25 bp, Mus musculus
tgcgctgcttcagctgcgggaagat

SEQ ID NO: 870705 - DNA, 25 bp, Mus musculus
tgcgctggccagctatacgtgattg

SEQ ID NO: 870706 - DNA, 25 bp, Mus musculus
tgcgctggccaggtatacgtgattg

SEQ ID NO: 870707 - DNA, 25 bp, Mus musculus
tgcgctggcgccagcaaatgcaaac

SEQ ID NO: 870708 - DNA, 25 bp, Mus musculus
tgcgctggcgcctgcaaatgcaaac

SEQ ID NO: 870709 - DNA, 25 bp, Mus musculus
tgcgctggtttcagtgaagggaata

SEQ ID NO: 870710 - DNA, 25 bp, Mus musculus
tgcgctggtttctgtgaagggaata

SEQ ID NO: 870711 - DNA, 25 bp, Mus musculus
tgcgctgtagcaagatcctgtttca

SEQ ID NO: 870712 - DNA, 25 bp, Mus musculus
tgcgctgtagcatgatcctgtttca

SEQ ID NO: 870713 - DNA, 25 bp, Mus musculus
tgcgctgtattcatcacagcaacag

SEQ ID NO: 870714 - DNA, 25 bp, Mus musculus
tgcgctgtattcttcacagcaacag

SEQ ID NO: 870715 - DNA, 25 bp, Mus musculus
tgcgctgtcaatactgtctcggttt

SEQ ID NO: 870716 - DNA, 25 bp, Mus musculus
tgcgctgtcaattctgtctcggttt

SEQ ID NO: 870717 - DNA, 25 bp, Mus musculus
tgcgctgtgccaacttgttaaagtg

SEQ ID NO: 870718 - DNA, 25 bp, Mus musculus
tgcgctgtgccatcttgttaaagtg

SEQ ID NO: 870719 - DNA, 25 bp, Mus musculus
tgcgctgtgcctagcttgtcctcgg

SEQ ID NO: 870720 - DNA, 25 bp, Mus musculus
tgcgctgtgccttgcttgtcctcgg

SEQ ID NO: 870721 - DNA, 25 bp, Mus musculus
tgcgctgtggttctgggtctctcaa

SEQ ID NO: 870722 - DNA, 25 bp, Mus musculus
tgcgctgtggttgtgggtctctcaa

SEQ ID NO: 870723 - DNA, 25 bp, Mus musculus
tgcgctgttctccagactgtgcaat

SEQ ID NO: 870724 - DNA, 25 bp, Mus musculus
tgcgctgttctcgagactgtgcaat

SEQ ID NO: 870725 - DNA, 25 bp, Mus musculus
tgcgcttacaggcaacaagaccatg

SEQ ID NO: 870726 - DNA, 25 bp, Mus musculus
tgcgcttacagggaacaagaccatg

SEQ ID NO: 870727 - DNA, 25 bp, Mus musculus
tgcgcttatccgccctctgcgtgga

SEQ ID NO: 870728 - DNA, 25 bp, Mus musculus
tgcgcttatccggcctctgcgtgga

SEQ ID NO: 870729 - DNA, 25 bp, Mus musculus
tgcgcttcaaaacgtttgctgaaga

SEQ ID NO: 870730 - DNA, 25 bp, Mus musculus
tgcgcttcaaaaggtttgctgaaga

SEQ ID NO: 870731 - DNA, 25 bp, Mus musculus
tgcgcttccagcactatatggtggg

SEQ ID NO: 870732 - DNA, 25 bp, Mus musculus
tgcgcttccagctctatatggtggg

SEQ ID NO: 870733 - DNA, 25 bp, Mus musculus
tgcgcttcctacagggactttgagt

SEQ ID NO: 870734 - DNA, 25 bp, Mus musculus
tgcgcttcctactgggactttgagt

SEQ ID NO: 870735 - DNA, 25 bp, Mus musculus
tgcgcttcctcaaggctccggagcg

SEQ ID NO: 870736 - DNA, 25 bp, Mus musculus
tgcgcttcctcatggctccggagcg

SEQ ID NO: 870737 - DNA, 25 bp, Mus musculus
tgcgcttcctttccttgtttactgg

SEQ ID NO: 870738 - DNA, 25 bp, Mus musculus
tgcgcttcctttgcttgtttactgg

SEQ ID NO: 870739 - DNA, 25 bp, Mus musculus
tgcgcttctttgagcagcatctaca

SEQ ID NO: 870740 - DNA, 25 bp, Mus musculus
tgcgcttctttgtgcagcatctaca

SEQ ID NO: 870741 - DNA, 25 bp, Mus musculus
tgcgcttgcaacaggcacctggagg

SEQ ID NO: 870742 - DNA, 25 bp, Mus musculus
tgcgcttgcaactggcacctggagg

SEQ ID NO: 870743 - DNA, 25 bp, Mus musculus
tgcgcttgcactagagctgcaacca

SEQ ID NO: 870744 - DNA, 25 bp, Mus musculus
tgcgcttgcacttgagctgcaacca

SEQ ID NO: 870745 - DNA, 25 bp, Mus musculus
tgcgctttccatactgttggttaat

SEQ ID NO: 870746 - DNA, 25 bp, Mus musculus
tgcgctttccattctgttggttaat

SEQ ID NO: 870747 - DNA, 25 bp, Mus musculus
tgcgctttctacatatttgaatgtt

SEQ ID NO: 870748 - DNA, 25 bp, Mus musculus
tgcgctttctacttatttgaatgtt

SEQ ID NO: 870749 - DNA, 25 bp, Mus musculus
tgcgctttgagaagcagccatctga

SEQ ID NO: 870750 - DNA, 25 bp, Mus musculus
tgcgctttgagatgcagccatctga

SEQ ID NO: 870751 - DNA, 25 bp, Mus musculus
tgcggaaaccgacacatagacgaag

SEQ ID NO: 870752 - DNA, 25 bp, Mus musculus
tgcggaaaccgagacatagacgaag

SEQ ID NO: 870753 - DNA, 25 bp, Mus musculus
tgcggaaacctgacggctccacggt

SEQ ID NO: 870754 - DNA, 25 bp, Mus musculus
tgcggaaacctgtcggctccacggt

SEQ ID NO: 870755 - DNA, 25 bp, Mus musculus
tgcggaaacgctaccatcatcctga

SEQ ID NO: 870756 - DNA, 25 bp, Mus musculus
tgcggaaacgcttccatcatcctga

SEQ ID NO: 870757 - DNA, 25 bp, Mus musculus
tgcggaaactacatcccagggtatc

SEQ ID NO: 870758 - DNA, 25 bp, Mus musculus
tgcggaaactacttcccagggtatc

SEQ ID NO: 870759 - DNA, 25 bp, Mus musculus
tgcggaaagaaaccagaagacctgt

SEQ ID NO: 870760 - DNA, 25 bp, Mus musculus
tgcggaaagaaagcagaagacctgt

SEQ ID NO: 870761 - DNA, 25 bp, Mus musculus
tgcggaaagctcaatttgaccacct

SEQ ID NO: 870762 - DNA, 25 bp, Mus musculus
tgcggaaagctctatttgaccacct

SEQ ID NO: 870763 - DNA, 25 bp, Mus musculus
tgcggaaatcgcctgtttggccctt

SEQ ID NO: 870764 - DNA, 25 bp, Mus musculus
tgcggaaatcgcgtgtttggccctt

SEQ ID NO: 870765 - DNA, 25 bp, Mus musculus
tgcggaaatgtgactgccttgggat

SEQ ID NO: 870766 - DNA, 25 bp, Mus musculus
tgcggaaatgtgtctgccttgggat

SEQ ID NO: 870767 - DNA, 25 bp, Mus musculus
tgcggaacccacagagcactgagtg

SEQ ID NO: 870768 - DNA, 25 bp, Mus musculus
tgcggaacccactgagcactgagtg

SEQ ID NO: 870769 - DNA, 25 bp, Mus musculus
tgcggaaccgtcatccaaatgcatc

SEQ ID NO: 870770 - DNA, 25 bp, Mus musculus
tgcggaaccgtcttccaaatgcatc

SEQ ID NO: 870771 - DNA, 25 bp, Mus musculus
tgcggaacggctattggccagaaaa

SEQ ID NO: 870772 - DNA, 25 bp, Mus musculus
tgcggaacggcttttggccagaaaa

SEQ ID NO: 870773 - DNA, 25 bp, Mus musculus
tgcggaactgcgacgagccctgaga

SEQ ID NO: 870774 - DNA, 25 bp, Mus musculus
tgcggaactgcgtcgagccctgaga

SEQ ID NO: 870775 - DNA, 25 bp, Mus musculus
tgcggaagactgacatgcgggtcat

SEQ ID NO: 870776 - DNA, 25 bp, Mus musculus
tgcggaagactgtcatgcgggtcat

SEQ ID NO: 870777 - DNA, 25 bp, Mus musculus
tgcggaagatgcaagaaggtccctt

SEQ ID NO: 870778 - DNA, 25 bp, Mus musculus
tgcggaagatgctagaaggtccctt

SEQ ID NO: 870779 - DNA, 25 bp, Mus musculus
tgcggaatgccacccctgaagaaat

SEQ ID NO: 870780 - DNA, 25 bp, Mus musculus
tgcggaatgccagccctgaagaaat

SEQ ID NO: 870781 - DNA, 25 bp, Mus musculus
tgcggaatggctagttggccactga

SEQ ID NO: 870782 - DNA, 25 bp, Mus musculus
tgcggaatggcttgttggccactga

SEQ ID NO: 870783 - DNA, 25 bp, Mus musculus
tgcggacagtggatcagcacagact

SEQ ID NO: 870784 - DNA, 25 bp, Mus musculus
tgcggacagtggttcagcacagact

SEQ ID NO: 870785 - DNA, 25 bp, Mus musculus
tgcggacataaaagtgttcccggtg

SEQ ID NO: 870786 - DNA, 25 bp, Mus musculus
tgcggacataaatgtgttcccggtg

SEQ ID NO: 870787 - DNA, 25 bp, Mus musculus
tgcggacatgttcacttctcctgac

SEQ ID NO: 870788 - DNA, 25 bp, Mus musculus
tgcggacatgttgacttctcctgac

SEQ ID NO: 870789 - DNA, 25 bp, Mus musculus
tgcggacccacgaagtttctcatgt

SEQ ID NO: 870790 - DNA, 25 bp, Mus musculus
tgcggacccacgtagtttctcatgt

SEQ ID NO: 870791 - DNA, 25 bp, Mus musculus
tgcggacccatcatagctgaccaac

SEQ ID NO: 870792 - DNA, 25 bp, Mus musculus
tgcggacccatcttagctgaccaac

SEQ ID NO: 870793 - DNA, 25 bp, Mus musculus
tgcggaccgatcaccgttttcagaa

SEQ ID NO: 870794 - DNA, 25 bp, Mus musculus
tgcggaccgatctccgttttcagaa

SEQ ID NO: 870795 - DNA, 25 bp, Mus musculus
tgcggactccctagcatacatcatt

SEQ ID NO: 870796 - DNA, 25 bp, Mus musculus
tgcggactcccttgcatacatcatt

SEQ ID NO: 870797 - DNA, 25 bp, Mus musculus
tgcggacttgaaccccgacacagag

SEQ ID NO: 870798 - DNA, 25 bp, Mus musculus
tgcggacttgaagcccgacacagag

SEQ ID NO: 870799 - DNA, 25 bp, Mus musculus
tgcggagagacaagccctgattgcc

SEQ ID NO: 870800 - DNA, 25 bp, Mus musculus
tgcggagagacatgccctgattgcc

SEQ ID NO: 870801 - DNA, 25 bp, Mus musculus
tgcggagccgaaactctaacctgaa

SEQ ID NO: 870802 - DNA, 25 bp, Mus musculus
tgcggagccgaatctctaacctgaa

SEQ ID NO: 870803 - DNA, 25 bp, Mus musculus
tgcggagcctaactctgtaccaaaa

SEQ ID NO: 870804 - DNA, 25 bp, Mus musculus
tgcggagcctaagtctgtaccaaaa

SEQ ID NO: 870805 - DNA, 25 bp, Mus musculus
tgcggaggactcacagacattgcct

SEQ ID NO: 870806 - DNA, 25 bp, Mus musculus
tgcggaggactctcagacattgcct

SEQ ID NO: 870807 - DNA, 25 bp, Mus musculus
tgcggaggagcaactaagattactg

SEQ ID NO: 870808 - DNA, 25 bp, Mus musculus
tgcggaggagcatctaagattactg

SEQ ID NO: 870809 - DNA, 25 bp, Mus musculus
tgcggagggcgccttaatttaatta

SEQ ID NO: 870810 - DNA, 25 bp, Mus musculus
tgcggagggcgcgttaatttaatta

SEQ ID NO: 870811 - DNA, 25 bp, Mus musculus
tgcggagtcagtagcaagacgtgta

SEQ ID NO: 870812 - DNA, 25 bp, Mus musculus
tgcggagtcagttgcaagacgtgta

SEQ ID NO: 870813 - DNA, 25 bp, Mus musculus
tgcggagtgattcctaagcctacca

SEQ ID NO: 870814 - DNA, 25 bp, Mus musculus
tgcggagtgattgctaagcctacca

SEQ ID NO: 870815 - DNA, 25 bp, Mus musculus
tgcggagtgtgcacgggttccaaat

SEQ ID NO: 870816 - DNA, 25 bp, Mus musculus
tgcggagtgtgctcgggttccaaat

SEQ ID NO: 870817 - DNA, 25 bp, Mus musculus
tgcggatcattcacgtctcatggaa

SEQ ID NO: 870818 - DNA, 25 bp, Mus musculus
tgcggatcattctcgtctcatggaa

SEQ ID NO: 870819 - DNA, 25 bp, Mus musculus
tgcggatcattgcagccctgcggta

SEQ ID NO: 870820 - DNA, 25 bp, Mus musculus
tgcggatcattggagccctgcggta

SEQ ID NO: 870821 - DNA, 25 bp, Mus musculus
tgcggatccatgagcgcagctagcg

SEQ ID NO: 870822 - DNA, 25 bp, Mus musculus
tgcggatccatgtgcgcagctagcg

SEQ ID NO: 870823 - DNA, 25 bp, Mus musculus
tgcggatcccagaatgaacagaact

SEQ ID NO: 870824 - DNA, 25 bp, Mus musculus
tgcggatcccagtatgaacagaact

SEQ ID NO: 870825 - DNA, 25 bp, Mus musculus
tgcggatcctttatgggacctcgag

SEQ ID NO: 870826 - DNA, 25 bp, Mus musculus
tgcggatcctttttgggacctcgag

SEQ ID NO: 870827 - DNA, 25 bp, Mus musculus
tgcggatctctcacacagagaagtg

SEQ ID NO: 870828 - DNA, 25 bp, Mus musculus
tgcggatctctctcacagagaagtg

SEQ ID NO: 870829 - DNA, 25 bp, Mus musculus
tgcggatgcacacttactccagatc

SEQ ID NO: 870830 - DNA, 25 bp, Mus musculus
tgcggatgcacagttactccagatc

SEQ ID NO: 870831 - DNA, 25 bp, Mus musculus
tgcggatggcatcctgaccttctct

SEQ ID NO: 870832 - DNA, 25 bp, Mus musculus
tgcggatggcatgctgaccttctct

SEQ ID NO: 870833 - DNA, 25 bp, Mus musculus
tgcggattctgaatcctaggcccag

SEQ ID NO: 870834 - DNA, 25 bp, Mus musculus
tgcggattctgattcctaggcccag

SEQ ID NO: 870835 - DNA, 25 bp, Mus musculus
tgcggcaaagccatttccaggtggt

SEQ ID NO: 870836 - DNA, 25 bp, Mus musculus
tgcggcaaagccttttccaggtggt

SEQ ID NO: 870837 - DNA, 25 bp, Mus musculus
tgcggcaaaggcatcagcaacagct

SEQ ID NO: 870838 - DNA, 25 bp, Mus musculus
tgcggcaaaggcttcagcaacagct

SEQ ID NO: 870839 - DNA, 25 bp, Mus musculus
tgcggcaaatacaggcgcctgcact

SEQ ID NO: 870840 - DNA, 25 bp, Mus musculus
tgcggcaaatactggcgcctgcact

SEQ ID NO: 870841 - DNA, 25 bp, Mus musculus
tgcggcaagtgcattactcagaagt

SEQ ID NO: 870842 - DNA, 25 bp, Mus musculus
tgcggcaagtgctttactcagaagt

SEQ ID NO: 870843 - DNA, 25 bp, Mus musculus
tgcggcaccagaaggcgcacgtggg

SEQ ID NO: 870844 - DNA, 25 bp, Mus musculus
tgcggcaccagatggcgcacgtggg

SEQ ID NO: 870845 - DNA, 25 bp, Mus musculus
tgcggcacccagaacgtaaacatga

SEQ ID NO: 870846 - DNA, 25 bp, Mus musculus
tgcggcacccagtacgtaaacatga

SEQ ID NO: 870847 - DNA, 25 bp, Mus musculus
tgcggcacctgcagcaaaggcttca

SEQ ID NO: 870848 - DNA, 25 bp, Mus musculus
tgcggcacctgctgcaaaggcttca

SEQ ID NO: 870849 - DNA, 25 bp, Mus musculus
tgcggcacgtgtccatccctgggaa

SEQ ID NO: 870850 - DNA, 25 bp, Mus musculus
tgcggcacgtgtgcatccctgggaa

SEQ ID NO: 870851 - DNA, 25 bp, Mus musculus
tgcggcactgcactaaactctttat

SEQ ID NO: 870852 - DNA, 25 bp, Mus musculus
tgcggcactgcagtaaactctttat

SEQ ID NO: 870853 - DNA, 25 bp, Mus musculus
tgcggcagcactatctttgctcgta

SEQ ID NO: 870854 - DNA, 25 bp, Mus musculus
tgcggcagcactttctttgctcgta

SEQ ID NO: 870855 - DNA, 25 bp, Mus musculus
tgcggcagccagaacctcggtgaag

SEQ ID NO: 870856 - DNA, 25 bp, Mus musculus
tgcggcagccagtacctcggtgaag

SEQ ID NO: 870857 - DNA, 25 bp, Mus musculus
tgcggcaggccacaagctctttcca

SEQ ID NO: 870858 - DNA, 25 bp, Mus musculus
tgcggcaggccagaagctctttcca

SEQ ID NO: 870859 - DNA, 25 bp, Mus musculus
tgcggcaggtgcaacttgcccagtg

SEQ ID NO: 870860 - DNA, 25 bp, Mus musculus
tgcggcaggtgctacttgcccagtg

SEQ ID NO: 870861 - DNA, 25 bp, Mus musculus
tgcggcataccgacagactgaggtt

SEQ ID NO: 870862 - DNA, 25 bp, Mus musculus
tgcggcataccgtcagactgaggtt

SEQ ID NO: 870863 - DNA, 25 bp, Mus musculus
tgcggcatccaaatgctgctttgtt

SEQ ID NO: 870864 - DNA, 25 bp, Mus musculus
tgcggcatccaattgctgctttgtt

SEQ ID NO: 870865 - DNA, 25 bp, Mus musculus
tgcggccacactactctgggaactg

SEQ ID NO: 870866 - DNA, 25 bp, Mus musculus
tgcggccacacttctctgggaactg

SEQ ID NO: 870867 - DNA, 25 bp, Mus musculus
tgcggccaccgtatctgccgggcgt

SEQ ID NO: 870868 - DNA, 25 bp, Mus musculus
tgcggccaccgtttctgccgggcgt

SEQ ID NO: 870869 - DNA, 25 bp, Mus musculus
tgcggccacgaaacgatcagcagag

SEQ ID NO: 870870 - DNA, 25 bp, Mus musculus
tgcggccacgaatcgatcagcagag

SEQ ID NO: 870871 - DNA, 25 bp, Mus musculus
tgcggccactttcgattccccggag

SEQ ID NO: 870872 - DNA, 25 bp, Mus musculus
tgcggccactttggattccccggag

SEQ ID NO: 870873 - DNA, 25 bp, Mus musculus
tgcggccagaccagcggcttatgga

SEQ ID NO: 870874 - DNA, 25 bp, Mus musculus
tgcggccagacctgcggcttatgga

SEQ ID NO: 870875 - DNA, 25 bp, Mus musculus
tgcggccatcgccagtaacatctgg

SEQ ID NO: 870876 - DNA, 25 bp, Mus musculus
tgcggccatcgcgagtaacatctgg

SEQ ID NO: 870877 - DNA, 25 bp, Mus musculus
tgcggcccacaaaacccagatgagg

SEQ ID NO: 870878 - DNA, 25 bp, Mus musculus
tgcggcccacaatacccagatgagg

SEQ ID NO: 870879 - DNA, 25 bp, Mus musculus
tgcggcccagtgacccaatagagta

SEQ ID NO: 870880 - DNA, 25 bp, Mus musculus
tgcggcccagtgtcccaatagagta

SEQ ID NO: 870881 - DNA, 25 bp, Mus musculus
tgcggcccatagcaggactgtgcta

SEQ ID NO: 870882 - DNA, 25 bp, Mus musculus
tgcggcccataggaggactgtgcta

SEQ ID NO: 870883 - DNA, 25 bp, Mus musculus
tgcggccccactcggagatggatat

SEQ ID NO: 870884 - DNA, 25 bp, Mus musculus
tgcggccccactgggagatggatat

SEQ ID NO: 870885 - DNA, 25 bp, Mus musculus
tgcggccccataatgcacttctggg

SEQ ID NO: 870886 - DNA, 25 bp, Mus musculus
tgcggccccatattgcacttctggg

SEQ ID NO: 870887 - DNA, 25 bp, Mus musculus
tgcggcccctgccacccttgcaacc

SEQ ID NO: 870888 - DNA, 25 bp, Mus musculus
tgcggcccctgcgacccttgcaacc

SEQ ID NO: 870889 - DNA, 25 bp, Mus musculus
tgcggccccttcagtgtgttctttc

SEQ ID NO: 870890 - DNA, 25 bp, Mus musculus
tgcggccccttctgtgtgttctttc

SEQ ID NO: 870891 - DNA, 25 bp, Mus musculus
tgcggcccggaacttatcacaagtc

SEQ ID NO: 870892 - DNA, 25 bp, Mus musculus
tgcggcccggaagttatcacaagtc

SEQ ID NO: 870893 - DNA, 25 bp, Mus musculus
tgcggccgagacatcaagctacccg

SEQ ID NO: 870894 - DNA, 25 bp, Mus musculus
tgcggccgagacttcaagctacccg

SEQ ID NO: 870895 - DNA, 25 bp, Mus musculus
tgcggccgatcaccgctgggagagg

SEQ ID NO: 870896 - DNA, 25 bp, Mus musculus
tgcggccgatcagcgctgggagagg

SEQ ID NO: 870897 - DNA, 25 bp, Mus musculus
tgcggcctgggcacccggctgtttt

SEQ ID NO: 870898 - DNA, 25 bp, Mus musculus
tgcggcctgggctcccggctgtttt

SEQ ID NO: 870899 - DNA, 25 bp, Mus musculus
tgcggcctgtgacagtcacttggta

SEQ ID NO: 870900 - DNA, 25 bp, Mus musculus
tgcggcctgtgagagtcacttggta

SEQ ID NO: 870901 - DNA, 25 bp, Mus musculus
tgcggccttgccactaaaatgttaa

SEQ ID NO: 870902 - DNA, 25 bp, Mus musculus
tgcggccttgcctctaaaatgttaa

SEQ ID NO: 870903 - DNA, 25 bp, Mus musculus
tgcggcctttgcaagcttttgcttg

SEQ ID NO: 870904 - DNA, 25 bp, Mus musculus
tgcggcctttgctagcttttgcttg

SEQ ID NO: 870905 - DNA, 25 bp, Mus musculus
tgcggcgacagcattcacgtgtgga

SEQ ID NO: 870906 - DNA, 25 bp, Mus musculus
tgcggcgacagctttcacgtgtgga

SEQ ID NO: 870907 - DNA, 25 bp, Mus musculus
tgcggcgagagacggtctcttctat

SEQ ID NO: 870908 - DNA, 25 bp, Mus musculus
tgcggcgagagagggtctcttctat

SEQ ID NO: 870909 - DNA, 25 bp, Mus musculus
tgcggcgatggcagtgtccactgca

SEQ ID NO: 870910 - DNA, 25 bp, Mus musculus
tgcggcgatggctgtgtccactgca

SEQ ID NO: 870911 - DNA, 25 bp, Mus musculus
tgcggcgattggaggctacagcaaa

SEQ ID NO: 870912 - DNA, 25 bp, Mus musculus
tgcggcgattggtggctacagcaaa

SEQ ID NO: 870913 - DNA, 25 bp, Mus musculus
tgcggcgccacgatcattgacaaac

SEQ ID NO: 870914 - DNA, 25 bp, Mus musculus
tgcggcgccacgttcattgacaaac

SEQ ID NO: 870915 - DNA, 25 bp, Mus musculus
tgcggcgctgccatagcaacgctgg

SEQ ID NO: 870916 - DNA, 25 bp, Mus musculus
tgcggcgctgccttagcaacgctgg

SEQ ID NO: 870917 - DNA, 25 bp, Mus musculus
tgcggcggccttatgagctgctgat

SEQ ID NO: 870918 - DNA, 25 bp, Mus musculus
tgcggcggccttttgagctgctgat

SEQ ID NO: 870919 - DNA, 25 bp, Mus musculus
tgcggcggcgcactcacacggcaaa

SEQ ID NO: 870920 - DNA, 25 bp, Mus musculus
tgcggcggcgcagtcacacggcaaa

SEQ ID NO: 870921 - DNA, 25 bp, Mus musculus
tgcggcggcttgaacagcccaatgt

SEQ ID NO: 870922 - DNA, 25 bp, Mus musculus
tgcggcggcttgtacagcccaatgt

SEQ ID NO: 870923 - DNA, 25 bp, Mus musculus
tgcggcgtctacagcgagaactcag

SEQ ID NO: 870924 - DNA, 25 bp, Mus musculus
tgcggcgtctactgcgagaactcag

SEQ ID NO: 870925 - DNA, 25 bp, Mus musculus
tgcggcgtgcttcaatatgtctaaa

SEQ ID NO: 870926 - DNA, 25 bp, Mus musculus
tgcggcgtgcttgaatatgtctaaa

SEQ ID NO: 870927 - DNA, 25 bp, Mus musculus
tgcggctaacacactctttcaatat

SEQ ID NO: 870928 - DNA, 25 bp, Mus musculus
tgcggctaacactctctttcaatat

SEQ ID NO: 870929 - DNA, 25 bp, Mus musculus
tgcggctcaagtccaagcagcactc

SEQ ID NO: 870930 - DNA, 25 bp, Mus musculus
tgcggctcaagtgcaagcagcactc

SEQ ID NO: 870931 - DNA, 25 bp, Mus musculus
tgcggctccgaacgctctgcgaggc

SEQ ID NO: 870932 - DNA, 25 bp, Mus musculus
tgcggctccgaaggctctgcgaggc

SEQ ID NO: 870933 - DNA, 25 bp, Mus musculus
tgcggctcgcccaaagcgtgagaat

SEQ ID NO: 870934 - DNA, 25 bp, Mus musculus
tgcggctcgccctaagcgtgagaat

SEQ ID NO: 870935 - DNA, 25 bp, Mus musculus
tgcggctctcatctcacaggcagag

SEQ ID NO: 870936 - DNA, 25 bp, Mus musculus
tgcggctctcatgtcacaggcagag

SEQ ID NO: 870937 - DNA, 25 bp, Mus musculus
tgcggctctgatctctgtgagctgt

SEQ ID NO: 870938 - DNA, 25 bp, Mus musculus
tgcggctctgatgtctgtgagctgt

SEQ ID NO: 870939 - DNA, 25 bp, Mus musculus
tgcggctctgcaaactcagtctgaa

SEQ ID NO: 870940 - DNA, 25 bp, Mus musculus
tgcggctctgcatactcagtctgaa

SEQ ID NO: 870941 - DNA, 25 bp, Mus musculus
tgcggctgaaatctcttatggaact

SEQ ID NO: 870942 - DNA, 25 bp, Mus musculus
tgcggctgaaatgtcttatggaact

SEQ ID NO: 870943 - DNA, 25 bp, Mus musculus
tgcggctgaagcagatcatcccgtt

SEQ ID NO: 870944 - DNA, 25 bp, Mus musculus
tgcggctgaagctgatcatcccgtt

SEQ ID NO: 870945 - DNA, 25 bp, Mus musculus
tgcggctgacgcagagactgataga

SEQ ID NO: 870946 - DNA, 25 bp, Mus musculus
tgcggctgacgctgagactgataga

SEQ ID NO: 870947 - DNA, 25 bp, Mus musculus
tgcggctgacggattagttattcct

SEQ ID NO: 870948 - DNA, 25 bp, Mus musculus
tgcggctgacggtttagttattcct

SEQ ID NO: 870949 - DNA, 25 bp, Mus musculus
tgcggctgaggcattttacagtggt

SEQ ID NO: 870950 - DNA, 25 bp, Mus musculus
tgcggctgaggctttttacagtggt

SEQ ID NO: 870951 - DNA, 25 bp, Mus musculus
tgcggctgcacaagaccgagttcct

SEQ ID NO: 870952 - DNA, 25 bp, Mus musculus
tgcggctgcacatgaccgagttcct

SEQ ID NO: 870953 - DNA, 25 bp, Mus musculus
tgcggctgcatcaaccggcttcgag

SEQ ID NO: 870954 - DNA, 25 bp, Mus musculus
tgcggctgcatctaccggcttcgag

SEQ ID NO: 870955 - DNA, 25 bp, Mus musculus
tgcggctgcgctctgagaaaccgtt

SEQ ID NO: 870956 - DNA, 25 bp, Mus musculus
tgcggctgcgctgtgagaaaccgtt

SEQ ID NO: 870957 - DNA, 25 bp, Mus musculus
tgcggctgtcgcaactgaagcagct

SEQ ID NO: 870958 - DNA, 25 bp, Mus musculus
tgcggctgtcgctactgaagcagct

SEQ ID NO: 870959 - DNA, 25 bp, Mus musculus
tgcggcttcatgacacttcctgaca

SEQ ID NO: 870960 - DNA, 25 bp, Mus musculus
tgcggcttcatgtcacttcctgaca

SEQ ID NO: 870961 - DNA, 25 bp, Mus musculus
tgcggcttcctaaatcactggacag

SEQ ID NO: 870962 - DNA, 25 bp, Mus musculus
tgcggcttcctatatcactggacag

SEQ ID NO: 870963 - DNA, 25 bp, Mus musculus
tgcggcttcgttacctgatatgcac

SEQ ID NO: 870964 - DNA, 25 bp, Mus musculus
tgcggcttcgtttcctgatatgcac

SEQ ID NO: 870965 - DNA, 25 bp, Mus musculus
tgcggctttgggaagctcaccagag

SEQ ID NO: 870966 - DNA, 25 bp, Mus musculus
tgcggctttgggtagctcaccagag

SEQ ID NO: 870967 - DNA, 25 bp, Mus musculus
tgcgggaacggtaatgattgccagc

SEQ ID NO: 870968 - DNA, 25 bp, Mus musculus
tgcgggaacggttatgattgccagc

SEQ ID NO: 870969 - DNA, 25 bp, Mus musculus
tgcgggacgtgcagccctacctcta

SEQ ID NO: 870970 - DNA, 25 bp, Mus musculus
tgcgggacgtgctgccctacctcta

SEQ ID NO: 870971 - DNA, 25 bp, Mus musculus
tgcgggactcgtccactttttttct

SEQ ID NO: 870972 - DNA, 25 bp, Mus musculus
tgcgggactcgtgcactttttttct

SEQ ID NO: 870973 - DNA, 25 bp, Mus musculus
tgcgggaggcatctgctgatttctc

SEQ ID NO: 870974 - DNA, 25 bp, Mus musculus
tgcgggaggcatgtgctgatttctc

SEQ ID NO: 870975 - DNA, 25 bp, Mus musculus
tgcgggaggctcacaaacttacaaa

SEQ ID NO: 870976 - DNA, 25 bp, Mus musculus
tgcgggaggctctcaaacttacaaa

SEQ ID NO: 870977 - DNA, 25 bp, Mus musculus
tgcgggaggtgcagaaccttttctg

SEQ ID NO: 870978 - DNA, 25 bp, Mus musculus
tgcgggaggtgctgaaccttttctg

SEQ ID NO: 870979 - DNA, 25 bp, Mus musculus
tgcgggagtttgagaatctcaacag

SEQ ID NO: 870980 - DNA, 25 bp, Mus musculus
tgcgggagtttgtgaatctcaacag

SEQ ID NO: 870981 - DNA, 25 bp, Mus musculus
tgcgggatcagaatatggactgctt

SEQ ID NO: 870982 - DNA, 25 bp, Mus musculus
tgcgggatcagattatggactgctt

SEQ ID NO: 870983 - DNA, 25 bp, Mus musculus
tgcgggatgcaccaatgcctcggtc

SEQ ID NO: 870984 - DNA, 25 bp, Mus musculus
tgcgggatgcacgaatgcctcggtc

SEQ ID NO: 870985 - DNA, 25 bp, Mus musculus
tgcgggatttttcgttccggtgcca

SEQ ID NO: 870986 - DNA, 25 bp, Mus musculus
tgcgggatttttggttccggtgcca

SEQ ID NO: 870987 - DNA, 25 bp, Mus musculus
tgcgggcacagcaggagctagaatc

SEQ ID NO: 870988 - DNA, 25 bp, Mus musculus
tgcgggcacagctggagctagaatc

SEQ ID NO: 870989 - DNA, 25 bp, Mus musculus
tgcgggcagccaatctgaacacgtt

SEQ ID NO: 870990 - DNA, 25 bp, Mus musculus
tgcgggcagccattctgaacacgtt

SEQ ID NO: 870991 - DNA, 25 bp, Mus musculus
tgcgggcatctgctgttcgaaatcg

SEQ ID NO: 870992 - DNA, 25 bp, Mus musculus
tgcgggcatctggtgttcgaaatcg

SEQ ID NO: 870993 - DNA, 25 bp, Mus musculus
tgcgggccaccaaaagcgaggactt

SEQ ID NO: 870994 - DNA, 25 bp, Mus musculus
tgcgggccaccataagcgaggactt

SEQ ID NO: 870995 - DNA, 25 bp, Mus musculus
tgcgggccatcgaaaagggctgctc

SEQ ID NO: 870996 - DNA, 25 bp, Mus musculus
tgcgggccatcgtaaagggctgctc

SEQ ID NO: 870997 - DNA, 25 bp, Mus musculus
tgcgggccctctatgactttaatgg

SEQ ID NO: 870998 - DNA, 25 bp, Mus musculus
tgcgggccctctttgactttaatgg

SEQ ID NO: 870999 - DNA, 25 bp, Mus musculus
tgcgggccctgcagagcatagagaa

SEQ ID NO: 871000 - DNA, 25 bp, Mus musculus
tgcgggccctgctgagcatagagaa

SEQ ID NO: 871001 - DNA, 25 bp, Mus musculus
tgcgggcctaccagaagacaacatg

SEQ ID NO: 871002 - DNA, 25 bp, Mus musculus
tgcgggcctacctgaagacaacatg

SEQ ID NO: 871003 - DNA, 25 bp, Mus musculus
tgcgggccttaactttgggaactca

SEQ ID NO: 871004 - DNA, 25 bp, Mus musculus
tgcgggccttaagtttgggaactca

SEQ ID NO: 871005 - DNA, 25 bp, Mus musculus
tgcgggctcaaaccctttgattggc

SEQ ID NO: 871006 - DNA, 25 bp, Mus musculus
tgcgggctcaaagcctttgattggc

SEQ ID NO: 871007 - DNA, 25 bp, Mus musculus
tgcgggctctagaattccatctgca

SEQ ID NO: 871008 - DNA, 25 bp, Mus musculus
tgcgggctctagtattccatctgca

SEQ ID NO: 871009 - DNA, 25 bp, Mus musculus
tgcgggctctctcgttccacaaaac

SEQ ID NO: 871010 - DNA, 25 bp, Mus musculus
tgcgggctctctggttccacaaaac

SEQ ID NO: 871011 - DNA, 25 bp, Mus musculus
tgcgggctgtgtacaatgtccttga

SEQ ID NO: 871012 - DNA, 25 bp, Mus musculus
tgcgggctgtgtatttgctcagcac

SEQ ID NO: 871013 - DNA, 25 bp, Mus musculus
tgcgggctgtgttcaatgtccttga

SEQ ID NO: 871014 - DNA, 25 bp, Mus musculus
tgcgggctgtgtttttgctcagcac

SEQ ID NO: 871015 - DNA, 25 bp, Mus musculus
tgcgggtaaaccagttggatttagt

SEQ ID NO: 871016 - DNA, 25 bp, Mus musculus
tgcgggtaaacctgttggatttagt

SEQ ID NO: 871017 - DNA, 25 bp, Mus musculus
tgcgggtagctcagtttttccaggc

SEQ ID NO: 871018 - DNA, 25 bp, Mus musculus
tgcgggtagctctgtttttccaggc

SEQ ID NO: 871019 - DNA, 25 bp, Mus musculus
tgcgggtcaactaccacatcgtgga

SEQ ID NO: 871020 - DNA, 25 bp, Mus musculus
tgcgggtcaacttccacatcgtgga

SEQ ID NO: 871021 - DNA, 25 bp, Mus musculus
tgcgggtccgcgacatcaatgaggc

SEQ ID NO: 871022 - DNA, 25 bp, Mus musculus
tgcgggtccgcgtcatcaatgaggc

SEQ ID NO: 871023 - DNA, 25 bp, Mus musculus
tgcgggtcgtgcatagctatgagga

SEQ ID NO: 871024 - DNA, 25 bp, Mus musculus
tgcgggtcgtgcttagctatgagga

SEQ ID NO: 871025 - DNA, 25 bp, Mus musculus
tgcgggtcttcaccaccaacaacgg

SEQ ID NO: 871026 - DNA, 25 bp, Mus musculus
tgcgggtcttcagcaccaacaacgg

SEQ ID NO: 871027 - DNA, 25 bp, Mus musculus
tgcgggtcttccagctgtcaggaca

SEQ ID NO: 871028 - DNA, 25 bp, Mus musculus
tgcgggtcttcctgctgtcaggaca

SEQ ID NO: 871029 - DNA, 25 bp, Mus musculus
tgcgggtgacttcgcacgcaaacgt

SEQ ID NO: 871030 - DNA, 25 bp, Mus musculus
tgcgggtgacttggcacgcaaacgt

SEQ ID NO: 871031 - DNA, 25 bp, Mus musculus
tgcgggtgcggcactgccaccatgt

SEQ ID NO: 871032 - DNA, 25 bp, Mus musculus
tgcgggtgcggctctgccaccatgt

SEQ ID NO: 871033 - DNA, 25 bp, Mus musculus
tgcgggtgctgaccatatcctgaaa

SEQ ID NO: 871034 - DNA, 25 bp, Mus musculus
tgcgggtgctgagcatatcctgaaa

SEQ ID NO: 871035 - DNA, 25 bp, Mus musculus
tgcgggtggaacatgcatccttcaa

SEQ ID NO: 871036 - DNA, 25 bp, Mus musculus
tgcgggtggaacttgcatccttcaa

SEQ ID NO: 871037 - DNA, 25 bp, Mus musculus
tgcgggttgcccattgtcatctact

SEQ ID NO: 871038 - DNA, 25 bp, Mus musculus
tgcgggttgccctttgtcatctact

SEQ ID NO: 871039 - DNA, 25 bp, Mus musculus
tgcggtaaagaaccctccccttcag

SEQ ID NO: 871040 - DNA, 25 bp, Mus musculus
tgcggtaaagaagcctccccttcag

SEQ ID NO: 871041 - DNA, 25 bp, Mus musculus
tgcggtacacgtccttcaggaaggc

SEQ ID NO: 871042 - DNA, 25 bp, Mus musculus
tgcggtacacgtgcttcaggaaggc

SEQ ID NO: 871043 - DNA, 25 bp, Mus musculus
tgcggtagcctacctttagccatct

SEQ ID NO: 871044 - DNA, 25 bp, Mus musculus
tgcggtagcctagctttagccatct

SEQ ID NO: 871045 - DNA, 25 bp, Mus musculus
tgcggtagcgccctgctccattggc

SEQ ID NO: 871046 - DNA, 25 bp, Mus musculus
tgcggtagcgccgtgctccattggc

SEQ ID NO: 871047 - DNA, 25 bp, Mus musculus
tgcggtcaccggagccaagcagggc

SEQ ID NO: 871048 - DNA, 25 bp, Mus musculus
tgcggtcaccggtgccaagcagggc

SEQ ID NO: 871049 - DNA, 25 bp, Mus musculus
tgcggtcagtgcagtgccttgtgct

SEQ ID NO: 871050 - DNA, 25 bp, Mus musculus
tgcggtcagtgctgtgccttgtgct

SEQ ID NO: 871051 - DNA, 25 bp, Mus musculus
tgcggtcccatgagttggaagcagt

SEQ ID NO: 871052 - DNA, 25 bp, Mus musculus
tgcggtcccatgtgttggaagcagt

SEQ ID NO: 871053 - DNA, 25 bp, Mus musculus
tgcggtccgaggctctgctgcactc

SEQ ID NO: 871054 - DNA, 25 bp, Mus musculus
tgcggtccgagggtctgctgcactc

SEQ ID NO: 871055 - DNA, 25 bp, Mus musculus
tgcggtctgcagacgaagggcacaa

SEQ ID NO: 871056 - DNA, 25 bp, Mus musculus
tgcggtctgcagtcgaagggcacaa

SEQ ID NO: 871057 - DNA, 25 bp, Mus musculus
tgcggtgacactcgcatgtgcacac

SEQ ID NO: 871058 - DNA, 25 bp, Mus musculus
tgcggtgacactggcatgtgcacac

SEQ ID NO: 871059 - DNA, 25 bp, Mus musculus
tgcggtgactcaagccattcaacaa

SEQ ID NO: 871060 - DNA, 25 bp, Mus musculus
tgcggtgactcatgccattcaacaa

SEQ ID NO: 871061 - DNA, 25 bp, Mus musculus
tgcggtgatcgaccgcttccgagaa

SEQ ID NO: 871062 - DNA, 25 bp, Mus musculus
tgcggtgatcgagcgcttccgagaa

SEQ ID NO: 871063 - DNA, 25 bp, Mus musculus
tgcggtgccagcagggccacatact

SEQ ID NO: 871064 - DNA, 25 bp, Mus musculus
tgcggtgccagctgggccacatact

SEQ ID NO: 871065 - DNA, 25 bp, Mus musculus
tgcggtgcctgaagatgactgccaa

SEQ ID NO: 871066 - DNA, 25 bp, Mus musculus
tgcggtgcctgatgatgactgccaa

SEQ ID NO: 871067 - DNA, 25 bp, Mus musculus
tgcggtgctgttcatcacgggaatt

SEQ ID NO: 871068 - DNA, 25 bp, Mus musculus
tgcggtgctgttgatcacgggaatt

SEQ ID NO: 871069 - DNA, 25 bp, Mus musculus
tgcggtgcttttccagactagattg

SEQ ID NO: 871070 - DNA, 25 bp, Mus musculus
tgcggtgcttttgcagactagattg

SEQ ID NO: 871071 - DNA, 25 bp, Mus musculus
tgcggtggtgacaccctgagcacca

SEQ ID NO: 871072 - DNA, 25 bp, Mus musculus
tgcggtggtgactccctgagcacca

SEQ ID NO: 871073 - DNA, 25 bp, Mus musculus
tgcggtgtcaccaattacggagatt

SEQ ID NO: 871074 - DNA, 25 bp, Mus musculus
tgcggtgtcacctattacggagatt

SEQ ID NO: 871075 - DNA, 25 bp, Mus musculus
tgcggtgtccctcataggctgttgc

SEQ ID NO: 871076 - DNA, 25 bp, Mus musculus
tgcggtgtccctgataggctgttgc

SEQ ID NO: 871077 - DNA, 25 bp, Mus musculus
tgcggtgtcttaccaacctgaacct

SEQ ID NO: 871078 - DNA, 25 bp, Mus musculus
tgcggtgtcttagcaacctgaacct

SEQ ID NO: 871079 - DNA, 25 bp, Mus musculus
tgcggtgtggttaagtttgagtctc

SEQ ID NO: 871080 - DNA, 25 bp, Mus musculus
tgcggtgtggtttagtttgagtctc

SEQ ID NO: 871081 - DNA, 25 bp, Mus musculus
tgcggtgtttttccgatctgcagaa

SEQ ID NO: 871082 - DNA, 25 bp, Mus musculus
tgcggtgtttttgcgatctgcagaa

SEQ ID NO: 871083 - DNA, 25 bp, Mus musculus
tgcggttagcaaacttcagtttact

SEQ ID NO: 871084 - DNA, 25 bp, Mus musculus
tgcggttagcaatcttcagtttact

SEQ ID NO: 871085 - DNA, 25 bp, Mus musculus
tgcggttcaactctaggattcgtgt

SEQ ID NO: 871086 - DNA, 25 bp, Mus musculus
tgcggttcaactgtaggattcgtgt

SEQ ID NO: 871087 - DNA, 25 bp, Mus musculus
tgcggttcagcgctaaaactcttac

SEQ ID NO: 871088 - DNA, 25 bp, Mus musculus
tgcggttcagcggtaaaactcttac

SEQ ID NO: 871089 - DNA, 25 bp, Mus musculus
tgcggttcccgtaatcatcttaggg

SEQ ID NO: 871090 - DNA, 25 bp, Mus musculus
tgcggttcccgttatcatcttaggg

SEQ ID NO: 871091 - DNA, 25 bp, Mus musculus
tgcggttcgggtattggcagtaaca

SEQ ID NO: 871092 - DNA, 25 bp, Mus musculus
tgcggttcgggttttggcagtaaca

SEQ ID NO: 871093 - DNA, 25 bp, Mus musculus
tgcggttcgtgcacgcagggctctc

SEQ ID NO: 871094 - DNA, 25 bp, Mus musculus
tgcggttcgtgctcgcagggctctc

SEQ ID NO: 871095 - DNA, 25 bp, Mus musculus
tgcggttctcgcctagcccatcagt

SEQ ID NO: 871096 - DNA, 25 bp, Mus musculus
tgcggttctcgcgtagcccatcagt

SEQ ID NO: 871097 - DNA, 25 bp, Mus musculus
tgcggttgcgctacacccgaatgcg

SEQ ID NO: 871098 - DNA, 25 bp, Mus musculus
tgcggttgcgcttcacccgaatgcg

SEQ ID NO: 871099 - DNA, 25 bp, Mus musculus
tgcggtttacagcacctgcttataa

SEQ ID NO: 871100 - DNA, 25 bp, Mus musculus
tgcggtttacaggacctgcttataa

SEQ ID NO: 871101 - DNA, 25 bp, Mus musculus
tgcggtttccctccagccggagtta

SEQ ID NO: 871102 - DNA, 25 bp, Mus musculus
tgcggtttccctgcagccggagtta

SEQ ID NO: 871103 - DNA, 25 bp, Mus musculus
tgcggtttcctgctgaagatcatag

SEQ ID NO: 871104 - DNA, 25 bp, Mus musculus
tgcggtttcctggtgaagatcatag

SEQ ID NO: 871105 - DNA, 25 bp, Mus musculus
tgcggtttccttcttggttaagcca

SEQ ID NO: 871106 - DNA, 25 bp, Mus musculus
tgcggtttccttgttggttaagcca

SEQ ID NO: 871107 - DNA, 25 bp, Mus musculus
tgcggtttgcacatactgtatgtca

SEQ ID NO: 871108 - DNA, 25 bp, Mus musculus
tgcggtttgcacttactgtatgtca

SEQ ID NO: 871109 - DNA, 25 bp, Mus musculus
tgcgtaaacacgagcgccgggtcaa

SEQ ID NO: 871110 - DNA, 25 bp, Mus musculus
tgcgtaaacacgtgcgccgggtcaa

SEQ ID NO: 871111 - DNA, 25 bp, Mus musculus
tgcgtaagacgtaaggcacaacctt

SEQ ID NO: 871112 - DNA, 25 bp, Mus musculus
tgcgtaagacgttaggcacaacctt

SEQ ID NO: 871113 - DNA, 25 bp, Mus musculus
tgcgtacagccaaactcagtggaac

SEQ ID NO: 871114 - DNA, 25 bp, Mus musculus
tgcgtacagccatactcagtggaac

SEQ ID NO: 871115 - DNA, 25 bp, Mus musculus
tgcgtacatacacgtgggtgtgcat

SEQ ID NO: 871116 - DNA, 25 bp, Mus musculus
tgcgtacatacaggtgggtgtgcat

SEQ ID NO: 871117 - DNA, 25 bp, Mus musculus
tgcgtacatcgtcaccaagggtcag

SEQ ID NO: 871118 - DNA, 25 bp, Mus musculus
tgcgtacatcgtgaccaagggtcag

SEQ ID NO: 871119 - DNA, 25 bp, Mus musculus
tgcgtacatgcaaatccatcagatg

SEQ ID NO: 871120 - DNA, 25 bp, Mus musculus
tgcgtacatgcatatccatcagatg

SEQ ID NO: 871121 - DNA, 25 bp, Mus musculus
tgcgtacccagaagcttttatactt

SEQ ID NO: 871122 - DNA, 25 bp, Mus musculus
tgcgtacccagatgcttttatactt

SEQ ID NO: 871123 - DNA, 25 bp, Mus musculus
tgcgtactggctagctgctgatggc

SEQ ID NO: 871124 - DNA, 25 bp, Mus musculus
tgcgtactggcttgctgctgatggc

SEQ ID NO: 871125 - DNA, 25 bp, Mus musculus
tgcgtacttcagcatgggctttgtc

SEQ ID NO: 871126 - DNA, 25 bp, Mus musculus
tgcgtacttcaggatgggctttgtc

SEQ ID NO: 871127 - DNA, 25 bp, Mus musculus
tgcgtagagaatctcctctggccca

SEQ ID NO: 871128 - DNA, 25 bp, Mus musculus
tgcgtagagaatgtcctctggccca

SEQ ID NO: 871129 - DNA, 25 bp, Mus musculus
tgcgtagcagtcagggtagagccac

SEQ ID NO: 871130 - DNA, 25 bp, Mus musculus
tgcgtagcagtctgggtagagccac

SEQ ID NO: 871131 - DNA, 25 bp, Mus musculus
tgcgtagcagtgacagacctcaagt

SEQ ID NO: 871132 - DNA, 25 bp, Mus musculus
tgcgtagcagtgtcagacctcaagt

SEQ ID NO: 871133 - DNA, 25 bp, Mus musculus
tgcgtagctcggaggccaagatttt

SEQ ID NO: 871134 - DNA, 25 bp, Mus musculus
tgcgtagctcggtggccaagatttt

SEQ ID NO: 871135 - DNA, 25 bp, Mus musculus
tgcgtagggaacaattctcccctta

SEQ ID NO: 871136 - DNA, 25 bp, Mus musculus
tgcgtagggaactattctcccctta

SEQ ID NO: 871137 - DNA, 25 bp, Mus musculus
tgcgtagtctccagggttctcaaaa

SEQ ID NO: 871138 - DNA, 25 bp, Mus musculus
tgcgtagtctcctgggttctcaaaa

SEQ ID NO: 871139 - DNA, 25 bp, Mus musculus
tgcgtagtgaaaatgagctgatctt

SEQ ID NO: 871140 - DNA, 25 bp, Mus musculus
tgcgtagtgaaattgagctgatctt

SEQ ID NO: 871141 - DNA, 25 bp, Mus musculus
tgcgtagtgctcagaaatgtagata

SEQ ID NO: 871142 - DNA, 25 bp, Mus musculus
tgcgtagtgctctgaaatgtagata

SEQ ID NO: 871143 - DNA, 25 bp, Mus musculus
tgcgtatcctttcatttttccttac

SEQ ID NO: 871144 - DNA, 25 bp, Mus musculus
tgcgtatcctttgatttttccttac

SEQ ID NO: 871145 - DNA, 25 bp, Mus musculus
tgcgtatgctctacccagtggaaac

SEQ ID NO: 871146 - DNA, 25 bp, Mus musculus
tgcgtatgctcttcccagtggaaac

SEQ ID NO: 871147 - DNA, 25 bp, Mus musculus
tgcgtatttattccttacatgtgtt

SEQ ID NO: 871148 - DNA, 25 bp, Mus musculus
tgcgtatttattgcttacatgtgtt

SEQ ID NO: 871149 - DNA, 25 bp, Mus musculus
tgcgtcacgtcaagacgaacctggg

SEQ ID NO: 871150 - DNA, 25 bp, Mus musculus
tgcgtcacgtcatgacgaacctggg

SEQ ID NO: 871151 - DNA, 25 bp, Mus musculus
tgcgtcagatatatattgcgtactc

SEQ ID NO: 871152 - DNA, 25 bp, Mus musculus
tgcgtcagatatttattgcgtactc

SEQ ID NO: 871153 - DNA, 25 bp, Mus musculus
tgcgtcagattcaaggagtcaccag

SEQ ID NO: 871154 - DNA, 25 bp, Mus musculus
tgcgtcagattctaggagtcaccag

SEQ ID NO: 871155 - DNA, 25 bp, Mus musculus
tgcgtcaggcacatacacaagtttc

SEQ ID NO: 871156 - DNA, 25 bp, Mus musculus
tgcgtcaggcacttacacaagtttc

SEQ ID NO: 871157 - DNA, 25 bp, Mus musculus
tgcgtcatcatgagatcctccagtg

SEQ ID NO: 871158 - DNA, 25 bp, Mus musculus
tgcgtcatcatgtgatcctccagtg

SEQ ID NO: 871159 - DNA, 25 bp, Mus musculus
tgcgtcatgttcctctgcgcagagt

SEQ ID NO: 871160 - DNA, 25 bp, Mus musculus
tgcgtcatgttcgtctgcgcagagt

SEQ ID NO: 871161 - DNA, 25 bp, Mus musculus
tgcgtcccagaactcgagggtgctt

SEQ ID NO: 871162 - DNA, 25 bp, Mus musculus
tgcgtcccagaagtcgagggtgctt

SEQ ID NO: 871163 - DNA, 25 bp, Mus musculus
tgcgtccccagacttttgatttgca

SEQ ID NO: 871164 - DNA, 25 bp, Mus musculus
tgcgtccccagagttttgatttgca

SEQ ID NO: 871165 - DNA, 25 bp, Mus musculus
tgcgtccccggccaaagagaagatc

SEQ ID NO: 871166 - DNA, 25 bp, Mus musculus
tgcgtccccggcgaaagagaagatc

SEQ ID NO: 871167 - DNA, 25 bp, Mus musculus
tgcgtcccggttcctatgcagagga

SEQ ID NO: 871168 - DNA, 25 bp, Mus musculus
tgcgtcccggttgctatgcagagga

SEQ ID NO: 871169 - DNA, 25 bp, Mus musculus
tgcgtccctttcaagattggtttct

SEQ ID NO: 871170 - DNA, 25 bp, Mus musculus
tgcgtccctttctagattggtttct

SEQ ID NO: 871171 - DNA, 25 bp, Mus musculus
tgcgtcctattacacacccaagtgg

SEQ ID NO: 871172 - DNA, 25 bp, Mus musculus
tgcgtcctattagacacccaagtgg

SEQ ID NO: 871173 - DNA, 25 bp, Mus musculus
tgcgtcctccttaacctctaaaaag

SEQ ID NO: 871174 - DNA, 25 bp, Mus musculus
tgcgtcctcctttacctctaaaaag

SEQ ID NO: 871175 - DNA, 25 bp, Mus musculus
tgcgtcctgaggaacaccagctggt

SEQ ID NO: 871176 - DNA, 25 bp, Mus musculus
tgcgtcctgaggtacaccagctggt

SEQ ID NO: 871177 - DNA, 25 bp, Mus musculus
tgcgtcctgtttacgccttacttta

SEQ ID NO: 871178 - DNA, 25 bp, Mus musculus
tgcgtcctgttttcgccttacttta

SEQ ID NO: 871179 - DNA, 25 bp, Mus musculus
tgcgtccttcacagcattgtgggct

SEQ ID NO: 871180 - DNA, 25 bp, Mus musculus
tgcgtccttcactgcattgtgggct

SEQ ID NO: 871181 - DNA, 25 bp, Mus musculus
tgcgtcgaaattcaacccacacagt

SEQ ID NO: 871182 - DNA, 25 bp, Mus musculus
tgcgtcgaaattgaacccacacagt

SEQ ID NO: 871183 - DNA, 25 bp, Mus musculus
tgcgtcgagtgaatcaggccatctg

SEQ ID NO: 871184 - DNA, 25 bp, Mus musculus
tgcgtcgagtgattcaggccatctg

SEQ ID NO: 871185 - DNA, 25 bp, Mus musculus
tgcgtcgcccaaatactctcaaaaa

SEQ ID NO: 871186 - DNA, 25 bp, Mus musculus
tgcgtcgcccaattactctcaaaaa

SEQ ID NO: 871187 - DNA, 25 bp, Mus musculus
tgcgtcgcctcaattctaccgcagg

SEQ ID NO: 871188 - DNA, 25 bp, Mus musculus
tgcgtcgcctcatttctaccgcagg

SEQ ID NO: 871189 - DNA, 25 bp, Mus musculus
tgcgtcgcgggactacaaaccgatt

SEQ ID NO: 871190 - DNA, 25 bp, Mus musculus
tgcgtcgcgggagtacaaaccgatt

SEQ ID NO: 871191 - DNA, 25 bp, Mus musculus
tgcgtcgcttctacaaggccaagaa

SEQ ID NO: 871192 - DNA, 25 bp, Mus musculus
tgcgtcgcttcttcaaggccaagaa

SEQ ID NO: 871193 - DNA, 25 bp, Mus musculus
tgcgtcggcaatctctacagttaga

SEQ ID NO: 871194 - DNA, 25 bp, Mus musculus
tgcgtcggcaatgtctacagttaga

SEQ ID NO: 871195 - DNA, 25 bp, Mus musculus
tgcgtctcaagtagggtctgacact

SEQ ID NO: 871196 - DNA, 25 bp, Mus musculus
tgcgtctcaagttgggtctgacact

SEQ ID NO: 871197 - DNA, 25 bp, Mus musculus
tgcgtctccagcaccaggttcgagg

SEQ ID NO: 871198 - DNA, 25 bp, Mus musculus
tgcgtctccagctccaggttcgagg

SEQ ID NO: 871199 - DNA, 25 bp, Mus musculus
tgcgtctctaatacctgtcaagccc

SEQ ID NO: 871200 - DNA, 25 bp, Mus musculus
tgcgtctctaattcctgtcaagccc

SEQ ID NO: 871201 - DNA, 25 bp, Mus musculus
tgcgtctgccgcatgtgtttcatgc

SEQ ID NO: 871202 - DNA, 25 bp, Mus musculus
tgcgtctgccgcttgtgtttcatgc

SEQ ID NO: 871203 - DNA, 25 bp, Mus musculus
tgcgtctgcgcgctggcatcattga

SEQ ID NO: 871204 - DNA, 25 bp, Mus musculus
tgcgtctgcgcggtggcatcattga

SEQ ID NO: 871205 - DNA, 25 bp, Mus musculus
tgcgtcttccttacctgagttacag

SEQ ID NO: 871206 - DNA, 25 bp, Mus musculus
tgcgtcttcctttcctgagttacag

SEQ ID NO: 871207 - DNA, 25 bp, Mus musculus
tgcgtcttctctacttgaatacttg

SEQ ID NO: 871208 - DNA, 25 bp, Mus musculus
tgcgtcttctcttcttgaatacttg

SEQ ID NO: 871209 - DNA, 25 bp, Mus musculus
tgcgtcttgctacaccttagccaag

SEQ ID NO: 871210 - DNA, 25 bp, Mus musculus
tgcgtcttgctagaccttagccaag

SEQ ID NO: 871211 - DNA, 25 bp, Mus musculus
tgcgtcttgtaaccctctttgtaac

SEQ ID NO: 871212 - DNA, 25 bp, Mus musculus
tgcgtcttgtaagcctctttgtaac

SEQ ID NO: 871213 - DNA, 25 bp, Mus musculus
tgcgtgacccttctccggaaaagga

SEQ ID NO: 871214 - DNA, 25 bp, Mus musculus
tgcgtgacccttgtccggaaaagga

SEQ ID NO: 871215 - DNA, 25 bp, Mus musculus
tgcgtgacttttaccggcccttcaa

SEQ ID NO: 871216 - DNA, 25 bp, Mus musculus
tgcgtgactttttccggcccttcaa

SEQ ID NO: 871217 - DNA, 25 bp, Mus musculus
tgcgtgagaattataccagacttca

SEQ ID NO: 871218 - DNA, 25 bp, Mus musculus
tgcgtgagaattttaccagacttca

SEQ ID NO: 871219 - DNA, 25 bp, Mus musculus
tgcgtgaggtgtcccgagtgctgaa

SEQ ID NO: 871220 - DNA, 25 bp, Mus musculus
tgcgtgaggtgtgccgagtgctgaa

SEQ ID NO: 871221 - DNA, 25 bp, Mus musculus
tgcgtgatgcaaacaatgctgctat

SEQ ID NO: 871222 - DNA, 25 bp, Mus musculus
tgcgtgatgcaatcaatgctgctat

SEQ ID NO: 871223 - DNA, 25 bp, Mus musculus
tgcgtgcacactcttgaccacagct

SEQ ID NO: 871224 - DNA, 25 bp, Mus musculus
tgcgtgcacactgttgaccacagct

SEQ ID NO: 871225 - DNA, 25 bp, Mus musculus
tgcgtgcacatgatacactaccatg

SEQ ID NO: 871226 - DNA, 25 bp, Mus musculus
tgcgtgcacatgttacactaccatg

SEQ ID NO: 871227 - DNA, 25 bp, Mus musculus
tgcgtgcaccacacagtttgatact

SEQ ID NO: 871228 - DNA, 25 bp, Mus musculus
tgcgtgcaccactcagtttgatact

SEQ ID NO: 871229 - DNA, 25 bp, Mus musculus
tgcgtgcacctacttatctctcaga

SEQ ID NO: 871230 - DNA, 25 bp, Mus musculus
tgcgtgcacctagttatctctcaga

SEQ ID NO: 871231 - DNA, 25 bp, Mus musculus
tgcgtgcacgtgctatagaccatgt

SEQ ID NO: 871232 - DNA, 25 bp, Mus musculus
tgcgtgcacgtggtatagaccatgt

SEQ ID NO: 871233 - DNA, 25 bp, Mus musculus
tgcgtgcagctgactcagatccagg

SEQ ID NO: 871234 - DNA, 25 bp, Mus musculus
tgcgtgcagctgtctcagatccagg

SEQ ID NO: 871235 - DNA, 25 bp, Mus musculus
tgcgtgccatgtatgccaccaggtg

SEQ ID NO: 871236 - DNA, 25 bp, Mus musculus
tgcgtgccatgtttgccaccaggtg

SEQ ID NO: 871237 - DNA, 25 bp, Mus musculus
tgcgtgcccagccagagcatatcat

SEQ ID NO: 871238 - DNA, 25 bp, Mus musculus
tgcgtgcccagcgagagcatatcat

SEQ ID NO: 871239 - DNA, 25 bp, Mus musculus
tgcgtgcccggccacaggagcagga

SEQ ID NO: 871240 - DNA, 25 bp, Mus musculus
tgcgtgcccggcgacaggagcagga

SEQ ID NO: 871241 - DNA, 25 bp, Mus musculus
tgcgtgccggacaaagccatacatg

SEQ ID NO: 871242 - DNA, 25 bp, Mus musculus
tgcgtgccggactaagccatacatg

SEQ ID NO: 871243 - DNA, 25 bp, Mus musculus
tgcgtgcgctgaagaccggcagcac

SEQ ID NO: 871244 - DNA, 25 bp, Mus musculus
tgcgtgcgctgatgaccggcagcac

SEQ ID NO: 871245 - DNA, 25 bp, Mus musculus
tgcgtgcgggttatctgtaaaggcc

SEQ ID NO: 871246 - DNA, 25 bp, Mus musculus
tgcgtgcgggttttctgtaaaggcc

SEQ ID NO: 871247 - DNA, 25 bp, Mus musculus
tgcgtgctacgtatcagtttccttg

SEQ ID NO: 871248 - DNA, 25 bp, Mus musculus
tgcgtgctacgtttcagtttccttg

SEQ ID NO: 871249 - DNA, 25 bp, Mus musculus
tgcgtgctagggagtctctggtctc

SEQ ID NO: 871250 - DNA, 25 bp, Mus musculus
tgcgtgctagggtgtctctggtctc

SEQ ID NO: 871251 - DNA, 25 bp, Mus musculus
tgcgtgctgactctcaatcaggatg

SEQ ID NO: 871252 - DNA, 25 bp, Mus musculus
tgcgtgctgactgtcaatcaggatg

SEQ ID NO: 871253 - DNA, 25 bp, Mus musculus
tgcgtgcttgcgctacacaaacaca

SEQ ID NO: 871254 - DNA, 25 bp, Mus musculus
tgcgtgcttgcggtacacaaacaca

SEQ ID NO: 871255 - DNA, 25 bp, Mus musculus
tgcgtgcttgttagcctgcgtgcat

SEQ ID NO: 871256 - DNA, 25 bp, Mus musculus
tgcgtgcttgtttgcctgcgtgcat

SEQ ID NO: 871257 - DNA, 25 bp, Mus musculus
tgcgtggcaacgaggctgtctttaa

SEQ ID NO: 871258 - DNA, 25 bp, Mus musculus
tgcgtggcaacgtggctgtctttaa

SEQ ID NO: 871259 - DNA, 25 bp, Mus musculus
tgcgtggcccacagcgatgagtgca

SEQ ID NO: 871260 - DNA, 25 bp, Mus musculus
tgcgtggcccactgcgatgagtgca

SEQ ID NO: 871261 - DNA, 25 bp, Mus musculus
tgcgtggctcagatggcagaaaact

SEQ ID NO: 871262 - DNA, 25 bp, Mus musculus
tgcgtggctcagttggcagaaaact

SEQ ID NO: 871263 - DNA, 25 bp, Mus musculus
tgcgtggctcgcagcccctgaagct

SEQ ID NO: 871264 - DNA, 25 bp, Mus musculus
tgcgtggctcgctgcccctgaagct

SEQ ID NO: 871265 - DNA, 25 bp, Mus musculus
tgcgtgggtggaattcgcggttcac

SEQ ID NO: 871266 - DNA, 25 bp, Mus musculus
tgcgtgggtggatttcgcggttcac

SEQ ID NO: 871267 - DNA, 25 bp, Mus musculus
tgcgtggtatctcactctgtatcgg

SEQ ID NO: 871268 - DNA, 25 bp, Mus musculus
tgcgtggtatctgactctgtatcgg

SEQ ID NO: 871269 - DNA, 25 bp, Mus musculus
tgcgtggttgcaagtgtctttcatc

SEQ ID NO: 871270 - DNA, 25 bp, Mus musculus
tgcgtggttgcatgtgtctttcatc

SEQ ID NO: 871271 - DNA, 25 bp, Mus musculus
tgcgtgtacctgctgcgggactcac

SEQ ID NO: 871272 - DNA, 25 bp, Mus musculus
tgcgtgtacctggtgcgggactcac

SEQ ID NO: 871273 - DNA, 25 bp, Mus musculus
tgcgtgtagtgcctgtaccttgatg

SEQ ID NO: 871274 - DNA, 25 bp, Mus musculus
tgcgtgtagtgcgtgtaccttgatg

SEQ ID NO: 871275 - DNA, 25 bp, Mus musculus
tgcgtgtcacccatagattggacta

SEQ ID NO: 871276 - DNA, 25 bp, Mus musculus
tgcgtgtcacccttagattggacta

SEQ ID NO: 871277 - DNA, 25 bp, Mus musculus
tgcgtgtccaacatagatgtggtga

SEQ ID NO: 871278 - DNA, 25 bp, Mus musculus
tgcgtgtccaacttagatgtggtga

SEQ ID NO: 871279 - DNA, 25 bp, Mus musculus
tgcgtgtccgttcctgtgttgtgaa

SEQ ID NO: 871280 - DNA, 25 bp, Mus musculus
tgcgtgtccgttgctgtgttgtgaa

SEQ ID NO: 871281 - DNA, 25 bp, Mus musculus
tgcgtgtctgcgattatgggccgaa

SEQ ID NO: 871282 - DNA, 25 bp, Mus musculus
tgcgtgtctgcgtttatgggccgaa

SEQ ID NO: 871283 - DNA, 25 bp, Mus musculus
tgcgtgtgggcaatcagttctcttt

SEQ ID NO: 871284 - DNA, 25 bp, Mus musculus
tgcgtgtgggcattcagttctcttt

SEQ ID NO: 871285 - DNA, 25 bp, Mus musculus
tgcgtgtggtcaccctgctctatga

SEQ ID NO: 871286 - DNA, 25 bp, Mus musculus
tgcgtgtggtcagcctgctctatga

SEQ ID NO: 871287 - DNA, 25 bp, Mus musculus
tgcgtgtgtctcaaaagtgacatgt

SEQ ID NO: 871288 - DNA, 25 bp, Mus musculus
tgcgtgtgtctctaaagtgacatgt

SEQ ID NO: 871289 - DNA, 25 bp, Mus musculus
tgcgtgtgtgtgatgtctagtattc

SEQ ID NO: 871290 - DNA, 25 bp, Mus musculus
tgcgtgtgtgtgttgtctagtattc

SEQ ID NO: 871291 - DNA, 25 bp, Mus musculus
tgcgtgtgtgttccttatgcacaga

SEQ ID NO: 871292 - DNA, 25 bp, Mus musculus
tgcgtgtgtgttgcttatgcacaga

SEQ ID NO: 871293 - DNA, 25 bp, Mus musculus
tgcgtgtgttgcaccaataaagttt

SEQ ID NO: 871294 - DNA, 25 bp, Mus musculus
tgcgtgtgttgctccaataaagttt

SEQ ID NO: 871295 - DNA, 25 bp, Mus musculus
tgcgtgttctacctagcttgtgtgt

SEQ ID NO: 871296 - DNA, 25 bp, Mus musculus
tgcgtgttctacgtagcttgtgtgt

SEQ ID NO: 871297 - DNA, 25 bp, Mus musculus
tgcgtgttgagaagacaggtggaca

SEQ ID NO: 871298 - DNA, 25 bp, Mus musculus
tgcgtgttgagatgacaggtggaca

SEQ ID NO: 871299 - DNA, 25 bp, Mus musculus
tgcgtgtttcggcaccagttagatc

SEQ ID NO: 871300 - DNA, 25 bp, Mus musculus
tgcgtgtttcgggaccagttagatc

SEQ ID NO: 871301 - DNA, 25 bp, Mus musculus
tgcgttaataaccatgcccagtaat

SEQ ID NO: 871302 - DNA, 25 bp, Mus musculus
tgcgttaataacgatgcccagtaat

SEQ ID NO: 871303 - DNA, 25 bp, Mus musculus
tgcgttacagaaccagaaccttggg

SEQ ID NO: 871304 - DNA, 25 bp, Mus musculus
tgcgttacagaagcagaaccttggg

SEQ ID NO: 871305 - DNA, 25 bp, Mus musculus
tgcgttacggtcagagatgcctgct

SEQ ID NO: 871306 - DNA, 25 bp, Mus musculus
tgcgttacggtctgagatgcctgct

SEQ ID NO: 871307 - DNA, 25 bp, Mus musculus
tgcgttactaatacaaacaaatgtg

SEQ ID NO: 871308 - DNA, 25 bp, Mus musculus
tgcgttactaattcaaacaaatgtg

SEQ ID NO: 871309 - DNA, 25 bp, Mus musculus
tgcgttatggttcaggtcagactgt

SEQ ID NO: 871310 - DNA, 25 bp, Mus musculus
tgcgttatggttgaggtcagactgt

SEQ ID NO: 871311 - DNA, 25 bp, Mus musculus
tgcgttatttagcactctctccgtg

SEQ ID NO: 871312 - DNA, 25 bp, Mus musculus
tgcgttatttaggactctctccgtg

SEQ ID NO: 871313 - DNA, 25 bp, Mus musculus
tgcgttatttggagtgcttttgttc

SEQ ID NO: 871314 - DNA, 25 bp, Mus musculus
tgcgttatttggtgtgcttttgttc

SEQ ID NO: 871315 - DNA, 25 bp, Mus musculus
tgcgttcaagctctatgcctctctt

SEQ ID NO: 871316 - DNA, 25 bp, Mus musculus
tgcgttcaagctgtatgcctctctt

SEQ ID NO: 871317 - DNA, 25 bp, Mus musculus
tgcgttcacgtgagatgctaacacc

SEQ ID NO: 871318 - DNA, 25 bp, Mus musculus
tgcgttcacgtgtgatgctaacacc

SEQ ID NO: 871319 - DNA, 25 bp, Mus musculus
tgcgttcacttcagttcacatacta

SEQ ID NO: 871320 - DNA, 25 bp, Mus musculus
tgcgttcacttctgttcacatacta

SEQ ID NO: 871321 - DNA, 25 bp, Mus musculus
tgcgttcagaaaagcccatggttac

SEQ ID NO: 871322 - DNA, 25 bp, Mus musculus
tgcgttcagaaatgcccatggttac

SEQ ID NO: 871323 - DNA, 25 bp, Mus musculus
tgcgttcagccaatccacacttact

SEQ ID NO: 871324 - DNA, 25 bp, Mus musculus
tgcgttcagccattccacacttact

SEQ ID NO: 871325 - DNA, 25 bp, Mus musculus
tgcgttcattgcacttgagatgatc

SEQ ID NO: 871326 - DNA, 25 bp, Mus musculus
tgcgttcattgctcttgagatgatc

SEQ ID NO: 871327 - DNA, 25 bp, Mus musculus
tgcgttccatccaaacaaatacctg

SEQ ID NO: 871328 - DNA, 25 bp, Mus musculus
tgcgttccatcctaacaaatacctg

SEQ ID NO: 871329 - DNA, 25 bp, Mus musculus
tgcgttccccagaggaagttagggt

SEQ ID NO: 871330 - DNA, 25 bp, Mus musculus
tgcgttccccagtggaagttagggt

SEQ ID NO: 871331 - DNA, 25 bp, Mus musculus
tgcgttccctttaatgacagatttt

SEQ ID NO: 871332 - DNA, 25 bp, Mus musculus
tgcgttcccttttatgacagatttt

SEQ ID NO: 871333 - DNA, 25 bp, Mus musculus
tgcgttccttggagacttattaaaa

SEQ ID NO: 871334 - DNA, 25 bp, Mus musculus
tgcgttccttggtgacttattaaaa

SEQ ID NO: 871335 - DNA, 25 bp, Mus musculus
tgcgttcgcgagatcgaggccctgc

SEQ ID NO: 871336 - DNA, 25 bp, Mus musculus
tgcgttcgcgagttcgaggccctgc

SEQ ID NO: 871337 - DNA, 25 bp, Mus musculus
tgcgttcgtgtaatagtctagtctg

SEQ ID NO: 871338 - DNA, 25 bp, Mus musculus
tgcgttcgtgtattagtctagtctg

SEQ ID NO: 871339 - DNA, 25 bp, Mus musculus
tgcgttctggatacacagaccaagt

SEQ ID NO: 871340 - DNA, 25 bp, Mus musculus
tgcgttctggattcacagaccaagt

SEQ ID NO: 871341 - DNA, 25 bp, Mus musculus
tgcgttctggccagacttactgaaa

SEQ ID NO: 871342 - DNA, 25 bp, Mus musculus
tgcgttctggcctgacttactgaaa

SEQ ID NO: 871343 - DNA, 25 bp, Mus musculus
tgcgttctgtttacgaggaaggctg

SEQ ID NO: 871344 - DNA, 25 bp, Mus musculus
tgcgttctgttttcgaggaaggctg

SEQ ID NO: 871345 - DNA, 25 bp, Mus musculus
tgcgttcttgatcttgtttgccatg

SEQ ID NO: 871346 - DNA, 25 bp, Mus musculus
tgcgttcttgatgttgtttgccatg

SEQ ID NO: 871347 - DNA, 25 bp, Mus musculus
tgcgttctttcccaacttaaacctg

SEQ ID NO: 871348 - DNA, 25 bp, Mus musculus
tgcgttctttccgaacttaaacctg

SEQ ID NO: 871349 - DNA, 25 bp, Mus musculus
tgcgttgaccttacctgggctgtag

SEQ ID NO: 871350 - DNA, 25 bp, Mus musculus
tgcgttgacctttcctgggctgtag

SEQ ID NO: 871351 - DNA, 25 bp, Mus musculus
tgcgttgcaacccagattctaggta

SEQ ID NO: 871352 - DNA, 25 bp, Mus musculus
tgcgttgcaaccgagattctaggta

SEQ ID NO: 871353 - DNA, 25 bp, Mus musculus
tgcgttgcacccaatgtaatacctc

SEQ ID NO: 871354 - DNA, 25 bp, Mus musculus
tgcgttgcaccctatgtaatacctc

SEQ ID NO: 871355 - DNA, 25 bp, Mus musculus
tgcgttgcactcatctttttgaaag

SEQ ID NO: 871356 - DNA, 25 bp, Mus musculus
tgcgttgcactcttctttttgaaag

SEQ ID NO: 871357 - DNA, 25 bp, Mus musculus
tgcgttgcagttatgaagtcaccca

SEQ ID NO: 871358 - DNA, 25 bp, Mus musculus
tgcgttgcagttttgaagtcaccca

SEQ ID NO: 871359 - DNA, 25 bp, Mus musculus
tgcgttgccctgcacaagtctgaaa

SEQ ID NO: 871360 - DNA, 25 bp, Mus musculus
tgcgttgccctggacaagtctgaaa

SEQ ID NO: 871361 - DNA, 25 bp, Mus musculus
tgcgttggaagcacccatttcagtt

SEQ ID NO: 871362 - DNA, 25 bp, Mus musculus
tgcgttggaagctcccatttcagtt

SEQ ID NO: 871363 - DNA, 25 bp, Mus musculus
tgcgttggccacctgagggtacaca

SEQ ID NO: 871364 - DNA, 25 bp, Mus musculus
tgcgttggccacgtgagggtacaca

SEQ ID NO: 871365 - DNA, 25 bp, Mus musculus
tgcgttgttactagtagctgccatt

SEQ ID NO: 871366 - DNA, 25 bp, Mus musculus
tgcgttgttacttgtagctgccatt

SEQ ID NO: 871367 - DNA, 25 bp, Mus musculus
tgcgttgttttcaccttactgtaga

SEQ ID NO: 871368 - DNA, 25 bp, Mus musculus
tgcgttgttttctccttactgtaga

SEQ ID NO: 871369 - DNA, 25 bp, Mus musculus
tgcgtttaagatagttgtggttttt

SEQ ID NO: 871370 - DNA, 25 bp, Mus musculus
tgcgtttaagattgttgtggttttt

SEQ ID NO: 871371 - DNA, 25 bp, Mus musculus
tgcgtttatgtaccaggagggcttt

SEQ ID NO: 871372 - DNA, 25 bp, Mus musculus
tgcgtttatgtagcaggagggcttt

SEQ ID NO: 871373 - DNA, 25 bp, Mus musculus
tgcgtttcaagtaacagggaccata

SEQ ID NO: 871374 - DNA, 25 bp, Mus musculus
tgcgtttcaagttacagggaccata

SEQ ID NO: 871375 - DNA, 25 bp, Mus musculus
tgcgtttcagtacaatggtaatgag

SEQ ID NO: 871376 - DNA, 25 bp, Mus musculus
tgcgtttcagtagaatggtaatgag

SEQ ID NO: 871377 - DNA, 25 bp, Mus musculus
tgcgtttcatctcagccaaagctat

SEQ ID NO: 871378 - DNA, 25 bp, Mus musculus
tgcgtttcatctgagccaaagctat

SEQ ID NO: 871379 - DNA, 25 bp, Mus musculus
tgcgtttcattacctatggcgttct

SEQ ID NO: 871380 - DNA, 25 bp, Mus musculus
tgcgtttcattagctatggcgttct

SEQ ID NO: 871381 - DNA, 25 bp, Mus musculus
tgcgtttcccaaaattttaccatca

SEQ ID NO: 871382 - DNA, 25 bp, Mus musculus
tgcgtttcccaatattttaccatca

SEQ ID NO: 871383 - DNA, 25 bp, Mus musculus
tgcgtttccccgaaagatcaacgga

SEQ ID NO: 871384 - DNA, 25 bp, Mus musculus
tgcgtttccccgtaagatcaacgga

SEQ ID NO: 871385 - DNA, 25 bp, Mus musculus
tgcgtttcctccctaaattctattt

SEQ ID NO: 871386 - DNA, 25 bp, Mus musculus
tgcgtttcctccgtaaattctattt

SEQ ID NO: 871387 - DNA, 25 bp, Mus musculus
tgcgtttcctctcccggcaactgga

SEQ ID NO: 871388 - DNA, 25 bp, Mus musculus
tgcgtttcctctgccggcaactgga

SEQ ID NO: 871389 - DNA, 25 bp, Mus musculus
tgcgtttcgttccaattggccctgt

SEQ ID NO: 871390 - DNA, 25 bp, Mus musculus
tgcgtttcgttcgaattggccctgt

SEQ ID NO: 871391 - DNA, 25 bp, Mus musculus
tgcgtttctataagtttgcccagtt

SEQ ID NO: 871392 - DNA, 25 bp, Mus musculus
tgcgtttctatatgtttgcccagtt

SEQ ID NO: 871393 - DNA, 25 bp, Mus musculus
tgcgtttgagcacagcaggccgaaa

SEQ ID NO: 871394 - DNA, 25 bp, Mus musculus
tgcgtttgagcagagcaggccgaaa

SEQ ID NO: 871395 - DNA, 25 bp, Mus musculus
tgcgtttgcaccatttgttgggaag

SEQ ID NO: 871396 - DNA, 25 bp, Mus musculus
tgcgtttgcaccttttgttgggaag

SEQ ID NO: 871397 - DNA, 25 bp, Mus musculus
tgcgtttgcctcagcggatatgttt

SEQ ID NO: 871398 - DNA, 25 bp, Mus musculus
tgcgtttgcctctgcggatatgttt

SEQ ID NO: 871399 - DNA, 25 bp, Mus musculus
tgcgttttatttacaggtaccctct

SEQ ID NO: 871400 - DNA, 25 bp, Mus musculus
tgcgttttattttcaggtaccctct

SEQ ID NO: 871401 - DNA, 25 bp, Mus musculus
tgcgttttcccaccatcttttgata

SEQ ID NO: 871402 - DNA, 25 bp, Mus musculus
tgcgttttcccagcatcttttgata

SEQ ID NO: 871403 - DNA, 25 bp, Mus musculus
tgcgttttctagagctgatcctgga

SEQ ID NO: 871404 - DNA, 25 bp, Mus musculus
tgcgttttctagtgctgatcctgga

SEQ ID NO: 871405 - DNA, 25 bp, Mus musculus
tgctaaaaaccaattattttgcttt

SEQ ID NO: 871406 - DNA, 25 bp, Mus musculus
tgctaaaaaccatttattttgcttt

SEQ ID NO: 871407 - DNA, 25 bp, Mus musculus
tgctaaaaccatacttccacccgga

SEQ ID NO: 871408 - DNA, 25 bp, Mus musculus
tgctaaaaccattcttccacccgga

SEQ ID NO: 871409 - DNA, 25 bp, Mus musculus
tgctaaaaccccatcactagtgagt

SEQ ID NO: 871410 - DNA, 25 bp, Mus musculus
tgctaaaaccccttcactagtgagt

SEQ ID NO: 871411 - DNA, 25 bp, Mus musculus
tgctaaaattccatggcgggaattt

SEQ ID NO: 871412 - DNA, 25 bp, Mus musculus
tgctaaaattccttggcgggaattt

SEQ ID NO: 871413 - DNA, 25 bp, Mus musculus
tgctaaacagctattctagccccaa

SEQ ID NO: 871414 - DNA, 25 bp, Mus musculus
tgctaaacagcttttctagccccaa

SEQ ID NO: 871415 - DNA, 25 bp, Mus musculus
tgctaaacatcaaatgctcaacttg

SEQ ID NO: 871416 - DNA, 25 bp, Mus musculus
tgctaaacatcatatgctcaacttg

SEQ ID NO: 871417 - DNA, 25 bp, Mus musculus
tgctaaacccttcgtgtgcctgaga

SEQ ID NO: 871418 - DNA, 25 bp, Mus musculus
tgctaaacccttggtgtgcctgaga

SEQ ID NO: 871419 - DNA, 25 bp, Mus musculus
tgctaaaccttaattgtcttcatca

SEQ ID NO: 871420 - DNA, 25 bp, Mus musculus
tgctaaaccttatttgtcttcatca

SEQ ID NO: 871421 - DNA, 25 bp, Mus musculus
tgctaaactagcctttgagtacctc

SEQ ID NO: 871422 - DNA, 25 bp, Mus musculus
tgctaaactagcgtttgagtacctc

SEQ ID NO: 871423 - DNA, 25 bp, Mus musculus
tgctaaactcagagatggaccagta

SEQ ID NO: 871424 - DNA, 25 bp, Mus musculus
tgctaaactcagtgatggaccagta

SEQ ID NO: 871425 - DNA, 25 bp, Mus musculus
tgctaaagactgactcaaggctgga

SEQ ID NO: 871426 - DNA, 25 bp, Mus musculus
tgctaaagactgtctcaaggctgga

SEQ ID NO: 871427 - DNA, 25 bp, Mus musculus
tgctaaagatctaccctgactctga

SEQ ID NO: 871428 - DNA, 25 bp, Mus musculus
tgctaaagatcttccctgactctga

SEQ ID NO: 871429 - DNA, 25 bp, Mus musculus
tgctaaaggcgtcggctcggcccat

SEQ ID NO: 871430 - DNA, 25 bp, Mus musculus
tgctaaaggcgtgggctcggcccat

SEQ ID NO: 871431 - DNA, 25 bp, Mus musculus
tgctaaagtccactgccaggtgttt

SEQ ID NO: 871432 - DNA, 25 bp, Mus musculus
tgctaaagtccagtgccaggtgttt

SEQ ID NO: 871433 - DNA, 25 bp, Mus musculus
tgctaaagtgcgaacaggtgctggc

SEQ ID NO: 871434 - DNA, 25 bp, Mus musculus
tgctaaagtgcgtacaggtgctggc

SEQ ID NO: 871435 - DNA, 25 bp, Mus musculus
tgctaaatgcttctgtgtcttctgt

SEQ ID NO: 871436 - DNA, 25 bp, Mus musculus
tgctaaatgcttgtgtgtcttctgt

SEQ ID NO: 871437 - DNA, 25 bp, Mus musculus
tgctaaattagaacctccattcccc

SEQ ID NO: 871438 - DNA, 25 bp, Mus musculus
tgctaaattagatcctccattcccc

SEQ ID NO: 871439 - DNA, 25 bp, Mus musculus
tgctaaattgctcagactggcctgt

SEQ ID NO: 871440 - DNA, 25 bp, Mus musculus
tgctaaattgctgagactggcctgt

SEQ ID NO: 871441 - DNA, 25 bp, Mus musculus
tgctaacaagtaccccatcttcaga

SEQ ID NO: 871442 - DNA, 25 bp, Mus musculus
tgctaacaagtagcccatcttcaga

SEQ ID NO: 871443 - DNA, 25 bp, Mus musculus
tgctaacacactctaactcacggtt

SEQ ID NO: 871444 - DNA, 25 bp, Mus musculus
tgctaacacactgtaactcacggtt

SEQ ID NO: 871445 - DNA, 25 bp, Mus musculus
tgctaacagaatccaggccaggctt

SEQ ID NO: 871446 - DNA, 25 bp, Mus musculus
tgctaacagaatgcaggccaggctt

SEQ ID NO: 871447 - DNA, 25 bp, Mus musculus
tgctaacaggagaaccaggctgcta

SEQ ID NO: 871448 - DNA, 25 bp, Mus musculus
tgctaacaggagtaccaggctgcta

SEQ ID NO: 871449 - DNA, 25 bp, Mus musculus
tgctaaccagacacaatccctacag

SEQ ID NO: 871450 - DNA, 25 bp, Mus musculus
tgctaaccagactcaatccctacag

SEQ ID NO: 871451 - DNA, 25 bp, Mus musculus
tgctaacccactaagtccagtcagt

SEQ ID NO: 871452 - DNA, 25 bp, Mus musculus
tgctaacccacttagtccagtcagt

SEQ ID NO: 871453 - DNA, 25 bp, Mus musculus
tgctaaccccatacaatgtgccaaa

SEQ ID NO: 871454 - DNA, 25 bp, Mus musculus
tgctaaccccattcaatgtgccaaa

SEQ ID NO: 871455 - DNA, 25 bp, Mus musculus
tgctaaccccttctcttcaatagtt

SEQ ID NO: 871456 - DNA, 25 bp, Mus musculus
tgctaaccccttgtcttcaatagtt

SEQ ID NO: 871457 - DNA, 25 bp, Mus musculus
tgctaaccgctgagcagaaccacct

SEQ ID NO: 871458 - DNA, 25 bp, Mus musculus
tgctaaccgctgtgcagaaccacct

SEQ ID NO: 871459 - DNA, 25 bp, Mus musculus
tgctaacgagcaatccactgcggag

SEQ ID NO: 871460 - DNA, 25 bp, Mus musculus
tgctaacgagcattccactgcggag

SEQ ID NO: 871461 - DNA, 25 bp, Mus musculus
tgctaacgatagcatcttgaacgac

SEQ ID NO: 871462 - DNA, 25 bp, Mus musculus
tgctaacgataggatcttgaacgac

SEQ ID NO: 871463 - DNA, 25 bp, Mus musculus
tgctaacgctcaagctcacacacta

SEQ ID NO: 871464 - DNA, 25 bp, Mus musculus
tgctaacgctcatgctcacacacta

SEQ ID NO: 871465 - DNA, 25 bp, Mus musculus
tgctaacgggaaattgtgccattat

SEQ ID NO: 871466 - DNA, 25 bp, Mus musculus
tgctaacgggaatttgtgccattat

SEQ ID NO: 871467 - DNA, 25 bp, Mus musculus
tgctaactcaatccccaatttgtgg

SEQ ID NO: 871468 - DNA, 25 bp, Mus musculus
tgctaactcaatgcccaatttgtgg

SEQ ID NO: 871469 - DNA, 25 bp, Mus musculus
tgctaactcagcatttctaatgtat

SEQ ID NO: 871470 - DNA, 25 bp, Mus musculus
tgctaactcagcttttctaatgtat

SEQ ID NO: 871471 - DNA, 25 bp, Mus musculus
tgctaactcagtatttcacacaccc

SEQ ID NO: 871472 - DNA, 25 bp, Mus musculus
tgctaactcagtttttcacacaccc

SEQ ID NO: 871473 - DNA, 25 bp, Mus musculus
tgctaacttaacaaggcctttcttt

SEQ ID NO: 871474 - DNA, 25 bp, Mus musculus
tgctaacttaactaggcctttcttt

SEQ ID NO: 871475 - DNA, 25 bp, Mus musculus
tgctaacttgcccttggcatgggtc

SEQ ID NO: 871476 - DNA, 25 bp, Mus musculus
tgctaacttgccgttggcatgggtc

SEQ ID NO: 871477 - DNA, 25 bp, Mus musculus
tgctaactttagcactgcgctccga

SEQ ID NO: 871478 - DNA, 25 bp, Mus musculus
tgctaactttaggactgcgctccga

SEQ ID NO: 871479 - DNA, 25 bp, Mus musculus
tgctaagaaactcctgggtaccccg

SEQ ID NO: 871480 - DNA, 25 bp, Mus musculus
tgctaagaaactgctgggtaccccg

SEQ ID NO: 871481 - DNA, 25 bp, Mus musculus
tgctaagaagctaagatcgttcacc

SEQ ID NO: 871482 - DNA, 25 bp, Mus musculus
tgctaagaagcttagatcgttcacc

SEQ ID NO: 871483 - DNA, 25 bp, Mus musculus
tgctaagaatttacctcttttcccg

SEQ ID NO: 871484 - DNA, 25 bp, Mus musculus
tgctaagaattttcctcttttcccg

SEQ ID NO: 871485 - DNA, 25 bp, Mus musculus
tgctaagagcacatatccctgttcc

SEQ ID NO: 871486 - DNA, 25 bp, Mus musculus
tgctaagagcacttatccctgttcc

SEQ ID NO: 871487 - DNA, 25 bp, Mus musculus
tgctaagaggctaccatctcaatgt

SEQ ID NO: 871488 - DNA, 25 bp, Mus musculus
tgctaagaggcttccatctcaatgt

SEQ ID NO: 871489 - DNA, 25 bp, Mus musculus
tgctaagatacaaactagtcctaat

SEQ ID NO: 871490 - DNA, 25 bp, Mus musculus
tgctaagatacatactagtcctaat

SEQ ID NO: 871491 - DNA, 25 bp, Mus musculus
tgctaagatcaaaggtatgctctac

SEQ ID NO: 871492 - DNA, 25 bp, Mus musculus
tgctaagatcaatggtatgctctac

SEQ ID NO: 871493 - DNA, 25 bp, Mus musculus
tgctaagattttcccatcccgttcc

SEQ ID NO: 871494 - DNA, 25 bp, Mus musculus
tgctaagattttgccatcccgttcc

SEQ ID NO: 871495 - DNA, 25 bp, Mus musculus
tgctaagcacttcaggccacttgga

SEQ ID NO: 871496 - DNA, 25 bp, Mus musculus
tgctaagcacttgaggccacttgga

SEQ ID NO: 871497 - DNA, 25 bp, Mus musculus
tgctaagcaggtcgacttctggttt

SEQ ID NO: 871498 - DNA, 25 bp, Mus musculus
tgctaagcaggtggacttctggttt

SEQ ID NO: 871499 - DNA, 25 bp, Mus musculus
tgctaagcatgtcaggcctggccta

SEQ ID NO: 871500 - DNA, 25 bp, Mus musculus
tgctaagcatgtctcacaaaacctg

SEQ ID NO: 871501 - DNA, 25 bp, Mus musculus
tgctaagcatgtgaggcctggccta

SEQ ID NO: 871502 - DNA, 25 bp, Mus musculus
tgctaagcatgtgtcacaaaacctg

SEQ ID NO: 871503 - DNA, 25 bp, Mus musculus
tgctaagccagaactacccaagtct

SEQ ID NO: 871504 - DNA, 25 bp, Mus musculus
tgctaagccagatctacccaagtct

SEQ ID NO: 871505 - DNA, 25 bp, Mus musculus
tgctaagccatcacaggccctaaaa

SEQ ID NO: 871506 - DNA, 25 bp, Mus musculus
tgctaagccatctcaggccctaaaa

SEQ ID NO: 871507 - DNA, 25 bp, Mus musculus
tgctaagccggaatttgacctgaat

SEQ ID NO: 871508 - DNA, 25 bp, Mus musculus
tgctaagccggattttgacctgaat

SEQ ID NO: 871509 - DNA, 25 bp, Mus musculus
tgctaaggacctagactactcacag

SEQ ID NO: 871510 - DNA, 25 bp, Mus musculus
tgctaaggaccttgactactcacag

SEQ ID NO: 871511 - DNA, 25 bp, Mus musculus
tgctaaggagtaagggcctgcctgt

SEQ ID NO: 871512 - DNA, 25 bp, Mus musculus
tgctaaggagtatgggcctgcctgt

SEQ ID NO: 871513 - DNA, 25 bp, Mus musculus
tgctaaggccataagaggcagggaa

SEQ ID NO: 871514 - DNA, 25 bp, Mus musculus
tgctaaggccattagaggcagggaa

SEQ ID NO: 871515 - DNA, 25 bp, Mus musculus
tgctaagggttaccccatgaatcgt

SEQ ID NO: 871516 - DNA, 25 bp, Mus musculus
tgctaagggttagcccatgaatcgt

SEQ ID NO: 871517 - DNA, 25 bp, Mus musculus
tgctaaggtgagacaggttcccaga

SEQ ID NO: 871518 - DNA, 25 bp, Mus musculus
tgctaaggtgagtcaggttcccaga

SEQ ID NO: 871519 - DNA, 25 bp, Mus musculus
tgctaaggttcacctccgacgcttg

SEQ ID NO: 871520 - DNA, 25 bp, Mus musculus
tgctaaggttcagctccgacgcttg

SEQ ID NO: 871521 - DNA, 25 bp, Mus musculus
tgctaagtacacatcctaccactag

SEQ ID NO: 871522 - DNA, 25 bp, Mus musculus
tgctaagtacacttcctaccactag

SEQ ID NO: 871523 - DNA, 25 bp, Mus musculus
tgctaagtctgcatgaccagtatgt

SEQ ID NO: 871524 - DNA, 25 bp, Mus musculus
tgctaagtctgcttgaccagtatgt

SEQ ID NO: 871525 - DNA, 25 bp, Mus musculus
tgctaagtgctgcacagaagcctgg

SEQ ID NO: 871526 - DNA, 25 bp, Mus musculus
tgctaagtgctggacagaagcctgg

SEQ ID NO: 871527 - DNA, 25 bp, Mus musculus
tgctaagtttttcctttgaccctcc

SEQ ID NO: 871528 - DNA, 25 bp, Mus musculus
tgctaagtttttgctttgaccctcc

SEQ ID NO: 871529 - DNA, 25 bp, Mus musculus
tgctaataactcatgggagccatct

SEQ ID NO: 871530 - DNA, 25 bp, Mus musculus
tgctaataactcttgggagccatct

SEQ ID NO: 871531 - DNA, 25 bp, Mus musculus
tgctaatacctgaatgtggcattta

SEQ ID NO: 871532 - DNA, 25 bp, Mus musculus
tgctaatacctgtatgtggcattta

SEQ ID NO: 871533 - DNA, 25 bp, Mus musculus
tgctaatacggcatccttcctttga

SEQ ID NO: 871534 - DNA, 25 bp, Mus musculus
tgctaatacggcttccttcctttga

SEQ ID NO: 871535 - DNA, 25 bp, Mus musculus
tgctaatcccctctttatatgcctt

SEQ ID NO: 871536 - DNA, 25 bp, Mus musculus
tgctaatcccctgtttatatgcctt

SEQ ID NO: 871537 - DNA, 25 bp, Mus musculus
tgctaatccctgctttgaataagtc

SEQ ID NO: 871538 - DNA, 25 bp, Mus musculus
tgctaatccctggtttgaataagtc

SEQ ID NO: 871539 - DNA, 25 bp, Mus musculus
tgctaatcccttacatggaacccat

SEQ ID NO: 871540 - DNA, 25 bp, Mus musculus
tgctaatccctttcatggaacccat

SEQ ID NO: 871541 - DNA, 25 bp, Mus musculus
tgctaatctcttaaaagaccctccc

SEQ ID NO: 871542 - DNA, 25 bp, Mus musculus
tgctaatctctttaaagaccctccc

SEQ ID NO: 871543 - DNA, 25 bp, Mus musculus
tgctaatgacgacacagccacccgg

SEQ ID NO: 871544 - DNA, 25 bp, Mus musculus
tgctaatgacgagacagccacccgg

SEQ ID NO: 871545 - DNA, 25 bp, Mus musculus
tgctaatgctatcatccctggtgac

SEQ ID NO: 871546 - DNA, 25 bp, Mus musculus
tgctaatgctatgatccctggtgac

SEQ ID NO: 871547 - DNA, 25 bp, Mus musculus
tgctaatgctctattgttctcttga

SEQ ID NO: 871548 - DNA, 25 bp, Mus musculus
tgctaatgctcttttgttctcttga

SEQ ID NO: 871549 - DNA, 25 bp, Mus musculus
tgctaatgctgacactgttgtatgc

SEQ ID NO: 871550 - DNA, 25 bp, Mus musculus
tgctaatgctgagactgttgtatgc

SEQ ID NO: 871551 - DNA, 25 bp, Mus musculus
tgctaatgctgcatcttcactcctg

SEQ ID NO: 871552 - DNA, 25 bp, Mus musculus
tgctaatgctgcttcttcactcctg

SEQ ID NO: 871553 - DNA, 25 bp, Mus musculus
tgctaatggcacaaggacctcactt

SEQ ID NO: 871554 - DNA, 25 bp, Mus musculus
tgctaatggcactaggacctcactt

SEQ ID NO: 871555 - DNA, 25 bp, Mus musculus
tgctaatggcctctacagcagcctg

SEQ ID NO: 871556 - DNA, 25 bp, Mus musculus
tgctaatggcctgtacagcagcctg

SEQ ID NO: 871557 - DNA, 25 bp, Mus musculus
tgctaatgtcttcagatcgcccagg

SEQ ID NO: 871558 - DNA, 25 bp, Mus musculus
tgctaatgtcttgagatcgcccagg

SEQ ID NO: 871559 - DNA, 25 bp, Mus musculus
tgctaattgcttcccgctgtgaaac

SEQ ID NO: 871560 - DNA, 25 bp, Mus musculus
tgctaattgcttgccgctgtgaaac

SEQ ID NO: 871561 - DNA, 25 bp, Mus musculus
tgctacacagacaagctttcccatc

SEQ ID NO: 871562 - DNA, 25 bp, Mus musculus
tgctacacagactagctttcccatc

SEQ ID NO: 871563 - DNA, 25 bp, Mus musculus
tgctacaccaatcgatcctcactgg

SEQ ID NO: 871564 - DNA, 25 bp, Mus musculus
tgctacaccaatggatcctcactgg

SEQ ID NO: 871565 - DNA, 25 bp, Mus musculus
tgctacacctgcagcacctgaggca

SEQ ID NO: 871566 - DNA, 25 bp, Mus musculus
tgctacacctgctgcacctgaggca

SEQ ID NO: 871567 - DNA, 25 bp, Mus musculus
tgctacacgcgcagctattggcact

SEQ ID NO: 871568 - DNA, 25 bp, Mus musculus
tgctacacgcgctgctattggcact

SEQ ID NO: 871569 - DNA, 25 bp, Mus musculus
tgctacactgtaatgcagcttttat

SEQ ID NO: 871570 - DNA, 25 bp, Mus musculus
tgctacactgtattgcagcttttat

SEQ ID NO: 871571 - DNA, 25 bp, Mus musculus
tgctacagaaggctggatgcttcta

SEQ ID NO: 871572 - DNA, 25 bp, Mus musculus
tgctacagaagggtggatgcttcta

SEQ ID NO: 871573 - DNA, 25 bp, Mus musculus
tgctacagaattaggcctggcctct

SEQ ID NO: 871574 - DNA, 25 bp, Mus musculus
tgctacagaatttggcctggcctct

SEQ ID NO: 871575 - DNA, 25 bp, Mus musculus
tgctacagacagacgacactcctat

SEQ ID NO: 871576 - DNA, 25 bp, Mus musculus
tgctacagacagtcgacactcctat

SEQ ID NO: 871577 - DNA, 25 bp, Mus musculus
tgctacagcacaacgacttcacgga

SEQ ID NO: 871578 - DNA, 25 bp, Mus musculus
tgctacagcacatcgacttcacgga

SEQ ID NO: 871579 - DNA, 25 bp, Mus musculus
tgctacagccagaaagaaccccgtt

SEQ ID NO: 871580 - DNA, 25 bp, Mus musculus
tgctacagccagtaagaaccccgtt

SEQ ID NO: 871581 - DNA, 25 bp, Mus musculus
tgctacagcccacactggagatcaa

SEQ ID NO: 871582 - DNA, 25 bp, Mus musculus
tgctacagcccagactggagatcaa

SEQ ID NO: 871583 - DNA, 25 bp, Mus musculus
tgctacagcgtgctctgctggtctt

SEQ ID NO: 871584 - DNA, 25 bp, Mus musculus
tgctacagcgtggtctgctggtctt

SEQ ID NO: 871585 - DNA, 25 bp, Mus musculus
tgctacaggcacatttactattaag

SEQ ID NO: 871586 - DNA, 25 bp, Mus musculus
tgctacaggcacttttactattaag

SEQ ID NO: 871587 - DNA, 25 bp, Mus musculus
tgctacaggccaatcgcggcttcct

SEQ ID NO: 871588 - DNA, 25 bp, Mus musculus
tgctacaggccactgtctgtctatc

SEQ ID NO: 871589 - DNA, 25 bp, Mus musculus
tgctacaggccagtgtctgtctatc

SEQ ID NO: 871590 - DNA, 25 bp, Mus musculus
tgctacaggccattcgcggcttcct

SEQ ID NO: 871591 - DNA, 25 bp, Mus musculus
tgctacagggctacatcaacaactc

SEQ ID NO: 871592 - DNA, 25 bp, Mus musculus
tgctacagggcttcatcaacaactc

SEQ ID NO: 871593 - DNA, 25 bp, Mus musculus
tgctacagtcggagtgtgtattccg

SEQ ID NO: 871594 - DNA, 25 bp, Mus musculus
tgctacagtcggtgtgtgtattccg

SEQ ID NO: 871595 - DNA, 25 bp, Mus musculus
tgctacatatgaaaccctgacccag

SEQ ID NO: 871596 - DNA, 25 bp, Mus musculus
tgctacatatgataccctgacccag

SEQ ID NO: 871597 - DNA, 25 bp, Mus musculus
tgctacatgcgaagcgattgctatc

SEQ ID NO: 871598 - DNA, 25 bp, Mus musculus
tgctacatgcgatgcgattgctatc

SEQ ID NO: 871599 - DNA, 25 bp, Mus musculus
tgctaccaagtgcctatgaattgac

SEQ ID NO: 871600 - DNA, 25 bp, Mus musculus
tgctaccaagtggctatgaattgac

SEQ ID NO: 871601 - DNA, 25 bp, Mus musculus
tgctaccacaccatggcacaaagtt

SEQ ID NO: 871602 - DNA, 25 bp, Mus musculus
tgctaccacaccttggcacaaagtt

SEQ ID NO: 871603 - DNA, 25 bp, Mus musculus
tgctaccactgtctgtcatcttttt

SEQ ID NO: 871604 - DNA, 25 bp, Mus musculus
tgctaccactgtgtgtcatcttttt

SEQ ID NO: 871605 - DNA, 25 bp, Mus musculus
tgctaccagacacagctcagcgatt

SEQ ID NO: 871606 - DNA, 25 bp, Mus musculus
tgctaccagacagagctcagcgatt

SEQ ID NO: 871607 - DNA, 25 bp, Mus musculus
tgctaccagggtatgtgaagaccag

SEQ ID NO: 871608 - DNA, 25 bp, Mus musculus
tgctaccagggtttgtgaagaccag

SEQ ID NO: 871609 - DNA, 25 bp, Mus musculus
tgctaccagtggagactgagatgtt

SEQ ID NO: 871610 - DNA, 25 bp, Mus musculus
tgctaccagtggtgactgagatgtt

SEQ ID NO: 871611 - DNA, 25 bp, Mus musculus
tgctaccatccgcacgaaaagtggg

SEQ ID NO: 871612 - DNA, 25 bp, Mus musculus
tgctaccatccggacgaaaagtggg

SEQ ID NO: 871613 - DNA, 25 bp, Mus musculus
tgctaccatgccctgtttaaaatta

SEQ ID NO: 871614 - DNA, 25 bp, Mus musculus
tgctaccatgccgtgtttaaaatta

SEQ ID NO: 871615 - DNA, 25 bp, Mus musculus
tgctaccattccattagtcccttgt

SEQ ID NO: 871616 - DNA, 25 bp, Mus musculus
tgctaccattcctttagtcccttgt

SEQ ID NO: 871617 - DNA, 25 bp, Mus musculus
tgctacccaacgagggcactggaaa

SEQ ID NO: 871618 - DNA, 25 bp, Mus musculus
tgctacccaacgtgggcactggaaa

SEQ ID NO: 871619 - DNA, 25 bp, Mus musculus
tgctacccagccaggtttcttcgag

SEQ ID NO: 871620 - DNA, 25 bp, Mus musculus
tgctacccagcctggtttcttcgag

SEQ ID NO: 871621 - DNA, 25 bp, Mus musculus
tgctaccccagaattgaaatccaag

SEQ ID NO: 871622 - DNA, 25 bp, Mus musculus
tgctaccccagatttgaaatccaag

SEQ ID NO: 871623 - DNA, 25 bp, Mus musculus
tgctacccccaaattaacttcaaat

SEQ ID NO: 871624 - DNA, 25 bp, Mus musculus
tgctacccccaatttaacttcaaat

SEQ ID NO: 871625 - DNA, 25 bp, Mus musculus
tgctaccccgaaacattgaggccaa

SEQ ID NO: 871626 - DNA, 25 bp, Mus musculus
tgctaccccgaatcattgaggccaa

SEQ ID NO: 871627 - DNA, 25 bp, Mus musculus
tgctacccctctagaacttgggtgg

SEQ ID NO: 871628 - DNA, 25 bp, Mus musculus
tgctacccctcttgaacttgggtgg

SEQ ID NO: 871629 - DNA, 25 bp, Mus musculus
tgctacccgggcatggcactccagg

SEQ ID NO: 871630 - DNA, 25 bp, Mus musculus
tgctacccgggcttggcactccagg

SEQ ID NO: 871631 - DNA, 25 bp, Mus musculus
tgctaccctggcattgacatcagag

SEQ ID NO: 871632 - DNA, 25 bp, Mus musculus
tgctaccctggctttgacatcagag

SEQ ID NO: 871633 - DNA, 25 bp, Mus musculus
tgctacccttgaatttcgctttttt

SEQ ID NO: 871634 - DNA, 25 bp, Mus musculus
tgctacccttgattttcgctttttt

SEQ ID NO: 871635 - DNA, 25 bp, Mus musculus
tgctacctatctacagagcagcctc

SEQ ID NO: 871636 - DNA, 25 bp, Mus musculus
tgctacctatcttcagagcagcctc

SEQ ID NO: 871637 - DNA, 25 bp, Mus musculus
tgctacctatgtcctcaagtgccat

SEQ ID NO: 871638 - DNA, 25 bp, Mus musculus
tgctacctatgtgctcaagtgccat

SEQ ID NO: 871639 - DNA, 25 bp, Mus musculus
tgctacctcccaatctggatgtaga

SEQ ID NO: 871640 - DNA, 25 bp, Mus musculus
tgctacctcccattctggatgtaga

SEQ ID NO: 871641 - DNA, 25 bp, Mus musculus
tgctacctcttgacatcatcttaaa

SEQ ID NO: 871642 - DNA, 25 bp, Mus musculus
tgctacctcttgtcatcatcttaaa

SEQ ID NO: 871643 - DNA, 25 bp, Mus musculus
tgctacctgctgaatctattatatg

SEQ ID NO: 871644 - DNA, 25 bp, Mus musculus
tgctacctgctgtatctattatatg

SEQ ID NO: 871645 - DNA, 25 bp, Mus musculus
tgctacctggacattgcctggtgcc

SEQ ID NO: 871646 - DNA, 25 bp, Mus musculus
tgctacctggactttgcctggtgcc

SEQ ID NO: 871647 - DNA, 25 bp, Mus musculus
tgctaccttaggacagcagctgaat

SEQ ID NO: 871648 - DNA, 25 bp, Mus musculus
tgctaccttaggtcagcagctgaat

SEQ ID NO: 871649 - DNA, 25 bp, Mus musculus
tgctaccttgccattctggaattcc

SEQ ID NO: 871650 - DNA, 25 bp, Mus musculus
tgctaccttgcctttctggaattcc

SEQ ID NO: 871651 - DNA, 25 bp, Mus musculus
tgctacgactgaaccagaaccagct

SEQ ID NO: 871652 - DNA, 25 bp, Mus musculus
tgctacgactgatccagaaccagct

SEQ ID NO: 871653 - DNA, 25 bp, Mus musculus
tgctacgagagcacccgtcgggctg

SEQ ID NO: 871654 - DNA, 25 bp, Mus musculus
tgctacgagagctcccgtcgggctg

SEQ ID NO: 871655 - DNA, 25 bp, Mus musculus
tgctacgatgccaggaatgtccagt

SEQ ID NO: 871656 - DNA, 25 bp, Mus musculus
tgctacgatgcctggaatgtccagt

SEQ ID NO: 871657 - DNA, 25 bp, Mus musculus
tgctacgcccagattttacacagtg

SEQ ID NO: 871658 - DNA, 25 bp, Mus musculus
tgctacgcccagtttttacacagtg

SEQ ID NO: 871659 - DNA, 25 bp, Mus musculus
tgctacgccggcagctagaggtcca

SEQ ID NO: 871660 - DNA, 25 bp, Mus musculus
tgctacgccggctgctagaggtcca

SEQ ID NO: 871661 - DNA, 25 bp, Mus musculus
tgctacgcgtcaaacgcctggagaa

SEQ ID NO: 871662 - DNA, 25 bp, Mus musculus
tgctacgcgtcatacgcctggagaa

SEQ ID NO: 871663 - DNA, 25 bp, Mus musculus
tgctacgctaggcactaagcttcca

SEQ ID NO: 871664 - DNA, 25 bp, Mus musculus
tgctacgctagggactaagcttcca

SEQ ID NO: 871665 - DNA, 25 bp, Mus musculus
tgctacggttttaaataacacattt

SEQ ID NO: 871666 - DNA, 25 bp, Mus musculus
tgctacggtttttaataacacattt

SEQ ID NO: 871667 - DNA, 25 bp, Mus musculus
tgctacgttggactgtgacacacct

SEQ ID NO: 871668 - DNA, 25 bp, Mus musculus
tgctacgttggagtgtgacacacct

SEQ ID NO: 871669 - DNA, 25 bp, Mus musculus
tgctactaatgacgatgctttggtc

SEQ ID NO: 871670 - DNA, 25 bp, Mus musculus
tgctactaatgaggatgctttggtc

SEQ ID NO: 871671 - DNA, 25 bp, Mus musculus
tgctactacatcagctgtccttgag

SEQ ID NO: 871672 - DNA, 25 bp, Mus musculus
tgctactacatctgctgtccttgag

SEQ ID NO: 871673 - DNA, 25 bp, Mus musculus
tgctactcagacctttggtatgtaa

SEQ ID NO: 871674 - DNA, 25 bp, Mus musculus
tgctactcagacgtttggtatgtaa

SEQ ID NO: 871675 - DNA, 25 bp, Mus musculus
tgctactcagcaagctctggatgga

SEQ ID NO: 871676 - DNA, 25 bp, Mus musculus
tgctactcagcatgctctggatgga

SEQ ID NO: 871677 - DNA, 25 bp, Mus musculus
tgctactcagctagagcccagttcc

SEQ ID NO: 871678 - DNA, 25 bp, Mus musculus
tgctactcagcttgagcccagttcc

SEQ ID NO: 871679 - DNA, 25 bp, Mus musculus
tgctactcattaaggcaagttcatt

SEQ ID NO: 871680 - DNA, 25 bp, Mus musculus
tgctactcattatggcaagttcatt

SEQ ID NO: 871681 - DNA, 25 bp, Mus musculus
tgctactcattcatccgaactgaac

SEQ ID NO: 871682 - DNA, 25 bp, Mus musculus
tgctactcattcttccgaactgaac

SEQ ID NO: 871683 - DNA, 25 bp, Mus musculus
tgctactcccaaattagaagaaggt

SEQ ID NO: 871684 - DNA, 25 bp, Mus musculus
tgctactcccaatttagaagaaggt

SEQ ID NO: 871685 - DNA, 25 bp, Mus musculus
tgctactcccggaacctggactacg

SEQ ID NO: 871686 - DNA, 25 bp, Mus musculus
tgctactcccggtacctggactacg

SEQ ID NO: 871687 - DNA, 25 bp, Mus musculus
tgctactcgcacagagggtgggctt

SEQ ID NO: 871688 - DNA, 25 bp, Mus musculus
tgctactcgcactgagggtgggctt

SEQ ID NO: 871689 - DNA, 25 bp, Mus musculus
tgctactcgcgacagttcatcacct

SEQ ID NO: 871690 - DNA, 25 bp, Mus musculus
tgctactcgcgagagttcatcacct

SEQ ID NO: 871691 - DNA, 25 bp, Mus musculus
tgctactcgcttcccatcacagaaa

SEQ ID NO: 871692 - DNA, 25 bp, Mus musculus
tgctactcgcttgccatcacagaaa

SEQ ID NO: 871693 - DNA, 25 bp, Mus musculus
tgctactctataagggcctctgcac

SEQ ID NO: 871694 - DNA, 25 bp, Mus musculus
tgctactctatatgggcctctgcac

SEQ ID NO: 871695 - DNA, 25 bp, Mus musculus
tgctactctgaactctgggtcatcc

SEQ ID NO: 871696 - DNA, 25 bp, Mus musculus
tgctactctgaagtctgggtcatcc

SEQ ID NO: 871697 - DNA, 25 bp, Mus musculus
tgctactctgctcatctggaagcta

SEQ ID NO: 871698 - DNA, 25 bp, Mus musculus
tgctactctgctgatctggaagcta

SEQ ID NO: 871699 - DNA, 25 bp, Mus musculus
tgctactgagcacctgctattcttt

SEQ ID NO: 871700 - DNA, 25 bp, Mus musculus
tgctactgagcagctgctattcttt

SEQ ID NO: 871701 - DNA, 25 bp, Mus musculus
tgctactgatgtcatgacccaccat

SEQ ID NO: 871702 - DNA, 25 bp, Mus musculus
tgctactgatgtgatgacccaccat

SEQ ID NO: 871703 - DNA, 25 bp, Mus musculus
tgctactgccaacggccagaaagca

SEQ ID NO: 871704 - DNA, 25 bp, Mus musculus
tgctactgccaagggccagaaagca

SEQ ID NO: 871705 - DNA, 25 bp, Mus musculus
tgctactgcctcactgaggacctag

SEQ ID NO: 871706 - DNA, 25 bp, Mus musculus
tgctactgcctctctgaggacctag

SEQ ID NO: 871707 - DNA, 25 bp, Mus musculus
tgctactgcggccaactatgaaagc

SEQ ID NO: 871708 - DNA, 25 bp, Mus musculus
tgctactgcggcgaactatgaaagc

SEQ ID NO: 871709 - DNA, 25 bp, Mus musculus
tgctactgctacctttgctgggtgc

SEQ ID NO: 871710 - DNA, 25 bp, Mus musculus
tgctactgctacgtttgctgggtgc

SEQ ID NO: 871711 - DNA, 25 bp, Mus musculus
tgctactgctatcagcgcggcttcc

SEQ ID NO: 871712 - DNA, 25 bp, Mus musculus
tgctactgctatgagcgcggcttcc

SEQ ID NO: 871713 - DNA, 25 bp, Mus musculus
tgctactgctcaaccatgctccata

SEQ ID NO: 871714 - DNA, 25 bp, Mus musculus
tgctactgctcatccatgctccata

SEQ ID NO: 871715 - DNA, 25 bp, Mus musculus
tgctactgctccacagagctggctc

SEQ ID NO: 871716 - DNA, 25 bp, Mus musculus
tgctactgctccctgacaaaaatgt

SEQ ID NO: 871717 - DNA, 25 bp, Mus musculus
tgctactgctccgtgacaaaaatgt

SEQ ID NO: 871718 - DNA, 25 bp, Mus musculus
tgctactgctcctcagagctggctc

SEQ ID NO: 871719 - DNA, 25 bp, Mus musculus
tgctactggaatcactgcatctgat

SEQ ID NO: 871720 - DNA, 25 bp, Mus musculus
tgctactggaatgactgcatctgat

SEQ ID NO: 871721 - DNA, 25 bp, Mus musculus
tgctactggcaaaaggtgcgaggac

SEQ ID NO: 871722 - DNA, 25 bp, Mus musculus
tgctactggcaataggtgcgaggac

SEQ ID NO: 871723 - DNA, 25 bp, Mus musculus
tgctactggtaccttggactctgaa

SEQ ID NO: 871724 - DNA, 25 bp, Mus musculus
tgctactggtacgttggactctgaa

SEQ ID NO: 871725 - DNA, 25 bp, Mus musculus
tgctacttacacatgcaagaatgtt

SEQ ID NO: 871726 - DNA, 25 bp, Mus musculus
tgctacttacacttgcaagaatgtt

SEQ ID NO: 871727 - DNA, 25 bp, Mus musculus
tgctacttacttacgacgtcacggg

SEQ ID NO: 871728 - DNA, 25 bp, Mus musculus
tgctacttactttcgacgtcacggg

SEQ ID NO: 871729 - DNA, 25 bp, Mus musculus
tgctacttatgtccctggcaggtat

SEQ ID NO: 871730 - DNA, 25 bp, Mus musculus
tgctacttatgtgcctggcaggtat

SEQ ID NO: 871731 - DNA, 25 bp, Mus musculus
tgctacttcctacaacccagagtaa

SEQ ID NO: 871732 - DNA, 25 bp, Mus musculus
tgctacttcctagaacccagagtaa

SEQ ID NO: 871733 - DNA, 25 bp, Mus musculus
tgctacttctagactaacaactgat

SEQ ID NO: 871734 - DNA, 25 bp, Mus musculus
tgctacttctagtctaacaactgat

SEQ ID NO: 871735 - DNA, 25 bp, Mus musculus
tgctacttctgtaccatgactttgg

SEQ ID NO: 871736 - DNA, 25 bp, Mus musculus
tgctacttctgttccatgactttgg

SEQ ID NO: 871737 - DNA, 25 bp, Mus musculus
tgctacttgaaaccacaggctagac

SEQ ID NO: 871738 - DNA, 25 bp, Mus musculus
tgctacttgaaagcacaggctagac

SEQ ID NO: 871739 - DNA, 25 bp, Mus musculus
tgctacttgactagctgacctggaa

SEQ ID NO: 871740 - DNA, 25 bp, Mus musculus
tgctacttgacttgctgacctggaa

SEQ ID NO: 871741 - DNA, 25 bp, Mus musculus
tgctacttgaggaggctctgcccac

SEQ ID NO: 871742 - DNA, 25 bp, Mus musculus
tgctacttgaggtggctctgcccac

SEQ ID NO: 871743 - DNA, 25 bp, Mus musculus
tgctacttgcagattctcctggcta

SEQ ID NO: 871744 - DNA, 25 bp, Mus musculus
tgctacttgcagtttctcctggcta

SEQ ID NO: 871745 - DNA, 25 bp, Mus musculus
tgctacttggaaccctgcatcttag

SEQ ID NO: 871746 - DNA, 25 bp, Mus musculus
tgctacttggaagcctgcatcttag

SEQ ID NO: 871747 - DNA, 25 bp, Mus musculus
tgctacttggacattggttctcaca

SEQ ID NO: 871748 - DNA, 25 bp, Mus musculus
tgctacttggactttggttctcaca

SEQ ID NO: 871749 - DNA, 25 bp, Mus musculus
tgctacttggagaggtacatgcctt

SEQ ID NO: 871750 - DNA, 25 bp, Mus musculus
tgctacttggagtggtacatgcctt

SEQ ID NO: 871751 - DNA, 25 bp, Mus musculus
tgctacttgtatcctgtccaatggg

SEQ ID NO: 871752 - DNA, 25 bp, Mus musculus
tgctacttgtatgctgtccaatggg

SEQ ID NO: 871753 - DNA, 25 bp, Mus musculus
tgctagaactctagccttacaggta

SEQ ID NO: 871754 - DNA, 25 bp, Mus musculus
tgctagaactcttgccttacaggta

SEQ ID NO: 871755 - DNA, 25 bp, Mus musculus
tgctagaagactctgcacctcactt

SEQ ID NO: 871756 - DNA, 25 bp, Mus musculus
tgctagaagactgtgcacctcactt

SEQ ID NO: 871757 - DNA, 25 bp, Mus musculus
tgctagaaggtcagtgctggcctcc

SEQ ID NO: 871758 - DNA, 25 bp, Mus musculus
tgctagaaggtctgtgctggcctcc

SEQ ID NO: 871759 - DNA, 25 bp, Mus musculus
tgctagacaactacgtgccactaat

SEQ ID NO: 871760 - DNA, 25 bp, Mus musculus
tgctagacaacttcgtgccactaat

SEQ ID NO: 871761 - DNA, 25 bp, Mus musculus
tgctagacctcgagggagtcagagt

SEQ ID NO: 871762 - DNA, 25 bp, Mus musculus
tgctagacctcgtgggagtcagagt

SEQ ID NO: 871763 - DNA, 25 bp, Mus musculus
tgctagactaccaagactacctttc

SEQ ID NO: 871764 - DNA, 25 bp, Mus musculus
tgctagactacctagactacctttc

SEQ ID NO: 871765 - DNA, 25 bp, Mus musculus
tgctagactcctctgtttctgggac

SEQ ID NO: 871766 - DNA, 25 bp, Mus musculus
tgctagactcctgtgtttctgggac

SEQ ID NO: 871767 - DNA, 25 bp, Mus musculus
tgctagactgatctcaccacacaga

SEQ ID NO: 871768 - DNA, 25 bp, Mus musculus
tgctagactgatgtcaccacacaga

SEQ ID NO: 871769 - DNA, 25 bp, Mus musculus
tgctagactggcatcgatacttggt

SEQ ID NO: 871770 - DNA, 25 bp, Mus musculus
tgctagactggcttcgatacttggt

SEQ ID NO: 871771 - DNA, 25 bp, Mus musculus
tgctagagaaggaggcgcgcctgca

SEQ ID NO: 871772 - DNA, 25 bp, Mus musculus
tgctagagaaggtggcgcgcctgca

SEQ ID NO: 871773 - DNA, 25 bp, Mus musculus
tgctagagcatcaggaaccagccct

SEQ ID NO: 871774 - DNA, 25 bp, Mus musculus
tgctagagcatctggaaccagccct

SEQ ID NO: 871775 - DNA, 25 bp, Mus musculus
tgctagagctgaccttaggtgcccc

SEQ ID NO: 871776 - DNA, 25 bp, Mus musculus
tgctagagctgagcttaggtgcccc

SEQ ID NO: 871777 - DNA, 25 bp, Mus musculus
tgctagaggcctagtctgggttccc

SEQ ID NO: 871778 - DNA, 25 bp, Mus musculus
tgctagaggccttgtctgggttccc

SEQ ID NO: 871779 - DNA, 25 bp, Mus musculus
tgctagagggatcacctctccttca

SEQ ID NO: 871780 - DNA, 25 bp, Mus musculus
tgctagagggatgacctctccttca

SEQ ID NO: 871781 - DNA, 25 bp, Mus musculus
tgctagaggtcccagtctgcagagt

SEQ ID NO: 871782 - DNA, 25 bp, Mus musculus
tgctagaggtccgagtctgcagagt

SEQ ID NO: 871783 - DNA, 25 bp, Mus musculus
tgctagaggtctcatcattcccaat

SEQ ID NO: 871784 - DNA, 25 bp, Mus musculus
tgctagaggtctgatcattcccaat

SEQ ID NO: 871785 - DNA, 25 bp, Mus musculus
tgctagagtccaaacagaacccgaa

SEQ ID NO: 871786 - DNA, 25 bp, Mus musculus
tgctagagtccatacagaacccgaa

SEQ ID NO: 871787 - DNA, 25 bp, Mus musculus
tgctagatacagccgatccaagcag

SEQ ID NO: 871788 - DNA, 25 bp, Mus musculus
tgctagatacaggcgatccaagcag

SEQ ID NO: 871789 - DNA, 25 bp, Mus musculus
tgctagatagcgctcataccttgtc

SEQ ID NO: 871790 - DNA, 25 bp, Mus musculus
tgctagatagcggtcataccttgtc

SEQ ID NO: 871791 - DNA, 25 bp, Mus musculus
tgctagatagtgctgcctgacatat

SEQ ID NO: 871792 - DNA, 25 bp, Mus musculus
tgctagatagtggtgcctgacatat

SEQ ID NO: 871793 - DNA, 25 bp, Mus musculus
tgctagatattaaggccttcctgag

SEQ ID NO: 871794 - DNA, 25 bp, Mus musculus
tgctagatattatggccttcctgag

SEQ ID NO: 871795 - DNA, 25 bp, Mus musculus
tgctagatctacagccagcgcggag

SEQ ID NO: 871796 - DNA, 25 bp, Mus musculus
tgctagatctactgccagcgcggag

SEQ ID NO: 871797 - DNA, 25 bp, Mus musculus
tgctagattgcgagttcagagacag

SEQ ID NO: 871798 - DNA, 25 bp, Mus musculus
tgctagattgcgtgttcagagacag

SEQ ID NO: 871799 - DNA, 25 bp, Mus musculus
tgctagatttacagtgggccacacc

SEQ ID NO: 871800 - DNA, 25 bp, Mus musculus
tgctagatttactgtgggccacacc

SEQ ID NO: 871801 - DNA, 25 bp, Mus musculus
tgctagcatcttacagtggcgagtg

SEQ ID NO: 871802 - DNA, 25 bp, Mus musculus
tgctagcatctttcagtggcgagtg

SEQ ID NO: 871803 - DNA, 25 bp, Mus musculus
tgctagccatcaacatctttctctg

SEQ ID NO: 871804 - DNA, 25 bp, Mus musculus
tgctagccatcatcatctttctctg

SEQ ID NO: 871805 - DNA, 25 bp, Mus musculus
tgctagccatccaaactcagtaagc

SEQ ID NO: 871806 - DNA, 25 bp, Mus musculus
tgctagccatcctaactcagtaagc

SEQ ID NO: 871807 - DNA, 25 bp, Mus musculus
tgctagcctgtcagtcaacaccgta

SEQ ID NO: 871808 - DNA, 25 bp, Mus musculus
tgctagcctgtctgtcaacaccgta

SEQ ID NO: 871809 - DNA, 25 bp, Mus musculus
tgctagccttgccttacagtgtgtg

SEQ ID NO: 871810 - DNA, 25 bp, Mus musculus
tgctagccttgcgttacagtgtgtg

SEQ ID NO: 871811 - DNA, 25 bp, Mus musculus
tgctagcctttacccacggagtcat

SEQ ID NO: 871812 - DNA, 25 bp, Mus musculus
tgctagcctttagccacggagtcat

SEQ ID NO: 871813 - DNA, 25 bp, Mus musculus
tgctagcgcgatacatccagcaggt

SEQ ID NO: 871814 - DNA, 25 bp, Mus musculus
tgctagcgcgattcatccagcaggt

SEQ ID NO: 871815 - DNA, 25 bp, Mus musculus
tgctagctacccacaacactataaa

SEQ ID NO: 871816 - DNA, 25 bp, Mus musculus
tgctagctaccctcaacactataaa

SEQ ID NO: 871817 - DNA, 25 bp, Mus musculus
tgctagctagccactccaaagagat

SEQ ID NO: 871818 - DNA, 25 bp, Mus musculus
tgctagctagcctctccaaagagat

SEQ ID NO: 871819 - DNA, 25 bp, Mus musculus
tgctagctatgtccacctatgcgtg

SEQ ID NO: 871820 - DNA, 25 bp, Mus musculus
tgctagctatgtgcacctatgcgtg

SEQ ID NO: 871821 - DNA, 25 bp, Mus musculus
tgctagctgcccagatggtcaatca

SEQ ID NO: 871822 - DNA, 25 bp, Mus musculus
tgctagctgccctgatggtcaatca

SEQ ID NO: 871823 - DNA, 25 bp, Mus musculus
tgctagctggataggtccattgata

SEQ ID NO: 871824 - DNA, 25 bp, Mus musculus
tgctagctggattggtccattgata

SEQ ID NO: 871825 - DNA, 25 bp, Mus musculus
tgctagctggcgagaccactagtcg

SEQ ID NO: 871826 - DNA, 25 bp, Mus musculus
tgctagctggcgtgaccactagtcg

SEQ ID NO: 871827 - DNA, 25 bp, Mus musculus
tgctagctggttcactaggtccaac

SEQ ID NO: 871828 - DNA, 25 bp, Mus musculus
tgctagctggttgactaggtccaac

SEQ ID NO: 871829 - DNA, 25 bp, Mus musculus
tgctagctgtggctaaggctgtcct

SEQ ID NO: 871830 - DNA, 25 bp, Mus musculus
tgctagctgtgggtaaggctgtcct

SEQ ID NO: 871831 - DNA, 25 bp, Mus musculus
tgctagcttgcaagtcttctttaac

SEQ ID NO: 871832 - DNA, 25 bp, Mus musculus
tgctagcttgcatgtcttctttaac

SEQ ID NO: 871833 - DNA, 25 bp, Mus musculus
tgctaggaaccgaactcaggccttc

SEQ ID NO: 871834 - DNA, 25 bp, Mus musculus
tgctaggaaccgtactcaggccttc

SEQ ID NO: 871835 - DNA, 25 bp, Mus musculus
tgctaggagaacacctgtgccccag

SEQ ID NO: 871836 - DNA, 25 bp, Mus musculus
tgctaggagaactcctgtgccccag

SEQ ID NO: 871837 - DNA, 25 bp, Mus musculus
tgctaggatttgagtgcctctgctg

SEQ ID NO: 871838 - DNA, 25 bp, Mus musculus
tgctaggatttgtgtgcctctgctg

SEQ ID NO: 871839 - DNA, 25 bp, Mus musculus
tgctaggcagccctttgcacaaatc

SEQ ID NO: 871840 - DNA, 25 bp, Mus musculus
tgctaggcagccgtttgcacaaatc

SEQ ID NO: 871841 - DNA, 25 bp, Mus musculus
tgctaggcataaaaccccagggctt

SEQ ID NO: 871842 - DNA, 25 bp, Mus musculus
tgctaggcataataccccagggctt

SEQ ID NO: 871843 - DNA, 25 bp, Mus musculus
tgctaggccgtcatttttagggaag

SEQ ID NO: 871844 - DNA, 25 bp, Mus musculus
tgctaggccgtcttttttagggaag

SEQ ID NO: 871845 - DNA, 25 bp, Mus musculus
tgctaggctagactcggaggctttt

SEQ ID NO: 871846 - DNA, 25 bp, Mus musculus
tgctaggctagagtcggaggctttt

SEQ ID NO: 871847 - DNA, 25 bp, Mus musculus
tgctaggctccaatcattgtgactt

SEQ ID NO: 871848 - DNA, 25 bp, Mus musculus
tgctaggctccattcattgtgactt

SEQ ID NO: 871849 - DNA, 25 bp, Mus musculus
tgctaggctgctcacaggacgtcga

SEQ ID NO: 871850 - DNA, 25 bp, Mus musculus
tgctaggctgctgacaggacgtcga

SEQ ID NO: 871851 - DNA, 25 bp, Mus musculus
tgctaggcttttcctcagtattgga

SEQ ID NO: 871852 - DNA, 25 bp, Mus musculus
tgctaggcttttgctcagtattgga

SEQ ID NO: 871853 - DNA, 25 bp, Mus musculus
tgctagggacaaacgctactgccac

SEQ ID NO: 871854 - DNA, 25 bp, Mus musculus
tgctagggacaatcgctactgccac

SEQ ID NO: 871855 - DNA, 25 bp, Mus musculus
tgctagggatctacaccctccctgt

SEQ ID NO: 871856 - DNA, 25 bp, Mus musculus
tgctagggatcttcaccctccctgt

SEQ ID NO: 871857 - DNA, 25 bp, Mus musculus
tgctagggatttcccacactcttct

SEQ ID NO: 871858 - DNA, 25 bp, Mus musculus
tgctagggatttgccacactcttct

SEQ ID NO: 871859 - DNA, 25 bp, Mus musculus
tgctagggcctaatatttttaacca

SEQ ID NO: 871860 - DNA, 25 bp, Mus musculus
tgctagggcctattatttttaacca

SEQ ID NO: 871861 - DNA, 25 bp, Mus musculus
tgctaggtactgaccctgctcacag

SEQ ID NO: 871862 - DNA, 25 bp, Mus musculus
tgctaggtactgtccctgctcacag

SEQ ID NO: 871863 - DNA, 25 bp, Mus musculus
tgctaggtctatactcgcccactga

SEQ ID NO: 871864 - DNA, 25 bp, Mus musculus
tgctaggtctattctcgcccactga

SEQ ID NO: 871865 - DNA, 25 bp, Mus musculus
tgctaggttgctcggtctccttgga

SEQ ID NO: 871866 - DNA, 25 bp, Mus musculus
tgctaggttgctgggtctccttgga

SEQ ID NO: 871867 - DNA, 25 bp, Mus musculus
tgctagtactttaaccacatggtga

SEQ ID NO: 871868 - DNA, 25 bp, Mus musculus
tgctagtacttttaccacatggtga

SEQ ID NO: 871869 - DNA, 25 bp, Mus musculus
tgctagtagaataaacagtttacca

SEQ ID NO: 871870 - DNA, 25 bp, Mus musculus
tgctagtagaattaacagtttacca

SEQ ID NO: 871871 - DNA, 25 bp, Mus musculus
tgctagtatgagctcctaacctggg

SEQ ID NO: 871872 - DNA, 25 bp, Mus musculus
tgctagtatgaggtcctaacctggg

SEQ ID NO: 871873 - DNA, 25 bp, Mus musculus
tgctagtcatctactgctggaaacc

SEQ ID NO: 871874 - DNA, 25 bp, Mus musculus
tgctagtcatcttctgctggaaacc

SEQ ID NO: 871875 - DNA, 25 bp, Mus musculus
tgctagtccggacactgcgtatttc

SEQ ID NO: 871876 - DNA, 25 bp, Mus musculus
tgctagtccggagactgcgtatttc

SEQ ID NO: 871877 - DNA, 25 bp, Mus musculus
tgctagtcctatcagagtctcttaa

SEQ ID NO: 871878 - DNA, 25 bp, Mus musculus
tgctagtcctatgagagtctcttaa

SEQ ID NO: 871879 - DNA, 25 bp, Mus musculus
tgctagtccttaaatgcattcttaa

SEQ ID NO: 871880 - DNA, 25 bp, Mus musculus
tgctagtccttatatgcattcttaa

SEQ ID NO: 871881 - DNA, 25 bp, Mus musculus
tgctagtctctcctcacacatagta

SEQ ID NO: 871882 - DNA, 25 bp, Mus musculus
tgctagtctctcgtcacacatagta

SEQ ID NO: 871883 - DNA, 25 bp, Mus musculus
tgctagtgcagcagcagacgtatgg

SEQ ID NO: 871884 - DNA, 25 bp, Mus musculus
tgctagtgcagctgcagacgtatgg

SEQ ID NO: 871885 - DNA, 25 bp, Mus musculus
tgctagtggcaaatgatcattaaga

SEQ ID NO: 871886 - DNA, 25 bp, Mus musculus
tgctagtggcaattgatcattaaga

SEQ ID NO: 871887 - DNA, 25 bp, Mus musculus
tgctagtggcagatgctgtggacct

SEQ ID NO: 871888 - DNA, 25 bp, Mus musculus
tgctagtggcagttgctgtggacct

SEQ ID NO: 871889 - DNA, 25 bp, Mus musculus
tgctagtgtctacttgaagatcttc

SEQ ID NO: 871890 - DNA, 25 bp, Mus musculus
tgctagtgtctagttgaagatcttc

SEQ ID NO: 871891 - DNA, 25 bp, Mus musculus
tgctagttaggtacaaattcttttt

SEQ ID NO: 871892 - DNA, 25 bp, Mus musculus
tgctagttaggttcaaattcttttt

SEQ ID NO: 871893 - DNA, 25 bp, Mus musculus
tgctagtttaacatcttcctctcta

SEQ ID NO: 871894 - DNA, 25 bp, Mus musculus
tgctagtttaacttcttcctctcta

SEQ ID NO: 871895 - DNA, 25 bp, Mus musculus
tgctagtttttacaggggccagtga

SEQ ID NO: 871896 - DNA, 25 bp, Mus musculus
tgctagtttttagaggggccagtga

SEQ ID NO: 871897 - DNA, 25 bp, Mus musculus
tgctataaaccacagacccaaagaa

SEQ ID NO: 871898 - DNA, 25 bp, Mus musculus
tgctataaaccagagacccaaagaa

SEQ ID NO: 871899 - DNA, 25 bp, Mus musculus
tgctataaagcccatcaacctggag

SEQ ID NO: 871900 - DNA, 25 bp, Mus musculus
tgctataaagccgatcaacctggag

SEQ ID NO: 871901 - DNA, 25 bp, Mus musculus
tgctataacaggcagagctggtgaa

SEQ ID NO: 871902 - DNA, 25 bp, Mus musculus
tgctataacagggagagctggtgaa

SEQ ID NO: 871903 - DNA, 25 bp, Mus musculus
tgctataaggaccagctgcctgctg

SEQ ID NO: 871904 - DNA, 25 bp, Mus musculus
tgctataaggacgagctgcctgctg

SEQ ID NO: 871905 - DNA, 25 bp, Mus musculus
tgctataatcccagaaccaactttg

SEQ ID NO: 871906 - DNA, 25 bp, Mus musculus
tgctataatccctgaaccaactttg

SEQ ID NO: 871907 - DNA, 25 bp, Mus musculus
tgctataatgccactgtatcaggta

SEQ ID NO: 871908 - DNA, 25 bp, Mus musculus
tgctataatgcctctgtatcaggta

SEQ ID NO: 871909 - DNA, 25 bp, Mus musculus
tgctatactgccagattggaagcaa

SEQ ID NO: 871910 - DNA, 25 bp, Mus musculus
tgctatactgcctgattggaagcaa

SEQ ID NO: 871911 - DNA, 25 bp, Mus musculus
tgctatagccttacatcttttttac

SEQ ID NO: 871912 - DNA, 25 bp, Mus musculus
tgctatagcctttcatcttttttac

SEQ ID NO: 871913 - DNA, 25 bp, Mus musculus
tgctatagctttacacttgcccagg

SEQ ID NO: 871914 - DNA, 25 bp, Mus musculus
tgctatagcttttcacttgcccagg

SEQ ID NO: 871915 - DNA, 25 bp, Mus musculus
tgctataggaccaggttgccatggt

SEQ ID NO: 871916 - DNA, 25 bp, Mus musculus
tgctataggacctggttgccatggt

SEQ ID NO: 871917 - DNA, 25 bp, Mus musculus
tgctatagtcagacaccaaggcctt

SEQ ID NO: 871918 - DNA, 25 bp, Mus musculus
tgctatagtcagtcaccaaggcctt

SEQ ID NO: 871919 - DNA, 25 bp, Mus musculus
tgctatatatcccagtctgacctta

SEQ ID NO: 871920 - DNA, 25 bp, Mus musculus
tgctatatatccgagtctgacctta

SEQ ID NO: 871921 - DNA, 25 bp, Mus musculus
tgctatatcataactgtctctaata

SEQ ID NO: 871922 - DNA, 25 bp, Mus musculus
tgctatatcatatctgtctctaata

SEQ ID NO: 871923 - DNA, 25 bp, Mus musculus
tgctatatctcacggagaagccaga

SEQ ID NO: 871924 - DNA, 25 bp, Mus musculus
tgctatatctcagggagaagccaga

SEQ ID NO: 871925 - DNA, 25 bp, Mus musculus
tgctatatgcgtatgacaccagcct

SEQ ID NO: 871926 - DNA, 25 bp, Mus musculus
tgctatatgcgtttgacaccagcct

SEQ ID NO: 871927 - DNA, 25 bp, Mus musculus
tgctatatgctcactaatgttctcc

SEQ ID NO: 871928 - DNA, 25 bp, Mus musculus
tgctatatgctctctaatgttctcc

SEQ ID NO: 871929 - DNA, 25 bp, Mus musculus
tgctatattgataagcagttcatat

SEQ ID NO: 871930 - DNA, 25 bp, Mus musculus
tgctatattgattagcagttcatat

SEQ ID NO: 871931 - DNA, 25 bp, Mus musculus
tgctatatttgccacagaaacagta

SEQ ID NO: 871932 - DNA, 25 bp, Mus musculus
tgctatatttgcgacagaaacagta

SEQ ID NO: 871933 - DNA, 25 bp, Mus musculus
tgctatcaagaacctgtccctgaga

SEQ ID NO: 871934 - DNA, 25 bp, Mus musculus
tgctatcaagaacttatcacagact

SEQ ID NO: 871935 - DNA, 25 bp, Mus musculus
tgctatcaagaagctgtccctgaga

SEQ ID NO: 871936 - DNA, 25 bp, Mus musculus
tgctatcaagaagttatcacagact

SEQ ID NO: 871937 - DNA, 25 bp, Mus musculus
tgctatcaccagaccttgtctggaa

SEQ ID NO: 871938 - DNA, 25 bp, Mus musculus
tgctatcaccagtccttgtctggaa

SEQ ID NO: 871939 - DNA, 25 bp, Mus musculus
tgctatcagccacagctaatcttat

SEQ ID NO: 871940 - DNA, 25 bp, Mus musculus
tgctatcagccacagtcaagtattt

SEQ ID NO: 871941 - DNA, 25 bp, Mus musculus
tgctatcagccagagctaatcttat

SEQ ID NO: 871942 - DNA, 25 bp, Mus musculus
tgctatcagccagagtcaagtattt

SEQ ID NO: 871943 - DNA, 25 bp, Mus musculus
tgctatcatcaaattcccactgacc

SEQ ID NO: 871944 - DNA, 25 bp, Mus musculus
tgctatcatcaatttcccactgacc

SEQ ID NO: 871945 - DNA, 25 bp, Mus musculus
tgctatccaggtagccagttcaaga

SEQ ID NO: 871946 - DNA, 25 bp, Mus musculus
tgctatccaggttgccagttcaaga

SEQ ID NO: 871947 - DNA, 25 bp, Mus musculus
tgctatccatgcagcctttgggccc

SEQ ID NO: 871948 - DNA, 25 bp, Mus musculus
tgctatccatgctgcctttgggccc

SEQ ID NO: 871949 - DNA, 25 bp, Mus musculus
tgctatcccactcttataattttaa

SEQ ID NO: 871950 - DNA, 25 bp, Mus musculus
tgctatcccactgttataattttaa

SEQ ID NO: 871951 - DNA, 25 bp, Mus musculus
tgctatcccctaagactgcaaataa

SEQ ID NO: 871952 - DNA, 25 bp, Mus musculus
tgctatcccctatgactgcaaataa

SEQ ID NO: 871953 - DNA, 25 bp, Mus musculus
tgctatccctaacctcgtgcaaatg

SEQ ID NO: 871954 - DNA, 25 bp, Mus musculus
tgctatccctaagctcgtgcaaatg

SEQ ID NO: 871955 - DNA, 25 bp, Mus musculus
tgctatccctcacgtacctgagggt

SEQ ID NO: 871956 - DNA, 25 bp, Mus musculus
tgctatccctcaggtacctgagggt

SEQ ID NO: 871957 - DNA, 25 bp, Mus musculus
tgctatccctgaaacatggttgcag

SEQ ID NO: 871958 - DNA, 25 bp, Mus musculus
tgctatccctgatacatggttgcag

SEQ ID NO: 871959 - DNA, 25 bp, Mus musculus
tgctatccctggatcaaacccaaga

SEQ ID NO: 871960 - DNA, 25 bp, Mus musculus
tgctatccctggttcaaacccaaga

SEQ ID NO: 871961 - DNA, 25 bp, Mus musculus
tgctatcgccagagatgttggccca

SEQ ID NO: 871962 - DNA, 25 bp, Mus musculus
tgctatcgccagtgatgttggccca

SEQ ID NO: 871963 - DNA, 25 bp, Mus musculus
tgctatctagcacctcagtttctgt

SEQ ID NO: 871964 - DNA, 25 bp, Mus musculus
tgctatctagcagctcagtttctgt

SEQ ID NO: 871965 - DNA, 25 bp, Mus musculus
tgctatctagccaactccagacaat

SEQ ID NO: 871966 - DNA, 25 bp, Mus musculus
tgctatctagcctactccagacaat

SEQ ID NO: 871967 - DNA, 25 bp, Mus musculus
tgctatctatacctcctggatgccc

SEQ ID NO: 871968 - DNA, 25 bp, Mus musculus
tgctatctatacgtcctggatgccc

SEQ ID NO: 871969 - DNA, 25 bp, Mus musculus
tgctatctccatccagcctggaaag

SEQ ID NO: 871970 - DNA, 25 bp, Mus musculus
tgctatctccatgcagcctggaaag

SEQ ID NO: 871971 - DNA, 25 bp, Mus musculus
tgctatctccttatctgtcccttga

SEQ ID NO: 871972 - DNA, 25 bp, Mus musculus
tgctatctccttttctgtcccttga

SEQ ID NO: 871973 - DNA, 25 bp, Mus musculus
tgctatctcttcagtatccctagaa

SEQ ID NO: 871974 - DNA, 25 bp, Mus musculus
tgctatctcttctgtatccctagaa

SEQ ID NO: 871975 - DNA, 25 bp, Mus musculus
tgctatctgctgattctagttaaaa

SEQ ID NO: 871976 - DNA, 25 bp, Mus musculus
tgctatctgctgtttctagttaaaa

SEQ ID NO: 871977 - DNA, 25 bp, Mus musculus
tgctatctggttacatcccattgaa

SEQ ID NO: 871978 - DNA, 25 bp, Mus musculus
tgctatctggtttcatcccattgaa

SEQ ID NO: 871979 - DNA, 25 bp, Mus musculus
tgctatctttccaacacacaaaaat

SEQ ID NO: 871980 - DNA, 25 bp, Mus musculus
tgctatctttcctacacacaaaaat

SEQ ID NO: 871981 - DNA, 25 bp, Mus musculus
tgctatctttgcactttcagggaag

SEQ ID NO: 871982 - DNA, 25 bp, Mus musculus
tgctatctttgctctttcagggaag

SEQ ID NO: 871983 - DNA, 25 bp, Mus musculus
tgctatgattttcccgactatgtac

SEQ ID NO: 871984 - DNA, 25 bp, Mus musculus
tgctatgattttctgacttctggtc

SEQ ID NO: 871985 - DNA, 25 bp, Mus musculus
tgctatgattttgccgactatgtac

SEQ ID NO: 871986 - DNA, 25 bp, Mus musculus
tgctatgattttgtgacttctggtc

SEQ ID NO: 871987 - DNA, 25 bp, Mus musculus
tgctatgcagctaaccgttgtgggt

SEQ ID NO: 871988 - DNA, 25 bp, Mus musculus
tgctatgcagcttaccgttgtgggt

SEQ ID NO: 871989 - DNA, 25 bp, Mus musculus
tgctatgcccagatacggcgggcgc

SEQ ID NO: 871990 - DNA, 25 bp, Mus musculus
tgctatgcccagttacggcgggcgc

SEQ ID NO: 871991 - DNA, 25 bp, Mus musculus
tgctatgcgctgaactgtgtagccc

SEQ ID NO: 871992 - DNA, 25 bp, Mus musculus
tgctatgcgctgtactgtgtagccc

SEQ ID NO: 871993 - DNA, 25 bp, Mus musculus
tgctatgctttgctcttgtttcact

SEQ ID NO: 871994 - DNA, 25 bp, Mus musculus
tgctatgctttggtcttgtttcact

SEQ ID NO: 871995 - DNA, 25 bp, Mus musculus
tgctatggctcgctctcaggtgaag

SEQ ID NO: 871996 - DNA, 25 bp, Mus musculus
tgctatggctcggtctcaggtgaag

SEQ ID NO: 871997 - DNA, 25 bp, Mus musculus
tgctatgggctaaatacgcatgata

SEQ ID NO: 871998 - DNA, 25 bp, Mus musculus
tgctatgggctatatacgcatgata

SEQ ID NO: 871999 - DNA, 25 bp, Mus musculus
tgctatggtgacacaggtggccctc

SEQ ID NO: 872000 - DNA, 25 bp, Mus musculus
tgctatggtgactcaggtggccctc

SEQ ID NO: 872001 - DNA, 25 bp, Mus musculus
tgctatggtgctattgtttctgttc

SEQ ID NO: 872002 - DNA, 25 bp, Mus musculus
tgctatggtgcttttgtttctgttc

SEQ ID NO: 872003 - DNA, 25 bp, Mus musculus
tgctatggtgtgcttcggttcatta

SEQ ID NO: 872004 - DNA, 25 bp, Mus musculus
tgctatggtgtggttcggttcatta

SEQ ID NO: 872005 - DNA, 25 bp, Mus musculus
tgctatgtaaacctctctttgtcca

SEQ ID NO: 872006 - DNA, 25 bp, Mus musculus
tgctatgtaaacgtctctttgtcca

SEQ ID NO: 872007 - DNA, 25 bp, Mus musculus
tgctatgtctatcctgggaactaaa

SEQ ID NO: 872008 - DNA, 25 bp, Mus musculus
tgctatgtctatgctgggaactaaa

SEQ ID NO: 872009 - DNA, 25 bp, Mus musculus
tgctatgtgataccactctaaaatg

SEQ ID NO: 872010 - DNA, 25 bp, Mus musculus
tgctatgtgatagcactctaaaatg

SEQ ID NO: 872011 - DNA, 25 bp, Mus musculus
tgctatgtgcctatcgatgctatat

SEQ ID NO: 872012 - DNA, 25 bp, Mus musculus
tgctatgtgcctttcgatgctatat

SEQ ID NO: 872013 - DNA, 25 bp, Mus musculus
tgctatgtggaccaagttggccttt

SEQ ID NO: 872014 - DNA, 25 bp, Mus musculus
tgctatgtggacgaagttggccttt

SEQ ID NO: 872015 - DNA, 25 bp, Mus musculus
tgctatgtgggcacatgctctccta

SEQ ID NO: 872016 - DNA, 25 bp, Mus musculus
tgctatgtgggctcatgctctccta

SEQ ID NO: 872017 - DNA, 25 bp, Mus musculus
tgctatgtgtttccttgtctatcgc

SEQ ID NO: 872018 - DNA, 25 bp, Mus musculus
tgctatgtgtttgcttgtctatcgc

SEQ ID NO: 872019 - DNA, 25 bp, Mus musculus
tgctatgttaatcagctgtccttcc

SEQ ID NO: 872020 - DNA, 25 bp, Mus musculus
tgctatgttaatgagctgtccttcc

SEQ ID NO: 872021 - DNA, 25 bp, Mus musculus
tgctatgttatccttattctctttg

SEQ ID NO: 872022 - DNA, 25 bp, Mus musculus
tgctatgttatcgttattctctttg

SEQ ID NO: 872023 - DNA, 25 bp, Mus musculus
tgctatgttattagtaggccctctc

SEQ ID NO: 872024 - DNA, 25 bp, Mus musculus
tgctatgttatttgtaggccctctc

SEQ ID NO: 872025 - DNA, 25 bp, Mus musculus
tgctatgttcatcctatgtatgtga

SEQ ID NO: 872026 - DNA, 25 bp, Mus musculus
tgctatgttcatgctatgtatgtga

SEQ ID NO: 872027 - DNA, 25 bp, Mus musculus
tgctatgtttttctccatgtttgcg

SEQ ID NO: 872028 - DNA, 25 bp, Mus musculus
tgctatgtttttgtccatgtttgcg

SEQ ID NO: 872029 - DNA, 25 bp, Mus musculus
tgctattaatttccctttaatccaa

SEQ ID NO: 872030 - DNA, 25 bp, Mus musculus
tgctattaatttgcctttaatccaa

SEQ ID NO: 872031 - DNA, 25 bp, Mus musculus
tgctattacagacagacacacccct

SEQ ID NO: 872032 - DNA, 25 bp, Mus musculus
tgctattacagagagacacacccct

SEQ ID NO: 872033 - DNA, 25 bp, Mus musculus
tgctattactaaaggctcaggcaat

SEQ ID NO: 872034 - DNA, 25 bp, Mus musculus
tgctattactaatggctcaggcaat

SEQ ID NO: 872035 - DNA, 25 bp, Mus musculus
tgctattagaccagctgctccaaat

SEQ ID NO: 872036 - DNA, 25 bp, Mus musculus
tgctattagacctgctgctccaaat

SEQ ID NO: 872037 - DNA, 25 bp, Mus musculus
tgctattatactcattgtgttgtgg

SEQ ID NO: 872038 - DNA, 25 bp, Mus musculus
tgctattatactgattgtgttgtgg

SEQ ID NO: 872039 - DNA, 25 bp, Mus musculus
tgctattatttgctccaggctcacc

SEQ ID NO: 872040 - DNA, 25 bp, Mus musculus
tgctattatttggtccaggctcacc

SEQ ID NO: 872041 - DNA, 25 bp, Mus musculus
tgctattcacaaccacatactgcct

SEQ ID NO: 872042 - DNA, 25 bp, Mus musculus
tgctattcacaagcacatactgcct

SEQ ID NO: 872043 - DNA, 25 bp, Mus musculus
tgctattcagcacaggcaccaaggg

SEQ ID NO: 872044 - DNA, 25 bp, Mus musculus
tgctattcagcagaggcaccaaggg

SEQ ID NO: 872045 - DNA, 25 bp, Mus musculus
tgctattccacactggagtcacctg

SEQ ID NO: 872046 - DNA, 25 bp, Mus musculus
tgctattccacagtggagtcacctg

SEQ ID NO: 872047 - DNA, 25 bp, Mus musculus
tgctattccagcaatgtaccaccca

SEQ ID NO: 872048 - DNA, 25 bp, Mus musculus
tgctattccagctatgtaccaccca

SEQ ID NO: 872049 - DNA, 25 bp, Mus musculus
tgctattcctatcacacctgaggat

SEQ ID NO: 872050 - DNA, 25 bp, Mus musculus
tgctattcctatgacacctgaggat

SEQ ID NO: 872051 - DNA, 25 bp, Mus musculus
tgctattcgctcatcgagaacttgg

SEQ ID NO: 872052 - DNA, 25 bp, Mus musculus
tgctattcgctcttcgagaacttgg

SEQ ID NO: 872053 - DNA, 25 bp, Mus musculus
tgctattctttgacttgctcactac

SEQ ID NO: 872054 - DNA, 25 bp, Mus musculus
tgctattctttgtcttgctcactac

SEQ ID NO: 872055 - DNA, 25 bp, Mus musculus
tgctattgactcaatgccacattgg

SEQ ID NO: 872056 - DNA, 25 bp, Mus musculus
tgctattgactctatgccacattgg

SEQ ID NO: 872057 - DNA, 25 bp, Mus musculus
tgctattggaacatgtctcggaatt

SEQ ID NO: 872058 - DNA, 25 bp, Mus musculus
tgctattggaacttgtctcggaatt

SEQ ID NO: 872059 - DNA, 25 bp, Mus musculus
tgctattggcttaaatttcatttgt

SEQ ID NO: 872060 - DNA, 25 bp, Mus musculus
tgctattggctttaatttcatttgt

SEQ ID NO: 872061 - DNA, 25 bp, Mus musculus
tgctattgtcttctcggtctctgta

SEQ ID NO: 872062 - DNA, 25 bp, Mus musculus
tgctattgtcttcttgccctagagt

SEQ ID NO: 872063 - DNA, 25 bp, Mus musculus
tgctattgtcttgtcggtctctgta

SEQ ID NO: 872064 - DNA, 25 bp, Mus musculus
tgctattgtcttgttgccctagagt

SEQ ID NO: 872065 - DNA, 25 bp, Mus musculus
tgctattgttcgatgtatccaggac

SEQ ID NO: 872066 - DNA, 25 bp, Mus musculus
tgctattgttcgttgtatccaggac

SEQ ID NO: 872067 - DNA, 25 bp, Mus musculus
tgctattgttgtctagaatggtcac

SEQ ID NO: 872068 - DNA, 25 bp, Mus musculus
tgctattgttgtgtagaatggtcac

SEQ ID NO: 872069 - DNA, 25 bp, Mus musculus
tgctatttagcccaggataaccttg

SEQ ID NO: 872070 - DNA, 25 bp, Mus musculus
tgctatttagccgaggataaccttg

SEQ ID NO: 872071 - DNA, 25 bp, Mus musculus
tgctatttgagtcagccagccttcg

SEQ ID NO: 872072 - DNA, 25 bp, Mus musculus
tgctatttgagtgagccagccttcg

SEQ ID NO: 872073 - DNA, 25 bp, Mus musculus
tgctatttgttgaactgggttttgt

SEQ ID NO: 872074 - DNA, 25 bp, Mus musculus
tgctatttgttgtactgggttttgt

SEQ ID NO: 872075 - DNA, 25 bp, Mus musculus
tgctattttataacatgactgcttt

SEQ ID NO: 872076 - DNA, 25 bp, Mus musculus
tgctattttatatcatgactgcttt

SEQ ID NO: 872077 - DNA, 25 bp, Mus musculus
tgctattttttgaaaccatgttatc

SEQ ID NO: 872078 - DNA, 25 bp, Mus musculus
tgctattttttgtaaccatgttatc

SEQ ID NO: 872079 - DNA, 25 bp, Mus musculus
tgctcaaaacacatgtgctaccctt

SEQ ID NO: 872080 - DNA, 25 bp, Mus musculus
tgctcaaaacacttgtgctaccctt

SEQ ID NO: 872081 - DNA, 25 bp, Mus musculus
tgctcaaaatacatcctctcttttc

SEQ ID NO: 872082 - DNA, 25 bp, Mus musculus
tgctcaaaatacttcctctcttttc

SEQ ID NO: 872083 - DNA, 25 bp, Mus musculus
tgctcaaaatccaccgtcagaccaa

SEQ ID NO: 872084 - DNA, 25 bp, Mus musculus
tgctcaaaatcctccgtcagaccaa

SEQ ID NO: 872085 - DNA, 25 bp, Mus musculus
tgctcaaaatgtaactaccacccct

SEQ ID NO: 872086 - DNA, 25 bp, Mus musculus
tgctcaaaatgttactaccacccct

SEQ ID NO: 872087 - DNA, 25 bp, Mus musculus
tgctcaaagagacgcagaccaccct

SEQ ID NO: 872088 - DNA, 25 bp, Mus musculus
tgctcaaagagaggcagaccaccct

SEQ ID NO: 872089 - DNA, 25 bp, Mus musculus
tgctcaaagcacagccccagagagg

SEQ ID NO: 872090 - DNA, 25 bp, Mus musculus
tgctcaaagcactgccccagagagg

SEQ ID NO: 872091 - DNA, 25 bp, Mus musculus
tgctcaaaggtacgcacagaccact

SEQ ID NO: 872092 - DNA, 25 bp, Mus musculus
tgctcaaaggtaggcacagaccact

SEQ ID NO: 872093 - DNA, 25 bp, Mus musculus
tgctcaaaggttcatctcctgcagc

SEQ ID NO: 872094 - DNA, 25 bp, Mus musculus
tgctcaaaggttgatctcctgcagc

SEQ ID NO: 872095 - DNA, 25 bp, Mus musculus
tgctcaaatgtgcttccaccaacca

SEQ ID NO: 872096 - DNA, 25 bp, Mus musculus
tgctcaaatgtggttccaccaacca

SEQ ID NO: 872097 - DNA, 25 bp, Mus musculus
tgctcaacagcaccattgcttggaa

SEQ ID NO: 872098 - DNA, 25 bp, Mus musculus
tgctcaacagcagcattgcttggaa

SEQ ID NO: 872099 - DNA, 25 bp, Mus musculus
tgctcaaccaaaaaggcagccgcct

SEQ ID NO: 872100 - DNA, 25 bp, Mus musculus
tgctcaaccaaataggcagccgcct

SEQ ID NO: 872101 - DNA, 25 bp, Mus musculus
tgctcaacctcactgaccggcaagt

SEQ ID NO: 872102 - DNA, 25 bp, Mus musculus
tgctcaacctcagtgaccggcaagt

SEQ ID NO: 872103 - DNA, 25 bp, Mus musculus
tgctcaactcccagttagaccaaaa

SEQ ID NO: 872104 - DNA, 25 bp, Mus musculus
tgctcaactccctgttagaccaaaa

SEQ ID NO: 872105 - DNA, 25 bp, Mus musculus
tgctcaactcttctccagaacagga

SEQ ID NO: 872106 - DNA, 25 bp, Mus musculus
tgctcaactcttgtccagaacagga

SEQ ID NO: 872107 - DNA, 25 bp, Mus musculus
tgctcaagagccagctgacccaggt

SEQ ID NO: 872108 - DNA, 25 bp, Mus musculus
tgctcaagagcctgctgacccaggt

SEQ ID NO: 872109 - DNA, 25 bp, Mus musculus
tgctcaagattgctgttaaacatac

SEQ ID NO: 872110 - DNA, 25 bp, Mus musculus
tgctcaagattggtgttaaacatac

SEQ ID NO: 872111 - DNA, 25 bp, Mus musculus
tgctcaagcaggatctgtggcgcca

SEQ ID NO: 872112 - DNA, 25 bp, Mus musculus
tgctcaagcaggttctgtggcgcca

SEQ ID NO: 872113 - DNA, 25 bp, Mus musculus
tgctcaagcggcagcggcttcagaa

SEQ ID NO: 872114 - DNA, 25 bp, Mus musculus
tgctcaagcggctgcggcttcagaa

SEQ ID NO: 872115 - DNA, 25 bp, Mus musculus
tgctcaaggagaagcctggctggat

SEQ ID NO: 872116 - DNA, 25 bp, Mus musculus
tgctcaaggagatgcctggctggat

SEQ ID NO: 872117 - DNA, 25 bp, Mus musculus
tgctcaagggctacacatgtggctc

SEQ ID NO: 872118 - DNA, 25 bp, Mus musculus
tgctcaagggcttcacatgtggctc

SEQ ID NO: 872119 - DNA, 25 bp, Mus musculus
tgctcaaggtgcagtacggcacggt

SEQ ID NO: 872120 - DNA, 25 bp, Mus musculus
tgctcaaggtgctgtacggcacggt

SEQ ID NO: 872121 - DNA, 25 bp, Mus musculus
tgctcaatacccaaacaccgctggg

SEQ ID NO: 872122 - DNA, 25 bp, Mus musculus
tgctcaataccctaacaccgctggg

SEQ ID NO: 872123 - DNA, 25 bp, Mus musculus
tgctcaatagtgagaaccttcttgt

SEQ ID NO: 872124 - DNA, 25 bp, Mus musculus
tgctcaatagtgtgaaccttcttgt

SEQ ID NO: 872125 - DNA, 25 bp, Mus musculus
tgctcaatccagctcacgtgggaca

SEQ ID NO: 872126 - DNA, 25 bp, Mus musculus
tgctcaatccaggtcacgtgggaca

SEQ ID NO: 872127 - DNA, 25 bp, Mus musculus
tgctcaatctcaccaccggctaggg

SEQ ID NO: 872128 - DNA, 25 bp, Mus musculus
tgctcaatctcagcaccggctaggg

SEQ ID NO: 872129 - DNA, 25 bp, Mus musculus
tgctcaatgaggcttatccactgaa

SEQ ID NO: 872130 - DNA, 25 bp, Mus musculus
tgctcaatgagggttatccactgaa

SEQ ID NO: 872131 - DNA, 25 bp, Mus musculus
tgctcacaacagcttctcacgaagt

SEQ ID NO: 872132 - DNA, 25 bp, Mus musculus
tgctcacaacaggttctcacgaagt

SEQ ID NO: 872133 - DNA, 25 bp, Mus musculus
tgctcacaagctagctggaccagta

SEQ ID NO: 872134 - DNA, 25 bp, Mus musculus
tgctcacaagcttgctggaccagta

SEQ ID NO: 872135 - DNA, 25 bp, Mus musculus
tgctcacacagcagactgacctgta

SEQ ID NO: 872136 - DNA, 25 bp, Mus musculus
tgctcacacagctgactgacctgta

SEQ ID NO: 872137 - DNA, 25 bp, Mus musculus
tgctcacaccagctaaatgctattg

SEQ ID NO: 872138 - DNA, 25 bp, Mus musculus
tgctcacaccaggtaaatgctattg

SEQ ID NO: 872139 - DNA, 25 bp, Mus musculus
tgctcacacctaattttatcaccat

SEQ ID NO: 872140 - DNA, 25 bp, Mus musculus
tgctcacacctatttttatcaccat

SEQ ID NO: 872141 - DNA, 25 bp, Mus musculus
tgctcacacgcaactgtgtgtgtgt

SEQ ID NO: 872142 - DNA, 25 bp, Mus musculus
tgctcacacgcatctgtgtgtgtgt

SEQ ID NO: 872143 - DNA, 25 bp, Mus musculus
tgctcacacggcagtattcttgaag

SEQ ID NO: 872144 - DNA, 25 bp, Mus musculus
tgctcacacggctgtattcttgaag

SEQ ID NO: 872145 - DNA, 25 bp, Mus musculus
tgctcacactaacagatgaaccaga

SEQ ID NO: 872146 - DNA, 25 bp, Mus musculus
tgctcacactaagagatgaaccaga

SEQ ID NO: 872147 - DNA, 25 bp, Mus musculus
tgctcacagagtacagtcatgcgga

SEQ ID NO: 872148 - DNA, 25 bp, Mus musculus
tgctcacagagttcagtcatgcgga

SEQ ID NO: 872149 - DNA, 25 bp, Mus musculus
tgctcacagcacatacggtagtcgg

SEQ ID NO: 872150 - DNA, 25 bp, Mus musculus
tgctcacagcacttacggtagtcgg

SEQ ID NO: 872151 - DNA, 25 bp, Mus musculus
tgctcacagccgagtcaacaattct

SEQ ID NO: 872152 - DNA, 25 bp, Mus musculus
tgctcacagccgtgtcaacaattct

SEQ ID NO: 872153 - DNA, 25 bp, Mus musculus
tgctcacaggatcggcacgtgtctt

SEQ ID NO: 872154 - DNA, 25 bp, Mus musculus
tgctcacaggatgggcacgtgtctt

SEQ ID NO: 872155 - DNA, 25 bp, Mus musculus
tgctcacaggcaacttcgcaaccta

SEQ ID NO: 872156 - DNA, 25 bp, Mus musculus
tgctcacaggcatcttcgcaaccta

SEQ ID NO: 872157 - DNA, 25 bp, Mus musculus
tgctcacaggttcgctggctcgacc

SEQ ID NO: 872158 - DNA, 25 bp, Mus musculus
tgctcacaggttggctggctcgacc

SEQ ID NO: 872159 - DNA, 25 bp, Mus musculus
tgctcacagtccactcttatggaga

SEQ ID NO: 872160 - DNA, 25 bp, Mus musculus
tgctcacagtcctctcttatggaga

SEQ ID NO: 872161 - DNA, 25 bp, Mus musculus
tgctcacagtgcacatagcctttac

SEQ ID NO: 872162 - DNA, 25 bp, Mus musculus
tgctcacagtgctcatagcctttac

SEQ ID NO: 872163 - DNA, 25 bp, Mus musculus
tgctcacatcatagaggctacctgt

SEQ ID NO: 872164 - DNA, 25 bp, Mus musculus
tgctcacatcatctcttacagtgca

SEQ ID NO: 872165 - DNA, 25 bp, Mus musculus
tgctcacatcatgtcttacagtgca

SEQ ID NO: 872166 - DNA, 25 bp, Mus musculus
tgctcacatcattgaggctacctgt

SEQ ID NO: 872167 - DNA, 25 bp, Mus musculus
tgctcacatgcaacacagtgtcttt

SEQ ID NO: 872168 - DNA, 25 bp, Mus musculus
tgctcacatgcatcacagtgtcttt

SEQ ID NO: 872169 - DNA, 25 bp, Mus musculus
tgctcacatgttaacacatatctgt

SEQ ID NO: 872170 - DNA, 25 bp, Mus musculus
tgctcacatgtttacacatatctgt

SEQ ID NO: 872171 - DNA, 25 bp, Mus musculus
tgctcaccacagatctatagccagt

SEQ ID NO: 872172 - DNA, 25 bp, Mus musculus
tgctcaccacagttctatagccagt

SEQ ID NO: 872173 - DNA, 25 bp, Mus musculus
tgctcaccccaaatatccatttttg

SEQ ID NO: 872174 - DNA, 25 bp, Mus musculus
tgctcaccccaattatccatttttg

SEQ ID NO: 872175 - DNA, 25 bp, Mus musculus
tgctcaccccgcaagagaacgagtc

SEQ ID NO: 872176 - DNA, 25 bp, Mus musculus
tgctcaccccgctagagaacgagtc

SEQ ID NO: 872177 - DNA, 25 bp, Mus musculus
tgctcacccctgcagacaagggaga

SEQ ID NO: 872178 - DNA, 25 bp, Mus musculus
tgctcacccctggagacaagggaga

SEQ ID NO: 872179 - DNA, 25 bp, Mus musculus
tgctcacccgtgatgtgattcacct

SEQ ID NO: 872180 - DNA, 25 bp, Mus musculus
tgctcacccgtgttgtgattcacct

SEQ ID NO: 872181 - DNA, 25 bp, Mus musculus
tgctcaccgtagacattgtgtcttt

SEQ ID NO: 872182 - DNA, 25 bp, Mus musculus
tgctcaccgtagtcattgtgtcttt

SEQ ID NO: 872183 - DNA, 25 bp, Mus musculus
tgctcacctggtctcgcatgatgca

SEQ ID NO: 872184 - DNA, 25 bp, Mus musculus
tgctcacctggtgtcgcatgatgca

SEQ ID NO: 872185 - DNA, 25 bp, Mus musculus
tgctcaccttcaactttctattaac

SEQ ID NO: 872186 - DNA, 25 bp, Mus musculus
tgctcaccttcatctttctattaac

SEQ ID NO: 872187 - DNA, 25 bp, Mus musculus
tgctcacgacctatctaacttcagt

SEQ ID NO: 872188 - DNA, 25 bp, Mus musculus
tgctcacgacctttctaacttcagt

SEQ ID NO: 872189 - DNA, 25 bp, Mus musculus
tgctcacgctgcatctgtccgtcat

SEQ ID NO: 872190 - DNA, 25 bp, Mus musculus
tgctcacgctgcttctgtccgtcat

SEQ ID NO: 872191 - DNA, 25 bp, Mus musculus
tgctcacgggagctgctagatcttc

SEQ ID NO: 872192 - DNA, 25 bp, Mus musculus
tgctcacgggaggtgctagatcttc

SEQ ID NO: 872193 - DNA, 25 bp, Mus musculus
tgctcacgtgacaaggcaggcgttt

SEQ ID NO: 872194 - DNA, 25 bp, Mus musculus
tgctcacgtgactaggcaggcgttt

SEQ ID NO: 872195 - DNA, 25 bp, Mus musculus
tgctcactatcaccacagacagatg

SEQ ID NO: 872196 - DNA, 25 bp, Mus musculus
tgctcactatcagcacagacagatg

SEQ ID NO: 872197 - DNA, 25 bp, Mus musculus
tgctcactcaaacttctgttcacat

SEQ ID NO: 872198 - DNA, 25 bp, Mus musculus
tgctcactcaaagttctgttcacat

SEQ ID NO: 872199 - DNA, 25 bp, Mus musculus
tgctcactcaccatcctgaggaaat

SEQ ID NO: 872200 - DNA, 25 bp, Mus musculus
tgctcactcaccttcctgaggaaat

SEQ ID NO: 872201 - DNA, 25 bp, Mus musculus
tgctcactcactaattcctggttcc

SEQ ID NO: 872202 - DNA, 25 bp, Mus musculus
tgctcactcacttattcctggttcc

SEQ ID NO: 872203 - DNA, 25 bp, Mus musculus
tgctcactcatactttctcaggatc

SEQ ID NO: 872204 - DNA, 25 bp, Mus musculus
tgctcactcatagtttctcaggatc

SEQ ID NO: 872205 - DNA, 25 bp, Mus musculus
tgctcactcatccttagccatgaga

SEQ ID NO: 872206 - DNA, 25 bp, Mus musculus
tgctcactcatcgttagccatgaga

SEQ ID NO: 872207 - DNA, 25 bp, Mus musculus
tgctcactccacacatggtactgag

SEQ ID NO: 872208 - DNA, 25 bp, Mus musculus
tgctcactccactcatggtactgag

SEQ ID NO: 872209 - DNA, 25 bp, Mus musculus
tgctcactccctaaactcttcaagt

SEQ ID NO: 872210 - DNA, 25 bp, Mus musculus
tgctcactcccttaactcttcaagt

SEQ ID NO: 872211 - DNA, 25 bp, Mus musculus
tgctcactccttctgtactttacat

SEQ ID NO: 872212 - DNA, 25 bp, Mus musculus
tgctcactccttgtgtactttacat

SEQ ID NO: 872213 - DNA, 25 bp, Mus musculus
tgctcactctaaacatctgctacac

SEQ ID NO: 872214 - DNA, 25 bp, Mus musculus
tgctcactctaatcatctgctacac

SEQ ID NO: 872215 - DNA, 25 bp, Mus musculus
tgctcactgaagctggtccacgtct

SEQ ID NO: 872216 - DNA, 25 bp, Mus musculus
tgctcactgaagcttctagttctga

SEQ ID NO: 872217 - DNA, 25 bp, Mus musculus
tgctcactgaaggtggtccacgtct

SEQ ID NO: 872218 - DNA, 25 bp, Mus musculus
tgctcactgaaggttctagttctga

SEQ ID NO: 872219 - DNA, 25 bp, Mus musculus
tgctcactgaccatgctgtttaagt

SEQ ID NO: 872220 - DNA, 25 bp, Mus musculus
tgctcactgaccttgctgtttaagt

SEQ ID NO: 872221 - DNA, 25 bp, Mus musculus
tgctcactgagtacatgctgtgctt

SEQ ID NO: 872222 - DNA, 25 bp, Mus musculus
tgctcactgagttcatgctgtgctt

SEQ ID NO: 872223 - DNA, 25 bp, Mus musculus
tgctcactgatgcttttacctgtct

SEQ ID NO: 872224 - DNA, 25 bp, Mus musculus
tgctcactgatggttttacctgtct

SEQ ID NO: 872225 - DNA, 25 bp, Mus musculus
tgctcactgcaactcgaacttcatc

SEQ ID NO: 872226 - DNA, 25 bp, Mus musculus
tgctcactgcaagtcgaacttcatc

SEQ ID NO: 872227 - DNA, 25 bp, Mus musculus
tgctcactgcacacagtcgctgagg

SEQ ID NO: 872228 - DNA, 25 bp, Mus musculus
tgctcactgcactcagtcgctgagg

SEQ ID NO: 872229 - DNA, 25 bp, Mus musculus
tgctcactgccgacagatgtggata

SEQ ID NO: 872230 - DNA, 25 bp, Mus musculus
tgctcactgccgtcagatgtggata

SEQ ID NO: 872231 - DNA, 25 bp, Mus musculus
tgctcactggatctggagaccccaa

SEQ ID NO: 872232 - DNA, 25 bp, Mus musculus
tgctcactggatgtggagaccccaa

SEQ ID NO: 872233 - DNA, 25 bp, Mus musculus
tgctcactggcaaatacttgatttg

SEQ ID NO: 872234 - DNA, 25 bp, Mus musculus
tgctcactggcatatacttgatttg

SEQ ID NO: 872235 - DNA, 25 bp, Mus musculus
tgctcactggtcagcaggacagttt

SEQ ID NO: 872236 - DNA, 25 bp, Mus musculus
tgctcactggtctgcaggacagttt

SEQ ID NO: 872237 - DNA, 25 bp, Mus musculus
tgctcactgttgagtgacctccttg

SEQ ID NO: 872238 - DNA, 25 bp, Mus musculus
tgctcactgttgtgtgacctccttg

SEQ ID NO: 872239 - DNA, 25 bp, Mus musculus
tgctcacttctcatcagacaggaat

SEQ ID NO: 872240 - DNA, 25 bp, Mus musculus
tgctcacttctcatggctttatggg

SEQ ID NO: 872241 - DNA, 25 bp, Mus musculus
tgctcacttctcttcagacaggaat

SEQ ID NO: 872242 - DNA, 25 bp, Mus musculus
tgctcacttctcttggctttatggg

SEQ ID NO: 872243 - DNA, 25 bp, Mus musculus
tgctcacttggtcagtctgtctgtc

SEQ ID NO: 872244 - DNA, 25 bp, Mus musculus
tgctcacttggtgagtctgtctgtc

SEQ ID NO: 872245 - DNA, 25 bp, Mus musculus
tgctcagaaactcctcacttcctta

SEQ ID NO: 872246 - DNA, 25 bp, Mus musculus
tgctcagaaactgctcacttcctta

SEQ ID NO: 872247 - DNA, 25 bp, Mus musculus
tgctcagaaggtagtggaccggcta

SEQ ID NO: 872248 - DNA, 25 bp, Mus musculus
tgctcagaaggttgtggaccggcta

SEQ ID NO: 872249 - DNA, 25 bp, Mus musculus
tgctcagaagtcaccataatcatga

SEQ ID NO: 872250 - DNA, 25 bp, Mus musculus
tgctcagaagtctccataatcatga

SEQ ID NO: 872251 - DNA, 25 bp, Mus musculus
tgctcagaccagagtgccattaatc

SEQ ID NO: 872252 - DNA, 25 bp, Mus musculus
tgctcagaccagtgtgccattaatc

SEQ ID NO: 872253 - DNA, 25 bp, Mus musculus
tgctcagactacatcgtgcctgcaa

SEQ ID NO: 872254 - DNA, 25 bp, Mus musculus
tgctcagactacttcgtgcctgcaa

SEQ ID NO: 872255 - DNA, 25 bp, Mus musculus
tgctcagactccagtgaaggcacag

SEQ ID NO: 872256 - DNA, 25 bp, Mus musculus
tgctcagactcctgtgaaggcacag

SEQ ID NO: 872257 - DNA, 25 bp, Mus musculus
tgctcagacttacacctgacttcct

SEQ ID NO: 872258 - DNA, 25 bp, Mus musculus
tgctcagacttagacctgacttcct

SEQ ID NO: 872259 - DNA, 25 bp, Mus musculus
tgctcagacttgaacatctctcatg

SEQ ID NO: 872260 - DNA, 25 bp, Mus musculus
tgctcagacttgtacatctctcatg

SEQ ID NO: 872261 - DNA, 25 bp, Mus musculus
tgctcagagactaaccgagggcctg

SEQ ID NO: 872262 - DNA, 25 bp, Mus musculus
tgctcagagactacctgctgctggg

SEQ ID NO: 872263 - DNA, 25 bp, Mus musculus
tgctcagagacttaccgagggcctg

SEQ ID NO: 872264 - DNA, 25 bp, Mus musculus
tgctcagagacttcctgctgctggg

SEQ ID NO: 872265 - DNA, 25 bp, Mus musculus
tgctcagagatcatgacttgacccc

SEQ ID NO: 872266 - DNA, 25 bp, Mus musculus
tgctcagagatcttgacttgacccc

SEQ ID NO: 872267 - DNA, 25 bp, Mus musculus
tgctcagagctgcattccgtgcata

SEQ ID NO: 872268 - DNA, 25 bp, Mus musculus
tgctcagagctggattccgtgcata

SEQ ID NO: 872269 - DNA, 25 bp, Mus musculus
tgctcagaggtgagtcaggttgtct

SEQ ID NO: 872270 - DNA, 25 bp, Mus musculus
tgctcagaggtgtgtcaggttgtct

SEQ ID NO: 872271 - DNA, 25 bp, Mus musculus
tgctcagatttacaactccagtgaa

SEQ ID NO: 872272 - DNA, 25 bp, Mus musculus
tgctcagatttagaactccagtgaa

SEQ ID NO: 872273 - DNA, 25 bp, Mus musculus
tgctcagattttaagtgtgcaccac

SEQ ID NO: 872274 - DNA, 25 bp, Mus musculus
tgctcagatttttagtgtgcaccac

SEQ ID NO: 872275 - DNA, 25 bp, Mus musculus
tgctcagcacatccacactgtagtg

SEQ ID NO: 872276 - DNA, 25 bp, Mus musculus
tgctcagcacatgcacactgtagtg

SEQ ID NO: 872277 - DNA, 25 bp, Mus musculus
tgctcagcacctcaatggttctgca

SEQ ID NO: 872278 - DNA, 25 bp, Mus musculus
tgctcagcacctgaatggttctgca

SEQ ID NO: 872279 - DNA, 25 bp, Mus musculus
tgctcagcagataccagagcttgca

SEQ ID NO: 872280 - DNA, 25 bp, Mus musculus
tgctcagcagattccagagcttgca

SEQ ID NO: 872281 - DNA, 25 bp, Mus musculus
tgctcagccactcagctagacaaaa

SEQ ID NO: 872282 - DNA, 25 bp, Mus musculus
tgctcagccactgagctagacaaaa

SEQ ID NO: 872283 - DNA, 25 bp, Mus musculus
tgctcagccattcaacaggaatcct

SEQ ID NO: 872284 - DNA, 25 bp, Mus musculus
tgctcagccattgaacaggaatcct

SEQ ID NO: 872285 - DNA, 25 bp, Mus musculus
tgctcagcccatatgttccaaaact

SEQ ID NO: 872286 - DNA, 25 bp, Mus musculus
tgctcagcccatttgttccaaaact

SEQ ID NO: 872287 - DNA, 25 bp, Mus musculus
tgctcagcctaacttcttgtagtgc

SEQ ID NO: 872288 - DNA, 25 bp, Mus musculus
tgctcagcctaagttcttgtagtgc

SEQ ID NO: 872289 - DNA, 25 bp, Mus musculus
tgctcagcctgaacagctgtgcaat

SEQ ID NO: 872290 - DNA, 25 bp, Mus musculus
tgctcagcctgacgtggccgactgg

SEQ ID NO: 872291 - DNA, 25 bp, Mus musculus
tgctcagcctgaggtggccgactgg

SEQ ID NO: 872292 - DNA, 25 bp, Mus musculus
tgctcagcctgatcagctgtgcaat

SEQ ID NO: 872293 - DNA, 25 bp, Mus musculus
tgctcagcctgtccacggcaggata

SEQ ID NO: 872294 - DNA, 25 bp, Mus musculus
tgctcagcctgtgcacggcaggata

SEQ ID NO: 872295 - DNA, 25 bp, Mus musculus
tgctcagccttgctggagattctgg

SEQ ID NO: 872296 - DNA, 25 bp, Mus musculus
tgctcagccttggtggagattctgg

SEQ ID NO: 872297 - DNA, 25 bp, Mus musculus
tgctcagcgacacaagtgcctctac

SEQ ID NO: 872298 - DNA, 25 bp, Mus musculus
tgctcagcgacagaagtgcctctac

SEQ ID NO: 872299 - DNA, 25 bp, Mus musculus
tgctcagcgagaccctcatcttttc

SEQ ID NO: 872300 - DNA, 25 bp, Mus musculus
tgctcagcgagactggtcctctgga

SEQ ID NO: 872301 - DNA, 25 bp, Mus musculus
tgctcagcgagagcctcatcttttc

SEQ ID NO: 872302 - DNA, 25 bp, Mus musculus
tgctcagcgagagtggtcctctgga

SEQ ID NO: 872303 - DNA, 25 bp, Mus musculus
tgctcagcgccaacgggcagaggat

SEQ ID NO: 872304 - DNA, 25 bp, Mus musculus
tgctcagcgccatcgggcagaggat

SEQ ID NO: 872305 - DNA, 25 bp, Mus musculus
tgctcagcgtccctggaaacgcagc

SEQ ID NO: 872306 - DNA, 25 bp, Mus musculus
tgctcagcgtccgtggaaacgcagc

SEQ ID NO: 872307 - DNA, 25 bp, Mus musculus
tgctcagctattcgctactggagag

SEQ ID NO: 872308 - DNA, 25 bp, Mus musculus
tgctcagctattggctactggagag

SEQ ID NO: 872309 - DNA, 25 bp, Mus musculus
tgctcagctgagatgttttcatagt

SEQ ID NO: 872310 - DNA, 25 bp, Mus musculus
tgctcagctgagttgttttcatagt

SEQ ID NO: 872311 - DNA, 25 bp, Mus musculus
tgctcagctgccatggatctgggat

SEQ ID NO: 872312 - DNA, 25 bp, Mus musculus
tgctcagctgccttggatctgggat

SEQ ID NO: 872313 - DNA, 25 bp, Mus musculus
tgctcagctggccaatggacctaga

SEQ ID NO: 872314 - DNA, 25 bp, Mus musculus
tgctcagctggcgaatggacctaga

SEQ ID NO: 872315 - DNA, 25 bp, Mus musculus
tgctcagcttctacacttgtctgtg

SEQ ID NO: 872316 - DNA, 25 bp, Mus musculus
tgctcagcttctcattgatatacag

SEQ ID NO: 872317 - DNA, 25 bp, Mus musculus
tgctcagcttctgattgatatacag

SEQ ID NO: 872318 - DNA, 25 bp, Mus musculus
tgctcagcttcttcacttgtctgtg

SEQ ID NO: 872319 - DNA, 25 bp, Mus musculus
tgctcaggacggaactggtggtctc

SEQ ID NO: 872320 - DNA, 25 bp, Mus musculus
tgctcaggacggtactggtggtctc

SEQ ID NO: 872321 - DNA, 25 bp, Mus musculus
tgctcaggagccatgaagtctcttt

SEQ ID NO: 872322 - DNA, 25 bp, Mus musculus
tgctcaggagccttgaagtctcttt

SEQ ID NO: 872323 - DNA, 25 bp, Mus musculus
tgctcaggagtcctcgccaagaaac

SEQ ID NO: 872324 - DNA, 25 bp, Mus musculus
tgctcaggagtcgtcgccaagaaac

SEQ ID NO: 872325 - DNA, 25 bp, Mus musculus
tgctcaggagttaatgtgacatgct

SEQ ID NO: 872326 - DNA, 25 bp, Mus musculus
tgctcaggagtttatgtgacatgct

SEQ ID NO: 872327 - DNA, 25 bp, Mus musculus
tgctcaggatgaaactggcggcctt

SEQ ID NO: 872328 - DNA, 25 bp, Mus musculus
tgctcaggatgatactggcggcctt

SEQ ID NO: 872329 - DNA, 25 bp, Mus musculus
tgctcaggatgcagggtccccatgg

SEQ ID NO: 872330 - DNA, 25 bp, Mus musculus
tgctcaggatgctgggtccccatgg

SEQ ID NO: 872331 - DNA, 25 bp, Mus musculus
tgctcaggcactcggatgctgcatc

SEQ ID NO: 872332 - DNA, 25 bp, Mus musculus
tgctcaggcactgggatgctgcatc

SEQ ID NO: 872333 - DNA, 25 bp, Mus musculus
tgctcaggcattagcaaatctgttt

SEQ ID NO: 872334 - DNA, 25 bp, Mus musculus
tgctcaggcatttgcaaatctgttt

SEQ ID NO: 872335 - DNA, 25 bp, Mus musculus
tgctcagggagaattggcagactct

SEQ ID NO: 872336 - DNA, 25 bp, Mus musculus
tgctcagggagatttggcagactct

SEQ ID NO: 872337 - DNA, 25 bp, Mus musculus
tgctcagggctaagaccaggaagac

SEQ ID NO: 872338 - DNA, 25 bp, Mus musculus
tgctcagggctatgaccaggaagac

SEQ ID NO: 872339 - DNA, 25 bp, Mus musculus
tgctcagggtctcaaggtaaggtct

SEQ ID NO: 872340 - DNA, 25 bp, Mus musculus
tgctcagggtctgaaggtaaggtct

SEQ ID NO: 872341 - DNA, 25 bp, Mus musculus
tgctcaggtccaacaccatcggtgt

SEQ ID NO: 872342 - DNA, 25 bp, Mus musculus
tgctcaggtccatcaccatcggtgt

SEQ ID NO: 872343 - DNA, 25 bp, Mus musculus
tgctcaggtcttcgccatcaggaat

SEQ ID NO: 872344 - DNA, 25 bp, Mus musculus
tgctcaggtcttcgtaacttgctca

SEQ ID NO: 872345 - DNA, 25 bp, Mus musculus
tgctcaggtcttggccatcaggaat

SEQ ID NO: 872346 - DNA, 25 bp, Mus musculus
tgctcaggtcttggtaacttgctca

SEQ ID NO: 872347 - DNA, 25 bp, Mus musculus
tgctcaggtgcacggaattccgctc

SEQ ID NO: 872348 - DNA, 25 bp, Mus musculus
tgctcaggtgcagggaattccgctc

SEQ ID NO: 872349 - DNA, 25 bp, Mus musculus
tgctcagtaacacgaccttgctaat

SEQ ID NO: 872350 - DNA, 25 bp, Mus musculus
tgctcagtaacaggaccttgctaat

SEQ ID NO: 872351 - DNA, 25 bp, Mus musculus
tgctcagtatcaatgtggagaacca

SEQ ID NO: 872352 - DNA, 25 bp, Mus musculus
tgctcagtatcattgtggagaacca

SEQ ID NO: 872353 - DNA, 25 bp, Mus musculus
tgctcagtatcccttccagacaggc

SEQ ID NO: 872354 - DNA, 25 bp, Mus musculus
tgctcagtatccgttccagacaggc

SEQ ID NO: 872355 - DNA, 25 bp, Mus musculus
tgctcagtcacacccattcagctaa

SEQ ID NO: 872356 - DNA, 25 bp, Mus musculus
tgctcagtcacagccattcagctaa

SEQ ID NO: 872357 - DNA, 25 bp, Mus musculus
tgctcagtcccaacaggaatcagat

SEQ ID NO: 872358 - DNA, 25 bp, Mus musculus
tgctcagtcccatcaggaatcagat

SEQ ID NO: 872359 - DNA, 25 bp, Mus musculus
tgctcagtgagcatcggctggccca

SEQ ID NO: 872360 - DNA, 25 bp, Mus musculus
tgctcagtgagcttcggctggccca

SEQ ID NO: 872361 - DNA, 25 bp, Mus musculus
tgctcagtgcagagtgcagtctcag

SEQ ID NO: 872362 - DNA, 25 bp, Mus musculus
tgctcagtgcagtgtgcagtctcag

SEQ ID NO: 872363 - DNA, 25 bp, Mus musculus
tgctcagtgcatcacccagaaatag

SEQ ID NO: 872364 - DNA, 25 bp, Mus musculus
tgctcagtgcatgacccagaaatag

SEQ ID NO: 872365 - DNA, 25 bp, Mus musculus
tgctcagtgccacacggtggaaaaa

SEQ ID NO: 872366 - DNA, 25 bp, Mus musculus
tgctcagtgccagacggtggaaaaa

SEQ ID NO: 872367 - DNA, 25 bp, Mus musculus
tgctcagtgcccatgggtccttact

SEQ ID NO: 872368 - DNA, 25 bp, Mus musculus
tgctcagtgcccttgggtccttact

SEQ ID NO: 872369 - DNA, 25 bp, Mus musculus
tgctcagtgcttaaaattttaagtt

SEQ ID NO: 872370 - DNA, 25 bp, Mus musculus
tgctcagtgctttaaattttaagtt

SEQ ID NO: 872371 - DNA, 25 bp, Mus musculus
tgctcagtggcgctgaagcttcctt

SEQ ID NO: 872372 - DNA, 25 bp, Mus musculus
tgctcagtggcggtgaagcttcctt

SEQ ID NO: 872373 - DNA, 25 bp, Mus musculus
tgctcagtggctcgatttctgttct

SEQ ID NO: 872374 - DNA, 25 bp, Mus musculus
tgctcagtggctggatttctgttct

SEQ ID NO: 872375 - DNA, 25 bp, Mus musculus
tgctcagtgtaaactcctcaggaaa

SEQ ID NO: 872376 - DNA, 25 bp, Mus musculus
tgctcagtgtaatctcctcaggaaa

SEQ ID NO: 872377 - DNA, 25 bp, Mus musculus
tgctcagtgtatagcccttaccttc

SEQ ID NO: 872378 - DNA, 25 bp, Mus musculus
tgctcagtgtattgcccttaccttc

SEQ ID NO: 872379 - DNA, 25 bp, Mus musculus
tgctcagtgtgcacagttctcaata

SEQ ID NO: 872380 - DNA, 25 bp, Mus musculus
tgctcagtgtgctcagttctcaata

SEQ ID NO: 872381 - DNA, 25 bp, Mus musculus
tgctcagttccaatgtgcccagtca

SEQ ID NO: 872382 - DNA, 25 bp, Mus musculus
tgctcagttccattgtgcccagtca

SEQ ID NO: 872383 - DNA, 25 bp, Mus musculus
tgctcagttcccacaagtgtagtac

SEQ ID NO: 872384 - DNA, 25 bp, Mus musculus
tgctcagttccccaagggcaaggaa

SEQ ID NO: 872385 - DNA, 25 bp, Mus musculus
tgctcagttcccgaagggcaaggaa

SEQ ID NO: 872386 - DNA, 25 bp, Mus musculus
tgctcagttccctcaagtgtagtac

SEQ ID NO: 872387 - DNA, 25 bp, Mus musculus
tgctcagttcctacacggaaaacta

SEQ ID NO: 872388 - DNA, 25 bp, Mus musculus
tgctcagttcctatctaccatttga

SEQ ID NO: 872389 - DNA, 25 bp, Mus musculus
tgctcagttccttcacggaaaacta

SEQ ID NO: 872390 - DNA, 25 bp, Mus musculus
tgctcagttcctttctaccatttga

SEQ ID NO: 872391 - DNA, 25 bp, Mus musculus
tgctcagttgctcgacattgaaaag

SEQ ID NO: 872392 - DNA, 25 bp, Mus musculus
tgctcagttgctggacattgaaaag

SEQ ID NO: 872393 - DNA, 25 bp, Mus musculus
tgctcatacagtcagccctgagttc

SEQ ID NO: 872394 - DNA, 25 bp, Mus musculus
tgctcatacagtgagccctgagttc

SEQ ID NO: 872395 - DNA, 25 bp, Mus musculus
tgctcataccctatatgtttcaata

SEQ ID NO: 872396 - DNA, 25 bp, Mus musculus
tgctcataccctttatgtttcaata

SEQ ID NO: 872397 - DNA, 25 bp, Mus musculus
tgctcatactgaatggtccatctaa

SEQ ID NO: 872398 - DNA, 25 bp, Mus musculus
tgctcatactgattggtccatctaa

SEQ ID NO: 872399 - DNA, 25 bp, Mus musculus
tgctcatagaaaaacgggctcattt

SEQ ID NO: 872400 - DNA, 25 bp, Mus musculus
tgctcatagaaatacgggctcattt

SEQ ID NO: 872401 - DNA, 25 bp, Mus musculus
tgctcatagccgctgctttcagcat

SEQ ID NO: 872402 - DNA, 25 bp, Mus musculus
tgctcatagccggtgctttcagcat

SEQ ID NO: 872403 - DNA, 25 bp, Mus musculus
tgctcataggtcaacatgaatcctg

SEQ ID NO: 872404 - DNA, 25 bp, Mus musculus
tgctcataggtctacatgaatcctg

SEQ ID NO: 872405 - DNA, 25 bp, Mus musculus
tgctcatatgccactcttacatttt

SEQ ID NO: 872406 - DNA, 25 bp, Mus musculus
tgctcatatgcctctcttacatttt

SEQ ID NO: 872407 - DNA, 25 bp, Mus musculus
tgctcatatgtcaggtttataaata

SEQ ID NO: 872408 - DNA, 25 bp, Mus musculus
tgctcatatgtctggtttataaata

SEQ ID NO: 872409 - DNA, 25 bp, Mus musculus
tgctcatattcacagtaggcagact

SEQ ID NO: 872410 - DNA, 25 bp, Mus musculus
tgctcatattcagagtaggcagact

SEQ ID NO: 872411 - DNA, 25 bp, Mus musculus
tgctcatatttcagggctgccccat

SEQ ID NO: 872412 - DNA, 25 bp, Mus musculus
tgctcatatttctgggctgccccat

SEQ ID NO: 872413 - DNA, 25 bp, Mus musculus
tgctcatcacctagtacgcaggaga

SEQ ID NO: 872414 - DNA, 25 bp, Mus musculus
tgctcatcaccttgtacgcaggaga

SEQ ID NO: 872415 - DNA, 25 bp, Mus musculus
tgctcatcagcactcagatccgtat

SEQ ID NO: 872416 - DNA, 25 bp, Mus musculus
tgctcatcagcactgtcctttttgg

SEQ ID NO: 872417 - DNA, 25 bp, Mus musculus
tgctcatcagcagtcagatccgtat

SEQ ID NO: 872418 - DNA, 25 bp, Mus musculus
tgctcatcagcagtgtcctttttgg

SEQ ID NO: 872419 - DNA, 25 bp, Mus musculus
tgctcatcagtgaagacacgccagt

SEQ ID NO: 872420 - DNA, 25 bp, Mus musculus
tgctcatcagtgtagacacgccagt

SEQ ID NO: 872421 - DNA, 25 bp, Mus musculus
tgctcatcatgcacttaatacaaga

SEQ ID NO: 872422 - DNA, 25 bp, Mus musculus
tgctcatcatgcctggactatttca

SEQ ID NO: 872423 - DNA, 25 bp, Mus musculus
tgctcatcatgcgtggactatttca

SEQ ID NO: 872424 - DNA, 25 bp, Mus musculus
tgctcatcatgctcttaatacaaga

SEQ ID NO: 872425 - DNA, 25 bp, Mus musculus
tgctcatccatactttctgctcctt

SEQ ID NO: 872426 - DNA, 25 bp, Mus musculus
tgctcatccatagtttctgctcctt

SEQ ID NO: 872427 - DNA, 25 bp, Mus musculus
tgctcatccgtgagattttgccaag

SEQ ID NO: 872428 - DNA, 25 bp, Mus musculus
tgctcatccgtgtgattttgccaag

SEQ ID NO: 872429 - DNA, 25 bp, Mus musculus
tgctcatcctgcagtgctttgaggc

SEQ ID NO: 872430 - DNA, 25 bp, Mus musculus
tgctcatcctgctgtgctttgaggc

SEQ ID NO: 872431 - DNA, 25 bp, Mus musculus
tgctcatccttccaagaaacctgct

SEQ ID NO: 872432 - DNA, 25 bp, Mus musculus
tgctcatccttcgaagaaacctgct

SEQ ID NO: 872433 - DNA, 25 bp, Mus musculus
tgctcatcgtagagggcaaccccct

SEQ ID NO: 872434 - DNA, 25 bp, Mus musculus
tgctcatcgtagtgggcaaccccct

SEQ ID NO: 872435 - DNA, 25 bp, Mus musculus
tgctcatctcatatacctgcatgtg

SEQ ID NO: 872436 - DNA, 25 bp, Mus musculus
tgctcatctcatttacctgcatgtg

SEQ ID NO: 872437 - DNA, 25 bp, Mus musculus
tgctcatctccaaggccaatgatct

SEQ ID NO: 872438 - DNA, 25 bp, Mus musculus
tgctcatctccatggccaatgatct

SEQ ID NO: 872439 - DNA, 25 bp, Mus musculus
tgctcatctccgatatggactatga

SEQ ID NO: 872440 - DNA, 25 bp, Mus musculus
tgctcatctccgttatggactatga

SEQ ID NO: 872441 - DNA, 25 bp, Mus musculus
tgctcatctcctcggcacagaagag

SEQ ID NO: 872442 - DNA, 25 bp, Mus musculus
tgctcatctcctgggcacagaagag

SEQ ID NO: 872443 - DNA, 25 bp, Mus musculus
tgctcatctcttacgaagcaccaga

SEQ ID NO: 872444 - DNA, 25 bp, Mus musculus
tgctcatctctttcgaagcaccaga

SEQ ID NO: 872445 - DNA, 25 bp, Mus musculus
tgctcatctgagattaatcacaaat

SEQ ID NO: 872446 - DNA, 25 bp, Mus musculus
tgctcatctgagtttaatcacaaat

SEQ ID NO: 872447 - DNA, 25 bp, Mus musculus
tgctcatcttctaggttcattttgt

SEQ ID NO: 872448 - DNA, 25 bp, Mus musculus
tgctcatcttcttggttcattttgt

SEQ ID NO: 872449 - DNA, 25 bp, Mus musculus
tgctcatgacccaggaggcacacag

SEQ ID NO: 872450 - DNA, 25 bp, Mus musculus
tgctcatgaccctggaggcacacag

SEQ ID NO: 872451 - DNA, 25 bp, Mus musculus
tgctcatgagcccatagtcaattgt

SEQ ID NO: 872452 - DNA, 25 bp, Mus musculus
tgctcatgagccgatagtcaattgt

SEQ ID NO: 872453 - DNA, 25 bp, Mus musculus
tgctcatgccggcaaccctagtgaa

SEQ ID NO: 872454 - DNA, 25 bp, Mus musculus
tgctcatgccgggaaccctagtgaa

SEQ ID NO: 872455 - DNA, 25 bp, Mus musculus
tgctcatgccttcctatgtgggtca

SEQ ID NO: 872456 - DNA, 25 bp, Mus musculus
tgctcatgccttgctatgtgggtca

SEQ ID NO: 872457 - DNA, 25 bp, Mus musculus
tgctcatgctcacctgtaagcagcg

SEQ ID NO: 872458 - DNA, 25 bp, Mus musculus
tgctcatgctcagctgtaagcagcg

SEQ ID NO: 872459 - DNA, 25 bp, Mus musculus
tgctcatggcaaccgtgggtgcacc

SEQ ID NO: 872460 - DNA, 25 bp, Mus musculus
tgctcatggcaagcgtgggtgcacc

SEQ ID NO: 872461 - DNA, 25 bp, Mus musculus
tgctcatggcacaacttgcctcaaa

SEQ ID NO: 872462 - DNA, 25 bp, Mus musculus
tgctcatggcactacttgcctcaaa

SEQ ID NO: 872463 - DNA, 25 bp, Mus musculus
tgctcatgtcaaagcttggcgtggg

SEQ ID NO: 872464 - DNA, 25 bp, Mus musculus
tgctcatgtcaatgcttggcgtggg

SEQ ID NO: 872465 - DNA, 25 bp, Mus musculus
tgctcatgtctgactgcactgatgt

SEQ ID NO: 872466 - DNA, 25 bp, Mus musculus
tgctcatgtctgtctgcactgatgt

SEQ ID NO: 872467 - DNA, 25 bp, Mus musculus
tgctcatgtttcatttccctcaaga

SEQ ID NO: 872468 - DNA, 25 bp, Mus musculus
tgctcatgtttcttttccctcaaga

SEQ ID NO: 872469 - DNA, 25 bp, Mus musculus
tgctcattccctcagatactcagag

SEQ ID NO: 872470 - DNA, 25 bp, Mus musculus
tgctcattccctgagatactcagag

SEQ ID NO: 872471 - DNA, 25 bp, Mus musculus
tgctcattcgagaaccccagttgaa

SEQ ID NO: 872472 - DNA, 25 bp, Mus musculus
tgctcattcgagtaccccagttgaa

SEQ ID NO: 872473 - DNA, 25 bp, Mus musculus
tgctcattggatagcccctgtaaat

SEQ ID NO: 872474 - DNA, 25 bp, Mus musculus
tgctcattggattgcccctgtaaat

SEQ ID NO: 872475 - DNA, 25 bp, Mus musculus
tgctcattggctccctacttgtcat

SEQ ID NO: 872476 - DNA, 25 bp, Mus musculus
tgctcattggctgcctacttgtcat

SEQ ID NO: 872477 - DNA, 25 bp, Mus musculus
tgctcattgtcaccagtaacttccg

SEQ ID NO: 872478 - DNA, 25 bp, Mus musculus
tgctcattgtcagcagtaacttccg

SEQ ID NO: 872479 - DNA, 25 bp, Mus musculus
tgctcattgtgacaattccttcccc

SEQ ID NO: 872480 - DNA, 25 bp, Mus musculus
tgctcattgtgagaattccttcccc

SEQ ID NO: 872481 - DNA, 25 bp, Mus musculus
tgctcatttatgattcctcatgcct

SEQ ID NO: 872482 - DNA, 25 bp, Mus musculus
tgctcatttatgtttcctcatgcct

SEQ ID NO: 872483 - DNA, 25 bp, Mus musculus
tgctccaaacggctgcggcatccaa

SEQ ID NO: 872484 - DNA, 25 bp, Mus musculus
tgctccaaacgggtgcggcatccaa

SEQ ID NO: 872485 - DNA, 25 bp, Mus musculus
tgctccaaagggacctcaaggcttt

SEQ ID NO: 872486 - DNA, 25 bp, Mus musculus
tgctccaaagggtcctcaaggcttt

SEQ ID NO: 872487 - DNA, 25 bp, Mus musculus
tgctccaaagtgcttccggcatgca

SEQ ID NO: 872488 - DNA, 25 bp, Mus musculus
tgctccaaagtggttccggcatgca

SEQ ID NO: 872489 - DNA, 25 bp, Mus musculus
tgctccaaatgtccccagggctgtg

SEQ ID NO: 872490 - DNA, 25 bp, Mus musculus
tgctccaaatgtgcccagggctgtg

SEQ ID NO: 872491 - DNA, 25 bp, Mus musculus
tgctccaacaccaactgcagtgatt

SEQ ID NO: 872492 - DNA, 25 bp, Mus musculus
tgctccaacacctactgcagtgatt

SEQ ID NO: 872493 - DNA, 25 bp, Mus musculus
tgctccaacagaccgtcatggccta

SEQ ID NO: 872494 - DNA, 25 bp, Mus musculus
tgctccaacagagcgtcatggccta

SEQ ID NO: 872495 - DNA, 25 bp, Mus musculus
tgctccaacaggatcggacgctttg

SEQ ID NO: 872496 - DNA, 25 bp, Mus musculus
tgctccaacaggttcggacgctttg

SEQ ID NO: 872497 - DNA, 25 bp, Mus musculus
tgctccaacagtatttaacctccgt

SEQ ID NO: 872498 - DNA, 25 bp, Mus musculus
tgctccaacagtttttaacctccgt

SEQ ID NO: 872499 - DNA, 25 bp, Mus musculus
tgctccaaccaccttgcaataggaa

SEQ ID NO: 872500 - DNA, 25 bp, Mus musculus
tgctccaaccacgttgcaataggaa

SEQ ID NO: 872501 - DNA, 25 bp, Mus musculus
tgctccaagcagctacctaccttga

SEQ ID NO: 872502 - DNA, 25 bp, Mus musculus
tgctccaagcaggtacctaccttga

SEQ ID NO: 872503 - DNA, 25 bp, Mus musculus
tgctccaagcctccgaggctataaa

SEQ ID NO: 872504 - DNA, 25 bp, Mus musculus
tgctccaagcctgcgaggctataaa

SEQ ID NO: 872505 - DNA, 25 bp, Mus musculus
tgctccaaggacatgaccactgaat

SEQ ID NO: 872506 - DNA, 25 bp, Mus musculus
tgctccaaggacttgaccactgaat

SEQ ID NO: 872507 - DNA, 25 bp, Mus musculus
tgctccaagggtcaacaatagctac

SEQ ID NO: 872508 - DNA, 25 bp, Mus musculus
tgctccaagggtgaacaatagctac

SEQ ID NO: 872509 - DNA, 25 bp, Mus musculus
tgctccacacacactttgggtggga

SEQ ID NO: 872510 - DNA, 25 bp, Mus musculus
tgctccacacactctttgggtggga

SEQ ID NO: 872511 - DNA, 25 bp, Mus musculus
tgctccacacatcctgcttttgtct

SEQ ID NO: 872512 - DNA, 25 bp, Mus musculus
tgctccacacatgctgcttttgtct

SEQ ID NO: 872513 - DNA, 25 bp, Mus musculus
tgctccacatgccaacatggttcat

SEQ ID NO: 872514 - DNA, 25 bp, Mus musculus
tgctccacatgcgaacatggttcat

SEQ ID NO: 872515 - DNA, 25 bp, Mus musculus
tgctccaccaggatatggtgcctga

SEQ ID NO: 872516 - DNA, 25 bp, Mus musculus
tgctccaccaggttatggtgcctga

SEQ ID NO: 872517 - DNA, 25 bp, Mus musculus
tgctccaccgccaagcgccgggaaa

SEQ ID NO: 872518 - DNA, 25 bp, Mus musculus
tgctccaccgcctagcgccgggaaa

SEQ ID NO: 872519 - DNA, 25 bp, Mus musculus
tgctccaccgtgctattaagactct

SEQ ID NO: 872520 - DNA, 25 bp, Mus musculus
tgctccaccgtggtattaagactct

SEQ ID NO: 872521 - DNA, 25 bp, Mus musculus
tgctccacgccactcttgagaggtg

SEQ ID NO: 872522 - DNA, 25 bp, Mus musculus
tgctccacgccagtcttgagaggtg

SEQ ID NO: 872523 - DNA, 25 bp, Mus musculus
tgctccactacacctgaagttttgg

SEQ ID NO: 872524 - DNA, 25 bp, Mus musculus
tgctccactacagctgaagttttgg

SEQ ID NO: 872525 - DNA, 25 bp, Mus musculus
tgctccactactccgaggttttcct

SEQ ID NO: 872526 - DNA, 25 bp, Mus musculus
tgctccactactgcgaggttttcct

SEQ ID NO: 872527 - DNA, 25 bp, Mus musculus
tgctccactgacctgacccaatggg

SEQ ID NO: 872528 - DNA, 25 bp, Mus musculus
tgctccactgacgtgacccaatggg

SEQ ID NO: 872529 - DNA, 25 bp, Mus musculus
tgctccacttaaagtttcccaggga

SEQ ID NO: 872530 - DNA, 25 bp, Mus musculus
tgctccacttaatgtttcccaggga

SEQ ID NO: 872531 - DNA, 25 bp, Mus musculus
tgctccagacacatccagcagggag

SEQ ID NO: 872532 - DNA, 25 bp, Mus musculus
tgctccagacacttccagcagggag

SEQ ID NO: 872533 - DNA, 25 bp, Mus musculus
tgctccagactaagactccagatct

SEQ ID NO: 872534 - DNA, 25 bp, Mus musculus
tgctccagactatgactccagatct

SEQ ID NO: 872535 - DNA, 25 bp, Mus musculus
tgctccagaggcatgggccacctgg

SEQ ID NO: 872536 - DNA, 25 bp, Mus musculus
tgctccagaggcttgggccacctgg

SEQ ID NO: 872537 - DNA, 25 bp, Mus musculus
tgctccagatccagtgtagaaccca

SEQ ID NO: 872538 - DNA, 25 bp, Mus musculus
tgctccagatcctgtgtagaaccca

SEQ ID NO: 872539 - DNA, 25 bp, Mus musculus
tgctccagatggatggtaccagtag

SEQ ID NO: 872540 - DNA, 25 bp, Mus musculus
tgctccagatggttggtaccagtag

SEQ ID NO: 872541 - DNA, 25 bp, Mus musculus
tgctccagcattcgccagcatgtag

SEQ ID NO: 872542 - DNA, 25 bp, Mus musculus
tgctccagcattggccagcatgtag

SEQ ID NO: 872543 - DNA, 25 bp, Mus musculus
tgctccagccgtctcttaaaacagg

SEQ ID NO: 872544 - DNA, 25 bp, Mus musculus
tgctccagccgtgtcttaaaacagg

SEQ ID NO: 872545 - DNA, 25 bp, Mus musculus
tgctccagctgaaggtcccagtgaa

SEQ ID NO: 872546 - DNA, 25 bp, Mus musculus
tgctccagctgatggtcccagtgaa

SEQ ID NO: 872547 - DNA, 25 bp, Mus musculus
tgctccagctgcatacagaccacat

SEQ ID NO: 872548 - DNA, 25 bp, Mus musculus
tgctccagctgcttacagaccacat

SEQ ID NO: 872549 - DNA, 25 bp, Mus musculus
tgctccagcttccatgcaagcacag

SEQ ID NO: 872550 - DNA, 25 bp, Mus musculus
tgctccagcttcgatgcaagcacag

SEQ ID NO: 872551 - DNA, 25 bp, Mus musculus
tgctccaggattcgccaccattaat

SEQ ID NO: 872552 - DNA, 25 bp, Mus musculus
tgctccaggattggccaccattaat

SEQ ID NO: 872553 - DNA, 25 bp, Mus musculus
tgctccaggcatccccttagagcat

SEQ ID NO: 872554 - DNA, 25 bp, Mus musculus
tgctccaggcatgcccttagagcat

SEQ ID NO: 872555 - DNA, 25 bp, Mus musculus
tgctccaggctaatatgggccacag

SEQ ID NO: 872556 - DNA, 25 bp, Mus musculus
tgctccaggctattatgggccacag

SEQ ID NO: 872557 - DNA, 25 bp, Mus musculus
tgctccaggctgctccatgaaagag

SEQ ID NO: 872558 - DNA, 25 bp, Mus musculus
tgctccaggctggtccatgaaagag

SEQ ID NO: 872559 - DNA, 25 bp, Mus musculus
tgctccaggcttatccttgagaaaa

SEQ ID NO: 872560 - DNA, 25 bp, Mus musculus
tgctccaggcttttccttgagaaaa

SEQ ID NO: 872561 - DNA, 25 bp, Mus musculus
tgctccagggtcagtgaaggcacct

SEQ ID NO: 872562 - DNA, 25 bp, Mus musculus
tgctccagggtctgtgaaggcacct

SEQ ID NO: 872563 - DNA, 25 bp, Mus musculus
tgctccaggtgcaggttcagaccag

SEQ ID NO: 872564 - DNA, 25 bp, Mus musculus
tgctccaggtgctggttcagaccag

SEQ ID NO: 872565 - DNA, 25 bp, Mus musculus
tgctccaggtttcgctgctcgttta

SEQ ID NO: 872566 - DNA, 25 bp, Mus musculus
tgctccaggtttggctgctcgttta

SEQ ID NO: 872567 - DNA, 25 bp, Mus musculus
tgctccagtagtacaatctttgaat

SEQ ID NO: 872568 - DNA, 25 bp, Mus musculus
tgctccagtagttcaatctttgaat

SEQ ID NO: 872569 - DNA, 25 bp, Mus musculus
tgctccagtcgaagggcaccaggga

SEQ ID NO: 872570 - DNA, 25 bp, Mus musculus
tgctccagtcgatgggcaccaggga

SEQ ID NO: 872571 - DNA, 25 bp, Mus musculus
tgctccagtctcagggcatcaccag

SEQ ID NO: 872572 - DNA, 25 bp, Mus musculus
tgctccagtctctgggcatcaccag

SEQ ID NO: 872573 - DNA, 25 bp, Mus musculus
tgctccataatgctactgtcaagtg

SEQ ID NO: 872574 - DNA, 25 bp, Mus musculus
tgctccataatggtactgtcaagtg

SEQ ID NO: 872575 - DNA, 25 bp, Mus musculus
tgctccatacaccttgcaggtggta

SEQ ID NO: 872576 - DNA, 25 bp, Mus musculus
tgctccatacacgttgcaggtggta

SEQ ID NO: 872577 - DNA, 25 bp, Mus musculus
tgctccatcaacatgtactttgtag

SEQ ID NO: 872578 - DNA, 25 bp, Mus musculus
tgctccatcaacttgtactttgtag

SEQ ID NO: 872579 - DNA, 25 bp, Mus musculus
tgctccatcaataccaggcaattct

SEQ ID NO: 872580 - DNA, 25 bp, Mus musculus
tgctccatcaattccaggcaattct

SEQ ID NO: 872581 - DNA, 25 bp, Mus musculus
tgctccatcatcctaagctcaggtg

SEQ ID NO: 872582 - DNA, 25 bp, Mus musculus
tgctccatcatcgtaagctcaggtg

SEQ ID NO: 872583 - DNA, 25 bp, Mus musculus
tgctccatccagatttgtcatcctt

SEQ ID NO: 872584 - DNA, 25 bp, Mus musculus
tgctccatccagttttgtcatcctt

SEQ ID NO: 872585 - DNA, 25 bp, Mus musculus
tgctccatcccaagggccaagggct

SEQ ID NO: 872586 - DNA, 25 bp, Mus musculus
tgctccatcccatgggccaagggct

SEQ ID NO: 872587 - DNA, 25 bp, Mus musculus
tgctccatcgttcctggtgtggttg

SEQ ID NO: 872588 - DNA, 25 bp, Mus musculus
tgctccatcgttgctggtgtggttg

SEQ ID NO: 872589 - DNA, 25 bp, Mus musculus
tgctccatgaagaggtggcccctaa

SEQ ID NO: 872590 - DNA, 25 bp, Mus musculus
tgctccatgaagtggtggcccctaa

SEQ ID NO: 872591 - DNA, 25 bp, Mus musculus
tgctccatgagaaaacgtccaagtt

SEQ ID NO: 872592 - DNA, 25 bp, Mus musculus
tgctccatgagataacgtccaagtt

SEQ ID NO: 872593 - DNA, 25 bp, Mus musculus
tgctccatggatcacctcaaattgc

SEQ ID NO: 872594 - DNA, 25 bp, Mus musculus
tgctccatggatgacctcaaattgc

SEQ ID NO: 872595 - DNA, 25 bp, Mus musculus
tgctccatggcaacagaatccgttt

SEQ ID NO: 872596 - DNA, 25 bp, Mus musculus
tgctccatggcatcagaatccgttt

SEQ ID NO: 872597 - DNA, 25 bp, Mus musculus
tgctccattcatcgtggtataatgt

SEQ ID NO: 872598 - DNA, 25 bp, Mus musculus
tgctccattcatggtggtataatgt

SEQ ID NO: 872599 - DNA, 25 bp, Mus musculus
tgctccattctccaaccagagggaa

SEQ ID NO: 872600 - DNA, 25 bp, Mus musculus
tgctccattctcgaaccagagggaa

SEQ ID NO: 872601 - DNA, 25 bp, Mus musculus
tgctccatttcactagctgtactga

SEQ ID NO: 872602 - DNA, 25 bp, Mus musculus
tgctccatttcagtagctgtactga

SEQ ID NO: 872603 - DNA, 25 bp, Mus musculus
tgctccatttctctcactaggactg

SEQ ID NO: 872604 - DNA, 25 bp, Mus musculus
tgctccatttctgtcactaggactg

SEQ ID NO: 872605 - DNA, 25 bp, Mus musculus
tgctcccacaataaagcttaaccca

SEQ ID NO: 872606 - DNA, 25 bp, Mus musculus
tgctcccacaattaagcttaaccca

SEQ ID NO: 872607 - DNA, 25 bp, Mus musculus
tgctcccaccccaaggaaagttagt

SEQ ID NO: 872608 - DNA, 25 bp, Mus musculus
tgctcccacccctaggaaagttagt

SEQ ID NO: 872609 - DNA, 25 bp, Mus musculus
tgctcccacctcagatgacttaata

SEQ ID NO: 872610 - DNA, 25 bp, Mus musculus
tgctcccacctctgatgacttaata

SEQ ID NO: 872611 - DNA, 25 bp, Mus musculus
tgctcccacttcctgagtgtcagaa

SEQ ID NO: 872612 - DNA, 25 bp, Mus musculus
tgctcccacttcgtgagtgtcagaa

SEQ ID NO: 872613 - DNA, 25 bp, Mus musculus
tgctcccagaatcctttgacctcat

SEQ ID NO: 872614 - DNA, 25 bp, Mus musculus
tgctcccagaatgctttgacctcat

SEQ ID NO: 872615 - DNA, 25 bp, Mus musculus
tgctcccagccgagatgatgaatgc

SEQ ID NO: 872616 - DNA, 25 bp, Mus musculus
tgctcccagccgtgatgatgaatgc

SEQ ID NO: 872617 - DNA, 25 bp, Mus musculus
tgctcccagcgcactgtagagggtg

SEQ ID NO: 872618 - DNA, 25 bp, Mus musculus
tgctcccagcgctctgtagagggtg

SEQ ID NO: 872619 - DNA, 25 bp, Mus musculus
tgctcccagctgagtcctgccacag

SEQ ID NO: 872620 - DNA, 25 bp, Mus musculus
tgctcccagctgtgtcctgccacag

SEQ ID NO: 872621 - DNA, 25 bp, Mus musculus
tgctcccaggcacgtatccaggaag

SEQ ID NO: 872622 - DNA, 25 bp, Mus musculus
tgctcccaggcaggtatccaggaag

SEQ ID NO: 872623 - DNA, 25 bp, Mus musculus
tgctcccagtctacaaaggctcaag

SEQ ID NO: 872624 - DNA, 25 bp, Mus musculus
tgctcccagtcttcaaaggctcaag

SEQ ID NO: 872625 - DNA, 25 bp, Mus musculus
tgctcccagtgtaccatgcttcagg

SEQ ID NO: 872626 - DNA, 25 bp, Mus musculus
tgctcccagtgttccatgcttcagg

SEQ ID NO: 872627 - DNA, 25 bp, Mus musculus
tgctcccagttccattgttgacaat

SEQ ID NO: 872628 - DNA, 25 bp, Mus musculus
tgctcccagttcgattgttgacaat

SEQ ID NO: 872629 - DNA, 25 bp, Mus musculus
tgctcccatagacgtgccctgtagt

SEQ ID NO: 872630 - DNA, 25 bp, Mus musculus
tgctcccatagaggtgccctgtagt

SEQ ID NO: 872631 - DNA, 25 bp, Mus musculus
tgctcccatattaattccctattag

SEQ ID NO: 872632 - DNA, 25 bp, Mus musculus
tgctcccatatttattccctattag

SEQ ID NO: 872633 - DNA, 25 bp, Mus musculus
tgctcccatgacatcttacttcaga

SEQ ID NO: 872634 - DNA, 25 bp, Mus musculus
tgctcccatgacttcttacttcaga

SEQ ID NO: 872635 - DNA, 25 bp, Mus musculus
tgctccccagggacactgaatcttt

SEQ ID NO: 872636 - DNA, 25 bp, Mus musculus
tgctccccagggtcactgaatcttt

SEQ ID NO: 872637 - DNA, 25 bp, Mus musculus
tgctccccatggatgtaggtcaggt

SEQ ID NO: 872638 - DNA, 25 bp, Mus musculus
tgctccccatggttgtaggtcaggt

SEQ ID NO: 872639 - DNA, 25 bp, Mus musculus
tgctcccccattatttataggaaat

SEQ ID NO: 872640 - DNA, 25 bp, Mus musculus
tgctcccccattttttataggaaat

SEQ ID NO: 872641 - DNA, 25 bp, Mus musculus
tgctccccgacaagctgtgtgacgg

SEQ ID NO: 872642 - DNA, 25 bp, Mus musculus
tgctccccgacatgctgtgtgacgg

SEQ ID NO: 872643 - DNA, 25 bp, Mus musculus
tgctcccctaacatacaaaactcag

SEQ ID NO: 872644 - DNA, 25 bp, Mus musculus
tgctcccctaacttacaaaactcag

SEQ ID NO: 872645 - DNA, 25 bp, Mus musculus
tgctcccctcaactgtctctggaaa

SEQ ID NO: 872646 - DNA, 25 bp, Mus musculus
tgctcccctcaagtgtctctggaaa

SEQ ID NO: 872647 - DNA, 25 bp, Mus musculus
tgctcccctctcactacagtgaaaa

SEQ ID NO: 872648 - DNA, 25 bp, Mus musculus
tgctcccctctctctacagtgaaaa

SEQ ID NO: 872649 - DNA, 25 bp, Mus musculus
tgctcccctgaaagtgtcctttgat

SEQ ID NO: 872650 - DNA, 25 bp, Mus musculus
tgctcccctgaatgtgtcctttgat

SEQ ID NO: 872651 - DNA, 25 bp, Mus musculus
tgctcccctggaacttttcatattc

SEQ ID NO: 872652 - DNA, 25 bp, Mus musculus
tgctcccctggatcttttcatattc

SEQ ID NO: 872653 - DNA, 25 bp, Mus musculus
tgctcccctgtgagatcagtcatac

SEQ ID NO: 872654 - DNA, 25 bp, Mus musculus
tgctcccctgtgctgtaacaaaatc

SEQ ID NO: 872655 - DNA, 25 bp, Mus musculus
tgctcccctgtggtgtaacaaaatc

SEQ ID NO: 872656 - DNA, 25 bp, Mus musculus
tgctcccctgtgtgatcagtcatac

SEQ ID NO: 872657 - DNA, 25 bp, Mus musculus
tgctcccgaaatctctctgtgagaa

SEQ ID NO: 872658 - DNA, 25 bp, Mus musculus
tgctcccgaaatgtctctgtgagaa

SEQ ID NO: 872659 - DNA, 25 bp, Mus musculus
tgctcccgagccatcatatagactt

SEQ ID NO: 872660 - DNA, 25 bp, Mus musculus
tgctcccgagccttcatatagactt

SEQ ID NO: 872661 - DNA, 25 bp, Mus musculus
tgctcccgctcacggttttcgtgga

SEQ ID NO: 872662 - DNA, 25 bp, Mus musculus
tgctcccgctcagggttttcgtgga

SEQ ID NO: 872663 - DNA, 25 bp, Mus musculus
tgctcccgtgcaaaaccttgttgaa

SEQ ID NO: 872664 - DNA, 25 bp, Mus musculus
tgctcccgtgcataaccttgttgaa

SEQ ID NO: 872665 - DNA, 25 bp, Mus musculus
tgctccctaaacacaacacagtaag

SEQ ID NO: 872666 - DNA, 25 bp, Mus musculus
tgctccctaaactcaacacagtaag

SEQ ID NO: 872667 - DNA, 25 bp, Mus musculus
tgctccctaccaagccgtgggcttg

SEQ ID NO: 872668 - DNA, 25 bp, Mus musculus
tgctccctaccatgccgtgggcttg

SEQ ID NO: 872669 - DNA, 25 bp, Mus musculus
tgctccctactgattctttgaattt

SEQ ID NO: 872670 - DNA, 25 bp, Mus musculus
tgctccctactgtttctttgaattt

SEQ ID NO: 872671 - DNA, 25 bp, Mus musculus
tgctccctaggcactgtaggagaca

SEQ ID NO: 872672 - DNA, 25 bp, Mus musculus
tgctccctaggctctgtaggagaca

SEQ ID NO: 872673 - DNA, 25 bp, Mus musculus
tgctccctcaagacaagctttttgt

SEQ ID NO: 872674 - DNA, 25 bp, Mus musculus
tgctccctcaagtcaagctttttgt

SEQ ID NO: 872675 - DNA, 25 bp, Mus musculus
tgctccctctcaaatgctttctgtt

SEQ ID NO: 872676 - DNA, 25 bp, Mus musculus
tgctccctctcatatgctttctgtt

SEQ ID NO: 872677 - DNA, 25 bp, Mus musculus
tgctccctctccattcataaataaa

SEQ ID NO: 872678 - DNA, 25 bp, Mus musculus
tgctccctctcctttcataaataaa

SEQ ID NO: 872679 - DNA, 25 bp, Mus musculus
tgctccctctgaaggtctagacatc

SEQ ID NO: 872680 - DNA, 25 bp, Mus musculus
tgctccctctgatggtctagacatc

SEQ ID NO: 872681 - DNA, 25 bp, Mus musculus
tgctccctcttacagttcctgagag

SEQ ID NO: 872682 - DNA, 25 bp, Mus musculus
tgctccctcttagagttcctgagag

SEQ ID NO: 872683 - DNA, 25 bp, Mus musculus
tgctccctgacaaaaatgtgatttt

SEQ ID NO: 872684 - DNA, 25 bp, Mus musculus
tgctccctgacataaatgtgatttt

SEQ ID NO: 872685 - DNA, 25 bp, Mus musculus
tgctccctgcatccagaaggttttt

SEQ ID NO: 872686 - DNA, 25 bp, Mus musculus
tgctccctgcatgcagaaggttttt

SEQ ID NO: 872687 - DNA, 25 bp, Mus musculus
tgctccctgcccaggtttagtaagg

SEQ ID NO: 872688 - DNA, 25 bp, Mus musculus
tgctccctgccctggtttagtaagg

SEQ ID NO: 872689 - DNA, 25 bp, Mus musculus
tgctccctgctcagatgtgtggcca

SEQ ID NO: 872690 - DNA, 25 bp, Mus musculus
tgctccctgctctgatgtgtggcca

SEQ ID NO: 872691 - DNA, 25 bp, Mus musculus
tgctccctggctccagagatttata

SEQ ID NO: 872692 - DNA, 25 bp, Mus musculus
tgctccctggctgcagagatttata

SEQ ID NO: 872693 - DNA, 25 bp, Mus musculus
tgctccctgggacatcagtattgtg

SEQ ID NO: 872694 - DNA, 25 bp, Mus musculus
tgctccctgggagatcagtattgtg

SEQ ID NO: 872695 - DNA, 25 bp, Mus musculus
tgctccctgttgctgaggcatacta

SEQ ID NO: 872696 - DNA, 25 bp, Mus musculus
tgctccctgttggtgaggcatacta

SEQ ID NO: 872697 - DNA, 25 bp, Mus musculus
tgctcccttaccatgaggccgatga

SEQ ID NO: 872698 - DNA, 25 bp, Mus musculus
tgctcccttaccttgaggccgatga

SEQ ID NO: 872699 - DNA, 25 bp, Mus musculus
tgctcccttataaaacacagatgta

SEQ ID NO: 872700 - DNA, 25 bp, Mus musculus
tgctcccttatataacacagatgta

SEQ ID NO: 872701 - DNA, 25 bp, Mus musculus
tgctcccttcagaactcagtaacag

SEQ ID NO: 872702 - DNA, 25 bp, Mus musculus
tgctcccttcagtactcagtaacag

SEQ ID NO: 872703 - DNA, 25 bp, Mus musculus
tgctcccttcttcggactgaggagg

SEQ ID NO: 872704 - DNA, 25 bp, Mus musculus
tgctcccttcttgggactgaggagg

SEQ ID NO: 872705 - DNA, 25 bp, Mus musculus
tgctcccttgaccacagagatgaga

SEQ ID NO: 872706 - DNA, 25 bp, Mus musculus
tgctcccttgacgacagagatgaga

SEQ ID NO: 872707 - DNA, 25 bp, Mus musculus
tgctcccttgatactgcggtttcca

SEQ ID NO: 872708 - DNA, 25 bp, Mus musculus
tgctcccttgattctgcggtttcca

SEQ ID NO: 872709 - DNA, 25 bp, Mus musculus
tgctcccttggaagttttccttaag

SEQ ID NO: 872710 - DNA, 25 bp, Mus musculus
tgctcccttggatgttttccttaag

SEQ ID NO: 872711 - DNA, 25 bp, Mus musculus
tgctcccttggcattcatagaccaa

SEQ ID NO: 872712 - DNA, 25 bp, Mus musculus
tgctcccttggctttcatagaccaa

SEQ ID NO: 872713 - DNA, 25 bp, Mus musculus
tgctccctttgaaggtctcagcaga

SEQ ID NO: 872714 - DNA, 25 bp, Mus musculus
tgctccctttgatggtctcagcaga

SEQ ID NO: 872715 - DNA, 25 bp, Mus musculus
tgctccgactttactgtgttggctt

SEQ ID NO: 872716 - DNA, 25 bp, Mus musculus
tgctccgacttttctgtgttggctt

SEQ ID NO: 872717 - DNA, 25 bp, Mus musculus
tgctccgagaggaaccagtgaccct

SEQ ID NO: 872718 - DNA, 25 bp, Mus musculus
tgctccgagaggtaccagtgaccct

SEQ ID NO: 872719 - DNA, 25 bp, Mus musculus
tgctccgagggcaacattcagaact

SEQ ID NO: 872720 - DNA, 25 bp, Mus musculus
tgctccgagggctacattcagaact

SEQ ID NO: 872721 - DNA, 25 bp, Mus musculus
tgctccgatggtcatggcctggctc

SEQ ID NO: 872722 - DNA, 25 bp, Mus musculus
tgctccgatggtgatggcctggctc

SEQ ID NO: 872723 - DNA, 25 bp, Mus musculus
tgctccgattccatgcatgcaccat

SEQ ID NO: 872724 - DNA, 25 bp, Mus musculus
tgctccgattccttgcatgcaccat

SEQ ID NO: 872725 - DNA, 25 bp, Mus musculus
tgctccgatttgagtacgtggcttc

SEQ ID NO: 872726 - DNA, 25 bp, Mus musculus
tgctccgatttgtgtacgtggcttc

SEQ ID NO: 872727 - DNA, 25 bp, Mus musculus
tgctccgctcgcagaatctgcttta

SEQ ID NO: 872728 - DNA, 25 bp, Mus musculus
tgctccgctcgctgaatctgcttta

SEQ ID NO: 872729 - DNA, 25 bp, Mus musculus
tgctccggatcacacagattcaaca

SEQ ID NO: 872730 - DNA, 25 bp, Mus musculus
tgctccggatcagacagattcaaca

SEQ ID NO: 872731 - DNA, 25 bp, Mus musculus
tgctccggccaacggactagcagta

SEQ ID NO: 872732 - DNA, 25 bp, Mus musculus
tgctccggccaagggactagcagta

SEQ ID NO: 872733 - DNA, 25 bp, Mus musculus
tgctccgggctcagctactcaaacg

SEQ ID NO: 872734 - DNA, 25 bp, Mus musculus
tgctccgggctctgctactcaaacg

SEQ ID NO: 872735 - DNA, 25 bp, Mus musculus
tgctccgtgcacagtgggatttgtg

SEQ ID NO: 872736 - DNA, 25 bp, Mus musculus
tgctccgtgcactgtgggatttgtg

SEQ ID NO: 872737 - DNA, 25 bp, Mus musculus
tgctccgtgctgaatgctgtctcgc

SEQ ID NO: 872738 - DNA, 25 bp, Mus musculus
tgctccgtgctgtatgctgtctcgc

SEQ ID NO: 872739 - DNA, 25 bp, Mus musculus
tgctccgtggagcttgttccaagtg

SEQ ID NO: 872740 - DNA, 25 bp, Mus musculus
tgctccgtggaggttgttccaagtg

SEQ ID NO: 872741 - DNA, 25 bp, Mus musculus
tgctccgtggcaactgttgctctgg

SEQ ID NO: 872742 - DNA, 25 bp, Mus musculus
tgctccgtggcacagagaccctgaa

SEQ ID NO: 872743 - DNA, 25 bp, Mus musculus
tgctccgtggcagagagaccctgaa

SEQ ID NO: 872744 - DNA, 25 bp, Mus musculus
tgctccgtggcatctgttgctctgg

SEQ ID NO: 872745 - DNA, 25 bp, Mus musculus
tgctccgttcttcctgtttaatatg

SEQ ID NO: 872746 - DNA, 25 bp, Mus musculus
tgctccgttcttgctgtttaatatg

SEQ ID NO: 872747 - DNA, 25 bp, Mus musculus
tgctccgttttcctgctggagaaga

SEQ ID NO: 872748 - DNA, 25 bp, Mus musculus
tgctccgttttcgtgctggagaaga

SEQ ID NO: 872749 - DNA, 25 bp, Mus musculus
tgctcctaatttagagggcttatat

SEQ ID NO: 872750 - DNA, 25 bp, Mus musculus
tgctcctaattttgagggcttatat

SEQ ID NO: 872751 - DNA, 25 bp, Mus musculus
tgctcctactccagtgaccctactt

SEQ ID NO: 872752 - DNA, 25 bp, Mus musculus
tgctcctactcctgtgaccctactt

SEQ ID NO: 872753 - DNA, 25 bp, Mus musculus
tgctcctactggctctgactggaca

SEQ ID NO: 872754 - DNA, 25 bp, Mus musculus
tgctcctactgggtctgactggaca

SEQ ID NO: 872755 - DNA, 25 bp, Mus musculus
tgctcctagaccacactgcagggta

SEQ ID NO: 872756 - DNA, 25 bp, Mus musculus
tgctcctagacctcactgcagggta

SEQ ID NO: 872757 - DNA, 25 bp, Mus musculus
tgctcctataaaagtgttccttcag

SEQ ID NO: 872758 - DNA, 25 bp, Mus musculus
tgctcctataaatgtgttccttcag

SEQ ID NO: 872759 - DNA, 25 bp, Mus musculus
tgctcctatacacagctttaactcc

SEQ ID NO: 872760 - DNA, 25 bp, Mus musculus
tgctcctatacagagctttaactcc

SEQ ID NO: 872761 - DNA, 25 bp, Mus musculus
tgctcctatcctatcaggattccgt

SEQ ID NO: 872762 - DNA, 25 bp, Mus musculus
tgctcctatcctttcaggattccgt

SEQ ID NO: 872763 - DNA, 25 bp, Mus musculus
tgctcctatctgatacacctgggaa

SEQ ID NO: 872764 - DNA, 25 bp, Mus musculus
tgctcctatctgttacacctgggaa

SEQ ID NO: 872765 - DNA, 25 bp, Mus musculus
tgctcctcactaacagacttgggtt

SEQ ID NO: 872766 - DNA, 25 bp, Mus musculus
tgctcctcactatcagacttgggtt

SEQ ID NO: 872767 - DNA, 25 bp, Mus musculus
tgctcctcactcatgggttgaaagt

SEQ ID NO: 872768 - DNA, 25 bp, Mus musculus
tgctcctcactcttgggttgaaagt

SEQ ID NO: 872769 - DNA, 25 bp, Mus musculus
tgctcctcagacaatgctgcattag

SEQ ID NO: 872770 - DNA, 25 bp, Mus musculus
tgctcctcagactatgctgcattag

SEQ ID NO: 872771 - DNA, 25 bp, Mus musculus
tgctcctcattcacaaagcgggaag

SEQ ID NO: 872772 - DNA, 25 bp, Mus musculus
tgctcctcattctcaaagcgggaag

SEQ ID NO: 872773 - DNA, 25 bp, Mus musculus
tgctcctccaaacgtgcagagatgc

SEQ ID NO: 872774 - DNA, 25 bp, Mus musculus
tgctcctccaaaggtgcagagatgc

SEQ ID NO: 872775 - DNA, 25 bp, Mus musculus
tgctcctccaatacctcatggtggc

SEQ ID NO: 872776 - DNA, 25 bp, Mus musculus
tgctcctccaattcctcatggtggc

SEQ ID NO: 872777 - DNA, 25 bp, Mus musculus
tgctcctccaggcatccaacgagat

SEQ ID NO: 872778 - DNA, 25 bp, Mus musculus
tgctcctccaggctatatattttta

SEQ ID NO: 872779 - DNA, 25 bp, Mus musculus
tgctcctccagggatccaacgagat

SEQ ID NO: 872780 - DNA, 25 bp, Mus musculus
tgctcctccagggtatatattttta

SEQ ID NO: 872781 - DNA, 25 bp, Mus musculus
tgctcctccagtcgtcactgttaca

SEQ ID NO: 872782 - DNA, 25 bp, Mus musculus
tgctcctccagtggtcactgttaca

SEQ ID NO: 872783 - DNA, 25 bp, Mus musculus
tgctcctcccgtatgaaaagtgcca

SEQ ID NO: 872784 - DNA, 25 bp, Mus musculus
tgctcctcccgtttgaaaagtgcca

SEQ ID NO: 872785 - DNA, 25 bp, Mus musculus
tgctcctcctcacgacgacagatgt

SEQ ID NO: 872786 - DNA, 25 bp, Mus musculus
tgctcctcctcaggacgacagatgt

SEQ ID NO: 872787 - DNA, 25 bp, Mus musculus
tgctcctcctgaccgcaagtactct

SEQ ID NO: 872788 - DNA, 25 bp, Mus musculus
tgctcctcctgagcgcaagtactct

SEQ ID NO: 872789 - DNA, 25 bp, Mus musculus
tgctcctccttcatttgccttaaga

SEQ ID NO: 872790 - DNA, 25 bp, Mus musculus
tgctcctccttcttttgccttaaga

SEQ ID NO: 872791 - DNA, 25 bp, Mus musculus
tgctcctcctttactaattttgcta

SEQ ID NO: 872792 - DNA, 25 bp, Mus musculus
tgctcctcctttcccacaaaagggt

SEQ ID NO: 872793 - DNA, 25 bp, Mus musculus
tgctcctcctttgccacaaaagggt

SEQ ID NO: 872794 - DNA, 25 bp, Mus musculus
tgctcctccttttctaattttgcta

SEQ ID NO: 872795 - DNA, 25 bp, Mus musculus
tgctcctctacaaagactgctctta

SEQ ID NO: 872796 - DNA, 25 bp, Mus musculus
tgctcctctacatagactgctctta

SEQ ID NO: 872797 - DNA, 25 bp, Mus musculus
tgctcctctgtcctcaaacagtgaa

SEQ ID NO: 872798 - DNA, 25 bp, Mus musculus
tgctcctctgtcgtcaaacagtgaa

SEQ ID NO: 872799 - DNA, 25 bp, Mus musculus
tgctcctctttcaatgttgatcttt

SEQ ID NO: 872800 - DNA, 25 bp, Mus musculus
tgctcctctttctatgttgatcttt

SEQ ID NO: 872801 - DNA, 25 bp, Mus musculus
tgctcctgaaagacggcctccactg

SEQ ID NO: 872802 - DNA, 25 bp, Mus musculus
tgctcctgaaagctcggaggacata

SEQ ID NO: 872803 - DNA, 25 bp, Mus musculus
tgctcctgaaaggtcggaggacata

SEQ ID NO: 872804 - DNA, 25 bp, Mus musculus
tgctcctgaaagtcggcctccactg

SEQ ID NO: 872805 - DNA, 25 bp, Mus musculus
tgctcctgaacaattgtgagtgccc

SEQ ID NO: 872806 - DNA, 25 bp, Mus musculus
tgctcctgaacatttgtgagtgccc

SEQ ID NO: 872807 - DNA, 25 bp, Mus musculus
tgctcctgaactagtgcgtttgtca

SEQ ID NO: 872808 - DNA, 25 bp, Mus musculus
tgctcctgaacttgtgcgtttgtca

SEQ ID NO: 872809 - DNA, 25 bp, Mus musculus
tgctcctgaagcatcccaaacagag

SEQ ID NO: 872810 - DNA, 25 bp, Mus musculus
tgctcctgaagcttcccaaacagag

SEQ ID NO: 872811 - DNA, 25 bp, Mus musculus
tgctcctgacgaacactcttttgtg

SEQ ID NO: 872812 - DNA, 25 bp, Mus musculus
tgctcctgacgatcactcttttgtg

SEQ ID NO: 872813 - DNA, 25 bp, Mus musculus
tgctcctgacgtacctggccaagca

SEQ ID NO: 872814 - DNA, 25 bp, Mus musculus
tgctcctgacgttcctggccaagca

SEQ ID NO: 872815 - DNA, 25 bp, Mus musculus
tgctcctgagcaatagcaatctcca

SEQ ID NO: 872816 - DNA, 25 bp, Mus musculus
tgctcctgagcattagcaatctcca

SEQ ID NO: 872817 - DNA, 25 bp, Mus musculus
tgctcctgagccatactgggaggga

SEQ ID NO: 872818 - DNA, 25 bp, Mus musculus
tgctcctgagccttactgggaggga

SEQ ID NO: 872819 - DNA, 25 bp, Mus musculus
tgctcctgagctatgggtgtgatcc

SEQ ID NO: 872820 - DNA, 25 bp, Mus musculus
tgctcctgagctttgggtgtgatcc

SEQ ID NO: 872821 - DNA, 25 bp, Mus musculus
tgctcctgatgaagaccctcttgtg

SEQ ID NO: 872822 - DNA, 25 bp, Mus musculus
tgctcctgatgatgaccctcttgtg

SEQ ID NO: 872823 - DNA, 25 bp, Mus musculus
tgctcctgattccagtactgaatgg

SEQ ID NO: 872824 - DNA, 25 bp, Mus musculus
tgctcctgattcgagtactgaatgg

SEQ ID NO: 872825 - DNA, 25 bp, Mus musculus
tgctcctgcaaaaggcgaattatat

SEQ ID NO: 872826 - DNA, 25 bp, Mus musculus
tgctcctgcaaatggcgaattatat

SEQ ID NO: 872827 - DNA, 25 bp, Mus musculus
tgctcctgcagtacgttggcttgtg

SEQ ID NO: 872828 - DNA, 25 bp, Mus musculus
tgctcctgcagttcgttggcttgtg

SEQ ID NO: 872829 - DNA, 25 bp, Mus musculus
tgctcctgcattactgatcacttat

SEQ ID NO: 872830 - DNA, 25 bp, Mus musculus
tgctcctgcatttctgatcacttat

SEQ ID NO: 872831 - DNA, 25 bp, Mus musculus
tgctcctgcccaaggtgcaagggat

SEQ ID NO: 872832 - DNA, 25 bp, Mus musculus
tgctcctgcccatggtgcaagggat

SEQ ID NO: 872833 - DNA, 25 bp, Mus musculus
tgctcctgccgactgtaatgggcaa

SEQ ID NO: 872834 - DNA, 25 bp, Mus musculus
tgctcctgccgagtgtaatgggcaa

SEQ ID NO: 872835 - DNA, 25 bp, Mus musculus
tgctcctgcctaagtgatctttaag

SEQ ID NO: 872836 - DNA, 25 bp, Mus musculus
tgctcctgcctatgtgatctttaag

SEQ ID NO: 872837 - DNA, 25 bp, Mus musculus
tgctcctgcctgaagatttatgctg

SEQ ID NO: 872838 - DNA, 25 bp, Mus musculus
tgctcctgcctgaggtattatatgt

SEQ ID NO: 872839 - DNA, 25 bp, Mus musculus
tgctcctgcctgtagatttatgctg

SEQ ID NO: 872840 - DNA, 25 bp, Mus musculus
tgctcctgcctgtggtattatatgt

SEQ ID NO: 872841 - DNA, 25 bp, Mus musculus
tgctcctgccttagtgattggattc

SEQ ID NO: 872842 - DNA, 25 bp, Mus musculus
tgctcctgcctttgtgattggattc

SEQ ID NO: 872843 - DNA, 25 bp, Mus musculus
tgctcctgcggtatccttaagaaaa

SEQ ID NO: 872844 - DNA, 25 bp, Mus musculus
tgctcctgcggtttccttaagaaaa

SEQ ID NO: 872845 - DNA, 25 bp, Mus musculus
tgctcctgctctcgtactgccagat

SEQ ID NO: 872846 - DNA, 25 bp, Mus musculus
tgctcctgctctggtactgccagat

SEQ ID NO: 872847 - DNA, 25 bp, Mus musculus
tgctcctgctgaatggacaactgga

SEQ ID NO: 872848 - DNA, 25 bp, Mus musculus
tgctcctgctgattggacaactgga

SEQ ID NO: 872849 - DNA, 25 bp, Mus musculus
tgctcctgctgccattccaaaatat

SEQ ID NO: 872850 - DNA, 25 bp, Mus musculus
tgctcctgctgcgattccaaaatat

SEQ ID NO: 872851 - DNA, 25 bp, Mus musculus
tgctcctgctgtatccatttacaca

SEQ ID NO: 872852 - DNA, 25 bp, Mus musculus
tgctcctgctgtttccatttacaca

SEQ ID NO: 872853 - DNA, 25 bp, Mus musculus
tgctcctggcagaatcaacttgtcc

SEQ ID NO: 872854 - DNA, 25 bp, Mus musculus
tgctcctggcagtatcaacttgtcc

SEQ ID NO: 872855 - DNA, 25 bp, Mus musculus
tgctcctggcatcgtttaagaatga

SEQ ID NO: 872856 - DNA, 25 bp, Mus musculus
tgctcctggcatggtttaagaatga

SEQ ID NO: 872857 - DNA, 25 bp, Mus musculus
tgctcctggcctaggaacacagatt

SEQ ID NO: 872858 - DNA, 25 bp, Mus musculus
tgctcctggccttggaacacagatt

SEQ ID NO: 872859 - DNA, 25 bp, Mus musculus
tgctcctgggaaattagtgttgtaa

SEQ ID NO: 872860 - DNA, 25 bp, Mus musculus
tgctcctgggaatttagtgttgtaa

SEQ ID NO: 872861 - DNA, 25 bp, Mus musculus
tgctcctgggatccaccgtggatag

SEQ ID NO: 872862 - DNA, 25 bp, Mus musculus
tgctcctgggatgcaccgtggatag

SEQ ID NO: 872863 - DNA, 25 bp, Mus musculus
tgctcctgggctaccccacagaccc

SEQ ID NO: 872864 - DNA, 25 bp, Mus musculus
tgctcctgggcttccccacagaccc

SEQ ID NO: 872865 - DNA, 25 bp, Mus musculus
tgctcctggtcacagactttgcagc

SEQ ID NO: 872866 - DNA, 25 bp, Mus musculus
tgctcctggtcagagactttgcagc

SEQ ID NO: 872867 - DNA, 25 bp, Mus musculus
tgctcctgtgcacatagcctaaagt

SEQ ID NO: 872868 - DNA, 25 bp, Mus musculus
tgctcctgtgcagatagcctaaagt

SEQ ID NO: 872869 - DNA, 25 bp, Mus musculus
tgctcctgtggaaggcctgtgttca

SEQ ID NO: 872870 - DNA, 25 bp, Mus musculus
tgctcctgtggaaggtgtcataccc

SEQ ID NO: 872871 - DNA, 25 bp, Mus musculus
tgctcctgtggatggcctgtgttca

SEQ ID NO: 872872 - DNA, 25 bp, Mus musculus
tgctcctgtggatggtgtcataccc

SEQ ID NO: 872873 - DNA, 25 bp, Mus musculus
tgctcctgtggtccagtgtgttgaa

SEQ ID NO: 872874 - DNA, 25 bp, Mus musculus
tgctcctgtggtgcagtgtgttgaa

SEQ ID NO: 872875 - DNA, 25 bp, Mus musculus
tgctccttaatactgtgctttatga

SEQ ID NO: 872876 - DNA, 25 bp, Mus musculus
tgctccttaatagtgtgctttatga

SEQ ID NO: 872877 - DNA, 25 bp, Mus musculus
tgctccttacttcgtagtcgctgtt

SEQ ID NO: 872878 - DNA, 25 bp, Mus musculus
tgctccttacttggtagtcgctgtt

SEQ ID NO: 872879 - DNA, 25 bp, Mus musculus
tgctccttagcaacacttccttgaa

SEQ ID NO: 872880 - DNA, 25 bp, Mus musculus
tgctccttagcatcacttccttgaa

SEQ ID NO: 872881 - DNA, 25 bp, Mus musculus
tgctccttagcccaagtggccaggg

SEQ ID NO: 872882 - DNA, 25 bp, Mus musculus
tgctccttagccgaagtggccaggg

SEQ ID NO: 872883 - DNA, 25 bp, Mus musculus
tgctccttcaagctattggcagaac

SEQ ID NO: 872884 - DNA, 25 bp, Mus musculus
tgctccttcaaggtattggcagaac

SEQ ID NO: 872885 - DNA, 25 bp, Mus musculus
tgctccttcaccagttggatgggtt

SEQ ID NO: 872886 - DNA, 25 bp, Mus musculus
tgctccttcaccatacttactgagt

SEQ ID NO: 872887 - DNA, 25 bp, Mus musculus
tgctccttcacctgttggatgggtt

SEQ ID NO: 872888 - DNA, 25 bp, Mus musculus
tgctccttcaccttacttactgagt

SEQ ID NO: 872889 - DNA, 25 bp, Mus musculus
tgctccttccctcaatatgcagtag

SEQ ID NO: 872890 - DNA, 25 bp, Mus musculus
tgctccttccctgaatatgcagtag

SEQ ID NO: 872891 - DNA, 25 bp, Mus musculus
tgctccttccttaccccatgaggag

SEQ ID NO: 872892 - DNA, 25 bp, Mus musculus
tgctccttcctttccccatgaggag

SEQ ID NO: 872893 - DNA, 25 bp, Mus musculus
tgctccttctccctatgagaggcgt

SEQ ID NO: 872894 - DNA, 25 bp, Mus musculus
tgctccttctccgtatgagaggcgt

SEQ ID NO: 872895 - DNA, 25 bp, Mus musculus
tgctccttctctccagattgttaga

SEQ ID NO: 872896 - DNA, 25 bp, Mus musculus
tgctccttctctgcagattgttaga

SEQ ID NO: 872897 - DNA, 25 bp, Mus musculus
tgctccttctgaaattggtgaggaa

SEQ ID NO: 872898 - DNA, 25 bp, Mus musculus
tgctccttctgatattggtgaggaa

SEQ ID NO: 872899 - DNA, 25 bp, Mus musculus
tgctccttgcaaatgtctgggtctg

SEQ ID NO: 872900 - DNA, 25 bp, Mus musculus
tgctccttgcaattgtctgggtctg

SEQ ID NO: 872901 - DNA, 25 bp, Mus musculus
tgctccttgcaccaaatgaaggcca

SEQ ID NO: 872902 - DNA, 25 bp, Mus musculus
tgctccttgcacgaaatgaaggcca

SEQ ID NO: 872903 - DNA, 25 bp, Mus musculus
tgctccttgccaatgtgatcatgct

SEQ ID NO: 872904 - DNA, 25 bp, Mus musculus
tgctccttgccattgtgatcatgct

SEQ ID NO: 872905 - DNA, 25 bp, Mus musculus
tgctccttggaacccagagtctttc

SEQ ID NO: 872906 - DNA, 25 bp, Mus musculus
tgctccttggaagccagagtctttc

SEQ ID NO: 872907 - DNA, 25 bp, Mus musculus
tgctccttggtacttagacctgatc

SEQ ID NO: 872908 - DNA, 25 bp, Mus musculus
tgctccttggtagttagacctgatc

SEQ ID NO: 872909 - DNA, 25 bp, Mus musculus
tgctccttggttattcttgatcata

SEQ ID NO: 872910 - DNA, 25 bp, Mus musculus
tgctccttggtttttcttgatcata

SEQ ID NO: 872911 - DNA, 25 bp, Mus musculus
tgctccttgtctctgaattgctgtt

SEQ ID NO: 872912 - DNA, 25 bp, Mus musculus
tgctccttgtctgtgaattgctgtt

SEQ ID NO: 872913 - DNA, 25 bp, Mus musculus
tgctccttgttcatgatgcttctag

SEQ ID NO: 872914 - DNA, 25 bp, Mus musculus
tgctccttgttcttgatgcttctag

SEQ ID NO: 872915 - DNA, 25 bp, Mus musculus
tgctcctttactacctggtgacctt

SEQ ID NO: 872916 - DNA, 25 bp, Mus musculus
tgctcctttacttcctggtgacctt

SEQ ID NO: 872917 - DNA, 25 bp, Mus musculus
tgctcctttatcacttttccagagt

SEQ ID NO: 872918 - DNA, 25 bp, Mus musculus
tgctcctttatctcttttccagagt

SEQ ID NO: 872919 - DNA, 25 bp, Mus musculus
tgctcctttatgacagcgcctttgg

SEQ ID NO: 872920 - DNA, 25 bp, Mus musculus
tgctcctttatgtcagcgcctttgg

SEQ ID NO: 872921 - DNA, 25 bp, Mus musculus
tgctcctttctgactgtagcactgg

SEQ ID NO: 872922 - DNA, 25 bp, Mus musculus
tgctcctttctgtctgtagcactgg

SEQ ID NO: 872923 - DNA, 25 bp, Mus musculus
tgctcctttggaaaccatgctggtg

SEQ ID NO: 872924 - DNA, 25 bp, Mus musculus
tgctcctttggataccatgctggtg

SEQ ID NO: 872925 - DNA, 25 bp, Mus musculus
tgctcctttgttatgtgcttcagtt

SEQ ID NO: 872926 - DNA, 25 bp, Mus musculus
tgctcctttgttttgtgcttcagtt

SEQ ID NO: 872927 - DNA, 25 bp, Mus musculus
tgctccttttaacccttacctgaga

SEQ ID NO: 872928 - DNA, 25 bp, Mus musculus
tgctccttttaagccttacctgaga

SEQ ID NO: 872929 - DNA, 25 bp, Mus musculus
tgctcctttttcaggattccttcaa

SEQ ID NO: 872930 - DNA, 25 bp, Mus musculus
tgctcctttttctggattccttcaa

SEQ ID NO: 872931 - DNA, 25 bp, Mus musculus
tgctcgaatgacaccacgcttttat

SEQ ID NO: 872932 - DNA, 25 bp, Mus musculus
tgctcgaatgactccacgcttttat

SEQ ID NO: 872933 - DNA, 25 bp, Mus musculus
tgctcgacaagcatctggacctaaa

SEQ ID NO: 872934 - DNA, 25 bp, Mus musculus
tgctcgacaagcttctggacctaaa

SEQ ID NO: 872935 - DNA, 25 bp, Mus musculus
tgctcgagaaacagtatgtgctact

SEQ ID NO: 872936 - DNA, 25 bp, Mus musculus
tgctcgagaaactgtatgtgctact

SEQ ID NO: 872937 - DNA, 25 bp, Mus musculus
tgctcgagaaagacagcctctgtct

SEQ ID NO: 872938 - DNA, 25 bp, Mus musculus
tgctcgagaaagtcagcctctgtct

SEQ ID NO: 872939 - DNA, 25 bp, Mus musculus
tgctcgagacaacccgggacatggc

SEQ ID NO: 872940 - DNA, 25 bp, Mus musculus
tgctcgagacaagccgggacatggc

SEQ ID NO: 872941 - DNA, 25 bp, Mus musculus
tgctcgagcagacccagatcatagg

SEQ ID NO: 872942 - DNA, 25 bp, Mus musculus
tgctcgagcagagccagatcatagg

SEQ ID NO: 872943 - DNA, 25 bp, Mus musculus
tgctcgatggacagggatagcgtca

SEQ ID NO: 872944 - DNA, 25 bp, Mus musculus
tgctcgatggactgggatagcgtca

SEQ ID NO: 872945 - DNA, 25 bp, Mus musculus
tgctcgcactgtagagtctcggcag

SEQ ID NO: 872946 - DNA, 25 bp, Mus musculus
tgctcgcactgttgagtctcggcag

SEQ ID NO: 872947 - DNA, 25 bp, Mus musculus
tgctcgcatatgagcccgtccttaa

SEQ ID NO: 872948 - DNA, 25 bp, Mus musculus
tgctcgcatatgtgcccgtccttaa

SEQ ID NO: 872949 - DNA, 25 bp, Mus musculus
tgctcgcatgagcagttttccttcc

SEQ ID NO: 872950 - DNA, 25 bp, Mus musculus
tgctcgcatgaggagttttccttcc

SEQ ID NO: 872951 - DNA, 25 bp, Mus musculus
tgctcgccaactccatcaggacgga

SEQ ID NO: 872952 - DNA, 25 bp, Mus musculus
tgctcgccaactgcatcaggacgga

SEQ ID NO: 872953 - DNA, 25 bp, Mus musculus
tgctcgcccgagacatggacaatga

SEQ ID NO: 872954 - DNA, 25 bp, Mus musculus
tgctcgcccgagtcatggacaatga

SEQ ID NO: 872955 - DNA, 25 bp, Mus musculus
tgctcgccctccaaaacatgatttt

SEQ ID NO: 872956 - DNA, 25 bp, Mus musculus
tgctcgccctcctaaacatgatttt

SEQ ID NO: 872957 - DNA, 25 bp, Mus musculus
tgctcgctggctacgacgacttcaa

SEQ ID NO: 872958 - DNA, 25 bp, Mus musculus
tgctcgctggcttcgacgacttcaa

SEQ ID NO: 872959 - DNA, 25 bp, Mus musculus
tgctcgcttgcacagccaagctgga

SEQ ID NO: 872960 - DNA, 25 bp, Mus musculus
tgctcgcttgcagagccaagctgga

SEQ ID NO: 872961 - DNA, 25 bp, Mus musculus
tgctcgcttggcactttatacagac

SEQ ID NO: 872962 - DNA, 25 bp, Mus musculus
tgctcgcttggctctttatacagac

SEQ ID NO: 872963 - DNA, 25 bp, Mus musculus
tgctcgctttggataagccagaagt

SEQ ID NO: 872964 - DNA, 25 bp, Mus musculus
tgctcgctttggttaagccagaagt

SEQ ID NO: 872965 - DNA, 25 bp, Mus musculus
tgctcggaagcaactcaacaagttg

SEQ ID NO: 872966 - DNA, 25 bp, Mus musculus
tgctcggaagcatctcaacaagttg

SEQ ID NO: 872967 - DNA, 25 bp, Mus musculus
tgctcggaatttacgttcacatctt

SEQ ID NO: 872968 - DNA, 25 bp, Mus musculus
tgctcggaattttcgttcacatctt

SEQ ID NO: 872969 - DNA, 25 bp, Mus musculus
tgctcggactctcttatacacatgt

SEQ ID NO: 872970 - DNA, 25 bp, Mus musculus
tgctcggactctgttatacacatgt

SEQ ID NO: 872971 - DNA, 25 bp, Mus musculus
tgctcggcaggccttggcccttagt

SEQ ID NO: 872972 - DNA, 25 bp, Mus musculus
tgctcggcaggcgttggcccttagt

SEQ ID NO: 872973 - DNA, 25 bp, Mus musculus
tgctcggctcgcagagctgagctct

SEQ ID NO: 872974 - DNA, 25 bp, Mus musculus
tgctcggctcgctgagctgagctct

SEQ ID NO: 872975 - DNA, 25 bp, Mus musculus
tgctcggctgctaatctaaaacctg

SEQ ID NO: 872976 - DNA, 25 bp, Mus musculus
tgctcggctgcttatctaaaacctg

SEQ ID NO: 872977 - DNA, 25 bp, Mus musculus
tgctcggcttcacctggaaaggcat

SEQ ID NO: 872978 - DNA, 25 bp, Mus musculus
tgctcggcttcagctggaaaggcat

SEQ ID NO: 872979 - DNA, 25 bp, Mus musculus
tgctcgggacaacactggactatca

SEQ ID NO: 872980 - DNA, 25 bp, Mus musculus
tgctcgggacaagactggactatca

SEQ ID NO: 872981 - DNA, 25 bp, Mus musculus
tgctcggtgctcagatcatcttggt

SEQ ID NO: 872982 - DNA, 25 bp, Mus musculus
tgctcggtgctctgatcatcttggt

SEQ ID NO: 872983 - DNA, 25 bp, Mus musculus
tgctcggtgtttactgcagtgcaag

SEQ ID NO: 872984 - DNA, 25 bp, Mus musculus
tgctcggtgttttctgcagtgcaag

SEQ ID NO: 872985 - DNA, 25 bp, Mus musculus
tgctcggtttctatccgccattata

SEQ ID NO: 872986 - DNA, 25 bp, Mus musculus
tgctcggtttctttccgccattata

SEQ ID NO: 872987 - DNA, 25 bp, Mus musculus
tgctcgtatattaggccatgagaat

SEQ ID NO: 872988 - DNA, 25 bp, Mus musculus
tgctcgtatatttggccatgagaat

SEQ ID NO: 872989 - DNA, 25 bp, Mus musculus
tgctcgtcatgtcgattcttaactg

SEQ ID NO: 872990 - DNA, 25 bp, Mus musculus
tgctcgtcatgtggattcttaactg

SEQ ID NO: 872991 - DNA, 25 bp, Mus musculus
tgctcgtctgtacagcacaggtcag

SEQ ID NO: 872992 - DNA, 25 bp, Mus musculus
tgctcgtctgtagagcacaggtcag

SEQ ID NO: 872993 - DNA, 25 bp, Mus musculus
tgctcgtgggcaccaacatggacaa

SEQ ID NO: 872994 - DNA, 25 bp, Mus musculus
tgctcgtgggcagcaacatggacaa

SEQ ID NO: 872995 - DNA, 25 bp, Mus musculus
tgctcgttcaggatgcgtccgagag

SEQ ID NO: 872996 - DNA, 25 bp, Mus musculus
tgctcgttcaggttgcgtccgagag

SEQ ID NO: 872997 - DNA, 25 bp, Mus musculus
tgctcgttcttcaccagtgaacaga

SEQ ID NO: 872998 - DNA, 25 bp, Mus musculus
tgctcgttcttctccagtgaacaga

SEQ ID NO: 872999 - DNA, 25 bp, Mus musculus
tgctcgtttaccagcgttggctctc

SEQ ID NO: 873000 - DNA, 25 bp, Mus musculus
tgctcgtttacctgcgttggctctc

SEQ ID NO: 873001 - DNA, 25 bp, Mus musculus
tgctctaacccactgtgctaatgtt

SEQ ID NO: 873002 - DNA, 25 bp, Mus musculus
tgctctaacccagtgtgctaatgtt

SEQ ID NO: 873003 - DNA, 25 bp, Mus musculus
tgctctaactctccaggtctgagtt

SEQ ID NO: 873004 - DNA, 25 bp, Mus musculus
tgctctaactctgcaggtctgagtt

SEQ ID NO: 873005 - DNA, 25 bp, Mus musculus
tgctctaagagccaatggcttcctt

SEQ ID NO: 873006 - DNA, 25 bp, Mus musculus
tgctctaagagcgaatggcttcctt

SEQ ID NO: 873007 - DNA, 25 bp, Mus musculus
tgctctaagggaaaggctctgctct

SEQ ID NO: 873008 - DNA, 25 bp, Mus musculus
tgctctaagggataggctctgctct

SEQ ID NO: 873009 - DNA, 25 bp, Mus musculus
tgctctacaagtcagtcattattct

SEQ ID NO: 873010 - DNA, 25 bp, Mus musculus
tgctctacaagtgagtcattattct

SEQ ID NO: 873011 - DNA, 25 bp, Mus musculus
tgctctacaatcctagggtaagtgt

SEQ ID NO: 873012 - DNA, 25 bp, Mus musculus
tgctctacaatcgtagggtaagtgt

SEQ ID NO: 873013 - DNA, 25 bp, Mus musculus
tgctctacaccgcaagctagctggg

SEQ ID NO: 873014 - DNA, 25 bp, Mus musculus
tgctctacaccggaagctagctggg

SEQ ID NO: 873015 - DNA, 25 bp, Mus musculus
tgctctacactaacttccaattcaa

SEQ ID NO: 873016 - DNA, 25 bp, Mus musculus
tgctctacactatcttccaattcaa

SEQ ID NO: 873017 - DNA, 25 bp, Mus musculus
tgctctacagccaaggaggtgcttt

SEQ ID NO: 873018 - DNA, 25 bp, Mus musculus
tgctctacagccaccagtttttcat

SEQ ID NO: 873019 - DNA, 25 bp, Mus musculus
tgctctacagcctaggaggtgcttt

SEQ ID NO: 873020 - DNA, 25 bp, Mus musculus
tgctctacagcctccagtttttcat

SEQ ID NO: 873021 - DNA, 25 bp, Mus musculus
tgctctacagtactaaccagatctt

SEQ ID NO: 873022 - DNA, 25 bp, Mus musculus
tgctctacagtagtaaccagatctt

SEQ ID NO: 873023 - DNA, 25 bp, Mus musculus
tgctctacatggaagtcatagatgc

SEQ ID NO: 873024 - DNA, 25 bp, Mus musculus
tgctctacatggtagtcatagatgc

SEQ ID NO: 873025 - DNA, 25 bp, Mus musculus
tgctctacattacacagggattctt

SEQ ID NO: 873026 - DNA, 25 bp, Mus musculus
tgctctacattagacagggattctt

SEQ ID NO: 873027 - DNA, 25 bp, Mus musculus
tgctctaccaggatctcaactgcaa

SEQ ID NO: 873028 - DNA, 25 bp, Mus musculus
tgctctaccaggttctcaactgcaa

SEQ ID NO: 873029 - DNA, 25 bp, Mus musculus
tgctctaccgctacgtgctggagct

SEQ ID NO: 873030 - DNA, 25 bp, Mus musculus
tgctctaccgcttcgtgctggagct

SEQ ID NO: 873031 - DNA, 25 bp, Mus musculus
tgctctaccgttatgtttcccaaga

SEQ ID NO: 873032 - DNA, 25 bp, Mus musculus
tgctctaccgttttgtttcccaaga

SEQ ID NO: 873033 - DNA, 25 bp, Mus musculus
tgctctaccttaatccttggaggta

SEQ ID NO: 873034 - DNA, 25 bp, Mus musculus
tgctctaccttattccttggaggta

SEQ ID NO: 873035 - DNA, 25 bp, Mus musculus
tgctctactgatccaggtcttacta

SEQ ID NO: 873036 - DNA, 25 bp, Mus musculus
tgctctactgatgcaggtcttacta

SEQ ID NO: 873037 - DNA, 25 bp, Mus musculus
tgctctacttccctggtttaattat

SEQ ID NO: 873038 - DNA, 25 bp, Mus musculus
tgctctacttccgtggtttaattat

SEQ ID NO: 873039 - DNA, 25 bp, Mus musculus
tgctctacttgtcatcttatctttg

SEQ ID NO: 873040 - DNA, 25 bp, Mus musculus
tgctctacttgtgatcttatctttg

SEQ ID NO: 873041 - DNA, 25 bp, Mus musculus
tgctctagagaaaccttcacccagg

SEQ ID NO: 873042 - DNA, 25 bp, Mus musculus
tgctctagagaatccttcacccagg

SEQ ID NO: 873043 - DNA, 25 bp, Mus musculus
tgctctagcatcaatttgggccatg

SEQ ID NO: 873044 - DNA, 25 bp, Mus musculus
tgctctagcatctatttgggccatg

SEQ ID NO: 873045 - DNA, 25 bp, Mus musculus
tgctctagctgtagactcctttata

SEQ ID NO: 873046 - DNA, 25 bp, Mus musculus
tgctctagctgttgactcctttata

SEQ ID NO: 873047 - DNA, 25 bp, Mus musculus
tgctctagggttccatctatcttta

SEQ ID NO: 873048 - DNA, 25 bp, Mus musculus
tgctctagggttgcatctatcttta

SEQ ID NO: 873049 - DNA, 25 bp, Mus musculus
tgctctaggtgaacagtttatccat

SEQ ID NO: 873050 - DNA, 25 bp, Mus musculus
tgctctaggtgatcagtttatccat

SEQ ID NO: 873051 - DNA, 25 bp, Mus musculus
tgctctagtggtcactcatgcttaa

SEQ ID NO: 873052 - DNA, 25 bp, Mus musculus
tgctctagtggtgactcatgcttaa

SEQ ID NO: 873053 - DNA, 25 bp, Mus musculus
tgctctagttcacacctggcaggtt

SEQ ID NO: 873054 - DNA, 25 bp, Mus musculus
tgctctagttcagacctggcaggtt

SEQ ID NO: 873055 - DNA, 25 bp, Mus musculus
tgctctagtttgcttcacagttctt

SEQ ID NO: 873056 - DNA, 25 bp, Mus musculus
tgctctagtttggttcacagttctt

SEQ ID NO: 873057 - DNA, 25 bp, Mus musculus
tgctctatactgactaacaactatg

SEQ ID NO: 873058 - DNA, 25 bp, Mus musculus
tgctctatactgtctaacaactatg

SEQ ID NO: 873059 - DNA, 25 bp, Mus musculus
tgctctatctcgctacctggtagac

SEQ ID NO: 873060 - DNA, 25 bp, Mus musculus
tgctctatctcggtacctggtagac

SEQ ID NO: 873061 - DNA, 25 bp, Mus musculus
tgctctatctgcattcctaactaaa

SEQ ID NO: 873062 - DNA, 25 bp, Mus musculus
tgctctatctgctttcctaactaaa

SEQ ID NO: 873063 - DNA, 25 bp, Mus musculus
tgctctatcttccttcctatatgag

SEQ ID NO: 873064 - DNA, 25 bp, Mus musculus
tgctctatcttcgttcctatatgag

SEQ ID NO: 873065 - DNA, 25 bp, Mus musculus
tgctctatgactctgtctgcctcta

SEQ ID NO: 873066 - DNA, 25 bp, Mus musculus
tgctctatgactgtgtctgcctcta

SEQ ID NO: 873067 - DNA, 25 bp, Mus musculus
tgctctatgagcctactttataaca

SEQ ID NO: 873068 - DNA, 25 bp, Mus musculus
tgctctatgagcgtactttataaca

SEQ ID NO: 873069 - DNA, 25 bp, Mus musculus
tgctctatgcctacctgggttcaca

SEQ ID NO: 873070 - DNA, 25 bp, Mus musculus
tgctctatgccttcctgggttcaca

SEQ ID NO: 873071 - DNA, 25 bp, Mus musculus
tgctctatgcttcgcctgcaagtag

SEQ ID NO: 873072 - DNA, 25 bp, Mus musculus
tgctctatgcttggcctgcaagtag

SEQ ID NO: 873073 - DNA, 25 bp, Mus musculus
tgctctatgtataattattctgtga

SEQ ID NO: 873074 - DNA, 25 bp, Mus musculus
tgctctatgtattattattctgtga

SEQ ID NO: 873075 - DNA, 25 bp, Mus musculus
tgctctattcccacgagacaggagt

SEQ ID NO: 873076 - DNA, 25 bp, Mus musculus
tgctctattccctcgagacaggagt

SEQ ID NO: 873077 - DNA, 25 bp, Mus musculus
tgctctcaaccgagtgggtcaggaa

SEQ ID NO: 873078 - DNA, 25 bp, Mus musculus
tgctctcaaccgtgtgggtcaggaa

SEQ ID NO: 873079 - DNA, 25 bp, Mus musculus
tgctctcaactcacagcaggaacca

SEQ ID NO: 873080 - DNA, 25 bp, Mus musculus
tgctctcaactctcagcaggaacca

SEQ ID NO: 873081 - DNA, 25 bp, Mus musculus
tgctctcacactatgctgaaaccgt

SEQ ID NO: 873082 - DNA, 25 bp, Mus musculus
tgctctcacactttgctgaaaccgt

SEQ ID NO: 873083 - DNA, 25 bp, Mus musculus
tgctctcacagaaatcacgttttcc

SEQ ID NO: 873084 - DNA, 25 bp, Mus musculus
tgctctcacagatatcacgttttcc

SEQ ID NO: 873085 - DNA, 25 bp, Mus musculus
tgctctcaccaccacatagttttgg

SEQ ID NO: 873086 - DNA, 25 bp, Mus musculus
tgctctcaccacgacatagttttgg

SEQ ID NO: 873087 - DNA, 25 bp, Mus musculus
tgctctcactggcagaaaacaagct

SEQ ID NO: 873088 - DNA, 25 bp, Mus musculus
tgctctcactgggagaaaacaagct

SEQ ID NO: 873089 - DNA, 25 bp, Mus musculus
tgctctcagaacacttgggcttaag

SEQ ID NO: 873090 - DNA, 25 bp, Mus musculus
tgctctcagaactcttgggcttaag

SEQ ID NO: 873091 - DNA, 25 bp, Mus musculus
tgctctcagaatctcttattttgta

SEQ ID NO: 873092 - DNA, 25 bp, Mus musculus
tgctctcagaatgtcttattttgta

SEQ ID NO: 873093 - DNA, 25 bp, Mus musculus
tgctctcagagtaactgctgccaag

SEQ ID NO: 873094 - DNA, 25 bp, Mus musculus
tgctctcagagttactgctgccaag

SEQ ID NO: 873095 - DNA, 25 bp, Mus musculus
tgctctcagataaggtaggcttaca

SEQ ID NO: 873096 - DNA, 25 bp, Mus musculus
tgctctcagatatggtaggcttaca

SEQ ID NO: 873097 - DNA, 25 bp, Mus musculus
tgctctcagccgcaaggtgtctgat

SEQ ID NO: 873098 - DNA, 25 bp, Mus musculus
tgctctcagccggaaggtgtctgat

SEQ ID NO: 873099 - DNA, 25 bp, Mus musculus
tgctctcaggagatcactgttccta

SEQ ID NO: 873100 - DNA, 25 bp, Mus musculus
tgctctcaggagttcactgttccta

SEQ ID NO: 873101 - DNA, 25 bp, Mus musculus
tgctctcaggtacaacagccagtgc

SEQ ID NO: 873102 - DNA, 25 bp, Mus musculus
tgctctcaggtagaacagccagtgc

SEQ ID NO: 873103 - DNA, 25 bp, Mus musculus
tgctctcagtcacccacagggacat

SEQ ID NO: 873104 - DNA, 25 bp, Mus musculus
tgctctcagtcagccacagggacat

SEQ ID NO: 873105 - DNA, 25 bp, Mus musculus
tgctctcatccaaaggccatgctat

SEQ ID NO: 873106 - DNA, 25 bp, Mus musculus
tgctctcatccataggccatgctat

SEQ ID NO: 873107 - DNA, 25 bp, Mus musculus
tgctctcatgacatgttctttgacc

SEQ ID NO: 873108 - DNA, 25 bp, Mus musculus
tgctctcatgacttgttctttgacc

SEQ ID NO: 873109 - DNA, 25 bp, Mus musculus
tgctctcatggaattctctgcataa

SEQ ID NO: 873110 - DNA, 25 bp, Mus musculus
tgctctcatggatttctctgcataa

SEQ ID NO: 873111 - DNA, 25 bp, Mus musculus
tgctctcatgtaaatgttgcttttc

SEQ ID NO: 873112 - DNA, 25 bp, Mus musculus
tgctctcatgtatatgttgcttttc

SEQ ID NO: 873113 - DNA, 25 bp, Mus musculus
tgctctccacaacccagctgaggga

SEQ ID NO: 873114 - DNA, 25 bp, Mus musculus
tgctctccacaacttcctattctag

SEQ ID NO: 873115 - DNA, 25 bp, Mus musculus
tgctctccacaagccagctgaggga

SEQ ID NO: 873116 - DNA, 25 bp, Mus musculus
tgctctccacaagttcctattctag

SEQ ID NO: 873117 - DNA, 25 bp, Mus musculus
tgctctccaccactgagtaaggcac

SEQ ID NO: 873118 - DNA, 25 bp, Mus musculus
tgctctccaccagtgagtaaggcac

SEQ ID NO: 873119 - DNA, 25 bp, Mus musculus
tgctctccacctaaaactcttatag

SEQ ID NO: 873120 - DNA, 25 bp, Mus musculus
tgctctccaccttaaactcttatag

SEQ ID NO: 873121 - DNA, 25 bp, Mus musculus
tgctctccagacaatcccagaacat

SEQ ID NO: 873122 - DNA, 25 bp, Mus musculus
tgctctccagactatcccagaacat

SEQ ID NO: 873123 - DNA, 25 bp, Mus musculus
tgctctccagagcaacacatctgca

SEQ ID NO: 873124 - DNA, 25 bp, Mus musculus
tgctctccagaggaacacatctgca

SEQ ID NO: 873125 - DNA, 25 bp, Mus musculus
tgctctccaggcaattactggttgc

SEQ ID NO: 873126 - DNA, 25 bp, Mus musculus
tgctctccaggctattactggttgc

SEQ ID NO: 873127 - DNA, 25 bp, Mus musculus
tgctctccagtcacagaacaatcaa

SEQ ID NO: 873128 - DNA, 25 bp, Mus musculus
tgctctccagtctcagaacaatcaa

SEQ ID NO: 873129 - DNA, 25 bp, Mus musculus
tgctctccatgcatcgcatcaagtc

SEQ ID NO: 873130 - DNA, 25 bp, Mus musculus
tgctctccatgcttcgcatcaagtc

SEQ ID NO: 873131 - DNA, 25 bp, Mus musculus
tgctctcccatgagacagatactat

SEQ ID NO: 873132 - DNA, 25 bp, Mus musculus
tgctctcccatgtgacagatactat

SEQ ID NO: 873133 - DNA, 25 bp, Mus musculus
tgctctccccaaagtaaaacactgc

SEQ ID NO: 873134 - DNA, 25 bp, Mus musculus
tgctctccccaatgtaaaacactgc

SEQ ID NO: 873135 - DNA, 25 bp, Mus musculus
tgctctccctaaatcttcacataag

SEQ ID NO: 873136 - DNA, 25 bp, Mus musculus
tgctctccctaattcttcacataag

SEQ ID NO: 873137 - DNA, 25 bp, Mus musculus
tgctctccctgtaggttgggcctag

SEQ ID NO: 873138 - DNA, 25 bp, Mus musculus
tgctctccctgttggttgggcctag

SEQ ID NO: 873139 - DNA, 25 bp, Mus musculus
tgctctccctttagatcggtggctt

SEQ ID NO: 873140 - DNA, 25 bp, Mus musculus
tgctctcccttttgatcggtggctt

SEQ ID NO: 873141 - DNA, 25 bp, Mus musculus
tgctctccgattacttccgggatat

SEQ ID NO: 873142 - DNA, 25 bp, Mus musculus
tgctctccgatttcttccgggatat

SEQ ID NO: 873143 - DNA, 25 bp, Mus musculus
tgctctccgcatcgcaacgtggaat

SEQ ID NO: 873144 - DNA, 25 bp, Mus musculus
tgctctccgcatggcaacgtggaat

SEQ ID NO: 873145 - DNA, 25 bp, Mus musculus
tgctctccgggcagctcaagaagga

SEQ ID NO: 873146 - DNA, 25 bp, Mus musculus
tgctctccgggctgctcaagaagga

SEQ ID NO: 873147 - DNA, 25 bp, Mus musculus
tgctctccgtcaacatcttgctgga

SEQ ID NO: 873148 - DNA, 25 bp, Mus musculus
tgctctccgtcatcatcttgctgga

SEQ ID NO: 873149 - DNA, 25 bp, Mus musculus
tgctctcctactcttccttgtcttt

SEQ ID NO: 873150 - DNA, 25 bp, Mus musculus
tgctctcctactgttccttgtcttt

SEQ ID NO: 873151 - DNA, 25 bp, Mus musculus
tgctctcctccaagttcagtaatga

SEQ ID NO: 873152 - DNA, 25 bp, Mus musculus
tgctctcctccatgttcagtaatga

SEQ ID NO: 873153 - DNA, 25 bp, Mus musculus
tgctctcctctcctaagaattcatg

SEQ ID NO: 873154 - DNA, 25 bp, Mus musculus
tgctctcctctcgtaagaattcatg

SEQ ID NO: 873155 - DNA, 25 bp, Mus musculus
tgctctcctggactaccgtgaagat

SEQ ID NO: 873156 - DNA, 25 bp, Mus musculus
tgctctcctggagtaccgtgaagat

SEQ ID NO: 873157 - DNA, 25 bp, Mus musculus
tgctctccttatcgccagtattggt

SEQ ID NO: 873158 - DNA, 25 bp, Mus musculus
tgctctccttatggccagtattggt

SEQ ID NO: 873159 - DNA, 25 bp, Mus musculus
tgctctccttccattaaacacaggt

SEQ ID NO: 873160 - DNA, 25 bp, Mus musculus
tgctctccttcctttaaacacaggt

SEQ ID NO: 873161 - DNA, 25 bp, Mus musculus
tgctctccttgtcaggcagatttgg

SEQ ID NO: 873162 - DNA, 25 bp, Mus musculus
tgctctccttgtgaggcagatttgg

SEQ ID NO: 873163 - DNA, 25 bp, Mus musculus
tgctctcgacagcaggtgttggctc

SEQ ID NO: 873164 - DNA, 25 bp, Mus musculus
tgctctcgacaggaggtgttggctc

SEQ ID NO: 873165 - DNA, 25 bp, Mus musculus
tgctctcgctctcgaaagttaacag

SEQ ID NO: 873166 - DNA, 25 bp, Mus musculus
tgctctcgctctggaaagttaacag

SEQ ID NO: 873167 - DNA, 25 bp, Mus musculus
tgctctcggagaatcagtcttgtaa

SEQ ID NO: 873168 - DNA, 25 bp, Mus musculus
tgctctcggagattcagtcttgtaa

SEQ ID NO: 873169 - DNA, 25 bp, Mus musculus
tgctctcgtgcccacatgtacaaat

SEQ ID NO: 873170 - DNA, 25 bp, Mus musculus
tgctctcgtgccgacatgtacaaat

SEQ ID NO: 873171 - DNA, 25 bp, Mus musculus
tgctctcgttccatcaggacaacat

SEQ ID NO: 873172 - DNA, 25 bp, Mus musculus
tgctctcgttccttcaggacaacat

SEQ ID NO: 873173 - DNA, 25 bp, Mus musculus
tgctctctacggagtgtgctcggct

SEQ ID NO: 873174 - DNA, 25 bp, Mus musculus
tgctctctacggtgtgtgctcggct

SEQ ID NO: 873175 - DNA, 25 bp, Mus musculus
tgctctctagatctccaaatacaaa

SEQ ID NO: 873176 - DNA, 25 bp, Mus musculus
tgctctctagatgtccaaatacaaa

SEQ ID NO: 873177 - DNA, 25 bp, Mus musculus
tgctctctagctcgtcaataaattt

SEQ ID NO: 873178 - DNA, 25 bp, Mus musculus
tgctctctagctggtcaataaattt

SEQ ID NO: 873179 - DNA, 25 bp, Mus musculus
tgctctctccccaattttgagaaga

SEQ ID NO: 873180 - DNA, 25 bp, Mus musculus
tgctctctcccctattttgagaaga

SEQ ID NO: 873181 - DNA, 25 bp, Mus musculus
tgctctctccctagttcagttattg

SEQ ID NO: 873182 - DNA, 25 bp, Mus musculus
tgctctctccctatctattcaatat

SEQ ID NO: 873183 - DNA, 25 bp, Mus musculus
tgctctctcccttgttcagttattg

SEQ ID NO: 873184 - DNA, 25 bp, Mus musculus
tgctctctccctttctattcaatat

SEQ ID NO: 873185 - DNA, 25 bp, Mus musculus
tgctctctcctacaaatgtgggctt

SEQ ID NO: 873186 - DNA, 25 bp, Mus musculus
tgctctctcctagaaatgtgggctt

SEQ ID NO: 873187 - DNA, 25 bp, Mus musculus
tgctctctccttatggatttgcatt

SEQ ID NO: 873188 - DNA, 25 bp, Mus musculus
tgctctctccttttggatttgcatt

SEQ ID NO: 873189 - DNA, 25 bp, Mus musculus
tgctctctgaacagtggcgagtctt

SEQ ID NO: 873190 - DNA, 25 bp, Mus musculus
tgctctctgaactgtggcgagtctt

SEQ ID NO: 873191 - DNA, 25 bp, Mus musculus
tgctctctgagtcaagtacagcttc

SEQ ID NO: 873192 - DNA, 25 bp, Mus musculus
tgctctctgagtgaagtacagcttc

SEQ ID NO: 873193 - DNA, 25 bp, Mus musculus
tgctctctgcctagcatatcaatat

SEQ ID NO: 873194 - DNA, 25 bp, Mus musculus
tgctctctgccttgcatatcaatat

SEQ ID NO: 873195 - DNA, 25 bp, Mus musculus
tgctctctgctaaggccgcaagaag

SEQ ID NO: 873196 - DNA, 25 bp, Mus musculus
tgctctctgctatggccgcaagaag

SEQ ID NO: 873197 - DNA, 25 bp, Mus musculus
tgctctctgctgaatatcttcctta

SEQ ID NO: 873198 - DNA, 25 bp, Mus musculus
tgctctctgctgtatatcttcctta

SEQ ID NO: 873199 - DNA, 25 bp, Mus musculus
tgctctctgtccaaaaatgctgtca

SEQ ID NO: 873200 - DNA, 25 bp, Mus musculus
tgctctctgtcctaaaatgctgtca

SEQ ID NO: 873201 - DNA, 25 bp, Mus musculus
tgctctctgtgaccctcagagtaca

SEQ ID NO: 873202 - DNA, 25 bp, Mus musculus
tgctctctgtgagcctcagagtaca

SEQ ID NO: 873203 - DNA, 25 bp, Mus musculus
tgctctctgttgcttggcctcctta

SEQ ID NO: 873204 - DNA, 25 bp, Mus musculus
tgctctctgttggttggcctcctta

SEQ ID NO: 873205 - DNA, 25 bp, Mus musculus
tgctctcttcaacattaggtcccga

SEQ ID NO: 873206 - DNA, 25 bp, Mus musculus
tgctctcttcaagattaggtcccga

SEQ ID NO: 873207 - DNA, 25 bp, Mus musculus
tgctctcttcccattccggtgggaa

SEQ ID NO: 873208 - DNA, 25 bp, Mus musculus
tgctctcttccctttccggtgggaa

SEQ ID NO: 873209 - DNA, 25 bp, Mus musculus
tgctctcttctgacatccacaggtt

SEQ ID NO: 873210 - DNA, 25 bp, Mus musculus
tgctctcttctgtcatccacaggtt

SEQ ID NO: 873211 - DNA, 25 bp, Mus musculus
tgctctcttgccaatttaaacacca

SEQ ID NO: 873212 - DNA, 25 bp, Mus musculus
tgctctcttgcctatttaaacacca

SEQ ID NO: 873213 - DNA, 25 bp, Mus musculus
tgctctctttgtcacacccaagaca

SEQ ID NO: 873214 - DNA, 25 bp, Mus musculus
tgctctctttgtccagggccaactc

SEQ ID NO: 873215 - DNA, 25 bp, Mus musculus
tgctctctttgtgacacccaagaca

SEQ ID NO: 873216 - DNA, 25 bp, Mus musculus
tgctctctttgtgcagggccaactc

SEQ ID NO: 873217 - DNA, 25 bp, Mus musculus
tgctctcttttcctgtaaacattgt

SEQ ID NO: 873218 - DNA, 25 bp, Mus musculus
tgctctcttttcgtgtaaacattgt

SEQ ID NO: 873219 - DNA, 25 bp, Mus musculus
tgctctgaacatctacgtggacatc

SEQ ID NO: 873220 - DNA, 25 bp, Mus musculus
tgctctgaacatctgactctcgggc

SEQ ID NO: 873221 - DNA, 25 bp, Mus musculus
tgctctgaacatgtacgtggacatc

SEQ ID NO: 873222 - DNA, 25 bp, Mus musculus
tgctctgaacatgtgactctcgggc

SEQ ID NO: 873223 - DNA, 25 bp, Mus musculus
tgctctgaactaatgttgattcccc

SEQ ID NO: 873224 - DNA, 25 bp, Mus musculus
tgctctgaactattgttgattcccc

SEQ ID NO: 873225 - DNA, 25 bp, Mus musculus
tgctctgaagcaagcctccaatatg

SEQ ID NO: 873226 - DNA, 25 bp, Mus musculus
tgctctgaagcatgcctccaatatg

SEQ ID NO: 873227 - DNA, 25 bp, Mus musculus
tgctctgaagtgagccagcctaagc

SEQ ID NO: 873228 - DNA, 25 bp, Mus musculus
tgctctgaagtgtgccagcctaagc

SEQ ID NO: 873229 - DNA, 25 bp, Mus musculus
tgctctgaatctccgctcctggctg

SEQ ID NO: 873230 - DNA, 25 bp, Mus musculus
tgctctgaatctgcgctcctggctg

SEQ ID NO: 873231 - DNA, 25 bp, Mus musculus
tgctctgacagacagtgcctgtttt

SEQ ID NO: 873232 - DNA, 25 bp, Mus musculus
tgctctgacagagagtgcctgtttt

SEQ ID NO: 873233 - DNA, 25 bp, Mus musculus
tgctctgacctaactacaccttgtt

SEQ ID NO: 873234 - DNA, 25 bp, Mus musculus
tgctctgacctatctacaccttgtt

SEQ ID NO: 873235 - DNA, 25 bp, Mus musculus
tgctctgaccttcatttgggcttag

SEQ ID NO: 873236 - DNA, 25 bp, Mus musculus
tgctctgaccttgatttgggcttag

SEQ ID NO: 873237 - DNA, 25 bp, Mus musculus
tgctctgacggacacactggacaag

SEQ ID NO: 873238 - DNA, 25 bp, Mus musculus
tgctctgacggagacactggacaag

SEQ ID NO: 873239 - DNA, 25 bp, Mus musculus
tgctctgactaacaggaggcagcca

SEQ ID NO: 873240 - DNA, 25 bp, Mus musculus
tgctctgactaagaggaggcagcca

SEQ ID NO: 873241 - DNA, 25 bp, Mus musculus
tgctctgactgcaagcttcccacag

SEQ ID NO: 873242 - DNA, 25 bp, Mus musculus
tgctctgactgctagcttcccacag

SEQ ID NO: 873243 - DNA, 25 bp, Mus musculus
tgctctgagactcatctcgtctgct

SEQ ID NO: 873244 - DNA, 25 bp, Mus musculus
tgctctgagactgatctcgtctgct

SEQ ID NO: 873245 - DNA, 25 bp, Mus musculus
tgctctgagctacccagcattcatt

SEQ ID NO: 873246 - DNA, 25 bp, Mus musculus
tgctctgagctagccagcattcatt

SEQ ID NO: 873247 - DNA, 25 bp, Mus musculus
tgctctgagctgcatggccctcgga

SEQ ID NO: 873248 - DNA, 25 bp, Mus musculus
tgctctgagctggatggccctcgga

SEQ ID NO: 873249 - DNA, 25 bp, Mus musculus
tgctctgaggtcagcttacccggta

SEQ ID NO: 873250 - DNA, 25 bp, Mus musculus
tgctctgaggtctgcttacccggta

SEQ ID NO: 873251 - DNA, 25 bp, Mus musculus
tgctctgagtctatctgtcctgaga

SEQ ID NO: 873252 - DNA, 25 bp, Mus musculus
tgctctgagtctttctgtcctgaga

SEQ ID NO: 873253 - DNA, 25 bp, Mus musculus
tgctctgatattcacgacacgttgg

SEQ ID NO: 873254 - DNA, 25 bp, Mus musculus
tgctctgatattgacgacacgttgg

SEQ ID NO: 873255 - DNA, 25 bp, Mus musculus
tgctctgatcacatcccagtgacag

SEQ ID NO: 873256 - DNA, 25 bp, Mus musculus
tgctctgatcacttcccagtgacag

SEQ ID NO: 873257 - DNA, 25 bp, Mus musculus
tgctctgatgggacttggtgcattc

SEQ ID NO: 873258 - DNA, 25 bp, Mus musculus
tgctctgatgggtcttggtgcattc

SEQ ID NO: 873259 - DNA, 25 bp, Mus musculus
tgctctgcagctcagatgggcttca

SEQ ID NO: 873260 - DNA, 25 bp, Mus musculus
tgctctgcagctgagatgggcttca

SEQ ID NO: 873261 - DNA, 25 bp, Mus musculus
tgctctgcatgtcttgtctgtttgg

SEQ ID NO: 873262 - DNA, 25 bp, Mus musculus
tgctctgcatgtgttgtctgtttgg

SEQ ID NO: 873263 - DNA, 25 bp, Mus musculus
tgctctgcattcctttactctgaaa

SEQ ID NO: 873264 - DNA, 25 bp, Mus musculus
tgctctgcattcgtttactctgaaa

SEQ ID NO: 873265 - DNA, 25 bp, Mus musculus
tgctctgccaacacagtctatttag

SEQ ID NO: 873266 - DNA, 25 bp, Mus musculus
tgctctgccaactcagtctatttag

SEQ ID NO: 873267 - DNA, 25 bp, Mus musculus
tgctctgccagcattaacttcttgg

SEQ ID NO: 873268 - DNA, 25 bp, Mus musculus
tgctctgccagctttaacttcttgg

SEQ ID NO: 873269 - DNA, 25 bp, Mus musculus
tgctctgccatcacgggacacgtgt

SEQ ID NO: 873270 - DNA, 25 bp, Mus musculus
tgctctgccatctcgggacacgtgt

SEQ ID NO: 873271 - DNA, 25 bp, Mus musculus
tgctctgcccacctccagtgaaaaa

SEQ ID NO: 873272 - DNA, 25 bp, Mus musculus
tgctctgcccacgtccagtgaaaaa

SEQ ID NO: 873273 - DNA, 25 bp, Mus musculus
tgctctgcccatatcaatcagttat

SEQ ID NO: 873274 - DNA, 25 bp, Mus musculus
tgctctgcccatttcaatcagttat

SEQ ID NO: 873275 - DNA, 25 bp, Mus musculus
tgctctgcccgaacttccagagact

SEQ ID NO: 873276 - DNA, 25 bp, Mus musculus
tgctctgcccgatcttccagagact

SEQ ID NO: 873277 - DNA, 25 bp, Mus musculus
tgctctgcccgtagccatgctgaag

SEQ ID NO: 873278 - DNA, 25 bp, Mus musculus
tgctctgcccgttgccatgctgaag

SEQ ID NO: 873279 - DNA, 25 bp, Mus musculus
tgctctgcctaccagtgttgagaac

SEQ ID NO: 873280 - DNA, 25 bp, Mus musculus
tgctctgcctacgagtgttgagaac

SEQ ID NO: 873281 - DNA, 25 bp, Mus musculus
tgctctgcctctcactggatagatg

SEQ ID NO: 873282 - DNA, 25 bp, Mus musculus
tgctctgcctctgactggatagatg

SEQ ID NO: 873283 - DNA, 25 bp, Mus musculus
tgctctgcctgtcatgctgttgatg

SEQ ID NO: 873284 - DNA, 25 bp, Mus musculus
tgctctgcctgtgatgctgttgatg

SEQ ID NO: 873285 - DNA, 25 bp, Mus musculus
tgctctgcgctccatcggcttgaaa

SEQ ID NO: 873286 - DNA, 25 bp, Mus musculus
tgctctgcgctcgatcggcttgaaa

SEQ ID NO: 873287 - DNA, 25 bp, Mus musculus
tgctctgcgggaaagataccagctc

SEQ ID NO: 873288 - DNA, 25 bp, Mus musculus
tgctctgcgggatagataccagctc

SEQ ID NO: 873289 - DNA, 25 bp, Mus musculus
tgctctgctattactctgcccgtga

SEQ ID NO: 873290 - DNA, 25 bp, Mus musculus
tgctctgctattccatgatgctcta

SEQ ID NO: 873291 - DNA, 25 bp, Mus musculus
tgctctgctattgcatgatgctcta

SEQ ID NO: 873292 - DNA, 25 bp, Mus musculus
tgctctgctatttctctgcccgtga

SEQ ID NO: 873293 - DNA, 25 bp, Mus musculus
tgctctgctcacaggtcatgtatag

SEQ ID NO: 873294 - DNA, 25 bp, Mus musculus
tgctctgctcactggtcatgtatag

SEQ ID NO: 873295 - DNA, 25 bp, Mus musculus
tgctctgctcctacctaggagatat

SEQ ID NO: 873296 - DNA, 25 bp, Mus musculus
tgctctgctccttcctaggagatat

SEQ ID NO: 873297 - DNA, 25 bp, Mus musculus
tgctctgctctgcttcacacgagta

SEQ ID NO: 873298 - DNA, 25 bp, Mus musculus
tgctctgctctggttcacacgagta

SEQ ID NO: 873299 - DNA, 25 bp, Mus musculus
tgctctgctgaaaacgagtccacat

SEQ ID NO: 873300 - DNA, 25 bp, Mus musculus
tgctctgctgaatacgagtccacat

SEQ ID NO: 873301 - DNA, 25 bp, Mus musculus
tgctctgctgcccaaaagatgtctt

SEQ ID NO: 873302 - DNA, 25 bp, Mus musculus
tgctctgctgccgaaaagatgtctt

SEQ ID NO: 873303 - DNA, 25 bp, Mus musculus
tgctctgcttagaggcaggcactat

SEQ ID NO: 873304 - DNA, 25 bp, Mus musculus
tgctctgcttagtggcaggcactat

SEQ ID NO: 873305 - DNA, 25 bp, Mus musculus
tgctctgcttcaatgatgggtgttc

SEQ ID NO: 873306 - DNA, 25 bp, Mus musculus
tgctctgcttcattgatgggtgttc

SEQ ID NO: 873307 - DNA, 25 bp, Mus musculus
tgctctgcttgacatgagctcgcag

SEQ ID NO: 873308 - DNA, 25 bp, Mus musculus
tgctctgcttgagatgagctcgcag

SEQ ID NO: 873309 - DNA, 25 bp, Mus musculus
tgctctggacacatttgcttgctag

SEQ ID NO: 873310 - DNA, 25 bp, Mus musculus
tgctctggacacttttgcttgctag

SEQ ID NO: 873311 - DNA, 25 bp, Mus musculus
tgctctggacagatccctggaggat

SEQ ID NO: 873312 - DNA, 25 bp, Mus musculus
tgctctggacagttccctggaggat

SEQ ID NO: 873313 - DNA, 25 bp, Mus musculus
tgctctggaccacgctagggcgttc

SEQ ID NO: 873314 - DNA, 25 bp, Mus musculus
tgctctggaccaggctagggcgttc

SEQ ID NO: 873315 - DNA, 25 bp, Mus musculus
tgctctggacctcgtcgacgaaaac

SEQ ID NO: 873316 - DNA, 25 bp, Mus musculus
tgctctggacctggtcgacgaaaac

SEQ ID NO: 873317 - DNA, 25 bp, Mus musculus
tgctctggacgacgtggtgccaccc

SEQ ID NO: 873318 - DNA, 25 bp, Mus musculus
tgctctggacgaggtggtgccaccc

SEQ ID NO: 873319 - DNA, 25 bp, Mus musculus
tgctctggactcaataccaggctca

SEQ ID NO: 873320 - DNA, 25 bp, Mus musculus
tgctctggactctataccaggctca

SEQ ID NO: 873321 - DNA, 25 bp, Mus musculus
tgctctggagccatacatgtggtca

SEQ ID NO: 873322 - DNA, 25 bp, Mus musculus
tgctctggagccttacatgtggtca

SEQ ID NO: 873323 - DNA, 25 bp, Mus musculus
tgctctggcacgcaacaagggctca

SEQ ID NO: 873324 - DNA, 25 bp, Mus musculus
tgctctggcacggaacaagggctca

SEQ ID NO: 873325 - DNA, 25 bp, Mus musculus
tgctctggctgccataggccgagaa

SEQ ID NO: 873326 - DNA, 25 bp, Mus musculus
tgctctggctgcgataggccgagaa

SEQ ID NO: 873327 - DNA, 25 bp, Mus musculus
tgctctgggatcactggtggcatcg

SEQ ID NO: 873328 - DNA, 25 bp, Mus musculus
tgctctgggatctctggtggcatcg

SEQ ID NO: 873329 - DNA, 25 bp, Mus musculus
tgctctgggatgcatgctgtctgat

SEQ ID NO: 873330 - DNA, 25 bp, Mus musculus
tgctctgggatggatgctgtctgat

SEQ ID NO: 873331 - DNA, 25 bp, Mus musculus
tgctctgggccacgatcgacaggtc

SEQ ID NO: 873332 - DNA, 25 bp, Mus musculus
tgctctgggccaggatcgacaggtc

SEQ ID NO: 873333 - DNA, 25 bp, Mus musculus
tgctctgggccgagttactgatgta

SEQ ID NO: 873334 - DNA, 25 bp, Mus musculus
tgctctgggccgtgttactgatgta

SEQ ID NO: 873335 - DNA, 25 bp, Mus musculus
tgctctgggcctatgggaggacaac

SEQ ID NO: 873336 - DNA, 25 bp, Mus musculus
tgctctgggcctttgggaggacaac

SEQ ID NO: 873337 - DNA, 25 bp, Mus musculus
tgctctgggctcattgtcaggccaa

SEQ ID NO: 873338 - DNA, 25 bp, Mus musculus
tgctctgggctctttgtcaggccaa

SEQ ID NO: 873339 - DNA, 25 bp, Mus musculus
tgctctgggttaccaagttctccca

SEQ ID NO: 873340 - DNA, 25 bp, Mus musculus
tgctctgggttagcaagttctccca

SEQ ID NO: 873341 - DNA, 25 bp, Mus musculus
tgctctgggttcctggctctgtgaa

SEQ ID NO: 873342 - DNA, 25 bp, Mus musculus
tgctctgggttcgtggctctgtgaa

SEQ ID NO: 873343 - DNA, 25 bp, Mus musculus
tgctctggtagacggcgagaaacct

SEQ ID NO: 873344 - DNA, 25 bp, Mus musculus
tgctctggtagagggcgagaaacct

SEQ ID NO: 873345 - DNA, 25 bp, Mus musculus
tgctctggtgtcaccatggaccaaa

SEQ ID NO: 873346 - DNA, 25 bp, Mus musculus
tgctctggtgtctccatggaccaaa

SEQ ID NO: 873347 - DNA, 25 bp, Mus musculus
tgctctggttatcggcacagttaag

SEQ ID NO: 873348 - DNA, 25 bp, Mus musculus
tgctctggttatgggcacagttaag

SEQ ID NO: 873349 - DNA, 25 bp, Mus musculus
tgctctggttcacgtccctccagga

SEQ ID NO: 873350 - DNA, 25 bp, Mus musculus
tgctctggttcaggtccctccagga

SEQ ID NO: 873351 - DNA, 25 bp, Mus musculus
tgctctggtttgaagggtttacctg

SEQ ID NO: 873352 - DNA, 25 bp, Mus musculus
tgctctggtttgtagggtttacctg

SEQ ID NO: 873353 - DNA, 25 bp, Mus musculus
tgctctgtaaacatggaccgggtca

SEQ ID NO: 873354 - DNA, 25 bp, Mus musculus
tgctctgtaaacttggaccgggtca

SEQ ID NO: 873355 - DNA, 25 bp, Mus musculus
tgctctgtaacgacatcctgtggat

SEQ ID NO: 873356 - DNA, 25 bp, Mus musculus
tgctctgtaacgtcatcctgtggat

SEQ ID NO: 873357 - DNA, 25 bp, Mus musculus
tgctctgtacacatttccactgagt

SEQ ID NO: 873358 - DNA, 25 bp, Mus musculus
tgctctgtacacttttccactgagt

SEQ ID NO: 873359 - DNA, 25 bp, Mus musculus
tgctctgtacccactgaaaccttga

SEQ ID NO: 873360 - DNA, 25 bp, Mus musculus
tgctctgtaccctctgaaaccttga

SEQ ID NO: 873361 - DNA, 25 bp, Mus musculus
tgctctgtagacagggacttctctc

SEQ ID NO: 873362 - DNA, 25 bp, Mus musculus
tgctctgtagactgggacttctctc

SEQ ID NO: 873363 - DNA, 25 bp, Mus musculus
tgctctgtagcaacaactgtctcat

SEQ ID NO: 873364 - DNA, 25 bp, Mus musculus
tgctctgtagcatcaactgtctcat

SEQ ID NO: 873365 - DNA, 25 bp, Mus musculus
tgctctgtataaacaaagcccctgt

SEQ ID NO: 873366 - DNA, 25 bp, Mus musculus
tgctctgtataatcaaagcccctgt

SEQ ID NO: 873367 - DNA, 25 bp, Mus musculus
tgctctgtatgcaaactctaactcc

SEQ ID NO: 873368 - DNA, 25 bp, Mus musculus
tgctctgtatgctaactctaactcc

SEQ ID NO: 873369 - DNA, 25 bp, Mus musculus
tgctctgtatggctacagcacccca

SEQ ID NO: 873370 - DNA, 25 bp, Mus musculus
tgctctgtatgggtacagcacccca

SEQ ID NO: 873371 - DNA, 25 bp, Mus musculus
tgctctgtcaatcatatggtctcac

SEQ ID NO: 873372 - DNA, 25 bp, Mus musculus
tgctctgtcaatgatatggtctcac

SEQ ID NO: 873373 - DNA, 25 bp, Mus musculus
tgctctgtcattactcatctggagt

SEQ ID NO: 873374 - DNA, 25 bp, Mus musculus
tgctctgtcattcaactacactcca

SEQ ID NO: 873375 - DNA, 25 bp, Mus musculus
tgctctgtcattgaactacactcca

SEQ ID NO: 873376 - DNA, 25 bp, Mus musculus
tgctctgtcatttctcatctggagt

SEQ ID NO: 873377 - DNA, 25 bp, Mus musculus
tgctctgtcgctcggcaggcagtac

SEQ ID NO: 873378 - DNA, 25 bp, Mus musculus
tgctctgtcgctgggcaggcagtac

SEQ ID NO: 873379 - DNA, 25 bp, Mus musculus
tgctctgtctctctttatgtcttgc

SEQ ID NO: 873380 - DNA, 25 bp, Mus musculus
tgctctgtctctgtttatgtcttgc

SEQ ID NO: 873381 - DNA, 25 bp, Mus musculus
tgctctgtcttaattctgatcctca

SEQ ID NO: 873382 - DNA, 25 bp, Mus musculus
tgctctgtcttatttctgatcctca

SEQ ID NO: 873383 - DNA, 25 bp, Mus musculus
tgctctgtcttcatttcatcaacta

SEQ ID NO: 873384 - DNA, 25 bp, Mus musculus
tgctctgtcttcttttcatcaacta

SEQ ID NO: 873385 - DNA, 25 bp, Mus musculus
tgctctgtctttatctttaggtccc

SEQ ID NO: 873386 - DNA, 25 bp, Mus musculus
tgctctgtctttttctttaggtccc

SEQ ID NO: 873387 - DNA, 25 bp, Mus musculus
tgctctgtgagcactttcaggaggg

SEQ ID NO: 873388 - DNA, 25 bp, Mus musculus
tgctctgtgagctctttcaggaggg

SEQ ID NO: 873389 - DNA, 25 bp, Mus musculus
tgctctgtgagtaactttccataaa

SEQ ID NO: 873390 - DNA, 25 bp, Mus musculus
tgctctgtgagttactttccataaa

SEQ ID NO: 873391 - DNA, 25 bp, Mus musculus
tgctctgtgataagagattcttagt

SEQ ID NO: 873392 - DNA, 25 bp, Mus musculus
tgctctgtgatatgagattcttagt

SEQ ID NO: 873393 - DNA, 25 bp, Mus musculus
tgctctgtgccaactatgagggaca

SEQ ID NO: 873394 - DNA, 25 bp, Mus musculus
tgctctgtgccactgatgagagagt

SEQ ID NO: 873395 - DNA, 25 bp, Mus musculus
tgctctgtgccagtgatgagagagt

SEQ ID NO: 873396 - DNA, 25 bp, Mus musculus
tgctctgtgccatctatgagggaca

SEQ ID NO: 873397 - DNA, 25 bp, Mus musculus
tgctctgtgcctacggcatgagctc

SEQ ID NO: 873398 - DNA, 25 bp, Mus musculus
tgctctgtgccttcggcatgagctc

SEQ ID NO: 873399 - DNA, 25 bp, Mus musculus
tgctctgtgctacaagtgctcccaa

SEQ ID NO: 873400 - DNA, 25 bp, Mus musculus
tgctctgtgctagaagtgctcccaa

SEQ ID NO: 873401 - DNA, 25 bp, Mus musculus
tgctctgtggaaacaggactttcat

SEQ ID NO: 873402 - DNA, 25 bp, Mus musculus
tgctctgtggaatcaggactttcat

SEQ ID NO: 873403 - DNA, 25 bp, Mus musculus
tgctctgtggagcagtttctacaca

SEQ ID NO: 873404 - DNA, 25 bp, Mus musculus
tgctctgtggaggagtttctacaca

SEQ ID NO: 873405 - DNA, 25 bp, Mus musculus
tgctctgtggcgatcatacgtggga

SEQ ID NO: 873406 - DNA, 25 bp, Mus musculus
tgctctgtggcgttcatacgtggga

SEQ ID NO: 873407 - DNA, 25 bp, Mus musculus
tgctctgtgggaaggtgcagttcaa

SEQ ID NO: 873408 - DNA, 25 bp, Mus musculus
tgctctgtgggatggtgcagttcaa

SEQ ID NO: 873409 - DNA, 25 bp, Mus musculus
tgctctgtggttctgaccttttgtt

SEQ ID NO: 873410 - DNA, 25 bp, Mus musculus
tgctctgtggttgtgaccttttgtt

SEQ ID NO: 873411 - DNA, 25 bp, Mus musculus
tgctctgtgtacaaaccctcattaa

SEQ ID NO: 873412 - DNA, 25 bp, Mus musculus
tgctctgtgtacacttcatcaaagg

SEQ ID NO: 873413 - DNA, 25 bp, Mus musculus
tgctctgtgtacatcaagtctgaca

SEQ ID NO: 873414 - DNA, 25 bp, Mus musculus
tgctctgtgtactaaccctcattaa

SEQ ID NO: 873415 - DNA, 25 bp, Mus musculus
tgctctgtgtactcttcatcaaagg

SEQ ID NO: 873416 - DNA, 25 bp, Mus musculus
tgctctgtgtacttcaagtctgaca

SEQ ID NO: 873417 - DNA, 25 bp, Mus musculus
tgctctgtgtgccaactcaagagag

SEQ ID NO: 873418 - DNA, 25 bp, Mus musculus
tgctctgtgtgcgaactcaagagag

SEQ ID NO: 873419 - DNA, 25 bp, Mus musculus
tgctctgtgtttctgactgaatatc

SEQ ID NO: 873420 - DNA, 25 bp, Mus musculus
tgctctgtgtttgtgactgaatatc

SEQ ID NO: 873421 - DNA, 25 bp, Mus musculus
tgctctgttcacaaaagttcctctt

SEQ ID NO: 873422 - DNA, 25 bp, Mus musculus
tgctctgttcactaaagttcctctt

SEQ ID NO: 873423 - DNA, 25 bp, Mus musculus
tgctctgttgagaccttctaacgat

SEQ ID NO: 873424 - DNA, 25 bp, Mus musculus
tgctctgttgagtccttctaacgat

SEQ ID NO: 873425 - DNA, 25 bp, Mus musculus
tgctcttaaccactttcctactttc

SEQ ID NO: 873426 - DNA, 25 bp, Mus musculus
tgctcttaaccagtttcctactttc

SEQ ID NO: 873427 - DNA, 25 bp, Mus musculus
tgctcttaaggacctcgatgaggac

SEQ ID NO: 873428 - DNA, 25 bp, Mus musculus
tgctcttaaggagctcgatgaggac

SEQ ID NO: 873429 - DNA, 25 bp, Mus musculus
tgctcttaattgcatttcccagcca

SEQ ID NO: 873430 - DNA, 25 bp, Mus musculus
tgctcttaattggatttcccagcca

SEQ ID NO: 873431 - DNA, 25 bp, Mus musculus
tgctcttacagaaggcccgtgttca

SEQ ID NO: 873432 - DNA, 25 bp, Mus musculus
tgctcttacagatggcccgtgttca

SEQ ID NO: 873433 - DNA, 25 bp, Mus musculus
tgctcttacagcatttttcttgaag

SEQ ID NO: 873434 - DNA, 25 bp, Mus musculus
tgctcttacagcttttttcttgaag

SEQ ID NO: 873435 - DNA, 25 bp, Mus musculus
tgctcttagtaacattctccactgc

SEQ ID NO: 873436 - DNA, 25 bp, Mus musculus
tgctcttagtaagattctccactgc

SEQ ID NO: 873437 - DNA, 25 bp, Mus musculus
tgctcttatacaccgagtactttta

SEQ ID NO: 873438 - DNA, 25 bp, Mus musculus
tgctcttatacagcgagtactttta

SEQ ID NO: 873439 - DNA, 25 bp, Mus musculus
tgctcttatcttctgtactgtactg

SEQ ID NO: 873440 - DNA, 25 bp, Mus musculus
tgctcttatcttgtgtactgtactg

SEQ ID NO: 873441 - DNA, 25 bp, Mus musculus
tgctcttatgttagatgcctttgaa

SEQ ID NO: 873442 - DNA, 25 bp, Mus musculus
tgctcttatgtttgatgcctttgaa

SEQ ID NO: 873443 - DNA, 25 bp, Mus musculus
tgctcttcaccacaggaagctctgg

SEQ ID NO: 873444 - DNA, 25 bp, Mus musculus
tgctcttcaccagaggaagctctgg

SEQ ID NO: 873445 - DNA, 25 bp, Mus musculus
tgctcttcactccagaactggctaa

SEQ ID NO: 873446 - DNA, 25 bp, Mus musculus
tgctcttcactcgagaactggctaa

SEQ ID NO: 873447 - DNA, 25 bp, Mus musculus
tgctcttcagagaccgtgcacactg

SEQ ID NO: 873448 - DNA, 25 bp, Mus musculus
tgctcttcagagtccgtgcacactg

SEQ ID NO: 873449 - DNA, 25 bp, Mus musculus
tgctcttcagcaagaaattaatcct

SEQ ID NO: 873450 - DNA, 25 bp, Mus musculus
tgctcttcagcacgctagtggattg

SEQ ID NO: 873451 - DNA, 25 bp, Mus musculus
tgctcttcagcaggctagtggattg

SEQ ID NO: 873452 - DNA, 25 bp, Mus musculus
tgctcttcagcatgaaattaatcct

SEQ ID NO: 873453 - DNA, 25 bp, Mus musculus
tgctcttcagctcacagaatccagt

SEQ ID NO: 873454 - DNA, 25 bp, Mus musculus
tgctcttcagctgacagaatccagt

SEQ ID NO: 873455 - DNA, 25 bp, Mus musculus
tgctcttcagttctgtgctgggcca

SEQ ID NO: 873456 - DNA, 25 bp, Mus musculus
tgctcttcagttgtgtgctgggcca

SEQ ID NO: 873457 - DNA, 25 bp, Mus musculus
tgctcttcatacagagctaccttcc

SEQ ID NO: 873458 - DNA, 25 bp, Mus musculus
tgctcttcatacagttactatttag

SEQ ID NO: 873459 - DNA, 25 bp, Mus musculus
tgctcttcatactgagctaccttcc

SEQ ID NO: 873460 - DNA, 25 bp, Mus musculus
tgctcttcatactgttactatttag

SEQ ID NO: 873461 - DNA, 25 bp, Mus musculus
tgctcttcatcaagctggatcagat

SEQ ID NO: 873462 - DNA, 25 bp, Mus musculus
tgctcttcatcatgctggatcagat

SEQ ID NO: 873463 - DNA, 25 bp, Mus musculus
tgctcttccagcctatgaatacttc

SEQ ID NO: 873464 - DNA, 25 bp, Mus musculus
tgctcttccagcgtatgaatacttc

SEQ ID NO: 873465 - DNA, 25 bp, Mus musculus
tgctcttcctcgactggtatgacag

SEQ ID NO: 873466 - DNA, 25 bp, Mus musculus
tgctcttcctcgtctggtatgacag

SEQ ID NO: 873467 - DNA, 25 bp, Mus musculus
tgctcttcctctcggagtcccaccc

SEQ ID NO: 873468 - DNA, 25 bp, Mus musculus
tgctcttcctctgggagtcccaccc

SEQ ID NO: 873469 - DNA, 25 bp, Mus musculus
tgctcttccttgcacggagacagct

SEQ ID NO: 873470 - DNA, 25 bp, Mus musculus
tgctcttccttggacggagacagct

SEQ ID NO: 873471 - DNA, 25 bp, Mus musculus
tgctcttcgaagacacgctgttgat

SEQ ID NO: 873472 - DNA, 25 bp, Mus musculus
tgctcttcgaagtcacgctgttgat

SEQ ID NO: 873473 - DNA, 25 bp, Mus musculus
tgctcttctatgctgcggacttgaa

SEQ ID NO: 873474 - DNA, 25 bp, Mus musculus
tgctcttctatggtgcggacttgaa

SEQ ID NO: 873475 - DNA, 25 bp, Mus musculus
tgctcttctcaaaacaggtgccaga

SEQ ID NO: 873476 - DNA, 25 bp, Mus musculus
tgctcttctcaatacaggtgccaga

SEQ ID NO: 873477 - DNA, 25 bp, Mus musculus
tgctcttctctcctgtgacaaaggc

SEQ ID NO: 873478 - DNA, 25 bp, Mus musculus
tgctcttctctcgtgtgacaaaggc

SEQ ID NO: 873479 - DNA, 25 bp, Mus musculus
tgctcttctcttcctttgttacctt

SEQ ID NO: 873480 - DNA, 25 bp, Mus musculus
tgctcttctcttgctttgttacctt

SEQ ID NO: 873481 - DNA, 25 bp, Mus musculus
tgctcttctgaacgcagggctctgg

SEQ ID NO: 873482 - DNA, 25 bp, Mus musculus
tgctcttctgaaggcagggctctgg

SEQ ID NO: 873483 - DNA, 25 bp, Mus musculus
tgctcttctgatctcccatacttac

SEQ ID NO: 873484 - DNA, 25 bp, Mus musculus
tgctcttctgatgtcccatacttac

SEQ ID NO: 873485 - DNA, 25 bp, Mus musculus
tgctcttctgcaaccggtattagta

SEQ ID NO: 873486 - DNA, 25 bp, Mus musculus
tgctcttctgcatccggtattagta

SEQ ID NO: 873487 - DNA, 25 bp, Mus musculus
tgctcttctggcatcaagtgtttct

SEQ ID NO: 873488 - DNA, 25 bp, Mus musculus
tgctcttctggcttcaagtgtttct

SEQ ID NO: 873489 - DNA, 25 bp, Mus musculus
tgctcttcttgcctttttgtaatct

SEQ ID NO: 873490 - DNA, 25 bp, Mus musculus
tgctcttcttgcgtttttgtaatct

SEQ ID NO: 873491 - DNA, 25 bp, Mus musculus
tgctcttcttggatctggcacctat

SEQ ID NO: 873492 - DNA, 25 bp, Mus musculus
tgctcttcttggttctggcacctat

SEQ ID NO: 873493 - DNA, 25 bp, Mus musculus
tgctcttcttgtacaagtcccagaa

SEQ ID NO: 873494 - DNA, 25 bp, Mus musculus
tgctcttcttgttcaagtcccagaa

SEQ ID NO: 873495 - DNA, 25 bp, Mus musculus
tgctcttctttcacgaatgtaccag

SEQ ID NO: 873496 - DNA, 25 bp, Mus musculus
tgctcttctttctcgaatgtaccag

SEQ ID NO: 873497 - DNA, 25 bp, Mus musculus
tgctcttgaagcctcaatccggtat

SEQ ID NO: 873498 - DNA, 25 bp, Mus musculus
tgctcttgaagcgtcaatccggtat

SEQ ID NO: 873499 - DNA, 25 bp, Mus musculus
tgctcttgactaaggatatgatgtg

SEQ ID NO: 873500 - DNA, 25 bp, Mus musculus
tgctcttgactatggatatgatgtg

SEQ ID NO: 873501 - DNA, 25 bp, Mus musculus
tgctcttgagatactttacgtctgt

SEQ ID NO: 873502 - DNA, 25 bp, Mus musculus
tgctcttgagattctttacgtctgt

SEQ ID NO: 873503 - DNA, 25 bp, Mus musculus
tgctcttgatttactattctctggg

SEQ ID NO: 873504 - DNA, 25 bp, Mus musculus
tgctcttgattttctattctctggg

SEQ ID NO: 873505 - DNA, 25 bp, Mus musculus
tgctcttgcactcaattgtcatctg

SEQ ID NO: 873506 - DNA, 25 bp, Mus musculus
tgctcttgcactgaattgtcatctg

SEQ ID NO: 873507 - DNA, 25 bp, Mus musculus
tgctcttgcgccctgtcagacaaag

SEQ ID NO: 873508 - DNA, 25 bp, Mus musculus
tgctcttgcgccgtgtcagacaaag

SEQ ID NO: 873509 - DNA, 25 bp, Mus musculus
tgctcttgcgtccagaaacagttat

SEQ ID NO: 873510 - DNA, 25 bp, Mus musculus
tgctcttgcgtcgagaaacagttat

SEQ ID NO: 873511 - DNA, 25 bp, Mus musculus
tgctcttgctctatgatccggtgga

SEQ ID NO: 873512 - DNA, 25 bp, Mus musculus
tgctcttgctctttgatccggtgga

SEQ ID NO: 873513 - DNA, 25 bp, Mus musculus
tgctcttggagcacagaaggttacc

SEQ ID NO: 873514 - DNA, 25 bp, Mus musculus
tgctcttggagctcagaaggttacc

SEQ ID NO: 873515 - DNA, 25 bp, Mus musculus
tgctcttggcatcaagttgttcttc

SEQ ID NO: 873516 - DNA, 25 bp, Mus musculus
tgctcttggcatgaagttgttcttc

SEQ ID NO: 873517 - DNA, 25 bp, Mus musculus
tgctcttggctgctgtactggataa

SEQ ID NO: 873518 - DNA, 25 bp, Mus musculus
tgctcttggctggtgtactggataa

SEQ ID NO: 873519 - DNA, 25 bp, Mus musculus
tgctcttgggccatgcttcagtcaa

SEQ ID NO: 873520 - DNA, 25 bp, Mus musculus
tgctcttgggccttgcttcagtcaa

SEQ ID NO: 873521 - DNA, 25 bp, Mus musculus
tgctcttgggtaatctgggtgctgc

SEQ ID NO: 873522 - DNA, 25 bp, Mus musculus
tgctcttgggtattctgggtgctgc

SEQ ID NO: 873523 - DNA, 25 bp, Mus musculus
tgctcttggtggagggtctcctgaa

SEQ ID NO: 873524 - DNA, 25 bp, Mus musculus
tgctcttggtggtgggtctcctgaa

SEQ ID NO: 873525 - DNA, 25 bp, Mus musculus
tgctcttggttacctggaggacctg

SEQ ID NO: 873526 - DNA, 25 bp, Mus musculus
tgctcttggttagctggaggacctg

SEQ ID NO: 873527 - DNA, 25 bp, Mus musculus
tgctcttgtactatccagtgacttc

SEQ ID NO: 873528 - DNA, 25 bp, Mus musculus
tgctcttgtactttccagtgacttc

SEQ ID NO: 873529 - DNA, 25 bp, Mus musculus
tgctcttgtagaagacctgggtcct

SEQ ID NO: 873530 - DNA, 25 bp, Mus musculus
tgctcttgtagatgacctgggtcct

SEQ ID NO: 873531 - DNA, 25 bp, Mus musculus
tgctcttgtgagagttgctgactaa

SEQ ID NO: 873532 - DNA, 25 bp, Mus musculus
tgctcttgtgagtgttgctgactaa

SEQ ID NO: 873533 - DNA, 25 bp, Mus musculus
tgctcttgtgcaccgagccattcct

SEQ ID NO: 873534 - DNA, 25 bp, Mus musculus
tgctcttgtgcagcgagccattcct

SEQ ID NO: 873535 - DNA, 25 bp, Mus musculus
tgctcttgttcaatcaggacctgcc

SEQ ID NO: 873536 - DNA, 25 bp, Mus musculus
tgctcttgttcattcaggacctgcc

SEQ ID NO: 873537 - DNA, 25 bp, Mus musculus
tgctcttgttcgagtgcagctgact

SEQ ID NO: 873538 - DNA, 25 bp, Mus musculus
tgctcttgttcgtgtgcagctgact

SEQ ID NO: 873539 - DNA, 25 bp, Mus musculus
tgctcttgttgactggtgcacacat

SEQ ID NO: 873540 - DNA, 25 bp, Mus musculus
tgctcttgttgagtggtgcacacat

SEQ ID NO: 873541 - DNA, 25 bp, Mus musculus
tgctctttacccagtctcattgctt

SEQ ID NO: 873542 - DNA, 25 bp, Mus musculus
tgctctttaccctgtctcattgctt

SEQ ID NO: 873543 - DNA, 25 bp, Mus musculus
tgctctttcagcaaggtcagcagag

SEQ ID NO: 873544 - DNA, 25 bp, Mus musculus
tgctctttcagctaggtcagcagag

SEQ ID NO: 873545 - DNA, 25 bp, Mus musculus
tgctctttccatatctgtctttagt

SEQ ID NO: 873546 - DNA, 25 bp, Mus musculus
tgctctttccatttctgtctttagt

SEQ ID NO: 873547 - DNA, 25 bp, Mus musculus
tgctctttcctcctggctatattat

SEQ ID NO: 873548 - DNA, 25 bp, Mus musculus
tgctctttcctcgtggctatattat

SEQ ID NO: 873549 - DNA, 25 bp, Mus musculus
tgctctttcgcaactggccttggaa

SEQ ID NO: 873550 - DNA, 25 bp, Mus musculus
tgctctttcgcatctggccttggaa

SEQ ID NO: 873551 - DNA, 25 bp, Mus musculus
tgctctttctaaagttacttataac

SEQ ID NO: 873552 - DNA, 25 bp, Mus musculus
tgctctttctaatgttacttataac

SEQ ID NO: 873553 - DNA, 25 bp, Mus musculus
tgctctttctatcccaagccgaaga

SEQ ID NO: 873554 - DNA, 25 bp, Mus musculus
tgctctttctatgccaagccgaaga

SEQ ID NO: 873555 - DNA, 25 bp, Mus musculus
tgctctttctctaagtgccacaaat

SEQ ID NO: 873556 - DNA, 25 bp, Mus musculus
tgctctttctcttagtgccacaaat

SEQ ID NO: 873557 - DNA, 25 bp, Mus musculus
tgctctttctttcctgaggaagaga

SEQ ID NO: 873558 - DNA, 25 bp, Mus musculus
tgctctttctttgctgaggaagaga

SEQ ID NO: 873559 - DNA, 25 bp, Mus musculus
tgctctttgagcaacaaactacggg

SEQ ID NO: 873560 - DNA, 25 bp, Mus musculus
tgctctttgagctacaaactacggg

SEQ ID NO: 873561 - DNA, 25 bp, Mus musculus
tgctctttgcaactgaccggctaca

SEQ ID NO: 873562 - DNA, 25 bp, Mus musculus
tgctctttgcaagtgaccggctaca

SEQ ID NO: 873563 - DNA, 25 bp, Mus musculus
tgctctttgcccaagaaaacagttc

SEQ ID NO: 873564 - DNA, 25 bp, Mus musculus
tgctctttgccctagaaaacagttc

SEQ ID NO: 873565 - DNA, 25 bp, Mus musculus
tgctctttggcaatttcttgtacat

SEQ ID NO: 873566 - DNA, 25 bp, Mus musculus
tgctctttggcattttcttgtacat

SEQ ID NO: 873567 - DNA, 25 bp, Mus musculus
tgctctttggtgctttcaactcatt

SEQ ID NO: 873568 - DNA, 25 bp, Mus musculus
tgctctttggtggtttcaactcatt

SEQ ID NO: 873569 - DNA, 25 bp, Mus musculus
tgctctttgtcaactgcctcagata

SEQ ID NO: 873570 - DNA, 25 bp, Mus musculus
tgctctttgtcatctgcctcagata

SEQ ID NO: 873571 - DNA, 25 bp, Mus musculus
tgctcttttattaaggccccatagt

SEQ ID NO: 873572 - DNA, 25 bp, Mus musculus
tgctcttttatttaggccccatagt

SEQ ID NO: 873573 - DNA, 25 bp, Mus musculus
tgctcttttcacacgactccctaaa

SEQ ID NO: 873574 - DNA, 25 bp, Mus musculus
tgctcttttcactcgactccctaaa

SEQ ID NO: 873575 - DNA, 25 bp, Mus musculus
tgctcttttcctcattcgaatgctt

SEQ ID NO: 873576 - DNA, 25 bp, Mus musculus
tgctcttttcctgattcgaatgctt

SEQ ID NO: 873577 - DNA, 25 bp, Mus musculus
tgctcttttctgatgtgagacaatt

SEQ ID NO: 873578 - DNA, 25 bp, Mus musculus
tgctcttttctgttgtgagacaatt

SEQ ID NO: 873579 - DNA, 25 bp, Mus musculus
tgctcttttcttccttaccaaccaa

SEQ ID NO: 873580 - DNA, 25 bp, Mus musculus
tgctcttttcttgcttaccaaccaa

SEQ ID NO: 873581 - DNA, 25 bp, Mus musculus
tgctcttttgccctaatctacttta

SEQ ID NO: 873582 - DNA, 25 bp, Mus musculus
tgctcttttgccgtaatctacttta

SEQ ID NO: 873583 - DNA, 25 bp, Mus musculus
tgctctttttcgaaatccattccag

SEQ ID NO: 873584 - DNA, 25 bp, Mus musculus
tgctctttttcgtaatccattccag

SEQ ID NO: 873585 - DNA, 25 bp, Mus musculus
tgctgaaaaagacaactggcctggt

SEQ ID NO: 873586 - DNA, 25 bp, Mus musculus
tgctgaaaaagagaactggcctggt

SEQ ID NO: 873587 - DNA, 25 bp, Mus musculus
tgctgaaaacacacatttacacaca

SEQ ID NO: 873588 - DNA, 25 bp, Mus musculus
tgctgaaaacactcatttacacaca

SEQ ID NO: 873589 - DNA, 25 bp, Mus musculus
tgctgaaaagcaaggtgctggtaac

SEQ ID NO: 873590 - DNA, 25 bp, Mus musculus
tgctgaaaagcatggtgctggtaac

SEQ ID NO: 873591 - DNA, 25 bp, Mus musculus
tgctgaaataacataggcgtgccaa

SEQ ID NO: 873592 - DNA, 25 bp, Mus musculus
tgctgaaataacttaggcgtgccaa

SEQ ID NO: 873593 - DNA, 25 bp, Mus musculus
tgctgaaatcaacgtcatgacggtt

SEQ ID NO: 873594 - DNA, 25 bp, Mus musculus
tgctgaaatcaaggtcatgacggtt

SEQ ID NO: 873595 - DNA, 25 bp, Mus musculus
tgctgaacacacaccatgtgaacaa

SEQ ID NO: 873596 - DNA, 25 bp, Mus musculus
tgctgaacacactccatgtgaacaa

SEQ ID NO: 873597 - DNA, 25 bp, Mus musculus
tgctgaacagcacagtggtttctct

SEQ ID NO: 873598 - DNA, 25 bp, Mus musculus
tgctgaacagcagagtggtttctct

SEQ ID NO: 873599 - DNA, 25 bp, Mus musculus
tgctgaacatcaagacccgcctgga

SEQ ID NO: 873600 - DNA, 25 bp, Mus musculus
tgctgaacatcatgacccgcctgga

SEQ ID NO: 873601 - DNA, 25 bp, Mus musculus
tgctgaaccattcaaggcacagtta

SEQ ID NO: 873602 - DNA, 25 bp, Mus musculus
tgctgaaccattgaaggcacagtta

SEQ ID NO: 873603 - DNA, 25 bp, Mus musculus
tgctgaacccgacgcgcactgagga

SEQ ID NO: 873604 - DNA, 25 bp, Mus musculus
tgctgaacccgaggcgcactgagga

SEQ ID NO: 873605 - DNA, 25 bp, Mus musculus
tgctgaaccgtcatgatagcccata

SEQ ID NO: 873606 - DNA, 25 bp, Mus musculus
tgctgaaccgtcttgatagcccata

SEQ ID NO: 873607 - DNA, 25 bp, Mus musculus
tgctgaaccttgagggcactgacct

SEQ ID NO: 873608 - DNA, 25 bp, Mus musculus
tgctgaaccttgtgggcactgacct

SEQ ID NO: 873609 - DNA, 25 bp, Mus musculus
tgctgaacgagcatcgctgcagagc

SEQ ID NO: 873610 - DNA, 25 bp, Mus musculus
tgctgaacgagcttcgctgcagagc

SEQ ID NO: 873611 - DNA, 25 bp, Mus musculus
tgctgaacgcctcgactaactgcat

SEQ ID NO: 873612 - DNA, 25 bp, Mus musculus
tgctgaacgcctggactaactgcat

SEQ ID NO: 873613 - DNA, 25 bp, Mus musculus
tgctgaactagcaactgggtctttc

SEQ ID NO: 873614 - DNA, 25 bp, Mus musculus
tgctgaactagctactgggtctttc

SEQ ID NO: 873615 - DNA, 25 bp, Mus musculus
tgctgaactataactgccacacgtc

SEQ ID NO: 873616 - DNA, 25 bp, Mus musculus
tgctgaactatatctgccacacgtc

SEQ ID NO: 873617 - DNA, 25 bp, Mus musculus
tgctgaactatcactccagcctttt

SEQ ID NO: 873618 - DNA, 25 bp, Mus musculus
tgctgaactatctctccagcctttt

SEQ ID NO: 873619 - DNA, 25 bp, Mus musculus
tgctgaactcagagcttccatggga

SEQ ID NO: 873620 - DNA, 25 bp, Mus musculus
tgctgaactcagtgcttccatggga

SEQ ID NO: 873621 - DNA, 25 bp, Mus musculus
tgctgaacttgactgccacgcgctg

SEQ ID NO: 873622 - DNA, 25 bp, Mus musculus
tgctgaacttgagtgccacgcgctg

SEQ ID NO: 873623 - DNA, 25 bp, Mus musculus
tgctgaactttcacggcagagtcac

SEQ ID NO: 873624 - DNA, 25 bp, Mus musculus
tgctgaactttctcggcagagtcac

SEQ ID NO: 873625 - DNA, 25 bp, Mus musculus
tgctgaagaactattccagtccctt

SEQ ID NO: 873626 - DNA, 25 bp, Mus musculus
tgctgaagaacttttccagtccctt

SEQ ID NO: 873627 - DNA, 25 bp, Mus musculus
tgctgaagaagcaactctcggattc

SEQ ID NO: 873628 - DNA, 25 bp, Mus musculus
tgctgaagaagctactctcggattc

SEQ ID NO: 873629 - DNA, 25 bp, Mus musculus
tgctgaagacagaagtaggattact

SEQ ID NO: 873630 - DNA, 25 bp, Mus musculus
tgctgaagacagtagtaggattact

SEQ ID NO: 873631 - DNA, 25 bp, Mus musculus
tgctgaagactgatccctgggagta

SEQ ID NO: 873632 - DNA, 25 bp, Mus musculus
tgctgaagactgttccctgggagta

SEQ ID NO: 873633 - DNA, 25 bp, Mus musculus
tgctgaagagctatccacatataag

SEQ ID NO: 873634 - DNA, 25 bp, Mus musculus
tgctgaagagctttccacatataag

SEQ ID NO: 873635 - DNA, 25 bp, Mus musculus
tgctgaagccagacaaagagatcgt

SEQ ID NO: 873636 - DNA, 25 bp, Mus musculus
tgctgaagccagtcaaagagatcgt

SEQ ID NO: 873637 - DNA, 25 bp, Mus musculus
tgctgaagccatactctatactttt

SEQ ID NO: 873638 - DNA, 25 bp, Mus musculus
tgctgaagccattctctatactttt

SEQ ID NO: 873639 - DNA, 25 bp, Mus musculus
tgctgaagctctccctgctacaggg

SEQ ID NO: 873640 - DNA, 25 bp, Mus musculus
tgctgaagctctcgtgactgcacac

SEQ ID NO: 873641 - DNA, 25 bp, Mus musculus
tgctgaagctctgcctgctacaggg

SEQ ID NO: 873642 - DNA, 25 bp, Mus musculus
tgctgaagctctggtgactgcacac

SEQ ID NO: 873643 - DNA, 25 bp, Mus musculus
tgctgaagctgtcactcctgcaggc

SEQ ID NO: 873644 - DNA, 25 bp, Mus musculus
tgctgaagctgtgactcctgcaggc

SEQ ID NO: 873645 - DNA, 25 bp, Mus musculus
tgctgaaggagaaaccccagtgcct

SEQ ID NO: 873646 - DNA, 25 bp, Mus musculus
tgctgaaggagataccccagtgcct

SEQ ID NO: 873647 - DNA, 25 bp, Mus musculus
tgctgaagggcaatggccgccgcat

SEQ ID NO: 873648 - DNA, 25 bp, Mus musculus
tgctgaagggcattggccgccgcat

SEQ ID NO: 873649 - DNA, 25 bp, Mus musculus
tgctgaaggtgcagttcctggtgct

SEQ ID NO: 873650 - DNA, 25 bp, Mus musculus
tgctgaaggtgctgttcctggtgct

SEQ ID NO: 873651 - DNA, 25 bp, Mus musculus
tgctgaaggtgtataatcacttaaa

SEQ ID NO: 873652 - DNA, 25 bp, Mus musculus
tgctgaaggtgtttaatcacttaaa

SEQ ID NO: 873653 - DNA, 25 bp, Mus musculus
tgctgaagtacaagtgccacacgat

SEQ ID NO: 873654 - DNA, 25 bp, Mus musculus
tgctgaagtacatgtgccacacgat

SEQ ID NO: 873655 - DNA, 25 bp, Mus musculus
tgctgaagtagacaagtgcttggca

SEQ ID NO: 873656 - DNA, 25 bp, Mus musculus
tgctgaagtagagaagtgcttggca

SEQ ID NO: 873657 - DNA, 25 bp, Mus musculus
tgctgaagtcacatcttcacttcca

SEQ ID NO: 873658 - DNA, 25 bp, Mus musculus
tgctgaagtcacttcttcacttcca

SEQ ID NO: 873659 - DNA, 25 bp, Mus musculus
tgctgaataacaacttgcccacaac

SEQ ID NO: 873660 - DNA, 25 bp, Mus musculus
tgctgaataacatcttgcccacaac

SEQ ID NO: 873661 - DNA, 25 bp, Mus musculus
tgctgaatcaccaagtatgttgctg

SEQ ID NO: 873662 - DNA, 25 bp, Mus musculus
tgctgaatcacctagtatgttgctg

SEQ ID NO: 873663 - DNA, 25 bp, Mus musculus
tgctgaatcacgcagccctcttaca

SEQ ID NO: 873664 - DNA, 25 bp, Mus musculus
tgctgaatcacggagccctcttaca

SEQ ID NO: 873665 - DNA, 25 bp, Mus musculus
tgctgaatccttagggcttttcttc

SEQ ID NO: 873666 - DNA, 25 bp, Mus musculus
tgctgaatcctttgggcttttcttc

SEQ ID NO: 873667 - DNA, 25 bp, Mus musculus
tgctgaatctgaatgtggctcccct

SEQ ID NO: 873668 - DNA, 25 bp, Mus musculus
tgctgaatctgattgtggctcccct

SEQ ID NO: 873669 - DNA, 25 bp, Mus musculus
tgctgaatctgtcttccaggagctg

SEQ ID NO: 873670 - DNA, 25 bp, Mus musculus
tgctgaatctgtgttccaggagctg

SEQ ID NO: 873671 - DNA, 25 bp, Mus musculus
tgctgaatgaaacccaccttccttt

SEQ ID NO: 873672 - DNA, 25 bp, Mus musculus
tgctgaatgaaagccaccttccttt

SEQ ID NO: 873673 - DNA, 25 bp, Mus musculus
tgctgaatgtccatgctcttcccaa

SEQ ID NO: 873674 - DNA, 25 bp, Mus musculus
tgctgaatgtccttgctcttcccaa

SEQ ID NO: 873675 - DNA, 25 bp, Mus musculus
tgctgaatgtttccctgtcttgaga

SEQ ID NO: 873676 - DNA, 25 bp, Mus musculus
tgctgaatgtttgcctgtcttgaga

SEQ ID NO: 873677 - DNA, 25 bp, Mus musculus
tgctgaattaccatctcccttaaat

SEQ ID NO: 873678 - DNA, 25 bp, Mus musculus
tgctgaattaccttctcccttaaat

SEQ ID NO: 873679 - DNA, 25 bp, Mus musculus
tgctgaattcaaccctaactactac

SEQ ID NO: 873680 - DNA, 25 bp, Mus musculus
tgctgaattcaagcctaactactac

SEQ ID NO: 873681 - DNA, 25 bp, Mus musculus
tgctgaattgctaccatcactgcag

SEQ ID NO: 873682 - DNA, 25 bp, Mus musculus
tgctgaattgcttccatcactgcag

SEQ ID NO: 873683 - DNA, 25 bp, Mus musculus
tgctgaattggaagcctacatggca

SEQ ID NO: 873684 - DNA, 25 bp, Mus musculus
tgctgaattggatgcctacatggca

SEQ ID NO: 873685 - DNA, 25 bp, Mus musculus
tgctgacaactgcagtctccagtta

SEQ ID NO: 873686 - DNA, 25 bp, Mus musculus
tgctgacaactggagtctccagtta

SEQ ID NO: 873687 - DNA, 25 bp, Mus musculus
tgctgacaagccctacatcgaggag

SEQ ID NO: 873688 - DNA, 25 bp, Mus musculus
tgctgacaagccgtacatcgaggag

SEQ ID NO: 873689 - DNA, 25 bp, Mus musculus
tgctgacacaccatgctaggaatga

SEQ ID NO: 873690 - DNA, 25 bp, Mus musculus
tgctgacacaccttgctaggaatga

SEQ ID NO: 873691 - DNA, 25 bp, Mus musculus
tgctgacaccatctctggagcttcg

SEQ ID NO: 873692 - DNA, 25 bp, Mus musculus
tgctgacaccatgtctggagcttcg

SEQ ID NO: 873693 - DNA, 25 bp, Mus musculus
tgctgacactgtaggtctctactgt

SEQ ID NO: 873694 - DNA, 25 bp, Mus musculus
tgctgacactgttggtctctactgt

SEQ ID NO: 873695 - DNA, 25 bp, Mus musculus
tgctgacagatacaccagagcccag

SEQ ID NO: 873696 - DNA, 25 bp, Mus musculus
tgctgacagatagaccagagcccag

SEQ ID NO: 873697 - DNA, 25 bp, Mus musculus
tgctgacagccaatcacaagtggga

SEQ ID NO: 873698 - DNA, 25 bp, Mus musculus
tgctgacagccattcacaagtggga

SEQ ID NO: 873699 - DNA, 25 bp, Mus musculus
tgctgacagcccaggatctatccct

SEQ ID NO: 873700 - DNA, 25 bp, Mus musculus
tgctgacagcccattggatgattat

SEQ ID NO: 873701 - DNA, 25 bp, Mus musculus
tgctgacagccctggatctatccct

SEQ ID NO: 873702 - DNA, 25 bp, Mus musculus
tgctgacagccctttggatgattat

SEQ ID NO: 873703 - DNA, 25 bp, Mus musculus
tgctgacagcttaacgagccttaga

SEQ ID NO: 873704 - DNA, 25 bp, Mus musculus
tgctgacagctttacgagccttaga

SEQ ID NO: 873705 - DNA, 25 bp, Mus musculus
tgctgacaggaacacctggatctca

SEQ ID NO: 873706 - DNA, 25 bp, Mus musculus
tgctgacaggaagacctggatctca

SEQ ID NO: 873707 - DNA, 25 bp, Mus musculus
tgctgacaggagcttatgcagtgct

SEQ ID NO: 873708 - DNA, 25 bp, Mus musculus
tgctgacaggaggttatgcagtgct

SEQ ID NO: 873709 - DNA, 25 bp, Mus musculus
tgctgacaggttcctgacccttctg

SEQ ID NO: 873710 - DNA, 25 bp, Mus musculus
tgctgacaggttgctgacccttctg

SEQ ID NO: 873711 - DNA, 25 bp, Mus musculus
tgctgacagtgtctcccggtgctga

SEQ ID NO: 873712 - DNA, 25 bp, Mus musculus
tgctgacagtgtgtcccggtgctga

SEQ ID NO: 873713 - DNA, 25 bp, Mus musculus
tgctgacataataccatttctgatc

SEQ ID NO: 873714 - DNA, 25 bp, Mus musculus
tgctgacataattccatttctgatc

SEQ ID NO: 873715 - DNA, 25 bp, Mus musculus
tgctgacatgcacatacgcacacgc

SEQ ID NO: 873716 - DNA, 25 bp, Mus musculus
tgctgacatgcagatacgcacacgc

SEQ ID NO: 873717 - DNA, 25 bp, Mus musculus
tgctgacatggacgcagttgatgct

SEQ ID NO: 873718 - DNA, 25 bp, Mus musculus
tgctgacatggaggcagttgatgct

SEQ ID NO: 873719 - DNA, 25 bp, Mus musculus
tgctgacatgttactgctctagatt

SEQ ID NO: 873720 - DNA, 25 bp, Mus musculus
tgctgacatgtttctgctctagatt

SEQ ID NO: 873721 - DNA, 25 bp, Mus musculus
tgctgacattacaggcatgcctgtg

SEQ ID NO: 873722 - DNA, 25 bp, Mus musculus
tgctgacattactggcatgcctgtg

SEQ ID NO: 873723 - DNA, 25 bp, Mus musculus
tgctgacattgtcatctgggaccca

SEQ ID NO: 873724 - DNA, 25 bp, Mus musculus
tgctgacattgtgatctgggaccca

SEQ ID NO: 873725 - DNA, 25 bp, Mus musculus
tgctgaccacatctcacactggaaa

SEQ ID NO: 873726 - DNA, 25 bp, Mus musculus
tgctgaccacatgtcacactggaaa

SEQ ID NO: 873727 - DNA, 25 bp, Mus musculus
tgctgaccactactgtactggagga

SEQ ID NO: 873728 - DNA, 25 bp, Mus musculus
tgctgaccactagtgtactggagga

SEQ ID NO: 873729 - DNA, 25 bp, Mus musculus
tgctgaccactcctgttttaagaac

SEQ ID NO: 873730 - DNA, 25 bp, Mus musculus
tgctgaccactcgtgttttaagaac

SEQ ID NO: 873731 - DNA, 25 bp, Mus musculus
tgctgaccagcaacctgtttcctca

SEQ ID NO: 873732 - DNA, 25 bp, Mus musculus
tgctgaccagcatcctgtttcctca

SEQ ID NO: 873733 - DNA, 25 bp, Mus musculus
tgctgaccatcaagtgcctgctgat

SEQ ID NO: 873734 - DNA, 25 bp, Mus musculus
tgctgaccatcacgtcctgtcatta

SEQ ID NO: 873735 - DNA, 25 bp, Mus musculus
tgctgaccatcaggtcctgtcatta

SEQ ID NO: 873736 - DNA, 25 bp, Mus musculus
tgctgaccatcatgtgcctgctgat

SEQ ID NO: 873737 - DNA, 25 bp, Mus musculus
tgctgacccagcactgaatgaactc

SEQ ID NO: 873738 - DNA, 25 bp, Mus musculus
tgctgacccagctctgaatgaactc

SEQ ID NO: 873739 - DNA, 25 bp, Mus musculus
tgctgaccccagagcaggcccgtat

SEQ ID NO: 873740 - DNA, 25 bp, Mus musculus
tgctgaccccagtgcaggcccgtat

SEQ ID NO: 873741 - DNA, 25 bp, Mus musculus
tgctgaccctagctcagactggaat

SEQ ID NO: 873742 - DNA, 25 bp, Mus musculus
tgctgaccctaggtcagactggaat

SEQ ID NO: 873743 - DNA, 25 bp, Mus musculus
tgctgaccctcaagaactgcgtgat

SEQ ID NO: 873744 - DNA, 25 bp, Mus musculus
tgctgaccctcatgaactgcgtgat

SEQ ID NO: 873745 - DNA, 25 bp, Mus musculus
tgctgaccgagaacgaactgcaccg

SEQ ID NO: 873746 - DNA, 25 bp, Mus musculus
tgctgaccgagacggccaagctgct

SEQ ID NO: 873747 - DNA, 25 bp, Mus musculus
tgctgaccgagagggccaagctgct

SEQ ID NO: 873748 - DNA, 25 bp, Mus musculus
tgctgaccgagatcgaactgcaccg

SEQ ID NO: 873749 - DNA, 25 bp, Mus musculus
tgctgaccgctgaggcaagctgaaa

SEQ ID NO: 873750 - DNA, 25 bp, Mus musculus
tgctgaccgctgtggcaagctgaaa

SEQ ID NO: 873751 - DNA, 25 bp, Mus musculus
tgctgacctcaactcacaagagatc

SEQ ID NO: 873752 - DNA, 25 bp, Mus musculus
tgctgacctcaagtcacaagagatc

SEQ ID NO: 873753 - DNA, 25 bp, Mus musculus
tgctgacctcacattagaactctga

SEQ ID NO: 873754 - DNA, 25 bp, Mus musculus
tgctgacctcactttagaactctga

SEQ ID NO: 873755 - DNA, 25 bp, Mus musculus
tgctgacctcggagtactgtgcagt

SEQ ID NO: 873756 - DNA, 25 bp, Mus musculus
tgctgacctcggtgtactgtgcagt

SEQ ID NO: 873757 - DNA, 25 bp, Mus musculus
tgctgacctgaaataccatctttcc

SEQ ID NO: 873758 - DNA, 25 bp, Mus musculus
tgctgacctgaattaccatctttcc

SEQ ID NO: 873759 - DNA, 25 bp, Mus musculus
tgctgacctgataatgctcccacta

SEQ ID NO: 873760 - DNA, 25 bp, Mus musculus
tgctgacctgattatgctcccacta

SEQ ID NO: 873761 - DNA, 25 bp, Mus musculus
tgctgacctgctactaagggtttag

SEQ ID NO: 873762 - DNA, 25 bp, Mus musculus
tgctgacctgctccatttcttttat

SEQ ID NO: 873763 - DNA, 25 bp, Mus musculus
tgctgacctgctgcatttcttttat

SEQ ID NO: 873764 - DNA, 25 bp, Mus musculus
tgctgacctgcttctaagggtttag

SEQ ID NO: 873765 - DNA, 25 bp, Mus musculus
tgctgacctggcagtatcttaaagg

SEQ ID NO: 873766 - DNA, 25 bp, Mus musculus
tgctgacctggccacgaagaacatg

SEQ ID NO: 873767 - DNA, 25 bp, Mus musculus
tgctgacctggcgacgaagaacatg

SEQ ID NO: 873768 - DNA, 25 bp, Mus musculus
tgctgacctggctgtatcttaaagg

SEQ ID NO: 873769 - DNA, 25 bp, Mus musculus
tgctgacctgtgactcctgggatgc

SEQ ID NO: 873770 - DNA, 25 bp, Mus musculus
tgctgacctgtgtctcctgggatgc

SEQ ID NO: 873771 - DNA, 25 bp, Mus musculus
tgctgacctttcaggccatggagtg

SEQ ID NO: 873772 - DNA, 25 bp, Mus musculus
tgctgacctttctggccatggagtg

SEQ ID NO: 873773 - DNA, 25 bp, Mus musculus
tgctgacgaggcctgtgtcacagac

SEQ ID NO: 873774 - DNA, 25 bp, Mus musculus
tgctgacgaggcgtgtgtcacagac

SEQ ID NO: 873775 - DNA, 25 bp, Mus musculus
tgctgacgatccactcacagacgag

SEQ ID NO: 873776 - DNA, 25 bp, Mus musculus
tgctgacgatcctctcacagacgag

SEQ ID NO: 873777 - DNA, 25 bp, Mus musculus
tgctgacgccagaaatggtccaagt

SEQ ID NO: 873778 - DNA, 25 bp, Mus musculus
tgctgacgccagtaatggtccaagt

SEQ ID NO: 873779 - DNA, 25 bp, Mus musculus
tgctgacggtcaatctgtccagtga

SEQ ID NO: 873780 - DNA, 25 bp, Mus musculus
tgctgacggtcattctgtccagtga

SEQ ID NO: 873781 - DNA, 25 bp, Mus musculus
tgctgactaaacaaacccaagtaat

SEQ ID NO: 873782 - DNA, 25 bp, Mus musculus
tgctgactaaactaacccaagtaat

SEQ ID NO: 873783 - DNA, 25 bp, Mus musculus
tgctgactaacgctccgccgcgagg

SEQ ID NO: 873784 - DNA, 25 bp, Mus musculus
tgctgactaacggtccgccgcgagg

SEQ ID NO: 873785 - DNA, 25 bp, Mus musculus
tgctgactaagcatccctctgagga

SEQ ID NO: 873786 - DNA, 25 bp, Mus musculus
tgctgactaagcttccctctgagga

SEQ ID NO: 873787 - DNA, 25 bp, Mus musculus
tgctgactaagtccttttgtggcta

SEQ ID NO: 873788 - DNA, 25 bp, Mus musculus
tgctgactaagtgcttttgtggcta

SEQ ID NO: 873789 - DNA, 25 bp, Mus musculus
tgctgactacaaaccccaggacggg

SEQ ID NO: 873790 - DNA, 25 bp, Mus musculus
tgctgactacaatccccaggacggg

SEQ ID NO: 873791 - DNA, 25 bp, Mus musculus
tgctgactacatatgctgtctcaag

SEQ ID NO: 873792 - DNA, 25 bp, Mus musculus
tgctgactacatttgctgtctcaag

SEQ ID NO: 873793 - DNA, 25 bp, Mus musculus
tgctgactcaggcaacgtcgattta

SEQ ID NO: 873794 - DNA, 25 bp, Mus musculus
tgctgactcagggaacgtcgattta

SEQ ID NO: 873795 - DNA, 25 bp, Mus musculus
tgctgactcccaagtggcaggcaga

SEQ ID NO: 873796 - DNA, 25 bp, Mus musculus
tgctgactcccatgtggcaggcaga

SEQ ID NO: 873797 - DNA, 25 bp, Mus musculus
tgctgactccccagtgagtctgaat

SEQ ID NO: 873798 - DNA, 25 bp, Mus musculus
tgctgactcccctgtgagtctgaat

SEQ ID NO: 873799 - DNA, 25 bp, Mus musculus
tgctgactccttagcacttcttcaa

SEQ ID NO: 873800 - DNA, 25 bp, Mus musculus
tgctgactcctttgcacttcttcaa

SEQ ID NO: 873801 - DNA, 25 bp, Mus musculus
tgctgactcgaaatgctattttgta

SEQ ID NO: 873802 - DNA, 25 bp, Mus musculus
tgctgactcgaattgctattttgta

SEQ ID NO: 873803 - DNA, 25 bp, Mus musculus
tgctgactgctcataatgccactct

SEQ ID NO: 873804 - DNA, 25 bp, Mus musculus
tgctgactgctcttaatgccactct

SEQ ID NO: 873805 - DNA, 25 bp, Mus musculus
tgctgactggtcagtgattttgtac

SEQ ID NO: 873806 - DNA, 25 bp, Mus musculus
tgctgactggtctgtgattttgtac

SEQ ID NO: 873807 - DNA, 25 bp, Mus musculus
tgctgactgttcatgcacttgaaat

SEQ ID NO: 873808 - DNA, 25 bp, Mus musculus
tgctgactgttcttgcacttgaaat

SEQ ID NO: 873809 - DNA, 25 bp, Mus musculus
tgctgacttcacattaagacctagg

SEQ ID NO: 873810 - DNA, 25 bp, Mus musculus
tgctgacttcactttaagacctagg

SEQ ID NO: 873811 - DNA, 25 bp, Mus musculus
tgctgacttcctacctgtattataa

SEQ ID NO: 873812 - DNA, 25 bp, Mus musculus
tgctgacttccttcctgtattataa

SEQ ID NO: 873813 - DNA, 25 bp, Mus musculus
tgctgacttttcagttgacgtttac

SEQ ID NO: 873814 - DNA, 25 bp, Mus musculus
tgctgacttttctgttgacgtttac

SEQ ID NO: 873815 - DNA, 25 bp, Mus musculus
tgctgagaactaaggtagaccatct

SEQ ID NO: 873816 - DNA, 25 bp, Mus musculus
tgctgagaactatggtagaccatct

SEQ ID NO: 873817 - DNA, 25 bp, Mus musculus
tgctgagaacttctatcatgcttta

SEQ ID NO: 873818 - DNA, 25 bp, Mus musculus
tgctgagaacttgtatcatgcttta

SEQ ID NO: 873819 - DNA, 25 bp, Mus musculus
tgctgagaagcaagaaagacacaca

SEQ ID NO: 873820 - DNA, 25 bp, Mus musculus
tgctgagaagcatgaaagacacaca

SEQ ID NO: 873821 - DNA, 25 bp, Mus musculus
tgctgagaagctctcaggcgccaca

SEQ ID NO: 873822 - DNA, 25 bp, Mus musculus
tgctgagaagctgtcaggcgccaca

SEQ ID NO: 873823 - DNA, 25 bp, Mus musculus
tgctgagaatgaaaccaacgaggtc

SEQ ID NO: 873824 - DNA, 25 bp, Mus musculus
tgctgagaatgataccaacgaggtc

SEQ ID NO: 873825 - DNA, 25 bp, Mus musculus
tgctgagacacaatcaggtctgttt

SEQ ID NO: 873826 - DNA, 25 bp, Mus musculus
tgctgagacacattcaggtctgttt

SEQ ID NO: 873827 - DNA, 25 bp, Mus musculus
tgctgagacatcagttccttcctga

SEQ ID NO: 873828 - DNA, 25 bp, Mus musculus
tgctgagacatctgttccttcctga

SEQ ID NO: 873829 - DNA, 25 bp, Mus musculus
tgctgagaccaaacgggaccttttt

SEQ ID NO: 873830 - DNA, 25 bp, Mus musculus
tgctgagaccaatcgggaccttttt

SEQ ID NO: 873831 - DNA, 25 bp, Mus musculus
tgctgagagccacacagtggatctt

SEQ ID NO: 873832 - DNA, 25 bp, Mus musculus
tgctgagagccagacagtggatctt

SEQ ID NO: 873833 - DNA, 25 bp, Mus musculus
tgctgagagctcactccagggccaa

SEQ ID NO: 873834 - DNA, 25 bp, Mus musculus
tgctgagagctctctccagggccaa

SEQ ID NO: 873835 - DNA, 25 bp, Mus musculus
tgctgagatcctcagtggcttgcta

SEQ ID NO: 873836 - DNA, 25 bp, Mus musculus
tgctgagatcctgagtggcttgcta

SEQ ID NO: 873837 - DNA, 25 bp, Mus musculus
tgctgagatcttagttggaggtcaa

SEQ ID NO: 873838 - DNA, 25 bp, Mus musculus
tgctgagatctttgttggaggtcaa

SEQ ID NO: 873839 - DNA, 25 bp, Mus musculus
tgctgagatgttacaaggagcgctt

SEQ ID NO: 873840 - DNA, 25 bp, Mus musculus
tgctgagatgtttcaaggagcgctt

SEQ ID NO: 873841 - DNA, 25 bp, Mus musculus
tgctgagattataggcatgtgccat

SEQ ID NO: 873842 - DNA, 25 bp, Mus musculus
tgctgagattatcggctttcattac

SEQ ID NO: 873843 - DNA, 25 bp, Mus musculus
tgctgagattatgggctttcattac

SEQ ID NO: 873844 - DNA, 25 bp, Mus musculus
tgctgagattattggcatgtgccat

SEQ ID NO: 873845 - DNA, 25 bp, Mus musculus
tgctgagcaaaaaggaccaccgttg

SEQ ID NO: 873846 - DNA, 25 bp, Mus musculus
tgctgagcaaaatggaccaccgttg

SEQ ID NO: 873847 - DNA, 25 bp, Mus musculus
tgctgagcaaacctaatgacgttag

SEQ ID NO: 873848 - DNA, 25 bp, Mus musculus
tgctgagcaaacgtaatgacgttag

SEQ ID NO: 873849 - DNA, 25 bp, Mus musculus
tgctgagcacaacgccgggactgca

SEQ ID NO: 873850 - DNA, 25 bp, Mus musculus
tgctgagcacaaggccgggactgca

SEQ ID NO: 873851 - DNA, 25 bp, Mus musculus
tgctgagcacagagagcccctggga

SEQ ID NO: 873852 - DNA, 25 bp, Mus musculus
tgctgagcacagtgagcccctggga

SEQ ID NO: 873853 - DNA, 25 bp, Mus musculus
tgctgagcaccaaatcaacctgata

SEQ ID NO: 873854 - DNA, 25 bp, Mus musculus
tgctgagcaccatatcaacctgata

SEQ ID NO: 873855 - DNA, 25 bp, Mus musculus
tgctgagcagaaatccggaacacaa

SEQ ID NO: 873856 - DNA, 25 bp, Mus musculus
tgctgagcagaattccggaacacaa

SEQ ID NO: 873857 - DNA, 25 bp, Mus musculus
tgctgagcagccaagattctcctcc

SEQ ID NO: 873858 - DNA, 25 bp, Mus musculus
tgctgagcagcctagattctcctcc

SEQ ID NO: 873859 - DNA, 25 bp, Mus musculus
tgctgagcaggcactctgcactcca

SEQ ID NO: 873860 - DNA, 25 bp, Mus musculus
tgctgagcaggctctctgcactcca

SEQ ID NO: 873861 - DNA, 25 bp, Mus musculus
tgctgagcaggtacacagccttcta

SEQ ID NO: 873862 - DNA, 25 bp, Mus musculus
tgctgagcaggttcacagccttcta

SEQ ID NO: 873863 - DNA, 25 bp, Mus musculus
tgctgagcagtaaagcttgaggcta

SEQ ID NO: 873864 - DNA, 25 bp, Mus musculus
tgctgagcagtacaaatatgggaag

SEQ ID NO: 873865 - DNA, 25 bp, Mus musculus
tgctgagcagtagaaatatgggaag

SEQ ID NO: 873866 - DNA, 25 bp, Mus musculus
tgctgagcagtatagcttgaggcta

SEQ ID NO: 873867 - DNA, 25 bp, Mus musculus
tgctgagcagtcaaagcgacctcct

SEQ ID NO: 873868 - DNA, 25 bp, Mus musculus
tgctgagcagtctaagcgacctcct

SEQ ID NO: 873869 - DNA, 25 bp, Mus musculus
tgctgagcatccagacgacacagaa

SEQ ID NO: 873870 - DNA, 25 bp, Mus musculus
tgctgagcatcctgacgacacagaa

SEQ ID NO: 873871 - DNA, 25 bp, Mus musculus
tgctgagcatgtactttgtcacctg

SEQ ID NO: 873872 - DNA, 25 bp, Mus musculus
tgctgagcatgttctttgtcacctg

SEQ ID NO: 873873 - DNA, 25 bp, Mus musculus
tgctgagccactatactgtccatct

SEQ ID NO: 873874 - DNA, 25 bp, Mus musculus
tgctgagccactttactgtccatct

SEQ ID NO: 873875 - DNA, 25 bp, Mus musculus
tgctgagccatcacataggcagctt

SEQ ID NO: 873876 - DNA, 25 bp, Mus musculus
tgctgagccatcactacagtcatga

SEQ ID NO: 873877 - DNA, 25 bp, Mus musculus
tgctgagccatctcataggcagctt

SEQ ID NO: 873878 - DNA, 25 bp, Mus musculus
tgctgagccatctctacagtcatga

SEQ ID NO: 873879 - DNA, 25 bp, Mus musculus
tgctgagccctgcatgtgatgaact

SEQ ID NO: 873880 - DNA, 25 bp, Mus musculus
tgctgagccctggatgtgatgaact

SEQ ID NO: 873881 - DNA, 25 bp, Mus musculus
tgctgagccgccacagacgccaagg

SEQ ID NO: 873882 - DNA, 25 bp, Mus musculus
tgctgagccgcctcagacgccaagg

SEQ ID NO: 873883 - DNA, 25 bp, Mus musculus
tgctgagccgtgaggctgtcctgct

SEQ ID NO: 873884 - DNA, 25 bp, Mus musculus
tgctgagccgtgtggctgtcctgct

SEQ ID NO: 873885 - DNA, 25 bp, Mus musculus
tgctgagccttgaggtccgttacct

SEQ ID NO: 873886 - DNA, 25 bp, Mus musculus
tgctgagccttgtggtccgttacct

SEQ ID NO: 873887 - DNA, 25 bp, Mus musculus
tgctgagcgccaacgaggtgtcctg

SEQ ID NO: 873888 - DNA, 25 bp, Mus musculus
tgctgagcgccatcgaggtgtcctg

SEQ ID NO: 873889 - DNA, 25 bp, Mus musculus
tgctgagcggccctgcgtacatcgt

SEQ ID NO: 873890 - DNA, 25 bp, Mus musculus
tgctgagcggccgtgcgtacatcgt

SEQ ID NO: 873891 - DNA, 25 bp, Mus musculus
tgctgagctaaaatggatccccttc

SEQ ID NO: 873892 - DNA, 25 bp, Mus musculus
tgctgagctaaattggatccccttc

SEQ ID NO: 873893 - DNA, 25 bp, Mus musculus
tgctgagctgggacctgctggcatt

SEQ ID NO: 873894 - DNA, 25 bp, Mus musculus
tgctgagctgggtcctgctggcatt

SEQ ID NO: 873895 - DNA, 25 bp, Mus musculus
tgctgagcttcaaccacacagttaa

SEQ ID NO: 873896 - DNA, 25 bp, Mus musculus
tgctgagcttcatccacacagttaa

SEQ ID NO: 873897 - DNA, 25 bp, Mus musculus
tgctgagcttgacgccttgtccaca

SEQ ID NO: 873898 - DNA, 25 bp, Mus musculus
tgctgagcttgaggccttgtccaca

SEQ ID NO: 873899 - DNA, 25 bp, Mus musculus
tgctgagctttcctacgtttgaaat

SEQ ID NO: 873900 - DNA, 25 bp, Mus musculus
tgctgagctttcgtacgtttgaaat

SEQ ID NO: 873901 - DNA, 25 bp, Mus musculus
tgctgaggacacatctcccagatga

SEQ ID NO: 873902 - DNA, 25 bp, Mus musculus
tgctgaggacacttctcccagatga

SEQ ID NO: 873903 - DNA, 25 bp, Mus musculus
tgctgaggaccgatggtggatttct

SEQ ID NO: 873904 - DNA, 25 bp, Mus musculus
tgctgaggaccgttggtggatttct

SEQ ID NO: 873905 - DNA, 25 bp, Mus musculus
tgctgaggcagcacaagtctctggg

SEQ ID NO: 873906 - DNA, 25 bp, Mus musculus
tgctgaggcagctcaagtctctggg

SEQ ID NO: 873907 - DNA, 25 bp, Mus musculus
tgctgaggcagtatgacctggcctg

SEQ ID NO: 873908 - DNA, 25 bp, Mus musculus
tgctgaggcagtttgacctggcctg

SEQ ID NO: 873909 - DNA, 25 bp, Mus musculus
tgctgaggccagaccgcaggcactg

SEQ ID NO: 873910 - DNA, 25 bp, Mus musculus
tgctgaggccagtccgcaggcactg

SEQ ID NO: 873911 - DNA, 25 bp, Mus musculus
tgctgaggctgtagaacattccaca

SEQ ID NO: 873912 - DNA, 25 bp, Mus musculus
tgctgaggctgttgaacattccaca

SEQ ID NO: 873913 - DNA, 25 bp, Mus musculus
tgctgagggatgctcctgacagtaa

SEQ ID NO: 873914 - DNA, 25 bp, Mus musculus
tgctgagggatggtcctgacagtaa

SEQ ID NO: 873915 - DNA, 25 bp, Mus musculus
tgctgagggcccatgctcctctcat

SEQ ID NO: 873916 - DNA, 25 bp, Mus musculus
tgctgagggcccttgctcctctcat

SEQ ID NO: 873917 - DNA, 25 bp, Mus musculus
tgctgagggtttcggtaatacactg

SEQ ID NO: 873918 - DNA, 25 bp, Mus musculus
tgctgagggtttgggtaatacactg

SEQ ID NO: 873919 - DNA, 25 bp, Mus musculus
tgctgaggtactcggtcatcgtgaa

SEQ ID NO: 873920 - DNA, 25 bp, Mus musculus
tgctgaggtactgggtcatcgtgaa

SEQ ID NO: 873921 - DNA, 25 bp, Mus musculus
tgctgagtaaccaccagtctttagg

SEQ ID NO: 873922 - DNA, 25 bp, Mus musculus
tgctgagtaacctccagtctttagg

SEQ ID NO: 873923 - DNA, 25 bp, Mus musculus
tgctgagtacctcactagcctcctg

SEQ ID NO: 873924 - DNA, 25 bp, Mus musculus
tgctgagtacctgactagcctcctg

SEQ ID NO: 873925 - DNA, 25 bp, Mus musculus
tgctgagtacgccacgtggaaccga

SEQ ID NO: 873926 - DNA, 25 bp, Mus musculus
tgctgagtacgcgacgtggaaccga

SEQ ID NO: 873927 - DNA, 25 bp, Mus musculus
tgctgagtataaacacctttcaagt

SEQ ID NO: 873928 - DNA, 25 bp, Mus musculus
tgctgagtataatcacctttcaagt

SEQ ID NO: 873929 - DNA, 25 bp, Mus musculus
tgctgagtatcaaaacctggttcca

SEQ ID NO: 873930 - DNA, 25 bp, Mus musculus
tgctgagtatcataacctggttcca

SEQ ID NO: 873931 - DNA, 25 bp, Mus musculus
tgctgagtatgaacgtgcctgcctt

SEQ ID NO: 873932 - DNA, 25 bp, Mus musculus
tgctgagtatgatcgtgcctgcctt

SEQ ID NO: 873933 - DNA, 25 bp, Mus musculus
tgctgagtcaccacctcattttaga

SEQ ID NO: 873934 - DNA, 25 bp, Mus musculus
tgctgagtcacctcctcattttaga

SEQ ID NO: 873935 - DNA, 25 bp, Mus musculus
tgctgagtcactcctattatactca

SEQ ID NO: 873936 - DNA, 25 bp, Mus musculus
tgctgagtcactgctattatactca

SEQ ID NO: 873937 - DNA, 25 bp, Mus musculus
tgctgagtcctcagaaacccaccat

SEQ ID NO: 873938 - DNA, 25 bp, Mus musculus
tgctgagtcctctgaaacccaccat

SEQ ID NO: 873939 - DNA, 25 bp, Mus musculus
tgctgagtctcaacttcaaggctgc

SEQ ID NO: 873940 - DNA, 25 bp, Mus musculus
tgctgagtctcatcttcaaggctgc

SEQ ID NO: 873941 - DNA, 25 bp, Mus musculus
tgctgagtctgtatcctgtctgtat

SEQ ID NO: 873942 - DNA, 25 bp, Mus musculus
tgctgagtctgtttcctgtctgtat

SEQ ID NO: 873943 - DNA, 25 bp, Mus musculus
tgctgagtgccgctgaccaatcaaa

SEQ ID NO: 873944 - DNA, 25 bp, Mus musculus
tgctgagtgccggtgaccaatcaaa

SEQ ID NO: 873945 - DNA, 25 bp, Mus musculus
tgctgagtgctgctgcaggctttat

SEQ ID NO: 873946 - DNA, 25 bp, Mus musculus
tgctgagtgctggtgcaggctttat

SEQ ID NO: 873947 - DNA, 25 bp, Mus musculus
tgctgagtggaaattaatctgggtt

SEQ ID NO: 873948 - DNA, 25 bp, Mus musculus
tgctgagtggaatttaatctgggtt

SEQ ID NO: 873949 - DNA, 25 bp, Mus musculus
tgctgagtggccacgtctacagagt

SEQ ID NO: 873950 - DNA, 25 bp, Mus musculus
tgctgagtggcctcgtctacagagt

SEQ ID NO: 873951 - DNA, 25 bp, Mus musculus
tgctgagtgtttacagccatgatct

SEQ ID NO: 873952 - DNA, 25 bp, Mus musculus
tgctgagtgttttcagccatgatct

SEQ ID NO: 873953 - DNA, 25 bp, Mus musculus
tgctgagttcacactgttgcctttg

SEQ ID NO: 873954 - DNA, 25 bp, Mus musculus
tgctgagttcactctgttgcctttg

SEQ ID NO: 873955 - DNA, 25 bp, Mus musculus
tgctgagttccacccagctgggttc

SEQ ID NO: 873956 - DNA, 25 bp, Mus musculus
tgctgagttccagccagctgggttc

SEQ ID NO: 873957 - DNA, 25 bp, Mus musculus
tgctgagttgatcccgggagcttca

SEQ ID NO: 873958 - DNA, 25 bp, Mus musculus
tgctgagttgatgccgggagcttca

SEQ ID NO: 873959 - DNA, 25 bp, Mus musculus
tgctgagttgctaatgttcactgtc

SEQ ID NO: 873960 - DNA, 25 bp, Mus musculus
tgctgagttgcttatgttcactgtc

SEQ ID NO: 873961 - DNA, 25 bp, Mus musculus
tgctgatacaccagtgaccctactt

SEQ ID NO: 873962 - DNA, 25 bp, Mus musculus
tgctgatacacctgtgaccctactt

SEQ ID NO: 873963 - DNA, 25 bp, Mus musculus
tgctgatagcttctgacaattacaa

SEQ ID NO: 873964 - DNA, 25 bp, Mus musculus
tgctgatagcttgtgacaattacaa

SEQ ID NO: 873965 - DNA, 25 bp, Mus musculus
tgctgatagtcacatgattaacatg

SEQ ID NO: 873966 - DNA, 25 bp, Mus musculus
tgctgatagtcagatgattaacatg

SEQ ID NO: 873967 - DNA, 25 bp, Mus musculus
tgctgatataatcgccaagacgaat

SEQ ID NO: 873968 - DNA, 25 bp, Mus musculus
tgctgatataatggccaagacgaat

SEQ ID NO: 873969 - DNA, 25 bp, Mus musculus
tgctgatccctcctttcgaaacttt

SEQ ID NO: 873970 - DNA, 25 bp, Mus musculus
tgctgatccctcgtttcgaaacttt

SEQ ID NO: 873971 - DNA, 25 bp, Mus musculus
tgctgatccgcaagctgccgttcca

SEQ ID NO: 873972 - DNA, 25 bp, Mus musculus
tgctgatccgcatgctgccgttcca

SEQ ID NO: 873973 - DNA, 25 bp, Mus musculus
tgctgatctgctctggccatcatta

SEQ ID NO: 873974 - DNA, 25 bp, Mus musculus
tgctgatctgctgtggccatcatta

SEQ ID NO: 873975 - DNA, 25 bp, Mus musculus
tgctgatcttgtagcagaattgcac

SEQ ID NO: 873976 - DNA, 25 bp, Mus musculus
tgctgatcttgttgcagaattgcac

SEQ ID NO: 873977 - DNA, 25 bp, Mus musculus
tgctgatgagaccaccttgaaggag

SEQ ID NO: 873978 - DNA, 25 bp, Mus musculus
tgctgatgagacgaccttgaaggag

SEQ ID NO: 873979 - DNA, 25 bp, Mus musculus
tgctgatgagatctccaaacgcctg

SEQ ID NO: 873980 - DNA, 25 bp, Mus musculus
tgctgatgagatgtccaaacgcctg

SEQ ID NO: 873981 - DNA, 25 bp, Mus musculus
tgctgatgatttagttcgaggtctc

SEQ ID NO: 873982 - DNA, 25 bp, Mus musculus
tgctgatgattttgttcgaggtctc

SEQ ID NO: 873983 - DNA, 25 bp, Mus musculus
tgctgatgcagcacctctttatttt

SEQ ID NO: 873984 - DNA, 25 bp, Mus musculus
tgctgatgcagctcctctttatttt

SEQ ID NO: 873985 - DNA, 25 bp, Mus musculus
tgctgatgcctaaagctgatactgc

SEQ ID NO: 873986 - DNA, 25 bp, Mus musculus
tgctgatgcctatagctgatactgc

SEQ ID NO: 873987 - DNA, 25 bp, Mus musculus
tgctgatgcgtaaatccctctgcct

SEQ ID NO: 873988 - DNA, 25 bp, Mus musculus
tgctgatgcgtatatccctctgcct

SEQ ID NO: 873989 - DNA, 25 bp, Mus musculus
tgctgatgctggactttagggacta

SEQ ID NO: 873990 - DNA, 25 bp, Mus musculus
tgctgatgctggtctttagggacta

SEQ ID NO: 873991 - DNA, 25 bp, Mus musculus
tgctgatgctgtctatcccctggga

SEQ ID NO: 873992 - DNA, 25 bp, Mus musculus
tgctgatgctgtgtatcccctggga

SEQ ID NO: 873993 - DNA, 25 bp, Mus musculus
tgctgatgcttactctgctcacagg

SEQ ID NO: 873994 - DNA, 25 bp, Mus musculus
tgctgatgcttagtctgctcacagg

SEQ ID NO: 873995 - DNA, 25 bp, Mus musculus
tgctgatggactacacttcccagct

SEQ ID NO: 873996 - DNA, 25 bp, Mus musculus
tgctgatggacttcacttcccagct

SEQ ID NO: 873997 - DNA, 25 bp, Mus musculus
tgctgatggcaaacgtcctgtggac

SEQ ID NO: 873998 - DNA, 25 bp, Mus musculus
tgctgatggcaatcgtcctgtggac

SEQ ID NO: 873999 - DNA, 25 bp, Mus musculus
tgctgatggcttacatccaaagtga

SEQ ID NO: 874000 - DNA, 25 bp, Mus musculus
tgctgatggctttcatccaaagtga

SEQ ID NO: 874001 - DNA, 25 bp, Mus musculus
tgctgatggtgccttcgtgttctcc

SEQ ID NO: 874002 - DNA, 25 bp, Mus musculus
tgctgatggtgcgttcgtgttctcc

SEQ ID NO: 874003 - DNA, 25 bp, Mus musculus
tgctgatgtaaccaccactgggagt

SEQ ID NO: 874004 - DNA, 25 bp, Mus musculus
tgctgatgtaacgaccactgggagt

SEQ ID NO: 874005 - DNA, 25 bp, Mus musculus
tgctgatgtcctctgtctatgggaa

SEQ ID NO: 874006 - DNA, 25 bp, Mus musculus
tgctgatgtcctgtgtctatgggaa

SEQ ID NO: 874007 - DNA, 25 bp, Mus musculus
tgctgatgttcaatcattttctgtt

SEQ ID NO: 874008 - DNA, 25 bp, Mus musculus
tgctgatgttcattcattttctgtt

SEQ ID NO: 874009 - DNA, 25 bp, Mus musculus
tgctgattagctcgactggtgtgac

SEQ ID NO: 874010 - DNA, 25 bp, Mus musculus
tgctgattagctggactggtgtgac

SEQ ID NO: 874011 - DNA, 25 bp, Mus musculus
tgctgattcatacctaaattggctg

SEQ ID NO: 874012 - DNA, 25 bp, Mus musculus
tgctgattcatagctaaattggctg

SEQ ID NO: 874013 - DNA, 25 bp, Mus musculus
tgctgattccaaaagctggctctta

SEQ ID NO: 874014 - DNA, 25 bp, Mus musculus
tgctgattccaatagctggctctta

SEQ ID NO: 874015 - DNA, 25 bp, Mus musculus
tgctgattccctagaagaccccgaa

SEQ ID NO: 874016 - DNA, 25 bp, Mus musculus
tgctgattcccttgaagaccccgaa

SEQ ID NO: 874017 - DNA, 25 bp, Mus musculus
tgctgattcgttaaacccaggctga

SEQ ID NO: 874018 - DNA, 25 bp, Mus musculus
tgctgattcgtttaacccaggctga

SEQ ID NO: 874019 - DNA, 25 bp, Mus musculus
tgctgattgcatacctctcattaac

SEQ ID NO: 874020 - DNA, 25 bp, Mus musculus
tgctgattgcattcctctcattaac

SEQ ID NO: 874021 - DNA, 25 bp, Mus musculus
tgctgattgcctaggccgtatacac

SEQ ID NO: 874022 - DNA, 25 bp, Mus musculus
tgctgattgccttggccgtatacac

SEQ ID NO: 874023 - DNA, 25 bp, Mus musculus
tgctgattggtcacatgcagattca

SEQ ID NO: 874024 - DNA, 25 bp, Mus musculus
tgctgattggtctcatgcagattca

SEQ ID NO: 874025 - DNA, 25 bp, Mus musculus
tgctgattggtgagtacatacattc

SEQ ID NO: 874026 - DNA, 25 bp, Mus musculus
tgctgattggtgtgtacatacattc

SEQ ID NO: 874027 - DNA, 25 bp, Mus musculus
tgctgatttaagctacatcgcccac

SEQ ID NO: 874028 - DNA, 25 bp, Mus musculus
tgctgatttaaggtacatcgcccac

SEQ ID NO: 874029 - DNA, 25 bp, Mus musculus
tgctgatttagaagtgggccaccca

SEQ ID NO: 874030 - DNA, 25 bp, Mus musculus
tgctgatttagatgtgggccaccca

SEQ ID NO: 874031 - DNA, 25 bp, Mus musculus
tgctgatttcacctatgagctccag

SEQ ID NO: 874032 - DNA, 25 bp, Mus musculus
tgctgatttcacgtatgagctccag

SEQ ID NO: 874033 - DNA, 25 bp, Mus musculus
tgctgatttctgagtggtttggtgc

SEQ ID NO: 874034 - DNA, 25 bp, Mus musculus
tgctgatttctgtgtggtttggtgc

SEQ ID NO: 874035 - DNA, 25 bp, Mus musculus
tgctgatttgcacataggccacttc

SEQ ID NO: 874036 - DNA, 25 bp, Mus musculus
tgctgatttgcagataggccacttc

SEQ ID NO: 874037 - DNA, 25 bp, Mus musculus
tgctgcaaaattaagatgctcctag

SEQ ID NO: 874038 - DNA, 25 bp, Mus musculus
tgctgcaaaatttagatgctcctag

SEQ ID NO: 874039 - DNA, 25 bp, Mus musculus
tgctgcaaatcgcagtgatgccttt

SEQ ID NO: 874040 - DNA, 25 bp, Mus musculus
tgctgcaaatcggagtgatgccttt

SEQ ID NO: 874041 - DNA, 25 bp, Mus musculus
tgctgcaaatggacattggtccatt

SEQ ID NO: 874042 - DNA, 25 bp, Mus musculus
tgctgcaaatggtcattggtccatt

SEQ ID NO: 874043 - DNA, 25 bp, Mus musculus
tgctgcaaccataatctctgttctt

SEQ ID NO: 874044 - DNA, 25 bp, Mus musculus
tgctgcaaccattatctctgttctt

SEQ ID NO: 874045 - DNA, 25 bp, Mus musculus
tgctgcaacgggacactggtgagtt

SEQ ID NO: 874046 - DNA, 25 bp, Mus musculus
tgctgcaacgggtcactggtgagtt

SEQ ID NO: 874047 - DNA, 25 bp, Mus musculus
tgctgcaaggacatcacttagccaa

SEQ ID NO: 874048 - DNA, 25 bp, Mus musculus
tgctgcaaggacttcacttagccaa

SEQ ID NO: 874049 - DNA, 25 bp, Mus musculus
tgctgcaagtttacaataaactact

SEQ ID NO: 874050 - DNA, 25 bp, Mus musculus
tgctgcaagttttcaataaactact

SEQ ID NO: 874051 - DNA, 25 bp, Mus musculus
tgctgcaatggtacctcttgtaggt

SEQ ID NO: 874052 - DNA, 25 bp, Mus musculus
tgctgcaatggttcctcttgtaggt

SEQ ID NO: 874053 - DNA, 25 bp, Mus musculus
tgctgcaattgaagaaccttctctg

SEQ ID NO: 874054 - DNA, 25 bp, Mus musculus
tgctgcaattgatgaaccttctctg

SEQ ID NO: 874055 - DNA, 25 bp, Mus musculus
tgctgcacaaaccaacacctatgaa

SEQ ID NO: 874056 - DNA, 25 bp, Mus musculus
tgctgcacaaacgaacacctatgaa

SEQ ID NO: 874057 - DNA, 25 bp, Mus musculus
tgctgcacaaccaggcgggtagtgc

SEQ ID NO: 874058 - DNA, 25 bp, Mus musculus
tgctgcacaacctggcgggtagtgc

SEQ ID NO: 874059 - DNA, 25 bp, Mus musculus
tgctgcacaacgctcgcctgaaggg

SEQ ID NO: 874060 - DNA, 25 bp, Mus musculus
tgctgcacaacggtcgcctgaaggg

SEQ ID NO: 874061 - DNA, 25 bp, Mus musculus
tgctgcacaagtctgtgtcccatgg

SEQ ID NO: 874062 - DNA, 25 bp, Mus musculus
tgctgcacaagtgtgtgtcccatgg

SEQ ID NO: 874063 - DNA, 25 bp, Mus musculus
tgctgcacacggacgctgagatccc

SEQ ID NO: 874064 - DNA, 25 bp, Mus musculus
tgctgcacacggtcgctgagatccc

SEQ ID NO: 874065 - DNA, 25 bp, Mus musculus
tgctgcacagttctgcctccagagg

SEQ ID NO: 874066 - DNA, 25 bp, Mus musculus
tgctgcacagttgtgcctccagagg

SEQ ID NO: 874067 - DNA, 25 bp, Mus musculus
tgctgcacatgaagtaccaggccat

SEQ ID NO: 874068 - DNA, 25 bp, Mus musculus
tgctgcacatgatgtaccaggccat

SEQ ID NO: 874069 - DNA, 25 bp, Mus musculus
tgctgcacatgcaggagtcccccga

SEQ ID NO: 874070 - DNA, 25 bp, Mus musculus
tgctgcacatgcatcatttggattt

SEQ ID NO: 874071 - DNA, 25 bp, Mus musculus
tgctgcacatgcatcgtaaactaca

SEQ ID NO: 874072 - DNA, 25 bp, Mus musculus
tgctgcacatgctggagtcccccga

SEQ ID NO: 874073 - DNA, 25 bp, Mus musculus
tgctgcacatgcttcatttggattt

SEQ ID NO: 874074 - DNA, 25 bp, Mus musculus
tgctgcacatgcttcgtaaactaca

SEQ ID NO: 874075 - DNA, 25 bp, Mus musculus
tgctgcaccaagaacttcgcaaacc

SEQ ID NO: 874076 - DNA, 25 bp, Mus musculus
tgctgcaccaagtacttcgcaaacc

SEQ ID NO: 874077 - DNA, 25 bp, Mus musculus
tgctgcaccatccactggctggtag

SEQ ID NO: 874078 - DNA, 25 bp, Mus musculus
tgctgcaccatcgactggctggtag

SEQ ID NO: 874079 - DNA, 25 bp, Mus musculus
tgctgcactagcatccagagtcaga

SEQ ID NO: 874080 - DNA, 25 bp, Mus musculus
tgctgcactagcttccagagtcaga

SEQ ID NO: 874081 - DNA, 25 bp, Mus musculus
tgctgcactcctaaggctggagaat

SEQ ID NO: 874082 - DNA, 25 bp, Mus musculus
tgctgcactccttaggctggagaat

SEQ ID NO: 874083 - DNA, 25 bp, Mus musculus
tgctgcactgccaaaccagtctgtt

SEQ ID NO: 874084 - DNA, 25 bp, Mus musculus
tgctgcactgcctaaccagtctgtt

SEQ ID NO: 874085 - DNA, 25 bp, Mus musculus
tgctgcacttccatgtggccgtcat

SEQ ID NO: 874086 - DNA, 25 bp, Mus musculus
tgctgcacttccttgtggccgtcat

SEQ ID NO: 874087 - DNA, 25 bp, Mus musculus
tgctgcacttttcaattcccctgca

SEQ ID NO: 874088 - DNA, 25 bp, Mus musculus
tgctgcacttttgaattcccctgca

SEQ ID NO: 874089 - DNA, 25 bp, Mus musculus
tgctgcagacagaacatttgagtgt

SEQ ID NO: 874090 - DNA, 25 bp, Mus musculus
tgctgcagacagtacatttgagtgt

SEQ ID NO: 874091 - DNA, 25 bp, Mus musculus
tgctgcagagatccaggctcagttc

SEQ ID NO: 874092 - DNA, 25 bp, Mus musculus
tgctgcagagatgcaggctcagttc

SEQ ID NO: 874093 - DNA, 25 bp, Mus musculus
tgctgcagagcgaggcatcctgcct

SEQ ID NO: 874094 - DNA, 25 bp, Mus musculus
tgctgcagagcgtggcatcctgcct

SEQ ID NO: 874095 - DNA, 25 bp, Mus musculus
tgctgcagatgccacgagtcaatat

SEQ ID NO: 874096 - DNA, 25 bp, Mus musculus
tgctgcagatgcgacgagtcaatat

SEQ ID NO: 874097 - DNA, 25 bp, Mus musculus
tgctgcagcaggaccacagacggac

SEQ ID NO: 874098 - DNA, 25 bp, Mus musculus
tgctgcagcaggtccacagacggac

SEQ ID NO: 874099 - DNA, 25 bp, Mus musculus
tgctgcagcagtacagactgtttct

SEQ ID NO: 874100 - DNA, 25 bp, Mus musculus
tgctgcagcagttcagactgtttct

SEQ ID NO: 874101 - DNA, 25 bp, Mus musculus
tgctgcagcattacattcatggttg

SEQ ID NO: 874102 - DNA, 25 bp, Mus musculus
tgctgcagcatttcattcatggttg

SEQ ID NO: 874103 - DNA, 25 bp, Mus musculus
tgctgcagccatccaaatgagaggt

SEQ ID NO: 874104 - DNA, 25 bp, Mus musculus
tgctgcagccatcttgtcgaggaat

SEQ ID NO: 874105 - DNA, 25 bp, Mus musculus
tgctgcagccatgcaaatgagaggt

SEQ ID NO: 874106 - DNA, 25 bp, Mus musculus
tgctgcagccatgttgtcgaggaat

SEQ ID NO: 874107 - DNA, 25 bp, Mus musculus
tgctgcagccccacggccatataat

SEQ ID NO: 874108 - DNA, 25 bp, Mus musculus
tgctgcagcccctcggccatataat

SEQ ID NO: 874109 - DNA, 25 bp, Mus musculus
tgctgcagcctcaacacctttgaag

SEQ ID NO: 874110 - DNA, 25 bp, Mus musculus
tgctgcagcctcacgtgtcatttag

SEQ ID NO: 874111 - DNA, 25 bp, Mus musculus
tgctgcagcctccataatttaatct

SEQ ID NO: 874112 - DNA, 25 bp, Mus musculus
tgctgcagcctcgataatttaatct

SEQ ID NO: 874113 - DNA, 25 bp, Mus musculus
tgctgcagcctctacacctttgaag

SEQ ID NO: 874114 - DNA, 25 bp, Mus musculus
tgctgcagcctctcgtgtcatttag

SEQ ID NO: 874115 - DNA, 25 bp, Mus musculus
tgctgcagctaaagtactctcgcca

SEQ ID NO: 874116 - DNA, 25 bp, Mus musculus
tgctgcagctaatgtactctcgcca

SEQ ID NO: 874117 - DNA, 25 bp, Mus musculus
tgctgcagctcaccttcttcggaca

SEQ ID NO: 874118 - DNA, 25 bp, Mus musculus
tgctgcagctcagcttcttcggaca

SEQ ID NO: 874119 - DNA, 25 bp, Mus musculus
tgctgcagctgacgagtcgtcttca

SEQ ID NO: 874120 - DNA, 25 bp, Mus musculus
tgctgcagctgaggagtcgtcttca

SEQ ID NO: 874121 - DNA, 25 bp, Mus musculus
tgctgcaggagaagcatgtcctcct

SEQ ID NO: 874122 - DNA, 25 bp, Mus musculus
tgctgcaggagatgcatgtcctcct

SEQ ID NO: 874123 - DNA, 25 bp, Mus musculus
tgctgcaggagtaatcacaccattt

SEQ ID NO: 874124 - DNA, 25 bp, Mus musculus
tgctgcaggagttatcacaccattt

SEQ ID NO: 874125 - DNA, 25 bp, Mus musculus
tgctgcaggataagagcggtatttt

SEQ ID NO: 874126 - DNA, 25 bp, Mus musculus
tgctgcaggatatgagcggtatttt

SEQ ID NO: 874127 - DNA, 25 bp, Mus musculus
tgctgcaggccacaggtgagaccat

SEQ ID NO: 874128 - DNA, 25 bp, Mus musculus
tgctgcaggccagaggtgagaccat

SEQ ID NO: 874129 - DNA, 25 bp, Mus musculus
tgctgcaggcccatgacccagtgag

SEQ ID NO: 874130 - DNA, 25 bp, Mus musculus
tgctgcaggcccttgacccagtgag

SEQ ID NO: 874131 - DNA, 25 bp, Mus musculus
tgctgcaggcggacctgccgccagt

SEQ ID NO: 874132 - DNA, 25 bp, Mus musculus
tgctgcaggcggtcctgccgccagt

SEQ ID NO: 874133 - DNA, 25 bp, Mus musculus
tgctgcaggctgaagtagtaagttc

SEQ ID NO: 874134 - DNA, 25 bp, Mus musculus
tgctgcaggctgtagtagtaagttc

SEQ ID NO: 874135 - DNA, 25 bp, Mus musculus
tgctgcagtcagacaatcactccaa

SEQ ID NO: 874136 - DNA, 25 bp, Mus musculus
tgctgcagtcagtcaatcactccaa

SEQ ID NO: 874137 - DNA, 25 bp, Mus musculus
tgctgcagtttgcaagctgtgaagt

SEQ ID NO: 874138 - DNA, 25 bp, Mus musculus
tgctgcagtttggaagctgtgaagt

SEQ ID NO: 874139 - DNA, 25 bp, Mus musculus
tgctgcatattcagcctgcccaggt

SEQ ID NO: 874140 - DNA, 25 bp, Mus musculus
tgctgcatattctgcctgcccaggt

SEQ ID NO: 874141 - DNA, 25 bp, Mus musculus
tgctgcatcagaagccccagacgca

SEQ ID NO: 874142 - DNA, 25 bp, Mus musculus
tgctgcatcagatgccccagacgca

SEQ ID NO: 874143 - DNA, 25 bp, Mus musculus
tgctgcatcattctgagcctgtatc

SEQ ID NO: 874144 - DNA, 25 bp, Mus musculus
tgctgcatcattgtgagcctgtatc

SEQ ID NO: 874145 - DNA, 25 bp, Mus musculus
tgctgcatcctcacgtgttaaagat

SEQ ID NO: 874146 - DNA, 25 bp, Mus musculus
tgctgcatcctctcgtgttaaagat

SEQ ID NO: 874147 - DNA, 25 bp, Mus musculus
tgctgcatgagaccgacacggacaa

SEQ ID NO: 874148 - DNA, 25 bp, Mus musculus
tgctgcatgagagcgacacggacaa

SEQ ID NO: 874149 - DNA, 25 bp, Mus musculus
tgctgcatgcaaaaggagactcttt

SEQ ID NO: 874150 - DNA, 25 bp, Mus musculus
tgctgcatgcaataggagactcttt

SEQ ID NO: 874151 - DNA, 25 bp, Mus musculus
tgctgcatgctcaaccgcggtgatg

SEQ ID NO: 874152 - DNA, 25 bp, Mus musculus
tgctgcatgctctaccgcggtgatg

SEQ ID NO: 874153 - DNA, 25 bp, Mus musculus
tgctgcatggaacatatttatttga

SEQ ID NO: 874154 - DNA, 25 bp, Mus musculus
tgctgcatggaagatatttatttga

SEQ ID NO: 874155 - DNA, 25 bp, Mus musculus
tgctgcatgggcagaaggttgactt

SEQ ID NO: 874156 - DNA, 25 bp, Mus musculus
tgctgcatgggctgaaggttgactt

SEQ ID NO: 874157 - DNA, 25 bp, Mus musculus
tgctgcatgtgcaggcttgccacat

SEQ ID NO: 874158 - DNA, 25 bp, Mus musculus
tgctgcatgtgctggcttgccacat

SEQ ID NO: 874159 - DNA, 25 bp, Mus musculus
tgctgcattcagacctgctgttcac

SEQ ID NO: 874160 - DNA, 25 bp, Mus musculus
tgctgcattcagctgggaactggaa

SEQ ID NO: 874161 - DNA, 25 bp, Mus musculus
tgctgcattcaggtgggaactggaa

SEQ ID NO: 874162 - DNA, 25 bp, Mus musculus
tgctgcattcagtcctgctgttcac

SEQ ID NO: 874163 - DNA, 25 bp, Mus musculus
tgctgcattgttccttctgttaagc

SEQ ID NO: 874164 - DNA, 25 bp, Mus musculus
tgctgcattgttgcttctgttaagc

SEQ ID NO: 874165 - DNA, 25 bp, Mus musculus
tgctgccaaagactgggacttcctg

SEQ ID NO: 874166 - DNA, 25 bp, Mus musculus
tgctgccaaagagtgggacttcctg

SEQ ID NO: 874167 - DNA, 25 bp, Mus musculus
tgctgccaaagcatcacatagtaca

SEQ ID NO: 874168 - DNA, 25 bp, Mus musculus
tgctgccaaagcttcacatagtaca

SEQ ID NO: 874169 - DNA, 25 bp, Mus musculus
tgctgccaaccaacttgctgtgaaa

SEQ ID NO: 874170 - DNA, 25 bp, Mus musculus
tgctgccaaccatcttgctgtgaaa

SEQ ID NO: 874171 - DNA, 25 bp, Mus musculus
tgctgccaacctagatgctgacgat

SEQ ID NO: 874172 - DNA, 25 bp, Mus musculus
tgctgccaaccttgatgctgacgat

SEQ ID NO: 874173 - DNA, 25 bp, Mus musculus
tgctgccaagccagctgatgtaagt

SEQ ID NO: 874174 - DNA, 25 bp, Mus musculus
tgctgccaagcctgctgatgtaagt

SEQ ID NO: 874175 - DNA, 25 bp, Mus musculus
tgctgccaccaacatcatcaatgag

SEQ ID NO: 874176 - DNA, 25 bp, Mus musculus
tgctgccaccaagatcatcaatgag

SEQ ID NO: 874177 - DNA, 25 bp, Mus musculus
tgctgccaccatcagtagcgagaga

SEQ ID NO: 874178 - DNA, 25 bp, Mus musculus
tgctgccaccatgagtagcgagaga

SEQ ID NO: 874179 - DNA, 25 bp, Mus musculus
tgctgccactacagctattcaggtt

SEQ ID NO: 874180 - DNA, 25 bp, Mus musculus
tgctgccactactgctattcaggtt

SEQ ID NO: 874181 - DNA, 25 bp, Mus musculus
tgctgccactccaaataggaagctc

SEQ ID NO: 874182 - DNA, 25 bp, Mus musculus
tgctgccactcctaataggaagctc

SEQ ID NO: 874183 - DNA, 25 bp, Mus musculus
tgctgccactctcagacagtggtct

SEQ ID NO: 874184 - DNA, 25 bp, Mus musculus
tgctgccactctgagacagtggtct

SEQ ID NO: 874185 - DNA, 25 bp, Mus musculus
tgctgccactgacagtccagtgaat

SEQ ID NO: 874186 - DNA, 25 bp, Mus musculus
tgctgccactgagagtccagtgaat

SEQ ID NO: 874187 - DNA, 25 bp, Mus musculus
tgctgccagtgtaaagttctagact

SEQ ID NO: 874188 - DNA, 25 bp, Mus musculus
tgctgccagtgttaagttctagact

SEQ ID NO: 874189 - DNA, 25 bp, Mus musculus
tgctgccatactctgggagaatttc

SEQ ID NO: 874190 - DNA, 25 bp, Mus musculus
tgctgccatactgtgggagaatttc

SEQ ID NO: 874191 - DNA, 25 bp, Mus musculus
tgctgccatattcgctcgctcgcag

SEQ ID NO: 874192 - DNA, 25 bp, Mus musculus
tgctgccatattggctcgctcgcag

SEQ ID NO: 874193 - DNA, 25 bp, Mus musculus
tgctgccatcagaaaagaacaagta

SEQ ID NO: 874194 - DNA, 25 bp, Mus musculus
tgctgccatcagtaaagaacaagta

SEQ ID NO: 874195 - DNA, 25 bp, Mus musculus
tgctgccatccaagtactggttaca

SEQ ID NO: 874196 - DNA, 25 bp, Mus musculus
tgctgccatccatgtactggttaca

SEQ ID NO: 874197 - DNA, 25 bp, Mus musculus
tgctgccatccccaagacatagatc

SEQ ID NO: 874198 - DNA, 25 bp, Mus musculus
tgctgccatcccgaagacatagatc

SEQ ID NO: 874199 - DNA, 25 bp, Mus musculus
tgctgccatccgatacagtggtatg

SEQ ID NO: 874200 - DNA, 25 bp, Mus musculus
tgctgccatccgttacagtggtatg

SEQ ID NO: 874201 - DNA, 25 bp, Mus musculus
tgctgccattggagacacgctccac

SEQ ID NO: 874202 - DNA, 25 bp, Mus musculus
tgctgccattggtgacacgctccac

SEQ ID NO: 874203 - DNA, 25 bp, Mus musculus
tgctgcccaaaccagagccatgaag

SEQ ID NO: 874204 - DNA, 25 bp, Mus musculus
tgctgcccaaacgagagccatgaag

SEQ ID NO: 874205 - DNA, 25 bp, Mus musculus
tgctgcccactccattgttactatg

SEQ ID NO: 874206 - DNA, 25 bp, Mus musculus
tgctgcccactcgattgttactatg

SEQ ID NO: 874207 - DNA, 25 bp, Mus musculus
tgctgcccagctagagtgaagcctt

SEQ ID NO: 874208 - DNA, 25 bp, Mus musculus
tgctgcccagcttgagtgaagcctt

SEQ ID NO: 874209 - DNA, 25 bp, Mus musculus
tgctgccccccgagaagaggagcaa

SEQ ID NO: 874210 - DNA, 25 bp, Mus musculus
tgctgccccccgtgaagaggagcaa

SEQ ID NO: 874211 - DNA, 25 bp, Mus musculus
tgctgcccctctcagtggatacagg

SEQ ID NO: 874212 - DNA, 25 bp, Mus musculus
tgctgcccctctgagtggatacagg

SEQ ID NO: 874213 - DNA, 25 bp, Mus musculus
tgctgcccctggatttactttgatg

SEQ ID NO: 874214 - DNA, 25 bp, Mus musculus
tgctgcccctggttttactttgatg

SEQ ID NO: 874215 - DNA, 25 bp, Mus musculus
tgctgcccctgtccaagacaagagg

SEQ ID NO: 874216 - DNA, 25 bp, Mus musculus
tgctgcccctgtgcaagacaagagg

SEQ ID NO: 874217 - DNA, 25 bp, Mus musculus
tgctgcccctttcacatcaaagaat

SEQ ID NO: 874218 - DNA, 25 bp, Mus musculus
tgctgcccctttgacatcaaagaat

SEQ ID NO: 874219 - DNA, 25 bp, Mus musculus
tgctgcccgagcagtagactattgg

SEQ ID NO: 874220 - DNA, 25 bp, Mus musculus
tgctgcccgagctgtagactattgg

SEQ ID NO: 874221 - DNA, 25 bp, Mus musculus
tgctgcccgggaaaagctagcccag

SEQ ID NO: 874222 - DNA, 25 bp, Mus musculus
tgctgcccgggataagctagcccag

SEQ ID NO: 874223 - DNA, 25 bp, Mus musculus
tgctgccctacacaacaggccagtg

SEQ ID NO: 874224 - DNA, 25 bp, Mus musculus
tgctgccctacagaacaggccagtg

SEQ ID NO: 874225 - DNA, 25 bp, Mus musculus
tgctgccctcaaaccgagtgtcctt

SEQ ID NO: 874226 - DNA, 25 bp, Mus musculus
tgctgccctcaatccgagtgtcctt

SEQ ID NO: 874227 - DNA, 25 bp, Mus musculus
tgctgccctctccatatataggata

SEQ ID NO: 874228 - DNA, 25 bp, Mus musculus
tgctgccctctcgatatataggata

SEQ ID NO: 874229 - DNA, 25 bp, Mus musculus
tgctgccctgaccatggcctggaat

SEQ ID NO: 874230 - DNA, 25 bp, Mus musculus
tgctgccctgacgatggcctggaat

SEQ ID NO: 874231 - DNA, 25 bp, Mus musculus
tgctgccctgagaacccagaaagat

SEQ ID NO: 874232 - DNA, 25 bp, Mus musculus
tgctgccctgagtacccagaaagat

SEQ ID NO: 874233 - DNA, 25 bp, Mus musculus
tgctgccctggacggtccacgaact

SEQ ID NO: 874234 - DNA, 25 bp, Mus musculus
tgctgccctggagggtccacgaact

SEQ ID NO: 874235 - DNA, 25 bp, Mus musculus
tgctgccctgtgagatggcctgcaa

SEQ ID NO: 874236 - DNA, 25 bp, Mus musculus
tgctgccctgtgtgatggcctgcaa

SEQ ID NO: 874237 - DNA, 25 bp, Mus musculus
tgctgcccttagccggaatccctta

SEQ ID NO: 874238 - DNA, 25 bp, Mus musculus
tgctgcccttaggcggaatccctta

SEQ ID NO: 874239 - DNA, 25 bp, Mus musculus
tgctgccctttcatgactttacaat

SEQ ID NO: 874240 - DNA, 25 bp, Mus musculus
tgctgccctttccttgaggatcatc

SEQ ID NO: 874241 - DNA, 25 bp, Mus musculus
tgctgccctttcgttgaggatcatc

SEQ ID NO: 874242 - DNA, 25 bp, Mus musculus
tgctgccctttcttgactttacaat

SEQ ID NO: 874243 - DNA, 25 bp, Mus musculus
tgctgccgagagactcctggatgaa

SEQ ID NO: 874244 - DNA, 25 bp, Mus musculus
tgctgccgagagtctcctggatgaa

SEQ ID NO: 874245 - DNA, 25 bp, Mus musculus
tgctgccgcccaaacaaaccagaga

SEQ ID NO: 874246 - DNA, 25 bp, Mus musculus
tgctgccgcccactgtgctgtggaa

SEQ ID NO: 874247 - DNA, 25 bp, Mus musculus
tgctgccgcccagtgtgctgtggaa

SEQ ID NO: 874248 - DNA, 25 bp, Mus musculus
tgctgccgcccatacaaaccagaga

SEQ ID NO: 874249 - DNA, 25 bp, Mus musculus
tgctgccgggcaacgtgcattgctg

SEQ ID NO: 874250 - DNA, 25 bp, Mus musculus
tgctgccgggcatcgtgcattgctg

SEQ ID NO: 874251 - DNA, 25 bp, Mus musculus
tgctgccggtacagcagaagccagc

SEQ ID NO: 874252 - DNA, 25 bp, Mus musculus
tgctgccggtactgcagaagccagc

SEQ ID NO: 874253 - DNA, 25 bp, Mus musculus
tgctgccggtgtcaatgctttgtaa

SEQ ID NO: 874254 - DNA, 25 bp, Mus musculus
tgctgccggtgtgaatgctttgtaa

SEQ ID NO: 874255 - DNA, 25 bp, Mus musculus
tgctgccgtattccctccatgatga

SEQ ID NO: 874256 - DNA, 25 bp, Mus musculus
tgctgccgtattgcctccatgatga

SEQ ID NO: 874257 - DNA, 25 bp, Mus musculus
tgctgccgtcctattgggttcttga

SEQ ID NO: 874258 - DNA, 25 bp, Mus musculus
tgctgccgtccttttgggttcttga

SEQ ID NO: 874259 - DNA, 25 bp, Mus musculus
tgctgccgttctcttagattgctaa

SEQ ID NO: 874260 - DNA, 25 bp, Mus musculus
tgctgccgttctgttagattgctaa

SEQ ID NO: 874261 - DNA, 25 bp, Mus musculus
tgctgcctaaggacaagccacgata

SEQ ID NO: 874262 - DNA, 25 bp, Mus musculus
tgctgcctaaggtcaagccacgata

SEQ ID NO: 874263 - DNA, 25 bp, Mus musculus
tgctgcctacacaacttatcccaga

SEQ ID NO: 874264 - DNA, 25 bp, Mus musculus
tgctgcctacactacttatcccaga

SEQ ID NO: 874265 - DNA, 25 bp, Mus musculus
tgctgcctacagagctaaaggaaaa

SEQ ID NO: 874266 - DNA, 25 bp, Mus musculus
tgctgcctacagtgctaaaggaaaa

SEQ ID NO: 874267 - DNA, 25 bp, Mus musculus
tgctgcctaccacactacatagttg

SEQ ID NO: 874268 - DNA, 25 bp, Mus musculus
tgctgcctaccacggtcaagctaga

SEQ ID NO: 874269 - DNA, 25 bp, Mus musculus
tgctgcctaccagactacatagttg

SEQ ID NO: 874270 - DNA, 25 bp, Mus musculus
tgctgcctaccagggtcaagctaga

SEQ ID NO: 874271 - DNA, 25 bp, Mus musculus
tgctgcctacccaaagtatcctggg

SEQ ID NO: 874272 - DNA, 25 bp, Mus musculus
tgctgcctaccctaagtatcctggg

SEQ ID NO: 874273 - DNA, 25 bp, Mus musculus
tgctgcctattgaaccacagtggta

SEQ ID NO: 874274 - DNA, 25 bp, Mus musculus
tgctgcctattgtaccacagtggta

SEQ ID NO: 874275 - DNA, 25 bp, Mus musculus
tgctgcctcataaagtaccactttc

SEQ ID NO: 874276 - DNA, 25 bp, Mus musculus
tgctgcctcatatagtaccactttc

SEQ ID NO: 874277 - DNA, 25 bp, Mus musculus
tgctgcctccatagtagacaagctg

SEQ ID NO: 874278 - DNA, 25 bp, Mus musculus
tgctgcctccattgtagacaagctg

SEQ ID NO: 874279 - DNA, 25 bp, Mus musculus
tgctgcctctcacgagttgtatgca

SEQ ID NO: 874280 - DNA, 25 bp, Mus musculus
tgctgcctctcaggagttgtatgca

SEQ ID NO: 874281 - DNA, 25 bp, Mus musculus
tgctgcctctctcggatgacatcct

SEQ ID NO: 874282 - DNA, 25 bp, Mus musculus
tgctgcctctctgggatgacatcct

SEQ ID NO: 874283 - DNA, 25 bp, Mus musculus
tgctgcctctgaaagttgaaccctt

SEQ ID NO: 874284 - DNA, 25 bp, Mus musculus
tgctgcctctgatagttgaaccctt

SEQ ID NO: 874285 - DNA, 25 bp, Mus musculus
tgctgcctgaatagttccacctaca

SEQ ID NO: 874286 - DNA, 25 bp, Mus musculus
tgctgcctgaattgttccacctaca

SEQ ID NO: 874287 - DNA, 25 bp, Mus musculus
tgctgcctgactatcgtgatgccct

SEQ ID NO: 874288 - DNA, 25 bp, Mus musculus
tgctgcctgactttcgtgatgccct

SEQ ID NO: 874289 - DNA, 25 bp, Mus musculus
tgctgcctgatgacagtcgggccag

SEQ ID NO: 874290 - DNA, 25 bp, Mus musculus
tgctgcctgatgtcagtcgggccag

SEQ ID NO: 874291 - DNA, 25 bp, Mus musculus
tgctgcctgcagagagatgtgttta

SEQ ID NO: 874292 - DNA, 25 bp, Mus musculus
tgctgcctgcagtgagatgtgttta

SEQ ID NO: 874293 - DNA, 25 bp, Mus musculus
tgctgcctgccaagacaactagaag

SEQ ID NO: 874294 - DNA, 25 bp, Mus musculus
tgctgcctgccatgacaactagaag

SEQ ID NO: 874295 - DNA, 25 bp, Mus musculus
tgctgcctggttctgttgtttgcaa

SEQ ID NO: 874296 - DNA, 25 bp, Mus musculus
tgctgcctggttgtgttgtttgcaa

SEQ ID NO: 874297 - DNA, 25 bp, Mus musculus
tgctgcctgtgtcgttcaccgacaa

SEQ ID NO: 874298 - DNA, 25 bp, Mus musculus
tgctgcctgtgtggttcaccgacaa

SEQ ID NO: 874299 - DNA, 25 bp, Mus musculus
tgctgccttagcatctagaacggag

SEQ ID NO: 874300 - DNA, 25 bp, Mus musculus
tgctgccttagcttctagaacggag

SEQ ID NO: 874301 - DNA, 25 bp, Mus musculus
tgctgccttattctaggaccactgt

SEQ ID NO: 874302 - DNA, 25 bp, Mus musculus
tgctgccttattgtaggaccactgt

SEQ ID NO: 874303 - DNA, 25 bp, Mus musculus
tgctgccttcgaagccgccctagga

SEQ ID NO: 874304 - DNA, 25 bp, Mus musculus
tgctgccttcgatgccgccctagga

SEQ ID NO: 874305 - DNA, 25 bp, Mus musculus
tgctgccttctacaaactagccttg

SEQ ID NO: 874306 - DNA, 25 bp, Mus musculus
tgctgccttctagaaactagccttg

SEQ ID NO: 874307 - DNA, 25 bp, Mus musculus
tgctgccttctgaaacttgagatgt

SEQ ID NO: 874308 - DNA, 25 bp, Mus musculus
tgctgccttctgtaacttgagatgt

SEQ ID NO: 874309 - DNA, 25 bp, Mus musculus
tgctgccttcttctgatgtccagag

SEQ ID NO: 874310 - DNA, 25 bp, Mus musculus
tgctgccttcttgtgatgtccagag

SEQ ID NO: 874311 - DNA, 25 bp, Mus musculus
tgctgccttgcaacctaggaggcag

SEQ ID NO: 874312 - DNA, 25 bp, Mus musculus
tgctgccttgcatcctaggaggcag

SEQ ID NO: 874313 - DNA, 25 bp, Mus musculus
tgctgccttgctcgctagcccaagg

SEQ ID NO: 874314 - DNA, 25 bp, Mus musculus
tgctgccttgctggctagcccaagg

SEQ ID NO: 874315 - DNA, 25 bp, Mus musculus
tgctgcctttagagtcctcctagat

SEQ ID NO: 874316 - DNA, 25 bp, Mus musculus
tgctgcctttagtgtcctcctagat

SEQ ID NO: 874317 - DNA, 25 bp, Mus musculus
tgctgcctttcaagggtcttaactc

SEQ ID NO: 874318 - DNA, 25 bp, Mus musculus
tgctgcctttcacagtgaccaatca

SEQ ID NO: 874319 - DNA, 25 bp, Mus musculus
tgctgcctttcagagtgaccaatca

SEQ ID NO: 874320 - DNA, 25 bp, Mus musculus
tgctgcctttcatgggtcttaactc

SEQ ID NO: 874321 - DNA, 25 bp, Mus musculus
tgctgcctttccacagaagcctgtt

SEQ ID NO: 874322 - DNA, 25 bp, Mus musculus
tgctgcctttcctcagaagcctgtt

SEQ ID NO: 874323 - DNA, 25 bp, Mus musculus
tgctgcctttgacttgtcttgggaa

SEQ ID NO: 874324 - DNA, 25 bp, Mus musculus
tgctgcctttgagttgtcttgggaa

SEQ ID NO: 874325 - DNA, 25 bp, Mus musculus
tgctgcctttgcagggtaggatgca

SEQ ID NO: 874326 - DNA, 25 bp, Mus musculus
tgctgcctttgctgggtaggatgca

SEQ ID NO: 874327 - DNA, 25 bp, Mus musculus
tgctgcctttggagtttgacatgaa

SEQ ID NO: 874328 - DNA, 25 bp, Mus musculus
tgctgcctttggattgcatttcaag

SEQ ID NO: 874329 - DNA, 25 bp, Mus musculus
tgctgcctttggtgtttgacatgaa

SEQ ID NO: 874330 - DNA, 25 bp, Mus musculus
tgctgcctttggtttgcatttcaag

SEQ ID NO: 874331 - DNA, 25 bp, Mus musculus
tgctgcctttgtaacagattatgag

SEQ ID NO: 874332 - DNA, 25 bp, Mus musculus
tgctgcctttgttacagattatgag

SEQ ID NO: 874333 - DNA, 25 bp, Mus musculus
tgctgccttttgagtcctgggctca

SEQ ID NO: 874334 - DNA, 25 bp, Mus musculus
tgctgccttttgtgtcctgggctca

SEQ ID NO: 874335 - DNA, 25 bp, Mus musculus
tgctgcgaacacaaaagggaatatt

SEQ ID NO: 874336 - DNA, 25 bp, Mus musculus
tgctgcgaacactaaagggaatatt

SEQ ID NO: 874337 - DNA, 25 bp, Mus musculus
tgctgcgaccttataatacctcatg

SEQ ID NO: 874338 - DNA, 25 bp, Mus musculus
tgctgcgaccttttaatacctcatg

SEQ ID NO: 874339 - DNA, 25 bp, Mus musculus
tgctgcgactctctcacaatattgt

SEQ ID NO: 874340 - DNA, 25 bp, Mus musculus
tgctgcgactctgtcacaatattgt

SEQ ID NO: 874341 - DNA, 25 bp, Mus musculus
tgctgcgagagccagatgagcttcc

SEQ ID NO: 874342 - DNA, 25 bp, Mus musculus
tgctgcgagagcgagatgagcttcc

SEQ ID NO: 874343 - DNA, 25 bp, Mus musculus
tgctgcgagcagattatagatacat

SEQ ID NO: 874344 - DNA, 25 bp, Mus musculus
tgctgcgagcagtttatagatacat

SEQ ID NO: 874345 - DNA, 25 bp, Mus musculus
tgctgcgagcgcagagaatgtacct

SEQ ID NO: 874346 - DNA, 25 bp, Mus musculus
tgctgcgagcgctgagaatgtacct

SEQ ID NO: 874347 - DNA, 25 bp, Mus musculus
tgctgcgagtttcacctatggatat

SEQ ID NO: 874348 - DNA, 25 bp, Mus musculus
tgctgcgagtttgacctatggatat

SEQ ID NO: 874349 - DNA, 25 bp, Mus musculus
tgctgcgataaaaccccgagacaac

SEQ ID NO: 874350 - DNA, 25 bp, Mus musculus
tgctgcgataaatccccgagacaac

SEQ ID NO: 874351 - DNA, 25 bp, Mus musculus
tgctgcgatacgaagttcctgaaga

SEQ ID NO: 874352 - DNA, 25 bp, Mus musculus
tgctgcgatacgtagttcctgaaga

SEQ ID NO: 874353 - DNA, 25 bp, Mus musculus
tgctgcgcatccagatcctgaggag

SEQ ID NO: 874354 - DNA, 25 bp, Mus musculus
tgctgcgcatcctgatcctgaggag

SEQ ID NO: 874355 - DNA, 25 bp, Mus musculus
tgctgcgccatcagggcagtgtaac

SEQ ID NO: 874356 - DNA, 25 bp, Mus musculus
tgctgcgccatctgggcagtgtaac

SEQ ID NO: 874357 - DNA, 25 bp, Mus musculus
tgctgcgcccatattcagaacatga

SEQ ID NO: 874358 - DNA, 25 bp, Mus musculus
tgctgcgcccattttcagaacatga

SEQ ID NO: 874359 - DNA, 25 bp, Mus musculus
tgctgcgcccctcttagctcataaa

SEQ ID NO: 874360 - DNA, 25 bp, Mus musculus
tgctgcgcccctgttagctcataaa

SEQ ID NO: 874361 - DNA, 25 bp, Mus musculus
tgctgcgcctgaagctgggacagcc

SEQ ID NO: 874362 - DNA, 25 bp, Mus musculus
tgctgcgcctgatgctgggacagcc

SEQ ID NO: 874363 - DNA, 25 bp, Mus musculus
tgctgcgctgagacaaacccaagtg

SEQ ID NO: 874364 - DNA, 25 bp, Mus musculus
tgctgcgctgagtcaaacccaagtg

SEQ ID NO: 874365 - DNA, 25 bp, Mus musculus
tgctgcggagcacctgacattgtct

SEQ ID NO: 874366 - DNA, 25 bp, Mus musculus
tgctgcggagcagctgacattgtct

SEQ ID NO: 874367 - DNA, 25 bp, Mus musculus
tgctgcggaggaagccaaaggtctc

SEQ ID NO: 874368 - DNA, 25 bp, Mus musculus
tgctgcggaggatgccaaaggtctc

SEQ ID NO: 874369 - DNA, 25 bp, Mus musculus
tgctgcggcacaacctttaccaggg

SEQ ID NO: 874370 - DNA, 25 bp, Mus musculus
tgctgcggcacatcctttaccaggg

SEQ ID NO: 874371 - DNA, 25 bp, Mus musculus
tgctgcggcagcagcgtgactttta

SEQ ID NO: 874372 - DNA, 25 bp, Mus musculus
tgctgcggcagctgcgtgactttta

SEQ ID NO: 874373 - DNA, 25 bp, Mus musculus
tgctgcggccagagctcaacgcggt

SEQ ID NO: 874374 - DNA, 25 bp, Mus musculus
tgctgcggccagtgctcaacgcggt

SEQ ID NO: 874375 - DNA, 25 bp, Mus musculus
tgctgcgtggacatcctatctctaa

SEQ ID NO: 874376 - DNA, 25 bp, Mus musculus
tgctgcgtggacttcctatctctaa

SEQ ID NO: 874377 - DNA, 25 bp, Mus musculus
tgctgcgtgtgccaaaggcgcggaa

SEQ ID NO: 874378 - DNA, 25 bp, Mus musculus
tgctgcgtgtgcgaaaggcgcggaa

SEQ ID NO: 874379 - DNA, 25 bp, Mus musculus
tgctgctaaacacggttcagaaatt

SEQ ID NO: 874380 - DNA, 25 bp, Mus musculus
tgctgctaaacagggttcagaaatt

SEQ ID NO: 874381 - DNA, 25 bp, Mus musculus
tgctgctaaagcaaccactgataac

SEQ ID NO: 874382 - DNA, 25 bp, Mus musculus
tgctgctaaagctaccactgataac

SEQ ID NO: 874383 - DNA, 25 bp, Mus musculus
tgctgctaacttccatcctgagttt

SEQ ID NO: 874384 - DNA, 25 bp, Mus musculus
tgctgctaacttgcatcctgagttt

SEQ ID NO: 874385 - DNA, 25 bp, Mus musculus
tgctgctaagctagcaaccagggtt

SEQ ID NO: 874386 - DNA, 25 bp, Mus musculus
tgctgctaagcttgcaaccagggtt

SEQ ID NO: 874387 - DNA, 25 bp, Mus musculus
tgctgctaaggcaggtacagctggc

SEQ ID NO: 874388 - DNA, 25 bp, Mus musculus
tgctgctaaggctggtacagctggc

SEQ ID NO: 874389 - DNA, 25 bp, Mus musculus
tgctgctaatctcatccctttgggc

SEQ ID NO: 874390 - DNA, 25 bp, Mus musculus
tgctgctaatctgatccctttgggc

SEQ ID NO: 874391 - DNA, 25 bp, Mus musculus
tgctgctaccatccctaactaaact

SEQ ID NO: 874392 - DNA, 25 bp, Mus musculus
tgctgctaccatgcctaactaaact

SEQ ID NO: 874393 - DNA, 25 bp, Mus musculus
tgctgctacccacagtcagagcatc

SEQ ID NO: 874394 - DNA, 25 bp, Mus musculus
tgctgctacccagagtcagagcatc

SEQ ID NO: 874395 - DNA, 25 bp, Mus musculus
tgctgctacctgctgggagtctgat

SEQ ID NO: 874396 - DNA, 25 bp, Mus musculus
tgctgctacctggtgggagtctgat

SEQ ID NO: 874397 - DNA, 25 bp, Mus musculus
tgctgctaccttcatctttaaatat

SEQ ID NO: 874398 - DNA, 25 bp, Mus musculus
tgctgctaccttgatctttaaatat

SEQ ID NO: 874399 - DNA, 25 bp, Mus musculus
tgctgctacgcactgacaagttgga

SEQ ID NO: 874400 - DNA, 25 bp, Mus musculus
tgctgctacgcagtgacaagttgga

SEQ ID NO: 874401 - DNA, 25 bp, Mus musculus
tgctgctactcacaaggctcagtag

SEQ ID NO: 874402 - DNA, 25 bp, Mus musculus
tgctgctactcagaaggctcagtag

SEQ ID NO: 874403 - DNA, 25 bp, Mus musculus
tgctgctacttacagtccatttcac

SEQ ID NO: 874404 - DNA, 25 bp, Mus musculus
tgctgctacttagagtccatttcac

SEQ ID NO: 874405 - DNA, 25 bp, Mus musculus
tgctgctagcccaactcatcttaag

SEQ ID NO: 874406 - DNA, 25 bp, Mus musculus
tgctgctagccctactcatcttaag

SEQ ID NO: 874407 - DNA, 25 bp, Mus musculus
tgctgctagcctcgaaagagcctct

SEQ ID NO: 874408 - DNA, 25 bp, Mus musculus
tgctgctagcctggaaagagcctct

SEQ ID NO: 874409 - DNA, 25 bp, Mus musculus
tgctgctagcttcggatgtctggcc

SEQ ID NO: 874410 - DNA, 25 bp, Mus musculus
tgctgctagcttgggatgtctggcc

SEQ ID NO: 874411 - DNA, 25 bp, Mus musculus
tgctgctagggaacacaatcctggt

SEQ ID NO: 874412 - DNA, 25 bp, Mus musculus
tgctgctagggatcacaatcctggt

SEQ ID NO: 874413 - DNA, 25 bp, Mus musculus
tgctgctagtccaacatgctacaga

SEQ ID NO: 874414 - DNA, 25 bp, Mus musculus
tgctgctagtcctacatgctacaga

SEQ ID NO: 874415 - DNA, 25 bp, Mus musculus
tgctgctatactcaatcagggagaa

SEQ ID NO: 874416 - DNA, 25 bp, Mus musculus
tgctgctatactgaatcagggagaa

SEQ ID NO: 874417 - DNA, 25 bp, Mus musculus
tgctgctatctaaacctcctggatg

SEQ ID NO: 874418 - DNA, 25 bp, Mus musculus
tgctgctatctatacctcctggatg

SEQ ID NO: 874419 - DNA, 25 bp, Mus musculus
tgctgctatgaaagtggcgtacacc

SEQ ID NO: 874420 - DNA, 25 bp, Mus musculus
tgctgctatgaatgtggcgtacacc

SEQ ID NO: 874421 - DNA, 25 bp, Mus musculus
tgctgctatgctatcctgaaggtca

SEQ ID NO: 874422 - DNA, 25 bp, Mus musculus
tgctgctatgctttcctgaaggtca

SEQ ID NO: 874423 - DNA, 25 bp, Mus musculus
tgctgctatggtcgtctgaggactt

SEQ ID NO: 874424 - DNA, 25 bp, Mus musculus
tgctgctatggtggtctgaggactt

SEQ ID NO: 874425 - DNA, 25 bp, Mus musculus
tgctgctcaagtatcgagtgatcga

SEQ ID NO: 874426 - DNA, 25 bp, Mus musculus
tgctgctcaagtttcgagtgatcga

SEQ ID NO: 874427 - DNA, 25 bp, Mus musculus
tgctgctcacccaagaaccatgtag

SEQ ID NO: 874428 - DNA, 25 bp, Mus musculus
tgctgctcaccctagaaccatgtag

SEQ ID NO: 874429 - DNA, 25 bp, Mus musculus
tgctgctcagtcagaattcacgagt

SEQ ID NO: 874430 - DNA, 25 bp, Mus musculus
tgctgctcagtctgaattcacgagt

SEQ ID NO: 874431 - DNA, 25 bp, Mus musculus
tgctgctcagtgagggatgaccgca

SEQ ID NO: 874432 - DNA, 25 bp, Mus musculus
tgctgctcagtgtgggatgaccgca

SEQ ID NO: 874433 - DNA, 25 bp, Mus musculus
tgctgctcatccagtcatggctggg

SEQ ID NO: 874434 - DNA, 25 bp, Mus musculus
tgctgctcatcctgtcatggctggg

SEQ ID NO: 874435 - DNA, 25 bp, Mus musculus
tgctgctccatgctttggccaataa

SEQ ID NO: 874436 - DNA, 25 bp, Mus musculus
tgctgctccatggtttggccaataa

SEQ ID NO: 874437 - DNA, 25 bp, Mus musculus
tgctgctccattaccataggtgtgg

SEQ ID NO: 874438 - DNA, 25 bp, Mus musculus
tgctgctccatttccataggtgtgg

SEQ ID NO: 874439 - DNA, 25 bp, Mus musculus
tgctgctcccacaagctaactttaa

SEQ ID NO: 874440 - DNA, 25 bp, Mus musculus
tgctgctcccactagctaactttaa

SEQ ID NO: 874441 - DNA, 25 bp, Mus musculus
tgctgctcccgtcgtagcaagaaga

SEQ ID NO: 874442 - DNA, 25 bp, Mus musculus
tgctgctcccgtggtagcaagaaga

SEQ ID NO: 874443 - DNA, 25 bp, Mus musculus
tgctgctccctacacattagagttt

SEQ ID NO: 874444 - DNA, 25 bp, Mus musculus
tgctgctccctagacattagagttt

SEQ ID NO: 874445 - DNA, 25 bp, Mus musculus
tgctgctccctcatagacaatgtca

SEQ ID NO: 874446 - DNA, 25 bp, Mus musculus
tgctgctccctcttagacaatgtca

SEQ ID NO: 874447 - DNA, 25 bp, Mus musculus
tgctgctccgctatatttaattggg

SEQ ID NO: 874448 - DNA, 25 bp, Mus musculus
tgctgctccgctttatttaattggg

SEQ ID NO: 874449 - DNA, 25 bp, Mus musculus
tgctgctcctgacaagtgtgtgtta

SEQ ID NO: 874450 - DNA, 25 bp, Mus musculus
tgctgctcctgagaagtgtgtgtta

SEQ ID NO: 874451 - DNA, 25 bp, Mus musculus
tgctgctcctggaagaccgtctgca

SEQ ID NO: 874452 - DNA, 25 bp, Mus musculus
tgctgctcctggtagaccgtctgca

SEQ ID NO: 874453 - DNA, 25 bp, Mus musculus
tgctgctccttacctggtctaaata

SEQ ID NO: 874454 - DNA, 25 bp, Mus musculus
tgctgctccttagctggtctaaata

SEQ ID NO: 874455 - DNA, 25 bp, Mus musculus
tgctgctccttcacagataggacgt

SEQ ID NO: 874456 - DNA, 25 bp, Mus musculus
tgctgctccttctcagataggacgt

SEQ ID NO: 874457 - DNA, 25 bp, Mus musculus
tgctgctcgagtagggctgcttcca

SEQ ID NO: 874458 - DNA, 25 bp, Mus musculus
tgctgctcgagttgggctgcttcca

SEQ ID NO: 874459 - DNA, 25 bp, Mus musculus
tgctgctcgcctacttcagtcgcct

SEQ ID NO: 874460 - DNA, 25 bp, Mus musculus
tgctgctcgccttcttcagtcgcct

SEQ ID NO: 874461 - DNA, 25 bp, Mus musculus
tgctgctcgctaatgagtgtccaga

SEQ ID NO: 874462 - DNA, 25 bp, Mus musculus
tgctgctcgctattgagtgtccaga

SEQ ID NO: 874463 - DNA, 25 bp, Mus musculus
tgctgctctaatctcacaatttcac

SEQ ID NO: 874464 - DNA, 25 bp, Mus musculus
tgctgctctaatgtcacaatttcac

SEQ ID NO: 874465 - DNA, 25 bp, Mus musculus
tgctgctctgacacttcattttgaa

SEQ ID NO: 874466 - DNA, 25 bp, Mus musculus
tgctgctctgactcttcattttgaa

SEQ ID NO: 874467 - DNA, 25 bp, Mus musculus
tgctgctctgagctcacacttagac

SEQ ID NO: 874468 - DNA, 25 bp, Mus musculus
tgctgctctgaggtcacacttagac

SEQ ID NO: 874469 - DNA, 25 bp, Mus musculus
tgctgctctggtaaggctgaggtta

SEQ ID NO: 874470 - DNA, 25 bp, Mus musculus
tgctgctctggttaggctgaggtta

SEQ ID NO: 874471 - DNA, 25 bp, Mus musculus
tgctgctcttgtagattgatttcca

SEQ ID NO: 874472 - DNA, 25 bp, Mus musculus
tgctgctcttgtattgggttatttt

SEQ ID NO: 874473 - DNA, 25 bp, Mus musculus
tgctgctcttgttgattgatttcca

SEQ ID NO: 874474 - DNA, 25 bp, Mus musculus
tgctgctcttgttttgggttatttt

SEQ ID NO: 874475 - DNA, 25 bp, Mus musculus
tgctgctgacagagctctgccctga

SEQ ID NO: 874476 - DNA, 25 bp, Mus musculus
tgctgctgacagtgctctgccctga

SEQ ID NO: 874477 - DNA, 25 bp, Mus musculus
tgctgctgacccagcgtgcaaaaat

SEQ ID NO: 874478 - DNA, 25 bp, Mus musculus
tgctgctgaccctgcgtgcaaaaat

SEQ ID NO: 874479 - DNA, 25 bp, Mus musculus
tgctgctgacctagagcgggttact

SEQ ID NO: 874480 - DNA, 25 bp, Mus musculus
tgctgctgaccttgagcgggttact

SEQ ID NO: 874481 - DNA, 25 bp, Mus musculus
tgctgctgactaaatccctattctg

SEQ ID NO: 874482 - DNA, 25 bp, Mus musculus
tgctgctgactatatccctattctg

SEQ ID NO: 874483 - DNA, 25 bp, Mus musculus
tgctgctgacttaccgaatgtgtgg

SEQ ID NO: 874484 - DNA, 25 bp, Mus musculus
tgctgctgactttccgaatgtgtgg

SEQ ID NO: 874485 - DNA, 25 bp, Mus musculus
tgctgctgagcccaaattatcatga

SEQ ID NO: 874486 - DNA, 25 bp, Mus musculus
tgctgctgagccgaaattatcatga

SEQ ID NO: 874487 - DNA, 25 bp, Mus musculus
tgctgctgaggaacccttacagttt

SEQ ID NO: 874488 - DNA, 25 bp, Mus musculus
tgctgctgaggatcccttacagttt

SEQ ID NO: 874489 - DNA, 25 bp, Mus musculus
tgctgctgaggcacacggtacagag

SEQ ID NO: 874490 - DNA, 25 bp, Mus musculus
tgctgctgaggctcacggtacagag

SEQ ID NO: 874491 - DNA, 25 bp, Mus musculus
tgctgctgatcacggcccttgcact

SEQ ID NO: 874492 - DNA, 25 bp, Mus musculus
tgctgctgatcagggcccttgcact

SEQ ID NO: 874493 - DNA, 25 bp, Mus musculus
tgctgctgcagtctatgtcatggac

SEQ ID NO: 874494 - DNA, 25 bp, Mus musculus
tgctgctgcagtgtatgtcatggac

SEQ ID NO: 874495 - DNA, 25 bp, Mus musculus
tgctgctgcatcagttctcagcttc

SEQ ID NO: 874496 - DNA, 25 bp, Mus musculus
tgctgctgcatctgttctcagcttc

SEQ ID NO: 874497 - DNA, 25 bp, Mus musculus
tgctgctgcctacctgagtagaagt

SEQ ID NO: 874498 - DNA, 25 bp, Mus musculus
tgctgctgcctagctgagtagaagt

SEQ ID NO: 874499 - DNA, 25 bp, Mus musculus
tgctgctgcctcagaaataacactt

SEQ ID NO: 874500 - DNA, 25 bp, Mus musculus
tgctgctgcctctgaaataacactt

SEQ ID NO: 874501 - DNA, 25 bp, Mus musculus
tgctgctgccttcttttgacacaga

SEQ ID NO: 874502 - DNA, 25 bp, Mus musculus
tgctgctgccttgttttgacacaga

SEQ ID NO: 874503 - DNA, 25 bp, Mus musculus
tgctgctgcggtagctgctgtattc

SEQ ID NO: 874504 - DNA, 25 bp, Mus musculus
tgctgctgcggttgctgctgtattc

SEQ ID NO: 874505 - DNA, 25 bp, Mus musculus
tgctgctgctacctaattggtgctg

SEQ ID NO: 874506 - DNA, 25 bp, Mus musculus
tgctgctgctacgtaattggtgctg

SEQ ID NO: 874507 - DNA, 25 bp, Mus musculus
tgctgctgctagaaaatgattcaca

SEQ ID NO: 874508 - DNA, 25 bp, Mus musculus
tgctgctgctagaggctgcggccca

SEQ ID NO: 874509 - DNA, 25 bp, Mus musculus
tgctgctgctagtaaatgattcaca

SEQ ID NO: 874510 - DNA, 25 bp, Mus musculus
tgctgctgctagtggctgcggccca

SEQ ID NO: 874511 - DNA, 25 bp, Mus musculus
tgctgctgctctctgagcactttca

SEQ ID NO: 874512 - DNA, 25 bp, Mus musculus
tgctgctgctctgtgagcactttca

SEQ ID NO: 874513 - DNA, 25 bp, Mus musculus
tgctgctgctgcacgttagggtgca

SEQ ID NO: 874514 - DNA, 25 bp, Mus musculus
tgctgctgctgctcgttagggtgca

SEQ ID NO: 874515 - DNA, 25 bp, Mus musculus
tgctgctgcttcaaacagttaggaa

SEQ ID NO: 874516 - DNA, 25 bp, Mus musculus
tgctgctgcttctaacagttaggaa

SEQ ID NO: 874517 - DNA, 25 bp, Mus musculus
tgctgctgcttgaactctgccatta

SEQ ID NO: 874518 - DNA, 25 bp, Mus musculus
tgctgctgcttgtactctgccatta

SEQ ID NO: 874519 - DNA, 25 bp, Mus musculus
tgctgctggaacagggtccttccca

SEQ ID NO: 874520 - DNA, 25 bp, Mus musculus
tgctgctggaactgggtccttccca

SEQ ID NO: 874521 - DNA, 25 bp, Mus musculus
tgctgctggaatacgtggcacgcgc

SEQ ID NO: 874522 - DNA, 25 bp, Mus musculus
tgctgctggaattcgtggcacgcgc

SEQ ID NO: 874523 - DNA, 25 bp, Mus musculus
tgctgctggacaacccatgtgcgga

SEQ ID NO: 874524 - DNA, 25 bp, Mus musculus
tgctgctggacatcccatgtgcgga

SEQ ID NO: 874525 - DNA, 25 bp, Mus musculus
tgctgctggatcagaccgagaactg

SEQ ID NO: 874526 - DNA, 25 bp, Mus musculus
tgctgctggatctgaccgagaactg

SEQ ID NO: 874527 - DNA, 25 bp, Mus musculus
tgctgctggcatatctcacttttag

SEQ ID NO: 874528 - DNA, 25 bp, Mus musculus
tgctgctggcatttctcacttttag

SEQ ID NO: 874529 - DNA, 25 bp, Mus musculus
tgctgctggcccactacaggagtgt

SEQ ID NO: 874530 - DNA, 25 bp, Mus musculus
tgctgctggccctctacaggagtgt

SEQ ID NO: 874531 - DNA, 25 bp, Mus musculus
tgctgctgggaaaaacctttagttt

SEQ ID NO: 874532 - DNA, 25 bp, Mus musculus
tgctgctgggaataacctttagttt

SEQ ID NO: 874533 - DNA, 25 bp, Mus musculus
tgctgctgggagattgttttccatc

SEQ ID NO: 874534 - DNA, 25 bp, Mus musculus
tgctgctgggagtttgttttccatc

SEQ ID NO: 874535 - DNA, 25 bp, Mus musculus
tgctgctggtgtatgactcttgatg

SEQ ID NO: 874536 - DNA, 25 bp, Mus musculus
tgctgctggtgtccatcccacatca

SEQ ID NO: 874537 - DNA, 25 bp, Mus musculus
tgctgctggtgtgcatcccacatca

SEQ ID NO: 874538 - DNA, 25 bp, Mus musculus
tgctgctggtgtttgactcttgatg

SEQ ID NO: 874539 - DNA, 25 bp, Mus musculus
tgctgctggttcattgaaggtctaa

SEQ ID NO: 874540 - DNA, 25 bp, Mus musculus
tgctgctggttctttgaaggtctaa

SEQ ID NO: 874541 - DNA, 25 bp, Mus musculus
tgctgctggttgaccttaacatgat

SEQ ID NO: 874542 - DNA, 25 bp, Mus musculus
tgctgctggttgtccttaacatgat

SEQ ID NO: 874543 - DNA, 25 bp, Mus musculus
tgctgctgtaagaccccaatgcaat

SEQ ID NO: 874544 - DNA, 25 bp, Mus musculus
tgctgctgtaagtccccaatgcaat

SEQ ID NO: 874545 - DNA, 25 bp, Mus musculus
tgctgctgtaccagctctttaacta

SEQ ID NO: 874546 - DNA, 25 bp, Mus musculus
tgctgctgtacctgctctttaacta

SEQ ID NO: 874547 - DNA, 25 bp, Mus musculus
tgctgctgtagcatcagtcatctga

SEQ ID NO: 874548 - DNA, 25 bp, Mus musculus
tgctgctgtagcttcagtcatctga

SEQ ID NO: 874549 - DNA, 25 bp, Mus musculus
tgctgctgtataacctggcggcaaa

SEQ ID NO: 874550 - DNA, 25 bp, Mus musculus
tgctgctgtatatcctggcggcaaa

SEQ ID NO: 874551 - DNA, 25 bp, Mus musculus
tgctgctgtcaacttttcatccagg

SEQ ID NO: 874552 - DNA, 25 bp, Mus musculus
tgctgctgtcaagttttcatccagg

SEQ ID NO: 874553 - DNA, 25 bp, Mus musculus
tgctgctgtcccaagagagctttta

SEQ ID NO: 874554 - DNA, 25 bp, Mus musculus
tgctgctgtccctagagagctttta

SEQ ID NO: 874555 - DNA, 25 bp, Mus musculus
tgctgctgtgcaactcaaagacctg

SEQ ID NO: 874556 - DNA, 25 bp, Mus musculus
tgctgctgtgcacggtcactgcctg

SEQ ID NO: 874557 - DNA, 25 bp, Mus musculus
tgctgctgtgcagggtcactgcctg

SEQ ID NO: 874558 - DNA, 25 bp, Mus musculus
tgctgctgtgcatctcaaagacctg

SEQ ID NO: 874559 - DNA, 25 bp, Mus musculus
tgctgctgtgcgctggctgcaccat

SEQ ID NO: 874560 - DNA, 25 bp, Mus musculus
tgctgctgtgcggtggctgcaccat

SEQ ID NO: 874561 - DNA, 25 bp, Mus musculus
tgctgctgtgtcctatgaactttgt

SEQ ID NO: 874562 - DNA, 25 bp, Mus musculus
tgctgctgtgtcgtatgaactttgt

SEQ ID NO: 874563 - DNA, 25 bp, Mus musculus
tgctgctgtgtgagacgagatcaga

SEQ ID NO: 874564 - DNA, 25 bp, Mus musculus
tgctgctgtgtgtgacgagatcaga

SEQ ID NO: 874565 - DNA, 25 bp, Mus musculus
tgctgctgttacacatttctggatt

SEQ ID NO: 874566 - DNA, 25 bp, Mus musculus
tgctgctgttactcatttctggatt

SEQ ID NO: 874567 - DNA, 25 bp, Mus musculus
tgctgctgttctaggtactcattta

SEQ ID NO: 874568 - DNA, 25 bp, Mus musculus
tgctgctgttcttggtactcattta

SEQ ID NO: 874569 - DNA, 25 bp, Mus musculus
tgctgctgttgcaagctagtgctaa

SEQ ID NO: 874570 - DNA, 25 bp, Mus musculus
tgctgctgttgctagctagtgctaa

SEQ ID NO: 874571 - DNA, 25 bp, Mus musculus
tgctgctgttggcacaggcaccaca

SEQ ID NO: 874572 - DNA, 25 bp, Mus musculus
tgctgctgttgggacaggcaccaca

SEQ ID NO: 874573 - DNA, 25 bp, Mus musculus
tgctgctgttttaggaggcacaacc

SEQ ID NO: 874574 - DNA, 25 bp, Mus musculus
tgctgctgtttttggaggcacaacc

SEQ ID NO: 874575 - DNA, 25 bp, Mus musculus
tgctgcttacaaagcattctcttcc

SEQ ID NO: 874576 - DNA, 25 bp, Mus musculus
tgctgcttacaatgcattctcttcc

SEQ ID NO: 874577 - DNA, 25 bp, Mus musculus
tgctgcttacataactctaatccct

SEQ ID NO: 874578 - DNA, 25 bp, Mus musculus
tgctgcttacattactctaatccct

SEQ ID NO: 874579 - DNA, 25 bp, Mus musculus
tgctgcttaccaactataacgctta

SEQ ID NO: 874580 - DNA, 25 bp, Mus musculus
tgctgcttaccaatgctctcttgct

SEQ ID NO: 874581 - DNA, 25 bp, Mus musculus
tgctgcttaccatctataacgctta

SEQ ID NO: 874582 - DNA, 25 bp, Mus musculus
tgctgcttaccattgctctcttgct

SEQ ID NO: 874583 - DNA, 25 bp, Mus musculus
tgctgcttatacacgagtggaatcc

SEQ ID NO: 874584 - DNA, 25 bp, Mus musculus
tgctgcttatactcgagtggaatcc

SEQ ID NO: 874585 - DNA, 25 bp, Mus musculus
tgctgcttattacattgccaccaaa

SEQ ID NO: 874586 - DNA, 25 bp, Mus musculus
tgctgcttattagattgccaccaaa

SEQ ID NO: 874587 - DNA, 25 bp, Mus musculus
tgctgcttcatgaccaaggcttgat

SEQ ID NO: 874588 - DNA, 25 bp, Mus musculus
tgctgcttcatgtccaaggcttgat

SEQ ID NO: 874589 - DNA, 25 bp, Mus musculus
tgctgcttccaaacttctttttctg

SEQ ID NO: 874590 - DNA, 25 bp, Mus musculus
tgctgcttccaatcttctttttctg

SEQ ID NO: 874591 - DNA, 25 bp, Mus musculus
tgctgcttccacaccggaggataag

SEQ ID NO: 874592 - DNA, 25 bp, Mus musculus
tgctgcttccactccggaggataag

SEQ ID NO: 874593 - DNA, 25 bp, Mus musculus
tgctgcttcccaattggttaccagg

SEQ ID NO: 874594 - DNA, 25 bp, Mus musculus
tgctgcttcccatttggttaccagg

SEQ ID NO: 874595 - DNA, 25 bp, Mus musculus
tgctgcttccccagatgagcagaag

SEQ ID NO: 874596 - DNA, 25 bp, Mus musculus
tgctgcttcccctgatgagcagaag

SEQ ID NO: 874597 - DNA, 25 bp, Mus musculus
tgctgcttccctaaacgggcagaaa

SEQ ID NO: 874598 - DNA, 25 bp, Mus musculus
tgctgcttcccttaacgggcagaaa

SEQ ID NO: 874599 - DNA, 25 bp, Mus musculus
tgctgcttcgaccactactggtaaa

SEQ ID NO: 874600 - DNA, 25 bp, Mus musculus
tgctgcttcgacgactactggtaaa

SEQ ID NO: 874601 - DNA, 25 bp, Mus musculus
tgctgcttcgttctggagcctcgaa

SEQ ID NO: 874602 - DNA, 25 bp, Mus musculus
tgctgcttcgttgtggagcctcgaa

SEQ ID NO: 874603 - DNA, 25 bp, Mus musculus
tgctgcttctagagtccttccggcg

SEQ ID NO: 874604 - DNA, 25 bp, Mus musculus
tgctgcttctagatcactctctgac

SEQ ID NO: 874605 - DNA, 25 bp, Mus musculus
tgctgcttctagtgtccttccggcg

SEQ ID NO: 874606 - DNA, 25 bp, Mus musculus
tgctgcttctagttcactctctgac

SEQ ID NO: 874607 - DNA, 25 bp, Mus musculus
tgctgcttctcacgcagattccaag

SEQ ID NO: 874608 - DNA, 25 bp, Mus musculus
tgctgcttctcaggcagattccaag

SEQ ID NO: 874609 - DNA, 25 bp, Mus musculus
tgctgcttctccaacagccggaaga

SEQ ID NO: 874610 - DNA, 25 bp, Mus musculus
tgctgcttctcctacagccggaaga

SEQ ID NO: 874611 - DNA, 25 bp, Mus musculus
tgctgcttctgacccactataataa

SEQ ID NO: 874612 - DNA, 25 bp, Mus musculus
tgctgcttctgagccactataataa

SEQ ID NO: 874613 - DNA, 25 bp, Mus musculus
tgctgcttctggagcttaaagatgt

SEQ ID NO: 874614 - DNA, 25 bp, Mus musculus
tgctgcttctggtgcttaaagatgt

SEQ ID NO: 874615 - DNA, 25 bp, Mus musculus
tgctgcttgaccacatgggatgtac

SEQ ID NO: 874616 - DNA, 25 bp, Mus musculus
tgctgcttgacctcatgggatgtac

SEQ ID NO: 874617 - DNA, 25 bp, Mus musculus
tgctgcttgcagacccttagtacat

SEQ ID NO: 874618 - DNA, 25 bp, Mus musculus
tgctgcttgcagtcccttagtacat

SEQ ID NO: 874619 - DNA, 25 bp, Mus musculus
tgctgcttgcatactgtccttattt

SEQ ID NO: 874620 - DNA, 25 bp, Mus musculus
tgctgcttgcattctgtccttattt

SEQ ID NO: 874621 - DNA, 25 bp, Mus musculus
tgctgcttgccacaggttagctttc

SEQ ID NO: 874622 - DNA, 25 bp, Mus musculus
tgctgcttgccagaggttagctttc

SEQ ID NO: 874623 - DNA, 25 bp, Mus musculus
tgctgcttgcttcaggtcactatca

SEQ ID NO: 874624 - DNA, 25 bp, Mus musculus
tgctgcttgcttcttttctcaccag

SEQ ID NO: 874625 - DNA, 25 bp, Mus musculus
tgctgcttgcttgaggtcactatca

SEQ ID NO: 874626 - DNA, 25 bp, Mus musculus
tgctgcttgcttgttttctcaccag

SEQ ID NO: 874627 - DNA, 25 bp, Mus musculus
tgctgcttggccagtatgagaagta

SEQ ID NO: 874628 - DNA, 25 bp, Mus musculus
tgctgcttggcctgtatgagaagta

SEQ ID NO: 874629 - DNA, 25 bp, Mus musculus
tgctgcttgggtcgaccgcccatca

SEQ ID NO: 874630 - DNA, 25 bp, Mus musculus
tgctgcttgggtcggatattttccc

SEQ ID NO: 874631 - DNA, 25 bp, Mus musculus
tgctgcttgggtggaccgcccatca

SEQ ID NO: 874632 - DNA, 25 bp, Mus musculus
tgctgcttgggtgggatattttccc

SEQ ID NO: 874633 - DNA, 25 bp, Mus musculus
tgctgcttgtatctgaggctccgaa

SEQ ID NO: 874634 - DNA, 25 bp, Mus musculus
tgctgcttgtatgtgaggctccgaa

SEQ ID NO: 874635 - DNA, 25 bp, Mus musculus
tgctgcttgtgcatgggagaacatt

SEQ ID NO: 874636 - DNA, 25 bp, Mus musculus
tgctgcttgtgcttgggagaacatt

SEQ ID NO: 874637 - DNA, 25 bp, Mus musculus
tgctgctttaaacgtgtcaatacat

SEQ ID NO: 874638 - DNA, 25 bp, Mus musculus
tgctgctttaaaggtgtcaatacat

SEQ ID NO: 874639 - DNA, 25 bp, Mus musculus
tgctgctttctgagttgttcttgtt

SEQ ID NO: 874640 - DNA, 25 bp, Mus musculus
tgctgctttctgtgttgttcttgtt

SEQ ID NO: 874641 - DNA, 25 bp, Mus musculus
tgctgctttcttacgtcaggctgct

SEQ ID NO: 874642 - DNA, 25 bp, Mus musculus
tgctgctttcttactcttagcattt

SEQ ID NO: 874643 - DNA, 25 bp, Mus musculus
tgctgctttctttcgtcaggctgct

SEQ ID NO: 874644 - DNA, 25 bp, Mus musculus
tgctgctttctttctcttagcattt

SEQ ID NO: 874645 - DNA, 25 bp, Mus musculus
tgctgctttgctccttggagccata

SEQ ID NO: 874646 - DNA, 25 bp, Mus musculus
tgctgctttgctgcttggagccata

SEQ ID NO: 874647 - DNA, 25 bp, Mus musculus
tgctgctttgtgctgagagaacatg

SEQ ID NO: 874648 - DNA, 25 bp, Mus musculus
tgctgctttgtggtgagagaacatg

SEQ ID NO: 874649 - DNA, 25 bp, Mus musculus
tgctgcttttatatctgtatgtatt

SEQ ID NO: 874650 - DNA, 25 bp, Mus musculus
tgctgcttttatttctgtatgtatt

SEQ ID NO: 874651 - DNA, 25 bp, Mus musculus
tgctgcttttcaacggcaagctaac

SEQ ID NO: 874652 - DNA, 25 bp, Mus musculus
tgctgcttttcatcggcaagctaac

SEQ ID NO: 874653 - DNA, 25 bp, Mus musculus
tgctgcttttgtctattctgcctaa

SEQ ID NO: 874654 - DNA, 25 bp, Mus musculus
tgctgcttttgtgtattctgcctaa

SEQ ID NO: 874655 - DNA, 25 bp, Mus musculus
tgctggaaaaccaacctcttactta

SEQ ID NO: 874656 - DNA, 25 bp, Mus musculus
tgctggaaaacctacctcttactta

SEQ ID NO: 874657 - DNA, 25 bp, Mus musculus
tgctggaacactcgacacactgaat

SEQ ID NO: 874658 - DNA, 25 bp, Mus musculus
tgctggaacactggacacactgaat

SEQ ID NO: 874659 - DNA, 25 bp, Mus musculus
tgctggaaccccatcggagagggca

SEQ ID NO: 874660 - DNA, 25 bp, Mus musculus
tgctggaaccccttcggagagggca

SEQ ID NO: 874661 - DNA, 25 bp, Mus musculus
tgctggaactctactgacagtcttg

SEQ ID NO: 874662 - DNA, 25 bp, Mus musculus
tgctggaactcttctgacagtcttg

SEQ ID NO: 874663 - DNA, 25 bp, Mus musculus
tgctggaagcaacatcctagaggaa

SEQ ID NO: 874664 - DNA, 25 bp, Mus musculus
tgctggaagcaagatcctagaggaa

SEQ ID NO: 874665 - DNA, 25 bp, Mus musculus
tgctggaagtaaaagaccgggtgtt

SEQ ID NO: 874666 - DNA, 25 bp, Mus musculus
tgctggaagtaatagaccgggtgtt

SEQ ID NO: 874667 - DNA, 25 bp, Mus musculus
tgctggaatacaacatcatcgacaa

SEQ ID NO: 874668 - DNA, 25 bp, Mus musculus
tgctggaatacacgcatggaagctc

SEQ ID NO: 874669 - DNA, 25 bp, Mus musculus
tgctggaatacaggcatggaagctc

SEQ ID NO: 874670 - DNA, 25 bp, Mus musculus
tgctggaatacatcatcatcgacaa

SEQ ID NO: 874671 - DNA, 25 bp, Mus musculus
tgctggaatcaaagcttgtggccgg

SEQ ID NO: 874672 - DNA, 25 bp, Mus musculus
tgctggaatcaatgcttgtggccgg

SEQ ID NO: 874673 - DNA, 25 bp, Mus musculus
tgctggaatgctccggtgcagcctt

SEQ ID NO: 874674 - DNA, 25 bp, Mus musculus
tgctggaatgctgcggtgcagcctt

SEQ ID NO: 874675 - DNA, 25 bp, Mus musculus
tgctggaatgttcagcctaagcaac

SEQ ID NO: 874676 - DNA, 25 bp, Mus musculus
tgctggaatgttctcttcacagtga

SEQ ID NO: 874677 - DNA, 25 bp, Mus musculus
tgctggaatgttgagcctaagcaac

SEQ ID NO: 874678 - DNA, 25 bp, Mus musculus
tgctggaatgttgtcttcacagtga

SEQ ID NO: 874679 - DNA, 25 bp, Mus musculus
tgctggaattggaacatgcgtgatg

SEQ ID NO: 874680 - DNA, 25 bp, Mus musculus
tgctggaattggtacatgcgtgatg

SEQ ID NO: 874681 - DNA, 25 bp, Mus musculus
tgctggacacgcagacgaaagtgtt

SEQ ID NO: 874682 - DNA, 25 bp, Mus musculus
tgctggacacgctgacgaaagtgtt

SEQ ID NO: 874683 - DNA, 25 bp, Mus musculus
tgctggacagaaactctggtctctt

SEQ ID NO: 874684 - DNA, 25 bp, Mus musculus
tgctggacagaatctctggtctctt

SEQ ID NO: 874685 - DNA, 25 bp, Mus musculus
tgctggacagagacacgtggaacat

SEQ ID NO: 874686 - DNA, 25 bp, Mus musculus
tgctggacagagtcacgtggaacat

SEQ ID NO: 874687 - DNA, 25 bp, Mus musculus
tgctggacatagacccgaaggactc

SEQ ID NO: 874688 - DNA, 25 bp, Mus musculus
tgctggacatagtcccgaaggactc

SEQ ID NO: 874689 - DNA, 25 bp, Mus musculus
tgctggaccaaaaatgtttcactgt

SEQ ID NO: 874690 - DNA, 25 bp, Mus musculus
tgctggaccaaaactacagggagaa

SEQ ID NO: 874691 - DNA, 25 bp, Mus musculus
tgctggaccaaatatgtttcactgt

SEQ ID NO: 874692 - DNA, 25 bp, Mus musculus
tgctggaccaaatctacagggagaa

SEQ ID NO: 874693 - DNA, 25 bp, Mus musculus
tgctggaccacaatctctgggtgaa

SEQ ID NO: 874694 - DNA, 25 bp, Mus musculus
tgctggaccacaccttgtaagccat

SEQ ID NO: 874695 - DNA, 25 bp, Mus musculus
tgctggaccacagcttgtaagccat

SEQ ID NO: 874696 - DNA, 25 bp, Mus musculus
tgctggaccacattctctgggtgaa

SEQ ID NO: 874697 - DNA, 25 bp, Mus musculus
tgctggacccagcagaattggagca

SEQ ID NO: 874698 - DNA, 25 bp, Mus musculus
tgctggacccaggagaattggagca

SEQ ID NO: 874699 - DNA, 25 bp, Mus musculus
tgctggaccgcgagtttgagagaca

SEQ ID NO: 874700 - DNA, 25 bp, Mus musculus
tgctggaccgcgtgtttgagagaca

SEQ ID NO: 874701 - DNA, 25 bp, Mus musculus
tgctggacctagcttatcaggccta

SEQ ID NO: 874702 - DNA, 25 bp, Mus musculus
tgctggacctaggttatcaggccta

SEQ ID NO: 874703 - DNA, 25 bp, Mus musculus
tgctggacctgaaggccctgaacca

SEQ ID NO: 874704 - DNA, 25 bp, Mus musculus
tgctggacctgatggccctgaacca

SEQ ID NO: 874705 - DNA, 25 bp, Mus musculus
tgctggacgctgctggagttgtgga

SEQ ID NO: 874706 - DNA, 25 bp, Mus musculus
tgctggacgctggtggagttgtgga

SEQ ID NO: 874707 - DNA, 25 bp, Mus musculus
tgctggacggttcctccactggaga

SEQ ID NO: 874708 - DNA, 25 bp, Mus musculus
tgctggacggttgctccactggaga

SEQ ID NO: 874709 - DNA, 25 bp, Mus musculus
tgctggacgtccacactctgttctt

SEQ ID NO: 874710 - DNA, 25 bp, Mus musculus
tgctggacgtcctcactctgttctt

SEQ ID NO: 874711 - DNA, 25 bp, Mus musculus
tgctggactacgacaacggctccat

SEQ ID NO: 874712 - DNA, 25 bp, Mus musculus
tgctggactacgtcaacggctccat

SEQ ID NO: 874713 - DNA, 25 bp, Mus musculus
tgctggactcagcttgcagatggcc

SEQ ID NO: 874714 - DNA, 25 bp, Mus musculus
tgctggactcaggttgcagatggcc

SEQ ID NO: 874715 - DNA, 25 bp, Mus musculus
tgctggactcccaagttaatccaca

SEQ ID NO: 874716 - DNA, 25 bp, Mus musculus
tgctggactccctagttaatccaca

SEQ ID NO: 874717 - DNA, 25 bp, Mus musculus
tgctggactctcactttagtgatgg

SEQ ID NO: 874718 - DNA, 25 bp, Mus musculus
tgctggactctctctttagtgatgg

SEQ ID NO: 874719 - DNA, 25 bp, Mus musculus
tgctggactgctctgtgttgctgct

SEQ ID NO: 874720 - DNA, 25 bp, Mus musculus
tgctggactgctgtgtgttgctgct

SEQ ID NO: 874721 - DNA, 25 bp, Mus musculus
tgctggactggcattctaccaataa

SEQ ID NO: 874722 - DNA, 25 bp, Mus musculus
tgctggactggctttctaccaataa

SEQ ID NO: 874723 - DNA, 25 bp, Mus musculus
tgctggacttctaatgacttctact

SEQ ID NO: 874724 - DNA, 25 bp, Mus musculus
tgctggacttcttatgacttctact

SEQ ID NO: 874725 - DNA, 25 bp, Mus musculus
tgctggagacagagctgaggcacct

SEQ ID NO: 874726 - DNA, 25 bp, Mus musculus
tgctggagacagtgctgaggcacct

SEQ ID NO: 874727 - DNA, 25 bp, Mus musculus
tgctggagaccaagaacatatgttc

SEQ ID NO: 874728 - DNA, 25 bp, Mus musculus
tgctggagaccatgaacatatgttc

SEQ ID NO: 874729 - DNA, 25 bp, Mus musculus
tgctggagagcaaccctgagaggcc

SEQ ID NO: 874730 - DNA, 25 bp, Mus musculus
tgctggagagcatccctgagaggcc

SEQ ID NO: 874731 - DNA, 25 bp, Mus musculus
tgctggagagtaacgctgtgaagtc

SEQ ID NO: 874732 - DNA, 25 bp, Mus musculus
tgctggagagtatcgctgtgaagtc

SEQ ID NO: 874733 - DNA, 25 bp, Mus musculus
tgctggagatatcccatgcgtgctg

SEQ ID NO: 874734 - DNA, 25 bp, Mus musculus
tgctggagatatgccatgcgtgctg

SEQ ID NO: 874735 - DNA, 25 bp, Mus musculus
tgctggagatgaagtgacagttaca

SEQ ID NO: 874736 - DNA, 25 bp, Mus musculus
tgctggagatgatgtgacagttaca

SEQ ID NO: 874737 - DNA, 25 bp, Mus musculus
tgctggagatgcaccgggttactga

SEQ ID NO: 874738 - DNA, 25 bp, Mus musculus
tgctggagatgctccgggttactga

SEQ ID NO: 874739 - DNA, 25 bp, Mus musculus
tgctggagcacacgccaactttgtg

SEQ ID NO: 874740 - DNA, 25 bp, Mus musculus
tgctggagcacaggccaactttgtg

SEQ ID NO: 874741 - DNA, 25 bp, Mus musculus
tgctggagcagacctttgcccttgc

SEQ ID NO: 874742 - DNA, 25 bp, Mus musculus
tgctggagcagagctttgcccttgc

SEQ ID NO: 874743 - DNA, 25 bp, Mus musculus
tgctggagcagcacctcgaaagcgg

SEQ ID NO: 874744 - DNA, 25 bp, Mus musculus
tgctggagcagctcctcgaaagcgg

SEQ ID NO: 874745 - DNA, 25 bp, Mus musculus
tgctggagccagagccagagctaaa

SEQ ID NO: 874746 - DNA, 25 bp, Mus musculus
tgctggagccagtgccagagctaaa

SEQ ID NO: 874747 - DNA, 25 bp, Mus musculus
tgctggagcctcacctggacccgga

SEQ ID NO: 874748 - DNA, 25 bp, Mus musculus
tgctggagcctctcctggacccgga

SEQ ID NO: 874749 - DNA, 25 bp, Mus musculus
tgctggagcgacacactgcagcgct

SEQ ID NO: 874750 - DNA, 25 bp, Mus musculus
tgctggagcgactcactgcagcgct

SEQ ID NO: 874751 - DNA, 25 bp, Mus musculus
tgctggagcgtaacccaggcttcaa

SEQ ID NO: 874752 - DNA, 25 bp, Mus musculus
tgctggagcgtatcccaggcttcaa

SEQ ID NO: 874753 - DNA, 25 bp, Mus musculus
tgctggagctcaatgctgatctatt

SEQ ID NO: 874754 - DNA, 25 bp, Mus musculus
tgctggagctcattgctgatctatt

SEQ ID NO: 874755 - DNA, 25 bp, Mus musculus
tgctggaggcctacggcatcgatgt

SEQ ID NO: 874756 - DNA, 25 bp, Mus musculus
tgctggaggccttcggcatcgatgt

SEQ ID NO: 874757 - DNA, 25 bp, Mus musculus
tgctggaggtgtacttcattgcctg

SEQ ID NO: 874758 - DNA, 25 bp, Mus musculus
tgctggaggtgttcttcattgcctg

SEQ ID NO: 874759 - DNA, 25 bp, Mus musculus
tgctggagtccgaagatccgtcaga

SEQ ID NO: 874760 - DNA, 25 bp, Mus musculus
tgctggagtccgtagatccgtcaga

SEQ ID NO: 874761 - DNA, 25 bp, Mus musculus
tgctggagtctgctattgaccgaat

SEQ ID NO: 874762 - DNA, 25 bp, Mus musculus
tgctggagtctggtattgaccgaat

SEQ ID NO: 874763 - DNA, 25 bp, Mus musculus
tgctggagtgcgaactgccgacata

SEQ ID NO: 874764 - DNA, 25 bp, Mus musculus
tgctggagtgcgtactgccgacata

SEQ ID NO: 874765 - DNA, 25 bp, Mus musculus
tgctggatactaagtgtctgctact

SEQ ID NO: 874766 - DNA, 25 bp, Mus musculus
tgctggatactatgtgtctgctact

SEQ ID NO: 874767 - DNA, 25 bp, Mus musculus
tgctggataggtacacagtcttatt

SEQ ID NO: 874768 - DNA, 25 bp, Mus musculus
tgctggataggttcacagtcttatt

SEQ ID NO: 874769 - DNA, 25 bp, Mus musculus
tgctggatagtcatccccactggaa

SEQ ID NO: 874770 - DNA, 25 bp, Mus musculus
tgctggatagtcttccccactggaa

SEQ ID NO: 874771 - DNA, 25 bp, Mus musculus
tgctggatatccaggccaactacct

SEQ ID NO: 874772 - DNA, 25 bp, Mus musculus
tgctggatatcctggccaactacct

SEQ ID NO: 874773 - DNA, 25 bp, Mus musculus
tgctggatcattagccttttctttc

SEQ ID NO: 874774 - DNA, 25 bp, Mus musculus
tgctggatcatttgccttttctttc

SEQ ID NO: 874775 - DNA, 25 bp, Mus musculus
tgctggatccacctggacaggtgcc

SEQ ID NO: 874776 - DNA, 25 bp, Mus musculus
tgctggatccacgtggacaggtgcc

SEQ ID NO: 874777 - DNA, 25 bp, Mus musculus
tgctggatccttctaattaaatttg

SEQ ID NO: 874778 - DNA, 25 bp, Mus musculus
tgctggatccttgtaattaaatttg

SEQ ID NO: 874779 - DNA, 25 bp, Mus musculus
tgctggatgaccatgtcacccgaga

SEQ ID NO: 874780 - DNA, 25 bp, Mus musculus
tgctggatgaccttgtcacccgaga

SEQ ID NO: 874781 - DNA, 25 bp, Mus musculus
tgctggatgagccactgtgagtccc

SEQ ID NO: 874782 - DNA, 25 bp, Mus musculus
tgctggatgagcgactgtgagtccc

SEQ ID NO: 874783 - DNA, 25 bp, Mus musculus
tgctggatgccaacacctgtgacta

SEQ ID NO: 874784 - DNA, 25 bp, Mus musculus
tgctggatgccatcacctgtgacta

SEQ ID NO: 874785 - DNA, 25 bp, Mus musculus
tgctggatgtttcacctcctatttc

SEQ ID NO: 874786 - DNA, 25 bp, Mus musculus
tgctggatgtttgacctcctatttc

SEQ ID NO: 874787 - DNA, 25 bp, Mus musculus
tgctggattccaaccaaggcctgca

SEQ ID NO: 874788 - DNA, 25 bp, Mus musculus
tgctggattccatccaaggcctgca

SEQ ID NO: 874789 - DNA, 25 bp, Mus musculus
tgctggattcggagttaaacgcatc

SEQ ID NO: 874790 - DNA, 25 bp, Mus musculus
tgctggattcggtgttaaacgcatc

SEQ ID NO: 874791 - DNA, 25 bp, Mus musculus
tgctggattctcatgctgtacaata

SEQ ID NO: 874792 - DNA, 25 bp, Mus musculus
tgctggattctcttgctgtacaata

SEQ ID NO: 874793 - DNA, 25 bp, Mus musculus
tgctggatttccactgcctctctat

SEQ ID NO: 874794 - DNA, 25 bp, Mus musculus
tgctggatttcctctgcctctctat

SEQ ID NO: 874795 - DNA, 25 bp, Mus musculus
tgctggattttgatgtgcatcattt

SEQ ID NO: 874796 - DNA, 25 bp, Mus musculus
tgctggattttgttgtgcatcattt

SEQ ID NO: 874797 - DNA, 25 bp, Mus musculus
tgctggcaaaaactgagtggagatt

SEQ ID NO: 874798 - DNA, 25 bp, Mus musculus
tgctggcaaaaagtgagtggagatt

SEQ ID NO: 874799 - DNA, 25 bp, Mus musculus
tgctggcaactacccttttgtaaca

SEQ ID NO: 874800 - DNA, 25 bp, Mus musculus
tgctggcaactagccttttgtaaca

SEQ ID NO: 874801 - DNA, 25 bp, Mus musculus
tgctggcaagacagaatgaggacga

SEQ ID NO: 874802 - DNA, 25 bp, Mus musculus
tgctggcaagactgaatgaggacga

SEQ ID NO: 874803 - DNA, 25 bp, Mus musculus
tgctggcaagtccatttcttcactg

SEQ ID NO: 874804 - DNA, 25 bp, Mus musculus
tgctggcaagtcgatttcttcactg

SEQ ID NO: 874805 - DNA, 25 bp, Mus musculus
tgctggcaagttactgcaccgctgt

SEQ ID NO: 874806 - DNA, 25 bp, Mus musculus
tgctggcaagtttctgcaccgctgt

SEQ ID NO: 874807 - DNA, 25 bp, Mus musculus
tgctggcacaggaggcaaggatctt

SEQ ID NO: 874808 - DNA, 25 bp, Mus musculus
tgctggcacaggtggcaaggatctt

SEQ ID NO: 874809 - DNA, 25 bp, Mus musculus
tgctggcacctgacaatgcctggtg

SEQ ID NO: 874810 - DNA, 25 bp, Mus musculus
tgctggcacctgctcttagggctta

SEQ ID NO: 874811 - DNA, 25 bp, Mus musculus
tgctggcacctggtcttagggctta

SEQ ID NO: 874812 - DNA, 25 bp, Mus musculus
tgctggcacctgtcaatgcctggtg

SEQ ID NO: 874813 - DNA, 25 bp, Mus musculus
tgctggcactgtatccgaggtcagg

SEQ ID NO: 874814 - DNA, 25 bp, Mus musculus
tgctggcactgtttccgaggtcagg

SEQ ID NO: 874815 - DNA, 25 bp, Mus musculus
tgctggcagatcatggccaggtcca

SEQ ID NO: 874816 - DNA, 25 bp, Mus musculus
tgctggcagatcttggccaggtcca

SEQ ID NO: 874817 - DNA, 25 bp, Mus musculus
tgctggcagcatcaaccaggactcc

SEQ ID NO: 874818 - DNA, 25 bp, Mus musculus
tgctggcagcatgaaccaggactcc

SEQ ID NO: 874819 - DNA, 25 bp, Mus musculus
tgctggcagcctaccttacgaacat

SEQ ID NO: 874820 - DNA, 25 bp, Mus musculus
tgctggcagccttccttacgaacat

SEQ ID NO: 874821 - DNA, 25 bp, Mus musculus
tgctggcagctcactaagggtcttg

SEQ ID NO: 874822 - DNA, 25 bp, Mus musculus
tgctggcagctctctaagggtcttg

SEQ ID NO: 874823 - DNA, 25 bp, Mus musculus
tgctggcagggcaatctcagggaaa

SEQ ID NO: 874824 - DNA, 25 bp, Mus musculus
tgctggcagggctatctcagggaaa

SEQ ID NO: 874825 - DNA, 25 bp, Mus musculus
tgctggcataggcagtgtccccaaa

SEQ ID NO: 874826 - DNA, 25 bp, Mus musculus
tgctggcatagggagtgtccccaaa

SEQ ID NO: 874827 - DNA, 25 bp, Mus musculus
tgctggcattgtccacttaccccaa

SEQ ID NO: 874828 - DNA, 25 bp, Mus musculus
tgctggcattgtgcacttaccccaa

SEQ ID NO: 874829 - DNA, 25 bp, Mus musculus
tgctggccaaccagtactcttgcgg

SEQ ID NO: 874830 - DNA, 25 bp, Mus musculus
tgctggccaacctgtactcttgcgg

SEQ ID NO: 874831 - DNA, 25 bp, Mus musculus
tgctggccaccaagcaactttgtaa

SEQ ID NO: 874832 - DNA, 25 bp, Mus musculus
tgctggccaccatgcaactttgtaa

SEQ ID NO: 874833 - DNA, 25 bp, Mus musculus
tgctggccactcagagctgggacct

SEQ ID NO: 874834 - DNA, 25 bp, Mus musculus
tgctggccactctgagctgggacct

SEQ ID NO: 874835 - DNA, 25 bp, Mus musculus
tgctggccagtcatcggcgcgtgca

SEQ ID NO: 874836 - DNA, 25 bp, Mus musculus
tgctggccagtcttcggcgcgtgca

SEQ ID NO: 874837 - DNA, 25 bp, Mus musculus
tgctggccagttctttatgccgaat

SEQ ID NO: 874838 - DNA, 25 bp, Mus musculus
tgctggccagttgtttatgccgaat

SEQ ID NO: 874839 - DNA, 25 bp, Mus musculus
tgctggccatagatcattgtgcgag

SEQ ID NO: 874840 - DNA, 25 bp, Mus musculus
tgctggccatagttcattgtgcgag

SEQ ID NO: 874841 - DNA, 25 bp, Mus musculus
tgctggccatgcctcaggccgttga

SEQ ID NO: 874842 - DNA, 25 bp, Mus musculus
tgctggccatgcgtcaggccgttga

SEQ ID NO: 874843 - DNA, 25 bp, Mus musculus
tgctggcccagcatggaatccgatg

SEQ ID NO: 874844 - DNA, 25 bp, Mus musculus
tgctggcccagcttggaatccgatg

SEQ ID NO: 874845 - DNA, 25 bp, Mus musculus
tgctggcccgggatcagtctcctgc

SEQ ID NO: 874846 - DNA, 25 bp, Mus musculus
tgctggcccgggttcagtctcctgc

SEQ ID NO: 874847 - DNA, 25 bp, Mus musculus
tgctggccctagacacttggatgag

SEQ ID NO: 874848 - DNA, 25 bp, Mus musculus
tgctggccctagtcacttggatgag

SEQ ID NO: 874849 - DNA, 25 bp, Mus musculus
tgctggccctgcactacagacaggg

SEQ ID NO: 874850 - DNA, 25 bp, Mus musculus
tgctggccctgctctacagacaggg

SEQ ID NO: 874851 - DNA, 25 bp, Mus musculus
tgctggccctttcgaagattctctg

SEQ ID NO: 874852 - DNA, 25 bp, Mus musculus
tgctggccctttggaagattctctg

SEQ ID NO: 874853 - DNA, 25 bp, Mus musculus
tgctggccgagacctgccctgatgt

SEQ ID NO: 874854 - DNA, 25 bp, Mus musculus
tgctggccgagagctgccctgatgt

SEQ ID NO: 874855 - DNA, 25 bp, Mus musculus
tgctggccgagtacaacctgggctg

SEQ ID NO: 874856 - DNA, 25 bp, Mus musculus
tgctggccgagttcaacctgggctg

SEQ ID NO: 874857 - DNA, 25 bp, Mus musculus
tgctggccgccaagttcacagggaa

SEQ ID NO: 874858 - DNA, 25 bp, Mus musculus
tgctggccgccatgttcacagggaa

SEQ ID NO: 874859 - DNA, 25 bp, Mus musculus
tgctggccgtgtacagttcccaagg

SEQ ID NO: 874860 - DNA, 25 bp, Mus musculus
tgctggccgtgttcagttcccaagg

SEQ ID NO: 874861 - DNA, 25 bp, Mus musculus
tgctggcctatcctcaggtgcagat

SEQ ID NO: 874862 - DNA, 25 bp, Mus musculus
tgctggcctatcgtcaggtgcagat

SEQ ID NO: 874863 - DNA, 25 bp, Mus musculus
tgctggcctccaatgaagcctttaa

SEQ ID NO: 874864 - DNA, 25 bp, Mus musculus
tgctggcctccacgaatatcgagtc

SEQ ID NO: 874865 - DNA, 25 bp, Mus musculus
tgctggcctccaggaatatcgagtc

SEQ ID NO: 874866 - DNA, 25 bp, Mus musculus
tgctggcctccattgaagcctttaa

SEQ ID NO: 874867 - DNA, 25 bp, Mus musculus
tgctggcctgccaaaaagatactga

SEQ ID NO: 874868 - DNA, 25 bp, Mus musculus
tgctggcctgcctaaaagatactga

SEQ ID NO: 874869 - DNA, 25 bp, Mus musculus
tgctggcctggtcttcaggagacca

SEQ ID NO: 874870 - DNA, 25 bp, Mus musculus
tgctggcctggtgttcaggagacca

SEQ ID NO: 874871 - DNA, 25 bp, Mus musculus
tgctggccttcaatggcccaggtga

SEQ ID NO: 874872 - DNA, 25 bp, Mus musculus
tgctggccttcattggcccaggtga

SEQ ID NO: 874873 - DNA, 25 bp, Mus musculus
tgctggcgatgaagagatctccttt

SEQ ID NO: 874874 - DNA, 25 bp, Mus musculus
tgctggcgatgatgagatctccttt

SEQ ID NO: 874875 - DNA, 25 bp, Mus musculus
tgctggcgctttctttgcatggagg

SEQ ID NO: 874876 - DNA, 25 bp, Mus musculus
tgctggcgctttgtttgcatggagg

SEQ ID NO: 874877 - DNA, 25 bp, Mus musculus
tgctggcggagtacgctacaggaca

SEQ ID NO: 874878 - DNA, 25 bp, Mus musculus
tgctggcggagttcgctacaggaca

SEQ ID NO: 874879 - DNA, 25 bp, Mus musculus
tgctggcggtgtctaatttgtgttt

SEQ ID NO: 874880 - DNA, 25 bp, Mus musculus
tgctggcggtgtgtaatttgtgttt

SEQ ID NO: 874881 - DNA, 25 bp, Mus musculus
tgctggcgtagtatctcagttttct

SEQ ID NO: 874882 - DNA, 25 bp, Mus musculus
tgctggcgtagtttctcagttttct

SEQ ID NO: 874883 - DNA, 25 bp, Mus musculus
tgctggctacacatttggacaagac

SEQ ID NO: 874884 - DNA, 25 bp, Mus musculus
tgctggctacacttttggacaagac

SEQ ID NO: 874885 - DNA, 25 bp, Mus musculus
tgctggctaccaacttgagtgtgac

SEQ ID NO: 874886 - DNA, 25 bp, Mus musculus
tgctggctaccactgttaggttcaa

SEQ ID NO: 874887 - DNA, 25 bp, Mus musculus
tgctggctaccagtgttaggttcaa

SEQ ID NO: 874888 - DNA, 25 bp, Mus musculus
tgctggctaccatcttgagtgtgac

SEQ ID NO: 874889 - DNA, 25 bp, Mus musculus
tgctggctacttaaaggtcccagga

SEQ ID NO: 874890 - DNA, 25 bp, Mus musculus
tgctggctactttaaggtcccagga

SEQ ID NO: 874891 - DNA, 25 bp, Mus musculus
tgctggctatcaaactagggtccct

SEQ ID NO: 874892 - DNA, 25 bp, Mus musculus
tgctggctatcatactagggtccct

SEQ ID NO: 874893 - DNA, 25 bp, Mus musculus
tgctggctcaagagatcgagaacct

SEQ ID NO: 874894 - DNA, 25 bp, Mus musculus
tgctggctcaagtgatcgagaacct

SEQ ID NO: 874895 - DNA, 25 bp, Mus musculus
tgctggctcagaacaagtcacaccc

SEQ ID NO: 874896 - DNA, 25 bp, Mus musculus
tgctggctcagatcaagtcacaccc

SEQ ID NO: 874897 - DNA, 25 bp, Mus musculus
tgctggctccagagtttttagaatg

SEQ ID NO: 874898 - DNA, 25 bp, Mus musculus
tgctggctccagtgtttttagaatg

SEQ ID NO: 874899 - DNA, 25 bp, Mus musculus
tgctggctctctcgagactccgtag

SEQ ID NO: 874900 - DNA, 25 bp, Mus musculus
tgctggctctctggagactccgtag

SEQ ID NO: 874901 - DNA, 25 bp, Mus musculus
tgctggctgagtctttacacattgc

SEQ ID NO: 874902 - DNA, 25 bp, Mus musculus
tgctggctgagtgtttacacattgc

SEQ ID NO: 874903 - DNA, 25 bp, Mus musculus
tgctggctggtaactcagatggact

SEQ ID NO: 874904 - DNA, 25 bp, Mus musculus
tgctggctggtatctcagatggact

SEQ ID NO: 874905 - DNA, 25 bp, Mus musculus
tgctggctgtaacaaacacctccat

SEQ ID NO: 874906 - DNA, 25 bp, Mus musculus
tgctggctgtaagaaacacctccat

SEQ ID NO: 874907 - DNA, 25 bp, Mus musculus
tgctggctgtagctcagatggaccc

SEQ ID NO: 874908 - DNA, 25 bp, Mus musculus
tgctggctgtaggtcagatggaccc

SEQ ID NO: 874909 - DNA, 25 bp, Mus musculus
tgctggctgtcaactacttcaacat

SEQ ID NO: 874910 - DNA, 25 bp, Mus musculus
tgctggctgtcatctacttcaacat

SEQ ID NO: 874911 - DNA, 25 bp, Mus musculus
tgctggctgtgcacctgtggaagat

SEQ ID NO: 874912 - DNA, 25 bp, Mus musculus
tgctggctgtgcacgcttacagcat

SEQ ID NO: 874913 - DNA, 25 bp, Mus musculus
tgctggctgtgctcctgtggaagat

SEQ ID NO: 874914 - DNA, 25 bp, Mus musculus
tgctggctgtgctcgcttacagcat

SEQ ID NO: 874915 - DNA, 25 bp, Mus musculus
tgctggctgtggactcgagcaatcc

SEQ ID NO: 874916 - DNA, 25 bp, Mus musculus
tgctggctgtggtctcgagcaatcc

SEQ ID NO: 874917 - DNA, 25 bp, Mus musculus
tgctggcttagcatgtcttagtcca

SEQ ID NO: 874918 - DNA, 25 bp, Mus musculus
tgctggcttagcttgtcttagtcca

SEQ ID NO: 874919 - DNA, 25 bp, Mus musculus
tgctggcttattatattggtctcaa

SEQ ID NO: 874920 - DNA, 25 bp, Mus musculus
tgctggcttattttattggtctcaa

SEQ ID NO: 874921 - DNA, 25 bp, Mus musculus
tgctggcttcaacacatttggaatc

SEQ ID NO: 874922 - DNA, 25 bp, Mus musculus
tgctggcttcaagacatttggaatc

SEQ ID NO: 874923 - DNA, 25 bp, Mus musculus
tgctggcttccaacattcagtacag

SEQ ID NO: 874924 - DNA, 25 bp, Mus musculus
tgctggcttccatcattcagtacag

SEQ ID NO: 874925 - DNA, 25 bp, Mus musculus
tgctggcttgcacgagttctctctc

SEQ ID NO: 874926 - DNA, 25 bp, Mus musculus
tgctggcttgcaggagttctctctc

SEQ ID NO: 874927 - DNA, 25 bp, Mus musculus
tgctggctttgcaagaattggatac

SEQ ID NO: 874928 - DNA, 25 bp, Mus musculus
tgctggctttgctagaattggatac

SEQ ID NO: 874929 - DNA, 25 bp, Mus musculus
tgctggctttttaagctacttggtc

SEQ ID NO: 874930 - DNA, 25 bp, Mus musculus
tgctggcttttttagctacttggtc

SEQ ID NO: 874931 - DNA, 25 bp, Mus musculus
tgctgggaaagcattgacctcctca

SEQ ID NO: 874932 - DNA, 25 bp, Mus musculus
tgctgggaaagctttgacctcctca

SEQ ID NO: 874933 - DNA, 25 bp, Mus musculus
tgctgggaaagtactgacttcctca

SEQ ID NO: 874934 - DNA, 25 bp, Mus musculus
tgctgggaaagttctgacttcctca

SEQ ID NO: 874935 - DNA, 25 bp, Mus musculus
tgctgggaacatacgagcaggcttg

SEQ ID NO: 874936 - DNA, 25 bp, Mus musculus
tgctgggaacattcgagcaggcttg

SEQ ID NO: 874937 - DNA, 25 bp, Mus musculus
tgctgggaacctcaaaacacggact

SEQ ID NO: 874938 - DNA, 25 bp, Mus musculus
tgctgggaacctcagtgtttcacat

SEQ ID NO: 874939 - DNA, 25 bp, Mus musculus
tgctgggaacctgaaaacacggact

SEQ ID NO: 874940 - DNA, 25 bp, Mus musculus
tgctgggaacctgagtgtttcacat

SEQ ID NO: 874941 - DNA, 25 bp, Mus musculus
tgctgggaacttcatcttctacaaa

SEQ ID NO: 874942 - DNA, 25 bp, Mus musculus
tgctgggaacttgatcttctacaaa

SEQ ID NO: 874943 - DNA, 25 bp, Mus musculus
tgctgggacacgacacccgtctttg

SEQ ID NO: 874944 - DNA, 25 bp, Mus musculus
tgctgggacacgtcacccgtctttg

SEQ ID NO: 874945 - DNA, 25 bp, Mus musculus
tgctgggacccactccgcgaacgga

SEQ ID NO: 874946 - DNA, 25 bp, Mus musculus
tgctgggacccagtccgcgaacgga

SEQ ID NO: 874947 - DNA, 25 bp, Mus musculus
tgctgggaccccagcttatttattt

SEQ ID NO: 874948 - DNA, 25 bp, Mus musculus
tgctgggacccctgcttatttattt

SEQ ID NO: 874949 - DNA, 25 bp, Mus musculus
tgctgggaccgccagggctacacct

SEQ ID NO: 874950 - DNA, 25 bp, Mus musculus
tgctgggaccgcgagggctacacct

SEQ ID NO: 874951 - DNA, 25 bp, Mus musculus
tgctgggactttcctatggcgtgaa

SEQ ID NO: 874952 - DNA, 25 bp, Mus musculus
tgctgggactttgctatggcgtgaa

SEQ ID NO: 874953 - DNA, 25 bp, Mus musculus
tgctgggagactaccttcctctaac

SEQ ID NO: 874954 - DNA, 25 bp, Mus musculus
tgctgggagacttccttcctctaac

SEQ ID NO: 874955 - DNA, 25 bp, Mus musculus
tgctgggagagaacccctggcttgc

SEQ ID NO: 874956 - DNA, 25 bp, Mus musculus
tgctgggagagatcccctggcttgc

SEQ ID NO: 874957 - DNA, 25 bp, Mus musculus
tgctgggagcacatacctactactg

SEQ ID NO: 874958 - DNA, 25 bp, Mus musculus
tgctgggagcacttacctactactg

SEQ ID NO: 874959 - DNA, 25 bp, Mus musculus
tgctgggagtcaacttggtgccact

SEQ ID NO: 874960 - DNA, 25 bp, Mus musculus
tgctgggagtcatcttggtgccact

SEQ ID NO: 874961 - DNA, 25 bp, Mus musculus
tgctgggagtccagggtacaaccct

SEQ ID NO: 874962 - DNA, 25 bp, Mus musculus
tgctgggagtcctgggtacaaccct

SEQ ID NO: 874963 - DNA, 25 bp, Mus musculus
tgctgggatacacccctgaagagct

SEQ ID NO: 874964 - DNA, 25 bp, Mus musculus
tgctgggatacagccctgaagagct

SEQ ID NO: 874965 - DNA, 25 bp, Mus musculus
tgctgggatcccaaggtttcaacac

SEQ ID NO: 874966 - DNA, 25 bp, Mus musculus
tgctgggatcccacgaacacatatt

SEQ ID NO: 874967 - DNA, 25 bp, Mus musculus
tgctgggatccctaggtttcaacac

SEQ ID NO: 874968 - DNA, 25 bp, Mus musculus
tgctgggatccctcgaacacatatt

SEQ ID NO: 874969 - DNA, 25 bp, Mus musculus
tgctgggatccgagtcttgtaacaa

SEQ ID NO: 874970 - DNA, 25 bp, Mus musculus
tgctgggatccgtgtcttgtaacaa

SEQ ID NO: 874971 - DNA, 25 bp, Mus musculus
tgctgggatgtcacgagcctgaaac

SEQ ID NO: 874972 - DNA, 25 bp, Mus musculus
tgctgggatgtctcgagcctgaaac

SEQ ID NO: 874973 - DNA, 25 bp, Mus musculus
tgctgggattacatctagttctgat

SEQ ID NO: 874974 - DNA, 25 bp, Mus musculus
tgctgggattacttctagttctgat

SEQ ID NO: 874975 - DNA, 25 bp, Mus musculus
tgctgggcaactacacttgttgtca

SEQ ID NO: 874976 - DNA, 25 bp, Mus musculus
tgctgggcaacttcacttgttgtca

SEQ ID NO: 874977 - DNA, 25 bp, Mus musculus
tgctgggcacgaacaactttgggtt

SEQ ID NO: 874978 - DNA, 25 bp, Mus musculus
tgctgggcacgatcaactttgggtt

SEQ ID NO: 874979 - DNA, 25 bp, Mus musculus
tgctgggcacgcatggcatgaaata

SEQ ID NO: 874980 - DNA, 25 bp, Mus musculus
tgctgggcacgcttggcatgaaata

SEQ ID NO: 874981 - DNA, 25 bp, Mus musculus
tgctgggcagaacacatgggttaaa

SEQ ID NO: 874982 - DNA, 25 bp, Mus musculus
tgctgggcagaagacatgggttaaa

SEQ ID NO: 874983 - DNA, 25 bp, Mus musculus
tgctgggcagatccaggaaccaaaa

SEQ ID NO: 874984 - DNA, 25 bp, Mus musculus
tgctgggcagatgcaggaaccaaaa

SEQ ID NO: 874985 - DNA, 25 bp, Mus musculus
tgctgggcagcaagtccactcagtg

SEQ ID NO: 874986 - DNA, 25 bp, Mus musculus
tgctgggcagcatgtccactcagtg

SEQ ID NO: 874987 - DNA, 25 bp, Mus musculus
tgctgggcatcactgcgcgctctct

SEQ ID NO: 874988 - DNA, 25 bp, Mus musculus
tgctgggcatcagtgcgcgctctct

SEQ ID NO: 874989 - DNA, 25 bp, Mus musculus
tgctgggcatgcacttgggctccta

SEQ ID NO: 874990 - DNA, 25 bp, Mus musculus
tgctgggcatgctcttgggctccta

SEQ ID NO: 874991 - DNA, 25 bp, Mus musculus
tgctgggccacaattgagcttggaa

SEQ ID NO: 874992 - DNA, 25 bp, Mus musculus
tgctgggccacacctccagttcgga

SEQ ID NO: 874993 - DNA, 25 bp, Mus musculus
tgctgggccacagctccagttcgga

SEQ ID NO: 874994 - DNA, 25 bp, Mus musculus
tgctgggccacatttgagcttggaa

SEQ ID NO: 874995 - DNA, 25 bp, Mus musculus
tgctgggccactatttggtgagaga

SEQ ID NO: 874996 - DNA, 25 bp, Mus musculus
tgctgggccactttttggtgagaga

SEQ ID NO: 874997 - DNA, 25 bp, Mus musculus
tgctgggcccacaaagaccagaaga

SEQ ID NO: 874998 - DNA, 25 bp, Mus musculus
tgctgggcccactaagaccagaaga

SEQ ID NO: 874999 - DNA, 25 bp, Mus musculus
tgctgggccccacgagtctggataa

SEQ ID NO: 875000 - DNA, 25 bp, Mus musculus
tgctgggccccaggagtctggataa

SEQ ID NO: 875001 - DNA, 25 bp, Mus musculus
tgctgggcccttagtagtgcaaggc

SEQ ID NO: 875002 - DNA, 25 bp, Mus musculus
tgctgggccctttgtagtgcaaggc

SEQ ID NO: 875003 - DNA, 25 bp, Mus musculus
tgctgggccgccaagtgagcaccaa

SEQ ID NO: 875004 - DNA, 25 bp, Mus musculus
tgctgggccgcctagtgagcaccaa

SEQ ID NO: 875005 - DNA, 25 bp, Mus musculus
tgctgggcgggacgtgcagcaccaa

SEQ ID NO: 875006 - DNA, 25 bp, Mus musculus
tgctgggcgggaggtgcagcaccaa

SEQ ID NO: 875007 - DNA, 25 bp, Mus musculus
tgctgggcgtacactggacaaggcc

SEQ ID NO: 875008 - DNA, 25 bp, Mus musculus
tgctgggcgtactctggacaaggcc

SEQ ID NO: 875009 - DNA, 25 bp, Mus musculus
tgctgggctcggagactcagaagct

SEQ ID NO: 875010 - DNA, 25 bp, Mus musculus
tgctgggctcggtgactcagaagct

SEQ ID NO: 875011 - DNA, 25 bp, Mus musculus
tgctgggctcttacctgtgctttct

SEQ ID NO: 875012 - DNA, 25 bp, Mus musculus
tgctgggctctttcctgtgctttct

SEQ ID NO: 875013 - DNA, 25 bp, Mus musculus
tgctgggctgtcagtcaccggccgc

SEQ ID NO: 875014 - DNA, 25 bp, Mus musculus
tgctgggctgtctgtcaccggccgc

SEQ ID NO: 875015 - DNA, 25 bp, Mus musculus
tgctgggcttaccactgtgcacctt

SEQ ID NO: 875016 - DNA, 25 bp, Mus musculus
tgctgggcttacgactgtgcacctt

SEQ ID NO: 875017 - DNA, 25 bp, Mus musculus
tgctgggcttcaaagtgactgtgta

SEQ ID NO: 875018 - DNA, 25 bp, Mus musculus
tgctgggcttcatagtgactgtgta

SEQ ID NO: 875019 - DNA, 25 bp, Mus musculus
tgctgggcttgtacttctcattcaa

SEQ ID NO: 875020 - DNA, 25 bp, Mus musculus
tgctgggcttgttcttctcattcaa

SEQ ID NO: 875021 - DNA, 25 bp, Mus musculus
tgctgggctttacctactttaactt

SEQ ID NO: 875022 - DNA, 25 bp, Mus musculus
tgctgggctttagctactttaactt

SEQ ID NO: 875023 - DNA, 25 bp, Mus musculus
tgctgggcttttctggtgactccac

SEQ ID NO: 875024 - DNA, 25 bp, Mus musculus
tgctgggcttttgtggtgactccac

SEQ ID NO: 875025 - DNA, 25 bp, Mus musculus
tgctgggtcactactccaagggagt

SEQ ID NO: 875026 - DNA, 25 bp, Mus musculus
tgctgggtcacttctccaagggagt

SEQ ID NO: 875027 - DNA, 25 bp, Mus musculus
tgctgggtctatccagtccacctgg

SEQ ID NO: 875028 - DNA, 25 bp, Mus musculus
tgctgggtctatgcagtccacctgg

SEQ ID NO: 875029 - DNA, 25 bp, Mus musculus
tgctgggtctggacgccttcaactt

SEQ ID NO: 875030 - DNA, 25 bp, Mus musculus
tgctgggtctggtcgccttcaactt

SEQ ID NO: 875031 - DNA, 25 bp, Mus musculus
tgctgggtctgtcgagcccacttga

SEQ ID NO: 875032 - DNA, 25 bp, Mus musculus
tgctgggtctgtcgtcgatcctgct

SEQ ID NO: 875033 - DNA, 25 bp, Mus musculus
tgctgggtctgtggagcccacttga

SEQ ID NO: 875034 - DNA, 25 bp, Mus musculus
tgctgggtctgtggtcgatcctgct

SEQ ID NO: 875035 - DNA, 25 bp, Mus musculus
tgctgggtcttactggtcctgttag

SEQ ID NO: 875036 - DNA, 25 bp, Mus musculus
tgctgggtcttagtggtcctgttag

SEQ ID NO: 875037 - DNA, 25 bp, Mus musculus
tgctgggtgacaacatcttctatga

SEQ ID NO: 875038 - DNA, 25 bp, Mus musculus
tgctgggtgacatcatcttctatga

SEQ ID NO: 875039 - DNA, 25 bp, Mus musculus
tgctgggtgctcacccccatgacag

SEQ ID NO: 875040 - DNA, 25 bp, Mus musculus
tgctgggtgctctcccccatgacag

SEQ ID NO: 875041 - DNA, 25 bp, Mus musculus
tgctgggttaacatgaggcttcttt

SEQ ID NO: 875042 - DNA, 25 bp, Mus musculus
tgctgggttaacttgaggcttcttt

SEQ ID NO: 875043 - DNA, 25 bp, Mus musculus
tgctgggttactctcccatgagact

SEQ ID NO: 875044 - DNA, 25 bp, Mus musculus
tgctgggttactgtcccatgagact

SEQ ID NO: 875045 - DNA, 25 bp, Mus musculus
tgctgggttcctactttacactgca

SEQ ID NO: 875046 - DNA, 25 bp, Mus musculus
tgctgggttccttctttacactgca

SEQ ID NO: 875047 - DNA, 25 bp, Mus musculus
tgctgggttcgcactcccgctgttg

SEQ ID NO: 875048 - DNA, 25 bp, Mus musculus
tgctgggttcgctctcccgctgttg

SEQ ID NO: 875049 - DNA, 25 bp, Mus musculus
tgctgggttggtatgcgctgcttcc

SEQ ID NO: 875050 - DNA, 25 bp, Mus musculus
tgctgggttggtttgcgctgcttcc

SEQ ID NO: 875051 - DNA, 25 bp, Mus musculus
tgctgggttgtcacttctgggagaa

SEQ ID NO: 875052 - DNA, 25 bp, Mus musculus
tgctgggttgtctcttctgggagaa

SEQ ID NO: 875053 - DNA, 25 bp, Mus musculus
tgctgggtttccaggctctaatcct

SEQ ID NO: 875054 - DNA, 25 bp, Mus musculus
tgctgggtttcctggctctaatcct

SEQ ID NO: 875055 - DNA, 25 bp, Mus musculus
tgctggtaacagatcaacaatccgt

SEQ ID NO: 875056 - DNA, 25 bp, Mus musculus
tgctggtaacagttcaacaatccgt

SEQ ID NO: 875057 - DNA, 25 bp, Mus musculus
tgctggtacagaccttggcctgatc

SEQ ID NO: 875058 - DNA, 25 bp, Mus musculus
tgctggtacagagcttggcctgatc

SEQ ID NO: 875059 - DNA, 25 bp, Mus musculus
tgctggtacagcagcttacacacag

SEQ ID NO: 875060 - DNA, 25 bp, Mus musculus
tgctggtacagctgcttacacacag

SEQ ID NO: 875061 - DNA, 25 bp, Mus musculus
tgctggtaccataggcaagaccccc

SEQ ID NO: 875062 - DNA, 25 bp, Mus musculus
tgctggtaccattggcaagaccccc

SEQ ID NO: 875063 - DNA, 25 bp, Mus musculus
tgctggtacccactgaagcccttgg

SEQ ID NO: 875064 - DNA, 25 bp, Mus musculus
tgctggtacccagtgaagcccttgg

SEQ ID NO: 875065 - DNA, 25 bp, Mus musculus
tgctggtagtggacagtccctgaga

SEQ ID NO: 875066 - DNA, 25 bp, Mus musculus
tgctggtagtggtcagtccctgaga

SEQ ID NO: 875067 - DNA, 25 bp, Mus musculus
tgctggtatctgctgaatattgaaa

SEQ ID NO: 875068 - DNA, 25 bp, Mus musculus
tgctggtatctggtgaatattgaaa

SEQ ID NO: 875069 - DNA, 25 bp, Mus musculus
tgctggtattataggcttgtgctac

SEQ ID NO: 875070 - DNA, 25 bp, Mus musculus
tgctggtattattggcttgtgctac

SEQ ID NO: 875071 - DNA, 25 bp, Mus musculus
tgctggtatttaagctgtcaagtcc

SEQ ID NO: 875072 - DNA, 25 bp, Mus musculus
tgctggtatttatgctgtcaagtcc

SEQ ID NO: 875073 - DNA, 25 bp, Mus musculus
tgctggtcaagacacctatctggaa

SEQ ID NO: 875074 - DNA, 25 bp, Mus musculus
tgctggtcaagagacctatctggaa

SEQ ID NO: 875075 - DNA, 25 bp, Mus musculus
tgctggtcacggacactggctgtga

SEQ ID NO: 875076 - DNA, 25 bp, Mus musculus
tgctggtcacggtcactggctgtga

SEQ ID NO: 875077 - DNA, 25 bp, Mus musculus
tgctggtcagccaccggcgcatgca

SEQ ID NO: 875078 - DNA, 25 bp, Mus musculus
tgctggtcagccactcctgaagggc

SEQ ID NO: 875079 - DNA, 25 bp, Mus musculus
tgctggtcagcctccggcgcatgca

SEQ ID NO: 875080 - DNA, 25 bp, Mus musculus
tgctggtcagcctctcctgaagggc

SEQ ID NO: 875081 - DNA, 25 bp, Mus musculus
tgctggtcattacgcccttcggaaa

SEQ ID NO: 875082 - DNA, 25 bp, Mus musculus
tgctggtcattaggcccttcggaaa

SEQ ID NO: 875083 - DNA, 25 bp, Mus musculus
tgctggtcccaacccatacacaagt

SEQ ID NO: 875084 - DNA, 25 bp, Mus musculus
tgctggtcccaagccatacacaagt

SEQ ID NO: 875085 - DNA, 25 bp, Mus musculus
tgctggtcccttaaatgtcctcatt

SEQ ID NO: 875086 - DNA, 25 bp, Mus musculus
tgctggtcccttacaaactgatccg

SEQ ID NO: 875087 - DNA, 25 bp, Mus musculus
tgctggtccctttaatgtcctcatt

SEQ ID NO: 875088 - DNA, 25 bp, Mus musculus
tgctggtccctttcaaactgatccg

SEQ ID NO: 875089 - DNA, 25 bp, Mus musculus
tgctggtcctaaccaaggcttgggt

SEQ ID NO: 875090 - DNA, 25 bp, Mus musculus
tgctggtcctaagcaaggcttgggt

SEQ ID NO: 875091 - DNA, 25 bp, Mus musculus
tgctggtcctatcattttcccagta

SEQ ID NO: 875092 - DNA, 25 bp, Mus musculus
tgctggtcctatgattttcccagta

SEQ ID NO: 875093 - DNA, 25 bp, Mus musculus
tgctggtcggcaacaaaacggatct

SEQ ID NO: 875094 - DNA, 25 bp, Mus musculus
tgctggtcggcatcaaaacggatct

SEQ ID NO: 875095 - DNA, 25 bp, Mus musculus
tgctggtctcatccaggcaaaagac

SEQ ID NO: 875096 - DNA, 25 bp, Mus musculus
tgctggtctcatgcaggcaaaagac

SEQ ID NO: 875097 - DNA, 25 bp, Mus musculus
tgctggtcttggattttgtcacacc

SEQ ID NO: 875098 - DNA, 25 bp, Mus musculus
tgctggtcttggtttttgtcacacc

SEQ ID NO: 875099 - DNA, 25 bp, Mus musculus
tgctggtgaaccatagcaccatgga

SEQ ID NO: 875100 - DNA, 25 bp, Mus musculus
tgctggtgaaccttagcaccatgga

SEQ ID NO: 875101 - DNA, 25 bp, Mus musculus
tgctggtgaggcatggagcttcagt

SEQ ID NO: 875102 - DNA, 25 bp, Mus musculus
tgctggtgaggcttggagcttcagt

SEQ ID NO: 875103 - DNA, 25 bp, Mus musculus
tgctggtgcactatctctgggtgtg

SEQ ID NO: 875104 - DNA, 25 bp, Mus musculus
tgctggtgcactttctctgggtgtg

SEQ ID NO: 875105 - DNA, 25 bp, Mus musculus
tgctggtgcctcagtgttggccaaa

SEQ ID NO: 875106 - DNA, 25 bp, Mus musculus
tgctggtgcctctgtgttggccaaa

SEQ ID NO: 875107 - DNA, 25 bp, Mus musculus
tgctggtgcgtacccacatgcagga

SEQ ID NO: 875108 - DNA, 25 bp, Mus musculus
tgctggtgcgtagccacatgcagga

SEQ ID NO: 875109 - DNA, 25 bp, Mus musculus
tgctggtgggcactgcaccctgata

SEQ ID NO: 875110 - DNA, 25 bp, Mus musculus
tgctggtgggcagtgcaccctgata

SEQ ID NO: 875111 - DNA, 25 bp, Mus musculus
tgctggtgggccagtgcagtaaaca

SEQ ID NO: 875112 - DNA, 25 bp, Mus musculus
tgctggtgggcctgtgcagtaaaca

SEQ ID NO: 875113 - DNA, 25 bp, Mus musculus
tgctggtggttcacaatccacccca

SEQ ID NO: 875114 - DNA, 25 bp, Mus musculus
tgctggtggttctcaatccacccca

SEQ ID NO: 875115 - DNA, 25 bp, Mus musculus
tgctggtgtactacgtggtcaggac

SEQ ID NO: 875116 - DNA, 25 bp, Mus musculus
tgctggtgtacttcgtggtcaggac

SEQ ID NO: 875117 - DNA, 25 bp, Mus musculus
tgctggtgtatgactcttgatgacg

SEQ ID NO: 875118 - DNA, 25 bp, Mus musculus
tgctggtgtatgtctcttgatgacg

SEQ ID NO: 875119 - DNA, 25 bp, Mus musculus
tgctggtgtccacccttggtgagaa

SEQ ID NO: 875120 - DNA, 25 bp, Mus musculus
tgctggtgtccagccttggtgagaa

SEQ ID NO: 875121 - DNA, 25 bp, Mus musculus
tgctggtgtcttactttgttgtcat

SEQ ID NO: 875122 - DNA, 25 bp, Mus musculus
tgctggtgtctttctttgttgtcat

SEQ ID NO: 875123 - DNA, 25 bp, Mus musculus
tgctggtgtgatcatgggcttccct

SEQ ID NO: 875124 - DNA, 25 bp, Mus musculus
tgctggtgtgatgatgggcttccct

SEQ ID NO: 875125 - DNA, 25 bp, Mus musculus
tgctggtgttttctttgtctggatc

SEQ ID NO: 875126 - DNA, 25 bp, Mus musculus
tgctggtgttttgtttgtctggatc

SEQ ID NO: 875127 - DNA, 25 bp, Mus musculus
tgctggttaaccaagtctcaaattt

SEQ ID NO: 875128 - DNA, 25 bp, Mus musculus
tgctggttaacctagtctcaaattt

SEQ ID NO: 875129 - DNA, 25 bp, Mus musculus
tgctggttactcacgtacggtcaaa

SEQ ID NO: 875130 - DNA, 25 bp, Mus musculus
tgctggttactctcgtacggtcaaa

SEQ ID NO: 875131 - DNA, 25 bp, Mus musculus
tgctggttcactcgctcaatgatat

SEQ ID NO: 875132 - DNA, 25 bp, Mus musculus
tgctggttcactggctcaatgatat

SEQ ID NO: 875133 - DNA, 25 bp, Mus musculus
tgctggttcagtaggtggcttgcat

SEQ ID NO: 875134 - DNA, 25 bp, Mus musculus
tgctggttcagttggtggcttgcat

SEQ ID NO: 875135 - DNA, 25 bp, Mus musculus
tgctggttccaaattttctcctgct

SEQ ID NO: 875136 - DNA, 25 bp, Mus musculus
tgctggttccaatttttctcctgct

SEQ ID NO: 875137 - DNA, 25 bp, Mus musculus
tgctggttgcttagttccatgcagt

SEQ ID NO: 875138 - DNA, 25 bp, Mus musculus
tgctggttgctttgttccatgcagt

SEQ ID NO: 875139 - DNA, 25 bp, Mus musculus
tgctggttgtctacccttggaccca

SEQ ID NO: 875140 - DNA, 25 bp, Mus musculus
tgctggttgtcttcccttggaccca

SEQ ID NO: 875141 - DNA, 25 bp, Mus musculus
tgctggttgtggactatgccacctg

SEQ ID NO: 875142 - DNA, 25 bp, Mus musculus
tgctggttgtggtctatgccacctg

SEQ ID NO: 875143 - DNA, 25 bp, Mus musculus
tgctggttgtttatggagctgccct

SEQ ID NO: 875144 - DNA, 25 bp, Mus musculus
tgctggttgtttttggagctgccct

SEQ ID NO: 875145 - DNA, 25 bp, Mus musculus
tgctggtttgtcattgtcatcttat

SEQ ID NO: 875146 - DNA, 25 bp, Mus musculus
tgctggtttgtccttctttttgggt

SEQ ID NO: 875147 - DNA, 25 bp, Mus musculus
tgctggtttgtcgttctttttgggt

SEQ ID NO: 875148 - DNA, 25 bp, Mus musculus
tgctggtttgtctttgtcatcttat

SEQ ID NO: 875149 - DNA, 25 bp, Mus musculus
tgctgtaaatttcgcttctgttgtc

SEQ ID NO: 875150 - DNA, 25 bp, Mus musculus
tgctgtaaatttggcttctgttgtc

SEQ ID NO: 875151 - DNA, 25 bp, Mus musculus
tgctgtaacaatacccagtgtggta

SEQ ID NO: 875152 - DNA, 25 bp, Mus musculus
tgctgtaacaattcccagtgtggta

SEQ ID NO: 875153 - DNA, 25 bp, Mus musculus
tgctgtaacacccacctaccatgaa

SEQ ID NO: 875154 - DNA, 25 bp, Mus musculus
tgctgtaacaccgacctaccatgaa

SEQ ID NO: 875155 - DNA, 25 bp, Mus musculus
tgctgtaacataacctatagcctat

SEQ ID NO: 875156 - DNA, 25 bp, Mus musculus
tgctgtaacatatcctatagcctat

SEQ ID NO: 875157 - DNA, 25 bp, Mus musculus
tgctgtaagcccagccatgagggaa

SEQ ID NO: 875158 - DNA, 25 bp, Mus musculus
tgctgtaagccctgccatgagggaa

SEQ ID NO: 875159 - DNA, 25 bp, Mus musculus
tgctgtaagtttctccatgcctgcc

SEQ ID NO: 875160 - DNA, 25 bp, Mus musculus
tgctgtaagtttctctgcccctgaa

SEQ ID NO: 875161 - DNA, 25 bp, Mus musculus
tgctgtaagtttgtccatgcctgcc

SEQ ID NO: 875162 - DNA, 25 bp, Mus musculus
tgctgtaagtttgtctgcccctgaa

SEQ ID NO: 875163 - DNA, 25 bp, Mus musculus
tgctgtaatattatcctggagacac

SEQ ID NO: 875164 - DNA, 25 bp, Mus musculus
tgctgtaatattttcctggagacac

SEQ ID NO: 875165 - DNA, 25 bp, Mus musculus
tgctgtaatcctaataacctatatg

SEQ ID NO: 875166 - DNA, 25 bp, Mus musculus
tgctgtaatccttataacctatatg

SEQ ID NO: 875167 - DNA, 25 bp, Mus musculus
tgctgtaattaaatccccattcatt

SEQ ID NO: 875168 - DNA, 25 bp, Mus musculus
tgctgtaattaacatcacttaaaat

SEQ ID NO: 875169 - DNA, 25 bp, Mus musculus
tgctgtaattaagatcacttaaaat

SEQ ID NO: 875170 - DNA, 25 bp, Mus musculus
tgctgtaattaattccccattcatt

SEQ ID NO: 875171 - DNA, 25 bp, Mus musculus
tgctgtacacatatataccccacat

SEQ ID NO: 875172 - DNA, 25 bp, Mus musculus
tgctgtacacatttataccccacat

SEQ ID NO: 875173 - DNA, 25 bp, Mus musculus
tgctgtacaggcaaagcgacttacc

SEQ ID NO: 875174 - DNA, 25 bp, Mus musculus
tgctgtacaggctaagcgacttacc

SEQ ID NO: 875175 - DNA, 25 bp, Mus musculus
tgctgtacatccatccagttagtgt

SEQ ID NO: 875176 - DNA, 25 bp, Mus musculus
tgctgtacatccttccagttagtgt

SEQ ID NO: 875177 - DNA, 25 bp, Mus musculus
tgctgtaccacacgaggcagagtca

SEQ ID NO: 875178 - DNA, 25 bp, Mus musculus
tgctgtaccacaggaggcagagtca

SEQ ID NO: 875179 - DNA, 25 bp, Mus musculus
tgctgtaccagcatcacttgtaaag

SEQ ID NO: 875180 - DNA, 25 bp, Mus musculus
tgctgtaccagcttcacttgtaaag

SEQ ID NO: 875181 - DNA, 25 bp, Mus musculus
tgctgtacctctcggactggagccc

SEQ ID NO: 875182 - DNA, 25 bp, Mus musculus
tgctgtacctctgggactggagccc

SEQ ID NO: 875183 - DNA, 25 bp, Mus musculus
tgctgtacctgtcttgtgctcttgc

SEQ ID NO: 875184 - DNA, 25 bp, Mus musculus
tgctgtacctgtgttgtgctcttgc

SEQ ID NO: 875185 - DNA, 25 bp, Mus musculus
tgctgtacctttcgttggtgggtaa

SEQ ID NO: 875186 - DNA, 25 bp, Mus musculus
tgctgtacctttggttggtgggtaa

SEQ ID NO: 875187 - DNA, 25 bp, Mus musculus
tgctgtacgagtctgagagcccctg

SEQ ID NO: 875188 - DNA, 25 bp, Mus musculus
tgctgtacgagtgtgagagcccctg

SEQ ID NO: 875189 - DNA, 25 bp, Mus musculus
tgctgtacgcagctcttgcttttat

SEQ ID NO: 875190 - DNA, 25 bp, Mus musculus
tgctgtacgcaggtcttgcttttat

SEQ ID NO: 875191 - DNA, 25 bp, Mus musculus
tgctgtacgccacagttcaaaagta

SEQ ID NO: 875192 - DNA, 25 bp, Mus musculus
tgctgtacgccagagttcaaaagta

SEQ ID NO: 875193 - DNA, 25 bp, Mus musculus
tgctgtacgggcagtcgctggcact

SEQ ID NO: 875194 - DNA, 25 bp, Mus musculus
tgctgtacgggctgtcgctggcact

SEQ ID NO: 875195 - DNA, 25 bp, Mus musculus
tgctgtacgttcataagtctcccaa

SEQ ID NO: 875196 - DNA, 25 bp, Mus musculus
tgctgtacgttcttaagtctcccaa

SEQ ID NO: 875197 - DNA, 25 bp, Mus musculus
tgctgtactccaaatgttttctgtg

SEQ ID NO: 875198 - DNA, 25 bp, Mus musculus
tgctgtactccatatgttttctgtg

SEQ ID NO: 875199 - DNA, 25 bp, Mus musculus
tgctgtactgcacagctatagtaat

SEQ ID NO: 875200 - DNA, 25 bp, Mus musculus
tgctgtactgcagagctatagtaat

SEQ ID NO: 875201 - DNA, 25 bp, Mus musculus
tgctgtacttcaaaatgctattcgt

SEQ ID NO: 875202 - DNA, 25 bp, Mus musculus
tgctgtacttcataatgctattcgt

SEQ ID NO: 875203 - DNA, 25 bp, Mus musculus
tgctgtacttccaggatgctcatgc

SEQ ID NO: 875204 - DNA, 25 bp, Mus musculus
tgctgtacttcctggatgctcatgc

SEQ ID NO: 875205 - DNA, 25 bp, Mus musculus
tgctgtactttgcttaatttttcga

SEQ ID NO: 875206 - DNA, 25 bp, Mus musculus
tgctgtactttggttaatttttcga

SEQ ID NO: 875207 - DNA, 25 bp, Mus musculus
tgctgtagaatgaaagcctctcttc

SEQ ID NO: 875208 - DNA, 25 bp, Mus musculus
tgctgtagaatgtaagcctctcttc

SEQ ID NO: 875209 - DNA, 25 bp, Mus musculus
tgctgtagacacacatcgtgacaag

SEQ ID NO: 875210 - DNA, 25 bp, Mus musculus
tgctgtagacactcatcgtgacaag

SEQ ID NO: 875211 - DNA, 25 bp, Mus musculus
tgctgtaggtagcaactgctgtttg

SEQ ID NO: 875212 - DNA, 25 bp, Mus musculus
tgctgtaggtaggaactgctgtttg

SEQ ID NO: 875213 - DNA, 25 bp, Mus musculus
tgctgtatacagagaaccccatgat

SEQ ID NO: 875214 - DNA, 25 bp, Mus musculus
tgctgtatacagtgaaccccatgat

SEQ ID NO: 875215 - DNA, 25 bp, Mus musculus
tgctgtatacatcgccagtgctgtg

SEQ ID NO: 875216 - DNA, 25 bp, Mus musculus
tgctgtatacatggccagtgctgtg

SEQ ID NO: 875217 - DNA, 25 bp, Mus musculus
tgctgtatcacgatcacttttgaaa

SEQ ID NO: 875218 - DNA, 25 bp, Mus musculus
tgctgtatcacgttcacttttgaaa

SEQ ID NO: 875219 - DNA, 25 bp, Mus musculus
tgctgtatccctaattcccaaaaga

SEQ ID NO: 875220 - DNA, 25 bp, Mus musculus
tgctgtatcccttattcccaaaaga

SEQ ID NO: 875221 - DNA, 25 bp, Mus musculus
tgctgtatcgcaataccttggcaac

SEQ ID NO: 875222 - DNA, 25 bp, Mus musculus
tgctgtatcgcattaccttggcaac

SEQ ID NO: 875223 - DNA, 25 bp, Mus musculus
tgctgtatctcactcagatgcccca

SEQ ID NO: 875224 - DNA, 25 bp, Mus musculus
tgctgtatctcagtcagatgcccca

SEQ ID NO: 875225 - DNA, 25 bp, Mus musculus
tgctgtatgagcacaagaccctgag

SEQ ID NO: 875226 - DNA, 25 bp, Mus musculus
tgctgtatgagctcaagaccctgag

SEQ ID NO: 875227 - DNA, 25 bp, Mus musculus
tgctgtatgattagtgtccttggac

SEQ ID NO: 875228 - DNA, 25 bp, Mus musculus
tgctgtatgatttgtgtccttggac

SEQ ID NO: 875229 - DNA, 25 bp, Mus musculus
tgctgtatgcacatgatgtccgaga

SEQ ID NO: 875230 - DNA, 25 bp, Mus musculus
tgctgtatgcacttgatgtccgaga

SEQ ID NO: 875231 - DNA, 25 bp, Mus musculus
tgctgtattagtcggtccttgctca

SEQ ID NO: 875232 - DNA, 25 bp, Mus musculus
tgctgtattagtgggtccttgctca

SEQ ID NO: 875233 - DNA, 25 bp, Mus musculus
tgctgtattccacatgctgcccaca

SEQ ID NO: 875234 - DNA, 25 bp, Mus musculus
tgctgtattccactatcctattaaa

SEQ ID NO: 875235 - DNA, 25 bp, Mus musculus
tgctgtattccagatgctgcccaca

SEQ ID NO: 875236 - DNA, 25 bp, Mus musculus
tgctgtattccagtatcctattaaa

SEQ ID NO: 875237 - DNA, 25 bp, Mus musculus
tgctgtatttaaactcccatcctgg

SEQ ID NO: 875238 - DNA, 25 bp, Mus musculus
tgctgtatttaatctcccatcctgg

SEQ ID NO: 875239 - DNA, 25 bp, Mus musculus
tgctgtcaaagtctgcttagctcat

SEQ ID NO: 875240 - DNA, 25 bp, Mus musculus
tgctgtcaaagtgtgcttagctcat

SEQ ID NO: 875241 - DNA, 25 bp, Mus musculus
tgctgtcaagacctttagctcgtga

SEQ ID NO: 875242 - DNA, 25 bp, Mus musculus
tgctgtcaagacgtttagctcgtga

SEQ ID NO: 875243 - DNA, 25 bp, Mus musculus
tgctgtcaagatacacgtggcccaa

SEQ ID NO: 875244 - DNA, 25 bp, Mus musculus
tgctgtcaagattcacgtggcccaa

SEQ ID NO: 875245 - DNA, 25 bp, Mus musculus
tgctgtcaagcacatggtcccaaga

SEQ ID NO: 875246 - DNA, 25 bp, Mus musculus
tgctgtcaagcagatggtcccaaga

SEQ ID NO: 875247 - DNA, 25 bp, Mus musculus
tgctgtcacaatatcattccgaggc

SEQ ID NO: 875248 - DNA, 25 bp, Mus musculus
tgctgtcacaatttcattccgaggc

SEQ ID NO: 875249 - DNA, 25 bp, Mus musculus
tgctgtcacagccaggacacacgta

SEQ ID NO: 875250 - DNA, 25 bp, Mus musculus
tgctgtcacagcgaggacacacgta

SEQ ID NO: 875251 - DNA, 25 bp, Mus musculus
tgctgtcacataacctcatagtgcc

SEQ ID NO: 875252 - DNA, 25 bp, Mus musculus
tgctgtcacatatcctcatagtgcc

SEQ ID NO: 875253 - DNA, 25 bp, Mus musculus
tgctgtcaccaacaccgagccggaa

SEQ ID NO: 875254 - DNA, 25 bp, Mus musculus
tgctgtcaccaagaccgagccggaa

SEQ ID NO: 875255 - DNA, 25 bp, Mus musculus
tgctgtcactccagtggtttgggaa

SEQ ID NO: 875256 - DNA, 25 bp, Mus musculus
tgctgtcactccctaaggatttagg

SEQ ID NO: 875257 - DNA, 25 bp, Mus musculus
tgctgtcactccgtaaggatttagg

SEQ ID NO: 875258 - DNA, 25 bp, Mus musculus
tgctgtcactcctgtggtttgggaa

SEQ ID NO: 875259 - DNA, 25 bp, Mus musculus
tgctgtcactcgagatcctgagaat

SEQ ID NO: 875260 - DNA, 25 bp, Mus musculus
tgctgtcactcgtgatcctgagaat

SEQ ID NO: 875261 - DNA, 25 bp, Mus musculus
tgctgtcactggcattgctgtcgca

SEQ ID NO: 875262 - DNA, 25 bp, Mus musculus
tgctgtcactgggattgctgtcgca

SEQ ID NO: 875263 - DNA, 25 bp, Mus musculus
tgctgtcactgtccaggagacccca

SEQ ID NO: 875264 - DNA, 25 bp, Mus musculus
tgctgtcactgtgcaggagacccca

SEQ ID NO: 875265 - DNA, 25 bp, Mus musculus
tgctgtcacttcacacctgaggagg

SEQ ID NO: 875266 - DNA, 25 bp, Mus musculus
tgctgtcacttctcacctgaggagg

SEQ ID NO: 875267 - DNA, 25 bp, Mus musculus
tgctgtcactttccctgatctttca

SEQ ID NO: 875268 - DNA, 25 bp, Mus musculus
tgctgtcactttgcctgatctttca

SEQ ID NO: 875269 - DNA, 25 bp, Mus musculus
tgctgtcagattctgctcacgttgt

SEQ ID NO: 875270 - DNA, 25 bp, Mus musculus
tgctgtcagattgtgctcacgttgt

SEQ ID NO: 875271 - DNA, 25 bp, Mus musculus
tgctgtcagcaaaatcctcattgct

SEQ ID NO: 875272 - DNA, 25 bp, Mus musculus
tgctgtcagcaaacactcggttgtt

SEQ ID NO: 875273 - DNA, 25 bp, Mus musculus
tgctgtcagcaatatcctcattgct

SEQ ID NO: 875274 - DNA, 25 bp, Mus musculus
tgctgtcagcaatcactcggttgtt

SEQ ID NO: 875275 - DNA, 25 bp, Mus musculus
tgctgtcagccgagtcccaaaggtg

SEQ ID NO: 875276 - DNA, 25 bp, Mus musculus
tgctgtcagccgtgtcccaaaggtg

SEQ ID NO: 875277 - DNA, 25 bp, Mus musculus
tgctgtcagctcagcttctacaagc

SEQ ID NO: 875278 - DNA, 25 bp, Mus musculus
tgctgtcagctctgcttctacaagc

SEQ ID NO: 875279 - DNA, 25 bp, Mus musculus
tgctgtcaggctcaagcgcgtcttg

SEQ ID NO: 875280 - DNA, 25 bp, Mus musculus
tgctgtcaggctgaagcgcgtcttg

SEQ ID NO: 875281 - DNA, 25 bp, Mus musculus
tgctgtcagtctcttagggttccca

SEQ ID NO: 875282 - DNA, 25 bp, Mus musculus
tgctgtcagtctgttagggttccca

SEQ ID NO: 875283 - DNA, 25 bp, Mus musculus
tgctgtcatctcattacttgtaaca

SEQ ID NO: 875284 - DNA, 25 bp, Mus musculus
tgctgtcatctctttacttgtaaca

SEQ ID NO: 875285 - DNA, 25 bp, Mus musculus
tgctgtcattaactgttgctggtca

SEQ ID NO: 875286 - DNA, 25 bp, Mus musculus
tgctgtcattaagtgttgctggtca

SEQ ID NO: 875287 - DNA, 25 bp, Mus musculus
tgctgtcattgcaagctgcagtggt

SEQ ID NO: 875288 - DNA, 25 bp, Mus musculus
tgctgtcattgctagctgcagtggt

SEQ ID NO: 875289 - DNA, 25 bp, Mus musculus
tgctgtccaaagattacaatccatt

SEQ ID NO: 875290 - DNA, 25 bp, Mus musculus
tgctgtccaaagcttgtcagggcct

SEQ ID NO: 875291 - DNA, 25 bp, Mus musculus
tgctgtccaaaggttgtcagggcct

SEQ ID NO: 875292 - DNA, 25 bp, Mus musculus
tgctgtccaaagtttacaatccatt

SEQ ID NO: 875293 - DNA, 25 bp, Mus musculus
tgctgtccacatctatggtttccac

SEQ ID NO: 875294 - DNA, 25 bp, Mus musculus
tgctgtccacatgtatggtttccac

SEQ ID NO: 875295 - DNA, 25 bp, Mus musculus
tgctgtccagacagtaaggtgcctg

SEQ ID NO: 875296 - DNA, 25 bp, Mus musculus
tgctgtccagactgtaaggtgcctg

SEQ ID NO: 875297 - DNA, 25 bp, Mus musculus
tgctgtccatcgatcagaactgggt

SEQ ID NO: 875298 - DNA, 25 bp, Mus musculus
tgctgtccatcgttcagaactgggt

SEQ ID NO: 875299 - DNA, 25 bp, Mus musculus
tgctgtccattccaaggacctctga

SEQ ID NO: 875300 - DNA, 25 bp, Mus musculus
tgctgtccattcgaaggacctctga

SEQ ID NO: 875301 - DNA, 25 bp, Mus musculus
tgctgtcccaccattgaatggtata

SEQ ID NO: 875302 - DNA, 25 bp, Mus musculus
tgctgtcccacctttgaatggtata

SEQ ID NO: 875303 - DNA, 25 bp, Mus musculus
tgctgtcccctacgtgtgagtattt

SEQ ID NO: 875304 - DNA, 25 bp, Mus musculus
tgctgtcccctaggtgtgagtattt

SEQ ID NO: 875305 - DNA, 25 bp, Mus musculus
tgctgtcccggtacctgtggtagga

SEQ ID NO: 875306 - DNA, 25 bp, Mus musculus
tgctgtcccggttcctgtggtagga

SEQ ID NO: 875307 - DNA, 25 bp, Mus musculus
tgctgtcccgtgacattcaaataaa

SEQ ID NO: 875308 - DNA, 25 bp, Mus musculus
tgctgtcccgtgtcattcaaataaa

SEQ ID NO: 875309 - DNA, 25 bp, Mus musculus
tgctgtccctgcatgtggacctggg

SEQ ID NO: 875310 - DNA, 25 bp, Mus musculus
tgctgtccctgcttgtggacctggg

SEQ ID NO: 875311 - DNA, 25 bp, Mus musculus
tgctgtccggacacactctcctggg

SEQ ID NO: 875312 - DNA, 25 bp, Mus musculus
tgctgtccggactcactctcctggg

SEQ ID NO: 875313 - DNA, 25 bp, Mus musculus
tgctgtccgtagagtccaaaggcca

SEQ ID NO: 875314 - DNA, 25 bp, Mus musculus
tgctgtccgtagtgtccaaaggcca

SEQ ID NO: 875315 - DNA, 25 bp, Mus musculus
tgctgtcctataagtttgccctgtg

SEQ ID NO: 875316 - DNA, 25 bp, Mus musculus
tgctgtcctatatgtttgccctgtg

SEQ ID NO: 875317 - DNA, 25 bp, Mus musculus
tgctgtcctatgctttgatccaccc

SEQ ID NO: 875318 - DNA, 25 bp, Mus musculus
tgctgtcctatggtttgatccaccc

SEQ ID NO: 875319 - DNA, 25 bp, Mus musculus
tgctgtcctcacaccagaatgagtg

SEQ ID NO: 875320 - DNA, 25 bp, Mus musculus
tgctgtcctcactccagaatgagtg

SEQ ID NO: 875321 - DNA, 25 bp, Mus musculus
tgctgtcctcagagataacacggga

SEQ ID NO: 875322 - DNA, 25 bp, Mus musculus
tgctgtcctcagtgataacacggga

SEQ ID NO: 875323 - DNA, 25 bp, Mus musculus
tgctgtcctgacaccaggtgaggca

SEQ ID NO: 875324 - DNA, 25 bp, Mus musculus
tgctgtcctgactccaggtgaggca

SEQ ID NO: 875325 - DNA, 25 bp, Mus musculus
tgctgtcctgatcagtccaactgtt

SEQ ID NO: 875326 - DNA, 25 bp, Mus musculus
tgctgtcctgatgagtccaactgtt

SEQ ID NO: 875327 - DNA, 25 bp, Mus musculus
tgctgtcctgcaaggttgagttgct

SEQ ID NO: 875328 - DNA, 25 bp, Mus musculus
tgctgtcctgcacaattttgggcta

SEQ ID NO: 875329 - DNA, 25 bp, Mus musculus
tgctgtcctgcagaattttgggcta

SEQ ID NO: 875330 - DNA, 25 bp, Mus musculus
tgctgtcctgcatggttgagttgct

SEQ ID NO: 875331 - DNA, 25 bp, Mus musculus
tgctgtccttgcctgcagtgtgacc

SEQ ID NO: 875332 - DNA, 25 bp, Mus musculus
tgctgtccttgcgtgcagtgtgacc

SEQ ID NO: 875333 - DNA, 25 bp, Mus musculus
tgctgtccttgtctagtgatttggt

SEQ ID NO: 875334 - DNA, 25 bp, Mus musculus
tgctgtccttgtgtagtgatttggt

SEQ ID NO: 875335 - DNA, 25 bp, Mus musculus
tgctgtcctttgactacagtgtccc

SEQ ID NO: 875336 - DNA, 25 bp, Mus musculus
tgctgtcctttgtctacagtgtccc

SEQ ID NO: 875337 - DNA, 25 bp, Mus musculus
tgctgtcgaacacctggctttacca

SEQ ID NO: 875338 - DNA, 25 bp, Mus musculus
tgctgtcgaacagctggctttacca

SEQ ID NO: 875339 - DNA, 25 bp, Mus musculus
tgctgtcgcattccctgctttaaaa

SEQ ID NO: 875340 - DNA, 25 bp, Mus musculus
tgctgtcgcattgcctgctttaaaa

SEQ ID NO: 875341 - DNA, 25 bp, Mus musculus
tgctgtcgctacaggagctgcagac

SEQ ID NO: 875342 - DNA, 25 bp, Mus musculus
tgctgtcgctactggagctgcagac

SEQ ID NO: 875343 - DNA, 25 bp, Mus musculus
tgctgtcgctcaccgtggtcttcgg

SEQ ID NO: 875344 - DNA, 25 bp, Mus musculus
tgctgtcgctcagcgtggtcttcgg

SEQ ID NO: 875345 - DNA, 25 bp, Mus musculus
tgctgtcgctttcatcccaagatgt

SEQ ID NO: 875346 - DNA, 25 bp, Mus musculus
tgctgtcgctttgatcccaagatgt

SEQ ID NO: 875347 - DNA, 25 bp, Mus musculus
tgctgtcggtggctctcatgttcat

SEQ ID NO: 875348 - DNA, 25 bp, Mus musculus
tgctgtcggtgggtctcatgttcat

SEQ ID NO: 875349 - DNA, 25 bp, Mus musculus
tgctgtctaggcaagctttgttcct

SEQ ID NO: 875350 - DNA, 25 bp, Mus musculus
tgctgtctaggctagctttgttcct

SEQ ID NO: 875351 - DNA, 25 bp, Mus musculus
tgctgtctagtcatgggctgaggaa

SEQ ID NO: 875352 - DNA, 25 bp, Mus musculus
tgctgtctagtcttgggctgaggaa

SEQ ID NO: 875353 - DNA, 25 bp, Mus musculus
tgctgtctagtgacgctgcattggt

SEQ ID NO: 875354 - DNA, 25 bp, Mus musculus
tgctgtctagtgtcgctgcattggt

SEQ ID NO: 875355 - DNA, 25 bp, Mus musculus
tgctgtctcacaacctgttcaactt

SEQ ID NO: 875356 - DNA, 25 bp, Mus musculus
tgctgtctcacatcctgttcaactt

SEQ ID NO: 875357 - DNA, 25 bp, Mus musculus
tgctgtctccatatagtgcctagaa

SEQ ID NO: 875358 - DNA, 25 bp, Mus musculus
tgctgtctccatcaacctctgaagg

SEQ ID NO: 875359 - DNA, 25 bp, Mus musculus
tgctgtctccatgaacctctgaagg

SEQ ID NO: 875360 - DNA, 25 bp, Mus musculus
tgctgtctccatttagtgcctagaa

SEQ ID NO: 875361 - DNA, 25 bp, Mus musculus
tgctgtctctccactggatgtcaaa

SEQ ID NO: 875362 - DNA, 25 bp, Mus musculus
tgctgtctctcctctggatgtcaaa

SEQ ID NO: 875363 - DNA, 25 bp, Mus musculus
tgctgtctctgccaatcacaagttt

SEQ ID NO: 875364 - DNA, 25 bp, Mus musculus
tgctgtctctgcgaatcacaagttt

SEQ ID NO: 875365 - DNA, 25 bp, Mus musculus
tgctgtctcttcaaactccttttat

SEQ ID NO: 875366 - DNA, 25 bp, Mus musculus
tgctgtctcttctaactccttttat

SEQ ID NO: 875367 - DNA, 25 bp, Mus musculus
tgctgtctctttactggtactggta

SEQ ID NO: 875368 - DNA, 25 bp, Mus musculus
tgctgtctcttttctggtactggta

SEQ ID NO: 875369 - DNA, 25 bp, Mus musculus
tgctgtctgaggaccacctgtggga

SEQ ID NO: 875370 - DNA, 25 bp, Mus musculus
tgctgtctgaggtccacctgtggga

SEQ ID NO: 875371 - DNA, 25 bp, Mus musculus
tgctgtctgagtccactgatgaaat

SEQ ID NO: 875372 - DNA, 25 bp, Mus musculus
tgctgtctgagtgcactgatgaaat

SEQ ID NO: 875373 - DNA, 25 bp, Mus musculus
tgctgtctgccaccttttgaagaga

SEQ ID NO: 875374 - DNA, 25 bp, Mus musculus
tgctgtctgccagcttttgaagaga

SEQ ID NO: 875375 - DNA, 25 bp, Mus musculus
tgctgtctgcccaccttggtgaaaa

SEQ ID NO: 875376 - DNA, 25 bp, Mus musculus
tgctgtctgccctccttggtgaaaa

SEQ ID NO: 875377 - DNA, 25 bp, Mus musculus
tgctgtctggcaacattggaccttt

SEQ ID NO: 875378 - DNA, 25 bp, Mus musculus
tgctgtctggcatcattggaccttt

SEQ ID NO: 875379 - DNA, 25 bp, Mus musculus
tgctgtctggccattgtgtccaagt

SEQ ID NO: 875380 - DNA, 25 bp, Mus musculus
tgctgtctggcctttgtgtccaagt

SEQ ID NO: 875381 - DNA, 25 bp, Mus musculus
tgctgtctggctagtggtccaaata

SEQ ID NO: 875382 - DNA, 25 bp, Mus musculus
tgctgtctggcttgtggtccaaata

SEQ ID NO: 875383 - DNA, 25 bp, Mus musculus
tgctgtctgtcacatgtgtttgtct

SEQ ID NO: 875384 - DNA, 25 bp, Mus musculus
tgctgtctgtcagatgtgtttgtct

SEQ ID NO: 875385 - DNA, 25 bp, Mus musculus
tgctgtctgtttagggcgctcttgt

SEQ ID NO: 875386 - DNA, 25 bp, Mus musculus
tgctgtctgttttgggcgctcttgt

SEQ ID NO: 875387 - DNA, 25 bp, Mus musculus
tgctgtcttaacaaccatgggttta

SEQ ID NO: 875388 - DNA, 25 bp, Mus musculus
tgctgtcttaactaccatgggttta

SEQ ID NO: 875389 - DNA, 25 bp, Mus musculus
tgctgtcttaagcttttccccatag

SEQ ID NO: 875390 - DNA, 25 bp, Mus musculus
tgctgtcttaaggttttccccatag

SEQ ID NO: 875391 - DNA, 25 bp, Mus musculus
tgctgtcttagaaatgtatcctaaa

SEQ ID NO: 875392 - DNA, 25 bp, Mus musculus
tgctgtcttagatatgtatcctaaa

SEQ ID NO: 875393 - DNA, 25 bp, Mus musculus
tgctgtcttcagagcctgacaccca

SEQ ID NO: 875394 - DNA, 25 bp, Mus musculus
tgctgtcttcagtgcctgacaccca

SEQ ID NO: 875395 - DNA, 25 bp, Mus musculus
tgctgtcttcgcaaacgtggtgtac

SEQ ID NO: 875396 - DNA, 25 bp, Mus musculus
tgctgtcttcgctaacgtggtgtac

SEQ ID NO: 875397 - DNA, 25 bp, Mus musculus
tgctgtcttctcattgacagagaca

SEQ ID NO: 875398 - DNA, 25 bp, Mus musculus
tgctgtcttctctttgacagagaca

SEQ ID NO: 875399 - DNA, 25 bp, Mus musculus
tgctgtcttctgcagtgcggaccta

SEQ ID NO: 875400 - DNA, 25 bp, Mus musculus
tgctgtcttctggagtgcggaccta

SEQ ID NO: 875401 - DNA, 25 bp, Mus musculus
tgctgtcttcttcccgatacgtttt

SEQ ID NO: 875402 - DNA, 25 bp, Mus musculus
tgctgtcttcttgccgatacgtttt

SEQ ID NO: 875403 - DNA, 25 bp, Mus musculus
tgctgtcttttgctgttggatgcca

SEQ ID NO: 875404 - DNA, 25 bp, Mus musculus
tgctgtcttttggtgttggatgcca

SEQ ID NO: 875405 - DNA, 25 bp, Mus musculus
tgctgtgaaaacaaaccagatagga

SEQ ID NO: 875406 - DNA, 25 bp, Mus musculus
tgctgtgaaaacactctggtttcta

SEQ ID NO: 875407 - DNA, 25 bp, Mus musculus
tgctgtgaaaactaaccagatagga

SEQ ID NO: 875408 - DNA, 25 bp, Mus musculus
tgctgtgaaaactctctggtttcta

SEQ ID NO: 875409 - DNA, 25 bp, Mus musculus
tgctgtgaacaccaggcactgtgcg

SEQ ID NO: 875410 - DNA, 25 bp, Mus musculus
tgctgtgaacacgaggcactgtgcg

SEQ ID NO: 875411 - DNA, 25 bp, Mus musculus
tgctgtgaacagcactcaactctca

SEQ ID NO: 875412 - DNA, 25 bp, Mus musculus
tgctgtgaacaggactcaactctca

SEQ ID NO: 875413 - DNA, 25 bp, Mus musculus
tgctgtgaacctatggactgctgtt

SEQ ID NO: 875414 - DNA, 25 bp, Mus musculus
tgctgtgaacctcaatctgataaac

SEQ ID NO: 875415 - DNA, 25 bp, Mus musculus
tgctgtgaacctgaatctgataaac

SEQ ID NO: 875416 - DNA, 25 bp, Mus musculus
tgctgtgaacctttggactgctgtt

SEQ ID NO: 875417 - DNA, 25 bp, Mus musculus
tgctgtgaactcaagcttcagctaa

SEQ ID NO: 875418 - DNA, 25 bp, Mus musculus
tgctgtgaactctagcttcagctaa

SEQ ID NO: 875419 - DNA, 25 bp, Mus musculus
tgctgtgaagcacgtcaactgtttt

SEQ ID NO: 875420 - DNA, 25 bp, Mus musculus
tgctgtgaagcaggtcaactgtttt

SEQ ID NO: 875421 - DNA, 25 bp, Mus musculus
tgctgtgaagccagaccactggttc

SEQ ID NO: 875422 - DNA, 25 bp, Mus musculus
tgctgtgaagccagattgtgtcaat

SEQ ID NO: 875423 - DNA, 25 bp, Mus musculus
tgctgtgaagcctgaccactggttc

SEQ ID NO: 875424 - DNA, 25 bp, Mus musculus
tgctgtgaagcctgattgtgtcaat

SEQ ID NO: 875425 - DNA, 25 bp, Mus musculus
tgctgtgaattcctactcccgttta

SEQ ID NO: 875426 - DNA, 25 bp, Mus musculus
tgctgtgaattcgtactcccgttta

SEQ ID NO: 875427 - DNA, 25 bp, Mus musculus
tgctgtgacaacagtaacttgcttt

SEQ ID NO: 875428 - DNA, 25 bp, Mus musculus
tgctgtgacaactgtaacttgcttt

SEQ ID NO: 875429 - DNA, 25 bp, Mus musculus
tgctgtgacccaagaatctgtggct

SEQ ID NO: 875430 - DNA, 25 bp, Mus musculus
tgctgtgacccaaggataggtggct

SEQ ID NO: 875431 - DNA, 25 bp, Mus musculus
tgctgtgacccatgaatctgtggct

SEQ ID NO: 875432 - DNA, 25 bp, Mus musculus
tgctgtgacccatggataggtggct

SEQ ID NO: 875433 - DNA, 25 bp, Mus musculus
tgctgtgacctaccaagggagccgt

SEQ ID NO: 875434 - DNA, 25 bp, Mus musculus
tgctgtgacctagcaagggagccgt

SEQ ID NO: 875435 - DNA, 25 bp, Mus musculus
tgctgtgacgtgatgagaactttac

SEQ ID NO: 875436 - DNA, 25 bp, Mus musculus
tgctgtgacgtgttgagaactttac

SEQ ID NO: 875437 - DNA, 25 bp, Mus musculus
tgctgtgagccacgtcaaggcagaa

SEQ ID NO: 875438 - DNA, 25 bp, Mus musculus
tgctgtgagccaggtcaaggcagaa

SEQ ID NO: 875439 - DNA, 25 bp, Mus musculus
tgctgtgaggttcctcctagcctgt

SEQ ID NO: 875440 - DNA, 25 bp, Mus musculus
tgctgtgaggttgctcctagcctgt

SEQ ID NO: 875441 - DNA, 25 bp, Mus musculus
tgctgtgatagcaattttttgttat

SEQ ID NO: 875442 - DNA, 25 bp, Mus musculus
tgctgtgatagctattttttgttat

SEQ ID NO: 875443 - DNA, 25 bp, Mus musculus
tgctgtgatctgaacactgcccaaa

SEQ ID NO: 875444 - DNA, 25 bp, Mus musculus
tgctgtgatctgtacactgcccaaa

SEQ ID NO: 875445 - DNA, 25 bp, Mus musculus
tgctgtgatgatcacagcctcagtt

SEQ ID NO: 875446 - DNA, 25 bp, Mus musculus
tgctgtgatgatgacagcctcagtt

SEQ ID NO: 875447 - DNA, 25 bp, Mus musculus
tgctgtgatggtccttccaacaacc

SEQ ID NO: 875448 - DNA, 25 bp, Mus musculus
tgctgtgatggtgcttccaacaacc

SEQ ID NO: 875449 - DNA, 25 bp, Mus musculus
tgctgtgattagctccccttatggc

SEQ ID NO: 875450 - DNA, 25 bp, Mus musculus
tgctgtgattaggtccccttatggc

SEQ ID NO: 875451 - DNA, 25 bp, Mus musculus
tgctgtgcaacaaaaccaggccctt

SEQ ID NO: 875452 - DNA, 25 bp, Mus musculus
tgctgtgcaacataaccaggccctt

SEQ ID NO: 875453 - DNA, 25 bp, Mus musculus
tgctgtgcaaggacttacccggttt

SEQ ID NO: 875454 - DNA, 25 bp, Mus musculus
tgctgtgcaaggtcttacccggttt

SEQ ID NO: 875455 - DNA, 25 bp, Mus musculus
tgctgtgcacacactacactggttg

SEQ ID NO: 875456 - DNA, 25 bp, Mus musculus
tgctgtgcacactctacactggttg

SEQ ID NO: 875457 - DNA, 25 bp, Mus musculus
tgctgtgcacgcagtggaaggccat

SEQ ID NO: 875458 - DNA, 25 bp, Mus musculus
tgctgtgcacgctgtggaaggccat

SEQ ID NO: 875459 - DNA, 25 bp, Mus musculus
tgctgtgcacttacctactgtgagc

SEQ ID NO: 875460 - DNA, 25 bp, Mus musculus
tgctgtgcactttcctactgtgagc

SEQ ID NO: 875461 - DNA, 25 bp, Mus musculus
tgctgtgcagcaaggccaagtagtt

SEQ ID NO: 875462 - DNA, 25 bp, Mus musculus
tgctgtgcagcatggccaagtagtt

SEQ ID NO: 875463 - DNA, 25 bp, Mus musculus
tgctgtgcagctaatcagattcttg

SEQ ID NO: 875464 - DNA, 25 bp, Mus musculus
tgctgtgcagcttatcagattcttg

SEQ ID NO: 875465 - DNA, 25 bp, Mus musculus
tgctgtgcagttatactccaaccta

SEQ ID NO: 875466 - DNA, 25 bp, Mus musculus
tgctgtgcagttttactccaaccta

SEQ ID NO: 875467 - DNA, 25 bp, Mus musculus
tgctgtgcatttacaagcacccctt

SEQ ID NO: 875468 - DNA, 25 bp, Mus musculus
tgctgtgcattttcaagcacccctt

SEQ ID NO: 875469 - DNA, 25 bp, Mus musculus
tgctgtgcctgcactatgtgattca

SEQ ID NO: 875470 - DNA, 25 bp, Mus musculus
tgctgtgcctgcagccattaaacaa

SEQ ID NO: 875471 - DNA, 25 bp, Mus musculus
tgctgtgcctgctctatgtgattca

SEQ ID NO: 875472 - DNA, 25 bp, Mus musculus
tgctgtgcctgctgccattaaacaa

SEQ ID NO: 875473 - DNA, 25 bp, Mus musculus
tgctgtgcctgtaggcagggaaaat

SEQ ID NO: 875474 - DNA, 25 bp, Mus musculus
tgctgtgcctgttggcagggaaaat

SEQ ID NO: 875475 - DNA, 25 bp, Mus musculus
tgctgtgcgaacacggagatgtcct

SEQ ID NO: 875476 - DNA, 25 bp, Mus musculus
tgctgtgcgaactcggagatgtcct

SEQ ID NO: 875477 - DNA, 25 bp, Mus musculus
tgctgtgcgaatcgttcctccgtgt

SEQ ID NO: 875478 - DNA, 25 bp, Mus musculus
tgctgtgcgaatggttcctccgtgt

SEQ ID NO: 875479 - DNA, 25 bp, Mus musculus
tgctgtgcgaccctggaagagttta

SEQ ID NO: 875480 - DNA, 25 bp, Mus musculus
tgctgtgcgaccgtggaagagttta

SEQ ID NO: 875481 - DNA, 25 bp, Mus musculus
tgctgtgcgtatacctgcttagaag

SEQ ID NO: 875482 - DNA, 25 bp, Mus musculus
tgctgtgcgtattcctgcttagaag

SEQ ID NO: 875483 - DNA, 25 bp, Mus musculus
tgctgtgctccaattggtgctagag

SEQ ID NO: 875484 - DNA, 25 bp, Mus musculus
tgctgtgctccatttggtgctagag

SEQ ID NO: 875485 - DNA, 25 bp, Mus musculus
tgctgtgctcctcgtacgcatgagc

SEQ ID NO: 875486 - DNA, 25 bp, Mus musculus
tgctgtgctcctggtacgcatgagc

SEQ ID NO: 875487 - DNA, 25 bp, Mus musculus
tgctgtgctcggagaagaaccagga

SEQ ID NO: 875488 - DNA, 25 bp, Mus musculus
tgctgtgctcggtgaagaaccagga

SEQ ID NO: 875489 - DNA, 25 bp, Mus musculus
tgctgtgctcgtaagtcaagactat

SEQ ID NO: 875490 - DNA, 25 bp, Mus musculus
tgctgtgctcgttagtcaagactat

SEQ ID NO: 875491 - DNA, 25 bp, Mus musculus
tgctgtgctcttacactggaagcaa

SEQ ID NO: 875492 - DNA, 25 bp, Mus musculus
tgctgtgctctttcactggaagcaa

SEQ ID NO: 875493 - DNA, 25 bp, Mus musculus
tgctgtgctgatagtcacggtgccc

SEQ ID NO: 875494 - DNA, 25 bp, Mus musculus
tgctgtgctgattgtcacggtgccc

SEQ ID NO: 875495 - DNA, 25 bp, Mus musculus
tgctgtgctgcactctgcaaaccat

SEQ ID NO: 875496 - DNA, 25 bp, Mus musculus
tgctgtgctgcagtctgcaaaccat

SEQ ID NO: 875497 - DNA, 25 bp, Mus musculus
tgctgtgctgcgaattccctgagtg

SEQ ID NO: 875498 - DNA, 25 bp, Mus musculus
tgctgtgctgcgtattccctgagtg

SEQ ID NO: 875499 - DNA, 25 bp, Mus musculus
tgctgtgctgctattcattagctga

SEQ ID NO: 875500 - DNA, 25 bp, Mus musculus
tgctgtgctgctattgtcccaacat

SEQ ID NO: 875501 - DNA, 25 bp, Mus musculus
tgctgtgctgcttttcattagctga

SEQ ID NO: 875502 - DNA, 25 bp, Mus musculus
tgctgtgctgcttttgtcccaacat

SEQ ID NO: 875503 - DNA, 25 bp, Mus musculus
tgctgtgctggccacatgaagatcc

SEQ ID NO: 875504 - DNA, 25 bp, Mus musculus
tgctgtgctggcgacatgaagatcc

SEQ ID NO: 875505 - DNA, 25 bp, Mus musculus
tgctgtgctgggacacttttcatat

SEQ ID NO: 875506 - DNA, 25 bp, Mus musculus
tgctgtgctgggtcacttttcatat

SEQ ID NO: 875507 - DNA, 25 bp, Mus musculus
tgctgtgctgtaaatggctactcat

SEQ ID NO: 875508 - DNA, 25 bp, Mus musculus
tgctgtgctgtatatggctactcat

SEQ ID NO: 875509 - DNA, 25 bp, Mus musculus
tgctgtgctgtgaccaaacctaaat

SEQ ID NO: 875510 - DNA, 25 bp, Mus musculus
tgctgtgctgtgtccaaacctaaat

SEQ ID NO: 875511 - DNA, 25 bp, Mus musculus
tgctgtgctttcattgcaaggtctg

SEQ ID NO: 875512 - DNA, 25 bp, Mus musculus
tgctgtgctttctttgcaaggtctg

SEQ ID NO: 875513 - DNA, 25 bp, Mus musculus
tgctgtgctttgcttcggccgtgtt

SEQ ID NO: 875514 - DNA, 25 bp, Mus musculus
tgctgtgctttggttcggccgtgtt

SEQ ID NO: 875515 - DNA, 25 bp, Mus musculus
tgctgtggaactaacggacctcttg

SEQ ID NO: 875516 - DNA, 25 bp, Mus musculus
tgctgtggaacttacggacctcttg

SEQ ID NO: 875517 - DNA, 25 bp, Mus musculus
tgctgtggacagaagtccagctgct

SEQ ID NO: 875518 - DNA, 25 bp, Mus musculus
tgctgtggacagtagtccagctgct

SEQ ID NO: 875519 - DNA, 25 bp, Mus musculus
tgctgtggacatacgggcccactca

SEQ ID NO: 875520 - DNA, 25 bp, Mus musculus
tgctgtggacattcgggcccactca

SEQ ID NO: 875521 - DNA, 25 bp, Mus musculus
tgctgtggactgacccacggaatgt

SEQ ID NO: 875522 - DNA, 25 bp, Mus musculus
tgctgtggactgactgcaaggcaga

SEQ ID NO: 875523 - DNA, 25 bp, Mus musculus
tgctgtggactgtcccacggaatgt

SEQ ID NO: 875524 - DNA, 25 bp, Mus musculus
tgctgtggactgtctgcaaggcaga

SEQ ID NO: 875525 - DNA, 25 bp, Mus musculus
tgctgtggagccagacgctgctgct

SEQ ID NO: 875526 - DNA, 25 bp, Mus musculus
tgctgtggagcctgacgctgctgct

SEQ ID NO: 875527 - DNA, 25 bp, Mus musculus
tgctgtggaggactcattccgtagt

SEQ ID NO: 875528 - DNA, 25 bp, Mus musculus
tgctgtggaggagtcattccgtagt

SEQ ID NO: 875529 - DNA, 25 bp, Mus musculus
tgctgtggatatagttgtggcttca

SEQ ID NO: 875530 - DNA, 25 bp, Mus musculus
tgctgtggatattgttgtggcttca

SEQ ID NO: 875531 - DNA, 25 bp, Mus musculus
tgctgtggatggatgctgttagtct

SEQ ID NO: 875532 - DNA, 25 bp, Mus musculus
tgctgtggatggttgctgttagtct

SEQ ID NO: 875533 - DNA, 25 bp, Mus musculus
tgctgtggccccacttgctaaattt

SEQ ID NO: 875534 - DNA, 25 bp, Mus musculus
tgctgtggcccctcttgctaaattt

SEQ ID NO: 875535 - DNA, 25 bp, Mus musculus
tgctgtggccctagtttggtcttca

SEQ ID NO: 875536 - DNA, 25 bp, Mus musculus
tgctgtggcccttgtttggtcttca

SEQ ID NO: 875537 - DNA, 25 bp, Mus musculus
tgctgtggctacatcgtggtcagag

SEQ ID NO: 875538 - DNA, 25 bp, Mus musculus
tgctgtggctacttcgtggtcagag

SEQ ID NO: 875539 - DNA, 25 bp, Mus musculus
tgctgtggctggctgaatccttcaa

SEQ ID NO: 875540 - DNA, 25 bp, Mus musculus
tgctgtggctgggtgaatccttcaa

SEQ ID NO: 875541 - DNA, 25 bp, Mus musculus
tgctgtggcttaatgatcctattaa

SEQ ID NO: 875542 - DNA, 25 bp, Mus musculus
tgctgtggcttattgatcctattaa

SEQ ID NO: 875543 - DNA, 25 bp, Mus musculus
tgctgtggcttcattctcttctcag

SEQ ID NO: 875544 - DNA, 25 bp, Mus musculus
tgctgtggcttctttctcttctcag

SEQ ID NO: 875545 - DNA, 25 bp, Mus musculus
tgctgtgggcataacagttttgtaa

SEQ ID NO: 875546 - DNA, 25 bp, Mus musculus
tgctgtgggcattacagttttgtaa

SEQ ID NO: 875547 - DNA, 25 bp, Mus musculus
tgctgtgggcctaagctggccgcct

SEQ ID NO: 875548 - DNA, 25 bp, Mus musculus
tgctgtgggcctacacagttcaggg

SEQ ID NO: 875549 - DNA, 25 bp, Mus musculus
tgctgtgggccttagctggccgcct

SEQ ID NO: 875550 - DNA, 25 bp, Mus musculus
tgctgtgggccttcacagttcaggg

SEQ ID NO: 875551 - DNA, 25 bp, Mus musculus
tgctgtgggcgaatggaactccagt

SEQ ID NO: 875552 - DNA, 25 bp, Mus musculus
tgctgtgggcgattggaactccagt

SEQ ID NO: 875553 - DNA, 25 bp, Mus musculus
tgctgtgggttcatagccgattgga

SEQ ID NO: 875554 - DNA, 25 bp, Mus musculus
tgctgtgggttcttagccgattgga

SEQ ID NO: 875555 - DNA, 25 bp, Mus musculus
tgctgtgggtttactgaatctgtat

SEQ ID NO: 875556 - DNA, 25 bp, Mus musculus
tgctgtgggttttctgaatctgtat

SEQ ID NO: 875557 - DNA, 25 bp, Mus musculus
tgctgtggtactaaaccctggctac

SEQ ID NO: 875558 - DNA, 25 bp, Mus musculus
tgctgtggtacttaaccctggctac

SEQ ID NO: 875559 - DNA, 25 bp, Mus musculus
tgctgtggtccgcaggaactggaag

SEQ ID NO: 875560 - DNA, 25 bp, Mus musculus
tgctgtggtccggaggaactggaag

SEQ ID NO: 875561 - DNA, 25 bp, Mus musculus
tgctgtggtcgcagtgtactggatt

SEQ ID NO: 875562 - DNA, 25 bp, Mus musculus
tgctgtggtcgctgtgtactggatt

SEQ ID NO: 875563 - DNA, 25 bp, Mus musculus
tgctgtggtcttaatctgcctatta

SEQ ID NO: 875564 - DNA, 25 bp, Mus musculus
tgctgtggtctttatctgcctatta

SEQ ID NO: 875565 - DNA, 25 bp, Mus musculus
tgctgtggtgatatgtacctgatcc

SEQ ID NO: 875566 - DNA, 25 bp, Mus musculus
tgctgtggtgatttgtacctgatcc

SEQ ID NO: 875567 - DNA, 25 bp, Mus musculus
tgctgtggttcacccattgtagaca

SEQ ID NO: 875568 - DNA, 25 bp, Mus musculus
tgctgtggttcagccattgtagaca

SEQ ID NO: 875569 - DNA, 25 bp, Mus musculus
tgctgtggttgcaccattcaaatgt

SEQ ID NO: 875570 - DNA, 25 bp, Mus musculus
tgctgtggttgctccattcaaatgt

SEQ ID NO: 875571 - DNA, 25 bp, Mus musculus
tgctgtgtaaacctagctgacctaa

SEQ ID NO: 875572 - DNA, 25 bp, Mus musculus
tgctgtgtaaacgtagctgacctaa

SEQ ID NO: 875573 - DNA, 25 bp, Mus musculus
tgctgtgtaaagatgcctgatgtca

SEQ ID NO: 875574 - DNA, 25 bp, Mus musculus
tgctgtgtaaagttgcctgatgtca

SEQ ID NO: 875575 - DNA, 25 bp, Mus musculus
tgctgtgtaagcctgggacctgaat

SEQ ID NO: 875576 - DNA, 25 bp, Mus musculus
tgctgtgtaagcgtgggacctgaat

SEQ ID NO: 875577 - DNA, 25 bp, Mus musculus
tgctgtgtacagaggcgagatttaa

SEQ ID NO: 875578 - DNA, 25 bp, Mus musculus
tgctgtgtacagtggcgagatttaa

SEQ ID NO: 875579 - DNA, 25 bp, Mus musculus
tgctgtgtagacacggctcttgtaa

SEQ ID NO: 875580 - DNA, 25 bp, Mus musculus
tgctgtgtagactcggctcttgtaa

SEQ ID NO: 875581 - DNA, 25 bp, Mus musculus
tgctgtgtagatcaactgatgactt

SEQ ID NO: 875582 - DNA, 25 bp, Mus musculus
tgctgtgtagatgaactgatgactt

SEQ ID NO: 875583 - DNA, 25 bp, Mus musculus
tgctgtgtagcccacactaacatca

SEQ ID NO: 875584 - DNA, 25 bp, Mus musculus
tgctgtgtagccgacactaacatca

SEQ ID NO: 875585 - DNA, 25 bp, Mus musculus
tgctgtgtatctatttctttgggta

SEQ ID NO: 875586 - DNA, 25 bp, Mus musculus
tgctgtgtatctttttctttgggta

SEQ ID NO: 875587 - DNA, 25 bp, Mus musculus
tgctgtgtcaaactgagggctctca

SEQ ID NO: 875588 - DNA, 25 bp, Mus musculus
tgctgtgtcaaagtgagggctctca

SEQ ID NO: 875589 - DNA, 25 bp, Mus musculus
tgctgtgtcaagattcctggtcatg

SEQ ID NO: 875590 - DNA, 25 bp, Mus musculus
tgctgtgtcaagtttcctggtcatg

SEQ ID NO: 875591 - DNA, 25 bp, Mus musculus
tgctgtgtcagcaccacctggaagc

SEQ ID NO: 875592 - DNA, 25 bp, Mus musculus
tgctgtgtcagcctgtttaggagat

SEQ ID NO: 875593 - DNA, 25 bp, Mus musculus
tgctgtgtcagcgtgtttaggagat

SEQ ID NO: 875594 - DNA, 25 bp, Mus musculus
tgctgtgtcagctccacctggaagc

SEQ ID NO: 875595 - DNA, 25 bp, Mus musculus
tgctgtgtcatgcagagacccactg

SEQ ID NO: 875596 - DNA, 25 bp, Mus musculus
tgctgtgtcatggagagacccactg

SEQ ID NO: 875597 - DNA, 25 bp, Mus musculus
tgctgtgtccaaatactttttaaat

SEQ ID NO: 875598 - DNA, 25 bp, Mus musculus
tgctgtgtccaacctccattgaaga

SEQ ID NO: 875599 - DNA, 25 bp, Mus musculus
tgctgtgtccaagctccattgaaga

SEQ ID NO: 875600 - DNA, 25 bp, Mus musculus
tgctgtgtccaattactttttaaat

SEQ ID NO: 875601 - DNA, 25 bp, Mus musculus
tgctgtgtccacatgcaagtgactt

SEQ ID NO: 875602 - DNA, 25 bp, Mus musculus
tgctgtgtccacttgcaagtgactt

SEQ ID NO: 875603 - DNA, 25 bp, Mus musculus
tgctgtgtgacccaggcagatccct

SEQ ID NO: 875604 - DNA, 25 bp, Mus musculus
tgctgtgtgaccgaggcagatccct

SEQ ID NO: 875605 - DNA, 25 bp, Mus musculus
tgctgtgtgagtatatccgggccaa

SEQ ID NO: 875606 - DNA, 25 bp, Mus musculus
tgctgtgtgagtttatccgggccaa

SEQ ID NO: 875607 - DNA, 25 bp, Mus musculus
tgctgtgtgcacatcaggttgtcat

SEQ ID NO: 875608 - DNA, 25 bp, Mus musculus
tgctgtgtgcacttcaggttgtcat

SEQ ID NO: 875609 - DNA, 25 bp, Mus musculus
tgctgtgtgccaaaacccagccttg

SEQ ID NO: 875610 - DNA, 25 bp, Mus musculus
tgctgtgtgccataacccagccttg

SEQ ID NO: 875611 - DNA, 25 bp, Mus musculus
tgctgtgtgcccacgaagctggatc

SEQ ID NO: 875612 - DNA, 25 bp, Mus musculus
tgctgtgtgccctcgaagctggatc

SEQ ID NO: 875613 - DNA, 25 bp, Mus musculus
tgctgtgtgcctacagtccagtctt

SEQ ID NO: 875614 - DNA, 25 bp, Mus musculus
tgctgtgtgccttcagtccagtctt

SEQ ID NO: 875615 - DNA, 25 bp, Mus musculus
tgctgtgtgcgacacatgcaggctc

SEQ ID NO: 875616 - DNA, 25 bp, Mus musculus
tgctgtgtgcgagacatgcaggctc

SEQ ID NO: 875617 - DNA, 25 bp, Mus musculus
tgctgtgtgctcctgattctgttca

SEQ ID NO: 875618 - DNA, 25 bp, Mus musculus
tgctgtgtgctcgtgattctgttca

SEQ ID NO: 875619 - DNA, 25 bp, Mus musculus
tgctgtgtgctgatgtcatgtaaca

SEQ ID NO: 875620 - DNA, 25 bp, Mus musculus
tgctgtgtgctgttgtcatgtaaca

SEQ ID NO: 875621 - DNA, 25 bp, Mus musculus
tgctgtgtggcacccggtacactct

SEQ ID NO: 875622 - DNA, 25 bp, Mus musculus
tgctgtgtggcagccggtacactct

SEQ ID NO: 875623 - DNA, 25 bp, Mus musculus
tgctgtgtgggtatgtcattcctac

SEQ ID NO: 875624 - DNA, 25 bp, Mus musculus
tgctgtgtgggtttgtcattcctac

SEQ ID NO: 875625 - DNA, 25 bp, Mus musculus
tgctgtgtgtacctgcagcccagga

SEQ ID NO: 875626 - DNA, 25 bp, Mus musculus
tgctgtgtgtacgtgcagcccagga

SEQ ID NO: 875627 - DNA, 25 bp, Mus musculus
tgctgtgtgtgtccctgaccagcga

SEQ ID NO: 875628 - DNA, 25 bp, Mus musculus
tgctgtgtgtgtgcctgaccagcga

SEQ ID NO: 875629 - DNA, 25 bp, Mus musculus
tgctgtgtgttaccctctctctggc

SEQ ID NO: 875630 - DNA, 25 bp, Mus musculus
tgctgtgtgttagcctctctctggc

SEQ ID NO: 875631 - DNA, 25 bp, Mus musculus
tgctgtgttagcaatgctgcctcga

SEQ ID NO: 875632 - DNA, 25 bp, Mus musculus
tgctgtgttagcaccagtgccccaa

SEQ ID NO: 875633 - DNA, 25 bp, Mus musculus
tgctgtgttagctatgctgcctcga

SEQ ID NO: 875634 - DNA, 25 bp, Mus musculus
tgctgtgttagctccagtgccccaa

SEQ ID NO: 875635 - DNA, 25 bp, Mus musculus
tgctgtgttcaacaaggctctgccc

SEQ ID NO: 875636 - DNA, 25 bp, Mus musculus
tgctgtgttcaagaaggctctgccc

SEQ ID NO: 875637 - DNA, 25 bp, Mus musculus
tgctgtgttccactccagtgagaac

SEQ ID NO: 875638 - DNA, 25 bp, Mus musculus
tgctgtgttccagtccagtgagaac

SEQ ID NO: 875639 - DNA, 25 bp, Mus musculus
tgctgtgttcggcagcctaaaggaa

SEQ ID NO: 875640 - DNA, 25 bp, Mus musculus
tgctgtgttcgggagcctaaaggaa

SEQ ID NO: 875641 - DNA, 25 bp, Mus musculus
tgctgtgttctcacggtgccagcca

SEQ ID NO: 875642 - DNA, 25 bp, Mus musculus
tgctgtgttctctcggtgccagcca

SEQ ID NO: 875643 - DNA, 25 bp, Mus musculus
tgctgtgttgatctatccctggctt

SEQ ID NO: 875644 - DNA, 25 bp, Mus musculus
tgctgtgttgatgtatccctggctt

SEQ ID NO: 875645 - DNA, 25 bp, Mus musculus
tgctgtgttgtcattgaaccccaga

SEQ ID NO: 875646 - DNA, 25 bp, Mus musculus
tgctgtgttgtcctctggcgggctg

SEQ ID NO: 875647 - DNA, 25 bp, Mus musculus
tgctgtgttgtcgtctggcgggctg

SEQ ID NO: 875648 - DNA, 25 bp, Mus musculus
tgctgtgttgtctttgaaccccaga

SEQ ID NO: 875649 - DNA, 25 bp, Mus musculus
tgctgtgtttacaaaggatcgcttg

SEQ ID NO: 875650 - DNA, 25 bp, Mus musculus
tgctgtgtttaccacctaaaagtga

SEQ ID NO: 875651 - DNA, 25 bp, Mus musculus
tgctgtgtttacgacctaaaagtga

SEQ ID NO: 875652 - DNA, 25 bp, Mus musculus
tgctgtgtttactaaggatcgcttg

SEQ ID NO: 875653 - DNA, 25 bp, Mus musculus
tgctgtgtttgcagtaataaattat

SEQ ID NO: 875654 - DNA, 25 bp, Mus musculus
tgctgtgtttgctgtaataaattat

SEQ ID NO: 875655 - DNA, 25 bp, Mus musculus
tgctgttaacaaatgtggattttac

SEQ ID NO: 875656 - DNA, 25 bp, Mus musculus
tgctgttaacaattgtggattttac

SEQ ID NO: 875657 - DNA, 25 bp, Mus musculus
tgctgttaacagctgcatggttcat

SEQ ID NO: 875658 - DNA, 25 bp, Mus musculus
tgctgttaacaggtgcatggttcat

SEQ ID NO: 875659 - DNA, 25 bp, Mus musculus
tgctgttacaccaccattcgctatt

SEQ ID NO: 875660 - DNA, 25 bp, Mus musculus
tgctgttacacctccattcgctatt

SEQ ID NO: 875661 - DNA, 25 bp, Mus musculus
tgctgttacagcacatcgaggtagc

SEQ ID NO: 875662 - DNA, 25 bp, Mus musculus
tgctgttacagctcatcgaggtagc

SEQ ID NO: 875663 - DNA, 25 bp, Mus musculus
tgctgttaccagacgacaccattgt

SEQ ID NO: 875664 - DNA, 25 bp, Mus musculus
tgctgttaccagtcgacaccattgt

SEQ ID NO: 875665 - DNA, 25 bp, Mus musculus
tgctgttaccttatgcagtcggtct

SEQ ID NO: 875666 - DNA, 25 bp, Mus musculus
tgctgttaccttttgcagtcggtct

SEQ ID NO: 875667 - DNA, 25 bp, Mus musculus
tgctgttacgctcccatgataatgt

SEQ ID NO: 875668 - DNA, 25 bp, Mus musculus
tgctgttacgctgccatgataatgt

SEQ ID NO: 875669 - DNA, 25 bp, Mus musculus
tgctgttacgggaactttcttcacc

SEQ ID NO: 875670 - DNA, 25 bp, Mus musculus
tgctgttacgggtactttcttcacc

SEQ ID NO: 875671 - DNA, 25 bp, Mus musculus
tgctgttactcaattctggatttgg

SEQ ID NO: 875672 - DNA, 25 bp, Mus musculus
tgctgttactcatttctggatttgg

SEQ ID NO: 875673 - DNA, 25 bp, Mus musculus
tgctgttagaacacccctgagagag

SEQ ID NO: 875674 - DNA, 25 bp, Mus musculus
tgctgttagaactcccctgagagag

SEQ ID NO: 875675 - DNA, 25 bp, Mus musculus
tgctgttagacaacctggaccccaa

SEQ ID NO: 875676 - DNA, 25 bp, Mus musculus
tgctgttagacatcctggaccccaa

SEQ ID NO: 875677 - DNA, 25 bp, Mus musculus
tgctgttagatcatgtcatcctgcc

SEQ ID NO: 875678 - DNA, 25 bp, Mus musculus
tgctgttagatcttgtcatcctgcc

SEQ ID NO: 875679 - DNA, 25 bp, Mus musculus
tgctgttagatgctgccccgtgaag

SEQ ID NO: 875680 - DNA, 25 bp, Mus musculus
tgctgttagatggtgccccgtgaag

SEQ ID NO: 875681 - DNA, 25 bp, Mus musculus
tgctgttagcatactcgataaatct

SEQ ID NO: 875682 - DNA, 25 bp, Mus musculus
tgctgttagcattctcgataaatct

SEQ ID NO: 875683 - DNA, 25 bp, Mus musculus
tgctgttagtaaactctcacccaaa

SEQ ID NO: 875684 - DNA, 25 bp, Mus musculus
tgctgttagtaatctctcacccaaa

SEQ ID NO: 875685 - DNA, 25 bp, Mus musculus
tgctgttatcatacaatacacactt

SEQ ID NO: 875686 - DNA, 25 bp, Mus musculus
tgctgttatcattcaatacacactt

SEQ ID NO: 875687 - DNA, 25 bp, Mus musculus
tgctgttatctcactgattgaccat

SEQ ID NO: 875688 - DNA, 25 bp, Mus musculus
tgctgttatctctctgattgaccat

SEQ ID NO: 875689 - DNA, 25 bp, Mus musculus
tgctgttatgggagctccgaagtgc

SEQ ID NO: 875690 - DNA, 25 bp, Mus musculus
tgctgttatgggtgctccgaagtgc

SEQ ID NO: 875691 - DNA, 25 bp, Mus musculus
tgctgttcaaccaggtctattgggt

SEQ ID NO: 875692 - DNA, 25 bp, Mus musculus
tgctgttcaacctggtctattgggt

SEQ ID NO: 875693 - DNA, 25 bp, Mus musculus
tgctgttcaagaccagttaaccctg

SEQ ID NO: 875694 - DNA, 25 bp, Mus musculus
tgctgttcaagagcagttaaccctg

SEQ ID NO: 875695 - DNA, 25 bp, Mus musculus
tgctgttcacaaaactctccagtgt

SEQ ID NO: 875696 - DNA, 25 bp, Mus musculus
tgctgttcacaaattacatctcagc

SEQ ID NO: 875697 - DNA, 25 bp, Mus musculus
tgctgttcacaatactctccagtgt

SEQ ID NO: 875698 - DNA, 25 bp, Mus musculus
tgctgttcacaatttacatctcagc

SEQ ID NO: 875699 - DNA, 25 bp, Mus musculus
tgctgttcacagatatgcgttcaca

SEQ ID NO: 875700 - DNA, 25 bp, Mus musculus
tgctgttcacagttatgcgttcaca

SEQ ID NO: 875701 - DNA, 25 bp, Mus musculus
tgctgttcacatctgtttctgctgt

SEQ ID NO: 875702 - DNA, 25 bp, Mus musculus
tgctgttcacatgtgtttctgctgt

SEQ ID NO: 875703 - DNA, 25 bp, Mus musculus
tgctgttcactgcacagtccgcgga

SEQ ID NO: 875704 - DNA, 25 bp, Mus musculus
tgctgttcactggacagtccgcgga

SEQ ID NO: 875705 - DNA, 25 bp, Mus musculus
tgctgttcatcacgctgcgggtctt

SEQ ID NO: 875706 - DNA, 25 bp, Mus musculus
tgctgttcatcaggctgcgggtctt

SEQ ID NO: 875707 - DNA, 25 bp, Mus musculus
tgctgttcatctaccatgggctctg

SEQ ID NO: 875708 - DNA, 25 bp, Mus musculus
tgctgttcatcttccatgggctctg

SEQ ID NO: 875709 - DNA, 25 bp, Mus musculus
tgctgttcatggagaatgttcagaa

SEQ ID NO: 875710 - DNA, 25 bp, Mus musculus
tgctgttcatggtgaatgttcagaa

SEQ ID NO: 875711 - DNA, 25 bp, Mus musculus
tgctgttcccccaggatacacggct

SEQ ID NO: 875712 - DNA, 25 bp, Mus musculus
tgctgttccccctggatacacggct

SEQ ID NO: 875713 - DNA, 25 bp, Mus musculus
tgctgttccgggagcaggatattag

SEQ ID NO: 875714 - DNA, 25 bp, Mus musculus
tgctgttccgggtgcaggatattag

SEQ ID NO: 875715 - DNA, 25 bp, Mus musculus
tgctgttcctgcaaatatgcgctgt

SEQ ID NO: 875716 - DNA, 25 bp, Mus musculus
tgctgttcctgctaatatgcgctgt

SEQ ID NO: 875717 - DNA, 25 bp, Mus musculus
tgctgttcctgtaagtttgctatta

SEQ ID NO: 875718 - DNA, 25 bp, Mus musculus
tgctgttcctgttagtttgctatta

SEQ ID NO: 875719 - DNA, 25 bp, Mus musculus
tgctgttccttacctcaagcacagt

SEQ ID NO: 875720 - DNA, 25 bp, Mus musculus
tgctgttccttagctcaagcacagt

SEQ ID NO: 875721 - DNA, 25 bp, Mus musculus
tgctgttccttccagtgaagccgct

SEQ ID NO: 875722 - DNA, 25 bp, Mus musculus
tgctgttccttcgagtgaagccgct

SEQ ID NO: 875723 - DNA, 25 bp, Mus musculus
tgctgttcgacactaacctactctg

SEQ ID NO: 875724 - DNA, 25 bp, Mus musculus
tgctgttcgacagtaacctactctg

SEQ ID NO: 875725 - DNA, 25 bp, Mus musculus
tgctgttcgcagatcacctgtagga

SEQ ID NO: 875726 - DNA, 25 bp, Mus musculus
tgctgttcgcagttcacctgtagga

SEQ ID NO: 875727 - DNA, 25 bp, Mus musculus
tgctgttctctcatgagggcttcca

SEQ ID NO: 875728 - DNA, 25 bp, Mus musculus
tgctgttctctcttgagggcttcca

SEQ ID NO: 875729 - DNA, 25 bp, Mus musculus
tgctgttctctgacactgttcccgg

SEQ ID NO: 875730 - DNA, 25 bp, Mus musculus
tgctgttctctgtcactgttcccgg

SEQ ID NO: 875731 - DNA, 25 bp, Mus musculus
tgctgttctgcacgttctttgcgta

SEQ ID NO: 875732 - DNA, 25 bp, Mus musculus
tgctgttctgcactttatcttctgt

SEQ ID NO: 875733 - DNA, 25 bp, Mus musculus
tgctgttctgcaggttctttgcgta

SEQ ID NO: 875734 - DNA, 25 bp, Mus musculus
tgctgttctgcagtttatcttctgt

SEQ ID NO: 875735 - DNA, 25 bp, Mus musculus
tgctgttctggaagcgaccacccaa

SEQ ID NO: 875736 - DNA, 25 bp, Mus musculus
tgctgttctggaattgtccttggtt

SEQ ID NO: 875737 - DNA, 25 bp, Mus musculus
tgctgttctggatgcgaccacccaa

SEQ ID NO: 875738 - DNA, 25 bp, Mus musculus
tgctgttctggatttgtccttggtt

SEQ ID NO: 875739 - DNA, 25 bp, Mus musculus
tgctgttctggtctcaggactgacc

SEQ ID NO: 875740 - DNA, 25 bp, Mus musculus
tgctgttctggtgtcaggactgacc

SEQ ID NO: 875741 - DNA, 25 bp, Mus musculus
tgctgttctgttctgatcaaccctc

SEQ ID NO: 875742 - DNA, 25 bp, Mus musculus
tgctgttctgttgtgatcaaccctc

SEQ ID NO: 875743 - DNA, 25 bp, Mus musculus
tgctgttgaagaaatctgggtgcag

SEQ ID NO: 875744 - DNA, 25 bp, Mus musculus
tgctgttgaagatatctgggtgcag

SEQ ID NO: 875745 - DNA, 25 bp, Mus musculus
tgctgttgaataatgggttggccat

SEQ ID NO: 875746 - DNA, 25 bp, Mus musculus
tgctgttgaatattgggttggccat

SEQ ID NO: 875747 - DNA, 25 bp, Mus musculus
tgctgttgaccacctgaaacaggtg

SEQ ID NO: 875748 - DNA, 25 bp, Mus musculus
tgctgttgaccagctgaaacaggtg

SEQ ID NO: 875749 - DNA, 25 bp, Mus musculus
tgctgttgattgcatagggctcctt

SEQ ID NO: 875750 - DNA, 25 bp, Mus musculus
tgctgttgattggatagggctcctt

SEQ ID NO: 875751 - DNA, 25 bp, Mus musculus
tgctgttgcactcctacctgggcat

SEQ ID NO: 875752 - DNA, 25 bp, Mus musculus
tgctgttgcactgctacctgggcat

SEQ ID NO: 875753 - DNA, 25 bp, Mus musculus
tgctgttgccaaagtattatcttta

SEQ ID NO: 875754 - DNA, 25 bp, Mus musculus
tgctgttgccaatgtattatcttta

SEQ ID NO: 875755 - DNA, 25 bp, Mus musculus
tgctgttgccccaggatacacaggc

SEQ ID NO: 875756 - DNA, 25 bp, Mus musculus
tgctgttgcccctggatacacaggc

SEQ ID NO: 875757 - DNA, 25 bp, Mus musculus
tgctgttgccctcactgatgagcct

SEQ ID NO: 875758 - DNA, 25 bp, Mus musculus
tgctgttgccctgactgatgagcct

SEQ ID NO: 875759 - DNA, 25 bp, Mus musculus
tgctgttgcctgctaaagatgtgac

SEQ ID NO: 875760 - DNA, 25 bp, Mus musculus
tgctgttgcctggtaaagatgtgac

SEQ ID NO: 875761 - DNA, 25 bp, Mus musculus
tgctgttgccttcgactgcagagga

SEQ ID NO: 875762 - DNA, 25 bp, Mus musculus
tgctgttgccttggactgcagagga

SEQ ID NO: 875763 - DNA, 25 bp, Mus musculus
tgctgttgctcaccaactctttgtt

SEQ ID NO: 875764 - DNA, 25 bp, Mus musculus
tgctgttgctcagcaactctttgtt

SEQ ID NO: 875765 - DNA, 25 bp, Mus musculus
tgctgttgctctcccgctgggacaa

SEQ ID NO: 875766 - DNA, 25 bp, Mus musculus
tgctgttgctctgccgctgggacaa

SEQ ID NO: 875767 - DNA, 25 bp, Mus musculus
tgctgttgctgaagctgcactctgc

SEQ ID NO: 875768 - DNA, 25 bp, Mus musculus
tgctgttgctgatgctgcactctgc

SEQ ID NO: 875769 - DNA, 25 bp, Mus musculus
tgctgttgctgtaaggccatcctgc

SEQ ID NO: 875770 - DNA, 25 bp, Mus musculus
tgctgttgctgttaggccatcctgc

SEQ ID NO: 875771 - DNA, 25 bp, Mus musculus
tgctgttggaatcagtgggctcccc

SEQ ID NO: 875772 - DNA, 25 bp, Mus musculus
tgctgttggaatgagtgggctcccc

SEQ ID NO: 875773 - DNA, 25 bp, Mus musculus
tgctgttggcagactctaccttgtc

SEQ ID NO: 875774 - DNA, 25 bp, Mus musculus
tgctgttggcagtctctaccttgtc

SEQ ID NO: 875775 - DNA, 25 bp, Mus musculus
tgctgttgggatacaggtcacctct

SEQ ID NO: 875776 - DNA, 25 bp, Mus musculus
tgctgttgggattcaggtcacctct

SEQ ID NO: 875777 - DNA, 25 bp, Mus musculus
tgctgttgggctccttagggcctcc

SEQ ID NO: 875778 - DNA, 25 bp, Mus musculus
tgctgttgggctgcttagggcctcc

SEQ ID NO: 875779 - DNA, 25 bp, Mus musculus
tgctgttgtgtcagtagacatgcat

SEQ ID NO: 875780 - DNA, 25 bp, Mus musculus
tgctgttgtgtctgtagacatgcat

SEQ ID NO: 875781 - DNA, 25 bp, Mus musculus
tgctgttgtgtgcacaagcaataaa

SEQ ID NO: 875782 - DNA, 25 bp, Mus musculus
tgctgttgtgtggacaagcaataaa

SEQ ID NO: 875783 - DNA, 25 bp, Mus musculus
tgctgttgttggattgcccttctgg

SEQ ID NO: 875784 - DNA, 25 bp, Mus musculus
tgctgttgttggtttgcccttctgg

SEQ ID NO: 875785 - DNA, 25 bp, Mus musculus
tgctgtttagttcaagttagtacca

SEQ ID NO: 875786 - DNA, 25 bp, Mus musculus
tgctgtttagttgaagttagtacca

SEQ ID NO: 875787 - DNA, 25 bp, Mus musculus
tgctgtttatagactggcccgtggg

SEQ ID NO: 875788 - DNA, 25 bp, Mus musculus
tgctgtttatagtctggcccgtggg

SEQ ID NO: 875789 - DNA, 25 bp, Mus musculus
tgctgtttcaagctgctggacatcc

SEQ ID NO: 875790 - DNA, 25 bp, Mus musculus
tgctgtttcaaggtgctggacatcc

SEQ ID NO: 875791 - DNA, 25 bp, Mus musculus
tgctgtttcagtcctaccaggaacg

SEQ ID NO: 875792 - DNA, 25 bp, Mus musculus
tgctgtttcagtgctaccaggaacg

SEQ ID NO: 875793 - DNA, 25 bp, Mus musculus
tgctgtttccagaaggtcaaaaggc

SEQ ID NO: 875794 - DNA, 25 bp, Mus musculus
tgctgtttccagtaggtcaaaaggc

SEQ ID NO: 875795 - DNA, 25 bp, Mus musculus
tgctgtttcccaagtaccctgaaca

SEQ ID NO: 875796 - DNA, 25 bp, Mus musculus
tgctgtttcccatgtaccctgaaca

SEQ ID NO: 875797 - DNA, 25 bp, Mus musculus
tgctgtttccggaagtgttcttttg

SEQ ID NO: 875798 - DNA, 25 bp, Mus musculus
tgctgtttccggcactacagggaga

SEQ ID NO: 875799 - DNA, 25 bp, Mus musculus
tgctgtttccgggactacagggaga

SEQ ID NO: 875800 - DNA, 25 bp, Mus musculus
tgctgtttccggtagtgttcttttg

SEQ ID NO: 875801 - DNA, 25 bp, Mus musculus
tgctgtttcctcacaaaagtatacc

SEQ ID NO: 875802 - DNA, 25 bp, Mus musculus
tgctgtttcctctcaaaagtatacc

SEQ ID NO: 875803 - DNA, 25 bp, Mus musculus
tgctgtttcggaatgggaagccctg

SEQ ID NO: 875804 - DNA, 25 bp, Mus musculus
tgctgtttcggacccttttcccgca

SEQ ID NO: 875805 - DNA, 25 bp, Mus musculus
tgctgtttcggagccttttcccgca

SEQ ID NO: 875806 - DNA, 25 bp, Mus musculus
tgctgtttcggattgggaagccctg

SEQ ID NO: 875807 - DNA, 25 bp, Mus musculus
tgctgtttcggtaaggcacgtcaaa

SEQ ID NO: 875808 - DNA, 25 bp, Mus musculus
tgctgtttcggtaccatttctgggt

SEQ ID NO: 875809 - DNA, 25 bp, Mus musculus
tgctgtttcggttaggcacgtcaaa

SEQ ID NO: 875810 - DNA, 25 bp, Mus musculus
tgctgtttcggttccatttctgggt

SEQ ID NO: 875811 - DNA, 25 bp, Mus musculus
tgctgtttctcacttttgctgtatc

SEQ ID NO: 875812 - DNA, 25 bp, Mus musculus
tgctgtttctcagttttgctgtatc

SEQ ID NO: 875813 - DNA, 25 bp, Mus musculus
tgctgtttctctcaggagctgtgca

SEQ ID NO: 875814 - DNA, 25 bp, Mus musculus
tgctgtttctctgaggagctgtgca

SEQ ID NO: 875815 - DNA, 25 bp, Mus musculus
tgctgtttctgcattgactgcgaaa

SEQ ID NO: 875816 - DNA, 25 bp, Mus musculus
tgctgtttctgctttgactgcgaaa

SEQ ID NO: 875817 - DNA, 25 bp, Mus musculus
tgctgtttgaccaggaaaccaatct

SEQ ID NO: 875818 - DNA, 25 bp, Mus musculus
tgctgtttgacctggaaaccaatct

SEQ ID NO: 875819 - DNA, 25 bp, Mus musculus
tgctgtttgaggctttatgtgctaa

SEQ ID NO: 875820 - DNA, 25 bp, Mus musculus
tgctgtttgagggtttatgtgctaa

SEQ ID NO: 875821 - DNA, 25 bp, Mus musculus
tgctgtttgatactgtgtgcgacgt

SEQ ID NO: 875822 - DNA, 25 bp, Mus musculus
tgctgtttgatagtgtgtgcgacgt

SEQ ID NO: 875823 - DNA, 25 bp, Mus musculus
tgctgtttgcacctctcagctgctt

SEQ ID NO: 875824 - DNA, 25 bp, Mus musculus
tgctgtttgcacgtctcagctgctt

SEQ ID NO: 875825 - DNA, 25 bp, Mus musculus
tgctgtttgctcaagggactgcaga

SEQ ID NO: 875826 - DNA, 25 bp, Mus musculus
tgctgtttgctctagggactgcaga

SEQ ID NO: 875827 - DNA, 25 bp, Mus musculus
tgctgtttgcttatgggctaaagag

SEQ ID NO: 875828 - DNA, 25 bp, Mus musculus
tgctgtttgcttttgggctaaagag

SEQ ID NO: 875829 - DNA, 25 bp, Mus musculus
tgctgtttgggtacaaaccctccaa

SEQ ID NO: 875830 - DNA, 25 bp, Mus musculus
tgctgtttgggttcaaaccctccaa

SEQ ID NO: 875831 - DNA, 25 bp, Mus musculus
tgctgtttgtagactcaccacccaa

SEQ ID NO: 875832 - DNA, 25 bp, Mus musculus
tgctgtttgtagagctgtatcccgt

SEQ ID NO: 875833 - DNA, 25 bp, Mus musculus
tgctgtttgtagtctcaccacccaa

SEQ ID NO: 875834 - DNA, 25 bp, Mus musculus
tgctgtttgtagtgctgtatcccgt

SEQ ID NO: 875835 - DNA, 25 bp, Mus musculus
tgctgtttgtgcctcaggactcttc

SEQ ID NO: 875836 - DNA, 25 bp, Mus musculus
tgctgtttgtgcgtcaggactcttc

SEQ ID NO: 875837 - DNA, 25 bp, Mus musculus
tgctgtttgtttactcgttctcctt

SEQ ID NO: 875838 - DNA, 25 bp, Mus musculus
tgctgtttgttttctcgttctcctt

SEQ ID NO: 875839 - DNA, 25 bp, Mus musculus
tgctgttttactctgtcattgtgaa

SEQ ID NO: 875840 - DNA, 25 bp, Mus musculus
tgctgttttactgtgtcattgtgaa

SEQ ID NO: 875841 - DNA, 25 bp, Mus musculus
tgctgttttcatactgcatttgtgt

SEQ ID NO: 875842 - DNA, 25 bp, Mus musculus
tgctgttttcattctgcatttgtgt

SEQ ID NO: 875843 - DNA, 25 bp, Mus musculus
tgctgttttctgatgacctctggga

SEQ ID NO: 875844 - DNA, 25 bp, Mus musculus
tgctgttttctgttgacctctggga

SEQ ID NO: 875845 - DNA, 25 bp, Mus musculus
tgctgttttgcacttctttgccagt

SEQ ID NO: 875846 - DNA, 25 bp, Mus musculus
tgctgttttgcagttctttgccagt

SEQ ID NO: 875847 - DNA, 25 bp, Mus musculus
tgctgttttgccagtagtggaagtt

SEQ ID NO: 875848 - DNA, 25 bp, Mus musculus
tgctgttttgcctgtagtggaagtt

SEQ ID NO: 875849 - DNA, 25 bp, Mus musculus
tgctgtttttaccatagtttaagat

SEQ ID NO: 875850 - DNA, 25 bp, Mus musculus
tgctgtttttacgatagtttaagat

SEQ ID NO: 875851 - DNA, 25 bp, Mus musculus
tgctgtttttagctataaaaccggt

SEQ ID NO: 875852 - DNA, 25 bp, Mus musculus
tgctgtttttaggtataaaaccggt

SEQ ID NO: 875853 - DNA, 25 bp, Mus musculus
tgctgtttttgccaggagacacaaa

SEQ ID NO: 875854 - DNA, 25 bp, Mus musculus
tgctgtttttgcgaggagacacaaa

SEQ ID NO: 875855 - DNA, 25 bp, Mus musculus
tgctgttttttccagctaggccatt

SEQ ID NO: 875856 - DNA, 25 bp, Mus musculus
tgctgttttttcgagctaggccatt

SEQ ID NO: 875857 - DNA, 25 bp, Mus musculus
tgcttaaactataggaactaaccaa

SEQ ID NO: 875858 - DNA, 25 bp, Mus musculus
tgcttaaactattggaactaaccaa

SEQ ID NO: 875859 - DNA, 25 bp, Mus musculus
tgcttaaagtaaacaatacccacct

SEQ ID NO: 875860 - DNA, 25 bp, Mus musculus
tgcttaaagtaatcaatacccacct

SEQ ID NO: 875861 - DNA, 25 bp, Mus musculus
tgcttaaatcccaggttccaactgc

SEQ ID NO: 875862 - DNA, 25 bp, Mus musculus
tgcttaaatccctggttccaactgc

SEQ ID NO: 875863 - DNA, 25 bp, Mus musculus
tgcttaactgcaatcatcctgacct

SEQ ID NO: 875864 - DNA, 25 bp, Mus musculus
tgcttaactgcattcatcctgacct

SEQ ID NO: 875865 - DNA, 25 bp, Mus musculus
tgcttaagaagaatgtggagctttt

SEQ ID NO: 875866 - DNA, 25 bp, Mus musculus
tgcttaagaagattgtggagctttt

SEQ ID NO: 875867 - DNA, 25 bp, Mus musculus
tgcttaagagacaccggcactgcgc

SEQ ID NO: 875868 - DNA, 25 bp, Mus musculus
tgcttaagagactccggcactgcgc

SEQ ID NO: 875869 - DNA, 25 bp, Mus musculus
tgcttaagagtacctgcctgggcct

SEQ ID NO: 875870 - DNA, 25 bp, Mus musculus
tgcttaagagtagctgcctgggcct

SEQ ID NO: 875871 - DNA, 25 bp, Mus musculus
tgcttaagcacaacagaggtcctaa

SEQ ID NO: 875872 - DNA, 25 bp, Mus musculus
tgcttaagcacatcagaggtcctaa

SEQ ID NO: 875873 - DNA, 25 bp, Mus musculus
tgcttaagtgatagtcggaccctga

SEQ ID NO: 875874 - DNA, 25 bp, Mus musculus
tgcttaagtgattgtcggaccctga

SEQ ID NO: 875875 - DNA, 25 bp, Mus musculus
tgcttaatacgcagtgatttcacat

SEQ ID NO: 875876 - DNA, 25 bp, Mus musculus
tgcttaatacgctgtgatttcacat

SEQ ID NO: 875877 - DNA, 25 bp, Mus musculus
tgcttaatctcacgctaacatttta

SEQ ID NO: 875878 - DNA, 25 bp, Mus musculus
tgcttaatctcaggctaacatttta

SEQ ID NO: 875879 - DNA, 25 bp, Mus musculus
tgcttaatgactagggacctgggtc

SEQ ID NO: 875880 - DNA, 25 bp, Mus musculus
tgcttaatgacttgggacctgggtc

SEQ ID NO: 875881 - DNA, 25 bp, Mus musculus
tgcttaatgcccatcttcacagaag

SEQ ID NO: 875882 - DNA, 25 bp, Mus musculus
tgcttaatgcccttcttcacagaag

SEQ ID NO: 875883 - DNA, 25 bp, Mus musculus
tgcttaatgctaatccctgctttga

SEQ ID NO: 875884 - DNA, 25 bp, Mus musculus
tgcttaatgctattccctgctttga

SEQ ID NO: 875885 - DNA, 25 bp, Mus musculus
tgcttaatgggtaatgttgcactta

SEQ ID NO: 875886 - DNA, 25 bp, Mus musculus
tgcttaatgggttatgttgcactta

SEQ ID NO: 875887 - DNA, 25 bp, Mus musculus
tgcttacaagatacagacgctccga

SEQ ID NO: 875888 - DNA, 25 bp, Mus musculus
tgcttacaagattcagacgctccga

SEQ ID NO: 875889 - DNA, 25 bp, Mus musculus
tgcttacagcccactctgagagata

SEQ ID NO: 875890 - DNA, 25 bp, Mus musculus
tgcttacagccctctctgagagata

SEQ ID NO: 875891 - DNA, 25 bp, Mus musculus
tgcttacaggaaaggcctttttcaa

SEQ ID NO: 875892 - DNA, 25 bp, Mus musculus
tgcttacaggaatggcctttttcaa

SEQ ID NO: 875893 - DNA, 25 bp, Mus musculus
tgcttacatgtgattgccatgttgt

SEQ ID NO: 875894 - DNA, 25 bp, Mus musculus
tgcttacatgtgtttgccatgttgt

SEQ ID NO: 875895 - DNA, 25 bp, Mus musculus
tgcttacattagctctgtcaccatc

SEQ ID NO: 875896 - DNA, 25 bp, Mus musculus
tgcttacattaggtctgtcaccatc

SEQ ID NO: 875897 - DNA, 25 bp, Mus musculus
tgcttaccatccatacaacaccagg

SEQ ID NO: 875898 - DNA, 25 bp, Mus musculus
tgcttaccatccttacaacaccagg

SEQ ID NO: 875899 - DNA, 25 bp, Mus musculus
tgcttaccatgtaattttgcttttc

SEQ ID NO: 875900 - DNA, 25 bp, Mus musculus
tgcttaccatgttattttgcttttc

SEQ ID NO: 875901 - DNA, 25 bp, Mus musculus
tgcttacccacaattacctctttag

SEQ ID NO: 875902 - DNA, 25 bp, Mus musculus
tgcttacccacatttacctctttag

SEQ ID NO: 875903 - DNA, 25 bp, Mus musculus
tgcttacctgctactaatttccagt

SEQ ID NO: 875904 - DNA, 25 bp, Mus musculus
tgcttacctgcttctaatttccagt

SEQ ID NO: 875905 - DNA, 25 bp, Mus musculus
tgcttaccttagacagtccaacctt

SEQ ID NO: 875906 - DNA, 25 bp, Mus musculus
tgcttaccttagtcagtccaacctt

SEQ ID NO: 875907 - DNA, 25 bp, Mus musculus
tgcttaccttggctgcttttttaga

SEQ ID NO: 875908 - DNA, 25 bp, Mus musculus
tgcttaccttgggtgcttttttaga

SEQ ID NO: 875909 - DNA, 25 bp, Mus musculus
tgcttacctttgctaaactctcagt

SEQ ID NO: 875910 - DNA, 25 bp, Mus musculus
tgcttacctttggtaaactctcagt

SEQ ID NO: 875911 - DNA, 25 bp, Mus musculus
tgcttacgcctgattcatcagaatg

SEQ ID NO: 875912 - DNA, 25 bp, Mus musculus
tgcttacgcctgtttcatcagaatg

SEQ ID NO: 875913 - DNA, 25 bp, Mus musculus
tgcttactcaaaaacacttcctgtt

SEQ ID NO: 875914 - DNA, 25 bp, Mus musculus
tgcttactcaaatacacttcctgtt

SEQ ID NO: 875915 - DNA, 25 bp, Mus musculus
tgcttactccggccccaaagattta

SEQ ID NO: 875916 - DNA, 25 bp, Mus musculus
tgcttactccgggcccaaagattta

SEQ ID NO: 875917 - DNA, 25 bp, Mus musculus
tgcttactctgaagcttcctttcta

SEQ ID NO: 875918 - DNA, 25 bp, Mus musculus
tgcttactctgatgcttcctttcta

SEQ ID NO: 875919 - DNA, 25 bp, Mus musculus
tgcttactctgtagctggcttacat

SEQ ID NO: 875920 - DNA, 25 bp, Mus musculus
tgcttactctgttgctggcttacat

SEQ ID NO: 875921 - DNA, 25 bp, Mus musculus
tgcttactgcagagtgcacgttgat

SEQ ID NO: 875922 - DNA, 25 bp, Mus musculus
tgcttactgcagtgtgcacgttgat

SEQ ID NO: 875923 - DNA, 25 bp, Mus musculus
tgcttactgtgtcgtcagcgcctaa

SEQ ID NO: 875924 - DNA, 25 bp, Mus musculus
tgcttactgtgtggtcagcgcctaa

SEQ ID NO: 875925 - DNA, 25 bp, Mus musculus
tgcttactgttcctaaacttaccca

SEQ ID NO: 875926 - DNA, 25 bp, Mus musculus
tgcttactgttcgtaaacttaccca

SEQ ID NO: 875927 - DNA, 25 bp, Mus musculus
tgcttacttgtcaggacaaagcccc

SEQ ID NO: 875928 - DNA, 25 bp, Mus musculus
tgcttacttgtctggacaaagcccc

SEQ ID NO: 875929 - DNA, 25 bp, Mus musculus
tgcttagaaccaccgtagaccggat

SEQ ID NO: 875930 - DNA, 25 bp, Mus musculus
tgcttagaaccagcgtagaccggat

SEQ ID NO: 875931 - DNA, 25 bp, Mus musculus
tgcttagacacaactaatcctccac

SEQ ID NO: 875932 - DNA, 25 bp, Mus musculus
tgcttagacacatctaatcctccac

SEQ ID NO: 875933 - DNA, 25 bp, Mus musculus
tgcttagacccgctgtcactcctga

SEQ ID NO: 875934 - DNA, 25 bp, Mus musculus
tgcttagacccggtgtcactcctga

SEQ ID NO: 875935 - DNA, 25 bp, Mus musculus
tgcttagacgccaggtgactctcat

SEQ ID NO: 875936 - DNA, 25 bp, Mus musculus
tgcttagacgcctggtgactctcat

SEQ ID NO: 875937 - DNA, 25 bp, Mus musculus
tgcttagagacaaagataccatgtt

SEQ ID NO: 875938 - DNA, 25 bp, Mus musculus
tgcttagagacatagataccatgtt

SEQ ID NO: 875939 - DNA, 25 bp, Mus musculus
tgcttagcaagcacactggcaaggc

SEQ ID NO: 875940 - DNA, 25 bp, Mus musculus
tgcttagcaagcattctgcccctga

SEQ ID NO: 875941 - DNA, 25 bp, Mus musculus
tgcttagcaagctcactggcaaggc

SEQ ID NO: 875942 - DNA, 25 bp, Mus musculus
tgcttagcaagctttctgcccctga

SEQ ID NO: 875943 - DNA, 25 bp, Mus musculus
tgcttagcacatctcagcggctggt

SEQ ID NO: 875944 - DNA, 25 bp, Mus musculus
tgcttagcacatgtcagcggctggt

SEQ ID NO: 875945 - DNA, 25 bp, Mus musculus
tgcttagcagcaagacacttccttt

SEQ ID NO: 875946 - DNA, 25 bp, Mus musculus
tgcttagcagcatgacacttccttt

SEQ ID NO: 875947 - DNA, 25 bp, Mus musculus
tgcttagcagctcccaattaccagt

SEQ ID NO: 875948 - DNA, 25 bp, Mus musculus
tgcttagcagctgccaattaccagt

SEQ ID NO: 875949 - DNA, 25 bp, Mus musculus
tgcttagccagtctaggaagcctca

SEQ ID NO: 875950 - DNA, 25 bp, Mus musculus
tgcttagccagtgtaggaagcctca

SEQ ID NO: 875951 - DNA, 25 bp, Mus musculus
tgcttagccccaaggttggcatgga

SEQ ID NO: 875952 - DNA, 25 bp, Mus musculus
tgcttagccccatggttggcatgga

SEQ ID NO: 875953 - DNA, 25 bp, Mus musculus
tgcttagcctatacacaattcccat

SEQ ID NO: 875954 - DNA, 25 bp, Mus musculus
tgcttagcctattcacaattcccat

SEQ ID NO: 875955 - DNA, 25 bp, Mus musculus
tgcttagcctttctagcagggctca

SEQ ID NO: 875956 - DNA, 25 bp, Mus musculus
tgcttagcctttgtagcagggctca

SEQ ID NO: 875957 - DNA, 25 bp, Mus musculus
tgcttagcttagaggtggccatcag

SEQ ID NO: 875958 - DNA, 25 bp, Mus musculus
tgcttagcttagtggtggccatcag

SEQ ID NO: 875959 - DNA, 25 bp, Mus musculus
tgcttaggaagcacagaatgtctgt

SEQ ID NO: 875960 - DNA, 25 bp, Mus musculus
tgcttaggaagctcagaatgtctgt

SEQ ID NO: 875961 - DNA, 25 bp, Mus musculus
tgcttaggaccgaggcgctctgatg

SEQ ID NO: 875962 - DNA, 25 bp, Mus musculus
tgcttaggaccgtggcgctctgatg

SEQ ID NO: 875963 - DNA, 25 bp, Mus musculus
tgcttagggcaacccggagctcata

SEQ ID NO: 875964 - DNA, 25 bp, Mus musculus
tgcttagggcaagccggagctcata

SEQ ID NO: 875965 - DNA, 25 bp, Mus musculus
tgcttagggtcccttctgactctta

SEQ ID NO: 875966 - DNA, 25 bp, Mus musculus
tgcttagggtccgttctgactctta

SEQ ID NO: 875967 - DNA, 25 bp, Mus musculus
tgcttaggtgctatttcctttgtgt

SEQ ID NO: 875968 - DNA, 25 bp, Mus musculus
tgcttaggtgctttttcctttgtgt

SEQ ID NO: 875969 - DNA, 25 bp, Mus musculus
tgcttaggtggcaacctgcagggca

SEQ ID NO: 875970 - DNA, 25 bp, Mus musculus
tgcttaggtggctacctgcagggca

SEQ ID NO: 875971 - DNA, 25 bp, Mus musculus
tgcttagtacccaagttgactgtgt

SEQ ID NO: 875972 - DNA, 25 bp, Mus musculus
tgcttagtaccctagttgactgtgt

SEQ ID NO: 875973 - DNA, 25 bp, Mus musculus
tgcttagtatcacggtcgtgtgaca

SEQ ID NO: 875974 - DNA, 25 bp, Mus musculus
tgcttagtatcagggtcgtgtgaca

SEQ ID NO: 875975 - DNA, 25 bp, Mus musculus
tgcttagtattgactgacttccctc

SEQ ID NO: 875976 - DNA, 25 bp, Mus musculus
tgcttagtattgtctgacttccctc

SEQ ID NO: 875977 - DNA, 25 bp, Mus musculus
tgcttagtctctccaacagttatga

SEQ ID NO: 875978 - DNA, 25 bp, Mus musculus
tgcttagtctctgcaacagttatga

SEQ ID NO: 875979 - DNA, 25 bp, Mus musculus
tgcttagtgctcagcttggaagtgg

SEQ ID NO: 875980 - DNA, 25 bp, Mus musculus
tgcttagtgctctgcttggaagtgg

SEQ ID NO: 875981 - DNA, 25 bp, Mus musculus
tgcttagttatacccattcatttaa

SEQ ID NO: 875982 - DNA, 25 bp, Mus musculus
tgcttagttatagccattcatttaa

SEQ ID NO: 875983 - DNA, 25 bp, Mus musculus
tgcttagttcctctatgttggcact

SEQ ID NO: 875984 - DNA, 25 bp, Mus musculus
tgcttagttcctgtatgttggcact

SEQ ID NO: 875985 - DNA, 25 bp, Mus musculus
tgcttagttgccatctcaaattaac

SEQ ID NO: 875986 - DNA, 25 bp, Mus musculus
tgcttagttgccttctcaaattaac

SEQ ID NO: 875987 - DNA, 25 bp, Mus musculus
tgcttatacctaccagcaacctagg

SEQ ID NO: 875988 - DNA, 25 bp, Mus musculus
tgcttatacctagcagcaacctagg

SEQ ID NO: 875989 - DNA, 25 bp, Mus musculus
tgcttatacgtaacaggtggcctgg

SEQ ID NO: 875990 - DNA, 25 bp, Mus musculus
tgcttatacgtatcaggtggcctgg

SEQ ID NO: 875991 - DNA, 25 bp, Mus musculus
tgcttatagagccacttctacaggg

SEQ ID NO: 875992 - DNA, 25 bp, Mus musculus
tgcttatagagcgacttctacaggg

SEQ ID NO: 875993 - DNA, 25 bp, Mus musculus
tgcttatatctcagactacgccttc

SEQ ID NO: 875994 - DNA, 25 bp, Mus musculus
tgcttatatctctgactacgccttc

SEQ ID NO: 875995 - DNA, 25 bp, Mus musculus
tgcttatcagacctccagcgaataa

SEQ ID NO: 875996 - DNA, 25 bp, Mus musculus
tgcttatcagacgtccagcgaataa

SEQ ID NO: 875997 - DNA, 25 bp, Mus musculus
tgcttatccacacaagagtgacctt

SEQ ID NO: 875998 - DNA, 25 bp, Mus musculus
tgcttatccacagaagagtgacctt

SEQ ID NO: 875999 - DNA, 25 bp, Mus musculus
tgcttatcctttcttaatttctaag

SEQ ID NO: 876000 - DNA, 25 bp, Mus musculus
tgcttatcctttgttaatttctaag

SEQ ID NO: 876001 - DNA, 25 bp, Mus musculus
tgcttatctgatcgcggtctcacct

SEQ ID NO: 876002 - DNA, 25 bp, Mus musculus
tgcttatctgatggcggtctcacct

SEQ ID NO: 876003 - DNA, 25 bp, Mus musculus
tgcttatcttcccatgttttctgta

SEQ ID NO: 876004 - DNA, 25 bp, Mus musculus
tgcttatcttccgatgttttctgta

SEQ ID NO: 876005 - DNA, 25 bp, Mus musculus
tgcttatgaactctgccctgcatgc

SEQ ID NO: 876006 - DNA, 25 bp, Mus musculus
tgcttatgaactgtgccctgcatgc

SEQ ID NO: 876007 - DNA, 25 bp, Mus musculus
tgcttatggcccagtcacacaaaag

SEQ ID NO: 876008 - DNA, 25 bp, Mus musculus
tgcttatggccctgtcacacaaaag

SEQ ID NO: 876009 - DNA, 25 bp, Mus musculus
tgcttatggtttagcttcaggttaa

SEQ ID NO: 876010 - DNA, 25 bp, Mus musculus
tgcttatggttttgcttcaggttaa

SEQ ID NO: 876011 - DNA, 25 bp, Mus musculus
tgcttatgtagtatgctttcaccat

SEQ ID NO: 876012 - DNA, 25 bp, Mus musculus
tgcttatgtagtttgctttcaccat

SEQ ID NO: 876013 - DNA, 25 bp, Mus musculus
tgcttatgtgcacctagcctctaga

SEQ ID NO: 876014 - DNA, 25 bp, Mus musculus
tgcttatgtgcagctagcctctaga

SEQ ID NO: 876015 - DNA, 25 bp, Mus musculus
tgcttattaaatctgtcctctgaca

SEQ ID NO: 876016 - DNA, 25 bp, Mus musculus
tgcttattaaatgtgtcctctgaca

SEQ ID NO: 876017 - DNA, 25 bp, Mus musculus
tgcttattcctgctaccaagggttc

SEQ ID NO: 876018 - DNA, 25 bp, Mus musculus
tgcttattcctggtaccaagggttc

SEQ ID NO: 876019 - DNA, 25 bp, Mus musculus
tgcttatttaatatgccagtggcgg

SEQ ID NO: 876020 - DNA, 25 bp, Mus musculus
tgcttatttaatttgccagtggcgg

SEQ ID NO: 876021 - DNA, 25 bp, Mus musculus
tgcttatttcttatatccacccata

SEQ ID NO: 876022 - DNA, 25 bp, Mus musculus
tgcttatttcttttatccacccata

SEQ ID NO: 876023 - DNA, 25 bp, Mus musculus
tgcttatttgcacatggtcaccttg

SEQ ID NO: 876024 - DNA, 25 bp, Mus musculus
tgcttatttgcagatggtcaccttg

SEQ ID NO: 876025 - DNA, 25 bp, Mus musculus
tgcttattttatagggttgtgggat

SEQ ID NO: 876026 - DNA, 25 bp, Mus musculus
tgcttattttattgggttgtgggat

SEQ ID NO: 876027 - DNA, 25 bp, Mus musculus
tgcttcaaatcacaggactcacaga

SEQ ID NO: 876028 - DNA, 25 bp, Mus musculus
tgcttcaaatcagaggactcacaga

SEQ ID NO: 876029 - DNA, 25 bp, Mus musculus
tgcttcaaatttacctctcccaaat

SEQ ID NO: 876030 - DNA, 25 bp, Mus musculus
tgcttcaaattttcctctcccaaat

SEQ ID NO: 876031 - DNA, 25 bp, Mus musculus
tgcttcaactttataaaactggaat

SEQ ID NO: 876032 - DNA, 25 bp, Mus musculus
tgcttcaactttttaaaactggaat

SEQ ID NO: 876033 - DNA, 25 bp, Mus musculus
tgcttcaagaacactcaagctgtgt

SEQ ID NO: 876034 - DNA, 25 bp, Mus musculus
tgcttcaagaactctcaagctgtgt

SEQ ID NO: 876035 - DNA, 25 bp, Mus musculus
tgcttcaagttgcttctgttccata

SEQ ID NO: 876036 - DNA, 25 bp, Mus musculus
tgcttcaagttggttctgttccata

SEQ ID NO: 876037 - DNA, 25 bp, Mus musculus
tgcttcaatactagcattacctggc

SEQ ID NO: 876038 - DNA, 25 bp, Mus musculus
tgcttcaatactcgctgtgacccac

SEQ ID NO: 876039 - DNA, 25 bp, Mus musculus
tgcttcaatactggctgtgacccac

SEQ ID NO: 876040 - DNA, 25 bp, Mus musculus
tgcttcaatacttgcattacctggc

SEQ ID NO: 876041 - DNA, 25 bp, Mus musculus
tgcttcaatataaagccaatcttga

SEQ ID NO: 876042 - DNA, 25 bp, Mus musculus
tgcttcaatatatagccaatcttga

SEQ ID NO: 876043 - DNA, 25 bp, Mus musculus
tgcttcacaaggatgccaggaggct

SEQ ID NO: 876044 - DNA, 25 bp, Mus musculus
tgcttcacaaggttgccaggaggct

SEQ ID NO: 876045 - DNA, 25 bp, Mus musculus
tgcttcacacatagtactccatttg

SEQ ID NO: 876046 - DNA, 25 bp, Mus musculus
tgcttcacacattgtactccatttg

SEQ ID NO: 876047 - DNA, 25 bp, Mus musculus
tgcttcacactccccacagatagag

SEQ ID NO: 876048 - DNA, 25 bp, Mus musculus
tgcttcacactcgccacagatagag

SEQ ID NO: 876049 - DNA, 25 bp, Mus musculus
tgcttcacaggtctctagccagtcc

SEQ ID NO: 876050 - DNA, 25 bp, Mus musculus
tgcttcacaggtgtctagccagtcc

SEQ ID NO: 876051 - DNA, 25 bp, Mus musculus
tgcttcacatcacatctcatctgga

SEQ ID NO: 876052 - DNA, 25 bp, Mus musculus
tgcttcacatcagatctcatctgga

SEQ ID NO: 876053 - DNA, 25 bp, Mus musculus
tgcttcacatgcacaaggcactgat

SEQ ID NO: 876054 - DNA, 25 bp, Mus musculus
tgcttcacatgctcaaggcactgat

SEQ ID NO: 876055 - DNA, 25 bp, Mus musculus
tgcttcacccacatacaatacaaaa

SEQ ID NO: 876056 - DNA, 25 bp, Mus musculus
tgcttcacccacttacaatacaaaa

SEQ ID NO: 876057 - DNA, 25 bp, Mus musculus
tgcttcaccccaatccttatgttga

SEQ ID NO: 876058 - DNA, 25 bp, Mus musculus
tgcttcaccccattccttatgttga

SEQ ID NO: 876059 - DNA, 25 bp, Mus musculus
tgcttcaccgcgataccttttttat

SEQ ID NO: 876060 - DNA, 25 bp, Mus musculus
tgcttcaccgcgttaccttttttat

SEQ ID NO: 876061 - DNA, 25 bp, Mus musculus
tgcttcactcagctcactgattctt

SEQ ID NO: 876062 - DNA, 25 bp, Mus musculus
tgcttcactcaggtcactgattctt

SEQ ID NO: 876063 - DNA, 25 bp, Mus musculus
tgcttcactgaaatcctgacgttga

SEQ ID NO: 876064 - DNA, 25 bp, Mus musculus
tgcttcactgaattcctgacgttga

SEQ ID NO: 876065 - DNA, 25 bp, Mus musculus
tgcttcacttcactgctgattcagc

SEQ ID NO: 876066 - DNA, 25 bp, Mus musculus
tgcttcacttcagtgctgattcagc

SEQ ID NO: 876067 - DNA, 25 bp, Mus musculus
tgcttcagacctagctaaccagacc

SEQ ID NO: 876068 - DNA, 25 bp, Mus musculus
tgcttcagaccttgctaaccagacc

SEQ ID NO: 876069 - DNA, 25 bp, Mus musculus
tgcttcagaggaaacagatggtcat

SEQ ID NO: 876070 - DNA, 25 bp, Mus musculus
tgcttcagaggatacagatggtcat

SEQ ID NO: 876071 - DNA, 25 bp, Mus musculus
tgcttcagatgtaactttggcgtcc

SEQ ID NO: 876072 - DNA, 25 bp, Mus musculus
tgcttcagatgttactttggcgtcc

SEQ ID NO: 876073 - DNA, 25 bp, Mus musculus
tgcttcagcataaccattaatgact

SEQ ID NO: 876074 - DNA, 25 bp, Mus musculus
tgcttcagcatatccattaatgact

SEQ ID NO: 876075 - DNA, 25 bp, Mus musculus
tgcttcagctaacgaactgcccctg

SEQ ID NO: 876076 - DNA, 25 bp, Mus musculus
tgcttcagctaaggaactgcccctg

SEQ ID NO: 876077 - DNA, 25 bp, Mus musculus
tgcttcaggctacctcatttctgat

SEQ ID NO: 876078 - DNA, 25 bp, Mus musculus
tgcttcaggctagctcatttctgat

SEQ ID NO: 876079 - DNA, 25 bp, Mus musculus
tgcttcagggtactgggtctactcc

SEQ ID NO: 876080 - DNA, 25 bp, Mus musculus
tgcttcagggtagtgggtctactcc

SEQ ID NO: 876081 - DNA, 25 bp, Mus musculus
tgcttcagggttacagtactgctca

SEQ ID NO: 876082 - DNA, 25 bp, Mus musculus
tgcttcagggtttcagtactgctca

SEQ ID NO: 876083 - DNA, 25 bp, Mus musculus
tgcttcaggtccctttgatggagtc

SEQ ID NO: 876084 - DNA, 25 bp, Mus musculus
tgcttcaggtccgtttgatggagtc

SEQ ID NO: 876085 - DNA, 25 bp, Mus musculus
tgcttcagtaacaaaggcaattgtt

SEQ ID NO: 876086 - DNA, 25 bp, Mus musculus
tgcttcagtaactaaggcaattgtt

SEQ ID NO: 876087 - DNA, 25 bp, Mus musculus
tgcttcagtacaacgaccccaaacg

SEQ ID NO: 876088 - DNA, 25 bp, Mus musculus
tgcttcagtacatcgaccccaaacg

SEQ ID NO: 876089 - DNA, 25 bp, Mus musculus
tgcttcagtctcagggagttcgtat

SEQ ID NO: 876090 - DNA, 25 bp, Mus musculus
tgcttcagtctctgggagttcgtat

SEQ ID NO: 876091 - DNA, 25 bp, Mus musculus
tgcttcagttctctacatcatccag

SEQ ID NO: 876092 - DNA, 25 bp, Mus musculus
tgcttcagttctgtacatcatccag

SEQ ID NO: 876093 - DNA, 25 bp, Mus musculus
tgcttcagttggagggtgtccctcc

SEQ ID NO: 876094 - DNA, 25 bp, Mus musculus
tgcttcagttggtgggtgtccctcc

SEQ ID NO: 876095 - DNA, 25 bp, Mus musculus
tgcttcagtttgattagcagaacca

SEQ ID NO: 876096 - DNA, 25 bp, Mus musculus
tgcttcagtttgtttagcagaacca

SEQ ID NO: 876097 - DNA, 25 bp, Mus musculus
tgcttcagttttatcacggataaaa

SEQ ID NO: 876098 - DNA, 25 bp, Mus musculus
tgcttcagttttttcacggataaaa

SEQ ID NO: 876099 - DNA, 25 bp, Mus musculus
tgcttcataaccaagtcagccttga

SEQ ID NO: 876100 - DNA, 25 bp, Mus musculus
tgcttcataacctagtcagccttga

SEQ ID NO: 876101 - DNA, 25 bp, Mus musculus
tgcttcatccagcatcgatgtgagt

SEQ ID NO: 876102 - DNA, 25 bp, Mus musculus
tgcttcatccaggatcgatgtgagt

SEQ ID NO: 876103 - DNA, 25 bp, Mus musculus
tgcttcatctctacacagacgtcaa

SEQ ID NO: 876104 - DNA, 25 bp, Mus musculus
tgcttcatctcttcacagacgtcaa

SEQ ID NO: 876105 - DNA, 25 bp, Mus musculus
tgcttcattctgaggaggagcccat

SEQ ID NO: 876106 - DNA, 25 bp, Mus musculus
tgcttcattctgtggaggagcccat

SEQ ID NO: 876107 - DNA, 25 bp, Mus musculus
tgcttcattgagaattcattaaacc

SEQ ID NO: 876108 - DNA, 25 bp, Mus musculus
tgcttcattgagtattcattaaacc

SEQ ID NO: 876109 - DNA, 25 bp, Mus musculus
tgcttcatttccagcgaggtctcag

SEQ ID NO: 876110 - DNA, 25 bp, Mus musculus
tgcttcatttccatttctcaagggc

SEQ ID NO: 876111 - DNA, 25 bp, Mus musculus
tgcttcatttcctgcgaggtctcag

SEQ ID NO: 876112 - DNA, 25 bp, Mus musculus
tgcttcatttccttttctcaagggc

SEQ ID NO: 876113 - DNA, 25 bp, Mus musculus
tgcttccaacggcatagcggcgtgc

SEQ ID NO: 876114 - DNA, 25 bp, Mus musculus
tgcttccaacgggatagcggcgtgc

SEQ ID NO: 876115 - DNA, 25 bp, Mus musculus
tgcttccacagaatgttggccttct

SEQ ID NO: 876116 - DNA, 25 bp, Mus musculus
tgcttccacagaccatcctcagtga

SEQ ID NO: 876117 - DNA, 25 bp, Mus musculus
tgcttccacagagcatcctcagtga

SEQ ID NO: 876118 - DNA, 25 bp, Mus musculus
tgcttccacagattgttggccttct

SEQ ID NO: 876119 - DNA, 25 bp, Mus musculus
tgcttccacagccttccaagtgcaa

SEQ ID NO: 876120 - DNA, 25 bp, Mus musculus
tgcttccacagcgttccaagtgcaa

SEQ ID NO: 876121 - DNA, 25 bp, Mus musculus
tgcttccaccacctgagtatgggaa

SEQ ID NO: 876122 - DNA, 25 bp, Mus musculus
tgcttccaccacgtgagtatgggaa

SEQ ID NO: 876123 - DNA, 25 bp, Mus musculus
tgcttccaccttacttttgacagaa

SEQ ID NO: 876124 - DNA, 25 bp, Mus musculus
tgcttccaccttctgtatatgtaaa

SEQ ID NO: 876125 - DNA, 25 bp, Mus musculus
tgcttccaccttgtgtatatgtaaa

SEQ ID NO: 876126 - DNA, 25 bp, Mus musculus
tgcttccacctttcttttgacagaa

SEQ ID NO: 876127 - DNA, 25 bp, Mus musculus
tgcttccacgccaggagcacgttcc

SEQ ID NO: 876128 - DNA, 25 bp, Mus musculus
tgcttccacgcctggagcacgttcc

SEQ ID NO: 876129 - DNA, 25 bp, Mus musculus
tgcttccacttcaggttcacagata

SEQ ID NO: 876130 - DNA, 25 bp, Mus musculus
tgcttccacttctggttcacagata

SEQ ID NO: 876131 - DNA, 25 bp, Mus musculus
tgcttccagagtagcccgtgctctt

SEQ ID NO: 876132 - DNA, 25 bp, Mus musculus
tgcttccagagttgcccgtgctctt

SEQ ID NO: 876133 - DNA, 25 bp, Mus musculus
tgcttccagcgtaactcttagggac

SEQ ID NO: 876134 - DNA, 25 bp, Mus musculus
tgcttccagcgttactcttagggac

SEQ ID NO: 876135 - DNA, 25 bp, Mus musculus
tgcttccagctcctattgcattgac

SEQ ID NO: 876136 - DNA, 25 bp, Mus musculus
tgcttccagctcgtattgcattgac

SEQ ID NO: 876137 - DNA, 25 bp, Mus musculus
tgcttccaggaactcaatgtctttg

SEQ ID NO: 876138 - DNA, 25 bp, Mus musculus
tgcttccaggaagtcaatgtctttg

SEQ ID NO: 876139 - DNA, 25 bp, Mus musculus
tgcttccaggcaaggccagacttca

SEQ ID NO: 876140 - DNA, 25 bp, Mus musculus
tgcttccaggcatggccagacttca

SEQ ID NO: 876141 - DNA, 25 bp, Mus musculus
tgcttccagggcaggagtcgtatgt

SEQ ID NO: 876142 - DNA, 25 bp, Mus musculus
tgcttccagggctggagtcgtatgt

SEQ ID NO: 876143 - DNA, 25 bp, Mus musculus
tgcttccaggtactcttgcaagata

SEQ ID NO: 876144 - DNA, 25 bp, Mus musculus
tgcttccaggtagtcttgcaagata

SEQ ID NO: 876145 - DNA, 25 bp, Mus musculus
tgcttccagtcgatacagaccacta

SEQ ID NO: 876146 - DNA, 25 bp, Mus musculus
tgcttccagtcgttacagaccacta

SEQ ID NO: 876147 - DNA, 25 bp, Mus musculus
tgcttccagtgaaccatctttcctt

SEQ ID NO: 876148 - DNA, 25 bp, Mus musculus
tgcttccagtgatccatctttcctt

SEQ ID NO: 876149 - DNA, 25 bp, Mus musculus
tgcttccagtttatgtgctctgtga

SEQ ID NO: 876150 - DNA, 25 bp, Mus musculus
tgcttccagtttttgtgctctgtga

SEQ ID NO: 876151 - DNA, 25 bp, Mus musculus
tgcttccatataacactttccattt

SEQ ID NO: 876152 - DNA, 25 bp, Mus musculus
tgcttccatatatcactttccattt

SEQ ID NO: 876153 - DNA, 25 bp, Mus musculus
tgcttccatatcaaaggagaacatg

SEQ ID NO: 876154 - DNA, 25 bp, Mus musculus
tgcttccatatctaaggagaacatg

SEQ ID NO: 876155 - DNA, 25 bp, Mus musculus
tgcttccatccaaactccagagaat

SEQ ID NO: 876156 - DNA, 25 bp, Mus musculus
tgcttccatccatactccagagaat

SEQ ID NO: 876157 - DNA, 25 bp, Mus musculus
tgcttccatgcaaggtgaacctgag

SEQ ID NO: 876158 - DNA, 25 bp, Mus musculus
tgcttccatgcatggtgaacctgag

SEQ ID NO: 876159 - DNA, 25 bp, Mus musculus
tgcttccatgctctgtgttctgaaa

SEQ ID NO: 876160 - DNA, 25 bp, Mus musculus
tgcttccatgctgtgtgttctgaaa

SEQ ID NO: 876161 - DNA, 25 bp, Mus musculus
tgcttccattaccactgtcagattg

SEQ ID NO: 876162 - DNA, 25 bp, Mus musculus
tgcttccattacgactgtcagattg

SEQ ID NO: 876163 - DNA, 25 bp, Mus musculus
tgcttcccaactaaggatcaatcag

SEQ ID NO: 876164 - DNA, 25 bp, Mus musculus
tgcttcccaacttaggatcaatcag

SEQ ID NO: 876165 - DNA, 25 bp, Mus musculus
tgcttcccaagactggttttaggca

SEQ ID NO: 876166 - DNA, 25 bp, Mus musculus
tgcttcccaagagtggttttaggca

SEQ ID NO: 876167 - DNA, 25 bp, Mus musculus
tgcttcccaagccagacagacatct

SEQ ID NO: 876168 - DNA, 25 bp, Mus musculus
tgcttcccaagcgagacagacatct

SEQ ID NO: 876169 - DNA, 25 bp, Mus musculus
tgcttcccagagctactgatgtctc

SEQ ID NO: 876170 - DNA, 25 bp, Mus musculus
tgcttcccagaggtactgatgtctc

SEQ ID NO: 876171 - DNA, 25 bp, Mus musculus
tgcttcccagggacagagcgtgtgc

SEQ ID NO: 876172 - DNA, 25 bp, Mus musculus
tgcttcccagggtcagagcgtgtgc

SEQ ID NO: 876173 - DNA, 25 bp, Mus musculus
tgcttcccatctagccataggagtg

SEQ ID NO: 876174 - DNA, 25 bp, Mus musculus
tgcttcccatcttgccataggagtg

SEQ ID NO: 876175 - DNA, 25 bp, Mus musculus
tgcttcccatgcaaacattcagcca

SEQ ID NO: 876176 - DNA, 25 bp, Mus musculus
tgcttcccatgctaacattcagcca

SEQ ID NO: 876177 - DNA, 25 bp, Mus musculus
tgcttccccattcttggcttataaa

SEQ ID NO: 876178 - DNA, 25 bp, Mus musculus
tgcttccccattgttggcttataaa

SEQ ID NO: 876179 - DNA, 25 bp, Mus musculus
tgcttccccgagagtcgccgtggga

SEQ ID NO: 876180 - DNA, 25 bp, Mus musculus
tgcttccccgagtgtcgccgtggga

SEQ ID NO: 876181 - DNA, 25 bp, Mus musculus
tgcttcccgtgccaaacacaaaaat

SEQ ID NO: 876182 - DNA, 25 bp, Mus musculus
tgcttcccgtgcgaaacacaaaaat

SEQ ID NO: 876183 - DNA, 25 bp, Mus musculus
tgcttcccgtttcctctaagagtgt

SEQ ID NO: 876184 - DNA, 25 bp, Mus musculus
tgcttcccgtttgctctaagagtgt

SEQ ID NO: 876185 - DNA, 25 bp, Mus musculus
tgcttccctacgaggagagccaggg

SEQ ID NO: 876186 - DNA, 25 bp, Mus musculus
tgcttccctacgtggagagccaggg

SEQ ID NO: 876187 - DNA, 25 bp, Mus musculus
tgcttccctattatttcgcaaagcc

SEQ ID NO: 876188 - DNA, 25 bp, Mus musculus
tgcttccctattttttcgcaaagcc

SEQ ID NO: 876189 - DNA, 25 bp, Mus musculus
tgcttccctcgtatacacagtattt

SEQ ID NO: 876190 - DNA, 25 bp, Mus musculus
tgcttccctcgtttacacagtattt

SEQ ID NO: 876191 - DNA, 25 bp, Mus musculus
tgcttccctctaaaaacgcttatat

SEQ ID NO: 876192 - DNA, 25 bp, Mus musculus
tgcttccctctataaacgcttatat

SEQ ID NO: 876193 - DNA, 25 bp, Mus musculus
tgcttccctgaactgatgctttcat

SEQ ID NO: 876194 - DNA, 25 bp, Mus musculus
tgcttccctgaagtgatgctttcat

SEQ ID NO: 876195 - DNA, 25 bp, Mus musculus
tgcttccctgggagtctcataatta

SEQ ID NO: 876196 - DNA, 25 bp, Mus musculus
tgcttccctgggtgtctcataatta

SEQ ID NO: 876197 - DNA, 25 bp, Mus musculus
tgcttccctggtatttctggctttc

SEQ ID NO: 876198 - DNA, 25 bp, Mus musculus
tgcttccctggtttttctggctttc

SEQ ID NO: 876199 - DNA, 25 bp, Mus musculus
tgcttccctgtacgtgcaacaacat

SEQ ID NO: 876200 - DNA, 25 bp, Mus musculus
tgcttccctgtaggtgcaacaacat

SEQ ID NO: 876201 - DNA, 25 bp, Mus musculus
tgcttccctttgctgttgtataact

SEQ ID NO: 876202 - DNA, 25 bp, Mus musculus
tgcttccctttggtgttgtataact

SEQ ID NO: 876203 - DNA, 25 bp, Mus musculus
tgcttccggcagaacgcgaaggaca

SEQ ID NO: 876204 - DNA, 25 bp, Mus musculus
tgcttccggcagtacgcgaaggaca

SEQ ID NO: 876205 - DNA, 25 bp, Mus musculus
tgcttccggcgcctcctaaagacgt

SEQ ID NO: 876206 - DNA, 25 bp, Mus musculus
tgcttccggcgcgtcctaaagacgt

SEQ ID NO: 876207 - DNA, 25 bp, Mus musculus
tgcttccgtcccatggatttaagta

SEQ ID NO: 876208 - DNA, 25 bp, Mus musculus
tgcttccgtcccttggatttaagta

SEQ ID NO: 876209 - DNA, 25 bp, Mus musculus
tgcttccgttttccatctgttttgt

SEQ ID NO: 876210 - DNA, 25 bp, Mus musculus
tgcttccgttttgcatctgttttgt

SEQ ID NO: 876211 - DNA, 25 bp, Mus musculus
tgcttcctaaggactggtgctctag

SEQ ID NO: 876212 - DNA, 25 bp, Mus musculus
tgcttcctaaggtctggtgctctag

SEQ ID NO: 876213 - DNA, 25 bp, Mus musculus
tgcttcctacccaagatgttggtgt

SEQ ID NO: 876214 - DNA, 25 bp, Mus musculus
tgcttcctaccctagatgttggtgt

SEQ ID NO: 876215 - DNA, 25 bp, Mus musculus
tgcttcctactgcacatgactgact

SEQ ID NO: 876216 - DNA, 25 bp, Mus musculus
tgcttcctactggacatgactgact

SEQ ID NO: 876217 - DNA, 25 bp, Mus musculus
tgcttcctagggatgcacagacaaa

SEQ ID NO: 876218 - DNA, 25 bp, Mus musculus
tgcttcctagggttgcacagacaaa

SEQ ID NO: 876219 - DNA, 25 bp, Mus musculus
tgcttcctatgtcctgaaggctctg

SEQ ID NO: 876220 - DNA, 25 bp, Mus musculus
tgcttcctatgtgctgaaggctctg

SEQ ID NO: 876221 - DNA, 25 bp, Mus musculus
tgcttcctcagcagctctgattatg

SEQ ID NO: 876222 - DNA, 25 bp, Mus musculus
tgcttcctcagctgctctgattatg

SEQ ID NO: 876223 - DNA, 25 bp, Mus musculus
tgcttcctcaggcagtagggagcac

SEQ ID NO: 876224 - DNA, 25 bp, Mus musculus
tgcttcctcagggagtagggagcac

SEQ ID NO: 876225 - DNA, 25 bp, Mus musculus
tgcttcctcctccaaatagctggga

SEQ ID NO: 876226 - DNA, 25 bp, Mus musculus
tgcttcctcctcgaaatagctggga

SEQ ID NO: 876227 - DNA, 25 bp, Mus musculus
tgcttcctctcacgtgggcagcctt

SEQ ID NO: 876228 - DNA, 25 bp, Mus musculus
tgcttcctctcaggtgggcagcctt

SEQ ID NO: 876229 - DNA, 25 bp, Mus musculus
tgcttcctctgtaggccaacttgag

SEQ ID NO: 876230 - DNA, 25 bp, Mus musculus
tgcttcctctgttggccaacttgag

SEQ ID NO: 876231 - DNA, 25 bp, Mus musculus
tgcttcctcttgcagcagtggaata

SEQ ID NO: 876232 - DNA, 25 bp, Mus musculus
tgcttcctcttggagcagtggaata

SEQ ID NO: 876233 - DNA, 25 bp, Mus musculus
tgcttcctgactctgtatggaacat

SEQ ID NO: 876234 - DNA, 25 bp, Mus musculus
tgcttcctgactgtgtatggaacat

SEQ ID NO: 876235 - DNA, 25 bp, Mus musculus
tgcttcctgcacatgtgaaattcaa

SEQ ID NO: 876236 - DNA, 25 bp, Mus musculus
tgcttcctgcacttgtgaaattcaa

SEQ ID NO: 876237 - DNA, 25 bp, Mus musculus
tgcttcctgcagagtggaggatcag

SEQ ID NO: 876238 - DNA, 25 bp, Mus musculus
tgcttcctgcagtgtggaggatcag

SEQ ID NO: 876239 - DNA, 25 bp, Mus musculus
tgcttcctgccaagagtgaacggat

SEQ ID NO: 876240 - DNA, 25 bp, Mus musculus
tgcttcctgccatgagtgaacggat

SEQ ID NO: 876241 - DNA, 25 bp, Mus musculus
tgcttcctgcccaagatactggtaa

SEQ ID NO: 876242 - DNA, 25 bp, Mus musculus
tgcttcctgccctagatactggtaa

SEQ ID NO: 876243 - DNA, 25 bp, Mus musculus
tgcttcctgcttagccttgttatag

SEQ ID NO: 876244 - DNA, 25 bp, Mus musculus
tgcttcctgcttatacaactgaaat

SEQ ID NO: 876245 - DNA, 25 bp, Mus musculus
tgcttcctgctttgccttgttatag

SEQ ID NO: 876246 - DNA, 25 bp, Mus musculus
tgcttcctgcttttacaactgaaat

SEQ ID NO: 876247 - DNA, 25 bp, Mus musculus
tgcttcctggatagtttctttggct

SEQ ID NO: 876248 - DNA, 25 bp, Mus musculus
tgcttcctggattgtttctttggct

SEQ ID NO: 876249 - DNA, 25 bp, Mus musculus
tgcttcctgggcaaattacatgggc

SEQ ID NO: 876250 - DNA, 25 bp, Mus musculus
tgcttcctgggcattgtatttttct

SEQ ID NO: 876251 - DNA, 25 bp, Mus musculus
tgcttcctgggccatagctgctttg

SEQ ID NO: 876252 - DNA, 25 bp, Mus musculus
tgcttcctgggcgatagctgctttg

SEQ ID NO: 876253 - DNA, 25 bp, Mus musculus
tgcttcctgggctaattacatgggc

SEQ ID NO: 876254 - DNA, 25 bp, Mus musculus
tgcttcctgggctttgtatttttct

SEQ ID NO: 876255 - DNA, 25 bp, Mus musculus
tgcttcctggtgcatttccagagat

SEQ ID NO: 876256 - DNA, 25 bp, Mus musculus
tgcttcctggtggatttccagagat

SEQ ID NO: 876257 - DNA, 25 bp, Mus musculus
tgcttcctgtacctagtgtcactgg

SEQ ID NO: 876258 - DNA, 25 bp, Mus musculus
tgcttcctgtacgtagtgtcactgg

SEQ ID NO: 876259 - DNA, 25 bp, Mus musculus
tgcttcctgtcaagctgagttcaga

SEQ ID NO: 876260 - DNA, 25 bp, Mus musculus
tgcttcctgtcatgctgagttcaga

SEQ ID NO: 876261 - DNA, 25 bp, Mus musculus
tgcttcctgtgcacagttacatagt

SEQ ID NO: 876262 - DNA, 25 bp, Mus musculus
tgcttcctgtgctcagttacatagt

SEQ ID NO: 876263 - DNA, 25 bp, Mus musculus
tgcttcctgtggattgcttgaactc

SEQ ID NO: 876264 - DNA, 25 bp, Mus musculus
tgcttcctgtggtttgcttgaactc

SEQ ID NO: 876265 - DNA, 25 bp, Mus musculus
tgcttccttaagcactttaacccta

SEQ ID NO: 876266 - DNA, 25 bp, Mus musculus
tgcttccttaaggactttaacccta

SEQ ID NO: 876267 - DNA, 25 bp, Mus musculus
tgcttccttactcataaagtccggg

SEQ ID NO: 876268 - DNA, 25 bp, Mus musculus
tgcttccttactgataaagtccggg

SEQ ID NO: 876269 - DNA, 25 bp, Mus musculus
tgcttccttcttaactggacattct

SEQ ID NO: 876270 - DNA, 25 bp, Mus musculus
tgcttccttctttactggacattct

SEQ ID NO: 876271 - DNA, 25 bp, Mus musculus
tgcttccttgccagcataaacatgc

SEQ ID NO: 876272 - DNA, 25 bp, Mus musculus
tgcttccttgcctgcataaacatgc

SEQ ID NO: 876273 - DNA, 25 bp, Mus musculus
tgcttcctttcacacagggctcatt

SEQ ID NO: 876274 - DNA, 25 bp, Mus musculus
tgcttcctttcagacagggctcatt

SEQ ID NO: 876275 - DNA, 25 bp, Mus musculus
tgcttcgaacgcaaccaacttagtt

SEQ ID NO: 876276 - DNA, 25 bp, Mus musculus
tgcttcgaacgctaccaacttagtt

SEQ ID NO: 876277 - DNA, 25 bp, Mus musculus
tgcttcgaataaagttccaccccac

SEQ ID NO: 876278 - DNA, 25 bp, Mus musculus
tgcttcgaataatgttccaccccac

SEQ ID NO: 876279 - DNA, 25 bp, Mus musculus
tgcttcgacttccagtacgctaaag

SEQ ID NO: 876280 - DNA, 25 bp, Mus musculus
tgcttcgacttcgagtacgctaaag

SEQ ID NO: 876281 - DNA, 25 bp, Mus musculus
tgcttcgactttccagactgtgcag

SEQ ID NO: 876282 - DNA, 25 bp, Mus musculus
tgcttcgactttgcagactgtgcag

SEQ ID NO: 876283 - DNA, 25 bp, Mus musculus
tgcttcgagaccagcacctggagat

SEQ ID NO: 876284 - DNA, 25 bp, Mus musculus
tgcttcgagacctgcacctggagat

SEQ ID NO: 876285 - DNA, 25 bp, Mus musculus
tgcttcgagctgcagagaatcttga

SEQ ID NO: 876286 - DNA, 25 bp, Mus musculus
tgcttcgagctggagagaatcttga

SEQ ID NO: 876287 - DNA, 25 bp, Mus musculus
tgcttcgcaagaaccagtgccggga

SEQ ID NO: 876288 - DNA, 25 bp, Mus musculus
tgcttcgcaagatccagtgccggga

SEQ ID NO: 876289 - DNA, 25 bp, Mus musculus
tgcttcgccctaactgcagatggtg

SEQ ID NO: 876290 - DNA, 25 bp, Mus musculus
tgcttcgccctatctgcagatggtg

SEQ ID NO: 876291 - DNA, 25 bp, Mus musculus
tgcttcggacacaggcggacctgat

SEQ ID NO: 876292 - DNA, 25 bp, Mus musculus
tgcttcggacactggcggacctgat

SEQ ID NO: 876293 - DNA, 25 bp, Mus musculus
tgcttcggagacactacgacagccg

SEQ ID NO: 876294 - DNA, 25 bp, Mus musculus
tgcttcggagactctacgacagccg

SEQ ID NO: 876295 - DNA, 25 bp, Mus musculus
tgcttcggatacatgtggctggatg

SEQ ID NO: 876296 - DNA, 25 bp, Mus musculus
tgcttcggatacttgtggctggatg

SEQ ID NO: 876297 - DNA, 25 bp, Mus musculus
tgcttcggcctgacacagaagctgt

SEQ ID NO: 876298 - DNA, 25 bp, Mus musculus
tgcttcggcctgtcacagaagctgt

SEQ ID NO: 876299 - DNA, 25 bp, Mus musculus
tgcttcggctggaaggtgattcacg

SEQ ID NO: 876300 - DNA, 25 bp, Mus musculus
tgcttcggctggtaggtgattcacg

SEQ ID NO: 876301 - DNA, 25 bp, Mus musculus
tgcttcggttgacttggctcctgaa

SEQ ID NO: 876302 - DNA, 25 bp, Mus musculus
tgcttcggttgagttggctcctgaa

SEQ ID NO: 876303 - DNA, 25 bp, Mus musculus
tgcttcgtccatcgcgcacaggaat

SEQ ID NO: 876304 - DNA, 25 bp, Mus musculus
tgcttcgtccatggcgcacaggaat

SEQ ID NO: 876305 - DNA, 25 bp, Mus musculus
tgcttcgtcgtgatattgactgcca

SEQ ID NO: 876306 - DNA, 25 bp, Mus musculus
tgcttcgtcgtgttattgactgcca

SEQ ID NO: 876307 - DNA, 25 bp, Mus musculus
tgcttcgtctaactattctcctttt

SEQ ID NO: 876308 - DNA, 25 bp, Mus musculus
tgcttcgtctaagtattctcctttt

SEQ ID NO: 876309 - DNA, 25 bp, Mus musculus
tgcttcgtgcatcccaatgtgtata

SEQ ID NO: 876310 - DNA, 25 bp, Mus musculus
tgcttcgtgcatgccaatgtgtata

SEQ ID NO: 876311 - DNA, 25 bp, Mus musculus
tgcttcgtgttcatatccctaggtc

SEQ ID NO: 876312 - DNA, 25 bp, Mus musculus
tgcttcgtgttcttatccctaggtc

SEQ ID NO: 876313 - DNA, 25 bp, Mus musculus
tgcttctaaactcagcccctaaata

SEQ ID NO: 876314 - DNA, 25 bp, Mus musculus
tgcttctaaactgagcccctaaata

SEQ ID NO: 876315 - DNA, 25 bp, Mus musculus
tgcttctaaagaacctcagtcttga

SEQ ID NO: 876316 - DNA, 25 bp, Mus musculus
tgcttctaaagatcctcagtcttga

SEQ ID NO: 876317 - DNA, 25 bp, Mus musculus
tgcttctaatcaccttttaaaattt

SEQ ID NO: 876318 - DNA, 25 bp, Mus musculus
tgcttctaatcagcttttaaaattt

SEQ ID NO: 876319 - DNA, 25 bp, Mus musculus
tgcttctacaatcctgactacctgg

SEQ ID NO: 876320 - DNA, 25 bp, Mus musculus
tgcttctacaatgctgactacctgg

SEQ ID NO: 876321 - DNA, 25 bp, Mus musculus
tgcttctacagcaacttcaagacac

SEQ ID NO: 876322 - DNA, 25 bp, Mus musculus
tgcttctacagctacttcaagacac

SEQ ID NO: 876323 - DNA, 25 bp, Mus musculus
tgcttctactgaccccaaacaagac

SEQ ID NO: 876324 - DNA, 25 bp, Mus musculus
tgcttctactgagcccaaacaagac

SEQ ID NO: 876325 - DNA, 25 bp, Mus musculus
tgcttctagccgagcccggcaggcg

SEQ ID NO: 876326 - DNA, 25 bp, Mus musculus
tgcttctagccgtgcccggcaggcg

SEQ ID NO: 876327 - DNA, 25 bp, Mus musculus
tgcttctagcttatctgaaccctgc

SEQ ID NO: 876328 - DNA, 25 bp, Mus musculus
tgcttctagcttttctgaaccctgc

SEQ ID NO: 876329 - DNA, 25 bp, Mus musculus
tgcttctaggtacagagcctcctgc

SEQ ID NO: 876330 - DNA, 25 bp, Mus musculus
tgcttctaggtagagagcctcctgc

SEQ ID NO: 876331 - DNA, 25 bp, Mus musculus
tgcttctatactcaaggttcccttt

SEQ ID NO: 876332 - DNA, 25 bp, Mus musculus
tgcttctatactgaaggttcccttt

SEQ ID NO: 876333 - DNA, 25 bp, Mus musculus
tgcttctatcacaactttatttttc

SEQ ID NO: 876334 - DNA, 25 bp, Mus musculus
tgcttctatcactactttatttttc

SEQ ID NO: 876335 - DNA, 25 bp, Mus musculus
tgcttctatttgcttcacctttaac

SEQ ID NO: 876336 - DNA, 25 bp, Mus musculus
tgcttctatttggttcacctttaac

SEQ ID NO: 876337 - DNA, 25 bp, Mus musculus
tgcttctcaccaacagctaaaggga

SEQ ID NO: 876338 - DNA, 25 bp, Mus musculus
tgcttctcaccatcagctaaaggga

SEQ ID NO: 876339 - DNA, 25 bp, Mus musculus
tgcttctcaccgagcagagctgcac

SEQ ID NO: 876340 - DNA, 25 bp, Mus musculus
tgcttctcaccgtgcagagctgcac

SEQ ID NO: 876341 - DNA, 25 bp, Mus musculus
tgcttctcacctcactgacttttga

SEQ ID NO: 876342 - DNA, 25 bp, Mus musculus
tgcttctcacctgactgacttttga

SEQ ID NO: 876343 - DNA, 25 bp, Mus musculus
tgcttctcaggaacaggccactcaa

SEQ ID NO: 876344 - DNA, 25 bp, Mus musculus
tgcttctcaggatcaggccactcaa

SEQ ID NO: 876345 - DNA, 25 bp, Mus musculus
tgcttctccacaaatgataccactg

SEQ ID NO: 876346 - DNA, 25 bp, Mus musculus
tgcttctccacatatgataccactg

SEQ ID NO: 876347 - DNA, 25 bp, Mus musculus
tgcttctccctaagcacttagaaag

SEQ ID NO: 876348 - DNA, 25 bp, Mus musculus
tgcttctccctatgcacttagaaag

SEQ ID NO: 876349 - DNA, 25 bp, Mus musculus
tgcttctccgtcctgagttccagga

SEQ ID NO: 876350 - DNA, 25 bp, Mus musculus
tgcttctccgtcgtgagttccagga

SEQ ID NO: 876351 - DNA, 25 bp, Mus musculus
tgcttctcctcaccacatcaggaaa

SEQ ID NO: 876352 - DNA, 25 bp, Mus musculus
tgcttctcctcagcacatcaggaaa

SEQ ID NO: 876353 - DNA, 25 bp, Mus musculus
tgcttctctcgcaacagttttaagt

SEQ ID NO: 876354 - DNA, 25 bp, Mus musculus
tgcttctctcgctacagttttaagt

SEQ ID NO: 876355 - DNA, 25 bp, Mus musculus
tgcttctctctgcatgtccttcatt

SEQ ID NO: 876356 - DNA, 25 bp, Mus musculus
tgcttctctctggatgtccttcatt

SEQ ID NO: 876357 - DNA, 25 bp, Mus musculus
tgcttctctcttcagtaactggcag

SEQ ID NO: 876358 - DNA, 25 bp, Mus musculus
tgcttctctcttgagtaactggcag

SEQ ID NO: 876359 - DNA, 25 bp, Mus musculus
tgcttctctgagatggccccagtat

SEQ ID NO: 876360 - DNA, 25 bp, Mus musculus
tgcttctctgagttggccccagtat

SEQ ID NO: 876361 - DNA, 25 bp, Mus musculus
tgcttctctgtccaagttgttgttc

SEQ ID NO: 876362 - DNA, 25 bp, Mus musculus
tgcttctctgtcgaagttgttgttc

SEQ ID NO: 876363 - DNA, 25 bp, Mus musculus
tgcttctcttgaccttccttaaaat

SEQ ID NO: 876364 - DNA, 25 bp, Mus musculus
tgcttctcttgagcttccttaaaat

SEQ ID NO: 876365 - DNA, 25 bp, Mus musculus
tgcttctgacaactgcctacagctt

SEQ ID NO: 876366 - DNA, 25 bp, Mus musculus
tgcttctgacaagtgcctacagctt

SEQ ID NO: 876367 - DNA, 25 bp, Mus musculus
tgcttctgagttcttgtttttgagc

SEQ ID NO: 876368 - DNA, 25 bp, Mus musculus
tgcttctgagttgttgtttttgagc

SEQ ID NO: 876369 - DNA, 25 bp, Mus musculus
tgcttctgatgcagttctggcttga

SEQ ID NO: 876370 - DNA, 25 bp, Mus musculus
tgcttctgatgctgttctggcttga

SEQ ID NO: 876371 - DNA, 25 bp, Mus musculus
tgcttctgcactcgtgtcttgagaa

SEQ ID NO: 876372 - DNA, 25 bp, Mus musculus
tgcttctgcactggtgtcttgagaa

SEQ ID NO: 876373 - DNA, 25 bp, Mus musculus
tgcttctgccaaaaccacaatttat

SEQ ID NO: 876374 - DNA, 25 bp, Mus musculus
tgcttctgccaaccggaagcacaga

SEQ ID NO: 876375 - DNA, 25 bp, Mus musculus
tgcttctgccaagcggaagcacaga

SEQ ID NO: 876376 - DNA, 25 bp, Mus musculus
tgcttctgccaataccacaatttat

SEQ ID NO: 876377 - DNA, 25 bp, Mus musculus
tgcttctgctccaagagatcctagt

SEQ ID NO: 876378 - DNA, 25 bp, Mus musculus
tgcttctgctcctagagatcctagt

SEQ ID NO: 876379 - DNA, 25 bp, Mus musculus
tgcttctgctgtcactttgatatgc

SEQ ID NO: 876380 - DNA, 25 bp, Mus musculus
tgcttctgctgtgactttgatatgc

SEQ ID NO: 876381 - DNA, 25 bp, Mus musculus
tgcttctgcttcaaagtgttggaat

SEQ ID NO: 876382 - DNA, 25 bp, Mus musculus
tgcttctgcttctaagtgttggaat

SEQ ID NO: 876383 - DNA, 25 bp, Mus musculus
tgcttctggagaatgacgtacttca

SEQ ID NO: 876384 - DNA, 25 bp, Mus musculus
tgcttctggagattgacgtacttca

SEQ ID NO: 876385 - DNA, 25 bp, Mus musculus
tgcttctggagcagatcctatgcca

SEQ ID NO: 876386 - DNA, 25 bp, Mus musculus
tgcttctggagctgatcctatgcca

SEQ ID NO: 876387 - DNA, 25 bp, Mus musculus
tgcttctggccaccgcgtgttccct

SEQ ID NO: 876388 - DNA, 25 bp, Mus musculus
tgcttctggccagcgcgtgttccct

SEQ ID NO: 876389 - DNA, 25 bp, Mus musculus
tgcttctggctcatttgttggagtt

SEQ ID NO: 876390 - DNA, 25 bp, Mus musculus
tgcttctggctcttttgttggagtt

SEQ ID NO: 876391 - DNA, 25 bp, Mus musculus
tgcttctggctgctacgtctgtgac

SEQ ID NO: 876392 - DNA, 25 bp, Mus musculus
tgcttctggctggtacgtctgtgac

SEQ ID NO: 876393 - DNA, 25 bp, Mus musculus
tgcttctgggccagcgactggacac

SEQ ID NO: 876394 - DNA, 25 bp, Mus musculus
tgcttctgggcctgcgactggacac

SEQ ID NO: 876395 - DNA, 25 bp, Mus musculus
tgcttctgggtacctgagtctagag

SEQ ID NO: 876396 - DNA, 25 bp, Mus musculus
tgcttctgggtagctgagtctagag

SEQ ID NO: 876397 - DNA, 25 bp, Mus musculus
tgcttctggtcaaatgaccccaggg

SEQ ID NO: 876398 - DNA, 25 bp, Mus musculus
tgcttctggtcatatgaccccaggg

SEQ ID NO: 876399 - DNA, 25 bp, Mus musculus
tgcttctgtatgagtactccctcct

SEQ ID NO: 876400 - DNA, 25 bp, Mus musculus
tgcttctgtatgtgtactccctcct

SEQ ID NO: 876401 - DNA, 25 bp, Mus musculus
tgcttctgtcctacaatgactccag

SEQ ID NO: 876402 - DNA, 25 bp, Mus musculus
tgcttctgtccttcaatgactccag

SEQ ID NO: 876403 - DNA, 25 bp, Mus musculus
tgcttctgtcgacactttcttactg

SEQ ID NO: 876404 - DNA, 25 bp, Mus musculus
tgcttctgtcgagactttcttactg

SEQ ID NO: 876405 - DNA, 25 bp, Mus musculus
tgcttctgtctgacctgttaatgtc

SEQ ID NO: 876406 - DNA, 25 bp, Mus musculus
tgcttctgtctgtcctgttaatgtc

SEQ ID NO: 876407 - DNA, 25 bp, Mus musculus
tgcttctgtgatattcccctggtcc

SEQ ID NO: 876408 - DNA, 25 bp, Mus musculus
tgcttctgtgattttcccctggtcc

SEQ ID NO: 876409 - DNA, 25 bp, Mus musculus
tgcttctgtgccaataagactattg

SEQ ID NO: 876410 - DNA, 25 bp, Mus musculus
tgcttctgtgcctataagactattg

SEQ ID NO: 876411 - DNA, 25 bp, Mus musculus
tgcttctgtgtgatgactgtcttca

SEQ ID NO: 876412 - DNA, 25 bp, Mus musculus
tgcttctgtgtgttgactgtcttca

SEQ ID NO: 876413 - DNA, 25 bp, Mus musculus
tgcttctgttcaagatgccaccatt

SEQ ID NO: 876414 - DNA, 25 bp, Mus musculus
tgcttctgttcatgatgccaccatt

SEQ ID NO: 876415 - DNA, 25 bp, Mus musculus
tgcttctgtttgatcgttctaggat

SEQ ID NO: 876416 - DNA, 25 bp, Mus musculus
tgcttctgtttgttcgttctaggat

SEQ ID NO: 876417 - DNA, 25 bp, Mus musculus
tgcttcttaaagacacggtcgttgt

SEQ ID NO: 876418 - DNA, 25 bp, Mus musculus
tgcttcttaaagtcacggtcgttgt

SEQ ID NO: 876419 - DNA, 25 bp, Mus musculus
tgcttcttagttcgtctgacccctc

SEQ ID NO: 876420 - DNA, 25 bp, Mus musculus
tgcttcttagttggtctgacccctc

SEQ ID NO: 876421 - DNA, 25 bp, Mus musculus
tgcttcttatatagcccctcagcac

SEQ ID NO: 876422 - DNA, 25 bp, Mus musculus
tgcttcttatattgcccctcagcac

SEQ ID NO: 876423 - DNA, 25 bp, Mus musculus
tgcttcttatgtatgagtatatcac

SEQ ID NO: 876424 - DNA, 25 bp, Mus musculus
tgcttcttatgtttgagtatatcac

SEQ ID NO: 876425 - DNA, 25 bp, Mus musculus
tgcttcttcacgagacctgacagtg

SEQ ID NO: 876426 - DNA, 25 bp, Mus musculus
tgcttcttcacgtgacctgacagtg

SEQ ID NO: 876427 - DNA, 25 bp, Mus musculus
tgcttcttcaggctcggcagaaaga

SEQ ID NO: 876428 - DNA, 25 bp, Mus musculus
tgcttcttcagggtcggcagaaaga

SEQ ID NO: 876429 - DNA, 25 bp, Mus musculus
tgcttcttccttaaatcccctatat

SEQ ID NO: 876430 - DNA, 25 bp, Mus musculus
tgcttcttcctttaatcccctatat

SEQ ID NO: 876431 - DNA, 25 bp, Mus musculus
tgcttcttctgaaagggtctctgct

SEQ ID NO: 876432 - DNA, 25 bp, Mus musculus
tgcttcttctgatagggtctctgct

SEQ ID NO: 876433 - DNA, 25 bp, Mus musculus
tgcttcttctgcagagcagccaaga

SEQ ID NO: 876434 - DNA, 25 bp, Mus musculus
tgcttcttctgctgagcagccaaga

SEQ ID NO: 876435 - DNA, 25 bp, Mus musculus
tgcttcttggccaggtactttttta

SEQ ID NO: 876436 - DNA, 25 bp, Mus musculus
tgcttcttggcctggtactttttta

SEQ ID NO: 876437 - DNA, 25 bp, Mus musculus
tgcttcttggctctgacgttcccct

SEQ ID NO: 876438 - DNA, 25 bp, Mus musculus
tgcttcttggctgtgacgttcccct

SEQ ID NO: 876439 - DNA, 25 bp, Mus musculus
tgcttcttggtcatccactgtcaaa

SEQ ID NO: 876440 - DNA, 25 bp, Mus musculus
tgcttcttggtcttccactgtcaaa

SEQ ID NO: 876441 - DNA, 25 bp, Mus musculus
tgcttcttgtccaccagtacagagt

SEQ ID NO: 876442 - DNA, 25 bp, Mus musculus
tgcttcttgtcctccagtacagagt

SEQ ID NO: 876443 - DNA, 25 bp, Mus musculus
tgcttcttgtttacccctgagactt

SEQ ID NO: 876444 - DNA, 25 bp, Mus musculus
tgcttcttgttttcccctgagactt

SEQ ID NO: 876445 - DNA, 25 bp, Mus musculus
tgcttctttaccagtgccatggagt

SEQ ID NO: 876446 - DNA, 25 bp, Mus musculus
tgcttctttacctgtgccatggagt

SEQ ID NO: 876447 - DNA, 25 bp, Mus musculus
tgcttctttagtacaggccatggaa

SEQ ID NO: 876448 - DNA, 25 bp, Mus musculus
tgcttctttagttcaggccatggaa

SEQ ID NO: 876449 - DNA, 25 bp, Mus musculus
tgcttctttatactgtgactctcct

SEQ ID NO: 876450 - DNA, 25 bp, Mus musculus
tgcttctttatagtgtgactctcct

SEQ ID NO: 876451 - DNA, 25 bp, Mus musculus
tgcttctttgttatgcagccgaaag

SEQ ID NO: 876452 - DNA, 25 bp, Mus musculus
tgcttctttgttttgcagccgaaag

SEQ ID NO: 876453 - DNA, 25 bp, Mus musculus
tgcttctttttcactgtatcagtta

SEQ ID NO: 876454 - DNA, 25 bp, Mus musculus
tgcttctttttctctgtatcagtta

SEQ ID NO: 876455 - DNA, 25 bp, Mus musculus
tgcttgaaaccgaatctgatgcttg

SEQ ID NO: 876456 - DNA, 25 bp, Mus musculus
tgcttgaaaccgtatctgatgcttg

SEQ ID NO: 876457 - DNA, 25 bp, Mus musculus
tgcttgaagcttagatttcaaccct

SEQ ID NO: 876458 - DNA, 25 bp, Mus musculus
tgcttgaagctttgatttcaaccct

SEQ ID NO: 876459 - DNA, 25 bp, Mus musculus
tgcttgaagtggcatcccctctgct

SEQ ID NO: 876460 - DNA, 25 bp, Mus musculus
tgcttgaagtgggatcccctctgct

SEQ ID NO: 876461 - DNA, 25 bp, Mus musculus
tgcttgacacacatgggctcttttt

SEQ ID NO: 876462 - DNA, 25 bp, Mus musculus
tgcttgacacacttgggctcttttt

SEQ ID NO: 876463 - DNA, 25 bp, Mus musculus
tgcttgacacccatggctgaaatgc

SEQ ID NO: 876464 - DNA, 25 bp, Mus musculus
tgcttgacacccttggctgaaatgc

SEQ ID NO: 876465 - DNA, 25 bp, Mus musculus
tgcttgacaggtaaacttgtccggg

SEQ ID NO: 876466 - DNA, 25 bp, Mus musculus
tgcttgacaggttaacttgtccggg

SEQ ID NO: 876467 - DNA, 25 bp, Mus musculus
tgcttgacagttacatcagttctct

SEQ ID NO: 876468 - DNA, 25 bp, Mus musculus
tgcttgacagtttcatcagttctct

SEQ ID NO: 876469 - DNA, 25 bp, Mus musculus
tgcttgacattgcaaaccgcactgg

SEQ ID NO: 876470 - DNA, 25 bp, Mus musculus
tgcttgacattggaaaccgcactgg

SEQ ID NO: 876471 - DNA, 25 bp, Mus musculus
tgcttgaccaaacccactttcaaaa

SEQ ID NO: 876472 - DNA, 25 bp, Mus musculus
tgcttgaccaaagccactttcaaaa

SEQ ID NO: 876473 - DNA, 25 bp, Mus musculus
tgcttgaccagaatccatcctatga

SEQ ID NO: 876474 - DNA, 25 bp, Mus musculus
tgcttgaccagattccatcctatga

SEQ ID NO: 876475 - DNA, 25 bp, Mus musculus
tgcttgacctgcaagtactgtacac

SEQ ID NO: 876476 - DNA, 25 bp, Mus musculus
tgcttgacctgctagtactgtacac

SEQ ID NO: 876477 - DNA, 25 bp, Mus musculus
tgcttgaccttaaccatctgtttag

SEQ ID NO: 876478 - DNA, 25 bp, Mus musculus
tgcttgaccttatccatctgtttag

SEQ ID NO: 876479 - DNA, 25 bp, Mus musculus
tgcttgacgtcaccttcaactgtga

SEQ ID NO: 876480 - DNA, 25 bp, Mus musculus
tgcttgacgtcagcttcaactgtga

SEQ ID NO: 876481 - DNA, 25 bp, Mus musculus
tgcttgacgtgtccattaaacctca

SEQ ID NO: 876482 - DNA, 25 bp, Mus musculus
tgcttgacgtgtgcattaaacctca

SEQ ID NO: 876483 - DNA, 25 bp, Mus musculus
tgcttgactgaaatccctcgatgga

SEQ ID NO: 876484 - DNA, 25 bp, Mus musculus
tgcttgactgaattccctcgatgga

SEQ ID NO: 876485 - DNA, 25 bp, Mus musculus
tgcttgagaagcactcgctggcagc

SEQ ID NO: 876486 - DNA, 25 bp, Mus musculus
tgcttgagaagctctcgctggcagc

SEQ ID NO: 876487 - DNA, 25 bp, Mus musculus
tgcttgagctagagtgcccctagtc

SEQ ID NO: 876488 - DNA, 25 bp, Mus musculus
tgcttgagctagtgtgcccctagtc

SEQ ID NO: 876489 - DNA, 25 bp, Mus musculus
tgcttgatacaccttgaacttcctc

SEQ ID NO: 876490 - DNA, 25 bp, Mus musculus
tgcttgatacacgttgaacttcctc

SEQ ID NO: 876491 - DNA, 25 bp, Mus musculus
tgcttgatcgctcgcccgatgatct

SEQ ID NO: 876492 - DNA, 25 bp, Mus musculus
tgcttgatcgctggcccgatgatct

SEQ ID NO: 876493 - DNA, 25 bp, Mus musculus
tgcttgatggatcaggtacgcccct

SEQ ID NO: 876494 - DNA, 25 bp, Mus musculus
tgcttgatggatgaggtacgcccct

SEQ ID NO: 876495 - DNA, 25 bp, Mus musculus
tgcttgattgtgactgcagggacca

SEQ ID NO: 876496 - DNA, 25 bp, Mus musculus
tgcttgattgtgtctgcagggacca

SEQ ID NO: 876497 - DNA, 25 bp, Mus musculus
tgcttgattttgacctctctaggta

SEQ ID NO: 876498 - DNA, 25 bp, Mus musculus
tgcttgattttgtcctctctaggta

SEQ ID NO: 876499 - DNA, 25 bp, Mus musculus
tgcttgcaagcacagcctgagagtc

SEQ ID NO: 876500 - DNA, 25 bp, Mus musculus
tgcttgcaagcagagcctgagagtc

SEQ ID NO: 876501 - DNA, 25 bp, Mus musculus
tgcttgcacccacaaattttccaat

SEQ ID NO: 876502 - DNA, 25 bp, Mus musculus
tgcttgcacccagaaattttccaat

SEQ ID NO: 876503 - DNA, 25 bp, Mus musculus
tgcttgcaccctccagtgcagaaag

SEQ ID NO: 876504 - DNA, 25 bp, Mus musculus
tgcttgcaccctgcagtgcagaaag

SEQ ID NO: 876505 - DNA, 25 bp, Mus musculus
tgcttgcactccatttctttagaga

SEQ ID NO: 876506 - DNA, 25 bp, Mus musculus
tgcttgcactccttttctttagaga

SEQ ID NO: 876507 - DNA, 25 bp, Mus musculus
tgcttgcagccacgtcttgatgacc

SEQ ID NO: 876508 - DNA, 25 bp, Mus musculus
tgcttgcagccaggtcttgatgacc

SEQ ID NO: 876509 - DNA, 25 bp, Mus musculus
tgcttgcaggtaaaggtgcaggcca

SEQ ID NO: 876510 - DNA, 25 bp, Mus musculus
tgcttgcaggtataggtgcaggcca

SEQ ID NO: 876511 - DNA, 25 bp, Mus musculus
tgcttgcaggtcacactacaacatg

SEQ ID NO: 876512 - DNA, 25 bp, Mus musculus
tgcttgcaggtctcactacaacatg

SEQ ID NO: 876513 - DNA, 25 bp, Mus musculus
tgcttgcagtctatttcattcctat

SEQ ID NO: 876514 - DNA, 25 bp, Mus musculus
tgcttgcagtctttttcattcctat

SEQ ID NO: 876515 - DNA, 25 bp, Mus musculus
tgcttgcatatcagtgccctcagga

SEQ ID NO: 876516 - DNA, 25 bp, Mus musculus
tgcttgcatatctgtgccctcagga

SEQ ID NO: 876517 - DNA, 25 bp, Mus musculus
tgcttgcatgccagtgccagaggag

SEQ ID NO: 876518 - DNA, 25 bp, Mus musculus
tgcttgcatgcctgtgccagaggag

SEQ ID NO: 876519 - DNA, 25 bp, Mus musculus
tgcttgcattatattgcgttactgt

SEQ ID NO: 876520 - DNA, 25 bp, Mus musculus
tgcttgcattattttgcgttactgt

SEQ ID NO: 876521 - DNA, 25 bp, Mus musculus
tgcttgcattctctccttatttata

SEQ ID NO: 876522 - DNA, 25 bp, Mus musculus
tgcttgcattctgtccttatttata

SEQ ID NO: 876523 - DNA, 25 bp, Mus musculus
tgcttgcattgaaaagccctgactt

SEQ ID NO: 876524 - DNA, 25 bp, Mus musculus
tgcttgcattgataagccctgactt

SEQ ID NO: 876525 - DNA, 25 bp, Mus musculus
tgcttgcatttccagggagaccgtg

SEQ ID NO: 876526 - DNA, 25 bp, Mus musculus
tgcttgcatttcgagggagaccgtg

SEQ ID NO: 876527 - DNA, 25 bp, Mus musculus
tgcttgccaccgagattaagaccct

SEQ ID NO: 876528 - DNA, 25 bp, Mus musculus
tgcttgccaccgtgattaagaccct

SEQ ID NO: 876529 - DNA, 25 bp, Mus musculus
tgcttgccatccagccaggaggtct

SEQ ID NO: 876530 - DNA, 25 bp, Mus musculus
tgcttgccatcctgccaggaggtct

SEQ ID NO: 876531 - DNA, 25 bp, Mus musculus
tgcttgcccactccagggagcagga

SEQ ID NO: 876532 - DNA, 25 bp, Mus musculus
tgcttgcccactgcagggagcagga

SEQ ID NO: 876533 - DNA, 25 bp, Mus musculus
tgcttgcccagcatgaacaagttcc

SEQ ID NO: 876534 - DNA, 25 bp, Mus musculus
tgcttgcccagcttgaacaagttcc

SEQ ID NO: 876535 - DNA, 25 bp, Mus musculus
tgcttgccccagatagagttccaat

SEQ ID NO: 876536 - DNA, 25 bp, Mus musculus
tgcttgccccagttagagttccaat

SEQ ID NO: 876537 - DNA, 25 bp, Mus musculus
tgcttgcccggtctatacacagttc

SEQ ID NO: 876538 - DNA, 25 bp, Mus musculus
tgcttgcccggtgtatacacagttc

SEQ ID NO: 876539 - DNA, 25 bp, Mus musculus
tgcttgcccttcatgccacgattaa

SEQ ID NO: 876540 - DNA, 25 bp, Mus musculus
tgcttgcccttcttgccacgattaa

SEQ ID NO: 876541 - DNA, 25 bp, Mus musculus
tgcttgccgggactattggacctac

SEQ ID NO: 876542 - DNA, 25 bp, Mus musculus
tgcttgccgggagtattggacctac

SEQ ID NO: 876543 - DNA, 25 bp, Mus musculus
tgcttgcctcaaatactgtctgttt

SEQ ID NO: 876544 - DNA, 25 bp, Mus musculus
tgcttgcctcaattactgtctgttt

SEQ ID NO: 876545 - DNA, 25 bp, Mus musculus
tgcttgcctccacttccagataagt

SEQ ID NO: 876546 - DNA, 25 bp, Mus musculus
tgcttgcctccagttccagataagt

SEQ ID NO: 876547 - DNA, 25 bp, Mus musculus
tgcttgcctgcaccagagtgggaac

SEQ ID NO: 876548 - DNA, 25 bp, Mus musculus
tgcttgcctgcagcagagtgggaac

SEQ ID NO: 876549 - DNA, 25 bp, Mus musculus
tgcttgcctgctacattgtgtgcca

SEQ ID NO: 876550 - DNA, 25 bp, Mus musculus
tgcttgcctgcttcattgtgtgcca

SEQ ID NO: 876551 - DNA, 25 bp, Mus musculus
tgcttgcctggcaaaaatccttcat

SEQ ID NO: 876552 - DNA, 25 bp, Mus musculus
tgcttgcctggctaaaatccttcat

SEQ ID NO: 876553 - DNA, 25 bp, Mus musculus
tgcttgcctgttagctccgtgcaga

SEQ ID NO: 876554 - DNA, 25 bp, Mus musculus
tgcttgcctgtttgctccgtgcaga

SEQ ID NO: 876555 - DNA, 25 bp, Mus musculus
tgcttgcgacgtctgtggacctgta

SEQ ID NO: 876556 - DNA, 25 bp, Mus musculus
tgcttgcgacgtgtgtggacctgta

SEQ ID NO: 876557 - DNA, 25 bp, Mus musculus
tgcttgcgggctctatatgaaactc

SEQ ID NO: 876558 - DNA, 25 bp, Mus musculus
tgcttgcgggctgtatatgaaactc

SEQ ID NO: 876559 - DNA, 25 bp, Mus musculus
tgcttgctaccaaaggacaaactct

SEQ ID NO: 876560 - DNA, 25 bp, Mus musculus
tgcttgctaccataggacaaactct

SEQ ID NO: 876561 - DNA, 25 bp, Mus musculus
tgcttgctactacgttgtttggctt

SEQ ID NO: 876562 - DNA, 25 bp, Mus musculus
tgcttgctactaggttgtttggctt

SEQ ID NO: 876563 - DNA, 25 bp, Mus musculus
tgcttgctagttaattgctttggag

SEQ ID NO: 876564 - DNA, 25 bp, Mus musculus
tgcttgctagtttattgctttggag

SEQ ID NO: 876565 - DNA, 25 bp, Mus musculus
tgcttgctatacacatctccttgtg

SEQ ID NO: 876566 - DNA, 25 bp, Mus musculus
tgcttgctatactcatctccttgtg

SEQ ID NO: 876567 - DNA, 25 bp, Mus musculus
tgcttgctcagaaggaaggactccc

SEQ ID NO: 876568 - DNA, 25 bp, Mus musculus
tgcttgctcagatggaaggactccc

SEQ ID NO: 876569 - DNA, 25 bp, Mus musculus
tgcttgctccacagtatacttggat

SEQ ID NO: 876570 - DNA, 25 bp, Mus musculus
tgcttgctccactgtatacttggat

SEQ ID NO: 876571 - DNA, 25 bp, Mus musculus
tgcttgctccatacatgaattctta

SEQ ID NO: 876572 - DNA, 25 bp, Mus musculus
tgcttgctccattcatgaattctta

SEQ ID NO: 876573 - DNA, 25 bp, Mus musculus
tgcttgctcctgattgtgctgcgga

SEQ ID NO: 876574 - DNA, 25 bp, Mus musculus
tgcttgctcctgtttgtgctgcgga

SEQ ID NO: 876575 - DNA, 25 bp, Mus musculus
tgcttgctcggcagccatgggtgtc

SEQ ID NO: 876576 - DNA, 25 bp, Mus musculus
tgcttgctcggctgccatgggtgtc

SEQ ID NO: 876577 - DNA, 25 bp, Mus musculus
tgcttgctctcaagagtttgctcaa

SEQ ID NO: 876578 - DNA, 25 bp, Mus musculus
tgcttgctctcatgagtttgctcaa

SEQ ID NO: 876579 - DNA, 25 bp, Mus musculus
tgcttgctgaatcctgtgactcata

SEQ ID NO: 876580 - DNA, 25 bp, Mus musculus
tgcttgctgaatgctgtgactcata

SEQ ID NO: 876581 - DNA, 25 bp, Mus musculus
tgcttgctgactacatctctgtggc

SEQ ID NO: 876582 - DNA, 25 bp, Mus musculus
tgcttgctgactcggtttcacacac

SEQ ID NO: 876583 - DNA, 25 bp, Mus musculus
tgcttgctgactgggtttcacacac

SEQ ID NO: 876584 - DNA, 25 bp, Mus musculus
tgcttgctgacttcatctctgtggc

SEQ ID NO: 876585 - DNA, 25 bp, Mus musculus
tgcttgctgagcattatcttctaaa

SEQ ID NO: 876586 - DNA, 25 bp, Mus musculus
tgcttgctgagcctttgttatctca

SEQ ID NO: 876587 - DNA, 25 bp, Mus musculus
tgcttgctgagcgtttgttatctca

SEQ ID NO: 876588 - DNA, 25 bp, Mus musculus
tgcttgctgagctttatcttctaaa

SEQ ID NO: 876589 - DNA, 25 bp, Mus musculus
tgcttgctgataatatttagagaac

SEQ ID NO: 876590 - DNA, 25 bp, Mus musculus
tgcttgctgatattatttagagaac

SEQ ID NO: 876591 - DNA, 25 bp, Mus musculus
tgcttgctgcacaattcggtttcca

SEQ ID NO: 876592 - DNA, 25 bp, Mus musculus
tgcttgctgcactattcggtttcca

SEQ ID NO: 876593 - DNA, 25 bp, Mus musculus
tgcttgctgccaatagtaaccttag

SEQ ID NO: 876594 - DNA, 25 bp, Mus musculus
tgcttgctgccattagtaaccttag

SEQ ID NO: 876595 - DNA, 25 bp, Mus musculus
tgcttgctggaactcgagcctgcat

SEQ ID NO: 876596 - DNA, 25 bp, Mus musculus
tgcttgctggaagtcgagcctgcat

SEQ ID NO: 876597 - DNA, 25 bp, Mus musculus
tgcttgctgtttcacctggaaacca

SEQ ID NO: 876598 - DNA, 25 bp, Mus musculus
tgcttgctgtttctcaactttctga

SEQ ID NO: 876599 - DNA, 25 bp, Mus musculus
tgcttgctgtttgacctggaaacca

SEQ ID NO: 876600 - DNA, 25 bp, Mus musculus
tgcttgctgtttgtcaactttctga

SEQ ID NO: 876601 - DNA, 25 bp, Mus musculus
tgcttgcttaagctactgttcccag

SEQ ID NO: 876602 - DNA, 25 bp, Mus musculus
tgcttgcttaaggtactgttcccag

SEQ ID NO: 876603 - DNA, 25 bp, Mus musculus
tgcttgcttattatgatttaggcca

SEQ ID NO: 876604 - DNA, 25 bp, Mus musculus
tgcttgcttattttgatttaggcca

SEQ ID NO: 876605 - DNA, 25 bp, Mus musculus
tgcttgcttccactatgacagaaga

SEQ ID NO: 876606 - DNA, 25 bp, Mus musculus
tgcttgcttccagtatgacagaaga

SEQ ID NO: 876607 - DNA, 25 bp, Mus musculus
tgcttgcttcgacccagccaatcag

SEQ ID NO: 876608 - DNA, 25 bp, Mus musculus
tgcttgcttcgagccagccaatcag

SEQ ID NO: 876609 - DNA, 25 bp, Mus musculus
tgcttgcttctaagtaattcctgtc

SEQ ID NO: 876610 - DNA, 25 bp, Mus musculus
tgcttgcttctatgtaattcctgtc

SEQ ID NO: 876611 - DNA, 25 bp, Mus musculus
tgcttgcttgatcagagcccggttt

SEQ ID NO: 876612 - DNA, 25 bp, Mus musculus
tgcttgcttgatgagagcccggttt

SEQ ID NO: 876613 - DNA, 25 bp, Mus musculus
tgcttgctttagatgttacagggct

SEQ ID NO: 876614 - DNA, 25 bp, Mus musculus
tgcttgctttagttgttacagggct

SEQ ID NO: 876615 - DNA, 25 bp, Mus musculus
tgcttgctttatcccatacccatct

SEQ ID NO: 876616 - DNA, 25 bp, Mus musculus
tgcttgctttatgccatacccatct

SEQ ID NO: 876617 - DNA, 25 bp, Mus musculus
tgcttgctttctctgaggtctgtaa

SEQ ID NO: 876618 - DNA, 25 bp, Mus musculus
tgcttgctttctgtgaggtctgtaa

SEQ ID NO: 876619 - DNA, 25 bp, Mus musculus
tgcttgcttttgagacattcattgt

SEQ ID NO: 876620 - DNA, 25 bp, Mus musculus
tgcttgcttttgtgacattcattgt

SEQ ID NO: 876621 - DNA, 25 bp, Mus musculus
tgcttggaaatgctcctgggactct

SEQ ID NO: 876622 - DNA, 25 bp, Mus musculus
tgcttggaaatggtcctgggactct

SEQ ID NO: 876623 - DNA, 25 bp, Mus musculus
tgcttggacaagaacctctgacaga

SEQ ID NO: 876624 - DNA, 25 bp, Mus musculus
tgcttggacaagtacctctgacaga

SEQ ID NO: 876625 - DNA, 25 bp, Mus musculus
tgcttggacatccttttcgccttca

SEQ ID NO: 876626 - DNA, 25 bp, Mus musculus
tgcttggacatcgttttcgccttca

SEQ ID NO: 876627 - DNA, 25 bp, Mus musculus
tgcttggagaccagaaactcaggct

SEQ ID NO: 876628 - DNA, 25 bp, Mus musculus
tgcttggagacctgaaactcaggct

SEQ ID NO: 876629 - DNA, 25 bp, Mus musculus
tgcttggagcacagaccctgtttta

SEQ ID NO: 876630 - DNA, 25 bp, Mus musculus
tgcttggagcactgaccctgtttta

SEQ ID NO: 876631 - DNA, 25 bp, Mus musculus
tgcttggatttccatctctagccag

SEQ ID NO: 876632 - DNA, 25 bp, Mus musculus
tgcttggatttcctacgcccccagg

SEQ ID NO: 876633 - DNA, 25 bp, Mus musculus
tgcttggatttcgatctctagccag

SEQ ID NO: 876634 - DNA, 25 bp, Mus musculus
tgcttggatttcgtacgcccccagg

SEQ ID NO: 876635 - DNA, 25 bp, Mus musculus
tgcttggcactcacaaagatccctt

SEQ ID NO: 876636 - DNA, 25 bp, Mus musculus
tgcttggcactctcaaagatccctt

SEQ ID NO: 876637 - DNA, 25 bp, Mus musculus
tgcttggcagttaacacctcatggt

SEQ ID NO: 876638 - DNA, 25 bp, Mus musculus
tgcttggcagtttacacctcatggt

SEQ ID NO: 876639 - DNA, 25 bp, Mus musculus
tgcttggcatgtaccgtgtgccgcc

SEQ ID NO: 876640 - DNA, 25 bp, Mus musculus
tgcttggcatgttccgtgtgccgcc

SEQ ID NO: 876641 - DNA, 25 bp, Mus musculus
tgcttggccagtacggagacctcta

SEQ ID NO: 876642 - DNA, 25 bp, Mus musculus
tgcttggccagttcggagacctcta

SEQ ID NO: 876643 - DNA, 25 bp, Mus musculus
tgcttggcctccacttgcaatagtg

SEQ ID NO: 876644 - DNA, 25 bp, Mus musculus
tgcttggcctcctcttgcaatagtg

SEQ ID NO: 876645 - DNA, 25 bp, Mus musculus
tgcttggcgctactgtgtgcctgta

SEQ ID NO: 876646 - DNA, 25 bp, Mus musculus
tgcttggcgctagtgtgtgcctgta

SEQ ID NO: 876647 - DNA, 25 bp, Mus musculus
tgcttggctccccatactattacag

SEQ ID NO: 876648 - DNA, 25 bp, Mus musculus
tgcttggctcccgatactattacag

SEQ ID NO: 876649 - DNA, 25 bp, Mus musculus
tgcttggctgtaagcactgtctgta

SEQ ID NO: 876650 - DNA, 25 bp, Mus musculus
tgcttggctgtatgcactgtctgta

SEQ ID NO: 876651 - DNA, 25 bp, Mus musculus
tgcttggcttacaggctctgacctc

SEQ ID NO: 876652 - DNA, 25 bp, Mus musculus
tgcttggcttacagtgtgctgtaga

SEQ ID NO: 876653 - DNA, 25 bp, Mus musculus
tgcttggcttactggctctgacctc

SEQ ID NO: 876654 - DNA, 25 bp, Mus musculus
tgcttggcttactgtgtgctgtaga

SEQ ID NO: 876655 - DNA, 25 bp, Mus musculus
tgcttgggaatacgttttgccaata

SEQ ID NO: 876656 - DNA, 25 bp, Mus musculus
tgcttgggaataggttttgccaata

SEQ ID NO: 876657 - DNA, 25 bp, Mus musculus
tgcttgggacagcaggtaccttgct

SEQ ID NO: 876658 - DNA, 25 bp, Mus musculus
tgcttgggacaggaggtaccttgct

SEQ ID NO: 876659 - DNA, 25 bp, Mus musculus
tgcttgggacataaaactgaggctt

SEQ ID NO: 876660 - DNA, 25 bp, Mus musculus
tgcttgggacattaaactgaggctt

SEQ ID NO: 876661 - DNA, 25 bp, Mus musculus
tgcttgggagagcagtctgtacctt

SEQ ID NO: 876662 - DNA, 25 bp, Mus musculus
tgcttgggagaggagtctgtacctt

SEQ ID NO: 876663 - DNA, 25 bp, Mus musculus
tgcttgggatctcactgctcacttt

SEQ ID NO: 876664 - DNA, 25 bp, Mus musculus
tgcttgggatctgactgctcacttt

SEQ ID NO: 876665 - DNA, 25 bp, Mus musculus
tgcttgggcagtctctggctagcat

SEQ ID NO: 876666 - DNA, 25 bp, Mus musculus
tgcttgggcagtgtctggctagcat

SEQ ID NO: 876667 - DNA, 25 bp, Mus musculus
tgcttgggctacctccgatgacaga

SEQ ID NO: 876668 - DNA, 25 bp, Mus musculus
tgcttgggctacgtccgatgacaga

SEQ ID NO: 876669 - DNA, 25 bp, Mus musculus
tgcttgggctttatcaggttggttt

SEQ ID NO: 876670 - DNA, 25 bp, Mus musculus
tgcttgggctttttcaggttggttt

SEQ ID NO: 876671 - DNA, 25 bp, Mus musculus
tgcttgggtcacagtcgccttgaac

SEQ ID NO: 876672 - DNA, 25 bp, Mus musculus
tgcttgggtcactgtcgccttgaac

SEQ ID NO: 876673 - DNA, 25 bp, Mus musculus
tgcttggtaagcctcaacactgtga

SEQ ID NO: 876674 - DNA, 25 bp, Mus musculus
tgcttggtaagcgtcaacactgtga

SEQ ID NO: 876675 - DNA, 25 bp, Mus musculus
tgcttggtcacacgctgggatcaga

SEQ ID NO: 876676 - DNA, 25 bp, Mus musculus
tgcttggtcacaggctgggatcaga

SEQ ID NO: 876677 - DNA, 25 bp, Mus musculus
tgcttggtccaaatacttgtgtgtt

SEQ ID NO: 876678 - DNA, 25 bp, Mus musculus
tgcttggtccaattacttgtgtgtt

SEQ ID NO: 876679 - DNA, 25 bp, Mus musculus
tgcttggtccggcttagactatttt

SEQ ID NO: 876680 - DNA, 25 bp, Mus musculus
tgcttggtccgggttagactatttt

SEQ ID NO: 876681 - DNA, 25 bp, Mus musculus
tgcttggtcctccatcacaggttat

SEQ ID NO: 876682 - DNA, 25 bp, Mus musculus
tgcttggtcctcgatcacaggttat

SEQ ID NO: 876683 - DNA, 25 bp, Mus musculus
tgcttggtccttcctcaatgtgctg

SEQ ID NO: 876684 - DNA, 25 bp, Mus musculus
tgcttggtccttgctcaatgtgctg

SEQ ID NO: 876685 - DNA, 25 bp, Mus musculus
tgcttggtctagatgcacctgcatt

SEQ ID NO: 876686 - DNA, 25 bp, Mus musculus
tgcttggtctagttgcacctgcatt

SEQ ID NO: 876687 - DNA, 25 bp, Mus musculus
tgcttggtcttccttgccatagatg

SEQ ID NO: 876688 - DNA, 25 bp, Mus musculus
tgcttggtcttcgttgccatagatg

SEQ ID NO: 876689 - DNA, 25 bp, Mus musculus
tgcttggtcttgagcgggtacccat

SEQ ID NO: 876690 - DNA, 25 bp, Mus musculus
tgcttggtcttgtgcgggtacccat

SEQ ID NO: 876691 - DNA, 25 bp, Mus musculus
tgcttggtgcagattctatgcagtt

SEQ ID NO: 876692 - DNA, 25 bp, Mus musculus
tgcttggtgcagtttctatgcagtt

SEQ ID NO: 876693 - DNA, 25 bp, Mus musculus
tgcttggtgcctcaagagtccagaa

SEQ ID NO: 876694 - DNA, 25 bp, Mus musculus
tgcttggtgcctgaagagtccagaa

SEQ ID NO: 876695 - DNA, 25 bp, Mus musculus
tgcttggtggccatcaggatctgtg

SEQ ID NO: 876696 - DNA, 25 bp, Mus musculus
tgcttggtggccttcaggatctgtg

SEQ ID NO: 876697 - DNA, 25 bp, Mus musculus
tgcttggtttaaaggcctgtgccgc

SEQ ID NO: 876698 - DNA, 25 bp, Mus musculus
tgcttggtttaatggcctgtgccgc

SEQ ID NO: 876699 - DNA, 25 bp, Mus musculus
tgcttggttttcagtgatagacatg

SEQ ID NO: 876700 - DNA, 25 bp, Mus musculus
tgcttggttttctgtgatagacatg

SEQ ID NO: 876701 - DNA, 25 bp, Mus musculus
tgcttgtaaacaactctggactttt

SEQ ID NO: 876702 - DNA, 25 bp, Mus musculus
tgcttgtaaacatctctggactttt

SEQ ID NO: 876703 - DNA, 25 bp, Mus musculus
tgcttgtaagagactgggtttccct

SEQ ID NO: 876704 - DNA, 25 bp, Mus musculus
tgcttgtaagagtctgggtttccct

SEQ ID NO: 876705 - DNA, 25 bp, Mus musculus
tgcttgtacaagcttgccaaagata

SEQ ID NO: 876706 - DNA, 25 bp, Mus musculus
tgcttgtacaaggttgccaaagata

SEQ ID NO: 876707 - DNA, 25 bp, Mus musculus
tgcttgtagatcactctctttgaat

SEQ ID NO: 876708 - DNA, 25 bp, Mus musculus
tgcttgtagatctctctctttgaat

SEQ ID NO: 876709 - DNA, 25 bp, Mus musculus
tgcttgtatagcatttatctgcggc

SEQ ID NO: 876710 - DNA, 25 bp, Mus musculus
tgcttgtatagcttttatctgcggc

SEQ ID NO: 876711 - DNA, 25 bp, Mus musculus
tgcttgtatcatcacagactaggga

SEQ ID NO: 876712 - DNA, 25 bp, Mus musculus
tgcttgtatcatgacagactaggga

SEQ ID NO: 876713 - DNA, 25 bp, Mus musculus
tgcttgtcaagcagactcgaccaga

SEQ ID NO: 876714 - DNA, 25 bp, Mus musculus
tgcttgtcaagctgactcgaccaga

SEQ ID NO: 876715 - DNA, 25 bp, Mus musculus
tgcttgtcacctcagtgagtgtcaa

SEQ ID NO: 876716 - DNA, 25 bp, Mus musculus
tgcttgtcacctgagtgagtgtcaa

SEQ ID NO: 876717 - DNA, 25 bp, Mus musculus
tgcttgtcagatactgtaccccaga

SEQ ID NO: 876718 - DNA, 25 bp, Mus musculus
tgcttgtcagattctgtaccccaga

SEQ ID NO: 876719 - DNA, 25 bp, Mus musculus
tgcttgtccagtactagtctacttt

SEQ ID NO: 876720 - DNA, 25 bp, Mus musculus
tgcttgtccagttctagtctacttt

SEQ ID NO: 876721 - DNA, 25 bp, Mus musculus
tgcttgtccctcctgagcttttcaa

SEQ ID NO: 876722 - DNA, 25 bp, Mus musculus
tgcttgtccctcgtgagcttttcaa

SEQ ID NO: 876723 - DNA, 25 bp, Mus musculus
tgcttgtctaggcttggtcccacag

SEQ ID NO: 876724 - DNA, 25 bp, Mus musculus
tgcttgtctagggttggtcccacag

SEQ ID NO: 876725 - DNA, 25 bp, Mus musculus
tgcttgtctgcacatagtggcttct

SEQ ID NO: 876726 - DNA, 25 bp, Mus musculus
tgcttgtctgcagatagtggcttct

SEQ ID NO: 876727 - DNA, 25 bp, Mus musculus
tgcttgtctggacacccaactgtca

SEQ ID NO: 876728 - DNA, 25 bp, Mus musculus
tgcttgtctggagacccaactgtca

SEQ ID NO: 876729 - DNA, 25 bp, Mus musculus
tgcttgtctgtaagtgcgccattca

SEQ ID NO: 876730 - DNA, 25 bp, Mus musculus
tgcttgtctgtatgtgcgccattca

SEQ ID NO: 876731 - DNA, 25 bp, Mus musculus
tgcttgtctttccatccttcaccgt

SEQ ID NO: 876732 - DNA, 25 bp, Mus musculus
tgcttgtctttcgatccttcaccgt

SEQ ID NO: 876733 - DNA, 25 bp, Mus musculus
tgcttgtgacatatccttcgctggt

SEQ ID NO: 876734 - DNA, 25 bp, Mus musculus
tgcttgtgacatttccttcgctggt

SEQ ID NO: 876735 - DNA, 25 bp, Mus musculus
tgcttgtgaccaactactttgtgtt

SEQ ID NO: 876736 - DNA, 25 bp, Mus musculus
tgcttgtgaccatctactttgtgtt

SEQ ID NO: 876737 - DNA, 25 bp, Mus musculus
tgcttgtgactgatagactctgtaa

SEQ ID NO: 876738 - DNA, 25 bp, Mus musculus
tgcttgtgactgttagactctgtaa

SEQ ID NO: 876739 - DNA, 25 bp, Mus musculus
tgcttgtgaggacccatctctatag

SEQ ID NO: 876740 - DNA, 25 bp, Mus musculus
tgcttgtgaggagccatctctatag

SEQ ID NO: 876741 - DNA, 25 bp, Mus musculus
tgcttgtgatccctgtacttaagag

SEQ ID NO: 876742 - DNA, 25 bp, Mus musculus
tgcttgtgatccgtgtacttaagag

SEQ ID NO: 876743 - DNA, 25 bp, Mus musculus
tgcttgtgcacaaactccttcacta

SEQ ID NO: 876744 - DNA, 25 bp, Mus musculus
tgcttgtgcacatactccttcacta

SEQ ID NO: 876745 - DNA, 25 bp, Mus musculus
tgcttgtgcagcaatcgctactcta

SEQ ID NO: 876746 - DNA, 25 bp, Mus musculus
tgcttgtgcagctatcgctactcta

SEQ ID NO: 876747 - DNA, 25 bp, Mus musculus
tgcttgtggatcagggtggctaaca

SEQ ID NO: 876748 - DNA, 25 bp, Mus musculus
tgcttgtggatctgggtggctaaca

SEQ ID NO: 876749 - DNA, 25 bp, Mus musculus
tgcttgtgggagacgctgctgaaaa

SEQ ID NO: 876750 - DNA, 25 bp, Mus musculus
tgcttgtgggagtcgctgctgaaaa

SEQ ID NO: 876751 - DNA, 25 bp, Mus musculus
tgcttgtggtccctatatttcttgt

SEQ ID NO: 876752 - DNA, 25 bp, Mus musculus
tgcttgtggtccgtatatttcttgt

SEQ ID NO: 876753 - DNA, 25 bp, Mus musculus
tgcttgttacatctctctagtggaa

SEQ ID NO: 876754 - DNA, 25 bp, Mus musculus
tgcttgttacatgtctctagtggaa

SEQ ID NO: 876755 - DNA, 25 bp, Mus musculus
tgcttgttcacacaggcagctggaa

SEQ ID NO: 876756 - DNA, 25 bp, Mus musculus
tgcttgttcacagaggcagctggaa

SEQ ID NO: 876757 - DNA, 25 bp, Mus musculus
tgcttgttcagcatattcagggaca

SEQ ID NO: 876758 - DNA, 25 bp, Mus musculus
tgcttgttcagcttattcagggaca

SEQ ID NO: 876759 - DNA, 25 bp, Mus musculus
tgcttgttcctaaagtttgtagttt

SEQ ID NO: 876760 - DNA, 25 bp, Mus musculus
tgcttgttcctatagtttgtagttt

SEQ ID NO: 876761 - DNA, 25 bp, Mus musculus
tgcttgttcggcaagcactttgcca

SEQ ID NO: 876762 - DNA, 25 bp, Mus musculus
tgcttgttcggctagcactttgcca

SEQ ID NO: 876763 - DNA, 25 bp, Mus musculus
tgcttgttctctagcaaatgtgtgt

SEQ ID NO: 876764 - DNA, 25 bp, Mus musculus
tgcttgttctcttgcaaatgtgtgt

SEQ ID NO: 876765 - DNA, 25 bp, Mus musculus
tgcttgttgaataacccacgggctg

SEQ ID NO: 876766 - DNA, 25 bp, Mus musculus
tgcttgttgaattacccacgggctg

SEQ ID NO: 876767 - DNA, 25 bp, Mus musculus
tgcttgttgacacccttcctttagc

SEQ ID NO: 876768 - DNA, 25 bp, Mus musculus
tgcttgttgacagccttcctttagc

SEQ ID NO: 876769 - DNA, 25 bp, Mus musculus
tgcttgttgccaactggccgagaga

SEQ ID NO: 876770 - DNA, 25 bp, Mus musculus
tgcttgttgccatctggccgagaga

SEQ ID NO: 876771 - DNA, 25 bp, Mus musculus
tgcttgtttacaaggcccgacaaca

SEQ ID NO: 876772 - DNA, 25 bp, Mus musculus
tgcttgtttacatggcccgacaaca

SEQ ID NO: 876773 - DNA, 25 bp, Mus musculus
tgcttgtttctcacagtgctggcac

SEQ ID NO: 876774 - DNA, 25 bp, Mus musculus
tgcttgtttctcctagccaatgcct

SEQ ID NO: 876775 - DNA, 25 bp, Mus musculus
tgcttgtttctcgtagccaatgcct

SEQ ID NO: 876776 - DNA, 25 bp, Mus musculus
tgcttgtttctctcagtgctggcac

SEQ ID NO: 876777 - DNA, 25 bp, Mus musculus
tgcttgtttgtactttttgagtcaa

SEQ ID NO: 876778 - DNA, 25 bp, Mus musculus
tgcttgtttgtagtttttgagtcaa

SEQ ID NO: 876779 - DNA, 25 bp, Mus musculus
tgcttgtttttacgttgccgaaaca

SEQ ID NO: 876780 - DNA, 25 bp, Mus musculus
tgcttgtttttaggttgccgaaaca

SEQ ID NO: 876781 - DNA, 25 bp, Mus musculus
tgctttaaaaagaaggcacctcagc

SEQ ID NO: 876782 - DNA, 25 bp, Mus musculus
tgctttaaaaagtaggcacctcagc

SEQ ID NO: 876783 - DNA, 25 bp, Mus musculus
tgctttaaacaaccgaaaccttatg

SEQ ID NO: 876784 - DNA, 25 bp, Mus musculus
tgctttaaacaagcgaaaccttatg

SEQ ID NO: 876785 - DNA, 25 bp, Mus musculus
tgctttaaagccagtgtgggtttgc

SEQ ID NO: 876786 - DNA, 25 bp, Mus musculus
tgctttaaagcctgtgtgggtttgc

SEQ ID NO: 876787 - DNA, 25 bp, Mus musculus
tgctttaacacccaaacttacctgt

SEQ ID NO: 876788 - DNA, 25 bp, Mus musculus
tgctttaacaccgaaacttacctgt

SEQ ID NO: 876789 - DNA, 25 bp, Mus musculus
tgctttaagcacacgcctctttcca

SEQ ID NO: 876790 - DNA, 25 bp, Mus musculus
tgctttaagcactcgcctctttcca

SEQ ID NO: 876791 - DNA, 25 bp, Mus musculus
tgctttaataaccattccattctgt

SEQ ID NO: 876792 - DNA, 25 bp, Mus musculus
tgctttaataacgattccattctgt

SEQ ID NO: 876793 - DNA, 25 bp, Mus musculus
tgctttaatgcaactacttctgtct

SEQ ID NO: 876794 - DNA, 25 bp, Mus musculus
tgctttaatgcatctacttctgtct

SEQ ID NO: 876795 - DNA, 25 bp, Mus musculus
tgctttacaaatacctgggcgcgcg

SEQ ID NO: 876796 - DNA, 25 bp, Mus musculus
tgctttacaaattcctgggcgcgcg

SEQ ID NO: 876797 - DNA, 25 bp, Mus musculus
tgctttacacagaggatcgcaccgt

SEQ ID NO: 876798 - DNA, 25 bp, Mus musculus
tgctttacacagtggatcgcaccgt

SEQ ID NO: 876799 - DNA, 25 bp, Mus musculus
tgctttacactaccttctgcattta

SEQ ID NO: 876800 - DNA, 25 bp, Mus musculus
tgctttacactagcttctgcattta

SEQ ID NO: 876801 - DNA, 25 bp, Mus musculus
tgctttacagtcctccaggcagctg

SEQ ID NO: 876802 - DNA, 25 bp, Mus musculus
tgctttacagtcgtccaggcagctg

SEQ ID NO: 876803 - DNA, 25 bp, Mus musculus
tgctttaccactcagtgaaaacccc

SEQ ID NO: 876804 - DNA, 25 bp, Mus musculus
tgctttaccactgagtgaaaacccc

SEQ ID NO: 876805 - DNA, 25 bp, Mus musculus
tgctttaccagtacctctgaagcag

SEQ ID NO: 876806 - DNA, 25 bp, Mus musculus
tgctttaccagttcctctgaagcag

SEQ ID NO: 876807 - DNA, 25 bp, Mus musculus
tgctttacccaccaagcaatctctg

SEQ ID NO: 876808 - DNA, 25 bp, Mus musculus
tgctttacccacgaagcaatctctg

SEQ ID NO: 876809 - DNA, 25 bp, Mus musculus
tgctttacccagaagcaatctcggc

SEQ ID NO: 876810 - DNA, 25 bp, Mus musculus
tgctttacccagtagcaatctcggc

SEQ ID NO: 876811 - DNA, 25 bp, Mus musculus
tgctttaccctgataccaacagtgt

SEQ ID NO: 876812 - DNA, 25 bp, Mus musculus
tgctttaccctgttaccaacagtgt

SEQ ID NO: 876813 - DNA, 25 bp, Mus musculus
tgctttaccgctccgaacactcagg

SEQ ID NO: 876814 - DNA, 25 bp, Mus musculus
tgctttaccgctgcgaacactcagg

SEQ ID NO: 876815 - DNA, 25 bp, Mus musculus
tgctttacctcaagaagtctccctt

SEQ ID NO: 876816 - DNA, 25 bp, Mus musculus
tgctttacctcatgaagtctccctt

SEQ ID NO: 876817 - DNA, 25 bp, Mus musculus
tgctttactatactgctgacttgaa

SEQ ID NO: 876818 - DNA, 25 bp, Mus musculus
tgctttactatagtgctgacttgaa

SEQ ID NO: 876819 - DNA, 25 bp, Mus musculus
tgctttacttcccaagacatcttgg

SEQ ID NO: 876820 - DNA, 25 bp, Mus musculus
tgctttacttccgaagacatcttgg

SEQ ID NO: 876821 - DNA, 25 bp, Mus musculus
tgctttacttgccagtctcctgtgt

SEQ ID NO: 876822 - DNA, 25 bp, Mus musculus
tgctttacttgcgagtctcctgtgt

SEQ ID NO: 876823 - DNA, 25 bp, Mus musculus
tgctttacttttcgtgttttactgg

SEQ ID NO: 876824 - DNA, 25 bp, Mus musculus
tgctttacttttggtgttttactgg

SEQ ID NO: 876825 - DNA, 25 bp, Mus musculus
tgctttagaaggcaattatcctgat

SEQ ID NO: 876826 - DNA, 25 bp, Mus musculus
tgctttagaagggaattatcctgat

SEQ ID NO: 876827 - DNA, 25 bp, Mus musculus
tgctttagacccagagcatctgacc

SEQ ID NO: 876828 - DNA, 25 bp, Mus musculus
tgctttagaccctgagcatctgacc

SEQ ID NO: 876829 - DNA, 25 bp, Mus musculus
tgctttagccatcactgcctgagaa

SEQ ID NO: 876830 - DNA, 25 bp, Mus musculus
tgctttagccatgactgcctgagaa

SEQ ID NO: 876831 - DNA, 25 bp, Mus musculus
tgctttagccttattcctctggaaa

SEQ ID NO: 876832 - DNA, 25 bp, Mus musculus
tgctttagcctttttcctctggaaa

SEQ ID NO: 876833 - DNA, 25 bp, Mus musculus
tgctttagctcgctggttatttgtc

SEQ ID NO: 876834 - DNA, 25 bp, Mus musculus
tgctttagctcggtggttatttgtc

SEQ ID NO: 876835 - DNA, 25 bp, Mus musculus
tgctttagctggagttttatgggct

SEQ ID NO: 876836 - DNA, 25 bp, Mus musculus
tgctttagctggtgttttatgggct

SEQ ID NO: 876837 - DNA, 25 bp, Mus musculus
tgctttagggaaacagtccttcaca

SEQ ID NO: 876838 - DNA, 25 bp, Mus musculus
tgctttagggaaccgtcttcactgt

SEQ ID NO: 876839 - DNA, 25 bp, Mus musculus
tgctttagggaagcgtcttcactgt

SEQ ID NO: 876840 - DNA, 25 bp, Mus musculus
tgctttagggaatcagtccttcaca

SEQ ID NO: 876841 - DNA, 25 bp, Mus musculus
tgctttatgccaaacccatctatat

SEQ ID NO: 876842 - DNA, 25 bp, Mus musculus
tgctttatgccatacccatctatat

SEQ ID NO: 876843 - DNA, 25 bp, Mus musculus
tgctttatgctcagcgagccataac

SEQ ID NO: 876844 - DNA, 25 bp, Mus musculus
tgctttatgctctgcgagccataac

SEQ ID NO: 876845 - DNA, 25 bp, Mus musculus
tgctttatgtaaacccaacctgagg

SEQ ID NO: 876846 - DNA, 25 bp, Mus musculus
tgctttatgtaatcccaacctgagg

SEQ ID NO: 876847 - DNA, 25 bp, Mus musculus
tgctttattagcaactctggatatt

SEQ ID NO: 876848 - DNA, 25 bp, Mus musculus
tgctttattagctactctggatatt

SEQ ID NO: 876849 - DNA, 25 bp, Mus musculus
tgctttcaaaccagatcactcagtt

SEQ ID NO: 876850 - DNA, 25 bp, Mus musculus
tgctttcaaacctgatcactcagtt

SEQ ID NO: 876851 - DNA, 25 bp, Mus musculus
tgctttcaaaggagccccgttgaag

SEQ ID NO: 876852 - DNA, 25 bp, Mus musculus
tgctttcaaaggtgccccgttgaag

SEQ ID NO: 876853 - DNA, 25 bp, Mus musculus
tgctttcaaatcactccaactggat

SEQ ID NO: 876854 - DNA, 25 bp, Mus musculus
tgctttcaaatctctccaactggat

SEQ ID NO: 876855 - DNA, 25 bp, Mus musculus
tgctttcaacccattggaactttgt

SEQ ID NO: 876856 - DNA, 25 bp, Mus musculus
tgctttcaaccctttggaactttgt

SEQ ID NO: 876857 - DNA, 25 bp, Mus musculus
tgctttcaagctactattgcatctg

SEQ ID NO: 876858 - DNA, 25 bp, Mus musculus
tgctttcaagcttctattgcatctg

SEQ ID NO: 876859 - DNA, 25 bp, Mus musculus
tgctttcaagtcacaaaaaagtctt

SEQ ID NO: 876860 - DNA, 25 bp, Mus musculus
tgctttcaagtctcaaaaaagtctt

SEQ ID NO: 876861 - DNA, 25 bp, Mus musculus
tgctttcacataaccagggctatgg

SEQ ID NO: 876862 - DNA, 25 bp, Mus musculus
tgctttcacatatccagggctatgg

SEQ ID NO: 876863 - DNA, 25 bp, Mus musculus
tgctttcacggtctgcaacctggga

SEQ ID NO: 876864 - DNA, 25 bp, Mus musculus
tgctttcacggtgtgcaacctggga

SEQ ID NO: 876865 - DNA, 25 bp, Mus musculus
tgctttcactgcatcagttcccatg

SEQ ID NO: 876866 - DNA, 25 bp, Mus musculus
tgctttcactgcttcagttcccatg

SEQ ID NO: 876867 - DNA, 25 bp, Mus musculus
tgctttcactgtcgtggtcagggca

SEQ ID NO: 876868 - DNA, 25 bp, Mus musculus
tgctttcactgtggtggtcagggca

SEQ ID NO: 876869 - DNA, 25 bp, Mus musculus
tgctttcactttaactgcttaccaa

SEQ ID NO: 876870 - DNA, 25 bp, Mus musculus
tgctttcactttcaacccctggtgt

SEQ ID NO: 876871 - DNA, 25 bp, Mus musculus
tgctttcactttgaacccctggtgt

SEQ ID NO: 876872 - DNA, 25 bp, Mus musculus
tgctttcacttttactgcttaccaa

SEQ ID NO: 876873 - DNA, 25 bp, Mus musculus
tgctttcagaagcacttgtgccgtt

SEQ ID NO: 876874 - DNA, 25 bp, Mus musculus
tgctttcagaaggacttgtgccgtt

SEQ ID NO: 876875 - DNA, 25 bp, Mus musculus
tgctttcagaatcagtgcaagttac

SEQ ID NO: 876876 - DNA, 25 bp, Mus musculus
tgctttcagaatgagtgcaagttac

SEQ ID NO: 876877 - DNA, 25 bp, Mus musculus
tgctttcagatgctgtcctttagta

SEQ ID NO: 876878 - DNA, 25 bp, Mus musculus
tgctttcagatggtgtcctttagta

SEQ ID NO: 876879 - DNA, 25 bp, Mus musculus
tgctttcaggccacacatcaaggag

SEQ ID NO: 876880 - DNA, 25 bp, Mus musculus
tgctttcaggcctcacatcaaggag

SEQ ID NO: 876881 - DNA, 25 bp, Mus musculus
tgctttcaggcgctcagtgagttga

SEQ ID NO: 876882 - DNA, 25 bp, Mus musculus
tgctttcaggcggtcagtgagttga

SEQ ID NO: 876883 - DNA, 25 bp, Mus musculus
tgctttcagggaacagggaaggtct

SEQ ID NO: 876884 - DNA, 25 bp, Mus musculus
tgctttcagggacccagccagtgct

SEQ ID NO: 876885 - DNA, 25 bp, Mus musculus
tgctttcagggagccagccagtgct

SEQ ID NO: 876886 - DNA, 25 bp, Mus musculus
tgctttcagggatcagggaaggtct

SEQ ID NO: 876887 - DNA, 25 bp, Mus musculus
tgctttcagtaactactctccagct

SEQ ID NO: 876888 - DNA, 25 bp, Mus musculus
tgctttcagtaagtactctccagct

SEQ ID NO: 876889 - DNA, 25 bp, Mus musculus
tgctttcatcacaactgacccttaa

SEQ ID NO: 876890 - DNA, 25 bp, Mus musculus
tgctttcatcactactgacccttaa

SEQ ID NO: 876891 - DNA, 25 bp, Mus musculus
tgctttcatctgcttgtcagttcgc

SEQ ID NO: 876892 - DNA, 25 bp, Mus musculus
tgctttcatctggttgtcagttcgc

SEQ ID NO: 876893 - DNA, 25 bp, Mus musculus
tgctttcatgtcactatttccatcc

SEQ ID NO: 876894 - DNA, 25 bp, Mus musculus
tgctttcatgtctctatttccatcc

SEQ ID NO: 876895 - DNA, 25 bp, Mus musculus
tgctttcattaaacccggttcacac

SEQ ID NO: 876896 - DNA, 25 bp, Mus musculus
tgctttcattaatcccggttcacac

SEQ ID NO: 876897 - DNA, 25 bp, Mus musculus
tgctttcattacagactgggaatat

SEQ ID NO: 876898 - DNA, 25 bp, Mus musculus
tgctttcattactgactgggaatat

SEQ ID NO: 876899 - DNA, 25 bp, Mus musculus
tgctttcatttacacagatatccat

SEQ ID NO: 876900 - DNA, 25 bp, Mus musculus
tgctttcatttagacagatatccat

SEQ ID NO: 876901 - DNA, 25 bp, Mus musculus
tgctttccaaagctagggtttaagg

SEQ ID NO: 876902 - DNA, 25 bp, Mus musculus
tgctttccaaaggtagggtttaagg

SEQ ID NO: 876903 - DNA, 25 bp, Mus musculus
tgctttccacgacattgtatttcct

SEQ ID NO: 876904 - DNA, 25 bp, Mus musculus
tgctttccacgagattgtatttcct

SEQ ID NO: 876905 - DNA, 25 bp, Mus musculus
tgctttccagagattcctgtccagc

SEQ ID NO: 876906 - DNA, 25 bp, Mus musculus
tgctttccagagtttcctgtccagc

SEQ ID NO: 876907 - DNA, 25 bp, Mus musculus
tgctttccattgcttaggagaccag

SEQ ID NO: 876908 - DNA, 25 bp, Mus musculus
tgctttccattggttaggagaccag

SEQ ID NO: 876909 - DNA, 25 bp, Mus musculus
tgctttccccagactagactttagt

SEQ ID NO: 876910 - DNA, 25 bp, Mus musculus
tgctttccccagagtacgtataatt

SEQ ID NO: 876911 - DNA, 25 bp, Mus musculus
tgctttccccagcatagcgcgggcc

SEQ ID NO: 876912 - DNA, 25 bp, Mus musculus
tgctttccccaggatagcgcgggcc

SEQ ID NO: 876913 - DNA, 25 bp, Mus musculus
tgctttccccagtctagactttagt

SEQ ID NO: 876914 - DNA, 25 bp, Mus musculus
tgctttccccagtgtacgtataatt

SEQ ID NO: 876915 - DNA, 25 bp, Mus musculus
tgctttcccctgatgctagattagc

SEQ ID NO: 876916 - DNA, 25 bp, Mus musculus
tgctttcccctgttgctagattagc

SEQ ID NO: 876917 - DNA, 25 bp, Mus musculus
tgctttccctaacaattgctgacac

SEQ ID NO: 876918 - DNA, 25 bp, Mus musculus
tgctttccctaagaattgctgacac

SEQ ID NO: 876919 - DNA, 25 bp, Mus musculus
tgctttccctgcaggtggatgccag

SEQ ID NO: 876920 - DNA, 25 bp, Mus musculus
tgctttccctgccttcttttttcac

SEQ ID NO: 876921 - DNA, 25 bp, Mus musculus
tgctttccctgcgttcttttttcac

SEQ ID NO: 876922 - DNA, 25 bp, Mus musculus
tgctttccctgctggtggatgccag

SEQ ID NO: 876923 - DNA, 25 bp, Mus musculus
tgctttccctggacagagacagttt

SEQ ID NO: 876924 - DNA, 25 bp, Mus musculus
tgctttccctggtcagagacagttt

SEQ ID NO: 876925 - DNA, 25 bp, Mus musculus
tgctttccgggaaatgccacggtgc

SEQ ID NO: 876926 - DNA, 25 bp, Mus musculus
tgctttccgggatatgccacggtgc

SEQ ID NO: 876927 - DNA, 25 bp, Mus musculus
tgctttccgtccattcagaggacaa

SEQ ID NO: 876928 - DNA, 25 bp, Mus musculus
tgctttccgtcctttcagaggacaa

SEQ ID NO: 876929 - DNA, 25 bp, Mus musculus
tgctttcctagccagatgagttcag

SEQ ID NO: 876930 - DNA, 25 bp, Mus musculus
tgctttcctagcgagatgagttcag

SEQ ID NO: 876931 - DNA, 25 bp, Mus musculus
tgctttcctctaagtcccatctgga

SEQ ID NO: 876932 - DNA, 25 bp, Mus musculus
tgctttcctctatgtcccatctgga

SEQ ID NO: 876933 - DNA, 25 bp, Mus musculus
tgctttcctctgcagtacagttgta

SEQ ID NO: 876934 - DNA, 25 bp, Mus musculus
tgctttcctctggagtacagttgta

SEQ ID NO: 876935 - DNA, 25 bp, Mus musculus
tgctttcctgccagctgcgagggaa

SEQ ID NO: 876936 - DNA, 25 bp, Mus musculus
tgctttcctgcctgctgcgagggaa

SEQ ID NO: 876937 - DNA, 25 bp, Mus musculus
tgctttcctggcaacttgactgagt

SEQ ID NO: 876938 - DNA, 25 bp, Mus musculus
tgctttcctggctacttgactgagt

SEQ ID NO: 876939 - DNA, 25 bp, Mus musculus
tgctttccttggcacacaggtcaga

SEQ ID NO: 876940 - DNA, 25 bp, Mus musculus
tgctttccttgggacacaggtcaga

SEQ ID NO: 876941 - DNA, 25 bp, Mus musculus
tgctttcctttcaagcgttttgttt

SEQ ID NO: 876942 - DNA, 25 bp, Mus musculus
tgctttcctttctagcgttttgttt

SEQ ID NO: 876943 - DNA, 25 bp, Mus musculus
tgctttcgcaccaccagacataaag

SEQ ID NO: 876944 - DNA, 25 bp, Mus musculus
tgctttcgcacctccagacataaag

SEQ ID NO: 876945 - DNA, 25 bp, Mus musculus
tgctttcgggctaccttgaacgaga

SEQ ID NO: 876946 - DNA, 25 bp, Mus musculus
tgctttcgggcttccttgaacgaga

SEQ ID NO: 876947 - DNA, 25 bp, Mus musculus
tgctttcggtacaaactcctgttga

SEQ ID NO: 876948 - DNA, 25 bp, Mus musculus
tgctttcggtactaactcctgttga

SEQ ID NO: 876949 - DNA, 25 bp, Mus musculus
tgctttcgtcttcacatggtgttgt

SEQ ID NO: 876950 - DNA, 25 bp, Mus musculus
tgctttcgtcttgacatggtgttgt

SEQ ID NO: 876951 - DNA, 25 bp, Mus musculus
tgctttctaatgcttcttcctgtga

SEQ ID NO: 876952 - DNA, 25 bp, Mus musculus
tgctttctaatggttcttcctgtga

SEQ ID NO: 876953 - DNA, 25 bp, Mus musculus
tgctttctatggctctgactctgcg

SEQ ID NO: 876954 - DNA, 25 bp, Mus musculus
tgctttctatgggtctgactctgcg

SEQ ID NO: 876955 - DNA, 25 bp, Mus musculus
tgctttctcaaccagccacttctaa

SEQ ID NO: 876956 - DNA, 25 bp, Mus musculus
tgctttctcaacgagccacttctaa

SEQ ID NO: 876957 - DNA, 25 bp, Mus musculus
tgctttctcaggagcacagatcttt

SEQ ID NO: 876958 - DNA, 25 bp, Mus musculus
tgctttctcaggtgcacagatcttt

SEQ ID NO: 876959 - DNA, 25 bp, Mus musculus
tgctttctccatctgtctagaggaa

SEQ ID NO: 876960 - DNA, 25 bp, Mus musculus
tgctttctccatgtgtctagaggaa

SEQ ID NO: 876961 - DNA, 25 bp, Mus musculus
tgctttctcctaacctgctgaataa

SEQ ID NO: 876962 - DNA, 25 bp, Mus musculus
tgctttctcctatcctgctgaataa

SEQ ID NO: 876963 - DNA, 25 bp, Mus musculus
tgctttctctaaatcgaggcttatt

SEQ ID NO: 876964 - DNA, 25 bp, Mus musculus
tgctttctctaattcgaggcttatt

SEQ ID NO: 876965 - DNA, 25 bp, Mus musculus
tgctttctctgcacagttgtcatat

SEQ ID NO: 876966 - DNA, 25 bp, Mus musculus
tgctttctctgctcagttgtcatat

SEQ ID NO: 876967 - DNA, 25 bp, Mus musculus
tgctttctctggacagcgcaggctg

SEQ ID NO: 876968 - DNA, 25 bp, Mus musculus
tgctttctctggcaatgtgattttc

SEQ ID NO: 876969 - DNA, 25 bp, Mus musculus
tgctttctctgggaatgtgattttc

SEQ ID NO: 876970 - DNA, 25 bp, Mus musculus
tgctttctctggtcagcgcaggctg

SEQ ID NO: 876971 - DNA, 25 bp, Mus musculus
tgctttctctgtcacattctcatca

SEQ ID NO: 876972 - DNA, 25 bp, Mus musculus
tgctttctctgtgacattctcatca

SEQ ID NO: 876973 - DNA, 25 bp, Mus musculus
tgctttctgacactaatcttgctgc

SEQ ID NO: 876974 - DNA, 25 bp, Mus musculus
tgctttctgacagtaatcttgctgc

SEQ ID NO: 876975 - DNA, 25 bp, Mus musculus
tgctttctgagcagccttcatagga

SEQ ID NO: 876976 - DNA, 25 bp, Mus musculus
tgctttctgagctgccttcatagga

SEQ ID NO: 876977 - DNA, 25 bp, Mus musculus
tgctttctgatcctgtgcgttgtaa

SEQ ID NO: 876978 - DNA, 25 bp, Mus musculus
tgctttctgatcgtgtgcgttgtaa

SEQ ID NO: 876979 - DNA, 25 bp, Mus musculus
tgctttctgccccagtccagtctgt

SEQ ID NO: 876980 - DNA, 25 bp, Mus musculus
tgctttctgcccgagtccagtctgt

SEQ ID NO: 876981 - DNA, 25 bp, Mus musculus
tgctttctgcctatatttccttgaa

SEQ ID NO: 876982 - DNA, 25 bp, Mus musculus
tgctttctgcctcctttagaaaccc

SEQ ID NO: 876983 - DNA, 25 bp, Mus musculus
tgctttctgcctgctttagaaaccc

SEQ ID NO: 876984 - DNA, 25 bp, Mus musculus
tgctttctgcctttatttccttgaa

SEQ ID NO: 876985 - DNA, 25 bp, Mus musculus
tgctttctgtaccattcacttactt

SEQ ID NO: 876986 - DNA, 25 bp, Mus musculus
tgctttctgtacgattcacttactt

SEQ ID NO: 876987 - DNA, 25 bp, Mus musculus
tgctttctgtcacgattgcacaact

SEQ ID NO: 876988 - DNA, 25 bp, Mus musculus
tgctttctgtcaggattgcacaact

SEQ ID NO: 876989 - DNA, 25 bp, Mus musculus
tgctttctgtctatttcaactgaaa

SEQ ID NO: 876990 - DNA, 25 bp, Mus musculus
tgctttctgtctttttcaactgaaa

SEQ ID NO: 876991 - DNA, 25 bp, Mus musculus
tgctttctgttcacaacgcagtgat

SEQ ID NO: 876992 - DNA, 25 bp, Mus musculus
tgctttctgttctcaacgcagtgat

SEQ ID NO: 876993 - DNA, 25 bp, Mus musculus
tgctttctgtttctcgctgattgag

SEQ ID NO: 876994 - DNA, 25 bp, Mus musculus
tgctttctgtttgtcgctgattgag

SEQ ID NO: 876995 - DNA, 25 bp, Mus musculus
tgctttcttacgcacattgcagaag

SEQ ID NO: 876996 - DNA, 25 bp, Mus musculus
tgctttcttacggacattgcagaag

SEQ ID NO: 876997 - DNA, 25 bp, Mus musculus
tgctttcttagactaaccgggacca

SEQ ID NO: 876998 - DNA, 25 bp, Mus musculus
tgctttcttagagtaaccgggacca

SEQ ID NO: 876999 - DNA, 25 bp, Mus musculus
tgctttcttagtccagctcttaaga

SEQ ID NO: 877000 - DNA, 25 bp, Mus musculus
tgctttcttagtgcagctcttaaga

SEQ ID NO: 877001 - DNA, 25 bp, Mus musculus
tgctttcttatgcagatgcctgtat

SEQ ID NO: 877002 - DNA, 25 bp, Mus musculus
tgctttcttatggagatgcctgtat

SEQ ID NO: 877003 - DNA, 25 bp, Mus musculus
tgctttcttccacgtaccagttgaa

SEQ ID NO: 877004 - DNA, 25 bp, Mus musculus
tgctttcttccaggtaccagttgaa

SEQ ID NO: 877005 - DNA, 25 bp, Mus musculus
tgctttcttctcatggtttcatttg

SEQ ID NO: 877006 - DNA, 25 bp, Mus musculus
tgctttcttctcttggtttcatttg

SEQ ID NO: 877007 - DNA, 25 bp, Mus musculus
tgctttcttctgaatccaagtgctc

SEQ ID NO: 877008 - DNA, 25 bp, Mus musculus
tgctttcttctgtatccaagtgctc

SEQ ID NO: 877009 - DNA, 25 bp, Mus musculus
tgctttcttcttattgtcccctaag

SEQ ID NO: 877010 - DNA, 25 bp, Mus musculus
tgctttcttctttttgtcccctaag

SEQ ID NO: 877011 - DNA, 25 bp, Mus musculus
tgctttcttgataccttgctcttta

SEQ ID NO: 877012 - DNA, 25 bp, Mus musculus
tgctttcttgattccttgctcttta

SEQ ID NO: 877013 - DNA, 25 bp, Mus musculus
tgctttcttgccagcttatccttca

SEQ ID NO: 877014 - DNA, 25 bp, Mus musculus
tgctttcttgcctgcttatccttca

SEQ ID NO: 877015 - DNA, 25 bp, Mus musculus
tgctttcttgtcatggcagagggag

SEQ ID NO: 877016 - DNA, 25 bp, Mus musculus
tgctttcttgtcttggcagagggag

SEQ ID NO: 877017 - DNA, 25 bp, Mus musculus
tgctttctttaaaattcgacaatgg

SEQ ID NO: 877018 - DNA, 25 bp, Mus musculus
tgctttctttaatattcgacaatgg

SEQ ID NO: 877019 - DNA, 25 bp, Mus musculus
tgctttctttggaactctctctcca

SEQ ID NO: 877020 - DNA, 25 bp, Mus musculus
tgctttctttggtactctctctcca

SEQ ID NO: 877021 - DNA, 25 bp, Mus musculus
tgctttcttttgaattccctacgac

SEQ ID NO: 877022 - DNA, 25 bp, Mus musculus
tgctttcttttgtattccctacgac

SEQ ID NO: 877023 - DNA, 25 bp, Mus musculus
tgctttgaactgactagggacttta

SEQ ID NO: 877024 - DNA, 25 bp, Mus musculus
tgctttgaactgtctagggacttta

SEQ ID NO: 877025 - DNA, 25 bp, Mus musculus
tgctttgaagtcactttgcttctgt

SEQ ID NO: 877026 - DNA, 25 bp, Mus musculus
tgctttgaagtctctttgcttctgt

SEQ ID NO: 877027 - DNA, 25 bp, Mus musculus
tgctttgactccagtatcccaaatg

SEQ ID NO: 877028 - DNA, 25 bp, Mus musculus
tgctttgactcctgtatcccaaatg

SEQ ID NO: 877029 - DNA, 25 bp, Mus musculus
tgctttgactgaaggtgtgctccac

SEQ ID NO: 877030 - DNA, 25 bp, Mus musculus
tgctttgactgatggtgtgctccac

SEQ ID NO: 877031 - DNA, 25 bp, Mus musculus
tgctttgagatgagagcatccccat

SEQ ID NO: 877032 - DNA, 25 bp, Mus musculus
tgctttgagatgtgagcatccccat

SEQ ID NO: 877033 - DNA, 25 bp, Mus musculus
tgctttgagcctaacgagttcaccc

SEQ ID NO: 877034 - DNA, 25 bp, Mus musculus
tgctttgagccttacgagttcaccc

SEQ ID NO: 877035 - DNA, 25 bp, Mus musculus
tgctttgaggtcacagtggagctgt

SEQ ID NO: 877036 - DNA, 25 bp, Mus musculus
tgctttgaggtctcagtggagctgt

SEQ ID NO: 877037 - DNA, 25 bp, Mus musculus
tgctttgagtgtaggtactgtccag

SEQ ID NO: 877038 - DNA, 25 bp, Mus musculus
tgctttgagtgttggtactgtccag

SEQ ID NO: 877039 - DNA, 25 bp, Mus musculus
tgctttgatcctatcatgtgaccag

SEQ ID NO: 877040 - DNA, 25 bp, Mus musculus
tgctttgatcctttcatgtgaccag

SEQ ID NO: 877041 - DNA, 25 bp, Mus musculus
tgctttgatgtcatgctatgctgtt

SEQ ID NO: 877042 - DNA, 25 bp, Mus musculus
tgctttgatgtcttgctatgctgtt

SEQ ID NO: 877043 - DNA, 25 bp, Mus musculus
tgctttgattatccaggtccttcag

SEQ ID NO: 877044 - DNA, 25 bp, Mus musculus
tgctttgattatctggcccaggttt

SEQ ID NO: 877045 - DNA, 25 bp, Mus musculus
tgctttgattatgcaggtccttcag

SEQ ID NO: 877046 - DNA, 25 bp, Mus musculus
tgctttgattatgtggcccaggttt

SEQ ID NO: 877047 - DNA, 25 bp, Mus musculus
tgctttgattgccattttgacctag

SEQ ID NO: 877048 - DNA, 25 bp, Mus musculus
tgctttgattgcgattttgacctag

SEQ ID NO: 877049 - DNA, 25 bp, Mus musculus
tgctttgcaagtcgacttcgctctc

SEQ ID NO: 877050 - DNA, 25 bp, Mus musculus
tgctttgcaagtggacttcgctctc

SEQ ID NO: 877051 - DNA, 25 bp, Mus musculus
tgctttgcacagaccttttcagagc

SEQ ID NO: 877052 - DNA, 25 bp, Mus musculus
tgctttgcacagtccttttcagagc

SEQ ID NO: 877053 - DNA, 25 bp, Mus musculus
tgctttgcactgattcactctgtta

SEQ ID NO: 877054 - DNA, 25 bp, Mus musculus
tgctttgcactgtttcactctgtta

SEQ ID NO: 877055 - DNA, 25 bp, Mus musculus
tgctttgcagaaaggcttgagtgag

SEQ ID NO: 877056 - DNA, 25 bp, Mus musculus
tgctttgcagaatggcttgagtgag

SEQ ID NO: 877057 - DNA, 25 bp, Mus musculus
tgctttgcagggagaccttatttat

SEQ ID NO: 877058 - DNA, 25 bp, Mus musculus
tgctttgcagggtgaccttatttat

SEQ ID NO: 877059 - DNA, 25 bp, Mus musculus
tgctttgcatggcagtgtgctgact

SEQ ID NO: 877060 - DNA, 25 bp, Mus musculus
tgctttgcatgggagtgtgctgact

SEQ ID NO: 877061 - DNA, 25 bp, Mus musculus
tgctttgccagtatcacacatttct

SEQ ID NO: 877062 - DNA, 25 bp, Mus musculus
tgctttgccagtttcacacatttct

SEQ ID NO: 877063 - DNA, 25 bp, Mus musculus
tgctttgcccacaggtaacttgtga

SEQ ID NO: 877064 - DNA, 25 bp, Mus musculus
tgctttgcccactggtaacttgtga

SEQ ID NO: 877065 - DNA, 25 bp, Mus musculus
tgctttgccctacagggaatccctc

SEQ ID NO: 877066 - DNA, 25 bp, Mus musculus
tgctttgccctagagggaatccctc

SEQ ID NO: 877067 - DNA, 25 bp, Mus musculus
tgctttgccctcatgggtagaggat

SEQ ID NO: 877068 - DNA, 25 bp, Mus musculus
tgctttgccctcttgggtagaggat

SEQ ID NO: 877069 - DNA, 25 bp, Mus musculus
tgctttgccgtcctgatgctacaag

SEQ ID NO: 877070 - DNA, 25 bp, Mus musculus
tgctttgccgtcgtgatgctacaag

SEQ ID NO: 877071 - DNA, 25 bp, Mus musculus
tgctttgcctctcgcctaaagaata

SEQ ID NO: 877072 - DNA, 25 bp, Mus musculus
tgctttgcctctggcctaaagaata

SEQ ID NO: 877073 - DNA, 25 bp, Mus musculus
tgctttgcggttcttggtgtgcata

SEQ ID NO: 877074 - DNA, 25 bp, Mus musculus
tgctttgcggttgttggtgtgcata

SEQ ID NO: 877075 - DNA, 25 bp, Mus musculus
tgctttgctcctccgtacaggaagc

SEQ ID NO: 877076 - DNA, 25 bp, Mus musculus
tgctttgctcctgcgtacaggaagc

SEQ ID NO: 877077 - DNA, 25 bp, Mus musculus
tgctttgctcggctagtctggtatg

SEQ ID NO: 877078 - DNA, 25 bp, Mus musculus
tgctttgctcgggtagtctggtatg

SEQ ID NO: 877079 - DNA, 25 bp, Mus musculus
tgctttgctctgagcactcagaatt

SEQ ID NO: 877080 - DNA, 25 bp, Mus musculus
tgctttgctctgtgcactcagaatt

SEQ ID NO: 877081 - DNA, 25 bp, Mus musculus
tgctttgcttccacctgaggtaaac

SEQ ID NO: 877082 - DNA, 25 bp, Mus musculus
tgctttgcttcctcctgaggtaaac

SEQ ID NO: 877083 - DNA, 25 bp, Mus musculus
tgctttgcttctccttaggtgatac

SEQ ID NO: 877084 - DNA, 25 bp, Mus musculus
tgctttgcttctgcttaggtgatac

SEQ ID NO: 877085 - DNA, 25 bp, Mus musculus
tgctttgctttactgcatgaatgaa

SEQ ID NO: 877086 - DNA, 25 bp, Mus musculus
tgctttgctttagtgcatgaatgaa

SEQ ID NO: 877087 - DNA, 25 bp, Mus musculus
tgctttgctttcattggccatcaat

SEQ ID NO: 877088 - DNA, 25 bp, Mus musculus
tgctttgctttctttggccatcaat

SEQ ID NO: 877089 - DNA, 25 bp, Mus musculus
tgctttgcttttcgttctcctactg

SEQ ID NO: 877090 - DNA, 25 bp, Mus musculus
tgctttgcttttggttctcctactg

SEQ ID NO: 877091 - DNA, 25 bp, Mus musculus
tgctttggcgatatggagacttccc

SEQ ID NO: 877092 - DNA, 25 bp, Mus musculus
tgctttggcgatttggagacttccc

SEQ ID NO: 877093 - DNA, 25 bp, Mus musculus
tgctttggcttgaatgtttcctgtg

SEQ ID NO: 877094 - DNA, 25 bp, Mus musculus
tgctttggcttgtatgtttcctgtg

SEQ ID NO: 877095 - DNA, 25 bp, Mus musculus
tgctttgggcagacatgtccacagc

SEQ ID NO: 877096 - DNA, 25 bp, Mus musculus
tgctttgggcagtcatgtccacagc

SEQ ID NO: 877097 - DNA, 25 bp, Mus musculus
tgctttgggcctctggcaacaatgc

SEQ ID NO: 877098 - DNA, 25 bp, Mus musculus
tgctttgggcctgtggcaacaatgc

SEQ ID NO: 877099 - DNA, 25 bp, Mus musculus
tgctttgggcttctgattttggttt

SEQ ID NO: 877100 - DNA, 25 bp, Mus musculus
tgctttgggcttgtgattttggttt

SEQ ID NO: 877101 - DNA, 25 bp, Mus musculus
tgctttgggggtcttcttatcaaac

SEQ ID NO: 877102 - DNA, 25 bp, Mus musculus
tgctttgggggtgttcttatcaaac

SEQ ID NO: 877103 - DNA, 25 bp, Mus musculus
tgctttgggtttagcaccttagcgg

SEQ ID NO: 877104 - DNA, 25 bp, Mus musculus
tgctttgggttttgcaccttagcgg

SEQ ID NO: 877105 - DNA, 25 bp, Mus musculus
tgctttggtacactgctgggcattg

SEQ ID NO: 877106 - DNA, 25 bp, Mus musculus
tgctttggtacagtgctgggcattg

SEQ ID NO: 877107 - DNA, 25 bp, Mus musculus
tgctttggtcggcactgatgaaatg

SEQ ID NO: 877108 - DNA, 25 bp, Mus musculus
tgctttggtcgggactgatgaaatg

SEQ ID NO: 877109 - DNA, 25 bp, Mus musculus
tgctttggtctcagggatctgggaa

SEQ ID NO: 877110 - DNA, 25 bp, Mus musculus
tgctttggtctctgggatctgggaa

SEQ ID NO: 877111 - DNA, 25 bp, Mus musculus
tgctttggtgtcacatttggatggc

SEQ ID NO: 877112 - DNA, 25 bp, Mus musculus
tgctttggtgtctcatttggatggc

SEQ ID NO: 877113 - DNA, 25 bp, Mus musculus
tgctttggttgcaggtgcataacaa

SEQ ID NO: 877114 - DNA, 25 bp, Mus musculus
tgctttggttgctggtgcataacaa

SEQ ID NO: 877115 - DNA, 25 bp, Mus musculus
tgctttggttttacctagaaaggct

SEQ ID NO: 877116 - DNA, 25 bp, Mus musculus
tgctttggtttttcctagaaaggct

SEQ ID NO: 877117 - DNA, 25 bp, Mus musculus
tgctttgtaagcatgtgcccagtct

SEQ ID NO: 877118 - DNA, 25 bp, Mus musculus
tgctttgtaagcttgtgcccagtct

SEQ ID NO: 877119 - DNA, 25 bp, Mus musculus
tgctttgtactaagcatgtgccaat

SEQ ID NO: 877120 - DNA, 25 bp, Mus musculus
tgctttgtactatgcatgtgccaat

SEQ ID NO: 877121 - DNA, 25 bp, Mus musculus
tgctttgtagctcaattttgctgtt

SEQ ID NO: 877122 - DNA, 25 bp, Mus musculus
tgctttgtagctgaattttgctgtt

SEQ ID NO: 877123 - DNA, 25 bp, Mus musculus
tgctttgtagttagcccagaggtgg

SEQ ID NO: 877124 - DNA, 25 bp, Mus musculus
tgctttgtagtttgcccagaggtgg

SEQ ID NO: 877125 - DNA, 25 bp, Mus musculus
tgctttgtatctcactccttttggc

SEQ ID NO: 877126 - DNA, 25 bp, Mus musculus
tgctttgtatctgactccttttggc

SEQ ID NO: 877127 - DNA, 25 bp, Mus musculus
tgctttgtattgacctcccttagtc

SEQ ID NO: 877128 - DNA, 25 bp, Mus musculus
tgctttgtattgtcctcccttagtc

SEQ ID NO: 877129 - DNA, 25 bp, Mus musculus
tgctttgtcaacaacggcccttgaa

SEQ ID NO: 877130 - DNA, 25 bp, Mus musculus
tgctttgtcaactacggcccttgaa

SEQ ID NO: 877131 - DNA, 25 bp, Mus musculus
tgctttgtccagagggtaaacacta

SEQ ID NO: 877132 - DNA, 25 bp, Mus musculus
tgctttgtccagtgggtaaacacta

SEQ ID NO: 877133 - DNA, 25 bp, Mus musculus
tgctttgtcctccactgtctatgta

SEQ ID NO: 877134 - DNA, 25 bp, Mus musculus
tgctttgtcctcgactgtctatgta

SEQ ID NO: 877135 - DNA, 25 bp, Mus musculus
tgctttgtcgtcagttcagccctaa

SEQ ID NO: 877136 - DNA, 25 bp, Mus musculus
tgctttgtcgtctgttcagccctaa

SEQ ID NO: 877137 - DNA, 25 bp, Mus musculus
tgctttgtctccattgccaaaatca

SEQ ID NO: 877138 - DNA, 25 bp, Mus musculus
tgctttgtctcccacagcactgtga

SEQ ID NO: 877139 - DNA, 25 bp, Mus musculus
tgctttgtctccgacagcactgtga

SEQ ID NO: 877140 - DNA, 25 bp, Mus musculus
tgctttgtctcctttgccaaaatca

SEQ ID NO: 877141 - DNA, 25 bp, Mus musculus
tgctttgtgaacagtgcgcaagtat

SEQ ID NO: 877142 - DNA, 25 bp, Mus musculus
tgctttgtgaacatatgtgtattgt

SEQ ID NO: 877143 - DNA, 25 bp, Mus musculus
tgctttgtgaactgtgcgcaagtat

SEQ ID NO: 877144 - DNA, 25 bp, Mus musculus
tgctttgtgaacttatgtgtattgt

SEQ ID NO: 877145 - DNA, 25 bp, Mus musculus
tgctttgtgacgaactctacagtag

SEQ ID NO: 877146 - DNA, 25 bp, Mus musculus
tgctttgtgacgtactctacagtag

SEQ ID NO: 877147 - DNA, 25 bp, Mus musculus
tgctttgtgcccactgatgcagtga

SEQ ID NO: 877148 - DNA, 25 bp, Mus musculus
tgctttgtgccctctgatgcagtga

SEQ ID NO: 877149 - DNA, 25 bp, Mus musculus
tgctttgtgcttcgctgctgagaga

SEQ ID NO: 877150 - DNA, 25 bp, Mus musculus
tgctttgtgcttggctgctgagaga

SEQ ID NO: 877151 - DNA, 25 bp, Mus musculus
tgctttgttctacggctgtctcaaa

SEQ ID NO: 877152 - DNA, 25 bp, Mus musculus
tgctttgttctagggctgtctcaaa

SEQ ID NO: 877153 - DNA, 25 bp, Mus musculus
tgctttgttggtaaatctttcttgg

SEQ ID NO: 877154 - DNA, 25 bp, Mus musculus
tgctttgttggttaatctttcttgg

SEQ ID NO: 877155 - DNA, 25 bp, Mus musculus
tgctttgtttaaaagacctaaggca

SEQ ID NO: 877156 - DNA, 25 bp, Mus musculus
tgctttgtttaacttcccatcctct

SEQ ID NO: 877157 - DNA, 25 bp, Mus musculus
tgctttgtttaagttcccatcctct

SEQ ID NO: 877158 - DNA, 25 bp, Mus musculus
tgctttgtttaatagacctaaggca

SEQ ID NO: 877159 - DNA, 25 bp, Mus musculus
tgctttgtttagatcccactaggaa

SEQ ID NO: 877160 - DNA, 25 bp, Mus musculus
tgctttgtttagttcccactaggaa

SEQ ID NO: 877161 - DNA, 25 bp, Mus musculus
tgctttgtttggactaaggcagaac

SEQ ID NO: 877162 - DNA, 25 bp, Mus musculus
tgctttgtttggtctaaggcagaac

SEQ ID NO: 877163 - DNA, 25 bp, Mus musculus
tgctttgttttcagcctggcctgga

SEQ ID NO: 877164 - DNA, 25 bp, Mus musculus
tgctttgttttctgcctggcctgga

SEQ ID NO: 877165 - DNA, 25 bp, Mus musculus
tgcttttaaacactaggccatttct

SEQ ID NO: 877166 - DNA, 25 bp, Mus musculus
tgcttttaaacagtaggccatttct

SEQ ID NO: 877167 - DNA, 25 bp, Mus musculus
tgcttttaacccagattatggacca

SEQ ID NO: 877168 - DNA, 25 bp, Mus musculus
tgcttttaaccctgattatggacca

SEQ ID NO: 877169 - DNA, 25 bp, Mus musculus
tgcttttaagttatcctctctactt

SEQ ID NO: 877170 - DNA, 25 bp, Mus musculus
tgcttttaagttttcctctctactt

SEQ ID NO: 877171 - DNA, 25 bp, Mus musculus
tgcttttaatctccagtccattaga

SEQ ID NO: 877172 - DNA, 25 bp, Mus musculus
tgcttttaatctgcagtccattaga

SEQ ID NO: 877173 - DNA, 25 bp, Mus musculus
tgcttttacagaccgctaataaaga

SEQ ID NO: 877174 - DNA, 25 bp, Mus musculus
tgcttttacagagcgctaataaaga

SEQ ID NO: 877175 - DNA, 25 bp, Mus musculus
tgcttttagcttattcatctcttga

SEQ ID NO: 877176 - DNA, 25 bp, Mus musculus
tgcttttagctttttcatctcttga

SEQ ID NO: 877177 - DNA, 25 bp, Mus musculus
tgcttttataaacattcccagttat

SEQ ID NO: 877178 - DNA, 25 bp, Mus musculus
tgcttttataaagattcccagttat

SEQ ID NO: 877179 - DNA, 25 bp, Mus musculus
tgcttttatgaaattctgtcttgtt

SEQ ID NO: 877180 - DNA, 25 bp, Mus musculus
tgcttttatgaatttctgtcttgtt

SEQ ID NO: 877181 - DNA, 25 bp, Mus musculus
tgcttttatgctacctgcatggact

SEQ ID NO: 877182 - DNA, 25 bp, Mus musculus
tgcttttatgcttcctgcatggact

SEQ ID NO: 877183 - DNA, 25 bp, Mus musculus
tgcttttcaatcatcttccacagag

SEQ ID NO: 877184 - DNA, 25 bp, Mus musculus
tgcttttcaatcttcttccacagag

SEQ ID NO: 877185 - DNA, 25 bp, Mus musculus
tgcttttcacctcgagttttcctag

SEQ ID NO: 877186 - DNA, 25 bp, Mus musculus
tgcttttcacctggagttttcctag

SEQ ID NO: 877187 - DNA, 25 bp, Mus musculus
tgcttttcactcacctagttttatt

SEQ ID NO: 877188 - DNA, 25 bp, Mus musculus
tgcttttcactctcctagttttatt

SEQ ID NO: 877189 - DNA, 25 bp, Mus musculus
tgcttttcagagaaggtttgctcgt

SEQ ID NO: 877190 - DNA, 25 bp, Mus musculus
tgcttttcagagagaatgcagccaa

SEQ ID NO: 877191 - DNA, 25 bp, Mus musculus
tgcttttcagagtaggtttgctcgt

SEQ ID NO: 877192 - DNA, 25 bp, Mus musculus
tgcttttcagagtgaatgcagccaa

SEQ ID NO: 877193 - DNA, 25 bp, Mus musculus
tgcttttcagcaacgttttctaact

SEQ ID NO: 877194 - DNA, 25 bp, Mus musculus
tgcttttcagcatcgttttctaact

SEQ ID NO: 877195 - DNA, 25 bp, Mus musculus
tgcttttcagctagatttaaagatg

SEQ ID NO: 877196 - DNA, 25 bp, Mus musculus
tgcttttcagcttgatttaaagatg

SEQ ID NO: 877197 - DNA, 25 bp, Mus musculus
tgcttttcatcacaaaccatgagct

SEQ ID NO: 877198 - DNA, 25 bp, Mus musculus
tgcttttcatcagaaaccatgagct

SEQ ID NO: 877199 - DNA, 25 bp, Mus musculus
tgcttttcatttccactgcatctct

SEQ ID NO: 877200 - DNA, 25 bp, Mus musculus
tgcttttcatttgcactgcatctct

SEQ ID NO: 877201 - DNA, 25 bp, Mus musculus
tgcttttccaccagatggaagatat

SEQ ID NO: 877202 - DNA, 25 bp, Mus musculus
tgcttttccacctgatggaagatat

SEQ ID NO: 877203 - DNA, 25 bp, Mus musculus
tgcttttccactaattcatgccttt

SEQ ID NO: 877204 - DNA, 25 bp, Mus musculus
tgcttttccacttattcatgccttt

SEQ ID NO: 877205 - DNA, 25 bp, Mus musculus
tgcttttccaggacccatgtcaggt

SEQ ID NO: 877206 - DNA, 25 bp, Mus musculus
tgcttttccaggtcccatgtcaggt

SEQ ID NO: 877207 - DNA, 25 bp, Mus musculus
tgcttttccagtactgcttgcatgt

SEQ ID NO: 877208 - DNA, 25 bp, Mus musculus
tgcttttccagttctgcttgcatgt

SEQ ID NO: 877209 - DNA, 25 bp, Mus musculus
tgcttttccccaatgtgagacagag

SEQ ID NO: 877210 - DNA, 25 bp, Mus musculus
tgcttttccccattgtgagacagag

SEQ ID NO: 877211 - DNA, 25 bp, Mus musculus
tgcttttcccgcaggacaagcggca

SEQ ID NO: 877212 - DNA, 25 bp, Mus musculus
tgcttttcccgctggacaagcggca

SEQ ID NO: 877213 - DNA, 25 bp, Mus musculus
tgcttttcctagcagaggtcgtgct

SEQ ID NO: 877214 - DNA, 25 bp, Mus musculus
tgcttttcctaggagaggtcgtgct

SEQ ID NO: 877215 - DNA, 25 bp, Mus musculus
tgcttttcctcccagcaaaggttgg

SEQ ID NO: 877216 - DNA, 25 bp, Mus musculus
tgcttttcctccgagcaaaggttgg

SEQ ID NO: 877217 - DNA, 25 bp, Mus musculus
tgcttttcctctattagaacccttg

SEQ ID NO: 877218 - DNA, 25 bp, Mus musculus
tgcttttcctcttttagaacccttg

SEQ ID NO: 877219 - DNA, 25 bp, Mus musculus
tgcttttcctggactctatgtgaac

SEQ ID NO: 877220 - DNA, 25 bp, Mus musculus
tgcttttcctggtctctatgtgaac

SEQ ID NO: 877221 - DNA, 25 bp, Mus musculus
tgcttttccttgagacgtagtccta

SEQ ID NO: 877222 - DNA, 25 bp, Mus musculus
tgcttttccttgtgacgtagtccta

SEQ ID NO: 877223 - DNA, 25 bp, Mus musculus
tgcttttcgccaacttctggaacgt

SEQ ID NO: 877224 - DNA, 25 bp, Mus musculus
tgcttttcgccatcttctggaacgt

SEQ ID NO: 877225 - DNA, 25 bp, Mus musculus
tgcttttctatcagagttctgtctg

SEQ ID NO: 877226 - DNA, 25 bp, Mus musculus
tgcttttctatctgagttctgtctg

SEQ ID NO: 877227 - DNA, 25 bp, Mus musculus
tgcttttctatgaagtgaatgcagt

SEQ ID NO: 877228 - DNA, 25 bp, Mus musculus
tgcttttctatgtagtgaatgcagt

SEQ ID NO: 877229 - DNA, 25 bp, Mus musculus
tgcttttctattactctatctcaga

SEQ ID NO: 877230 - DNA, 25 bp, Mus musculus
tgcttttctatttctctatctcaga

SEQ ID NO: 877231 - DNA, 25 bp, Mus musculus
tgcttttctcccctaatcctgactg

SEQ ID NO: 877232 - DNA, 25 bp, Mus musculus
tgcttttctcccgtaatcctgactg

SEQ ID NO: 877233 - DNA, 25 bp, Mus musculus
tgcttttctctccacacatctgaga

SEQ ID NO: 877234 - DNA, 25 bp, Mus musculus
tgcttttctctcgacacatctgaga

SEQ ID NO: 877235 - DNA, 25 bp, Mus musculus
tgcttttctgttactaagtctcaac

SEQ ID NO: 877236 - DNA, 25 bp, Mus musculus
tgcttttctgtttctaagtctcaac

SEQ ID NO: 877237 - DNA, 25 bp, Mus musculus
tgcttttcttggatggcttctggat

SEQ ID NO: 877238 - DNA, 25 bp, Mus musculus
tgcttttcttggttggcttctggat

SEQ ID NO: 877239 - DNA, 25 bp, Mus musculus
tgcttttcttttcagatccctggtg

SEQ ID NO: 877240 - DNA, 25 bp, Mus musculus
tgcttttcttttcgaatggccctgt

SEQ ID NO: 877241 - DNA, 25 bp, Mus musculus
tgcttttcttttgagatccctggtg

SEQ ID NO: 877242 - DNA, 25 bp, Mus musculus
tgcttttcttttggaatggccctgt

SEQ ID NO: 877243 - DNA, 25 bp, Mus musculus
tgcttttgaacacagtgactgctgg

SEQ ID NO: 877244 - DNA, 25 bp, Mus musculus
tgcttttgaacagagtgactgctgg

SEQ ID NO: 877245 - DNA, 25 bp, Mus musculus
tgcttttgagccctttctcgaaggg

SEQ ID NO: 877246 - DNA, 25 bp, Mus musculus
tgcttttgagccgtttctcgaaggg

SEQ ID NO: 877247 - DNA, 25 bp, Mus musculus
tgcttttgaggtctgcgctagcgcc

SEQ ID NO: 877248 - DNA, 25 bp, Mus musculus
tgcttttgaggtgtgcgctagcgcc

SEQ ID NO: 877249 - DNA, 25 bp, Mus musculus
tgcttttgatccacttgttcagtcc

SEQ ID NO: 877250 - DNA, 25 bp, Mus musculus
tgcttttgatcccagtgctgaggaa

SEQ ID NO: 877251 - DNA, 25 bp, Mus musculus
tgcttttgatccgagtgctgaggaa

SEQ ID NO: 877252 - DNA, 25 bp, Mus musculus
tgcttttgatcctcttgttcagtcc

SEQ ID NO: 877253 - DNA, 25 bp, Mus musculus
tgcttttgatgtcccactgcctgga

SEQ ID NO: 877254 - DNA, 25 bp, Mus musculus
tgcttttgatgtgccactgcctgga

SEQ ID NO: 877255 - DNA, 25 bp, Mus musculus
tgcttttgcagacaacctcagttca

SEQ ID NO: 877256 - DNA, 25 bp, Mus musculus
tgcttttgcagagaacctcagttca

SEQ ID NO: 877257 - DNA, 25 bp, Mus musculus
tgcttttgcaggaaccccagaacat

SEQ ID NO: 877258 - DNA, 25 bp, Mus musculus
tgcttttgcaggtaccccagaacat

SEQ ID NO: 877259 - DNA, 25 bp, Mus musculus
tgcttttgcatacctgaggcaggag

SEQ ID NO: 877260 - DNA, 25 bp, Mus musculus
tgcttttgcatagctgaggcaggag

SEQ ID NO: 877261 - DNA, 25 bp, Mus musculus
tgcttttgcctgagccatttttggg

SEQ ID NO: 877262 - DNA, 25 bp, Mus musculus
tgcttttgcctgtgccatttttggg

SEQ ID NO: 877263 - DNA, 25 bp, Mus musculus
tgcttttgggacataaggacagaga

SEQ ID NO: 877264 - DNA, 25 bp, Mus musculus
tgcttttgggacttaaggacagaga

SEQ ID NO: 877265 - DNA, 25 bp, Mus musculus
tgcttttggtacattccaccgagtc

SEQ ID NO: 877266 - DNA, 25 bp, Mus musculus
tgcttttggtactttccaccgagtc

SEQ ID NO: 877267 - DNA, 25 bp, Mus musculus
tgcttttggtagctcacttgtatct

SEQ ID NO: 877268 - DNA, 25 bp, Mus musculus
tgcttttggtaggtcacttgtatct

SEQ ID NO: 877269 - DNA, 25 bp, Mus musculus
tgcttttggtgtagtgtttcattac

SEQ ID NO: 877270 - DNA, 25 bp, Mus musculus
tgcttttggtgttgtgtttcattac

SEQ ID NO: 877271 - DNA, 25 bp, Mus musculus
tgcttttgtaagacagtggcgctgg

SEQ ID NO: 877272 - DNA, 25 bp, Mus musculus
tgcttttgtaagtcagtggcgctgg

SEQ ID NO: 877273 - DNA, 25 bp, Mus musculus
tgcttttgtactatgggtccctggg

SEQ ID NO: 877274 - DNA, 25 bp, Mus musculus
tgcttttgtactcgcaaggcggaat

SEQ ID NO: 877275 - DNA, 25 bp, Mus musculus
tgcttttgtactggcaaggcggaat

SEQ ID NO: 877276 - DNA, 25 bp, Mus musculus
tgcttttgtactttgggtccctggg

SEQ ID NO: 877277 - DNA, 25 bp, Mus musculus
tgcttttgtctcctgagtaccagaa

SEQ ID NO: 877278 - DNA, 25 bp, Mus musculus
tgcttttgtctcgtgagtaccagaa

SEQ ID NO: 877279 - DNA, 25 bp, Mus musculus
tgcttttgtcttaccagtgatgttt

SEQ ID NO: 877280 - DNA, 25 bp, Mus musculus
tgcttttgtctttccagtgatgttt

SEQ ID NO: 877281 - DNA, 25 bp, Mus musculus
tgcttttgtgaacacgtcactgcat

SEQ ID NO: 877282 - DNA, 25 bp, Mus musculus
tgcttttgtgaagacgtcactgcat

SEQ ID NO: 877283 - DNA, 25 bp, Mus musculus
tgcttttgtgacattaaagtttggt

SEQ ID NO: 877284 - DNA, 25 bp, Mus musculus
tgcttttgtgactttaaagtttggt

SEQ ID NO: 877285 - DNA, 25 bp, Mus musculus
tgcttttgtgatatcaaccgtttaa

SEQ ID NO: 877286 - DNA, 25 bp, Mus musculus
tgcttttgtgatttcaaccgtttaa

SEQ ID NO: 877287 - DNA, 25 bp, Mus musculus
tgcttttgtgttcatcatatgacca

SEQ ID NO: 877288 - DNA, 25 bp, Mus musculus
tgcttttgtgttgatcatatgacca

SEQ ID NO: 877289 - DNA, 25 bp, Mus musculus
tgcttttgttcacatggcatcacta

SEQ ID NO: 877290 - DNA, 25 bp, Mus musculus
tgcttttgttcagatggcatcacta

SEQ ID NO: 877291 - DNA, 25 bp, Mus musculus
tgcttttgttccctgccaggacaga

SEQ ID NO: 877292 - DNA, 25 bp, Mus musculus
tgcttttgttccgtgccaggacaga

SEQ ID NO: 877293 - DNA, 25 bp, Mus musculus
tgctttttaaccaccctggaatcca

SEQ ID NO: 877294 - DNA, 25 bp, Mus musculus
tgctttttaacctccctggaatcca

SEQ ID NO: 877295 - DNA, 25 bp, Mus musculus
tgctttttataccacttgaattaga

SEQ ID NO: 877296 - DNA, 25 bp, Mus musculus
tgctttttatacgacttgaattaga

SEQ ID NO: 877297 - DNA, 25 bp, Mus musculus
tgctttttcaaaacctcgctcagat

SEQ ID NO: 877298 - DNA, 25 bp, Mus musculus
tgctttttcaaatcctcgctcagat

SEQ ID NO: 877299 - DNA, 25 bp, Mus musculus
tgctttttcacaagtcagttaaacc

SEQ ID NO: 877300 - DNA, 25 bp, Mus musculus
tgctttttcacacctttctagaact

SEQ ID NO: 877301 - DNA, 25 bp, Mus musculus
tgctttttcacagctttctagaact

SEQ ID NO: 877302 - DNA, 25 bp, Mus musculus
tgctttttcacatgtcagttaaacc

SEQ ID NO: 877303 - DNA, 25 bp, Mus musculus
tgctttttcacgctctgaccactta

SEQ ID NO: 877304 - DNA, 25 bp, Mus musculus
tgctttttcacggtctgaccactta

SEQ ID NO: 877305 - DNA, 25 bp, Mus musculus
tgctttttctagaggcatgatgtaa

SEQ ID NO: 877306 - DNA, 25 bp, Mus musculus
tgctttttctagtggcatgatgtaa

SEQ ID NO: 877307 - DNA, 25 bp, Mus musculus
tgctttttctccctgttgttatgag

SEQ ID NO: 877308 - DNA, 25 bp, Mus musculus
tgctttttctccgtgttgttatgag

SEQ ID NO: 877309 - DNA, 25 bp, Mus musculus
tgctttttctgtatgttgaataaat

SEQ ID NO: 877310 - DNA, 25 bp, Mus musculus
tgctttttctgtttgttgaataaat

SEQ ID NO: 877311 - DNA, 25 bp, Mus musculus
tgctttttcttaatccatcctgtaa

SEQ ID NO: 877312 - DNA, 25 bp, Mus musculus
tgctttttcttacatcccagcccag

SEQ ID NO: 877313 - DNA, 25 bp, Mus musculus
tgctttttcttagatcccagcccag

SEQ ID NO: 877314 - DNA, 25 bp, Mus musculus
tgctttttcttattccatcctgtaa

SEQ ID NO: 877315 - DNA, 25 bp, Mus musculus
tgctttttctttaccctgactcatt

SEQ ID NO: 877316 - DNA, 25 bp, Mus musculus
tgctttttcttttccctgactcatt

SEQ ID NO: 877317 - DNA, 25 bp, Mus musculus
tgctttttgagcacagtcgtcctag

SEQ ID NO: 877318 - DNA, 25 bp, Mus musculus
tgctttttgagctcagtcgtcctag

SEQ ID NO: 877319 - DNA, 25 bp, Mus musculus
tgctttttgccaaccatagctacaa

SEQ ID NO: 877320 - DNA, 25 bp, Mus musculus
tgctttttgccatccatagctacaa

SEQ ID NO: 877321 - DNA, 25 bp, Mus musculus
tgctttttgcccaaaagttgtggtt

SEQ ID NO: 877322 - DNA, 25 bp, Mus musculus
tgctttttgccctaaagttgtggtt

SEQ ID NO: 877323 - DNA, 25 bp, Mus musculus
tgctttttgctcagacatatattat

SEQ ID NO: 877324 - DNA, 25 bp, Mus musculus
tgctttttgctctgacatatattat

SEQ ID NO: 877325 - DNA, 25 bp, Mus musculus
tgctttttggctactatcctctgat

SEQ ID NO: 877326 - DNA, 25 bp, Mus musculus
tgctttttggcttctatcctctgat

SEQ ID NO: 877327 - DNA, 25 bp, Mus musculus
tgctttttgtctcccgatgatgggt

SEQ ID NO: 877328 - DNA, 25 bp, Mus musculus
tgctttttgtctgccgatgatgggt

SEQ ID NO: 877329 - DNA, 25 bp, Mus musculus
tgcttttttaccacattttcctgcg

SEQ ID NO: 877330 - DNA, 25 bp, Mus musculus
tgcttttttacctcattttcctgcg

SEQ ID NO: 877331 - DNA, 25 bp, Mus musculus
tgcttttttgagcttcaggtcccaa

SEQ ID NO: 877332 - DNA, 25 bp, Mus musculus
tgcttttttgaggttcaggtcccaa

SEQ ID NO: 877333 - DNA, 25 bp, Mus musculus
tgcttttttgctctttagatcgaag

SEQ ID NO: 877334 - DNA, 25 bp, Mus musculus
tgcttttttgctgtttagatcgaag

SEQ ID NO: 877335 - DNA, 25 bp, Mus musculus
tgctttttttggacttcccaacctg

SEQ ID NO: 877336 - DNA, 25 bp, Mus musculus
tgctttttttggtcttcccaacctg

SEQ ID NO: 877337 - DNA, 25 bp, Mus musculus
tggaaaaaaggcagcttaccgcttt

SEQ ID NO: 877338 - DNA, 25 bp, Mus musculus
tggaaaaaaggctgcttaccgcttt

SEQ ID NO: 877339 - DNA, 25 bp, Mus musculus
tggaaaaacacacttctttgcctaa

SEQ ID NO: 877340 - DNA, 25 bp, Mus musculus
tggaaaaacacagttctttgcctaa

SEQ ID NO: 877341 - DNA, 25 bp, Mus musculus
tggaaaaaccccacagcatttaaga

SEQ ID NO: 877342 - DNA, 25 bp, Mus musculus
tggaaaaacccctcagcatttaaga

SEQ ID NO: 877343 - DNA, 25 bp, Mus musculus
tggaaaaaccttctgccaactggaa

SEQ ID NO: 877344 - DNA, 25 bp, Mus musculus
tggaaaaaccttgtgccaactggaa

SEQ ID NO: 877345 - DNA, 25 bp, Mus musculus
tggaaaaactgaagacatgagcccc

SEQ ID NO: 877346 - DNA, 25 bp, Mus musculus
tggaaaaactgatgacatgagcccc

SEQ ID NO: 877347 - DNA, 25 bp, Mus musculus
tggaaaaagactcacccctcttacg

SEQ ID NO: 877348 - DNA, 25 bp, Mus musculus
tggaaaaagactgacccctcttacg

SEQ ID NO: 877349 - DNA, 25 bp, Mus musculus
tggaaaaatccaactggcgtgggct

SEQ ID NO: 877350 - DNA, 25 bp, Mus musculus
tggaaaaatccatctggcgtgggct

SEQ ID NO: 877351 - DNA, 25 bp, Mus musculus
tggaaaaattcccacgtccctacag

SEQ ID NO: 877352 - DNA, 25 bp, Mus musculus
tggaaaaattccgacgtccctacag

SEQ ID NO: 877353 - DNA, 25 bp, Mus musculus
tggaaaaatttcattaaccttagtg

SEQ ID NO: 877354 - DNA, 25 bp, Mus musculus
tggaaaaatttctttaaccttagtg

SEQ ID NO: 877355 - DNA, 25 bp, Mus musculus
tggaaaacaactacagagtctgact

SEQ ID NO: 877356 - DNA, 25 bp, Mus musculus
tggaaaacaacttcagagtctgact

SEQ ID NO: 877357 - DNA, 25 bp, Mus musculus
tggaaaacaatcaatcacccgggat

SEQ ID NO: 877358 - DNA, 25 bp, Mus musculus
tggaaaacaatctatcacccgggat

SEQ ID NO: 877359 - DNA, 25 bp, Mus musculus
tggaaaacatctaagagacgtggaa

SEQ ID NO: 877360 - DNA, 25 bp, Mus musculus
tggaaaacatcttagagacgtggaa

SEQ ID NO: 877361 - DNA, 25 bp, Mus musculus
tggaaaaccacaatggaccctgcca

SEQ ID NO: 877362 - DNA, 25 bp, Mus musculus
tggaaaaccacattggaccctgcca

SEQ ID NO: 877363 - DNA, 25 bp, Mus musculus
tggaaaacctgcagcctcatcctct

SEQ ID NO: 877364 - DNA, 25 bp, Mus musculus
tggaaaacctgctgcctcatcctct

SEQ ID NO: 877365 - DNA, 25 bp, Mus musculus
tggaaaaccttgcaccactctgggc

SEQ ID NO: 877366 - DNA, 25 bp, Mus musculus
tggaaaaccttggaccactctgggc

SEQ ID NO: 877367 - DNA, 25 bp, Mus musculus
tggaaaacgccacagatgtgacatg

SEQ ID NO: 877368 - DNA, 25 bp, Mus musculus
tggaaaacgccagagatgtgacatg

SEQ ID NO: 877369 - DNA, 25 bp, Mus musculus
tggaaaacgttcctggagttctgta

SEQ ID NO: 877370 - DNA, 25 bp, Mus musculus
tggaaaacgttcgtggagttctgta

SEQ ID NO: 877371 - DNA, 25 bp, Mus musculus
tggaaaactagtcacaacgccctga

SEQ ID NO: 877372 - DNA, 25 bp, Mus musculus
tggaaaactagtgacaacgccctga

SEQ ID NO: 877373 - DNA, 25 bp, Mus musculus
tggaaaactcgtccgatgcttagtt

SEQ ID NO: 877374 - DNA, 25 bp, Mus musculus
tggaaaactcgtgcgatgcttagtt

SEQ ID NO: 877375 - DNA, 25 bp, Mus musculus
tggaaaacttcaacaggtttcagtt

SEQ ID NO: 877376 - DNA, 25 bp, Mus musculus
tggaaaacttcatcaggtttcagtt

SEQ ID NO: 877377 - DNA, 25 bp, Mus musculus
tggaaaagacgtctgcaatggcaga

SEQ ID NO: 877378 - DNA, 25 bp, Mus musculus
tggaaaagacgtgtgcaatggcaga

SEQ ID NO: 877379 - DNA, 25 bp, Mus musculus
tggaaaagcccaacacagcctgcag

SEQ ID NO: 877380 - DNA, 25 bp, Mus musculus
tggaaaagcccatcacagcctgcag

SEQ ID NO: 877381 - DNA, 25 bp, Mus musculus
tggaaaagccctcgatattgcccgc

SEQ ID NO: 877382 - DNA, 25 bp, Mus musculus
tggaaaagccctggatattgcccgc

SEQ ID NO: 877383 - DNA, 25 bp, Mus musculus
tggaaaagcctgacagcccagtctg

SEQ ID NO: 877384 - DNA, 25 bp, Mus musculus
tggaaaagcctgtcagcccagtctg

SEQ ID NO: 877385 - DNA, 25 bp, Mus musculus
tggaaaagcgcgaaccctcaggggt

SEQ ID NO: 877386 - DNA, 25 bp, Mus musculus
tggaaaagcgcgtaccctcaggggt

SEQ ID NO: 877387 - DNA, 25 bp, Mus musculus
tggaaaagcttcactctgttgtgcc

SEQ ID NO: 877388 - DNA, 25 bp, Mus musculus
tggaaaagcttctctctgttgtgcc

SEQ ID NO: 877389 - DNA, 25 bp, Mus musculus
tggaaaaggagaactgagtgcataa

SEQ ID NO: 877390 - DNA, 25 bp, Mus musculus
tggaaaaggagatctgagtgcataa

SEQ ID NO: 877391 - DNA, 25 bp, Mus musculus
tggaaaaggcctatcttcttcactc

SEQ ID NO: 877392 - DNA, 25 bp, Mus musculus
tggaaaaggcctttcttcttcactc

SEQ ID NO: 877393 - DNA, 25 bp, Mus musculus
tggaaaaggcttcacccgaccttca

SEQ ID NO: 877394 - DNA, 25 bp, Mus musculus
tggaaaaggcttgacccgaccttca

SEQ ID NO: 877395 - DNA, 25 bp, Mus musculus
tggaaaaggtccatcctcgtggctt

SEQ ID NO: 877396 - DNA, 25 bp, Mus musculus
tggaaaaggtccttcctcgtggctt

SEQ ID NO: 877397 - DNA, 25 bp, Mus musculus
tggaaaagtcccagtgctgagaccc

SEQ ID NO: 877398 - DNA, 25 bp, Mus musculus
tggaaaagtccctgtgctgagaccc

SEQ ID NO: 877399 - DNA, 25 bp, Mus musculus
tggaaaagttctcttagttttactg

SEQ ID NO: 877400 - DNA, 25 bp, Mus musculus
tggaaaagttctgttagttttactg

SEQ ID NO: 877401 - DNA, 25 bp, Mus musculus
tggaaaatagaactccactattctt

SEQ ID NO: 877402 - DNA, 25 bp, Mus musculus
tggaaaatagaagtccactattctt

SEQ ID NO: 877403 - DNA, 25 bp, Mus musculus
tggaaaatatcacctcactgctcct

SEQ ID NO: 877404 - DNA, 25 bp, Mus musculus
tggaaaatatcagctcactgctcct

SEQ ID NO: 877405 - DNA, 25 bp, Mus musculus
tggaaaatatccagtatatgtgtgt

SEQ ID NO: 877406 - DNA, 25 bp, Mus musculus
tggaaaatatcctgtatatgtgtgt

SEQ ID NO: 877407 - DNA, 25 bp, Mus musculus
tggaaaatcaatatgcccctctggt

SEQ ID NO: 877408 - DNA, 25 bp, Mus musculus
tggaaaatcaatttgcccctctggt

SEQ ID NO: 877409 - DNA, 25 bp, Mus musculus
tggaaaatcccgaattccctttgct

SEQ ID NO: 877410 - DNA, 25 bp, Mus musculus
tggaaaatcccgtattccctttgct

SEQ ID NO: 877411 - DNA, 25 bp, Mus musculus
tggaaaatggaaaatactgagtaac

SEQ ID NO: 877412 - DNA, 25 bp, Mus musculus
tggaaaatggaatatactgagtaac

SEQ ID NO: 877413 - DNA, 25 bp, Mus musculus
tggaaaatgggcaccctcctcagta

SEQ ID NO: 877414 - DNA, 25 bp, Mus musculus
tggaaaatgggctccctcctcagta

SEQ ID NO: 877415 - DNA, 25 bp, Mus musculus
tggaaaatggtcatgcagtggcttt

SEQ ID NO: 877416 - DNA, 25 bp, Mus musculus
tggaaaatggtcttgcagtggcttt

SEQ ID NO: 877417 - DNA, 25 bp, Mus musculus
tggaaaatgtctccctctccaaata

SEQ ID NO: 877418 - DNA, 25 bp, Mus musculus
tggaaaatgtctgcctctccaaata

SEQ ID NO: 877419 - DNA, 25 bp, Mus musculus
tggaaaattcttaattgtgacactg

SEQ ID NO: 877420 - DNA, 25 bp, Mus musculus
tggaaaattctttattgtgacactg

SEQ ID NO: 877421 - DNA, 25 bp, Mus musculus
tggaaacaaaccaaaagctgcccta

SEQ ID NO: 877422 - DNA, 25 bp, Mus musculus
tggaaacaaacctaaagctgcccta

SEQ ID NO: 877423 - DNA, 25 bp, Mus musculus
tggaaacaaactagccggctagccg

SEQ ID NO: 877424 - DNA, 25 bp, Mus musculus
tggaaacaaacttgccggctagccg

SEQ ID NO: 877425 - DNA, 25 bp, Mus musculus
tggaaacaacacaagcagggccggt

SEQ ID NO: 877426 - DNA, 25 bp, Mus musculus
tggaaacaacactagcagggccggt

SEQ ID NO: 877427 - DNA, 25 bp, Mus musculus
tggaaacaagcccttacgaagagat

SEQ ID NO: 877428 - DNA, 25 bp, Mus musculus
tggaaacaagccgttacgaagagat

SEQ ID NO: 877429 - DNA, 25 bp, Mus musculus
tggaaacaatcacccatggaaggag

SEQ ID NO: 877430 - DNA, 25 bp, Mus musculus
tggaaacaatcagccatggaaggag

SEQ ID NO: 877431 - DNA, 25 bp, Mus musculus
tggaaacaatgtcactctggctaac

SEQ ID NO: 877432 - DNA, 25 bp, Mus musculus
tggaaacaatgtgactctggctaac

SEQ ID NO: 877433 - DNA, 25 bp, Mus musculus
tggaaacagagcctacagattttta

SEQ ID NO: 877434 - DNA, 25 bp, Mus musculus
tggaaacagagcgtacagattttta

SEQ ID NO: 877435 - DNA, 25 bp, Mus musculus
tggaaacagctcacctggataccaa

SEQ ID NO: 877436 - DNA, 25 bp, Mus musculus
tggaaacagctctcctggataccaa

SEQ ID NO: 877437 - DNA, 25 bp, Mus musculus
tggaaacagctgctgacccgtttgt

SEQ ID NO: 877438 - DNA, 25 bp, Mus musculus
tggaaacagctggtgacccgtttgt

SEQ ID NO: 877439 - DNA, 25 bp, Mus musculus
tggaaacagtgtacaaaccttcatt

SEQ ID NO: 877440 - DNA, 25 bp, Mus musculus
tggaaacagtgttcaaaccttcatt

SEQ ID NO: 877441 - DNA, 25 bp, Mus musculus
tggaaacatccccactgtggccttt

SEQ ID NO: 877442 - DNA, 25 bp, Mus musculus
tggaaacatcccgactgtggccttt

SEQ ID NO: 877443 - DNA, 25 bp, Mus musculus
tggaaacatgccatcaaattctgaa

SEQ ID NO: 877444 - DNA, 25 bp, Mus musculus
tggaaacatgccttcaaattctgaa

SEQ ID NO: 877445 - DNA, 25 bp, Mus musculus
tggaaacattctcactgcttcactt

SEQ ID NO: 877446 - DNA, 25 bp, Mus musculus
tggaaacattctgactgcttcactt

SEQ ID NO: 877447 - DNA, 25 bp, Mus musculus
tggaaacattttaccaccaaattca

SEQ ID NO: 877448 - DNA, 25 bp, Mus musculus
tggaaacatttttccaccaaattca

SEQ ID NO: 877449 - DNA, 25 bp, Mus musculus
tggaaaccacacaagattagtctgt

SEQ ID NO: 877450 - DNA, 25 bp, Mus musculus
tggaaaccacactagattagtctgt

SEQ ID NO: 877451 - DNA, 25 bp, Mus musculus
tggaaaccaccaaacttatgacctg

SEQ ID NO: 877452 - DNA, 25 bp, Mus musculus
tggaaaccaccaagataacctcaaa

SEQ ID NO: 877453 - DNA, 25 bp, Mus musculus
tggaaaccaccatacttatgacctg

SEQ ID NO: 877454 - DNA, 25 bp, Mus musculus
tggaaaccaccatgataacctcaaa

SEQ ID NO: 877455 - DNA, 25 bp, Mus musculus
tggaaaccactaatgctgacatcgt

SEQ ID NO: 877456 - DNA, 25 bp, Mus musculus
tggaaaccactattgctgacatcgt

SEQ ID NO: 877457 - DNA, 25 bp, Mus musculus
tggaaaccagaaacacccgctgtga

SEQ ID NO: 877458 - DNA, 25 bp, Mus musculus
tggaaaccagaacgaacgaagctct

SEQ ID NO: 877459 - DNA, 25 bp, Mus musculus
tggaaaccagaaggaacgaagctct

SEQ ID NO: 877460 - DNA, 25 bp, Mus musculus
tggaaaccagaatcacccgctgtga

SEQ ID NO: 877461 - DNA, 25 bp, Mus musculus
tggaaaccagcaacgagggcaccat

SEQ ID NO: 877462 - DNA, 25 bp, Mus musculus
tggaaaccagcatcgagggcaccat

SEQ ID NO: 877463 - DNA, 25 bp, Mus musculus
tggaaacccactcttttttcattgt

SEQ ID NO: 877464 - DNA, 25 bp, Mus musculus
tggaaacccactgttttttcattgt

SEQ ID NO: 877465 - DNA, 25 bp, Mus musculus
tggaaacccagacagcttttgtgat

SEQ ID NO: 877466 - DNA, 25 bp, Mus musculus
tggaaacccagagagcttttgtgat

SEQ ID NO: 877467 - DNA, 25 bp, Mus musculus
tggaaacccagccttggcatttgat

SEQ ID NO: 877468 - DNA, 25 bp, Mus musculus
tggaaacccagcgttggcatttgat

SEQ ID NO: 877469 - DNA, 25 bp, Mus musculus
tggaaaccccaaccgtgtgtgtact

SEQ ID NO: 877470 - DNA, 25 bp, Mus musculus
tggaaaccccaagcgtgtgtgtact

SEQ ID NO: 877471 - DNA, 25 bp, Mus musculus
tggaaaccccagaaggccataaaca

SEQ ID NO: 877472 - DNA, 25 bp, Mus musculus
tggaaaccccagtaggccataaaca

SEQ ID NO: 877473 - DNA, 25 bp, Mus musculus
tggaaacccctcataagttgtggct

SEQ ID NO: 877474 - DNA, 25 bp, Mus musculus
tggaaacccctcttaagttgtggct

SEQ ID NO: 877475 - DNA, 25 bp, Mus musculus
tggaaacccggaagaagcagctctc

SEQ ID NO: 877476 - DNA, 25 bp, Mus musculus
tggaaacccggaccacattttgtgc

SEQ ID NO: 877477 - DNA, 25 bp, Mus musculus
tggaaacccggagcacattttgtgc

SEQ ID NO: 877478 - DNA, 25 bp, Mus musculus
tggaaacccggatgaagcagctctc

SEQ ID NO: 877479 - DNA, 25 bp, Mus musculus
tggaaaccctaactcagcctttacg

SEQ ID NO: 877480 - DNA, 25 bp, Mus musculus
tggaaaccctaagtcagcctttacg

SEQ ID NO: 877481 - DNA, 25 bp, Mus musculus
tggaaacccttcctcagatgtcaca

SEQ ID NO: 877482 - DNA, 25 bp, Mus musculus
tggaaacccttcgtcagatgtcaca

SEQ ID NO: 877483 - DNA, 25 bp, Mus musculus
tggaaaccgccacactcttctaaga

SEQ ID NO: 877484 - DNA, 25 bp, Mus musculus
tggaaaccgccagactcttctaaga

SEQ ID NO: 877485 - DNA, 25 bp, Mus musculus
tggaaacctactcactgcaggaatg

SEQ ID NO: 877486 - DNA, 25 bp, Mus musculus
tggaaacctactgactgcaggaatg

SEQ ID NO: 877487 - DNA, 25 bp, Mus musculus
tggaaacctcacaaagccctgggct

SEQ ID NO: 877488 - DNA, 25 bp, Mus musculus
tggaaacctcactaagccctgggct

SEQ ID NO: 877489 - DNA, 25 bp, Mus musculus
tggaaacctcatatccctttcttca

SEQ ID NO: 877490 - DNA, 25 bp, Mus musculus
tggaaacctcatttccctttcttca

SEQ ID NO: 877491 - DNA, 25 bp, Mus musculus
tggaaacctcttagatggaattctc

SEQ ID NO: 877492 - DNA, 25 bp, Mus musculus
tggaaacctctttgatggaattctc

SEQ ID NO: 877493 - DNA, 25 bp, Mus musculus
tggaaacctgacaaagcgcgcctgc

SEQ ID NO: 877494 - DNA, 25 bp, Mus musculus
tggaaacctgactaagcgcgcctgc

SEQ ID NO: 877495 - DNA, 25 bp, Mus musculus
tggaaacctgtaatacaccttaaat

SEQ ID NO: 877496 - DNA, 25 bp, Mus musculus
tggaaacctgtattacaccttaaat

SEQ ID NO: 877497 - DNA, 25 bp, Mus musculus
tggaaaccttcgcatcctggatcac

SEQ ID NO: 877498 - DNA, 25 bp, Mus musculus
tggaaaccttcggatcctggatcac

SEQ ID NO: 877499 - DNA, 25 bp, Mus musculus
tggaaaccttgaagcagcaagcggg

SEQ ID NO: 877500 - DNA, 25 bp, Mus musculus
tggaaaccttgatgcagcaagcggg

SEQ ID NO: 877501 - DNA, 25 bp, Mus musculus
tggaaaccttttagcccattctgac

SEQ ID NO: 877502 - DNA, 25 bp, Mus musculus
tggaaacctttttgcccattctgac

SEQ ID NO: 877503 - DNA, 25 bp, Mus musculus
tggaaacgcttcctttgggagacct

SEQ ID NO: 877504 - DNA, 25 bp, Mus musculus
tggaaacgcttcgtttgggagacct

SEQ ID NO: 877505 - DNA, 25 bp, Mus musculus
tggaaacgtgcaccgggacaaaagc

SEQ ID NO: 877506 - DNA, 25 bp, Mus musculus
tggaaacgtgcagcgggacaaaagc

SEQ ID NO: 877507 - DNA, 25 bp, Mus musculus
tggaaactattcctagctccagttc

SEQ ID NO: 877508 - DNA, 25 bp, Mus musculus
tggaaactattcgtagctccagttc

SEQ ID NO: 877509 - DNA, 25 bp, Mus musculus
tggaaactcaggctctttacagaat

SEQ ID NO: 877510 - DNA, 25 bp, Mus musculus
tggaaactcagggtctttacagaat

SEQ ID NO: 877511 - DNA, 25 bp, Mus musculus
tggaaactcccaccctctgtgtaat

SEQ ID NO: 877512 - DNA, 25 bp, Mus musculus
tggaaactcccagcctctgtgtaat

SEQ ID NO: 877513 - DNA, 25 bp, Mus musculus
tggaaactccccagacagtcagctg

SEQ ID NO: 877514 - DNA, 25 bp, Mus musculus
tggaaactcccctgacagtcagctg

SEQ ID NO: 877515 - DNA, 25 bp, Mus musculus
tggaaactccctcaatgccttttat

SEQ ID NO: 877516 - DNA, 25 bp, Mus musculus
tggaaactccctgaatgccttttat

SEQ ID NO: 877517 - DNA, 25 bp, Mus musculus
tggaaactccgccatggggcccttt

SEQ ID NO: 877518 - DNA, 25 bp, Mus musculus
tggaaactccgcgatggggcccttt

SEQ ID NO: 877519 - DNA, 25 bp, Mus musculus
tggaaactctggcaaaacttgctga

SEQ ID NO: 877520 - DNA, 25 bp, Mus musculus
tggaaactctgggaaaacttgctga

SEQ ID NO: 877521 - DNA, 25 bp, Mus musculus
tggaaactgcacaacggagacctgt

SEQ ID NO: 877522 - DNA, 25 bp, Mus musculus
tggaaactgcactacggagacctgt

SEQ ID NO: 877523 - DNA, 25 bp, Mus musculus
tggaaactgcataagcaccccacta

SEQ ID NO: 877524 - DNA, 25 bp, Mus musculus
tggaaactgcattagcaccccacta

SEQ ID NO: 877525 - DNA, 25 bp, Mus musculus
tggaaacttgcaagcagatggccct

SEQ ID NO: 877526 - DNA, 25 bp, Mus musculus
tggaaacttgcatgcagatggccct

SEQ ID NO: 877527 - DNA, 25 bp, Mus musculus
tggaaacttgggacatacgcctttt

SEQ ID NO: 877528 - DNA, 25 bp, Mus musculus
tggaaacttgggtcatacgcctttt

SEQ ID NO: 877529 - DNA, 25 bp, Mus musculus
tggaaacttgtacgcccatgatcct

SEQ ID NO: 877530 - DNA, 25 bp, Mus musculus
tggaaacttgtaggcccatgatcct

SEQ ID NO: 877531 - DNA, 25 bp, Mus musculus
tggaaacttttgctagtacgttctt

SEQ ID NO: 877532 - DNA, 25 bp, Mus musculus
tggaaacttttggtagtacgttctt

SEQ ID NO: 877533 - DNA, 25 bp, Mus musculus
tggaaagaacaacctctgtctcccc

SEQ ID NO: 877534 - DNA, 25 bp, Mus musculus
tggaaagaacaagctctgtctcccc

SEQ ID NO: 877535 - DNA, 25 bp, Mus musculus
tggaaagaacccaagcattcagagc

SEQ ID NO: 877536 - DNA, 25 bp, Mus musculus
tggaaagaaccctagcattcagagc

SEQ ID NO: 877537 - DNA, 25 bp, Mus musculus
tggaaagaactgattgcccctcagc

SEQ ID NO: 877538 - DNA, 25 bp, Mus musculus
tggaaagaactgtttgcccctcagc

SEQ ID NO: 877539 - DNA, 25 bp, Mus musculus
tggaaagaagtcagggaagcccctt

SEQ ID NO: 877540 - DNA, 25 bp, Mus musculus
tggaaagaagtctgggaagcccctt

SEQ ID NO: 877541 - DNA, 25 bp, Mus musculus
tggaaagacaagaacccacccttct

SEQ ID NO: 877542 - DNA, 25 bp, Mus musculus
tggaaagacaagtacccacccttct

SEQ ID NO: 877543 - DNA, 25 bp, Mus musculus
tggaaagaccgcaaccttccagaca

SEQ ID NO: 877544 - DNA, 25 bp, Mus musculus
tggaaagaccgctaccttccagaca

SEQ ID NO: 877545 - DNA, 25 bp, Mus musculus
tggaaagacgtcatgatcagctggg

SEQ ID NO: 877546 - DNA, 25 bp, Mus musculus
tggaaagacgtcttgatcagctggg

SEQ ID NO: 877547 - DNA, 25 bp, Mus musculus
tggaaagagataacccctcccatgc

SEQ ID NO: 877548 - DNA, 25 bp, Mus musculus
tggaaagagatatcccctcccatgc

SEQ ID NO: 877549 - DNA, 25 bp, Mus musculus
tggaaagagcatccgtaccgtcctg

SEQ ID NO: 877550 - DNA, 25 bp, Mus musculus
tggaaagagcatgcgtaccgtcctg

SEQ ID NO: 877551 - DNA, 25 bp, Mus musculus
tggaaagagctgctaactccctcta

SEQ ID NO: 877552 - DNA, 25 bp, Mus musculus
tggaaagagctggtaactccctcta

SEQ ID NO: 877553 - DNA, 25 bp, Mus musculus
tggaaagagcttcagtcacacctcc

SEQ ID NO: 877554 - DNA, 25 bp, Mus musculus
tggaaagagcttgagtcacacctcc

SEQ ID NO: 877555 - DNA, 25 bp, Mus musculus
tggaaagagtcaactggctttcaga

SEQ ID NO: 877556 - DNA, 25 bp, Mus musculus
tggaaagagtcatctggctttcaga

SEQ ID NO: 877557 - DNA, 25 bp, Mus musculus
tggaaagatcttcaatgctcatggg

SEQ ID NO: 877558 - DNA, 25 bp, Mus musculus
tggaaagatcttgaatgctcatggg

SEQ ID NO: 877559 - DNA, 25 bp, Mus musculus
tggaaagatgtccacccagaccatg

SEQ ID NO: 877560 - DNA, 25 bp, Mus musculus
tggaaagatgtcgacccagaccatg

SEQ ID NO: 877561 - DNA, 25 bp, Mus musculus
tggaaagattccagcagtcacctga

SEQ ID NO: 877562 - DNA, 25 bp, Mus musculus
tggaaagattcctgcagtcacctga

SEQ ID NO: 877563 - DNA, 25 bp, Mus musculus
tggaaagatttgctccctgtatgtg

SEQ ID NO: 877564 - DNA, 25 bp, Mus musculus
tggaaagatttggtccctgtatgtg

SEQ ID NO: 877565 - DNA, 25 bp, Mus musculus
tggaaagcacgtcctgccaaaggct

SEQ ID NO: 877566 - DNA, 25 bp, Mus musculus
tggaaagcacgtgctgccaaaggct

SEQ ID NO: 877567 - DNA, 25 bp, Mus musculus
tggaaagcagccctggtaccagctc

SEQ ID NO: 877568 - DNA, 25 bp, Mus musculus
tggaaagcagccgtggtaccagctc

SEQ ID NO: 877569 - DNA, 25 bp, Mus musculus
tggaaagcagctcccgcgacaagcg

SEQ ID NO: 877570 - DNA, 25 bp, Mus musculus
tggaaagcagctgccgcgacaagcg

SEQ ID NO: 877571 - DNA, 25 bp, Mus musculus
tggaaagcatcaagcgtctctaccc

SEQ ID NO: 877572 - DNA, 25 bp, Mus musculus
tggaaagcatcatgcgtctctaccc

SEQ ID NO: 877573 - DNA, 25 bp, Mus musculus
tggaaagccagtattgtcccctaca

SEQ ID NO: 877574 - DNA, 25 bp, Mus musculus
tggaaagccagtcccattcacttac

SEQ ID NO: 877575 - DNA, 25 bp, Mus musculus
tggaaagccagtccccaagagtttg

SEQ ID NO: 877576 - DNA, 25 bp, Mus musculus
tggaaagccagtgccattcacttac

SEQ ID NO: 877577 - DNA, 25 bp, Mus musculus
tggaaagccagtgcccaagagtttg

SEQ ID NO: 877578 - DNA, 25 bp, Mus musculus
tggaaagccagttttgtcccctaca

SEQ ID NO: 877579 - DNA, 25 bp, Mus musculus
tggaaagcccttagaggctctggtc

SEQ ID NO: 877580 - DNA, 25 bp, Mus musculus
tggaaagccctttgaggctctggtc

SEQ ID NO: 877581 - DNA, 25 bp, Mus musculus
tggaaagccttcaccatgtagtcta

SEQ ID NO: 877582 - DNA, 25 bp, Mus musculus
tggaaagccttcacgggcatcgggt

SEQ ID NO: 877583 - DNA, 25 bp, Mus musculus
tggaaagccttctccatgtagtcta

SEQ ID NO: 877584 - DNA, 25 bp, Mus musculus
tggaaagccttctcgggcatcgggt

SEQ ID NO: 877585 - DNA, 25 bp, Mus musculus
tggaaagcgagcacgggcagacaaa

SEQ ID NO: 877586 - DNA, 25 bp, Mus musculus
tggaaagcgagctcgggcagacaaa

SEQ ID NO: 877587 - DNA, 25 bp, Mus musculus
tggaaagcggagaccccagtcctat

SEQ ID NO: 877588 - DNA, 25 bp, Mus musculus
tggaaagcggagtccccagtcctat

SEQ ID NO: 877589 - DNA, 25 bp, Mus musculus
tggaaagctgctacctgccatcact

SEQ ID NO: 877590 - DNA, 25 bp, Mus musculus
tggaaagctgcttcctgccatcact

SEQ ID NO: 877591 - DNA, 25 bp, Mus musculus
tggaaagctgggacttgtacacgtt

SEQ ID NO: 877592 - DNA, 25 bp, Mus musculus
tggaaagctgggtcttgtacacgtt

SEQ ID NO: 877593 - DNA, 25 bp, Mus musculus
tggaaagctttgcttccgtttcatc

SEQ ID NO: 877594 - DNA, 25 bp, Mus musculus
tggaaagctttggttccgtttcatc

SEQ ID NO: 877595 - DNA, 25 bp, Mus musculus
tggaaaggcacgctcctgtggtcac

SEQ ID NO: 877596 - DNA, 25 bp, Mus musculus
tggaaaggcacggtcctgtggtcac

SEQ ID NO: 877597 - DNA, 25 bp, Mus musculus
tggaaaggcagcagtcctcgaacca

SEQ ID NO: 877598 - DNA, 25 bp, Mus musculus
tggaaaggcagctgtcctcgaacca

SEQ ID NO: 877599 - DNA, 25 bp, Mus musculus
tggaaaggccctagccatctcttag

SEQ ID NO: 877600 - DNA, 25 bp, Mus musculus
tggaaaggcccttgccatctcttag

SEQ ID NO: 877601 - DNA, 25 bp, Mus musculus
tggaaaggccggacaaacttcagtt

SEQ ID NO: 877602 - DNA, 25 bp, Mus musculus
tggaaaggccggtcaaacttcagtt

SEQ ID NO: 877603 - DNA, 25 bp, Mus musculus
tggaaaggccttaacccaatgttca

SEQ ID NO: 877604 - DNA, 25 bp, Mus musculus
tggaaaggcctttacccaatgttca

SEQ ID NO: 877605 - DNA, 25 bp, Mus musculus
tggaaaggctccaatgcccatttgt

SEQ ID NO: 877606 - DNA, 25 bp, Mus musculus
tggaaaggctcctatgcccatttgt

SEQ ID NO: 877607 - DNA, 25 bp, Mus musculus
tggaaagggtggatggtcccatttc

SEQ ID NO: 877608 - DNA, 25 bp, Mus musculus
tggaaagggtggttggtcccatttc

SEQ ID NO: 877609 - DNA, 25 bp, Mus musculus
tggaaaggtcatacacccctccaag

SEQ ID NO: 877610 - DNA, 25 bp, Mus musculus
tggaaaggtcattcacccctccaag

SEQ ID NO: 877611 - DNA, 25 bp, Mus musculus
tggaaaggtctgagggctacaccca

SEQ ID NO: 877612 - DNA, 25 bp, Mus musculus
tggaaaggtctgtgggctacaccca

SEQ ID NO: 877613 - DNA, 25 bp, Mus musculus
tggaaaggtgtcacagcaggaagta

SEQ ID NO: 877614 - DNA, 25 bp, Mus musculus
tggaaaggtgtctcagcaggaagta

SEQ ID NO: 877615 - DNA, 25 bp, Mus musculus
tggaaagtaagacacagccccccct

SEQ ID NO: 877616 - DNA, 25 bp, Mus musculus
tggaaagtaagagacagccccccct

SEQ ID NO: 877617 - DNA, 25 bp, Mus musculus
tggaaagtagtcatctttttactca

SEQ ID NO: 877618 - DNA, 25 bp, Mus musculus
tggaaagtagtcttctttttactca

SEQ ID NO: 877619 - DNA, 25 bp, Mus musculus
tggaaagtcccacatgttagagagc

SEQ ID NO: 877620 - DNA, 25 bp, Mus musculus
tggaaagtcccactggaactccagg

SEQ ID NO: 877621 - DNA, 25 bp, Mus musculus
tggaaagtcccagatgttagagagc

SEQ ID NO: 877622 - DNA, 25 bp, Mus musculus
tggaaagtcccagtggaactccagg

SEQ ID NO: 877623 - DNA, 25 bp, Mus musculus
tggaaagtccctatactctttacag

SEQ ID NO: 877624 - DNA, 25 bp, Mus musculus
tggaaagtccctttactctttacag

SEQ ID NO: 877625 - DNA, 25 bp, Mus musculus
tggaaagtctccctcataccagaac

SEQ ID NO: 877626 - DNA, 25 bp, Mus musculus
tggaaagtctccgtcataccagaac

SEQ ID NO: 877627 - DNA, 25 bp, Mus musculus
tggaaagtgctgattattccccttc

SEQ ID NO: 877628 - DNA, 25 bp, Mus musculus
tggaaagtgctgtttattccccttc

SEQ ID NO: 877629 - DNA, 25 bp, Mus musculus
tggaaagtggccaccattgtgctat

SEQ ID NO: 877630 - DNA, 25 bp, Mus musculus
tggaaagtggcctccattgtgctat

SEQ ID NO: 877631 - DNA, 25 bp, Mus musculus
tggaaagtggctccccggcctccat

SEQ ID NO: 877632 - DNA, 25 bp, Mus musculus
tggaaagtggctgcccggcctccat

SEQ ID NO: 877633 - DNA, 25 bp, Mus musculus
tggaaagttcacacagcaggacatt

SEQ ID NO: 877634 - DNA, 25 bp, Mus musculus
tggaaagttcacatgtctgcacaca

SEQ ID NO: 877635 - DNA, 25 bp, Mus musculus
tggaaagttcactcagcaggacatt

SEQ ID NO: 877636 - DNA, 25 bp, Mus musculus
tggaaagttcacttgtctgcacaca

SEQ ID NO: 877637 - DNA, 25 bp, Mus musculus
tggaaagttctaatcgcctgcgttc

SEQ ID NO: 877638 - DNA, 25 bp, Mus musculus
tggaaagttctattcgcctgcgttc

SEQ ID NO: 877639 - DNA, 25 bp, Mus musculus
tggaaataaggtcgccccatggagc

SEQ ID NO: 877640 - DNA, 25 bp, Mus musculus
tggaaataaggtggccccatggagc

SEQ ID NO: 877641 - DNA, 25 bp, Mus musculus
tggaaataccagcatgcccgcacca

SEQ ID NO: 877642 - DNA, 25 bp, Mus musculus
tggaaataccaggatgcccgcacca

SEQ ID NO: 877643 - DNA, 25 bp, Mus musculus
tggaaataccctatccacttttgaa

SEQ ID NO: 877644 - DNA, 25 bp, Mus musculus
tggaaataccctttccacttttgaa

SEQ ID NO: 877645 - DNA, 25 bp, Mus musculus
tggaaatcaagtcaactggataacg

SEQ ID NO: 877646 - DNA, 25 bp, Mus musculus
tggaaatcaagtgaactggataacg

SEQ ID NO: 877647 - DNA, 25 bp, Mus musculus
tggaaatcatgtagcctgggatgct

SEQ ID NO: 877648 - DNA, 25 bp, Mus musculus
tggaaatcatgtctgcaggctccca

SEQ ID NO: 877649 - DNA, 25 bp, Mus musculus
tggaaatcatgtgtgcaggctccca

SEQ ID NO: 877650 - DNA, 25 bp, Mus musculus
tggaaatcatgttgcctgggatgct

SEQ ID NO: 877651 - DNA, 25 bp, Mus musculus
tggaaatccacacatcttcttaccc

SEQ ID NO: 877652 - DNA, 25 bp, Mus musculus
tggaaatccacagatcttcttaccc

SEQ ID NO: 877653 - DNA, 25 bp, Mus musculus
tggaaatccagcatgggatagagat

SEQ ID NO: 877654 - DNA, 25 bp, Mus musculus
tggaaatccagcttgggatagagat

SEQ ID NO: 877655 - DNA, 25 bp, Mus musculus
tggaaatcccgaaataagcactctt

SEQ ID NO: 877656 - DNA, 25 bp, Mus musculus
tggaaatcccgatataagcactctt

SEQ ID NO: 877657 - DNA, 25 bp, Mus musculus
tggaaatcctaccaacctctgatgc

SEQ ID NO: 877658 - DNA, 25 bp, Mus musculus
tggaaatcctacgaacctctgatgc

SEQ ID NO: 877659 - DNA, 25 bp, Mus musculus
tggaaatcctgtatgtcttaaacca

SEQ ID NO: 877660 - DNA, 25 bp, Mus musculus
tggaaatcctgtttgtcttaaacca

SEQ ID NO: 877661 - DNA, 25 bp, Mus musculus
tggaaatccttcatgtcatctctga

SEQ ID NO: 877662 - DNA, 25 bp, Mus musculus
tggaaatccttcttgtcatctctga

SEQ ID NO: 877663 - DNA, 25 bp, Mus musculus
tggaaatcctttccagcgcttagct

SEQ ID NO: 877664 - DNA, 25 bp, Mus musculus
tggaaatcctttgcagcgcttagct

SEQ ID NO: 877665 - DNA, 25 bp, Mus musculus
tggaaatcgacaactctgagctgct

SEQ ID NO: 877666 - DNA, 25 bp, Mus musculus
tggaaatcgacatctctgagctgct

SEQ ID NO: 877667 - DNA, 25 bp, Mus musculus
tggaaatctcatacacagccggaca

SEQ ID NO: 877668 - DNA, 25 bp, Mus musculus
tggaaatctcattcacagccggaca

SEQ ID NO: 877669 - DNA, 25 bp, Mus musculus
tggaaatctgccacagcagaggcgc

SEQ ID NO: 877670 - DNA, 25 bp, Mus musculus
tggaaatctgcctcagcagaggcgc

SEQ ID NO: 877671 - DNA, 25 bp, Mus musculus
tggaaatgagccacccgcagaggac

SEQ ID NO: 877672 - DNA, 25 bp, Mus musculus
tggaaatgagcctcccgcagaggac

SEQ ID NO: 877673 - DNA, 25 bp, Mus musculus
tggaaatgcagactgggctgtccca

SEQ ID NO: 877674 - DNA, 25 bp, Mus musculus
tggaaatgcagagtgggctgtccca

SEQ ID NO: 877675 - DNA, 25 bp, Mus musculus
tggaaatgcagcctcgcccaggaaa

SEQ ID NO: 877676 - DNA, 25 bp, Mus musculus
tggaaatgcagcgtcgcccaggaaa

SEQ ID NO: 877677 - DNA, 25 bp, Mus musculus
tggaaatgccaccacgcagaccact

SEQ ID NO: 877678 - DNA, 25 bp, Mus musculus
tggaaatgccacgacgcagaccact

SEQ ID NO: 877679 - DNA, 25 bp, Mus musculus
tggaaatgccatatgcagacaacat

SEQ ID NO: 877680 - DNA, 25 bp, Mus musculus
tggaaatgccatttgcagacaacat

SEQ ID NO: 877681 - DNA, 25 bp, Mus musculus
tggaaatgcgttatcgcgaggcgcc

SEQ ID NO: 877682 - DNA, 25 bp, Mus musculus
tggaaatgcgttttcgcgaggcgcc

SEQ ID NO: 877683 - DNA, 25 bp, Mus musculus
tggaaatggtcacacaaacctttaa

SEQ ID NO: 877684 - DNA, 25 bp, Mus musculus
tggaaatggtcagacaaacctttaa

SEQ ID NO: 877685 - DNA, 25 bp, Mus musculus
tggaaatggtttccccatcaccagg

SEQ ID NO: 877686 - DNA, 25 bp, Mus musculus
tggaaatggtttgcccatcaccagg

SEQ ID NO: 877687 - DNA, 25 bp, Mus musculus
tggaaatgtatcctcctcctggaag

SEQ ID NO: 877688 - DNA, 25 bp, Mus musculus
tggaaatgtatcgtcctcctggaag

SEQ ID NO: 877689 - DNA, 25 bp, Mus musculus
tggaaatgtccacctctactgtgtc

SEQ ID NO: 877690 - DNA, 25 bp, Mus musculus
tggaaatgtccagctctactgtgtc

SEQ ID NO: 877691 - DNA, 25 bp, Mus musculus
tggaaatgtcccaccctgatcctgg

SEQ ID NO: 877692 - DNA, 25 bp, Mus musculus
tggaaatgtccctccctgatcctgg

SEQ ID NO: 877693 - DNA, 25 bp, Mus musculus
tggaaatgtgctagcctgtaaaatt

SEQ ID NO: 877694 - DNA, 25 bp, Mus musculus
tggaaatgtgcttgcctgtaaaatt

SEQ ID NO: 877695 - DNA, 25 bp, Mus musculus
tggaaattgacacgtgccaccaact

SEQ ID NO: 877696 - DNA, 25 bp, Mus musculus
tggaaattgacaggtgccaccaact

SEQ ID NO: 877697 - DNA, 25 bp, Mus musculus
tggaaatttcaacggtgccacccaa

SEQ ID NO: 877698 - DNA, 25 bp, Mus musculus
tggaaatttcaagggtgccacccaa

SEQ ID NO: 877699 - DNA, 25 bp, Mus musculus
tggaaatttctgactattacaccgt

SEQ ID NO: 877700 - DNA, 25 bp, Mus musculus
tggaaatttctgtctattacaccgt

SEQ ID NO: 877701 - DNA, 25 bp, Mus musculus
tggaaatttgaactcttagcggttt

SEQ ID NO: 877702 - DNA, 25 bp, Mus musculus
tggaaatttgaagtcttagcggttt

SEQ ID NO: 877703 - DNA, 25 bp, Mus musculus
tggaaatttgagacgacagccaggg

SEQ ID NO: 877704 - DNA, 25 bp, Mus musculus
tggaaatttgagtcgacagccaggg

SEQ ID NO: 877705 - DNA, 25 bp, Mus musculus
tggaaattttctcaagcctcccatc

SEQ ID NO: 877706 - DNA, 25 bp, Mus musculus
tggaaattttctgaagcctcccatc

SEQ ID NO: 877707 - DNA, 25 bp, Mus musculus
tggaacaaactgacacctatcccaa

SEQ ID NO: 877708 - DNA, 25 bp, Mus musculus
tggaacaaactgtcacctatcccaa

SEQ ID NO: 877709 - DNA, 25 bp, Mus musculus
tggaacaaagtaacagccggcttga

SEQ ID NO: 877710 - DNA, 25 bp, Mus musculus
tggaacaaagtatcagccggcttga

SEQ ID NO: 877711 - DNA, 25 bp, Mus musculus
tggaacaacctcagatcctggcagc

SEQ ID NO: 877712 - DNA, 25 bp, Mus musculus
tggaacaacctctgatcctggcagc

SEQ ID NO: 877713 - DNA, 25 bp, Mus musculus
tggaacaactgcacttggtcactca

SEQ ID NO: 877714 - DNA, 25 bp, Mus musculus
tggaacaactgctcttggtcactca

SEQ ID NO: 877715 - DNA, 25 bp, Mus musculus
tggaacaagtctctgcccatttaga

SEQ ID NO: 877716 - DNA, 25 bp, Mus musculus
tggaacaagtctgtgcccatttaga

SEQ ID NO: 877717 - DNA, 25 bp, Mus musculus
tggaacaataccctgtccctctgga

SEQ ID NO: 877718 - DNA, 25 bp, Mus musculus
tggaacaataccgtgtccctctgga

SEQ ID NO: 877719 - DNA, 25 bp, Mus musculus
tggaacaatcttctcaccaggcttg

SEQ ID NO: 877720 - DNA, 25 bp, Mus musculus
tggaacaatcttgtcaccaggcttg

SEQ ID NO: 877721 - DNA, 25 bp, Mus musculus
tggaacacaaggacagtgcctgcct

SEQ ID NO: 877722 - DNA, 25 bp, Mus musculus
tggaacacaaggctgtccccgttgt

SEQ ID NO: 877723 - DNA, 25 bp, Mus musculus
tggaacacaagggtgtccccgttgt

SEQ ID NO: 877724 - DNA, 25 bp, Mus musculus
tggaacacaaggtcagtgcctgcct

SEQ ID NO: 877725 - DNA, 25 bp, Mus musculus
tggaacacaccaattgccactattc

SEQ ID NO: 877726 - DNA, 25 bp, Mus musculus
tggaacacaccatttgccactattc

SEQ ID NO: 877727 - DNA, 25 bp, Mus musculus
tggaacacagacaggccatggcttc

SEQ ID NO: 877728 - DNA, 25 bp, Mus musculus
tggaacacagactggccatggcttc

SEQ ID NO: 877729 - DNA, 25 bp, Mus musculus
tggaacacagggaagagctcaggct

SEQ ID NO: 877730 - DNA, 25 bp, Mus musculus
tggaacacagggtagagctcaggct

SEQ ID NO: 877731 - DNA, 25 bp, Mus musculus
tggaacacagttaaccccatgccag

SEQ ID NO: 877732 - DNA, 25 bp, Mus musculus
tggaacacagtttaccccatgccag

SEQ ID NO: 877733 - DNA, 25 bp, Mus musculus
tggaacacatgacgacacatacagg

SEQ ID NO: 877734 - DNA, 25 bp, Mus musculus
tggaacacatgaggacacatacagg

SEQ ID NO: 877735 - DNA, 25 bp, Mus musculus
tggaacacatggcagcagctactgt

SEQ ID NO: 877736 - DNA, 25 bp, Mus musculus
tggaacacatgggagcagctactgt

SEQ ID NO: 877737 - DNA, 25 bp, Mus musculus
tggaacacgcggacacctgatgagt

SEQ ID NO: 877738 - DNA, 25 bp, Mus musculus
tggaacacgcggtcacctgatgagt

SEQ ID NO: 877739 - DNA, 25 bp, Mus musculus
tggaacactaacaccggttttctgt

SEQ ID NO: 877740 - DNA, 25 bp, Mus musculus
tggaacactaactccggttttctgt

SEQ ID NO: 877741 - DNA, 25 bp, Mus musculus
tggaacactcacacggacatcagtg

SEQ ID NO: 877742 - DNA, 25 bp, Mus musculus
tggaacactcactcggacatcagtg

SEQ ID NO: 877743 - DNA, 25 bp, Mus musculus
tggaacactggcaccagctagtgga

SEQ ID NO: 877744 - DNA, 25 bp, Mus musculus
tggaacactggctccagctagtgga

SEQ ID NO: 877745 - DNA, 25 bp, Mus musculus
tggaacagaagccagccttgacgga

SEQ ID NO: 877746 - DNA, 25 bp, Mus musculus
tggaacagaagcgagccttgacgga

SEQ ID NO: 877747 - DNA, 25 bp, Mus musculus
tggaacagagccaaacctacccaca

SEQ ID NO: 877748 - DNA, 25 bp, Mus musculus
tggaacagagcctaacctacccaca

SEQ ID NO: 877749 - DNA, 25 bp, Mus musculus
tggaacagagggagggactccccct

SEQ ID NO: 877750 - DNA, 25 bp, Mus musculus
tggaacagagggtgggactccccct

SEQ ID NO: 877751 - DNA, 25 bp, Mus musculus
tggaacagcaccatgctacctaaaa

SEQ ID NO: 877752 - DNA, 25 bp, Mus musculus
tggaacagcaccttgctacctaaaa

SEQ ID NO: 877753 - DNA, 25 bp, Mus musculus
tggaacagcagaccttatgtaagga

SEQ ID NO: 877754 - DNA, 25 bp, Mus musculus
tggaacagcagagcttatgtaagga

SEQ ID NO: 877755 - DNA, 25 bp, Mus musculus
tggaacagcagtcacctcgggcctg

SEQ ID NO: 877756 - DNA, 25 bp, Mus musculus
tggaacagcagtgacctcgggcctg

SEQ ID NO: 877757 - DNA, 25 bp, Mus musculus
tggaacagccccacggaggaagacc

SEQ ID NO: 877758 - DNA, 25 bp, Mus musculus
tggaacagcccctcggaggaagacc

SEQ ID NO: 877759 - DNA, 25 bp, Mus musculus
tggaacagctcaatgtagccctgca

SEQ ID NO: 877760 - DNA, 25 bp, Mus musculus
tggaacagctcattgtagccctgca

SEQ ID NO: 877761 - DNA, 25 bp, Mus musculus
tggaacaggaccattgctgcttcga

SEQ ID NO: 877762 - DNA, 25 bp, Mus musculus
tggaacaggacctttgctgcttcga

SEQ ID NO: 877763 - DNA, 25 bp, Mus musculus
tggaacaggctgcagatctttttaa

SEQ ID NO: 877764 - DNA, 25 bp, Mus musculus
tggaacaggctggagatctttttaa

SEQ ID NO: 877765 - DNA, 25 bp, Mus musculus
tggaacagtaccagtccacgggcta

SEQ ID NO: 877766 - DNA, 25 bp, Mus musculus
tggaacagtacctgtccacgggcta

SEQ ID NO: 877767 - DNA, 25 bp, Mus musculus
tggaacagttaaccgaagaccctca

SEQ ID NO: 877768 - DNA, 25 bp, Mus musculus
tggaacagttaagcgaagaccctca

SEQ ID NO: 877769 - DNA, 25 bp, Mus musculus
tggaacatatctatccctttaaact

SEQ ID NO: 877770 - DNA, 25 bp, Mus musculus
tggaacatatctttccctttaaact

SEQ ID NO: 877771 - DNA, 25 bp, Mus musculus
tggaacatcacaattccctgaagaa

SEQ ID NO: 877772 - DNA, 25 bp, Mus musculus
tggaacatcacatttccctgaagaa

SEQ ID NO: 877773 - DNA, 25 bp, Mus musculus
tggaacatccttaaatcctctgagc

SEQ ID NO: 877774 - DNA, 25 bp, Mus musculus
tggaacatcctttaatcctctgagc

SEQ ID NO: 877775 - DNA, 25 bp, Mus musculus
tggaacatcggacccagcttacctt

SEQ ID NO: 877776 - DNA, 25 bp, Mus musculus
tggaacatcggagccagcttacctt

SEQ ID NO: 877777 - DNA, 25 bp, Mus musculus
tggaacatgaccagtatccgccagc

SEQ ID NO: 877778 - DNA, 25 bp, Mus musculus
tggaacatgacctgtatccgccagc

SEQ ID NO: 877779 - DNA, 25 bp, Mus musculus
tggaacattacaaccccttgggtgg

SEQ ID NO: 877780 - DNA, 25 bp, Mus musculus
tggaacattacatccccttgggtgg

SEQ ID NO: 877781 - DNA, 25 bp, Mus musculus
tggaacattgttacctactccactg

SEQ ID NO: 877782 - DNA, 25 bp, Mus musculus
tggaacattgtttcctactccactg

SEQ ID NO: 877783 - DNA, 25 bp, Mus musculus
tggaacatttaaacccaacaatagg

SEQ ID NO: 877784 - DNA, 25 bp, Mus musculus
tggaacatttaatcccaacaatagg

SEQ ID NO: 877785 - DNA, 25 bp, Mus musculus
tggaaccaatgcactgcgggcaatg

SEQ ID NO: 877786 - DNA, 25 bp, Mus musculus
tggaaccaatgctctgcgggcaatg

SEQ ID NO: 877787 - DNA, 25 bp, Mus musculus
tggaaccacacacttcttttctttt

SEQ ID NO: 877788 - DNA, 25 bp, Mus musculus
tggaaccacacagttcttttctttt

SEQ ID NO: 877789 - DNA, 25 bp, Mus musculus
tggaaccacagacgcggagacttgc

SEQ ID NO: 877790 - DNA, 25 bp, Mus musculus
tggaaccacagaggcggagacttgc

SEQ ID NO: 877791 - DNA, 25 bp, Mus musculus
tggaaccacagcacttcagacctag

SEQ ID NO: 877792 - DNA, 25 bp, Mus musculus
tggaaccacagctcttcagacctag

SEQ ID NO: 877793 - DNA, 25 bp, Mus musculus
tggaaccacatgctcactctagcca

SEQ ID NO: 877794 - DNA, 25 bp, Mus musculus
tggaaccacatggtcactctagcca

SEQ ID NO: 877795 - DNA, 25 bp, Mus musculus
tggaaccaccttcctgtgtcaggaa

SEQ ID NO: 877796 - DNA, 25 bp, Mus musculus
tggaaccaccttgctgtgtcaggaa

SEQ ID NO: 877797 - DNA, 25 bp, Mus musculus
tggaaccacgccagtgactcatcac

SEQ ID NO: 877798 - DNA, 25 bp, Mus musculus
tggaaccacgcctgtgactcatcac

SEQ ID NO: 877799 - DNA, 25 bp, Mus musculus
tggaaccactcaaggcacatcttag

SEQ ID NO: 877800 - DNA, 25 bp, Mus musculus
tggaaccactcatggcacatcttag

SEQ ID NO: 877801 - DNA, 25 bp, Mus musculus
tggaaccactgaccattctctatta

SEQ ID NO: 877802 - DNA, 25 bp, Mus musculus
tggaaccactgagcattctctatta

SEQ ID NO: 877803 - DNA, 25 bp, Mus musculus
tggaaccagactatgacctgccttt

SEQ ID NO: 877804 - DNA, 25 bp, Mus musculus
tggaaccagactttgacctgccttt

SEQ ID NO: 877805 - DNA, 25 bp, Mus musculus
tggaaccaggccaatattctgagat

SEQ ID NO: 877806 - DNA, 25 bp, Mus musculus
tggaaccaggcctatattctgagat

SEQ ID NO: 877807 - DNA, 25 bp, Mus musculus
tggaaccaggtaaagtggcccatac

SEQ ID NO: 877808 - DNA, 25 bp, Mus musculus
tggaaccaggtatagtggcccatac

SEQ ID NO: 877809 - DNA, 25 bp, Mus musculus
tggaaccagtgcacatatgtcatgt

SEQ ID NO: 877810 - DNA, 25 bp, Mus musculus
tggaaccagtgctcatatgtcatgt

SEQ ID NO: 877811 - DNA, 25 bp, Mus musculus
tggaaccatctacggaggcctgcca

SEQ ID NO: 877812 - DNA, 25 bp, Mus musculus
tggaaccatctagggaggcctgcca

SEQ ID NO: 877813 - DNA, 25 bp, Mus musculus
tggaaccatctccaaattccaaata

SEQ ID NO: 877814 - DNA, 25 bp, Mus musculus
tggaaccatctcgaaattccaaata

SEQ ID NO: 877815 - DNA, 25 bp, Mus musculus
tggaacccaagacccaagaactgtt

SEQ ID NO: 877816 - DNA, 25 bp, Mus musculus
tggaacccaagagccaagaactgtt

SEQ ID NO: 877817 - DNA, 25 bp, Mus musculus
tggaacccaattcatgcacactagg

SEQ ID NO: 877818 - DNA, 25 bp, Mus musculus
tggaacccaattgatgcacactagg

SEQ ID NO: 877819 - DNA, 25 bp, Mus musculus
tggaacccacgtcacagctcagtac

SEQ ID NO: 877820 - DNA, 25 bp, Mus musculus
tggaacccacgtgacagctcagtac

SEQ ID NO: 877821 - DNA, 25 bp, Mus musculus
tggaacccagagcacacatgagtcc

SEQ ID NO: 877822 - DNA, 25 bp, Mus musculus
tggaacccagaggacacatgagtcc

SEQ ID NO: 877823 - DNA, 25 bp, Mus musculus
tggaacccaggtcccactaagtttt

SEQ ID NO: 877824 - DNA, 25 bp, Mus musculus
tggaacccaggtgccactaagtttt

SEQ ID NO: 877825 - DNA, 25 bp, Mus musculus
tggaacccatccagtggaagcttcc

SEQ ID NO: 877826 - DNA, 25 bp, Mus musculus
tggaacccatcctgtggaagcttcc

SEQ ID NO: 877827 - DNA, 25 bp, Mus musculus
tggaacccattacaagctggtgccc

SEQ ID NO: 877828 - DNA, 25 bp, Mus musculus
tggaacccattagaagctggtgccc

SEQ ID NO: 877829 - DNA, 25 bp, Mus musculus
tggaaccccattagtttgggattag

SEQ ID NO: 877830 - DNA, 25 bp, Mus musculus
tggaaccccatttgtttgggattag

SEQ ID NO: 877831 - DNA, 25 bp, Mus musculus
tggaacccctttaacggatcaatat

SEQ ID NO: 877832 - DNA, 25 bp, Mus musculus
tggaaccccttttacggatcaatat

SEQ ID NO: 877833 - DNA, 25 bp, Mus musculus
tggaacccgacaccgctgcgtttgg

SEQ ID NO: 877834 - DNA, 25 bp, Mus musculus
tggaacccgacagcgctgcgtttgg

SEQ ID NO: 877835 - DNA, 25 bp, Mus musculus
tggaacccggctccctgaaggtaga

SEQ ID NO: 877836 - DNA, 25 bp, Mus musculus
tggaacccggctgcctgaaggtaga

SEQ ID NO: 877837 - DNA, 25 bp, Mus musculus
tggaaccctatacttctgcattcgg

SEQ ID NO: 877838 - DNA, 25 bp, Mus musculus
tggaaccctatagttctgcattcgg

SEQ ID NO: 877839 - DNA, 25 bp, Mus musculus
tggaaccctattaacattcaagtaa

SEQ ID NO: 877840 - DNA, 25 bp, Mus musculus
tggaaccctatttacattcaagtaa

SEQ ID NO: 877841 - DNA, 25 bp, Mus musculus
tggaaccctctgatcaacttgctgg

SEQ ID NO: 877842 - DNA, 25 bp, Mus musculus
tggaaccctctgttcaacttgctgg

SEQ ID NO: 877843 - DNA, 25 bp, Mus musculus
tggaaccctcttatcccagaggagt

SEQ ID NO: 877844 - DNA, 25 bp, Mus musculus
tggaaccctcttttcccagaggagt

SEQ ID NO: 877845 - DNA, 25 bp, Mus musculus
tggaaccctgttcggcacagatcat

SEQ ID NO: 877846 - DNA, 25 bp, Mus musculus
tggaaccctgttgggcacagatcat

SEQ ID NO: 877847 - DNA, 25 bp, Mus musculus
tggaacccttcccagaggattagtg

SEQ ID NO: 877848 - DNA, 25 bp, Mus musculus
tggaacccttccgagaggattagtg

SEQ ID NO: 877849 - DNA, 25 bp, Mus musculus
tggaaccgaaagagggcgtgctttt

SEQ ID NO: 877850 - DNA, 25 bp, Mus musculus
tggaaccgaaagtgggcgtgctttt

SEQ ID NO: 877851 - DNA, 25 bp, Mus musculus
tggaaccgcccacatagaggatccg

SEQ ID NO: 877852 - DNA, 25 bp, Mus musculus
tggaaccgcccagatagaggatccg

SEQ ID NO: 877853 - DNA, 25 bp, Mus musculus
tggaaccggaatccttgtcaacaaa

SEQ ID NO: 877854 - DNA, 25 bp, Mus musculus
tggaaccggaatgcttgtcaacaaa

SEQ ID NO: 877855 - DNA, 25 bp, Mus musculus
tggaaccgggcacagcatagccttc

SEQ ID NO: 877856 - DNA, 25 bp, Mus musculus
tggaaccgggcagagcatagccttc

SEQ ID NO: 877857 - DNA, 25 bp, Mus musculus
tggaaccgtctcatgcggcagttgg

SEQ ID NO: 877858 - DNA, 25 bp, Mus musculus
tggaaccgtctcttgcggcagttgg

SEQ ID NO: 877859 - DNA, 25 bp, Mus musculus
tggaaccgttccaactggatcccaa

SEQ ID NO: 877860 - DNA, 25 bp, Mus musculus
tggaaccgttcctactggatcccaa

SEQ ID NO: 877861 - DNA, 25 bp, Mus musculus
tggaacctaaccagggctctgagag

SEQ ID NO: 877862 - DNA, 25 bp, Mus musculus
tggaacctaacctgggctctgagag

SEQ ID NO: 877863 - DNA, 25 bp, Mus musculus
tggaacctaccaactagaaactcaa

SEQ ID NO: 877864 - DNA, 25 bp, Mus musculus
tggaacctaccatctagaaactcaa

SEQ ID NO: 877865 - DNA, 25 bp, Mus musculus
tggaacctcactacagaccctggaa

SEQ ID NO: 877866 - DNA, 25 bp, Mus musculus
tggaacctcacttcagaccctggaa

SEQ ID NO: 877867 - DNA, 25 bp, Mus musculus
tggaacctcagcagggcaacactgc

SEQ ID NO: 877868 - DNA, 25 bp, Mus musculus
tggaacctcagctgggcaacactgc

SEQ ID NO: 877869 - DNA, 25 bp, Mus musculus
tggaacctcccaaaggactttctgt

SEQ ID NO: 877870 - DNA, 25 bp, Mus musculus
tggaacctcccataggactttctgt

SEQ ID NO: 877871 - DNA, 25 bp, Mus musculus
tggaacctccgtagcctgaggacgg

SEQ ID NO: 877872 - DNA, 25 bp, Mus musculus
tggaacctccgttgcctgaggacgg

SEQ ID NO: 877873 - DNA, 25 bp, Mus musculus
tggaacctcggtcccagacacattt

SEQ ID NO: 877874 - DNA, 25 bp, Mus musculus
tggaacctcggtgccagacacattt

SEQ ID NO: 877875 - DNA, 25 bp, Mus musculus
tggaacctctgcaccctgatgggaa

SEQ ID NO: 877876 - DNA, 25 bp, Mus musculus
tggaacctctgctccctgatgggaa

SEQ ID NO: 877877 - DNA, 25 bp, Mus musculus
tggaacctgccaagtaagaggaact

SEQ ID NO: 877878 - DNA, 25 bp, Mus musculus
tggaacctgccacttgttttctttc

SEQ ID NO: 877879 - DNA, 25 bp, Mus musculus
tggaacctgccagttgttttctttc

SEQ ID NO: 877880 - DNA, 25 bp, Mus musculus
tggaacctgccatgtaagaggaact

SEQ ID NO: 877881 - DNA, 25 bp, Mus musculus
tggaacctgctgattcgtgacacgc

SEQ ID NO: 877882 - DNA, 25 bp, Mus musculus
tggaacctgctgtttcgtgacacgc

SEQ ID NO: 877883 - DNA, 25 bp, Mus musculus
tggaacctgcttaagagctaggtac

SEQ ID NO: 877884 - DNA, 25 bp, Mus musculus
tggaacctgctttagagctaggtac

SEQ ID NO: 877885 - DNA, 25 bp, Mus musculus
tggaacctggctcctgctaattcac

SEQ ID NO: 877886 - DNA, 25 bp, Mus musculus
tggaacctggctgctgctaattcac

SEQ ID NO: 877887 - DNA, 25 bp, Mus musculus
tggaacctggttactccactgccac

SEQ ID NO: 877888 - DNA, 25 bp, Mus musculus
tggaacctggtttctccactgccac

SEQ ID NO: 877889 - DNA, 25 bp, Mus musculus
tggaacctgtgtctgtataggagtc

SEQ ID NO: 877890 - DNA, 25 bp, Mus musculus
tggaacctgtgtgtgtataggagtc

SEQ ID NO: 877891 - DNA, 25 bp, Mus musculus
tggaaccttgagacctattctctac

SEQ ID NO: 877892 - DNA, 25 bp, Mus musculus
tggaaccttgagtcctattctctac

SEQ ID NO: 877893 - DNA, 25 bp, Mus musculus
tggaaccttgccctgaatcctgaag

SEQ ID NO: 877894 - DNA, 25 bp, Mus musculus
tggaaccttgccgtgaatcctgaag

SEQ ID NO: 877895 - DNA, 25 bp, Mus musculus
tggaaccttggaaggagcccagctc

SEQ ID NO: 877896 - DNA, 25 bp, Mus musculus
tggaaccttggacacctgtccagat

SEQ ID NO: 877897 - DNA, 25 bp, Mus musculus
tggaaccttggagacctgtccagat

SEQ ID NO: 877898 - DNA, 25 bp, Mus musculus
tggaaccttggatggagcccagctc

SEQ ID NO: 877899 - DNA, 25 bp, Mus musculus
tggaaccttgtacagtcagtccttc

SEQ ID NO: 877900 - DNA, 25 bp, Mus musculus
tggaaccttgtagagtcagtccttc

SEQ ID NO: 877901 - DNA, 25 bp, Mus musculus
tggaacctttcaagcctcataaatg

SEQ ID NO: 877902 - DNA, 25 bp, Mus musculus
tggaacctttcatgcctcataaatg

SEQ ID NO: 877903 - DNA, 25 bp, Mus musculus
tggaacgagatgctggcctatcacc

SEQ ID NO: 877904 - DNA, 25 bp, Mus musculus
tggaacgagatggtggcctatcacc

SEQ ID NO: 877905 - DNA, 25 bp, Mus musculus
tggaacgcaagcaccgggaagtcat

SEQ ID NO: 877906 - DNA, 25 bp, Mus musculus
tggaacgcaagctccgggaagtcat

SEQ ID NO: 877907 - DNA, 25 bp, Mus musculus
tggaacgcaagtactcccactattg

SEQ ID NO: 877908 - DNA, 25 bp, Mus musculus
tggaacgcaagttctcccactattg

SEQ ID NO: 877909 - DNA, 25 bp, Mus musculus
tggaacgcagccagctgattgcagc

SEQ ID NO: 877910 - DNA, 25 bp, Mus musculus
tggaacgcagcctgctgattgcagc

SEQ ID NO: 877911 - DNA, 25 bp, Mus musculus
tggaacgccaagaagtacagcactt

SEQ ID NO: 877912 - DNA, 25 bp, Mus musculus
tggaacgccaagtagtacagcactt

SEQ ID NO: 877913 - DNA, 25 bp, Mus musculus
tggaacgccttcaggttttgcctgg

SEQ ID NO: 877914 - DNA, 25 bp, Mus musculus
tggaacgccttctggttttgcctgg

SEQ ID NO: 877915 - DNA, 25 bp, Mus musculus
tggaacgcgcacaaccggagctgtc

SEQ ID NO: 877916 - DNA, 25 bp, Mus musculus
tggaacgcgcactaccggagctgtc

SEQ ID NO: 877917 - DNA, 25 bp, Mus musculus
tggaacgctgcaatacctcgaggac

SEQ ID NO: 877918 - DNA, 25 bp, Mus musculus
tggaacgctgcattacctcgaggac

SEQ ID NO: 877919 - DNA, 25 bp, Mus musculus
tggaacggcgttatgatgccatgcc

SEQ ID NO: 877920 - DNA, 25 bp, Mus musculus
tggaacggcgttttgatgccatgcc

SEQ ID NO: 877921 - DNA, 25 bp, Mus musculus
tggaacgggccgctcgcgctagtgg

SEQ ID NO: 877922 - DNA, 25 bp, Mus musculus
tggaacgggccggtcgcgctagtgg

SEQ ID NO: 877923 - DNA, 25 bp, Mus musculus
tggaacgtagaaccaacccctcaag

SEQ ID NO: 877924 - DNA, 25 bp, Mus musculus
tggaacgtagaagcaacccctcaag

SEQ ID NO: 877925 - DNA, 25 bp, Mus musculus
tggaacgtccgtctctatgtttcta

SEQ ID NO: 877926 - DNA, 25 bp, Mus musculus
tggaacgtccgtgtctatgtttcta

SEQ ID NO: 877927 - DNA, 25 bp, Mus musculus
tggaacgtctttccctatgacctgc

SEQ ID NO: 877928 - DNA, 25 bp, Mus musculus
tggaacgtctttgcctatgacctgc

SEQ ID NO: 877929 - DNA, 25 bp, Mus musculus
tggaacgttctaatgtatgtgagaa

SEQ ID NO: 877930 - DNA, 25 bp, Mus musculus
tggaacgttctattgtatgtgagaa

SEQ ID NO: 877931 - DNA, 25 bp, Mus musculus
tggaactaaagcattagcttagcta

SEQ ID NO: 877932 - DNA, 25 bp, Mus musculus
tggaactaaagctttagcttagcta

SEQ ID NO: 877933 - DNA, 25 bp, Mus musculus
tggaactaccagattgattactttg

SEQ ID NO: 877934 - DNA, 25 bp, Mus musculus
tggaactaccagtttgattactttg

SEQ ID NO: 877935 - DNA, 25 bp, Mus musculus
tggaactactccataacagcagcac

SEQ ID NO: 877936 - DNA, 25 bp, Mus musculus
tggaactactccttaacagcagcac

SEQ ID NO: 877937 - DNA, 25 bp, Mus musculus
tggaactagggcactgtggttgaaa

SEQ ID NO: 877938 - DNA, 25 bp, Mus musculus
tggaactagggcataaggactcaga

SEQ ID NO: 877939 - DNA, 25 bp, Mus musculus
tggaactagggctctgtggttgaaa

SEQ ID NO: 877940 - DNA, 25 bp, Mus musculus
tggaactagggcttaaggactcaga

SEQ ID NO: 877941 - DNA, 25 bp, Mus musculus
tggaactatagtcccacacgatggt

SEQ ID NO: 877942 - DNA, 25 bp, Mus musculus
tggaactatagtgccacacgatggt

SEQ ID NO: 877943 - DNA, 25 bp, Mus musculus
tggaactatctgcttgagcccctca

SEQ ID NO: 877944 - DNA, 25 bp, Mus musculus
tggaactatctggttgagcccctca

SEQ ID NO: 877945 - DNA, 25 bp, Mus musculus
tggaactcaacaacctgtaagggct

SEQ ID NO: 877946 - DNA, 25 bp, Mus musculus
tggaactcaacatcctgtaagggct

SEQ ID NO: 877947 - DNA, 25 bp, Mus musculus
tggaactcaccacgaatcacagtta

SEQ ID NO: 877948 - DNA, 25 bp, Mus musculus
tggaactcaccaggaatcacagtta

SEQ ID NO: 877949 - DNA, 25 bp, Mus musculus
tggaactcactgagacatttccaca

SEQ ID NO: 877950 - DNA, 25 bp, Mus musculus
tggaactcactgagcttcctgcttt

SEQ ID NO: 877951 - DNA, 25 bp, Mus musculus
tggaactcactgtgacatttccaca

SEQ ID NO: 877952 - DNA, 25 bp, Mus musculus
tggaactcactgtgcttcctgcttt

SEQ ID NO: 877953 - DNA, 25 bp, Mus musculus
tggaactcagaaattggtgcatgct

SEQ ID NO: 877954 - DNA, 25 bp, Mus musculus
tggaactcagaatttggtgcatgct

SEQ ID NO: 877955 - DNA, 25 bp, Mus musculus
tggaactcaggcatcatctcagtca

SEQ ID NO: 877956 - DNA, 25 bp, Mus musculus
tggaactcaggcttcatctcagtca

SEQ ID NO: 877957 - DNA, 25 bp, Mus musculus
tggaactcataaccggacccctgga

SEQ ID NO: 877958 - DNA, 25 bp, Mus musculus
tggaactcataagcggacccctgga

SEQ ID NO: 877959 - DNA, 25 bp, Mus musculus
tggaactcatttagtggagcaggtt

SEQ ID NO: 877960 - DNA, 25 bp, Mus musculus
tggaactcattttgtggagcaggtt

SEQ ID NO: 877961 - DNA, 25 bp, Mus musculus
tggaactccacaccgcaagaccagt

SEQ ID NO: 877962 - DNA, 25 bp, Mus musculus
tggaactccacagcgcaagaccagt

SEQ ID NO: 877963 - DNA, 25 bp, Mus musculus
tggaactccagcctaacctgcctta

SEQ ID NO: 877964 - DNA, 25 bp, Mus musculus
tggaactccagcgtaacctgcctta

SEQ ID NO: 877965 - DNA, 25 bp, Mus musculus
tggaactccatcactagcggtgcct

SEQ ID NO: 877966 - DNA, 25 bp, Mus musculus
tggaactccatctctagcggtgcct

SEQ ID NO: 877967 - DNA, 25 bp, Mus musculus
tggaactcccttagtcactgcctat

SEQ ID NO: 877968 - DNA, 25 bp, Mus musculus
tggaactccctttgtcactgcctat

SEQ ID NO: 877969 - DNA, 25 bp, Mus musculus
tggaactcctctcaggccccaagga

SEQ ID NO: 877970 - DNA, 25 bp, Mus musculus
tggaactcctctgaggccccaagga

SEQ ID NO: 877971 - DNA, 25 bp, Mus musculus
tggaactcgagaccacctctctcta

SEQ ID NO: 877972 - DNA, 25 bp, Mus musculus
tggaactcgagagcacctctctcta

SEQ ID NO: 877973 - DNA, 25 bp, Mus musculus
tggaactcgagcacgggttgcaccg

SEQ ID NO: 877974 - DNA, 25 bp, Mus musculus
tggaactcgagctcgggttgcaccg

SEQ ID NO: 877975 - DNA, 25 bp, Mus musculus
tggaactcgctgatttgactaccct

SEQ ID NO: 877976 - DNA, 25 bp, Mus musculus
tggaactcgctgttttgactaccct

SEQ ID NO: 877977 - DNA, 25 bp, Mus musculus
tggaactctaggctctgccgtgcta

SEQ ID NO: 877978 - DNA, 25 bp, Mus musculus
tggaactctagggtctgccgtgcta

SEQ ID NO: 877979 - DNA, 25 bp, Mus musculus
tggaactctcaactctcgagcctga

SEQ ID NO: 877980 - DNA, 25 bp, Mus musculus
tggaactctcaagtctcgagcctga

SEQ ID NO: 877981 - DNA, 25 bp, Mus musculus
tggaactctcacatcttccagagcg

SEQ ID NO: 877982 - DNA, 25 bp, Mus musculus
tggaactctcacttcttccagagcg

SEQ ID NO: 877983 - DNA, 25 bp, Mus musculus
tggaactctgaaatctgtctgtctc

SEQ ID NO: 877984 - DNA, 25 bp, Mus musculus
tggaactctgaattctgtctgtctc

SEQ ID NO: 877985 - DNA, 25 bp, Mus musculus
tggaactcttctctagccgggaaag

SEQ ID NO: 877986 - DNA, 25 bp, Mus musculus
tggaactcttctgtagccgggaaag

SEQ ID NO: 877987 - DNA, 25 bp, Mus musculus
tggaactcttgcagtcacccaatag

SEQ ID NO: 877988 - DNA, 25 bp, Mus musculus
tggaactcttgctgtcacccaatag

SEQ ID NO: 877989 - DNA, 25 bp, Mus musculus
tggaactctttgaagggcagtaaac

SEQ ID NO: 877990 - DNA, 25 bp, Mus musculus
tggaactctttgtagggcagtaaac

SEQ ID NO: 877991 - DNA, 25 bp, Mus musculus
tggaactgcactagcagtctcctac

SEQ ID NO: 877992 - DNA, 25 bp, Mus musculus
tggaactgcacttgcagtctcctac

SEQ ID NO: 877993 - DNA, 25 bp, Mus musculus
tggaactgcccacgtgtccacagag

SEQ ID NO: 877994 - DNA, 25 bp, Mus musculus
tggaactgcccaggtgtccacagag

SEQ ID NO: 877995 - DNA, 25 bp, Mus musculus
tggaactggattacacacagctctg

SEQ ID NO: 877996 - DNA, 25 bp, Mus musculus
tggaactggatttcacacagctctg

SEQ ID NO: 877997 - DNA, 25 bp, Mus musculus
tggaactggcacatttcccacgggt

SEQ ID NO: 877998 - DNA, 25 bp, Mus musculus
tggaactggcacttttcccacgggt

SEQ ID NO: 877999 - DNA, 25 bp, Mus musculus
tggaactggccaatgcacttagcaa

SEQ ID NO: 878000 - DNA, 25 bp, Mus musculus
tggaactggccattgcacttagcaa

SEQ ID NO: 878001 - DNA, 25 bp, Mus musculus
tggaactggtccctggttactctgc

SEQ ID NO: 878002 - DNA, 25 bp, Mus musculus
tggaactggtccgtggttactctgc

SEQ ID NO: 878003 - DNA, 25 bp, Mus musculus
tggaactggtggaagagatgactgt

SEQ ID NO: 878004 - DNA, 25 bp, Mus musculus
tggaactggtggtagagatgactgt

SEQ ID NO: 878005 - DNA, 25 bp, Mus musculus
tggaactgtaggctgtgaacccaga

SEQ ID NO: 878006 - DNA, 25 bp, Mus musculus
tggaactgtagggtgtgaacccaga

SEQ ID NO: 878007 - DNA, 25 bp, Mus musculus
tggaactgtggaagtatcaagccct

SEQ ID NO: 878008 - DNA, 25 bp, Mus musculus
tggaactgtggatgtatcaagccct

SEQ ID NO: 878009 - DNA, 25 bp, Mus musculus
tggaactgttgccttgggccacttc

SEQ ID NO: 878010 - DNA, 25 bp, Mus musculus
tggaactgttgcgttgggccacttc

SEQ ID NO: 878011 - DNA, 25 bp, Mus musculus
tggaacttaaagctttctgtctgaa

SEQ ID NO: 878012 - DNA, 25 bp, Mus musculus
tggaacttaaaggtttctgtctgaa

SEQ ID NO: 878013 - DNA, 25 bp, Mus musculus
tggaacttatccaaggacagcagtt

SEQ ID NO: 878014 - DNA, 25 bp, Mus musculus
tggaacttatcctaggacagcagtt

SEQ ID NO: 878015 - DNA, 25 bp, Mus musculus
tggaacttcaaacatgtcattcttt

SEQ ID NO: 878016 - DNA, 25 bp, Mus musculus
tggaacttcaaagatgtcattcttt

SEQ ID NO: 878017 - DNA, 25 bp, Mus musculus
tggaacttcaggactccttgttgag

SEQ ID NO: 878018 - DNA, 25 bp, Mus musculus
tggaacttcaggtctccttgttgag

SEQ ID NO: 878019 - DNA, 25 bp, Mus musculus
tggaacttccctaccgaaatgattt

SEQ ID NO: 878020 - DNA, 25 bp, Mus musculus
tggaacttcccttccgaaatgattt

SEQ ID NO: 878021 - DNA, 25 bp, Mus musculus
tggaacttcggaacagtttctcttt

SEQ ID NO: 878022 - DNA, 25 bp, Mus musculus
tggaacttcggatcagtttctcttt

SEQ ID NO: 878023 - DNA, 25 bp, Mus musculus
tggaacttgcagaccttaagtctta

SEQ ID NO: 878024 - DNA, 25 bp, Mus musculus
tggaacttgcagtccttaagtctta

SEQ ID NO: 878025 - DNA, 25 bp, Mus musculus
tggaacttgcttccactctgtggtt

SEQ ID NO: 878026 - DNA, 25 bp, Mus musculus
tggaacttgcttgcactctgtggtt

SEQ ID NO: 878027 - DNA, 25 bp, Mus musculus
tggaacttggctcctctacaaaagc

SEQ ID NO: 878028 - DNA, 25 bp, Mus musculus
tggaacttggctgctctacaaaagc

SEQ ID NO: 878029 - DNA, 25 bp, Mus musculus
tggaactttcaaaggcctgatctgt

SEQ ID NO: 878030 - DNA, 25 bp, Mus musculus
tggaactttcaatggcctgatctgt

SEQ ID NO: 878031 - DNA, 25 bp, Mus musculus
tggaactttctaattcgtacgactt

SEQ ID NO: 878032 - DNA, 25 bp, Mus musculus
tggaactttctatttcgtacgactt

SEQ ID NO: 878033 - DNA, 25 bp, Mus musculus
tggaactttctcagaagctcctttc

SEQ ID NO: 878034 - DNA, 25 bp, Mus musculus
tggaactttctctgaagctcctttc

SEQ ID NO: 878035 - DNA, 25 bp, Mus musculus
tggaagaaaaatctcctcctcaaag

SEQ ID NO: 878036 - DNA, 25 bp, Mus musculus
tggaagaaaaatgtcctcctcaaag

SEQ ID NO: 878037 - DNA, 25 bp, Mus musculus
tggaagaaacaaccgcgatactttt

SEQ ID NO: 878038 - DNA, 25 bp, Mus musculus
tggaagaaacaagcgcgatactttt

SEQ ID NO: 878039 - DNA, 25 bp, Mus musculus
tggaagaaacagactgccccagaga

SEQ ID NO: 878040 - DNA, 25 bp, Mus musculus
tggaagaaacagtctgccccagaga

SEQ ID NO: 878041 - DNA, 25 bp, Mus musculus
tggaagaaagcgactgaaactgttg

SEQ ID NO: 878042 - DNA, 25 bp, Mus musculus
tggaagaaagcgtctgaaactgttg

SEQ ID NO: 878043 - DNA, 25 bp, Mus musculus
tggaagaaatacctaccagccctgc

SEQ ID NO: 878044 - DNA, 25 bp, Mus musculus
tggaagaaatacgtaccagccctgc

SEQ ID NO: 878045 - DNA, 25 bp, Mus musculus
tggaagaaatttaagtcctttggag

SEQ ID NO: 878046 - DNA, 25 bp, Mus musculus
tggaagaaattttagtcctttggag

SEQ ID NO: 878047 - DNA, 25 bp, Mus musculus
tggaagaacagtctccggctccttg

SEQ ID NO: 878048 - DNA, 25 bp, Mus musculus
tggaagaacagtgtccggctccttg

SEQ ID NO: 878049 - DNA, 25 bp, Mus musculus
tggaagaactaacctgtcagtcata

SEQ ID NO: 878050 - DNA, 25 bp, Mus musculus
tggaagaactaagctgtcagtcata

SEQ ID NO: 878051 - DNA, 25 bp, Mus musculus
tggaagaactttaacgccggcccat

SEQ ID NO: 878052 - DNA, 25 bp, Mus musculus
tggaagaactttagcttaactattt

SEQ ID NO: 878053 - DNA, 25 bp, Mus musculus
tggaagaacttttacgccggcccat

SEQ ID NO: 878054 - DNA, 25 bp, Mus musculus
tggaagaacttttgcttaactattt

SEQ ID NO: 878055 - DNA, 25 bp, Mus musculus
tggaagaagtgacagcccgctgcct

SEQ ID NO: 878056 - DNA, 25 bp, Mus musculus
tggaagaagtgagagcccgctgcct

SEQ ID NO: 878057 - DNA, 25 bp, Mus musculus
tggaagaatggcctgttacactcaa

SEQ ID NO: 878058 - DNA, 25 bp, Mus musculus
tggaagaatggcgtgttacactcaa

SEQ ID NO: 878059 - DNA, 25 bp, Mus musculus
tggaagaatggtaccctgtcacagt

SEQ ID NO: 878060 - DNA, 25 bp, Mus musculus
tggaagaatggttccctgtcacagt

SEQ ID NO: 878061 - DNA, 25 bp, Mus musculus
tggaagacaactaactctgctgcct

SEQ ID NO: 878062 - DNA, 25 bp, Mus musculus
tggaagacaacttactctgctgcct

SEQ ID NO: 878063 - DNA, 25 bp, Mus musculus
tggaagacaccccaacagaggcagt

SEQ ID NO: 878064 - DNA, 25 bp, Mus musculus
tggaagacaccccagtatcactagg

SEQ ID NO: 878065 - DNA, 25 bp, Mus musculus
tggaagacacccgaacagaggcagt

SEQ ID NO: 878066 - DNA, 25 bp, Mus musculus
tggaagacacccgagtatcactagg

SEQ ID NO: 878067 - DNA, 25 bp, Mus musculus
tggaagacacgaaagctcctcgagc

SEQ ID NO: 878068 - DNA, 25 bp, Mus musculus
tggaagacacgatagctcctcgagc

SEQ ID NO: 878069 - DNA, 25 bp, Mus musculus
tggaagacacggcactccttggtat

SEQ ID NO: 878070 - DNA, 25 bp, Mus musculus
tggaagacacgggactccttggtat

SEQ ID NO: 878071 - DNA, 25 bp, Mus musculus
tggaagacactcacaaggcggctct

SEQ ID NO: 878072 - DNA, 25 bp, Mus musculus
tggaagacactctcaaggcggctct

SEQ ID NO: 878073 - DNA, 25 bp, Mus musculus
tggaagacatgacagcctgacgctt

SEQ ID NO: 878074 - DNA, 25 bp, Mus musculus
tggaagacatgagagcctgacgctt

SEQ ID NO: 878075 - DNA, 25 bp, Mus musculus
tggaagaccaccatttgacactgac

SEQ ID NO: 878076 - DNA, 25 bp, Mus musculus
tggaagaccaccttttgacactgac

SEQ ID NO: 878077 - DNA, 25 bp, Mus musculus
tggaagaccaggaacggctgctgca

SEQ ID NO: 878078 - DNA, 25 bp, Mus musculus
tggaagaccaggagctgagcccttt

SEQ ID NO: 878079 - DNA, 25 bp, Mus musculus
tggaagaccaggtacggctgctgca

SEQ ID NO: 878080 - DNA, 25 bp, Mus musculus
tggaagaccaggtgctgagcccttt

SEQ ID NO: 878081 - DNA, 25 bp, Mus musculus
tggaagacccttcggaatccggcct

SEQ ID NO: 878082 - DNA, 25 bp, Mus musculus
tggaagacccttgggaatccggcct

SEQ ID NO: 878083 - DNA, 25 bp, Mus musculus
tggaagacgagcactatgcccagaa

SEQ ID NO: 878084 - DNA, 25 bp, Mus musculus
tggaagacgagctctatgcccagaa

SEQ ID NO: 878085 - DNA, 25 bp, Mus musculus
tggaagactctcaaggctcacctag

SEQ ID NO: 878086 - DNA, 25 bp, Mus musculus
tggaagactctctaggctcacctag

SEQ ID NO: 878087 - DNA, 25 bp, Mus musculus
tggaagactgctagcttagagtgcc

SEQ ID NO: 878088 - DNA, 25 bp, Mus musculus
tggaagactgcttgcttagagtgcc

SEQ ID NO: 878089 - DNA, 25 bp, Mus musculus
tggaagactgttaaatgaacccacg

SEQ ID NO: 878090 - DNA, 25 bp, Mus musculus
tggaagactgtttaatgaacccacg

SEQ ID NO: 878091 - DNA, 25 bp, Mus musculus
tggaagacttcaacctttaaagaag

SEQ ID NO: 878092 - DNA, 25 bp, Mus musculus
tggaagacttcatcctttaaagaag

SEQ ID NO: 878093 - DNA, 25 bp, Mus musculus
tggaagacttggaaccaccaccagc

SEQ ID NO: 878094 - DNA, 25 bp, Mus musculus
tggaagacttggtaccaccaccagc

SEQ ID NO: 878095 - DNA, 25 bp, Mus musculus
tggaagagaccacaagacccaccac

SEQ ID NO: 878096 - DNA, 25 bp, Mus musculus
tggaagagaccagaagacccaccac

SEQ ID NO: 878097 - DNA, 25 bp, Mus musculus
tggaagagccatcaagccattcagc

SEQ ID NO: 878098 - DNA, 25 bp, Mus musculus
tggaagagccatgaagccattcagc

SEQ ID NO: 878099 - DNA, 25 bp, Mus musculus
tggaagagcgtcaggcccaggcaat

SEQ ID NO: 878100 - DNA, 25 bp, Mus musculus
tggaagagcgtctggcccaggcaat

SEQ ID NO: 878101 - DNA, 25 bp, Mus musculus
tggaagaggaagaggcactgtctta

SEQ ID NO: 878102 - DNA, 25 bp, Mus musculus
tggaagaggaagtggcactgtctta

SEQ ID NO: 878103 - DNA, 25 bp, Mus musculus
tggaagaggcgtagcccgcgcaaca

SEQ ID NO: 878104 - DNA, 25 bp, Mus musculus
tggaagaggcgttgcccgcgcaaca

SEQ ID NO: 878105 - DNA, 25 bp, Mus musculus
tggaagagggcaaccaggctctgat

SEQ ID NO: 878106 - DNA, 25 bp, Mus musculus
tggaagagggcatccaggctctgat

SEQ ID NO: 878107 - DNA, 25 bp, Mus musculus
tggaagagggccctgctccagtcct

SEQ ID NO: 878108 - DNA, 25 bp, Mus musculus
tggaagagggccgtgctccagtcct

SEQ ID NO: 878109 - DNA, 25 bp, Mus musculus
tggaagaggtagaaggaaccgccat

SEQ ID NO: 878110 - DNA, 25 bp, Mus musculus
tggaagaggtagtaggaaccgccat

SEQ ID NO: 878111 - DNA, 25 bp, Mus musculus
tggaagagtattaaatcccagtact

SEQ ID NO: 878112 - DNA, 25 bp, Mus musculus
tggaagagtatttaatcccagtact

SEQ ID NO: 878113 - DNA, 25 bp, Mus musculus
tggaagagtcctatctcccagagac

SEQ ID NO: 878114 - DNA, 25 bp, Mus musculus
tggaagagtcctttctcccagagac

SEQ ID NO: 878115 - DNA, 25 bp, Mus musculus
tggaagagttagacccccgtggcaa

SEQ ID NO: 878116 - DNA, 25 bp, Mus musculus
tggaagagttagtcccccgtggcaa

SEQ ID NO: 878117 - DNA, 25 bp, Mus musculus
tggaagagttctccgtgggcgccga

SEQ ID NO: 878118 - DNA, 25 bp, Mus musculus
tggaagagttctgcgtgggcgccga

SEQ ID NO: 878119 - DNA, 25 bp, Mus musculus
tggaagagttttcccagttgccgct

SEQ ID NO: 878120 - DNA, 25 bp, Mus musculus
tggaagagttttgccagttgccgct

SEQ ID NO: 878121 - DNA, 25 bp, Mus musculus
tggaagatacatccccttaccttat

SEQ ID NO: 878122 - DNA, 25 bp, Mus musculus
tggaagatacatgcccttaccttat

SEQ ID NO: 878123 - DNA, 25 bp, Mus musculus
tggaagatatccctctccagcacat

SEQ ID NO: 878124 - DNA, 25 bp, Mus musculus
tggaagatatccgtctccagcacat

SEQ ID NO: 878125 - DNA, 25 bp, Mus musculus
tggaagatatctagtctggctgcaa

SEQ ID NO: 878126 - DNA, 25 bp, Mus musculus
tggaagatatcttgtctggctgcaa

SEQ ID NO: 878127 - DNA, 25 bp, Mus musculus
tggaagatccggaccaagccaccac

SEQ ID NO: 878128 - DNA, 25 bp, Mus musculus
tggaagatccggtccaagccaccac

SEQ ID NO: 878129 - DNA, 25 bp, Mus musculus
tggaagatctgcaccacacaccggg

SEQ ID NO: 878130 - DNA, 25 bp, Mus musculus
tggaagatctgctccacacaccggg

SEQ ID NO: 878131 - DNA, 25 bp, Mus musculus
tggaagatggccattggcacaaagc

SEQ ID NO: 878132 - DNA, 25 bp, Mus musculus
tggaagatggcctttggcacaaagc

SEQ ID NO: 878133 - DNA, 25 bp, Mus musculus
tggaagcaaaacactcctccacaag

SEQ ID NO: 878134 - DNA, 25 bp, Mus musculus
tggaagcaaaactctcctccacaag

SEQ ID NO: 878135 - DNA, 25 bp, Mus musculus
tggaagcaaaggagccctgacctct

SEQ ID NO: 878136 - DNA, 25 bp, Mus musculus
tggaagcaaaggtgccctgacctct

SEQ ID NO: 878137 - DNA, 25 bp, Mus musculus
tggaagcaaccacacccaggacatg

SEQ ID NO: 878138 - DNA, 25 bp, Mus musculus
tggaagcaaccagacccaggacatg

SEQ ID NO: 878139 - DNA, 25 bp, Mus musculus
tggaagcaagctatctcatccacca

SEQ ID NO: 878140 - DNA, 25 bp, Mus musculus
tggaagcaagctttctcatccacca

SEQ ID NO: 878141 - DNA, 25 bp, Mus musculus
tggaagcaataaagataccctgtat

SEQ ID NO: 878142 - DNA, 25 bp, Mus musculus
tggaagcaataatgataccctgtat

SEQ ID NO: 878143 - DNA, 25 bp, Mus musculus
tggaagcaccacatccggttcggag

SEQ ID NO: 878144 - DNA, 25 bp, Mus musculus
tggaagcaccacttccggttcggag

SEQ ID NO: 878145 - DNA, 25 bp, Mus musculus
tggaagcacgccatccgcctagagt

SEQ ID NO: 878146 - DNA, 25 bp, Mus musculus
tggaagcacgccttccgcctagagt

SEQ ID NO: 878147 - DNA, 25 bp, Mus musculus
tggaagcagcatagcccatgagcct

SEQ ID NO: 878148 - DNA, 25 bp, Mus musculus
tggaagcagcattgcccatgagcct

SEQ ID NO: 878149 - DNA, 25 bp, Mus musculus
tggaagcattaaaaccaatgttcag

SEQ ID NO: 878150 - DNA, 25 bp, Mus musculus
tggaagcattaataccaatgttcag

SEQ ID NO: 878151 - DNA, 25 bp, Mus musculus
tggaagccaagcacacgctggtggc

SEQ ID NO: 878152 - DNA, 25 bp, Mus musculus
tggaagccaagctcacgctggtggc

SEQ ID NO: 878153 - DNA, 25 bp, Mus musculus
tggaagccactcatgatattcccac

SEQ ID NO: 878154 - DNA, 25 bp, Mus musculus
tggaagccactcttgatattcccac

SEQ ID NO: 878155 - DNA, 25 bp, Mus musculus
tggaagccaggaaccctacaaagat

SEQ ID NO: 878156 - DNA, 25 bp, Mus musculus
tggaagccaggatccctacaaagat

SEQ ID NO: 878157 - DNA, 25 bp, Mus musculus
tggaagccagtcaatacccaggagc

SEQ ID NO: 878158 - DNA, 25 bp, Mus musculus
tggaagccagtctatacccaggagc

SEQ ID NO: 878159 - DNA, 25 bp, Mus musculus
tggaagccccaacagagcgccactt

SEQ ID NO: 878160 - DNA, 25 bp, Mus musculus
tggaagccccaagagagcgccactt

SEQ ID NO: 878161 - DNA, 25 bp, Mus musculus
tggaagccccagattgaacagtctc

SEQ ID NO: 878162 - DNA, 25 bp, Mus musculus
tggaagccccagtttgaacagtctc

SEQ ID NO: 878163 - DNA, 25 bp, Mus musculus
tggaagcccgttaaaagcactaatt

SEQ ID NO: 878164 - DNA, 25 bp, Mus musculus
tggaagcccgtttaaagcactaatt

SEQ ID NO: 878165 - DNA, 25 bp, Mus musculus
tggaagccctatcccaaacccaaag

SEQ ID NO: 878166 - DNA, 25 bp, Mus musculus
tggaagccctatgccaaacccaaag

SEQ ID NO: 878167 - DNA, 25 bp, Mus musculus
tggaagccctcgatgccaattctcg

SEQ ID NO: 878168 - DNA, 25 bp, Mus musculus
tggaagccctcgttgccaattctcg

SEQ ID NO: 878169 - DNA, 25 bp, Mus musculus
tggaagccctctagtgttgtgttac

SEQ ID NO: 878170 - DNA, 25 bp, Mus musculus
tggaagccctcttgtgttgtgttac

SEQ ID NO: 878171 - DNA, 25 bp, Mus musculus
tggaagccgagtagccgctggaact

SEQ ID NO: 878172 - DNA, 25 bp, Mus musculus
tggaagccgagttgccgctggaact

SEQ ID NO: 878173 - DNA, 25 bp, Mus musculus
tggaagccgcccaggcagagtatgt

SEQ ID NO: 878174 - DNA, 25 bp, Mus musculus
tggaagccgccctggcagagtatgt

SEQ ID NO: 878175 - DNA, 25 bp, Mus musculus
tggaagccgcctccccaaacgaaaa

SEQ ID NO: 878176 - DNA, 25 bp, Mus musculus
tggaagccgcctgcccaaacgaaaa

SEQ ID NO: 878177 - DNA, 25 bp, Mus musculus
tggaagcctatcagcgatgccacac

SEQ ID NO: 878178 - DNA, 25 bp, Mus musculus
tggaagcctatctgcgatgccacac

SEQ ID NO: 878179 - DNA, 25 bp, Mus musculus
tggaagcctcagagtcctcatcttt

SEQ ID NO: 878180 - DNA, 25 bp, Mus musculus
tggaagcctcagtgtcctcatcttt

SEQ ID NO: 878181 - DNA, 25 bp, Mus musculus
tggaagcctcatcctcaagagcgat

SEQ ID NO: 878182 - DNA, 25 bp, Mus musculus
tggaagcctcatgctcaagagcgat

SEQ ID NO: 878183 - DNA, 25 bp, Mus musculus
tggaagcctgaacagggcctctgac

SEQ ID NO: 878184 - DNA, 25 bp, Mus musculus
tggaagcctgaagagggcctctgac

SEQ ID NO: 878185 - DNA, 25 bp, Mus musculus
tggaagccttgtcatctttcaatac

SEQ ID NO: 878186 - DNA, 25 bp, Mus musculus
tggaagccttgtgatctttcaatac

SEQ ID NO: 878187 - DNA, 25 bp, Mus musculus
tggaagcgaccaatgcctctaggag

SEQ ID NO: 878188 - DNA, 25 bp, Mus musculus
tggaagcgaccattgcctctaggag

SEQ ID NO: 878189 - DNA, 25 bp, Mus musculus
tggaagcgcagtactgtttttcctt

SEQ ID NO: 878190 - DNA, 25 bp, Mus musculus
tggaagcgcagttctgtttttcctt

SEQ ID NO: 878191 - DNA, 25 bp, Mus musculus
tggaagcggtggagcctgcccatct

SEQ ID NO: 878192 - DNA, 25 bp, Mus musculus
tggaagcggtggtgcctgcccatct

SEQ ID NO: 878193 - DNA, 25 bp, Mus musculus
tggaagctaacgatcttactacggc

SEQ ID NO: 878194 - DNA, 25 bp, Mus musculus
tggaagctaacgttcttactacggc

SEQ ID NO: 878195 - DNA, 25 bp, Mus musculus
tggaagctactcatcaccattcatg

SEQ ID NO: 878196 - DNA, 25 bp, Mus musculus
tggaagctactcttcaccattcatg

SEQ ID NO: 878197 - DNA, 25 bp, Mus musculus
tggaagctagatcgcgttcatgcct

SEQ ID NO: 878198 - DNA, 25 bp, Mus musculus
tggaagctagatggcgttcatgcct

SEQ ID NO: 878199 - DNA, 25 bp, Mus musculus
tggaagctaggtcacactctctaac

SEQ ID NO: 878200 - DNA, 25 bp, Mus musculus
tggaagctaggtgacactctctaac

SEQ ID NO: 878201 - DNA, 25 bp, Mus musculus
tggaagctattcctggtcacaccat

SEQ ID NO: 878202 - DNA, 25 bp, Mus musculus
tggaagctattcgtggtcacaccat

SEQ ID NO: 878203 - DNA, 25 bp, Mus musculus
tggaagctctctacctagtgtgcgg

SEQ ID NO: 878204 - DNA, 25 bp, Mus musculus
tggaagctctctcgcctcattagaa

SEQ ID NO: 878205 - DNA, 25 bp, Mus musculus
tggaagctctctggcctcattagaa

SEQ ID NO: 878206 - DNA, 25 bp, Mus musculus
tggaagctctcttcctagtgtgcgg

SEQ ID NO: 878207 - DNA, 25 bp, Mus musculus
tggaagctctgacaatggcccgcag

SEQ ID NO: 878208 - DNA, 25 bp, Mus musculus
tggaagctctgagaatggcccgcag

SEQ ID NO: 878209 - DNA, 25 bp, Mus musculus
tggaagctgaatctgggtcttttgt

SEQ ID NO: 878210 - DNA, 25 bp, Mus musculus
tggaagctgaatgtgggtcttttgt

SEQ ID NO: 878211 - DNA, 25 bp, Mus musculus
tggaagctgagacctgccaggacat

SEQ ID NO: 878212 - DNA, 25 bp, Mus musculus
tggaagctgagagctgccaggacat

SEQ ID NO: 878213 - DNA, 25 bp, Mus musculus
tggaagctgcaacacacgggaaagt

SEQ ID NO: 878214 - DNA, 25 bp, Mus musculus
tggaagctgcaagacacgggaaagt

SEQ ID NO: 878215 - DNA, 25 bp, Mus musculus
tggaagctgcacctgacactcctca

SEQ ID NO: 878216 - DNA, 25 bp, Mus musculus
tggaagctgcacgtgacactcctca

SEQ ID NO: 878217 - DNA, 25 bp, Mus musculus
tggaagctgcatctggacacactgg

SEQ ID NO: 878218 - DNA, 25 bp, Mus musculus
tggaagctgcatgtggacacactgg

SEQ ID NO: 878219 - DNA, 25 bp, Mus musculus
tggaagctgcttccaaccagttcct

SEQ ID NO: 878220 - DNA, 25 bp, Mus musculus
tggaagctgcttgcaaccagttcct

SEQ ID NO: 878221 - DNA, 25 bp, Mus musculus
tggaagctggccagactccagacat

SEQ ID NO: 878222 - DNA, 25 bp, Mus musculus
tggaagctggcctgactccagacat

SEQ ID NO: 878223 - DNA, 25 bp, Mus musculus
tggaagctgggcctagaaactcaca

SEQ ID NO: 878224 - DNA, 25 bp, Mus musculus
tggaagctgggcgtagaaactcaca

SEQ ID NO: 878225 - DNA, 25 bp, Mus musculus
tggaagctggtgacttccatgttcc

SEQ ID NO: 878226 - DNA, 25 bp, Mus musculus
tggaagctggtgtcttccatgttcc

SEQ ID NO: 878227 - DNA, 25 bp, Mus musculus
tggaagctgtccaccaagaaagcct

SEQ ID NO: 878228 - DNA, 25 bp, Mus musculus
tggaagctgtcctccaagaaagcct

SEQ ID NO: 878229 - DNA, 25 bp, Mus musculus
tggaagctgtttctggacgccacca

SEQ ID NO: 878230 - DNA, 25 bp, Mus musculus
tggaagctgtttgtggacgccacca

SEQ ID NO: 878231 - DNA, 25 bp, Mus musculus
tggaagcttacaacctatttgcctg

SEQ ID NO: 878232 - DNA, 25 bp, Mus musculus
tggaagcttacatcctatttgcctg

SEQ ID NO: 878233 - DNA, 25 bp, Mus musculus
tggaagcttcagagtttttggacat

SEQ ID NO: 878234 - DNA, 25 bp, Mus musculus
tggaagcttcagtgtttttggacat

SEQ ID NO: 878235 - DNA, 25 bp, Mus musculus
tggaagcttccccaagtactatgcc

SEQ ID NO: 878236 - DNA, 25 bp, Mus musculus
tggaagcttcccgaagtactatgcc

SEQ ID NO: 878237 - DNA, 25 bp, Mus musculus
tggaagcttctaaccatctactaga

SEQ ID NO: 878238 - DNA, 25 bp, Mus musculus
tggaagcttctatccatctactaga

SEQ ID NO: 878239 - DNA, 25 bp, Mus musculus
tggaagcttctcagctgtggtgaac

SEQ ID NO: 878240 - DNA, 25 bp, Mus musculus
tggaagcttctctgctgtggtgaac

SEQ ID NO: 878241 - DNA, 25 bp, Mus musculus
tggaagcttgacattgccaagactt

SEQ ID NO: 878242 - DNA, 25 bp, Mus musculus
tggaagcttgactttgccaagactt

SEQ ID NO: 878243 - DNA, 25 bp, Mus musculus
tggaagcttgcacagatctctagac

SEQ ID NO: 878244 - DNA, 25 bp, Mus musculus
tggaagcttgcagagatctctagac

SEQ ID NO: 878245 - DNA, 25 bp, Mus musculus
tggaagcttggccagcgacagacaa

SEQ ID NO: 878246 - DNA, 25 bp, Mus musculus
tggaagcttggcgagcgacagacaa

SEQ ID NO: 878247 - DNA, 25 bp, Mus musculus
tggaagctttaacggtttcaggtca

SEQ ID NO: 878248 - DNA, 25 bp, Mus musculus
tggaagctttaagggtttcaggtca

SEQ ID NO: 878249 - DNA, 25 bp, Mus musculus
tggaagctttgaccttcaccaacag

SEQ ID NO: 878250 - DNA, 25 bp, Mus musculus
tggaagctttgagcttcaccaacag

SEQ ID NO: 878251 - DNA, 25 bp, Mus musculus
tggaaggaagaaaatgttacccgcc

SEQ ID NO: 878252 - DNA, 25 bp, Mus musculus
tggaaggaagaatatgttacccgcc

SEQ ID NO: 878253 - DNA, 25 bp, Mus musculus
tggaaggaatccatcccgcagacga

SEQ ID NO: 878254 - DNA, 25 bp, Mus musculus
tggaaggaatccttcccgcagacga

SEQ ID NO: 878255 - DNA, 25 bp, Mus musculus
tggaaggaatctcgcctgtgtgtat

SEQ ID NO: 878256 - DNA, 25 bp, Mus musculus
tggaaggaatctggcctgtgtgtat

SEQ ID NO: 878257 - DNA, 25 bp, Mus musculus
tggaaggactaacctgacacacgaa

SEQ ID NO: 878258 - DNA, 25 bp, Mus musculus
tggaaggactaagctgacacacgaa

SEQ ID NO: 878259 - DNA, 25 bp, Mus musculus
tggaaggactcaagctactacatgg

SEQ ID NO: 878260 - DNA, 25 bp, Mus musculus
tggaaggactcatgctactacatgg

SEQ ID NO: 878261 - DNA, 25 bp, Mus musculus
tggaaggagaagacgtactcctgta

SEQ ID NO: 878262 - DNA, 25 bp, Mus musculus
tggaaggagaagtcgtactcctgta

SEQ ID NO: 878263 - DNA, 25 bp, Mus musculus
tggaaggagcatcgctttccctttt

SEQ ID NO: 878264 - DNA, 25 bp, Mus musculus
tggaaggagcatggctttccctttt

SEQ ID NO: 878265 - DNA, 25 bp, Mus musculus
tggaaggagctaccacccatgcaga

SEQ ID NO: 878266 - DNA, 25 bp, Mus musculus
tggaaggagctagcacccatgcaga

SEQ ID NO: 878267 - DNA, 25 bp, Mus musculus
tggaaggagctcacatcctactatt

SEQ ID NO: 878268 - DNA, 25 bp, Mus musculus
tggaaggagctctcatcctactatt

SEQ ID NO: 878269 - DNA, 25 bp, Mus musculus
tggaaggatcagctaaaggcacact

SEQ ID NO: 878270 - DNA, 25 bp, Mus musculus
tggaaggatcagctcatcctgtggc

SEQ ID NO: 878271 - DNA, 25 bp, Mus musculus
tggaaggatcaggtaaaggcacact

SEQ ID NO: 878272 - DNA, 25 bp, Mus musculus
tggaaggatcaggtcatcctgtggc

SEQ ID NO: 878273 - DNA, 25 bp, Mus musculus
tggaaggattgaacgctaccagcaa

SEQ ID NO: 878274 - DNA, 25 bp, Mus musculus
tggaaggattgatcgctaccagcaa

SEQ ID NO: 878275 - DNA, 25 bp, Mus musculus
tggaaggcacataacaggtctttgt

SEQ ID NO: 878276 - DNA, 25 bp, Mus musculus
tggaaggcacattacaggtctttgt

SEQ ID NO: 878277 - DNA, 25 bp, Mus musculus
tggaaggcaccgatattctgcacat

SEQ ID NO: 878278 - DNA, 25 bp, Mus musculus
tggaaggcaccgttattctgcacat

SEQ ID NO: 878279 - DNA, 25 bp, Mus musculus
tggaaggccagaactccataccgtg

SEQ ID NO: 878280 - DNA, 25 bp, Mus musculus
tggaaggccagatctccataccgtg

SEQ ID NO: 878281 - DNA, 25 bp, Mus musculus
tggaaggccagcaagatcccagctg

SEQ ID NO: 878282 - DNA, 25 bp, Mus musculus
tggaaggccagctagatcccagctg

SEQ ID NO: 878283 - DNA, 25 bp, Mus musculus
tggaaggcccacaacttgcaagatg

SEQ ID NO: 878284 - DNA, 25 bp, Mus musculus
tggaaggcccactacttgcaagatg

SEQ ID NO: 878285 - DNA, 25 bp, Mus musculus
tggaaggcccatcaaaacatgtaaa

SEQ ID NO: 878286 - DNA, 25 bp, Mus musculus
tggaaggcccatcacatcgatctgt

SEQ ID NO: 878287 - DNA, 25 bp, Mus musculus
tggaaggcccatgaaaacatgtaaa

SEQ ID NO: 878288 - DNA, 25 bp, Mus musculus
tggaaggcccatgacatcgatctgt

SEQ ID NO: 878289 - DNA, 25 bp, Mus musculus
tggaaggcccctagaggctgattac

SEQ ID NO: 878290 - DNA, 25 bp, Mus musculus
tggaaggccccttgaggctgattac

SEQ ID NO: 878291 - DNA, 25 bp, Mus musculus
tggaaggcccttctctggtctcaat

SEQ ID NO: 878292 - DNA, 25 bp, Mus musculus
tggaaggcccttgtctggtctcaat

SEQ ID NO: 878293 - DNA, 25 bp, Mus musculus
tggaaggccgagatccaccgctgga

SEQ ID NO: 878294 - DNA, 25 bp, Mus musculus
tggaaggccgagttccaccgctgga

SEQ ID NO: 878295 - DNA, 25 bp, Mus musculus
tggaaggcctctcgtacccaaacca

SEQ ID NO: 878296 - DNA, 25 bp, Mus musculus
tggaaggcctctggtacccaaacca

SEQ ID NO: 878297 - DNA, 25 bp, Mus musculus
tggaaggcggacactgtacacgtct

SEQ ID NO: 878298 - DNA, 25 bp, Mus musculus
tggaaggcggactctgtacacgtct

SEQ ID NO: 878299 - DNA, 25 bp, Mus musculus
tggaaggcgtgtataccaggtgcta

SEQ ID NO: 878300 - DNA, 25 bp, Mus musculus
tggaaggcgtgtttaccaggtgcta

SEQ ID NO: 878301 - DNA, 25 bp, Mus musculus
tggaaggctggcacatactcctcag

SEQ ID NO: 878302 - DNA, 25 bp, Mus musculus
tggaaggctggctcatactcctcag

SEQ ID NO: 878303 - DNA, 25 bp, Mus musculus
tggaaggctgggactgcacacacta

SEQ ID NO: 878304 - DNA, 25 bp, Mus musculus
tggaaggctgggtctgcacacacta

SEQ ID NO: 878305 - DNA, 25 bp, Mus musculus
tggaaggcttccacacgcagatctc

SEQ ID NO: 878306 - DNA, 25 bp, Mus musculus
tggaaggcttcctcacgcagatctc

SEQ ID NO: 878307 - DNA, 25 bp, Mus musculus
tggaagggaaggagtccctgtcacc

SEQ ID NO: 878308 - DNA, 25 bp, Mus musculus
tggaagggaaggtgtccctgtcacc

SEQ ID NO: 878309 - DNA, 25 bp, Mus musculus
tggaagggacaaatctcaccccggt

SEQ ID NO: 878310 - DNA, 25 bp, Mus musculus
tggaagggacaattctcaccccggt

SEQ ID NO: 878311 - DNA, 25 bp, Mus musculus
tggaagggacccattttcatttgac

SEQ ID NO: 878312 - DNA, 25 bp, Mus musculus
tggaagggaccctttttcatttgac

SEQ ID NO: 878313 - DNA, 25 bp, Mus musculus
tggaagggacttcataaagttgctt

SEQ ID NO: 878314 - DNA, 25 bp, Mus musculus
tggaagggacttgataaagttgctt

SEQ ID NO: 878315 - DNA, 25 bp, Mus musculus
tggaagggagcacggcgccggtctt

SEQ ID NO: 878316 - DNA, 25 bp, Mus musculus
tggaagggagcagggcgccggtctt

SEQ ID NO: 878317 - DNA, 25 bp, Mus musculus
tggaagggcatccaacatggagtaa

SEQ ID NO: 878318 - DNA, 25 bp, Mus musculus
tggaagggcatcgaacatggagtaa

SEQ ID NO: 878319 - DNA, 25 bp, Mus musculus
tggaagggcctgagagtcctcagaa

SEQ ID NO: 878320 - DNA, 25 bp, Mus musculus
tggaagggcctgtgagtcctcagaa

SEQ ID NO: 878321 - DNA, 25 bp, Mus musculus
tggaagggctccatcatcaaagacc

SEQ ID NO: 878322 - DNA, 25 bp, Mus musculus
tggaagggctccttcatcaaagacc

SEQ ID NO: 878323 - DNA, 25 bp, Mus musculus
tggaagggtaatatgctctcagata

SEQ ID NO: 878324 - DNA, 25 bp, Mus musculus
tggaagggtaatttgctctcagata

SEQ ID NO: 878325 - DNA, 25 bp, Mus musculus
tggaagggtctaaacgtttcacgct

SEQ ID NO: 878326 - DNA, 25 bp, Mus musculus
tggaagggtctatacgtttcacgct

SEQ ID NO: 878327 - DNA, 25 bp, Mus musculus
tggaaggtagggaccagcaccccaa

SEQ ID NO: 878328 - DNA, 25 bp, Mus musculus
tggaaggtagggtccagcaccccaa

SEQ ID NO: 878329 - DNA, 25 bp, Mus musculus
tggaaggtccctagtgcaacagtgg

SEQ ID NO: 878330 - DNA, 25 bp, Mus musculus
tggaaggtcccttgtgcaacagtgg

SEQ ID NO: 878331 - DNA, 25 bp, Mus musculus
tggaaggtccttcctaccttgggca

SEQ ID NO: 878332 - DNA, 25 bp, Mus musculus
tggaaggtccttgctaccttgggca

SEQ ID NO: 878333 - DNA, 25 bp, Mus musculus
tggaaggtgacaactgggccctaca

SEQ ID NO: 878334 - DNA, 25 bp, Mus musculus
tggaaggtgacatctgggccctaca

SEQ ID NO: 878335 - DNA, 25 bp, Mus musculus
tggaaggtggcgaccacagcctcca

SEQ ID NO: 878336 - DNA, 25 bp, Mus musculus
tggaaggtggcgtccacagcctcca

SEQ ID NO: 878337 - DNA, 25 bp, Mus musculus
tggaaggtggctccagcttcacgtc

SEQ ID NO: 878338 - DNA, 25 bp, Mus musculus
tggaaggtggctgcagcttcacgtc

SEQ ID NO: 878339 - DNA, 25 bp, Mus musculus
tggaaggtgtccaggcccttagagc

SEQ ID NO: 878340 - DNA, 25 bp, Mus musculus
tggaaggtgtcctggcccttagagc

SEQ ID NO: 878341 - DNA, 25 bp, Mus musculus
tggaaggttcccaaagtagaagcaa

SEQ ID NO: 878342 - DNA, 25 bp, Mus musculus
tggaaggttccctaagtagaagcaa

SEQ ID NO: 878343 - DNA, 25 bp, Mus musculus
tggaaggtttccagctttgaagcaa

SEQ ID NO: 878344 - DNA, 25 bp, Mus musculus
tggaaggtttcctgctttgaagcaa

SEQ ID NO: 878345 - DNA, 25 bp, Mus musculus
tggaaggtttctatcctcacaagaa

SEQ ID NO: 878346 - DNA, 25 bp, Mus musculus
tggaaggtttctttcctcacaagaa

SEQ ID NO: 878347 - DNA, 25 bp, Mus musculus
tggaaggttttccagtgcctcctaa

SEQ ID NO: 878348 - DNA, 25 bp, Mus musculus
tggaaggttttcgagtgcctcctaa

SEQ ID NO: 878349 - DNA, 25 bp, Mus musculus
tggaagtaaactcctgcccttaggg

SEQ ID NO: 878350 - DNA, 25 bp, Mus musculus
tggaagtaaactgctgcccttaggg

SEQ ID NO: 878351 - DNA, 25 bp, Mus musculus
tggaagtaacgtatcccctcaacag

SEQ ID NO: 878352 - DNA, 25 bp, Mus musculus
tggaagtaacgtttcccctcaacag

SEQ ID NO: 878353 - DNA, 25 bp, Mus musculus
tggaagtatccaaccatggcccagg

SEQ ID NO: 878354 - DNA, 25 bp, Mus musculus
tggaagtatccatccatggcccagg

SEQ ID NO: 878355 - DNA, 25 bp, Mus musculus
tggaagtcagccatcttttcctagc

SEQ ID NO: 878356 - DNA, 25 bp, Mus musculus
tggaagtcagccttcttttcctagc

SEQ ID NO: 878357 - DNA, 25 bp, Mus musculus
tggaagtcaggcagtgcgctcactt

SEQ ID NO: 878358 - DNA, 25 bp, Mus musculus
tggaagtcaggctgtgcgctcactt

SEQ ID NO: 878359 - DNA, 25 bp, Mus musculus
tggaagtccaaccttccacttcttg

SEQ ID NO: 878360 - DNA, 25 bp, Mus musculus
tggaagtccaacgttccacttcttg

SEQ ID NO: 878361 - DNA, 25 bp, Mus musculus
tggaagtccatgatgggttggtctt

SEQ ID NO: 878362 - DNA, 25 bp, Mus musculus
tggaagtccatgttgggttggtctt

SEQ ID NO: 878363 - DNA, 25 bp, Mus musculus
tggaagtcccagcaagaccttctgg

SEQ ID NO: 878364 - DNA, 25 bp, Mus musculus
tggaagtcccaggaagaccttctgg

SEQ ID NO: 878365 - DNA, 25 bp, Mus musculus
tggaagtccgttaacaacttgaact

SEQ ID NO: 878366 - DNA, 25 bp, Mus musculus
tggaagtccgtttacaacttgaact

SEQ ID NO: 878367 - DNA, 25 bp, Mus musculus
tggaagtcctccacatttgtatcag

SEQ ID NO: 878368 - DNA, 25 bp, Mus musculus
tggaagtcctcctcatttgtatcag

SEQ ID NO: 878369 - DNA, 25 bp, Mus musculus
tggaagtccttcagcaggtgctgct

SEQ ID NO: 878370 - DNA, 25 bp, Mus musculus
tggaagtccttctgcaggtgctgct

SEQ ID NO: 878371 - DNA, 25 bp, Mus musculus
tggaagtcgaaaaccacctaagaat

SEQ ID NO: 878372 - DNA, 25 bp, Mus musculus
tggaagtcgaaatccacctaagaat

SEQ ID NO: 878373 - DNA, 25 bp, Mus musculus
tggaagtgaacccttccgcatagcc

SEQ ID NO: 878374 - DNA, 25 bp, Mus musculus
tggaagtgaaccgttccgcatagcc

SEQ ID NO: 878375 - DNA, 25 bp, Mus musculus
tggaagtgaatcacggcacggccat

SEQ ID NO: 878376 - DNA, 25 bp, Mus musculus
tggaagtgaatctcggcacggccat

SEQ ID NO: 878377 - DNA, 25 bp, Mus musculus
tggaagtgacccagactacagaccc

SEQ ID NO: 878378 - DNA, 25 bp, Mus musculus
tggaagtgacccatttttgtacctt

SEQ ID NO: 878379 - DNA, 25 bp, Mus musculus
tggaagtgaccctgactacagaccc

SEQ ID NO: 878380 - DNA, 25 bp, Mus musculus
tggaagtgacccttttttgtacctt

SEQ ID NO: 878381 - DNA, 25 bp, Mus musculus
tggaagtgccctcccagagtttgca

SEQ ID NO: 878382 - DNA, 25 bp, Mus musculus
tggaagtgccctgccagagtttgca

SEQ ID NO: 878383 - DNA, 25 bp, Mus musculus
tggaagtgcctgcttgagttctgcc

SEQ ID NO: 878384 - DNA, 25 bp, Mus musculus
tggaagtgcctggttgagttctgcc

SEQ ID NO: 878385 - DNA, 25 bp, Mus musculus
tggaagtgctcaaggcattgccacg

SEQ ID NO: 878386 - DNA, 25 bp, Mus musculus
tggaagtgctcatggcattgccacg

SEQ ID NO: 878387 - DNA, 25 bp, Mus musculus
tggaagtggaatactacccacctaa

SEQ ID NO: 878388 - DNA, 25 bp, Mus musculus
tggaagtggaattctacccacctaa

SEQ ID NO: 878389 - DNA, 25 bp, Mus musculus
tggaagtggagacccctcattgtgc

SEQ ID NO: 878390 - DNA, 25 bp, Mus musculus
tggaagtggagagccctcattgtgc

SEQ ID NO: 878391 - DNA, 25 bp, Mus musculus
tggaagtggctcagcacggaactcc

SEQ ID NO: 878392 - DNA, 25 bp, Mus musculus
tggaagtggctctgcacggaactcc

SEQ ID NO: 878393 - DNA, 25 bp, Mus musculus
tggaagtggtcgacctggtcctgaa

SEQ ID NO: 878394 - DNA, 25 bp, Mus musculus
tggaagtggtcgtcctggtcctgaa

SEQ ID NO: 878395 - DNA, 25 bp, Mus musculus
tggaagtgtcctaatcctacatgtg

SEQ ID NO: 878396 - DNA, 25 bp, Mus musculus
tggaagtgtccttatcctacatgtg

SEQ ID NO: 878397 - DNA, 25 bp, Mus musculus
tggaagtgttcacctaccaccaagg

SEQ ID NO: 878398 - DNA, 25 bp, Mus musculus
tggaagtgttcagctaccaccaagg

SEQ ID NO: 878399 - DNA, 25 bp, Mus musculus
tggaagtgttccacccagatacaat

SEQ ID NO: 878400 - DNA, 25 bp, Mus musculus
tggaagtgttcctcccagatacaat

SEQ ID NO: 878401 - DNA, 25 bp, Mus musculus
tggaagttcactaaccataaggtat

SEQ ID NO: 878402 - DNA, 25 bp, Mus musculus
tggaagttcacttaccataaggtat

SEQ ID NO: 878403 - DNA, 25 bp, Mus musculus
tggaagttcatgaggccaagcctgt

SEQ ID NO: 878404 - DNA, 25 bp, Mus musculus
tggaagttcatgtggccaagcctgt

SEQ ID NO: 878405 - DNA, 25 bp, Mus musculus
tggaagttccttccacttctaggac

SEQ ID NO: 878406 - DNA, 25 bp, Mus musculus
tggaagttccttgcacttctaggac

SEQ ID NO: 878407 - DNA, 25 bp, Mus musculus
tggaagttctctacctcgacaagaa

SEQ ID NO: 878408 - DNA, 25 bp, Mus musculus
tggaagttctcttcctcgacaagaa

SEQ ID NO: 878409 - DNA, 25 bp, Mus musculus
tggaagttgtggatgcacctcaccc

SEQ ID NO: 878410 - DNA, 25 bp, Mus musculus
tggaagttgtggttgcacctcaccc

SEQ ID NO: 878411 - DNA, 25 bp, Mus musculus
tggaagtttataaccggctctccca

SEQ ID NO: 878412 - DNA, 25 bp, Mus musculus
tggaagtttatatccggctctccca

SEQ ID NO: 878413 - DNA, 25 bp, Mus musculus
tggaataactacactgtcctgacct

SEQ ID NO: 878414 - DNA, 25 bp, Mus musculus
tggaataactactctgtcctgacct

SEQ ID NO: 878415 - DNA, 25 bp, Mus musculus
tggaataatactctttagtttacct

SEQ ID NO: 878416 - DNA, 25 bp, Mus musculus
tggaataatactgtttagtttacct

SEQ ID NO: 878417 - DNA, 25 bp, Mus musculus
tggaatacaacaactacggctgcta

SEQ ID NO: 878418 - DNA, 25 bp, Mus musculus
tggaatacaacatctacggctgcta

SEQ ID NO: 878419 - DNA, 25 bp, Mus musculus
tggaatacacaactgaccactttca

SEQ ID NO: 878420 - DNA, 25 bp, Mus musculus
tggaatacacaagtgaccactttca

SEQ ID NO: 878421 - DNA, 25 bp, Mus musculus
tggaataccctaagcatttgctttt

SEQ ID NO: 878422 - DNA, 25 bp, Mus musculus
tggaataccctatgcatttgctttt

SEQ ID NO: 878423 - DNA, 25 bp, Mus musculus
tggaatactacaagacataactgga

SEQ ID NO: 878424 - DNA, 25 bp, Mus musculus
tggaatactacatgacataactgga

SEQ ID NO: 878425 - DNA, 25 bp, Mus musculus
tggaatactaccacatgcagataaa

SEQ ID NO: 878426 - DNA, 25 bp, Mus musculus
tggaatactacctcatgcagataaa

SEQ ID NO: 878427 - DNA, 25 bp, Mus musculus
tggaatagcagacgcccacagcaca

SEQ ID NO: 878428 - DNA, 25 bp, Mus musculus
tggaatagcagaggcccacagcaca

SEQ ID NO: 878429 - DNA, 25 bp, Mus musculus
tggaataggcctacaaacccagcta

SEQ ID NO: 878430 - DNA, 25 bp, Mus musculus
tggaataggccttcaaacccagcta

SEQ ID NO: 878431 - DNA, 25 bp, Mus musculus
tggaatagggttccagccactagcc

SEQ ID NO: 878432 - DNA, 25 bp, Mus musculus
tggaatagggttgcagccactagcc

SEQ ID NO: 878433 - DNA, 25 bp, Mus musculus
tggaatagtaccataggctcatgtg

SEQ ID NO: 878434 - DNA, 25 bp, Mus musculus
tggaatagtaccttaggctcatgtg

SEQ ID NO: 878435 - DNA, 25 bp, Mus musculus
tggaatagttacatagttgtgagcc

SEQ ID NO: 878436 - DNA, 25 bp, Mus musculus
tggaatagttacttagttgtgagcc

SEQ ID NO: 878437 - DNA, 25 bp, Mus musculus
tggaatataccactgcagagctaac

SEQ ID NO: 878438 - DNA, 25 bp, Mus musculus
tggaatataccagtgcagagctaac

SEQ ID NO: 878439 - DNA, 25 bp, Mus musculus
tggaatatatctcctcccctgggtc

SEQ ID NO: 878440 - DNA, 25 bp, Mus musculus
tggaatatatctgctcccctgggtc

SEQ ID NO: 878441 - DNA, 25 bp, Mus musculus
tggaatcaaattagtgtattctcag

SEQ ID NO: 878442 - DNA, 25 bp, Mus musculus
tggaatcaaatttgtgtattctcag

SEQ ID NO: 878443 - DNA, 25 bp, Mus musculus
tggaatcaagagcagcaagcatgct

SEQ ID NO: 878444 - DNA, 25 bp, Mus musculus
tggaatcaagaggagcaagcatgct

SEQ ID NO: 878445 - DNA, 25 bp, Mus musculus
tggaatcacacacctgagccaccat

SEQ ID NO: 878446 - DNA, 25 bp, Mus musculus
tggaatcacacagctgagccaccat

SEQ ID NO: 878447 - DNA, 25 bp, Mus musculus
tggaatcacataccagcagcattgt

SEQ ID NO: 878448 - DNA, 25 bp, Mus musculus
tggaatcacatagcagcagcattgt

SEQ ID NO: 878449 - DNA, 25 bp, Mus musculus
tggaatcacctcataccaacttgaa

SEQ ID NO: 878450 - DNA, 25 bp, Mus musculus
tggaatcacctcttaccaacttgaa

SEQ ID NO: 878451 - DNA, 25 bp, Mus musculus
tggaatcactcaactcaacaactac

SEQ ID NO: 878452 - DNA, 25 bp, Mus musculus
tggaatcactcatctcaacaactac

SEQ ID NO: 878453 - DNA, 25 bp, Mus musculus
tggaatcagcctcaccttctcattg

SEQ ID NO: 878454 - DNA, 25 bp, Mus musculus
tggaatcagcctccccacagggagc

SEQ ID NO: 878455 - DNA, 25 bp, Mus musculus
tggaatcagcctgaccttctcattg

SEQ ID NO: 878456 - DNA, 25 bp, Mus musculus
tggaatcagcctgcccacagggagc

SEQ ID NO: 878457 - DNA, 25 bp, Mus musculus
tggaatcagggcaacggcaaatact

SEQ ID NO: 878458 - DNA, 25 bp, Mus musculus
tggaatcagggctacggcaaatact

SEQ ID NO: 878459 - DNA, 25 bp, Mus musculus
tggaatcatatcatcaacaagtaga

SEQ ID NO: 878460 - DNA, 25 bp, Mus musculus
tggaatcatatcttcaacaagtaga

SEQ ID NO: 878461 - DNA, 25 bp, Mus musculus
tggaatcatccaaaagcatctcaag

SEQ ID NO: 878462 - DNA, 25 bp, Mus musculus
tggaatcatccataagcatctcaag

SEQ ID NO: 878463 - DNA, 25 bp, Mus musculus
tggaatcatttgaagcctgctgcgt

SEQ ID NO: 878464 - DNA, 25 bp, Mus musculus
tggaatcatttgtagcctgctgcgt

SEQ ID NO: 878465 - DNA, 25 bp, Mus musculus
tggaatccaactacttcgatcccag

SEQ ID NO: 878466 - DNA, 25 bp, Mus musculus
tggaatccaacttcttcgatcccag

SEQ ID NO: 878467 - DNA, 25 bp, Mus musculus
tggaatccacccactaagagactgg

SEQ ID NO: 878468 - DNA, 25 bp, Mus musculus
tggaatccaccctctaagagactgg

SEQ ID NO: 878469 - DNA, 25 bp, Mus musculus
tggaatccactgaaccgagctgtcg

SEQ ID NO: 878470 - DNA, 25 bp, Mus musculus
tggaatccactgtaccgagctgtcg

SEQ ID NO: 878471 - DNA, 25 bp, Mus musculus
tggaatccaggtatatatgaatatt

SEQ ID NO: 878472 - DNA, 25 bp, Mus musculus
tggaatccaggtttatatgaatatt

SEQ ID NO: 878473 - DNA, 25 bp, Mus musculus
tggaatccagtcaacctctgtacct

SEQ ID NO: 878474 - DNA, 25 bp, Mus musculus
tggaatccagtctacctctgtacct

SEQ ID NO: 878475 - DNA, 25 bp, Mus musculus
tggaatccattcatttatttctgag

SEQ ID NO: 878476 - DNA, 25 bp, Mus musculus
tggaatccattcttttatttctgag

SEQ ID NO: 878477 - DNA, 25 bp, Mus musculus
tggaatccccaccagatccgagaaa

SEQ ID NO: 878478 - DNA, 25 bp, Mus musculus
tggaatccccacgagatccgagaaa

SEQ ID NO: 878479 - DNA, 25 bp, Mus musculus
tggaatccccatagtgtatgagctg

SEQ ID NO: 878480 - DNA, 25 bp, Mus musculus
tggaatccccattgtgtatgagctg

SEQ ID NO: 878481 - DNA, 25 bp, Mus musculus
tggaatcccggacatttctcttaac

SEQ ID NO: 878482 - DNA, 25 bp, Mus musculus
tggaatcccggagatttctcttaac

SEQ ID NO: 878483 - DNA, 25 bp, Mus musculus
tggaatccctagatagcctctttga

SEQ ID NO: 878484 - DNA, 25 bp, Mus musculus
tggaatccctagttagcctctttga

SEQ ID NO: 878485 - DNA, 25 bp, Mus musculus
tggaatccctcacccatgtttgtcc

SEQ ID NO: 878486 - DNA, 25 bp, Mus musculus
tggaatccctcagccatgtttgtcc

SEQ ID NO: 878487 - DNA, 25 bp, Mus musculus
tggaatccctgaagcgccatcatgc

SEQ ID NO: 878488 - DNA, 25 bp, Mus musculus
tggaatccctgatgcgccatcatgc

SEQ ID NO: 878489 - DNA, 25 bp, Mus musculus
tggaatccctttcagccatttagaa

SEQ ID NO: 878490 - DNA, 25 bp, Mus musculus
tggaatccctttgagccatttagaa

SEQ ID NO: 878491 - DNA, 25 bp, Mus musculus
tggaatccgaatactctatttggta

SEQ ID NO: 878492 - DNA, 25 bp, Mus musculus
tggaatccgaattctctatttggta

SEQ ID NO: 878493 - DNA, 25 bp, Mus musculus
tggaatccgatgaaactcggtcctc

SEQ ID NO: 878494 - DNA, 25 bp, Mus musculus
tggaatccgatgtaactcggtcctc

SEQ ID NO: 878495 - DNA, 25 bp, Mus musculus
tggaatccgcttctctctgttgcct

SEQ ID NO: 878496 - DNA, 25 bp, Mus musculus
tggaatccgcttgtctctgttgcct

SEQ ID NO: 878497 - DNA, 25 bp, Mus musculus
tggaatccgtctcagctgcagttgt

SEQ ID NO: 878498 - DNA, 25 bp, Mus musculus
tggaatccgtctgagctgcagttgt

SEQ ID NO: 878499 - DNA, 25 bp, Mus musculus
tggaatcctattacatgcagctaat

SEQ ID NO: 878500 - DNA, 25 bp, Mus musculus
tggaatcctatttcatgcagctaat

SEQ ID NO: 878501 - DNA, 25 bp, Mus musculus
tggaatcctcctcttgagcaaccat

SEQ ID NO: 878502 - DNA, 25 bp, Mus musculus
tggaatcctcctgttgagcaaccat

SEQ ID NO: 878503 - DNA, 25 bp, Mus musculus
tggaatcctcgtcgcacagcctgaa

SEQ ID NO: 878504 - DNA, 25 bp, Mus musculus
tggaatcctcgtggcacagcctgaa

SEQ ID NO: 878505 - DNA, 25 bp, Mus musculus
tggaatcctctaaacatttttgtat

SEQ ID NO: 878506 - DNA, 25 bp, Mus musculus
tggaatcctctatacatttttgtat

SEQ ID NO: 878507 - DNA, 25 bp, Mus musculus
tggaatcctgcgagggaccctggac

SEQ ID NO: 878508 - DNA, 25 bp, Mus musculus
tggaatcctgcgtgggaccctggac

SEQ ID NO: 878509 - DNA, 25 bp, Mus musculus
tggaatccttctcttttaatccagt

SEQ ID NO: 878510 - DNA, 25 bp, Mus musculus
tggaatccttctgttttaatccagt

SEQ ID NO: 878511 - DNA, 25 bp, Mus musculus
tggaatcctttacctcctactggct

SEQ ID NO: 878512 - DNA, 25 bp, Mus musculus
tggaatcctttagctcctactggct

SEQ ID NO: 878513 - DNA, 25 bp, Mus musculus
tggaatcgcccaacactgtgagagc

SEQ ID NO: 878514 - DNA, 25 bp, Mus musculus
tggaatcgcccatcactgtgagagc

SEQ ID NO: 878515 - DNA, 25 bp, Mus musculus
tggaatcgtcctaccagactgactt

SEQ ID NO: 878516 - DNA, 25 bp, Mus musculus
tggaatcgtccttccagactgactt

SEQ ID NO: 878517 - DNA, 25 bp, Mus musculus
tggaatcgtgccagagggaaccctt

SEQ ID NO: 878518 - DNA, 25 bp, Mus musculus
tggaatcgtgcctgagggaaccctt

SEQ ID NO: 878519 - DNA, 25 bp, Mus musculus
tggaatctaacaagggcaagtcaat

SEQ ID NO: 878520 - DNA, 25 bp, Mus musculus
tggaatctaacatgggcaagtcaat

SEQ ID NO: 878521 - DNA, 25 bp, Mus musculus
tggaatctacacctgcacactttta

SEQ ID NO: 878522 - DNA, 25 bp, Mus musculus
tggaatctacacgtgcacactttta

SEQ ID NO: 878523 - DNA, 25 bp, Mus musculus
tggaatctagctcctttgatttgcc

SEQ ID NO: 878524 - DNA, 25 bp, Mus musculus
tggaatctagctgctttgatttgcc

SEQ ID NO: 878525 - DNA, 25 bp, Mus musculus
tggaatctcccaacgctttagtgag

SEQ ID NO: 878526 - DNA, 25 bp, Mus musculus
tggaatctcccatcgctttagtgag

SEQ ID NO: 878527 - DNA, 25 bp, Mus musculus
tggaatctcctcatttgcaccaggt

SEQ ID NO: 878528 - DNA, 25 bp, Mus musculus
tggaatctcctcttttgcaccaggt

SEQ ID NO: 878529 - DNA, 25 bp, Mus musculus
tggaatctcgccctgagctgctagc

SEQ ID NO: 878530 - DNA, 25 bp, Mus musculus
tggaatctcgccgtgagctgctagc

SEQ ID NO: 878531 - DNA, 25 bp, Mus musculus
tggaatctgaccctgccaccaggaa

SEQ ID NO: 878532 - DNA, 25 bp, Mus musculus
tggaatctgaccgtgccaccaggaa

SEQ ID NO: 878533 - DNA, 25 bp, Mus musculus
tggaatctgcttccggtgccccatg

SEQ ID NO: 878534 - DNA, 25 bp, Mus musculus
tggaatctgcttgcggtgccccatg

SEQ ID NO: 878535 - DNA, 25 bp, Mus musculus
tggaatctgttgaagctcccatgaa

SEQ ID NO: 878536 - DNA, 25 bp, Mus musculus
tggaatctgttgtagctcccatgaa

SEQ ID NO: 878537 - DNA, 25 bp, Mus musculus
tggaatcttccaactcaaaacctca

SEQ ID NO: 878538 - DNA, 25 bp, Mus musculus
tggaatcttccatctcaaaacctca

SEQ ID NO: 878539 - DNA, 25 bp, Mus musculus
tggaatcttctgaagagctgcctgc

SEQ ID NO: 878540 - DNA, 25 bp, Mus musculus
tggaatcttctgtagagctgcctgc

SEQ ID NO: 878541 - DNA, 25 bp, Mus musculus
tggaatcttgaacgcagctgtgtct

SEQ ID NO: 878542 - DNA, 25 bp, Mus musculus
tggaatcttgaaggcagctgtgtct

SEQ ID NO: 878543 - DNA, 25 bp, Mus musculus
tggaatcttgagacagcctgtggaa

SEQ ID NO: 878544 - DNA, 25 bp, Mus musculus
tggaatcttgagtcagcctgtggaa

SEQ ID NO: 878545 - DNA, 25 bp, Mus musculus
tggaatctttccacccagtgcagca

SEQ ID NO: 878546 - DNA, 25 bp, Mus musculus
tggaatctttcctcccagtgcagca

SEQ ID NO: 878547 - DNA, 25 bp, Mus musculus
tggaatgaacaaacacccgtggcag

SEQ ID NO: 878548 - DNA, 25 bp, Mus musculus
tggaatgaacaatcacccgtggcag

SEQ ID NO: 878549 - DNA, 25 bp, Mus musculus
tggaatgaactgactctacggtatc

SEQ ID NO: 878550 - DNA, 25 bp, Mus musculus
tggaatgaactgtctctacggtatc

SEQ ID NO: 878551 - DNA, 25 bp, Mus musculus
tggaatgaacttagtgcctggcccc

SEQ ID NO: 878552 - DNA, 25 bp, Mus musculus
tggaatgaactttgtgcctggcccc

SEQ ID NO: 878553 - DNA, 25 bp, Mus musculus
tggaatgacaccctggctttaagct

SEQ ID NO: 878554 - DNA, 25 bp, Mus musculus
tggaatgacaccgtggctttaagct

SEQ ID NO: 878555 - DNA, 25 bp, Mus musculus
tggaatgacattccatgaacgcttt

SEQ ID NO: 878556 - DNA, 25 bp, Mus musculus
tggaatgacattgcatgaacgcttt

SEQ ID NO: 878557 - DNA, 25 bp, Mus musculus
tggaatgaccaacgccgacttgatc

SEQ ID NO: 878558 - DNA, 25 bp, Mus musculus
tggaatgaccaaggccgacttgatc

SEQ ID NO: 878559 - DNA, 25 bp, Mus musculus
tggaatgagaacagatgccccaccc

SEQ ID NO: 878560 - DNA, 25 bp, Mus musculus
tggaatgagaactgatgccccaccc

SEQ ID NO: 878561 - DNA, 25 bp, Mus musculus
tggaatgcaagtccctgtactcaca

SEQ ID NO: 878562 - DNA, 25 bp, Mus musculus
tggaatgcaagtgcctgtactcaca

SEQ ID NO: 878563 - DNA, 25 bp, Mus musculus
tggaatgcacacacctgaccaagtc

SEQ ID NO: 878564 - DNA, 25 bp, Mus musculus
tggaatgcacactcctgaccaagtc

SEQ ID NO: 878565 - DNA, 25 bp, Mus musculus
tggaatgcagacacctgcctcctgc

SEQ ID NO: 878566 - DNA, 25 bp, Mus musculus
tggaatgcagaccactctggattac

SEQ ID NO: 878567 - DNA, 25 bp, Mus musculus
tggaatgcagacgactctggattac

SEQ ID NO: 878568 - DNA, 25 bp, Mus musculus
tggaatgcagactcctgcctcctgc

SEQ ID NO: 878569 - DNA, 25 bp, Mus musculus
tggaatgccaaacctgaggcgtcaa

SEQ ID NO: 878570 - DNA, 25 bp, Mus musculus
tggaatgccaaagctgaggcgtcaa

SEQ ID NO: 878571 - DNA, 25 bp, Mus musculus
tggaatgccaagaatgtcccaagct

SEQ ID NO: 878572 - DNA, 25 bp, Mus musculus
tggaatgccaagtatgtcccaagct

SEQ ID NO: 878573 - DNA, 25 bp, Mus musculus
tggaatgccattacattctcctctg

SEQ ID NO: 878574 - DNA, 25 bp, Mus musculus
tggaatgccattagccatgttccca

SEQ ID NO: 878575 - DNA, 25 bp, Mus musculus
tggaatgccatttcattctcctctg

SEQ ID NO: 878576 - DNA, 25 bp, Mus musculus
tggaatgccatttgccatgttccca

SEQ ID NO: 878577 - DNA, 25 bp, Mus musculus
tggaatgcggctatatcatcaatca

SEQ ID NO: 878578 - DNA, 25 bp, Mus musculus
tggaatgcggctttatcatcaatca

SEQ ID NO: 878579 - DNA, 25 bp, Mus musculus
tggaatgcttcccagctgcaggccc

SEQ ID NO: 878580 - DNA, 25 bp, Mus musculus
tggaatgcttccgagctgcaggccc

SEQ ID NO: 878581 - DNA, 25 bp, Mus musculus
tggaatgcttgtcagtccgttccca

SEQ ID NO: 878582 - DNA, 25 bp, Mus musculus
tggaatgcttgtgagtccgttccca

SEQ ID NO: 878583 - DNA, 25 bp, Mus musculus
tggaatgctttaattaccttgacag

SEQ ID NO: 878584 - DNA, 25 bp, Mus musculus
tggaatgctttatttaccttgacag

SEQ ID NO: 878585 - DNA, 25 bp, Mus musculus
tggaatggactaatttctcaggatt

SEQ ID NO: 878586 - DNA, 25 bp, Mus musculus
tggaatggactattttctcaggatt

SEQ ID NO: 878587 - DNA, 25 bp, Mus musculus
tggaatggaggaccagtgctttttt

SEQ ID NO: 878588 - DNA, 25 bp, Mus musculus
tggaatggaggacctctgacctctg

SEQ ID NO: 878589 - DNA, 25 bp, Mus musculus
tggaatggaggagcagtgctttttt

SEQ ID NO: 878590 - DNA, 25 bp, Mus musculus
tggaatggaggagctctgacctctg

SEQ ID NO: 878591 - DNA, 25 bp, Mus musculus
tggaatggaggtccgtacttcccgt

SEQ ID NO: 878592 - DNA, 25 bp, Mus musculus
tggaatggaggtgcgtacttcccgt

SEQ ID NO: 878593 - DNA, 25 bp, Mus musculus
tggaatggagtcaccatgttactga

SEQ ID NO: 878594 - DNA, 25 bp, Mus musculus
tggaatggagtctccatgttactga

SEQ ID NO: 878595 - DNA, 25 bp, Mus musculus
tggaatggccctctggtcacagagc

SEQ ID NO: 878596 - DNA, 25 bp, Mus musculus
tggaatggccctgtggtcacagagc

SEQ ID NO: 878597 - DNA, 25 bp, Mus musculus
tggaatgggaccccatcccacctgt

SEQ ID NO: 878598 - DNA, 25 bp, Mus musculus
tggaatgggaccgcatcccacctgt

SEQ ID NO: 878599 - DNA, 25 bp, Mus musculus
tggaatgggctcaacaccgatttac

SEQ ID NO: 878600 - DNA, 25 bp, Mus musculus
tggaatgggctctacaccgatttac

SEQ ID NO: 878601 - DNA, 25 bp, Mus musculus
tggaatgggtgcattgtttttctaa

SEQ ID NO: 878602 - DNA, 25 bp, Mus musculus
tggaatgggtgctttgtttttctaa

SEQ ID NO: 878603 - DNA, 25 bp, Mus musculus
tggaatggtaacagagccagcgctg

SEQ ID NO: 878604 - DNA, 25 bp, Mus musculus
tggaatggtaactgagccagcgctg

SEQ ID NO: 878605 - DNA, 25 bp, Mus musculus
tggaatggtcacatcaagccttggg

SEQ ID NO: 878606 - DNA, 25 bp, Mus musculus
tggaatggtcacttcaagccttggg

SEQ ID NO: 878607 - DNA, 25 bp, Mus musculus
tggaatggtcttacctttccgctag

SEQ ID NO: 878608 - DNA, 25 bp, Mus musculus
tggaatggtctttcctttccgctag

SEQ ID NO: 878609 - DNA, 25 bp, Mus musculus
tggaatgtaactccgagtgctcccc

SEQ ID NO: 878610 - DNA, 25 bp, Mus musculus
tggaatgtaactgcgagtgctcccc

SEQ ID NO: 878611 - DNA, 25 bp, Mus musculus
tggaatgtaccccagtcctctcgac

SEQ ID NO: 878612 - DNA, 25 bp, Mus musculus
tggaatgtacccgagtcctctcgac

SEQ ID NO: 878613 - DNA, 25 bp, Mus musculus
tggaatgtcaccatgtggcacaatc

SEQ ID NO: 878614 - DNA, 25 bp, Mus musculus
tggaatgtcaccttgtggcacaatc

SEQ ID NO: 878615 - DNA, 25 bp, Mus musculus
tggaatgtccacagcgcaagcccaa

SEQ ID NO: 878616 - DNA, 25 bp, Mus musculus
tggaatgtccactgcgcaagcccaa

SEQ ID NO: 878617 - DNA, 25 bp, Mus musculus
tggaatgtccagatgaacaggctca

SEQ ID NO: 878618 - DNA, 25 bp, Mus musculus
tggaatgtccagttgaacaggctca

SEQ ID NO: 878619 - DNA, 25 bp, Mus musculus
tggaatgtctccaggccatgggatt

SEQ ID NO: 878620 - DNA, 25 bp, Mus musculus
tggaatgtctcctggccatgggatt

SEQ ID NO: 878621 - DNA, 25 bp, Mus musculus
tggaatgtgcctcagctctcagtga

SEQ ID NO: 878622 - DNA, 25 bp, Mus musculus
tggaatgtgcctgagctctcagtga

SEQ ID NO: 878623 - DNA, 25 bp, Mus musculus
tggaatgtgctgaagcatttcctaa

SEQ ID NO: 878624 - DNA, 25 bp, Mus musculus
tggaatgtgctgtagcatttcctaa

SEQ ID NO: 878625 - DNA, 25 bp, Mus musculus
tggaatgtgcttattaccataaatt

SEQ ID NO: 878626 - DNA, 25 bp, Mus musculus
tggaatgtgctttttaccataaatt

SEQ ID NO: 878627 - DNA, 25 bp, Mus musculus
tggaatgtgtcacgtcaagctgcct

SEQ ID NO: 878628 - DNA, 25 bp, Mus musculus
tggaatgtgtcaggtcaagctgcct

SEQ ID NO: 878629 - DNA, 25 bp, Mus musculus
tggaatgttatactgctggaccaca

SEQ ID NO: 878630 - DNA, 25 bp, Mus musculus
tggaatgttatagtgctggaccaca

SEQ ID NO: 878631 - DNA, 25 bp, Mus musculus
tggaatgttggcatcagactgttgt

SEQ ID NO: 878632 - DNA, 25 bp, Mus musculus
tggaatgttggcttcagactgttgt

SEQ ID NO: 878633 - DNA, 25 bp, Mus musculus
tggaattaacctcaatgcctcctcc

SEQ ID NO: 878634 - DNA, 25 bp, Mus musculus
tggaattaacctgaatgcctcctcc

SEQ ID NO: 878635 - DNA, 25 bp, Mus musculus
tggaattacagtcctcctggcgctg

SEQ ID NO: 878636 - DNA, 25 bp, Mus musculus
tggaattacagtgctcctggcgctg

SEQ ID NO: 878637 - DNA, 25 bp, Mus musculus
tggaattacggcagggccttctaca

SEQ ID NO: 878638 - DNA, 25 bp, Mus musculus
tggaattacggctgggccttctaca

SEQ ID NO: 878639 - DNA, 25 bp, Mus musculus
tggaattactggatccgtgacatcc

SEQ ID NO: 878640 - DNA, 25 bp, Mus musculus
tggaattactggttccgtgacatcc

SEQ ID NO: 878641 - DNA, 25 bp, Mus musculus
tggaattactgtcgtttcttacttt

SEQ ID NO: 878642 - DNA, 25 bp, Mus musculus
tggaattactgtggtttcttacttt

SEQ ID NO: 878643 - DNA, 25 bp, Mus musculus
tggaattagcgacaccctgtttcaa

SEQ ID NO: 878644 - DNA, 25 bp, Mus musculus
tggaattagcgagaccctgtttcaa

SEQ ID NO: 878645 - DNA, 25 bp, Mus musculus
tggaattagctcctccccttcaaat

SEQ ID NO: 878646 - DNA, 25 bp, Mus musculus
tggaattagctcgtccccttcaaat

SEQ ID NO: 878647 - DNA, 25 bp, Mus musculus
tggaattaggatccatttgccttgt

SEQ ID NO: 878648 - DNA, 25 bp, Mus musculus
tggaattaggatgcatttgccttgt

SEQ ID NO: 878649 - DNA, 25 bp, Mus musculus
tggaattatgttcgtcaaccatgac

SEQ ID NO: 878650 - DNA, 25 bp, Mus musculus
tggaattatgttggtcaaccatgac

SEQ ID NO: 878651 - DNA, 25 bp, Mus musculus
tggaattcaaatattcctacctcag

SEQ ID NO: 878652 - DNA, 25 bp, Mus musculus
tggaattcaaattttcctacctcag

SEQ ID NO: 878653 - DNA, 25 bp, Mus musculus
tggaattcaatgacggcgcctacaa

SEQ ID NO: 878654 - DNA, 25 bp, Mus musculus
tggaattcaatgtcggcgcctacaa

SEQ ID NO: 878655 - DNA, 25 bp, Mus musculus
tggaattcactaagtcacccaggct

SEQ ID NO: 878656 - DNA, 25 bp, Mus musculus
tggaattcactatgtcacccaggct

SEQ ID NO: 878657 - DNA, 25 bp, Mus musculus
tggaattcactgagcaggctgggtt

SEQ ID NO: 878658 - DNA, 25 bp, Mus musculus
tggaattcactgtgcaggctgggtt

SEQ ID NO: 878659 - DNA, 25 bp, Mus musculus
tggaattcagggatggacccagcct

SEQ ID NO: 878660 - DNA, 25 bp, Mus musculus
tggaattcagggttggacccagcct

SEQ ID NO: 878661 - DNA, 25 bp, Mus musculus
tggaattcatggaatcacatttttt

SEQ ID NO: 878662 - DNA, 25 bp, Mus musculus
tggaattcatggtatcacatttttt

SEQ ID NO: 878663 - DNA, 25 bp, Mus musculus
tggaattccattctgggagatcatg

SEQ ID NO: 878664 - DNA, 25 bp, Mus musculus
tggaattccattgtgggagatcatg

SEQ ID NO: 878665 - DNA, 25 bp, Mus musculus
tggaattccctactcttcactatac

SEQ ID NO: 878666 - DNA, 25 bp, Mus musculus
tggaattccctagtcttcactatac

SEQ ID NO: 878667 - DNA, 25 bp, Mus musculus
tggaattccggaagcttttcagagg

SEQ ID NO: 878668 - DNA, 25 bp, Mus musculus
tggaattccggatgcttttcagagg

SEQ ID NO: 878669 - DNA, 25 bp, Mus musculus
tggaattcctatatcttctgcctat

SEQ ID NO: 878670 - DNA, 25 bp, Mus musculus
tggaattcctatttcttctgcctat

SEQ ID NO: 878671 - DNA, 25 bp, Mus musculus
tggaattcctccatcggctcacagg

SEQ ID NO: 878672 - DNA, 25 bp, Mus musculus
tggaattcctccttcggctcacagg

SEQ ID NO: 878673 - DNA, 25 bp, Mus musculus
tggaattcctctcatgttcattatt

SEQ ID NO: 878674 - DNA, 25 bp, Mus musculus
tggaattcctctgatgttcattatt

SEQ ID NO: 878675 - DNA, 25 bp, Mus musculus
tggaattcgaaccacccatttggtg

SEQ ID NO: 878676 - DNA, 25 bp, Mus musculus
tggaattcgaacgacccatttggtg

SEQ ID NO: 878677 - DNA, 25 bp, Mus musculus
tggaattcggtgagccacccaaggg

SEQ ID NO: 878678 - DNA, 25 bp, Mus musculus
tggaattcggtgtgccacccaaggg

SEQ ID NO: 878679 - DNA, 25 bp, Mus musculus
tggaattctgtaccacacctcatag

SEQ ID NO: 878680 - DNA, 25 bp, Mus musculus
tggaattctgtagcacacctcatag

SEQ ID NO: 878681 - DNA, 25 bp, Mus musculus
tggaattctttaaccctcttgtcct

SEQ ID NO: 878682 - DNA, 25 bp, Mus musculus
tggaattctttatccctcttgtcct

SEQ ID NO: 878683 - DNA, 25 bp, Mus musculus
tggaattgagtcaagggtacttgtt

SEQ ID NO: 878684 - DNA, 25 bp, Mus musculus
tggaattgagtctagggtacttgtt

SEQ ID NO: 878685 - DNA, 25 bp, Mus musculus
tggaattgatggacttgccccgtga

SEQ ID NO: 878686 - DNA, 25 bp, Mus musculus
tggaattgatggtcttgccccgtga

SEQ ID NO: 878687 - DNA, 25 bp, Mus musculus
tggaattgatttccattgaacacaa

SEQ ID NO: 878688 - DNA, 25 bp, Mus musculus
tggaattgatttgcattgaacacaa

SEQ ID NO: 878689 - DNA, 25 bp, Mus musculus
tggaattgccgaagtcaccatccgg

SEQ ID NO: 878690 - DNA, 25 bp, Mus musculus
tggaattgccgatgtcaccatccgg

SEQ ID NO: 878691 - DNA, 25 bp, Mus musculus
tggaattgcctgaatcttatcaccc

SEQ ID NO: 878692 - DNA, 25 bp, Mus musculus
tggaattgcctgtatcttatcaccc

SEQ ID NO: 878693 - DNA, 25 bp, Mus musculus
tggaattgctgtatctccgtgtggc

SEQ ID NO: 878694 - DNA, 25 bp, Mus musculus
tggaattgctgtttctccgtgtggc

SEQ ID NO: 878695 - DNA, 25 bp, Mus musculus
tggaattggctgacccggagttcaa

SEQ ID NO: 878696 - DNA, 25 bp, Mus musculus
tggaattggctgtcccggagttcaa

SEQ ID NO: 878697 - DNA, 25 bp, Mus musculus
tggaattgtcaaacccctttcatct

SEQ ID NO: 878698 - DNA, 25 bp, Mus musculus
tggaattgtcaatcccctttcatct

SEQ ID NO: 878699 - DNA, 25 bp, Mus musculus
tggaattgtcatctgatcaaagaat

SEQ ID NO: 878700 - DNA, 25 bp, Mus musculus
tggaattgtcatgtgatcaaagaat

SEQ ID NO: 878701 - DNA, 25 bp, Mus musculus
tggaatttaatgacccaatgctggg

SEQ ID NO: 878702 - DNA, 25 bp, Mus musculus
tggaatttaatgtcccaatgctggg

SEQ ID NO: 878703 - DNA, 25 bp, Mus musculus
tggaatttatatactcacccttcca

SEQ ID NO: 878704 - DNA, 25 bp, Mus musculus
tggaatttatattctcacccttcca

SEQ ID NO: 878705 - DNA, 25 bp, Mus musculus
tggaatttattccttaactcgttag

SEQ ID NO: 878706 - DNA, 25 bp, Mus musculus
tggaatttattcgttaactcgttag

SEQ ID NO: 878707 - DNA, 25 bp, Mus musculus
tggaatttctttaactagcctaggg

SEQ ID NO: 878708 - DNA, 25 bp, Mus musculus
tggaatttcttttactagcctaggg

SEQ ID NO: 878709 - DNA, 25 bp, Mus musculus
tggaatttgggaattaacatcctcc

SEQ ID NO: 878710 - DNA, 25 bp, Mus musculus
tggaatttgggatttaacatcctcc

SEQ ID NO: 878711 - DNA, 25 bp, Mus musculus
tggaattttcccattctctagagac

SEQ ID NO: 878712 - DNA, 25 bp, Mus musculus
tggaattttccctttctctagagac

SEQ ID NO: 878713 - DNA, 25 bp, Mus musculus
tggacaaaaagaagtacccgtactg

SEQ ID NO: 878714 - DNA, 25 bp, Mus musculus
tggacaaaaagatgtacccgtactg

SEQ ID NO: 878715 - DNA, 25 bp, Mus musculus
tggacaaacaccacggaattccctg

SEQ ID NO: 878716 - DNA, 25 bp, Mus musculus
tggacaaacacctcggaattccctg

SEQ ID NO: 878717 - DNA, 25 bp, Mus musculus
tggacaaacactatatcagctgggt

SEQ ID NO: 878718 - DNA, 25 bp, Mus musculus
tggacaaacactttatcagctgggt

SEQ ID NO: 878719 - DNA, 25 bp, Mus musculus
tggacaaacagcctggaagctccag

SEQ ID NO: 878720 - DNA, 25 bp, Mus musculus
tggacaaacagcgtggaagctccag

SEQ ID NO: 878721 - DNA, 25 bp, Mus musculus
tggacaaaccagagacctgtagctt

SEQ ID NO: 878722 - DNA, 25 bp, Mus musculus
tggacaaaccagtgacctgtagctt

SEQ ID NO: 878723 - DNA, 25 bp, Mus musculus
tggacaaaccggatgtttccatgtt

SEQ ID NO: 878724 - DNA, 25 bp, Mus musculus
tggacaaaccggttgtttccatgtt

SEQ ID NO: 878725 - DNA, 25 bp, Mus musculus
tggacaaactccaacggttcctcta

SEQ ID NO: 878726 - DNA, 25 bp, Mus musculus
tggacaaactcctacggttcctcta

SEQ ID NO: 878727 - DNA, 25 bp, Mus musculus
tggacaaactggaccacctggtgct

SEQ ID NO: 878728 - DNA, 25 bp, Mus musculus
tggacaaactggtccacctggtgct

SEQ ID NO: 878729 - DNA, 25 bp, Mus musculus
tggacaaagcacctaagctccctgt

SEQ ID NO: 878730 - DNA, 25 bp, Mus musculus
tggacaaagcacgtaagctccctgt

SEQ ID NO: 878731 - DNA, 25 bp, Mus musculus
tggacaaagcccctcacaagcagtt

SEQ ID NO: 878732 - DNA, 25 bp, Mus musculus
tggacaaagcccgtcacaagcagtt

SEQ ID NO: 878733 - DNA, 25 bp, Mus musculus
tggacaaagtgcagctccttctcgc

SEQ ID NO: 878734 - DNA, 25 bp, Mus musculus
tggacaaagtgctgctccttctcgc

SEQ ID NO: 878735 - DNA, 25 bp, Mus musculus
tggacaaatgtgcagcagcccgcat

SEQ ID NO: 878736 - DNA, 25 bp, Mus musculus
tggacaaatgtggagcagcccgcat

SEQ ID NO: 878737 - DNA, 25 bp, Mus musculus
tggacaacaaacactgggtttcata

SEQ ID NO: 878738 - DNA, 25 bp, Mus musculus
tggacaacaaactctgggtttcata

SEQ ID NO: 878739 - DNA, 25 bp, Mus musculus
tggacaacactaacacaggaccctt

SEQ ID NO: 878740 - DNA, 25 bp, Mus musculus
tggacaacactatcacaggaccctt

SEQ ID NO: 878741 - DNA, 25 bp, Mus musculus
tggacaacactgagatacgcaactt

SEQ ID NO: 878742 - DNA, 25 bp, Mus musculus
tggacaacactgaggacctgcagcg

SEQ ID NO: 878743 - DNA, 25 bp, Mus musculus
tggacaacactgtgatacgcaactt

SEQ ID NO: 878744 - DNA, 25 bp, Mus musculus
tggacaacactgtggacctgcagcg

SEQ ID NO: 878745 - DNA, 25 bp, Mus musculus
tggacaacaggaagccatggcccat

SEQ ID NO: 878746 - DNA, 25 bp, Mus musculus
tggacaacaggatgccatggcccat

SEQ ID NO: 878747 - DNA, 25 bp, Mus musculus
tggacaacatcactaacctctttac

SEQ ID NO: 878748 - DNA, 25 bp, Mus musculus
tggacaacatcagtaacctctttac

SEQ ID NO: 878749 - DNA, 25 bp, Mus musculus
tggacaaccagtcttttatttattg

SEQ ID NO: 878750 - DNA, 25 bp, Mus musculus
tggacaaccagtgttttatttattg

SEQ ID NO: 878751 - DNA, 25 bp, Mus musculus
tggacaacccaacctctctagacga

SEQ ID NO: 878752 - DNA, 25 bp, Mus musculus
tggacaacccaagctctctagacga

SEQ ID NO: 878753 - DNA, 25 bp, Mus musculus
tggacaaccttaccctgtgtatctt

SEQ ID NO: 878754 - DNA, 25 bp, Mus musculus
tggacaaccttagcctgtgtatctt

SEQ ID NO: 878755 - DNA, 25 bp, Mus musculus
tggacaaccttgaggctcctcatga

SEQ ID NO: 878756 - DNA, 25 bp, Mus musculus
tggacaaccttgtggctcctcatga

SEQ ID NO: 878757 - DNA, 25 bp, Mus musculus
tggacaacgatgagctccggcaaca

SEQ ID NO: 878758 - DNA, 25 bp, Mus musculus
tggacaacgatgtgctccggcaaca

SEQ ID NO: 878759 - DNA, 25 bp, Mus musculus
tggacaacgtctacccggagctgag

SEQ ID NO: 878760 - DNA, 25 bp, Mus musculus
tggacaacgtcttcccggagctgag

SEQ ID NO: 878761 - DNA, 25 bp, Mus musculus
tggacaactccacaacggttcagta

SEQ ID NO: 878762 - DNA, 25 bp, Mus musculus
tggacaactccagaacggttcagta

SEQ ID NO: 878763 - DNA, 25 bp, Mus musculus
tggacaactcccaggagacctgtgc

SEQ ID NO: 878764 - DNA, 25 bp, Mus musculus
tggacaactccctggagacctgtgc

SEQ ID NO: 878765 - DNA, 25 bp, Mus musculus
tggacaactgaacacagagggtgat

SEQ ID NO: 878766 - DNA, 25 bp, Mus musculus
tggacaactgaagacagagggtgat

SEQ ID NO: 878767 - DNA, 25 bp, Mus musculus
tggacaagacccactctcagagaac

SEQ ID NO: 878768 - DNA, 25 bp, Mus musculus
tggacaagaccctctctcagagaac

SEQ ID NO: 878769 - DNA, 25 bp, Mus musculus
tggacaagacttatcctccaagttg

SEQ ID NO: 878770 - DNA, 25 bp, Mus musculus
tggacaagacttttcctccaagttg

SEQ ID NO: 878771 - DNA, 25 bp, Mus musculus
tggacaagagcgacagcgactgagc

SEQ ID NO: 878772 - DNA, 25 bp, Mus musculus
tggacaagagcgtcagcgactgagc

SEQ ID NO: 878773 - DNA, 25 bp, Mus musculus
tggacaagatccctctcactggtgg

SEQ ID NO: 878774 - DNA, 25 bp, Mus musculus
tggacaagatccgtctcactggtgg

SEQ ID NO: 878775 - DNA, 25 bp, Mus musculus
tggacaagccatctgcctccgaggg

SEQ ID NO: 878776 - DNA, 25 bp, Mus musculus
tggacaagccatgtgcctccgaggg

SEQ ID NO: 878777 - DNA, 25 bp, Mus musculus
tggacaagctccagcgtgatgccaa

SEQ ID NO: 878778 - DNA, 25 bp, Mus musculus
tggacaagctcctgcgtgatgccaa

SEQ ID NO: 878779 - DNA, 25 bp, Mus musculus
tggacaagctgaccgacgagtacaa

SEQ ID NO: 878780 - DNA, 25 bp, Mus musculus
tggacaagctgagcgacgagtacaa

SEQ ID NO: 878781 - DNA, 25 bp, Mus musculus
tggacaagctttatactatatttct

SEQ ID NO: 878782 - DNA, 25 bp, Mus musculus
tggacaagctttttactatatttct

SEQ ID NO: 878783 - DNA, 25 bp, Mus musculus
tggacaagtaccaggcacgggagca

SEQ ID NO: 878784 - DNA, 25 bp, Mus musculus
tggacaagtacctggcacgggagca

SEQ ID NO: 878785 - DNA, 25 bp, Mus musculus
tggacaagtagtaaccaggtgtgac

SEQ ID NO: 878786 - DNA, 25 bp, Mus musculus
tggacaagtagttaccaggtgtgac

SEQ ID NO: 878787 - DNA, 25 bp, Mus musculus
tggacaagtataatctgctgccaca

SEQ ID NO: 878788 - DNA, 25 bp, Mus musculus
tggacaagtatattctgctgccaca

SEQ ID NO: 878789 - DNA, 25 bp, Mus musculus
tggacaagtatcagtaccccgcggc

SEQ ID NO: 878790 - DNA, 25 bp, Mus musculus
tggacaagtatctgtaccccgcggc

SEQ ID NO: 878791 - DNA, 25 bp, Mus musculus
tggacaagtatgatagcccattcga

SEQ ID NO: 878792 - DNA, 25 bp, Mus musculus
tggacaagtatgttagcccattcga

SEQ ID NO: 878793 - DNA, 25 bp, Mus musculus
tggacaagtcccactgcttcactta

SEQ ID NO: 878794 - DNA, 25 bp, Mus musculus
tggacaagtccctctgcttcactta

SEQ ID NO: 878795 - DNA, 25 bp, Mus musculus
tggacaagtgctcccagacacatga

SEQ ID NO: 878796 - DNA, 25 bp, Mus musculus
tggacaagtgctgccagacacatga

SEQ ID NO: 878797 - DNA, 25 bp, Mus musculus
tggacaagtgtcctagcgctgctga

SEQ ID NO: 878798 - DNA, 25 bp, Mus musculus
tggacaagtgtcgtagcgctgctga

SEQ ID NO: 878799 - DNA, 25 bp, Mus musculus
tggacaagttgtctgccggagtcta

SEQ ID NO: 878800 - DNA, 25 bp, Mus musculus
tggacaagttgtgtgccggagtcta

SEQ ID NO: 878801 - DNA, 25 bp, Mus musculus
tggacaataaaacgactgtccccaa

SEQ ID NO: 878802 - DNA, 25 bp, Mus musculus
tggacaataaaaggactgtccccaa

SEQ ID NO: 878803 - DNA, 25 bp, Mus musculus
tggacaatacaacccagctgggttt

SEQ ID NO: 878804 - DNA, 25 bp, Mus musculus
tggacaatacaagccagctgggttt

SEQ ID NO: 878805 - DNA, 25 bp, Mus musculus
tggacaatagaacctgccctgctat

SEQ ID NO: 878806 - DNA, 25 bp, Mus musculus
tggacaatagaagctgccctgctat

SEQ ID NO: 878807 - DNA, 25 bp, Mus musculus
tggacaatatttcctatcgcaggga

SEQ ID NO: 878808 - DNA, 25 bp, Mus musculus
tggacaatatttgctatcgcaggga

SEQ ID NO: 878809 - DNA, 25 bp, Mus musculus
tggacaatgactccctactattact

SEQ ID NO: 878810 - DNA, 25 bp, Mus musculus
tggacaatgactgcctactattact

SEQ ID NO: 878811 - DNA, 25 bp, Mus musculus
tggacaatgggcacaaaccctacac

SEQ ID NO: 878812 - DNA, 25 bp, Mus musculus
tggacaatgggctcaaaccctacac

SEQ ID NO: 878813 - DNA, 25 bp, Mus musculus
tggacaatgtccatcttagcacttt

SEQ ID NO: 878814 - DNA, 25 bp, Mus musculus
tggacaatgtccttcttagcacttt

SEQ ID NO: 878815 - DNA, 25 bp, Mus musculus
tggacaatgtctagcacagcctatc

SEQ ID NO: 878816 - DNA, 25 bp, Mus musculus
tggacaatgtcttgcacagcctatc

SEQ ID NO: 878817 - DNA, 25 bp, Mus musculus
tggacaattgccacttctgactata

SEQ ID NO: 878818 - DNA, 25 bp, Mus musculus
tggacaattgcctcttctgactata

SEQ ID NO: 878819 - DNA, 25 bp, Mus musculus
tggacaattggcactacctcagcaa

SEQ ID NO: 878820 - DNA, 25 bp, Mus musculus
tggacaattggctctacctcagcaa

SEQ ID NO: 878821 - DNA, 25 bp, Mus musculus
tggacacaaaggagaacctggcctt

SEQ ID NO: 878822 - DNA, 25 bp, Mus musculus
tggacacaaaggtgaacctggcctt

SEQ ID NO: 878823 - DNA, 25 bp, Mus musculus
tggacacaagatctttcccggtctt

SEQ ID NO: 878824 - DNA, 25 bp, Mus musculus
tggacacaagatgtttcccggtctt

SEQ ID NO: 878825 - DNA, 25 bp, Mus musculus
tggacacaagcactgggtgcccaca

SEQ ID NO: 878826 - DNA, 25 bp, Mus musculus
tggacacaagcagtgggtgcccaca

SEQ ID NO: 878827 - DNA, 25 bp, Mus musculus
tggacacaatacacttacccctgtg

SEQ ID NO: 878828 - DNA, 25 bp, Mus musculus
tggacacaatactcttacccctgtg

SEQ ID NO: 878829 - DNA, 25 bp, Mus musculus
tggacacaatctcatgattcccatg

SEQ ID NO: 878830 - DNA, 25 bp, Mus musculus
tggacacaatctgatgattcccatg

SEQ ID NO: 878831 - DNA, 25 bp, Mus musculus
tggacacacaagctcaacagcagtt

SEQ ID NO: 878832 - DNA, 25 bp, Mus musculus
tggacacacaaggtcaacagcagtt

SEQ ID NO: 878833 - DNA, 25 bp, Mus musculus
tggacacacctgaaaatgtgatcag

SEQ ID NO: 878834 - DNA, 25 bp, Mus musculus
tggacacacctgtaaatgtgatcag

SEQ ID NO: 878835 - DNA, 25 bp, Mus musculus
tggacacacggaagagtaacctgtt

SEQ ID NO: 878836 - DNA, 25 bp, Mus musculus
tggacacacggatgagtaacctgtt

SEQ ID NO: 878837 - DNA, 25 bp, Mus musculus
tggacacactatatcctggataact

SEQ ID NO: 878838 - DNA, 25 bp, Mus musculus
tggacacactatttcctggataact

SEQ ID NO: 878839 - DNA, 25 bp, Mus musculus
tggacacactgactgctcctttgat

SEQ ID NO: 878840 - DNA, 25 bp, Mus musculus
tggacacactgagtgctcctttgat

SEQ ID NO: 878841 - DNA, 25 bp, Mus musculus
tggacacactgtaaacccctgggta

SEQ ID NO: 878842 - DNA, 25 bp, Mus musculus
tggacacactgtactcacagactac

SEQ ID NO: 878843 - DNA, 25 bp, Mus musculus
tggacacactgttaacccctgggta

SEQ ID NO: 878844 - DNA, 25 bp, Mus musculus
tggacacactgttctcacagactac

SEQ ID NO: 878845 - DNA, 25 bp, Mus musculus
tggacacagaacagcatcactaaat

SEQ ID NO: 878846 - DNA, 25 bp, Mus musculus
tggacacagaactgcatcactaaat

SEQ ID NO: 878847 - DNA, 25 bp, Mus musculus
tggacacaggcccacatcaaattac

SEQ ID NO: 878848 - DNA, 25 bp, Mus musculus
tggacacaggccctctgatttctga

SEQ ID NO: 878849 - DNA, 25 bp, Mus musculus
tggacacaggccgacatcaaattac

SEQ ID NO: 878850 - DNA, 25 bp, Mus musculus
tggacacaggccgtctgatttctga

SEQ ID NO: 878851 - DNA, 25 bp, Mus musculus
tggacacagtagctattcatttgaa

SEQ ID NO: 878852 - DNA, 25 bp, Mus musculus
tggacacagtaggtattcatttgaa

SEQ ID NO: 878853 - DNA, 25 bp, Mus musculus
tggacacatcaaaccagccccaggg

SEQ ID NO: 878854 - DNA, 25 bp, Mus musculus
tggacacatcaatccagccccaggg

SEQ ID NO: 878855 - DNA, 25 bp, Mus musculus
tggacacatcctatttagagcatca

SEQ ID NO: 878856 - DNA, 25 bp, Mus musculus
tggacacatcctttttagagcatca

SEQ ID NO: 878857 - DNA, 25 bp, Mus musculus
tggacacatgatatgcctcttgatt

SEQ ID NO: 878858 - DNA, 25 bp, Mus musculus
tggacacatgatttgcctcttgatt

SEQ ID NO: 878859 - DNA, 25 bp, Mus musculus
tggacacatgctaataccttcccag

SEQ ID NO: 878860 - DNA, 25 bp, Mus musculus
tggacacatgcttataccttcccag

SEQ ID NO: 878861 - DNA, 25 bp, Mus musculus
tggacaccacatacactacttttcc

SEQ ID NO: 878862 - DNA, 25 bp, Mus musculus
tggacaccacattcactacttttcc

SEQ ID NO: 878863 - DNA, 25 bp, Mus musculus
tggacaccatctactcttacgtcag

SEQ ID NO: 878864 - DNA, 25 bp, Mus musculus
tggacaccatcttctcttacgtcag

SEQ ID NO: 878865 - DNA, 25 bp, Mus musculus
tggacaccatgcagctgaccgtgaa

SEQ ID NO: 878866 - DNA, 25 bp, Mus musculus
tggacaccatgctgctgaccgtgaa

SEQ ID NO: 878867 - DNA, 25 bp, Mus musculus
tggacaccatggagtcggacagtga

SEQ ID NO: 878868 - DNA, 25 bp, Mus musculus
tggacaccatggtgtcggacagtga

SEQ ID NO: 878869 - DNA, 25 bp, Mus musculus
tggacacccacccagtgttaatatg

SEQ ID NO: 878870 - DNA, 25 bp, Mus musculus
tggacacccaccgagtgttaatatg

SEQ ID NO: 878871 - DNA, 25 bp, Mus musculus
tggacacccatcagtttttgctggc

SEQ ID NO: 878872 - DNA, 25 bp, Mus musculus
tggacacccatctgtttttgctggc

SEQ ID NO: 878873 - DNA, 25 bp, Mus musculus
tggacaccgcaccaaaggactttgt

SEQ ID NO: 878874 - DNA, 25 bp, Mus musculus
tggacaccgcacgaaaggactttgt

SEQ ID NO: 878875 - DNA, 25 bp, Mus musculus
tggacaccgcatcattgaggtcaac

SEQ ID NO: 878876 - DNA, 25 bp, Mus musculus
tggacaccgcatgattgaggtcaac

SEQ ID NO: 878877 - DNA, 25 bp, Mus musculus
tggacacctaacagtctctctttgt

SEQ ID NO: 878878 - DNA, 25 bp, Mus musculus
tggacacctaactgtctctctttgt

SEQ ID NO: 878879 - DNA, 25 bp, Mus musculus
tggacacctcatctggtactggctg

SEQ ID NO: 878880 - DNA, 25 bp, Mus musculus
tggacacctcatgtggtactggctg

SEQ ID NO: 878881 - DNA, 25 bp, Mus musculus
tggacacctggaacacacatgcagt

SEQ ID NO: 878882 - DNA, 25 bp, Mus musculus
tggacacctggatcacacatgcagt

SEQ ID NO: 878883 - DNA, 25 bp, Mus musculus
tggacacctggcaacaagacaccat

SEQ ID NO: 878884 - DNA, 25 bp, Mus musculus
tggacacctggctacaagacaccat

SEQ ID NO: 878885 - DNA, 25 bp, Mus musculus
tggacacctgtaagaaagcactggc

SEQ ID NO: 878886 - DNA, 25 bp, Mus musculus
tggacacctgtatgaaagcactggc

SEQ ID NO: 878887 - DNA, 25 bp, Mus musculus
tggacacgagtgataccatcccatg

SEQ ID NO: 878888 - DNA, 25 bp, Mus musculus
tggacacgagtgttaccatcccatg

SEQ ID NO: 878889 - DNA, 25 bp, Mus musculus
tggacacgcctgagaatgaccctgt

SEQ ID NO: 878890 - DNA, 25 bp, Mus musculus
tggacacgcctgctgatgatactga

SEQ ID NO: 878891 - DNA, 25 bp, Mus musculus
tggacacgcctggtgatgatactga

SEQ ID NO: 878892 - DNA, 25 bp, Mus musculus
tggacacgcctgtgaatgaccctgt

SEQ ID NO: 878893 - DNA, 25 bp, Mus musculus
tggacacgcgaaattcttgcttccg

SEQ ID NO: 878894 - DNA, 25 bp, Mus musculus
tggacacgcgaatttcttgcttccg

SEQ ID NO: 878895 - DNA, 25 bp, Mus musculus
tggacacggcttcatgctgactcaa

SEQ ID NO: 878896 - DNA, 25 bp, Mus musculus
tggacacggcttgatgctgactcaa

SEQ ID NO: 878897 - DNA, 25 bp, Mus musculus
tggacacgtgaacatcagcgccatc

SEQ ID NO: 878898 - DNA, 25 bp, Mus musculus
tggacacgtgaagatcagcgccatc

SEQ ID NO: 878899 - DNA, 25 bp, Mus musculus
tggacacgtgacatccacagctggg

SEQ ID NO: 878900 - DNA, 25 bp, Mus musculus
tggacacgtgacttccacagctggg

SEQ ID NO: 878901 - DNA, 25 bp, Mus musculus
tggacacgtgttcgccacctttgga

SEQ ID NO: 878902 - DNA, 25 bp, Mus musculus
tggacacgtgttggccacctttgga

SEQ ID NO: 878903 - DNA, 25 bp, Mus musculus
tggacactacagacgagacaaccaa

SEQ ID NO: 878904 - DNA, 25 bp, Mus musculus
tggacactacagtcgagacaaccaa

SEQ ID NO: 878905 - DNA, 25 bp, Mus musculus
tggacactcactccagacgcgtgca

SEQ ID NO: 878906 - DNA, 25 bp, Mus musculus
tggacactcactgcagacgcgtgca

SEQ ID NO: 878907 - DNA, 25 bp, Mus musculus
tggacactcagcacaccaaacggat

SEQ ID NO: 878908 - DNA, 25 bp, Mus musculus
tggacactcagcatacgcttcaagc

SEQ ID NO: 878909 - DNA, 25 bp, Mus musculus
tggacactcagctcaccaaacggat

SEQ ID NO: 878910 - DNA, 25 bp, Mus musculus
tggacactcagcttacgcttcaagc

SEQ ID NO: 878911 - DNA, 25 bp, Mus musculus
tggacactgaccacttgtgccttgc

SEQ ID NO: 878912 - DNA, 25 bp, Mus musculus
tggacactgacctcttgtgccttgc

SEQ ID NO: 878913 - DNA, 25 bp, Mus musculus
tggacactgaggattgtgagcagct

SEQ ID NO: 878914 - DNA, 25 bp, Mus musculus
tggacactgaggtttgtgagcagct

SEQ ID NO: 878915 - DNA, 25 bp, Mus musculus
tggacactggacactgtgctcacct

SEQ ID NO: 878916 - DNA, 25 bp, Mus musculus
tggacactggactctgtgctcacct

SEQ ID NO: 878917 - DNA, 25 bp, Mus musculus
tggacactgggcaccagctgctcga

SEQ ID NO: 878918 - DNA, 25 bp, Mus musculus
tggacactgggctccagctgctcga

SEQ ID NO: 878919 - DNA, 25 bp, Mus musculus
tggacactgggtactcactccttca

SEQ ID NO: 878920 - DNA, 25 bp, Mus musculus
tggacactgggttctcactccttca

SEQ ID NO: 878921 - DNA, 25 bp, Mus musculus
tggacactggtgctagagactccct

SEQ ID NO: 878922 - DNA, 25 bp, Mus musculus
tggacactggtgctctagagccaca

SEQ ID NO: 878923 - DNA, 25 bp, Mus musculus
tggacactggtggtagagactccct

SEQ ID NO: 878924 - DNA, 25 bp, Mus musculus
tggacactggtggtctagagccaca

SEQ ID NO: 878925 - DNA, 25 bp, Mus musculus
tggacactgtcacctgatgattata

SEQ ID NO: 878926 - DNA, 25 bp, Mus musculus
tggacactgtcagctgatgattata

SEQ ID NO: 878927 - DNA, 25 bp, Mus musculus
tggacacttaaaactctcacttgaa

SEQ ID NO: 878928 - DNA, 25 bp, Mus musculus
tggacacttaaatctctcacttgaa

SEQ ID NO: 878929 - DNA, 25 bp, Mus musculus
tggacacttctcaacctgatgatga

SEQ ID NO: 878930 - DNA, 25 bp, Mus musculus
tggacacttctctacctgatgatga

SEQ ID NO: 878931 - DNA, 25 bp, Mus musculus
tggacacttcttaatactctcttcc

SEQ ID NO: 878932 - DNA, 25 bp, Mus musculus
tggacacttctttatactctcttcc

SEQ ID NO: 878933 - DNA, 25 bp, Mus musculus
tggacacttggcatgggctacctgg

SEQ ID NO: 878934 - DNA, 25 bp, Mus musculus
tggacacttggcttgggctacctgg

SEQ ID NO: 878935 - DNA, 25 bp, Mus musculus
tggacacttgtcaggacacctccgg

SEQ ID NO: 878936 - DNA, 25 bp, Mus musculus
tggacacttgtctggacacctccgg

SEQ ID NO: 878937 - DNA, 25 bp, Mus musculus
tggacactttaccaaagagcactct

SEQ ID NO: 878938 - DNA, 25 bp, Mus musculus
tggacactttaccatttctgaaaat

SEQ ID NO: 878939 - DNA, 25 bp, Mus musculus
tggacactttacgaaagagcactct

SEQ ID NO: 878940 - DNA, 25 bp, Mus musculus
tggacactttacgatttctgaaaat

SEQ ID NO: 878941 - DNA, 25 bp, Mus musculus
tggacactttcacggtggttggttt

SEQ ID NO: 878942 - DNA, 25 bp, Mus musculus
tggacactttcagggtggttggttt

SEQ ID NO: 878943 - DNA, 25 bp, Mus musculus
tggacactttggaacgaggaccctc

SEQ ID NO: 878944 - DNA, 25 bp, Mus musculus
tggacactttggtacgaggaccctc

SEQ ID NO: 878945 - DNA, 25 bp, Mus musculus
tggacagaaacgctccctgggagat

SEQ ID NO: 878946 - DNA, 25 bp, Mus musculus
tggacagaaacggtccctgggagat

SEQ ID NO: 878947 - DNA, 25 bp, Mus musculus
tggacagaaccacgcgtccaggacg

SEQ ID NO: 878948 - DNA, 25 bp, Mus musculus
tggacagaaccaggcgtccaggacg

SEQ ID NO: 878949 - DNA, 25 bp, Mus musculus
tggacagaacgaactttcagggtct

SEQ ID NO: 878950 - DNA, 25 bp, Mus musculus
tggacagaacgatctttcagggtct

SEQ ID NO: 878951 - DNA, 25 bp, Mus musculus
tggacagaagccaggacacccctgg

SEQ ID NO: 878952 - DNA, 25 bp, Mus musculus
tggacagaagcctggacacccctgg

SEQ ID NO: 878953 - DNA, 25 bp, Mus musculus
tggacagaaggccatactgtttctt

SEQ ID NO: 878954 - DNA, 25 bp, Mus musculus
tggacagaaggcgatactgtttctt

SEQ ID NO: 878955 - DNA, 25 bp, Mus musculus
tggacagacacaaggccaaggcctc

SEQ ID NO: 878956 - DNA, 25 bp, Mus musculus
tggacagacacatggccaaggcctc

SEQ ID NO: 878957 - DNA, 25 bp, Mus musculus
tggacagacactacccttaaggaac

SEQ ID NO: 878958 - DNA, 25 bp, Mus musculus
tggacagacacttcccttaaggaac

SEQ ID NO: 878959 - DNA, 25 bp, Mus musculus
tggacagacagacgttcccagctta

SEQ ID NO: 878960 - DNA, 25 bp, Mus musculus
tggacagacagaggttcccagctta

SEQ ID NO: 878961 - DNA, 25 bp, Mus musculus
tggacagacgctcggtgtttctaac

SEQ ID NO: 878962 - DNA, 25 bp, Mus musculus
tggacagacgctgggtgtttctaac

SEQ ID NO: 878963 - DNA, 25 bp, Mus musculus
tggacagacttcctaacagtggccc

SEQ ID NO: 878964 - DNA, 25 bp, Mus musculus
tggacagacttcgtaacagtggccc

SEQ ID NO: 878965 - DNA, 25 bp, Mus musculus
tggacagagaaacgatcgctactta

SEQ ID NO: 878966 - DNA, 25 bp, Mus musculus
tggacagagaaaggatcgctactta

SEQ ID NO: 878967 - DNA, 25 bp, Mus musculus
tggacagagataatgctaggagccc

SEQ ID NO: 878968 - DNA, 25 bp, Mus musculus
tggacagagatattgctaggagccc

SEQ ID NO: 878969 - DNA, 25 bp, Mus musculus
tggacagagcacaccaggctagcac

SEQ ID NO: 878970 - DNA, 25 bp, Mus musculus
tggacagagcactccaggctagcac

SEQ ID NO: 878971 - DNA, 25 bp, Mus musculus
tggacagagcatctttggacccctt

SEQ ID NO: 878972 - DNA, 25 bp, Mus musculus
tggacagagcatgtttggacccctt

SEQ ID NO: 878973 - DNA, 25 bp, Mus musculus
tggacagagcctcattctttcactg

SEQ ID NO: 878974 - DNA, 25 bp, Mus musculus
tggacagagcctgattctttcactg

SEQ ID NO: 878975 - DNA, 25 bp, Mus musculus
tggacagagggacgtcacccaccca

SEQ ID NO: 878976 - DNA, 25 bp, Mus musculus
tggacagagggaggtcacccaccca

SEQ ID NO: 878977 - DNA, 25 bp, Mus musculus
tggacagagtctagtggcctcgtga

SEQ ID NO: 878978 - DNA, 25 bp, Mus musculus
tggacagagtcttgtggcctcgtga

SEQ ID NO: 878979 - DNA, 25 bp, Mus musculus
tggacagatattctgcctccacggt

SEQ ID NO: 878980 - DNA, 25 bp, Mus musculus
tggacagatattgtgcctccacggt

SEQ ID NO: 878981 - DNA, 25 bp, Mus musculus
tggacagatcatccccactcaattc

SEQ ID NO: 878982 - DNA, 25 bp, Mus musculus
tggacagatcatgcccactcaattc

SEQ ID NO: 878983 - DNA, 25 bp, Mus musculus
tggacagatctgacaaaatggcttc

SEQ ID NO: 878984 - DNA, 25 bp, Mus musculus
tggacagatctgtcaaaatggcttc

SEQ ID NO: 878985 - DNA, 25 bp, Mus musculus
tggacagatgagagtgccatggcca

SEQ ID NO: 878986 - DNA, 25 bp, Mus musculus
tggacagatgagtgtgccatggcca

SEQ ID NO: 878987 - DNA, 25 bp, Mus musculus
tggacagcaacacgaccgccaaatg

SEQ ID NO: 878988 - DNA, 25 bp, Mus musculus
tggacagcaacaggaccgccaaatg

SEQ ID NO: 878989 - DNA, 25 bp, Mus musculus
tggacagcacaaacaatcaacttga

SEQ ID NO: 878990 - DNA, 25 bp, Mus musculus
tggacagcacaatcaatcaacttga

SEQ ID NO: 878991 - DNA, 25 bp, Mus musculus
tggacagcacagatctaagggttgt

SEQ ID NO: 878992 - DNA, 25 bp, Mus musculus
tggacagcacagttctaagggttgt

SEQ ID NO: 878993 - DNA, 25 bp, Mus musculus
tggacagcactcctaaactgaccct

SEQ ID NO: 878994 - DNA, 25 bp, Mus musculus
tggacagcactcgtaaactgaccct

SEQ ID NO: 878995 - DNA, 25 bp, Mus musculus
tggacagcagacatctgatcttccc

SEQ ID NO: 878996 - DNA, 25 bp, Mus musculus
tggacagcagacttctgatcttccc

SEQ ID NO: 878997 - DNA, 25 bp, Mus musculus
tggacagcagggagacagccagctc

SEQ ID NO: 878998 - DNA, 25 bp, Mus musculus
tggacagcagggtgacagccagctc

SEQ ID NO: 878999 - DNA, 25 bp, Mus musculus
tggacagcatccaccatgggagttt

SEQ ID NO: 879000 - DNA, 25 bp, Mus musculus
tggacagcatcctccatgggagttt

SEQ ID NO: 879001 - DNA, 25 bp, Mus musculus
tggacagccaatctttatcaggaaa

SEQ ID NO: 879002 - DNA, 25 bp, Mus musculus
tggacagccaatgtttatcaggaaa

SEQ ID NO: 879003 - DNA, 25 bp, Mus musculus
tggacagccacccagaaactgccag

SEQ ID NO: 879004 - DNA, 25 bp, Mus musculus
tggacagccaccgagaaactgccag

SEQ ID NO: 879005 - DNA, 25 bp, Mus musculus
tggacagccacgaaggtctactcgg

SEQ ID NO: 879006 - DNA, 25 bp, Mus musculus
tggacagccacgtaggtctactcgg

SEQ ID NO: 879007 - DNA, 25 bp, Mus musculus
tggacagccattattccgggctctt

SEQ ID NO: 879008 - DNA, 25 bp, Mus musculus
tggacagccatttttccgggctctt

SEQ ID NO: 879009 - DNA, 25 bp, Mus musculus
tggacagccggtaggacccaccagg

SEQ ID NO: 879010 - DNA, 25 bp, Mus musculus
tggacagccggttggacccaccagg

SEQ ID NO: 879011 - DNA, 25 bp, Mus musculus
tggacagcctcactatgaatattag

SEQ ID NO: 879012 - DNA, 25 bp, Mus musculus
tggacagcctcagtatgaatattag

SEQ ID NO: 879013 - DNA, 25 bp, Mus musculus
tggacagcctgactcaacctagagt

SEQ ID NO: 879014 - DNA, 25 bp, Mus musculus
tggacagcctgagtcaacctagagt

SEQ ID NO: 879015 - DNA, 25 bp, Mus musculus
tggacagcctgcagatcagctagca

SEQ ID NO: 879016 - DNA, 25 bp, Mus musculus
tggacagcctgctgatcagctagca

SEQ ID NO: 879017 - DNA, 25 bp, Mus musculus
tggacagcctggcaagttgagcctt

SEQ ID NO: 879018 - DNA, 25 bp, Mus musculus
tggacagcctggcttccctgacgga

SEQ ID NO: 879019 - DNA, 25 bp, Mus musculus
tggacagcctgggaagttgagcctt

SEQ ID NO: 879020 - DNA, 25 bp, Mus musculus
tggacagcctgggttccctgacgga

SEQ ID NO: 879021 - DNA, 25 bp, Mus musculus
tggacagcgtacacggttgtcattc

SEQ ID NO: 879022 - DNA, 25 bp, Mus musculus
tggacagcgtactcggttgtcattc

SEQ ID NO: 879023 - DNA, 25 bp, Mus musculus
tggacagcgtctactgcattgggca

SEQ ID NO: 879024 - DNA, 25 bp, Mus musculus
tggacagcgtcttctgcattgggca

SEQ ID NO: 879025 - DNA, 25 bp, Mus musculus
tggacagcttgaactgtgtgagact

SEQ ID NO: 879026 - DNA, 25 bp, Mus musculus
tggacagcttgatctgtgtgagact

SEQ ID NO: 879027 - DNA, 25 bp, Mus musculus
tggacaggaacacccatttcagcct

SEQ ID NO: 879028 - DNA, 25 bp, Mus musculus
tggacaggaacagccatttcagcct

SEQ ID NO: 879029 - DNA, 25 bp, Mus musculus
tggacaggaaggaccaggccctgaa

SEQ ID NO: 879030 - DNA, 25 bp, Mus musculus
tggacaggaaggtccaggccctgaa

SEQ ID NO: 879031 - DNA, 25 bp, Mus musculus
tggacaggaccccaggtagccaaag

SEQ ID NO: 879032 - DNA, 25 bp, Mus musculus
tggacaggacccctggatgttcttg

SEQ ID NO: 879033 - DNA, 25 bp, Mus musculus
tggacaggacccgaggtagccaaag

SEQ ID NO: 879034 - DNA, 25 bp, Mus musculus
tggacaggacccgtggatgttcttg

SEQ ID NO: 879035 - DNA, 25 bp, Mus musculus
tggacaggagcaacttgcatgtggt

SEQ ID NO: 879036 - DNA, 25 bp, Mus musculus
tggacaggagcatcttgcatgtggt

SEQ ID NO: 879037 - DNA, 25 bp, Mus musculus
tggacaggcaccatgtgcctctact

SEQ ID NO: 879038 - DNA, 25 bp, Mus musculus
tggacaggcaccttgtgcctctact

SEQ ID NO: 879039 - DNA, 25 bp, Mus musculus
tggacaggccaaaacccacactgaa

SEQ ID NO: 879040 - DNA, 25 bp, Mus musculus
tggacaggccaatacccacactgaa

SEQ ID NO: 879041 - DNA, 25 bp, Mus musculus
tggacaggccatacctctaaagaac

SEQ ID NO: 879042 - DNA, 25 bp, Mus musculus
tggacaggccattcctctaaagaac

SEQ ID NO: 879043 - DNA, 25 bp, Mus musculus
tggacaggccctatgatgagactac

SEQ ID NO: 879044 - DNA, 25 bp, Mus musculus
tggacaggccctttgatgagactac

SEQ ID NO: 879045 - DNA, 25 bp, Mus musculus
tggacaggcctgcattttaatgatg

SEQ ID NO: 879046 - DNA, 25 bp, Mus musculus
tggacaggcctggattttaatgatg

SEQ ID NO: 879047 - DNA, 25 bp, Mus musculus
tggacaggcggcagcaagaaccaat

SEQ ID NO: 879048 - DNA, 25 bp, Mus musculus
tggacaggcggctgcaagaaccaat

SEQ ID NO: 879049 - DNA, 25 bp, Mus musculus
tggacaggctggaacacgacctacc

SEQ ID NO: 879050 - DNA, 25 bp, Mus musculus
tggacaggctggtacacgacctacc

SEQ ID NO: 879051 - DNA, 25 bp, Mus musculus
tggacaggcttaacagggacacaaa

SEQ ID NO: 879052 - DNA, 25 bp, Mus musculus
tggacaggcttatcagggacacaaa

SEQ ID NO: 879053 - DNA, 25 bp, Mus musculus
tggacaggcttcagatcttacctgg

SEQ ID NO: 879054 - DNA, 25 bp, Mus musculus
tggacaggcttctgatcttacctgg

SEQ ID NO: 879055 - DNA, 25 bp, Mus musculus
tggacaggcttgatacaccccaagt

SEQ ID NO: 879056 - DNA, 25 bp, Mus musculus
tggacaggcttgttacaccccaagt

SEQ ID NO: 879057 - DNA, 25 bp, Mus musculus
tggacagggaccatccattattcct

SEQ ID NO: 879058 - DNA, 25 bp, Mus musculus
tggacagggaccttccattattcct

SEQ ID NO: 879059 - DNA, 25 bp, Mus musculus
tggacagggccaagttagcctgtgt

SEQ ID NO: 879060 - DNA, 25 bp, Mus musculus
tggacagggccatgttagcctgtgt

SEQ ID NO: 879061 - DNA, 25 bp, Mus musculus
tggacaggtccaagccccaaagaga

SEQ ID NO: 879062 - DNA, 25 bp, Mus musculus
tggacaggtccatgccccaaagaga

SEQ ID NO: 879063 - DNA, 25 bp, Mus musculus
tggacagtaaagacacctgatttgt

SEQ ID NO: 879064 - DNA, 25 bp, Mus musculus
tggacagtaaagtcacctgatttgt

SEQ ID NO: 879065 - DNA, 25 bp, Mus musculus
tggacagtaccaccccgacaggagg

SEQ ID NO: 879066 - DNA, 25 bp, Mus musculus
tggacagtaccagcccgacaggagg

SEQ ID NO: 879067 - DNA, 25 bp, Mus musculus
tggacagtacctcatgacaccttcc

SEQ ID NO: 879068 - DNA, 25 bp, Mus musculus
tggacagtacctgatgacaccttcc

SEQ ID NO: 879069 - DNA, 25 bp, Mus musculus
tggacagtagtgaggagaatcttct

SEQ ID NO: 879070 - DNA, 25 bp, Mus musculus
tggacagtagtgtggagaatcttct

SEQ ID NO: 879071 - DNA, 25 bp, Mus musculus
tggacagtattcatttcttccggcc

SEQ ID NO: 879072 - DNA, 25 bp, Mus musculus
tggacagtattcttttcttccggcc

SEQ ID NO: 879073 - DNA, 25 bp, Mus musculus
tggacagtcattccacccatgagga

SEQ ID NO: 879074 - DNA, 25 bp, Mus musculus
tggacagtcattgcacccatgagga

SEQ ID NO: 879075 - DNA, 25 bp, Mus musculus
tggacagtccctaggtttactcatc

SEQ ID NO: 879076 - DNA, 25 bp, Mus musculus
tggacagtccctctgtaaggtcatt

SEQ ID NO: 879077 - DNA, 25 bp, Mus musculus
tggacagtccctgtgtaaggtcatt

SEQ ID NO: 879078 - DNA, 25 bp, Mus musculus
tggacagtcccttggtttactcatc

SEQ ID NO: 879079 - DNA, 25 bp, Mus musculus
tggacagtcctccttaagtgtgctt

SEQ ID NO: 879080 - DNA, 25 bp, Mus musculus
tggacagtcctcgttaagtgtgctt

SEQ ID NO: 879081 - DNA, 25 bp, Mus musculus
tggacagtgaagagtgagggaacct

SEQ ID NO: 879082 - DNA, 25 bp, Mus musculus
tggacagtgaagtgtgagggaacct

SEQ ID NO: 879083 - DNA, 25 bp, Mus musculus
tggacagtgaccaggtccacgacct

SEQ ID NO: 879084 - DNA, 25 bp, Mus musculus
tggacagtgacctggtccacgacct

SEQ ID NO: 879085 - DNA, 25 bp, Mus musculus
tggacagtgactcgcaagataccca

SEQ ID NO: 879086 - DNA, 25 bp, Mus musculus
tggacagtgactggcaagataccca

SEQ ID NO: 879087 - DNA, 25 bp, Mus musculus
tggacagtggccagtaccttgggat

SEQ ID NO: 879088 - DNA, 25 bp, Mus musculus
tggacagtggcctgtaccttgggat

SEQ ID NO: 879089 - DNA, 25 bp, Mus musculus
tggacagtggttaccggcaggacct

SEQ ID NO: 879090 - DNA, 25 bp, Mus musculus
tggacagtggtttccggcaggacct

SEQ ID NO: 879091 - DNA, 25 bp, Mus musculus
tggacagtgtgacaagcccttcagc

SEQ ID NO: 879092 - DNA, 25 bp, Mus musculus
tggacagtgtgagaagcccttcagc

SEQ ID NO: 879093 - DNA, 25 bp, Mus musculus
tggacagtgtggagaacccttgcct

SEQ ID NO: 879094 - DNA, 25 bp, Mus musculus
tggacagtgtggtgaacccttgcct

SEQ ID NO: 879095 - DNA, 25 bp, Mus musculus
tggacagttaccatgtgagcagcag

SEQ ID NO: 879096 - DNA, 25 bp, Mus musculus
tggacagttaccttgtgagcagcag

SEQ ID NO: 879097 - DNA, 25 bp, Mus musculus
tggacagttactcttgcctgcatag

SEQ ID NO: 879098 - DNA, 25 bp, Mus musculus
tggacagttactgttgcctgcatag

SEQ ID NO: 879099 - DNA, 25 bp, Mus musculus
tggacagttcacctagctcatgtgt

SEQ ID NO: 879100 - DNA, 25 bp, Mus musculus
tggacagttcacgtagctcatgtgt

SEQ ID NO: 879101 - DNA, 25 bp, Mus musculus
tggacagttcctacctttctgtgtg

SEQ ID NO: 879102 - DNA, 25 bp, Mus musculus
tggacagttccttcctttctgtgtg

SEQ ID NO: 879103 - DNA, 25 bp, Mus musculus
tggacagttctcagttgtgacaaat

SEQ ID NO: 879104 - DNA, 25 bp, Mus musculus
tggacagttctctgttgtgacaaat

SEQ ID NO: 879105 - DNA, 25 bp, Mus musculus
tggacagttgagagttcctgccttt

SEQ ID NO: 879106 - DNA, 25 bp, Mus musculus
tggacagttgagtgttcctgccttt

SEQ ID NO: 879107 - DNA, 25 bp, Mus musculus
tggacagttgcactcattgttttct

SEQ ID NO: 879108 - DNA, 25 bp, Mus musculus
tggacagttgcagtcattgttttct

SEQ ID NO: 879109 - DNA, 25 bp, Mus musculus
tggacagttgcgaggctgcacccag

SEQ ID NO: 879110 - DNA, 25 bp, Mus musculus
tggacagttgcgtggctgcacccag

SEQ ID NO: 879111 - DNA, 25 bp, Mus musculus
tggacagtttatacccaaggacggt

SEQ ID NO: 879112 - DNA, 25 bp, Mus musculus
tggacagtttatcacccagactggg

SEQ ID NO: 879113 - DNA, 25 bp, Mus musculus
tggacagtttatctgtacccctggt

SEQ ID NO: 879114 - DNA, 25 bp, Mus musculus
tggacagtttatgacccagactggg

SEQ ID NO: 879115 - DNA, 25 bp, Mus musculus
tggacagtttatgtgtacccctggt

SEQ ID NO: 879116 - DNA, 25 bp, Mus musculus
tggacagtttattcccaaggacggt

SEQ ID NO: 879117 - DNA, 25 bp, Mus musculus
tggacagtttccaggccgtcgacat

SEQ ID NO: 879118 - DNA, 25 bp, Mus musculus
tggacagtttcctggccgtcgacat

SEQ ID NO: 879119 - DNA, 25 bp, Mus musculus
tggacataccagacagtctcctacc

SEQ ID NO: 879120 - DNA, 25 bp, Mus musculus
tggacataccagtcagtctcctacc

SEQ ID NO: 879121 - DNA, 25 bp, Mus musculus
tggacatagccaacacgcctccaaa

SEQ ID NO: 879122 - DNA, 25 bp, Mus musculus
tggacatagccatcacgcctccaaa

SEQ ID NO: 879123 - DNA, 25 bp, Mus musculus
tggacataggtcacttctgaaccct

SEQ ID NO: 879124 - DNA, 25 bp, Mus musculus
tggacataggtctcttctgaaccct

SEQ ID NO: 879125 - DNA, 25 bp, Mus musculus
tggacatattccactggcagatcat

SEQ ID NO: 879126 - DNA, 25 bp, Mus musculus
tggacatattcctctggcagatcat

SEQ ID NO: 879127 - DNA, 25 bp, Mus musculus
tggacatcaccactagagccacaga

SEQ ID NO: 879128 - DNA, 25 bp, Mus musculus
tggacatcaccagtagagccacaga

SEQ ID NO: 879129 - DNA, 25 bp, Mus musculus
tggacatcagcaagatcctctcaga

SEQ ID NO: 879130 - DNA, 25 bp, Mus musculus
tggacatcagcatgatcctctcaga

SEQ ID NO: 879131 - DNA, 25 bp, Mus musculus
tggacatcagccacgggctcaagaa

SEQ ID NO: 879132 - DNA, 25 bp, Mus musculus
tggacatcagcctcgggctcaagaa

SEQ ID NO: 879133 - DNA, 25 bp, Mus musculus
tggacatcaggtaccaactgcactc

SEQ ID NO: 879134 - DNA, 25 bp, Mus musculus
tggacatcaggttccaactgcactc

SEQ ID NO: 879135 - DNA, 25 bp, Mus musculus
tggacatccacaccggcggcataga

SEQ ID NO: 879136 - DNA, 25 bp, Mus musculus
tggacatccacagcggcggcataga

SEQ ID NO: 879137 - DNA, 25 bp, Mus musculus
tggacatcccaaaaccagagctttt

SEQ ID NO: 879138 - DNA, 25 bp, Mus musculus
tggacatcccaataccagagctttt

SEQ ID NO: 879139 - DNA, 25 bp, Mus musculus
tggacatcccgtccaattccgtgta

SEQ ID NO: 879140 - DNA, 25 bp, Mus musculus
tggacatcccgtgcaattccgtgta

SEQ ID NO: 879141 - DNA, 25 bp, Mus musculus
tggacatcctcacggacctggttag

SEQ ID NO: 879142 - DNA, 25 bp, Mus musculus
tggacatcctcagggacctggttag

SEQ ID NO: 879143 - DNA, 25 bp, Mus musculus
tggacatcctctatagctcgtgtta

SEQ ID NO: 879144 - DNA, 25 bp, Mus musculus
tggacatcctctttagctcgtgtta

SEQ ID NO: 879145 - DNA, 25 bp, Mus musculus
tggacatcctgacggcagctgcctt

SEQ ID NO: 879146 - DNA, 25 bp, Mus musculus
tggacatcctgagggcagctgcctt

SEQ ID NO: 879147 - DNA, 25 bp, Mus musculus
tggacatcgataactgtgggccatc

SEQ ID NO: 879148 - DNA, 25 bp, Mus musculus
tggacatcgatatctgtgggccatc

SEQ ID NO: 879149 - DNA, 25 bp, Mus musculus
tggacatcggagaactgctcatgat

SEQ ID NO: 879150 - DNA, 25 bp, Mus musculus
tggacatcggagtactgctcatgat

SEQ ID NO: 879151 - DNA, 25 bp, Mus musculus
tggacatctagtacaccccttgtaa

SEQ ID NO: 879152 - DNA, 25 bp, Mus musculus
tggacatctagttcaccccttgtaa

SEQ ID NO: 879153 - DNA, 25 bp, Mus musculus
tggacatctcatacctgatttccga

SEQ ID NO: 879154 - DNA, 25 bp, Mus musculus
tggacatctcattcctgatttccga

SEQ ID NO: 879155 - DNA, 25 bp, Mus musculus
tggacatctcttcagcgcaggtgct

SEQ ID NO: 879156 - DNA, 25 bp, Mus musculus
tggacatctcttgagcgcaggtgct

SEQ ID NO: 879157 - DNA, 25 bp, Mus musculus
tggacatgaaacagcctgggccaca

SEQ ID NO: 879158 - DNA, 25 bp, Mus musculus
tggacatgaaactgcctgggccaca

SEQ ID NO: 879159 - DNA, 25 bp, Mus musculus
tggacatgagagacttctcccctga

SEQ ID NO: 879160 - DNA, 25 bp, Mus musculus
tggacatgagagtcttctcccctga

SEQ ID NO: 879161 - DNA, 25 bp, Mus musculus
tggacatgatccagttaaacataga

SEQ ID NO: 879162 - DNA, 25 bp, Mus musculus
tggacatgatcctgttaaacataga

SEQ ID NO: 879163 - DNA, 25 bp, Mus musculus
tggacatgcagacgtccatctcctt

SEQ ID NO: 879164 - DNA, 25 bp, Mus musculus
tggacatgcagaggtccatctcctt

SEQ ID NO: 879165 - DNA, 25 bp, Mus musculus
tggacatgccaaagtcaagcccttt

SEQ ID NO: 879166 - DNA, 25 bp, Mus musculus
tggacatgccaatgtcaagcccttt

SEQ ID NO: 879167 - DNA, 25 bp, Mus musculus
tggacatgctacatgttttgacaca

SEQ ID NO: 879168 - DNA, 25 bp, Mus musculus
tggacatgctacttgttttgacaca

SEQ ID NO: 879169 - DNA, 25 bp, Mus musculus
tggacatgctcactacacacgacag

SEQ ID NO: 879170 - DNA, 25 bp, Mus musculus
tggacatgctcagtacacacgacag

SEQ ID NO: 879171 - DNA, 25 bp, Mus musculus
tggacatgctggatcagcagcctca

SEQ ID NO: 879172 - DNA, 25 bp, Mus musculus
tggacatgctggttcagcagcctca

SEQ ID NO: 879173 - DNA, 25 bp, Mus musculus
tggacatgtaacacaccacactgtg

SEQ ID NO: 879174 - DNA, 25 bp, Mus musculus
tggacatgtaactcaccacactgtg

SEQ ID NO: 879175 - DNA, 25 bp, Mus musculus
tggacatgtaagagaggcatcctca

SEQ ID NO: 879176 - DNA, 25 bp, Mus musculus
tggacatgtaagtgaggcatcctca

SEQ ID NO: 879177 - DNA, 25 bp, Mus musculus
tggacatgtatcctgctgtgagcac

SEQ ID NO: 879178 - DNA, 25 bp, Mus musculus
tggacatgtatcgtgctgtgagcac

SEQ ID NO: 879179 - DNA, 25 bp, Mus musculus
tggacatgtccacacagctataaac

SEQ ID NO: 879180 - DNA, 25 bp, Mus musculus
tggacatgtccagacagctataaac

SEQ ID NO: 879181 - DNA, 25 bp, Mus musculus
tggacatgtcgcaatcaggagcccc

SEQ ID NO: 879182 - DNA, 25 bp, Mus musculus
tggacatgtcgctatcaggagcccc

SEQ ID NO: 879183 - DNA, 25 bp, Mus musculus
tggacatgtgatacctggcatcctt

SEQ ID NO: 879184 - DNA, 25 bp, Mus musculus
tggacatgtgattcctggcatcctt

SEQ ID NO: 879185 - DNA, 25 bp, Mus musculus
tggacatgtgtgagtaacagttcat

SEQ ID NO: 879186 - DNA, 25 bp, Mus musculus
tggacatgtgtgtgtaacagttcat

SEQ ID NO: 879187 - DNA, 25 bp, Mus musculus
tggacatgtgttatactaagactac

SEQ ID NO: 879188 - DNA, 25 bp, Mus musculus
tggacatgtgttttactaagactac

SEQ ID NO: 879189 - DNA, 25 bp, Mus musculus
tggacattacaaactcacatttatt

SEQ ID NO: 879190 - DNA, 25 bp, Mus musculus
tggacattacaatctcacatttatt

SEQ ID NO: 879191 - DNA, 25 bp, Mus musculus
tggacattactccttcagagccagg

SEQ ID NO: 879192 - DNA, 25 bp, Mus musculus
tggacattactcgttcagagccagg

SEQ ID NO: 879193 - DNA, 25 bp, Mus musculus
tggacattcattactgccagggaaa

SEQ ID NO: 879194 - DNA, 25 bp, Mus musculus
tggacattcatttctgccagggaaa

SEQ ID NO: 879195 - DNA, 25 bp, Mus musculus
tggacattccataccccgggtgtag

SEQ ID NO: 879196 - DNA, 25 bp, Mus musculus
tggacattccattccccgggtgtag

SEQ ID NO: 879197 - DNA, 25 bp, Mus musculus
tggacattcctgagtggcccgggaa

SEQ ID NO: 879198 - DNA, 25 bp, Mus musculus
tggacattcctgtgtggcccgggaa

SEQ ID NO: 879199 - DNA, 25 bp, Mus musculus
tggacattctctcgcaccttagaaa

SEQ ID NO: 879200 - DNA, 25 bp, Mus musculus
tggacattctctggcaccttagaaa

SEQ ID NO: 879201 - DNA, 25 bp, Mus musculus
tggacattcttacatgctaccttgc

SEQ ID NO: 879202 - DNA, 25 bp, Mus musculus
tggacattcttagatgctaccttgc

SEQ ID NO: 879203 - DNA, 25 bp, Mus musculus
tggacattgccacgtacctcctgag

SEQ ID NO: 879204 - DNA, 25 bp, Mus musculus
tggacattgccaggtacctcctgag

SEQ ID NO: 879205 - DNA, 25 bp, Mus musculus
tggacattgggacttccatgccact

SEQ ID NO: 879206 - DNA, 25 bp, Mus musculus
tggacattgggagttccatgccact

SEQ ID NO: 879207 - DNA, 25 bp, Mus musculus
tggacattgggtaaatggacttaat

SEQ ID NO: 879208 - DNA, 25 bp, Mus musculus
tggacattgggttaatggacttaat

SEQ ID NO: 879209 - DNA, 25 bp, Mus musculus
tggacattggtcagcgagcagacac

SEQ ID NO: 879210 - DNA, 25 bp, Mus musculus
tggacattggtcctgcttgtatcat

SEQ ID NO: 879211 - DNA, 25 bp, Mus musculus
tggacattggtcgtgcttgtatcat

SEQ ID NO: 879212 - DNA, 25 bp, Mus musculus
tggacattggtctgcgagcagacac

SEQ ID NO: 879213 - DNA, 25 bp, Mus musculus
tggacattgtgtcctagggtagttt

SEQ ID NO: 879214 - DNA, 25 bp, Mus musculus
tggacattgtgtgctagggtagttt

SEQ ID NO: 879215 - DNA, 25 bp, Mus musculus
tggacatttcaaccttgcggcctga

SEQ ID NO: 879216 - DNA, 25 bp, Mus musculus
tggacatttcaagcttgcggcctga

SEQ ID NO: 879217 - DNA, 25 bp, Mus musculus
tggacatttcatcaccagggtgcca

SEQ ID NO: 879218 - DNA, 25 bp, Mus musculus
tggacatttcatgaccagggtgcca

SEQ ID NO: 879219 - DNA, 25 bp, Mus musculus
tggacatttctgcagttagtacact

SEQ ID NO: 879220 - DNA, 25 bp, Mus musculus
tggacatttctggagttagtacact

SEQ ID NO: 879221 - DNA, 25 bp, Mus musculus
tggacatttgccacctaaacgacca

SEQ ID NO: 879222 - DNA, 25 bp, Mus musculus
tggacatttgcctcctaaacgacca

SEQ ID NO: 879223 - DNA, 25 bp, Mus musculus
tggacatttggtcccatcgtcagaa

SEQ ID NO: 879224 - DNA, 25 bp, Mus musculus
tggacatttggtgccatcgtcagaa

SEQ ID NO: 879225 - DNA, 25 bp, Mus musculus
tggacatttgtcctttgtacctcac

SEQ ID NO: 879226 - DNA, 25 bp, Mus musculus
tggacatttgtcgtttgtacctcac

SEQ ID NO: 879227 - DNA, 25 bp, Mus musculus
tggacattttctacccagtttaaag

SEQ ID NO: 879228 - DNA, 25 bp, Mus musculus
tggacattttcttcccagtttaaag

SEQ ID NO: 879229 - DNA, 25 bp, Mus musculus
tggaccaacacgatgtgcgcctggt

SEQ ID NO: 879230 - DNA, 25 bp, Mus musculus
tggaccaacacgttgtgcgcctggt

SEQ ID NO: 879231 - DNA, 25 bp, Mus musculus
tggaccaacatgactgtgcagtgcg

SEQ ID NO: 879232 - DNA, 25 bp, Mus musculus
tggaccaacatgtctgtgcagtgcg

SEQ ID NO: 879233 - DNA, 25 bp, Mus musculus
tggaccaacctgaaatagagcaccg

SEQ ID NO: 879234 - DNA, 25 bp, Mus musculus
tggaccaacctgtaatagagcaccg

SEQ ID NO: 879235 - DNA, 25 bp, Mus musculus
tggaccaacgttaccttgttattga

SEQ ID NO: 879236 - DNA, 25 bp, Mus musculus
tggaccaacgtttccttgttattga

SEQ ID NO: 879237 - DNA, 25 bp, Mus musculus
tggaccaacttcagcctcaagaaaa

SEQ ID NO: 879238 - DNA, 25 bp, Mus musculus
tggaccaacttctgcctcaagaaaa

SEQ ID NO: 879239 - DNA, 25 bp, Mus musculus
tggaccaagacaaggatggccagaa

SEQ ID NO: 879240 - DNA, 25 bp, Mus musculus
tggaccaagacatggatggccagaa

SEQ ID NO: 879241 - DNA, 25 bp, Mus musculus
tggaccaagcaactgtgcccagtga

SEQ ID NO: 879242 - DNA, 25 bp, Mus musculus
tggaccaagcaagtgtgcccagtga

SEQ ID NO: 879243 - DNA, 25 bp, Mus musculus
tggaccaaggaactaccactaccgc

SEQ ID NO: 879244 - DNA, 25 bp, Mus musculus
tggaccaaggaagtaccactaccgc

SEQ ID NO: 879245 - DNA, 25 bp, Mus musculus
tggaccaaggcccaacatctgatgg

SEQ ID NO: 879246 - DNA, 25 bp, Mus musculus
tggaccaaggccgaacatctgatgg

SEQ ID NO: 879247 - DNA, 25 bp, Mus musculus
tggaccaatatgcttcgtttgcggt

SEQ ID NO: 879248 - DNA, 25 bp, Mus musculus
tggaccaatatggttcgtttgcggt

SEQ ID NO: 879249 - DNA, 25 bp, Mus musculus
tggaccaatgagctgtattccccac

SEQ ID NO: 879250 - DNA, 25 bp, Mus musculus
tggaccaatgaggtgtattccccac

SEQ ID NO: 879251 - DNA, 25 bp, Mus musculus
tggaccaatgatctcctaactgtac

SEQ ID NO: 879252 - DNA, 25 bp, Mus musculus
tggaccaatgatgtcctaactgtac

SEQ ID NO: 879253 - DNA, 25 bp, Mus musculus
tggaccaattcaaggtgtttttttt

SEQ ID NO: 879254 - DNA, 25 bp, Mus musculus
tggaccaattcatggtgtttttttt

SEQ ID NO: 879255 - DNA, 25 bp, Mus musculus
tggaccacaccgctttgggacaagc

SEQ ID NO: 879256 - DNA, 25 bp, Mus musculus
tggaccacaccggtttgggacaagc

SEQ ID NO: 879257 - DNA, 25 bp, Mus musculus
tggaccacacttcaggaacacagca

SEQ ID NO: 879258 - DNA, 25 bp, Mus musculus
tggaccacacttgaggaacacagca

SEQ ID NO: 879259 - DNA, 25 bp, Mus musculus
tggaccacagagaaagaccggcttt

SEQ ID NO: 879260 - DNA, 25 bp, Mus musculus
tggaccacagagtaagaccggcttt

SEQ ID NO: 879261 - DNA, 25 bp, Mus musculus
tggaccacagatcgccagcagctgg

SEQ ID NO: 879262 - DNA, 25 bp, Mus musculus
tggaccacagatggccagcagctgg

SEQ ID NO: 879263 - DNA, 25 bp, Mus musculus
tggaccacagggaaccttgtctagc

SEQ ID NO: 879264 - DNA, 25 bp, Mus musculus
tggaccacagggtaccttgtctagc

SEQ ID NO: 879265 - DNA, 25 bp, Mus musculus
tggaccacaggtctggagacgcaca

SEQ ID NO: 879266 - DNA, 25 bp, Mus musculus
tggaccacaggtgtggagacgcaca

SEQ ID NO: 879267 - DNA, 25 bp, Mus musculus
tggaccaccacacagtggatccaaa

SEQ ID NO: 879268 - DNA, 25 bp, Mus musculus
tggaccaccacactcgtcggtactt

SEQ ID NO: 879269 - DNA, 25 bp, Mus musculus
tggaccaccacagagtggatccaaa

SEQ ID NO: 879270 - DNA, 25 bp, Mus musculus
tggaccaccacagtcgtcggtactt

SEQ ID NO: 879271 - DNA, 25 bp, Mus musculus
tggaccaccagccagagggcaatca

SEQ ID NO: 879272 - DNA, 25 bp, Mus musculus
tggaccaccagcgagagggcaatca

SEQ ID NO: 879273 - DNA, 25 bp, Mus musculus
tggaccacccagctctgtacaggga

SEQ ID NO: 879274 - DNA, 25 bp, Mus musculus
tggaccacccaggtctgtacaggga

SEQ ID NO: 879275 - DNA, 25 bp, Mus musculus
tggaccacctacctcttgatggaca

SEQ ID NO: 879276 - DNA, 25 bp, Mus musculus
tggaccacctacgtcttgatggaca

SEQ ID NO: 879277 - DNA, 25 bp, Mus musculus
tggaccacctcccaaacaagacaga

SEQ ID NO: 879278 - DNA, 25 bp, Mus musculus
tggaccacctccgaaacaagacaga

SEQ ID NO: 879279 - DNA, 25 bp, Mus musculus
tggaccaccttgattacacactaat

SEQ ID NO: 879280 - DNA, 25 bp, Mus musculus
tggaccaccttgtttacacactaat

SEQ ID NO: 879281 - DNA, 25 bp, Mus musculus
tggaccacgaacaggcacaggagcc

SEQ ID NO: 879282 - DNA, 25 bp, Mus musculus
tggaccacgaactggcacaggagcc

SEQ ID NO: 879283 - DNA, 25 bp, Mus musculus
tggaccacgcccacaatgacatgac

SEQ ID NO: 879284 - DNA, 25 bp, Mus musculus
tggaccacgccctcaatgacatgac

SEQ ID NO: 879285 - DNA, 25 bp, Mus musculus
tggaccacgcctcaaagagcagtgc

SEQ ID NO: 879286 - DNA, 25 bp, Mus musculus
tggaccacgcctgaaagagcagtgc

SEQ ID NO: 879287 - DNA, 25 bp, Mus musculus
tggaccacggatcgcaaagtacatc

SEQ ID NO: 879288 - DNA, 25 bp, Mus musculus
tggaccacggatggcaaagtacatc

SEQ ID NO: 879289 - DNA, 25 bp, Mus musculus
tggaccacgggtaggttgcctacat

SEQ ID NO: 879290 - DNA, 25 bp, Mus musculus
tggaccacgggttggttgcctacat

SEQ ID NO: 879291 - DNA, 25 bp, Mus musculus
tggaccacggtgagctacgtcttgt

SEQ ID NO: 879292 - DNA, 25 bp, Mus musculus
tggaccacggtgtgctacgtcttgt

SEQ ID NO: 879293 - DNA, 25 bp, Mus musculus
tggaccacgtctcagctgttgcagc

SEQ ID NO: 879294 - DNA, 25 bp, Mus musculus
tggaccacgtctgagctgttgcagc

SEQ ID NO: 879295 - DNA, 25 bp, Mus musculus
tggaccacgtgcagtgcactcagcg

SEQ ID NO: 879296 - DNA, 25 bp, Mus musculus
tggaccacgtgctgtgcactcagcg

SEQ ID NO: 879297 - DNA, 25 bp, Mus musculus
tggaccactcaacccttggcaatag

SEQ ID NO: 879298 - DNA, 25 bp, Mus musculus
tggaccactcaagccttggcaatag

SEQ ID NO: 879299 - DNA, 25 bp, Mus musculus
tggaccactctgacactaatgctct

SEQ ID NO: 879300 - DNA, 25 bp, Mus musculus
tggaccactctgtcactaatgctct

SEQ ID NO: 879301 - DNA, 25 bp, Mus musculus
tggaccactcttcagagggtggcta

SEQ ID NO: 879302 - DNA, 25 bp, Mus musculus
tggaccactcttgagagggtggcta

SEQ ID NO: 879303 - DNA, 25 bp, Mus musculus
tggaccactgttcgcctcgtggcac

SEQ ID NO: 879304 - DNA, 25 bp, Mus musculus
tggaccactgttggcctcgtggcac

SEQ ID NO: 879305 - DNA, 25 bp, Mus musculus
tggaccacttccaaattgtttcaca

SEQ ID NO: 879306 - DNA, 25 bp, Mus musculus
tggaccacttcctaattgtttcaca

SEQ ID NO: 879307 - DNA, 25 bp, Mus musculus
tggaccacttgcagactgtcagtgc

SEQ ID NO: 879308 - DNA, 25 bp, Mus musculus
tggaccacttgctgactgtcagtgc

SEQ ID NO: 879309 - DNA, 25 bp, Mus musculus
tggaccactttcatcttagctggga

SEQ ID NO: 879310 - DNA, 25 bp, Mus musculus
tggaccactttcttcttagctggga

SEQ ID NO: 879311 - DNA, 25 bp, Mus musculus
tggaccagaactacggctccaggag

SEQ ID NO: 879312 - DNA, 25 bp, Mus musculus
tggaccagaacttcggctccaggag

SEQ ID NO: 879313 - DNA, 25 bp, Mus musculus
tggaccagactgaccgcgtttggga

SEQ ID NO: 879314 - DNA, 25 bp, Mus musculus
tggaccagactgtccgcgtttggga

SEQ ID NO: 879315 - DNA, 25 bp, Mus musculus
tggaccagatacatgcagcctcttt

SEQ ID NO: 879316 - DNA, 25 bp, Mus musculus
tggaccagatacttgcagcctcttt

SEQ ID NO: 879317 - DNA, 25 bp, Mus musculus
tggaccagcacacgcaagcactcat

SEQ ID NO: 879318 - DNA, 25 bp, Mus musculus
tggaccagcacaggcaagcactcat

SEQ ID NO: 879319 - DNA, 25 bp, Mus musculus
tggaccagcagaagtacctctgtta

SEQ ID NO: 879320 - DNA, 25 bp, Mus musculus
tggaccagcagatgtacctctgtta

SEQ ID NO: 879321 - DNA, 25 bp, Mus musculus
tggaccagccaacgagaccctgcag

SEQ ID NO: 879322 - DNA, 25 bp, Mus musculus
tggaccagccaaggagaccctgcag

SEQ ID NO: 879323 - DNA, 25 bp, Mus musculus
tggaccagctacaatctagcctgtg

SEQ ID NO: 879324 - DNA, 25 bp, Mus musculus
tggaccagctactatctagcctgtg

SEQ ID NO: 879325 - DNA, 25 bp, Mus musculus
tggaccagctggattaactcttaag

SEQ ID NO: 879326 - DNA, 25 bp, Mus musculus
tggaccagctggtttaactcttaag

SEQ ID NO: 879327 - DNA, 25 bp, Mus musculus
tggaccaggacaagttcccagtggt

SEQ ID NO: 879328 - DNA, 25 bp, Mus musculus
tggaccaggacatgttcccagtggt

SEQ ID NO: 879329 - DNA, 25 bp, Mus musculus
tggaccaggctgaatgcttcagtgt

SEQ ID NO: 879330 - DNA, 25 bp, Mus musculus
tggaccaggctgtatgcttcagtgt

SEQ ID NO: 879331 - DNA, 25 bp, Mus musculus
tggaccaggttgaggtactgtgccc

SEQ ID NO: 879332 - DNA, 25 bp, Mus musculus
tggaccaggttgtggtactgtgccc

SEQ ID NO: 879333 - DNA, 25 bp, Mus musculus
tggaccagtggcactcagggagact

SEQ ID NO: 879334 - DNA, 25 bp, Mus musculus
tggaccagtggctctcagggagact

SEQ ID NO: 879335 - DNA, 25 bp, Mus musculus
tggaccagtgtgagccatggcctgt

SEQ ID NO: 879336 - DNA, 25 bp, Mus musculus
tggaccagtgtgtgccatggcctgt

SEQ ID NO: 879337 - DNA, 25 bp, Mus musculus
tggaccagttgtacattttctagga

SEQ ID NO: 879338 - DNA, 25 bp, Mus musculus
tggaccagttgttcattttctagga

SEQ ID NO: 879339 - DNA, 25 bp, Mus musculus
tggaccagtttcagcctcgaatgat

SEQ ID NO: 879340 - DNA, 25 bp, Mus musculus
tggaccagtttctgcctcgaatgat

SEQ ID NO: 879341 - DNA, 25 bp, Mus musculus
tggaccataacgagaagaagccttc

SEQ ID NO: 879342 - DNA, 25 bp, Mus musculus
tggaccataacgtgaagaagccttc

SEQ ID NO: 879343 - DNA, 25 bp, Mus musculus
tggaccatacatcgttactgtgcct

SEQ ID NO: 879344 - DNA, 25 bp, Mus musculus
tggaccatacatggttactgtgcct

SEQ ID NO: 879345 - DNA, 25 bp, Mus musculus
tggaccatagtaccgtcagctcaca

SEQ ID NO: 879346 - DNA, 25 bp, Mus musculus
tggaccatagtagcgtcagctcaca

SEQ ID NO: 879347 - DNA, 25 bp, Mus musculus
tggaccatatcaactggcctcagtg

SEQ ID NO: 879348 - DNA, 25 bp, Mus musculus
tggaccatatcaattgaccataaat

SEQ ID NO: 879349 - DNA, 25 bp, Mus musculus
tggaccatatcatctggcctcagtg

SEQ ID NO: 879350 - DNA, 25 bp, Mus musculus
tggaccatatcatttgaccataaat

SEQ ID NO: 879351 - DNA, 25 bp, Mus musculus
tggaccatcatccaggccttatcct

SEQ ID NO: 879352 - DNA, 25 bp, Mus musculus
tggaccatcatcgaggccttatcct

SEQ ID NO: 879353 - DNA, 25 bp, Mus musculus
tggaccatcccgacttatggtgaaa

SEQ ID NO: 879354 - DNA, 25 bp, Mus musculus
tggaccatcccgtcttatggtgaaa

SEQ ID NO: 879355 - DNA, 25 bp, Mus musculus
tggaccatcgcaatcagatacactg

SEQ ID NO: 879356 - DNA, 25 bp, Mus musculus
tggaccatcgcattcagatacactg

SEQ ID NO: 879357 - DNA, 25 bp, Mus musculus
tggaccatctgcagagggtgcctga

SEQ ID NO: 879358 - DNA, 25 bp, Mus musculus
tggaccatctgctgagggtgcctga

SEQ ID NO: 879359 - DNA, 25 bp, Mus musculus
tggaccatcttcatccagggcttgt

SEQ ID NO: 879360 - DNA, 25 bp, Mus musculus
tggaccatcttcttccagggcttgt

SEQ ID NO: 879361 - DNA, 25 bp, Mus musculus
tggaccatgaaaacaccatctagag

SEQ ID NO: 879362 - DNA, 25 bp, Mus musculus
tggaccatgaaatcaccatctagag

SEQ ID NO: 879363 - DNA, 25 bp, Mus musculus
tggaccatgactcaggagacaaacc

SEQ ID NO: 879364 - DNA, 25 bp, Mus musculus
tggaccatgactgaggagacaaacc

SEQ ID NO: 879365 - DNA, 25 bp, Mus musculus
tggaccatggacagacccttctgac

SEQ ID NO: 879366 - DNA, 25 bp, Mus musculus
tggaccatggacaggagacctggca

SEQ ID NO: 879367 - DNA, 25 bp, Mus musculus
tggaccatggactgacccttctgac

SEQ ID NO: 879368 - DNA, 25 bp, Mus musculus
tggaccatggactggagacctggca

SEQ ID NO: 879369 - DNA, 25 bp, Mus musculus
tggaccatggtcagggacggacttc

SEQ ID NO: 879370 - DNA, 25 bp, Mus musculus
tggaccatggtctgggacggacttc

SEQ ID NO: 879371 - DNA, 25 bp, Mus musculus
tggaccatgtccaaacctgaaacaa

SEQ ID NO: 879372 - DNA, 25 bp, Mus musculus
tggaccatgtcctaacctgaaacaa

SEQ ID NO: 879373 - DNA, 25 bp, Mus musculus
tggaccattcagattttcaggatac

SEQ ID NO: 879374 - DNA, 25 bp, Mus musculus
tggaccattcagtttttcaggatac

SEQ ID NO: 879375 - DNA, 25 bp, Mus musculus
tggaccatttgcacacgctagctag

SEQ ID NO: 879376 - DNA, 25 bp, Mus musculus
tggaccatttgctcacgctagctag

SEQ ID NO: 879377 - DNA, 25 bp, Mus musculus
tggacccaaattcgttaccacatgc

SEQ ID NO: 879378 - DNA, 25 bp, Mus musculus
tggacccaaattggttaccacatgc

SEQ ID NO: 879379 - DNA, 25 bp, Mus musculus
tggacccaactgagaccgcttcaaa

SEQ ID NO: 879380 - DNA, 25 bp, Mus musculus
tggacccaactgtgaccgcttcaaa

SEQ ID NO: 879381 - DNA, 25 bp, Mus musculus
tggacccaagtaaaataacaggatt

SEQ ID NO: 879382 - DNA, 25 bp, Mus musculus
tggacccaagtataataacaggatt

SEQ ID NO: 879383 - DNA, 25 bp, Mus musculus
tggacccaccagaatcagcgaggag

SEQ ID NO: 879384 - DNA, 25 bp, Mus musculus
tggacccaccagtatcagcgaggag

SEQ ID NO: 879385 - DNA, 25 bp, Mus musculus
tggacccacggtacacgggtagagt

SEQ ID NO: 879386 - DNA, 25 bp, Mus musculus
tggacccacggttcacgggtagagt

SEQ ID NO: 879387 - DNA, 25 bp, Mus musculus
tggacccacttgatccctgatggaa

SEQ ID NO: 879388 - DNA, 25 bp, Mus musculus
tggacccacttgttccctgatggaa

SEQ ID NO: 879389 - DNA, 25 bp, Mus musculus
tggacccagacaccggcatcataga

SEQ ID NO: 879390 - DNA, 25 bp, Mus musculus
tggacccagacagcggcatcataga

SEQ ID NO: 879391 - DNA, 25 bp, Mus musculus
tggacccagcgcacatgagaccggg

SEQ ID NO: 879392 - DNA, 25 bp, Mus musculus
tggacccagcgctcatgagaccggg

SEQ ID NO: 879393 - DNA, 25 bp, Mus musculus
tggacccagctaccggctatgtggt

SEQ ID NO: 879394 - DNA, 25 bp, Mus musculus
tggacccagctaccttgtatgaagt

SEQ ID NO: 879395 - DNA, 25 bp, Mus musculus
tggacccagctagcggctatgtggt

SEQ ID NO: 879396 - DNA, 25 bp, Mus musculus
tggacccagctagcttgtatgaagt

SEQ ID NO: 879397 - DNA, 25 bp, Mus musculus
tggacccagctgagagccacacaca

SEQ ID NO: 879398 - DNA, 25 bp, Mus musculus
tggacccagctgtgagccacacaca

SEQ ID NO: 879399 - DNA, 25 bp, Mus musculus
tggacccaggctccttgctggtcaa

SEQ ID NO: 879400 - DNA, 25 bp, Mus musculus
tggacccaggctgcttgctggtcaa

SEQ ID NO: 879401 - DNA, 25 bp, Mus musculus
tggacccagggtatttgagtgttat

SEQ ID NO: 879402 - DNA, 25 bp, Mus musculus
tggacccagggtttttgagtgttat

SEQ ID NO: 879403 - DNA, 25 bp, Mus musculus
tggacccataggattggcattccct

SEQ ID NO: 879404 - DNA, 25 bp, Mus musculus
tggacccataggtttggcattccct

SEQ ID NO: 879405 - DNA, 25 bp, Mus musculus
tggacccattatcatagtacctgcc

SEQ ID NO: 879406 - DNA, 25 bp, Mus musculus
tggacccattatgatagtacctgcc

SEQ ID NO: 879407 - DNA, 25 bp, Mus musculus
tggacccattcaataacctgcccag

SEQ ID NO: 879408 - DNA, 25 bp, Mus musculus
tggacccattcattaacctgcccag

SEQ ID NO: 879409 - DNA, 25 bp, Mus musculus
tggaccccaaggagatagtggagat

SEQ ID NO: 879410 - DNA, 25 bp, Mus musculus
tggaccccaaggtgatagtggagat

SEQ ID NO: 879411 - DNA, 25 bp, Mus musculus
tggaccccacagatacttttcttaa

SEQ ID NO: 879412 - DNA, 25 bp, Mus musculus
tggaccccacagcattaacgcttgt

SEQ ID NO: 879413 - DNA, 25 bp, Mus musculus
tggaccccacaggattaacgcttgt

SEQ ID NO: 879414 - DNA, 25 bp, Mus musculus
tggaccccacagttacttttcttaa

SEQ ID NO: 879415 - DNA, 25 bp, Mus musculus
tggaccccacctatggcttggagag

SEQ ID NO: 879416 - DNA, 25 bp, Mus musculus
tggaccccacctttggcttggagag

SEQ ID NO: 879417 - DNA, 25 bp, Mus musculus
tggaccccaggaaatcacacgggac

SEQ ID NO: 879418 - DNA, 25 bp, Mus musculus
tggaccccaggatatcacacgggac

SEQ ID NO: 879419 - DNA, 25 bp, Mus musculus
tggaccccataacaaacagcctata

SEQ ID NO: 879420 - DNA, 25 bp, Mus musculus
tggaccccataagaaacagcctata

SEQ ID NO: 879421 - DNA, 25 bp, Mus musculus
tggaccccatacaggtgaccagctt

SEQ ID NO: 879422 - DNA, 25 bp, Mus musculus
tggaccccatactggtgaccagctt

SEQ ID NO: 879423 - DNA, 25 bp, Mus musculus
tggaccccatctaagatctcagaga

SEQ ID NO: 879424 - DNA, 25 bp, Mus musculus
tggaccccatcttagatctcagaga

SEQ ID NO: 879425 - DNA, 25 bp, Mus musculus
tggaccccatgcaagatgactcggt

SEQ ID NO: 879426 - DNA, 25 bp, Mus musculus
tggaccccatgctagatgactcggt

SEQ ID NO: 879427 - DNA, 25 bp, Mus musculus
tggaccccggatagcatcataaagc

SEQ ID NO: 879428 - DNA, 25 bp, Mus musculus
tggaccccggattgcatcataaagc

SEQ ID NO: 879429 - DNA, 25 bp, Mus musculus
tggaccccgtttatcacctggacaa

SEQ ID NO: 879430 - DNA, 25 bp, Mus musculus
tggaccccgtttttcacctggacaa

SEQ ID NO: 879431 - DNA, 25 bp, Mus musculus
tggacccctcctaactaatcttaag

SEQ ID NO: 879432 - DNA, 25 bp, Mus musculus
tggacccctccttactaatcttaag

SEQ ID NO: 879433 - DNA, 25 bp, Mus musculus
tggacccctctcattagaatgagct

SEQ ID NO: 879434 - DNA, 25 bp, Mus musculus
tggacccctctctttagaatgagct

SEQ ID NO: 879435 - DNA, 25 bp, Mus musculus
tggacccctggaatatttggcggga

SEQ ID NO: 879436 - DNA, 25 bp, Mus musculus
tggacccctggattatttggcggga

SEQ ID NO: 879437 - DNA, 25 bp, Mus musculus
tggacccctgggactatatcctctt

SEQ ID NO: 879438 - DNA, 25 bp, Mus musculus
tggacccctgggtctatatcctctt

SEQ ID NO: 879439 - DNA, 25 bp, Mus musculus
tggacccgaagtaatgctgccttgg

SEQ ID NO: 879440 - DNA, 25 bp, Mus musculus
tggacccgaagttatgctgccttgg

SEQ ID NO: 879441 - DNA, 25 bp, Mus musculus
tggacccgagaacgatcctggctca

SEQ ID NO: 879442 - DNA, 25 bp, Mus musculus
tggacccgagaaggatcctggctca

SEQ ID NO: 879443 - DNA, 25 bp, Mus musculus
tggacccggagcaaaaggaaacatt

SEQ ID NO: 879444 - DNA, 25 bp, Mus musculus
tggacccggagctaaaggaaacatt

SEQ ID NO: 879445 - DNA, 25 bp, Mus musculus
tggacccgtcccagtaaatataaag

SEQ ID NO: 879446 - DNA, 25 bp, Mus musculus
tggacccgtccctgtaaatataaag

SEQ ID NO: 879447 - DNA, 25 bp, Mus musculus
tggaccctactcagtctgtggatga

SEQ ID NO: 879448 - DNA, 25 bp, Mus musculus
tggaccctactctgtctgtggatga

SEQ ID NO: 879449 - DNA, 25 bp, Mus musculus
tggaccctagctatgaggctgaacc

SEQ ID NO: 879450 - DNA, 25 bp, Mus musculus
tggaccctagctttgaggctgaacc

SEQ ID NO: 879451 - DNA, 25 bp, Mus musculus
tggaccctagggatttgcactacag

SEQ ID NO: 879452 - DNA, 25 bp, Mus musculus
tggaccctagggttttgcactacag

SEQ ID NO: 879453 - DNA, 25 bp, Mus musculus
tggaccctcagcattatgtcacgat

SEQ ID NO: 879454 - DNA, 25 bp, Mus musculus
tggaccctcagctttatgtcacgat

SEQ ID NO: 879455 - DNA, 25 bp, Mus musculus
tggaccctccctctgatgttgatag

SEQ ID NO: 879456 - DNA, 25 bp, Mus musculus
tggaccctccctgtgatgttgatag

SEQ ID NO: 879457 - DNA, 25 bp, Mus musculus
tggaccctcttaaagctaagactgc

SEQ ID NO: 879458 - DNA, 25 bp, Mus musculus
tggaccctcttatagctaagactgc

SEQ ID NO: 879459 - DNA, 25 bp, Mus musculus
tggaccctgagaaatgtatgcgttt

SEQ ID NO: 879460 - DNA, 25 bp, Mus musculus
tggaccctgagatatgtatgcgttt

SEQ ID NO: 879461 - DNA, 25 bp, Mus musculus
tggaccctgatcagcaccataggtt

SEQ ID NO: 879462 - DNA, 25 bp, Mus musculus
tggaccctgatctgcaccataggtt

SEQ ID NO: 879463 - DNA, 25 bp, Mus musculus
tggaccctgcgcaatttagttccag

SEQ ID NO: 879464 - DNA, 25 bp, Mus musculus
tggaccctgcgctatttagttccag

SEQ ID NO: 879465 - DNA, 25 bp, Mus musculus
tggaccctgctccatgttatttttg

SEQ ID NO: 879466 - DNA, 25 bp, Mus musculus
tggaccctgctcgatgttatttttg

SEQ ID NO: 879467 - DNA, 25 bp, Mus musculus
tggaccctgctgaattataccactt

SEQ ID NO: 879468 - DNA, 25 bp, Mus musculus
tggaccctgctgacttttcggtggg

SEQ ID NO: 879469 - DNA, 25 bp, Mus musculus
tggaccctgctgtattataccactt

SEQ ID NO: 879470 - DNA, 25 bp, Mus musculus
tggaccctgctgtcttttcggtggg

SEQ ID NO: 879471 - DNA, 25 bp, Mus musculus
tggaccctgcttaccccaagctgat

SEQ ID NO: 879472 - DNA, 25 bp, Mus musculus
tggaccctgctttccccaagctgat

SEQ ID NO: 879473 - DNA, 25 bp, Mus musculus
tggaccctggttcctgtcggagttc

SEQ ID NO: 879474 - DNA, 25 bp, Mus musculus
tggaccctggttgctgtcggagttc

SEQ ID NO: 879475 - DNA, 25 bp, Mus musculus
tggacccttcaaatactaaagcact

SEQ ID NO: 879476 - DNA, 25 bp, Mus musculus
tggacccttcaattactaaagcact

SEQ ID NO: 879477 - DNA, 25 bp, Mus musculus
tggacccttcagagccaaggccttc

SEQ ID NO: 879478 - DNA, 25 bp, Mus musculus
tggacccttcagtgccaaggccttc

SEQ ID NO: 879479 - DNA, 25 bp, Mus musculus
tggacccttcgtcagaactggcttc

SEQ ID NO: 879480 - DNA, 25 bp, Mus musculus
tggacccttcgtgagaactggcttc

SEQ ID NO: 879481 - DNA, 25 bp, Mus musculus
tggacccttgtacaactcacactgt

SEQ ID NO: 879482 - DNA, 25 bp, Mus musculus
tggacccttgtagaactcacactgt

SEQ ID NO: 879483 - DNA, 25 bp, Mus musculus
tggaccctttcaaagactacactgt

SEQ ID NO: 879484 - DNA, 25 bp, Mus musculus
tggaccctttcatagactacactgt

SEQ ID NO: 879485 - DNA, 25 bp, Mus musculus
tggacccttttcactaactgggttg

SEQ ID NO: 879486 - DNA, 25 bp, Mus musculus
tggacccttttctctaactgggttg

SEQ ID NO: 879487 - DNA, 25 bp, Mus musculus
tggaccgaaaatctcccttatcttt

SEQ ID NO: 879488 - DNA, 25 bp, Mus musculus
tggaccgaaaatgtcccttatcttt

SEQ ID NO: 879489 - DNA, 25 bp, Mus musculus
tggaccgatacacggacagtcatga

SEQ ID NO: 879490 - DNA, 25 bp, Mus musculus
tggaccgatacagggacagtcatga

SEQ ID NO: 879491 - DNA, 25 bp, Mus musculus
tggaccgcagaaccagcaacagatc

SEQ ID NO: 879492 - DNA, 25 bp, Mus musculus
tggaccgcagaagcagcaacagatc

SEQ ID NO: 879493 - DNA, 25 bp, Mus musculus
tggaccgccattatgtcctatgctg

SEQ ID NO: 879494 - DNA, 25 bp, Mus musculus
tggaccgccattttgtcctatgctg

SEQ ID NO: 879495 - DNA, 25 bp, Mus musculus
tggaccgccggaataagttgattat

SEQ ID NO: 879496 - DNA, 25 bp, Mus musculus
tggaccgccggattaagttgattat

SEQ ID NO: 879497 - DNA, 25 bp, Mus musculus
tggaccgcgacgaaggcgccaagaa

SEQ ID NO: 879498 - DNA, 25 bp, Mus musculus
tggaccgcgacgtaggcgccaagaa

SEQ ID NO: 879499 - DNA, 25 bp, Mus musculus
tggaccgctacaaggacgcctggaa

SEQ ID NO: 879500 - DNA, 25 bp, Mus musculus
tggaccgctacatggacgcctggaa

SEQ ID NO: 879501 - DNA, 25 bp, Mus musculus
tggaccgctgtgcataactgggcct

SEQ ID NO: 879502 - DNA, 25 bp, Mus musculus
tggaccgctgtggataactgggcct

SEQ ID NO: 879503 - DNA, 25 bp, Mus musculus
tggaccgcttccacattaacctggg

SEQ ID NO: 879504 - DNA, 25 bp, Mus musculus
tggaccgcttcctcattaacctggg

SEQ ID NO: 879505 - DNA, 25 bp, Mus musculus
tggaccgcttgcacattgtatcaac

SEQ ID NO: 879506 - DNA, 25 bp, Mus musculus
tggaccgcttgctcattgtatcaac

SEQ ID NO: 879507 - DNA, 25 bp, Mus musculus
tggaccggaacaaagcagctgagct

SEQ ID NO: 879508 - DNA, 25 bp, Mus musculus
tggaccggaacaccttggaaaatat

SEQ ID NO: 879509 - DNA, 25 bp, Mus musculus
tggaccggaacagcttggaaaatat

SEQ ID NO: 879510 - DNA, 25 bp, Mus musculus
tggaccggaacatagcagctgagct

SEQ ID NO: 879511 - DNA, 25 bp, Mus musculus
tggaccggaaggatgccgaccagca

SEQ ID NO: 879512 - DNA, 25 bp, Mus musculus
tggaccggaaggttgccgaccagca

SEQ ID NO: 879513 - DNA, 25 bp, Mus musculus
tggaccggatccaccagcagttgga

SEQ ID NO: 879514 - DNA, 25 bp, Mus musculus
tggaccggatcctccagcagttgga

SEQ ID NO: 879515 - DNA, 25 bp, Mus musculus
tggaccggatgcactatcttcagga

SEQ ID NO: 879516 - DNA, 25 bp, Mus musculus
tggaccggatgctctatcttcagga

SEQ ID NO: 879517 - DNA, 25 bp, Mus musculus
tggaccggcactatatgttcctaag

SEQ ID NO: 879518 - DNA, 25 bp, Mus musculus
tggaccggcactttatgttcctaag

SEQ ID NO: 879519 - DNA, 25 bp, Mus musculus
tggaccggcagcagatgctctctca

SEQ ID NO: 879520 - DNA, 25 bp, Mus musculus
tggaccggcagctgatgctctctca

SEQ ID NO: 879521 - DNA, 25 bp, Mus musculus
tggaccggctccagacagtttgaga

SEQ ID NO: 879522 - DNA, 25 bp, Mus musculus
tggaccggctcctgacagtttgaga

SEQ ID NO: 879523 - DNA, 25 bp, Mus musculus
tggaccgggactcggccatcacctt

SEQ ID NO: 879524 - DNA, 25 bp, Mus musculus
tggaccgggactgggccatcacctt

SEQ ID NO: 879525 - DNA, 25 bp, Mus musculus
tggaccgtctcgatgatgttactgc

SEQ ID NO: 879526 - DNA, 25 bp, Mus musculus
tggaccgtctcgttgatgttactgc

SEQ ID NO: 879527 - DNA, 25 bp, Mus musculus
tggaccgtctctcgaggccgagcaa

SEQ ID NO: 879528 - DNA, 25 bp, Mus musculus
tggaccgtctctggaggccgagcaa

SEQ ID NO: 879529 - DNA, 25 bp, Mus musculus
tggaccgtgacaatatacctgcttg

SEQ ID NO: 879530 - DNA, 25 bp, Mus musculus
tggaccgtgacattatacctgcttg

SEQ ID NO: 879531 - DNA, 25 bp, Mus musculus
tggaccgtgcaaccattgtggctgt

SEQ ID NO: 879532 - DNA, 25 bp, Mus musculus
tggaccgtgcaagcattgtggctgt

SEQ ID NO: 879533 - DNA, 25 bp, Mus musculus
tggaccgtggctatgtgtttgatga

SEQ ID NO: 879534 - DNA, 25 bp, Mus musculus
tggaccgtggctttgtgtttgatga

SEQ ID NO: 879535 - DNA, 25 bp, Mus musculus
tggaccgtggtgataatctcataac

SEQ ID NO: 879536 - DNA, 25 bp, Mus musculus
tggaccgtggtgttaatctcataac

SEQ ID NO: 879537 - DNA, 25 bp, Mus musculus
tggaccgtgtaaacctggcatcagg

SEQ ID NO: 879538 - DNA, 25 bp, Mus musculus
tggaccgtgtaatcctggcatcagg

SEQ ID NO: 879539 - DNA, 25 bp, Mus musculus
tggaccgtgtcccagggcagttctc

SEQ ID NO: 879540 - DNA, 25 bp, Mus musculus
tggaccgtgtccgagggcagttctc

SEQ ID NO: 879541 - DNA, 25 bp, Mus musculus
tggacctaaacccagcttcaaggat

SEQ ID NO: 879542 - DNA, 25 bp, Mus musculus
tggacctaaaccgagcttcaaggat

SEQ ID NO: 879543 - DNA, 25 bp, Mus musculus
tggacctaaatgataagagggcttt

SEQ ID NO: 879544 - DNA, 25 bp, Mus musculus
tggacctaaatgttaagagggcttt

SEQ ID NO: 879545 - DNA, 25 bp, Mus musculus
tggacctaacatacgatctcattca

SEQ ID NO: 879546 - DNA, 25 bp, Mus musculus
tggacctaacatcacacctgaacat

SEQ ID NO: 879547 - DNA, 25 bp, Mus musculus
tggacctaacatgacacctgaacat

SEQ ID NO: 879548 - DNA, 25 bp, Mus musculus
tggacctaacattcgatctcattca

SEQ ID NO: 879549 - DNA, 25 bp, Mus musculus
tggacctaactcataatggctcagt

SEQ ID NO: 879550 - DNA, 25 bp, Mus musculus
tggacctaactcttaatggctcagt

SEQ ID NO: 879551 - DNA, 25 bp, Mus musculus
tggacctaactgagggttcgtggac

SEQ ID NO: 879552 - DNA, 25 bp, Mus musculus
tggacctaactgtgggttcgtggac

SEQ ID NO: 879553 - DNA, 25 bp, Mus musculus
tggacctaaggaccaaccccagctg

SEQ ID NO: 879554 - DNA, 25 bp, Mus musculus
tggacctaaggagcaaccccagctg

SEQ ID NO: 879555 - DNA, 25 bp, Mus musculus
tggacctaataaaacaccaaagcgc

SEQ ID NO: 879556 - DNA, 25 bp, Mus musculus
tggacctaataatacaccaaagcgc

SEQ ID NO: 879557 - DNA, 25 bp, Mus musculus
tggacctaccacagtagtgatgctg

SEQ ID NO: 879558 - DNA, 25 bp, Mus musculus
tggacctaccactgtagtgatgctg

SEQ ID NO: 879559 - DNA, 25 bp, Mus musculus
tggacctactatctgccaatagatt

SEQ ID NO: 879560 - DNA, 25 bp, Mus musculus
tggacctactatgtgccaatagatt

SEQ ID NO: 879561 - DNA, 25 bp, Mus musculus
tggacctactgaaaaccctttctgt

SEQ ID NO: 879562 - DNA, 25 bp, Mus musculus
tggacctactgataaccctttctgt

SEQ ID NO: 879563 - DNA, 25 bp, Mus musculus
tggacctagaacatcatgcatgcta

SEQ ID NO: 879564 - DNA, 25 bp, Mus musculus
tggacctagaacttcatgcatgcta

SEQ ID NO: 879565 - DNA, 25 bp, Mus musculus
tggacctagcccacatttttgagtg

SEQ ID NO: 879566 - DNA, 25 bp, Mus musculus
tggacctagccctcatttttgagtg

SEQ ID NO: 879567 - DNA, 25 bp, Mus musculus
tggacctagctgaagctttgggcta

SEQ ID NO: 879568 - DNA, 25 bp, Mus musculus
tggacctagctgtagctttgggcta

SEQ ID NO: 879569 - DNA, 25 bp, Mus musculus
tggacctaggtcattgtctcagcac

SEQ ID NO: 879570 - DNA, 25 bp, Mus musculus
tggacctaggtctttgtctcagcac

SEQ ID NO: 879571 - DNA, 25 bp, Mus musculus
tggacctagtccagacagtatgctt

SEQ ID NO: 879572 - DNA, 25 bp, Mus musculus
tggacctagtcctgacagtatgctt

SEQ ID NO: 879573 - DNA, 25 bp, Mus musculus
tggacctagtgcagctcacagagct

SEQ ID NO: 879574 - DNA, 25 bp, Mus musculus
tggacctagtgctgctcacagagct

SEQ ID NO: 879575 - DNA, 25 bp, Mus musculus
tggacctatattctggactgctgag

SEQ ID NO: 879576 - DNA, 25 bp, Mus musculus
tggacctatattgtggactgctgag

SEQ ID NO: 879577 - DNA, 25 bp, Mus musculus
tggacctatgtacttctgcaaactg

SEQ ID NO: 879578 - DNA, 25 bp, Mus musculus
tggacctatgtagttctgcaaactg

SEQ ID NO: 879579 - DNA, 25 bp, Mus musculus
tggacctcaccgagcaggagttccg

SEQ ID NO: 879580 - DNA, 25 bp, Mus musculus
tggacctcaccgtgcaggagttccg

SEQ ID NO: 879581 - DNA, 25 bp, Mus musculus
tggacctcagcacatctcagagtta

SEQ ID NO: 879582 - DNA, 25 bp, Mus musculus
tggacctcagcagatctcagagtta

SEQ ID NO: 879583 - DNA, 25 bp, Mus musculus
tggacctcagccatcgctggcagtg

SEQ ID NO: 879584 - DNA, 25 bp, Mus musculus
tggacctcagccttcgctggcagtg

SEQ ID NO: 879585 - DNA, 25 bp, Mus musculus
tggacctcagtgaagacactccagc

SEQ ID NO: 879586 - DNA, 25 bp, Mus musculus
tggacctcagtgtagacactccagc

SEQ ID NO: 879587 - DNA, 25 bp, Mus musculus
tggacctcagttattcccactcaga

SEQ ID NO: 879588 - DNA, 25 bp, Mus musculus
tggacctcagtttttcccactcaga

SEQ ID NO: 879589 - DNA, 25 bp, Mus musculus
tggacctccaaccaaatgggcacta

SEQ ID NO: 879590 - DNA, 25 bp, Mus musculus
tggacctccaacgaaatgggcacta

SEQ ID NO: 879591 - DNA, 25 bp, Mus musculus
tggacctccactacagactcggagc

SEQ ID NO: 879592 - DNA, 25 bp, Mus musculus
tggacctccacttcagactcggagc

SEQ ID NO: 879593 - DNA, 25 bp, Mus musculus
tggacctccaggagttgatctgtac

SEQ ID NO: 879594 - DNA, 25 bp, Mus musculus
tggacctccaggtgttgatctgtac

SEQ ID NO: 879595 - DNA, 25 bp, Mus musculus
tggacctccgtactctcgagtcgct

SEQ ID NO: 879596 - DNA, 25 bp, Mus musculus
tggacctccgtagtctcgagtcgct

SEQ ID NO: 879597 - DNA, 25 bp, Mus musculus
tggacctcctagaagctgctgggaa

SEQ ID NO: 879598 - DNA, 25 bp, Mus musculus
tggacctcctagtagctgctgggaa

SEQ ID NO: 879599 - DNA, 25 bp, Mus musculus
tggacctcctcactgcattctgaga

SEQ ID NO: 879600 - DNA, 25 bp, Mus musculus
tggacctcctcagtgcattctgaga

SEQ ID NO: 879601 - DNA, 25 bp, Mus musculus
tggacctccttccagtgggttcagt

SEQ ID NO: 879602 - DNA, 25 bp, Mus musculus
tggacctccttcgagtgggttcagt

SEQ ID NO: 879603 - DNA, 25 bp, Mus musculus
tggacctcggccactttagcaaagt

SEQ ID NO: 879604 - DNA, 25 bp, Mus musculus
tggacctcggcctctttagcaaagt

SEQ ID NO: 879605 - DNA, 25 bp, Mus musculus
tggacctcggctatcgctacgttga

SEQ ID NO: 879606 - DNA, 25 bp, Mus musculus
tggacctcggctttcgctacgttga

SEQ ID NO: 879607 - DNA, 25 bp, Mus musculus
tggacctctacaacactgagatcct

SEQ ID NO: 879608 - DNA, 25 bp, Mus musculus
tggacctctacatcactgagatcct

SEQ ID NO: 879609 - DNA, 25 bp, Mus musculus
tggacctctataccctcagcaaaat

SEQ ID NO: 879610 - DNA, 25 bp, Mus musculus
tggacctctatagcctcagcaaaat

SEQ ID NO: 879611 - DNA, 25 bp, Mus musculus
tggacctctgccagagggcagtaag

SEQ ID NO: 879612 - DNA, 25 bp, Mus musculus
tggacctctgcctgagggcagtaag

SEQ ID NO: 879613 - DNA, 25 bp, Mus musculus
tggacctctgttactttgctaggca

SEQ ID NO: 879614 - DNA, 25 bp, Mus musculus
tggacctctgtttctttgctaggca

SEQ ID NO: 879615 - DNA, 25 bp, Mus musculus
tggacctcttacagctctatggact

SEQ ID NO: 879616 - DNA, 25 bp, Mus musculus
tggacctcttactgctctatggact

SEQ ID NO: 879617 - DNA, 25 bp, Mus musculus
tggacctcttccacgttcgggagag

SEQ ID NO: 879618 - DNA, 25 bp, Mus musculus
tggacctcttcctcgttcgggagag

SEQ ID NO: 879619 - DNA, 25 bp, Mus musculus
tggacctcttgtcaatttagcctgg

SEQ ID NO: 879620 - DNA, 25 bp, Mus musculus
tggacctcttgtgaatttagcctgg

SEQ ID NO: 879621 - DNA, 25 bp, Mus musculus
tggacctgaagaacaacttgctggg

SEQ ID NO: 879622 - DNA, 25 bp, Mus musculus
tggacctgaagatcaacttgctggg

SEQ ID NO: 879623 - DNA, 25 bp, Mus musculus
tggacctgacctatcaagcccgttc

SEQ ID NO: 879624 - DNA, 25 bp, Mus musculus
tggacctgacctttcaagcccgttc

SEQ ID NO: 879625 - DNA, 25 bp, Mus musculus
tggacctgcagcacgtgggataagc

SEQ ID NO: 879626 - DNA, 25 bp, Mus musculus
tggacctgcagctcgtgggataagc

SEQ ID NO: 879627 - DNA, 25 bp, Mus musculus
tggacctgctggataaccttctgaa

SEQ ID NO: 879628 - DNA, 25 bp, Mus musculus
tggacctgctggttaaccttctgaa

SEQ ID NO: 879629 - DNA, 25 bp, Mus musculus
tggacctggacccactgacgtcctg

SEQ ID NO: 879630 - DNA, 25 bp, Mus musculus
tggacctggaccgactgacgtcctg

SEQ ID NO: 879631 - DNA, 25 bp, Mus musculus
tggacctggccaacttgaggtaggc

SEQ ID NO: 879632 - DNA, 25 bp, Mus musculus
tggacctggccatcttgaggtaggc

SEQ ID NO: 879633 - DNA, 25 bp, Mus musculus
tggacctggcttcttctcagggaga

SEQ ID NO: 879634 - DNA, 25 bp, Mus musculus
tggacctggcttgttctcagggaga

SEQ ID NO: 879635 - DNA, 25 bp, Mus musculus
tggacctgggtgctcagcagcaaaa

SEQ ID NO: 879636 - DNA, 25 bp, Mus musculus
tggacctgggtggtcagcagcaaaa

SEQ ID NO: 879637 - DNA, 25 bp, Mus musculus
tggacctgtacccaataattaagaa

SEQ ID NO: 879638 - DNA, 25 bp, Mus musculus
tggacctgtaccgaataattaagaa

SEQ ID NO: 879639 - DNA, 25 bp, Mus musculus
tggacctgtcagagactgccaacat

SEQ ID NO: 879640 - DNA, 25 bp, Mus musculus
tggacctgtcagtgactgccaacat

SEQ ID NO: 879641 - DNA, 25 bp, Mus musculus
tggacctgtcctagatgataactga

SEQ ID NO: 879642 - DNA, 25 bp, Mus musculus
tggacctgtccttgatgataactga

SEQ ID NO: 879643 - DNA, 25 bp, Mus musculus
tggacctgtgcaaagattcctcttt

SEQ ID NO: 879644 - DNA, 25 bp, Mus musculus
tggacctgtgcatagattcctcttt

SEQ ID NO: 879645 - DNA, 25 bp, Mus musculus
tggacctgtggaagctctcctcatg

SEQ ID NO: 879646 - DNA, 25 bp, Mus musculus
tggacctgtggaccctggttgtaaa

SEQ ID NO: 879647 - DNA, 25 bp, Mus musculus
tggacctgtggaccttgctccagtt

SEQ ID NO: 879648 - DNA, 25 bp, Mus musculus
tggacctgtggagcctggttgtaaa

SEQ ID NO: 879649 - DNA, 25 bp, Mus musculus
tggacctgtggagcttgctccagtt

SEQ ID NO: 879650 - DNA, 25 bp, Mus musculus
tggacctgtggatgctctcctcatg

SEQ ID NO: 879651 - DNA, 25 bp, Mus musculus
tggacctgttggcaccgcctgaagg

SEQ ID NO: 879652 - DNA, 25 bp, Mus musculus
tggacctgttgggaccgcctgaagg

SEQ ID NO: 879653 - DNA, 25 bp, Mus musculus
tggacctgtttcaatctctaaatga

SEQ ID NO: 879654 - DNA, 25 bp, Mus musculus
tggacctgtttctatctctaaatga

SEQ ID NO: 879655 - DNA, 25 bp, Mus musculus
tggaccttacgtccttgctgggtga

SEQ ID NO: 879656 - DNA, 25 bp, Mus musculus
tggaccttacgtgcttgctgggtga

SEQ ID NO: 879657 - DNA, 25 bp, Mus musculus
tggaccttagcaagtgtttcttaaa

SEQ ID NO: 879658 - DNA, 25 bp, Mus musculus
tggaccttagcaagttacctgcccc

SEQ ID NO: 879659 - DNA, 25 bp, Mus musculus
tggaccttagcatgtgtttcttaaa

SEQ ID NO: 879660 - DNA, 25 bp, Mus musculus
tggaccttagcatgttacctgcccc

SEQ ID NO: 879661 - DNA, 25 bp, Mus musculus
tggaccttcactaccttatcattat

SEQ ID NO: 879662 - DNA, 25 bp, Mus musculus
tggaccttcactaggtgcatcggga

SEQ ID NO: 879663 - DNA, 25 bp, Mus musculus
tggaccttcacttccttatcattat

SEQ ID NO: 879664 - DNA, 25 bp, Mus musculus
tggaccttcacttggtgcatcggga

SEQ ID NO: 879665 - DNA, 25 bp, Mus musculus
tggaccttcagaccgacacccagtt

SEQ ID NO: 879666 - DNA, 25 bp, Mus musculus
tggaccttcagagcgacacccagtt

SEQ ID NO: 879667 - DNA, 25 bp, Mus musculus
tggaccttcctcaatggcatggtgc

SEQ ID NO: 879668 - DNA, 25 bp, Mus musculus
tggaccttcctctatggcatggtgc

SEQ ID NO: 879669 - DNA, 25 bp, Mus musculus
tggaccttctagcagcggctactca

SEQ ID NO: 879670 - DNA, 25 bp, Mus musculus
tggaccttctaggagcggctactca

SEQ ID NO: 879671 - DNA, 25 bp, Mus musculus
tggaccttgaccaccacatcaacat

SEQ ID NO: 879672 - DNA, 25 bp, Mus musculus
tggaccttgacctccacatcaacat

SEQ ID NO: 879673 - DNA, 25 bp, Mus musculus
tggaccttgcctactatcttaaaat

SEQ ID NO: 879674 - DNA, 25 bp, Mus musculus
tggaccttgccttctatcttaaaat

SEQ ID NO: 879675 - DNA, 25 bp, Mus musculus
tggaccttgcttactcactgtgtgt

SEQ ID NO: 879676 - DNA, 25 bp, Mus musculus
tggaccttgctttctcactgtgtgt

SEQ ID NO: 879677 - DNA, 25 bp, Mus musculus
tggaccttggcaaactcctgtaatg

SEQ ID NO: 879678 - DNA, 25 bp, Mus musculus
tggaccttggcatactcctgtaatg

SEQ ID NO: 879679 - DNA, 25 bp, Mus musculus
tggaccttgggcatatctaaatgtg

SEQ ID NO: 879680 - DNA, 25 bp, Mus musculus
tggaccttgggcttatctaaatgtg

SEQ ID NO: 879681 - DNA, 25 bp, Mus musculus
tggaccttgtgaacctgctgctgac

SEQ ID NO: 879682 - DNA, 25 bp, Mus musculus
tggaccttgtgatcctgctgctgac

SEQ ID NO: 879683 - DNA, 25 bp, Mus musculus
tggaccttgtgtactgtgtggcccc

SEQ ID NO: 879684 - DNA, 25 bp, Mus musculus
tggaccttgtgttctgtgtggcccc

SEQ ID NO: 879685 - DNA, 25 bp, Mus musculus
tggaccttgttcatctttcaacagc

SEQ ID NO: 879686 - DNA, 25 bp, Mus musculus
tggaccttgttcttctttcaacagc

SEQ ID NO: 879687 - DNA, 25 bp, Mus musculus
tggacctttaggcatagtcaccttt

SEQ ID NO: 879688 - DNA, 25 bp, Mus musculus
tggacctttagggatagtcaccttt

SEQ ID NO: 879689 - DNA, 25 bp, Mus musculus
tggacctttggtagctgtcaggaaa

SEQ ID NO: 879690 - DNA, 25 bp, Mus musculus
tggacctttggttgctgtcaggaaa

SEQ ID NO: 879691 - DNA, 25 bp, Mus musculus
tggaccttttataccctcaattatt

SEQ ID NO: 879692 - DNA, 25 bp, Mus musculus
tggaccttttattccctcaattatt

SEQ ID NO: 879693 - DNA, 25 bp, Mus musculus
tggaccttttccatattacgcaact

SEQ ID NO: 879694 - DNA, 25 bp, Mus musculus
tggaccttttccttattacgcaact

SEQ ID NO: 879695 - DNA, 25 bp, Mus musculus
tggaccttttgcagtaatcactcag

SEQ ID NO: 879696 - DNA, 25 bp, Mus musculus
tggaccttttgctgtaatcactcag

SEQ ID NO: 879697 - DNA, 25 bp, Mus musculus
tggacctttttcacagctgatgcta

SEQ ID NO: 879698 - DNA, 25 bp, Mus musculus
tggacctttttctcagctgatgcta

SEQ ID NO: 879699 - DNA, 25 bp, Mus musculus
tggacgaacggtccccaagttcatt

SEQ ID NO: 879700 - DNA, 25 bp, Mus musculus
tggacgaacggtgcccaagttcatt

SEQ ID NO: 879701 - DNA, 25 bp, Mus musculus
tggacgaactgcactctagacggaa

SEQ ID NO: 879702 - DNA, 25 bp, Mus musculus
tggacgaactgctctctagacggaa

SEQ ID NO: 879703 - DNA, 25 bp, Mus musculus
tggacgaagcaactgcctccattga

SEQ ID NO: 879704 - DNA, 25 bp, Mus musculus
tggacgaagcaagtgcctccattga

SEQ ID NO: 879705 - DNA, 25 bp, Mus musculus
tggacgaagtagaagcctcagctgc

SEQ ID NO: 879706 - DNA, 25 bp, Mus musculus
tggacgaagtagtagcctcagctgc

SEQ ID NO: 879707 - DNA, 25 bp, Mus musculus
tggacgaatgcacggatgagcacaa

SEQ ID NO: 879708 - DNA, 25 bp, Mus musculus
tggacgaatgcagggatgagcacaa

SEQ ID NO: 879709 - DNA, 25 bp, Mus musculus
tggacgaccggtatgggcagatcat

SEQ ID NO: 879710 - DNA, 25 bp, Mus musculus
tggacgaccggtttgggcagatcat

SEQ ID NO: 879711 - DNA, 25 bp, Mus musculus
tggacgactcctcgctgcaggtgca

SEQ ID NO: 879712 - DNA, 25 bp, Mus musculus
tggacgactcctggctgcaggtgca

SEQ ID NO: 879713 - DNA, 25 bp, Mus musculus
tggacgacttccaggtacatcaaag

SEQ ID NO: 879714 - DNA, 25 bp, Mus musculus
tggacgacttcctggtacatcaaag

SEQ ID NO: 879715 - DNA, 25 bp, Mus musculus
tggacgagaaccagctccggaggcc

SEQ ID NO: 879716 - DNA, 25 bp, Mus musculus
tggacgagaacctgctccggaggcc

SEQ ID NO: 879717 - DNA, 25 bp, Mus musculus
tggacgagcttgaggagcactacaa

SEQ ID NO: 879718 - DNA, 25 bp, Mus musculus
tggacgagcttgtggagcactacaa

SEQ ID NO: 879719 - DNA, 25 bp, Mus musculus
tggacgaggctaaatcagtacgact

SEQ ID NO: 879720 - DNA, 25 bp, Mus musculus
tggacgaggctatatcagtacgact

SEQ ID NO: 879721 - DNA, 25 bp, Mus musculus
tggacgatactcaaaccggctctac

SEQ ID NO: 879722 - DNA, 25 bp, Mus musculus
tggacgatactctaaccggctctac

SEQ ID NO: 879723 - DNA, 25 bp, Mus musculus
tggacgatgggtatcaagacactac

SEQ ID NO: 879724 - DNA, 25 bp, Mus musculus
tggacgatgggtttcaagacactac

SEQ ID NO: 879725 - DNA, 25 bp, Mus musculus
tggacgatgtgtacctgcccaaaga

SEQ ID NO: 879726 - DNA, 25 bp, Mus musculus
tggacgatgtgttcctgcccaaaga

SEQ ID NO: 879727 - DNA, 25 bp, Mus musculus
tggacgatttccctaatgctgcttc

SEQ ID NO: 879728 - DNA, 25 bp, Mus musculus
tggacgatttccgtaatgctgcttc

SEQ ID NO: 879729 - DNA, 25 bp, Mus musculus
tggacgccatagatctcactgacaa

SEQ ID NO: 879730 - DNA, 25 bp, Mus musculus
tggacgccatagttctcactgacaa

SEQ ID NO: 879731 - DNA, 25 bp, Mus musculus
tggacgccatggagcgcctggccta

SEQ ID NO: 879732 - DNA, 25 bp, Mus musculus
tggacgccatggtgcgcctggccta

SEQ ID NO: 879733 - DNA, 25 bp, Mus musculus
tggacgccattaccctgacaactga

SEQ ID NO: 879734 - DNA, 25 bp, Mus musculus
tggacgccattagcctgacaactga

SEQ ID NO: 879735 - DNA, 25 bp, Mus musculus
tggacgccatttcctccacagacaa

SEQ ID NO: 879736 - DNA, 25 bp, Mus musculus
tggacgccatttgctccacagacaa

SEQ ID NO: 879737 - DNA, 25 bp, Mus musculus
tggacgccccgacccatgtgtggaa

SEQ ID NO: 879738 - DNA, 25 bp, Mus musculus
tggacgccccgagccatgtgtggaa

SEQ ID NO: 879739 - DNA, 25 bp, Mus musculus
tggacgccgcgacagtaaacccgtg

SEQ ID NO: 879740 - DNA, 25 bp, Mus musculus
tggacgccgcgagagtaaacccgtg

SEQ ID NO: 879741 - DNA, 25 bp, Mus musculus
tggacgcctcggagatgtacagaaa

SEQ ID NO: 879742 - DNA, 25 bp, Mus musculus
tggacgcctcggtgatgtacagaaa

SEQ ID NO: 879743 - DNA, 25 bp, Mus musculus
tggacgcgagccacaagctgcactg

SEQ ID NO: 879744 - DNA, 25 bp, Mus musculus
tggacgcgagcctcaagctgcactg

SEQ ID NO: 879745 - DNA, 25 bp, Mus musculus
tggacgcgcctgacatgatcatgaa

SEQ ID NO: 879746 - DNA, 25 bp, Mus musculus
tggacgcgcctgtcatgatcatgaa

SEQ ID NO: 879747 - DNA, 25 bp, Mus musculus
tggacgctctccaggatctggaaag

SEQ ID NO: 879748 - DNA, 25 bp, Mus musculus
tggacgctctcctggatctggaaag

SEQ ID NO: 879749 - DNA, 25 bp, Mus musculus
tggacgctctgcacatttgggagga

SEQ ID NO: 879750 - DNA, 25 bp, Mus musculus
tggacgctctgctcatttgggagga

SEQ ID NO: 879751 - DNA, 25 bp, Mus musculus
tggacgctggacacttcagttggag

SEQ ID NO: 879752 - DNA, 25 bp, Mus musculus
tggacgctggactcttcagttggag

SEQ ID NO: 879753 - DNA, 25 bp, Mus musculus
tggacggaagtaatctcctggcctc

SEQ ID NO: 879754 - DNA, 25 bp, Mus musculus
tggacggaagtattctcctggcctc

SEQ ID NO: 879755 - DNA, 25 bp, Mus musculus
tggacggagaagactgattcagcct

SEQ ID NO: 879756 - DNA, 25 bp, Mus musculus
tggacggagaagtctgattcagcct

SEQ ID NO: 879757 - DNA, 25 bp, Mus musculus
tggacggagaggacaccactctggt

SEQ ID NO: 879758 - DNA, 25 bp, Mus musculus
tggacggagaggtcaccactctggt

SEQ ID NO: 879759 - DNA, 25 bp, Mus musculus
tggacggagatacaggttcttccag

SEQ ID NO: 879760 - DNA, 25 bp, Mus musculus
tggacggagatagaggttcttccag

SEQ ID NO: 879761 - DNA, 25 bp, Mus musculus
tggacggcaaagatgctccctcatc

SEQ ID NO: 879762 - DNA, 25 bp, Mus musculus
tggacggcaaagttgctccctcatc

SEQ ID NO: 879763 - DNA, 25 bp, Mus musculus
tggacggcatccagaacagcttcaa

SEQ ID NO: 879764 - DNA, 25 bp, Mus musculus
tggacggcatcctgaacagcttcaa

SEQ ID NO: 879765 - DNA, 25 bp, Mus musculus
tggacggccatcagtacgagctcga

SEQ ID NO: 879766 - DNA, 25 bp, Mus musculus
tggacggccatctgtacgagctcga

SEQ ID NO: 879767 - DNA, 25 bp, Mus musculus
tggacggccgacatgtcaagaccct

SEQ ID NO: 879768 - DNA, 25 bp, Mus musculus
tggacggccgacttgtcaagaccct

SEQ ID NO: 879769 - DNA, 25 bp, Mus musculus
tggacgggatgtctccaagctcttg

SEQ ID NO: 879770 - DNA, 25 bp, Mus musculus
tggacgggatgtgtccaagctcttg

SEQ ID NO: 879771 - DNA, 25 bp, Mus musculus
tggacgggccataccgaataaccag

SEQ ID NO: 879772 - DNA, 25 bp, Mus musculus
tggacgggccattccgaataaccag

SEQ ID NO: 879773 - DNA, 25 bp, Mus musculus
tggacggtccaacagcagatttagt

SEQ ID NO: 879774 - DNA, 25 bp, Mus musculus
tggacggtccaagagcagatttagt

SEQ ID NO: 879775 - DNA, 25 bp, Mus musculus
tggacggtgattacccactagtggt

SEQ ID NO: 879776 - DNA, 25 bp, Mus musculus
tggacggtgatttcccactagtggt

SEQ ID NO: 879777 - DNA, 25 bp, Mus musculus
tggacggttcaaccttcccagacat

SEQ ID NO: 879778 - DNA, 25 bp, Mus musculus
tggacggttcaagcttcccagacat

SEQ ID NO: 879779 - DNA, 25 bp, Mus musculus
tggacgtaaagcaggtctctgagtt

SEQ ID NO: 879780 - DNA, 25 bp, Mus musculus
tggacgtaaagctggtctctgagtt

SEQ ID NO: 879781 - DNA, 25 bp, Mus musculus
tggacgtaactacaaaggccttggc

SEQ ID NO: 879782 - DNA, 25 bp, Mus musculus
tggacgtaactagaaaggccttggc

SEQ ID NO: 879783 - DNA, 25 bp, Mus musculus
tggacgtactttaacctttgtctct

SEQ ID NO: 879784 - DNA, 25 bp, Mus musculus
tggacgtacttttacctttgtctct

SEQ ID NO: 879785 - DNA, 25 bp, Mus musculus
tggacgtatccaaagcaacagggct

SEQ ID NO: 879786 - DNA, 25 bp, Mus musculus
tggacgtatccatagcaacagggct

SEQ ID NO: 879787 - DNA, 25 bp, Mus musculus
tggacgtcagcgctacaggaacact

SEQ ID NO: 879788 - DNA, 25 bp, Mus musculus
tggacgtcagcggtacaggaacact

SEQ ID NO: 879789 - DNA, 25 bp, Mus musculus
tggacgtcctgtcctcggatggatc

SEQ ID NO: 879790 - DNA, 25 bp, Mus musculus
tggacgtcctgtgctcggatggatc

SEQ ID NO: 879791 - DNA, 25 bp, Mus musculus
tggacgtctacgatggatgaggcaa

SEQ ID NO: 879792 - DNA, 25 bp, Mus musculus
tggacgtctacgttggatgaggcaa

SEQ ID NO: 879793 - DNA, 25 bp, Mus musculus
tggacgtgcataacttctcggctga

SEQ ID NO: 879794 - DNA, 25 bp, Mus musculus
tggacgtgcatatcttctcggctga

SEQ ID NO: 879795 - DNA, 25 bp, Mus musculus
tggacgttcttgaggtcactcttaa

SEQ ID NO: 879796 - DNA, 25 bp, Mus musculus
tggacgttcttgctgatgcttctca

SEQ ID NO: 879797 - DNA, 25 bp, Mus musculus
tggacgttcttggtgatgcttctca

SEQ ID NO: 879798 - DNA, 25 bp, Mus musculus
tggacgttcttgtggtcactcttaa

SEQ ID NO: 879799 - DNA, 25 bp, Mus musculus
tggacgttgggactcgcacacgctt

SEQ ID NO: 879800 - DNA, 25 bp, Mus musculus
tggacgttgggagtcgcacacgctt

SEQ ID NO: 879801 - DNA, 25 bp, Mus musculus
tggacgttgtacagaggacatgact

SEQ ID NO: 879802 - DNA, 25 bp, Mus musculus
tggacgttgtactgaggacatgact

SEQ ID NO: 879803 - DNA, 25 bp, Mus musculus
tggacgtttctcatatgtgtggtgt

SEQ ID NO: 879804 - DNA, 25 bp, Mus musculus
tggacgtttctcttatgtgtggtgt

SEQ ID NO: 879805 - DNA, 25 bp, Mus musculus
tggactaaatttatgaactgaacgc

SEQ ID NO: 879806 - DNA, 25 bp, Mus musculus
tggactaaatttttgaactgaacgc

SEQ ID NO: 879807 - DNA, 25 bp, Mus musculus
tggactaacataccatgcaactggg

SEQ ID NO: 879808 - DNA, 25 bp, Mus musculus
tggactaacatagcatgcaactggg

SEQ ID NO: 879809 - DNA, 25 bp, Mus musculus
tggactaaccaaagatgtgcatgtt

SEQ ID NO: 879810 - DNA, 25 bp, Mus musculus
tggactaaccaatgatgtgcatgtt

SEQ ID NO: 879811 - DNA, 25 bp, Mus musculus
tggactaacctcagagaccaaaagt

SEQ ID NO: 879812 - DNA, 25 bp, Mus musculus
tggactaacctctgagaccaaaagt

SEQ ID NO: 879813 - DNA, 25 bp, Mus musculus
tggactaactcaagacataaggctc

SEQ ID NO: 879814 - DNA, 25 bp, Mus musculus
tggactaactcatgacataaggctc

SEQ ID NO: 879815 - DNA, 25 bp, Mus musculus
tggactaagcgaccttgaatggatt

SEQ ID NO: 879816 - DNA, 25 bp, Mus musculus
tggactaagcgagcttgaatggatt

SEQ ID NO: 879817 - DNA, 25 bp, Mus musculus
tggactacaagaacgacctcctggc

SEQ ID NO: 879818 - DNA, 25 bp, Mus musculus
tggactacaagatcgacctcctggc

SEQ ID NO: 879819 - DNA, 25 bp, Mus musculus
tggactacacagatctctcttctaa

SEQ ID NO: 879820 - DNA, 25 bp, Mus musculus
tggactacacagttctctcttctaa

SEQ ID NO: 879821 - DNA, 25 bp, Mus musculus
tggactacacttatacagagctgaa

SEQ ID NO: 879822 - DNA, 25 bp, Mus musculus
tggactacacttttacagagctgaa

SEQ ID NO: 879823 - DNA, 25 bp, Mus musculus
tggactacccttaggagtcggttat

SEQ ID NO: 879824 - DNA, 25 bp, Mus musculus
tggactacccttatactcagggatc

SEQ ID NO: 879825 - DNA, 25 bp, Mus musculus
tggactaccctttggagtcggttat

SEQ ID NO: 879826 - DNA, 25 bp, Mus musculus
tggactacccttttactcagggatc

SEQ ID NO: 879827 - DNA, 25 bp, Mus musculus
tggactacgtgaagtgtccgcctct

SEQ ID NO: 879828 - DNA, 25 bp, Mus musculus
tggactacgtgatgtgtccgcctct

SEQ ID NO: 879829 - DNA, 25 bp, Mus musculus
tggactacttcaacagacacgcggt

SEQ ID NO: 879830 - DNA, 25 bp, Mus musculus
tggactacttcatcagacacgcggt

SEQ ID NO: 879831 - DNA, 25 bp, Mus musculus
tggactacttccagtgaatgcaccc

SEQ ID NO: 879832 - DNA, 25 bp, Mus musculus
tggactacttcctgtgaatgcaccc

SEQ ID NO: 879833 - DNA, 25 bp, Mus musculus
tggactagaaacagcatctcatttt

SEQ ID NO: 879834 - DNA, 25 bp, Mus musculus
tggactagaaactgcatctcatttt

SEQ ID NO: 879835 - DNA, 25 bp, Mus musculus
tggactagaagcagaaacactgaac

SEQ ID NO: 879836 - DNA, 25 bp, Mus musculus
tggactagaagctgaaacactgaac

SEQ ID NO: 879837 - DNA, 25 bp, Mus musculus
tggactagacagagagttacaggac

SEQ ID NO: 879838 - DNA, 25 bp, Mus musculus
tggactagacagtgagttacaggac

SEQ ID NO: 879839 - DNA, 25 bp, Mus musculus
tggactagagctccgaagtgccaag

SEQ ID NO: 879840 - DNA, 25 bp, Mus musculus
tggactagagctgcgaagtgccaag

SEQ ID NO: 879841 - DNA, 25 bp, Mus musculus
tggactagatgtacctacacaggct

SEQ ID NO: 879842 - DNA, 25 bp, Mus musculus
tggactagatgttcctacacaggct

SEQ ID NO: 879843 - DNA, 25 bp, Mus musculus
tggactagcacccagcactgagaac

SEQ ID NO: 879844 - DNA, 25 bp, Mus musculus
tggactagcaccgagcactgagaac

SEQ ID NO: 879845 - DNA, 25 bp, Mus musculus
tggactagccctatacatacagatg

SEQ ID NO: 879846 - DNA, 25 bp, Mus musculus
tggactagccctttacatacagatg

SEQ ID NO: 879847 - DNA, 25 bp, Mus musculus
tggactaggtcccagaaaccatccg

SEQ ID NO: 879848 - DNA, 25 bp, Mus musculus
tggactaggtccgagaaaccatccg

SEQ ID NO: 879849 - DNA, 25 bp, Mus musculus
tggactagtgacatgctctgcagat

SEQ ID NO: 879850 - DNA, 25 bp, Mus musculus
tggactagtgacttgctctgcagat

SEQ ID NO: 879851 - DNA, 25 bp, Mus musculus
tggactagttaccttttctggccat

SEQ ID NO: 879852 - DNA, 25 bp, Mus musculus
tggactagttacgttttctggccat

SEQ ID NO: 879853 - DNA, 25 bp, Mus musculus
tggactataatcatgcacttttgag

SEQ ID NO: 879854 - DNA, 25 bp, Mus musculus
tggactataatcttgcacttttgag

SEQ ID NO: 879855 - DNA, 25 bp, Mus musculus
tggactataatgatcagcccctgta

SEQ ID NO: 879856 - DNA, 25 bp, Mus musculus
tggactataatgttcagcccctgta

SEQ ID NO: 879857 - DNA, 25 bp, Mus musculus
tggactatataaccagaacctgtat

SEQ ID NO: 879858 - DNA, 25 bp, Mus musculus
tggactatataagcagaacctgtat

SEQ ID NO: 879859 - DNA, 25 bp, Mus musculus
tggactatatcccaagcctccatga

SEQ ID NO: 879860 - DNA, 25 bp, Mus musculus
tggactatatccgaagcctccatga

SEQ ID NO: 879861 - DNA, 25 bp, Mus musculus
tggactatcccaccgatgaagacct

SEQ ID NO: 879862 - DNA, 25 bp, Mus musculus
tggactatcccagcgatgaagacct

SEQ ID NO: 879863 - DNA, 25 bp, Mus musculus
tggactatcctaaaggctgccacag

SEQ ID NO: 879864 - DNA, 25 bp, Mus musculus
tggactatcctataggctgccacag

SEQ ID NO: 879865 - DNA, 25 bp, Mus musculus
tggactatcttcattactccacttc

SEQ ID NO: 879866 - DNA, 25 bp, Mus musculus
tggactatcttctttactccacttc

SEQ ID NO: 879867 - DNA, 25 bp, Mus musculus
tggactatgaagacgccatgtagaa

SEQ ID NO: 879868 - DNA, 25 bp, Mus musculus
tggactatgaagtcgccatgtagaa

SEQ ID NO: 879869 - DNA, 25 bp, Mus musculus
tggactatgtcacatgtcactcagt

SEQ ID NO: 879870 - DNA, 25 bp, Mus musculus
tggactatgtcagatgtcactcagt

SEQ ID NO: 879871 - DNA, 25 bp, Mus musculus
tggactatgttcaagctctatgaat

SEQ ID NO: 879872 - DNA, 25 bp, Mus musculus
tggactatgttctagctctatgaat

SEQ ID NO: 879873 - DNA, 25 bp, Mus musculus
tggactcaaggtcgcagttctgctc

SEQ ID NO: 879874 - DNA, 25 bp, Mus musculus
tggactcaaggtggcagttctgctc

SEQ ID NO: 879875 - DNA, 25 bp, Mus musculus
tggactcaagttataccccagggct

SEQ ID NO: 879876 - DNA, 25 bp, Mus musculus
tggactcaagttttaccccagggct

SEQ ID NO: 879877 - DNA, 25 bp, Mus musculus
tggactcaccatagtgttggaaatc

SEQ ID NO: 879878 - DNA, 25 bp, Mus musculus
tggactcaccattgtgttggaaatc

SEQ ID NO: 879879 - DNA, 25 bp, Mus musculus
tggactcacctacctgcaagaacca

SEQ ID NO: 879880 - DNA, 25 bp, Mus musculus
tggactcacctagctgcaagaacca

SEQ ID NO: 879881 - DNA, 25 bp, Mus musculus
tggactcagaacacactggcttcaa

SEQ ID NO: 879882 - DNA, 25 bp, Mus musculus
tggactcagaactcactggcttcaa

SEQ ID NO: 879883 - DNA, 25 bp, Mus musculus
tggactcagcacattgccttcaact

SEQ ID NO: 879884 - DNA, 25 bp, Mus musculus
tggactcagcactttgccttcaact

SEQ ID NO: 879885 - DNA, 25 bp, Mus musculus
tggactcagccacaaactactacag

SEQ ID NO: 879886 - DNA, 25 bp, Mus musculus
tggactcagccagaaactactacag

SEQ ID NO: 879887 - DNA, 25 bp, Mus musculus
tggactcagtggcttgtatttataa

SEQ ID NO: 879888 - DNA, 25 bp, Mus musculus
tggactcagtgggttgtatttataa

SEQ ID NO: 879889 - DNA, 25 bp, Mus musculus
tggactcatagaattctgcctgcct

SEQ ID NO: 879890 - DNA, 25 bp, Mus musculus
tggactcatagatttctgcctgcct

SEQ ID NO: 879891 - DNA, 25 bp, Mus musculus
tggactcatcaaactctatgttacc

SEQ ID NO: 879892 - DNA, 25 bp, Mus musculus
tggactcatcaatctctatgttacc

SEQ ID NO: 879893 - DNA, 25 bp, Mus musculus
tggactcatggcaatactcctgacc

SEQ ID NO: 879894 - DNA, 25 bp, Mus musculus
tggactcatggctatactcctgacc

SEQ ID NO: 879895 - DNA, 25 bp, Mus musculus
tggactcatttcatcgaaccatgta

SEQ ID NO: 879896 - DNA, 25 bp, Mus musculus
tggactcatttcttcgaaccatgta

SEQ ID NO: 879897 - DNA, 25 bp, Mus musculus
tggactccaaacctactcagccatg

SEQ ID NO: 879898 - DNA, 25 bp, Mus musculus
tggactccaaacgtactcagccatg

SEQ ID NO: 879899 - DNA, 25 bp, Mus musculus
tggactccaagcacgtgttcccagt

SEQ ID NO: 879900 - DNA, 25 bp, Mus musculus
tggactccaagctcgtgttcccagt

SEQ ID NO: 879901 - DNA, 25 bp, Mus musculus
tggactccaaggaggttcagacaag

SEQ ID NO: 879902 - DNA, 25 bp, Mus musculus
tggactccaaggtggttcagacaag

SEQ ID NO: 879903 - DNA, 25 bp, Mus musculus
tggactccacctctcgaattatgga

SEQ ID NO: 879904 - DNA, 25 bp, Mus musculus
tggactccacctgtcgaattatgga

SEQ ID NO: 879905 - DNA, 25 bp, Mus musculus
tggactccactaatcctggttcttt

SEQ ID NO: 879906 - DNA, 25 bp, Mus musculus
tggactccactattcctggttcttt

SEQ ID NO: 879907 - DNA, 25 bp, Mus musculus
tggactccagacagcatgaaatgca

SEQ ID NO: 879908 - DNA, 25 bp, Mus musculus
tggactccagactgcatgaaatgca

SEQ ID NO: 879909 - DNA, 25 bp, Mus musculus
tggactccagagagactgttcctgc

SEQ ID NO: 879910 - DNA, 25 bp, Mus musculus
tggactccagagtgactgttcctgc

SEQ ID NO: 879911 - DNA, 25 bp, Mus musculus
tggactccagccaatctcccgagat

SEQ ID NO: 879912 - DNA, 25 bp, Mus musculus
tggactccagcctatctcccgagat

SEQ ID NO: 879913 - DNA, 25 bp, Mus musculus
tggactccaggcagcctagtgcctg

SEQ ID NO: 879914 - DNA, 25 bp, Mus musculus
tggactccaggcaggcttacaatga

SEQ ID NO: 879915 - DNA, 25 bp, Mus musculus
tggactccaggccatcatttgatga

SEQ ID NO: 879916 - DNA, 25 bp, Mus musculus
tggactccaggcgatcatttgatga

SEQ ID NO: 879917 - DNA, 25 bp, Mus musculus
tggactccaggctgcctagtgcctg

SEQ ID NO: 879918 - DNA, 25 bp, Mus musculus
tggactccaggctggcttacaatga

SEQ ID NO: 879919 - DNA, 25 bp, Mus musculus
tggactccagtcaggaaagcccctt

SEQ ID NO: 879920 - DNA, 25 bp, Mus musculus
tggactccagtctggaaagcccctt

SEQ ID NO: 879921 - DNA, 25 bp, Mus musculus
tggactccataccatcttgtcggag

SEQ ID NO: 879922 - DNA, 25 bp, Mus musculus
tggactccatacgatcttgtcggag

SEQ ID NO: 879923 - DNA, 25 bp, Mus musculus
tggactccattcaaatcattctgct

SEQ ID NO: 879924 - DNA, 25 bp, Mus musculus
tggactccattctaatcattctgct

SEQ ID NO: 879925 - DNA, 25 bp, Mus musculus
tggactcccacacattcctcagtga

SEQ ID NO: 879926 - DNA, 25 bp, Mus musculus
tggactcccacagattcctcagtga

SEQ ID NO: 879927 - DNA, 25 bp, Mus musculus
tggactcccgccatttaactggaat

SEQ ID NO: 879928 - DNA, 25 bp, Mus musculus
tggactcccgccttttaactggaat

SEQ ID NO: 879929 - DNA, 25 bp, Mus musculus
tggactccctagctgactcagacgg

SEQ ID NO: 879930 - DNA, 25 bp, Mus musculus
tggactccctaggtgactcagacgg

SEQ ID NO: 879931 - DNA, 25 bp, Mus musculus
tggactccctccaacagtttgtgtg

SEQ ID NO: 879932 - DNA, 25 bp, Mus musculus
tggactccctcctacagtttgtgtg

SEQ ID NO: 879933 - DNA, 25 bp, Mus musculus
tggactccctggaatatgacatccc

SEQ ID NO: 879934 - DNA, 25 bp, Mus musculus
tggactccctggtatatgacatccc

SEQ ID NO: 879935 - DNA, 25 bp, Mus musculus
tggactccctgtacctgaagaccct

SEQ ID NO: 879936 - DNA, 25 bp, Mus musculus
tggactccctgtagtgtttgccaga

SEQ ID NO: 879937 - DNA, 25 bp, Mus musculus
tggactccctgttcctgaagaccct

SEQ ID NO: 879938 - DNA, 25 bp, Mus musculus
tggactccctgttgtgtttgccaga

SEQ ID NO: 879939 - DNA, 25 bp, Mus musculus
tggactccgagtcaagctttagctt

SEQ ID NO: 879940 - DNA, 25 bp, Mus musculus
tggactccgagtgaagctttagctt

SEQ ID NO: 879941 - DNA, 25 bp, Mus musculus
tggactccggaacaaacgtgaggtt

SEQ ID NO: 879942 - DNA, 25 bp, Mus musculus
tggactccggaagaaacgtgaggtt

SEQ ID NO: 879943 - DNA, 25 bp, Mus musculus
tggactccgtccattgtaattctga

SEQ ID NO: 879944 - DNA, 25 bp, Mus musculus
tggactccgtcctttgtaattctga

SEQ ID NO: 879945 - DNA, 25 bp, Mus musculus
tggactcctaccatccgggaagaca

SEQ ID NO: 879946 - DNA, 25 bp, Mus musculus
tggactcctaccttccgggaagaca

SEQ ID NO: 879947 - DNA, 25 bp, Mus musculus
tggactcctcccacatgatgctgac

SEQ ID NO: 879948 - DNA, 25 bp, Mus musculus
tggactcctcccagtttgcctggga

SEQ ID NO: 879949 - DNA, 25 bp, Mus musculus
tggactcctccctcatgatgctgac

SEQ ID NO: 879950 - DNA, 25 bp, Mus musculus
tggactcctccctgtttgcctggga

SEQ ID NO: 879951 - DNA, 25 bp, Mus musculus
tggactcctctacaaccataagcca

SEQ ID NO: 879952 - DNA, 25 bp, Mus musculus
tggactcctctagaaccataagcca

SEQ ID NO: 879953 - DNA, 25 bp, Mus musculus
tggactcctgaaatgatctcgatgt

SEQ ID NO: 879954 - DNA, 25 bp, Mus musculus
tggactcctgaattgatctcgatgt

SEQ ID NO: 879955 - DNA, 25 bp, Mus musculus
tggactccttgcagagactgtttaa

SEQ ID NO: 879956 - DNA, 25 bp, Mus musculus
tggactccttgctgagactgtttaa

SEQ ID NO: 879957 - DNA, 25 bp, Mus musculus
tggactcgcccacctgtgttgacag

SEQ ID NO: 879958 - DNA, 25 bp, Mus musculus
tggactcgcccagctgtgttgacag

SEQ ID NO: 879959 - DNA, 25 bp, Mus musculus
tggactcgtcatacgtccctgtggg

SEQ ID NO: 879960 - DNA, 25 bp, Mus musculus
tggactcgtcattcgtccctgtggg

SEQ ID NO: 879961 - DNA, 25 bp, Mus musculus
tggactctaaaacccatctcagcat

SEQ ID NO: 879962 - DNA, 25 bp, Mus musculus
tggactctaaaagccatctcagcat

SEQ ID NO: 879963 - DNA, 25 bp, Mus musculus
tggactctaagcatcagacctgtgt

SEQ ID NO: 879964 - DNA, 25 bp, Mus musculus
tggactctaagcttcagacctgtgt

SEQ ID NO: 879965 - DNA, 25 bp, Mus musculus
tggactctaaggataactcagggaa

SEQ ID NO: 879966 - DNA, 25 bp, Mus musculus
tggactctaaggttaactcagggaa

SEQ ID NO: 879967 - DNA, 25 bp, Mus musculus
tggactctacacaatgagcagctca

SEQ ID NO: 879968 - DNA, 25 bp, Mus musculus
tggactctacactatgagcagctca

SEQ ID NO: 879969 - DNA, 25 bp, Mus musculus
tggactctcaagatctatgcccagt

SEQ ID NO: 879970 - DNA, 25 bp, Mus musculus
tggactctcaagttctatgcccagt

SEQ ID NO: 879971 - DNA, 25 bp, Mus musculus
tggactctcacaactgacagggtct

SEQ ID NO: 879972 - DNA, 25 bp, Mus musculus
tggactctcacatctgacagggtct

SEQ ID NO: 879973 - DNA, 25 bp, Mus musculus
tggactctcaccaaggctacatagt

SEQ ID NO: 879974 - DNA, 25 bp, Mus musculus
tggactctcacctaggctacatagt

SEQ ID NO: 879975 - DNA, 25 bp, Mus musculus
tggactctcagcactatctcttcaa

SEQ ID NO: 879976 - DNA, 25 bp, Mus musculus
tggactctcagctctatctcttcaa

SEQ ID NO: 879977 - DNA, 25 bp, Mus musculus
tggactctcctacggatgttgtgtt

SEQ ID NO: 879978 - DNA, 25 bp, Mus musculus
tggactctcctagggatgttgtgtt

SEQ ID NO: 879979 - DNA, 25 bp, Mus musculus
tggactctcctgagggacacaatct

SEQ ID NO: 879980 - DNA, 25 bp, Mus musculus
tggactctcctgtgggacacaatct

SEQ ID NO: 879981 - DNA, 25 bp, Mus musculus
tggactctccttcgcatgcatgtga

SEQ ID NO: 879982 - DNA, 25 bp, Mus musculus
tggactctccttggcatgcatgtga

SEQ ID NO: 879983 - DNA, 25 bp, Mus musculus
tggactctcgagaggcggacaattc

SEQ ID NO: 879984 - DNA, 25 bp, Mus musculus
tggactctcgagtggcggacaattc

SEQ ID NO: 879985 - DNA, 25 bp, Mus musculus
tggactctctctctacttcttggag

SEQ ID NO: 879986 - DNA, 25 bp, Mus musculus
tggactctctctgtacttcttggag

SEQ ID NO: 879987 - DNA, 25 bp, Mus musculus
tggactctgaatcccactcggagaa

SEQ ID NO: 879988 - DNA, 25 bp, Mus musculus
tggactctgaatgccactcggagaa

SEQ ID NO: 879989 - DNA, 25 bp, Mus musculus
tggactctgcgcaggcgttaggcaa

SEQ ID NO: 879990 - DNA, 25 bp, Mus musculus
tggactctgcgctggcgttaggcaa

SEQ ID NO: 879991 - DNA, 25 bp, Mus musculus
tggactctgtgaccgtgtccacaga

SEQ ID NO: 879992 - DNA, 25 bp, Mus musculus
tggactctgtgagcgtgtccacaga

SEQ ID NO: 879993 - DNA, 25 bp, Mus musculus
tggactctgtgtccgcactgcttat

SEQ ID NO: 879994 - DNA, 25 bp, Mus musculus
tggactctgtgtgcgcactgcttat

SEQ ID NO: 879995 - DNA, 25 bp, Mus musculus
tggactcttagaacagactttgtct

SEQ ID NO: 879996 - DNA, 25 bp, Mus musculus
tggactcttagatcagactttgtct

SEQ ID NO: 879997 - DNA, 25 bp, Mus musculus
tggactcttatgcactacaggcgaa

SEQ ID NO: 879998 - DNA, 25 bp, Mus musculus
tggactcttatggactacaggcgaa

SEQ ID NO: 879999 - DNA, 25 bp, Mus musculus
tggactcttcatctcaacttctact

SEQ ID NO: 880000 - DNA, 25 bp, Mus musculus
tggactcttcatgtcaacttctact

SEQ ID NO: 880001 - DNA, 25 bp, Mus musculus
tggactctttctagtgaaacccgac

SEQ ID NO: 880002 - DNA, 25 bp, Mus musculus
tggactctttcttgtgaaacccgac

SEQ ID NO: 880003 - DNA, 25 bp, Mus musculus
tggactgaactgattacctcagcag

SEQ ID NO: 880004 - DNA, 25 bp, Mus musculus
tggactgaactgtttacctcagcag

SEQ ID NO: 880005 - DNA, 25 bp, Mus musculus
tggactgaacttctggctaagaagc

SEQ ID NO: 880006 - DNA, 25 bp, Mus musculus
tggactgaacttgtggctaagaagc

SEQ ID NO: 880007 - DNA, 25 bp, Mus musculus
tggactgaagagctggtgaccacat

SEQ ID NO: 880008 - DNA, 25 bp, Mus musculus
tggactgaagaggtggtgaccacat

SEQ ID NO: 880009 - DNA, 25 bp, Mus musculus
tggactgaagctaacacacatacct

SEQ ID NO: 880010 - DNA, 25 bp, Mus musculus
tggactgaagcttacacacatacct

SEQ ID NO: 880011 - DNA, 25 bp, Mus musculus
tggactgaatccaatgtagaaacat

SEQ ID NO: 880012 - DNA, 25 bp, Mus musculus
tggactgaatccctgacacatctgt

SEQ ID NO: 880013 - DNA, 25 bp, Mus musculus
tggactgaatccgtgacacatctgt

SEQ ID NO: 880014 - DNA, 25 bp, Mus musculus
tggactgaatcctatgtagaaacat

SEQ ID NO: 880015 - DNA, 25 bp, Mus musculus
tggactgaatgccttctgcctgcaa

SEQ ID NO: 880016 - DNA, 25 bp, Mus musculus
tggactgaatgcgttctgcctgcaa

SEQ ID NO: 880017 - DNA, 25 bp, Mus musculus
tggactgaattcacctatccctgag

SEQ ID NO: 880018 - DNA, 25 bp, Mus musculus
tggactgaattctcctatccctgag

SEQ ID NO: 880019 - DNA, 25 bp, Mus musculus
tggactgacatcactggtaccaggg

SEQ ID NO: 880020 - DNA, 25 bp, Mus musculus
tggactgacatctctggtaccaggg

SEQ ID NO: 880021 - DNA, 25 bp, Mus musculus
tggactgaccatatctgctgggcat

SEQ ID NO: 880022 - DNA, 25 bp, Mus musculus
tggactgaccatttctgctgggcat

SEQ ID NO: 880023 - DNA, 25 bp, Mus musculus
tggactgacggtccctacttcataa

SEQ ID NO: 880024 - DNA, 25 bp, Mus musculus
tggactgacggtgcctacttcataa

SEQ ID NO: 880025 - DNA, 25 bp, Mus musculus
tggactgactctagccttgtgataa

SEQ ID NO: 880026 - DNA, 25 bp, Mus musculus
tggactgactcttgccttgtgataa

SEQ ID NO: 880027 - DNA, 25 bp, Mus musculus
tggactgagaaacccgattgccacg

SEQ ID NO: 880028 - DNA, 25 bp, Mus musculus
tggactgagaaagccgattgccacg

SEQ ID NO: 880029 - DNA, 25 bp, Mus musculus
tggactgagcagcttcttgttcttt

SEQ ID NO: 880030 - DNA, 25 bp, Mus musculus
tggactgagcaggttcttgttcttt

SEQ ID NO: 880031 - DNA, 25 bp, Mus musculus
tggactgagccgctatgctacagta

SEQ ID NO: 880032 - DNA, 25 bp, Mus musculus
tggactgagccggtatgctacagta

SEQ ID NO: 880033 - DNA, 25 bp, Mus musculus
tggactgaggtgctgcagatcaatc

SEQ ID NO: 880034 - DNA, 25 bp, Mus musculus
tggactgaggtggtgcagatcaatc

SEQ ID NO: 880035 - DNA, 25 bp, Mus musculus
tggactgcaaatagagtttctttct

SEQ ID NO: 880036 - DNA, 25 bp, Mus musculus
tggactgcaaattgagtttctttct

SEQ ID NO: 880037 - DNA, 25 bp, Mus musculus
tggactgcaagaaatggtagagctc

SEQ ID NO: 880038 - DNA, 25 bp, Mus musculus
tggactgcaagatatggtagagctc

SEQ ID NO: 880039 - DNA, 25 bp, Mus musculus
tggactgcacagatcatggaagctg

SEQ ID NO: 880040 - DNA, 25 bp, Mus musculus
tggactgcacagttcatggaagctg

SEQ ID NO: 880041 - DNA, 25 bp, Mus musculus
tggactgcagctccttggccttaga

SEQ ID NO: 880042 - DNA, 25 bp, Mus musculus
tggactgcagctgcttggccttaga

SEQ ID NO: 880043 - DNA, 25 bp, Mus musculus
tggactgcattaccagatcccttat

SEQ ID NO: 880044 - DNA, 25 bp, Mus musculus
tggactgcattagcagatcccttat

SEQ ID NO: 880045 - DNA, 25 bp, Mus musculus
tggactgcattgagagcagctgtct

SEQ ID NO: 880046 - DNA, 25 bp, Mus musculus
tggactgcattgtgagcagctgtct

SEQ ID NO: 880047 - DNA, 25 bp, Mus musculus
tggactgcccacatgctatggagag

SEQ ID NO: 880048 - DNA, 25 bp, Mus musculus
tggactgcccacttgctatggagag

SEQ ID NO: 880049 - DNA, 25 bp, Mus musculus
tggactgcccatacttagcatttaa

SEQ ID NO: 880050 - DNA, 25 bp, Mus musculus
tggactgcccattcttagcatttaa

SEQ ID NO: 880051 - DNA, 25 bp, Mus musculus
tggactgcctgcaggttgttcccat

SEQ ID NO: 880052 - DNA, 25 bp, Mus musculus
tggactgcctgcctaggtccttgca

SEQ ID NO: 880053 - DNA, 25 bp, Mus musculus
tggactgcctgcgtaggtccttgca

SEQ ID NO: 880054 - DNA, 25 bp, Mus musculus
tggactgcctgctggttgttcccat

SEQ ID NO: 880055 - DNA, 25 bp, Mus musculus
tggactgcgagtccacccagggttc

SEQ ID NO: 880056 - DNA, 25 bp, Mus musculus
tggactgcgagtgcacccagggttc

SEQ ID NO: 880057 - DNA, 25 bp, Mus musculus
tggactgcgcacattatttgctggt

SEQ ID NO: 880058 - DNA, 25 bp, Mus musculus
tggactgcgcactttatttgctggt

SEQ ID NO: 880059 - DNA, 25 bp, Mus musculus
tggactgcgcctaggacctgatgag

SEQ ID NO: 880060 - DNA, 25 bp, Mus musculus
tggactgcgccttggacctgatgag

SEQ ID NO: 880061 - DNA, 25 bp, Mus musculus
tggactgcgctacggctgcacagca

SEQ ID NO: 880062 - DNA, 25 bp, Mus musculus
tggactgcgctagggctgcacagca

SEQ ID NO: 880063 - DNA, 25 bp, Mus musculus
tggactgcgtggagcacacctctaa

SEQ ID NO: 880064 - DNA, 25 bp, Mus musculus
tggactgcgtggtgcacacctctaa

SEQ ID NO: 880065 - DNA, 25 bp, Mus musculus
tggactgctccaacaggtggcaaac

SEQ ID NO: 880066 - DNA, 25 bp, Mus musculus
tggactgctccatcaggtggcaaac

SEQ ID NO: 880067 - DNA, 25 bp, Mus musculus
tggactgctgcacccttgccctgag

SEQ ID NO: 880068 - DNA, 25 bp, Mus musculus
tggactgctgcagccttgccctgag

SEQ ID NO: 880069 - DNA, 25 bp, Mus musculus
tggactgctggaacagaccccggga

SEQ ID NO: 880070 - DNA, 25 bp, Mus musculus
tggactgctggatcagaccccggga

SEQ ID NO: 880071 - DNA, 25 bp, Mus musculus
tggactgcttcgctgtgggctccaa

SEQ ID NO: 880072 - DNA, 25 bp, Mus musculus
tggactgcttcggtgtgggctccaa

SEQ ID NO: 880073 - DNA, 25 bp, Mus musculus
tggactgcttggctggtctccatcg

SEQ ID NO: 880074 - DNA, 25 bp, Mus musculus
tggactgcttgggtggtctccatcg

SEQ ID NO: 880075 - DNA, 25 bp, Mus musculus
tggactgctttcactagcagttctt

SEQ ID NO: 880076 - DNA, 25 bp, Mus musculus
tggactgctttctctagcagttctt

SEQ ID NO: 880077 - DNA, 25 bp, Mus musculus
tggactgcttttatacctcattttc

SEQ ID NO: 880078 - DNA, 25 bp, Mus musculus
tggactgcttttttacctcattttc

SEQ ID NO: 880079 - DNA, 25 bp, Mus musculus
tggactggagacctggcagcttttg

SEQ ID NO: 880080 - DNA, 25 bp, Mus musculus
tggactggagacgtggcagcttttg

SEQ ID NO: 880081 - DNA, 25 bp, Mus musculus
tggactggagagctgacacagtggt

SEQ ID NO: 880082 - DNA, 25 bp, Mus musculus
tggactggagaggtgacacagtggt

SEQ ID NO: 880083 - DNA, 25 bp, Mus musculus
tggactggagcccagttactgtttg

SEQ ID NO: 880084 - DNA, 25 bp, Mus musculus
tggactggagccgagttactgtttg

SEQ ID NO: 880085 - DNA, 25 bp, Mus musculus
tggactggagttccttcaaaaggtt

SEQ ID NO: 880086 - DNA, 25 bp, Mus musculus
tggactggagttgcttcaaaaggtt

SEQ ID NO: 880087 - DNA, 25 bp, Mus musculus
tggactggatccacaggccttgaag

SEQ ID NO: 880088 - DNA, 25 bp, Mus musculus
tggactggatcctcaggccttgaag

SEQ ID NO: 880089 - DNA, 25 bp, Mus musculus
tggactggccacagcaaagacaaaa

SEQ ID NO: 880090 - DNA, 25 bp, Mus musculus
tggactggccacctgaatgcttagt

SEQ ID NO: 880091 - DNA, 25 bp, Mus musculus
tggactggccacgtgaatgcttagt

SEQ ID NO: 880092 - DNA, 25 bp, Mus musculus
tggactggccactgcaaagacaaaa

SEQ ID NO: 880093 - DNA, 25 bp, Mus musculus
tggactggctgaagttggatttata

SEQ ID NO: 880094 - DNA, 25 bp, Mus musculus
tggactggctgatgttggatttata

SEQ ID NO: 880095 - DNA, 25 bp, Mus musculus
tggactgggaaacttcactttgtag

SEQ ID NO: 880096 - DNA, 25 bp, Mus musculus
tggactgggaaagttcactttgtag

SEQ ID NO: 880097 - DNA, 25 bp, Mus musculus
tggactgggccaaacctaagggtga

SEQ ID NO: 880098 - DNA, 25 bp, Mus musculus
tggactgggccacgtgcctgtccca

SEQ ID NO: 880099 - DNA, 25 bp, Mus musculus
tggactgggccaggtgcctgtccca

SEQ ID NO: 880100 - DNA, 25 bp, Mus musculus
tggactgggccatacctaagggtga

SEQ ID NO: 880101 - DNA, 25 bp, Mus musculus
tggactgtaaccatatctctggaaa

SEQ ID NO: 880102 - DNA, 25 bp, Mus musculus
tggactgtaaccttatctctggaaa

SEQ ID NO: 880103 - DNA, 25 bp, Mus musculus
tggactgtaagtaagagccccttaa

SEQ ID NO: 880104 - DNA, 25 bp, Mus musculus
tggactgtaagtagcagagcaagcc

SEQ ID NO: 880105 - DNA, 25 bp, Mus musculus
tggactgtaagttagagccccttaa

SEQ ID NO: 880106 - DNA, 25 bp, Mus musculus
tggactgtaagttgcagagcaagcc

SEQ ID NO: 880107 - DNA, 25 bp, Mus musculus
tggactgtacaactctctgctttct

SEQ ID NO: 880108 - DNA, 25 bp, Mus musculus
tggactgtacaagtctctgctttct

SEQ ID NO: 880109 - DNA, 25 bp, Mus musculus
tggactgtactgagtgacagacgat

SEQ ID NO: 880110 - DNA, 25 bp, Mus musculus
tggactgtactgtgtgacagacgat

SEQ ID NO: 880111 - DNA, 25 bp, Mus musculus
tggactgtagacaccctttaactct

SEQ ID NO: 880112 - DNA, 25 bp, Mus musculus
tggactgtagactccctttaactct

SEQ ID NO: 880113 - DNA, 25 bp, Mus musculus
tggactgtagtcagagctctccaga

SEQ ID NO: 880114 - DNA, 25 bp, Mus musculus
tggactgtagtctgagctctccaga

SEQ ID NO: 880115 - DNA, 25 bp, Mus musculus
tggactgtattaagtgcgcttgaat

SEQ ID NO: 880116 - DNA, 25 bp, Mus musculus
tggactgtattatgtgcgcttgaat

SEQ ID NO: 880117 - DNA, 25 bp, Mus musculus
tggactgtcaccagtgaacgctttc

SEQ ID NO: 880118 - DNA, 25 bp, Mus musculus
tggactgtcacctgtgaacgctttc

SEQ ID NO: 880119 - DNA, 25 bp, Mus musculus
tggactgtcactatcctgaggatga

SEQ ID NO: 880120 - DNA, 25 bp, Mus musculus
tggactgtcactcgcagcccctgga

SEQ ID NO: 880121 - DNA, 25 bp, Mus musculus
tggactgtcactggcagcccctgga

SEQ ID NO: 880122 - DNA, 25 bp, Mus musculus
tggactgtcactttcctgaggatga

SEQ ID NO: 880123 - DNA, 25 bp, Mus musculus
tggactgtcagtctcaggcgctcag

SEQ ID NO: 880124 - DNA, 25 bp, Mus musculus
tggactgtcagtgtcaggcgctcag

SEQ ID NO: 880125 - DNA, 25 bp, Mus musculus
tggactgtccacaaagcgaactcca

SEQ ID NO: 880126 - DNA, 25 bp, Mus musculus
tggactgtccactaagcgaactcca

SEQ ID NO: 880127 - DNA, 25 bp, Mus musculus
tggactgtccctactttggaggtgc

SEQ ID NO: 880128 - DNA, 25 bp, Mus musculus
tggactgtcccttctttggaggtgc

SEQ ID NO: 880129 - DNA, 25 bp, Mus musculus
tggactgtctcactctgagtttctc

SEQ ID NO: 880130 - DNA, 25 bp, Mus musculus
tggactgtctcagtctgagtttctc

SEQ ID NO: 880131 - DNA, 25 bp, Mus musculus
tggactgtctttccctcatattaaa

SEQ ID NO: 880132 - DNA, 25 bp, Mus musculus
tggactgtctttgcctcatattaaa

SEQ ID NO: 880133 - DNA, 25 bp, Mus musculus
tggactgtgaaaccagtgcccatct

SEQ ID NO: 880134 - DNA, 25 bp, Mus musculus
tggactgtgaaagcagtgcccatct

SEQ ID NO: 880135 - DNA, 25 bp, Mus musculus
tggactgtgaccaaatactgaggct

SEQ ID NO: 880136 - DNA, 25 bp, Mus musculus
tggactgtgacctaatactgaggct

SEQ ID NO: 880137 - DNA, 25 bp, Mus musculus
tggactgtgcacactgagcggctgc

SEQ ID NO: 880138 - DNA, 25 bp, Mus musculus
tggactgtgcactctgagcggctgc

SEQ ID NO: 880139 - DNA, 25 bp, Mus musculus
tggactgtgccactatagtacacat

SEQ ID NO: 880140 - DNA, 25 bp, Mus musculus
tggactgtgccagtatagtacacat

SEQ ID NO: 880141 - DNA, 25 bp, Mus musculus
tggactgtgggacttcagcccagaa

SEQ ID NO: 880142 - DNA, 25 bp, Mus musculus
tggactgtgggagttcagcccagaa

SEQ ID NO: 880143 - DNA, 25 bp, Mus musculus
tggactgtgggtccctgactccaaa

SEQ ID NO: 880144 - DNA, 25 bp, Mus musculus
tggactgtgggtgcctgactccaaa

SEQ ID NO: 880145 - DNA, 25 bp, Mus musculus
tggactgtggtcacataatgttgta

SEQ ID NO: 880146 - DNA, 25 bp, Mus musculus
tggactgtggtctcataatgttgta

SEQ ID NO: 880147 - DNA, 25 bp, Mus musculus
tggactgtgtgcacggccctgaatc

SEQ ID NO: 880148 - DNA, 25 bp, Mus musculus
tggactgtgtgctcggccctgaatc

SEQ ID NO: 880149 - DNA, 25 bp, Mus musculus
tggactgttaatcacctactggctc

SEQ ID NO: 880150 - DNA, 25 bp, Mus musculus
tggactgttaatgacctactggctc

SEQ ID NO: 880151 - DNA, 25 bp, Mus musculus
tggactgttacaagcactttcttgg

SEQ ID NO: 880152 - DNA, 25 bp, Mus musculus
tggactgttacatgcactttcttgg

SEQ ID NO: 880153 - DNA, 25 bp, Mus musculus
tggactgttacccaaggcctgatag

SEQ ID NO: 880154 - DNA, 25 bp, Mus musculus
tggactgttaccgaaggcctgatag

SEQ ID NO: 880155 - DNA, 25 bp, Mus musculus
tggactgttcatacctcgcttagga

SEQ ID NO: 880156 - DNA, 25 bp, Mus musculus
tggactgttcattcctcgcttagga

SEQ ID NO: 880157 - DNA, 25 bp, Mus musculus
tggactgttccaccgttttctgcat

SEQ ID NO: 880158 - DNA, 25 bp, Mus musculus
tggactgttccagcgttttctgcat

SEQ ID NO: 880159 - DNA, 25 bp, Mus musculus
tggactgttgaactcaccaaactgt

SEQ ID NO: 880160 - DNA, 25 bp, Mus musculus
tggactgttgaagtcaccaaactgt

SEQ ID NO: 880161 - DNA, 25 bp, Mus musculus
tggactgtttaaactgcactcactg

SEQ ID NO: 880162 - DNA, 25 bp, Mus musculus
tggactgtttaatctgcactcactg

SEQ ID NO: 880163 - DNA, 25 bp, Mus musculus
tggacttaaagtagggccccgccat

SEQ ID NO: 880164 - DNA, 25 bp, Mus musculus
tggacttaaagttgggccccgccat

SEQ ID NO: 880165 - DNA, 25 bp, Mus musculus
tggacttaaatgatttatggtaaca

SEQ ID NO: 880166 - DNA, 25 bp, Mus musculus
tggacttaaatgttttatggtaaca

SEQ ID NO: 880167 - DNA, 25 bp, Mus musculus
tggacttaacgaatcctgtctccaa

SEQ ID NO: 880168 - DNA, 25 bp, Mus musculus
tggacttaacgattcctgtctccaa

SEQ ID NO: 880169 - DNA, 25 bp, Mus musculus
tggacttaagctacccaaggagccc

SEQ ID NO: 880170 - DNA, 25 bp, Mus musculus
tggacttaagcttcccaaggagccc

SEQ ID NO: 880171 - DNA, 25 bp, Mus musculus
tggacttagccaacagctgctatgt

SEQ ID NO: 880172 - DNA, 25 bp, Mus musculus
tggacttagccatcagctgctatgt

SEQ ID NO: 880173 - DNA, 25 bp, Mus musculus
tggacttaggctcgactgtgacacc

SEQ ID NO: 880174 - DNA, 25 bp, Mus musculus
tggacttaggctggactgtgacacc

SEQ ID NO: 880175 - DNA, 25 bp, Mus musculus
tggacttaggtgacaagttccggtt

SEQ ID NO: 880176 - DNA, 25 bp, Mus musculus
tggacttaggtgtcaagttccggtt

SEQ ID NO: 880177 - DNA, 25 bp, Mus musculus
tggacttagttcaggtactctcgaa

SEQ ID NO: 880178 - DNA, 25 bp, Mus musculus
tggacttagttctggtactctcgaa

SEQ ID NO: 880179 - DNA, 25 bp, Mus musculus
tggacttattaaaacacttgtgact

SEQ ID NO: 880180 - DNA, 25 bp, Mus musculus
tggacttattaatacacttgtgact

SEQ ID NO: 880181 - DNA, 25 bp, Mus musculus
tggacttattgacccagcaatgcta

SEQ ID NO: 880182 - DNA, 25 bp, Mus musculus
tggacttattgagccagcaatgcta

SEQ ID NO: 880183 - DNA, 25 bp, Mus musculus
tggacttcaccaccggcagaaagct

SEQ ID NO: 880184 - DNA, 25 bp, Mus musculus
tggacttcaccagcggcagaaagct

SEQ ID NO: 880185 - DNA, 25 bp, Mus musculus
tggacttcaccgatactctgacaag

SEQ ID NO: 880186 - DNA, 25 bp, Mus musculus
tggacttcaccgttactctgacaag

SEQ ID NO: 880187 - DNA, 25 bp, Mus musculus
tggacttcaggccagtctacttaat

SEQ ID NO: 880188 - DNA, 25 bp, Mus musculus
tggacttcaggcgagtctacttaat

SEQ ID NO: 880189 - DNA, 25 bp, Mus musculus
tggacttcatcaagagccacgggaa

SEQ ID NO: 880190 - DNA, 25 bp, Mus musculus
tggacttcatcacccatcaggaccg

SEQ ID NO: 880191 - DNA, 25 bp, Mus musculus
tggacttcatcactggccatgggaa

SEQ ID NO: 880192 - DNA, 25 bp, Mus musculus
tggacttcatcagccatcaggaccg

SEQ ID NO: 880193 - DNA, 25 bp, Mus musculus
tggacttcatcagtggccatgggaa

SEQ ID NO: 880194 - DNA, 25 bp, Mus musculus
tggacttcatcatgagccacgggaa

SEQ ID NO: 880195 - DNA, 25 bp, Mus musculus
tggacttcattcactcagtgttgtt

SEQ ID NO: 880196 - DNA, 25 bp, Mus musculus
tggacttcattctctcagtgttgtt

SEQ ID NO: 880197 - DNA, 25 bp, Mus musculus
tggacttccaccatgatggcatcag

SEQ ID NO: 880198 - DNA, 25 bp, Mus musculus
tggacttccaccctggcgagtaaca

SEQ ID NO: 880199 - DNA, 25 bp, Mus musculus
tggacttccaccgtggcgagtaaca

SEQ ID NO: 880200 - DNA, 25 bp, Mus musculus
tggacttccaccttgatggcatcag

SEQ ID NO: 880201 - DNA, 25 bp, Mus musculus
tggacttccagaccatacagaacaa

SEQ ID NO: 880202 - DNA, 25 bp, Mus musculus
tggacttccagagcatacagaacaa

SEQ ID NO: 880203 - DNA, 25 bp, Mus musculus
tggacttcccaacctgaccctaagg

SEQ ID NO: 880204 - DNA, 25 bp, Mus musculus
tggacttcccaagctgaccctaagg

SEQ ID NO: 880205 - DNA, 25 bp, Mus musculus
tggacttcccacacatgtatgtaaa

SEQ ID NO: 880206 - DNA, 25 bp, Mus musculus
tggacttcccactcatgtatgtaaa

SEQ ID NO: 880207 - DNA, 25 bp, Mus musculus
tggacttcccttacagatcaagcta

SEQ ID NO: 880208 - DNA, 25 bp, Mus musculus
tggacttcccttccagttgatttca

SEQ ID NO: 880209 - DNA, 25 bp, Mus musculus
tggacttcccttcttaagcacattc

SEQ ID NO: 880210 - DNA, 25 bp, Mus musculus
tggacttcccttgcagttgatttca

SEQ ID NO: 880211 - DNA, 25 bp, Mus musculus
tggacttcccttgttaagcacattc

SEQ ID NO: 880212 - DNA, 25 bp, Mus musculus
tggacttccctttcagatcaagcta

SEQ ID NO: 880213 - DNA, 25 bp, Mus musculus
tggacttccgaacgctggctacagc

SEQ ID NO: 880214 - DNA, 25 bp, Mus musculus
tggacttccgaaggctggctacagc

SEQ ID NO: 880215 - DNA, 25 bp, Mus musculus
tggacttccgagaccttcctaggaa

SEQ ID NO: 880216 - DNA, 25 bp, Mus musculus
tggacttccgagtccttcctaggaa

SEQ ID NO: 880217 - DNA, 25 bp, Mus musculus
tggacttcctcaagatcttgctgtg

SEQ ID NO: 880218 - DNA, 25 bp, Mus musculus
tggacttcctcatgatcttgctgtg

SEQ ID NO: 880219 - DNA, 25 bp, Mus musculus
tggacttcctccaaaatatacaagt

SEQ ID NO: 880220 - DNA, 25 bp, Mus musculus
tggacttcctcctaaatatacaagt

SEQ ID NO: 880221 - DNA, 25 bp, Mus musculus
tggacttcctctcctacttgtgata

SEQ ID NO: 880222 - DNA, 25 bp, Mus musculus
tggacttcctctgctacttgtgata

SEQ ID NO: 880223 - DNA, 25 bp, Mus musculus
tggacttcctgaaattgttgataca

SEQ ID NO: 880224 - DNA, 25 bp, Mus musculus
tggacttcctgatattgttgataca

SEQ ID NO: 880225 - DNA, 25 bp, Mus musculus
tggacttcctggcaaatcctagtaa

SEQ ID NO: 880226 - DNA, 25 bp, Mus musculus
tggacttcctgggaaatcctagtaa

SEQ ID NO: 880227 - DNA, 25 bp, Mus musculus
tggacttcctgtaagctctaggtat

SEQ ID NO: 880228 - DNA, 25 bp, Mus musculus
tggacttcctgtctcgctaagcctg

SEQ ID NO: 880229 - DNA, 25 bp, Mus musculus
tggacttcctgtgtcgctaagcctg

SEQ ID NO: 880230 - DNA, 25 bp, Mus musculus
tggacttcctgttagctctaggtat

SEQ ID NO: 880231 - DNA, 25 bp, Mus musculus
tggacttccttcagcgtgccctaca

SEQ ID NO: 880232 - DNA, 25 bp, Mus musculus
tggacttccttctgcgtgccctaca

SEQ ID NO: 880233 - DNA, 25 bp, Mus musculus
tggacttcgagaagttcctgcccat

SEQ ID NO: 880234 - DNA, 25 bp, Mus musculus
tggacttcgagatgttcctgcccat

SEQ ID NO: 880235 - DNA, 25 bp, Mus musculus
tggacttcgagtagaaagcctgaca

SEQ ID NO: 880236 - DNA, 25 bp, Mus musculus
tggacttcgagttgaaagcctgaca

SEQ ID NO: 880237 - DNA, 25 bp, Mus musculus
tggacttcgcccctgctgatagtca

SEQ ID NO: 880238 - DNA, 25 bp, Mus musculus
tggacttcgcccgtgctgatagtca

SEQ ID NO: 880239 - DNA, 25 bp, Mus musculus
tggacttctagactgcacacgtgat

SEQ ID NO: 880240 - DNA, 25 bp, Mus musculus
tggacttctagacttccctcctgtg

SEQ ID NO: 880241 - DNA, 25 bp, Mus musculus
tggacttctagagtgcacacgtgat

SEQ ID NO: 880242 - DNA, 25 bp, Mus musculus
tggacttctagagttccctcctgtg

SEQ ID NO: 880243 - DNA, 25 bp, Mus musculus
tggacttctcatcgtttttgcagtg

SEQ ID NO: 880244 - DNA, 25 bp, Mus musculus
tggacttctcatggtttttgcagtg

SEQ ID NO: 880245 - DNA, 25 bp, Mus musculus
tggacttctccaacaggatatgaaa

SEQ ID NO: 880246 - DNA, 25 bp, Mus musculus
tggacttctccatcaggatatgaaa

SEQ ID NO: 880247 - DNA, 25 bp, Mus musculus
tggacttctgctcatcaagtgccaa

SEQ ID NO: 880248 - DNA, 25 bp, Mus musculus
tggacttctgctgatcaagtgccaa

SEQ ID NO: 880249 - DNA, 25 bp, Mus musculus
tggacttgaaaacctcgagctttca

SEQ ID NO: 880250 - DNA, 25 bp, Mus musculus
tggacttgaaaagctcgagctttca

SEQ ID NO: 880251 - DNA, 25 bp, Mus musculus
tggacttgaactcatgcttttttct

SEQ ID NO: 880252 - DNA, 25 bp, Mus musculus
tggacttgaactgatgcttttttct

SEQ ID NO: 880253 - DNA, 25 bp, Mus musculus
tggacttgagttctaacccctgttt

SEQ ID NO: 880254 - DNA, 25 bp, Mus musculus
tggacttgagttgtaacccctgttt

SEQ ID NO: 880255 - DNA, 25 bp, Mus musculus
tggacttgattactccttgggacaa

SEQ ID NO: 880256 - DNA, 25 bp, Mus musculus
tggacttgattagtccttgggacaa

SEQ ID NO: 880257 - DNA, 25 bp, Mus musculus
tggacttgcatccagaagacccttc

SEQ ID NO: 880258 - DNA, 25 bp, Mus musculus
tggacttgcatcgagaagacccttc

SEQ ID NO: 880259 - DNA, 25 bp, Mus musculus
tggacttgcccaagggtgacgtccc

SEQ ID NO: 880260 - DNA, 25 bp, Mus musculus
tggacttgcccactgtggaggccca

SEQ ID NO: 880261 - DNA, 25 bp, Mus musculus
tggacttgcccagtgtggaggccca

SEQ ID NO: 880262 - DNA, 25 bp, Mus musculus
tggacttgcccatgggtgacgtccc

SEQ ID NO: 880263 - DNA, 25 bp, Mus musculus
tggacttgcctgattagtcctcacc

SEQ ID NO: 880264 - DNA, 25 bp, Mus musculus
tggacttgcctgctggctacaaact

SEQ ID NO: 880265 - DNA, 25 bp, Mus musculus
tggacttgcctggtggctacaaact

SEQ ID NO: 880266 - DNA, 25 bp, Mus musculus
tggacttgcctgtttagtcctcacc

SEQ ID NO: 880267 - DNA, 25 bp, Mus musculus
tggacttgctgaagcctttgtacct

SEQ ID NO: 880268 - DNA, 25 bp, Mus musculus
tggacttgctgatgcctttgtacct

SEQ ID NO: 880269 - DNA, 25 bp, Mus musculus
tggacttgcttcacgcgctgcagga

SEQ ID NO: 880270 - DNA, 25 bp, Mus musculus
tggacttgcttctcgcgctgcagga

SEQ ID NO: 880271 - DNA, 25 bp, Mus musculus
tggacttggaggatcccaccctgga

SEQ ID NO: 880272 - DNA, 25 bp, Mus musculus
tggacttggaggttcccaccctgga

SEQ ID NO: 880273 - DNA, 25 bp, Mus musculus
tggacttggccaccctgtgaccatc

SEQ ID NO: 880274 - DNA, 25 bp, Mus musculus
tggacttggccagcctgtgaccatc

SEQ ID NO: 880275 - DNA, 25 bp, Mus musculus
tggacttggccgatgcgtgcaatac

SEQ ID NO: 880276 - DNA, 25 bp, Mus musculus
tggacttggccgttgcgtgcaatac

SEQ ID NO: 880277 - DNA, 25 bp, Mus musculus
tggacttgggtgaaaccgcggctta

SEQ ID NO: 880278 - DNA, 25 bp, Mus musculus
tggacttgggtgtaaccgcggctta

SEQ ID NO: 880279 - DNA, 25 bp, Mus musculus
tggacttgtccaaacaggtttttgt

SEQ ID NO: 880280 - DNA, 25 bp, Mus musculus
tggacttgtccatacaggtttttgt

SEQ ID NO: 880281 - DNA, 25 bp, Mus musculus
tggacttgtctaaagcaatcgtgct

SEQ ID NO: 880282 - DNA, 25 bp, Mus musculus
tggacttgtctatagcaatcgtgct

SEQ ID NO: 880283 - DNA, 25 bp, Mus musculus
tggacttgtgatcgctattcttggt

SEQ ID NO: 880284 - DNA, 25 bp, Mus musculus
tggacttgtgatggctattcttggt

SEQ ID NO: 880285 - DNA, 25 bp, Mus musculus
tggacttgttcactaacgtgccctt

SEQ ID NO: 880286 - DNA, 25 bp, Mus musculus
tggacttgttcagtaacgtgccctt

SEQ ID NO: 880287 - DNA, 25 bp, Mus musculus
tggactttacctacctctctttaag

SEQ ID NO: 880288 - DNA, 25 bp, Mus musculus
tggactttaccttcctctctttaag

SEQ ID NO: 880289 - DNA, 25 bp, Mus musculus
tggactttagcccaccagtttgtct

SEQ ID NO: 880290 - DNA, 25 bp, Mus musculus
tggactttagccgaccagtttgtct

SEQ ID NO: 880291 - DNA, 25 bp, Mus musculus
tggactttatggatctttttctagg

SEQ ID NO: 880292 - DNA, 25 bp, Mus musculus
tggactttatggttctttttctagg

SEQ ID NO: 880293 - DNA, 25 bp, Mus musculus
tggactttcaacctcaactttcaac

SEQ ID NO: 880294 - DNA, 25 bp, Mus musculus
tggactttcaacgtcaactttcaac

SEQ ID NO: 880295 - DNA, 25 bp, Mus musculus
tggactttccacctgaacgaagaag

SEQ ID NO: 880296 - DNA, 25 bp, Mus musculus
tggactttccacgtgaacgaagaag

SEQ ID NO: 880297 - DNA, 25 bp, Mus musculus
tggactttccgaagctcagtttctt

SEQ ID NO: 880298 - DNA, 25 bp, Mus musculus
tggactttccgatgctcagtttctt

SEQ ID NO: 880299 - DNA, 25 bp, Mus musculus
tggactttccgcctgacagtcaaag

SEQ ID NO: 880300 - DNA, 25 bp, Mus musculus
tggactttccgcgtgacagtcaaag

SEQ ID NO: 880301 - DNA, 25 bp, Mus musculus
tggactttcctcacatgacaagaag

SEQ ID NO: 880302 - DNA, 25 bp, Mus musculus
tggactttcctctcatgacaagaag

SEQ ID NO: 880303 - DNA, 25 bp, Mus musculus
tggactttctcccatttatccaggt

SEQ ID NO: 880304 - DNA, 25 bp, Mus musculus
tggactttctccgatttatccaggt

SEQ ID NO: 880305 - DNA, 25 bp, Mus musculus
tggactttctcgaagagtcgaagac

SEQ ID NO: 880306 - DNA, 25 bp, Mus musculus
tggactttctcgtagagtcgaagac

SEQ ID NO: 880307 - DNA, 25 bp, Mus musculus
tggactttctgccattgcttatgca

SEQ ID NO: 880308 - DNA, 25 bp, Mus musculus
tggactttctgcctgcccttgggaa

SEQ ID NO: 880309 - DNA, 25 bp, Mus musculus
tggactttctgcgattgcttatgca

SEQ ID NO: 880310 - DNA, 25 bp, Mus musculus
tggactttctgcgtgcccttgggaa

SEQ ID NO: 880311 - DNA, 25 bp, Mus musculus
tggactttctggatatgctggactc

SEQ ID NO: 880312 - DNA, 25 bp, Mus musculus
tggactttctggttatgctggactc

SEQ ID NO: 880313 - DNA, 25 bp, Mus musculus
tggactttgaacaacccactcggga

SEQ ID NO: 880314 - DNA, 25 bp, Mus musculus
tggactttgaactacccactcggga

SEQ ID NO: 880315 - DNA, 25 bp, Mus musculus
tggactttgaagaccgccttcctag

SEQ ID NO: 880316 - DNA, 25 bp, Mus musculus
tggactttgaagtccgccttcctag

SEQ ID NO: 880317 - DNA, 25 bp, Mus musculus
tggactttgaccataaaaactcgag

SEQ ID NO: 880318 - DNA, 25 bp, Mus musculus
tggactttgaccttaaaaactcgag

SEQ ID NO: 880319 - DNA, 25 bp, Mus musculus
tggactttgagcacttcctgcccat

SEQ ID NO: 880320 - DNA, 25 bp, Mus musculus
tggactttgagctcttcctgcccat

SEQ ID NO: 880321 - DNA, 25 bp, Mus musculus
tggactttgccacacgagactacag

SEQ ID NO: 880322 - DNA, 25 bp, Mus musculus
tggactttgccagacgagactacag

SEQ ID NO: 880323 - DNA, 25 bp, Mus musculus
tggactttgcctcgtgccttctagg

SEQ ID NO: 880324 - DNA, 25 bp, Mus musculus
tggactttgcctggtgccttctagg

SEQ ID NO: 880325 - DNA, 25 bp, Mus musculus
tggactttgtctacagttccgcgga

SEQ ID NO: 880326 - DNA, 25 bp, Mus musculus
tggactttgtcttcagttccgcgga

SEQ ID NO: 880327 - DNA, 25 bp, Mus musculus
tggacttttacaaggcgcggcttca

SEQ ID NO: 880328 - DNA, 25 bp, Mus musculus
tggacttttacatggcgcggcttca

SEQ ID NO: 880329 - DNA, 25 bp, Mus musculus
tggacttttacgcttactccctctg

SEQ ID NO: 880330 - DNA, 25 bp, Mus musculus
tggacttttacggttactccctctg

SEQ ID NO: 880331 - DNA, 25 bp, Mus musculus
tggacttttccaacaacttttcctt

SEQ ID NO: 880332 - DNA, 25 bp, Mus musculus
tggacttttccaatccttcaggtaa

SEQ ID NO: 880333 - DNA, 25 bp, Mus musculus
tggacttttccatcaacttttcctt

SEQ ID NO: 880334 - DNA, 25 bp, Mus musculus
tggacttttccattccttcaggtaa

SEQ ID NO: 880335 - DNA, 25 bp, Mus musculus
tggacttttcccacttactgggctt

SEQ ID NO: 880336 - DNA, 25 bp, Mus musculus
tggacttttccctcttactgggctt

SEQ ID NO: 880337 - DNA, 25 bp, Mus musculus
tggacttttgctaaactattaatag

SEQ ID NO: 880338 - DNA, 25 bp, Mus musculus
tggacttttgcttaactattaatag

SEQ ID NO: 880339 - DNA, 25 bp, Mus musculus
tggactttttggcttctcctgggca

SEQ ID NO: 880340 - DNA, 25 bp, Mus musculus
tggactttttgggttctcctgggca

SEQ ID NO: 880341 - DNA, 25 bp, Mus musculus
tggagaaaacccctttgccaccgtg

SEQ ID NO: 880342 - DNA, 25 bp, Mus musculus
tggagaaaacccgtttgccaccgtg

SEQ ID NO: 880343 - DNA, 25 bp, Mus musculus
tggagaaaagccaaggtttccagaa

SEQ ID NO: 880344 - DNA, 25 bp, Mus musculus
tggagaaaagcctaggtttccagaa

SEQ ID NO: 880345 - DNA, 25 bp, Mus musculus
tggagaaaatcccttactctgccaa

SEQ ID NO: 880346 - DNA, 25 bp, Mus musculus
tggagaaaatccgttactctgccaa

SEQ ID NO: 880347 - DNA, 25 bp, Mus musculus
tggagaaacactcggactttgcctc

SEQ ID NO: 880348 - DNA, 25 bp, Mus musculus
tggagaaacactgggactttgcctc

SEQ ID NO: 880349 - DNA, 25 bp, Mus musculus
tggagaaacattcccagctgtaatg

SEQ ID NO: 880350 - DNA, 25 bp, Mus musculus
tggagaaacattgccagctgtaatg

SEQ ID NO: 880351 - DNA, 25 bp, Mus musculus
tggagaaaccagatacttcacttaa

SEQ ID NO: 880352 - DNA, 25 bp, Mus musculus
tggagaaaccagttacttcacttaa

SEQ ID NO: 880353 - DNA, 25 bp, Mus musculus
tggagaaacgccacatcactgcgac

SEQ ID NO: 880354 - DNA, 25 bp, Mus musculus
tggagaaacgcctcatcactgcgac

SEQ ID NO: 880355 - DNA, 25 bp, Mus musculus
tggagaaactttacagcccgagccg

SEQ ID NO: 880356 - DNA, 25 bp, Mus musculus
tggagaaacttttcagcccgagccg

SEQ ID NO: 880357 - DNA, 25 bp, Mus musculus
tggagaaagcgcaccggccccaaag

SEQ ID NO: 880358 - DNA, 25 bp, Mus musculus
tggagaaagcgctccggccccaaag

SEQ ID NO: 880359 - DNA, 25 bp, Mus musculus
tggagaaaggaaccccatccctcag

SEQ ID NO: 880360 - DNA, 25 bp, Mus musculus
tggagaaaggaagcccatccctcag

SEQ ID NO: 880361 - DNA, 25 bp, Mus musculus
tggagaaagtctatctgcataatcc

SEQ ID NO: 880362 - DNA, 25 bp, Mus musculus
tggagaaagtctttctgcataatcc

SEQ ID NO: 880363 - DNA, 25 bp, Mus musculus
tggagaaatattcaccggttaagag

SEQ ID NO: 880364 - DNA, 25 bp, Mus musculus
tggagaaatattgaccggttaagag

SEQ ID NO: 880365 - DNA, 25 bp, Mus musculus
tggagaaatgcgctttcagttgaat

SEQ ID NO: 880366 - DNA, 25 bp, Mus musculus
tggagaaatgcggtttcagttgaat

SEQ ID NO: 880367 - DNA, 25 bp, Mus musculus
tggagaacacacaatccggaactac

SEQ ID NO: 880368 - DNA, 25 bp, Mus musculus
tggagaacacactatccggaactac

SEQ ID NO: 880369 - DNA, 25 bp, Mus musculus
tggagaacaccactccttcaccagt

SEQ ID NO: 880370 - DNA, 25 bp, Mus musculus
tggagaacaccagtccttcaccagt

SEQ ID NO: 880371 - DNA, 25 bp, Mus musculus
tggagaaccagcaggctagccgaaa

SEQ ID NO: 880372 - DNA, 25 bp, Mus musculus
tggagaaccagctggctagccgaaa

SEQ ID NO: 880373 - DNA, 25 bp, Mus musculus
tggagaacccctcagaacaaaccgg

SEQ ID NO: 880374 - DNA, 25 bp, Mus musculus
tggagaacccctgagaacaaaccgg

SEQ ID NO: 880375 - DNA, 25 bp, Mus musculus
tggagaacccgcatctgtgccacag

SEQ ID NO: 880376 - DNA, 25 bp, Mus musculus
tggagaacccgcttctgtgccacag

SEQ ID NO: 880377 - DNA, 25 bp, Mus musculus
tggagaacctcaaggtccagcagct

SEQ ID NO: 880378 - DNA, 25 bp, Mus musculus
tggagaacctcatggtccagcagct

SEQ ID NO: 880379 - DNA, 25 bp, Mus musculus
tggagaacctctaccaggagacgaa

SEQ ID NO: 880380 - DNA, 25 bp, Mus musculus
tggagaacctcttccaggagacgaa

SEQ ID NO: 880381 - DNA, 25 bp, Mus musculus
tggagaacgaggctccagtcctcac

SEQ ID NO: 880382 - DNA, 25 bp, Mus musculus
tggagaacgagggtccagtcctcac

SEQ ID NO: 880383 - DNA, 25 bp, Mus musculus
tggagaacgtgaaccgcgacgccgt

SEQ ID NO: 880384 - DNA, 25 bp, Mus musculus
tggagaacgtgatccgcgacgccgt

SEQ ID NO: 880385 - DNA, 25 bp, Mus musculus
tggagaactcagacccaagggcgct

SEQ ID NO: 880386 - DNA, 25 bp, Mus musculus
tggagaactcagtcccaagggcgct

SEQ ID NO: 880387 - DNA, 25 bp, Mus musculus
tggagaactcttccaacagcccaag

SEQ ID NO: 880388 - DNA, 25 bp, Mus musculus
tggagaactcttgcaacagcccaag

SEQ ID NO: 880389 - DNA, 25 bp, Mus musculus
tggagaactgctacccattccgttt

SEQ ID NO: 880390 - DNA, 25 bp, Mus musculus
tggagaactgcttcccattccgttt

SEQ ID NO: 880391 - DNA, 25 bp, Mus musculus
tggagaactggtcccggaactcgca

SEQ ID NO: 880392 - DNA, 25 bp, Mus musculus
tggagaactggtgccggaactcgca

SEQ ID NO: 880393 - DNA, 25 bp, Mus musculus
tggagaagaagcatccgcccttgcc

SEQ ID NO: 880394 - DNA, 25 bp, Mus musculus
tggagaagaagcttccgcccttgcc

SEQ ID NO: 880395 - DNA, 25 bp, Mus musculus
tggagaagagaaaacctggttcctg

SEQ ID NO: 880396 - DNA, 25 bp, Mus musculus
tggagaagagaatacctggttcctg

SEQ ID NO: 880397 - DNA, 25 bp, Mus musculus
tggagaagagatcccagaccctctt

SEQ ID NO: 880398 - DNA, 25 bp, Mus musculus
tggagaagagatgccagaccctctt

SEQ ID NO: 880399 - DNA, 25 bp, Mus musculus
tggagaagagcccagtcctaattct

SEQ ID NO: 880400 - DNA, 25 bp, Mus musculus
tggagaagagccgagtcctaattct

SEQ ID NO: 880401 - DNA, 25 bp, Mus musculus
tggagaagatctctaacccagtctt

SEQ ID NO: 880402 - DNA, 25 bp, Mus musculus
tggagaagatctgtaacccagtctt

SEQ ID NO: 880403 - DNA, 25 bp, Mus musculus
tggagaagattgctgcattcctgca

SEQ ID NO: 880404 - DNA, 25 bp, Mus musculus
tggagaagattggtgcattcctgca

SEQ ID NO: 880405 - DNA, 25 bp, Mus musculus
tggagaagcaccagtccctaaacac

SEQ ID NO: 880406 - DNA, 25 bp, Mus musculus
tggagaagcacctgtccctaaacac

SEQ ID NO: 880407 - DNA, 25 bp, Mus musculus
tggagaagcccaacctcagagggat

SEQ ID NO: 880408 - DNA, 25 bp, Mus musculus
tggagaagcccacaaatcgcactgg

SEQ ID NO: 880409 - DNA, 25 bp, Mus musculus
tggagaagcccagaaatcgcactgg

SEQ ID NO: 880410 - DNA, 25 bp, Mus musculus
tggagaagcccatcctcagagggat

SEQ ID NO: 880411 - DNA, 25 bp, Mus musculus
tggagaagccccaatcctggatggt

SEQ ID NO: 880412 - DNA, 25 bp, Mus musculus
tggagaagccccagcgtacattgat

SEQ ID NO: 880413 - DNA, 25 bp, Mus musculus
tggagaagcccctatcctggatggt

SEQ ID NO: 880414 - DNA, 25 bp, Mus musculus
tggagaagcccctgcgtacattgat

SEQ ID NO: 880415 - DNA, 25 bp, Mus musculus
tggagaagcctcctgtcttcagagc

SEQ ID NO: 880416 - DNA, 25 bp, Mus musculus
tggagaagcctcgtgtcttcagagc

SEQ ID NO: 880417 - DNA, 25 bp, Mus musculus
tggagaagccttagccacggtgtgc

SEQ ID NO: 880418 - DNA, 25 bp, Mus musculus
tggagaagcctttgccacggtgtgc

SEQ ID NO: 880419 - DNA, 25 bp, Mus musculus
tggagaaggactattcacactaagt

SEQ ID NO: 880420 - DNA, 25 bp, Mus musculus
tggagaaggacttttcacactaagt

SEQ ID NO: 880421 - DNA, 25 bp, Mus musculus
tggagaaggccgatcatcccgcagt

SEQ ID NO: 880422 - DNA, 25 bp, Mus musculus
tggagaaggccgttcatcccgcagt

SEQ ID NO: 880423 - DNA, 25 bp, Mus musculus
tggagaaggcttaccaccccttcat

SEQ ID NO: 880424 - DNA, 25 bp, Mus musculus
tggagaaggctttccaccccttcat

SEQ ID NO: 880425 - DNA, 25 bp, Mus musculus
tggagaagggctctcaatcaccaca

SEQ ID NO: 880426 - DNA, 25 bp, Mus musculus
tggagaagggctgtcaatcaccaca

SEQ ID NO: 880427 - DNA, 25 bp, Mus musculus
tggagaaggtccataacctgcagtt

SEQ ID NO: 880428 - DNA, 25 bp, Mus musculus
tggagaaggtccttaacctgcagtt

SEQ ID NO: 880429 - DNA, 25 bp, Mus musculus
tggagaaggtgcatcctgggcactt

SEQ ID NO: 880430 - DNA, 25 bp, Mus musculus
tggagaaggtgcttcctgggcactt

SEQ ID NO: 880431 - DNA, 25 bp, Mus musculus
tggagaagtaccctgcacctgatga

SEQ ID NO: 880432 - DNA, 25 bp, Mus musculus
tggagaagtaccgtgcacctgatga

SEQ ID NO: 880433 - DNA, 25 bp, Mus musculus
tggagaagtcacaccatttcccatt

SEQ ID NO: 880434 - DNA, 25 bp, Mus musculus
tggagaagtcactccatttcccatt

SEQ ID NO: 880435 - DNA, 25 bp, Mus musculus
tggagaagtgccagggtcccgactt

SEQ ID NO: 880436 - DNA, 25 bp, Mus musculus
tggagaagtgcccttttcccctcaa

SEQ ID NO: 880437 - DNA, 25 bp, Mus musculus
tggagaagtgccgttttcccctcaa

SEQ ID NO: 880438 - DNA, 25 bp, Mus musculus
tggagaagtgcctgggtcccgactt

SEQ ID NO: 880439 - DNA, 25 bp, Mus musculus
tggagaagtggccatccaacaccca

SEQ ID NO: 880440 - DNA, 25 bp, Mus musculus
tggagaagtggcgatccaacaccca

SEQ ID NO: 880441 - DNA, 25 bp, Mus musculus
tggagaagtggtccttgctcttcca

SEQ ID NO: 880442 - DNA, 25 bp, Mus musculus
tggagaagtggtgcttgctcttcca

SEQ ID NO: 880443 - DNA, 25 bp, Mus musculus
tggagaagtttgctgcacgatacat

SEQ ID NO: 880444 - DNA, 25 bp, Mus musculus
tggagaagtttggtgcacgatacat

SEQ ID NO: 880445 - DNA, 25 bp, Mus musculus
tggagaatacagacgccaggcagtg

SEQ ID NO: 880446 - DNA, 25 bp, Mus musculus
tggagaatacagtcgccaggcagtg

SEQ ID NO: 880447 - DNA, 25 bp, Mus musculus
tggagaatccccaatacacatatga

SEQ ID NO: 880448 - DNA, 25 bp, Mus musculus
tggagaatcccctatacacatatga

SEQ ID NO: 880449 - DNA, 25 bp, Mus musculus
tggagaatgacactgccacatcctt

SEQ ID NO: 880450 - DNA, 25 bp, Mus musculus
tggagaatgacagtgccacatcctt

SEQ ID NO: 880451 - DNA, 25 bp, Mus musculus
tggagaatgagcactggcctctgga

SEQ ID NO: 880452 - DNA, 25 bp, Mus musculus
tggagaatgagctctggcctctgga

SEQ ID NO: 880453 - DNA, 25 bp, Mus musculus
tggagaatggtgactttttcctttt

SEQ ID NO: 880454 - DNA, 25 bp, Mus musculus
tggagaatggtgtctttttcctttt

SEQ ID NO: 880455 - DNA, 25 bp, Mus musculus
tggagaattcaaacgtgccattttt

SEQ ID NO: 880456 - DNA, 25 bp, Mus musculus
tggagaattcaatcgtgccattttt

SEQ ID NO: 880457 - DNA, 25 bp, Mus musculus
tggagaattcccaccctgcatgata

SEQ ID NO: 880458 - DNA, 25 bp, Mus musculus
tggagaattccctccctgcatgata

SEQ ID NO: 880459 - DNA, 25 bp, Mus musculus
tggagaattctaagccccgacactg

SEQ ID NO: 880460 - DNA, 25 bp, Mus musculus
tggagaattctatgccccgacactg

SEQ ID NO: 880461 - DNA, 25 bp, Mus musculus
tggagaatttaacaggttccttcga

SEQ ID NO: 880462 - DNA, 25 bp, Mus musculus
tggagaatttaagaggttccttcga

SEQ ID NO: 880463 - DNA, 25 bp, Mus musculus
tggagaatttccatcccttttgcca

SEQ ID NO: 880464 - DNA, 25 bp, Mus musculus
tggagaatttccttcccttttgcca

SEQ ID NO: 880465 - DNA, 25 bp, Mus musculus
tggagacaaaccaccaatcccattt

SEQ ID NO: 880466 - DNA, 25 bp, Mus musculus
tggagacaaacctccaatcccattt

SEQ ID NO: 880467 - DNA, 25 bp, Mus musculus
tggagacaaggcattgttccccttc

SEQ ID NO: 880468 - DNA, 25 bp, Mus musculus
tggagacaaggctttgttccccttc

SEQ ID NO: 880469 - DNA, 25 bp, Mus musculus
tggagacacatcctatcctgaactt

SEQ ID NO: 880470 - DNA, 25 bp, Mus musculus
tggagacacatcgtatcctgaactt

SEQ ID NO: 880471 - DNA, 25 bp, Mus musculus
tggagacaccagctaagatactact

SEQ ID NO: 880472 - DNA, 25 bp, Mus musculus
tggagacaccaggtaagatactact

SEQ ID NO: 880473 - DNA, 25 bp, Mus musculus
tggagacacccaatgctttaaaaag

SEQ ID NO: 880474 - DNA, 25 bp, Mus musculus
tggagacacccattgctttaaaaag

SEQ ID NO: 880475 - DNA, 25 bp, Mus musculus
tggagacaccccaggcttctgtgaa

SEQ ID NO: 880476 - DNA, 25 bp, Mus musculus
tggagacaccccatgtcagagctga

SEQ ID NO: 880477 - DNA, 25 bp, Mus musculus
tggagacacccctggcttctgtgaa

SEQ ID NO: 880478 - DNA, 25 bp, Mus musculus
tggagacaccccttgtcagagctga

SEQ ID NO: 880479 - DNA, 25 bp, Mus musculus
tggagacaccttcaatgcctctgtc

SEQ ID NO: 880480 - DNA, 25 bp, Mus musculus
tggagacaccttgaatgcctctgtc

SEQ ID NO: 880481 - DNA, 25 bp, Mus musculus
tggagacagaacaccgcaacgcgat

SEQ ID NO: 880482 - DNA, 25 bp, Mus musculus
tggagacagaactccgcaacgcgat

SEQ ID NO: 880483 - DNA, 25 bp, Mus musculus
tggagacagatactcgctcatctct

SEQ ID NO: 880484 - DNA, 25 bp, Mus musculus
tggagacagatagtcgctcatctct

SEQ ID NO: 880485 - DNA, 25 bp, Mus musculus
tggagacagcccacagaagcagtgt

SEQ ID NO: 880486 - DNA, 25 bp, Mus musculus
tggagacagccctcagaagcagtgt

SEQ ID NO: 880487 - DNA, 25 bp, Mus musculus
tggagacagtacacagcccaacggg

SEQ ID NO: 880488 - DNA, 25 bp, Mus musculus
tggagacagtactcagcccaacggg

SEQ ID NO: 880489 - DNA, 25 bp, Mus musculus
tggagacagtctcttcctacagcag

SEQ ID NO: 880490 - DNA, 25 bp, Mus musculus
tggagacagtctgttcctacagcag

SEQ ID NO: 880491 - DNA, 25 bp, Mus musculus
tggagacagtggagtccgtcacgct

SEQ ID NO: 880492 - DNA, 25 bp, Mus musculus
tggagacagtggtgtccgtcacgct

SEQ ID NO: 880493 - DNA, 25 bp, Mus musculus
tggagacagtttcacattacataaa

SEQ ID NO: 880494 - DNA, 25 bp, Mus musculus
tggagacagtttgacattacataaa

SEQ ID NO: 880495 - DNA, 25 bp, Mus musculus
tggagacatccacccaggagtcctc

SEQ ID NO: 880496 - DNA, 25 bp, Mus musculus
tggagacatccagccaggagtcctc

SEQ ID NO: 880497 - DNA, 25 bp, Mus musculus
tggagacatctaagggcattggccc

SEQ ID NO: 880498 - DNA, 25 bp, Mus musculus
tggagacatctatgggcattggccc

SEQ ID NO: 880499 - DNA, 25 bp, Mus musculus
tggagacattcaaagggacagccct

SEQ ID NO: 880500 - DNA, 25 bp, Mus musculus
tggagacattcaaatttcattcatc

SEQ ID NO: 880501 - DNA, 25 bp, Mus musculus
tggagacattcatagggacagccct

SEQ ID NO: 880502 - DNA, 25 bp, Mus musculus
tggagacattcatatttcattcatc

SEQ ID NO: 880503 - DNA, 25 bp, Mus musculus
tggagaccacacacttggaattacg

SEQ ID NO: 880504 - DNA, 25 bp, Mus musculus
tggagaccacactcttggaattacg

SEQ ID NO: 880505 - DNA, 25 bp, Mus musculus
tggagaccaccacgtttttgtctgc

SEQ ID NO: 880506 - DNA, 25 bp, Mus musculus
tggagaccaccaggtttttgtctgc

SEQ ID NO: 880507 - DNA, 25 bp, Mus musculus
tggagaccactgcattaatttcttt

SEQ ID NO: 880508 - DNA, 25 bp, Mus musculus
tggagaccactggattaatttcttt

SEQ ID NO: 880509 - DNA, 25 bp, Mus musculus
tggagaccagtcatgacccaatcaa

SEQ ID NO: 880510 - DNA, 25 bp, Mus musculus
tggagaccagtcttgacccaatcaa

SEQ ID NO: 880511 - DNA, 25 bp, Mus musculus
tggagaccatcacagaaatccacag

SEQ ID NO: 880512 - DNA, 25 bp, Mus musculus
tggagaccatcagagaaatccacag

SEQ ID NO: 880513 - DNA, 25 bp, Mus musculus
tggagaccatgtaccggtttttcaa

SEQ ID NO: 880514 - DNA, 25 bp, Mus musculus
tggagaccatgttccggtttttcaa

SEQ ID NO: 880515 - DNA, 25 bp, Mus musculus
tggagacccagcagtactgcggaca

SEQ ID NO: 880516 - DNA, 25 bp, Mus musculus
tggagacccagctgtactgcggaca

SEQ ID NO: 880517 - DNA, 25 bp, Mus musculus
tggagacccagtatcattgggagaa

SEQ ID NO: 880518 - DNA, 25 bp, Mus musculus
tggagacccagtttcattgggagaa

SEQ ID NO: 880519 - DNA, 25 bp, Mus musculus
tggagacccatgagggcttaggcct

SEQ ID NO: 880520 - DNA, 25 bp, Mus musculus
tggagacccatgtgggcttaggcct

SEQ ID NO: 880521 - DNA, 25 bp, Mus musculus
tggagaccccagaatgcatgaagag

SEQ ID NO: 880522 - DNA, 25 bp, Mus musculus
tggagaccccagtatgcatgaagag

SEQ ID NO: 880523 - DNA, 25 bp, Mus musculus
tggagaccctacagtaaataaacca

SEQ ID NO: 880524 - DNA, 25 bp, Mus musculus
tggagaccctactgtaaataaacca

SEQ ID NO: 880525 - DNA, 25 bp, Mus musculus
tggagaccctagcagtaaacgtgaa

SEQ ID NO: 880526 - DNA, 25 bp, Mus musculus
tggagaccctaggagtaaacgtgaa

SEQ ID NO: 880527 - DNA, 25 bp, Mus musculus
tggagaccctcaccggttactattt

SEQ ID NO: 880528 - DNA, 25 bp, Mus musculus
tggagaccctcagcggttactattt

SEQ ID NO: 880529 - DNA, 25 bp, Mus musculus
tggagacccttcagaaaaagcctgg

SEQ ID NO: 880530 - DNA, 25 bp, Mus musculus
tggagacccttctgaaaaagcctgg

SEQ ID NO: 880531 - DNA, 25 bp, Mus musculus
tggagacccttgaggctcaaaatac

SEQ ID NO: 880532 - DNA, 25 bp, Mus musculus
tggagacccttgtggctcaaaatac

SEQ ID NO: 880533 - DNA, 25 bp, Mus musculus
tggagaccgagtccttccaggaact

SEQ ID NO: 880534 - DNA, 25 bp, Mus musculus
tggagaccgagtgcttccaggaact

SEQ ID NO: 880535 - DNA, 25 bp, Mus musculus
tggagaccgtgtacctggagcgcaa

SEQ ID NO: 880536 - DNA, 25 bp, Mus musculus
tggagaccgtgttcctggagcgcaa

SEQ ID NO: 880537 - DNA, 25 bp, Mus musculus
tggagacctagacacagtgtaactt

SEQ ID NO: 880538 - DNA, 25 bp, Mus musculus
tggagacctagagacagtgtaactt

SEQ ID NO: 880539 - DNA, 25 bp, Mus musculus
tggagacctcccatgtgtgcttcat

SEQ ID NO: 880540 - DNA, 25 bp, Mus musculus
tggagacctcccttgtgtgcttcat

SEQ ID NO: 880541 - DNA, 25 bp, Mus musculus
tggagacctctccagggagtcgaat

SEQ ID NO: 880542 - DNA, 25 bp, Mus musculus
tggagacctctcgagggagtcgaat

SEQ ID NO: 880543 - DNA, 25 bp, Mus musculus
tggagacctgaaactcaggctgaaa

SEQ ID NO: 880544 - DNA, 25 bp, Mus musculus
tggagacctgaatctcaggctgaaa

SEQ ID NO: 880545 - DNA, 25 bp, Mus musculus
tggagacctgacatctaaaacctgt

SEQ ID NO: 880546 - DNA, 25 bp, Mus musculus
tggagacctgacttctaaaacctgt

SEQ ID NO: 880547 - DNA, 25 bp, Mus musculus
tggagacctgccactttcaagcctt

SEQ ID NO: 880548 - DNA, 25 bp, Mus musculus
tggagacctgcctctttcaagcctt

SEQ ID NO: 880549 - DNA, 25 bp, Mus musculus
tggagacctgtaccccaggtgccag

SEQ ID NO: 880550 - DNA, 25 bp, Mus musculus
tggagacctgtagcccaggtgccag

SEQ ID NO: 880551 - DNA, 25 bp, Mus musculus
tggagaccttcaaagctgaccccaa

SEQ ID NO: 880552 - DNA, 25 bp, Mus musculus
tggagaccttcatagctgaccccaa

SEQ ID NO: 880553 - DNA, 25 bp, Mus musculus
tggagaccttccaacatgttgactt

SEQ ID NO: 880554 - DNA, 25 bp, Mus musculus
tggagaccttcccatcctaaaaaca

SEQ ID NO: 880555 - DNA, 25 bp, Mus musculus
tggagaccttccgatcctaaaaaca

SEQ ID NO: 880556 - DNA, 25 bp, Mus musculus
tggagaccttcctacatgttgactt

SEQ ID NO: 880557 - DNA, 25 bp, Mus musculus
tggagacgccccactgaagtcattg

SEQ ID NO: 880558 - DNA, 25 bp, Mus musculus
tggagacgcccctctgaagtcattg

SEQ ID NO: 880559 - DNA, 25 bp, Mus musculus
tggagacgctatccctgtcagggaa

SEQ ID NO: 880560 - DNA, 25 bp, Mus musculus
tggagacgctatgcctgtcagggaa

SEQ ID NO: 880561 - DNA, 25 bp, Mus musculus
tggagacgctctagcagcagatgca

SEQ ID NO: 880562 - DNA, 25 bp, Mus musculus
tggagacgctcttgcagcagatgca

SEQ ID NO: 880563 - DNA, 25 bp, Mus musculus
tggagacggttgcttgccttgcaca

SEQ ID NO: 880564 - DNA, 25 bp, Mus musculus
tggagacggttggttgccttgcaca

SEQ ID NO: 880565 - DNA, 25 bp, Mus musculus
tggagacgtagccagatccccaagc

SEQ ID NO: 880566 - DNA, 25 bp, Mus musculus
tggagacgtagcgagatccccaagc

SEQ ID NO: 880567 - DNA, 25 bp, Mus musculus
tggagactaaggctcctcccagtca

SEQ ID NO: 880568 - DNA, 25 bp, Mus musculus
tggagactaagggtcctcccagtca

SEQ ID NO: 880569 - DNA, 25 bp, Mus musculus
tggagactaataaccctgtgacctt

SEQ ID NO: 880570 - DNA, 25 bp, Mus musculus
tggagactaatatccctgtgacctt

SEQ ID NO: 880571 - DNA, 25 bp, Mus musculus
tggagactacggctgcagaccttgc

SEQ ID NO: 880572 - DNA, 25 bp, Mus musculus
tggagactacgggtgcagaccttgc

SEQ ID NO: 880573 - DNA, 25 bp, Mus musculus
tggagactactgagcaccgtgttga

SEQ ID NO: 880574 - DNA, 25 bp, Mus musculus
tggagactactgtgcaccgtgttga

SEQ ID NO: 880575 - DNA, 25 bp, Mus musculus
tggagactagtaatcagcacatgtg

SEQ ID NO: 880576 - DNA, 25 bp, Mus musculus
tggagactagtattcagcacatgtg

SEQ ID NO: 880577 - DNA, 25 bp, Mus musculus
tggagactatgaattggcctggtat

SEQ ID NO: 880578 - DNA, 25 bp, Mus musculus
tggagactatgatttggcctggtat

SEQ ID NO: 880579 - DNA, 25 bp, Mus musculus
tggagactattacaccactcactag

SEQ ID NO: 880580 - DNA, 25 bp, Mus musculus
tggagactattagaccactcactag

SEQ ID NO: 880581 - DNA, 25 bp, Mus musculus
tggagactccaccaactccagcgag

SEQ ID NO: 880582 - DNA, 25 bp, Mus musculus
tggagactccacgaactccagcgag

SEQ ID NO: 880583 - DNA, 25 bp, Mus musculus
tggagactcgagagttcctgcagta

SEQ ID NO: 880584 - DNA, 25 bp, Mus musculus
tggagactcgagtgttcctgcagta

SEQ ID NO: 880585 - DNA, 25 bp, Mus musculus
tggagactcgccatgcataggagct

SEQ ID NO: 880586 - DNA, 25 bp, Mus musculus
tggagactcgccttgcataggagct

SEQ ID NO: 880587 - DNA, 25 bp, Mus musculus
tggagactctagatccatttatgtc

SEQ ID NO: 880588 - DNA, 25 bp, Mus musculus
tggagactctagttccatttatgtc

SEQ ID NO: 880589 - DNA, 25 bp, Mus musculus
tggagactctgaattgctgtgacaa

SEQ ID NO: 880590 - DNA, 25 bp, Mus musculus
tggagactctgatttgctgtgacaa

SEQ ID NO: 880591 - DNA, 25 bp, Mus musculus
tggagactctgtacaagtgcccggt

SEQ ID NO: 880592 - DNA, 25 bp, Mus musculus
tggagactctgttcaagtgcccggt

SEQ ID NO: 880593 - DNA, 25 bp, Mus musculus
tggagactgaagcatccttcttcct

SEQ ID NO: 880594 - DNA, 25 bp, Mus musculus
tggagactgaaggatccttcttcct

SEQ ID NO: 880595 - DNA, 25 bp, Mus musculus
tggagactgcacaggcagaccatct

SEQ ID NO: 880596 - DNA, 25 bp, Mus musculus
tggagactgcactggcagaccatct

SEQ ID NO: 880597 - DNA, 25 bp, Mus musculus
tggagactgccacctgacacctgac

SEQ ID NO: 880598 - DNA, 25 bp, Mus musculus
tggagactgccagctgacacctgac

SEQ ID NO: 880599 - DNA, 25 bp, Mus musculus
tggagactgctgatcacaccctaaa

SEQ ID NO: 880600 - DNA, 25 bp, Mus musculus
tggagactgctgttcacaccctaaa

SEQ ID NO: 880601 - DNA, 25 bp, Mus musculus
tggagactggcactgtcccaatccg

SEQ ID NO: 880602 - DNA, 25 bp, Mus musculus
tggagactggcagtgtcccaatccg

SEQ ID NO: 880603 - DNA, 25 bp, Mus musculus
tggagactgtcacggcctccttagc

SEQ ID NO: 880604 - DNA, 25 bp, Mus musculus
tggagactgtcagggcctccttagc

SEQ ID NO: 880605 - DNA, 25 bp, Mus musculus
tggagacttccactacctggatggg

SEQ ID NO: 880606 - DNA, 25 bp, Mus musculus
tggagacttccagtacctggatggg

SEQ ID NO: 880607 - DNA, 25 bp, Mus musculus
tggagacttccccacagtgcccaag

SEQ ID NO: 880608 - DNA, 25 bp, Mus musculus
tggagacttcccgacagtgcccaag

SEQ ID NO: 880609 - DNA, 25 bp, Mus musculus
tggagacttctgacagttctgacct

SEQ ID NO: 880610 - DNA, 25 bp, Mus musculus
tggagacttctgtcagttctgacct

SEQ ID NO: 880611 - DNA, 25 bp, Mus musculus
tggagacttgaaaaggtgacacctg

SEQ ID NO: 880612 - DNA, 25 bp, Mus musculus
tggagacttgaataggtgacacctg

SEQ ID NO: 880613 - DNA, 25 bp, Mus musculus
tggagacttggcaccggaacccagg

SEQ ID NO: 880614 - DNA, 25 bp, Mus musculus
tggagacttggctccggaacccagg

SEQ ID NO: 880615 - DNA, 25 bp, Mus musculus
tggagactttccaggtgtttctttt

SEQ ID NO: 880616 - DNA, 25 bp, Mus musculus
tggagactttcctggtgtttctttt

SEQ ID NO: 880617 - DNA, 25 bp, Mus musculus
tggagactttgaccgtgcattgctt

SEQ ID NO: 880618 - DNA, 25 bp, Mus musculus
tggagactttgagcgtgcattgctt

SEQ ID NO: 880619 - DNA, 25 bp, Mus musculus
tggagagaacgtcagcccagccagt

SEQ ID NO: 880620 - DNA, 25 bp, Mus musculus
tggagagaacgtgagcccagccagt

SEQ ID NO: 880621 - DNA, 25 bp, Mus musculus
tggagagaacttagtcctgccccag

SEQ ID NO: 880622 - DNA, 25 bp, Mus musculus
tggagagaactttgtcctgccccag

SEQ ID NO: 880623 - DNA, 25 bp, Mus musculus
tggagagaattcagctcccatttct

SEQ ID NO: 880624 - DNA, 25 bp, Mus musculus
tggagagaattctgctcccatttct

SEQ ID NO: 880625 - DNA, 25 bp, Mus musculus
tggagagaccccagaagaacgagat

SEQ ID NO: 880626 - DNA, 25 bp, Mus musculus
tggagagacccctgaagaacgagat

SEQ ID NO: 880627 - DNA, 25 bp, Mus musculus
tggagagacggtacttcttacccaa

SEQ ID NO: 880628 - DNA, 25 bp, Mus musculus
tggagagacggttcttcttacccaa

SEQ ID NO: 880629 - DNA, 25 bp, Mus musculus
tggagagactggaggaccccttttc

SEQ ID NO: 880630 - DNA, 25 bp, Mus musculus
tggagagactggtggaccccttttc

SEQ ID NO: 880631 - DNA, 25 bp, Mus musculus
tggagagagaccaaccatcttaccc

SEQ ID NO: 880632 - DNA, 25 bp, Mus musculus
tggagagagacctaccatcttaccc

SEQ ID NO: 880633 - DNA, 25 bp, Mus musculus
tggagagagactagcctgacccctt

SEQ ID NO: 880634 - DNA, 25 bp, Mus musculus
tggagagagactctgctcccacctg

SEQ ID NO: 880635 - DNA, 25 bp, Mus musculus
tggagagagactgtgctcccacctg

SEQ ID NO: 880636 - DNA, 25 bp, Mus musculus
tggagagagacttgcctgacccctt

SEQ ID NO: 880637 - DNA, 25 bp, Mus musculus
tggagagagatgagtcagcagttaa

SEQ ID NO: 880638 - DNA, 25 bp, Mus musculus
tggagagagatgtgtcagcagttaa

SEQ ID NO: 880639 - DNA, 25 bp, Mus musculus
tggagagagtctcacacttctggct

SEQ ID NO: 880640 - DNA, 25 bp, Mus musculus
tggagagagtctgacacttctggct

SEQ ID NO: 880641 - DNA, 25 bp, Mus musculus
tggagagatcctacaaaacccgtcg

SEQ ID NO: 880642 - DNA, 25 bp, Mus musculus
tggagagatccttcaaaacccgtcg

SEQ ID NO: 880643 - DNA, 25 bp, Mus musculus
tggagagattcaaattcatttgtat

SEQ ID NO: 880644 - DNA, 25 bp, Mus musculus
tggagagattcatattcatttgtat

SEQ ID NO: 880645 - DNA, 25 bp, Mus musculus
tggagagcaatccaactgcctgtgt

SEQ ID NO: 880646 - DNA, 25 bp, Mus musculus
tggagagcaatcgaactgcctgtgt

SEQ ID NO: 880647 - DNA, 25 bp, Mus musculus
tggagagcacagagcgcacgccatc

SEQ ID NO: 880648 - DNA, 25 bp, Mus musculus
tggagagcacagtgcgcacgccatc

SEQ ID NO: 880649 - DNA, 25 bp, Mus musculus
tggagagcaccaaaatgtaagcagc

SEQ ID NO: 880650 - DNA, 25 bp, Mus musculus
tggagagcaccataatgtaagcagc

SEQ ID NO: 880651 - DNA, 25 bp, Mus musculus
tggagagcactcaggagcccagcca

SEQ ID NO: 880652 - DNA, 25 bp, Mus musculus
tggagagcactctggagcccagcca

SEQ ID NO: 880653 - DNA, 25 bp, Mus musculus
tggagagcactgctaatgccaaggc

SEQ ID NO: 880654 - DNA, 25 bp, Mus musculus
tggagagcactggtaatgccaaggc

SEQ ID NO: 880655 - DNA, 25 bp, Mus musculus
tggagagcagccatcgagtgaccca

SEQ ID NO: 880656 - DNA, 25 bp, Mus musculus
tggagagcagccttcgagtgaccca

SEQ ID NO: 880657 - DNA, 25 bp, Mus musculus
tggagagcatcgagtgctcgcgcca

SEQ ID NO: 880658 - DNA, 25 bp, Mus musculus
tggagagcatcgtgtgctcgcgcca

SEQ ID NO: 880659 - DNA, 25 bp, Mus musculus
tggagagccaaaccactgccatgag

SEQ ID NO: 880660 - DNA, 25 bp, Mus musculus
tggagagccaaagcactgccatgag

SEQ ID NO: 880661 - DNA, 25 bp, Mus musculus
tggagagccaacacctaggagcaac

SEQ ID NO: 880662 - DNA, 25 bp, Mus musculus
tggagagccaacagcatgtgcttca

SEQ ID NO: 880663 - DNA, 25 bp, Mus musculus
tggagagccaactcctaggagcaac

SEQ ID NO: 880664 - DNA, 25 bp, Mus musculus
tggagagccaactgcatgtgcttca

SEQ ID NO: 880665 - DNA, 25 bp, Mus musculus
tggagagccagcagccaggacgaaa

SEQ ID NO: 880666 - DNA, 25 bp, Mus musculus
tggagagccagctgccaggacgaaa

SEQ ID NO: 880667 - DNA, 25 bp, Mus musculus
tggagagccatgatctctgacttcc

SEQ ID NO: 880668 - DNA, 25 bp, Mus musculus
tggagagccatgttctctgacttcc

SEQ ID NO: 880669 - DNA, 25 bp, Mus musculus
tggagagcccacatctcagtatttc

SEQ ID NO: 880670 - DNA, 25 bp, Mus musculus
tggagagcccacttctcagtatttc

SEQ ID NO: 880671 - DNA, 25 bp, Mus musculus
tggagagcccgcagtgactcagtca

SEQ ID NO: 880672 - DNA, 25 bp, Mus musculus
tggagagcccgctgtgactcagtca

SEQ ID NO: 880673 - DNA, 25 bp, Mus musculus
tggagagcctgtagccgggccaccc

SEQ ID NO: 880674 - DNA, 25 bp, Mus musculus
tggagagcctgttgccgggccaccc

SEQ ID NO: 880675 - DNA, 25 bp, Mus musculus
tggagagctcccactgctgaccaga

SEQ ID NO: 880676 - DNA, 25 bp, Mus musculus
tggagagctccctctgctgaccaga

SEQ ID NO: 880677 - DNA, 25 bp, Mus musculus
tggagagctcctcgcgtctgaatga

SEQ ID NO: 880678 - DNA, 25 bp, Mus musculus
tggagagctcctggcgtctgaatga

SEQ ID NO: 880679 - DNA, 25 bp, Mus musculus
tggagagctcttccttttgaggttc

SEQ ID NO: 880680 - DNA, 25 bp, Mus musculus
tggagagctcttgcttttgaggttc

SEQ ID NO: 880681 - DNA, 25 bp, Mus musculus
tggagagctgagctgtccctggtgc

SEQ ID NO: 880682 - DNA, 25 bp, Mus musculus
tggagagctgaggtgtccctggtgc

SEQ ID NO: 880683 - DNA, 25 bp, Mus musculus
tggagagctgatcctgacaatgaca

SEQ ID NO: 880684 - DNA, 25 bp, Mus musculus
tggagagctgatgctgacaatgaca

SEQ ID NO: 880685 - DNA, 25 bp, Mus musculus
tggagagctgccagggctccctcgt

SEQ ID NO: 880686 - DNA, 25 bp, Mus musculus
tggagagctgccatcttctgaccat

SEQ ID NO: 880687 - DNA, 25 bp, Mus musculus
tggagagctgcctgggctccctcgt

SEQ ID NO: 880688 - DNA, 25 bp, Mus musculus
tggagagctgccttcttctgaccat

SEQ ID NO: 880689 - DNA, 25 bp, Mus musculus
tggagagcttctcactagcctttgc

SEQ ID NO: 880690 - DNA, 25 bp, Mus musculus
tggagagcttctgactagcctttgc

SEQ ID NO: 880691 - DNA, 25 bp, Mus musculus
tggagaggactgacttggatcaaca

SEQ ID NO: 880692 - DNA, 25 bp, Mus musculus
tggagaggactgtcttggatcaaca

SEQ ID NO: 880693 - DNA, 25 bp, Mus musculus
tggagaggagacatccctccgggtt

SEQ ID NO: 880694 - DNA, 25 bp, Mus musculus
tggagaggagacttccctccgggtt

SEQ ID NO: 880695 - DNA, 25 bp, Mus musculus
tggagaggagccacccactcagggt

SEQ ID NO: 880696 - DNA, 25 bp, Mus musculus
tggagaggagcctcccactcagggt

SEQ ID NO: 880697 - DNA, 25 bp, Mus musculus
tggagaggcaacatgcactccacct

SEQ ID NO: 880698 - DNA, 25 bp, Mus musculus
tggagaggcaacttgcactccacct

SEQ ID NO: 880699 - DNA, 25 bp, Mus musculus
tggagaggcaccctgcttcgtagaa

SEQ ID NO: 880700 - DNA, 25 bp, Mus musculus
tggagaggcaccgtgcttcgtagaa

SEQ ID NO: 880701 - DNA, 25 bp, Mus musculus
tggagaggccctacccaaagtatta

SEQ ID NO: 880702 - DNA, 25 bp, Mus musculus
tggagaggcccttcccaaagtatta

SEQ ID NO: 880703 - DNA, 25 bp, Mus musculus
tggagaggcctacccctaagatgct

SEQ ID NO: 880704 - DNA, 25 bp, Mus musculus
tggagaggcctagccctaagatgct

SEQ ID NO: 880705 - DNA, 25 bp, Mus musculus
tggagaggcgaacaacagactttta

SEQ ID NO: 880706 - DNA, 25 bp, Mus musculus
tggagaggcgaagaacagactttta

SEQ ID NO: 880707 - DNA, 25 bp, Mus musculus
tggagagggcctcagcttattctca

SEQ ID NO: 880708 - DNA, 25 bp, Mus musculus
tggagagggcctgagcttattctca

SEQ ID NO: 880709 - DNA, 25 bp, Mus musculus
tggagagggtctaactaagcagccc

SEQ ID NO: 880710 - DNA, 25 bp, Mus musculus
tggagagggtcttactaagcagccc

SEQ ID NO: 880711 - DNA, 25 bp, Mus musculus
tggagagggtgtacactgtgtaatc

SEQ ID NO: 880712 - DNA, 25 bp, Mus musculus
tggagagggtgttcactgtgtaatc

SEQ ID NO: 880713 - DNA, 25 bp, Mus musculus
tggagaggtcatccggctggatggg

SEQ ID NO: 880714 - DNA, 25 bp, Mus musculus
tggagaggtcatgcggctggatggg

SEQ ID NO: 880715 - DNA, 25 bp, Mus musculus
tggagaggttcccactcatacctta

SEQ ID NO: 880716 - DNA, 25 bp, Mus musculus
tggagaggttccgactcatacctta

SEQ ID NO: 880717 - DNA, 25 bp, Mus musculus
tggagaggtttgaccagtcaggcct

SEQ ID NO: 880718 - DNA, 25 bp, Mus musculus
tggagaggtttgtccagtcaggcct

SEQ ID NO: 880719 - DNA, 25 bp, Mus musculus
tggagagtaatcctacaactgtaga

SEQ ID NO: 880720 - DNA, 25 bp, Mus musculus
tggagagtaatcgtacaactgtaga

SEQ ID NO: 880721 - DNA, 25 bp, Mus musculus
tggagagtacccactgacagctatg

SEQ ID NO: 880722 - DNA, 25 bp, Mus musculus
tggagagtaccctctgacagctatg

SEQ ID NO: 880723 - DNA, 25 bp, Mus musculus
tggagagtactcatgaccccacgaa

SEQ ID NO: 880724 - DNA, 25 bp, Mus musculus
tggagagtactcttgaccccacgaa

SEQ ID NO: 880725 - DNA, 25 bp, Mus musculus
tggagagtatgcagccatcctaagc

SEQ ID NO: 880726 - DNA, 25 bp, Mus musculus
tggagagtatgctgccatcctaagc

SEQ ID NO: 880727 - DNA, 25 bp, Mus musculus
tggagagtcagcctctggaccctat

SEQ ID NO: 880728 - DNA, 25 bp, Mus musculus
tggagagtcagcgtctggaccctat

SEQ ID NO: 880729 - DNA, 25 bp, Mus musculus
tggagagtccatcttgtatttagat

SEQ ID NO: 880730 - DNA, 25 bp, Mus musculus
tggagagtccatgttgtatttagat

SEQ ID NO: 880731 - DNA, 25 bp, Mus musculus
tggagagtcctgattgcacatccag

SEQ ID NO: 880732 - DNA, 25 bp, Mus musculus
tggagagtcctgtttgcacatccag

SEQ ID NO: 880733 - DNA, 25 bp, Mus musculus
tggagagtgacaccactgtctgtca

SEQ ID NO: 880734 - DNA, 25 bp, Mus musculus
tggagagtgacagcactgtctgtca

SEQ ID NO: 880735 - DNA, 25 bp, Mus musculus
tggagagtgcagagctcctcgcaac

SEQ ID NO: 880736 - DNA, 25 bp, Mus musculus
tggagagtgcagtgctcctcgcaac

SEQ ID NO: 880737 - DNA, 25 bp, Mus musculus
tggagagtggtcctgaccctcagtt

SEQ ID NO: 880738 - DNA, 25 bp, Mus musculus
tggagagtggtcgtgaccctcagtt

SEQ ID NO: 880739 - DNA, 25 bp, Mus musculus
tggagagtgtggacgcccatctgca

SEQ ID NO: 880740 - DNA, 25 bp, Mus musculus
tggagagtgtggtcgcccatctgca

SEQ ID NO: 880741 - DNA, 25 bp, Mus musculus
tggagagtgttcctcatcccagaac

SEQ ID NO: 880742 - DNA, 25 bp, Mus musculus
tggagagtgttcgtcatcccagaac

SEQ ID NO: 880743 - DNA, 25 bp, Mus musculus
tggagagttagccagtcttcctctt

SEQ ID NO: 880744 - DNA, 25 bp, Mus musculus
tggagagttagcgagtcttcctctt

SEQ ID NO: 880745 - DNA, 25 bp, Mus musculus
tggagagttaggactatctgctcag

SEQ ID NO: 880746 - DNA, 25 bp, Mus musculus
tggagagttaggcttgttctacttt

SEQ ID NO: 880747 - DNA, 25 bp, Mus musculus
tggagagttagggttgttctacttt

SEQ ID NO: 880748 - DNA, 25 bp, Mus musculus
tggagagttaggtctatctgctcag

SEQ ID NO: 880749 - DNA, 25 bp, Mus musculus
tggagagttgcactgactgaactgt

SEQ ID NO: 880750 - DNA, 25 bp, Mus musculus
tggagagttgcagtgactgaactgt

SEQ ID NO: 880751 - DNA, 25 bp, Mus musculus
tggagagtttatcgctgtgttcttc

SEQ ID NO: 880752 - DNA, 25 bp, Mus musculus
tggagagtttatggctgtgttcttc

SEQ ID NO: 880753 - DNA, 25 bp, Mus musculus
tggagagtttggctgacccaccact

SEQ ID NO: 880754 - DNA, 25 bp, Mus musculus
tggagagtttgggtgacccaccact

SEQ ID NO: 880755 - DNA, 25 bp, Mus musculus
tggagataaagaaatccttgagtcc

SEQ ID NO: 880756 - DNA, 25 bp, Mus musculus
tggagataaagatatccttgagtcc

SEQ ID NO: 880757 - DNA, 25 bp, Mus musculus
tggagataactacctttaacacaaa

SEQ ID NO: 880758 - DNA, 25 bp, Mus musculus
tggagataactagctttaacacaaa

SEQ ID NO: 880759 - DNA, 25 bp, Mus musculus
tggagataagttccgactcctctca

SEQ ID NO: 880760 - DNA, 25 bp, Mus musculus
tggagataagttgcgactcctctca

SEQ ID NO: 880761 - DNA, 25 bp, Mus musculus
tggagatacacacgccagctaccag

SEQ ID NO: 880762 - DNA, 25 bp, Mus musculus
tggagatacacaggccagctaccag

SEQ ID NO: 880763 - DNA, 25 bp, Mus musculus
tggagatacacgaaagaagatcaac

SEQ ID NO: 880764 - DNA, 25 bp, Mus musculus
tggagatacacgtaagaagatcaac

SEQ ID NO: 880765 - DNA, 25 bp, Mus musculus
tggagataccgcaggctcacattct

SEQ ID NO: 880766 - DNA, 25 bp, Mus musculus
tggagataccgctggctcacattct

SEQ ID NO: 880767 - DNA, 25 bp, Mus musculus
tggagatacctcaaagcctagccgg

SEQ ID NO: 880768 - DNA, 25 bp, Mus musculus
tggagatacctctaagcctagccgg

SEQ ID NO: 880769 - DNA, 25 bp, Mus musculus
tggagatagtgtcgcctctgcacat

SEQ ID NO: 880770 - DNA, 25 bp, Mus musculus
tggagatagtgtggcctctgcacat

SEQ ID NO: 880771 - DNA, 25 bp, Mus musculus
tggagatatagcctttttacccaaa

SEQ ID NO: 880772 - DNA, 25 bp, Mus musculus
tggagatatagcgtttttacccaaa

SEQ ID NO: 880773 - DNA, 25 bp, Mus musculus
tggagatcaagcaccggaactcgga

SEQ ID NO: 880774 - DNA, 25 bp, Mus musculus
tggagatcaagcatcgcctgctgga

SEQ ID NO: 880775 - DNA, 25 bp, Mus musculus
tggagatcaagctccggaactcgga

SEQ ID NO: 880776 - DNA, 25 bp, Mus musculus
tggagatcaagcttcgcctgctgga

SEQ ID NO: 880777 - DNA, 25 bp, Mus musculus
tggagatcacaccacttcatacctg

SEQ ID NO: 880778 - DNA, 25 bp, Mus musculus
tggagatcacacgacttcatacctg

SEQ ID NO: 880779 - DNA, 25 bp, Mus musculus
tggagatcacagacccaatccgaca

SEQ ID NO: 880780 - DNA, 25 bp, Mus musculus
tggagatcacagtcccaatccgaca

SEQ ID NO: 880781 - DNA, 25 bp, Mus musculus
tggagatcacatccacccctatggt

SEQ ID NO: 880782 - DNA, 25 bp, Mus musculus
tggagatcacatgcacccctatggt

SEQ ID NO: 880783 - DNA, 25 bp, Mus musculus
tggagatcacctacagctactggga

SEQ ID NO: 880784 - DNA, 25 bp, Mus musculus
tggagatcaccttcagctactggga

SEQ ID NO: 880785 - DNA, 25 bp, Mus musculus
tggagatcactaaactctttgcatg

SEQ ID NO: 880786 - DNA, 25 bp, Mus musculus
tggagatcactatactctttgcatg

SEQ ID NO: 880787 - DNA, 25 bp, Mus musculus
tggagatcagtgcacagttttacca

SEQ ID NO: 880788 - DNA, 25 bp, Mus musculus
tggagatcagtggacagttttacca

SEQ ID NO: 880789 - DNA, 25 bp, Mus musculus
tggagatcatggcttccgaacccaa

SEQ ID NO: 880790 - DNA, 25 bp, Mus musculus
tggagatcatgggttccgaacccaa

SEQ ID NO: 880791 - DNA, 25 bp, Mus musculus
tggagatcattgaggaagcagtaac

SEQ ID NO: 880792 - DNA, 25 bp, Mus musculus
tggagatcattgtggaagcagtaac

SEQ ID NO: 880793 - DNA, 25 bp, Mus musculus
tggagatcccagcacctctctacat

SEQ ID NO: 880794 - DNA, 25 bp, Mus musculus
tggagatcccaggacctctctacat

SEQ ID NO: 880795 - DNA, 25 bp, Mus musculus
tggagatccctgcaactaaggttag

SEQ ID NO: 880796 - DNA, 25 bp, Mus musculus
tggagatccctggaactaaggttag

SEQ ID NO: 880797 - DNA, 25 bp, Mus musculus
tggagatcccttcatagccactgct

SEQ ID NO: 880798 - DNA, 25 bp, Mus musculus
tggagatcccttgatagccactgct

SEQ ID NO: 880799 - DNA, 25 bp, Mus musculus
tggagatccgaaatgcttatgctgt

SEQ ID NO: 880800 - DNA, 25 bp, Mus musculus
tggagatccgaattgcttatgctgt

SEQ ID NO: 880801 - DNA, 25 bp, Mus musculus
tggagatccggcaccgcatgcagag

SEQ ID NO: 880802 - DNA, 25 bp, Mus musculus
tggagatccggctccgcatgcagag

SEQ ID NO: 880803 - DNA, 25 bp, Mus musculus
tggagatctcatcccgtacaatgat

SEQ ID NO: 880804 - DNA, 25 bp, Mus musculus
tggagatctcatgccgtacaatgat

SEQ ID NO: 880805 - DNA, 25 bp, Mus musculus
tggagatctcccacggtttggtcac

SEQ ID NO: 880806 - DNA, 25 bp, Mus musculus
tggagatctccctcggtttggtcac

SEQ ID NO: 880807 - DNA, 25 bp, Mus musculus
tggagatctccgactcgcagctggg

SEQ ID NO: 880808 - DNA, 25 bp, Mus musculus
tggagatctccgtctcgcagctggg

SEQ ID NO: 880809 - DNA, 25 bp, Mus musculus
tggagatctcttcccagcaagtgga

SEQ ID NO: 880810 - DNA, 25 bp, Mus musculus
tggagatctcttgccagcaagtgga

SEQ ID NO: 880811 - DNA, 25 bp, Mus musculus
tggagatcttccaccaaggccagtg

SEQ ID NO: 880812 - DNA, 25 bp, Mus musculus
tggagatcttcctccaaggccagtg

SEQ ID NO: 880813 - DNA, 25 bp, Mus musculus
tggagatcttctatggcaaggccaa

SEQ ID NO: 880814 - DNA, 25 bp, Mus musculus
tggagatcttctttggcaaggccaa

SEQ ID NO: 880815 - DNA, 25 bp, Mus musculus
tggagatgacaacgctgaccacgcc

SEQ ID NO: 880816 - DNA, 25 bp, Mus musculus
tggagatgacaaggctgaccacgcc

SEQ ID NO: 880817 - DNA, 25 bp, Mus musculus
tggagatgagctcacctgcaggcac

SEQ ID NO: 880818 - DNA, 25 bp, Mus musculus
tggagatgagctgacctgcaggcac

SEQ ID NO: 880819 - DNA, 25 bp, Mus musculus
tggagatgatcactcatcccgtctc

SEQ ID NO: 880820 - DNA, 25 bp, Mus musculus
tggagatgatcagtcatcccgtctc

SEQ ID NO: 880821 - DNA, 25 bp, Mus musculus
tggagatgatctagcaccccaaact

SEQ ID NO: 880822 - DNA, 25 bp, Mus musculus
tggagatgatctaggaccctcactg

SEQ ID NO: 880823 - DNA, 25 bp, Mus musculus
tggagatgatcttgcaccccaaact

SEQ ID NO: 880824 - DNA, 25 bp, Mus musculus
tggagatgatcttggaccctcactg

SEQ ID NO: 880825 - DNA, 25 bp, Mus musculus
tggagatgcaaaccttcacaaggac

SEQ ID NO: 880826 - DNA, 25 bp, Mus musculus
tggagatgcaaagcttcacaaggac

SEQ ID NO: 880827 - DNA, 25 bp, Mus musculus
tggagatgcaccaggtgctgcactg

SEQ ID NO: 880828 - DNA, 25 bp, Mus musculus
tggagatgcacctggtgctgcactg

SEQ ID NO: 880829 - DNA, 25 bp, Mus musculus
tggagatgcatcaccgtaccctgag

SEQ ID NO: 880830 - DNA, 25 bp, Mus musculus
tggagatgcatctccgtaccctgag

SEQ ID NO: 880831 - DNA, 25 bp, Mus musculus
tggagatgccatctctgtctccctg

SEQ ID NO: 880832 - DNA, 25 bp, Mus musculus
tggagatgccatgtctgtctccctg

SEQ ID NO: 880833 - DNA, 25 bp, Mus musculus
tggagatgccgcaggttctggacca

SEQ ID NO: 880834 - DNA, 25 bp, Mus musculus
tggagatgccgctggttctggacca

SEQ ID NO: 880835 - DNA, 25 bp, Mus musculus
tggagatgcctaacaccagccacag

SEQ ID NO: 880836 - DNA, 25 bp, Mus musculus
tggagatgcctatcaccagccacag

SEQ ID NO: 880837 - DNA, 25 bp, Mus musculus
tggagatgctccctcaactaatgtt

SEQ ID NO: 880838 - DNA, 25 bp, Mus musculus
tggagatgctccgtcaactaatgtt

SEQ ID NO: 880839 - DNA, 25 bp, Mus musculus
tggagatgggcaagtcacccactgc

SEQ ID NO: 880840 - DNA, 25 bp, Mus musculus
tggagatgggcatgtcacccactgc

SEQ ID NO: 880841 - DNA, 25 bp, Mus musculus
tggagatgtaccatcctagcatgta

SEQ ID NO: 880842 - DNA, 25 bp, Mus musculus
tggagatgtaccttcctagcatgta

SEQ ID NO: 880843 - DNA, 25 bp, Mus musculus
tggagatgtactacgcccgcttggg

SEQ ID NO: 880844 - DNA, 25 bp, Mus musculus
tggagatgtactcgccaccgttggt

SEQ ID NO: 880845 - DNA, 25 bp, Mus musculus
tggagatgtactggccaccgttggt

SEQ ID NO: 880846 - DNA, 25 bp, Mus musculus
tggagatgtacttcgcccgcttggg

SEQ ID NO: 880847 - DNA, 25 bp, Mus musculus
tggagatgtcccacagatgcagcat

SEQ ID NO: 880848 - DNA, 25 bp, Mus musculus
tggagatgtccctcagatgcagcat

SEQ ID NO: 880849 - DNA, 25 bp, Mus musculus
tggagatgtctaaattaaatacctg

SEQ ID NO: 880850 - DNA, 25 bp, Mus musculus
tggagatgtctatattaaatacctg

SEQ ID NO: 880851 - DNA, 25 bp, Mus musculus
tggagatgtttaacacagtcgtgtg

SEQ ID NO: 880852 - DNA, 25 bp, Mus musculus
tggagatgtttatcacagtcgtgtg

SEQ ID NO: 880853 - DNA, 25 bp, Mus musculus
tggagattaagcactgcctgctgtc

SEQ ID NO: 880854 - DNA, 25 bp, Mus musculus
tggagattaagctctgcctgctgtc

SEQ ID NO: 880855 - DNA, 25 bp, Mus musculus
tggagattacttatctattttctaa

SEQ ID NO: 880856 - DNA, 25 bp, Mus musculus
tggagattacttttctattttctaa

SEQ ID NO: 880857 - DNA, 25 bp, Mus musculus
tggagattcagtaagtgccttggaa

SEQ ID NO: 880858 - DNA, 25 bp, Mus musculus
tggagattcagttagtgccttggaa

SEQ ID NO: 880859 - DNA, 25 bp, Mus musculus
tggagattccacaatctgcaccagg

SEQ ID NO: 880860 - DNA, 25 bp, Mus musculus
tggagattccactatctgcaccagg

SEQ ID NO: 880861 - DNA, 25 bp, Mus musculus
tggagattccctagtggttctagga

SEQ ID NO: 880862 - DNA, 25 bp, Mus musculus
tggagattcccttgtggttctagga

SEQ ID NO: 880863 - DNA, 25 bp, Mus musculus
tggagattctccacgggcgcaagag

SEQ ID NO: 880864 - DNA, 25 bp, Mus musculus
tggagattctcctcgggcgcaagag

SEQ ID NO: 880865 - DNA, 25 bp, Mus musculus
tggagattctgcactgggtccctgt

SEQ ID NO: 880866 - DNA, 25 bp, Mus musculus
tggagattctgctctgggtccctgt

SEQ ID NO: 880867 - DNA, 25 bp, Mus musculus
tggagattgcagaccgctccaggtt

SEQ ID NO: 880868 - DNA, 25 bp, Mus musculus
tggagattgcagtccgctccaggtt

SEQ ID NO: 880869 - DNA, 25 bp, Mus musculus
tggagattgccaaccgaaataccgg

SEQ ID NO: 880870 - DNA, 25 bp, Mus musculus
tggagattgccatccgaaataccgg

SEQ ID NO: 880871 - DNA, 25 bp, Mus musculus
tggagattgcccactattgtggctt

SEQ ID NO: 880872 - DNA, 25 bp, Mus musculus
tggagattgccctctattgtggctt

SEQ ID NO: 880873 - DNA, 25 bp, Mus musculus
tggagattggatcgccttaaattaa

SEQ ID NO: 880874 - DNA, 25 bp, Mus musculus
tggagattggatggccttaaattaa

SEQ ID NO: 880875 - DNA, 25 bp, Mus musculus
tggagattgtagaagtttcttttat

SEQ ID NO: 880876 - DNA, 25 bp, Mus musculus
tggagattgtagtagtttcttttat

SEQ ID NO: 880877 - DNA, 25 bp, Mus musculus
tggagattgtgcactgcagtgagcc

SEQ ID NO: 880878 - DNA, 25 bp, Mus musculus
tggagattgtgctctgcagtgagcc

SEQ ID NO: 880879 - DNA, 25 bp, Mus musculus
tggagatttaccagggcccatgaat

SEQ ID NO: 880880 - DNA, 25 bp, Mus musculus
tggagatttacctgggcccatgaat

SEQ ID NO: 880881 - DNA, 25 bp, Mus musculus
tggagatttctaatgttacgggctt

SEQ ID NO: 880882 - DNA, 25 bp, Mus musculus
tggagatttctattgttacgggctt

SEQ ID NO: 880883 - DNA, 25 bp, Mus musculus
tggagatttgttcaagtcctccctc

SEQ ID NO: 880884 - DNA, 25 bp, Mus musculus
tggagatttgttgaagtcctccctc

SEQ ID NO: 880885 - DNA, 25 bp, Mus musculus
tggagcaaagccagaccttggaacc

SEQ ID NO: 880886 - DNA, 25 bp, Mus musculus
tggagcaaagcctgaccttggaacc

SEQ ID NO: 880887 - DNA, 25 bp, Mus musculus
tggagcaactctcgctaatctggag

SEQ ID NO: 880888 - DNA, 25 bp, Mus musculus
tggagcaactctggctaatctggag

SEQ ID NO: 880889 - DNA, 25 bp, Mus musculus
tggagcaagcagctctccattgcaa

SEQ ID NO: 880890 - DNA, 25 bp, Mus musculus
tggagcaagcaggtctccattgcaa

SEQ ID NO: 880891 - DNA, 25 bp, Mus musculus
tggagcaagctcaaatccggccgcg

SEQ ID NO: 880892 - DNA, 25 bp, Mus musculus
tggagcaagctctaatccggccgcg

SEQ ID NO: 880893 - DNA, 25 bp, Mus musculus
tggagcaagcttcgtctgcccatga

SEQ ID NO: 880894 - DNA, 25 bp, Mus musculus
tggagcaagcttggtctgcccatga

SEQ ID NO: 880895 - DNA, 25 bp, Mus musculus
tggagcaatccaagccgcatatcta

SEQ ID NO: 880896 - DNA, 25 bp, Mus musculus
tggagcaatccatgccgcatatcta

SEQ ID NO: 880897 - DNA, 25 bp, Mus musculus
tggagcaatggcatatgcccagatt

SEQ ID NO: 880898 - DNA, 25 bp, Mus musculus
tggagcaatggcttatgcccagatt

SEQ ID NO: 880899 - DNA, 25 bp, Mus musculus
tggagcaattaacaccaccatgcct

SEQ ID NO: 880900 - DNA, 25 bp, Mus musculus
tggagcaattaagaccaccatgcct

SEQ ID NO: 880901 - DNA, 25 bp, Mus musculus
tggagcacacagctgaacccatcat

SEQ ID NO: 880902 - DNA, 25 bp, Mus musculus
tggagcacacaggtgaacccatcat

SEQ ID NO: 880903 - DNA, 25 bp, Mus musculus
tggagcacacgcaacttcagtcaaa

SEQ ID NO: 880904 - DNA, 25 bp, Mus musculus
tggagcacacgctacttcagtcaaa

SEQ ID NO: 880905 - DNA, 25 bp, Mus musculus
tggagcaccatcatgagtccccaga

SEQ ID NO: 880906 - DNA, 25 bp, Mus musculus
tggagcaccatcttgagtccccaga

SEQ ID NO: 880907 - DNA, 25 bp, Mus musculus
tggagcacccgacccagaaagacat

SEQ ID NO: 880908 - DNA, 25 bp, Mus musculus
tggagcacccgagccagaaagacat

SEQ ID NO: 880909 - DNA, 25 bp, Mus musculus
tggagcaccgcgcttggaaagccat

SEQ ID NO: 880910 - DNA, 25 bp, Mus musculus
tggagcaccgcggttggaaagccat

SEQ ID NO: 880911 - DNA, 25 bp, Mus musculus
tggagcacctcaaaggcctgaagtg

SEQ ID NO: 880912 - DNA, 25 bp, Mus musculus
tggagcacctcataggcctgaagtg

SEQ ID NO: 880913 - DNA, 25 bp, Mus musculus
tggagcacctccacaaagttcagtt

SEQ ID NO: 880914 - DNA, 25 bp, Mus musculus
tggagcacctcctcaaagttcagtt

SEQ ID NO: 880915 - DNA, 25 bp, Mus musculus
tggagcacctgcagagtgaccagat

SEQ ID NO: 880916 - DNA, 25 bp, Mus musculus
tggagcacctgcagggatttattca

SEQ ID NO: 880917 - DNA, 25 bp, Mus musculus
tggagcacctgctgagtgaccagat

SEQ ID NO: 880918 - DNA, 25 bp, Mus musculus
tggagcacctgctgggatttattca

SEQ ID NO: 880919 - DNA, 25 bp, Mus musculus
tggagcacgacccaggacgcttgtt

SEQ ID NO: 880920 - DNA, 25 bp, Mus musculus
tggagcacgaccgaggacgcttgtt

SEQ ID NO: 880921 - DNA, 25 bp, Mus musculus
tggagcacgtatcgccctctcaaag

SEQ ID NO: 880922 - DNA, 25 bp, Mus musculus
tggagcacgtatggccctctcaaag

SEQ ID NO: 880923 - DNA, 25 bp, Mus musculus
tggagcacgtccatgatacggtgtt

SEQ ID NO: 880924 - DNA, 25 bp, Mus musculus
tggagcacgtccttgatacggtgtt

SEQ ID NO: 880925 - DNA, 25 bp, Mus musculus
tggagcactacgacttgcaggccac

SEQ ID NO: 880926 - DNA, 25 bp, Mus musculus
tggagcactacgtcttgcaggccac

SEQ ID NO: 880927 - DNA, 25 bp, Mus musculus
tggagcactaggagtggtcagttat

SEQ ID NO: 880928 - DNA, 25 bp, Mus musculus
tggagcactaggtgtggtcagttat

SEQ ID NO: 880929 - DNA, 25 bp, Mus musculus
tggagcactcacaaaaagcgaccta

SEQ ID NO: 880930 - DNA, 25 bp, Mus musculus
tggagcactcactaaaagcgaccta

SEQ ID NO: 880931 - DNA, 25 bp, Mus musculus
tggagcactgctagctgacaatctc

SEQ ID NO: 880932 - DNA, 25 bp, Mus musculus
tggagcactgcttgctgacaatctc

SEQ ID NO: 880933 - DNA, 25 bp, Mus musculus
tggagcactgtcagccttatatcag

SEQ ID NO: 880934 - DNA, 25 bp, Mus musculus
tggagcactgtctgccttatatcag

SEQ ID NO: 880935 - DNA, 25 bp, Mus musculus
tggagcagaactaggccgccactga

SEQ ID NO: 880936 - DNA, 25 bp, Mus musculus
tggagcagaacttggccgccactga

SEQ ID NO: 880937 - DNA, 25 bp, Mus musculus
tggagcagaagaaatcctacctgga

SEQ ID NO: 880938 - DNA, 25 bp, Mus musculus
tggagcagaagatatcctacctgga

SEQ ID NO: 880939 - DNA, 25 bp, Mus musculus
tggagcagaccgagaccaggctgac

SEQ ID NO: 880940 - DNA, 25 bp, Mus musculus
tggagcagaccgtgaccaggctgac

SEQ ID NO: 880941 - DNA, 25 bp, Mus musculus
tggagcagagagactgcaagccttt

SEQ ID NO: 880942 - DNA, 25 bp, Mus musculus
tggagcagagagtctgcaagccttt

SEQ ID NO: 880943 - DNA, 25 bp, Mus musculus
tggagcagccagacaaggtggacat

SEQ ID NO: 880944 - DNA, 25 bp, Mus musculus
tggagcagccagacatccttcaaca

SEQ ID NO: 880945 - DNA, 25 bp, Mus musculus
tggagcagccagtcaaggtggacat

SEQ ID NO: 880946 - DNA, 25 bp, Mus musculus
tggagcagccagtcatccttcaaca

SEQ ID NO: 880947 - DNA, 25 bp, Mus musculus
tggagcagccataccttcaccaaaa

SEQ ID NO: 880948 - DNA, 25 bp, Mus musculus
tggagcagccattccttcaccaaaa

SEQ ID NO: 880949 - DNA, 25 bp, Mus musculus
tggagcagctcaagcgccattactg

SEQ ID NO: 880950 - DNA, 25 bp, Mus musculus
tggagcagctcatgcgccattactg

SEQ ID NO: 880951 - DNA, 25 bp, Mus musculus
tggagcagctccacagtcaccgcga

SEQ ID NO: 880952 - DNA, 25 bp, Mus musculus
tggagcagctccatataatacaaat

SEQ ID NO: 880953 - DNA, 25 bp, Mus musculus
tggagcagctcctcagtcaccgcga

SEQ ID NO: 880954 - DNA, 25 bp, Mus musculus
tggagcagctccttataatacaaat

SEQ ID NO: 880955 - DNA, 25 bp, Mus musculus
tggagcagctgacgaatgtcccctc

SEQ ID NO: 880956 - DNA, 25 bp, Mus musculus
tggagcagctgaggaatgtcccctc

SEQ ID NO: 880957 - DNA, 25 bp, Mus musculus
tggagcagctgtagacgggacccct

SEQ ID NO: 880958 - DNA, 25 bp, Mus musculus
tggagcagctgtatcaggagcaccg

SEQ ID NO: 880959 - DNA, 25 bp, Mus musculus
tggagcagctgttgacgggacccct

SEQ ID NO: 880960 - DNA, 25 bp, Mus musculus
tggagcagctgtttcaggagcaccg

SEQ ID NO: 880961 - DNA, 25 bp, Mus musculus
tggagcagcttcagcctttcttcaa

SEQ ID NO: 880962 - DNA, 25 bp, Mus musculus
tggagcagcttctgcctttcttcaa

SEQ ID NO: 880963 - DNA, 25 bp, Mus musculus
tggagcaggaccagcttgagctacc

SEQ ID NO: 880964 - DNA, 25 bp, Mus musculus
tggagcaggacctgcttgagctacc

SEQ ID NO: 880965 - DNA, 25 bp, Mus musculus
tggagcaggctgatgagatttcttg

SEQ ID NO: 880966 - DNA, 25 bp, Mus musculus
tggagcaggctgttgagatttcttg

SEQ ID NO: 880967 - DNA, 25 bp, Mus musculus
tggagcaggttaacatccctcactg

SEQ ID NO: 880968 - DNA, 25 bp, Mus musculus
tggagcaggttatcatccctcactg

SEQ ID NO: 880969 - DNA, 25 bp, Mus musculus
tggagcagtatcagcgtgtccaccc

SEQ ID NO: 880970 - DNA, 25 bp, Mus musculus
tggagcagtatctgcgtgtccaccc

SEQ ID NO: 880971 - DNA, 25 bp, Mus musculus
tggagcagtattagtgagcacagta

SEQ ID NO: 880972 - DNA, 25 bp, Mus musculus
tggagcagtatttgtgagcacagta

SEQ ID NO: 880973 - DNA, 25 bp, Mus musculus
tggagcagtgtccatatgccacacc

SEQ ID NO: 880974 - DNA, 25 bp, Mus musculus
tggagcagtgtcgatatgccacacc

SEQ ID NO: 880975 - DNA, 25 bp, Mus musculus
tggagcagtgttcaattaaaagtac

SEQ ID NO: 880976 - DNA, 25 bp, Mus musculus
tggagcagtgttgaattaaaagtac

SEQ ID NO: 880977 - DNA, 25 bp, Mus musculus
tggagcagttccaccacggcaggtg

SEQ ID NO: 880978 - DNA, 25 bp, Mus musculus
tggagcagttcctccacggcaggtg

SEQ ID NO: 880979 - DNA, 25 bp, Mus musculus
tggagcagtttaaaccgcgacaata

SEQ ID NO: 880980 - DNA, 25 bp, Mus musculus
tggagcagtttataccgcgacaata

SEQ ID NO: 880981 - DNA, 25 bp, Mus musculus
tggagcatacaaccgatgaagatct

SEQ ID NO: 880982 - DNA, 25 bp, Mus musculus
tggagcatacaagcgatgaagatct

SEQ ID NO: 880983 - DNA, 25 bp, Mus musculus
tggagcataccaacagctctccttg

SEQ ID NO: 880984 - DNA, 25 bp, Mus musculus
tggagcataccatcagctctccttg

SEQ ID NO: 880985 - DNA, 25 bp, Mus musculus
tggagcatatggaaagccctgggtt

SEQ ID NO: 880986 - DNA, 25 bp, Mus musculus
tggagcatatggtaagccctgggtt

SEQ ID NO: 880987 - DNA, 25 bp, Mus musculus
tggagcatcagcctgcgcacacagg

SEQ ID NO: 880988 - DNA, 25 bp, Mus musculus
tggagcatcagcgtgcgcacacagg

SEQ ID NO: 880989 - DNA, 25 bp, Mus musculus
tggagcatcaggcaggaacctcgca

SEQ ID NO: 880990 - DNA, 25 bp, Mus musculus
tggagcatcagggaggaacctcgca

SEQ ID NO: 880991 - DNA, 25 bp, Mus musculus
tggagcatcatgagtgtcagacact

SEQ ID NO: 880992 - DNA, 25 bp, Mus musculus
tggagcatcatgtgtgtcagacact

SEQ ID NO: 880993 - DNA, 25 bp, Mus musculus
tggagcattattcattcctggtctc

SEQ ID NO: 880994 - DNA, 25 bp, Mus musculus
tggagcattattgattcctggtctc

SEQ ID NO: 880995 - DNA, 25 bp, Mus musculus
tggagcattggtacttgttaggtct

SEQ ID NO: 880996 - DNA, 25 bp, Mus musculus
tggagcattggttcttgttaggtct

SEQ ID NO: 880997 - DNA, 25 bp, Mus musculus
tggagccaacctagtgcagtgtaac

SEQ ID NO: 880998 - DNA, 25 bp, Mus musculus
tggagccaaccttgtgcagtgtaac

SEQ ID NO: 880999 - DNA, 25 bp, Mus musculus
tggagccaatgtacccaggcgacta

SEQ ID NO: 881000 - DNA, 25 bp, Mus musculus
tggagccaatgttcccaggcgacta

SEQ ID NO: 881001 - DNA, 25 bp, Mus musculus
tggagccacacaagtgccaataaat

SEQ ID NO: 881002 - DNA, 25 bp, Mus musculus
tggagccacacatgtgccaataaat

SEQ ID NO: 881003 - DNA, 25 bp, Mus musculus
tggagccaccccacgagttgtacct

SEQ ID NO: 881004 - DNA, 25 bp, Mus musculus
tggagccacccctcgagttgtacct

SEQ ID NO: 881005 - DNA, 25 bp, Mus musculus
tggagccacccgagcaggtcaggaa

SEQ ID NO: 881006 - DNA, 25 bp, Mus musculus
tggagccacccgtgcaggtcaggaa

SEQ ID NO: 881007 - DNA, 25 bp, Mus musculus
tggagccacctgctgacacagtgta

SEQ ID NO: 881008 - DNA, 25 bp, Mus musculus
tggagccacctggtgacacagtgta

SEQ ID NO: 881009 - DNA, 25 bp, Mus musculus
tggagccacggcagaagcagcttct

SEQ ID NO: 881010 - DNA, 25 bp, Mus musculus
tggagccacggctgaagcagcttct

SEQ ID NO: 881011 - DNA, 25 bp, Mus musculus
tggagccagagaactttcctgctgc

SEQ ID NO: 881012 - DNA, 25 bp, Mus musculus
tggagccagagatctttcctgctgc

SEQ ID NO: 881013 - DNA, 25 bp, Mus musculus
tggagccagcagacaacccgttcct

SEQ ID NO: 881014 - DNA, 25 bp, Mus musculus
tggagccagcagtcaacccgttcct

SEQ ID NO: 881015 - DNA, 25 bp, Mus musculus
tggagccagccacagcctgtgatta

SEQ ID NO: 881016 - DNA, 25 bp, Mus musculus
tggagccagccagagcctgtgatta

SEQ ID NO: 881017 - DNA, 25 bp, Mus musculus
tggagccagctcatttttggccttt

SEQ ID NO: 881018 - DNA, 25 bp, Mus musculus
tggagccagctcttttttggccttt

SEQ ID NO: 881019 - DNA, 25 bp, Mus musculus
tggagccagctgagacctggccctg

SEQ ID NO: 881020 - DNA, 25 bp, Mus musculus
tggagccagctgtgacctggccctg

SEQ ID NO: 881021 - DNA, 25 bp, Mus musculus
tggagccaggagcaatctcacccac

SEQ ID NO: 881022 - DNA, 25 bp, Mus musculus
tggagccaggaggaatctcacccac

SEQ ID NO: 881023 - DNA, 25 bp, Mus musculus
tggagccaggccaccagacaggaca

SEQ ID NO: 881024 - DNA, 25 bp, Mus musculus
tggagccaggcctccagacaggaca

SEQ ID NO: 881025 - DNA, 25 bp, Mus musculus
tggagccagggcacaatcaaggctg

SEQ ID NO: 881026 - DNA, 25 bp, Mus musculus
tggagccagggccatactgctgtat

SEQ ID NO: 881027 - DNA, 25 bp, Mus musculus
tggagccagggcgatactgctgtat

SEQ ID NO: 881028 - DNA, 25 bp, Mus musculus
tggagccagggctcaatcaaggctg

SEQ ID NO: 881029 - DNA, 25 bp, Mus musculus
tggagccagtgcatcggacggttca

SEQ ID NO: 881030 - DNA, 25 bp, Mus musculus
tggagccagtgcttcggacggttca

SEQ ID NO: 881031 - DNA, 25 bp, Mus musculus
tggagccatggtcaccctcactgga

SEQ ID NO: 881032 - DNA, 25 bp, Mus musculus
tggagccatggtgaccctcactgga

SEQ ID NO: 881033 - DNA, 25 bp, Mus musculus
tggagccatgtgctcaaactcctct

SEQ ID NO: 881034 - DNA, 25 bp, Mus musculus
tggagccatgtggtcaaactcctct

SEQ ID NO: 881035 - DNA, 25 bp, Mus musculus
tggagccattgcctcgtgcaggaat

SEQ ID NO: 881036 - DNA, 25 bp, Mus musculus
tggagccattgcctgatccatcagt

SEQ ID NO: 881037 - DNA, 25 bp, Mus musculus
tggagccattgcgtcgtgcaggaat

SEQ ID NO: 881038 - DNA, 25 bp, Mus musculus
tggagccattgcgtgatccatcagt

SEQ ID NO: 881039 - DNA, 25 bp, Mus musculus
tggagcccaaggctcatcctctcta

SEQ ID NO: 881040 - DNA, 25 bp, Mus musculus
tggagcccaagggtcatcctctcta

SEQ ID NO: 881041 - DNA, 25 bp, Mus musculus
tggagcccacatcaattgccagagc

SEQ ID NO: 881042 - DNA, 25 bp, Mus musculus
tggagcccacatgaattgccagagc

SEQ ID NO: 881043 - DNA, 25 bp, Mus musculus
tggagcccactgagcgctctggtgc

SEQ ID NO: 881044 - DNA, 25 bp, Mus musculus
tggagcccactgtgcgctctggtgc

SEQ ID NO: 881045 - DNA, 25 bp, Mus musculus
tggagcccagcccgcagtttgtaaa

SEQ ID NO: 881046 - DNA, 25 bp, Mus musculus
tggagcccagccggcagtttgtaaa

SEQ ID NO: 881047 - DNA, 25 bp, Mus musculus
tggagcccagcgctgcgctatgctc

SEQ ID NO: 881048 - DNA, 25 bp, Mus musculus
tggagcccagcggtgcgctatgctc

SEQ ID NO: 881049 - DNA, 25 bp, Mus musculus
tggagcccagctatgcgccgcagag

SEQ ID NO: 881050 - DNA, 25 bp, Mus musculus
tggagcccagctttgcgccgcagag

SEQ ID NO: 881051 - DNA, 25 bp, Mus musculus
tggagcccaggccttttgcagaatg

SEQ ID NO: 881052 - DNA, 25 bp, Mus musculus
tggagcccaggcgttttgcagaatg

SEQ ID NO: 881053 - DNA, 25 bp, Mus musculus
tggagccccacaaggagtccctgaa

SEQ ID NO: 881054 - DNA, 25 bp, Mus musculus
tggagccccacatggagtccctgaa

SEQ ID NO: 881055 - DNA, 25 bp, Mus musculus
tggagccccagaaggtagtgttttc

SEQ ID NO: 881056 - DNA, 25 bp, Mus musculus
tggagccccagatggtagtgttttc

SEQ ID NO: 881057 - DNA, 25 bp, Mus musculus
tggagccccagtcttgactcagcca

SEQ ID NO: 881058 - DNA, 25 bp, Mus musculus
tggagccccagtgttgactcagcca

SEQ ID NO: 881059 - DNA, 25 bp, Mus musculus
tggagcccctcaatacggagatcct

SEQ ID NO: 881060 - DNA, 25 bp, Mus musculus
tggagcccctcattacggagatcct

SEQ ID NO: 881061 - DNA, 25 bp, Mus musculus
tggagcccctggctctcaagtgcac

SEQ ID NO: 881062 - DNA, 25 bp, Mus musculus
tggagcccctgggtctcaagtgcac

SEQ ID NO: 881063 - DNA, 25 bp, Mus musculus
tggagcccctttcctgattctatgg

SEQ ID NO: 881064 - DNA, 25 bp, Mus musculus
tggagcccctttgctgattctatgg

SEQ ID NO: 881065 - DNA, 25 bp, Mus musculus
tggagcccgagcagaagcgcagcaa

SEQ ID NO: 881066 - DNA, 25 bp, Mus musculus
tggagcccgagctgaagcgcagcaa

SEQ ID NO: 881067 - DNA, 25 bp, Mus musculus
tggagcccgtccctctgcactggat

SEQ ID NO: 881068 - DNA, 25 bp, Mus musculus
tggagcccgtccgtctgcactggat

SEQ ID NO: 881069 - DNA, 25 bp, Mus musculus
tggagccctaagctttgatcctcta

SEQ ID NO: 881070 - DNA, 25 bp, Mus musculus
tggagccctaaggtttgatcctcta

SEQ ID NO: 881071 - DNA, 25 bp, Mus musculus
tggagccctcagaagctttgacact

SEQ ID NO: 881072 - DNA, 25 bp, Mus musculus
tggagccctcagtagctttgacact

SEQ ID NO: 881073 - DNA, 25 bp, Mus musculus
tggagccctccaaagtgcaaagaag

SEQ ID NO: 881074 - DNA, 25 bp, Mus musculus
tggagccctccacgaacttagataa

SEQ ID NO: 881075 - DNA, 25 bp, Mus musculus
tggagccctccaggaacttagataa

SEQ ID NO: 881076 - DNA, 25 bp, Mus musculus
tggagccctccatagtgcaaagaag

SEQ ID NO: 881077 - DNA, 25 bp, Mus musculus
tggagccctctcaaaactgttaatg

SEQ ID NO: 881078 - DNA, 25 bp, Mus musculus
tggagccctctctaaactgttaatg

SEQ ID NO: 881079 - DNA, 25 bp, Mus musculus
tggagccctctgaacttcaagtcaa

SEQ ID NO: 881080 - DNA, 25 bp, Mus musculus
tggagccctctgctcctacaggact

SEQ ID NO: 881081 - DNA, 25 bp, Mus musculus
tggagccctctgctgtttaagaaac

SEQ ID NO: 881082 - DNA, 25 bp, Mus musculus
tggagccctctggtcctacaggact

SEQ ID NO: 881083 - DNA, 25 bp, Mus musculus
tggagccctctggtgtttaagaaac

SEQ ID NO: 881084 - DNA, 25 bp, Mus musculus
tggagccctctgtacttcaagtcaa

SEQ ID NO: 881085 - DNA, 25 bp, Mus musculus
tggagccctgagagcagcattgcca

SEQ ID NO: 881086 - DNA, 25 bp, Mus musculus
tggagccctgagtgcagcattgcca

SEQ ID NO: 881087 - DNA, 25 bp, Mus musculus
tggagccgactgcaaatacaagttt

SEQ ID NO: 881088 - DNA, 25 bp, Mus musculus
tggagccgactggaaatacaagttt

SEQ ID NO: 881089 - DNA, 25 bp, Mus musculus
tggagccgagtgcagttttccctga

SEQ ID NO: 881090 - DNA, 25 bp, Mus musculus
tggagccgagtggagttttccctga

SEQ ID NO: 881091 - DNA, 25 bp, Mus musculus
tggagccgccatagagctaagctgt

SEQ ID NO: 881092 - DNA, 25 bp, Mus musculus
tggagccgccattgagctaagctgt

SEQ ID NO: 881093 - DNA, 25 bp, Mus musculus
tggagccgggataccaggcagaccc

SEQ ID NO: 881094 - DNA, 25 bp, Mus musculus
tggagccgggattccaggcagaccc

SEQ ID NO: 881095 - DNA, 25 bp, Mus musculus
tggagcctagaccttgggcacaata

SEQ ID NO: 881096 - DNA, 25 bp, Mus musculus
tggagcctagacgttgggcacaata

SEQ ID NO: 881097 - DNA, 25 bp, Mus musculus
tggagcctcaagcaccagttagctt

SEQ ID NO: 881098 - DNA, 25 bp, Mus musculus
tggagcctcaaggaccagttagctt

SEQ ID NO: 881099 - DNA, 25 bp, Mus musculus
tggagcctcagtagacaaggagact

SEQ ID NO: 881100 - DNA, 25 bp, Mus musculus
tggagcctcagttgacaaggagact

SEQ ID NO: 881101 - DNA, 25 bp, Mus musculus
tggagcctcatgacttgggagccta

SEQ ID NO: 881102 - DNA, 25 bp, Mus musculus
tggagcctcatgtcttgggagccta

SEQ ID NO: 881103 - DNA, 25 bp, Mus musculus
tggagcctccacctatatgtatgag

SEQ ID NO: 881104 - DNA, 25 bp, Mus musculus
tggagcctccacgtatatgtatgag

SEQ ID NO: 881105 - DNA, 25 bp, Mus musculus
tggagcctctgtacaatcggtatga

SEQ ID NO: 881106 - DNA, 25 bp, Mus musculus
tggagcctctgttcaatcggtatga

SEQ ID NO: 881107 - DNA, 25 bp, Mus musculus
tggagcctgagaattcaccagtagc

SEQ ID NO: 881108 - DNA, 25 bp, Mus musculus
tggagcctgagatttcaccagtagc

SEQ ID NO: 881109 - DNA, 25 bp, Mus musculus
tggagcctgaggaacgcctggaaca

SEQ ID NO: 881110 - DNA, 25 bp, Mus musculus
tggagcctgaggtacgcctggaaca

SEQ ID NO: 881111 - DNA, 25 bp, Mus musculus
tggagcctgagtaccacatgtcctg

SEQ ID NO: 881112 - DNA, 25 bp, Mus musculus
tggagcctgagttccacatgtcctg

SEQ ID NO: 881113 - DNA, 25 bp, Mus musculus
tggagcctgattctgtgttgcgcct

SEQ ID NO: 881114 - DNA, 25 bp, Mus musculus
tggagcctgattgtgtgttgcgcct

SEQ ID NO: 881115 - DNA, 25 bp, Mus musculus
tggagcctgcaactccagcattcag

SEQ ID NO: 881116 - DNA, 25 bp, Mus musculus
tggagcctgcaagtccagcattcag

SEQ ID NO: 881117 - DNA, 25 bp, Mus musculus
tggagcctggaaacctctgcttcta

SEQ ID NO: 881118 - DNA, 25 bp, Mus musculus
tggagcctggaatcctctgcttcta

SEQ ID NO: 881119 - DNA, 25 bp, Mus musculus
tggagcctggcaaccagagttgctt

SEQ ID NO: 881120 - DNA, 25 bp, Mus musculus
tggagcctggcatccagagttgctt

SEQ ID NO: 881121 - DNA, 25 bp, Mus musculus
tggagcctggcgaccttatcaagtg

SEQ ID NO: 881122 - DNA, 25 bp, Mus musculus
tggagcctggcgtccttatcaagtg

SEQ ID NO: 881123 - DNA, 25 bp, Mus musculus
tggagcctggtcatcaataagaaca

SEQ ID NO: 881124 - DNA, 25 bp, Mus musculus
tggagcctggtcttcaataagaaca

SEQ ID NO: 881125 - DNA, 25 bp, Mus musculus
tggagcctggttatctgtgtccaac

SEQ ID NO: 881126 - DNA, 25 bp, Mus musculus
tggagcctggttttctgtgtccaac

SEQ ID NO: 881127 - DNA, 25 bp, Mus musculus
tggagcctgtctaatatcaatctag

SEQ ID NO: 881128 - DNA, 25 bp, Mus musculus
tggagcctgtcttatatcaatctag

SEQ ID NO: 881129 - DNA, 25 bp, Mus musculus
tggagcctgtgcatcagggtataaa

SEQ ID NO: 881130 - DNA, 25 bp, Mus musculus
tggagcctgtgcttcagggtataaa

SEQ ID NO: 881131 - DNA, 25 bp, Mus musculus
tggagccttcacagggatgccagga

SEQ ID NO: 881132 - DNA, 25 bp, Mus musculus
tggagccttcacatggtcctggtgt

SEQ ID NO: 881133 - DNA, 25 bp, Mus musculus
tggagccttcactgggatgccagga

SEQ ID NO: 881134 - DNA, 25 bp, Mus musculus
tggagccttcacttggtcctggtgt

SEQ ID NO: 881135 - DNA, 25 bp, Mus musculus
tggagccttccaaagtcaagtgaat

SEQ ID NO: 881136 - DNA, 25 bp, Mus musculus
tggagccttccatagtcaagtgaat

SEQ ID NO: 881137 - DNA, 25 bp, Mus musculus
tggagccttcccatgttcctacaat

SEQ ID NO: 881138 - DNA, 25 bp, Mus musculus
tggagccttcccttgttcctacaat

SEQ ID NO: 881139 - DNA, 25 bp, Mus musculus
tggagcctttgaccatggtacgtgc

SEQ ID NO: 881140 - DNA, 25 bp, Mus musculus
tggagcctttgagcatggtacgtgc

SEQ ID NO: 881141 - DNA, 25 bp, Mus musculus
tggagcgaacctcccggttcctggc

SEQ ID NO: 881142 - DNA, 25 bp, Mus musculus
tggagcgaacctgccggttcctggc

SEQ ID NO: 881143 - DNA, 25 bp, Mus musculus
tggagcgacgtccaacccttttgaa

SEQ ID NO: 881144 - DNA, 25 bp, Mus musculus
tggagcgacgtcgaacccttttgaa

SEQ ID NO: 881145 - DNA, 25 bp, Mus musculus
tggagcgactccaataatttctaat

SEQ ID NO: 881146 - DNA, 25 bp, Mus musculus
tggagcgactcctataatttctaat

SEQ ID NO: 881147 - DNA, 25 bp, Mus musculus
tggagcgagaatataagcatgagcc

SEQ ID NO: 881148 - DNA, 25 bp, Mus musculus
tggagcgagaatttaagcatgagcc

SEQ ID NO: 881149 - DNA, 25 bp, Mus musculus
tggagcgaggaacggatcgcttaca

SEQ ID NO: 881150 - DNA, 25 bp, Mus musculus
tggagcgaggaagggatcgcttaca

SEQ ID NO: 881151 - DNA, 25 bp, Mus musculus
tggagcgagtgaacaccatcatgca

SEQ ID NO: 881152 - DNA, 25 bp, Mus musculus
tggagcgagtgatcaccatcatgca

SEQ ID NO: 881153 - DNA, 25 bp, Mus musculus
tggagcgataggactcccaggtgac

SEQ ID NO: 881154 - DNA, 25 bp, Mus musculus
tggagcgataggtctcccaggtgac

SEQ ID NO: 881155 - DNA, 25 bp, Mus musculus
tggagcgcagcaaaaccaccatcat

SEQ ID NO: 881156 - DNA, 25 bp, Mus musculus
tggagcgcagcataaccaccatcat

SEQ ID NO: 881157 - DNA, 25 bp, Mus musculus
tggagcgcagctcctactggaaatg

SEQ ID NO: 881158 - DNA, 25 bp, Mus musculus
tggagcgcagctgctactggaaatg

SEQ ID NO: 881159 - DNA, 25 bp, Mus musculus
tggagcgccacgctgacacaggcaa

SEQ ID NO: 881160 - DNA, 25 bp, Mus musculus
tggagcgccacggtgacacaggcaa

SEQ ID NO: 881161 - DNA, 25 bp, Mus musculus
tggagcgcctgtatgagatgattct

SEQ ID NO: 881162 - DNA, 25 bp, Mus musculus
tggagcgcctgtcgctcgatgccaa

SEQ ID NO: 881163 - DNA, 25 bp, Mus musculus
tggagcgcctgtggctcgatgccaa

SEQ ID NO: 881164 - DNA, 25 bp, Mus musculus
tggagcgcctgtttgagatgattct

SEQ ID NO: 881165 - DNA, 25 bp, Mus musculus
tggagcgccttgcacggtaccagac

SEQ ID NO: 881166 - DNA, 25 bp, Mus musculus
tggagcgccttggacggtaccagac

SEQ ID NO: 881167 - DNA, 25 bp, Mus musculus
tggagcgcgctcatgggcagcaaac

SEQ ID NO: 881168 - DNA, 25 bp, Mus musculus
tggagcgcgctcttgggcagcaaac

SEQ ID NO: 881169 - DNA, 25 bp, Mus musculus
tggagcgcgggaccatcgtcttcat

SEQ ID NO: 881170 - DNA, 25 bp, Mus musculus
tggagcgcgggagcatcgtcttcat

SEQ ID NO: 881171 - DNA, 25 bp, Mus musculus
tggagcgctacgactgcaagtgaga

SEQ ID NO: 881172 - DNA, 25 bp, Mus musculus
tggagcgctacgtctgcaagtgaga

SEQ ID NO: 881173 - DNA, 25 bp, Mus musculus
tggagcggaagcagtggccaccaca

SEQ ID NO: 881174 - DNA, 25 bp, Mus musculus
tggagcggaagctgtggccaccaca

SEQ ID NO: 881175 - DNA, 25 bp, Mus musculus
tggagcggcgtgctcattctctgtc

SEQ ID NO: 881176 - DNA, 25 bp, Mus musculus
tggagcggcgtggtcattctctgtc

SEQ ID NO: 881177 - DNA, 25 bp, Mus musculus
tggagcggctctccgacagactgct

SEQ ID NO: 881178 - DNA, 25 bp, Mus musculus
tggagcggctctgcgacagactgct

SEQ ID NO: 881179 - DNA, 25 bp, Mus musculus
tggagcgggactacgaccgccttat

SEQ ID NO: 881180 - DNA, 25 bp, Mus musculus
tggagcgggacttcgaccgccttat

SEQ ID NO: 881181 - DNA, 25 bp, Mus musculus
tggagcgggcagagtctcgacaaaa

SEQ ID NO: 881182 - DNA, 25 bp, Mus musculus
tggagcgggcagcaactctagccac

SEQ ID NO: 881183 - DNA, 25 bp, Mus musculus
tggagcgggcaggaactctagccac

SEQ ID NO: 881184 - DNA, 25 bp, Mus musculus
tggagcgggcagtgtctcgacaaaa

SEQ ID NO: 881185 - DNA, 25 bp, Mus musculus
tggagcggtcccagggaagttacac

SEQ ID NO: 881186 - DNA, 25 bp, Mus musculus
tggagcggtccctgggaagttacac

SEQ ID NO: 881187 - DNA, 25 bp, Mus musculus
tggagcggtgtgctcagattctttc

SEQ ID NO: 881188 - DNA, 25 bp, Mus musculus
tggagcggtgtggtcagattctttc

SEQ ID NO: 881189 - DNA, 25 bp, Mus musculus
tggagcgtaattatcccgagcgtcc

SEQ ID NO: 881190 - DNA, 25 bp, Mus musculus
tggagcgtaattttcccgagcgtcc

SEQ ID NO: 881191 - DNA, 25 bp, Mus musculus
tggagcgttaccaccgaaccagctg

SEQ ID NO: 881192 - DNA, 25 bp, Mus musculus
tggagcgttacctccgaaccagctg

SEQ ID NO: 881193 - DNA, 25 bp, Mus musculus
tggagctaagaaagctacctacctc

SEQ ID NO: 881194 - DNA, 25 bp, Mus musculus
tggagctaagaatgctacctacctc

SEQ ID NO: 881195 - DNA, 25 bp, Mus musculus
tggagctaagacaacttatcaagaa

SEQ ID NO: 881196 - DNA, 25 bp, Mus musculus
tggagctaagactacttatcaagaa

SEQ ID NO: 881197 - DNA, 25 bp, Mus musculus
tggagctaatcaaccatgccttctt

SEQ ID NO: 881198 - DNA, 25 bp, Mus musculus
tggagctaatcatccatgccttctt

SEQ ID NO: 881199 - DNA, 25 bp, Mus musculus
tggagctacctccttagactgtatt

SEQ ID NO: 881200 - DNA, 25 bp, Mus musculus
tggagctacctcgttagactgtatt

SEQ ID NO: 881201 - DNA, 25 bp, Mus musculus
tggagctactagcattggtttcctt

SEQ ID NO: 881202 - DNA, 25 bp, Mus musculus
tggagctactaggattggtttcctt

SEQ ID NO: 881203 - DNA, 25 bp, Mus musculus
tggagctagaaaagccactacctgc

SEQ ID NO: 881204 - DNA, 25 bp, Mus musculus
tggagctagaaatgccactacctgc

SEQ ID NO: 881205 - DNA, 25 bp, Mus musculus
tggagctagaggagtgcccaccatt

SEQ ID NO: 881206 - DNA, 25 bp, Mus musculus
tggagctagaggcttctgtgccaca

SEQ ID NO: 881207 - DNA, 25 bp, Mus musculus
tggagctagagggttctgtgccaca

SEQ ID NO: 881208 - DNA, 25 bp, Mus musculus
tggagctagaggtgtgcccaccatt

SEQ ID NO: 881209 - DNA, 25 bp, Mus musculus
tggagctaggacatccaccagcatg

SEQ ID NO: 881210 - DNA, 25 bp, Mus musculus
tggagctaggacttccaccagcatg

SEQ ID NO: 881211 - DNA, 25 bp, Mus musculus
tggagctaggatacagcctgcacca

SEQ ID NO: 881212 - DNA, 25 bp, Mus musculus
tggagctaggattcagcctgcacca

SEQ ID NO: 881213 - DNA, 25 bp, Mus musculus
tggagctaggttcctatgtaaccca

SEQ ID NO: 881214 - DNA, 25 bp, Mus musculus
tggagctaggttgctatgtaaccca

SEQ ID NO: 881215 - DNA, 25 bp, Mus musculus
tggagctcagctctaatgccatcat

SEQ ID NO: 881216 - DNA, 25 bp, Mus musculus
tggagctcagctgtaatgccatcat

SEQ ID NO: 881217 - DNA, 25 bp, Mus musculus
tggagctcaggtaccaagttggaaa

SEQ ID NO: 881218 - DNA, 25 bp, Mus musculus
tggagctcaggttccaagttggaaa

SEQ ID NO: 881219 - DNA, 25 bp, Mus musculus
tggagctcagtgctgtagtacatgc

SEQ ID NO: 881220 - DNA, 25 bp, Mus musculus
tggagctcagtggtgtagtacatgc

SEQ ID NO: 881221 - DNA, 25 bp, Mus musculus
tggagctcatcgaacgaggacttgc

SEQ ID NO: 881222 - DNA, 25 bp, Mus musculus
tggagctcatcgtacgaggacttgc

SEQ ID NO: 881223 - DNA, 25 bp, Mus musculus
tggagctcatggacacaagcctggt

SEQ ID NO: 881224 - DNA, 25 bp, Mus musculus
tggagctcatggtcacaagcctggt

SEQ ID NO: 881225 - DNA, 25 bp, Mus musculus
tggagctcccacctcatgtgttgag

SEQ ID NO: 881226 - DNA, 25 bp, Mus musculus
tggagctcccacgtcatgtgttgag

SEQ ID NO: 881227 - DNA, 25 bp, Mus musculus
tggagctcctatcggcacatcggcc

SEQ ID NO: 881228 - DNA, 25 bp, Mus musculus
tggagctcctatgggcacatcggcc

SEQ ID NO: 881229 - DNA, 25 bp, Mus musculus
tggagctcgcacacaggtacttcag

SEQ ID NO: 881230 - DNA, 25 bp, Mus musculus
tggagctcgcactcaggtacttcag

SEQ ID NO: 881231 - DNA, 25 bp, Mus musculus
tggagctcgccaaacaggatgttgt

SEQ ID NO: 881232 - DNA, 25 bp, Mus musculus
tggagctcgccatacaggatgttgt

SEQ ID NO: 881233 - DNA, 25 bp, Mus musculus
tggagctcggaactctaccctggta

SEQ ID NO: 881234 - DNA, 25 bp, Mus musculus
tggagctcggaagtctaccctggta

SEQ ID NO: 881235 - DNA, 25 bp, Mus musculus
tggagctcgtccatgctgccaggga

SEQ ID NO: 881236 - DNA, 25 bp, Mus musculus
tggagctcgtccttgctgccaggga

SEQ ID NO: 881237 - DNA, 25 bp, Mus musculus
tggagctctacacccattaagacac

SEQ ID NO: 881238 - DNA, 25 bp, Mus musculus
tggagctctacagccattaagacac

SEQ ID NO: 881239 - DNA, 25 bp, Mus musculus
tggagctctcccaaacacacatgta

SEQ ID NO: 881240 - DNA, 25 bp, Mus musculus
tggagctctccctaacacacatgta

SEQ ID NO: 881241 - DNA, 25 bp, Mus musculus
tggagctctcgtcctggttcccaat

SEQ ID NO: 881242 - DNA, 25 bp, Mus musculus
tggagctctcgtgctggttcccaat

SEQ ID NO: 881243 - DNA, 25 bp, Mus musculus
tggagctctctgcaggcgtcaaatc

SEQ ID NO: 881244 - DNA, 25 bp, Mus musculus
tggagctctctggaggcgtcaaatc

SEQ ID NO: 881245 - DNA, 25 bp, Mus musculus
tggagctctgctagtctggaagact

SEQ ID NO: 881246 - DNA, 25 bp, Mus musculus
tggagctctgcttgtctggaagact

SEQ ID NO: 881247 - DNA, 25 bp, Mus musculus
tggagctctgtaaggctctgtagct

SEQ ID NO: 881248 - DNA, 25 bp, Mus musculus
tggagctctgtatggctctgtagct

SEQ ID NO: 881249 - DNA, 25 bp, Mus musculus
tggagctctgtcaactgcatttgcc

SEQ ID NO: 881250 - DNA, 25 bp, Mus musculus
tggagctctgtctactgcatttgcc

SEQ ID NO: 881251 - DNA, 25 bp, Mus musculus
tggagctgacagaggcatgcccatt

SEQ ID NO: 881252 - DNA, 25 bp, Mus musculus
tggagctgacagtggcatgcccatt

SEQ ID NO: 881253 - DNA, 25 bp, Mus musculus
tggagctgaccacttttctaagcct

SEQ ID NO: 881254 - DNA, 25 bp, Mus musculus
tggagctgaccagttttctaagcct

SEQ ID NO: 881255 - DNA, 25 bp, Mus musculus
tggagctgagacctcaagtcccgct

SEQ ID NO: 881256 - DNA, 25 bp, Mus musculus
tggagctgagacgtcaagtcccgct

SEQ ID NO: 881257 - DNA, 25 bp, Mus musculus
tggagctgatctccacttaaggtga

SEQ ID NO: 881258 - DNA, 25 bp, Mus musculus
tggagctgatctgcacttaaggtga

SEQ ID NO: 881259 - DNA, 25 bp, Mus musculus
tggagctgcactccttgtatggcac

SEQ ID NO: 881260 - DNA, 25 bp, Mus musculus
tggagctgcactgcttgtatggcac

SEQ ID NO: 881261 - DNA, 25 bp, Mus musculus
tggagctgcagcacaatcacctgca

SEQ ID NO: 881262 - DNA, 25 bp, Mus musculus
tggagctgcagctcaatcacctgca

SEQ ID NO: 881263 - DNA, 25 bp, Mus musculus
tggagctgccaacaacttaactttc

SEQ ID NO: 881264 - DNA, 25 bp, Mus musculus
tggagctgccaagaacttaactttc

SEQ ID NO: 881265 - DNA, 25 bp, Mus musculus
tggagctgcccacctataatcactg

SEQ ID NO: 881266 - DNA, 25 bp, Mus musculus
tggagctgcccagctataatcactg

SEQ ID NO: 881267 - DNA, 25 bp, Mus musculus
tggagctgccccatcatggagacat

SEQ ID NO: 881268 - DNA, 25 bp, Mus musculus
tggagctgccccttcatggagacat

SEQ ID NO: 881269 - DNA, 25 bp, Mus musculus
tggagctgcctcagtgcgatggcat

SEQ ID NO: 881270 - DNA, 25 bp, Mus musculus
tggagctgcctctgtgcgatggcat

SEQ ID NO: 881271 - DNA, 25 bp, Mus musculus
tggagctgcgcaacacgttcaagga

SEQ ID NO: 881272 - DNA, 25 bp, Mus musculus
tggagctgcgcatcacgttcaagga

SEQ ID NO: 881273 - DNA, 25 bp, Mus musculus
tggagctgctgacatgtgtaccccg

SEQ ID NO: 881274 - DNA, 25 bp, Mus musculus
tggagctgctgagatgtgtaccccg

SEQ ID NO: 881275 - DNA, 25 bp, Mus musculus
tggagctgctgtagcgccagctgaa

SEQ ID NO: 881276 - DNA, 25 bp, Mus musculus
tggagctgctgttgcgccagctgaa

SEQ ID NO: 881277 - DNA, 25 bp, Mus musculus
tggagctggactccatccgcagcca

SEQ ID NO: 881278 - DNA, 25 bp, Mus musculus
tggagctggactgcatccgcagcca

SEQ ID NO: 881279 - DNA, 25 bp, Mus musculus
tggagctggccaatattacatgtgc

SEQ ID NO: 881280 - DNA, 25 bp, Mus musculus
tggagctggccattattacatgtgc

SEQ ID NO: 881281 - DNA, 25 bp, Mus musculus
tggagctggcgcacctgcacggcat

SEQ ID NO: 881282 - DNA, 25 bp, Mus musculus
tggagctggcgctcctgcacggcat

SEQ ID NO: 881283 - DNA, 25 bp, Mus musculus
tggagctggctacgattcccctaag

SEQ ID NO: 881284 - DNA, 25 bp, Mus musculus
tggagctggctaggattcccctaag

SEQ ID NO: 881285 - DNA, 25 bp, Mus musculus
tggagctggctgaaccgcccggact

SEQ ID NO: 881286 - DNA, 25 bp, Mus musculus
tggagctggctgtaccgcccggact

SEQ ID NO: 881287 - DNA, 25 bp, Mus musculus
tggagctggcttctctctgccccaa

SEQ ID NO: 881288 - DNA, 25 bp, Mus musculus
tggagctggcttgtctctgccccaa

SEQ ID NO: 881289 - DNA, 25 bp, Mus musculus
tggagctgggaacccctggcacaaa

SEQ ID NO: 881290 - DNA, 25 bp, Mus musculus
tggagctgggaagccctggcacaaa

SEQ ID NO: 881291 - DNA, 25 bp, Mus musculus
tggagctgggccatcattaccacgt

SEQ ID NO: 881292 - DNA, 25 bp, Mus musculus
tggagctgggccttcattaccacgt

SEQ ID NO: 881293 - DNA, 25 bp, Mus musculus
tggagctggtcgacctcagcggtaa

SEQ ID NO: 881294 - DNA, 25 bp, Mus musculus
tggagctggtcgtcctcagcggtaa

SEQ ID NO: 881295 - DNA, 25 bp, Mus musculus
tggagctgtcagaggcaatgcctgt

SEQ ID NO: 881296 - DNA, 25 bp, Mus musculus
tggagctgtcagtggcaatgcctgt

SEQ ID NO: 881297 - DNA, 25 bp, Mus musculus
tggagctgtccgagaccatttctat

SEQ ID NO: 881298 - DNA, 25 bp, Mus musculus
tggagctgtccgtgaccatttctat

SEQ ID NO: 881299 - DNA, 25 bp, Mus musculus
tggagctgtgctcctggtgcctcat

SEQ ID NO: 881300 - DNA, 25 bp, Mus musculus
tggagctgtgctgctggtgcctcat

SEQ ID NO: 881301 - DNA, 25 bp, Mus musculus
tggagcttaaaccccttgtatattt

SEQ ID NO: 881302 - DNA, 25 bp, Mus musculus
tggagcttaaacgccttgtatattt

SEQ ID NO: 881303 - DNA, 25 bp, Mus musculus
tggagcttagatcctccgtgagccc

SEQ ID NO: 881304 - DNA, 25 bp, Mus musculus
tggagcttagatgctccgtgagccc

SEQ ID NO: 881305 - DNA, 25 bp, Mus musculus
tggagcttagcacctcaggtccctc

SEQ ID NO: 881306 - DNA, 25 bp, Mus musculus
tggagcttagcagctcaggtccctc

SEQ ID NO: 881307 - DNA, 25 bp, Mus musculus
tggagcttcaggaatttgatagcac

SEQ ID NO: 881308 - DNA, 25 bp, Mus musculus
tggagcttcaggtatttgatagcac

SEQ ID NO: 881309 - DNA, 25 bp, Mus musculus
tggagcttccttaagcagaccatgt

SEQ ID NO: 881310 - DNA, 25 bp, Mus musculus
tggagcttcctttagcagaccatgt

SEQ ID NO: 881311 - DNA, 25 bp, Mus musculus
tggagcttcgagcaccgtcactgtg

SEQ ID NO: 881312 - DNA, 25 bp, Mus musculus
tggagcttcgaggaccgtcactgtg

SEQ ID NO: 881313 - DNA, 25 bp, Mus musculus
tggagcttgagcactaggatacctc

SEQ ID NO: 881314 - DNA, 25 bp, Mus musculus
tggagcttgagctctaggatacctc

SEQ ID NO: 881315 - DNA, 25 bp, Mus musculus
tggagcttgctcaatgtgcatgcat

SEQ ID NO: 881316 - DNA, 25 bp, Mus musculus
tggagcttgctctatgtgcatgcat

SEQ ID NO: 881317 - DNA, 25 bp, Mus musculus
tggagcttgctgactttaagcccca

SEQ ID NO: 881318 - DNA, 25 bp, Mus musculus
tggagcttgctgagtttcccagcct

SEQ ID NO: 881319 - DNA, 25 bp, Mus musculus
tggagcttgctgtctttaagcccca

SEQ ID NO: 881320 - DNA, 25 bp, Mus musculus
tggagcttgctgtgtttcccagcct

SEQ ID NO: 881321 - DNA, 25 bp, Mus musculus
tggagcttggtacccatccagccaa

SEQ ID NO: 881322 - DNA, 25 bp, Mus musculus
tggagcttggtagccatccagccaa

SEQ ID NO: 881323 - DNA, 25 bp, Mus musculus
tggagcttgtagagagccacaccaa

SEQ ID NO: 881324 - DNA, 25 bp, Mus musculus
tggagcttgtagtgagccacaccaa

SEQ ID NO: 881325 - DNA, 25 bp, Mus musculus
tggagcttgtcaatgaacccctcag

SEQ ID NO: 881326 - DNA, 25 bp, Mus musculus
tggagcttgtcattgaacccctcag

SEQ ID NO: 881327 - DNA, 25 bp, Mus musculus
tggagctttcggcatctggaaatct

SEQ ID NO: 881328 - DNA, 25 bp, Mus musculus
tggagctttcgggatctggaaatct

SEQ ID NO: 881329 - DNA, 25 bp, Mus musculus
tggagctttggtccactgatgtgaa

SEQ ID NO: 881330 - DNA, 25 bp, Mus musculus
tggagctttggtgcactgatgtgaa

SEQ ID NO: 881331 - DNA, 25 bp, Mus musculus
tggaggaaaagcacacaccccagtg

SEQ ID NO: 881332 - DNA, 25 bp, Mus musculus
tggaggaaaagctcacaccccagtg

SEQ ID NO: 881333 - DNA, 25 bp, Mus musculus
tggaggaacaccaccagagcctgca

SEQ ID NO: 881334 - DNA, 25 bp, Mus musculus
tggaggaacacctccagagcctgca

SEQ ID NO: 881335 - DNA, 25 bp, Mus musculus
tggaggaaccaaactgactgtccta

SEQ ID NO: 881336 - DNA, 25 bp, Mus musculus
tggaggaaccaatctgactgtccta

SEQ ID NO: 881337 - DNA, 25 bp, Mus musculus
tggaggaaccacaatcccttctgca

SEQ ID NO: 881338 - DNA, 25 bp, Mus musculus
tggaggaaccactatcccttctgca

SEQ ID NO: 881339 - DNA, 25 bp, Mus musculus
tggaggaaccccaggattcgaggcc

SEQ ID NO: 881340 - DNA, 25 bp, Mus musculus
tggaggaacccctggattcgaggcc

SEQ ID NO: 881341 - DNA, 25 bp, Mus musculus
tggaggaactccacgcgttctatca

SEQ ID NO: 881342 - DNA, 25 bp, Mus musculus
tggaggaactcctcgcgttctatca

SEQ ID NO: 881343 - DNA, 25 bp, Mus musculus
tggaggaagccactcttcctggcat

SEQ ID NO: 881344 - DNA, 25 bp, Mus musculus
tggaggaagccagtcttcctggcat

SEQ ID NO: 881345 - DNA, 25 bp, Mus musculus
tggaggaagccccaaagcctctgtc

SEQ ID NO: 881346 - DNA, 25 bp, Mus musculus
tggaggaagcccgaaagcctctgtc

SEQ ID NO: 881347 - DNA, 25 bp, Mus musculus
tggaggaatcacacgaatggaagct

SEQ ID NO: 881348 - DNA, 25 bp, Mus musculus
tggaggaatcactcgaatggaagct

SEQ ID NO: 881349 - DNA, 25 bp, Mus musculus
tggaggaattccagccattggtgct

SEQ ID NO: 881350 - DNA, 25 bp, Mus musculus
tggaggaattcctgccattggtgct

SEQ ID NO: 881351 - DNA, 25 bp, Mus musculus
tggaggacaagcacaaccaggctca

SEQ ID NO: 881352 - DNA, 25 bp, Mus musculus
tggaggacaagctcaaccaggctca

SEQ ID NO: 881353 - DNA, 25 bp, Mus musculus
tggaggacaccacctgacctaaggc

SEQ ID NO: 881354 - DNA, 25 bp, Mus musculus
tggaggacaccagctgacctaaggc

SEQ ID NO: 881355 - DNA, 25 bp, Mus musculus
tggaggacacccctcgtactgttac

SEQ ID NO: 881356 - DNA, 25 bp, Mus musculus
tggaggacacccgtcgtactgttac

SEQ ID NO: 881357 - DNA, 25 bp, Mus musculus
tggaggacactaacgaagacaagct

SEQ ID NO: 881358 - DNA, 25 bp, Mus musculus
tggaggacactatcgaagacaagct

SEQ ID NO: 881359 - DNA, 25 bp, Mus musculus
tggaggacagaaagctgcccgctgt

SEQ ID NO: 881360 - DNA, 25 bp, Mus musculus
tggaggacagaatgctgcccgctgt

SEQ ID NO: 881361 - DNA, 25 bp, Mus musculus
tggaggacagacaagtccaccacct

SEQ ID NO: 881362 - DNA, 25 bp, Mus musculus
tggaggacagactagtccaccacct

SEQ ID NO: 881363 - DNA, 25 bp, Mus musculus
tggaggacagcactcacggatgcaa

SEQ ID NO: 881364 - DNA, 25 bp, Mus musculus
tggaggacagcagtcacggatgcaa

SEQ ID NO: 881365 - DNA, 25 bp, Mus musculus
tggaggacagttacccaggtccttt

SEQ ID NO: 881366 - DNA, 25 bp, Mus musculus
tggaggacagtttcccaggtccttt

SEQ ID NO: 881367 - DNA, 25 bp, Mus musculus
tggaggacataaagcagctccccaa

SEQ ID NO: 881368 - DNA, 25 bp, Mus musculus
tggaggacataatgcagctccccaa

SEQ ID NO: 881369 - DNA, 25 bp, Mus musculus
tggaggacatgcctctcttccttgg

SEQ ID NO: 881370 - DNA, 25 bp, Mus musculus
tggaggacatgcgtctcttccttgg

SEQ ID NO: 881371 - DNA, 25 bp, Mus musculus
tggaggaccacactttacaacacgc

SEQ ID NO: 881372 - DNA, 25 bp, Mus musculus
tggaggaccacagtttacaacacgc

SEQ ID NO: 881373 - DNA, 25 bp, Mus musculus
tggaggaccagaacacgctcgtgag

SEQ ID NO: 881374 - DNA, 25 bp, Mus musculus
tggaggaccagatcacgctcgtgag

SEQ ID NO: 881375 - DNA, 25 bp, Mus musculus
tggaggacccagatggtctagcctg

SEQ ID NO: 881376 - DNA, 25 bp, Mus musculus
tggaggacccagttggtctagcctg

SEQ ID NO: 881377 - DNA, 25 bp, Mus musculus
tggaggaccccacgttaacccaatg

SEQ ID NO: 881378 - DNA, 25 bp, Mus musculus
tggaggaccccaggttaacccaatg

SEQ ID NO: 881379 - DNA, 25 bp, Mus musculus
tggaggaccctcaagatgaccaaga

SEQ ID NO: 881380 - DNA, 25 bp, Mus musculus
tggaggaccctctagatgaccaaga

SEQ ID NO: 881381 - DNA, 25 bp, Mus musculus
tggaggaccctgctagactacttaa

SEQ ID NO: 881382 - DNA, 25 bp, Mus musculus
tggaggaccctggtagactacttaa

SEQ ID NO: 881383 - DNA, 25 bp, Mus musculus
tggaggaccgaaactattggaagaa

SEQ ID NO: 881384 - DNA, 25 bp, Mus musculus
tggaggaccgaatctattggaagaa

SEQ ID NO: 881385 - DNA, 25 bp, Mus musculus
tggaggaccggcaagaccgaaagct

SEQ ID NO: 881386 - DNA, 25 bp, Mus musculus
tggaggaccggctagaccgaaagct

SEQ ID NO: 881387 - DNA, 25 bp, Mus musculus
tggaggaccgggacctccagtgaca

SEQ ID NO: 881388 - DNA, 25 bp, Mus musculus
tggaggaccgggtcctccagtgaca

SEQ ID NO: 881389 - DNA, 25 bp, Mus musculus
tggaggaccgtaagtggcacagcat

SEQ ID NO: 881390 - DNA, 25 bp, Mus musculus
tggaggaccgtatgtggcacagcat

SEQ ID NO: 881391 - DNA, 25 bp, Mus musculus
tggaggacctacatgggcggcaacc

SEQ ID NO: 881392 - DNA, 25 bp, Mus musculus
tggaggacctacttgggcggcaacc

SEQ ID NO: 881393 - DNA, 25 bp, Mus musculus
tggaggacctcccagttaccaggtg

SEQ ID NO: 881394 - DNA, 25 bp, Mus musculus
tggaggacctccgagttaccaggtg

SEQ ID NO: 881395 - DNA, 25 bp, Mus musculus
tggaggacctgtaaccactgcgtct

SEQ ID NO: 881396 - DNA, 25 bp, Mus musculus
tggaggacctgttaccactgcgtct

SEQ ID NO: 881397 - DNA, 25 bp, Mus musculus
tggaggaccttgaaaaggcccctgg

SEQ ID NO: 881398 - DNA, 25 bp, Mus musculus
tggaggaccttgtaaaggcccctgg

SEQ ID NO: 881399 - DNA, 25 bp, Mus musculus
tggaggacgacaacctcatggacct

SEQ ID NO: 881400 - DNA, 25 bp, Mus musculus
tggaggacgacatcctcatggacct

SEQ ID NO: 881401 - DNA, 25 bp, Mus musculus
tggaggacgctcacccaaaccgtga

SEQ ID NO: 881402 - DNA, 25 bp, Mus musculus
tggaggacgctctcccaaaccgtga

SEQ ID NO: 881403 - DNA, 25 bp, Mus musculus
tggaggacggctagcgttcgttctc

SEQ ID NO: 881404 - DNA, 25 bp, Mus musculus
tggaggacggcttgcgttcgttctc

SEQ ID NO: 881405 - DNA, 25 bp, Mus musculus
tggaggactaccaaacagtgaagac

SEQ ID NO: 881406 - DNA, 25 bp, Mus musculus
tggaggactacctaacagtgaagac

SEQ ID NO: 881407 - DNA, 25 bp, Mus musculus
tggaggactcacctttcttgtcatc

SEQ ID NO: 881408 - DNA, 25 bp, Mus musculus
tggaggactcacgtttcttgtcatc

SEQ ID NO: 881409 - DNA, 25 bp, Mus musculus
tggaggactgccatggtcacacaaa

SEQ ID NO: 881410 - DNA, 25 bp, Mus musculus
tggaggactgccttggtcacacaaa

SEQ ID NO: 881411 - DNA, 25 bp, Mus musculus
tggaggactgctcttaccttttgca

SEQ ID NO: 881412 - DNA, 25 bp, Mus musculus
tggaggactgctgttaccttttgca

SEQ ID NO: 881413 - DNA, 25 bp, Mus musculus
tggaggactttaacacaagtaccct

SEQ ID NO: 881414 - DNA, 25 bp, Mus musculus
tggaggactttatcacaagtaccct

SEQ ID NO: 881415 - DNA, 25 bp, Mus musculus
tggaggagaatgagctcccgagtct

SEQ ID NO: 881416 - DNA, 25 bp, Mus musculus
tggaggagaatgtgctcccgagtct

SEQ ID NO: 881417 - DNA, 25 bp, Mus musculus
tggaggagacctcttcctgctgctc

SEQ ID NO: 881418 - DNA, 25 bp, Mus musculus
tggaggagacctgttcctgctgctc

SEQ ID NO: 881419 - DNA, 25 bp, Mus musculus
tggaggagccaacgtcctcacactg

SEQ ID NO: 881420 - DNA, 25 bp, Mus musculus
tggaggagccaaggtcctcacactg

SEQ ID NO: 881421 - DNA, 25 bp, Mus musculus
tggaggagccatcgagaccctcaga

SEQ ID NO: 881422 - DNA, 25 bp, Mus musculus
tggaggagccatggagaccctcaga

SEQ ID NO: 881423 - DNA, 25 bp, Mus musculus
tggaggagcccaaacaagccaatgg

SEQ ID NO: 881424 - DNA, 25 bp, Mus musculus
tggaggagcccaaactaagggtcca

SEQ ID NO: 881425 - DNA, 25 bp, Mus musculus
tggaggagcccatacaagccaatgg

SEQ ID NO: 881426 - DNA, 25 bp, Mus musculus
tggaggagcccatactaagggtcca

SEQ ID NO: 881427 - DNA, 25 bp, Mus musculus
tggaggaggagtacatccatcagct

SEQ ID NO: 881428 - DNA, 25 bp, Mus musculus
tggaggaggagttcatccatcagct

SEQ ID NO: 881429 - DNA, 25 bp, Mus musculus
tggaggaggtttaggctgtcctact

SEQ ID NO: 881430 - DNA, 25 bp, Mus musculus
tggaggaggttttggctgtcctact

SEQ ID NO: 881431 - DNA, 25 bp, Mus musculus
tggaggagttaacctggcaagccca

SEQ ID NO: 881432 - DNA, 25 bp, Mus musculus
tggaggagttaagctggcaagccca

SEQ ID NO: 881433 - DNA, 25 bp, Mus musculus
tggaggagttcaaccgcggagccaa

SEQ ID NO: 881434 - DNA, 25 bp, Mus musculus
tggaggagttcatccgcggagccaa

SEQ ID NO: 881435 - DNA, 25 bp, Mus musculus
tggaggatagagagctactgctcct

SEQ ID NO: 881436 - DNA, 25 bp, Mus musculus
tggaggatagagtgctactgctcct

SEQ ID NO: 881437 - DNA, 25 bp, Mus musculus
tggaggatgacaaagtgggcaccga

SEQ ID NO: 881438 - DNA, 25 bp, Mus musculus
tggaggatgacatagtgggcaccga

SEQ ID NO: 881439 - DNA, 25 bp, Mus musculus
tggaggatgccaatcatacagccat

SEQ ID NO: 881440 - DNA, 25 bp, Mus musculus
tggaggatgccattcatacagccat

SEQ ID NO: 881441 - DNA, 25 bp, Mus musculus
tggaggatgcctactatacactagt

SEQ ID NO: 881442 - DNA, 25 bp, Mus musculus
tggaggatgccttctatacactagt

SEQ ID NO: 881443 - DNA, 25 bp, Mus musculus
tggaggatggagatatacctgtccc

SEQ ID NO: 881444 - DNA, 25 bp, Mus musculus
tggaggatggagttatacctgtccc

SEQ ID NO: 881445 - DNA, 25 bp, Mus musculus
tggaggatggcaccccgagcatcag

SEQ ID NO: 881446 - DNA, 25 bp, Mus musculus
tggaggatggcagcccgagcatcag

SEQ ID NO: 881447 - DNA, 25 bp, Mus musculus
tggaggatggctactcatcacacct

SEQ ID NO: 881448 - DNA, 25 bp, Mus musculus
tggaggatggctccaccctatctga

SEQ ID NO: 881449 - DNA, 25 bp, Mus musculus
tggaggatggctgcaccctatctga

SEQ ID NO: 881450 - DNA, 25 bp, Mus musculus
tggaggatggcttctcatcacacct

SEQ ID NO: 881451 - DNA, 25 bp, Mus musculus
tggaggcaacgcctaaaggctccta

SEQ ID NO: 881452 - DNA, 25 bp, Mus musculus
tggaggcaacgcgtaaaggctccta

SEQ ID NO: 881453 - DNA, 25 bp, Mus musculus
tggaggcaagctacgggacactgat

SEQ ID NO: 881454 - DNA, 25 bp, Mus musculus
tggaggcaagcttcgggacactgat

SEQ ID NO: 881455 - DNA, 25 bp, Mus musculus
tggaggcaagggatcaaggttatct

SEQ ID NO: 881456 - DNA, 25 bp, Mus musculus
tggaggcaagggttcaaggttatct

SEQ ID NO: 881457 - DNA, 25 bp, Mus musculus
tggaggcactcacagactcacccga

SEQ ID NO: 881458 - DNA, 25 bp, Mus musculus
tggaggcactcagagactcacccga

SEQ ID NO: 881459 - DNA, 25 bp, Mus musculus
tggaggcactgccttgttactgcca

SEQ ID NO: 881460 - DNA, 25 bp, Mus musculus
tggaggcactgcgttgttactgcca

SEQ ID NO: 881461 - DNA, 25 bp, Mus musculus
tggaggcactggaaacttcatgccc

SEQ ID NO: 881462 - DNA, 25 bp, Mus musculus
tggaggcactggtaacttcatgccc

SEQ ID NO: 881463 - DNA, 25 bp, Mus musculus
tggaggcactttcccagaggatgat

SEQ ID NO: 881464 - DNA, 25 bp, Mus musculus
tggaggcactttgccagaggatgat

SEQ ID NO: 881465 - DNA, 25 bp, Mus musculus
tggaggcagatgagacttcaaacat

SEQ ID NO: 881466 - DNA, 25 bp, Mus musculus
tggaggcagatgtgacttcaaacat

SEQ ID NO: 881467 - DNA, 25 bp, Mus musculus
tggaggcagccaacaacagtaggca

SEQ ID NO: 881468 - DNA, 25 bp, Mus musculus
tggaggcagccatcaacagtaggca

SEQ ID NO: 881469 - DNA, 25 bp, Mus musculus
tggaggcagcctcacctgctctctg

SEQ ID NO: 881470 - DNA, 25 bp, Mus musculus
tggaggcagcctgacctgctctctg

SEQ ID NO: 881471 - DNA, 25 bp, Mus musculus
tggaggcagctactctcttccttga

SEQ ID NO: 881472 - DNA, 25 bp, Mus musculus
tggaggcagctagtctcttccttga

SEQ ID NO: 881473 - DNA, 25 bp, Mus musculus
tggaggcaggatcccacaagccata

SEQ ID NO: 881474 - DNA, 25 bp, Mus musculus
tggaggcaggatgccacaagccata

SEQ ID NO: 881475 - DNA, 25 bp, Mus musculus
tggaggcagggcatgtactttgctt

SEQ ID NO: 881476 - DNA, 25 bp, Mus musculus
tggaggcagggcttgtactttgctt

SEQ ID NO: 881477 - DNA, 25 bp, Mus musculus
tggaggcagtgccaatgaacaagct

SEQ ID NO: 881478 - DNA, 25 bp, Mus musculus
tggaggcagtgcgaatgaacaagct

SEQ ID NO: 881479 - DNA, 25 bp, Mus musculus
tggaggccaaaaccttctgccagat

SEQ ID NO: 881480 - DNA, 25 bp, Mus musculus
tggaggccaaaagcttctgccagat

SEQ ID NO: 881481 - DNA, 25 bp, Mus musculus
tggaggccaagaagggtctgctctt

SEQ ID NO: 881482 - DNA, 25 bp, Mus musculus
tggaggccaagatgggtctgctctt

SEQ ID NO: 881483 - DNA, 25 bp, Mus musculus
tggaggccacttaaaagccattgtt

SEQ ID NO: 881484 - DNA, 25 bp, Mus musculus
tggaggccacttaccaagtagccca

SEQ ID NO: 881485 - DNA, 25 bp, Mus musculus
tggaggccactttaaagccattgtt

SEQ ID NO: 881486 - DNA, 25 bp, Mus musculus
tggaggccactttccaagtagccca

SEQ ID NO: 881487 - DNA, 25 bp, Mus musculus
tggaggccagggactactttgataa

SEQ ID NO: 881488 - DNA, 25 bp, Mus musculus
tggaggccagggtctactttgataa

SEQ ID NO: 881489 - DNA, 25 bp, Mus musculus
tggaggccagttcgatacttaactc

SEQ ID NO: 881490 - DNA, 25 bp, Mus musculus
tggaggccagttggatacttaactc

SEQ ID NO: 881491 - DNA, 25 bp, Mus musculus
tggaggccatccaagtgtacagaat

SEQ ID NO: 881492 - DNA, 25 bp, Mus musculus
tggaggccatcctagtgtacagaat

SEQ ID NO: 881493 - DNA, 25 bp, Mus musculus
tggaggccattcacagctggcagaa

SEQ ID NO: 881494 - DNA, 25 bp, Mus musculus
tggaggccattctcagctggcagaa

SEQ ID NO: 881495 - DNA, 25 bp, Mus musculus
tggaggccattgagatctaccctct

SEQ ID NO: 881496 - DNA, 25 bp, Mus musculus
tggaggccattgtgatctaccctct

SEQ ID NO: 881497 - DNA, 25 bp, Mus musculus
tggaggcccaagagtttggcatctt

SEQ ID NO: 881498 - DNA, 25 bp, Mus musculus
tggaggcccaagtgtttggcatctt

SEQ ID NO: 881499 - DNA, 25 bp, Mus musculus
tggaggcccacgacaaaggttgatg

SEQ ID NO: 881500 - DNA, 25 bp, Mus musculus
tggaggcccacgtcaaaggttgatg

SEQ ID NO: 881501 - DNA, 25 bp, Mus musculus
tggaggcccagaatcctgtccattt

SEQ ID NO: 881502 - DNA, 25 bp, Mus musculus
tggaggcccagattcctgtccattt

SEQ ID NO: 881503 - DNA, 25 bp, Mus musculus
tggaggcccatacccactgtcctta

SEQ ID NO: 881504 - DNA, 25 bp, Mus musculus
tggaggcccatagccactgtcctta

SEQ ID NO: 881505 - DNA, 25 bp, Mus musculus
tggaggccccggaggacccgaggcg

SEQ ID NO: 881506 - DNA, 25 bp, Mus musculus
tggaggccccggtggacccgaggcg

SEQ ID NO: 881507 - DNA, 25 bp, Mus musculus
tggaggccccttctcgaaagcggaa

SEQ ID NO: 881508 - DNA, 25 bp, Mus musculus
tggaggccccttgtcgaaagcggaa

SEQ ID NO: 881509 - DNA, 25 bp, Mus musculus
tggaggcccgatacaaggcacagat

SEQ ID NO: 881510 - DNA, 25 bp, Mus musculus
tggaggcccgattcaaggcacagat

SEQ ID NO: 881511 - DNA, 25 bp, Mus musculus
tggaggcccgccagcattgcatagg

SEQ ID NO: 881512 - DNA, 25 bp, Mus musculus
tggaggcccgcctgcattgcatagg

SEQ ID NO: 881513 - DNA, 25 bp, Mus musculus
tggaggcccgggaattatccctaca

SEQ ID NO: 881514 - DNA, 25 bp, Mus musculus
tggaggcccgggtattatccctaca

SEQ ID NO: 881515 - DNA, 25 bp, Mus musculus
tggaggccctaccagagtaaggtct

SEQ ID NO: 881516 - DNA, 25 bp, Mus musculus
tggaggccctacgagagtaaggtct

SEQ ID NO: 881517 - DNA, 25 bp, Mus musculus
tggaggccctccatgagagtaagta

SEQ ID NO: 881518 - DNA, 25 bp, Mus musculus
tggaggccctccttgagagtaagta

SEQ ID NO: 881519 - DNA, 25 bp, Mus musculus
tggaggccctgcaggaaccactgca

SEQ ID NO: 881520 - DNA, 25 bp, Mus musculus
tggaggccctgctggaaccactgca

SEQ ID NO: 881521 - DNA, 25 bp, Mus musculus
tggaggcccttgcacggaaatttga

SEQ ID NO: 881522 - DNA, 25 bp, Mus musculus
tggaggcccttggacggaaatttga

SEQ ID NO: 881523 - DNA, 25 bp, Mus musculus
tggaggccggtcatctagccatgat

SEQ ID NO: 881524 - DNA, 25 bp, Mus musculus
tggaggccggtcttctagccatgat

SEQ ID NO: 881525 - DNA, 25 bp, Mus musculus
tggaggcctcatagctgggcgccct

SEQ ID NO: 881526 - DNA, 25 bp, Mus musculus
tggaggcctcattgctgggcgccct

SEQ ID NO: 881527 - DNA, 25 bp, Mus musculus
tggaggcctctacttgtaaacccag

SEQ ID NO: 881528 - DNA, 25 bp, Mus musculus
tggaggcctctagttgtaaacccag

SEQ ID NO: 881529 - DNA, 25 bp, Mus musculus
tggaggcctctcaaagaaacacatt

SEQ ID NO: 881530 - DNA, 25 bp, Mus musculus
tggaggcctctctaagaaacacatt

SEQ ID NO: 881531 - DNA, 25 bp, Mus musculus
tggaggcctcttaggcactttgcag

SEQ ID NO: 881532 - DNA, 25 bp, Mus musculus
tggaggcctctttggcactttgcag

SEQ ID NO: 881533 - DNA, 25 bp, Mus musculus
tggaggccttggcaagaccaccagt

SEQ ID NO: 881534 - DNA, 25 bp, Mus musculus
tggaggccttgggaagaccaccagt

SEQ ID NO: 881535 - DNA, 25 bp, Mus musculus
tggaggcctttcagttgagtggaaa

SEQ ID NO: 881536 - DNA, 25 bp, Mus musculus
tggaggcctttctgttgagtggaaa

SEQ ID NO: 881537 - DNA, 25 bp, Mus musculus
tggaggcgcacacctgtagactctg

SEQ ID NO: 881538 - DNA, 25 bp, Mus musculus
tggaggcgcacagctgtagactctg

SEQ ID NO: 881539 - DNA, 25 bp, Mus musculus
tggaggcggcggcaatgggtcctgc

SEQ ID NO: 881540 - DNA, 25 bp, Mus musculus
tggaggcggcgggaatgggtcctgc

SEQ ID NO: 881541 - DNA, 25 bp, Mus musculus
tggaggcggctgcttttgtaccttc

SEQ ID NO: 881542 - DNA, 25 bp, Mus musculus
tggaggcggctggttttgtaccttc

SEQ ID NO: 881543 - DNA, 25 bp, Mus musculus
tggaggcgggacaatctcctcagat

SEQ ID NO: 881544 - DNA, 25 bp, Mus musculus
tggaggcgggactatctcctcagat

SEQ ID NO: 881545 - DNA, 25 bp, Mus musculus
tggaggcgtcctaccagaggctctg

SEQ ID NO: 881546 - DNA, 25 bp, Mus musculus
tggaggcgtccttccagaggctctg

SEQ ID NO: 881547 - DNA, 25 bp, Mus musculus
tggaggcgtggtatctctgtcttcc

SEQ ID NO: 881548 - DNA, 25 bp, Mus musculus
tggaggcgtggtttctctgtcttcc

SEQ ID NO: 881549 - DNA, 25 bp, Mus musculus
tggaggcgtttcctcgttctctagg

SEQ ID NO: 881550 - DNA, 25 bp, Mus musculus
tggaggcgtttcgtcgttctctagg

SEQ ID NO: 881551 - DNA, 25 bp, Mus musculus
tggaggctaaccacttccgcaagca

SEQ ID NO: 881552 - DNA, 25 bp, Mus musculus
tggaggctaacctcttccgcaagca

SEQ ID NO: 881553 - DNA, 25 bp, Mus musculus
tggaggctacaaccccttccagaat

SEQ ID NO: 881554 - DNA, 25 bp, Mus musculus
tggaggctacaagcccttccagaat

SEQ ID NO: 881555 - DNA, 25 bp, Mus musculus
tggaggctactcacggctctcaagt

SEQ ID NO: 881556 - DNA, 25 bp, Mus musculus
tggaggctactctcggctctcaagt

SEQ ID NO: 881557 - DNA, 25 bp, Mus musculus
tggaggctactgagcgccatgtttc

SEQ ID NO: 881558 - DNA, 25 bp, Mus musculus
tggaggctactgtgcgccatgtttc

SEQ ID NO: 881559 - DNA, 25 bp, Mus musculus
tggaggctagcacaaagcatcagat

SEQ ID NO: 881560 - DNA, 25 bp, Mus musculus
tggaggctagcagaaagcatcagat

SEQ ID NO: 881561 - DNA, 25 bp, Mus musculus
tggaggctagccaactttacataga

SEQ ID NO: 881562 - DNA, 25 bp, Mus musculus
tggaggctagcctactttacataga

SEQ ID NO: 881563 - DNA, 25 bp, Mus musculus
tggaggctcacaacacaggatctaa

SEQ ID NO: 881564 - DNA, 25 bp, Mus musculus
tggaggctcacatcacaggatctaa

SEQ ID NO: 881565 - DNA, 25 bp, Mus musculus
tggaggctccccacaatgtctctag

SEQ ID NO: 881566 - DNA, 25 bp, Mus musculus
tggaggctccccagcatgaggagat

SEQ ID NO: 881567 - DNA, 25 bp, Mus musculus
tggaggctcccctcaatgtctctag

SEQ ID NO: 881568 - DNA, 25 bp, Mus musculus
tggaggctcccctgcatgaggagat

SEQ ID NO: 881569 - DNA, 25 bp, Mus musculus
tggaggctcccgaccaggaatgaat

SEQ ID NO: 881570 - DNA, 25 bp, Mus musculus
tggaggctcccgtccaggaatgaat

SEQ ID NO: 881571 - DNA, 25 bp, Mus musculus
tggaggctccggaggcggaggatcc

SEQ ID NO: 881572 - DNA, 25 bp, Mus musculus
tggaggctccggtggcggaggatcc

SEQ ID NO: 881573 - DNA, 25 bp, Mus musculus
tggaggctgaacacacttcatgtta

SEQ ID NO: 881574 - DNA, 25 bp, Mus musculus
tggaggctgaactcacttcatgtta

SEQ ID NO: 881575 - DNA, 25 bp, Mus musculus
tggaggctgcctcgtcgcctagcaa

SEQ ID NO: 881576 - DNA, 25 bp, Mus musculus
tggaggctgcctggtcgcctagcaa

SEQ ID NO: 881577 - DNA, 25 bp, Mus musculus
tggaggctggtcaccgcatatcctt

SEQ ID NO: 881578 - DNA, 25 bp, Mus musculus
tggaggctggtcagagaccctgtct

SEQ ID NO: 881579 - DNA, 25 bp, Mus musculus
tggaggctggtctccgcatatcctt

SEQ ID NO: 881580 - DNA, 25 bp, Mus musculus
tggaggctggtctgagaccctgtct

SEQ ID NO: 881581 - DNA, 25 bp, Mus musculus
tggaggctgtgcacatctccgaagg

SEQ ID NO: 881582 - DNA, 25 bp, Mus musculus
tggaggctgtgctcatctccgaagg

SEQ ID NO: 881583 - DNA, 25 bp, Mus musculus
tggaggcttaatctgctaaccaggt

SEQ ID NO: 881584 - DNA, 25 bp, Mus musculus
tggaggcttaatgtgctaaccaggt

SEQ ID NO: 881585 - DNA, 25 bp, Mus musculus
tggaggcttcacagcatagacccat

SEQ ID NO: 881586 - DNA, 25 bp, Mus musculus
tggaggcttcactgcatagacccat

SEQ ID NO: 881587 - DNA, 25 bp, Mus musculus
tggaggcttccaaccattcgtaatg

SEQ ID NO: 881588 - DNA, 25 bp, Mus musculus
tggaggcttccactgccaatgcaaa

SEQ ID NO: 881589 - DNA, 25 bp, Mus musculus
tggaggcttccagtgccaatgcaaa

SEQ ID NO: 881590 - DNA, 25 bp, Mus musculus
tggaggcttccatccattcgtaatg

SEQ ID NO: 881591 - DNA, 25 bp, Mus musculus
tggaggcttcctacaagtgctgtgc

SEQ ID NO: 881592 - DNA, 25 bp, Mus musculus
tggaggcttccttcaagtgctgtgc

SEQ ID NO: 881593 - DNA, 25 bp, Mus musculus
tggaggcttgtcacgggccagatct

SEQ ID NO: 881594 - DNA, 25 bp, Mus musculus
tggaggcttgtctcgggccagatct

SEQ ID NO: 881595 - DNA, 25 bp, Mus musculus
tggagggaacacctcctcccttagg

SEQ ID NO: 881596 - DNA, 25 bp, Mus musculus
tggagggaacacgtcctcccttagg

SEQ ID NO: 881597 - DNA, 25 bp, Mus musculus
tggagggaacctcatcctggagctc

SEQ ID NO: 881598 - DNA, 25 bp, Mus musculus
tggagggaacctgatcctggagctc

SEQ ID NO: 881599 - DNA, 25 bp, Mus musculus
tggagggaactacatcagcgcccac

SEQ ID NO: 881600 - DNA, 25 bp, Mus musculus
tggagggaactagatcagcgcccac

SEQ ID NO: 881601 - DNA, 25 bp, Mus musculus
tggagggaagcgcaaacacatttat

SEQ ID NO: 881602 - DNA, 25 bp, Mus musculus
tggagggaagcggaaacacatttat

SEQ ID NO: 881603 - DNA, 25 bp, Mus musculus
tggagggaagtcacttgcaaacgtg

SEQ ID NO: 881604 - DNA, 25 bp, Mus musculus
tggagggaagtcattctccactcca

SEQ ID NO: 881605 - DNA, 25 bp, Mus musculus
tggagggaagtctcttgcaaacgtg

SEQ ID NO: 881606 - DNA, 25 bp, Mus musculus
tggagggaagtctttctccactcca

SEQ ID NO: 881607 - DNA, 25 bp, Mus musculus
tggagggacctcagtcctcattgtg

SEQ ID NO: 881608 - DNA, 25 bp, Mus musculus
tggagggacctctgtcctcattgtg

SEQ ID NO: 881609 - DNA, 25 bp, Mus musculus
tggagggactaacagccagccccgc

SEQ ID NO: 881610 - DNA, 25 bp, Mus musculus
tggagggactaagagccagccccgc

SEQ ID NO: 881611 - DNA, 25 bp, Mus musculus
tggagggagacaaagcccaccgtct

SEQ ID NO: 881612 - DNA, 25 bp, Mus musculus
tggagggagacatagcccaccgtct

SEQ ID NO: 881613 - DNA, 25 bp, Mus musculus
tggagggagcgcatctgcaccatct

SEQ ID NO: 881614 - DNA, 25 bp, Mus musculus
tggagggagcgcttctgcaccatct

SEQ ID NO: 881615 - DNA, 25 bp, Mus musculus
tggagggagggacccggcctttctg

SEQ ID NO: 881616 - DNA, 25 bp, Mus musculus
tggagggagggagccggcctttctg

SEQ ID NO: 881617 - DNA, 25 bp, Mus musculus
tggagggatcctctgcctctcggca

SEQ ID NO: 881618 - DNA, 25 bp, Mus musculus
tggagggatcctgtgcctctcggca

SEQ ID NO: 881619 - DNA, 25 bp, Mus musculus
tggagggatgccacaccccttacag

SEQ ID NO: 881620 - DNA, 25 bp, Mus musculus
tggagggatgcctcaccccttacag

SEQ ID NO: 881621 - DNA, 25 bp, Mus musculus
tggagggcaacactcagcccaggcc

SEQ ID NO: 881622 - DNA, 25 bp, Mus musculus
tggagggcaacagtcagcccaggcc

SEQ ID NO: 881623 - DNA, 25 bp, Mus musculus
tggagggcacaccagtctgtcatcc

SEQ ID NO: 881624 - DNA, 25 bp, Mus musculus
tggagggcacacgagtctgtcatcc

SEQ ID NO: 881625 - DNA, 25 bp, Mus musculus
tggagggcacctctcgcagctcagc

SEQ ID NO: 881626 - DNA, 25 bp, Mus musculus
tggagggcacctgtcgcagctcagc

SEQ ID NO: 881627 - DNA, 25 bp, Mus musculus
tggagggcactccagatgtcaccct

SEQ ID NO: 881628 - DNA, 25 bp, Mus musculus
tggagggcactcgagatgtcaccct

SEQ ID NO: 881629 - DNA, 25 bp, Mus musculus
tggagggcagctctctacaggcttc

SEQ ID NO: 881630 - DNA, 25 bp, Mus musculus
tggagggcagctgtctacaggcttc

SEQ ID NO: 881631 - DNA, 25 bp, Mus musculus
tggagggccaggattgcaggagtca

SEQ ID NO: 881632 - DNA, 25 bp, Mus musculus
tggagggccaggtttgcaggagtca

SEQ ID NO: 881633 - DNA, 25 bp, Mus musculus
tggagggccatgcaactcccagagt

SEQ ID NO: 881634 - DNA, 25 bp, Mus musculus
tggagggccatggaactcccagagt

SEQ ID NO: 881635 - DNA, 25 bp, Mus musculus
tggagggcccctctcctgcaaatac

SEQ ID NO: 881636 - DNA, 25 bp, Mus musculus
tggagggcccctgtcctgcaaatac

SEQ ID NO: 881637 - DNA, 25 bp, Mus musculus
tggagggccggcagctctatacgct

SEQ ID NO: 881638 - DNA, 25 bp, Mus musculus
tggagggccggctgctctatacgct

SEQ ID NO: 881639 - DNA, 25 bp, Mus musculus
tggagggcctggatctgtctctctg

SEQ ID NO: 881640 - DNA, 25 bp, Mus musculus
tggagggcctggttctgtctctctg

SEQ ID NO: 881641 - DNA, 25 bp, Mus musculus
tggagggcctttcgattttcactca

SEQ ID NO: 881642 - DNA, 25 bp, Mus musculus
tggagggcctttggattttcactca

SEQ ID NO: 881643 - DNA, 25 bp, Mus musculus
tggagggcgacaatccctaggctgt

SEQ ID NO: 881644 - DNA, 25 bp, Mus musculus
tggagggcgacattccctaggctgt

SEQ ID NO: 881645 - DNA, 25 bp, Mus musculus
tggagggcgggtaccatacagactc

SEQ ID NO: 881646 - DNA, 25 bp, Mus musculus
tggagggcgggttccatacagactc

SEQ ID NO: 881647 - DNA, 25 bp, Mus musculus
tggagggctaacagtgaacctagag

SEQ ID NO: 881648 - DNA, 25 bp, Mus musculus
tggagggctaactgtgaacctagag

SEQ ID NO: 881649 - DNA, 25 bp, Mus musculus
tggagggctctgcacaccaaggaca

SEQ ID NO: 881650 - DNA, 25 bp, Mus musculus
tggagggctctggacaccaaggaca

SEQ ID NO: 881651 - DNA, 25 bp, Mus musculus
tggagggctgatctcatctgcttgc

SEQ ID NO: 881652 - DNA, 25 bp, Mus musculus
tggagggctgatgtcatctgcttgc

SEQ ID NO: 881653 - DNA, 25 bp, Mus musculus
tggagggctgccagtcgctctaaag

SEQ ID NO: 881654 - DNA, 25 bp, Mus musculus
tggagggctgcctgtcgctctaaag

SEQ ID NO: 881655 - DNA, 25 bp, Mus musculus
tggagggtcaagattaccctggcca

SEQ ID NO: 881656 - DNA, 25 bp, Mus musculus
tggagggtcaagtttaccctggcca

SEQ ID NO: 881657 - DNA, 25 bp, Mus musculus
tggagggtccaacatttcagtgctt

SEQ ID NO: 881658 - DNA, 25 bp, Mus musculus
tggagggtccaagatttcagtgctt

SEQ ID NO: 881659 - DNA, 25 bp, Mus musculus
tggagggtccagagcattataggta

SEQ ID NO: 881660 - DNA, 25 bp, Mus musculus
tggagggtccagtgcattataggta

SEQ ID NO: 881661 - DNA, 25 bp, Mus musculus
tggagggtgattcaggccttatatt

SEQ ID NO: 881662 - DNA, 25 bp, Mus musculus
tggagggtgattgaggccttatatt

SEQ ID NO: 881663 - DNA, 25 bp, Mus musculus
tggagggtgccaaaaaggccaacaa

SEQ ID NO: 881664 - DNA, 25 bp, Mus musculus
tggagggtgccataaaggccaacaa

SEQ ID NO: 881665 - DNA, 25 bp, Mus musculus
tggagggtgccgacattgtctacca

SEQ ID NO: 881666 - DNA, 25 bp, Mus musculus
tggagggtgccgtcattgtctacca

SEQ ID NO: 881667 - DNA, 25 bp, Mus musculus
tggagggtggagactgtcttttaaa

SEQ ID NO: 881668 - DNA, 25 bp, Mus musculus
tggagggtggagtctgtcttttaaa

SEQ ID NO: 881669 - DNA, 25 bp, Mus musculus
tggagggttaatactagaacctttg

SEQ ID NO: 881670 - DNA, 25 bp, Mus musculus
tggagggttaattctagaacctttg

SEQ ID NO: 881671 - DNA, 25 bp, Mus musculus
tggagggttccaagacctctcagca

SEQ ID NO: 881672 - DNA, 25 bp, Mus musculus
tggagggttccatgacctctcagca

SEQ ID NO: 881673 - DNA, 25 bp, Mus musculus
tggagggttttaattcaggctgaat

SEQ ID NO: 881674 - DNA, 25 bp, Mus musculus
tggagggttttatttcaggctgaat

SEQ ID NO: 881675 - DNA, 25 bp, Mus musculus
tggaggtaaccacaggtcagagcat

SEQ ID NO: 881676 - DNA, 25 bp, Mus musculus
tggaggtaaccagaggtcagagcat

SEQ ID NO: 881677 - DNA, 25 bp, Mus musculus
tggaggtaccctaacccaaagctga

SEQ ID NO: 881678 - DNA, 25 bp, Mus musculus
tggaggtaccctacgtggatcgcaa

SEQ ID NO: 881679 - DNA, 25 bp, Mus musculus
tggaggtacccttacccaaagctga

SEQ ID NO: 881680 - DNA, 25 bp, Mus musculus
tggaggtacccttcgtggatcgcaa

SEQ ID NO: 881681 - DNA, 25 bp, Mus musculus
tggaggtactagctgaccaccctgg

SEQ ID NO: 881682 - DNA, 25 bp, Mus musculus
tggaggtactaggtgaccaccctgg

SEQ ID NO: 881683 - DNA, 25 bp, Mus musculus
tggaggtagctcagtgacggaaaac

SEQ ID NO: 881684 - DNA, 25 bp, Mus musculus
tggaggtagctctgtgacggaaaac

SEQ ID NO: 881685 - DNA, 25 bp, Mus musculus
tggaggtatcgtcatcagagttcaa

SEQ ID NO: 881686 - DNA, 25 bp, Mus musculus
tggaggtatcgtgatcagagttcaa

SEQ ID NO: 881687 - DNA, 25 bp, Mus musculus
tggaggtcaaccagagacgaagccg

SEQ ID NO: 881688 - DNA, 25 bp, Mus musculus
tggaggtcaacctgagacgaagccg

SEQ ID NO: 881689 - DNA, 25 bp, Mus musculus
tggaggtcacctaagtgcttacccc

SEQ ID NO: 881690 - DNA, 25 bp, Mus musculus
tggaggtcaccttagtgcttacccc

SEQ ID NO: 881691 - DNA, 25 bp, Mus musculus
tggaggtcactgaggcctgagcact

SEQ ID NO: 881692 - DNA, 25 bp, Mus musculus
tggaggtcactgtggcctgagcact

SEQ ID NO: 881693 - DNA, 25 bp, Mus musculus
tggaggtcacttaccgggaacggct

SEQ ID NO: 881694 - DNA, 25 bp, Mus musculus
tggaggtcactttccgggaacggct

SEQ ID NO: 881695 - DNA, 25 bp, Mus musculus
tggaggtcatcaagcctgaaaaatg

SEQ ID NO: 881696 - DNA, 25 bp, Mus musculus
tggaggtcatcatgcctgaaaaatg

SEQ ID NO: 881697 - DNA, 25 bp, Mus musculus
tggaggtcatggaagcccctgccga

SEQ ID NO: 881698 - DNA, 25 bp, Mus musculus
tggaggtcatggtagcccctgccga

SEQ ID NO: 881699 - DNA, 25 bp, Mus musculus
tggaggtcccacaccctgggaatga

SEQ ID NO: 881700 - DNA, 25 bp, Mus musculus
tggaggtcccacataccacatctca

SEQ ID NO: 881701 - DNA, 25 bp, Mus musculus
tggaggtcccactccctgggaatga

SEQ ID NO: 881702 - DNA, 25 bp, Mus musculus
tggaggtcccacttaccacatctca

SEQ ID NO: 881703 - DNA, 25 bp, Mus musculus
tggaggtcctgtagcacctggctcg

SEQ ID NO: 881704 - DNA, 25 bp, Mus musculus
tggaggtcctgttgcacctggctcg

SEQ ID NO: 881705 - DNA, 25 bp, Mus musculus
tggaggtcgaagcaatcagcaaaca

SEQ ID NO: 881706 - DNA, 25 bp, Mus musculus
tggaggtcgaaggaatcagcaaaca

SEQ ID NO: 881707 - DNA, 25 bp, Mus musculus
tggaggtctattaacaggaatttga

SEQ ID NO: 881708 - DNA, 25 bp, Mus musculus
tggaggtctatttacaggaatttga

SEQ ID NO: 881709 - DNA, 25 bp, Mus musculus
tggaggtcttctatcccaagttcaa

SEQ ID NO: 881710 - DNA, 25 bp, Mus musculus
tggaggtcttctttcccaagttcaa

SEQ ID NO: 881711 - DNA, 25 bp, Mus musculus
tggaggtgccagaaccacgcgacaa

SEQ ID NO: 881712 - DNA, 25 bp, Mus musculus
tggaggtgccagctttgagtccttc

SEQ ID NO: 881713 - DNA, 25 bp, Mus musculus
tggaggtgccaggtttgagtccttc

SEQ ID NO: 881714 - DNA, 25 bp, Mus musculus
tggaggtgccagtaccacgcgacaa

SEQ ID NO: 881715 - DNA, 25 bp, Mus musculus
tggaggtgccgaaccgcaaggccaa

SEQ ID NO: 881716 - DNA, 25 bp, Mus musculus
tggaggtgccgatccgcaaggccaa

SEQ ID NO: 881717 - DNA, 25 bp, Mus musculus
tggaggtgcgcaacccactgtttga

SEQ ID NO: 881718 - DNA, 25 bp, Mus musculus
tggaggtgcgcatcccactgtttga

SEQ ID NO: 881719 - DNA, 25 bp, Mus musculus
tggaggtgctagaccccatggaatt

SEQ ID NO: 881720 - DNA, 25 bp, Mus musculus
tggaggtgctagtccccatggaatt

SEQ ID NO: 881721 - DNA, 25 bp, Mus musculus
tggaggtggcccctggttttcacat

SEQ ID NO: 881722 - DNA, 25 bp, Mus musculus
tggaggtggcccgtggttttcacat

SEQ ID NO: 881723 - DNA, 25 bp, Mus musculus
tggaggtggcctcacagtgtcccat

SEQ ID NO: 881724 - DNA, 25 bp, Mus musculus
tggaggtggcctgacagtgtcccat

SEQ ID NO: 881725 - DNA, 25 bp, Mus musculus
tggaggtgggttacacaacaatgcc

SEQ ID NO: 881726 - DNA, 25 bp, Mus musculus
tggaggtgggtttcacaacaatgcc

SEQ ID NO: 881727 - DNA, 25 bp, Mus musculus
tggaggttaattatcctgcctgcca

SEQ ID NO: 881728 - DNA, 25 bp, Mus musculus
tggaggttaattttcctgcctgcca

SEQ ID NO: 881729 - DNA, 25 bp, Mus musculus
tggaggttacatctttctgtgacaa

SEQ ID NO: 881730 - DNA, 25 bp, Mus musculus
tggaggttacatgtttctgtgacaa

SEQ ID NO: 881731 - DNA, 25 bp, Mus musculus
tggaggttatccagaccgtgtctgt

SEQ ID NO: 881732 - DNA, 25 bp, Mus musculus
tggaggttatcctgaccgtgtctgt

SEQ ID NO: 881733 - DNA, 25 bp, Mus musculus
tggaggttcacacgcagctcggctc

SEQ ID NO: 881734 - DNA, 25 bp, Mus musculus
tggaggttcacaggcagctcggctc

SEQ ID NO: 881735 - DNA, 25 bp, Mus musculus
tggaggttcattaagtgcacttgta

SEQ ID NO: 881736 - DNA, 25 bp, Mus musculus
tggaggttcatttagtgcacttgta

SEQ ID NO: 881737 - DNA, 25 bp, Mus musculus
tggaggttccatagcttctcttaac

SEQ ID NO: 881738 - DNA, 25 bp, Mus musculus
tggaggttccattgcttctcttaac

SEQ ID NO: 881739 - DNA, 25 bp, Mus musculus
tggaggttccccacgcaagaggcaa

SEQ ID NO: 881740 - DNA, 25 bp, Mus musculus
tggaggttcccctcgcaagaggcaa

SEQ ID NO: 881741 - DNA, 25 bp, Mus musculus
tggaggttcctccatgatgcacatc

SEQ ID NO: 881742 - DNA, 25 bp, Mus musculus
tggaggttcctcgatgatgcacatc

SEQ ID NO: 881743 - DNA, 25 bp, Mus musculus
tggaggttctccatgcagcctgcat

SEQ ID NO: 881744 - DNA, 25 bp, Mus musculus
tggaggttctccttgcagcctgcat

SEQ ID NO: 881745 - DNA, 25 bp, Mus musculus
tggaggttgactctgcaatgttatt

SEQ ID NO: 881746 - DNA, 25 bp, Mus musculus
tggaggttgactgtgcaatgttatt

SEQ ID NO: 881747 - DNA, 25 bp, Mus musculus
tggaggttgataccctagcttcctt

SEQ ID NO: 881748 - DNA, 25 bp, Mus musculus
tggaggttgatagcctagcttcctt

SEQ ID NO: 881749 - DNA, 25 bp, Mus musculus
tggaggttgatgcatacacctatga

SEQ ID NO: 881750 - DNA, 25 bp, Mus musculus
tggaggttgatggatacacctatga

SEQ ID NO: 881751 - DNA, 25 bp, Mus musculus
tggaggttgtgccattaagagccac

SEQ ID NO: 881752 - DNA, 25 bp, Mus musculus
tggaggttgtgcgattaagagccac

SEQ ID NO: 881753 - DNA, 25 bp, Mus musculus
tggaggtttgttaccccatctgtaa

SEQ ID NO: 881754 - DNA, 25 bp, Mus musculus
tggaggtttgtttccccatctgtaa

SEQ ID NO: 881755 - DNA, 25 bp, Mus musculus
tggaggttttccacaccttgtagta

SEQ ID NO: 881756 - DNA, 25 bp, Mus musculus
tggaggttttcctcaccttgtagta

SEQ ID NO: 881757 - DNA, 25 bp, Mus musculus
tggaggttttctaggcactgtttct

SEQ ID NO: 881758 - DNA, 25 bp, Mus musculus
tggaggttttcttggcactgtttct

SEQ ID NO: 881759 - DNA, 25 bp, Mus musculus
tggagtaaggctcaaaccagcctcc

SEQ ID NO: 881760 - DNA, 25 bp, Mus musculus
tggagtaaggctgaaaccagcctcc

SEQ ID NO: 881761 - DNA, 25 bp, Mus musculus
tggagtaatgccacatgcctgcagc

SEQ ID NO: 881762 - DNA, 25 bp, Mus musculus
tggagtaatgcctcatgcctgcagc

SEQ ID NO: 881763 - DNA, 25 bp, Mus musculus
tggagtacaagacctgtgcgcagaa

SEQ ID NO: 881764 - DNA, 25 bp, Mus musculus
tggagtacaagagctgtgcgcagaa

SEQ ID NO: 881765 - DNA, 25 bp, Mus musculus
tggagtacacttataggcacattac

SEQ ID NO: 881766 - DNA, 25 bp, Mus musculus
tggagtacacttttaggcacattac

SEQ ID NO: 881767 - DNA, 25 bp, Mus musculus
tggagtacagcaccatgggctttac

SEQ ID NO: 881768 - DNA, 25 bp, Mus musculus
tggagtacagcagcatgggctttac

SEQ ID NO: 881769 - DNA, 25 bp, Mus musculus
tggagtaccaccaaacttacacaat

SEQ ID NO: 881770 - DNA, 25 bp, Mus musculus
tggagtaccacctaacttacacaat

SEQ ID NO: 881771 - DNA, 25 bp, Mus musculus
tggagtaccggcaacaacttatccc

SEQ ID NO: 881772 - DNA, 25 bp, Mus musculus
tggagtaccggctacaacttatccc

SEQ ID NO: 881773 - DNA, 25 bp, Mus musculus
tggagtacctccaatggccagtgtt

SEQ ID NO: 881774 - DNA, 25 bp, Mus musculus
tggagtacctcctatggccagtgtt

SEQ ID NO: 881775 - DNA, 25 bp, Mus musculus
tggagtactacaagggcttagctga

SEQ ID NO: 881776 - DNA, 25 bp, Mus musculus
tggagtactacatgggcttagctga

SEQ ID NO: 881777 - DNA, 25 bp, Mus musculus
tggagtactggcaagtgtgagttac

SEQ ID NO: 881778 - DNA, 25 bp, Mus musculus
tggagtactggctagtgtgagttac

SEQ ID NO: 881779 - DNA, 25 bp, Mus musculus
tggagtactttacagcttgcatgct

SEQ ID NO: 881780 - DNA, 25 bp, Mus musculus
tggagtactttagagcttgcatgct

SEQ ID NO: 881781 - DNA, 25 bp, Mus musculus
tggagtagaattatcgcccgaagga

SEQ ID NO: 881782 - DNA, 25 bp, Mus musculus
tggagtagaattccgggcagcttct

SEQ ID NO: 881783 - DNA, 25 bp, Mus musculus
tggagtagaattgcgggcagcttct

SEQ ID NO: 881784 - DNA, 25 bp, Mus musculus
tggagtagaattttcgcccgaagga

SEQ ID NO: 881785 - DNA, 25 bp, Mus musculus
tggagtagactcatcctggcatgca

SEQ ID NO: 881786 - DNA, 25 bp, Mus musculus
tggagtagactcttcctggcatgca

SEQ ID NO: 881787 - DNA, 25 bp, Mus musculus
tggagtaggcctccttttgagccct

SEQ ID NO: 881788 - DNA, 25 bp, Mus musculus
tggagtaggcctgcttttgagccct

SEQ ID NO: 881789 - DNA, 25 bp, Mus musculus
tggagtagggttccatctcccattt

SEQ ID NO: 881790 - DNA, 25 bp, Mus musculus
tggagtagggttgcatctcccattt

SEQ ID NO: 881791 - DNA, 25 bp, Mus musculus
tggagtatcactacctgtcgcccta

SEQ ID NO: 881792 - DNA, 25 bp, Mus musculus
tggagtatcacttcctgtcgcccta

SEQ ID NO: 881793 - DNA, 25 bp, Mus musculus
tggagtatcgggacctggatgcccc

SEQ ID NO: 881794 - DNA, 25 bp, Mus musculus
tggagtatcgggtcctggatgcccc

SEQ ID NO: 881795 - DNA, 25 bp, Mus musculus
tggagtatgcccacgtgtactgcct

SEQ ID NO: 881796 - DNA, 25 bp, Mus musculus
tggagtatgccctcgtgtactgcct

SEQ ID NO: 881797 - DNA, 25 bp, Mus musculus
tggagtatgcttagcctcaggcacc

SEQ ID NO: 881798 - DNA, 25 bp, Mus musculus
tggagtatgctttgcctcaggcacc

SEQ ID NO: 881799 - DNA, 25 bp, Mus musculus
tggagtatggcaccctgcattattt

SEQ ID NO: 881800 - DNA, 25 bp, Mus musculus
tggagtatggcagcctgcattattt

SEQ ID NO: 881801 - DNA, 25 bp, Mus musculus
tggagtattcggactctttcctgca

SEQ ID NO: 881802 - DNA, 25 bp, Mus musculus
tggagtattcggtctctttcctgca

SEQ ID NO: 881803 - DNA, 25 bp, Mus musculus
tggagtcaaccactgttgcccagca

SEQ ID NO: 881804 - DNA, 25 bp, Mus musculus
tggagtcaaccagtgttgcccagca

SEQ ID NO: 881805 - DNA, 25 bp, Mus musculus
tggagtcacaagcagacacagggtt

SEQ ID NO: 881806 - DNA, 25 bp, Mus musculus
tggagtcacaaggagacacagggtt

SEQ ID NO: 881807 - DNA, 25 bp, Mus musculus
tggagtcacactacagcttgctctt

SEQ ID NO: 881808 - DNA, 25 bp, Mus musculus
tggagtcacacttcagcttgctctt

SEQ ID NO: 881809 - DNA, 25 bp, Mus musculus
tggagtcacaggctcatgcatctat

SEQ ID NO: 881810 - DNA, 25 bp, Mus musculus
tggagtcacagggtcatgcatctat

SEQ ID NO: 881811 - DNA, 25 bp, Mus musculus
tggagtcaccacatgacctactttt

SEQ ID NO: 881812 - DNA, 25 bp, Mus musculus
tggagtcaccacttgacctactttt

SEQ ID NO: 881813 - DNA, 25 bp, Mus musculus
tggagtcaccggacacatctgtgat

SEQ ID NO: 881814 - DNA, 25 bp, Mus musculus
tggagtcaccggtcacatctgtgat

SEQ ID NO: 881815 - DNA, 25 bp, Mus musculus
tggagtcaccgtagccccattaaga

SEQ ID NO: 881816 - DNA, 25 bp, Mus musculus
tggagtcaccgtcagtttcctcggc

SEQ ID NO: 881817 - DNA, 25 bp, Mus musculus
tggagtcaccgtgagtttcctcggc

SEQ ID NO: 881818 - DNA, 25 bp, Mus musculus
tggagtcaccgttgccccattaaga

SEQ ID NO: 881819 - DNA, 25 bp, Mus musculus
tggagtcactcacggcaaggcattg

SEQ ID NO: 881820 - DNA, 25 bp, Mus musculus
tggagtcactcagggcaaggcattg

SEQ ID NO: 881821 - DNA, 25 bp, Mus musculus
tggagtcactctaatgctgttccca

SEQ ID NO: 881822 - DNA, 25 bp, Mus musculus
tggagtcactcttatgctgttccca

SEQ ID NO: 881823 - DNA, 25 bp, Mus musculus
tggagtcactttccccacgagagga

SEQ ID NO: 881824 - DNA, 25 bp, Mus musculus
tggagtcactttgcccacgagagga

SEQ ID NO: 881825 - DNA, 25 bp, Mus musculus
tggagtcagcacaggacagccactt

SEQ ID NO: 881826 - DNA, 25 bp, Mus musculus
tggagtcagcactggacagccactt

SEQ ID NO: 881827 - DNA, 25 bp, Mus musculus
tggagtcagcttcttccgagctgag

SEQ ID NO: 881828 - DNA, 25 bp, Mus musculus
tggagtcagcttgttccgagctgag

SEQ ID NO: 881829 - DNA, 25 bp, Mus musculus
tggagtcaggacaagtaccagcccc

SEQ ID NO: 881830 - DNA, 25 bp, Mus musculus
tggagtcaggactagtaccagcccc

SEQ ID NO: 881831 - DNA, 25 bp, Mus musculus
tggagtcaggctcgcccatcactag

SEQ ID NO: 881832 - DNA, 25 bp, Mus musculus
tggagtcaggctggcccatcactag

SEQ ID NO: 881833 - DNA, 25 bp, Mus musculus
tggagtcagtgcacaaccgtgtgtc

SEQ ID NO: 881834 - DNA, 25 bp, Mus musculus
tggagtcagtgctcaaccgtgtgtc

SEQ ID NO: 881835 - DNA, 25 bp, Mus musculus
tggagtcataagagggcagccgtct

SEQ ID NO: 881836 - DNA, 25 bp, Mus musculus
tggagtcataagtgggcagccgtct

SEQ ID NO: 881837 - DNA, 25 bp, Mus musculus
tggagtcatcagaccttacaggttg

SEQ ID NO: 881838 - DNA, 25 bp, Mus musculus
tggagtcatcagtccttacaggttg

SEQ ID NO: 881839 - DNA, 25 bp, Mus musculus
tggagtcatccacgtttcaggcatc

SEQ ID NO: 881840 - DNA, 25 bp, Mus musculus
tggagtcatccaggtttcaggcatc

SEQ ID NO: 881841 - DNA, 25 bp, Mus musculus
tggagtcatccccttgaacgagaag

SEQ ID NO: 881842 - DNA, 25 bp, Mus musculus
tggagtcatcccgttgaacgagaag

SEQ ID NO: 881843 - DNA, 25 bp, Mus musculus
tggagtcatctcctctagacagaca

SEQ ID NO: 881844 - DNA, 25 bp, Mus musculus
tggagtcatctcgtctagacagaca

SEQ ID NO: 881845 - DNA, 25 bp, Mus musculus
tggagtcatgagcagacacacaatt

SEQ ID NO: 881846 - DNA, 25 bp, Mus musculus
tggagtcatgaggagacacacaatt

SEQ ID NO: 881847 - DNA, 25 bp, Mus musculus
tggagtcattgtcgatccctgcctg

SEQ ID NO: 881848 - DNA, 25 bp, Mus musculus
tggagtcattgtggatccctgcctg

SEQ ID NO: 881849 - DNA, 25 bp, Mus musculus
tggagtccaaatctcagcctttttc

SEQ ID NO: 881850 - DNA, 25 bp, Mus musculus
tggagtccaaatgtcagcctttttc

SEQ ID NO: 881851 - DNA, 25 bp, Mus musculus
tggagtccaacacatccctgcctta

SEQ ID NO: 881852 - DNA, 25 bp, Mus musculus
tggagtccaacagatccctgcctta

SEQ ID NO: 881853 - DNA, 25 bp, Mus musculus
tggagtccacacctctagcatgtag

SEQ ID NO: 881854 - DNA, 25 bp, Mus musculus
tggagtccacacgtctagcatgtag

SEQ ID NO: 881855 - DNA, 25 bp, Mus musculus
tggagtccacgtccgctctgtgtgc

SEQ ID NO: 881856 - DNA, 25 bp, Mus musculus
tggagtccacgtgcgctctgtgtgc

SEQ ID NO: 881857 - DNA, 25 bp, Mus musculus
tggagtccagagcatcatccaccag

SEQ ID NO: 881858 - DNA, 25 bp, Mus musculus
tggagtccagaggatcatccaccag

SEQ ID NO: 881859 - DNA, 25 bp, Mus musculus
tggagtccagtaccccagctgtggt

SEQ ID NO: 881860 - DNA, 25 bp, Mus musculus
tggagtccagtagcccagctgtggt

SEQ ID NO: 881861 - DNA, 25 bp, Mus musculus
tggagtcccacacagagcccttcag

SEQ ID NO: 881862 - DNA, 25 bp, Mus musculus
tggagtcccacagagagcccttcag

SEQ ID NO: 881863 - DNA, 25 bp, Mus musculus
tggagtcccagacacgtcccagaga

SEQ ID NO: 881864 - DNA, 25 bp, Mus musculus
tggagtcccagagacgtcccagaga

SEQ ID NO: 881865 - DNA, 25 bp, Mus musculus
tggagtcccatgatagcaggcccaa

SEQ ID NO: 881866 - DNA, 25 bp, Mus musculus
tggagtcccatgttagcaggcccaa

SEQ ID NO: 881867 - DNA, 25 bp, Mus musculus
tggagtccccaacaggtgatgctat

SEQ ID NO: 881868 - DNA, 25 bp, Mus musculus
tggagtccccaagaggtgatgctat

SEQ ID NO: 881869 - DNA, 25 bp, Mus musculus
tggagtcccgacacctaagacccat

SEQ ID NO: 881870 - DNA, 25 bp, Mus musculus
tggagtcccgactcctaagacccat

SEQ ID NO: 881871 - DNA, 25 bp, Mus musculus
tggagtccctcaaggtcacctatgt

SEQ ID NO: 881872 - DNA, 25 bp, Mus musculus
tggagtccctcatggtcacctatgt

SEQ ID NO: 881873 - DNA, 25 bp, Mus musculus
tggagtccctggagggtccactgct

SEQ ID NO: 881874 - DNA, 25 bp, Mus musculus
tggagtccctggtgggtccactgct

SEQ ID NO: 881875 - DNA, 25 bp, Mus musculus
tggagtcctcccctgcaggcggaac

SEQ ID NO: 881876 - DNA, 25 bp, Mus musculus
tggagtcctcccgtgcaggcggaac

SEQ ID NO: 881877 - DNA, 25 bp, Mus musculus
tggagtcctgcaagactgggtcatt

SEQ ID NO: 881878 - DNA, 25 bp, Mus musculus
tggagtcctgcatgactgggtcatt

SEQ ID NO: 881879 - DNA, 25 bp, Mus musculus
tggagtcctgccatcaggcaagcaa

SEQ ID NO: 881880 - DNA, 25 bp, Mus musculus
tggagtcctgccattgtgctgccaa

SEQ ID NO: 881881 - DNA, 25 bp, Mus musculus
tggagtcctgccttcaggcaagcaa

SEQ ID NO: 881882 - DNA, 25 bp, Mus musculus
tggagtcctgcctttgtgctgccaa

SEQ ID NO: 881883 - DNA, 25 bp, Mus musculus
tggagtcctggccagtcactacatc

SEQ ID NO: 881884 - DNA, 25 bp, Mus musculus
tggagtcctggcgagtcactacatc

SEQ ID NO: 881885 - DNA, 25 bp, Mus musculus
tggagtcctgtgatacccagcactg

SEQ ID NO: 881886 - DNA, 25 bp, Mus musculus
tggagtcctgtgttacccagcactg

SEQ ID NO: 881887 - DNA, 25 bp, Mus musculus
tggagtccttgaacgagcactgtca

SEQ ID NO: 881888 - DNA, 25 bp, Mus musculus
tggagtccttgacaagaacagccag

SEQ ID NO: 881889 - DNA, 25 bp, Mus musculus
tggagtccttgagaagaacagccag

SEQ ID NO: 881890 - DNA, 25 bp, Mus musculus
tggagtccttgatcgagcactgtca

SEQ ID NO: 881891 - DNA, 25 bp, Mus musculus
tggagtccttgcagcaccatgaaga

SEQ ID NO: 881892 - DNA, 25 bp, Mus musculus
tggagtccttgctgcaccatgaaga

SEQ ID NO: 881893 - DNA, 25 bp, Mus musculus
tggagtcctttcacaccaggaggta

SEQ ID NO: 881894 - DNA, 25 bp, Mus musculus
tggagtcctttccaccaggtgaatg

SEQ ID NO: 881895 - DNA, 25 bp, Mus musculus
tggagtcctttcgaccaggtgaatg

SEQ ID NO: 881896 - DNA, 25 bp, Mus musculus
tggagtcctttctcaccaggaggta

SEQ ID NO: 881897 - DNA, 25 bp, Mus musculus
tggagtcgccgcagctgctcgacag

SEQ ID NO: 881898 - DNA, 25 bp, Mus musculus
tggagtcgccgctgctgctcgacag

SEQ ID NO: 881899 - DNA, 25 bp, Mus musculus
tggagtcgttccactattgtccaaa

SEQ ID NO: 881900 - DNA, 25 bp, Mus musculus
tggagtcgttcctctattgtccaaa

SEQ ID NO: 881901 - DNA, 25 bp, Mus musculus
tggagtctaagccaggcacagcttt

SEQ ID NO: 881902 - DNA, 25 bp, Mus musculus
tggagtctaagcgaggcacagcttt

SEQ ID NO: 881903 - DNA, 25 bp, Mus musculus
tggagtctaatcaccacatcttggg

SEQ ID NO: 881904 - DNA, 25 bp, Mus musculus
tggagtctaatctccacatcttggg

SEQ ID NO: 881905 - DNA, 25 bp, Mus musculus
tggagtctagggactttctcatgcc

SEQ ID NO: 881906 - DNA, 25 bp, Mus musculus
tggagtctagggtctttctcatgcc

SEQ ID NO: 881907 - DNA, 25 bp, Mus musculus
tggagtctagtaccaccagaagtga

SEQ ID NO: 881908 - DNA, 25 bp, Mus musculus
tggagtctagtagcaccagaagtga

SEQ ID NO: 881909 - DNA, 25 bp, Mus musculus
tggagtctatcacccaggcttctag

SEQ ID NO: 881910 - DNA, 25 bp, Mus musculus
tggagtctatcagccaggcttctag

SEQ ID NO: 881911 - DNA, 25 bp, Mus musculus
tggagtctcaagagtaccagagtca

SEQ ID NO: 881912 - DNA, 25 bp, Mus musculus
tggagtctcaagtgtaccagagtca

SEQ ID NO: 881913 - DNA, 25 bp, Mus musculus
tggagtctcagcagacggcatgcag

SEQ ID NO: 881914 - DNA, 25 bp, Mus musculus
tggagtctcagctgacggcatgcag

SEQ ID NO: 881915 - DNA, 25 bp, Mus musculus
tggagtctcagtaccagcagagcat

SEQ ID NO: 881916 - DNA, 25 bp, Mus musculus
tggagtctcagttccagcagagcat

SEQ ID NO: 881917 - DNA, 25 bp, Mus musculus
tggagtctccaaaacctgtggagtc

SEQ ID NO: 881918 - DNA, 25 bp, Mus musculus
tggagtctccaatacctgtggagtc

SEQ ID NO: 881919 - DNA, 25 bp, Mus musculus
tggagtctccataagtgccatcctt

SEQ ID NO: 881920 - DNA, 25 bp, Mus musculus
tggagtctccattagtgccatcctt

SEQ ID NO: 881921 - DNA, 25 bp, Mus musculus
tggagtctccctaagtacagcatat

SEQ ID NO: 881922 - DNA, 25 bp, Mus musculus
tggagtctcccttagtacagcatat

SEQ ID NO: 881923 - DNA, 25 bp, Mus musculus
tggagtctccgcagttttgtaaaca

SEQ ID NO: 881924 - DNA, 25 bp, Mus musculus
tggagtctccgctgttttgtaaaca

SEQ ID NO: 881925 - DNA, 25 bp, Mus musculus
tggagtctctacatccttatagaac

SEQ ID NO: 881926 - DNA, 25 bp, Mus musculus
tggagtctctacttccttatagaac

SEQ ID NO: 881927 - DNA, 25 bp, Mus musculus
tggagtctctctacttaatctctca

SEQ ID NO: 881928 - DNA, 25 bp, Mus musculus
tggagtctctcttcttaatctctca

SEQ ID NO: 881929 - DNA, 25 bp, Mus musculus
tggagtctcttcagagccatacagg

SEQ ID NO: 881930 - DNA, 25 bp, Mus musculus
tggagtctcttctgagccatacagg

SEQ ID NO: 881931 - DNA, 25 bp, Mus musculus
tggagtctgccaagcgaactcttgc

SEQ ID NO: 881932 - DNA, 25 bp, Mus musculus
tggagtctgccatgcgaactcttgc

SEQ ID NO: 881933 - DNA, 25 bp, Mus musculus
tggagtctgcggagctaagagccat

SEQ ID NO: 881934 - DNA, 25 bp, Mus musculus
tggagtctgcggtgctaagagccat

SEQ ID NO: 881935 - DNA, 25 bp, Mus musculus
tggagtctgcgtctgggattcttac

SEQ ID NO: 881936 - DNA, 25 bp, Mus musculus
tggagtctgcgtgtgggattcttac

SEQ ID NO: 881937 - DNA, 25 bp, Mus musculus
tggagtctgctgacagtaggcgtct

SEQ ID NO: 881938 - DNA, 25 bp, Mus musculus
tggagtctgctgtcagtaggcgtct

SEQ ID NO: 881939 - DNA, 25 bp, Mus musculus
tggagtctggcacgatatagctcct

SEQ ID NO: 881940 - DNA, 25 bp, Mus musculus
tggagtctggcaggatatagctcct

SEQ ID NO: 881941 - DNA, 25 bp, Mus musculus
tggagtctggctactactggacgtc

SEQ ID NO: 881942 - DNA, 25 bp, Mus musculus
tggagtctggcttctactggacgtc

SEQ ID NO: 881943 - DNA, 25 bp, Mus musculus
tggagtctgtatacatcccagccac

SEQ ID NO: 881944 - DNA, 25 bp, Mus musculus
tggagtctgtattcatcccagccac

SEQ ID NO: 881945 - DNA, 25 bp, Mus musculus
tggagtctgtgacatccttggatac

SEQ ID NO: 881946 - DNA, 25 bp, Mus musculus
tggagtctgtgagatccttggatac

SEQ ID NO: 881947 - DNA, 25 bp, Mus musculus
tggagtctgtgcacaccaccatgta

SEQ ID NO: 881948 - DNA, 25 bp, Mus musculus
tggagtctgtgctcaccaccatgta

SEQ ID NO: 881949 - DNA, 25 bp, Mus musculus
tggagtcttccactgctaggcttca

SEQ ID NO: 881950 - DNA, 25 bp, Mus musculus
tggagtcttccagtgctaggcttca

SEQ ID NO: 881951 - DNA, 25 bp, Mus musculus
tggagtcttgctccatggtgttttc

SEQ ID NO: 881952 - DNA, 25 bp, Mus musculus
tggagtcttgctgcatggtgttttc

SEQ ID NO: 881953 - DNA, 25 bp, Mus musculus
tggagtctttctacctggctgaaac

SEQ ID NO: 881954 - DNA, 25 bp, Mus musculus
tggagtctttctcacacagaggcgg

SEQ ID NO: 881955 - DNA, 25 bp, Mus musculus
tggagtctttctgacacagaggcgg

SEQ ID NO: 881956 - DNA, 25 bp, Mus musculus
tggagtctttcttcctggctgaaac

SEQ ID NO: 881957 - DNA, 25 bp, Mus musculus
tggagtgaatcacctctaacgtccc

SEQ ID NO: 881958 - DNA, 25 bp, Mus musculus
tggagtgaatcagctctaacgtccc

SEQ ID NO: 881959 - DNA, 25 bp, Mus musculus
tggagtgacaaactttcccaacatc

SEQ ID NO: 881960 - DNA, 25 bp, Mus musculus
tggagtgacaaagtttcccaacatc

SEQ ID NO: 881961 - DNA, 25 bp, Mus musculus
tggagtgaccacctcccagattgct

SEQ ID NO: 881962 - DNA, 25 bp, Mus musculus
tggagtgaccacgtcccagattgct

SEQ ID NO: 881963 - DNA, 25 bp, Mus musculus
tggagtgactagctaaacactgtca

SEQ ID NO: 881964 - DNA, 25 bp, Mus musculus
tggagtgactaggtaaacactgtca

SEQ ID NO: 881965 - DNA, 25 bp, Mus musculus
tggagtgactccaaccattggtatg

SEQ ID NO: 881966 - DNA, 25 bp, Mus musculus
tggagtgactcctaccattggtatg

SEQ ID NO: 881967 - DNA, 25 bp, Mus musculus
tggagtgagcgacacacgtcatctt

SEQ ID NO: 881968 - DNA, 25 bp, Mus musculus
tggagtgagcgagacacgtcatctt

SEQ ID NO: 881969 - DNA, 25 bp, Mus musculus
tggagtgagtctagtggcagcctta

SEQ ID NO: 881970 - DNA, 25 bp, Mus musculus
tggagtgagtcttgtggcagcctta

SEQ ID NO: 881971 - DNA, 25 bp, Mus musculus
tggagtgagttaacattcttccttt

SEQ ID NO: 881972 - DNA, 25 bp, Mus musculus
tggagtgagttatcattcttccttt

SEQ ID NO: 881973 - DNA, 25 bp, Mus musculus
tggagtgatacaccctcactatgta

SEQ ID NO: 881974 - DNA, 25 bp, Mus musculus
tggagtgatacagcctcactatgta

SEQ ID NO: 881975 - DNA, 25 bp, Mus musculus
tggagtgataccacgcagtgagcgc

SEQ ID NO: 881976 - DNA, 25 bp, Mus musculus
tggagtgatacctcgcagtgagcgc

SEQ ID NO: 881977 - DNA, 25 bp, Mus musculus
tggagtgatagtcaacgttttcttt

SEQ ID NO: 881978 - DNA, 25 bp, Mus musculus
tggagtgatagtgaacgttttcttt

SEQ ID NO: 881979 - DNA, 25 bp, Mus musculus
tggagtgatctgcacagcctgctca

SEQ ID NO: 881980 - DNA, 25 bp, Mus musculus
tggagtgatctggacagcctgctca

SEQ ID NO: 881981 - DNA, 25 bp, Mus musculus
tggagtgatgatcctgaccctgact

SEQ ID NO: 881982 - DNA, 25 bp, Mus musculus
tggagtgatgatgctgaccctgact

SEQ ID NO: 881983 - DNA, 25 bp, Mus musculus
tggagtgcaaacactgccgtgccaa

SEQ ID NO: 881984 - DNA, 25 bp, Mus musculus
tggagtgcaaactctgccgtgccaa

SEQ ID NO: 881985 - DNA, 25 bp, Mus musculus
tggagtgcaacaccttcacatcacc

SEQ ID NO: 881986 - DNA, 25 bp, Mus musculus
tggagtgcaacagcttcacatcacc

SEQ ID NO: 881987 - DNA, 25 bp, Mus musculus
tggagtgcatacagaaggcttggct

SEQ ID NO: 881988 - DNA, 25 bp, Mus musculus
tggagtgcatactgaaggcttggct

SEQ ID NO: 881989 - DNA, 25 bp, Mus musculus
tggagtgcccaacccaaagaacatg

SEQ ID NO: 881990 - DNA, 25 bp, Mus musculus
tggagtgcccaagccaaagaacatg

SEQ ID NO: 881991 - DNA, 25 bp, Mus musculus
tggagtgcccagacactgtgtctca

SEQ ID NO: 881992 - DNA, 25 bp, Mus musculus
tggagtgcccagctagttaagaagc

SEQ ID NO: 881993 - DNA, 25 bp, Mus musculus
tggagtgcccaggtagttaagaagc

SEQ ID NO: 881994 - DNA, 25 bp, Mus musculus
tggagtgcccagtcactgtgtctca

SEQ ID NO: 881995 - DNA, 25 bp, Mus musculus
tggagtgccctgaactctagccatg

SEQ ID NO: 881996 - DNA, 25 bp, Mus musculus
tggagtgccctgtactctagccatg

SEQ ID NO: 881997 - DNA, 25 bp, Mus musculus
tggagtgcccttacaggtcttggac

SEQ ID NO: 881998 - DNA, 25 bp, Mus musculus
tggagtgccctttcaggtcttggac

SEQ ID NO: 881999 - DNA, 25 bp, Mus musculus
tggagtgccgctatgccacacagct

SEQ ID NO: 882000 - DNA, 25 bp, Mus musculus
tggagtgccgctttgccacacagct

SEQ ID NO: 882001 - DNA, 25 bp, Mus musculus
tggagtgctaataaatgaccctttt

SEQ ID NO: 882002 - DNA, 25 bp, Mus musculus
tggagtgctaattaatgaccctttt

SEQ ID NO: 882003 - DNA, 25 bp, Mus musculus
tggagtgctacaaacctacaagatc

SEQ ID NO: 882004 - DNA, 25 bp, Mus musculus
tggagtgctacatacctacaagatc

SEQ ID NO: 882005 - DNA, 25 bp, Mus musculus
tggagtgctctgacccattgtgtct

SEQ ID NO: 882006 - DNA, 25 bp, Mus musculus
tggagtgctctgtcccattgtgtct

SEQ ID NO: 882007 - DNA, 25 bp, Mus musculus
tggagtgctgggattgccacaagat

SEQ ID NO: 882008 - DNA, 25 bp, Mus musculus
tggagtgctgggtttgccacaagat

SEQ ID NO: 882009 - DNA, 25 bp, Mus musculus
tggagtgctggtatctgccttcctg

SEQ ID NO: 882010 - DNA, 25 bp, Mus musculus
tggagtgctggtttctgccttcctg

SEQ ID NO: 882011 - DNA, 25 bp, Mus musculus
tggagtggacagaagttaactaacc

SEQ ID NO: 882012 - DNA, 25 bp, Mus musculus
tggagtggacagtagttaactaacc

SEQ ID NO: 882013 - DNA, 25 bp, Mus musculus
tggagtggagctctataacgagatt

SEQ ID NO: 882014 - DNA, 25 bp, Mus musculus
tggagtggagctgtataacgagatt

SEQ ID NO: 882015 - DNA, 25 bp, Mus musculus
tggagtggagtcagctctgttccct

SEQ ID NO: 882016 - DNA, 25 bp, Mus musculus
tggagtggagtctgctctgttccct

SEQ ID NO: 882017 - DNA, 25 bp, Mus musculus
tggagtggatgtagccctcagtcat

SEQ ID NO: 882018 - DNA, 25 bp, Mus musculus
tggagtggatgttgccctcagtcat

SEQ ID NO: 882019 - DNA, 25 bp, Mus musculus
tggagtggcacccttttggtttaga

SEQ ID NO: 882020 - DNA, 25 bp, Mus musculus
tggagtggcaccgttttggtttaga

SEQ ID NO: 882021 - DNA, 25 bp, Mus musculus
tggagtggccacagccttggctgac

SEQ ID NO: 882022 - DNA, 25 bp, Mus musculus
tggagtggccactgccttggctgac

SEQ ID NO: 882023 - DNA, 25 bp, Mus musculus
tggagtggctccaaccttgttggaa

SEQ ID NO: 882024 - DNA, 25 bp, Mus musculus
tggagtggctcctaccttgttggaa

SEQ ID NO: 882025 - DNA, 25 bp, Mus musculus
tggagtggctggctgctgaccgaaa

SEQ ID NO: 882026 - DNA, 25 bp, Mus musculus
tggagtggctgggtgctgaccgaaa

SEQ ID NO: 882027 - DNA, 25 bp, Mus musculus
tggagtggtattaggcatgcatgtt

SEQ ID NO: 882028 - DNA, 25 bp, Mus musculus
tggagtggtatttggcatgcatgtt

SEQ ID NO: 882029 - DNA, 25 bp, Mus musculus
tggagtgtaaataggacggtgtaaa

SEQ ID NO: 882030 - DNA, 25 bp, Mus musculus
tggagtgtaaattggacggtgtaaa

SEQ ID NO: 882031 - DNA, 25 bp, Mus musculus
tggagtgtacacaacccgatggaac

SEQ ID NO: 882032 - DNA, 25 bp, Mus musculus
tggagtgtacactacccgatggaac

SEQ ID NO: 882033 - DNA, 25 bp, Mus musculus
tggagtgtcagaaatgcagcaatct

SEQ ID NO: 882034 - DNA, 25 bp, Mus musculus
tggagtgtcagatatgcagcaatct

SEQ ID NO: 882035 - DNA, 25 bp, Mus musculus
tggagtgtccctatcaggccttatg

SEQ ID NO: 882036 - DNA, 25 bp, Mus musculus
tggagtgtccctttcaggccttatg

SEQ ID NO: 882037 - DNA, 25 bp, Mus musculus
tggagtgtcctgcaattatcatttt

SEQ ID NO: 882038 - DNA, 25 bp, Mus musculus
tggagtgtcctggaattatcatttt

SEQ ID NO: 882039 - DNA, 25 bp, Mus musculus
tggagtgtctttccactttcgaacc

SEQ ID NO: 882040 - DNA, 25 bp, Mus musculus
tggagtgtctttgcactttcgaacc

SEQ ID NO: 882041 - DNA, 25 bp, Mus musculus
tggagtgtgttcacgtgcgcaccaa

SEQ ID NO: 882042 - DNA, 25 bp, Mus musculus
tggagtgtgttctcgtgcgcaccaa

SEQ ID NO: 882043 - DNA, 25 bp, Mus musculus
tggagtgttaaccacagcgaggaca

SEQ ID NO: 882044 - DNA, 25 bp, Mus musculus
tggagtgttaacgacagcgaggaca

SEQ ID NO: 882045 - DNA, 25 bp, Mus musculus
tggagtgttccactaggttggctac

SEQ ID NO: 882046 - DNA, 25 bp, Mus musculus
tggagtgttccagtaggttggctac

SEQ ID NO: 882047 - DNA, 25 bp, Mus musculus
tggagtgttcttcctaataaacaca

SEQ ID NO: 882048 - DNA, 25 bp, Mus musculus
tggagtgttcttgctaataaacaca

SEQ ID NO: 882049 - DNA, 25 bp, Mus musculus
tggagtgtttacctagctagtatat

SEQ ID NO: 882050 - DNA, 25 bp, Mus musculus
tggagtgtttacgtagctagtatat

SEQ ID NO: 882051 - DNA, 25 bp, Mus musculus
tggagttaactaatggctggaagcc

SEQ ID NO: 882052 - DNA, 25 bp, Mus musculus
tggagttaactattggctggaagcc

SEQ ID NO: 882053 - DNA, 25 bp, Mus musculus
tggagttaatctagaacccaccccg

SEQ ID NO: 882054 - DNA, 25 bp, Mus musculus
tggagttaatcttgaacccaccccg

SEQ ID NO: 882055 - DNA, 25 bp, Mus musculus
tggagttaccaaattcctaagatta

SEQ ID NO: 882056 - DNA, 25 bp, Mus musculus
tggagttaccaatttcctaagatta

SEQ ID NO: 882057 - DNA, 25 bp, Mus musculus
tggagttaccagaggctttgagtag

SEQ ID NO: 882058 - DNA, 25 bp, Mus musculus
tggagttaccagtggctttgagtag

SEQ ID NO: 882059 - DNA, 25 bp, Mus musculus
tggagttactccaacaaggacttat

SEQ ID NO: 882060 - DNA, 25 bp, Mus musculus
tggagttactcctacaaggacttat

SEQ ID NO: 882061 - DNA, 25 bp, Mus musculus
tggagttattccatccaccagcttg

SEQ ID NO: 882062 - DNA, 25 bp, Mus musculus
tggagttattccttccaccagcttg

SEQ ID NO: 882063 - DNA, 25 bp, Mus musculus
tggagttcaaggactacttgctaaa

SEQ ID NO: 882064 - DNA, 25 bp, Mus musculus
tggagttcaaggtctacttgctaaa

SEQ ID NO: 882065 - DNA, 25 bp, Mus musculus
tggagttcacaaaccatttgacctt

SEQ ID NO: 882066 - DNA, 25 bp, Mus musculus
tggagttcacaatccatttgacctt

SEQ ID NO: 882067 - DNA, 25 bp, Mus musculus
tggagttcacagcaacgaccactct

SEQ ID NO: 882068 - DNA, 25 bp, Mus musculus
tggagttcacagcactgccccagat

SEQ ID NO: 882069 - DNA, 25 bp, Mus musculus
tggagttcacaggaacgaccactct

SEQ ID NO: 882070 - DNA, 25 bp, Mus musculus
tggagttcacaggactgccccagat

SEQ ID NO: 882071 - DNA, 25 bp, Mus musculus
tggagttcagggacacacaccctca

SEQ ID NO: 882072 - DNA, 25 bp, Mus musculus
tggagttcagggtcacacaccctca

SEQ ID NO: 882073 - DNA, 25 bp, Mus musculus
tggagttcagtgcatatgcccttga

SEQ ID NO: 882074 - DNA, 25 bp, Mus musculus
tggagttcagtggatatgcccttga

SEQ ID NO: 882075 - DNA, 25 bp, Mus musculus
tggagttcatccacaggctccaggg

SEQ ID NO: 882076 - DNA, 25 bp, Mus musculus
tggagttcatcctcaggctccaggg

SEQ ID NO: 882077 - DNA, 25 bp, Mus musculus
tggagttcatcgcatcctcagacta

SEQ ID NO: 882078 - DNA, 25 bp, Mus musculus
tggagttcatcggatcctcagacta

SEQ ID NO: 882079 - DNA, 25 bp, Mus musculus
tggagttccaagacttttcagactt

SEQ ID NO: 882080 - DNA, 25 bp, Mus musculus
tggagttccaagtcttttcagactt

SEQ ID NO: 882081 - DNA, 25 bp, Mus musculus
tggagttccagaaccagccggattc

SEQ ID NO: 882082 - DNA, 25 bp, Mus musculus
tggagttccagatccagccggattc

SEQ ID NO: 882083 - DNA, 25 bp, Mus musculus
tggagttccaggaaacgtgggtgct

SEQ ID NO: 882084 - DNA, 25 bp, Mus musculus
tggagttccaggtaacgtgggtgct

SEQ ID NO: 882085 - DNA, 25 bp, Mus musculus
tggagttcctctacgacaagcttag

SEQ ID NO: 882086 - DNA, 25 bp, Mus musculus
tggagttcctcttcgacaagcttag

SEQ ID NO: 882087 - DNA, 25 bp, Mus musculus
tggagttcctgacagcctaagctcg

SEQ ID NO: 882088 - DNA, 25 bp, Mus musculus
tggagttcctgagagcctaagctcg

SEQ ID NO: 882089 - DNA, 25 bp, Mus musculus
tggagttcctgcctagaatttccca

SEQ ID NO: 882090 - DNA, 25 bp, Mus musculus
tggagttcctgcgtagaatttccca

SEQ ID NO: 882091 - DNA, 25 bp, Mus musculus
tggagttcctggacccggtacaaag

SEQ ID NO: 882092 - DNA, 25 bp, Mus musculus
tggagttcctggtcccggtacaaag

SEQ ID NO: 882093 - DNA, 25 bp, Mus musculus
tggagttcgggcagatgtgacatca

SEQ ID NO: 882094 - DNA, 25 bp, Mus musculus
tggagttcgggctgatgtgacatca

SEQ ID NO: 882095 - DNA, 25 bp, Mus musculus
tggagttcgtctaagacctgcccaa

SEQ ID NO: 882096 - DNA, 25 bp, Mus musculus
tggagttcgtcttagacctgcccaa

SEQ ID NO: 882097 - DNA, 25 bp, Mus musculus
tggagttctaagatccaaaacgcat

SEQ ID NO: 882098 - DNA, 25 bp, Mus musculus
tggagttctaagttccaaaacgcat

SEQ ID NO: 882099 - DNA, 25 bp, Mus musculus
tggagttctgggagacttggctctt

SEQ ID NO: 882100 - DNA, 25 bp, Mus musculus
tggagttctgggtgacttggctctt

SEQ ID NO: 882101 - DNA, 25 bp, Mus musculus
tggagttcttccaaaggagttttgt

SEQ ID NO: 882102 - DNA, 25 bp, Mus musculus
tggagttcttcctaaggagttttgt

SEQ ID NO: 882103 - DNA, 25 bp, Mus musculus
tggagttcttcgcaaacccaagagt

SEQ ID NO: 882104 - DNA, 25 bp, Mus musculus
tggagttcttcggaaacccaagagt

SEQ ID NO: 882105 - DNA, 25 bp, Mus musculus
tggagttcttgtaacaatgtctcaa

SEQ ID NO: 882106 - DNA, 25 bp, Mus musculus
tggagttcttgttacaatgtctcaa

SEQ ID NO: 882107 - DNA, 25 bp, Mus musculus
tggagttgccacaggcccaggagct

SEQ ID NO: 882108 - DNA, 25 bp, Mus musculus
tggagttgccactggcccaggagct

SEQ ID NO: 882109 - DNA, 25 bp, Mus musculus
tggagttgctcacctctaaagtcac

SEQ ID NO: 882110 - DNA, 25 bp, Mus musculus
tggagttgctcagctctaaagtcac

SEQ ID NO: 882111 - DNA, 25 bp, Mus musculus
tggagttgctcccatcattgatgtt

SEQ ID NO: 882112 - DNA, 25 bp, Mus musculus
tggagttgctccgatcattgatgtt

SEQ ID NO: 882113 - DNA, 25 bp, Mus musculus
tggagttggagccatccatgcgcaa

SEQ ID NO: 882114 - DNA, 25 bp, Mus musculus
tggagttggagcgatccatgcgcaa

SEQ ID NO: 882115 - DNA, 25 bp, Mus musculus
tggagttggcctccaccttctagac

SEQ ID NO: 882116 - DNA, 25 bp, Mus musculus
tggagttggcctgcaccttctagac

SEQ ID NO: 882117 - DNA, 25 bp, Mus musculus
tggagttggcgtacagcctgagatc

SEQ ID NO: 882118 - DNA, 25 bp, Mus musculus
tggagttggcgttcagcctgagatc

SEQ ID NO: 882119 - DNA, 25 bp, Mus musculus
tggagttgggacactgctctggcta

SEQ ID NO: 882120 - DNA, 25 bp, Mus musculus
tggagttgggactctgctctggcta

SEQ ID NO: 882121 - DNA, 25 bp, Mus musculus
tggagttggtagattcagctgtaca

SEQ ID NO: 882122 - DNA, 25 bp, Mus musculus
tggagttggtagtttcagctgtaca

SEQ ID NO: 882123 - DNA, 25 bp, Mus musculus
tggagttgtagcagtcctgtgtctg

SEQ ID NO: 882124 - DNA, 25 bp, Mus musculus
tggagttgtagctgtcctgtgtctg

SEQ ID NO: 882125 - DNA, 25 bp, Mus musculus
tggagttgtccaacctttacctggg

SEQ ID NO: 882126 - DNA, 25 bp, Mus musculus
tggagttgtccatcctttacctggg

SEQ ID NO: 882127 - DNA, 25 bp, Mus musculus
tggagttgtgcaaaccaaggtgaaa

SEQ ID NO: 882128 - DNA, 25 bp, Mus musculus
tggagttgtgcataccaaggtgaaa

SEQ ID NO: 882129 - DNA, 25 bp, Mus musculus
tggagttgtttaagtttgtctcccc

SEQ ID NO: 882130 - DNA, 25 bp, Mus musculus
tggagttgtttatgtttgtctcccc

SEQ ID NO: 882131 - DNA, 25 bp, Mus musculus
tggagtttaagtcccaccagtggtt

SEQ ID NO: 882132 - DNA, 25 bp, Mus musculus
tggagtttaagtgccaccagtggtt

SEQ ID NO: 882133 - DNA, 25 bp, Mus musculus
tggagtttataccagagtccccgcc

SEQ ID NO: 882134 - DNA, 25 bp, Mus musculus
tggagtttatacgagagtccccgcc

SEQ ID NO: 882135 - DNA, 25 bp, Mus musculus
tggagtttatggcttttccctactg

SEQ ID NO: 882136 - DNA, 25 bp, Mus musculus
tggagtttatgggttttccctactg

SEQ ID NO: 882137 - DNA, 25 bp, Mus musculus
tggagtttcaaacttttccacgcac

SEQ ID NO: 882138 - DNA, 25 bp, Mus musculus
tggagtttcaaagttttccacgcac

SEQ ID NO: 882139 - DNA, 25 bp, Mus musculus
tggagtttcaacattcatgcccatg

SEQ ID NO: 882140 - DNA, 25 bp, Mus musculus
tggagtttcaactttcatgcccatg

SEQ ID NO: 882141 - DNA, 25 bp, Mus musculus
tggagtttccaactttgggcctagg

SEQ ID NO: 882142 - DNA, 25 bp, Mus musculus
tggagtttccaagtttgggcctagg

SEQ ID NO: 882143 - DNA, 25 bp, Mus musculus
tggagtttccagaaatacacatagc

SEQ ID NO: 882144 - DNA, 25 bp, Mus musculus
tggagtttccagtaatacacatagc

SEQ ID NO: 882145 - DNA, 25 bp, Mus musculus
tggagtttcctcaagatcatgttat

SEQ ID NO: 882146 - DNA, 25 bp, Mus musculus
tggagtttcctctagatcatgttat

SEQ ID NO: 882147 - DNA, 25 bp, Mus musculus
tggagtttcctgaggaggtgaacac

SEQ ID NO: 882148 - DNA, 25 bp, Mus musculus
tggagtttcctgtggaggtgaacac

SEQ ID NO: 882149 - DNA, 25 bp, Mus musculus
tggagtttgaaaaggcctgtgcttc

SEQ ID NO: 882150 - DNA, 25 bp, Mus musculus
tggagtttgaaatggcctgtgcttc

SEQ ID NO: 882151 - DNA, 25 bp, Mus musculus
tggagtttgaaccacttcccgaaag

SEQ ID NO: 882152 - DNA, 25 bp, Mus musculus
tggagtttgaacgacttcccgaaag

SEQ ID NO: 882153 - DNA, 25 bp, Mus musculus
tggagtttgcccatgaggccttggc

SEQ ID NO: 882154 - DNA, 25 bp, Mus musculus
tggagtttgcccttgaggccttggc

SEQ ID NO: 882155 - DNA, 25 bp, Mus musculus
tggagtttggaaacctcctacccgg

SEQ ID NO: 882156 - DNA, 25 bp, Mus musculus
tggagtttggaatcctcctacccgg

SEQ ID NO: 882157 - DNA, 25 bp, Mus musculus
tggagtttggtgatcccgcagccat

SEQ ID NO: 882158 - DNA, 25 bp, Mus musculus
tggagtttggtgttcccgcagccat

SEQ ID NO: 882159 - DNA, 25 bp, Mus musculus
tggagtttgtttcagaattgcccaa

SEQ ID NO: 882160 - DNA, 25 bp, Mus musculus
tggagtttgtttgagaattgcccaa

SEQ ID NO: 882161 - DNA, 25 bp, Mus musculus
tggagttttatcacttgcaagatgc

SEQ ID NO: 882162 - DNA, 25 bp, Mus musculus
tggagttttatctcttgcaagatgc

SEQ ID NO: 882163 - DNA, 25 bp, Mus musculus
tggagttttcctaaatacttcgtga

SEQ ID NO: 882164 - DNA, 25 bp, Mus musculus
tggagttttccttaatacttcgtga

SEQ ID NO: 882165 - DNA, 25 bp, Mus musculus
tggagttttgagctctcactaccct

SEQ ID NO: 882166 - DNA, 25 bp, Mus musculus
tggagttttgaggtctcactaccct

SEQ ID NO: 882167 - DNA, 25 bp, Mus musculus
tggagttttgctagggtcttgactt

SEQ ID NO: 882168 - DNA, 25 bp, Mus musculus
tggagttttgcttgggtcttgactt

SEQ ID NO: 882169 - DNA, 25 bp, Mus musculus
tggagttttggacccatgggacaaa

SEQ ID NO: 882170 - DNA, 25 bp, Mus musculus
tggagttttggagccatgggacaaa

SEQ ID NO: 882171 - DNA, 25 bp, Mus musculus
tggataacccctccttttcaaatac

SEQ ID NO: 882172 - DNA, 25 bp, Mus musculus
tggataacccctgcttttcaaatac

SEQ ID NO: 882173 - DNA, 25 bp, Mus musculus
tggataacctctacaaataaagcta

SEQ ID NO: 882174 - DNA, 25 bp, Mus musculus
tggataacctcttcaaataaagcta

SEQ ID NO: 882175 - DNA, 25 bp, Mus musculus
tggataaccttgattcttcctctcc

SEQ ID NO: 882176 - DNA, 25 bp, Mus musculus
tggataaccttgtttcttcctctcc

SEQ ID NO: 882177 - DNA, 25 bp, Mus musculus
tggataacttcacgtttactccccg

SEQ ID NO: 882178 - DNA, 25 bp, Mus musculus
tggataacttcaggtttactccccg

SEQ ID NO: 882179 - DNA, 25 bp, Mus musculus
tggataagaagcctgagccccatca

SEQ ID NO: 882180 - DNA, 25 bp, Mus musculus
tggataagaagcgtgagccccatca

SEQ ID NO: 882181 - DNA, 25 bp, Mus musculus
tggataagatctcaggccttcctac

SEQ ID NO: 882182 - DNA, 25 bp, Mus musculus
tggataagatctgaggccttcctac

SEQ ID NO: 882183 - DNA, 25 bp, Mus musculus
tggataatctcaaggtctcccactt

SEQ ID NO: 882184 - DNA, 25 bp, Mus musculus
tggataatctcacggcctcagcaca

SEQ ID NO: 882185 - DNA, 25 bp, Mus musculus
tggataatctcagggcctcagcaca

SEQ ID NO: 882186 - DNA, 25 bp, Mus musculus
tggataatctcatggtctcccactt

SEQ ID NO: 882187 - DNA, 25 bp, Mus musculus
tggataatgccccagaagccatgca

SEQ ID NO: 882188 - DNA, 25 bp, Mus musculus
tggataatgcccgagaagccatgca

SEQ ID NO: 882189 - DNA, 25 bp, Mus musculus
tggatacaagtactttaccacttag

SEQ ID NO: 882190 - DNA, 25 bp, Mus musculus
tggatacaagtagtttaccacttag

SEQ ID NO: 882191 - DNA, 25 bp, Mus musculus
tggatacaatccagcaacccaagta

SEQ ID NO: 882192 - DNA, 25 bp, Mus musculus
tggatacaatcctgcaacccaagta

SEQ ID NO: 882193 - DNA, 25 bp, Mus musculus
tggatacacaggctctcagtgatac

SEQ ID NO: 882194 - DNA, 25 bp, Mus musculus
tggatacacagggtctcagtgatac

SEQ ID NO: 882195 - DNA, 25 bp, Mus musculus
tggatacagagactgcagtcgctct

SEQ ID NO: 882196 - DNA, 25 bp, Mus musculus
tggatacagagagtgcagtcgctct

SEQ ID NO: 882197 - DNA, 25 bp, Mus musculus
tggatacagctaacccacagtggaa

SEQ ID NO: 882198 - DNA, 25 bp, Mus musculus
tggatacagctatcccacagtggaa

SEQ ID NO: 882199 - DNA, 25 bp, Mus musculus
tggatacatcaaaaccatggctgtt

SEQ ID NO: 882200 - DNA, 25 bp, Mus musculus
tggatacatcaataccatggctgtt

SEQ ID NO: 882201 - DNA, 25 bp, Mus musculus
tggatacatctgacggacaacaggg

SEQ ID NO: 882202 - DNA, 25 bp, Mus musculus
tggatacatctgtcggacaacaggg

SEQ ID NO: 882203 - DNA, 25 bp, Mus musculus
tggatacatggacccaggctgcttg

SEQ ID NO: 882204 - DNA, 25 bp, Mus musculus
tggatacatggagccaggctgcttg

SEQ ID NO: 882205 - DNA, 25 bp, Mus musculus
tggatacatttcaagcagtgtggct

SEQ ID NO: 882206 - DNA, 25 bp, Mus musculus
tggatacatttcctcgttgtcctca

SEQ ID NO: 882207 - DNA, 25 bp, Mus musculus
tggatacatttcgtcgttgtcctca

SEQ ID NO: 882208 - DNA, 25 bp, Mus musculus
tggatacatttctagcagtgtggct

SEQ ID NO: 882209 - DNA, 25 bp, Mus musculus
tggataccaaggcatgctcatctca

SEQ ID NO: 882210 - DNA, 25 bp, Mus musculus
tggataccaagggatgctcatctca

SEQ ID NO: 882211 - DNA, 25 bp, Mus musculus
tggataccaatcacatttactactg

SEQ ID NO: 882212 - DNA, 25 bp, Mus musculus
tggataccaatctcatttactactg

SEQ ID NO: 882213 - DNA, 25 bp, Mus musculus
tggataccacagatcaaaggcctgg

SEQ ID NO: 882214 - DNA, 25 bp, Mus musculus
tggataccacagttcaaaggcctgg

SEQ ID NO: 882215 - DNA, 25 bp, Mus musculus
tggataccagctcattgccttgttt

SEQ ID NO: 882216 - DNA, 25 bp, Mus musculus
tggataccagctgattgccttgttt

SEQ ID NO: 882217 - DNA, 25 bp, Mus musculus
tggataccatccatttgggaaggga

SEQ ID NO: 882218 - DNA, 25 bp, Mus musculus
tggataccatccttttgggaaggga

SEQ ID NO: 882219 - DNA, 25 bp, Mus musculus
tggatacccactagaacagccacta

SEQ ID NO: 882220 - DNA, 25 bp, Mus musculus
tggatacccacttgaacagccacta

SEQ ID NO: 882221 - DNA, 25 bp, Mus musculus
tggatacccaggatgtgcccgagct

SEQ ID NO: 882222 - DNA, 25 bp, Mus musculus
tggatacccaggttgtgcccgagct

SEQ ID NO: 882223 - DNA, 25 bp, Mus musculus
tggatacccagtctctaacaccgac

SEQ ID NO: 882224 - DNA, 25 bp, Mus musculus
tggatacccagtgtctaacaccgac

SEQ ID NO: 882225 - DNA, 25 bp, Mus musculus
tggataccccacaatcacagtgact

SEQ ID NO: 882226 - DNA, 25 bp, Mus musculus
tggataccccactatcacagtgact

SEQ ID NO: 882227 - DNA, 25 bp, Mus musculus
tggataccccgccaggataaaaata

SEQ ID NO: 882228 - DNA, 25 bp, Mus musculus
tggataccccgcgaggataaaaata

SEQ ID NO: 882229 - DNA, 25 bp, Mus musculus
tggatacccctgcaaatgagaaaat

SEQ ID NO: 882230 - DNA, 25 bp, Mus musculus
tggatacccctggaaatgagaaaat

SEQ ID NO: 882231 - DNA, 25 bp, Mus musculus
tggataccctacagcatcaagctaa

SEQ ID NO: 882232 - DNA, 25 bp, Mus musculus
tggataccctactgcatcaagctaa

SEQ ID NO: 882233 - DNA, 25 bp, Mus musculus
tggataccctcactagttgttctga

SEQ ID NO: 882234 - DNA, 25 bp, Mus musculus
tggataccctcagtagttgttctga

SEQ ID NO: 882235 - DNA, 25 bp, Mus musculus
tggataccctgcctctacatgcaat

SEQ ID NO: 882236 - DNA, 25 bp, Mus musculus
tggataccctgcgtctacatgcaat

SEQ ID NO: 882237 - DNA, 25 bp, Mus musculus
tggataccgcagctaggaataatgg

SEQ ID NO: 882238 - DNA, 25 bp, Mus musculus
tggataccgcaggtaggaataatgg

SEQ ID NO: 882239 - DNA, 25 bp, Mus musculus
tggatacctgatacctaggcagttt

SEQ ID NO: 882240 - DNA, 25 bp, Mus musculus
tggatacctgattcctaggcagttt

SEQ ID NO: 882241 - DNA, 25 bp, Mus musculus
tggataccttctcggcttttgaact

SEQ ID NO: 882242 - DNA, 25 bp, Mus musculus
tggataccttctgggcttttgaact

SEQ ID NO: 882243 - DNA, 25 bp, Mus musculus
tggataccttttcacaccatttatg

SEQ ID NO: 882244 - DNA, 25 bp, Mus musculus
tggataccttttgacaccatttatg

SEQ ID NO: 882245 - DNA, 25 bp, Mus musculus
tggatacgagtcacttgccctaaat

SEQ ID NO: 882246 - DNA, 25 bp, Mus musculus
tggatacgagtctcttgccctaaat

SEQ ID NO: 882247 - DNA, 25 bp, Mus musculus
tggatactaataccctcctgtaact

SEQ ID NO: 882248 - DNA, 25 bp, Mus musculus
tggatactaatagcctcctgtaact

SEQ ID NO: 882249 - DNA, 25 bp, Mus musculus
tggatactacctccaaaaagttagg

SEQ ID NO: 882250 - DNA, 25 bp, Mus musculus
tggatactacctgcaaaaagttagg

SEQ ID NO: 882251 - DNA, 25 bp, Mus musculus
tggatactctcactgccagccaaat

SEQ ID NO: 882252 - DNA, 25 bp, Mus musculus
tggatactctcagtgccagccaaat

SEQ ID NO: 882253 - DNA, 25 bp, Mus musculus
tggatactctgtcccaatttattta

SEQ ID NO: 882254 - DNA, 25 bp, Mus musculus
tggatactctgtgccaatttattta

SEQ ID NO: 882255 - DNA, 25 bp, Mus musculus
tggatactgacacggatcctgccaa

SEQ ID NO: 882256 - DNA, 25 bp, Mus musculus
tggatactgacagggatcctgccaa

SEQ ID NO: 882257 - DNA, 25 bp, Mus musculus
tggatactggccatattttgctttt

SEQ ID NO: 882258 - DNA, 25 bp, Mus musculus
tggatactggccttattttgctttt

SEQ ID NO: 882259 - DNA, 25 bp, Mus musculus
tggatacttcttcaggattcttgcc

SEQ ID NO: 882260 - DNA, 25 bp, Mus musculus
tggatacttcttgaggattcttgcc

SEQ ID NO: 882261 - DNA, 25 bp, Mus musculus
tggatactttatcacggaggatggt

SEQ ID NO: 882262 - DNA, 25 bp, Mus musculus
tggatactttatgacggaggatggt

SEQ ID NO: 882263 - DNA, 25 bp, Mus musculus
tggatactttcaaaccatgccctat

SEQ ID NO: 882264 - DNA, 25 bp, Mus musculus
tggatactttcaatctgtccaagga

SEQ ID NO: 882265 - DNA, 25 bp, Mus musculus
tggatactttcataccatgccctat

SEQ ID NO: 882266 - DNA, 25 bp, Mus musculus
tggatactttcattctgtccaagga

SEQ ID NO: 882267 - DNA, 25 bp, Mus musculus
tggatagaccagacccactgtaaag

SEQ ID NO: 882268 - DNA, 25 bp, Mus musculus
tggatagaccagtcccactgtaaag

SEQ ID NO: 882269 - DNA, 25 bp, Mus musculus
tggatagactcaaaccacaggctct

SEQ ID NO: 882270 - DNA, 25 bp, Mus musculus
tggatagactcataccacaggctct

SEQ ID NO: 882271 - DNA, 25 bp, Mus musculus
tggatagagccacccaggacgcact

SEQ ID NO: 882272 - DNA, 25 bp, Mus musculus
tggatagagccagccaggacgcact

SEQ ID NO: 882273 - DNA, 25 bp, Mus musculus
tggatagatgcacctcccatacacc

SEQ ID NO: 882274 - DNA, 25 bp, Mus musculus
tggatagatgcagctcccatacacc

SEQ ID NO: 882275 - DNA, 25 bp, Mus musculus
tggatagcacgacacaccgccaaac

SEQ ID NO: 882276 - DNA, 25 bp, Mus musculus
tggatagcacgagacaccgccaaac

SEQ ID NO: 882277 - DNA, 25 bp, Mus musculus
tggatagccattaccccacagaagg

SEQ ID NO: 882278 - DNA, 25 bp, Mus musculus
tggatagccatttccccacagaagg

SEQ ID NO: 882279 - DNA, 25 bp, Mus musculus
tggatagctgagcaggcccatccca

SEQ ID NO: 882280 - DNA, 25 bp, Mus musculus
tggatagctgaggaggcccatccca

SEQ ID NO: 882281 - DNA, 25 bp, Mus musculus
tggatagctgtgatcccaaattctt

SEQ ID NO: 882282 - DNA, 25 bp, Mus musculus
tggatagctgtgttcccaaattctt

SEQ ID NO: 882283 - DNA, 25 bp, Mus musculus
tggataggatttcggcagggtttca

SEQ ID NO: 882284 - DNA, 25 bp, Mus musculus
tggataggatttgggcagggtttca

SEQ ID NO: 882285 - DNA, 25 bp, Mus musculus
tggatagtcccaacccaggttctgt

SEQ ID NO: 882286 - DNA, 25 bp, Mus musculus
tggatagtcccatcccaggttctgt

SEQ ID NO: 882287 - DNA, 25 bp, Mus musculus
tggatagtccgaatctctctggctc

SEQ ID NO: 882288 - DNA, 25 bp, Mus musculus
tggatagtccgattctctctggctc

SEQ ID NO: 882289 - DNA, 25 bp, Mus musculus
tggatagtctgtaaccacaccactc

SEQ ID NO: 882290 - DNA, 25 bp, Mus musculus
tggatagtctgttaccacaccactc

SEQ ID NO: 882291 - DNA, 25 bp, Mus musculus
tggatagtggacaccccattcacca

SEQ ID NO: 882292 - DNA, 25 bp, Mus musculus
tggatagtggactccccattcacca

SEQ ID NO: 882293 - DNA, 25 bp, Mus musculus
tggatagttgccaagttcctctttc

SEQ ID NO: 882294 - DNA, 25 bp, Mus musculus
tggatagttgcctagttcctctttc

SEQ ID NO: 882295 - DNA, 25 bp, Mus musculus
tggatatacccacactgttaaataa

SEQ ID NO: 882296 - DNA, 25 bp, Mus musculus
tggatatacccagactgttaaataa

SEQ ID NO: 882297 - DNA, 25 bp, Mus musculus
tggatatatacgactccgtcctaac

SEQ ID NO: 882298 - DNA, 25 bp, Mus musculus
tggatatatacgtctccgtcctaac

SEQ ID NO: 882299 - DNA, 25 bp, Mus musculus
tggatatcaaacacaggaagcacct

SEQ ID NO: 882300 - DNA, 25 bp, Mus musculus
tggatatcaaactcaggaagcacct

SEQ ID NO: 882301 - DNA, 25 bp, Mus musculus
tggatatcaacaaggaccccagctg

SEQ ID NO: 882302 - DNA, 25 bp, Mus musculus
tggatatcaacatggaccccagctg

SEQ ID NO: 882303 - DNA, 25 bp, Mus musculus
tggatatcagaaattaagcagttac

SEQ ID NO: 882304 - DNA, 25 bp, Mus musculus
tggatatcagaatttaagcagttac

SEQ ID NO: 882305 - DNA, 25 bp, Mus musculus
tggatatctctgactagccgcattt

SEQ ID NO: 882306 - DNA, 25 bp, Mus musculus
tggatatctctgtctagccgcattt

SEQ ID NO: 882307 - DNA, 25 bp, Mus musculus
tggatatgatttcggatgacacaca

SEQ ID NO: 882308 - DNA, 25 bp, Mus musculus
tggatatgatttgggatgacacaca

SEQ ID NO: 882309 - DNA, 25 bp, Mus musculus
tggatatgcacaccctcgtgacatt

SEQ ID NO: 882310 - DNA, 25 bp, Mus musculus
tggatatgcacagcctcgtgacatt

SEQ ID NO: 882311 - DNA, 25 bp, Mus musculus
tggatatgcagcattactctttaac

SEQ ID NO: 882312 - DNA, 25 bp, Mus musculus
tggatatgcagctttactctttaac

SEQ ID NO: 882313 - DNA, 25 bp, Mus musculus
tggatatgcgcaagtgtctcccctg

SEQ ID NO: 882314 - DNA, 25 bp, Mus musculus
tggatatgcgcatgtgtctcccctg

SEQ ID NO: 882315 - DNA, 25 bp, Mus musculus
tggatatgctggaatatggcaacca

SEQ ID NO: 882316 - DNA, 25 bp, Mus musculus
tggatatgctggtatatggcaacca

SEQ ID NO: 882317 - DNA, 25 bp, Mus musculus
tggatatgggctcccatttccaaaa

SEQ ID NO: 882318 - DNA, 25 bp, Mus musculus
tggatatgggctgccatttccaaaa

SEQ ID NO: 882319 - DNA, 25 bp, Mus musculus
tggatattaccaaccctaaagcggt

SEQ ID NO: 882320 - DNA, 25 bp, Mus musculus
tggatattaccatccctaaagcggt

SEQ ID NO: 882321 - DNA, 25 bp, Mus musculus
tggatattcagacaggagctattgc

SEQ ID NO: 882322 - DNA, 25 bp, Mus musculus
tggatattcagagaggagctattgc

SEQ ID NO: 882323 - DNA, 25 bp, Mus musculus
tggatattcccaacaggacctgcaa

SEQ ID NO: 882324 - DNA, 25 bp, Mus musculus
tggatattcccatcaggacctgcaa

SEQ ID NO: 882325 - DNA, 25 bp, Mus musculus
tggatattgtgacttctgctcaccc

SEQ ID NO: 882326 - DNA, 25 bp, Mus musculus
tggatattgtgagttctgctcaccc

SEQ ID NO: 882327 - DNA, 25 bp, Mus musculus
tggatatttccaagtgaccagcaca

SEQ ID NO: 882328 - DNA, 25 bp, Mus musculus
tggatatttccatgtgaccagcaca

SEQ ID NO: 882329 - DNA, 25 bp, Mus musculus
tggatatttccgacagaatctgaga

SEQ ID NO: 882330 - DNA, 25 bp, Mus musculus
tggatatttccgtcagaatctgaga

SEQ ID NO: 882331 - DNA, 25 bp, Mus musculus
tggatatttcctaccgatcagatgg

SEQ ID NO: 882332 - DNA, 25 bp, Mus musculus
tggatatttccttccgatcagatgg

SEQ ID NO: 882333 - DNA, 25 bp, Mus musculus
tggatatttctcaacattcctgaaa

SEQ ID NO: 882334 - DNA, 25 bp, Mus musculus
tggatatttctctacattcctgaaa

SEQ ID NO: 882335 - DNA, 25 bp, Mus musculus
tggatattttcccagagatgcagtc

SEQ ID NO: 882336 - DNA, 25 bp, Mus musculus
tggatattttccctcatccatcaac

SEQ ID NO: 882337 - DNA, 25 bp, Mus musculus
tggatattttccgagagatgcagtc

SEQ ID NO: 882338 - DNA, 25 bp, Mus musculus
tggatattttccgtcatccatcaac

SEQ ID NO: 882339 - DNA, 25 bp, Mus musculus
tggatcaacccaccaaaccttagaa

SEQ ID NO: 882340 - DNA, 25 bp, Mus musculus
tggatcaacccagcaaaccttagaa

SEQ ID NO: 882341 - DNA, 25 bp, Mus musculus
tggatcaaggcaaccgagaaagctt

SEQ ID NO: 882342 - DNA, 25 bp, Mus musculus
tggatcaaggcatccgagaaagctt

SEQ ID NO: 882343 - DNA, 25 bp, Mus musculus
tggatcacaatgcttctctgcagaa

SEQ ID NO: 882344 - DNA, 25 bp, Mus musculus
tggatcacaatggttctctgcagaa

SEQ ID NO: 882345 - DNA, 25 bp, Mus musculus
tggatcaccaaaccagtccacaaac

SEQ ID NO: 882346 - DNA, 25 bp, Mus musculus
tggatcaccaaagcagtccacaaac

SEQ ID NO: 882347 - DNA, 25 bp, Mus musculus
tggatcaccactctccttgggtcaa

SEQ ID NO: 882348 - DNA, 25 bp, Mus musculus
tggatcaccactgtccttgggtcaa

SEQ ID NO: 882349 - DNA, 25 bp, Mus musculus
tggatcacgtgtctgcagtacttga

SEQ ID NO: 882350 - DNA, 25 bp, Mus musculus
tggatcacgtgtgtgcagtacttga

SEQ ID NO: 882351 - DNA, 25 bp, Mus musculus
tggatcactgaaataagcactttca

SEQ ID NO: 882352 - DNA, 25 bp, Mus musculus
tggatcactgaattaagcactttca

SEQ ID NO: 882353 - DNA, 25 bp, Mus musculus
tggatcacttaaagcctcaggcctg

SEQ ID NO: 882354 - DNA, 25 bp, Mus musculus
tggatcacttaatgcctcaggcctg

SEQ ID NO: 882355 - DNA, 25 bp, Mus musculus
tggatcagaagcacggaatcacctt

SEQ ID NO: 882356 - DNA, 25 bp, Mus musculus
tggatcagaagctcggaatcacctt

SEQ ID NO: 882357 - DNA, 25 bp, Mus musculus
tggatcagaccacgcttaggctacg

SEQ ID NO: 882358 - DNA, 25 bp, Mus musculus
tggatcagaccactgcactcatgtt

SEQ ID NO: 882359 - DNA, 25 bp, Mus musculus
tggatcagaccaggcttaggctacg

SEQ ID NO: 882360 - DNA, 25 bp, Mus musculus
tggatcagaccagtgcactcatgtt

SEQ ID NO: 882361 - DNA, 25 bp, Mus musculus
tggatcagagctaacctggagcagt

SEQ ID NO: 882362 - DNA, 25 bp, Mus musculus
tggatcagagcttacctggagcagt

SEQ ID NO: 882363 - DNA, 25 bp, Mus musculus
tggatcagattgaacctaccccatt

SEQ ID NO: 882364 - DNA, 25 bp, Mus musculus
tggatcagattgtacctaccccatt

SEQ ID NO: 882365 - DNA, 25 bp, Mus musculus
tggatcagcaacatacccagtcaga

SEQ ID NO: 882366 - DNA, 25 bp, Mus musculus
tggatcagcaacttacccagtcaga

SEQ ID NO: 882367 - DNA, 25 bp, Mus musculus
tggatcagcaagcaggagtacgatg

SEQ ID NO: 882368 - DNA, 25 bp, Mus musculus
tggatcagcaaggaggagtacgatg

SEQ ID NO: 882369 - DNA, 25 bp, Mus musculus
tggatcagcagacggacatgctccc

SEQ ID NO: 882370 - DNA, 25 bp, Mus musculus
tggatcagcagagggacatgctccc

SEQ ID NO: 882371 - DNA, 25 bp, Mus musculus
tggatcagccaaaggcttttgtaga

SEQ ID NO: 882372 - DNA, 25 bp, Mus musculus
tggatcagccaatggcttttgtaga

SEQ ID NO: 882373 - DNA, 25 bp, Mus musculus
tggatcagcgggacctatcctgttc

SEQ ID NO: 882374 - DNA, 25 bp, Mus musculus
tggatcagcgggtcctatcctgttc

SEQ ID NO: 882375 - DNA, 25 bp, Mus musculus
tggatcaggagcaggcattggcaca

SEQ ID NO: 882376 - DNA, 25 bp, Mus musculus
tggatcaggagctggcattggcaca

SEQ ID NO: 882377 - DNA, 25 bp, Mus musculus
tggatcaggtgaccaatcagacact

SEQ ID NO: 882378 - DNA, 25 bp, Mus musculus
tggatcaggtgagcaatcagacact

SEQ ID NO: 882379 - DNA, 25 bp, Mus musculus
tggatcagtgatcgctcttgagcct

SEQ ID NO: 882380 - DNA, 25 bp, Mus musculus
tggatcagtgatggctcttgagcct

SEQ ID NO: 882381 - DNA, 25 bp, Mus musculus
tggatcatacacaatacgcactgcc

SEQ ID NO: 882382 - DNA, 25 bp, Mus musculus
tggatcatacactatacgcactgcc

SEQ ID NO: 882383 - DNA, 25 bp, Mus musculus
tggatcatcagacctgagtgacaac

SEQ ID NO: 882384 - DNA, 25 bp, Mus musculus
tggatcatcagagctgagtgacaac

SEQ ID NO: 882385 - DNA, 25 bp, Mus musculus
tggatcatcagtctgtaacccctac

SEQ ID NO: 882386 - DNA, 25 bp, Mus musculus
tggatcatcagtgtgtaacccctac

SEQ ID NO: 882387 - DNA, 25 bp, Mus musculus
tggatcatctatcgagtcctctcca

SEQ ID NO: 882388 - DNA, 25 bp, Mus musculus
tggatcatctatggagtcctctcca

SEQ ID NO: 882389 - DNA, 25 bp, Mus musculus
tggatcatctccctgctaaaggcag

SEQ ID NO: 882390 - DNA, 25 bp, Mus musculus
tggatcatctccgtgctaaaggcag

SEQ ID NO: 882391 - DNA, 25 bp, Mus musculus
tggatcatctgtatcacaacccatc

SEQ ID NO: 882392 - DNA, 25 bp, Mus musculus
tggatcatctgtttcacaacccatc

SEQ ID NO: 882393 - DNA, 25 bp, Mus musculus
tggatcatgattaaagtgcgcgtgg

SEQ ID NO: 882394 - DNA, 25 bp, Mus musculus
tggatcatgatttaagtgcgcgtgg

SEQ ID NO: 882395 - DNA, 25 bp, Mus musculus
tggatcatgcaaatattaccgagtc

SEQ ID NO: 882396 - DNA, 25 bp, Mus musculus
tggatcatgcaattattaccgagtc

SEQ ID NO: 882397 - DNA, 25 bp, Mus musculus
tggatcatgctcaaccaacatcaca

SEQ ID NO: 882398 - DNA, 25 bp, Mus musculus
tggatcatgctctaccaacatcaca

SEQ ID NO: 882399 - DNA, 25 bp, Mus musculus
tggatcatggacctcctcgtctgca

SEQ ID NO: 882400 - DNA, 25 bp, Mus musculus
tggatcatggacgtcctcgtctgca

SEQ ID NO: 882401 - DNA, 25 bp, Mus musculus
tggatcatggttcgccacttctata

SEQ ID NO: 882402 - DNA, 25 bp, Mus musculus
tggatcatggttggccacttctata

SEQ ID NO: 882403 - DNA, 25 bp, Mus musculus
tggatcatgttacatatgccttcct

SEQ ID NO: 882404 - DNA, 25 bp, Mus musculus
tggatcatgttagatatgccttcct

SEQ ID NO: 882405 - DNA, 25 bp, Mus musculus
tggatcattcaaagagccccactca

SEQ ID NO: 882406 - DNA, 25 bp, Mus musculus
tggatcattcaatgagccccactca

SEQ ID NO: 882407 - DNA, 25 bp, Mus musculus
tggatcattgctccctctggctatc

SEQ ID NO: 882408 - DNA, 25 bp, Mus musculus
tggatcattgctgcctctggctatc

SEQ ID NO: 882409 - DNA, 25 bp, Mus musculus
tggatcatttccctggttaactttc

SEQ ID NO: 882410 - DNA, 25 bp, Mus musculus
tggatcatttccgtggttaactttc

SEQ ID NO: 882411 - DNA, 25 bp, Mus musculus
tggatccaaaaccaagtcctgctgg

SEQ ID NO: 882412 - DNA, 25 bp, Mus musculus
tggatccaaaacgaagtcctgctgg

SEQ ID NO: 882413 - DNA, 25 bp, Mus musculus
tggatccaaactaaacgagccctgt

SEQ ID NO: 882414 - DNA, 25 bp, Mus musculus
tggatccaaacttaacgagccctgt

SEQ ID NO: 882415 - DNA, 25 bp, Mus musculus
tggatccaacacctctatgctaaat

SEQ ID NO: 882416 - DNA, 25 bp, Mus musculus
tggatccaacacgtctatgctaaat

SEQ ID NO: 882417 - DNA, 25 bp, Mus musculus
tggatccaacccctatacgttgaag

SEQ ID NO: 882418 - DNA, 25 bp, Mus musculus
tggatccaacccgtatacgttgaag

SEQ ID NO: 882419 - DNA, 25 bp, Mus musculus
tggatccaagctcgcagcacagcag

SEQ ID NO: 882420 - DNA, 25 bp, Mus musculus
tggatccaagctggcagcacagcag

SEQ ID NO: 882421 - DNA, 25 bp, Mus musculus
tggatccaaggaaagctgtgtgctc

SEQ ID NO: 882422 - DNA, 25 bp, Mus musculus
tggatccaaggatagctgtgtgctc

SEQ ID NO: 882423 - DNA, 25 bp, Mus musculus
tggatccaatcacggcaagaacatt

SEQ ID NO: 882424 - DNA, 25 bp, Mus musculus
tggatccaatcagggcaagaacatt

SEQ ID NO: 882425 - DNA, 25 bp, Mus musculus
tggatccacagcaagacgtaagact

SEQ ID NO: 882426 - DNA, 25 bp, Mus musculus
tggatccacagctagacgtaagact

SEQ ID NO: 882427 - DNA, 25 bp, Mus musculus
tggatccacggcagccatcgtacaa

SEQ ID NO: 882428 - DNA, 25 bp, Mus musculus
tggatccacggctgccatcgtacaa

SEQ ID NO: 882429 - DNA, 25 bp, Mus musculus
tggatccactaaccagcttcacttt

SEQ ID NO: 882430 - DNA, 25 bp, Mus musculus
tggatccactaagcagcttcacttt

SEQ ID NO: 882431 - DNA, 25 bp, Mus musculus
tggatccagaatccttgctccaggt

SEQ ID NO: 882432 - DNA, 25 bp, Mus musculus
tggatccagaatgcttgctccaggt

SEQ ID NO: 882433 - DNA, 25 bp, Mus musculus
tggatccagaccatcattcagacaa

SEQ ID NO: 882434 - DNA, 25 bp, Mus musculus
tggatccagaccttcattcagacaa

SEQ ID NO: 882435 - DNA, 25 bp, Mus musculus
tggatccagagcagcagcggactgt

SEQ ID NO: 882436 - DNA, 25 bp, Mus musculus
tggatccagagctgcagcggactgt

SEQ ID NO: 882437 - DNA, 25 bp, Mus musculus
tggatccagaggcacaagggtccta

SEQ ID NO: 882438 - DNA, 25 bp, Mus musculus
tggatccagagggacaagggtccta

SEQ ID NO: 882439 - DNA, 25 bp, Mus musculus
tggatccagagtcgcacagggtcct

SEQ ID NO: 882440 - DNA, 25 bp, Mus musculus
tggatccagagtggcacagggtcct

SEQ ID NO: 882441 - DNA, 25 bp, Mus musculus
tggatccagattcccctaagatgaa

SEQ ID NO: 882442 - DNA, 25 bp, Mus musculus
tggatccagattgccctaagatgaa

SEQ ID NO: 882443 - DNA, 25 bp, Mus musculus
tggatccagggcacagtagttagaa

SEQ ID NO: 882444 - DNA, 25 bp, Mus musculus
tggatccagggctcagtagttagaa

SEQ ID NO: 882445 - DNA, 25 bp, Mus musculus
tggatccagggtatattttcttact

SEQ ID NO: 882446 - DNA, 25 bp, Mus musculus
tggatccagggtttattttcttact

SEQ ID NO: 882447 - DNA, 25 bp, Mus musculus
tggatccagtgaccctttctctgtc

SEQ ID NO: 882448 - DNA, 25 bp, Mus musculus
tggatccagtgagcctttctctgtc

SEQ ID NO: 882449 - DNA, 25 bp, Mus musculus
tggatcccaaaaatctcagccgact

SEQ ID NO: 882450 - DNA, 25 bp, Mus musculus
tggatcccaaaattctcagccgact

SEQ ID NO: 882451 - DNA, 25 bp, Mus musculus
tggatcccaaacactgctacttgct

SEQ ID NO: 882452 - DNA, 25 bp, Mus musculus
tggatcccaaactctgctacttgct

SEQ ID NO: 882453 - DNA, 25 bp, Mus musculus
tggatcccaagtcacataagttcgt

SEQ ID NO: 882454 - DNA, 25 bp, Mus musculus
tggatcccaagtgacataagttcgt

SEQ ID NO: 882455 - DNA, 25 bp, Mus musculus
tggatcccacgccacagtgaaaagc

SEQ ID NO: 882456 - DNA, 25 bp, Mus musculus
tggatcccacgcgacagtgaaaagc

SEQ ID NO: 882457 - DNA, 25 bp, Mus musculus
tggatcccagagagcttgatgccat

SEQ ID NO: 882458 - DNA, 25 bp, Mus musculus
tggatcccagagtgcttgatgccat

SEQ ID NO: 882459 - DNA, 25 bp, Mus musculus
tggatcccagccagcattagtggtg

SEQ ID NO: 882460 - DNA, 25 bp, Mus musculus
tggatcccagcctgcattagtggtg

SEQ ID NO: 882461 - DNA, 25 bp, Mus musculus
tggatcccaggtctgcttggcagat

SEQ ID NO: 882462 - DNA, 25 bp, Mus musculus
tggatcccaggtgtgcttggcagat

SEQ ID NO: 882463 - DNA, 25 bp, Mus musculus
tggatccccaagcttctgcaggaaa

SEQ ID NO: 882464 - DNA, 25 bp, Mus musculus
tggatccccaaggttctgcaggaaa

SEQ ID NO: 882465 - DNA, 25 bp, Mus musculus
tggatccccctcagaaggaacggct

SEQ ID NO: 882466 - DNA, 25 bp, Mus musculus
tggatccccctctgaaggaacggct

SEQ ID NO: 882467 - DNA, 25 bp, Mus musculus
tggatcccctttcctgtgaatggag

SEQ ID NO: 882468 - DNA, 25 bp, Mus musculus
tggatcccctttgctgtgaatggag

SEQ ID NO: 882469 - DNA, 25 bp, Mus musculus
tggatcccgacaccaaggagatgct

SEQ ID NO: 882470 - DNA, 25 bp, Mus musculus
tggatcccgacagcaaggagatgct

SEQ ID NO: 882471 - DNA, 25 bp, Mus musculus
tggatccctaaactaatacatacta

SEQ ID NO: 882472 - DNA, 25 bp, Mus musculus
tggatccctaaagtaatacatacta

SEQ ID NO: 882473 - DNA, 25 bp, Mus musculus
tggatccctcagaatcctacttggc

SEQ ID NO: 882474 - DNA, 25 bp, Mus musculus
tggatccctcagtatcctacttggc

SEQ ID NO: 882475 - DNA, 25 bp, Mus musculus
tggatccctctaatgttctgctact

SEQ ID NO: 882476 - DNA, 25 bp, Mus musculus
tggatccctctattgttctgctact

SEQ ID NO: 882477 - DNA, 25 bp, Mus musculus
tggatccctcttcgtttgtgacctt

SEQ ID NO: 882478 - DNA, 25 bp, Mus musculus
tggatccctcttggtttgtgacctt

SEQ ID NO: 882479 - DNA, 25 bp, Mus musculus
tggatccgaatcagccgggacctcg

SEQ ID NO: 882480 - DNA, 25 bp, Mus musculus
tggatccgaatctgccgggacctcg

SEQ ID NO: 882481 - DNA, 25 bp, Mus musculus
tggatccgttccaagggtacctaag

SEQ ID NO: 882482 - DNA, 25 bp, Mus musculus
tggatccgttcctagggtacctaag

SEQ ID NO: 882483 - DNA, 25 bp, Mus musculus
tggatcctaacaacacagtctgtaa

SEQ ID NO: 882484 - DNA, 25 bp, Mus musculus
tggatcctaacatcacagtctgtaa

SEQ ID NO: 882485 - DNA, 25 bp, Mus musculus
tggatcctacagctctcaaatctgg

SEQ ID NO: 882486 - DNA, 25 bp, Mus musculus
tggatcctacaggtctcaaatctgg

SEQ ID NO: 882487 - DNA, 25 bp, Mus musculus
tggatcctagtaacagtatcagctg

SEQ ID NO: 882488 - DNA, 25 bp, Mus musculus
tggatcctagtatcagtatcagctg

SEQ ID NO: 882489 - DNA, 25 bp, Mus musculus
tggatcctcagcactttcatggaga

SEQ ID NO: 882490 - DNA, 25 bp, Mus musculus
tggatcctcagctctttcatggaga

SEQ ID NO: 882491 - DNA, 25 bp, Mus musculus
tggatcctgaggacatcgacctgac

SEQ ID NO: 882492 - DNA, 25 bp, Mus musculus
tggatcctgaggatgagagtgctct

SEQ ID NO: 882493 - DNA, 25 bp, Mus musculus
tggatcctgaggtcatcgacctgac

SEQ ID NO: 882494 - DNA, 25 bp, Mus musculus
tggatcctgaggttgagagtgctct

SEQ ID NO: 882495 - DNA, 25 bp, Mus musculus
tggatcctggatatgtgtgctcgaa

SEQ ID NO: 882496 - DNA, 25 bp, Mus musculus
tggatcctggatttgtgtgctcgaa

SEQ ID NO: 882497 - DNA, 25 bp, Mus musculus
tggatcctggctacacattccaaac

SEQ ID NO: 882498 - DNA, 25 bp, Mus musculus
tggatcctggcttcacattccaaac

SEQ ID NO: 882499 - DNA, 25 bp, Mus musculus
tggatcctgtgtcaaccgaggcact

SEQ ID NO: 882500 - DNA, 25 bp, Mus musculus
tggatcctgtgtgaaccgaggcact

SEQ ID NO: 882501 - DNA, 25 bp, Mus musculus
tggatcctgttcacacattctacag

SEQ ID NO: 882502 - DNA, 25 bp, Mus musculus
tggatcctgttctcacattctacag

SEQ ID NO: 882503 - DNA, 25 bp, Mus musculus
tggatccttaaacatttctttccag

SEQ ID NO: 882504 - DNA, 25 bp, Mus musculus
tggatccttaaagatttctttccag

SEQ ID NO: 882505 - DNA, 25 bp, Mus musculus
tggatccttacaaaagcctttcaga

SEQ ID NO: 882506 - DNA, 25 bp, Mus musculus
tggatccttacataagcctttcaga

SEQ ID NO: 882507 - DNA, 25 bp, Mus musculus
tggatccttcaaaccccgggatgga

SEQ ID NO: 882508 - DNA, 25 bp, Mus musculus
tggatccttcaatccccgggatgga

SEQ ID NO: 882509 - DNA, 25 bp, Mus musculus
tggatccttgatatcagaccctgat

SEQ ID NO: 882510 - DNA, 25 bp, Mus musculus
tggatccttgatttcagaccctgat

SEQ ID NO: 882511 - DNA, 25 bp, Mus musculus
tggatcctttcgaagctcagtgggc

SEQ ID NO: 882512 - DNA, 25 bp, Mus musculus
tggatcctttcgtagctcagtgggc

SEQ ID NO: 882513 - DNA, 25 bp, Mus musculus
tggatcctttggaagcgcagcctgt

SEQ ID NO: 882514 - DNA, 25 bp, Mus musculus
tggatcctttggtagcgcagcctgt

SEQ ID NO: 882515 - DNA, 25 bp, Mus musculus
tggatcgagcttcgctgcccacaag

SEQ ID NO: 882516 - DNA, 25 bp, Mus musculus
tggatcgagcttggctgcccacaag

SEQ ID NO: 882517 - DNA, 25 bp, Mus musculus
tggatcgcccatcccaatttagaat

SEQ ID NO: 882518 - DNA, 25 bp, Mus musculus
tggatcgcccatgccaatttagaat

SEQ ID NO: 882519 - DNA, 25 bp, Mus musculus
tggatcgcgcggacgcttggctcct

SEQ ID NO: 882520 - DNA, 25 bp, Mus musculus
tggatcgcgcggtcgcttggctcct

SEQ ID NO: 882521 - DNA, 25 bp, Mus musculus
tggatcgggttaaaggcagcctgcg

SEQ ID NO: 882522 - DNA, 25 bp, Mus musculus
tggatcgggttataggcagcctgcg

SEQ ID NO: 882523 - DNA, 25 bp, Mus musculus
tggatcgtcaggactggaccccatt

SEQ ID NO: 882524 - DNA, 25 bp, Mus musculus
tggatcgtcaggtctggaccccatt

SEQ ID NO: 882525 - DNA, 25 bp, Mus musculus
tggatctaaatgctgcccagaagga

SEQ ID NO: 882526 - DNA, 25 bp, Mus musculus
tggatctaaatggtgcccagaagga

SEQ ID NO: 882527 - DNA, 25 bp, Mus musculus
tggatctaacccaaggacacccgaa

SEQ ID NO: 882528 - DNA, 25 bp, Mus musculus
tggatctaaccctaggacacccgaa

SEQ ID NO: 882529 - DNA, 25 bp, Mus musculus
tggatctacagcatcagcccctcac

SEQ ID NO: 882530 - DNA, 25 bp, Mus musculus
tggatctacagcttcagcccctcac

SEQ ID NO: 882531 - DNA, 25 bp, Mus musculus
tggatctactcaagtgcagaagctg

SEQ ID NO: 882532 - DNA, 25 bp, Mus musculus
tggatctactcatgtgcagaagctg

SEQ ID NO: 882533 - DNA, 25 bp, Mus musculus
tggatctatagcactttgtcaccgt

SEQ ID NO: 882534 - DNA, 25 bp, Mus musculus
tggatctatagctctttgtcaccgt

SEQ ID NO: 882535 - DNA, 25 bp, Mus musculus
tggatctatctaacaaagcttgctg

SEQ ID NO: 882536 - DNA, 25 bp, Mus musculus
tggatctatctatcaaagcttgctg

SEQ ID NO: 882537 - DNA, 25 bp, Mus musculus
tggatctattgcacaacagtccctg

SEQ ID NO: 882538 - DNA, 25 bp, Mus musculus
tggatctattgctcaacagtccctg

SEQ ID NO: 882539 - DNA, 25 bp, Mus musculus
tggatctattggacggttcatatga

SEQ ID NO: 882540 - DNA, 25 bp, Mus musculus
tggatctattggtcggttcatatga

SEQ ID NO: 882541 - DNA, 25 bp, Mus musculus
tggatctattttcaggccccggtaa

SEQ ID NO: 882542 - DNA, 25 bp, Mus musculus
tggatctattttgaggccccggtaa

SEQ ID NO: 882543 - DNA, 25 bp, Mus musculus
tggatctcaacgacgatggtactaa

SEQ ID NO: 882544 - DNA, 25 bp, Mus musculus
tggatctcaacgtcgatggtactaa

SEQ ID NO: 882545 - DNA, 25 bp, Mus musculus
tggatctcacggagctggaccacat

SEQ ID NO: 882546 - DNA, 25 bp, Mus musculus
tggatctcacggtgctggaccacat

SEQ ID NO: 882547 - DNA, 25 bp, Mus musculus
tggatctcaggactagaaggtcccc

SEQ ID NO: 882548 - DNA, 25 bp, Mus musculus
tggatctcaggagtagaaggtcccc

SEQ ID NO: 882549 - DNA, 25 bp, Mus musculus
tggatctccagcagccgtgaatcat

SEQ ID NO: 882550 - DNA, 25 bp, Mus musculus
tggatctccagctgccgtgaatcat

SEQ ID NO: 882551 - DNA, 25 bp, Mus musculus
tggatctcccatcgcgagacgctga

SEQ ID NO: 882552 - DNA, 25 bp, Mus musculus
tggatctcccatggcgagacgctga

SEQ ID NO: 882553 - DNA, 25 bp, Mus musculus
tggatctcctgaaatgagagctgcc

SEQ ID NO: 882554 - DNA, 25 bp, Mus musculus
tggatctcctgaagcacgctgcctg

SEQ ID NO: 882555 - DNA, 25 bp, Mus musculus
tggatctcctgatatgagagctgcc

SEQ ID NO: 882556 - DNA, 25 bp, Mus musculus
tggatctcctgatgcacgctgcctg

SEQ ID NO: 882557 - DNA, 25 bp, Mus musculus
tggatctctataaacatcctgtcat

SEQ ID NO: 882558 - DNA, 25 bp, Mus musculus
tggatctctatatacatcctgtcat

SEQ ID NO: 882559 - DNA, 25 bp, Mus musculus
tggatctctcccaaacggtgataga

SEQ ID NO: 882560 - DNA, 25 bp, Mus musculus
tggatctctccctaacggtgataga

SEQ ID NO: 882561 - DNA, 25 bp, Mus musculus
tggatctctcgcatacgacaaccga

SEQ ID NO: 882562 - DNA, 25 bp, Mus musculus
tggatctctcgcttacgacaaccga

SEQ ID NO: 882563 - DNA, 25 bp, Mus musculus
tggatctctctcaacatatatatat

SEQ ID NO: 882564 - DNA, 25 bp, Mus musculus
tggatctctctctacatatatatat

SEQ ID NO: 882565 - DNA, 25 bp, Mus musculus
tggatctctgatatccaagcccaat

SEQ ID NO: 882566 - DNA, 25 bp, Mus musculus
tggatctctgatttccaagcccaat

SEQ ID NO: 882567 - DNA, 25 bp, Mus musculus
tggatctctggcacttcatcctttt

SEQ ID NO: 882568 - DNA, 25 bp, Mus musculus
tggatctctggctcttcatcctttt

SEQ ID NO: 882569 - DNA, 25 bp, Mus musculus
tggatctcttaaacagttcaccgcg

SEQ ID NO: 882570 - DNA, 25 bp, Mus musculus
tggatctcttaatcagttcaccgcg

SEQ ID NO: 882571 - DNA, 25 bp, Mus musculus
tggatctcttgaaacagctttaagg

SEQ ID NO: 882572 - DNA, 25 bp, Mus musculus
tggatctcttgatacagctttaagg

SEQ ID NO: 882573 - DNA, 25 bp, Mus musculus
tggatctcttgtatggtcttcagta

SEQ ID NO: 882574 - DNA, 25 bp, Mus musculus
tggatctcttgtttggtcttcagta

SEQ ID NO: 882575 - DNA, 25 bp, Mus musculus
tggatctgaaggcactgcatctgga

SEQ ID NO: 882576 - DNA, 25 bp, Mus musculus
tggatctgaagggactgcatctgga

SEQ ID NO: 882577 - DNA, 25 bp, Mus musculus
tggatctgacagcttccttcttcca

SEQ ID NO: 882578 - DNA, 25 bp, Mus musculus
tggatctgacaggttccttcttcca

SEQ ID NO: 882579 - DNA, 25 bp, Mus musculus
tggatctgacatcgctgaccttgga

SEQ ID NO: 882580 - DNA, 25 bp, Mus musculus
tggatctgacatggctgaccttgga

SEQ ID NO: 882581 - DNA, 25 bp, Mus musculus
tggatctggaaacgccggaaaccaa

SEQ ID NO: 882582 - DNA, 25 bp, Mus musculus
tggatctggaaaggccggaaaccaa

SEQ ID NO: 882583 - DNA, 25 bp, Mus musculus
tggatctggcagagcgcagctgtaa

SEQ ID NO: 882584 - DNA, 25 bp, Mus musculus
tggatctggcagtgcgcagctgtaa

SEQ ID NO: 882585 - DNA, 25 bp, Mus musculus
tggatctggcgactgtgctgacccc

SEQ ID NO: 882586 - DNA, 25 bp, Mus musculus
tggatctggcgagtgtgctgacccc

SEQ ID NO: 882587 - DNA, 25 bp, Mus musculus
tggatctggcgtaagctacagccca

SEQ ID NO: 882588 - DNA, 25 bp, Mus musculus
tggatctggcgttagctacagccca

SEQ ID NO: 882589 - DNA, 25 bp, Mus musculus
tggatctgggccacttcgggccctc

SEQ ID NO: 882590 - DNA, 25 bp, Mus musculus
tggatctgggcctcttcgggccctc

SEQ ID NO: 882591 - DNA, 25 bp, Mus musculus
tggatctgggtactttcacgggcta

SEQ ID NO: 882592 - DNA, 25 bp, Mus musculus
tggatctgggtagtttcacgggcta

SEQ ID NO: 882593 - DNA, 25 bp, Mus musculus
tggatctggtgcaagacagcgcttg

SEQ ID NO: 882594 - DNA, 25 bp, Mus musculus
tggatctggtgctagacagcgcttg

SEQ ID NO: 882595 - DNA, 25 bp, Mus musculus
tggatctgtacaacccttactgaac

SEQ ID NO: 882596 - DNA, 25 bp, Mus musculus
tggatctgtacatcccttactgaac

SEQ ID NO: 882597 - DNA, 25 bp, Mus musculus
tggatctgtccaataactctctgtc

SEQ ID NO: 882598 - DNA, 25 bp, Mus musculus
tggatctgtccattaactctctgtc

SEQ ID NO: 882599 - DNA, 25 bp, Mus musculus
tggatctgtgatcatttgattcccc

SEQ ID NO: 882600 - DNA, 25 bp, Mus musculus
tggatctgtgatgatttgattcccc

SEQ ID NO: 882601 - DNA, 25 bp, Mus musculus
tggatcttcaaaacacaccagcgaa

SEQ ID NO: 882602 - DNA, 25 bp, Mus musculus
tggatcttcaaatcacaccagcgaa

SEQ ID NO: 882603 - DNA, 25 bp, Mus musculus
tggatcttgacccaactgctcagct

SEQ ID NO: 882604 - DNA, 25 bp, Mus musculus
tggatcttgaccgaactgctcagct

SEQ ID NO: 882605 - DNA, 25 bp, Mus musculus
tggatcttgatcatgcgcacagcct

SEQ ID NO: 882606 - DNA, 25 bp, Mus musculus
tggatcttgatcttgcgcacagcct

SEQ ID NO: 882607 - DNA, 25 bp, Mus musculus
tggatcttgattagctaccggtctt

SEQ ID NO: 882608 - DNA, 25 bp, Mus musculus
tggatcttgatttgctaccggtctt

SEQ ID NO: 882609 - DNA, 25 bp, Mus musculus
tggatcttgctgctatctttaaata

SEQ ID NO: 882610 - DNA, 25 bp, Mus musculus
tggatcttgctggtatctttaaata

SEQ ID NO: 882611 - DNA, 25 bp, Mus musculus
tggatcttgggcaacacttatgttt

SEQ ID NO: 882612 - DNA, 25 bp, Mus musculus
tggatcttgggctacacttatgttt

SEQ ID NO: 882613 - DNA, 25 bp, Mus musculus
tggatctttaaaccgcagtggctcc

SEQ ID NO: 882614 - DNA, 25 bp, Mus musculus
tggatctttaaagcgcagtggctcc

SEQ ID NO: 882615 - DNA, 25 bp, Mus musculus
tggatctttcctcgtctcacctttc

SEQ ID NO: 882616 - DNA, 25 bp, Mus musculus
tggatctttcctggtctcacctttc

SEQ ID NO: 882617 - DNA, 25 bp, Mus musculus
tggatctttctactcggcgagttat

SEQ ID NO: 882618 - DNA, 25 bp, Mus musculus
tggatctttctagtcggcgagttat

SEQ ID NO: 882619 - DNA, 25 bp, Mus musculus
tggatctttgaaaccgctggcctct

SEQ ID NO: 882620 - DNA, 25 bp, Mus musculus
tggatctttgaatccgctggcctct

SEQ ID NO: 882621 - DNA, 25 bp, Mus musculus
tggatctttgccatgacattctcta

SEQ ID NO: 882622 - DNA, 25 bp, Mus musculus
tggatctttgccttgacattctcta

SEQ ID NO: 882623 - DNA, 25 bp, Mus musculus
tggatcttttcaacaaacactgctg

SEQ ID NO: 882624 - DNA, 25 bp, Mus musculus
tggatcttttcatcaaacactgctg

SEQ ID NO: 882625 - DNA, 25 bp, Mus musculus
tggatcttttccacacatttcctac

SEQ ID NO: 882626 - DNA, 25 bp, Mus musculus
tggatcttttcctcacatttcctac

SEQ ID NO: 882627 - DNA, 25 bp, Mus musculus
tggatgaaagcacttgccacacagt

SEQ ID NO: 882628 - DNA, 25 bp, Mus musculus
tggatgaaagcagttgccacacagt

SEQ ID NO: 882629 - DNA, 25 bp, Mus musculus
tggatgaaaggtctgcaagcatttt

SEQ ID NO: 882630 - DNA, 25 bp, Mus musculus
tggatgaaaggtgtgcaagcatttt

SEQ ID NO: 882631 - DNA, 25 bp, Mus musculus
tggatgaaatgcattgttcattcct

SEQ ID NO: 882632 - DNA, 25 bp, Mus musculus
tggatgaaatgctttgttcattcct

SEQ ID NO: 882633 - DNA, 25 bp, Mus musculus
tggatgaaccttcggtcccatccac

SEQ ID NO: 882634 - DNA, 25 bp, Mus musculus
tggatgaaccttgggtcccatccac

SEQ ID NO: 882635 - DNA, 25 bp, Mus musculus
tggatgaacgtcaacatgaggccgt

SEQ ID NO: 882636 - DNA, 25 bp, Mus musculus
tggatgaacgtctacatgaggccgt

SEQ ID NO: 882637 - DNA, 25 bp, Mus musculus
tggatgaagaccatgtgccccggca

SEQ ID NO: 882638 - DNA, 25 bp, Mus musculus
tggatgaagaccttgtgccccggca

SEQ ID NO: 882639 - DNA, 25 bp, Mus musculus
tggatgaagaggacccgtctcctaa

SEQ ID NO: 882640 - DNA, 25 bp, Mus musculus
tggatgaagaggtcccgtctcctaa

SEQ ID NO: 882641 - DNA, 25 bp, Mus musculus
tggatgaagcaaaatcactaacttg

SEQ ID NO: 882642 - DNA, 25 bp, Mus musculus
tggatgaagcaatatcactaacttg

SEQ ID NO: 882643 - DNA, 25 bp, Mus musculus
tggatgaagtccatttgacctaggg

SEQ ID NO: 882644 - DNA, 25 bp, Mus musculus
tggatgaagtccttttgacctaggg

SEQ ID NO: 882645 - DNA, 25 bp, Mus musculus
tggatgacaacgcactggtgccttc

SEQ ID NO: 882646 - DNA, 25 bp, Mus musculus
tggatgacaacggactggtgccttc

SEQ ID NO: 882647 - DNA, 25 bp, Mus musculus
tggatgacccagctgtgcagcagca

SEQ ID NO: 882648 - DNA, 25 bp, Mus musculus
tggatgacccaggtgtgcagcagca

SEQ ID NO: 882649 - DNA, 25 bp, Mus musculus
tggatgacccgtcttccttttgctt

SEQ ID NO: 882650 - DNA, 25 bp, Mus musculus
tggatgacccgtgttccttttgctt

SEQ ID NO: 882651 - DNA, 25 bp, Mus musculus
tggatgaccttgacacccgagagag

SEQ ID NO: 882652 - DNA, 25 bp, Mus musculus
tggatgaccttgtcacccgagagag

SEQ ID NO: 882653 - DNA, 25 bp, Mus musculus
tggatgacgaccaccgctgggttgc

SEQ ID NO: 882654 - DNA, 25 bp, Mus musculus
tggatgacgacctccgctgggttgc

SEQ ID NO: 882655 - DNA, 25 bp, Mus musculus
tggatgacgcttacgtgagaagaat

SEQ ID NO: 882656 - DNA, 25 bp, Mus musculus
tggatgacgctttcgtgagaagaat

SEQ ID NO: 882657 - DNA, 25 bp, Mus musculus
tggatgacgtcgcatacactgtcct

SEQ ID NO: 882658 - DNA, 25 bp, Mus musculus
tggatgacgtcggatacactgtcct

SEQ ID NO: 882659 - DNA, 25 bp, Mus musculus
tggatgactactaggcttccctctg

SEQ ID NO: 882660 - DNA, 25 bp, Mus musculus
tggatgactacttggcttccctctg

SEQ ID NO: 882661 - DNA, 25 bp, Mus musculus
tggatgactcccatggtctctgagt

SEQ ID NO: 882662 - DNA, 25 bp, Mus musculus
tggatgactcccttggtctctgagt

SEQ ID NO: 882663 - DNA, 25 bp, Mus musculus
tggatgagatgaccctccggcacat

SEQ ID NO: 882664 - DNA, 25 bp, Mus musculus
tggatgagatgagcctccggcacat

SEQ ID NO: 882665 - DNA, 25 bp, Mus musculus
tggatgaggagcacagccaagagct

SEQ ID NO: 882666 - DNA, 25 bp, Mus musculus
tggatgaggagctcagccaagagct

SEQ ID NO: 882667 - DNA, 25 bp, Mus musculus
tggatgaggcttacagttccctggc

SEQ ID NO: 882668 - DNA, 25 bp, Mus musculus
tggatgaggctttcagttccctggc

SEQ ID NO: 882669 - DNA, 25 bp, Mus musculus
tggatgatatccacactgtcctcaa

SEQ ID NO: 882670 - DNA, 25 bp, Mus musculus
tggatgatatcctcactgtcctcaa

SEQ ID NO: 882671 - DNA, 25 bp, Mus musculus
tggatgatcttcagacttcctacat

SEQ ID NO: 882672 - DNA, 25 bp, Mus musculus
tggatgatcttctgacttcctacat

SEQ ID NO: 882673 - DNA, 25 bp, Mus musculus
tggatgatgatgatggccctcacct

SEQ ID NO: 882674 - DNA, 25 bp, Mus musculus
tggatgatgatgttggccctcacct

SEQ ID NO: 882675 - DNA, 25 bp, Mus musculus
tggatgattcttaggtgtctctctt

SEQ ID NO: 882676 - DNA, 25 bp, Mus musculus
tggatgattcttcagagcctcgggc

SEQ ID NO: 882677 - DNA, 25 bp, Mus musculus
tggatgattcttgagagcctcgggc

SEQ ID NO: 882678 - DNA, 25 bp, Mus musculus
tggatgattctttggtgtctctctt

SEQ ID NO: 882679 - DNA, 25 bp, Mus musculus
tggatgcaagacctgtcgctacctc

SEQ ID NO: 882680 - DNA, 25 bp, Mus musculus
tggatgcaagacgtgtcgctacctc

SEQ ID NO: 882681 - DNA, 25 bp, Mus musculus
tggatgcacattcctggtcactcag

SEQ ID NO: 882682 - DNA, 25 bp, Mus musculus
tggatgcacattgctggtcactcag

SEQ ID NO: 882683 - DNA, 25 bp, Mus musculus
tggatgcaccaccattggttttcca

SEQ ID NO: 882684 - DNA, 25 bp, Mus musculus
tggatgcaccacgattggttttcca

SEQ ID NO: 882685 - DNA, 25 bp, Mus musculus
tggatgcactgtcgttctcagactc

SEQ ID NO: 882686 - DNA, 25 bp, Mus musculus
tggatgcactgtggttctcagactc

SEQ ID NO: 882687 - DNA, 25 bp, Mus musculus
tggatgcagataccacacccagtgg

SEQ ID NO: 882688 - DNA, 25 bp, Mus musculus
tggatgcagatagcacacccagtgg

SEQ ID NO: 882689 - DNA, 25 bp, Mus musculus
tggatgcagcagacaaccgaaaaat

SEQ ID NO: 882690 - DNA, 25 bp, Mus musculus
tggatgcagcagtcaaccgaaaaat

SEQ ID NO: 882691 - DNA, 25 bp, Mus musculus
tggatgcaggtcatgcccgaactac

SEQ ID NO: 882692 - DNA, 25 bp, Mus musculus
tggatgcaggtcttgcccgaactac

SEQ ID NO: 882693 - DNA, 25 bp, Mus musculus
tggatgcagtgacttttatggatgt

SEQ ID NO: 882694 - DNA, 25 bp, Mus musculus
tggatgcagtgagttttatggatgt

SEQ ID NO: 882695 - DNA, 25 bp, Mus musculus
tggatgcagtgcaatctcgggccaa

SEQ ID NO: 882696 - DNA, 25 bp, Mus musculus
tggatgcagtgctatctcgggccaa

SEQ ID NO: 882697 - DNA, 25 bp, Mus musculus
tggatgccaagtacctgaacccctt

SEQ ID NO: 882698 - DNA, 25 bp, Mus musculus
tggatgccaagttcctgaacccctt

SEQ ID NO: 882699 - DNA, 25 bp, Mus musculus
tggatgccagaacaccacttggttt

SEQ ID NO: 882700 - DNA, 25 bp, Mus musculus
tggatgccagaagaccacttggttt

SEQ ID NO: 882701 - DNA, 25 bp, Mus musculus
tggatgccagcaagactgtgtgaac

SEQ ID NO: 882702 - DNA, 25 bp, Mus musculus
tggatgccagcatgactgtgtgaac

SEQ ID NO: 882703 - DNA, 25 bp, Mus musculus
tggatgccagtaacgtggccctcac

SEQ ID NO: 882704 - DNA, 25 bp, Mus musculus
tggatgccagtatcgtggccctcac

SEQ ID NO: 882705 - DNA, 25 bp, Mus musculus
tggatgccatacaggccaaggaaga

SEQ ID NO: 882706 - DNA, 25 bp, Mus musculus
tggatgccatactggccaaggaaga

SEQ ID NO: 882707 - DNA, 25 bp, Mus musculus
tggatgcccactcttccaagtgtgc

SEQ ID NO: 882708 - DNA, 25 bp, Mus musculus
tggatgcccactgttccaagtgtgc

SEQ ID NO: 882709 - DNA, 25 bp, Mus musculus
tggatgccccagcaaagcgtgcttc

SEQ ID NO: 882710 - DNA, 25 bp, Mus musculus
tggatgccccaggaaagcgtgcttc

SEQ ID NO: 882711 - DNA, 25 bp, Mus musculus
tggatgccctaccatgtacacagtg

SEQ ID NO: 882712 - DNA, 25 bp, Mus musculus
tggatgccctacgatgtacacagtg

SEQ ID NO: 882713 - DNA, 25 bp, Mus musculus
tggatgccctgaaactcgttgtgta

SEQ ID NO: 882714 - DNA, 25 bp, Mus musculus
tggatgccctgatactcgttgtgta

SEQ ID NO: 882715 - DNA, 25 bp, Mus musculus
tggatgccgggaaagcagctgcaca

SEQ ID NO: 882716 - DNA, 25 bp, Mus musculus
tggatgccgggatagcagctgcaca

SEQ ID NO: 882717 - DNA, 25 bp, Mus musculus
tggatgccgtcaagaaagcccgcaa

SEQ ID NO: 882718 - DNA, 25 bp, Mus musculus
tggatgccgtcatgaaagcccgcaa

SEQ ID NO: 882719 - DNA, 25 bp, Mus musculus
tggatgccgttcatgaagcccgcca

SEQ ID NO: 882720 - DNA, 25 bp, Mus musculus
tggatgccgttcttgaagcccgcca

SEQ ID NO: 882721 - DNA, 25 bp, Mus musculus
tggatgccgttgacccacagggaga

SEQ ID NO: 882722 - DNA, 25 bp, Mus musculus
tggatgccgttgtcccacagggaga

SEQ ID NO: 882723 - DNA, 25 bp, Mus musculus
tggatgcctactactgacgcaggaa

SEQ ID NO: 882724 - DNA, 25 bp, Mus musculus
tggatgcctacttctgacgcaggaa

SEQ ID NO: 882725 - DNA, 25 bp, Mus musculus
tggatgcctcacagtagatacagcc

SEQ ID NO: 882726 - DNA, 25 bp, Mus musculus
tggatgcctcactgtagatacagcc

SEQ ID NO: 882727 - DNA, 25 bp, Mus musculus
tggatgcctgtaccccattgaggtg

SEQ ID NO: 882728 - DNA, 25 bp, Mus musculus
tggatgcctgtagcccattgaggtg

SEQ ID NO: 882729 - DNA, 25 bp, Mus musculus
tggatgccttgcaagacacttctgt

SEQ ID NO: 882730 - DNA, 25 bp, Mus musculus
tggatgccttgctagacacttctgt

SEQ ID NO: 882731 - DNA, 25 bp, Mus musculus
tggatgcgcagtacaggacccgaca

SEQ ID NO: 882732 - DNA, 25 bp, Mus musculus
tggatgcgcagttcaggacccgaca

SEQ ID NO: 882733 - DNA, 25 bp, Mus musculus
tggatgcgtttccagatgccctcat

SEQ ID NO: 882734 - DNA, 25 bp, Mus musculus
tggatgcgtttcgagatgccctcat

SEQ ID NO: 882735 - DNA, 25 bp, Mus musculus
tggatgctaccgagagaccttttgc

SEQ ID NO: 882736 - DNA, 25 bp, Mus musculus
tggatgctaccgtgagaccttttgc

SEQ ID NO: 882737 - DNA, 25 bp, Mus musculus
tggatgctcatgacctattgagctg

SEQ ID NO: 882738 - DNA, 25 bp, Mus musculus
tggatgctcatgtcctattgagctg

SEQ ID NO: 882739 - DNA, 25 bp, Mus musculus
tggatgctccaaaatgccttccctt

SEQ ID NO: 882740 - DNA, 25 bp, Mus musculus
tggatgctccaatatgccttccctt

SEQ ID NO: 882741 - DNA, 25 bp, Mus musculus
tggatgctctctatttagcggagaa

SEQ ID NO: 882742 - DNA, 25 bp, Mus musculus
tggatgctctctttttagcggagaa

SEQ ID NO: 882743 - DNA, 25 bp, Mus musculus
tggatgctctgtcttagccgtaaga

SEQ ID NO: 882744 - DNA, 25 bp, Mus musculus
tggatgctctgtgttagccgtaaga

SEQ ID NO: 882745 - DNA, 25 bp, Mus musculus
tggatgctcttgcaaacactgccct

SEQ ID NO: 882746 - DNA, 25 bp, Mus musculus
tggatgctcttggaaacactgccct

SEQ ID NO: 882747 - DNA, 25 bp, Mus musculus
tggatgctgagcaacctgtttctcc

SEQ ID NO: 882748 - DNA, 25 bp, Mus musculus
tggatgctgagcactatctggttag

SEQ ID NO: 882749 - DNA, 25 bp, Mus musculus
tggatgctgagctacctgtttctcc

SEQ ID NO: 882750 - DNA, 25 bp, Mus musculus
tggatgctgagctctatctggttag

SEQ ID NO: 882751 - DNA, 25 bp, Mus musculus
tggatgctgatgctgagactcccct

SEQ ID NO: 882752 - DNA, 25 bp, Mus musculus
tggatgctgatggtgagactcccct

SEQ ID NO: 882753 - DNA, 25 bp, Mus musculus
tggatgctgcagcatctaggactca

SEQ ID NO: 882754 - DNA, 25 bp, Mus musculus
tggatgctgcaggatctaggactca

SEQ ID NO: 882755 - DNA, 25 bp, Mus musculus
tggatgctggccacgtttacaactc

SEQ ID NO: 882756 - DNA, 25 bp, Mus musculus
tggatgctggcctcgtttacaactc

SEQ ID NO: 882757 - DNA, 25 bp, Mus musculus
tggatgctgggaccaattctaggcc

SEQ ID NO: 882758 - DNA, 25 bp, Mus musculus
tggatgctgggagcaattctaggcc

SEQ ID NO: 882759 - DNA, 25 bp, Mus musculus
tggatgctgtacacaaacattcacg

SEQ ID NO: 882760 - DNA, 25 bp, Mus musculus
tggatgctgtactcaaacattcacg

SEQ ID NO: 882761 - DNA, 25 bp, Mus musculus
tggatgctgtagacacacatcgtga

SEQ ID NO: 882762 - DNA, 25 bp, Mus musculus
tggatgctgtagtcacacatcgtga

SEQ ID NO: 882763 - DNA, 25 bp, Mus musculus
tggatgcttctaagtccgtacgtaa

SEQ ID NO: 882764 - DNA, 25 bp, Mus musculus
tggatgcttctatgtccgtacgtaa

SEQ ID NO: 882765 - DNA, 25 bp, Mus musculus
tggatgcttgctagtttcctgagcc

SEQ ID NO: 882766 - DNA, 25 bp, Mus musculus
tggatgcttgcttgtttcctgagcc

SEQ ID NO: 882767 - DNA, 25 bp, Mus musculus
tggatgcttggccttttctaaacag

SEQ ID NO: 882768 - DNA, 25 bp, Mus musculus
tggatgcttggcgttttctaaacag

SEQ ID NO: 882769 - DNA, 25 bp, Mus musculus
tggatgctttggaccctggaacaag

SEQ ID NO: 882770 - DNA, 25 bp, Mus musculus
tggatgctttggtccctggaacaag

SEQ ID NO: 882771 - DNA, 25 bp, Mus musculus
tggatggaatcacaggccctttttt

SEQ ID NO: 882772 - DNA, 25 bp, Mus musculus
tggatggaatcagaggccctttttt

SEQ ID NO: 882773 - DNA, 25 bp, Mus musculus
tggatggagcccaaggtttccaatg

SEQ ID NO: 882774 - DNA, 25 bp, Mus musculus
tggatggagccctaggtttccaatg

SEQ ID NO: 882775 - DNA, 25 bp, Mus musculus
tggatggagttaaaattgtgcacat

SEQ ID NO: 882776 - DNA, 25 bp, Mus musculus
tggatggagttataattgtgcacat

SEQ ID NO: 882777 - DNA, 25 bp, Mus musculus
tggatggatggcagctcaacacact

SEQ ID NO: 882778 - DNA, 25 bp, Mus musculus
tggatggatggctgctcaacacact

SEQ ID NO: 882779 - DNA, 25 bp, Mus musculus
tggatggatggtatgtgcccttgct

SEQ ID NO: 882780 - DNA, 25 bp, Mus musculus
tggatggatggtttgtgcccttgct

SEQ ID NO: 882781 - DNA, 25 bp, Mus musculus
tggatggattctatgcagcacaaca

SEQ ID NO: 882782 - DNA, 25 bp, Mus musculus
tggatggattctttgcagcacaaca

SEQ ID NO: 882783 - DNA, 25 bp, Mus musculus
tggatggcaacccagcaggaagcct

SEQ ID NO: 882784 - DNA, 25 bp, Mus musculus
tggatggcaaccgagcaggaagcct

SEQ ID NO: 882785 - DNA, 25 bp, Mus musculus
tggatggcaatcctctcactcagag

SEQ ID NO: 882786 - DNA, 25 bp, Mus musculus
tggatggcaatcgtctcactcagag

SEQ ID NO: 882787 - DNA, 25 bp, Mus musculus
tggatggcacaacgctgtgccctct

SEQ ID NO: 882788 - DNA, 25 bp, Mus musculus
tggatggcacaaggctgtgccctct

SEQ ID NO: 882789 - DNA, 25 bp, Mus musculus
tggatggcacagcactagcggacct

SEQ ID NO: 882790 - DNA, 25 bp, Mus musculus
tggatggcacaggactagcggacct

SEQ ID NO: 882791 - DNA, 25 bp, Mus musculus
tggatggcacccatctaggacacac

SEQ ID NO: 882792 - DNA, 25 bp, Mus musculus
tggatggcacccttctaggacacac

SEQ ID NO: 882793 - DNA, 25 bp, Mus musculus
tggatggcagctctgcttcgctcgc

SEQ ID NO: 882794 - DNA, 25 bp, Mus musculus
tggatggcagctgtgcttcgctcgc

SEQ ID NO: 882795 - DNA, 25 bp, Mus musculus
tggatggcatcgactacctgagctc

SEQ ID NO: 882796 - DNA, 25 bp, Mus musculus
tggatggcatcgtctacctgagctc

SEQ ID NO: 882797 - DNA, 25 bp, Mus musculus
tggatggcatttacttcccatgctt

SEQ ID NO: 882798 - DNA, 25 bp, Mus musculus
tggatggcattttcttcccatgctt

SEQ ID NO: 882799 - DNA, 25 bp, Mus musculus
tggatggccactaaaccaccagaaa

SEQ ID NO: 882800 - DNA, 25 bp, Mus musculus
tggatggccacttaaccaccagaaa

SEQ ID NO: 882801 - DNA, 25 bp, Mus musculus
tggatggccatgacgcaagaaattt

SEQ ID NO: 882802 - DNA, 25 bp, Mus musculus
tggatggccatgtcgcaagaaattt

SEQ ID NO: 882803 - DNA, 25 bp, Mus musculus
tggatggccgccacagcctatgttt

SEQ ID NO: 882804 - DNA, 25 bp, Mus musculus
tggatggccgccagtaaccgtctca

SEQ ID NO: 882805 - DNA, 25 bp, Mus musculus
tggatggccgccatggcgagtggtg

SEQ ID NO: 882806 - DNA, 25 bp, Mus musculus
tggatggccgcctcagcctatgttt

SEQ ID NO: 882807 - DNA, 25 bp, Mus musculus
tggatggccgcctgtaaccgtctca

SEQ ID NO: 882808 - DNA, 25 bp, Mus musculus
tggatggccgccttggcgagtggtg

SEQ ID NO: 882809 - DNA, 25 bp, Mus musculus
tggatggcctataccggaatctcat

SEQ ID NO: 882810 - DNA, 25 bp, Mus musculus
tggatggcctattccggaatctcat

SEQ ID NO: 882811 - DNA, 25 bp, Mus musculus
tggatggcggccatgcagcaagacc

SEQ ID NO: 882812 - DNA, 25 bp, Mus musculus
tggatggcggccttgcagcaagacc

SEQ ID NO: 882813 - DNA, 25 bp, Mus musculus
tggatggctattaatcactttttaa

SEQ ID NO: 882814 - DNA, 25 bp, Mus musculus
tggatggctatttatcactttttaa

SEQ ID NO: 882815 - DNA, 25 bp, Mus musculus
tggatggctcccaccatgcactgac

SEQ ID NO: 882816 - DNA, 25 bp, Mus musculus
tggatggctccctccatgcactgac

SEQ ID NO: 882817 - DNA, 25 bp, Mus musculus
tggatggcttataacatcaaccacc

SEQ ID NO: 882818 - DNA, 25 bp, Mus musculus
tggatggcttattacatcaaccacc

SEQ ID NO: 882819 - DNA, 25 bp, Mus musculus
tggatggctttccttggcgttagca

SEQ ID NO: 882820 - DNA, 25 bp, Mus musculus
tggatggctttcgttggcgttagca

SEQ ID NO: 882821 - DNA, 25 bp, Mus musculus
tggatggctttgatcctcgcggcaa

SEQ ID NO: 882822 - DNA, 25 bp, Mus musculus
tggatggctttgttcctcgcggcaa

SEQ ID NO: 882823 - DNA, 25 bp, Mus musculus
tggatgggacagattcaaccagaaa

SEQ ID NO: 882824 - DNA, 25 bp, Mus musculus
tggatgggacagtttcaaccagaaa

SEQ ID NO: 882825 - DNA, 25 bp, Mus musculus
tggatgggcaaactgctcagctcat

SEQ ID NO: 882826 - DNA, 25 bp, Mus musculus
tggatgggcaaagtgctcagctcat

SEQ ID NO: 882827 - DNA, 25 bp, Mus musculus
tggatgggccccaccatagcgttgg

SEQ ID NO: 882828 - DNA, 25 bp, Mus musculus
tggatgggcccctccatagcgttgg

SEQ ID NO: 882829 - DNA, 25 bp, Mus musculus
tggatgggttgcattaacttctttt

SEQ ID NO: 882830 - DNA, 25 bp, Mus musculus
tggatgggttgctttaacttctttt

SEQ ID NO: 882831 - DNA, 25 bp, Mus musculus
tggatggtaccaccagacttccaac

SEQ ID NO: 882832 - DNA, 25 bp, Mus musculus
tggatggtaccagcagacttccaac

SEQ ID NO: 882833 - DNA, 25 bp, Mus musculus
tggatggtcccacaagcacaaacga

SEQ ID NO: 882834 - DNA, 25 bp, Mus musculus
tggatggtcccagaagcacaaacga

SEQ ID NO: 882835 - DNA, 25 bp, Mus musculus
tggatggtccttcaaagctgagact

SEQ ID NO: 882836 - DNA, 25 bp, Mus musculus
tggatggtccttgaaagctgagact

SEQ ID NO: 882837 - DNA, 25 bp, Mus musculus
tggatggtgctcacaagaggcccca

SEQ ID NO: 882838 - DNA, 25 bp, Mus musculus
tggatggtgctctcaagaggcccca

SEQ ID NO: 882839 - DNA, 25 bp, Mus musculus
tggatggtggcaaggacctcaacat

SEQ ID NO: 882840 - DNA, 25 bp, Mus musculus
tggatggtggcatggacctcaacat

SEQ ID NO: 882841 - DNA, 25 bp, Mus musculus
tggatggtgttcaagattgcttcaa

SEQ ID NO: 882842 - DNA, 25 bp, Mus musculus
tggatggtgttctagattgcttcaa

SEQ ID NO: 882843 - DNA, 25 bp, Mus musculus
tggatgtaagggaaaccaaggctca

SEQ ID NO: 882844 - DNA, 25 bp, Mus musculus
tggatgtaagggtaaccaaggctca

SEQ ID NO: 882845 - DNA, 25 bp, Mus musculus
tggatgtacaatccaacctcctacc

SEQ ID NO: 882846 - DNA, 25 bp, Mus musculus
tggatgtacaatgcaacctcctacc

SEQ ID NO: 882847 - DNA, 25 bp, Mus musculus
tggatgtacctcagtgcgttccaaa

SEQ ID NO: 882848 - DNA, 25 bp, Mus musculus
tggatgtacctctgtgcgttccaaa

SEQ ID NO: 882849 - DNA, 25 bp, Mus musculus
tggatgtaggagctgcccactctac

SEQ ID NO: 882850 - DNA, 25 bp, Mus musculus
tggatgtaggaggtgcccactctac

SEQ ID NO: 882851 - DNA, 25 bp, Mus musculus
tggatgtagtccacagctgggtaga

SEQ ID NO: 882852 - DNA, 25 bp, Mus musculus
tggatgtagtcctcagctgggtaga

SEQ ID NO: 882853 - DNA, 25 bp, Mus musculus
tggatgtagtgaccggcctcaactt

SEQ ID NO: 882854 - DNA, 25 bp, Mus musculus
tggatgtagtgagcggcctcaactt

SEQ ID NO: 882855 - DNA, 25 bp, Mus musculus
tggatgtatttgaccgatgcctgct

SEQ ID NO: 882856 - DNA, 25 bp, Mus musculus
tggatgtatttgtccgatgcctgct

SEQ ID NO: 882857 - DNA, 25 bp, Mus musculus
tggatgtcacatcaccagctcctat

SEQ ID NO: 882858 - DNA, 25 bp, Mus musculus
tggatgtcacatgaccagctcctat

SEQ ID NO: 882859 - DNA, 25 bp, Mus musculus
tggatgtcatatagtgccaccatgg

SEQ ID NO: 882860 - DNA, 25 bp, Mus musculus
tggatgtcatattgtgccaccatgg

SEQ ID NO: 882861 - DNA, 25 bp, Mus musculus
tggatgtcatccagtgccatctctc

SEQ ID NO: 882862 - DNA, 25 bp, Mus musculus
tggatgtcatcctgtgccatctctc

SEQ ID NO: 882863 - DNA, 25 bp, Mus musculus
tggatgtcatctcacttgatccccg

SEQ ID NO: 882864 - DNA, 25 bp, Mus musculus
tggatgtcatctgacttgatccccg

SEQ ID NO: 882865 - DNA, 25 bp, Mus musculus
tggatgtccaacatctctgtgtcta

SEQ ID NO: 882866 - DNA, 25 bp, Mus musculus
tggatgtccaacttctctgtgtcta

SEQ ID NO: 882867 - DNA, 25 bp, Mus musculus
tggatgtcctgtctccttggtgctc

SEQ ID NO: 882868 - DNA, 25 bp, Mus musculus
tggatgtcctgtgtccttggtgctc

SEQ ID NO: 882869 - DNA, 25 bp, Mus musculus
tggatgtcgtgcatgcttcgcgagc

SEQ ID NO: 882870 - DNA, 25 bp, Mus musculus
tggatgtcgtgcttgcttcgcgagc

SEQ ID NO: 882871 - DNA, 25 bp, Mus musculus
tggatgtcgtggaagctctgcaaag

SEQ ID NO: 882872 - DNA, 25 bp, Mus musculus
tggatgtcgtggtagctctgcaaag

SEQ ID NO: 882873 - DNA, 25 bp, Mus musculus
tggatgtctacacccagtggcacca

SEQ ID NO: 882874 - DNA, 25 bp, Mus musculus
tggatgtctacagccagtggcacca

SEQ ID NO: 882875 - DNA, 25 bp, Mus musculus
tggatgtctacccaaactactcaga

SEQ ID NO: 882876 - DNA, 25 bp, Mus musculus
tggatgtctaccgaaactactcaga

SEQ ID NO: 882877 - DNA, 25 bp, Mus musculus
tggatgtctgccctactgaatacat

SEQ ID NO: 882878 - DNA, 25 bp, Mus musculus
tggatgtctgccgtactgaatacat

SEQ ID NO: 882879 - DNA, 25 bp, Mus musculus
tggatgtctgtgaggcagcctggtc

SEQ ID NO: 882880 - DNA, 25 bp, Mus musculus
tggatgtctgtgtggcagcctggtc

SEQ ID NO: 882881 - DNA, 25 bp, Mus musculus
tggatgtgacacacaacccctggca

SEQ ID NO: 882882 - DNA, 25 bp, Mus musculus
tggatgtgacactcaacccctggca

SEQ ID NO: 882883 - DNA, 25 bp, Mus musculus
tggatgtgacgtctcctgcttccaa

SEQ ID NO: 882884 - DNA, 25 bp, Mus musculus
tggatgtgacgtgtcctgcttccaa

SEQ ID NO: 882885 - DNA, 25 bp, Mus musculus
tggatgtgagccctttcctttacca

SEQ ID NO: 882886 - DNA, 25 bp, Mus musculus
tggatgtgagccgtttcctttacca

SEQ ID NO: 882887 - DNA, 25 bp, Mus musculus
tggatgtgcccaagtggaggctcca

SEQ ID NO: 882888 - DNA, 25 bp, Mus musculus
tggatgtgcccatgtggaggctcca

SEQ ID NO: 882889 - DNA, 25 bp, Mus musculus
tggatgtggacaagcgtctgaccgc

SEQ ID NO: 882890 - DNA, 25 bp, Mus musculus
tggatgtggacatgcgtctgaccgc

SEQ ID NO: 882891 - DNA, 25 bp, Mus musculus
tggatgtgttaacaagcaaacttgc

SEQ ID NO: 882892 - DNA, 25 bp, Mus musculus
tggatgtgttaagaagcaaacttgc

SEQ ID NO: 882893 - DNA, 25 bp, Mus musculus
tggatgtgtttacccgaccgccaac

SEQ ID NO: 882894 - DNA, 25 bp, Mus musculus
tggatgtgtttagccgaccgccaac

SEQ ID NO: 882895 - DNA, 25 bp, Mus musculus
tggatgttcaaacccaagaggctct

SEQ ID NO: 882896 - DNA, 25 bp, Mus musculus
tggatgttcaaagccaagaggctct

SEQ ID NO: 882897 - DNA, 25 bp, Mus musculus
tggatgttcatcattgtctgccttc

SEQ ID NO: 882898 - DNA, 25 bp, Mus musculus
tggatgttcatctttgtctgccttc

SEQ ID NO: 882899 - DNA, 25 bp, Mus musculus
tggatgttcccacgcaagataagga

SEQ ID NO: 882900 - DNA, 25 bp, Mus musculus
tggatgttcccaggcaagataagga

SEQ ID NO: 882901 - DNA, 25 bp, Mus musculus
tggatgttcgatcccctggtttatg

SEQ ID NO: 882902 - DNA, 25 bp, Mus musculus
tggatgttcgatgccctggtttatg

SEQ ID NO: 882903 - DNA, 25 bp, Mus musculus
tggatgttcttcatgattcagcccc

SEQ ID NO: 882904 - DNA, 25 bp, Mus musculus
tggatgttcttcttgattcagcccc

SEQ ID NO: 882905 - DNA, 25 bp, Mus musculus
tggatgttgaataccaagtgtaaaa

SEQ ID NO: 882906 - DNA, 25 bp, Mus musculus
tggatgttgaatagccgcctgtttg

SEQ ID NO: 882907 - DNA, 25 bp, Mus musculus
tggatgttgaattccaagtgtaaaa

SEQ ID NO: 882908 - DNA, 25 bp, Mus musculus
tggatgttgaattgccgcctgtttg

SEQ ID NO: 882909 - DNA, 25 bp, Mus musculus
tggatgtttaggaccgtgccctttg

SEQ ID NO: 882910 - DNA, 25 bp, Mus musculus
tggatgtttaggtccgtgccctttg

SEQ ID NO: 882911 - DNA, 25 bp, Mus musculus
tggatgtttcccaggtaaatgctcc

SEQ ID NO: 882912 - DNA, 25 bp, Mus musculus
tggatgtttccctggtaaatgctcc

SEQ ID NO: 882913 - DNA, 25 bp, Mus musculus
tggatgtttcctacgttgtgaggca

SEQ ID NO: 882914 - DNA, 25 bp, Mus musculus
tggatgtttccttcgttgtgaggca

SEQ ID NO: 882915 - DNA, 25 bp, Mus musculus
tggatgtttgcaatcttctgtgcct

SEQ ID NO: 882916 - DNA, 25 bp, Mus musculus
tggatgtttgcattcttctgtgcct

SEQ ID NO: 882917 - DNA, 25 bp, Mus musculus
tggatgttttaacgcgctctcagta

SEQ ID NO: 882918 - DNA, 25 bp, Mus musculus
tggatgttttaaggcgctctcagta

SEQ ID NO: 882919 - DNA, 25 bp, Mus musculus
tggatgttttctaccaagaccccat

SEQ ID NO: 882920 - DNA, 25 bp, Mus musculus
tggatgttttcttccaagaccccat

SEQ ID NO: 882921 - DNA, 25 bp, Mus musculus
tggattaaagccactgttttacacc

SEQ ID NO: 882922 - DNA, 25 bp, Mus musculus
tggattaaagcctctgttttacacc

SEQ ID NO: 882923 - DNA, 25 bp, Mus musculus
tggattaaatccctcagccactgtt

SEQ ID NO: 882924 - DNA, 25 bp, Mus musculus
tggattaaatccgtcagccactgtt

SEQ ID NO: 882925 - DNA, 25 bp, Mus musculus
tggattaaggcccagtttgaccatg

SEQ ID NO: 882926 - DNA, 25 bp, Mus musculus
tggattaaggccgagtttgaccatg

SEQ ID NO: 882927 - DNA, 25 bp, Mus musculus
tggattacaagacagccgagcagaa

SEQ ID NO: 882928 - DNA, 25 bp, Mus musculus
tggattacaagagagccgagcagaa

SEQ ID NO: 882929 - DNA, 25 bp, Mus musculus
tggattacagctctcctgatgggat

SEQ ID NO: 882930 - DNA, 25 bp, Mus musculus
tggattacagctgtcctgatgggat

SEQ ID NO: 882931 - DNA, 25 bp, Mus musculus
tggattaccaccctaagccaccatg

SEQ ID NO: 882932 - DNA, 25 bp, Mus musculus
tggattaccaccgtaagccaccatg

SEQ ID NO: 882933 - DNA, 25 bp, Mus musculus
tggattacgcgcaacacatgtgttt

SEQ ID NO: 882934 - DNA, 25 bp, Mus musculus
tggattacgcgctacacatgtgttt

SEQ ID NO: 882935 - DNA, 25 bp, Mus musculus
tggattactactacctgcgtgactt

SEQ ID NO: 882936 - DNA, 25 bp, Mus musculus
tggattactacttcctgcgtgactt

SEQ ID NO: 882937 - DNA, 25 bp, Mus musculus
tggattagacagcagagacagattt

SEQ ID NO: 882938 - DNA, 25 bp, Mus musculus
tggattagacaggagagacagattt

SEQ ID NO: 882939 - DNA, 25 bp, Mus musculus
tggattatacccactcctaccttat

SEQ ID NO: 882940 - DNA, 25 bp, Mus musculus
tggattataccctctcctaccttat

SEQ ID NO: 882941 - DNA, 25 bp, Mus musculus
tggattatatccacatatgcagtaa

SEQ ID NO: 882942 - DNA, 25 bp, Mus musculus
tggattatatcctcatatgcagtaa

SEQ ID NO: 882943 - DNA, 25 bp, Mus musculus
tggattatcctgatgagtctatgtc

SEQ ID NO: 882944 - DNA, 25 bp, Mus musculus
tggattatcctgttgagtctatgtc

SEQ ID NO: 882945 - DNA, 25 bp, Mus musculus
tggattatcttcaacggtacccttt

SEQ ID NO: 882946 - DNA, 25 bp, Mus musculus
tggattatcttctacggtacccttt

SEQ ID NO: 882947 - DNA, 25 bp, Mus musculus
tggattatgcctaaattgccacccc

SEQ ID NO: 882948 - DNA, 25 bp, Mus musculus
tggattatgccttaattgccacccc

SEQ ID NO: 882949 - DNA, 25 bp, Mus musculus
tggattatgtcccttctcaattcac

SEQ ID NO: 882950 - DNA, 25 bp, Mus musculus
tggattatgtccgttctcaattcac

SEQ ID NO: 882951 - DNA, 25 bp, Mus musculus
tggattatgttcaggttccaccttc

SEQ ID NO: 882952 - DNA, 25 bp, Mus musculus
tggattatgttctggttccaccttc

SEQ ID NO: 882953 - DNA, 25 bp, Mus musculus
tggattattatgacgcctacctgag

SEQ ID NO: 882954 - DNA, 25 bp, Mus musculus
tggattattatgtcgcctacctgag

SEQ ID NO: 882955 - DNA, 25 bp, Mus musculus
tggattattttactcttcccaggcc

SEQ ID NO: 882956 - DNA, 25 bp, Mus musculus
tggattattttagtcttcccaggcc

SEQ ID NO: 882957 - DNA, 25 bp, Mus musculus
tggattcaaagtcggccaaggccaa

SEQ ID NO: 882958 - DNA, 25 bp, Mus musculus
tggattcaaagtgggccaaggccaa

SEQ ID NO: 882959 - DNA, 25 bp, Mus musculus
tggattcacaggactattcccagag

SEQ ID NO: 882960 - DNA, 25 bp, Mus musculus
tggattcacaggtctattcccagag

SEQ ID NO: 882961 - DNA, 25 bp, Mus musculus
tggattcaccctcagtgacggatgt

SEQ ID NO: 882962 - DNA, 25 bp, Mus musculus
tggattcaccctgagtgacggatgt

SEQ ID NO: 882963 - DNA, 25 bp, Mus musculus
tggattcaccgcaggctcatctcta

SEQ ID NO: 882964 - DNA, 25 bp, Mus musculus
tggattcaccgctggctcatctcta

SEQ ID NO: 882965 - DNA, 25 bp, Mus musculus
tggattcaccggatttcattccaac

SEQ ID NO: 882966 - DNA, 25 bp, Mus musculus
tggattcaccggttttcattccaac

SEQ ID NO: 882967 - DNA, 25 bp, Mus musculus
tggattcagagccacccacctttta

SEQ ID NO: 882968 - DNA, 25 bp, Mus musculus
tggattcagagcgacccacctttta

SEQ ID NO: 882969 - DNA, 25 bp, Mus musculus
tggattcagcaaacaaattctggaa

SEQ ID NO: 882970 - DNA, 25 bp, Mus musculus
tggattcagcaatcaaattctggaa

SEQ ID NO: 882971 - DNA, 25 bp, Mus musculus
tggattcagcttctctagcgtatgt

SEQ ID NO: 882972 - DNA, 25 bp, Mus musculus
tggattcagcttgtctagcgtatgt

SEQ ID NO: 882973 - DNA, 25 bp, Mus musculus
tggattcaggcacacgatcaccaca

SEQ ID NO: 882974 - DNA, 25 bp, Mus musculus
tggattcaggcagacgatcaccaca

SEQ ID NO: 882975 - DNA, 25 bp, Mus musculus
tggattcatcaccttctttacctgc

SEQ ID NO: 882976 - DNA, 25 bp, Mus musculus
tggattcatcacgttctttacctgc

SEQ ID NO: 882977 - DNA, 25 bp, Mus musculus
tggattcatcttacaggattctctg

SEQ ID NO: 882978 - DNA, 25 bp, Mus musculus
tggattcatctttcaggattctctg

SEQ ID NO: 882979 - DNA, 25 bp, Mus musculus
tggattccaaatcccaaataggcaa

SEQ ID NO: 882980 - DNA, 25 bp, Mus musculus
tggattccaaatgccaaataggcaa

SEQ ID NO: 882981 - DNA, 25 bp, Mus musculus
tggattccaacacgcaacagtgagc

SEQ ID NO: 882982 - DNA, 25 bp, Mus musculus
tggattccaacaggcaacagtgagc

SEQ ID NO: 882983 - DNA, 25 bp, Mus musculus
tggattccacgcacacatgcacaac

SEQ ID NO: 882984 - DNA, 25 bp, Mus musculus
tggattccacgctcacatgcacaac

SEQ ID NO: 882985 - DNA, 25 bp, Mus musculus
tggattccaggacactcgcacagta

SEQ ID NO: 882986 - DNA, 25 bp, Mus musculus
tggattccaggagactcgcacagta

SEQ ID NO: 882987 - DNA, 25 bp, Mus musculus
tggattccatatatcccagtctcag

SEQ ID NO: 882988 - DNA, 25 bp, Mus musculus
tggattccatatttcccagtctcag

SEQ ID NO: 882989 - DNA, 25 bp, Mus musculus
tggattccatccatcctaccaactt

SEQ ID NO: 882990 - DNA, 25 bp, Mus musculus
tggattccatccttcctaccaactt

SEQ ID NO: 882991 - DNA, 25 bp, Mus musculus
tggattccattgaaaaaggctttgg

SEQ ID NO: 882992 - DNA, 25 bp, Mus musculus
tggattccattgtaaaaggctttgg

SEQ ID NO: 882993 - DNA, 25 bp, Mus musculus
tggattcccaccaagtactatcgaa

SEQ ID NO: 882994 - DNA, 25 bp, Mus musculus
tggattcccacctagtactatcgaa

SEQ ID NO: 882995 - DNA, 25 bp, Mus musculus
tggattcccggaccttagagaagga

SEQ ID NO: 882996 - DNA, 25 bp, Mus musculus
tggattcccggagcttagagaagga

SEQ ID NO: 882997 - DNA, 25 bp, Mus musculus
tggattccctatatcatcttcttca

SEQ ID NO: 882998 - DNA, 25 bp, Mus musculus
tggattccctatttcatcttcttca

SEQ ID NO: 882999 - DNA, 25 bp, Mus musculus
tggattccctggactgcttactttt

SEQ ID NO: 883000 - DNA, 25 bp, Mus musculus
tggattccctggtctgcttactttt

SEQ ID NO: 883001 - DNA, 25 bp, Mus musculus
tggattccgtaaagctagaagcctg

SEQ ID NO: 883002 - DNA, 25 bp, Mus musculus
tggattccgtaatgctagaagcctg

SEQ ID NO: 883003 - DNA, 25 bp, Mus musculus
tggattcctaccaataaggtcttac

SEQ ID NO: 883004 - DNA, 25 bp, Mus musculus
tggattcctacctataaggtcttac

SEQ ID NO: 883005 - DNA, 25 bp, Mus musculus
tggattcctatgctcctgtttaaat

SEQ ID NO: 883006 - DNA, 25 bp, Mus musculus
tggattcctatggtcctgtttaaat

SEQ ID NO: 883007 - DNA, 25 bp, Mus musculus
tggattcctcataggcagaactcgt

SEQ ID NO: 883008 - DNA, 25 bp, Mus musculus
tggattcctcattggcagaactcgt

SEQ ID NO: 883009 - DNA, 25 bp, Mus musculus
tggattcctggaagtccttttcttc

SEQ ID NO: 883010 - DNA, 25 bp, Mus musculus
tggattcctggatgtccttttcttc

SEQ ID NO: 883011 - DNA, 25 bp, Mus musculus
tggattcctgggaagatccacctgt

SEQ ID NO: 883012 - DNA, 25 bp, Mus musculus
tggattcctgggtagatccacctgt

SEQ ID NO: 883013 - DNA, 25 bp, Mus musculus
tggattcctgtacggcctgagctga

SEQ ID NO: 883014 - DNA, 25 bp, Mus musculus
tggattcctgtagggcctgagctga

SEQ ID NO: 883015 - DNA, 25 bp, Mus musculus
tggattccttcaagagtcatggccg

SEQ ID NO: 883016 - DNA, 25 bp, Mus musculus
tggattccttcatgagtcatggccg

SEQ ID NO: 883017 - DNA, 25 bp, Mus musculus
tggattccttgcagccgtagttaag

SEQ ID NO: 883018 - DNA, 25 bp, Mus musculus
tggattccttgctgccgtagttaag

SEQ ID NO: 883019 - DNA, 25 bp, Mus musculus
tggattcgaccaagaagcattcacg

SEQ ID NO: 883020 - DNA, 25 bp, Mus musculus
tggattcgaccatgaagcattcacg

SEQ ID NO: 883021 - DNA, 25 bp, Mus musculus
tggattcgacgtcgcctttaactac

SEQ ID NO: 883022 - DNA, 25 bp, Mus musculus
tggattcgacgtggcctttaactac

SEQ ID NO: 883023 - DNA, 25 bp, Mus musculus
tggattcgtacactcaaggctcggt

SEQ ID NO: 883024 - DNA, 25 bp, Mus musculus
tggattcgtacagtcaaggctcggt

SEQ ID NO: 883025 - DNA, 25 bp, Mus musculus
tggattctaaacatgatcctgcttg

SEQ ID NO: 883026 - DNA, 25 bp, Mus musculus
tggattctaaacttgatcctgcttg

SEQ ID NO: 883027 - DNA, 25 bp, Mus musculus
tggattctagcaccagagctggaaa

SEQ ID NO: 883028 - DNA, 25 bp, Mus musculus
tggattctagcagcagagctggaaa

SEQ ID NO: 883029 - DNA, 25 bp, Mus musculus
tggattctagcccacggcacatgcc

SEQ ID NO: 883030 - DNA, 25 bp, Mus musculus
tggattctagccgacggcacatgcc

SEQ ID NO: 883031 - DNA, 25 bp, Mus musculus
tggattctatccacagcttctagat

SEQ ID NO: 883032 - DNA, 25 bp, Mus musculus
tggattctatcctcagcttctagat

SEQ ID NO: 883033 - DNA, 25 bp, Mus musculus
tggattctcagacgatgtccccatg

SEQ ID NO: 883034 - DNA, 25 bp, Mus musculus
tggattctcagactgccgtggcctt

SEQ ID NO: 883035 - DNA, 25 bp, Mus musculus
tggattctcagaggatgtccccatg

SEQ ID NO: 883036 - DNA, 25 bp, Mus musculus
tggattctcagagtgccgtggcctt

SEQ ID NO: 883037 - DNA, 25 bp, Mus musculus
tggattctggcactagcctgactct

SEQ ID NO: 883038 - DNA, 25 bp, Mus musculus
tggattctggcagtagcctgactct

SEQ ID NO: 883039 - DNA, 25 bp, Mus musculus
tggattctgttcagattgtgtgatt

SEQ ID NO: 883040 - DNA, 25 bp, Mus musculus
tggattctgttctgattgtgtgatt

SEQ ID NO: 883041 - DNA, 25 bp, Mus musculus
tggattcttcaacactgcattctct

SEQ ID NO: 883042 - DNA, 25 bp, Mus musculus
tggattcttcaagactgcattctct

SEQ ID NO: 883043 - DNA, 25 bp, Mus musculus
tggattcttcccagggaactatgtg

SEQ ID NO: 883044 - DNA, 25 bp, Mus musculus
tggattcttccctgggaactatgtg

SEQ ID NO: 883045 - DNA, 25 bp, Mus musculus
tggattcttcgcctgaacgttctta

SEQ ID NO: 883046 - DNA, 25 bp, Mus musculus
tggattcttcgcgtgaacgttctta

SEQ ID NO: 883047 - DNA, 25 bp, Mus musculus
tggattcttgagctagccactctga

SEQ ID NO: 883048 - DNA, 25 bp, Mus musculus
tggattcttgaggtagccactctga

SEQ ID NO: 883049 - DNA, 25 bp, Mus musculus
tggattctttatacgcagactcctg

SEQ ID NO: 883050 - DNA, 25 bp, Mus musculus
tggattctttattcgcagactcctg

SEQ ID NO: 883051 - DNA, 25 bp, Mus musculus
tggattcttttacgccatttaaagg

SEQ ID NO: 883052 - DNA, 25 bp, Mus musculus
tggattcttttaggccatttaaagg

SEQ ID NO: 883053 - DNA, 25 bp, Mus musculus
tggattgaaggcatgggctccctct

SEQ ID NO: 883054 - DNA, 25 bp, Mus musculus
tggattgaaggcttgggctccctct

SEQ ID NO: 883055 - DNA, 25 bp, Mus musculus
tggattgactagacagtggctcaga

SEQ ID NO: 883056 - DNA, 25 bp, Mus musculus
tggattgactagtcagtggctcaga

SEQ ID NO: 883057 - DNA, 25 bp, Mus musculus
tggattgaggctcctgtggataaaa

SEQ ID NO: 883058 - DNA, 25 bp, Mus musculus
tggattgaggctgctgtggataaaa

SEQ ID NO: 883059 - DNA, 25 bp, Mus musculus
tggattgcacctactactggcaacc

SEQ ID NO: 883060 - DNA, 25 bp, Mus musculus
tggattgcaccttctactggcaacc

SEQ ID NO: 883061 - DNA, 25 bp, Mus musculus
tggattgcagatcttcatctccctg

SEQ ID NO: 883062 - DNA, 25 bp, Mus musculus
tggattgcagatgttcatctccctg

SEQ ID NO: 883063 - DNA, 25 bp, Mus musculus
tggattgcatcaatttccccattgg

SEQ ID NO: 883064 - DNA, 25 bp, Mus musculus
tggattgcatcattttccccattgg

SEQ ID NO: 883065 - DNA, 25 bp, Mus musculus
tggattgcccacaaagttcccaaag

SEQ ID NO: 883066 - DNA, 25 bp, Mus musculus
tggattgcccacagactcatacaaa

SEQ ID NO: 883067 - DNA, 25 bp, Mus musculus
tggattgcccactaagttcccaaag

SEQ ID NO: 883068 - DNA, 25 bp, Mus musculus
tggattgcccactgactcatacaaa

SEQ ID NO: 883069 - DNA, 25 bp, Mus musculus
tggattgcctcgaaccagtcagagg

SEQ ID NO: 883070 - DNA, 25 bp, Mus musculus
tggattgcctcgtaccagtcagagg

SEQ ID NO: 883071 - DNA, 25 bp, Mus musculus
tggattgctgtgaggctactttgtg

SEQ ID NO: 883072 - DNA, 25 bp, Mus musculus
tggattgctgtgtggctactttgtg

SEQ ID NO: 883073 - DNA, 25 bp, Mus musculus
tggattgcttccaagatcggcccta

SEQ ID NO: 883074 - DNA, 25 bp, Mus musculus
tggattgcttcctagatcggcccta

SEQ ID NO: 883075 - DNA, 25 bp, Mus musculus
tggattggacagatcacggcccttc

SEQ ID NO: 883076 - DNA, 25 bp, Mus musculus
tggattggacagttcacggcccttc

SEQ ID NO: 883077 - DNA, 25 bp, Mus musculus
tggattggctgtcccctttacaaag

SEQ ID NO: 883078 - DNA, 25 bp, Mus musculus
tggattggctgtgccctttacaaag

SEQ ID NO: 883079 - DNA, 25 bp, Mus musculus
tggattgggccaatatatcacttgg

SEQ ID NO: 883080 - DNA, 25 bp, Mus musculus
tggattgggccattatatcacttgg

SEQ ID NO: 883081 - DNA, 25 bp, Mus musculus
tggattgggcccaatgaacacctgg

SEQ ID NO: 883082 - DNA, 25 bp, Mus musculus
tggattgggccctatgaacacctgg

SEQ ID NO: 883083 - DNA, 25 bp, Mus musculus
tggattgggctcactgaccagggca

SEQ ID NO: 883084 - DNA, 25 bp, Mus musculus
tggattgggctctctgaccagggca

SEQ ID NO: 883085 - DNA, 25 bp, Mus musculus
tggattgggtcacaggactacctct

SEQ ID NO: 883086 - DNA, 25 bp, Mus musculus
tggattgggtcagaggactacctct

SEQ ID NO: 883087 - DNA, 25 bp, Mus musculus
tggattgtacagaatcggccgtgcc

SEQ ID NO: 883088 - DNA, 25 bp, Mus musculus
tggattgtacagtatcggccgtgcc

SEQ ID NO: 883089 - DNA, 25 bp, Mus musculus
tggattgtcacaactggctttcttt

SEQ ID NO: 883090 - DNA, 25 bp, Mus musculus
tggattgtcacatctggctttcttt

SEQ ID NO: 883091 - DNA, 25 bp, Mus musculus
tggattgtcactactttcaggataa

SEQ ID NO: 883092 - DNA, 25 bp, Mus musculus
tggattgtcacttctttcaggataa

SEQ ID NO: 883093 - DNA, 25 bp, Mus musculus
tggattgtctccagaggctgagcag

SEQ ID NO: 883094 - DNA, 25 bp, Mus musculus
tggattgtctcctgaggctgagcag

SEQ ID NO: 883095 - DNA, 25 bp, Mus musculus
tggattgtgtctcgacgcactgcac

SEQ ID NO: 883096 - DNA, 25 bp, Mus musculus
tggattgtgtctggacgcactgcac

SEQ ID NO: 883097 - DNA, 25 bp, Mus musculus
tggattgttaccacatctctgcatt

SEQ ID NO: 883098 - DNA, 25 bp, Mus musculus
tggattgttacctcatctctgcatt

SEQ ID NO: 883099 - DNA, 25 bp, Mus musculus
tggattgttgtgagcctgtctgtgc

SEQ ID NO: 883100 - DNA, 25 bp, Mus musculus
tggattgttgtgtgcctgtctgtgc

SEQ ID NO: 883101 - DNA, 25 bp, Mus musculus
tggatttacaccatacacctttctg

SEQ ID NO: 883102 - DNA, 25 bp, Mus musculus
tggatttacaccttacacctttctg

SEQ ID NO: 883103 - DNA, 25 bp, Mus musculus
tggatttactacaagaacattgctg

SEQ ID NO: 883104 - DNA, 25 bp, Mus musculus
tggatttactactagaacattgctg

SEQ ID NO: 883105 - DNA, 25 bp, Mus musculus
tggatttagggcactgctgcataat

SEQ ID NO: 883106 - DNA, 25 bp, Mus musculus
tggatttagggctctgctgcataat

SEQ ID NO: 883107 - DNA, 25 bp, Mus musculus
tggatttcaactccaccacttgtgt

SEQ ID NO: 883108 - DNA, 25 bp, Mus musculus
tggatttcaactgcaccacttgtgt

SEQ ID NO: 883109 - DNA, 25 bp, Mus musculus
tggatttcacaaagttacccctggc

SEQ ID NO: 883110 - DNA, 25 bp, Mus musculus
tggatttcacaatgttacccctggc

SEQ ID NO: 883111 - DNA, 25 bp, Mus musculus
tggatttcacagcaaccggccagaa

SEQ ID NO: 883112 - DNA, 25 bp, Mus musculus
tggatttcacaggaaccggccagaa

SEQ ID NO: 883113 - DNA, 25 bp, Mus musculus
tggatttcagttccctagctatgag

SEQ ID NO: 883114 - DNA, 25 bp, Mus musculus
tggatttcagttgcctagctatgag

SEQ ID NO: 883115 - DNA, 25 bp, Mus musculus
tggatttcatccaccttattggcaa

SEQ ID NO: 883116 - DNA, 25 bp, Mus musculus
tggatttcatcctccttattggcaa

SEQ ID NO: 883117 - DNA, 25 bp, Mus musculus
tggatttccagtacccaggtgttaa

SEQ ID NO: 883118 - DNA, 25 bp, Mus musculus
tggatttccagttcccaggtgttaa

SEQ ID NO: 883119 - DNA, 25 bp, Mus musculus
tggatttcccagatagtgatttccc

SEQ ID NO: 883120 - DNA, 25 bp, Mus musculus
tggatttcccagttagtgatttccc

SEQ ID NO: 883121 - DNA, 25 bp, Mus musculus
tggatttccggaccctagaactgat

SEQ ID NO: 883122 - DNA, 25 bp, Mus musculus
tggatttccggagcctagaactgat

SEQ ID NO: 883123 - DNA, 25 bp, Mus musculus
tggatttcctgcctgctacatatgc

SEQ ID NO: 883124 - DNA, 25 bp, Mus musculus
tggatttcctgcgtgctacatatgc

SEQ ID NO: 883125 - DNA, 25 bp, Mus musculus
tggatttcctttcgaatggcactac

SEQ ID NO: 883126 - DNA, 25 bp, Mus musculus
tggatttcctttggaatggcactac

SEQ ID NO: 883127 - DNA, 25 bp, Mus musculus
tggatttcgatcactagccagagtg

SEQ ID NO: 883128 - DNA, 25 bp, Mus musculus
tggatttcgatctctagccagagtg

SEQ ID NO: 883129 - DNA, 25 bp, Mus musculus
tggatttctcacatagcttctggac

SEQ ID NO: 883130 - DNA, 25 bp, Mus musculus
tggatttctcacttagcttctggac

SEQ ID NO: 883131 - DNA, 25 bp, Mus musculus
tggatttctgcgcagtgcctgaaca

SEQ ID NO: 883132 - DNA, 25 bp, Mus musculus
tggatttctgcggagtgcctgaaca

SEQ ID NO: 883133 - DNA, 25 bp, Mus musculus
tggatttctgctatcatcttctcaa

SEQ ID NO: 883134 - DNA, 25 bp, Mus musculus
tggatttctgctttcatcttctcaa

SEQ ID NO: 883135 - DNA, 25 bp, Mus musculus
tggatttgatcccacatggaggcaa

SEQ ID NO: 883136 - DNA, 25 bp, Mus musculus
tggatttgatccgacatggaggcaa

SEQ ID NO: 883137 - DNA, 25 bp, Mus musculus
tggatttgcctgctcttaacatgca

SEQ ID NO: 883138 - DNA, 25 bp, Mus musculus
tggatttgcctggtcttaacatgca

SEQ ID NO: 883139 - DNA, 25 bp, Mus musculus
tggatttgctcgcatacctcgaaag

SEQ ID NO: 883140 - DNA, 25 bp, Mus musculus
tggatttgctcggatacctcgaaag

SEQ ID NO: 883141 - DNA, 25 bp, Mus musculus
tggatttggaagaacgcacactcat

SEQ ID NO: 883142 - DNA, 25 bp, Mus musculus
tggatttggaagtacgcacactcat

SEQ ID NO: 883143 - DNA, 25 bp, Mus musculus
tggattttccagacaatgtcttatt

SEQ ID NO: 883144 - DNA, 25 bp, Mus musculus
tggattttccagtcaatgtcttatt

SEQ ID NO: 883145 - DNA, 25 bp, Mus musculus
tggattttccctcccgtggaagaac

SEQ ID NO: 883146 - DNA, 25 bp, Mus musculus
tggattttccctgccgtggaagaac

SEQ ID NO: 883147 - DNA, 25 bp, Mus musculus
tggattttgaagcatattggatatt

SEQ ID NO: 883148 - DNA, 25 bp, Mus musculus
tggattttgaaggatattggatatt

SEQ ID NO: 883149 - DNA, 25 bp, Mus musculus
tggattttgagaatgccacaggcat

SEQ ID NO: 883150 - DNA, 25 bp, Mus musculus
tggattttgagattgccacaggcat

SEQ ID NO: 883151 - DNA, 25 bp, Mus musculus
tggattttgagcagcaggcctgtat

SEQ ID NO: 883152 - DNA, 25 bp, Mus musculus
tggattttgagctgcaggcctgtat

SEQ ID NO: 883153 - DNA, 25 bp, Mus musculus
tggattttggtacagcattgctcat

SEQ ID NO: 883154 - DNA, 25 bp, Mus musculus
tggattttggtagagcattgctcat

SEQ ID NO: 883155 - DNA, 25 bp, Mus musculus
tggatttttaccagccatcaccttg

SEQ ID NO: 883156 - DNA, 25 bp, Mus musculus
tggatttttacctgccatcaccttg

SEQ ID NO: 883157 - DNA, 25 bp, Mus musculus
tggatttttataattgccatgtaat

SEQ ID NO: 883158 - DNA, 25 bp, Mus musculus
tggatttttatatttgccatgtaat

SEQ ID NO: 883159 - DNA, 25 bp, Mus musculus
tggatttttcccacaaactgtttgc

SEQ ID NO: 883160 - DNA, 25 bp, Mus musculus
tggatttttccctcaaactgtttgc

SEQ ID NO: 883161 - DNA, 25 bp, Mus musculus
tggatttttcttaagggacatgacc

SEQ ID NO: 883162 - DNA, 25 bp, Mus musculus
tggatttttctttagggacatgacc

SEQ ID NO: 883163 - DNA, 25 bp, Mus musculus
tggatttttggacctttggtgctcc

SEQ ID NO: 883164 - DNA, 25 bp, Mus musculus
tggatttttggagctttggtgctcc

SEQ ID NO: 883165 - DNA, 25 bp, Mus musculus
tggattttttcgatggcaacctagg

SEQ ID NO: 883166 - DNA, 25 bp, Mus musculus
tggattttttcgttggcaacctagg

SEQ ID NO: 883167 - DNA, 25 bp, Mus musculus
tggcaaaacattcctgctgtctcag

SEQ ID NO: 883168 - DNA, 25 bp, Mus musculus
tggcaaaacattgctgctgtctcag

SEQ ID NO: 883169 - DNA, 25 bp, Mus musculus
tggcaaaactagattcccatgtagt

SEQ ID NO: 883170 - DNA, 25 bp, Mus musculus
tggcaaaactagtttcccatgtagt

SEQ ID NO: 883171 - DNA, 25 bp, Mus musculus
tggcaaaactgcatccactggtgat

SEQ ID NO: 883172 - DNA, 25 bp, Mus musculus
tggcaaaactgcttccactggtgat

SEQ ID NO: 883173 - DNA, 25 bp, Mus musculus
tggcaaaagaccctcgcctcagtag

SEQ ID NO: 883174 - DNA, 25 bp, Mus musculus
tggcaaaagaccgtcgcctcagtag

SEQ ID NO: 883175 - DNA, 25 bp, Mus musculus
tggcaaaagttcagcttctgttaag

SEQ ID NO: 883176 - DNA, 25 bp, Mus musculus
tggcaaaagttctgcttctgttaag

SEQ ID NO: 883177 - DNA, 25 bp, Mus musculus
tggcaaaatgccaagccctgggtta

SEQ ID NO: 883178 - DNA, 25 bp, Mus musculus
tggcaaaatgcctagccctgggtta

SEQ ID NO: 883179 - DNA, 25 bp, Mus musculus
tggcaaaatttcaaagcagtggtct

SEQ ID NO: 883180 - DNA, 25 bp, Mus musculus
tggcaaaatttctaagcagtggtct

SEQ ID NO: 883181 - DNA, 25 bp, Mus musculus
tggcaaacagccattatcccaaatg

SEQ ID NO: 883182 - DNA, 25 bp, Mus musculus
tggcaaacagcctttatcccaaatg

SEQ ID NO: 883183 - DNA, 25 bp, Mus musculus
tggcaaacagtactgctcatctcac

SEQ ID NO: 883184 - DNA, 25 bp, Mus musculus
tggcaaacagtagtgctcatctcac

SEQ ID NO: 883185 - DNA, 25 bp, Mus musculus
tggcaaacctcacagcccatgggct

SEQ ID NO: 883186 - DNA, 25 bp, Mus musculus
tggcaaacctcagagcccatgggct

SEQ ID NO: 883187 - DNA, 25 bp, Mus musculus
tggcaaacctttatctccaaaatag

SEQ ID NO: 883188 - DNA, 25 bp, Mus musculus
tggcaaacctttttctccaaaatag

SEQ ID NO: 883189 - DNA, 25 bp, Mus musculus
tggcaaacgtgcaggattgctgccc

SEQ ID NO: 883190 - DNA, 25 bp, Mus musculus
tggcaaacgtgctggattgctgccc

SEQ ID NO: 883191 - DNA, 25 bp, Mus musculus
tggcaaactttgatgtactaatagt

SEQ ID NO: 883192 - DNA, 25 bp, Mus musculus
tggcaaactttgttgtactaatagt

SEQ ID NO: 883193 - DNA, 25 bp, Mus musculus
tggcaaagatacacctccacctgtg

SEQ ID NO: 883194 - DNA, 25 bp, Mus musculus
tggcaaagatactcctccacctgtg

SEQ ID NO: 883195 - DNA, 25 bp, Mus musculus
tggcaaagatggacccagcagcctt

SEQ ID NO: 883196 - DNA, 25 bp, Mus musculus
tggcaaagatggtcccagcagcctt

SEQ ID NO: 883197 - DNA, 25 bp, Mus musculus
tggcaaagcaaaccctatcctgagt

SEQ ID NO: 883198 - DNA, 25 bp, Mus musculus
tggcaaagcaaagcctatcctgagt

SEQ ID NO: 883199 - DNA, 25 bp, Mus musculus
tggcaaagcccactgtgaccatcag

SEQ ID NO: 883200 - DNA, 25 bp, Mus musculus
tggcaaagcccagtgtgaccatcag

SEQ ID NO: 883201 - DNA, 25 bp, Mus musculus
tggcaaagccttcgttcattcgtca

SEQ ID NO: 883202 - DNA, 25 bp, Mus musculus
tggcaaagccttggttcattcgtca

SEQ ID NO: 883203 - DNA, 25 bp, Mus musculus
tggcaaaggactccgtaggctttct

SEQ ID NO: 883204 - DNA, 25 bp, Mus musculus
tggcaaaggactgcgtaggctttct

SEQ ID NO: 883205 - DNA, 25 bp, Mus musculus
tggcaaaggagcatagcccttgacc

SEQ ID NO: 883206 - DNA, 25 bp, Mus musculus
tggcaaaggagcttagcccttgacc

SEQ ID NO: 883207 - DNA, 25 bp, Mus musculus
tggcaaaggccaattcagagcactt

SEQ ID NO: 883208 - DNA, 25 bp, Mus musculus
tggcaaaggccatttcagagcactt

SEQ ID NO: 883209 - DNA, 25 bp, Mus musculus
tggcaaagggccctgccctacaggt

SEQ ID NO: 883210 - DNA, 25 bp, Mus musculus
tggcaaagggccgtgccctacaggt

SEQ ID NO: 883211 - DNA, 25 bp, Mus musculus
tggcaaagggctactgctcaccaca

SEQ ID NO: 883212 - DNA, 25 bp, Mus musculus
tggcaaagggcttctgctcaccaca

SEQ ID NO: 883213 - DNA, 25 bp, Mus musculus
tggcaaagtgcacctgttcagctac

SEQ ID NO: 883214 - DNA, 25 bp, Mus musculus
tggcaaagtgcagctgttcagctac

SEQ ID NO: 883215 - DNA, 25 bp, Mus musculus
tggcaaatcaatacagttctttagt

SEQ ID NO: 883216 - DNA, 25 bp, Mus musculus
tggcaaatcaattcagttctttagt

SEQ ID NO: 883217 - DNA, 25 bp, Mus musculus
tggcaaatcctacttgtctggcacc

SEQ ID NO: 883218 - DNA, 25 bp, Mus musculus
tggcaaatcctagttgtctggcacc

SEQ ID NO: 883219 - DNA, 25 bp, Mus musculus
tggcaaatggttacttattccttcc

SEQ ID NO: 883220 - DNA, 25 bp, Mus musculus
tggcaaatggtttcttattccttcc

SEQ ID NO: 883221 - DNA, 25 bp, Mus musculus
tggcaacaaaagaatccggtacaaa

SEQ ID NO: 883222 - DNA, 25 bp, Mus musculus
tggcaacaaaagtatccggtacaaa

SEQ ID NO: 883223 - DNA, 25 bp, Mus musculus
tggcaacaaactcgccctacttaag

SEQ ID NO: 883224 - DNA, 25 bp, Mus musculus
tggcaacaaactggccctacttaag

SEQ ID NO: 883225 - DNA, 25 bp, Mus musculus
tggcaacaaagacctttgcgaggaa

SEQ ID NO: 883226 - DNA, 25 bp, Mus musculus
tggcaacaaagagctttgcgaggaa

SEQ ID NO: 883227 - DNA, 25 bp, Mus musculus
tggcaacaacatcacggtcaaaacc

SEQ ID NO: 883228 - DNA, 25 bp, Mus musculus
tggcaacaacatgacggtcaaaacc

SEQ ID NO: 883229 - DNA, 25 bp, Mus musculus
tggcaacaacttattcatcctataa

SEQ ID NO: 883230 - DNA, 25 bp, Mus musculus
tggcaacaactttttcatcctataa

SEQ ID NO: 883231 - DNA, 25 bp, Mus musculus
tggcaacaagccagtcatgtctcta

SEQ ID NO: 883232 - DNA, 25 bp, Mus musculus
tggcaacaagcctgtcatgtctcta

SEQ ID NO: 883233 - DNA, 25 bp, Mus musculus
tggcaacaatgtcctggctcatcgg

SEQ ID NO: 883234 - DNA, 25 bp, Mus musculus
tggcaacaatgtgctggctcatcgg

SEQ ID NO: 883235 - DNA, 25 bp, Mus musculus
tggcaacacagtcaattagggaagt

SEQ ID NO: 883236 - DNA, 25 bp, Mus musculus
tggcaacacagtgaattagggaagt

SEQ ID NO: 883237 - DNA, 25 bp, Mus musculus
tggcaacacataacagaccccttta

SEQ ID NO: 883238 - DNA, 25 bp, Mus musculus
tggcaacacatatcagaccccttta

SEQ ID NO: 883239 - DNA, 25 bp, Mus musculus
tggcaacaccataagatgcagggat

SEQ ID NO: 883240 - DNA, 25 bp, Mus musculus
tggcaacaccattagatgcagggat

SEQ ID NO: 883241 - DNA, 25 bp, Mus musculus
tggcaacacggcatgacgttttctt

SEQ ID NO: 883242 - DNA, 25 bp, Mus musculus
tggcaacacggcttgacgttttctt

SEQ ID NO: 883243 - DNA, 25 bp, Mus musculus
tggcaacactggataatggcttttt

SEQ ID NO: 883244 - DNA, 25 bp, Mus musculus
tggcaacactggttaatggcttttt

SEQ ID NO: 883245 - DNA, 25 bp, Mus musculus
tggcaacagccacaatgctagaaga

SEQ ID NO: 883246 - DNA, 25 bp, Mus musculus
tggcaacagccagaatgctagaaga

SEQ ID NO: 883247 - DNA, 25 bp, Mus musculus
tggcaacagctgatcatcccaaact

SEQ ID NO: 883248 - DNA, 25 bp, Mus musculus
tggcaacagctgttcatcccaaact

SEQ ID NO: 883249 - DNA, 25 bp, Mus musculus
tggcaacatacaatcttctccaggg

SEQ ID NO: 883250 - DNA, 25 bp, Mus musculus
tggcaacatacattcttctccaggg

SEQ ID NO: 883251 - DNA, 25 bp, Mus musculus
tggcaacatcatcttaatacacagt

SEQ ID NO: 883252 - DNA, 25 bp, Mus musculus
tggcaacatcatgttaatacacagt

SEQ ID NO: 883253 - DNA, 25 bp, Mus musculus
tggcaacattcaccagtacacttat

SEQ ID NO: 883254 - DNA, 25 bp, Mus musculus
tggcaacattcaccatggctaggct

SEQ ID NO: 883255 - DNA, 25 bp, Mus musculus
tggcaacattcagcagtacacttat

SEQ ID NO: 883256 - DNA, 25 bp, Mus musculus
tggcaacattcagcatggctaggct

SEQ ID NO: 883257 - DNA, 25 bp, Mus musculus
tggcaaccaactatcatgtaaataa

SEQ ID NO: 883258 - DNA, 25 bp, Mus musculus
tggcaaccaactttcatgtaaataa

SEQ ID NO: 883259 - DNA, 25 bp, Mus musculus
tggcaaccacacaactcagggaaag

SEQ ID NO: 883260 - DNA, 25 bp, Mus musculus
tggcaaccacactactcagggaaag

SEQ ID NO: 883261 - DNA, 25 bp, Mus musculus
tggcaaccacccctttccagaataa

SEQ ID NO: 883262 - DNA, 25 bp, Mus musculus
tggcaaccacccgtttccagaataa

SEQ ID NO: 883263 - DNA, 25 bp, Mus musculus
tggcaaccagcacttaatcagtggg

SEQ ID NO: 883264 - DNA, 25 bp, Mus musculus
tggcaaccagcagttaatcagtggg

SEQ ID NO: 883265 - DNA, 25 bp, Mus musculus
tggcaacccgatatctagtttcctg

SEQ ID NO: 883266 - DNA, 25 bp, Mus musculus
tggcaacccgatttctagtttcctg

SEQ ID NO: 883267 - DNA, 25 bp, Mus musculus
tggcaacccgttcacactagcagtg

SEQ ID NO: 883268 - DNA, 25 bp, Mus musculus
tggcaacccgttgacactagcagtg

SEQ ID NO: 883269 - DNA, 25 bp, Mus musculus
tggcaaccgaatcctggcccagcat

SEQ ID NO: 883270 - DNA, 25 bp, Mus musculus
tggcaaccgaatgctggcccagcat

SEQ ID NO: 883271 - DNA, 25 bp, Mus musculus
tggcaacctgagattgctcctgaaa

SEQ ID NO: 883272 - DNA, 25 bp, Mus musculus
tggcaacctgagtttgctcctgaaa

SEQ ID NO: 883273 - DNA, 25 bp, Mus musculus
tggcaacgactccacgcatgtgaaa

SEQ ID NO: 883274 - DNA, 25 bp, Mus musculus
tggcaacgactcgacgcatgtgaaa

SEQ ID NO: 883275 - DNA, 25 bp, Mus musculus
tggcaacgcgtacctaaacaccgtg

SEQ ID NO: 883276 - DNA, 25 bp, Mus musculus
tggcaacgcgtagctaaacaccgtg

SEQ ID NO: 883277 - DNA, 25 bp, Mus musculus
tggcaacggaagactggagtcccag

SEQ ID NO: 883278 - DNA, 25 bp, Mus musculus
tggcaacggaagtctggagtcccag

SEQ ID NO: 883279 - DNA, 25 bp, Mus musculus
tggcaacggtcacagcacttcgtcg

SEQ ID NO: 883280 - DNA, 25 bp, Mus musculus
tggcaacggtcagagcacttcgtcg

SEQ ID NO: 883281 - DNA, 25 bp, Mus musculus
tggcaacggtctccatgccatcatc

SEQ ID NO: 883282 - DNA, 25 bp, Mus musculus
tggcaacggtctgcatgccatcatc

SEQ ID NO: 883283 - DNA, 25 bp, Mus musculus
tggcaacgtcagcaggccctcacga

SEQ ID NO: 883284 - DNA, 25 bp, Mus musculus
tggcaacgtcaggaggccctcacga

SEQ ID NO: 883285 - DNA, 25 bp, Mus musculus
tggcaactatttaccagttgaaaag

SEQ ID NO: 883286 - DNA, 25 bp, Mus musculus
tggcaactattttccagttgaaaag

SEQ ID NO: 883287 - DNA, 25 bp, Mus musculus
tggcaactctacctgggtcctctgg

SEQ ID NO: 883288 - DNA, 25 bp, Mus musculus
tggcaactctacgtgggtcctctgg

SEQ ID NO: 883289 - DNA, 25 bp, Mus musculus
tggcaactcttcaatgcgctgacat

SEQ ID NO: 883290 - DNA, 25 bp, Mus musculus
tggcaactcttctatgcgctgacat

SEQ ID NO: 883291 - DNA, 25 bp, Mus musculus
tggcaactggacagggtaaccccgt

SEQ ID NO: 883292 - DNA, 25 bp, Mus musculus
tggcaactggactgggtaaccccgt

SEQ ID NO: 883293 - DNA, 25 bp, Mus musculus
tggcaactgtggaagaattatccct

SEQ ID NO: 883294 - DNA, 25 bp, Mus musculus
tggcaactgtggtagaattatccct

SEQ ID NO: 883295 - DNA, 25 bp, Mus musculus
tggcaacttcggcagactagatctt

SEQ ID NO: 883296 - DNA, 25 bp, Mus musculus
tggcaacttcgggagactagatctt

SEQ ID NO: 883297 - DNA, 25 bp, Mus musculus
tggcaacttctaagtgcccgcagaa

SEQ ID NO: 883298 - DNA, 25 bp, Mus musculus
tggcaacttctatgtgcccgcagaa

SEQ ID NO: 883299 - DNA, 25 bp, Mus musculus
tggcaacttgtcaagtccccaattg

SEQ ID NO: 883300 - DNA, 25 bp, Mus musculus
tggcaacttgtctagtccccaattg

SEQ ID NO: 883301 - DNA, 25 bp, Mus musculus
tggcaacttttgatccggtggacaa

SEQ ID NO: 883302 - DNA, 25 bp, Mus musculus
tggcaacttttgttccggtggacaa

SEQ ID NO: 883303 - DNA, 25 bp, Mus musculus
tggcaactttttccctctgtcacat

SEQ ID NO: 883304 - DNA, 25 bp, Mus musculus
tggcaactttttgcctctgtcacat

SEQ ID NO: 883305 - DNA, 25 bp, Mus musculus
tggcaagaacccacccagaaggtta

SEQ ID NO: 883306 - DNA, 25 bp, Mus musculus
tggcaagaaccctcccagaaggtta

SEQ ID NO: 883307 - DNA, 25 bp, Mus musculus
tggcaagaaggtcctgactgctttt

SEQ ID NO: 883308 - DNA, 25 bp, Mus musculus
tggcaagaaggtgctgactgctttt

SEQ ID NO: 883309 - DNA, 25 bp, Mus musculus
tggcaagaagtcaatggcagcgagt

SEQ ID NO: 883310 - DNA, 25 bp, Mus musculus
tggcaagaagtctatggcagcgagt

SEQ ID NO: 883311 - DNA, 25 bp, Mus musculus
tggcaagacctcagagctaaatggg

SEQ ID NO: 883312 - DNA, 25 bp, Mus musculus
tggcaagacctctgagctaaatggg

SEQ ID NO: 883313 - DNA, 25 bp, Mus musculus
tggcaagagagtagtttctgtaccc

SEQ ID NO: 883314 - DNA, 25 bp, Mus musculus
tggcaagagagttgtttctgtaccc

SEQ ID NO: 883315 - DNA, 25 bp, Mus musculus
tggcaagagcccatcacactgagct

SEQ ID NO: 883316 - DNA, 25 bp, Mus musculus
tggcaagagcccttcacactgagct

SEQ ID NO: 883317 - DNA, 25 bp, Mus musculus
tggcaagagctaccgttccttctcc

SEQ ID NO: 883318 - DNA, 25 bp, Mus musculus
tggcaagagctagcgttccttctcc

SEQ ID NO: 883319 - DNA, 25 bp, Mus musculus
tggcaagagctcacccagccattta

SEQ ID NO: 883320 - DNA, 25 bp, Mus musculus
tggcaagagctctcccagccattta

SEQ ID NO: 883321 - DNA, 25 bp, Mus musculus
tggcaagagtatacaattttcattc

SEQ ID NO: 883322 - DNA, 25 bp, Mus musculus
tggcaagagtattcaattttcattc

SEQ ID NO: 883323 - DNA, 25 bp, Mus musculus
tggcaagatcacaccttttgaggaa

SEQ ID NO: 883324 - DNA, 25 bp, Mus musculus
tggcaagatcactccttttgaggaa

SEQ ID NO: 883325 - DNA, 25 bp, Mus musculus
tggcaagatggcacaacggataagg

SEQ ID NO: 883326 - DNA, 25 bp, Mus musculus
tggcaagatggctcaacggataagg

SEQ ID NO: 883327 - DNA, 25 bp, Mus musculus
tggcaagattacaagggcctataat

SEQ ID NO: 883328 - DNA, 25 bp, Mus musculus
tggcaagattactagggcctataat

SEQ ID NO: 883329 - DNA, 25 bp, Mus musculus
tggcaagcaaggctcagtgatgaaa

SEQ ID NO: 883330 - DNA, 25 bp, Mus musculus
tggcaagcaagggtcagtgatgaaa

SEQ ID NO: 883331 - DNA, 25 bp, Mus musculus
tggcaagcaattactacagtgttct

SEQ ID NO: 883332 - DNA, 25 bp, Mus musculus
tggcaagcaatttctacagtgttct

SEQ ID NO: 883333 - DNA, 25 bp, Mus musculus
tggcaagcaccgacagactcacata

SEQ ID NO: 883334 - DNA, 25 bp, Mus musculus
tggcaagcaccgtcagactcacata

SEQ ID NO: 883335 - DNA, 25 bp, Mus musculus
tggcaagcacgaactgcccatggaa

SEQ ID NO: 883336 - DNA, 25 bp, Mus musculus
tggcaagcacgaagaaaggcaggac

SEQ ID NO: 883337 - DNA, 25 bp, Mus musculus
tggcaagcacgatctgcccatggaa

SEQ ID NO: 883338 - DNA, 25 bp, Mus musculus
tggcaagcacgatgaaaggcaggac

SEQ ID NO: 883339 - DNA, 25 bp, Mus musculus
tggcaagcacgtccaggtcaccgga

SEQ ID NO: 883340 - DNA, 25 bp, Mus musculus
tggcaagcacgtgcaggtcaccgga

SEQ ID NO: 883341 - DNA, 25 bp, Mus musculus
tggcaagcatgtcgttttcggcaaa

SEQ ID NO: 883342 - DNA, 25 bp, Mus musculus
tggcaagcatgtggttttcggcaaa

SEQ ID NO: 883343 - DNA, 25 bp, Mus musculus
tggcaagccctcaagaggcgctgcg

SEQ ID NO: 883344 - DNA, 25 bp, Mus musculus
tggcaagccctcacacttctgagaa

SEQ ID NO: 883345 - DNA, 25 bp, Mus musculus
tggcaagccctctagaggcgctgcg

SEQ ID NO: 883346 - DNA, 25 bp, Mus musculus
tggcaagccctctcacttctgagaa

SEQ ID NO: 883347 - DNA, 25 bp, Mus musculus
tggcaagcgctacaatcatggtcaa

SEQ ID NO: 883348 - DNA, 25 bp, Mus musculus
tggcaagcgctagaatcatggtcaa

SEQ ID NO: 883349 - DNA, 25 bp, Mus musculus
tggcaaggaccgctgcttacacgag

SEQ ID NO: 883350 - DNA, 25 bp, Mus musculus
tggcaaggaccggtgcttacacgag

SEQ ID NO: 883351 - DNA, 25 bp, Mus musculus
tggcaaggcagaccggcagctacct

SEQ ID NO: 883352 - DNA, 25 bp, Mus musculus
tggcaaggcagagcggcagctacct

SEQ ID NO: 883353 - DNA, 25 bp, Mus musculus
tggcaaggcctcaagattctcctat

SEQ ID NO: 883354 - DNA, 25 bp, Mus musculus
tggcaaggcctctagattctcctat

SEQ ID NO: 883355 - DNA, 25 bp, Mus musculus
tggcaaggccttagcttgtcacagc

SEQ ID NO: 883356 - DNA, 25 bp, Mus musculus
tggcaaggcctttgcttgtcacagc

SEQ ID NO: 883357 - DNA, 25 bp, Mus musculus
tggcaaggctctccattaccaaagg

SEQ ID NO: 883358 - DNA, 25 bp, Mus musculus
tggcaaggctctgcattaccaaagg

SEQ ID NO: 883359 - DNA, 25 bp, Mus musculus
tggcaaggctttaagagggtcaacc

SEQ ID NO: 883360 - DNA, 25 bp, Mus musculus
tggcaaggcttttagagggtcaacc

SEQ ID NO: 883361 - DNA, 25 bp, Mus musculus
tggcaagggacccttctgctactct

SEQ ID NO: 883362 - DNA, 25 bp, Mus musculus
tggcaagggaccgttctgctactct

SEQ ID NO: 883363 - DNA, 25 bp, Mus musculus
tggcaagggcaccatctctctaggc

SEQ ID NO: 883364 - DNA, 25 bp, Mus musculus
tggcaagggcacgatctctctaggc

SEQ ID NO: 883365 - DNA, 25 bp, Mus musculus
tggcaagggccgagaacttccaact

SEQ ID NO: 883366 - DNA, 25 bp, Mus musculus
tggcaagggccgtgaacttccaact

SEQ ID NO: 883367 - DNA, 25 bp, Mus musculus
tggcaagggctcatcttacagatgc

SEQ ID NO: 883368 - DNA, 25 bp, Mus musculus
tggcaagggctcttcttacagatgc

SEQ ID NO: 883369 - DNA, 25 bp, Mus musculus
tggcaaggtctcaccgctccttgtt

SEQ ID NO: 883370 - DNA, 25 bp, Mus musculus
tggcaaggtctctccgctccttgtt

SEQ ID NO: 883371 - DNA, 25 bp, Mus musculus
tggcaaggtgctatccctgagggaa

SEQ ID NO: 883372 - DNA, 25 bp, Mus musculus
tggcaaggtgctttccctgagggaa

SEQ ID NO: 883373 - DNA, 25 bp, Mus musculus
tggcaagtagtgaatcctagctagt

SEQ ID NO: 883374 - DNA, 25 bp, Mus musculus
tggcaagtagtgtatcctagctagt

SEQ ID NO: 883375 - DNA, 25 bp, Mus musculus
tggcaagtatccatcaatctcctgc

SEQ ID NO: 883376 - DNA, 25 bp, Mus musculus
tggcaagtatccttcaatctcctgc

SEQ ID NO: 883377 - DNA, 25 bp, Mus musculus
tggcaagtccaaactaaacagtgtg

SEQ ID NO: 883378 - DNA, 25 bp, Mus musculus
tggcaagtccaatctaaacagtgtg

SEQ ID NO: 883379 - DNA, 25 bp, Mus musculus
tggcaagtgagtacaggctgcagct

SEQ ID NO: 883380 - DNA, 25 bp, Mus musculus
tggcaagtgagttcaggctgcagct

SEQ ID NO: 883381 - DNA, 25 bp, Mus musculus
tggcaagtgcttagacccattgctc

SEQ ID NO: 883382 - DNA, 25 bp, Mus musculus
tggcaagtgctttgacccattgctc

SEQ ID NO: 883383 - DNA, 25 bp, Mus musculus
tggcaagtggaacgatgtcccctgc

SEQ ID NO: 883384 - DNA, 25 bp, Mus musculus
tggcaagtggaaggatgtcccctgc

SEQ ID NO: 883385 - DNA, 25 bp, Mus musculus
tggcaagttacacggccttgtgtcc

SEQ ID NO: 883386 - DNA, 25 bp, Mus musculus
tggcaagttacagggccttgtgtcc

SEQ ID NO: 883387 - DNA, 25 bp, Mus musculus
tggcaagttcgacctgtaccgcaag

SEQ ID NO: 883388 - DNA, 25 bp, Mus musculus
tggcaagttcgagctgtaccgcaag

SEQ ID NO: 883389 - DNA, 25 bp, Mus musculus
tggcaagttgtgaggctatgagaag

SEQ ID NO: 883390 - DNA, 25 bp, Mus musculus
tggcaagttgtgtggctatgagaag

SEQ ID NO: 883391 - DNA, 25 bp, Mus musculus
tggcaagtttgacgtttacctgggc

SEQ ID NO: 883392 - DNA, 25 bp, Mus musculus
tggcaagtttgaggtttacctgggc

SEQ ID NO: 883393 - DNA, 25 bp, Mus musculus
tggcaataccaaccctttgttccat

SEQ ID NO: 883394 - DNA, 25 bp, Mus musculus
tggcaataccaagcctttgttccat

SEQ ID NO: 883395 - DNA, 25 bp, Mus musculus
tggcaatacttcacccagagcgatc

SEQ ID NO: 883396 - DNA, 25 bp, Mus musculus
tggcaatacttctcccagagcgatc

SEQ ID NO: 883397 - DNA, 25 bp, Mus musculus
tggcaataggataaaacgggttact

SEQ ID NO: 883398 - DNA, 25 bp, Mus musculus
tggcaataggattaaacgggttact

SEQ ID NO: 883399 - DNA, 25 bp, Mus musculus
tggcaatattataccctctttaggt

SEQ ID NO: 883400 - DNA, 25 bp, Mus musculus
tggcaatattattccctctttaggt

SEQ ID NO: 883401 - DNA, 25 bp, Mus musculus
tggcaatcaaggatgctcatgctaa

SEQ ID NO: 883402 - DNA, 25 bp, Mus musculus
tggcaatcaaggttgctcatgctaa

SEQ ID NO: 883403 - DNA, 25 bp, Mus musculus
tggcaatcaccacgaaaagtctttc

SEQ ID NO: 883404 - DNA, 25 bp, Mus musculus
tggcaatcaccaggaaaagtctttc

SEQ ID NO: 883405 - DNA, 25 bp, Mus musculus
tggcaatccctaatcctatgttttg

SEQ ID NO: 883406 - DNA, 25 bp, Mus musculus
tggcaatccctattcctatgttttg

SEQ ID NO: 883407 - DNA, 25 bp, Mus musculus
tggcaatccttaccgttttcattat

SEQ ID NO: 883408 - DNA, 25 bp, Mus musculus
tggcaatccttagcgttttcattat

SEQ ID NO: 883409 - DNA, 25 bp, Mus musculus
tggcaatcggaaattgatccattat

SEQ ID NO: 883410 - DNA, 25 bp, Mus musculus
tggcaatcggaatttgatccattat

SEQ ID NO: 883411 - DNA, 25 bp, Mus musculus
tggcaatcgttgctctattcaaaat

SEQ ID NO: 883412 - DNA, 25 bp, Mus musculus
tggcaatcgttggtctattcaaaat

SEQ ID NO: 883413 - DNA, 25 bp, Mus musculus
tggcaatctcaaatctcaggctcac

SEQ ID NO: 883414 - DNA, 25 bp, Mus musculus
tggcaatctcaattctcaggctcac

SEQ ID NO: 883415 - DNA, 25 bp, Mus musculus
tggcaatctgatcgctctcagcctc

SEQ ID NO: 883416 - DNA, 25 bp, Mus musculus
tggcaatctgatggctctcagcctc

SEQ ID NO: 883417 - DNA, 25 bp, Mus musculus
tggcaatcttgcaagtcctgacttc

SEQ ID NO: 883418 - DNA, 25 bp, Mus musculus
tggcaatcttgctagtcctgacttc

SEQ ID NO: 883419 - DNA, 25 bp, Mus musculus
tggcaatctttgcacacacactgtg

SEQ ID NO: 883420 - DNA, 25 bp, Mus musculus
tggcaatctttggacacacactgtg

SEQ ID NO: 883421 - DNA, 25 bp, Mus musculus
tggcaatgactcagcttacccagga

SEQ ID NO: 883422 - DNA, 25 bp, Mus musculus
tggcaatgactctgcttacccagga

SEQ ID NO: 883423 - DNA, 25 bp, Mus musculus
tggcaatgactgctgtccactccca

SEQ ID NO: 883424 - DNA, 25 bp, Mus musculus
tggcaatgactggtgtccactccca

SEQ ID NO: 883425 - DNA, 25 bp, Mus musculus
tggcaatgcaacaccatgtccagca

SEQ ID NO: 883426 - DNA, 25 bp, Mus musculus
tggcaatgcaactccatgtccagca

SEQ ID NO: 883427 - DNA, 25 bp, Mus musculus
tggcaatgcacacagtgacgctgct

SEQ ID NO: 883428 - DNA, 25 bp, Mus musculus
tggcaatgcacagagtgacgctgct

SEQ ID NO: 883429 - DNA, 25 bp, Mus musculus
tggcaatgccacagtaagcccacac

SEQ ID NO: 883430 - DNA, 25 bp, Mus musculus
tggcaatgccactgtaagcccacac

SEQ ID NO: 883431 - DNA, 25 bp, Mus musculus
tggcaatggcaaacagtagtggact

SEQ ID NO: 883432 - DNA, 25 bp, Mus musculus
tggcaatggcaatcagtagtggact

SEQ ID NO: 883433 - DNA, 25 bp, Mus musculus
tggcaatgttgcaccaagggcagct

SEQ ID NO: 883434 - DNA, 25 bp, Mus musculus
tggcaatgttgctccaagggcagct

SEQ ID NO: 883435 - DNA, 25 bp, Mus musculus
tggcaatgtttaattacccccaatg

SEQ ID NO: 883436 - DNA, 25 bp, Mus musculus
tggcaatgtttatttacccccaatg

SEQ ID NO: 883437 - DNA, 25 bp, Mus musculus
tggcaattacgaaaaggaaaccctt

SEQ ID NO: 883438 - DNA, 25 bp, Mus musculus
tggcaattacgataaggaaaccctt

SEQ ID NO: 883439 - DNA, 25 bp, Mus musculus
tggcaattgtctaatgctccagctg

SEQ ID NO: 883440 - DNA, 25 bp, Mus musculus
tggcaattgtcttatgctccagctg

SEQ ID NO: 883441 - DNA, 25 bp, Mus musculus
tggcaatttaaaagcaaacttcccc

SEQ ID NO: 883442 - DNA, 25 bp, Mus musculus
tggcaatttaaatgcaaacttcccc

SEQ ID NO: 883443 - DNA, 25 bp, Mus musculus
tggcaatttaagacctcctaagtga

SEQ ID NO: 883444 - DNA, 25 bp, Mus musculus
tggcaatttaagtcctcctaagtga

SEQ ID NO: 883445 - DNA, 25 bp, Mus musculus
tggcaatttattaacaccccttgtt

SEQ ID NO: 883446 - DNA, 25 bp, Mus musculus
tggcaatttatttacaccccttgtt

SEQ ID NO: 883447 - DNA, 25 bp, Mus musculus
tggcaatttctcactggtcaggcta

SEQ ID NO: 883448 - DNA, 25 bp, Mus musculus
tggcaatttctctctggtcaggcta

SEQ ID NO: 883449 - DNA, 25 bp, Mus musculus
tggcacaaccgtccatgtgggcatc

SEQ ID NO: 883450 - DNA, 25 bp, Mus musculus
tggcacaaccgtgcatgtgggcatc

SEQ ID NO: 883451 - DNA, 25 bp, Mus musculus
tggcacaactagctatgatgcacaa

SEQ ID NO: 883452 - DNA, 25 bp, Mus musculus
tggcacaactaggtatgatgcacaa

SEQ ID NO: 883453 - DNA, 25 bp, Mus musculus
tggcacaagaaaatttccaactgaa

SEQ ID NO: 883454 - DNA, 25 bp, Mus musculus
tggcacaagaaattttccaactgaa

SEQ ID NO: 883455 - DNA, 25 bp, Mus musculus
tggcacaagaccatctgcgattctt

SEQ ID NO: 883456 - DNA, 25 bp, Mus musculus
tggcacaagaccttctgcgattctt

SEQ ID NO: 883457 - DNA, 25 bp, Mus musculus
tggcacaagtctagaatctcagcac

SEQ ID NO: 883458 - DNA, 25 bp, Mus musculus
tggcacaagtcttgaatctcagcac

SEQ ID NO: 883459 - DNA, 25 bp, Mus musculus
tggcacaatactacagcctcaatgt

SEQ ID NO: 883460 - DNA, 25 bp, Mus musculus
tggcacaatacttcagcctcaatgt

SEQ ID NO: 883461 - DNA, 25 bp, Mus musculus
tggcacaatatcagggctcagctct

SEQ ID NO: 883462 - DNA, 25 bp, Mus musculus
tggcacaatatctgggctcagctct

SEQ ID NO: 883463 - DNA, 25 bp, Mus musculus
tggcacaatgctaagtgttttcaga

SEQ ID NO: 883464 - DNA, 25 bp, Mus musculus
tggcacaatgcttagtgttttcaga

SEQ ID NO: 883465 - DNA, 25 bp, Mus musculus
tggcacaatggacctgctggctttg

SEQ ID NO: 883466 - DNA, 25 bp, Mus musculus
tggcacaatggagctgctggctttg

SEQ ID NO: 883467 - DNA, 25 bp, Mus musculus
tggcacacaaggctaaattcttctg

SEQ ID NO: 883468 - DNA, 25 bp, Mus musculus
tggcacacaagggtaaattcttctg

SEQ ID NO: 883469 - DNA, 25 bp, Mus musculus
tggcacacacatatgacaccatcac

SEQ ID NO: 883470 - DNA, 25 bp, Mus musculus
tggcacacacatttgacaccatcac

SEQ ID NO: 883471 - DNA, 25 bp, Mus musculus
tggcacacactgaagtctcggtttc

SEQ ID NO: 883472 - DNA, 25 bp, Mus musculus
tggcacacactgtagtctcggtttc

SEQ ID NO: 883473 - DNA, 25 bp, Mus musculus
tggcacaccaacctgtaatctcagt

SEQ ID NO: 883474 - DNA, 25 bp, Mus musculus
tggcacaccaacgtgtaatctcagt

SEQ ID NO: 883475 - DNA, 25 bp, Mus musculus
tggcacaccacgcagtagggtcaca

SEQ ID NO: 883476 - DNA, 25 bp, Mus musculus
tggcacaccacggagtagggtcaca

SEQ ID NO: 883477 - DNA, 25 bp, Mus musculus
tggcacaccagtattcatgctcgct

SEQ ID NO: 883478 - DNA, 25 bp, Mus musculus
tggcacaccagttttcatgctcgct

SEQ ID NO: 883479 - DNA, 25 bp, Mus musculus
tggcacacccatccagttctagaat

SEQ ID NO: 883480 - DNA, 25 bp, Mus musculus
tggcacacccatgcagttctagaat

SEQ ID NO: 883481 - DNA, 25 bp, Mus musculus
tggcacacccggacagagaaaccta

SEQ ID NO: 883482 - DNA, 25 bp, Mus musculus
tggcacacccggtcagagaaaccta

SEQ ID NO: 883483 - DNA, 25 bp, Mus musculus
tggcacaccgataaactcccagcaa

SEQ ID NO: 883484 - DNA, 25 bp, Mus musculus
tggcacaccgattaactcccagcaa

SEQ ID NO: 883485 - DNA, 25 bp, Mus musculus
tggcacacctcaagatgtcccttag

SEQ ID NO: 883486 - DNA, 25 bp, Mus musculus
tggcacacctcatgatgtcccttag

SEQ ID NO: 883487 - DNA, 25 bp, Mus musculus
tggcacacctctaactaagggacgt

SEQ ID NO: 883488 - DNA, 25 bp, Mus musculus
tggcacacctcttactaagggacgt

SEQ ID NO: 883489 - DNA, 25 bp, Mus musculus
tggcacacctgtacagctctgagca

SEQ ID NO: 883490 - DNA, 25 bp, Mus musculus
tggcacacctgttcagctctgagca

SEQ ID NO: 883491 - DNA, 25 bp, Mus musculus
tggcacaccttgcacagagcactgg

SEQ ID NO: 883492 - DNA, 25 bp, Mus musculus
tggcacaccttggacagagcactgg

SEQ ID NO: 883493 - DNA, 25 bp, Mus musculus
tggcacacgtgcagtactaccgaag

SEQ ID NO: 883494 - DNA, 25 bp, Mus musculus
tggcacacgtgctgtactaccgaag

SEQ ID NO: 883495 - DNA, 25 bp, Mus musculus
tggcacactccactctcaagaggag

SEQ ID NO: 883496 - DNA, 25 bp, Mus musculus
tggcacactccagtctcaagaggag

SEQ ID NO: 883497 - DNA, 25 bp, Mus musculus
tggcacactctacgcatgagaaagc

SEQ ID NO: 883498 - DNA, 25 bp, Mus musculus
tggcacactctaggcatgagaaagc

SEQ ID NO: 883499 - DNA, 25 bp, Mus musculus
tggcacactgaactccagcaagcat

SEQ ID NO: 883500 - DNA, 25 bp, Mus musculus
tggcacactgaagtccagcaagcat

SEQ ID NO: 883501 - DNA, 25 bp, Mus musculus
tggcacactgcacatgctgatctga

SEQ ID NO: 883502 - DNA, 25 bp, Mus musculus
tggcacactgcagatgctgatctga

SEQ ID NO: 883503 - DNA, 25 bp, Mus musculus
tggcacactggccttggataaactg

SEQ ID NO: 883504 - DNA, 25 bp, Mus musculus
tggcacactggcgttggataaactg

SEQ ID NO: 883505 - DNA, 25 bp, Mus musculus
tggcacactgtgctatcaggttcca

SEQ ID NO: 883506 - DNA, 25 bp, Mus musculus
tggcacactgtggtatcaggttcca

SEQ ID NO: 883507 - DNA, 25 bp, Mus musculus
tggcacacttggaaaaaccctagct

SEQ ID NO: 883508 - DNA, 25 bp, Mus musculus
tggcacacttggtaaaaccctagct

SEQ ID NO: 883509 - DNA, 25 bp, Mus musculus
tggcacagacttctgagccttctgg

SEQ ID NO: 883510 - DNA, 25 bp, Mus musculus
tggcacagacttgtgagccttctgg

SEQ ID NO: 883511 - DNA, 25 bp, Mus musculus
tggcacagatcccagtggtattccg

SEQ ID NO: 883512 - DNA, 25 bp, Mus musculus
tggcacagatccgagtggtattccg

SEQ ID NO: 883513 - DNA, 25 bp, Mus musculus
tggcacagcaggaggcacagcagta

SEQ ID NO: 883514 - DNA, 25 bp, Mus musculus
tggcacagcaggtggcacagcagta

SEQ ID NO: 883515 - DNA, 25 bp, Mus musculus
tggcacagccctaccatgaggagcc

SEQ ID NO: 883516 - DNA, 25 bp, Mus musculus
tggcacagcccttccatgaggagcc

SEQ ID NO: 883517 - DNA, 25 bp, Mus musculus
tggcacagcgtcacaggagggataa

SEQ ID NO: 883518 - DNA, 25 bp, Mus musculus
tggcacagcgtctcaggagggataa

SEQ ID NO: 883519 - DNA, 25 bp, Mus musculus
tggcacagggaaatctacactcctt

SEQ ID NO: 883520 - DNA, 25 bp, Mus musculus
tggcacagggaattctacactcctt

SEQ ID NO: 883521 - DNA, 25 bp, Mus musculus
tggcacaggtacaagctgtccgcct

SEQ ID NO: 883522 - DNA, 25 bp, Mus musculus
tggcacaggtactagctgtccgcct

SEQ ID NO: 883523 - DNA, 25 bp, Mus musculus
tggcacaggttgatcaggcttttcc

SEQ ID NO: 883524 - DNA, 25 bp, Mus musculus
tggcacaggttgttcaggcttttcc

SEQ ID NO: 883525 - DNA, 25 bp, Mus musculus
tggcacagtgcaccggacaagaccg

SEQ ID NO: 883526 - DNA, 25 bp, Mus musculus
tggcacagtgcagcggacaagaccg

SEQ ID NO: 883527 - DNA, 25 bp, Mus musculus
tggcacatatgcatccaaggctatg

SEQ ID NO: 883528 - DNA, 25 bp, Mus musculus
tggcacatatgcttccaaggctatg

SEQ ID NO: 883529 - DNA, 25 bp, Mus musculus
tggcacatcattatgctggaaaatt

SEQ ID NO: 883530 - DNA, 25 bp, Mus musculus
tggcacatcattttgctggaaaatt

SEQ ID NO: 883531 - DNA, 25 bp, Mus musculus
tggcacatccctataggaggcagag

SEQ ID NO: 883532 - DNA, 25 bp, Mus musculus
tggcacatccctttaggaggcagag

SEQ ID NO: 883533 - DNA, 25 bp, Mus musculus
tggcacatcctcactttgaattgtt

SEQ ID NO: 883534 - DNA, 25 bp, Mus musculus
tggcacatcctctctttgaattgtt

SEQ ID NO: 883535 - DNA, 25 bp, Mus musculus
tggcacatcgcaaggcagcccaggc

SEQ ID NO: 883536 - DNA, 25 bp, Mus musculus
tggcacatcgcatggcagcccaggc

SEQ ID NO: 883537 - DNA, 25 bp, Mus musculus
tggcacatgcttacactcacagctg

SEQ ID NO: 883538 - DNA, 25 bp, Mus musculus
tggcacatgctttcactcacagctg

SEQ ID NO: 883539 - DNA, 25 bp, Mus musculus
tggcacatgggaatgcactgctgaa

SEQ ID NO: 883540 - DNA, 25 bp, Mus musculus
tggcacatgggattgcactgctgaa

SEQ ID NO: 883541 - DNA, 25 bp, Mus musculus
tggcacatggtcagctgctgactga

SEQ ID NO: 883542 - DNA, 25 bp, Mus musculus
tggcacatggtctgctgctgactga

SEQ ID NO: 883543 - DNA, 25 bp, Mus musculus
tggcacattgctaatgttctacttt

SEQ ID NO: 883544 - DNA, 25 bp, Mus musculus
tggcacattgcttatgttctacttt

SEQ ID NO: 883545 - DNA, 25 bp, Mus musculus
tggcacatttacacctctttgaagc

SEQ ID NO: 883546 - DNA, 25 bp, Mus musculus
tggcacatttactcctctttgaagc

SEQ ID NO: 883547 - DNA, 25 bp, Mus musculus
tggcacatttttaactgagcagcac

SEQ ID NO: 883548 - DNA, 25 bp, Mus musculus
tggcacattttttactgagcagcac

SEQ ID NO: 883549 - DNA, 25 bp, Mus musculus
tggcaccaaattcccgaaaggacct

SEQ ID NO: 883550 - DNA, 25 bp, Mus musculus
tggcaccaaattgccgaaaggacct

SEQ ID NO: 883551 - DNA, 25 bp, Mus musculus
tggcaccaatatacatctcttcaac

SEQ ID NO: 883552 - DNA, 25 bp, Mus musculus
tggcaccaatattcatctcttcaac

SEQ ID NO: 883553 - DNA, 25 bp, Mus musculus
tggcaccaatgcctgtcagtctgaa

SEQ ID NO: 883554 - DNA, 25 bp, Mus musculus
tggcaccaatgcgtgtcagtctgaa

SEQ ID NO: 883555 - DNA, 25 bp, Mus musculus
tggcaccagaatccttgcttcagcc

SEQ ID NO: 883556 - DNA, 25 bp, Mus musculus
tggcaccagaatgcttgcttcagcc

SEQ ID NO: 883557 - DNA, 25 bp, Mus musculus
tggcaccagagcatactatgaatct

SEQ ID NO: 883558 - DNA, 25 bp, Mus musculus
tggcaccagagcttactatgaatct

SEQ ID NO: 883559 - DNA, 25 bp, Mus musculus
tggcaccagtaccactttctagatg

SEQ ID NO: 883560 - DNA, 25 bp, Mus musculus
tggcaccagtacgactttctagatg

SEQ ID NO: 883561 - DNA, 25 bp, Mus musculus
tggcaccagtgactaaggaaccttg

SEQ ID NO: 883562 - DNA, 25 bp, Mus musculus
tggcaccagtgagtaaggaaccttg

SEQ ID NO: 883563 - DNA, 25 bp, Mus musculus
tggcaccatagacttccgagagtat

SEQ ID NO: 883564 - DNA, 25 bp, Mus musculus
tggcaccatagactttgacgagttt

SEQ ID NO: 883565 - DNA, 25 bp, Mus musculus
tggcaccatagagttccgagagtat

SEQ ID NO: 883566 - DNA, 25 bp, Mus musculus
tggcaccatagagtttgacgagttt

SEQ ID NO: 883567 - DNA, 25 bp, Mus musculus
tggcaccatctaactctcaaggatt

SEQ ID NO: 883568 - DNA, 25 bp, Mus musculus
tggcaccatctatctctcaaggatt

SEQ ID NO: 883569 - DNA, 25 bp, Mus musculus
tggcaccatcttaactgttacctaa

SEQ ID NO: 883570 - DNA, 25 bp, Mus musculus
tggcaccatctttactgttacctaa

SEQ ID NO: 883571 - DNA, 25 bp, Mus musculus
tggcaccatgatagtctgcactgag

SEQ ID NO: 883572 - DNA, 25 bp, Mus musculus
tggcaccatgattgtctgcactgag

SEQ ID NO: 883573 - DNA, 25 bp, Mus musculus
tggcaccattaccaccaaggagctg

SEQ ID NO: 883574 - DNA, 25 bp, Mus musculus
tggcaccattacgaccaaggagctg

SEQ ID NO: 883575 - DNA, 25 bp, Mus musculus
tggcacccaaacacatcactttcaa

SEQ ID NO: 883576 - DNA, 25 bp, Mus musculus
tggcacccaaactcatcactttcaa

SEQ ID NO: 883577 - DNA, 25 bp, Mus musculus
tggcacccaagaatatgaccttatt

SEQ ID NO: 883578 - DNA, 25 bp, Mus musculus
tggcacccaagattatgaccttatt

SEQ ID NO: 883579 - DNA, 25 bp, Mus musculus
tggcacccactgacagtcaggttag

SEQ ID NO: 883580 - DNA, 25 bp, Mus musculus
tggcacccactgtcagtcaggttag

SEQ ID NO: 883581 - DNA, 25 bp, Mus musculus
tggcacccagcactatcttcagcat

SEQ ID NO: 883582 - DNA, 25 bp, Mus musculus
tggcacccagcagtatcttcagcat

SEQ ID NO: 883583 - DNA, 25 bp, Mus musculus
tggcacccattactagtcacagcat

SEQ ID NO: 883584 - DNA, 25 bp, Mus musculus
tggcacccattagtagtcacagcat

SEQ ID NO: 883585 - DNA, 25 bp, Mus musculus
tggcaccccaaaacacaacagtcag

SEQ ID NO: 883586 - DNA, 25 bp, Mus musculus
tggcaccccaaatcacaacagtcag

SEQ ID NO: 883587 - DNA, 25 bp, Mus musculus
tggcaccccagtacacttgcagtga

SEQ ID NO: 883588 - DNA, 25 bp, Mus musculus
tggcaccccagttcacttgcagtga

SEQ ID NO: 883589 - DNA, 25 bp, Mus musculus
tggcaccccgggaacgcaaagctgg

SEQ ID NO: 883590 - DNA, 25 bp, Mus musculus
tggcaccccgggtacgcaaagctgg

SEQ ID NO: 883591 - DNA, 25 bp, Mus musculus
tggcacccctagatattgatcagac

SEQ ID NO: 883592 - DNA, 25 bp, Mus musculus
tggcacccctagttattgatcagac

SEQ ID NO: 883593 - DNA, 25 bp, Mus musculus
tggcacccctgacaaatgagaccct

SEQ ID NO: 883594 - DNA, 25 bp, Mus musculus
tggcacccctgagaaatgagaccct

SEQ ID NO: 883595 - DNA, 25 bp, Mus musculus
tggcacccctgtaacgattgagaat

SEQ ID NO: 883596 - DNA, 25 bp, Mus musculus
tggcacccctgttacgattgagaat

SEQ ID NO: 883597 - DNA, 25 bp, Mus musculus
tggcacccgagtcttcttgggaaaa

SEQ ID NO: 883598 - DNA, 25 bp, Mus musculus
tggcacccgagtgttcttgggaaaa

SEQ ID NO: 883599 - DNA, 25 bp, Mus musculus
tggcaccctgatcaatgtttaaagc

SEQ ID NO: 883600 - DNA, 25 bp, Mus musculus
tggcaccctgatgaatgtttaaagc

SEQ ID NO: 883601 - DNA, 25 bp, Mus musculus
tggcaccctttcatgaggcccatgt

SEQ ID NO: 883602 - DNA, 25 bp, Mus musculus
tggcaccctttcttgaggcccatgt

SEQ ID NO: 883603 - DNA, 25 bp, Mus musculus
tggcaccgacgcaagcatgcagaga

SEQ ID NO: 883604 - DNA, 25 bp, Mus musculus
tggcaccgacgctagcatgcagaga

SEQ ID NO: 883605 - DNA, 25 bp, Mus musculus
tggcaccgggtcaatgggcttcctt

SEQ ID NO: 883606 - DNA, 25 bp, Mus musculus
tggcaccgggtctatgggcttcctt

SEQ ID NO: 883607 - DNA, 25 bp, Mus musculus
tggcaccgtagcacttcctggaagg

SEQ ID NO: 883608 - DNA, 25 bp, Mus musculus
tggcaccgtagctcttcctggaagg

SEQ ID NO: 883609 - DNA, 25 bp, Mus musculus
tggcacctacggagaggttttaact

SEQ ID NO: 883610 - DNA, 25 bp, Mus musculus
tggcacctacggtgaggttttaact

SEQ ID NO: 883611 - DNA, 25 bp, Mus musculus
tggcacctactgatgctattaccac

SEQ ID NO: 883612 - DNA, 25 bp, Mus musculus
tggcacctactgttgctattaccac

SEQ ID NO: 883613 - DNA, 25 bp, Mus musculus
tggcacctagcaagctgaaaccagg

SEQ ID NO: 883614 - DNA, 25 bp, Mus musculus
tggcacctagcatgctgaaaccagg

SEQ ID NO: 883615 - DNA, 25 bp, Mus musculus
tggcacctcacaaggcaggacctaa

SEQ ID NO: 883616 - DNA, 25 bp, Mus musculus
tggcacctcacatggcaggacctaa

SEQ ID NO: 883617 - DNA, 25 bp, Mus musculus
tggcacctcataaaaccagcaaagg

SEQ ID NO: 883618 - DNA, 25 bp, Mus musculus
tggcacctcatataaccagcaaagg

SEQ ID NO: 883619 - DNA, 25 bp, Mus musculus
tggcacctctagaaccacgtgtaga

SEQ ID NO: 883620 - DNA, 25 bp, Mus musculus
tggcacctctagtaccacgtgtaga

SEQ ID NO: 883621 - DNA, 25 bp, Mus musculus
tggcacctgaatagttccttccatc

SEQ ID NO: 883622 - DNA, 25 bp, Mus musculus
tggcacctgaattgttccttccatc

SEQ ID NO: 883623 - DNA, 25 bp, Mus musculus
tggcacctgaggacaaagtctggag

SEQ ID NO: 883624 - DNA, 25 bp, Mus musculus
tggcacctgaggtcaaagtctggag

SEQ ID NO: 883625 - DNA, 25 bp, Mus musculus
tggcacctgcctaaaatagcacgaa

SEQ ID NO: 883626 - DNA, 25 bp, Mus musculus
tggcacctgccttaaatagcacgaa

SEQ ID NO: 883627 - DNA, 25 bp, Mus musculus
tggcacctggccataggtgacttag

SEQ ID NO: 883628 - DNA, 25 bp, Mus musculus
tggcacctggccttaggtgacttag

SEQ ID NO: 883629 - DNA, 25 bp, Mus musculus
tggcacctggtgatcgcagctatgg

SEQ ID NO: 883630 - DNA, 25 bp, Mus musculus
tggcacctggtgcacgacctgtcgc

SEQ ID NO: 883631 - DNA, 25 bp, Mus musculus
tggcacctggtggacgacctgtcgc

SEQ ID NO: 883632 - DNA, 25 bp, Mus musculus
tggcacctggtgttcgcagctatgg

SEQ ID NO: 883633 - DNA, 25 bp, Mus musculus
tggcacctggttagagccctgcgga

SEQ ID NO: 883634 - DNA, 25 bp, Mus musculus
tggcacctggtttgagccctgcgga

SEQ ID NO: 883635 - DNA, 25 bp, Mus musculus
tggcacctgtgcagttgttgtctgg

SEQ ID NO: 883636 - DNA, 25 bp, Mus musculus
tggcacctgtgctgttgttgtctgg

SEQ ID NO: 883637 - DNA, 25 bp, Mus musculus
tggcaccttccaactcagcactggg

SEQ ID NO: 883638 - DNA, 25 bp, Mus musculus
tggcaccttccatctcagcactggg

SEQ ID NO: 883639 - DNA, 25 bp, Mus musculus
tggcaccttctacctagatgttcta

SEQ ID NO: 883640 - DNA, 25 bp, Mus musculus
tggcaccttctagctagatgttcta

SEQ ID NO: 883641 - DNA, 25 bp, Mus musculus
tggcaccttgcgataagactcctgt

SEQ ID NO: 883642 - DNA, 25 bp, Mus musculus
tggcaccttgcgttaagactcctgt

SEQ ID NO: 883643 - DNA, 25 bp, Mus musculus
tggcacctttctcagtagcggcaaa

SEQ ID NO: 883644 - DNA, 25 bp, Mus musculus
tggcacctttctgagtagcggcaaa

SEQ ID NO: 883645 - DNA, 25 bp, Mus musculus
tggcacgaagacaccaagcctggaa

SEQ ID NO: 883646 - DNA, 25 bp, Mus musculus
tggcacgaagactccaagcctggaa

SEQ ID NO: 883647 - DNA, 25 bp, Mus musculus
tggcacgaagtgactcttgggtata

SEQ ID NO: 883648 - DNA, 25 bp, Mus musculus
tggcacgaagtgtctcttgggtata

SEQ ID NO: 883649 - DNA, 25 bp, Mus musculus
tggcacgactacaccggaggccgag

SEQ ID NO: 883650 - DNA, 25 bp, Mus musculus
tggcacgactactccggaggccgag

SEQ ID NO: 883651 - DNA, 25 bp, Mus musculus
tggcacgagcacagtctcgctgtgg

SEQ ID NO: 883652 - DNA, 25 bp, Mus musculus
tggcacgagcactgtctcgctgtgg

SEQ ID NO: 883653 - DNA, 25 bp, Mus musculus
tggcacgcaaacctgacgtgacgtt

SEQ ID NO: 883654 - DNA, 25 bp, Mus musculus
tggcacgcaaacgtgacgtgacgtt

SEQ ID NO: 883655 - DNA, 25 bp, Mus musculus
tggcacgcacatccagctcagaagc

SEQ ID NO: 883656 - DNA, 25 bp, Mus musculus
tggcacgcacatgcagctcagaagc

SEQ ID NO: 883657 - DNA, 25 bp, Mus musculus
tggcacgcacgtcaacagtgaccat

SEQ ID NO: 883658 - DNA, 25 bp, Mus musculus
tggcacgcacgtgaacagtgaccat

SEQ ID NO: 883659 - DNA, 25 bp, Mus musculus
tggcacgcgcagctcagtggaccat

SEQ ID NO: 883660 - DNA, 25 bp, Mus musculus
tggcacgcgcaggtcagtggaccat

SEQ ID NO: 883661 - DNA, 25 bp, Mus musculus
tggcacgcggctacagaagcagctg

SEQ ID NO: 883662 - DNA, 25 bp, Mus musculus
tggcacgcggcttcagaagcagctg

SEQ ID NO: 883663 - DNA, 25 bp, Mus musculus
tggcacgctgcaactgaccagaagg

SEQ ID NO: 883664 - DNA, 25 bp, Mus musculus
tggcacgctgcatctgaccagaagg

SEQ ID NO: 883665 - DNA, 25 bp, Mus musculus
tggcacgctgtaattaaaatccaca

SEQ ID NO: 883666 - DNA, 25 bp, Mus musculus
tggcacgctgtatttaaaatccaca

SEQ ID NO: 883667 - DNA, 25 bp, Mus musculus
tggcacggagcgataaccacacctt

SEQ ID NO: 883668 - DNA, 25 bp, Mus musculus
tggcacggagcgttaaccacacctt

SEQ ID NO: 883669 - DNA, 25 bp, Mus musculus
tggcacggcaccagcagacttacgg

SEQ ID NO: 883670 - DNA, 25 bp, Mus musculus
tggcacggcacctgcagacttacgg

SEQ ID NO: 883671 - DNA, 25 bp, Mus musculus
tggcacggccatcgtcctgtgattc

SEQ ID NO: 883672 - DNA, 25 bp, Mus musculus
tggcacggccatggtcctgtgattc

SEQ ID NO: 883673 - DNA, 25 bp, Mus musculus
tggcacggccccaggaaatgcattc

SEQ ID NO: 883674 - DNA, 25 bp, Mus musculus
tggcacggcccctggaaatgcattc

SEQ ID NO: 883675 - DNA, 25 bp, Mus musculus
tggcacgggcctccttcagactgtc

SEQ ID NO: 883676 - DNA, 25 bp, Mus musculus
tggcacgggcctgcttcagactgtc

SEQ ID NO: 883677 - DNA, 25 bp, Mus musculus
tggcacgtaataaacactcagtccc

SEQ ID NO: 883678 - DNA, 25 bp, Mus musculus
tggcacgtaatatacactcagtccc

SEQ ID NO: 883679 - DNA, 25 bp, Mus musculus
tggcacgtcatcattcttagcacta

SEQ ID NO: 883680 - DNA, 25 bp, Mus musculus
tggcacgtcatctttcttagcacta

SEQ ID NO: 883681 - DNA, 25 bp, Mus musculus
tggcacgtccagagaactcccttcg

SEQ ID NO: 883682 - DNA, 25 bp, Mus musculus
tggcacgtccagtgaactcccttcg

SEQ ID NO: 883683 - DNA, 25 bp, Mus musculus
tggcacgtggctacccaaaggtggt

SEQ ID NO: 883684 - DNA, 25 bp, Mus musculus
tggcacgtggcttcccaaaggtggt

SEQ ID NO: 883685 - DNA, 25 bp, Mus musculus
tggcacgtgtttctttacctacgac

SEQ ID NO: 883686 - DNA, 25 bp, Mus musculus
tggcacgtgtttgtttacctacgac

SEQ ID NO: 883687 - DNA, 25 bp, Mus musculus
tggcactaagtgcagctaagtagct

SEQ ID NO: 883688 - DNA, 25 bp, Mus musculus
tggcactaagtggagctaagtagct

SEQ ID NO: 883689 - DNA, 25 bp, Mus musculus
tggcactaatctcaactccatagac

SEQ ID NO: 883690 - DNA, 25 bp, Mus musculus
tggcactaatctgaactccatagac

SEQ ID NO: 883691 - DNA, 25 bp, Mus musculus
tggcactagcctacgggaccctaga

SEQ ID NO: 883692 - DNA, 25 bp, Mus musculus
tggcactagccttcgggaccctaga

SEQ ID NO: 883693 - DNA, 25 bp, Mus musculus
tggcactagctgaaaaacatggccg

SEQ ID NO: 883694 - DNA, 25 bp, Mus musculus
tggcactagctgtaaaacatggccg

SEQ ID NO: 883695 - DNA, 25 bp, Mus musculus
tggcactcacatcctgtgcattaag

SEQ ID NO: 883696 - DNA, 25 bp, Mus musculus
tggcactcacatgctgtgcattaag

SEQ ID NO: 883697 - DNA, 25 bp, Mus musculus
tggcactcacttaccgtgcagattt

SEQ ID NO: 883698 - DNA, 25 bp, Mus musculus
tggcactcactttccgtgcagattt

SEQ ID NO: 883699 - DNA, 25 bp, Mus musculus
tggcactcagttcactcctttcttg

SEQ ID NO: 883700 - DNA, 25 bp, Mus musculus
tggcactcagttgactcctttcttg

SEQ ID NO: 883701 - DNA, 25 bp, Mus musculus
tggcactccatcacttagaacatat

SEQ ID NO: 883702 - DNA, 25 bp, Mus musculus
tggcactccatctcttagaacatat

SEQ ID NO: 883703 - DNA, 25 bp, Mus musculus
tggcactcccctcagctgtcttttg

SEQ ID NO: 883704 - DNA, 25 bp, Mus musculus
tggcactcccctgagctgtcttttg

SEQ ID NO: 883705 - DNA, 25 bp, Mus musculus
tggcactcctgacgatgacactggt

SEQ ID NO: 883706 - DNA, 25 bp, Mus musculus
tggcactcctgaggatgacactggt

SEQ ID NO: 883707 - DNA, 25 bp, Mus musculus
tggcactctatgagttctccaacaa

SEQ ID NO: 883708 - DNA, 25 bp, Mus musculus
tggcactctatgtgttctccaacaa

SEQ ID NO: 883709 - DNA, 25 bp, Mus musculus
tggcactctccaccacaggttggag

SEQ ID NO: 883710 - DNA, 25 bp, Mus musculus
tggcactctccagcacaggttggag

SEQ ID NO: 883711 - DNA, 25 bp, Mus musculus
tggcactctgccaggacacacaaag

SEQ ID NO: 883712 - DNA, 25 bp, Mus musculus
tggcactctgccatagtaggaacat

SEQ ID NO: 883713 - DNA, 25 bp, Mus musculus
tggcactctgcctggacacacaaag

SEQ ID NO: 883714 - DNA, 25 bp, Mus musculus
tggcactctgccttagtaggaacat

SEQ ID NO: 883715 - DNA, 25 bp, Mus musculus
tggcactcttgacttataattttat

SEQ ID NO: 883716 - DNA, 25 bp, Mus musculus
tggcactcttgagttataattttat

SEQ ID NO: 883717 - DNA, 25 bp, Mus musculus
tggcactctttgctaacttactaga

SEQ ID NO: 883718 - DNA, 25 bp, Mus musculus
tggcactctttggtaacttactaga

SEQ ID NO: 883719 - DNA, 25 bp, Mus musculus
tggcactgaaacaagtggccctcat

SEQ ID NO: 883720 - DNA, 25 bp, Mus musculus
tggcactgaaactagtggccctcat

SEQ ID NO: 883721 - DNA, 25 bp, Mus musculus
tggcactgacaactacttatgactt

SEQ ID NO: 883722 - DNA, 25 bp, Mus musculus
tggcactgacaagtacttatgactt

SEQ ID NO: 883723 - DNA, 25 bp, Mus musculus
tggcactgagccagtgaaacgctgt

SEQ ID NO: 883724 - DNA, 25 bp, Mus musculus
tggcactgagcctgtgaaacgctgt

SEQ ID NO: 883725 - DNA, 25 bp, Mus musculus
tggcactgagtgaacagtctttccc

SEQ ID NO: 883726 - DNA, 25 bp, Mus musculus
tggcactgagtgctacctccgagat

SEQ ID NO: 883727 - DNA, 25 bp, Mus musculus
tggcactgagtggtacctccgagat

SEQ ID NO: 883728 - DNA, 25 bp, Mus musculus
tggcactgagtgtacagtctttccc

SEQ ID NO: 883729 - DNA, 25 bp, Mus musculus
tggcactgataaaccagaacaattt

SEQ ID NO: 883730 - DNA, 25 bp, Mus musculus
tggcactgataatccagaacaattt

SEQ ID NO: 883731 - DNA, 25 bp, Mus musculus
tggcactgcaggacatggtgacctt
